United States Patent 7,250,496 (BIOINFORMATICALLY DETECTABLE GROUP OF NOVEL REGULATORY GENES AND USES THEREOF) - sequence listing, part 16

SEQ ID NO: 651348 - RNA, 19 nt, Human
aacccagacuuucuuuuuu

SEQ ID NO: 651349 - RNA, 18 nt, Human
accugccgcugcggaaca

SEQ ID NO: 651350 - RNA, 18 nt, Human
aggcacaguagcacugua

SEQ ID NO: 651351 - RNA, 18 nt, Human
cgcugcggaacagcccaa

SEQ ID NO: 651352 - RNA, 22 nt, Human
cggaacagcccaaaucugagga

SEQ ID NO: 651353 - RNA, 23 nt, Human
cugcaaaacccuuccccggaucu

SEQ ID NO: 651354 - RNA, 18 nt, Human
gccuaggaagaugucugu

SEQ ID NO: 651355 - RNA, 22 nt, Human
guaaagcuuucucagaacauaa

SEQ ID NO: 651356 - RNA, 19 nt, Human
uacuggggggccccagcag

SEQ ID NO: 651357 - RNA, 18 nt, Human
ucugaggaaaccuuggac

SEQ ID NO: 651358 - RNA, 18 nt, Human
ucugcaaaacccuucccc

SEQ ID NO: 651359 - RNA, 21 nt, Human
ucugcaaaacccuuccccgga

SEQ ID NO: 651360 - RNA, 21 nt, Human
uggggggccccagcagccgug

SEQ ID NO: 651361 - RNA, 18 nt, Human
uucccgggaccugccgcu

SEQ ID NO: 651362 - RNA, 20 nt, Human
uugaaggacugaaagaauua

SEQ ID NO: 651363 - RNA, 20 nt, Human
aacugcaugacaugaaaagu

SEQ ID NO: 651364 - RNA, 27 nt, Human
aagcagcauggaccuucccugagagcc

SEQ ID NO: 651365 - RNA, 24 nt, Human
acgcuguagcagaggcugcccaac

SEQ ID NO: 651366 - RNA, 25 nt, Human
acucaggccaagcagcauggaccuu

SEQ ID NO: 651367 - RNA, 24 nt, Human
acugcucucaggagagugggggau

SEQ ID NO: 651368 - RNA, 23 nt, Human
agaaagccuugaacucaggccaa

SEQ ID NO: 651369 - RNA, 18 nt, Human
agccuggcuggaggaacc

SEQ ID NO: 651370 - RNA, 18 nt, Human
agcggugcagggggccug

SEQ ID NO: 651371 - RNA, 22 nt, Human
aggaauucugaaggggccgagu

SEQ ID NO: 651372 - RNA, 18 nt, Human
aggcugggcagggccagg

SEQ ID NO: 651373 - RNA, 21 nt, Human
auggaccuucccugagagccu

SEQ ID NO: 651374 - RNA, 22 nt, Human
cagaccccggcuucaggagcuc

SEQ ID NO: 651375 - RNA, 20 nt, Human
ccaaagcuuuaauuccucag

SEQ ID NO: 651376 - RNA, 27 nt, Human
ccaaagcuuuaauuccucaggcugacc

SEQ ID NO: 651377 - RNA, 24 nt, Human
ccaagacagaggcugggcagggcu

SEQ ID NO: 651378 - RNA, 22 nt, Human
cccaaccugauuaaagcugccc

SEQ ID NO: 651379 - RNA, 18 nt, Human
cccacuucccacuccccc

SEQ ID NO: 651380 - RNA, 21 nt, Human
cccagagggggcucuggagcg

SEQ ID NO: 651381 - RNA, 26 nt, Human
cccccgggcugcucaggggugagggu

SEQ ID NO: 651382 - RNA, 21 nt, Human
ccccuuaucccugcuguccac

SEQ ID NO: 651383 - RNA, 23 nt, Human
cccggcuucaggagcucggggug

SEQ ID NO: 651384 - RNA, 19 nt, Human
cccuggggcugagcuccca

SEQ ID NO: 651385 - RNA, 19 nt, Human
ccgcugugaccacugcucu

SEQ ID NO: 651386 - RNA, 18 nt, Human
ccugagaguccugaggaa

SEQ ID NO: 651387 - RNA, 25 nt, Human
ccugcccacggggguccacgggagu

SEQ ID NO: 651388 - RNA, 22 nt, Human
ccuggggcugagcucccaagac

SEQ ID NO: 651389 - RNA, 24 nt, Human
cgaacccuggggcugagcucccaa

SEQ ID NO: 651390 - RNA, 24 nt, Human
cgcugaggccugagccugccucuc

SEQ ID NO: 651391 - RNA, 18 nt, Human
cgggguggggucguggga

SEQ ID NO: 651392 - RNA, 18 nt, Human
cguggagagcgcuggggu

SEQ ID NO: 651393 - RNA, 19 nt, Human
cuacaggcagaaagccuug

SEQ ID NO: 651394 - RNA, 26 nt, Human
cucaaaucccucuccuguucucuggu

SEQ ID NO: 651395 - RNA, 27 nt, Human
cucaaaucccucuccuguucucuggug

SEQ ID NO: 651396 - RNA, 19 nt, Human
cucagaccccggcuucagg

SEQ ID NO: 651397 - RNA, 20 nt, Human
cuucccacuucccacucccc

SEQ ID NO: 651398 - RNA, 18 nt, Human
cuucccugagagccuggc

SEQ ID NO: 651399 - RNA, 22 nt, Human
cuugaacucaggccaagcagca

SEQ ID NO: 651400 - RNA, 23 nt, Human
cuuuuuggcaaagcugcaccuga

SEQ ID NO: 651401 - RNA, 23 nt, Human
gaccgaacccuggggcugagcuc

SEQ ID NO: 651402 - RNA, 19 nt, Human
gccugccucucugccuucu

SEQ ID NO: 651403 - RNA, 19 nt, Human
gcugggcagggccagggcc

SEQ ID NO: 651404 - RNA, 18 nt, Human
ggcugggcagggccaggg

SEQ ID NO: 651405 - RNA, 20 nt, Human
ggggcaggcagaggcggugu

SEQ ID NO: 651406 - RNA, 21 nt, Human
ggggcaggcagaggcggugug

SEQ ID NO: 651407 - RNA, 22 nt, Human
ggggguccacgggaguccaggc

SEQ ID NO: 651408 - RNA, 19 nt, Human
ucaaaucccucuccuguuc

SEQ ID NO: 651409 - RNA, 25 nt, Human
ucaagaggagccugggauugagacu

SEQ ID NO: 651410 - RNA, 18 nt, Human
ucaggccaagcagcaugg

SEQ ID NO: 651411 - RNA, 18 nt, Human
uccacgcugaggccugag

SEQ ID NO: 651412 - RNA, 19 nt, Human
uccaggcuacaggcagaaa

SEQ ID NO: 651413 - RNA, 24 nt, Human
ucccacuucccacucccccaccuc

SEQ ID NO: 651414 - RNA, 18 nt, Human
uccccguccuucgugccc

SEQ ID NO: 651415 - RNA, 19 nt, Human
ucccugagagccuggcugg

SEQ ID NO: 651416 - RNA, 22 nt, Human
ucuccuguucucuggugacuuc

SEQ ID NO: 651417 - RNA, 18 nt, Human
ugaaggggccgagucccc

SEQ ID NO: 651418 - RNA, 18 nt, Human
ugacuucccacuucccac

SEQ ID NO: 651419 - RNA, 22 nt, Human
ugacuucccacuucccacuccc

SEQ ID NO: 651420 - RNA, 24 nt, Human
ugagaguccugaggaauucugaag

SEQ ID NO: 651421 - RNA, 23 nt, Human
ugagcucccaagacagaggcugg

SEQ ID NO: 651422 - RNA, 21 nt, Human
ugccaucacaucuuguucuug

SEQ ID NO: 651423 - RNA, 22 nt, Human
uggaggaacccagggugaccca

SEQ ID NO: 651424 - RNA, 23 nt, Human
uggcaaagcugcaccugagaguc

SEQ ID NO: 651425 - RNA, 26 nt, Human
ugggaccgugcgcgauagcaucaguc

SEQ ID NO: 651426 - RNA, 18 nt, Human
uggugacuucccacuucc

SEQ ID NO: 651427 - RNA, 21 nt, Human
uguaccucuugcuguggcccc

SEQ ID NO: 651428 - RNA, 18 nt, Human
ugugaccacugcucucag

SEQ ID NO: 651429 - RNA, 18 nt, Human
uucaggagcucggggugg

SEQ ID NO: 651430 - RNA, 27 nt, Human
uuccucaggcugacagcggugcagggg

SEQ ID NO: 651431 - RNA, 22 nt, Human
uuuuuuuuuuuuuuuugcucuu

SEQ ID NO: 651432 - RNA, 18 nt, Human
uuuuuuuuuuuuuuuuug

SEQ ID NO: 651433 - RNA, 20 nt, Human
uuuuuuuuuuuuuuuuugcu

SEQ ID NO: 651434 - RNA, 25 nt, Human
aauaaugaaaaccaaaccucaagaa

SEQ ID NO: 651435 - RNA, 22 nt, Human
accaccgccaccuccucuguuc

SEQ ID NO: 651436 - RNA, 24 nt, Human
acccuaaaaauuaauaaugaaaac

SEQ ID NO: 651437 - RNA, 19 nt, Human
acuaaagguaaaaaagcca

SEQ ID NO: 651438 - RNA, 18 nt, Human
cacagugcccauacccua

SEQ ID NO: 651439 - RNA, 19 nt, Human
cacagugcccauacccuaa

SEQ ID NO: 651440 - RNA, 18 nt, Human
cacccaggcccuuuccca

SEQ ID NO: 651441 - RNA, 21 nt, Human
caccgccaccuccucuguuca

SEQ ID NO: 651442 - RNA, 24 nt, Human
cagcauaagaaaagcagauaguug

SEQ ID NO: 651443 - RNA, 21 nt, Human
cauggguaacacccaggcccu

SEQ ID NO: 651444 - RNA, 18 nt, Human
ccaccaccgccaccuccu

SEQ ID NO: 651445 - RNA, 22 nt, Human
cccuaaaaauuaauaaugaaaa

SEQ ID NO: 651446 - RNA, 21 nt, Human
ccucugucacuuuuccuagac

SEQ ID NO: 651447 - RNA, 18 nt, Human
gaacuaaagguaaaaaag

SEQ ID NO: 651448 - RNA, 19 nt, Human
gagggccaccaccgccacc

SEQ ID NO: 651449 - RNA, 20 nt, Human
uaacacccaggcccuuuccc

SEQ ID NO: 651450 - RNA, 21 nt, Human
uagcugcuuuguuccuuugug

SEQ ID NO: 651451 - RNA, 21 nt, Human
uaggcacagcuauggagucuu

SEQ ID NO: 651452 - RNA, 19 nt, Human
ucacuaagcagaggcucaa

SEQ ID NO: 651453 - RNA, 21 nt, Human
ucaggacuugaaaaugacuug

SEQ ID NO: 651454 - RNA, 23 nt, Human
uccucuguucaggguuugguugg

SEQ ID NO: 651455 - RNA, 22 nt, Human
ucugucacuuuuccuagacucc

SEQ ID NO: 651456 - RNA, 22 nt, Human
ugcuuuguuccuuuguguuuca

SEQ ID NO: 651457 - RNA, 24 nt, Human
uggcugaacuaaagguaaaaaagc

SEQ ID NO: 651458 - RNA, 21 nt, Human
uucauuuucaguacaugggua

SEQ ID NO: 651459 - RNA, 19 nt, Human
uuggcugaacuaaagguaa

SEQ ID NO: 651460 - RNA, 24 nt, Human
uuggcugaacuaaagguaaaaaag

SEQ ID NO: 651461 - RNA, 21 nt, Human
uuguguuucacuaagcagagg

SEQ ID NO: 651462 - RNA, 19 nt, Human
uuuagccauguugguaaaa

SEQ ID NO: 651463 - RNA, 19 nt, Human
uuuccuagacuccuaggca

SEQ ID NO: 651464 - RNA, 25 nt, Human
uuuuuuuuuuuuuuuuuuaauuuuu

SEQ ID NO: 651465 - RNA, 18 nt, Human
aacuagggaggaagggcc

SEQ ID NO: 651466 - RNA, 19 nt, Human
aagcuguugaauacuaaac

SEQ ID NO: 651467 - RNA, 22 nt, Human
aaguauugaggccucauaagcu

SEQ ID NO: 651468 - RNA, 18 nt, Human
acccgagcggaccuuggc

SEQ ID NO: 651469 - RNA, 19 nt, Human
agaaaacaucacaaagaaa

SEQ ID NO: 651470 - RNA, 21 nt, Human
agaaaacaucacaaagaaaac

SEQ ID NO: 651471 - RNA, 19 nt, Human
agcagaccccgggugugga

SEQ ID NO: 651472 - RNA, 20 nt, Human
aggaagcuguugaauacuaa

SEQ ID NO: 651473 - RNA, 21 nt, Human
aggccucauaagcugaaccug

SEQ ID NO: 651474 - RNA, 22 nt, Human
aggcuucugcugcccucucugc

SEQ ID NO: 651475 - RNA, 22 nt, Human
agggaggggacugcguggcugg

SEQ ID NO: 651476 - RNA, 21 nt, Human
cacagcuauuaaauacagaga

SEQ ID NO: 651477 - RNA, 18 nt, Human
cagaccccggguguggag

SEQ ID NO: 651478 - RNA, 19 nt, Human
cagacgcagaucuggcagc

SEQ ID NO: 651479 - RNA, 19 nt, Human
ccacaaaaagcggagggca

SEQ ID NO: 651480 - RNA, 19 nt, Human
cccauuuugucuauuucca

SEQ ID NO: 651481 - RNA, 21 nt, Human
cccucucugcuacugacgguc

SEQ ID NO: 651482 - RNA, 21 nt, Human
ccgcggagaccagcagacccc

SEQ ID NO: 651483 - RNA, 27 nt, Human
cgagccugugacauccgcggagaccag

SEQ ID NO: 651484 - RNA, 21 nt, Human
cucagugacggaaccggacac

SEQ ID NO: 651485 - RNA, 19 nt, Human
gaagugcacacugaauuaa

SEQ ID NO: 651486 - RNA, 19 nt, Human
gcagaaaacaucacaaaga

SEQ ID NO: 651487 - RNA, 22 nt, Human
ggugaagagaacuagggaggaa

SEQ ID NO: 651488 - RNA, 27 nt, Human
uaagcugaaccugacacaauaaauuua

SEQ ID NO: 651489 - RNA, 21 nt, Human
uacuaaacuaacucaaaucau

SEQ ID NO: 651490 - RNA, 23 nt, Human
ucaaggccuccucauuguauucu

SEQ ID NO: 651491 - RNA, 22 nt, Human
ucacccgagcggaccuuggcuc

SEQ ID NO: 651492 - RNA, 20 nt, Human
ucucugcuacugacggucaa

SEQ ID NO: 651493 - RNA, 18 nt, Human
ugccacagcuauuaaaua

SEQ ID NO: 651494 - RNA, 19 nt, Human
ugccgagccugugacaucc

SEQ ID NO: 651495 - RNA, 22 nt, Human
uggaaacuuuaugccacagcua

SEQ ID NO: 651496 - RNA, 19 nt, Human
uuggaaacuuuaugccaca

SEQ ID NO: 651497 - RNA, 23 nt, Human
uuuuuuuuuuuuuuuuuaucuuu

SEQ ID NO: 651498 - RNA, 19 nt, Human
augcauucaauaagaccag

SEQ ID NO: 651499 - RNA, 25 nt, Human
cauggaacauaauaaaccacuuuaa

SEQ ID NO: 651500 - RNA, 18 nt, Human
cuuuauggccaccucccc

SEQ ID NO: 651501 - RNA, 19 nt, Human
gaaagaagacucugccccu

SEQ ID NO: 651502 - RNA, 21 nt, Human
gugauguggagccuggugaug

SEQ ID NO: 651503 - RNA, 24 nt, Human
uaaaccacuuuaaaacagcaguuu

SEQ ID NO: 651504 - RNA, 22 nt, Human
uaagaccaguuucuuccaugga

SEQ ID NO: 651505 - RNA, 19 nt, Human
uggagccuggugaugugcc

SEQ ID NO: 651506 - RNA, 22 nt, Human
ugucaagaaauuuauuaaccuu

SEQ ID NO: 651507 - RNA, 25 nt, Human
ugucaagaaauuuauuaaccuuuau

SEQ ID NO: 651508 - RNA, 21 nt, Human
uuuuuuuuuuuuuuugucaag

SEQ ID NO: 651509 - RNA, 18 nt, Human
uuuuuuuuuuuuuuuuug

SEQ ID NO: 651510 - RNA, 19 nt, Human
uuuuuuuuuuuuuuuuugu

SEQ ID NO: 651511 - RNA, 21 nt, Human
aaaauaucucccaccucagcu

SEQ ID NO: 651512 - RNA, 22 nt, Human
aaaccaaagcuguacuggaaga

SEQ ID NO: 651513 - RNA, 18 nt, Human
aagacaccacggccauga

SEQ ID NO: 651514 - RNA, 20 nt, Human
aagacaccacggccaugaaa

SEQ ID NO: 651515 - RNA, 19 nt, Human
aaggagaagauuggcacca

SEQ ID NO: 651516 - RNA, 19 nt, Human
aaucuggucaaauagguca

SEQ ID NO: 651517 - RNA, 23 nt, Human
acagaucucagaucaaaugccag

SEQ ID NO: 651518 - RNA, 18 nt, Human
acugcacuccaggcugag

SEQ ID NO: 651519 - RNA, 27 nt, Human
acugcacuccaggcugagcgacaagag

SEQ ID NO: 651520 - RNA, 21 nt, Human
agaaugcuucagagaguccuc

SEQ ID NO: 651521 - RNA, 26 nt, Human
agaggaaagagggcaugugggaggcc

SEQ ID NO: 651522 - RNA, 21 nt, Human
agcaaaacucuuaaaaaaaaa

SEQ ID NO: 651523 - RNA, 24 nt, Human
agcccaggcuggagugcaguggcg

SEQ ID NO: 651524 - RNA, 22 nt, Human
aggaaagagggcaugugggagg

SEQ ID NO: 651525 - RNA, 19 nt, Human
aggagccagaagaguuggg

SEQ ID NO: 651526 - RNA, 21 nt, Human
aggagccagaagaguugggaa

SEQ ID NO: 651527 - RNA, 25 nt, Human
aggcuggagugcaguggcgcaaucu

SEQ ID NO: 651528 - RNA, 24 nt, Human
aggucccuugcagggccacaacuu

SEQ ID NO: 651529 - RNA, 21 nt, Human
agugcaguggcgcaaucucag

SEQ ID NO: 651530 - RNA, 24 nt, Human
agugcaguggcgcaaucucagcuc

SEQ ID NO: 651531 - RNA, 18 nt, Human
caacuucccaguugcacc

SEQ ID NO: 651532 - RNA, 21 nt, Human
caccaggggugcccuggagac

SEQ ID NO: 651533 - RNA, 22 nt, Human
caccugggcuggagguggaggc

SEQ ID NO: 651534 - RNA, 19 nt, Human
cacugcacuccaggcugag

SEQ ID NO: 651535 - RNA, 19 nt, Human
cacugcacuccaggcugag

SEQ ID NO: 651536 - RNA, 20 nt, Human
cacugcacuccaggcugagc

SEQ ID NO: 651537 - RNA, 23 nt, Human
cacugcacuccaggcugagcgac

SEQ ID NO: 651538 - RNA, 24 nt, Human
cacugcacuccaggcugagcgaca

SEQ ID NO: 651539 - RNA, 25 nt, Human
cagcacacaaccugcccugucccuu

SEQ ID NO: 651540 - RNA, 24 nt, Human
cauguccccuugcagcacacaacc

SEQ ID NO: 651541 - RNA, 24 nt, Human
ccaaagcuguacuggaagacacca

SEQ ID NO: 651542 - RNA, 19 nt, Human
ccacagaucucagaucaaa

SEQ ID NO: 651543 - RNA, 20 nt, Human
ccaccugggcuggaggugga

SEQ ID NO: 651544 - RNA, 20 nt, Human
ccagaccuucacagccccau

SEQ ID NO: 651545 - RNA, 21 nt, Human
ccaggagccagaagaguuggg

SEQ ID NO: 651546 - RNA, 19 nt, Human
cccagauauaaaaaucugc

SEQ ID NO: 651547 - RNA, 20 nt, Human
cccaugaucuucugcaaccg

SEQ ID NO: 651548 - RNA, 20 nt, Human
ccccagagaaggcacgagcu

SEQ ID NO: 651549 - RNA, 19 nt, Human
ccccgaaggagaagauugg

SEQ ID NO: 651550 - RNA, 25 nt, Human
ccgaaggagaagauugggggggcuc

SEQ ID NO: 651551 - RNA, 19 nt, Human
ccuagaaaaauaucuccca

SEQ ID NO: 651552 - RNA, 25 nt, Human
ccucccucccagccugguccuggac

SEQ ID NO: 651553 - RNA, 18 nt, Human
ccuccucccucccagccu

SEQ ID NO: 651554 - RNA, 22 nt, Human
ccuggcucccgcagguucugug

SEQ ID NO: 651555 - RNA, 19 nt, Human
ccugggcuggagguggagg

SEQ ID NO: 651556 - RNA, 24 nt, Human
cgcucuguagcccaggcuggagug

SEQ ID NO: 651557 - RNA, 21 nt, Human
cguaaccaggagccagaagag

SEQ ID NO: 651558 - RNA, 18 nt, Human
cucagaucaaaugccagc

SEQ ID NO: 651559 - RNA, 21 nt, Human
cucccagccugguccuggacu

SEQ ID NO: 651560 - RNA, 22 nt, Human
gaacagcucugaaauguacccc

SEQ ID NO: 651561 - RNA, 22 nt, Human
gagaguccucccagauauaaaa

SEQ ID NO: 651562 - RNA, 19 nt, Human
gaucuucugcaaccgauuc

SEQ ID NO: 651563 - RNA, 19 nt, Human
gcccaggcuggagugcagu

SEQ ID NO: 651564 - RNA, 20 nt, Human
gcccaggcuggagugcagug

SEQ ID NO: 651565 - RNA, 22 nt, Human
gcucuguagcccaggcuggagu

SEQ ID NO: 651566 - RNA, 19 nt, Human
gcuggagugcaguggcgca

SEQ ID NO: 651567 - RNA, 22 nt, Human
ggccaugaaagagugggaggga

SEQ ID NO: 651568 - RNA, 21 nt, Human
ggcuggagguggaggccuggg

SEQ ID NO: 651569 - RNA, 23 nt, Human
gggcuggagguggaggccugggu

SEQ ID NO: 651570 - RNA, 18 nt, Human
gguauuaaaccaaagcug

SEQ ID NO: 651571 - RNA, 20 nt, Human
gucccuuuggccuccucccu

SEQ ID NO: 651572 - RNA, 18 nt, Human
guccucccagauauaaaa

SEQ ID NO: 651573 - RNA, 18 nt, Human
uauagcguaaccaggagc

SEQ ID NO: 651574 - RNA, 21 nt, Human
ucaaggaugccucaccccaag

SEQ ID NO: 651575 - RNA, 21 nt, Human
ucacugcacuccaggcugagc

SEQ ID NO: 651576 - RNA, 21 nt, Human
ucagugaccaagaaauggagc

SEQ ID NO: 651577 - RNA, 22 nt, Human
ucccuuuggccuccucccuccc

SEQ ID NO: 651578 - RNA, 22 nt, Human
uccuagaaaaauaucucccacc

SEQ ID NO: 651579 - RNA, 23 nt, Human
ucucgcucuguagcccaggcugg

SEQ ID NO: 651580 - RNA, 24 nt, Human
ucucgcucuguagcccaggcugga

SEQ ID NO: 651581 - RNA, 24 nt, Human
ucuguagcccaggcuggagugcag

SEQ ID NO: 651582 - RNA, 18 nt, Human
ugcagggccacaacuucc

SEQ ID NO: 651583 - RNA, 23 nt, Human
ugcaguggcgcaaucucagcuca

SEQ ID NO: 651584 - RNA, 19 nt, Human
ugcccugucccuuuggccu

SEQ ID NO: 651585 - RNA, 20 nt, Human
ugcccugucccuuuggccuc

SEQ ID NO: 651586 - RNA, 22 nt, Human
ugcuucagagaguccucccaga

SEQ ID NO: 651587 - RNA, 24 nt, Human
uggaagacaccacggccaugaaag

SEQ ID NO: 651588 - RNA, 19 nt, Human
uggagguggaggccugggu

SEQ ID NO: 651589 - RNA, 18 nt, Human
uggagugcaguggcgcaa

SEQ ID NO: 651590 - RNA, 23 nt, Human
uggagugcaguggcgcaaucuca

SEQ ID NO: 651591 - RNA, 24 nt, Human
uggagugcaguggcgcaaucucag

SEQ ID NO: 651592 - RNA, 18 nt, Human
uggcaccaggggugcccu

SEQ ID NO: 651593 - RNA, 21 nt, Human
uggcaccaggggugcccugga

SEQ ID NO: 651594 - RNA, 20 nt, Human
uggccuccucccucccagcc

SEQ ID NO: 651595 - RNA, 23 nt, Human
uggcgcaaucucagcucacugca

SEQ ID NO: 651596 - RNA, 21 nt, Human
ugggaggccccagagaaggca

SEQ ID NO: 651597 - RNA, 23 nt, Human
ugggagggagaugcccaugaucu

SEQ ID NO: 651598 - RNA, 20 nt, Human
ugggcuggagguggaggccu

SEQ ID NO: 651599 - RNA, 23 nt, Human
uguauguguauguuucccagucu

SEQ ID NO: 651600 - RNA, 25 nt, Human
uguauguuucccagucuagaaugug

SEQ ID NO: 651601 - RNA, 23 nt, Human
ugucccuuuggccuccucccucc

SEQ ID NO: 651602 - RNA, 20 nt, Human
uguggucugaggcacccaca

SEQ ID NO: 651603 - RNA, 20 nt, Human
uuguauguguauguuucccu

SEQ ID NO: 651604 - RNA, 22 nt, Human
uuucucaaggaugccucacccc

SEQ ID NO: 651605 - RNA, 26 nt, Human
uuuuuuuuuuuuugagguagagucuc

SEQ ID NO: 651606 - RNA, 25 nt, Human
aaaaaaaaaaaaaaacccaaaacca

SEQ ID NO: 651607 - RNA, 26 nt, Human
aaaaaaaaguacaaagcuauaaagga

SEQ ID NO: 651608 - RNA, 26 nt, Human
aaaaaaaaguacaaagcuauaaagga

SEQ ID NO: 651609 - RNA, 23 nt, Human
aaaaaacccaaaaccaaaaaaca

SEQ ID NO: 651610 - RNA, 26 nt, Human
aaaaaacccaaaaccaaaaaacaaac

SEQ ID NO: 651611 - RNA, 26 nt, Human
aaaaacccaaaaccaaaaaacaaacc

SEQ ID NO: 651612 - RNA, 25 nt, Human
aaacaaaccaacaauacaugaagau

SEQ ID NO: 651613 - RNA, 28 nt, Human
aaccagacuucuaacaaauaaccauauu

SEQ ID NO: 651614 - RNA, 25 nt, Human
aagaaacauaacucagaggguaaac

SEQ ID NO: 651615 - RNA, 25 nt, Human
aagcacugaagacacacauuuugcu

SEQ ID NO: 651616 - RNA, 19 nt, Human
aauaauggaaauacaggga

SEQ ID NO: 651617 - RNA, 25 nt, Human
aauggcaacgcuaaaaaaaaaagua

SEQ ID NO: 651618 - RNA, 22 nt, Human
accggcucccugcgauccgcgc

SEQ ID NO: 651619 - RNA, 25 nt, Human
agacuucuaacaaauaaccauauua

SEQ ID NO: 651620 - RNA, 19 nt, Human
aggaaaaagagaaugucua

SEQ ID NO: 651621 - RNA, 21 nt, Human
agguauuuagucuuuaagugg

SEQ ID NO: 651622 - RNA, 22 nt, Human
auaaagaauaauggaaauacag

SEQ ID NO: 651623 - RNA, 22 nt, Human
caaauaaccauauuaauuuucc

SEQ ID NO: 651624 - RNA, 24 nt, Human
caaauggaauaaauuccaucacuu

SEQ ID NO: 651625 - RNA, 21 nt, Human
cauguaagaaaaacaaguauu

SEQ ID NO: 651626 - RNA, 20 nt, Human
ccaaaaccaaaaaacaaacc

SEQ ID NO: 651627 - RNA, 19 nt, Human
cccaaaaccaaaaaacaaa

SEQ ID NO: 651628 - RNA, 24 nt, Human
cccaaaaccaaaaaacaaaccaac

SEQ ID NO: 651629 - RNA, 19 nt, Human
cccacgaguccggacucca

SEQ ID NO: 651630 - RNA, 22 nt, Human
cccauuaaccuuucccuuuaaa

SEQ ID NO: 651631 - RNA, 18 nt, Human
ccgcgccgucugcggugc

SEQ ID NO: 651632 - RNA, 21 nt, Human
ccggcggcggaccggcucccu

SEQ ID NO: 651633 - RNA, 19 nt, Human
cggcggcggaccggcuccc

SEQ ID NO: 651634 - RNA, 27 nt, Human
cuuauaccaaaaaaaaaaaaaaaaaac

SEQ ID NO: 651635 - RNA, 18 nt, Human
cuuucccuuuaaacaggc

SEQ ID NO: 651636 - RNA, 22 nt, Human
gaagacacacauuuugcugacc

SEQ ID NO: 651637 - RNA, 18 nt, Human
gauaauauuccacugugg

SEQ ID NO: 651638 - RNA, 22 nt, Human
gcuauaaaggaacguuuuuaga

SEQ ID NO: 651639 - RNA, 30 nt, Human
guucuuauaccaaaaaaaaaaaaaaaaaaa

SEQ ID NO: 651640 - RNA, 21 nt, Human
uaaaauauagaccuacaaaaa

SEQ ID NO: 651641 - RNA, 25 nt, Human
uaaccauauuaauuuuccaguaauc

SEQ ID NO: 651642 - RNA, 24 nt, Human
uaccaaaaaaaaaaaaaaaaaacc

SEQ ID NO: 651643 - RNA, 22 nt, Human
uagaagaaacauaacucagagg

SEQ ID NO: 651644 - RNA, 21 nt, Human
uauccuaaaagaggaaaaaga

SEQ ID NO: 651645 - RNA, 20 nt, Human
uauuaugggccuuccuaaga

SEQ ID NO: 651646 - RNA, 24 nt, Human
ucaauggcaacgcuaaaaaaaaaa

SEQ ID NO: 651647 - RNA, 18 nt, Human
uccacacgcacacccagg

SEQ ID NO: 651648 - RNA, 21 nt, Human
uccaucacuuuuggcuuuuuu

SEQ ID NO: 651649 - RNA, 18 nt, Human
ugaagacacacauuuugc

SEQ ID NO: 651650 - RNA, 19 nt, Human
ugaagauguaagggaagag

SEQ ID NO: 651651 - RNA, 23 nt, Human
ugaagauguaagggaagagauua

SEQ ID NO: 651652 - RNA, 19 nt, Human
ugauguuaguucuuauacc

SEQ ID NO: 651653 - RNA, 20 nt, Human
uggcaacgcuaaaaaaaaaa

SEQ ID NO: 651654 - RNA, 21 nt, Human
uucaugcuuacuuuauauucc

SEQ ID NO: 651655 - RNA, 21 nt, Human
aaacacagcugugguucauac

SEQ ID NO: 651656 - RNA, 25 nt, Human
aaagguucugugugaaggagagugg

SEQ ID NO: 651657 - RNA, 21 nt, Human
acaaccaaaaaggcaaacuac

SEQ ID NO: 651658 - RNA, 19 nt, Human
agggaccagauuugccugu

SEQ ID NO: 651659 - RNA, 23 nt, Human
auacucaaucauuucauaucucc

SEQ ID NO: 651660 - RNA, 22 nt, Human
caaacugggaucgcuguccgcc

SEQ ID NO: 651661 - RNA, 25 nt, Human
cauaucuccaagagaauucuuuuua

SEQ ID NO: 651662 - RNA, 23 nt, Human
gaaggagagugagcaggguacaa

SEQ ID NO: 651663 - RNA, 25 nt, Human
uacaacaaccaaaaaggcaaacuac

SEQ ID NO: 651664 - RNA, 23 nt, Human
uaccaaaaaaaaauugcauacaa

SEQ ID NO: 651665 - RNA, 24 nt, Human
uaucaugugaauguuugaaacucu

SEQ ID NO: 651666 - RNA, 18 nt, Human
ucucugauauaggaaauc

SEQ ID NO: 651667 - RNA, 19 nt, Human
ugaaagguucugugugaag

SEQ ID NO: 651668 - RNA, 22 nt, Human
uguacaauaaaugaaagguucu

SEQ ID NO: 651669 - RNA, 24 nt, Human
uguuugaaacucucugauauagga

SEQ ID NO: 651670 - RNA, 20 nt, Human
uucucugucaaacucagucu

SEQ ID NO: 651671 - RNA, 27 nt, Human
uuugaaacucucugauauaggaaaucu

SEQ ID NO: 651672 - RNA, 18 nt, Human
uuuuuuuuuuuuuuuuug

SEQ ID NO: 651673 - RNA, 25 nt, Human
uuuuuuuuuuuuuuuuuugucguuu

SEQ ID NO: 651674 - RNA, 18 nt, Human
acagcagcacccaccugg

SEQ ID NO: 651675 - RNA, 21 nt, Human
acagcagcacccaccuggagc

SEQ ID NO: 651676 - RNA, 22 nt, Human
accuggagccccuuauagcagc

SEQ ID NO: 651677 - RNA, 25 nt, Human
accuggagccccuuauagcagcccu

SEQ ID NO: 651678 - RNA, 21 nt, Human
acuccgggaaccuccaacccu

SEQ ID NO: 651679 - RNA, 20 nt, Human
agagaugcgcucaggaaccc

SEQ ID NO: 651680 - RNA, 19 nt, Human
aggaacccaguucccugac

SEQ ID NO: 651681 - RNA, 23 nt, Human
aggaacccaguucccugaccucc

SEQ ID NO: 651682 - RNA, 18 nt, Human
aggucucaaaggucgacu

SEQ ID NO: 651683 - RNA, 22 nt, Human
aguagcaucccuagaaccuagc

SEQ ID NO: 651684 - RNA, 19 nt, Human
aucucauuuaaccuucacc

SEQ ID NO: 651685 - RNA, 20 nt, Human
caacccaacuaggaaggcac

SEQ ID NO: 651686 - RNA, 21 nt, Human
cacuuccauuucagcugggag

SEQ ID NO: 651687 - RNA, 23 nt, Human
cagagaccaaguuuccaaggccu

SEQ ID NO: 651688 - RNA, 22 nt, Human
caggaaccuucaucugucuugu

SEQ ID NO: 651689 - RNA, 20 nt, Human
caucucauuuaaccuucacc

SEQ ID NO: 651690 - RNA, 20 nt, Human
ccaagcacuuccauuucagc

SEQ ID NO: 651691 - RNA, 22 nt, Human
ccaggccgagguguccgaggcc

SEQ ID NO: 651692 - RNA, 19 nt, Human
cccaaucauaacagcagca

SEQ ID NO: 651693 - RNA, 22 nt, Human
cccaggccgagguguccgaggc

SEQ ID NO: 651694 - RNA, 22 nt, Human
ccccucaggagucuagguuccu

SEQ ID NO: 651695 - RNA, 23 nt, Human
ccccucaggagucuagguuccug

SEQ ID NO: 651696 - RNA, 27 nt, Human
ccuccccuccaugagggcaggaacugg

SEQ ID NO: 651697 - RNA, 19 nt, Human
ccugcugagccuccacuuc

SEQ ID NO: 651698 - RNA, 19 nt, Human
cgacauccgugaaacagcc

SEQ ID NO: 651699 - RNA, 23 nt, Human
cuccacuucgacauccgugaaac

SEQ ID NO: 651700 - RNA, 27 nt, Human
cuggagccccuuauagcagcccuucuc

SEQ ID NO: 651701 - RNA, 22 nt, Human
cuuauugccucccuccccucca

SEQ ID NO: 651702 - RNA, 28 nt, Human
cuuugcuuauugccucccuccccuccaa

SEQ ID NO: 651703 - RNA, 19 nt, Human
gaagaaacugaggcccagg

SEQ ID NO: 651704 - RNA, 18 nt, Human
gcacccaccuggagcccc

SEQ ID NO: 651705 - RNA, 25 nt, Human
ggaaaccaauggagagaugaauggc

SEQ ID NO: 651706 - RNA, 23 nt, Human
ggcccaggcugaaauccgguugc

SEQ ID NO: 651707 - RNA, 21 nt, Human
gggaaccuccaacccugcuga

SEQ ID NO: 651708 - RNA, 27 nt, Human
gggagacuccgggaaccuccaaccccc

SEQ ID NO: 651709 - RNA, 19 nt, Human
gugcucaguccacauuugg

SEQ ID NO: 651710 - RNA, 24 nt, Human
uacccaggccgagguguccgaggc

SEQ ID NO: 651711 - RNA, 24 nt, Human
uagcagcccuucuccucugcacuu

SEQ ID NO: 651712 - RNA, 21 nt, Human
uagcucaggccugacucacag

SEQ ID NO: 651713 - RNA, 24 nt, Human
uaggaaggcaccaucauuauccca

SEQ ID NO: 651714 - RNA, 23 nt, Human
uaugcagggacacagcaugcagu

SEQ ID NO: 651715 - RNA, 23 nt, Human
ucaggccugacucacagugugug

SEQ ID NO: 651716 - RNA, 20 nt, Human
uccaaggccuugucaagaag

SEQ ID NO: 651717 - RNA, 20 nt, Human
ucccauccaggcugcacccc

SEQ ID NO: 651718 - RNA, 20 nt, Human
ucccugaccucccauccagg

SEQ ID NO: 651719 - RNA, 22 nt, Human
ucugucuuguugacaguagcau

SEQ ID NO: 651720 - RNA, 19 nt, Human
ucuucggcucggacacacc

SEQ ID NO: 651721 - RNA, 19 nt, Human
ugaagaaacugaggcccag

SEQ ID NO: 651722 - RNA, 23 nt, Human
ugaagaaacugaggcccaggaag

SEQ ID NO: 651723 - RNA, 24 nt, Human
ugaagaaacugaggcccaggaagg

SEQ ID NO: 651724 - RNA, 18 nt, Human
ugaauggcacagagaugc

SEQ ID NO: 651725 - RNA, 23 nt, Human
ugaccucccauccaggcugcacc

SEQ ID NO: 651726 - RNA, 25 nt, Human
ugaccucccauccaggcugcacccc

SEQ ID NO: 651727 - RNA, 20 nt, Human
uggacuaguagauggcaguu

SEQ ID NO: 651728 - RNA, 19 nt, Human
uggcugcucuucggcucgg

SEQ ID NO: 651729 - RNA, 21 nt, Human
uuauagcagcccuucuccucu

SEQ ID NO: 651730 - RNA, 26 nt, Human
uuuccaaggccuugucaagaaguggg

SEQ ID NO: 651731 - RNA, 18 nt, Human
uuuuuuuuuuuuuuuuug

SEQ ID NO: 651732 - RNA, 19 nt, Human
aaacauagcuaaaauagug

SEQ ID NO: 651733 - RNA, 18 nt, Human
ccugcagguuucggcggc

SEQ ID NO: 651734 - RNA, 21 nt, Human
cuccugcagguuucggcggcu

SEQ ID NO: 651735 - RNA, 19 nt, Human
uaguagacuccugcagguu

SEQ ID NO: 651736 - RNA, 21 nt, Human
ugcauaguagacuccugcagg

SEQ ID NO: 651737 - RNA, 20 nt, Human
ugggaaaaacauagcuaaaa

SEQ ID NO: 651738 - RNA, 18 nt, Human
uuuuuuuuuuuuuuuuug

SEQ ID NO: 651739 - RNA, 28 nt, Human
aaaaagcucuaaaaucucaauggcuuaa

SEQ ID NO: 651740 - RNA, 19 nt, Human
aaagccccaguaguaucag

SEQ ID NO: 651741 - RNA, 19 nt, Human
aacaacacaugccuuucuc

SEQ ID NO: 651742 - RNA, 19 nt, Human
agacaggaaaacaaauuga

SEQ ID NO: 651743 - RNA, 20 nt, Human
aguaucagucuugacagaua

SEQ ID NO: 651744 - RNA, 18 nt, Human
caagccccaaaggaccag

SEQ ID NO: 651745 - RNA, 20 nt, Human
cacggcccugcccaagcccc

SEQ ID NO: 651746 - RNA, 22 nt, Human
cacggcccugcccaagccccaa

SEQ ID NO: 651747 - RNA, 20 nt, Human
ccaaaggaccagacugugcc

SEQ ID NO: 651748 - RNA, 21 nt, Human
cccaaaggaccagacugugcc

SEQ ID NO: 651749 - RNA, 20 nt, Human
ccccaaaggaccagacugug

SEQ ID NO: 651750 - RNA, 22 nt, Human
ccccaaaggaccagacugugcc

SEQ ID NO: 651751 - RNA, 18 nt, Human
ccucaugggugaguuggg

SEQ ID NO: 651752 - RNA, 24 nt, Human
ccuugcaggacuuaugcccagaag

SEQ ID NO: 651753 - RNA, 18 nt, Human
cuaggagaagacauugau

SEQ ID NO: 651754 - RNA, 24 nt, Human
ggccagaaccugugucacggcccu

SEQ ID NO: 651755 - RNA, 24 nt, Human
uaauauguaaagaacucccaaauc

SEQ ID NO: 651756 - RNA, 20 nt, Human
uaggaaaagccccaguagua

SEQ ID NO: 651757 - RNA, 24 nt, Human
uaggaaaagccccaguaguaucag

SEQ ID NO: 651758 - RNA, 25 nt, Human
ucaaaugucaaaagacaggaaaaca

SEQ ID NO: 651759 - RNA, 23 nt, Human
ucccaaaucaauaggaaaagccc

SEQ ID NO: 651760 - RNA, 22 nt, Human
ucccucaugggugaguuggggc

SEQ ID NO: 651761 - RNA, 22 nt, Human
ucugcaggaucuugugcugcca

SEQ ID NO: 651762 - RNA, 23 nt, Human
ugacaaaaagcucuaaaaucuca

SEQ ID NO: 651763 - RNA, 21 nt, Human
uuccauguugcuuuccuugca

SEQ ID NO: 651764 - RNA, 27 nt, Human
uugacagauagugacaaaaagcucuuu

SEQ ID NO: 651765 - RNA, 19 nt, Human
uuuuccauguugcuuuccu

SEQ ID NO: 651766 - RNA, 23 nt, Human
aaaaaaccagaucucaugagaac

SEQ ID NO: 651767 - RNA, 18 nt, Human
aaaaucccuccacuaccc

SEQ ID NO: 651768 - RNA, 22 nt, Human
aaaaucccuccacuacccccuc

SEQ ID NO: 651769 - RNA, 21 nt, Human
aagagagcaaaaggagagggg

SEQ ID NO: 651770 - RNA, 18 nt, Human
aagcagaugggaguaguc

SEQ ID NO: 651771 - RNA, 24 nt, Human
acagagaauggagaagacucaaaa

SEQ ID NO: 651772 - RNA, 22 nt, Human
acccccaugauccaaucaccuc

SEQ ID NO: 651773 - RNA, 25 nt, Human
accucccacugggccccuccuccaa

SEQ ID NO: 651774 - RNA, 19 nt, Human
acucaaaaaaccagaucuc

SEQ ID NO: 651775 - RNA, 22 nt, Human
agaacagguggcugagaccagg

SEQ ID NO: 651776 - RNA, 23 nt, Human
agaagcccguuucuucuuccaaa

SEQ ID NO: 651777 - RNA, 18 nt, Human
agaggaagagagcaaaag

SEQ ID NO: 651778 - RNA, 18 nt, Human
agaggccacugcugggga

SEQ ID NO: 651779 - RNA, 22 nt, Human
aggcccugacccagggaggagg

SEQ ID NO: 651780 - RNA, 19 nt, Human
agggaggaggugcuccaag

SEQ ID NO: 651781 - RNA, 18 nt, Human
agguaggagguggggaug

SEQ ID NO: 651782 - RNA, 25 nt, Human
agguaggagguggggaugccugggg

SEQ ID NO: 651783 - RNA, 24 nt, Human
aguccucggcacaacugucagcuc

SEQ ID NO: 651784 - RNA, 23 nt, Human
aucaccucccacugggccccucc

SEQ ID NO: 651785 - RNA, 24 nt, Human
augagaacucacucacuaucauga

SEQ ID NO: 651786 - RNA, 20 nt, Human
auuucaucaccaaggaaugg

SEQ ID NO: 651787 - RNA, 22 nt, Human
auuucaucaccaaggaauggca

SEQ ID NO: 651788 - RNA, 22 nt, Human
caaaaucccuccacuacccccu

SEQ ID NO: 651789 - RNA, 18 nt, Human
caacacuggggauuacaa

SEQ ID NO: 651790 - RNA, 21 nt, Human
cacaugagccuuuucuacuuu

SEQ ID NO: 651791 - RNA, 19 nt, Human
caccaaggaauggcauaca

SEQ ID NO: 651792 - RNA, 19 nt, Human
caccaugccugcccaaugg

SEQ ID NO: 651793 - RNA, 18 nt, Human
cacugcuggggacaaaau

SEQ ID NO: 651794 - RNA, 23 nt, Human
cacugggccccuccuccaacacu

SEQ ID NO: 651795 - RNA, 21 nt, Human
cauccaggcccugacccaggg

SEQ ID NO: 651796 - RNA, 20 nt, Human
cauucauuuuuucaaaacca

SEQ ID NO: 651797 - RNA, 21 nt, Human
ccaccaggcacugaaagacuc

SEQ ID NO: 651798 - RNA, 24 nt, Human
ccacccccaugauccaaucaccuc

SEQ ID NO: 651799 - RNA, 18 nt, Human
cccacugggccccuccuc

SEQ ID NO: 651800 - RNA, 20 nt, Human
cccacugggccccuccucca

SEQ ID NO: 651801 - RNA, 23 nt, Human
cccccaugauccaaucaccuccc

SEQ ID NO: 651802 - RNA, 19 nt, Human
cccccucaaggagaagccc

SEQ ID NO: 651803 - RNA, 28 nt, Human
cccuccacuacccccucaaggagaagcc

SEQ ID NO: 651804 - RNA, 22 nt, Human
cccugccccaccaggcacugaa

SEQ ID NO: 651805 - RNA, 20 nt, Human
ccucagcuccaggucuccug

SEQ ID NO: 651806 - RNA, 23 nt, Human
ccucccauggugcagugcagagu

SEQ ID NO: 651807 - RNA, 28 nt, Human
ccugcccugccccaccaggcacugaaag

SEQ ID NO: 651808 - RNA, 24 nt, Human
cucaggaaacugacaaucauggug

SEQ ID NO: 651809 - RNA, 18 nt, Human
cucuaagaacgagguagg

SEQ ID NO: 651810 - RNA, 21 nt, Human
cugcccugccccaccaggcac

SEQ ID NO: 651811 - RNA, 22 nt, Human
gaaagaggaagagagcaaaagg

SEQ ID NO: 651812 - RNA, 24 nt, Human
gagaacaguaagggagaaauccac

SEQ ID NO: 651813 - RNA, 18 nt, Human
gagaaggaggcauaucuu

SEQ ID NO: 651814 - RNA, 21 nt, Human
gagacuuggguggggacacag

SEQ ID NO: 651815 - RNA, 21 nt, Human
gagagcaaaaggagaggggga

SEQ ID NO: 651816 - RNA, 21 nt, Human
gagauuuggguggggauacag

SEQ ID NO: 651817 - RNA, 21 nt, Human
gauuuggguggggauacagau

SEQ ID NO: 651818 - RNA, 21 nt, Human
gcucauggcugugugugcacc

SEQ ID NO: 651819 - RNA, 22 nt, Human
ggaagagagcaaaaggagaggg

SEQ ID NO: 651820 - RNA, 19 nt, Human
ggagaaagaggaagagagc

SEQ ID NO: 651821 - RNA, 22 nt, Human
ggagguggggaugccuggggaa

SEQ ID NO: 651822 - RNA, 18 nt, Human
gggaagaagcagauggga

SEQ ID NO: 651823 - RNA, 23 nt, Human
ggugcagugcagagucuguuggg

SEQ ID NO: 651824 - RNA, 21 nt, Human
uaggagguggggaugccuggg

SEQ ID NO: 651825 - RNA, 22 nt, Human
ucacacugauauacaaaaagug

SEQ ID NO: 651826 - RNA, 25 nt, Human
ucacagagaauggagaagacucaaa

SEQ ID NO: 651827 - RNA, 19 nt, Human
uccacccccaugauccaau

SEQ ID NO: 651828 - RNA, 19 nt, Human
uccacuacccccucaagga

SEQ ID NO: 651829 - RNA, 22 nt, Human
ucccauggugcagugcagaguc

SEQ ID NO: 651830 - RNA, 18 nt, Human
ucccuccacuacccccuc

SEQ ID NO: 651831 - RNA, 26 nt, Human
ucuccugccgaugcuguuugcuugac

SEQ ID NO: 651832 - RNA, 23 nt, Human
ugacaacaccacguggcuggguc

SEQ ID NO: 651833 - RNA, 18 nt, Human
ugcagugcagagucuguu

SEQ ID NO: 651834 - RNA, 20 nt, Human
ugcccugccccaccaggcaa

SEQ ID NO: 651835 - RNA, 23 nt, Human
uggccggagaaagaggaagagag

SEQ ID NO: 651836 - RNA, 24 nt, Human
uggggaugccuggggaaggggguc

SEQ ID NO: 651837 - RNA, 22 nt, Human
uuuuuuuuuuuuuuuuuuaaug

SEQ ID NO: 651838 - RNA, 21 nt, Human
aacaccuccccccgccaaccu

SEQ ID NO: 651839 - RNA, 22 nt, Human
aauauaggggcaucuucagccu

SEQ ID NO: 651840 - RNA, 21 nt, Human
accauccauaaugcacccaga

SEQ ID NO: 651841 - RNA, 19 nt, Human
accccaacaccuccccccg

SEQ ID NO: 651842 - RNA, 21 nt, Human
accccaacaccuccccccgcc

SEQ ID NO: 651843 - RNA, 22 nt, Human
accccaacaccuccccccgcca

SEQ ID NO: 651844 - RNA, 25 nt, Human
accccaacaccuccccccgccaacc

SEQ ID NO: 651845 - RNA, 21 nt, Human
acuggggccuggccucugccc

SEQ ID NO: 651846 - RNA, 24 nt, Human
acuuccagaagcaccagaaacgga

SEQ ID NO: 651847 - RNA, 24 nt, Human
agacaccccuccucuucucugccc

SEQ ID NO: 651848 - RNA, 30 nt, Human
agagcccccucacggucccucucacacucu

SEQ ID NO: 651849 - RNA, 19 nt, Human
agcagagacuuccagaagc

SEQ ID NO: 651850 - RNA, 21 nt, Human
aggaccccaacaccucccccc

SEQ ID NO: 651851 - RNA, 23 nt, Human
aggaccccaacaccuccccccgc

SEQ ID NO: 651852 - RNA, 21 nt, Human
aguucuucccugugcugagca

SEQ ID NO: 651853 - RNA, 21 nt, Human
caaaccauccauaaugcaccc

SEQ ID NO: 651854 - RNA, 21 nt, Human
caacaccuccccccgccaacc

SEQ ID NO: 651855 - RNA, 21 nt, Human
caccagaaacggagccagaug

SEQ ID NO: 651856 - RNA, 19 nt, Human
caccucaauccaccaaacc

SEQ ID NO: 651857 - RNA, 21 nt, Human
caccucaauccaccaaaccau

SEQ ID NO: 651858 - RNA, 18 nt, Human
caccuccccccgccaacc

SEQ ID NO: 651859 - RNA, 21 nt, Human
cacucugccagucccccuaga

SEQ ID NO: 651860 - RNA, 24 nt, Human
cagauaggcccacccccaaaagcc

SEQ ID NO: 651861 - RNA, 20 nt, Human
cagcacuggggccuggccuc

SEQ ID NO: 651862 - RNA, 18 nt, Human
caucuccccucucagacc

SEQ ID NO: 651863 - RNA, 22 nt, Human
ccaacaccuccccccgccaacc

SEQ ID NO: 651864 - RNA, 25 nt, Human
cccaaaagccuggacaccuugagca

SEQ ID NO: 651865 - RNA, 21 nt, Human
cccaacaccuccccccgccaa

SEQ ID NO: 651866 - RNA, 19 nt, Human
cccacaccucaauccacca

SEQ ID NO: 651867 - RNA, 21 nt, Human
cccacccccaaaagccuggac

SEQ ID NO: 651868 - RNA, 23 nt, Human
cccagauaggcccacccccaaaa

SEQ ID NO: 651869 - RNA, 21 nt, Human
ccccaaaagccuggacaccuc

SEQ ID NO: 651870 - RNA, 19 nt, Human
ccccaacaccuccccccgc

SEQ ID NO: 651871 - RNA, 24 nt, Human
ccccaacaccuccccccgccaacc

SEQ ID NO: 651872 - RNA, 20 nt, Human
ccccacaccucaauccaccu

SEQ ID NO: 651873 - RNA, 22 nt, Human
cccccaaaagccuggacaccuu

SEQ ID NO: 651874 - RNA, 25 nt, Human
cccccaaaagccuggacaccuugag

SEQ ID NO: 651875 - RNA, 18 nt, Human
cccccuagacaccccucc

SEQ ID NO: 651876 - RNA, 18 nt, Human
cccuccucuucucugccc

SEQ ID NO: 651877 - RNA, 18 nt, Human
cccucuagccuaggaccc

SEQ ID NO: 651878 - RNA, 18 nt, Human
cccucucuccucagcccc

SEQ ID NO: 651879 - RNA, 22 nt, Human
cccugugcugagcagagacuuc

SEQ ID NO: 651880 - RNA, 19 nt, Human
ccuaggacccuccucccca

SEQ ID NO: 651881 - RNA, 23 nt, Human
ccucaauccaccaaaccauccau

SEQ ID NO: 651882 - RNA, 25 nt, Human
ccuccaggacagggucagggauggg

SEQ ID NO: 651883 - RNA, 22 nt, Human
ccuccuccccacaccucaaucc

SEQ ID NO: 651884 - RNA, 19 nt, Human
ccuggccucugcccccucc

SEQ ID NO: 651885 - RNA, 20 nt, Human
ccuggccucugcccccucca

SEQ ID NO: 651886 - RNA, 27 nt, Human
ccugugcugagcagagacuuccagaag

SEQ ID NO: 651887 - RNA, 27 nt, Human
cgcaugcaucuccccucucagacccuu

SEQ ID NO: 651888 - RNA, 20 nt, Human
cuaacuagggauacccccuc

SEQ ID NO: 651889 - RNA, 19 nt, Human
cucacggucccucucacac

SEQ ID NO: 651890 - RNA, 22 nt, Human
cucacggucccucucacacucu

SEQ ID NO: 651891 - RNA, 22 nt, Human
cucagcacuucuuccacuccca

SEQ ID NO: 651892 - RNA, 18 nt, Human
cuggccucugcccccucc

SEQ ID NO: 651893 - RNA, 20 nt, Human
cugugcccucucuccucagc

SEQ ID NO: 651894 - RNA, 22 nt, Human
gaaacggagccagaugaaagga

SEQ ID NO: 651895 - RNA, 20 nt, Human
gacccuccuccccacaccuc

SEQ ID NO: 651896 - RNA, 22 nt, Human
gagccagaugaaaggaccccaa

SEQ ID NO: 651897 - RNA, 24 nt, Human
gccagucccccuagacaccccucc

SEQ ID NO: 651898 - RNA, 23 nt, Human
gccuaggacccuccuccccacac

SEQ ID NO: 651899 - RNA, 21 nt, Human
gccuggccucugcccccucca

SEQ ID NO: 651900 - RNA, 24 nt, Human
uaggacccuccuccccacaccuca

SEQ ID NO: 651901 - RNA, 22 nt, Human
uauaggcaaauagcugcuggca

SEQ ID NO: 651902 - RNA, 19 nt, Human
uauuuguaccugccuuguu

SEQ ID NO: 651903 - RNA, 19 nt, Human
ucaauccaccaaaccaucc

SEQ ID NO: 651904 - RNA, 25 nt, Human
uccacucccaucaagagcccccuca

SEQ ID NO: 651905 - RNA, 23 nt, Human
uccagaagcaccagaaacggagc

SEQ ID NO: 651906 - RNA, 18 nt, Human
ucccaucaagagcccccu

SEQ ID NO: 651907 - RNA, 18 nt, Human
ucccugugcugagcagag

SEQ ID NO: 651908 - RNA, 19 nt, Human
uccuccccacaccucaauc

SEQ ID NO: 651909 - RNA, 25 nt, Human
ucuucagccuggacacgcaugcauc

SEQ ID NO: 651910 - RNA, 24 nt, Human
ugaaaggaccccaacaccuccccc

SEQ ID NO: 651911 - RNA, 19 nt, Human
ugagcacacaguuaugacc

SEQ ID NO: 651912 - RNA, 22 nt, Human
ugagcacacaguuaugaccagg

SEQ ID NO: 651913 - RNA, 24 nt, Human
ugagcagagacuuccagaagcacc

SEQ ID NO: 651914 - RNA, 19 nt, Human
ugcccucucuccucagccc

SEQ ID NO: 651915 - RNA, 21 nt, Human
uggcaaacuggcauuaccugg

SEQ ID NO: 651916 - RNA, 18 nt, Human
uggggccuggccucugcc

SEQ ID NO: 651917 - RNA, 20 nt, Human
uguggggaugggggggcaag

SEQ ID NO: 651918 - RNA, 21 nt, Human
uguuccagaaaacauugaagg

SEQ ID NO: 651919 - RNA, 23 nt, Human
uuaguucuucccugugcugagca

SEQ ID NO: 651920 - RNA, 23 nt, Human
uugaagguggcuucccaaagucu

SEQ ID NO: 651921 - RNA, 18 nt, Human
uuguaccugccuuguucc

SEQ ID NO: 651922 - RNA, 25 nt, Human
uuuuuuuuuuuuuuuugcuuuccaa

SEQ ID NO: 651923 - RNA, 23 nt, Human
uuuuuuuuuuuuuuuuuugcuuu

SEQ ID NO: 651924 - RNA, 20 nt, Human
uuuuuuuuuuuuuuuuuugg

SEQ ID NO: 651925 - RNA, 21 nt, Human
acccacagagccagagagggg

SEQ ID NO: 651926 - RNA, 22 nt, Human
agcgaggcuggcagguggcucu

SEQ ID NO: 651927 - RNA, 20 nt, Human
agguggcucugguuuugggg

SEQ ID NO: 651928 - RNA, 18 nt, Human
cacggcccacggggacag

SEQ ID NO: 651929 - RNA, 24 nt, Human
cagagcccagggacccacagagcc

SEQ ID NO: 651930 - RNA, 23 nt, Human
ccagugggccagcuuggggucug

SEQ ID NO: 651931 - RNA, 23 nt, Human
cccacagagccagagaggggacc

SEQ ID NO: 651932 - RNA, 21 nt, Human
cccagggacccacagagccag

SEQ ID NO: 651933 - RNA, 25 nt, Human
gaggggaccagugggccagcuuggg

SEQ ID NO: 651934 - RNA, 19 nt, Human
gcuacggccagcccugccc

SEQ ID NO: 651935 - RNA, 20 nt, Human
ggggagaagugggguggggu

SEQ ID NO: 651936 - RNA, 20 nt, Human
gggggagaaguggggugggg

SEQ ID NO: 651937 - RNA, 21 nt, Human
gguuugggaugagaagugggu

SEQ ID NO: 651938 - RNA, 21 nt, Human
guggcucugggggcacguccc

SEQ ID NO: 651939 - RNA, 18 nt, Human
uggcucugggggcacguc

SEQ ID NO: 651940 - RNA, 20 nt, Human
uggcucugggggcacguccc

SEQ ID NO: 651941 - RNA, 18 nt, Human
uggcucugguuuuggggg

SEQ ID NO: 651942 - RNA, 20 nt, Human
ugggaugagaaguggguggc

SEQ ID NO: 651943 - RNA, 18 nt, Human
ugggccagcuuggggucu

SEQ ID NO: 651944 - RNA, 21 nt, Human
ugggguguggccaugccacgg

SEQ ID NO: 651945 - RNA, 23 nt, Human
aaccgcguggccgucucugcccc

SEQ ID NO: 651946 - RNA, 25 nt, Human
aaccgcguggccgucucugccccca

SEQ ID NO: 651947 - RNA, 23 nt, Human
aaccucaacagaggcuacagccg

SEQ ID NO: 651948 - RNA, 23 nt, Human
aaccucaacagaggcuacagccg

SEQ ID NO: 651949 - RNA, 22 nt, Human
aagaaagcaagaguuuucaaaa

SEQ ID NO: 651950 - RNA, 22 nt, Human
aagaaagcaagaguuuucaaaa

SEQ ID NO: 651951 - RNA, 25 nt, Human
aagcaagaguuuucaaaacaacagc

SEQ ID NO: 651952 - RNA, 25 nt, Human
aagcaagaguuuucaaaacaacagc

SEQ ID NO: 651953 - RNA, 23 nt, Human
aaggaggaaaaagaaauacacca

SEQ ID NO: 651954 - RNA, 24 nt, Human
aaggcgggcacacccccacaaccc

SEQ ID NO: 651955 - RNA, 26 nt, Human
aaugaccauuuauuuccaaaggcgac

SEQ ID NO: 651956 - RNA, 26 nt, Human
aaugaccauuuauuuccaaaggcgac

SEQ ID NO: 651957 - RNA, 23 nt, Human
acaaaaaugucacagacgagagc

SEQ ID NO: 651958 - RNA, 23 nt, Human
acaaaaaugucacagacgagagc

SEQ ID NO: 651959 - RNA, 19 nt, Human
acacugaauuaccaaugau

SEQ ID NO: 651960 - RNA, 19 nt, Human
acacugaauuaccaaugau

SEQ ID NO: 651961 - RNA, 19 nt, Human
acagagaaaacacauuaca

SEQ ID NO: 651962 - RNA, 21 nt, Human
acagagcacgcaagaaccagc

SEQ ID NO: 651963 - RNA, 21 nt, Human
acagagcacgcaagaaccagc

SEQ ID NO: 651964 - RNA, 28 nt, Human
acagagcacgcaagaaccagccugacaa

SEQ ID NO: 651965 - RNA, 28 nt, Human
acagagcacgcaagaaccagccugacaa

SEQ ID NO: 651966 - RNA, 20 nt, Human
acagaggcuacagcaaaagg

SEQ ID NO: 651967 - RNA, 20 nt, Human
acagaggcuacagcaaaagg

SEQ ID NO: 651968 - RNA, 24 nt, Human
acccccacaaccccccuccagaca

SEQ ID NO: 651969 - RNA, 24 nt, Human
acuccugcaaccgcguggccgucu

SEQ ID NO: 651970 - RNA, 19 nt, Human
agaaaauccucuucaggag

SEQ ID NO: 651971 - RNA, 19 nt, Human
agaaaauccucuucaggag

SEQ ID NO: 651972 - RNA, 22 nt, Human
agaaaccaguaagaaaauccuc

SEQ ID NO: 651973 - RNA, 22 nt, Human
agaaaccaguaagaaaauccuc

SEQ ID NO: 651974 - RNA, 19 nt, Human
agaagaaagggacagaaag

SEQ ID NO: 651975 - RNA, 24 nt, Human
agaggcuacagcaaaaggggugau

SEQ ID NO: 651976 - RNA, 24 nt, Human
agaggcuacagcaaaaggggugau

SEQ ID NO: 651977 - RNA, 23 nt, Human
agcuccuucccagccuggggccu

SEQ ID NO: 651978 - RNA, 23 nt, Human
agcuccuucccagccuggggccu

SEQ ID NO: 651979 - RNA, 24 nt, Human
aggaaaaagaaauacaccaaacau

SEQ ID NO: 651980 - RNA, 21 nt, Human
aggagagagccaaagggaagg

SEQ ID NO: 651981 - RNA, 21 nt, Human
aggaggggacagaggacucug

SEQ ID NO: 651982 - RNA, 21 nt, Human
aggaggggacagaggacucug

SEQ ID NO: 651983 - RNA, 21 nt, Human
aggaggggacagaggacucug

SEQ ID NO: 651984 - RNA, 21 nt, Human
aggaggggacagaggacucug

SEQ ID NO: 651985 - RNA, 18 nt, Human
agggacagaaaggaggaa

SEQ ID NO: 651986 - RNA, 19 nt, Human
agggaggaaaaaaaaaaaa

SEQ ID NO: 651987 - RNA, 18 nt, Human
aggggaagaggggcagag

SEQ ID NO: 651988 - RNA, 18 nt, Human
aggggaagaggggcagag

SEQ ID NO: 651989 - RNA, 22 nt, Human
agggguaggggaagaggggcag

SEQ ID NO: 651990 - RNA, 22 nt, Human
agggguaggggaagaggggcag

SEQ ID NO: 651991 - RNA, 21 nt, Human
aucagcucacucuauauacac

SEQ ID NO: 651992 - RNA, 23 nt, Human
augcgaugaaguuugaggagaga

SEQ ID NO: 651993 - RNA, 23 nt, Human
augcgaugaaguuugaggagaga

SEQ ID NO: 651994 - RNA, 23 nt, Human
caaacuggugggggcacagagca

SEQ ID NO: 651995 - RNA, 23 nt, Human
caaacuggugggggcacagagca

SEQ ID NO: 651996 - RNA, 19 nt, Human
caacagaggcuacagcaaa

SEQ ID NO: 651997 - RNA, 19 nt, Human
caacagaggcuacagcaaa

SEQ ID NO: 651998 - RNA, 18 nt, Human
caaccccccuccagacac

SEQ ID NO: 651999 - RNA, 23 nt, Human
caaggcccgggguaaagugcugg

SEQ ID NO: 652000 - RNA, 20 nt, Human
caagggccugcaggagaccc

SEQ ID NO: 652001 - RNA, 20 nt, Human
caagggccugcaggagaccc

SEQ ID NO: 652002 - RNA, 21 nt, Human
caagggccugcaggagacccu

SEQ ID NO: 652003 - RNA, 21 nt, Human
caagggccugcaggagacccu

SEQ ID NO: 652004 - RNA, 22 nt, Human
cacaaccccccuccagacacca

SEQ ID NO: 652005 - RNA, 18 nt, Human
cacaagggccugcaggag

SEQ ID NO: 652006 - RNA, 18 nt, Human
cacaagggccugcaggag

SEQ ID NO: 652007 - RNA, 25 nt, Human
cacacccccacaaccccccuccaga

SEQ ID NO: 652008 - RNA, 18 nt, Human
caccaaaagaaagcaaga

SEQ ID NO: 652009 - RNA, 20 nt, Human
caccaaaagaaagcaagagu

SEQ ID NO: 652010 - RNA, 20 nt, Human
caccaaaagaaagcaagagu

SEQ ID NO: 652011 - RNA, 25 nt, Human
caccaaaagaaagcaagaguuuuca

SEQ ID NO: 652012 - RNA, 25 nt, Human
caccaaaagaaagcaagaguuuuca

SEQ ID NO: 652013 - RNA, 22 nt, Human
caccaaacauccuacugcccuc

SEQ ID NO: 652014 - RNA, 20 nt, Human
caccccaggcucaaggagaa

SEQ ID NO: 652015 - RNA, 23 nt, Human
cacgcaagaaccagccugacaaa

SEQ ID NO: 652016 - RNA, 23 nt, Human
cacgcaagaaccagccugacaaa

SEQ ID NO: 652017 - RNA, 18 nt, Human
cacuacaccccaggcuca

SEQ ID NO: 652018 - RNA, 18 nt, Human
cagacgagagcaacaagc

SEQ ID NO: 652019 - RNA, 23 nt, Human
cagcacuacaccccaggcucaag

SEQ ID NO: 652020 - RNA, 24 nt, Human
cagcaucacacaugguccuuuuuu

SEQ ID NO: 652021 - RNA, 24 nt, Human
cagcaucacacaugguccuuuuuu

SEQ ID NO: 652022 - RNA, 24 nt, Human
cagccuggggccuugccaaggagc

SEQ ID NO: 652023 - RNA, 24 nt, Human
cagccuggggccuugccaaggagc

SEQ ID NO: 652024 - RNA, 23 nt, Human
cagggcacugcccugccccaaua

SEQ ID NO: 652025 - RNA, 23 nt, Human
cagggcacugcccugccccaaua

SEQ ID NO: 652026 - RNA, 18 nt, Human
cagggguaggggaagagg

SEQ ID NO: 652027 - RNA, 18 nt, Human
cagggguaggggaagagg

SEQ ID NO: 652028 - RNA, 20 nt, Human
cagggguaggggaagagggg

SEQ ID NO: 652029 - RNA, 20 nt, Human
cagggguaggggaagagggg

SEQ ID NO: 652030 - RNA, 19 nt, Human
cauccuacugcccucuccc

SEQ ID NO: 652031 - RNA, 20 nt, Human
ccaaacauccuacugcccuc

SEQ ID NO: 652032 - RNA, 30 nt, Human
ccaaacauccuacugcccucucccaugauu

SEQ ID NO: 652033 - RNA, 21 nt, Human
ccacucccugagccaccuagc

SEQ ID NO: 652034 - RNA, 21 nt, Human
ccacucccugagccaccuagc

SEQ ID NO: 652035 - RNA, 21 nt, Human
cccacaaccccccuccagaca

SEQ ID NO: 652036 - RNA, 24 nt, Human
cccacaaccccccuccagacacca

SEQ ID NO: 652037 - RNA, 26 nt, Human
ccccaauaccagugcacagagaccug

SEQ ID NO: 652038 - RNA, 26 nt, Human
ccccaauaccagugcacagagaccug

SEQ ID NO: 652039 - RNA, 19 nt, Human
ccccacaaccccccuccag

SEQ ID NO: 652040 - RNA, 22 nt, Human
ccccagggcacugcccugcccc

SEQ ID NO: 652041 - RNA, 22 nt, Human
ccccagggcacugcccugcccc

SEQ ID NO: 652042 - RNA, 21 nt, Human
cccccacaaccccccuccaga

SEQ ID NO: 652043 - RNA, 21 nt, Human
cccccuccagacaccagggcu

SEQ ID NO: 652044 - RNA, 23 nt, Human
cccuccagacaccagggcaccga

SEQ ID NO: 652045 - RNA, 23 nt, Human
cccugagccaccuagcuuacccc

SEQ ID NO: 652046 - RNA, 23 nt, Human
cccugagccaccuagcuuacccc

SEQ ID NO: 652047 - RNA, 19 nt, Human
ccgccacaaagcgggcagg

SEQ ID NO: 652048 - RNA, 19 nt, Human
ccugcaaccgcguggccgu

SEQ ID NO: 652049 - RNA, 21 nt, Human
ccugcaggagacccuccauaa

SEQ ID NO: 652050 - RNA, 21 nt, Human
ccugcaggagacccuccauaa

SEQ ID NO: 652051 - RNA, 19 nt, Human
ccuucugccacucccugag

SEQ ID NO: 652052 - RNA, 19 nt, Human
ccuucugccacucccugag

SEQ ID NO: 652053 - RNA, 22 nt, Human
ccuucugccacucccugagcca

SEQ ID NO: 652054 - RNA, 23 nt, Human
ccuucugccacucccugagccac

SEQ ID NO: 652055 - RNA, 28 nt, Human
cgggugguggaccauguaaggcgggcac

SEQ ID NO: 652056 - RNA, 22 nt, Human
cuacaccccaggcucaaggaga

SEQ ID NO: 652057 - RNA, 23 nt, Human
cucagggaggaaaaaaaaaaaaa

SEQ ID NO: 652058 - RNA, 23 nt, Human
cuccaagucaagucacgacuugc

SEQ ID NO: 652059 - RNA, 19 nt, Human
cuccuccccuaccuccccu

SEQ ID NO: 652060 - RNA, 19 nt, Human
cuccuccccuaccuccccu

SEQ ID NO: 652061 - RNA, 22 nt, Human
cuccuucccagccuggggccuu

SEQ ID NO: 652062 - RNA, 22 nt, Human
cuccuucccagccuggggccuu

SEQ ID NO: 652063 - RNA, 22 nt, Human
cugagccaccuagcuuaccccc

SEQ ID NO: 652064 - RNA, 22 nt, Human
cugagccaccuagcuuaccccc

SEQ ID NO: 652065 - RNA, 22 nt, Human
cugagcccaaaucagcucacuc

SEQ ID NO: 652066 - RNA, 22 nt, Human
cugagcccaaaucagcucacuc

SEQ ID NO: 652067 - RNA, 19 nt, Human
gaaaccaguaagaaaaucc

SEQ ID NO: 652068 - RNA, 19 nt, Human
gaaaccaguaagaaaaucc

SEQ ID NO: 652069 - RNA, 18 nt, Human
gacaaaaauccuaagccu

SEQ ID NO: 652070 - RNA, 18 nt, Human
gacaaaaauccuaagccu

SEQ ID NO: 652071 - RNA, 21 nt, Human
gacagggguaggggaagaggg

SEQ ID NO: 652072 - RNA, 21 nt, Human
gacagggguaggggaagaggg

SEQ ID NO: 652073 - RNA, 19 nt, Human
gacagugacgggucugccc

SEQ ID NO: 652074 - RNA, 19 nt, Human
gacagugacgggucugccc

SEQ ID NO: 652075 - RNA, 22 nt, Human
gaccauguaaggcgggcacacc

SEQ ID NO: 652076 - RNA, 24 nt, Human
gaccauuuauuuccaaaggcgacu

SEQ ID NO: 652077 - RNA, 24 nt, Human
gaccauuuauuuccaaaggcgacu

SEQ ID NO: 652078 - RNA, 23 nt, Human
gacugcagauaccauuucgguac

SEQ ID NO: 652079 - RNA, 23 nt, Human
gacugcagauaccauuucgguac

SEQ ID NO: 652080 - RNA, 18 nt, Human
gagagccaaagggaagga

SEQ ID NO: 652081 - RNA, 19 nt, Human
gagcugggaaaggaagagu

SEQ ID NO: 652082 - RNA, 21 nt, Human
gaguuuucaaaacaacagcuu

SEQ ID NO: 652083 - RNA, 21 nt, Human
gaguuuucaaaacaacagcuu

SEQ ID NO: 652084 - RNA, 28 nt, Human
gccccaauaccagugcacagagaccugc

SEQ ID NO: 652085 - RNA, 28 nt, Human
gccccaauaccagugcacagagaccugc

SEQ ID NO: 652086 - RNA, 21 nt, Human
gcuaagcuccugacagaaacc

SEQ ID NO: 652087 - RNA, 21 nt, Human
gcuaagcuccugacagaaacc

SEQ ID NO: 652088 - RNA, 22 nt, Human
ggaaggacagggguaggggaag

SEQ ID NO: 652089 - RNA, 22 nt, Human
ggaaggacagggguaggggaag

SEQ ID NO: 652090 - RNA, 21 nt, Human
ggcuacagcaaaaggggugau

SEQ ID NO: 652091 - RNA, 21 nt, Human
ggcuacagcaaaaggggugau

SEQ ID NO: 652092 - RNA, 21 nt, Human
gggaagagcugggaaaggaag

SEQ ID NO: 652093 - RNA, 21 nt, Human
guaaggcgggcacacccccac

SEQ ID NO: 652094 - RNA, 21 nt, Human
guccuuuuuuccuccuccccu

SEQ ID NO: 652095 - RNA, 21 nt, Human
guccuuuuuuccuccuccccu

SEQ ID NO: 652096 - RNA, 20 nt, Human
guggaccauguaaggcgggc

SEQ ID NO: 652097 - RNA, 18 nt, Human
guggggagcugugcccac

SEQ ID NO: 652098 - RNA, 18 nt, Human
guggggagcugugcccac

SEQ ID NO: 652099 - RNA, 24 nt, Human
guggggggagcuccuucccagccu

SEQ ID NO: 652100 - RNA, 24 nt, Human
guggggggagcuccuucccagccu

SEQ ID NO: 652101 - RNA, 19 nt, Human
uaaaguucgccgaucaccc

SEQ ID NO: 652102 - RNA, 18 nt, Human
uaacagcaucacacaugg

SEQ ID NO: 652103 - RNA, 18 nt, Human
uaacagcaucacacaugg

SEQ ID NO: 652104 - RNA, 20 nt, Human
uaaggcgggcacacccccaa

SEQ ID NO: 652105 - RNA, 21 nt, Human
uaaguacacaaauuaaugacc

SEQ ID NO: 652106 - RNA, 21 nt, Human
uaaguacacaaauuaaugacc

SEQ ID NO: 652107 - RNA, 20 nt, Human
uacaagacagagaaaacaca

SEQ ID NO: 652108 - RNA, 20 nt, Human
uacaagacagagaaaacaca

SEQ ID NO: 652109 - RNA, 26 nt, Human
uacaagacagagaaaacacauuacaa

SEQ ID NO: 652110 - RNA, 26 nt, Human
uacaagacagagaaaacacauuacaa

SEQ ID NO: 652111 - RNA, 22 nt, Human
uacaccaaacauccuacugccc

SEQ ID NO: 652112 - RNA, 21 nt, Human
uagaaaccaguaagaaaaucc

SEQ ID NO: 652113 - RNA, 26 nt, Human
uagaacacaaaauggacaccaaaaga

SEQ ID NO: 652114 - RNA, 26 nt, Human
uagaacacaaaauggacaccaaaaga

SEQ ID NO: 652115 - RNA, 18 nt, Human
uagcaaaccaguguacaa

SEQ ID NO: 652116 - RNA, 24 nt, Human
uagggggaagagcugggaaaggaa

SEQ ID NO: 652117 - RNA, 18 nt, Human
uaucacauucucuucacu

SEQ ID NO: 652118 - RNA, 18 nt, Human
uaucacauucucuucacu

SEQ ID NO: 652119 - RNA, 19 nt, Human
ucaagaacuggguguucuc

SEQ ID NO: 652120 - RNA, 21 nt, Human
ucacagacgagagcaacaagc

SEQ ID NO: 652121 - RNA, 19 nt, Human
ucacugacucuacccgcca

SEQ ID NO: 652122 - RNA, 18 nt, Human
uccccuucaguagaaacc

SEQ ID NO: 652123 - RNA, 18 nt, Human
uccccuucaguagaaacc

SEQ ID NO: 652124 - RNA, 18 nt, Human
ucccugagccaccuagcu

SEQ ID NO: 652125 - RNA, 19 nt, Human
ucccugagccaccuagcuu

SEQ ID NO: 652126 - RNA, 19 nt, Human
ucccugagccaccuagcuu

SEQ ID NO: 652127 - RNA, 20 nt, Human
uccuacugcccucucccaug

SEQ ID NO: 652128 - RNA, 20 nt, Human
uccugagcccaaaucagcuc

SEQ ID NO: 652129 - RNA, 20 nt, Human
uccugagcccaaaucagcuc

SEQ ID NO: 652130 - RNA, 28 nt, Human
ucguagggggaagagcugggaaaggaag

SEQ ID NO: 652131 - RNA, 20 nt, Human
ucuccaguggccaccaacga

SEQ ID NO: 652132 - RNA, 19 nt, Human
ugaaguuugaggagagagc

SEQ ID NO: 652133 - RNA, 23 nt, Human
ugacucuacccgccacaaagcgg

SEQ ID NO: 652134 - RNA, 23 nt, Human
ugacucuacccgccacaaagcgg

SEQ ID NO: 652135 - RNA, 18 nt, Human
ugagauggaacacaagcc

SEQ ID NO: 652136 - RNA, 23 nt, Human
ugagcaaacuggugggggcacag

SEQ ID NO: 652137 - RNA, 23 nt, Human
ugagcaaacuggugggggcacag

SEQ ID NO: 652138 - RNA, 19 nt, Human
ugaggagagagagagaaag

SEQ ID NO: 652139 - RNA, 22 nt, Human
ugaggagagagagagaaagaga

SEQ ID NO: 652140 - RNA, 25 nt, Human
ugaggagagagccaaagggaaggag

SEQ ID NO: 652141 - RNA, 24 nt, Human
ugccaaggagcccacaagggccug

SEQ ID NO: 652142 - RNA, 24 nt, Human
ugccaaggagcccacaagggccug

SEQ ID NO: 652143 - RNA, 19 nt, Human
ugcccugccccaauaccag

SEQ ID NO: 652144 - RNA, 19 nt, Human
ugcccugccccaauaccag

SEQ ID NO: 652145 - RNA, 25 nt, Human
uggaacacaagcccagaggguugcc

SEQ ID NO: 652146 - RNA, 18 nt, Human
uggcagagggaaaaaugg

SEQ ID NO: 652147 - RNA, 18 nt, Human
uggcagagggaaaaaugg

SEQ ID NO: 652148 - RNA, 19 nt, Human
ugggaaaggaagaguggua

SEQ ID NO: 652149 - RNA, 22 nt, Human
ugggaaaggaagagugguagaa

SEQ ID NO: 652150 - RNA, 19 nt, Human
uggggagacugagucugug

SEQ ID NO: 652151 - RNA, 27 nt, Human
uguacaaaaaugucacagacgagagca

SEQ ID NO: 652152 - RNA, 27 nt, Human
uguacaaaaaugucacagacgagagca

SEQ ID NO: 652153 - RNA, 20 nt, Human
uguccccacggcugucuggg

SEQ ID NO: 652154 - RNA, 19 nt, Human
uugcugacuuggggagacu

SEQ ID NO: 652155 - RNA, 24 nt, Human
uuuuuuuuuuuuuuuuuuuuucag

SEQ ID NO: 652156 - RNA, 20 nt, Human
aaagauaucucacccaaagc

SEQ ID NO: 652157 - RNA, 20 nt, Human
aacauggugaaacccugucu

SEQ ID NO: 652158 - RNA, 21 nt, Human
aacauggugaaacccugucuc

SEQ ID NO: 652159 - RNA, 19 nt, Human
aacccgcaacccuuauccc

SEQ ID NO: 652160 - RNA, 20 nt, Human
aacccuuauccccaacccuc

SEQ ID NO: 652161 - RNA, 24 nt, Human
aagauaucucacccaaagccccag

SEQ ID NO: 652162 - RNA, 22 nt, Human
aauacaaaaaaaguuagcugga

SEQ ID NO: 652163 - RNA, 24 nt, Human
aaucucuugaacccgguaggcaga

SEQ ID NO: 652164 - RNA, 21 nt, Human
acccuuauccccaacccucac

SEQ ID NO: 652165 - RNA, 24 nt, Human
accugaggucaggaguuugagacc

SEQ ID NO: 652166 - RNA, 24 nt, Human
agagguugcaggguugcagugagc

SEQ ID NO: 652167 - RNA, 24 nt, Human
agaugugguggcucaugccuguaa

SEQ ID NO: 652168 - RNA, 23 nt, Human
agcuggaugugguggcaggugcc

SEQ ID NO: 652169 - RNA, 20 nt, Human
aggaguuugagaccagugug

SEQ ID NO: 652170 - RNA, 21 nt, Human
aggcagagguugcaggguugc

SEQ ID NO: 652171 - RNA, 18 nt, Human
aggcaggcggaucaccug

SEQ ID NO: 652172 - RNA, 22 nt, Human
aggcaggcggaucaccugaggu

SEQ ID NO: 652173 - RNA, 26 nt, Human
aggcaggcggaucaccugaggucagg

SEQ ID NO: 652174 - RNA, 24 nt, Human
aggcaggggaaucucuugaacccg

SEQ ID NO: 652175 - RNA, 23 nt, Human
aggcaucauaucuccuguaguug

SEQ ID NO: 652176 - RNA, 22 nt, Human
aggccagaugugguggcucaug

SEQ ID NO: 652177 - RNA, 24 nt, Human
aggccagaugugguggcucaugcc

SEQ ID NO: 652178 - RNA, 24 nt, Human
aggcugaggcaggggaaucucuug

SEQ ID NO: 652179 - RNA, 24 nt, Human
aguguggccaacauggugaaaccc

SEQ ID NO: 652180 - RNA, 23 nt, Human
augaggcaucauaucuccuguag

SEQ ID NO: 652181 - RNA, 19 nt, Human
augccuguaaucccagcac

SEQ ID NO: 652182 - RNA, 25 nt, Human
caaaaaaaguuagcuggauguggug

SEQ ID NO: 652183 - RNA, 24 nt, Human
caacauggugaaacccugucucua

SEQ ID NO: 652184 - RNA, 19 nt, Human
caacccgcaacccuuaucc

SEQ ID NO: 652185 - RNA, 21 nt, Human
caacccgcaacccuuaucccc

SEQ ID NO: 652186 - RNA, 23 nt, Human
caacccgcaacccuuauccccaa

SEQ ID NO: 652187 - RNA, 21 nt, Human
cacaacucgagggagcccuuc

SEQ ID NO: 652188 - RNA, 18 nt, Human
cacccuucgacaacccgc

SEQ ID NO: 652189 - RNA, 21 nt, Human
cacccuucgacaacccgcaac

SEQ ID NO: 652190 - RNA, 23 nt, Human
caccugaggucaggaguuugaga

SEQ ID NO: 652191 - RNA, 23 nt, Human
cagcacuuugggggccgaggcag

SEQ ID NO: 652192 - RNA, 25 nt, Human
cagcacuuugggggccgaggcaggc

SEQ ID NO: 652193 - RNA, 23 nt, Human
cagcagucgggugcauagucugu

SEQ ID NO: 652194 - RNA, 24 nt, Human
cagcuacuugggaggcugaggcag

SEQ ID NO: 652195 - RNA, 24 nt, Human
caggcggaucaccugaggucagga

SEQ ID NO: 652196 - RNA, 22 nt, Human
cccaaagccccacuucuggcuc

SEQ ID NO: 652197 - RNA, 23 nt, Human
cccaaagccccacuucuggcucc

SEQ ID NO: 652198 - RNA, 21 nt, Human
ccccaacccucacuuuuuccc

SEQ ID NO: 652199 - RNA, 23 nt, Human
cccgcaacccuuauccccaaccc

SEQ ID NO: 652200 - RNA, 21 nt, Human
cccgguaggcagagguugcag

SEQ ID NO: 652201 - RNA, 20 nt, Human
ccucacuuuuucccauccac

SEQ ID NO: 652202 - RNA, 22 nt, Human
ccugaggucaggaguuugagac

SEQ ID NO: 652203 - RNA, 20 nt, Human
ccuguaaucccagcacuuug

SEQ ID NO: 652204 - RNA, 22 nt, Human
ccuguaaucccagcacuuuggg

SEQ ID NO: 652205 - RNA, 18 nt, Human
ccuguaauuccagcuacu

SEQ ID NO: 652206 - RNA, 19 nt, Human
ccuguaauuccagcuacuu

SEQ ID NO: 652207 - RNA, 21 nt, Human
ccuguaauuccagcuacuugg

SEQ ID NO: 652208 - RNA, 22 nt, Human
ccuguaauuccagcuacuuggg

SEQ ID NO: 652209 - RNA, 20 nt, Human
cgaggcaggcggaucaccug

SEQ ID NO: 652210 - RNA, 24 nt, Human
cggaucaccugaggucaggaguuu

SEQ ID NO: 652211 - RNA, 19 nt, Human
cucacuuuuucccauccac

SEQ ID NO: 652212 - RNA, 24 nt, Human
cucaugccuguaaucccagcacuu

SEQ ID NO: 652213 - RNA, 23 nt, Human
cugcccuacugcuauuguuuugu

SEQ ID NO: 652214 - RNA, 19 nt, Human
gaacagcagcagucgggug

SEQ ID NO: 652215 - RNA, 25 nt, Human
gaggcaggcggaucaccugagguca

SEQ ID NO: 652216 - RNA, 21 nt, Human
gaucaccugaggucaggaguu

SEQ ID NO: 652217 - RNA, 24 nt, Human
gaucaccugaggucaggaguuuga

SEQ ID NO: 652218 - RNA, 21 nt, Human
gcaaagauaucucacccaaag

SEQ ID NO: 652219 - RNA, 24 nt, Human
gccaacauggugaaacccugucuc

SEQ ID NO: 652220 - RNA, 23 nt, Human
ggagcccuuccuucaguauacuu

SEQ ID NO: 652221 - RNA, 22 nt, Human
ggaucaccugaggucaggaguu

SEQ ID NO: 652222 - RNA, 25 nt, Human
ggaucaccugaggucaggaguuuga

SEQ ID NO: 652223 - RNA, 21 nt, Human
gggccgaggcaggcggaucac

SEQ ID NO: 652224 - RNA, 19 nt, Human
ggucaggaguuugagacca

SEQ ID NO: 652225 - RNA, 24 nt, Human
gguggcucaugccuguaaucccag

SEQ ID NO: 652226 - RNA, 23 nt, Human
guggcaggugccuguaauuccag

SEQ ID NO: 652227 - RNA, 19 nt, Human
guggccaacauggugaaac

SEQ ID NO: 652228 - RNA, 23 nt, Human
guggcucaugccuguaaucccag

SEQ ID NO: 652229 - RNA, 22 nt, Human
uagcuggaugugguggcaggug

SEQ ID NO: 652230 - RNA, 18 nt, Human
ucacccaaagccccacuu

SEQ ID NO: 652231 - RNA, 19 nt, Human
ucaccugaggucaggaguu

SEQ ID NO: 652232 - RNA, 22 nt, Human
ucaugccuguaaucccagcacu

SEQ ID NO: 652233 - RNA, 21 nt, Human
ucgagggagcccuuccuucag

SEQ ID NO: 652234 - RNA, 21 nt, Human
ugagaccaguguggccaacau

SEQ ID NO: 652235 - RNA, 24 nt, Human
ugagaccaguguggccaacauggu

SEQ ID NO: 652236 - RNA, 24 nt, Human
ugaggcaggggaaucucuugaacc

SEQ ID NO: 652237 - RNA, 25 nt, Human
ugaggcaggggaaucucuugaaccc

SEQ ID NO: 652238 - RNA, 18 nt, Human
ugaggucaggaguuugag

SEQ ID NO: 652239 - RNA, 23 nt, Human
ugccuguaaucccagcacuuugg

SEQ ID NO: 652240 - RNA, 23 nt, Human
ugccuguaaucccagcacuuugg

SEQ ID NO: 652241 - RNA, 24 nt, Human
ugccuguaauuccagcuacuuggg

SEQ ID NO: 652242 - RNA, 22 nt, Human
uggcaggugccuguaauuccag

SEQ ID NO: 652243 - RNA, 20 nt, Human
uggccaacauggugaaaccc

SEQ ID NO: 652244 - RNA, 23 nt, Human
uggccaacauggugaaacccugu

SEQ ID NO: 652245 - RNA, 24 nt, Human
uggccaacauggugaaacccuguc

SEQ ID NO: 652246 - RNA, 22 nt, Human
uggcucaugccuguaaucccag

SEQ ID NO: 652247 - RNA, 24 nt, Human
uggcucaugccuguaaucccagca

SEQ ID NO: 652248 - RNA, 18 nt, Human
ugggaggcugaggcaggg

SEQ ID NO: 652249 - RNA, 23 nt, Human
ugggggccgaggcaggcggauca

SEQ ID NO: 652250 - RNA, 24 nt, Human
ugguggcaggugccuguaauucca

SEQ ID NO: 652251 - RNA, 24 nt, Human
ugguggcucaugccuguaauccca

SEQ ID NO: 652252 - RNA, 21 nt, Human
uguauacauguuaucugugca

SEQ ID NO: 652253 - RNA, 24 nt, Human
uguggccaacauggugaaacccug

SEQ ID NO: 652254 - RNA, 24 nt, Human
uuagcuggaugugguggcaggugc

SEQ ID NO: 652255 - RNA, 18 nt, Human
uugcaggguugcagugag

SEQ ID NO: 652256 - RNA, 22 nt, Human
uugggaggcugaggcaggggaa

SEQ ID NO: 652257 - RNA, 20 nt, Human
uuugaacuaugauguauaca

SEQ ID NO: 652258 - RNA, 25 nt, Human
uuuuuuuaauuuacuaaauauuucu

SEQ ID NO: 652259 - RNA, 20 nt, Human
agguucuagaacagugaucu

SEQ ID NO: 652260 - RNA, 20 nt, Human
ccccugccucauggccugca

SEQ ID NO: 652261 - RNA, 24 nt, Human
ccguccuggagagggucuggcugu

SEQ ID NO: 652262 - RNA, 22 nt, Human
ccucauggccugcaugugggcc

SEQ ID NO: 652263 - RNA, 21 nt, Human
ccugcagcccgcuuuggcccc

SEQ ID NO: 652264 - RNA, 22 nt, Human
cucccaugccugggcuugugcu

SEQ ID NO: 652265 - RNA, 23 nt, Human
cuggugacgugauagcagccccu

SEQ ID NO: 652266 - RNA, 21 nt, Human
cuguuucucccaugccugggc

SEQ ID NO: 652267 - RNA, 20 nt, Human
uagcauccaaggcagaccau

SEQ ID NO: 652268 - RNA, 22 nt, Human
ugcagcccgcuuuggccccagg

SEQ ID NO: 652269 - RNA, 22 nt, Human
ugccugggcuugugcuaaugug

SEQ ID NO: 652270 - RNA, 23 nt, Human
uuuggccccaggccguccuggag

SEQ ID NO: 652271 - RNA, 25 nt, Human
uuuuuuuuuuuuuuuucuccagggg

SEQ ID NO: 652272 - RNA, 19 nt, Human
aagcacagaggggagaggg

SEQ ID NO: 652273 - RNA, 20 nt, Human
caagcacagaggggagaggg

SEQ ID NO: 652274 - RNA, 18 nt, Human
caccccacccuguuguag

SEQ ID NO: 652275 - RNA, 18 nt, Human
cagaguaacucggccugu

SEQ ID NO: 652276 - RNA, 20 nt, Human
caucacccacugcuagguag

SEQ ID NO: 652277 - RNA, 23 nt, Human
ccccucccucccuuuccccccca

SEQ ID NO: 652278 - RNA, 22 nt, Human
cccucccaccccacccuguugu

SEQ ID NO: 652279 - RNA, 19 nt, Human
cccuguuguagccccuccu

SEQ ID NO: 652280 - RNA, 23 nt, Human
ccuacccccuccccauccagggg

SEQ ID NO: 652281 - RNA, 24 nt, Human
ccucccaccccacccuguuguagc

SEQ ID NO: 652282 - RNA, 25 nt, Human
ccucccaccccacccuguuguagcc

SEQ ID NO: 652283 - RNA, 21 nt, Human
ccucccucccuuuccccccca

SEQ ID NO: 652284 - RNA, 24 nt, Human
ccucccucccuuucccccccaagc

SEQ ID NO: 652285 - RNA, 20 nt, Human
cgaauaaacagagagacgcu

SEQ ID NO: 652286 - RNA, 21 nt, Human
cucccaccccacccuguugua

SEQ ID NO: 652287 - RNA, 21 nt, Human
cuccuacccccuccccaucca

SEQ ID NO: 652288 - RNA, 20 nt, Human
ggagaggggccagggaagug

SEQ ID NO: 652289 - RNA, 20 nt, Human
guagccccuccuacccccuc

SEQ ID NO: 652290 - RNA, 20 nt, Human
uagccccuccuacccccucc

SEQ ID NO: 652291 - RNA, 21 nt, Human
uccggagccgccagagggccc

SEQ ID NO: 652292 - RNA, 20 nt, Human
ucuccuccccucccacccca

SEQ ID NO: 652293 - RNA, 18 nt, Human
uguagccccuccuacccc

SEQ ID NO: 652294 - RNA, 19 nt, Human
uguguccaucacccacugc

SEQ ID NO: 652295 - RNA, 24 nt, Human
uuacauucugggggguuaggggga

SEQ ID NO: 652296 - RNA, 18 nt, Human
uuagggggagucccccuc

SEQ ID NO: 652297 - RNA, 21 nt, Human
uuguagccccuccuacccccu

SEQ ID NO: 652298 - RNA, 26 nt, Human
uuuuuuuuuuuuuuuuucggccuuuu

SEQ ID NO: 652299 - RNA, 23 nt, Human
uuuuuuuuuuuuuuuuuuuucgg

SEQ ID NO: 652300 - RNA, 21 nt, Human
aaaagauacaggccugcccuc

SEQ ID NO: 652301 - RNA, 22 nt, Human
aaaggcugucuucagcaaacac

SEQ ID NO: 652302 - RNA, 25 nt, Human
aacagaaauaaaaauucugaccaaa

SEQ ID NO: 652303 - RNA, 22 nt, Human
aagagaaaugcugaagcuuucu

SEQ ID NO: 652304 - RNA, 19 nt, Human
aagauacaggccugcccuc

SEQ ID NO: 652305 - RNA, 19 nt, Human
aauaagugauuguggcaca

SEQ ID NO: 652306 - RNA, 18 nt, Human
acaacaggcaccuuaaac

SEQ ID NO: 652307 - RNA, 18 nt, Human
acaaguaacucaugaaag

SEQ ID NO: 652308 - RNA, 24 nt, Human
acagaaguaaaagauacaggccug

SEQ ID NO: 652309 - RNA, 21 nt, Human
acagaggagggaggacccaga

SEQ ID NO: 652310 - RNA, 22 nt, Human
accaaauaacucugugcucugc

SEQ ID NO: 652311 - RNA, 18 nt, Human
accagcucacaggcaaga

SEQ ID NO: 652312 - RNA, 20 nt, Human
acggaggaggcagagaaaag

SEQ ID NO: 652313 - RNA, 19 nt, Human
acuugaacuaccaauuccc

SEQ ID NO: 652314 - RNA, 19 nt, Human
agaaaaguagaagacauga

SEQ ID NO: 652315 - RNA, 20 nt, Human
agaccugaggcugugcccug

SEQ ID NO: 652316 - RNA, 20 nt, Human
agagaaaagcuuccacagug

SEQ ID NO: 652317 - RNA, 24 nt, Human
agaggccacaggucggcugugagc

SEQ ID NO: 652318 - RNA, 20 nt, Human
agaugggggauggcuucaga

SEQ ID NO: 652319 - RNA, 20 nt, Human
aggaagacagcgugcuguug

SEQ ID NO: 652320 - RNA, 27 nt, Human
aggcaagagaaaggaccacguuucugg

SEQ ID NO: 652321 - RNA, 22 nt, Human
aggccacaggucggcugugagc

SEQ ID NO: 652322 - RNA, 19 nt, Human
aggccgauguuugcuuaua

SEQ ID NO: 652323 - RNA, 22 nt, Human
aguaacucaugaaaggcaaugc

SEQ ID NO: 652324 - RNA, 23 nt, Human
auaaaaauucugaccaaaucuua

SEQ ID NO: 652325 - RNA, 24 nt, Human
auagaguuaaaauaauagcaucaa

SEQ ID NO: 652326 - RNA, 21 nt, Human
aucuccuaucugaaugaaaau

SEQ ID NO: 652327 - RNA, 26 nt, Human
augaacagaaauaaaaauucugacca

SEQ ID NO: 652328 - RNA, 19 nt, Human
augcagucaaaagcugugg

SEQ ID NO: 652329 - RNA, 19 nt, Human
auuauagucaaagccacug

SEQ ID NO: 652330 - RNA, 19 nt, Human
caaguaacucaugaaaggc

SEQ ID NO: 652331 - RNA, 23 nt, Human
cagcgugcuguuggggcacagag

SEQ ID NO: 652332 - RNA, 24 nt, Human
cagcucacaggcaagagaaaggac

SEQ ID NO: 652333 - RNA, 22 nt, Human
cagcuugcauggaguugccgca

SEQ ID NO: 652334 - RNA, 19 nt, Human
cucaagccccaugccccuc

SEQ ID NO: 652335 - RNA, 19 nt, Human
cucacaggcaagagaaagg

SEQ ID NO: 652336 - RNA, 18 nt, Human
cugagaauaacaagguaa

SEQ ID NO: 652337 - RNA, 18 nt, Human
cugcaccagcucacaggc

SEQ ID NO: 652338 - RNA, 18 nt, Human
cugugucuagggaagaug

SEQ ID NO: 652339 - RNA, 18 nt, Human
gaacacaaggaggacaag

SEQ ID NO: 652340 - RNA, 22 nt, Human
gaacuaccaauucccucaaacu

SEQ ID NO: 652341 - RNA, 22 nt, Human
gagggcuggacacaggggggug

SEQ ID NO: 652342 - RNA, 22 nt, Human
gaucgcuuauuuaauaagugau

SEQ ID NO: 652343 - RNA, 24 nt, Human
gcaaacaccaaauaacucugugcu

SEQ ID NO: 652344 - RNA, 19 nt, Human
gcagagaaaagcuuccaca

SEQ ID NO: 652345 - RNA, 24 nt, Human
gcccucaagaaacuuugguucuau

SEQ ID NO: 652346 - RNA, 19 nt, Human
gcuuccacaguguaugaac

SEQ ID NO: 652347 - RNA, 18 nt, Human
ggaagaaggaaugaagga

SEQ ID NO: 652348 - RNA, 21 nt, Human
gguguggggagagaugagaag

SEQ ID NO: 652349 - RNA, 27 nt, Human
guagaagacaugaacagaaauaaaaau

SEQ ID NO: 652350 - RNA, 25 nt, Human
uacuucaguagcucuggaguuucaa

SEQ ID NO: 652351 - RNA, 19 nt, Human
uagaagguccaauaggaag

SEQ ID NO: 652352 - RNA, 20 nt, Human
uagcaagagaaaugcugaag

SEQ ID NO: 652353 - RNA, 22 nt, Human
uccaugggauggaaagagaaac

SEQ ID NO: 652354 - RNA, 18 nt, Human
uccucaagccccaugccc

SEQ ID NO: 652355 - RNA, 18 nt, Human
ucucagaugucugcugug

SEQ ID NO: 652356 - RNA, 21 nt, Human
ucuccaacaguggaugagugu

SEQ ID NO: 652357 - RNA, 19 nt, Human
ugaauggaucucauuuggu

SEQ ID NO: 652358 - RNA, 22 nt, Human
ugagacacuuuucugaaucugu

SEQ ID NO: 652359 - RNA, 24 nt, Human
ugcaccagcucacaggcaagagaa

SEQ ID NO: 652360 - RNA, 18 nt, Human
ugccugagaauaacaagg

SEQ ID NO: 652361 - RNA, 21 nt, Human
uggaaagagaaacagagggcu

SEQ ID NO: 652362 - RNA, 18 nt, Human
ugggaagcacuccauggg

SEQ ID NO: 652363 - RNA, 20 nt, Human
ugggauggaaagagaaacag

SEQ ID NO: 652364 - RNA, 24 nt, Human
uuaacauaaauguaagacauugcc

SEQ ID NO: 652365 - RNA, 19 nt, Human
uucuggucucccggccacg

SEQ ID NO: 652366 - RNA, 18 nt, Human
uuuuuuuuuuuuuuuuug

SEQ ID NO: 652367 - RNA, 23 nt, Human
uuuuuuuuuuuuuuuuuuugagg

SEQ ID NO: 652368 - RNA, 21 nt, Human
aaacucccucuuuaugcagac

SEQ ID NO: 652369 - RNA, 24 nt, Human
aaagugcugggauuacaggcguga

SEQ ID NO: 652370 - RNA, 24 nt, Human
aaaguuuugggauuacaagaguga

SEQ ID NO: 652371 - RNA, 25 nt, Human
aagcgauccucccaccucaaccucc

SEQ ID NO: 652372 - RNA, 25 nt, Human
aagcgauccucccaccucaaccucc

SEQ ID NO: 652373 - RNA, 25 nt, Human
aagcgauccucccaccuuggccucc

SEQ ID NO: 652374 - RNA, 22 nt, Human
aagugcaguggcgugaucucgg

SEQ ID NO: 652375 - RNA, 19 nt, Human
aagugcugggauuacaggc

SEQ ID NO: 652376 - RNA, 19 nt, Human
aagugcugggauuacaggc

SEQ ID NO: 652377 - RNA, 26 nt, Human
aagugcugggauuacaggcgugagcc

SEQ ID NO: 652378 - RNA, 23 nt, Human
acaggguuuacuguguuggccag

SEQ ID NO: 652379 - RNA, 24 nt, Human
acaggguuuacuguguuggccagg

SEQ ID NO: 652380 - RNA, 18 nt, Human
acaggguuuuaccguguu

SEQ ID NO: 652381 - RNA, 19 nt, Human
acaggguuuuaccguguua

SEQ ID NO: 652382 - RNA, 20 nt, Human
acaggguuuuaccguguuag

SEQ ID NO: 652383 - RNA, 24 nt, Human
acaggguuuuaccguguuagccag

SEQ ID NO: 652384 - RNA, 22 nt, Human
acccaggcugaagugcaguggc

SEQ ID NO: 652385 - RNA, 23 nt, Human
accucaaccuccauaguagcugg

SEQ ID NO: 652386 - RNA, 24 nt, Human
accuugugauccgccugccucggc

SEQ ID NO: 652387 - RNA, 18 nt, Human
acugcaagcucugccucc

SEQ ID NO: 652388 - RNA, 18 nt, Human
acuguguuggccaggcug

SEQ ID NO: 652389 - RNA, 23 nt, Human
acuguguuggccaggcuggucuc

SEQ ID NO: 652390 - RNA, 27 nt, Human
agaaggucucuuucugucacccaggcu

SEQ ID NO: 652391 - RNA, 18 nt, Human
agacaggguuuuaccgug

SEQ ID NO: 652392 - RNA, 19 nt, Human
agagacaggguuuuaccgu

SEQ ID NO: 652393 - RNA, 18 nt, Human
agccuccagaguagcugg

SEQ ID NO: 652394 - RNA, 18 nt, Human
agcucugccuccuggguu

SEQ ID NO: 652395 - RNA, 24 nt, Human
aggcugaagugcaguggcacgauc

SEQ ID NO: 652396 - RNA, 19 nt, Human
aguagcugggacuacaggc

SEQ ID NO: 652397 - RNA, 19 nt, Human
aguagcugggacuacaggc

SEQ ID NO: 652398 - RNA, 25 nt, Human
aguagcugggacuacaggcgcuugc

SEQ ID NO: 652399 - RNA, 20 nt, Human
agugcaguggcacgaucuug

SEQ ID NO: 652400 - RNA, 23 nt, Human
agugcaguggcacgaucuuggcu

SEQ ID NO: 652401 - RNA, 24 nt, Human
agugcaguggcacgaucuuggcuc

SEQ ID NO: 652402 - RNA, 19 nt, Human
agugcaguggcgugaucuc

SEQ ID NO: 652403 - RNA, 20 nt, Human
agugcaguggcgugaucucg

SEQ ID NO: 652404 - RNA, 23 nt, Human
agugcaguggcgugaucucggcu

SEQ ID NO: 652405 - RNA, 24 nt, Human
agugcaguggcgugaucucggcuc

SEQ ID NO: 652406 - RNA, 18 nt, Human
agugcugggauuacaggc

SEQ ID NO: 652407 - RNA, 23 nt, Human
auaguagcugggacuacaggcac

SEQ ID NO: 652408 - RNA, 25 nt, Human
caaacuccugggcucaagcgauccu

SEQ ID NO: 652409 - RNA, 24 nt, Human
caaagugcugggauuacaggcgug

SEQ ID NO: 652410 - RNA, 19 nt, Human
caagcgauccucccaccuu

SEQ ID NO: 652411 - RNA, 27 nt, Human
caagcgauccucccaccuuggccuccu

SEQ ID NO: 652412 - RNA, 19 nt, Human
cacacaccaccaugcucag

SEQ ID NO: 652413 - RNA, 24 nt, Human
cacaccaccaugcucagcuaauuu

SEQ ID NO: 652414 - RNA, 22 nt, Human
cacgccauucuccugccucagc

SEQ ID NO: 652415 - RNA, 19 nt, Human
cacggcgcccagcccccaa

SEQ ID NO: 652416 - RNA, 23 nt, Human
cacugcaagcucugccuccuggg

SEQ ID NO: 652417 - RNA, 23 nt, Human
caggguuuacuguguuggccagg

SEQ ID NO: 652418 - RNA, 24 nt, Human
caggguuuuaccguguuagccagg

SEQ ID NO: 652419 - RNA, 19 nt, Human
caguggcacgaucuuggcu

SEQ ID NO: 652420 - RNA, 21 nt, Human
cauggaggguggugcccccga

SEQ ID NO: 652421 - RNA, 20 nt, Human
caugggcucaagcgauccuc

SEQ ID NO: 652422 - RNA, 22 nt, Human
ccaaagugcugggauuacaggc

SEQ ID NO: 652423 - RNA, 22 nt, Human
ccaaagugcugggauuacaggc

SEQ ID NO: 652424 - RNA, 24 nt, Human
ccaaagugcugggauuacaggcgu

SEQ ID NO: 652425 - RNA, 24 nt, Human
ccagaguagcugggacuacaggcg

SEQ ID NO: 652426 - RNA, 25 nt, Human
cccaaaacucccucuuuaugcagac

SEQ ID NO: 652427 - RNA, 18 nt, Human
cccagaagcugggcuugc

SEQ ID NO: 652428 - RNA, 22 nt, Human
cccagcccccaaaacucccucu

SEQ ID NO: 652429 - RNA, 18 nt, Human
ccccaaaacucccucuuu

SEQ ID NO: 652430 - RNA, 25 nt, Human
ccucccaccucaaccuccauaguag

SEQ ID NO: 652431 - RNA, 18 nt, Human
ccucccaccuuggccucc

SEQ ID NO: 652432 - RNA, 24 nt, Human
ccuccuggguucacgccauucucc

SEQ ID NO: 652433 - RNA, 24 nt, Human
ccugccucagccuccagaguagcu

SEQ ID NO: 652434 - RNA, 20 nt, Human
ccugggcucaagcgauccuc

SEQ ID NO: 652435 - RNA, 24 nt, Human
cgcugugucgcccaggcucaagug

SEQ ID NO: 652436 - RNA, 23 nt, Human
cggcgcccagcccccaaaacucc

SEQ ID NO: 652437 - RNA, 24 nt, Human
cuaaaguuuugggauuacaagagu

SEQ ID NO: 652438 - RNA, 24 nt, Human
cucaagcgauccucccaccucaac

SEQ ID NO: 652439 - RNA, 24 nt, Human
cucaagcgauccucccaccuuggc

SEQ ID NO: 652440 - RNA, 24 nt, Human
cucacugcaagcucugccuccugg

SEQ ID NO: 652441 - RNA, 24 nt, Human
cucagccuccagaguagcugggac

SEQ ID NO: 652442 - RNA, 24 nt, Human
cuccugaccuugugauccgccugc

SEQ ID NO: 652443 - RNA, 23 nt, Human
cuccugggcucaagcgauccucc

SEQ ID NO: 652444 - RNA, 21 nt, Human
cuccuggguucacgccauucu

SEQ ID NO: 652445 - RNA, 19 nt, Human
cucuuucugucacccaggc

SEQ ID NO: 652446 - RNA, 19 nt, Human
cugcaagcucugccuccug

SEQ ID NO: 652447 - RNA, 23 nt, Human
cugccucggccucccaaagugcu

SEQ ID NO: 652448 - RNA, 20 nt, Human
cuuuaugcagaccuccccuc

SEQ ID NO: 652449 - RNA, 22 nt, Human
gaccuugugauccgccugccuc

SEQ ID NO: 652450 - RNA, 24 nt, Human
gaccuugugauccgccugccucgg

SEQ ID NO: 652451 - RNA, 22 nt, Human
gacuacaggcacacaccaccau

SEQ ID NO: 652452 - RNA, 24 nt, Human
gacuacaggcgcuugccaccaugc

SEQ ID NO: 652453 - RNA, 19 nt, Human
gagacaggguuuacugugu

SEQ ID NO: 652454 - RNA, 18 nt, Human
gauuacaagagugagcca

SEQ ID NO: 652455 - RNA, 18 nt, Human
gauuacaggcgugagcca

SEQ ID NO: 652456 - RNA, 22 nt, Human
gauuacaggcgugagccacugc

SEQ ID NO: 652457 - RNA, 22 nt, Human
gauuacaggcgugagccacugc

SEQ ID NO: 652458 - RNA, 24 nt, Human
gcccaggcucaagugcaguggcgu

SEQ ID NO: 652459 - RNA, 24 nt, Human
gccuggcuaauuuuuuuguauuuu

SEQ ID NO: 652460 - RNA, 19 nt, Human
gcugaagugcaguggcacg

SEQ ID NO: 652461 - RNA, 20 nt, Human
ggagacaggguuuacugugu

SEQ ID NO: 652462 - RNA, 22 nt, Human
ggagucucgcugugucgcccag

SEQ ID NO: 652463 - RNA, 22 nt, Human
ggcucaagugcaguggcgugau

SEQ ID NO: 652464 - RNA, 21 nt, Human
ggguuuacuguguuggccagg

SEQ ID NO: 652465 - RNA, 21 nt, Human
gugaucucggcucacugcaag

SEQ ID NO: 652466 - RNA, 26 nt, Human
uaauuuuuuuguauuuuuaguagaga

SEQ ID NO: 652467 - RNA, 19 nt, Human
uacaggcgugagccacugc

SEQ ID NO: 652468 - RNA, 23 nt, Human
uacaggcgugagccacugcgccc

SEQ ID NO: 652469 - RNA, 24 nt, Human
uaccguguuagccaggauagucuu

SEQ ID NO: 652470 - RNA, 21 nt, Human
uaccugcaaaggcauggaggg

SEQ ID NO: 652471 - RNA, 21 nt, Human
uacuguguuggccaggcuggu

SEQ ID NO: 652472 - RNA, 22 nt, Human
uagagacaggguuuuaccgugu

SEQ ID NO: 652473 - RNA, 21 nt, Human
uaguagagacaggguuuuacc

SEQ ID NO: 652474 - RNA, 24 nt, Human
uaguagagacaggguuuuaccgug

SEQ ID NO: 652475 - RNA, 25 nt, Human
uaguagcugggacuacaggcacaca

SEQ ID NO: 652476 - RNA, 21 nt, Human
uaugcagaccuccccucucuc

SEQ ID NO: 652477 - RNA, 25 nt, Human
ucaagcgauccucccaccuuggccu

SEQ ID NO: 652478 - RNA, 24 nt, Human
ucaagugcaguggcgugaucucgg

SEQ ID NO: 652479 - RNA, 18 nt, Human
ucacugcaagcucugccu

SEQ ID NO: 652480 - RNA, 23 nt, Human
ucacugcaagcucugccuccugg

SEQ ID NO: 652481 - RNA, 24 nt, Human
ucacugcaagcucugccuccuggg

SEQ ID NO: 652482 - RNA, 24 nt, Human
ucacuguaaccugggccucauggg

SEQ ID NO: 652483 - RNA, 24 nt, Human
uccagaguagcugggacuacaggc

SEQ ID NO: 652484 - RNA, 24 nt, Human
uccauaguagcugggacuacaggc

SEQ ID NO: 652485 - RNA, 24 nt, Human
ucccaaagugcugggauuacaggc

SEQ ID NO: 652486 - RNA, 19 nt, Human
ucccagaagcugggcuugc

SEQ ID NO: 652487 - RNA, 21 nt, Human
ucccuucccagaagcugggcu

SEQ ID NO: 652488 - RNA, 18 nt, Human
uccuaaaguuuugggauu

SEQ ID NO: 652489 - RNA, 21 nt, Human
uccugggcucaagcgauccuc

SEQ ID NO: 652490 - RNA, 24 nt, Human
uccugggcucaagcgauccuccca

SEQ ID NO: 652491 - RNA, 24 nt, Human
uccuggguucacgccauucuccug

SEQ ID NO: 652492 - RNA, 22 nt, Human
ucucaaacuccugggcucaagc

SEQ ID NO: 652493 - RNA, 21 nt, Human
ucucccuucccagaagcuggg

SEQ ID NO: 652494 - RNA, 24 nt, Human
ucuccugccucagccuccagagua

SEQ ID NO: 652495 - RNA, 19 nt, Human
ucucgcugugucgcccagg

SEQ ID NO: 652496 - RNA, 24 nt, Human
ucucgcugugucgcccaggcucaa

SEQ ID NO: 652497 - RNA, 24 nt, Human
ucucuuucugucacccaggcugaa

SEQ ID NO: 652498 - RNA, 24 nt, Human
ucugucacccaggcugaagugcag

SEQ ID NO: 652499 - RNA, 22 nt, Human
ucuuucugucacccaggcugaa

SEQ ID NO: 652500 - RNA, 24 nt, Human
ucuuucugucacccaggcugaagu

SEQ ID NO: 652501 - RNA, 24 nt, Human
ugaagugcaguggcacgaucuugg

SEQ ID NO: 652502 - RNA, 22 nt, Human
ugcaguggcacgaucuuggcuc

SEQ ID NO: 652503 - RNA, 24 nt, Human
ugccucagccuccagaguagcugg

SEQ ID NO: 652504 - RNA, 19 nt, Human
ugccuccuggguucacgcc

SEQ ID NO: 652505 - RNA, 21 nt, Human
ugccucggccucccaaagugc

SEQ ID NO: 652506 - RNA, 24 nt, Human
ugccucggccucccaaagugcugg

SEQ ID NO: 652507 - RNA, 24 nt, Human
ugcugggauuacaggcgugagcca

SEQ ID NO: 652508 - RNA, 18 nt, Human
uggaggguggugcccccg

SEQ ID NO: 652509 - RNA, 24 nt, Human
uggagucucgcugugucgcccagg

SEQ ID NO: 652510 - RNA, 24 nt, Human
uggcacgaucuuggcucacuguaa

SEQ ID NO: 652511 - RNA, 24 nt, Human
uggccaggcuggucucaaacuccu

SEQ ID NO: 652512 - RNA, 20 nt, Human
uggcgugaucucggcucacu

SEQ ID NO: 652513 - RNA, 21 nt, Human
ugggacuacaggcacacacca

SEQ ID NO: 652514 - RNA, 22 nt, Human
ugggacuacaggcacacaccac

SEQ ID NO: 652515 - RNA, 24 nt, Human
ugggacuacaggcacacaccacca

SEQ ID NO: 652516 - RNA, 21 nt, Human
ugggacuacaggcgcuugcca

SEQ ID NO: 652517 - RNA, 22 nt, Human
ugggacuacaggcgcuugccac

SEQ ID NO: 652518 - RNA, 24 nt, Human
ugggacuacaggcgcuugccacca

SEQ ID NO: 652519 - RNA, 25 nt, Human
ugggacuacaggcgcuugccaccau

SEQ ID NO: 652520 - RNA, 21 nt, Human
ugggauuacaagagugagcca

SEQ ID NO: 652521 - RNA, 22 nt, Human
ugggauuacaagagugagccac

SEQ ID NO: 652522 - RNA, 18 nt, Human
ugggauuacaggcgugag

SEQ ID NO: 652523 - RNA, 19 nt, Human
ugggauuacaggcgugagc

SEQ ID NO: 652524 - RNA, 21 nt, Human
ugggauuacaggcgugagcca

SEQ ID NO: 652525 - RNA, 22 nt, Human
ugggauuacaggcgugagccac

SEQ ID NO: 652526 - RNA, 22 nt, Human
ugggauuacaggcgugagccac

SEQ ID NO: 652527 - RNA, 24 nt, Human
ugggauuacaggcgugagccacug

SEQ ID NO: 652528 - RNA, 26 nt, Human
ugggauuacaggcgugagccacugcg

SEQ ID NO: 652529 - RNA, 20 nt, Human
uggguucacgccauucuccu

SEQ ID NO: 652530 - RNA, 23 nt, Human
uguggagacaggguuuacugugu

SEQ ID NO: 652531 - RNA, 24 nt, Human
ugugucgcccaggcucaagugcag

SEQ ID NO: 652532 - RNA, 23 nt, Human
uguguuggccaggcuggucucaa

SEQ ID NO: 652533 - RNA, 24 nt, Human
uguguuggccaggcuggucucaaa

SEQ ID NO: 652534 - RNA, 22 nt, Human
uguuggccaggcuggucucaaa

SEQ ID NO: 652535 - RNA, 22 nt, Human
uguuuuguuuuguuuugagaug

SEQ ID NO: 652536 - RNA, 24 nt, Human
uuaccguguuagccaggauagucu

SEQ ID NO: 652537 - RNA, 22 nt, Human
uuaguagagacaggguuuuacc

SEQ ID NO: 652538 - RNA, 24 nt, Human
uuaguagagacaggguuuuaccgu

SEQ ID NO: 652539 - RNA, 22 nt, Human
uuuguggagacaggguuuacug

SEQ ID NO: 652540 - RNA, 23 nt, Human
uuuguggagacaggguuuacugu

SEQ ID NO: 652541 - RNA, 19 nt, Human
uuuguuuuguuuuguuuug

SEQ ID NO: 652542 - RNA, 21 nt, Human
uuuuuaguagagacaggguuu

SEQ ID NO: 652543 - RNA, 21 nt, Human
uuuuuguauuuuuaguagaga

SEQ ID NO: 652544 - RNA, 21 nt, Human
uuuuuuguauuuuuaguagag

SEQ ID NO: 652545 - RNA, 24 nt, Human
uuuuuuguauuuuuaguagagaca

SEQ ID NO: 652546 - RNA, 18 nt, Human
uuuuuuuuuuuuuuuuug

SEQ ID NO: 652547 - RNA, 21 nt, Human
aaaagcaaaacuggacucaac

SEQ ID NO: 652548 - RNA, 23 nt, Human
aaaccgaaucacugcagagacaa

SEQ ID NO: 652549 - RNA, 22 nt, Human
aacccaaaagugacuuaaaagu

SEQ ID NO: 652550 - RNA, 24 nt, Human
aagcggccccgggccggcgaaaaa

SEQ ID NO: 652551 - RNA, 19 nt, Human
acauuauuaaaaagcaaaa

SEQ ID NO: 652552 - RNA, 18 nt, Human
agaacauaacuucauuga

SEQ ID NO: 652553 - RNA, 20 nt, Human
agcaaagucaacaaagagua

SEQ ID NO: 652554 - RNA, 18 nt, Human
agcagagcugccuggguu

SEQ ID NO: 652555 - RNA, 21 nt, Human
agcaggugaaaggccuggaac

SEQ ID NO: 652556 - RNA, 21 nt, Human
agcugccuggguuggugucag

SEQ ID NO: 652557 - RNA, 20 nt, Human
aggagaagccacagcagagc

SEQ ID NO: 652558 - RNA, 23 nt, Human
aguaccuagucccugaaaauggc

SEQ ID NO: 652559 - RNA, 22 nt, Human
auaagcagcaaagucaacaaag

SEQ ID NO: 652560 - RNA, 22 nt, Human
aucacuucugguuaguccacuu

SEQ ID NO: 652561 - RNA, 23 nt, Human
augccagagcccaggagaagcca

SEQ ID NO: 652562 - RNA, 22 nt, Human
cacagcagccaccuguucugac

SEQ ID NO: 652563 - RNA, 23 nt, Human
cacagcagccaccuguucugaca

SEQ ID NO: 652564 - RNA, 24 nt, Human
cacagcagccaccuguucugacaa

SEQ ID NO: 652565 - RNA, 18 nt, Human
cacaggccaagccugggg

SEQ ID NO: 652566 - RNA, 18 nt, Human
cacauuauuaaaaagcaa

SEQ ID NO: 652567 - RNA, 18 nt, Human
caggucaccugccaggug

SEQ ID NO: 652568 - RNA, 24 nt, Human
ccaaaagugacuuaaaaguaaaaa

SEQ ID NO: 652569 - RNA, 20 nt, Human
ccaaauagccauuucaaggc

SEQ ID NO: 652570 - RNA, 18 nt, Human
ccaauaagcagcaaaguc

SEQ ID NO: 652571 - RNA, 24 nt, Human
ccaggacaaggggaaccagcaggg

SEQ ID NO: 652572 - RNA, 27 nt, Human
ccccgguccgcagcugagcggcugcgc

SEQ ID NO: 652573 - RNA, 22 nt, Human
ccgccucagggcccccagcugu

SEQ ID NO: 652574 - RNA, 19 nt, Human
ccucagggcccccagcugu

SEQ ID NO: 652575 - RNA, 22 nt, Human
ccucagggcccccagcugugag

SEQ ID NO: 652576 - RNA, 20 nt, Human
ccucccaggacaaggggaac

SEQ ID NO: 652577 - RNA, 18 nt, Human
cgaaaccgaaagcggccc

SEQ ID NO: 652578 - RNA, 20 nt, Human
cgacggaagcucgggagcuc

SEQ ID NO: 652579 - RNA, 19 nt, Human
cgagggcggcggcagcgcu

SEQ ID NO: 652580 - RNA, 23 nt, Human
cgcgccuucagucagagggagcc

SEQ ID NO: 652581 - RNA, 23 nt, Human
cggcgaaaaacagaaccugugcg

SEQ ID NO: 652582 - RNA, 19 nt, Human
cggcggcagcgcuggcgga

SEQ ID NO: 652583 - RNA, 20 nt, Human
cggcggcggacgcuggcugg

SEQ ID NO: 652584 - RNA, 19 nt, Human
cuaaugccgcgaugcucag

SEQ ID NO: 652585 - RNA, 20 nt, Human
cuccaggucaccugccaggu

SEQ ID NO: 652586 - RNA, 25 nt, Human
cucuuuugugacauguguggcacaa

SEQ ID NO: 652587 - RNA, 19 nt, Human
cuggcgggcggcucucgca

SEQ ID NO: 652588 - RNA, 25 nt, Human
gaaaaacagaaccugugcgcccucc

SEQ ID NO: 652589 - RNA, 18 nt, Human
gaagcuacuccuccaggu

SEQ ID NO: 652590 - RNA, 22 nt, Human
gagcccaggagaagccacagca

SEQ ID NO: 652591 - RNA, 19 nt, Human
gccacgcccccgguccgca

SEQ ID NO: 652592 - RNA, 18 nt, Human
gcgcccucgccacgcccc

SEQ ID NO: 652593 - RNA, 21 nt, Human
gcucagugucgcccaggccaa

SEQ ID NO: 652594 - RNA, 19 nt, Human
ggacucaacuacaaucacu

SEQ ID NO: 652595 - RNA, 18 nt, Human
ggcaccacacagcagcca

SEQ ID NO: 652596 - RNA, 19 nt, Human
ggcccggagcgcgggcugu

SEQ ID NO: 652597 - RNA, 19 nt, Human
ggcgggcggcucucgcagg

SEQ ID NO: 652598 - RNA, 21 nt, Human
ggcuguggcuguggcggcucg

SEQ ID NO: 652599 - RNA, 24 nt, Human
gggaaccagcagggacucgauggc

SEQ ID NO: 652600 - RNA, 23 nt, Human
gggcuguggcuguggcggcucgc

SEQ ID NO: 652601 - RNA, 22 nt, Human
ggggguccucggggaagcuacu

SEQ ID NO: 652602 - RNA, 24 nt, Human
guaccuagucccugaaaauggcuu

SEQ ID NO: 652603 - RNA, 21 nt, Human
guggcggcucgcgggggucag

SEQ ID NO: 652604 - RNA, 21 nt, Human
uaacuucauugagaggucaau

SEQ ID NO: 652605 - RNA, 23 nt, Human
ucaaucucacagggauguuaaaa

SEQ ID NO: 652606 - RNA, 24 nt, Human
ucaccugccagguggaugcacuuc

SEQ ID NO: 652607 - RNA, 24 nt, Human
ucagucagagggagccucgaggga

SEQ ID NO: 652608 - RNA, 18 nt, Human
uccagugugcuuaggaaa

SEQ ID NO: 652609 - RNA, 19 nt, Human
ucccaggacaaggggaacc

SEQ ID NO: 652610 - RNA, 18 nt, Human
ucgccacgcccccggucc

SEQ ID NO: 652611 - RNA, 21 nt, Human
ugaaaggccuggaacacuccu

SEQ ID NO: 652612 - RNA, 22 nt, Human
ugacaaugugacacagaccaac

SEQ ID NO: 652613 - RNA, 20 nt, Human
ugagaaaccgaaucacugca

SEQ ID NO: 652614 - RNA, 22 nt, Human
ugagaaaccgaaucacugcaga

SEQ ID NO: 652615 - RNA, 19 nt, Human
ugagaggucaauguuaaga

SEQ ID NO: 652616 - RNA, 18 nt, Human
ugcacuuccuugggcaau

SEQ ID NO: 652617 - RNA, 24 nt, Human
ugcagagacaaacucauaaaaauu

SEQ ID NO: 652618 - RNA, 21 nt, Human
ugccagguggaugcacuuccu

SEQ ID NO: 652619 - RNA, 18 nt, Human
ugccaugagacucugaga

SEQ ID NO: 652620 - RNA, 21 nt, Human
ugccuggguuggugucagagc

SEQ ID NO: 652621 - RNA, 23 nt, Human
ugcuuaggaaauguggguuugcg

SEQ ID NO: 652622 - RNA, 18 nt, Human
uggcaccacacagcagcc

SEQ ID NO: 652623 - RNA, 18 nt, Human
uggugccaauaagcagca

SEQ ID NO: 652624 - RNA, 23 nt, Human
ugugacacagaccaacuaaugcc

SEQ ID NO: 652625 - RNA, 20 nt, Human
uucaaggcagagcaggugaa

SEQ ID NO: 652626 - RNA, 23 nt, Human
uuuaaaaagaaaaggaaaggccc

SEQ ID NO: 652627 - RNA, 22 nt, Human
uuuuuuuuuuuuuuuuucggau

SEQ ID NO: 652628 - RNA, 25 nt, Human
uuuuuuuuuuuuuuuuuuuuuucgg

SEQ ID NO: 652629 - RNA, 19 nt, Human
aacagguugagaucuggag

SEQ ID NO: 652630 - RNA, 18 nt, Human
agaggacccagaggagga

SEQ ID NO: 652631 - RNA, 23 nt, Human
aguccuggaaggccuuccuggag

SEQ ID NO: 652632 - RNA, 22 nt, Human
auggagagcaggcccuacuucc

SEQ ID NO: 652633 - RNA, 22 nt, Human
cauccccaugcaucccucugcc

SEQ ID NO: 652634 - RNA, 18 nt, Human
ccagaggaggaaguccug

SEQ ID NO: 652635 - RNA, 24 nt, Human
ccuggaggaggggcugucagagcu

SEQ ID NO: 652636 - RNA, 18 nt, Human
gagcaggcccuacuucca

SEQ ID NO: 652637 - RNA, 19 nt, Human
gagucccuguagggucaga

SEQ ID NO: 652638 - RNA, 19 nt, Human
ggagcugcaagaggaaaag

SEQ ID NO: 652639 - RNA, 19 nt, Human
gucccuguagggucagagc

SEQ ID NO: 652640 - RNA, 18 nt, Human
uccaggagaaagcgaccc

SEQ ID NO: 652641 - RNA, 23 nt, Human
uccccaugcaucccucugcccau

SEQ ID NO: 652642 - RNA, 20 nt, Human
uccuggaaggccuuccugga

SEQ ID NO: 652643 - RNA, 25 nt, Human
ugcaagaggaaaagcugagagauac

SEQ ID NO: 652644 - RNA, 22 nt, Human
ugggauggagagcaggcccuac

SEQ ID NO: 652645 - RNA, 23 nt, Human
uuugcaauccaggagaaagcgac

SEQ ID NO: 652646 - RNA, 23 nt, Human
uuuuuuuuuuuuuuuuuuuuagg

SEQ ID NO: 652647 - RNA, 19 nt, Human
aaaauguuauaaaccauga

SEQ ID NO: 652648 - RNA, 21 nt, Human
aacugacgaaccuacauauca

SEQ ID NO: 652649 - RNA, 22 nt, Human
aauguaccaucuccuaaacaac

SEQ ID NO: 652650 - RNA, 21 nt, Human
accugcauucccuucuuguug

SEQ ID NO: 652651 - RNA, 28 nt, Human
acucccacacaugcacagccuuccccau

SEQ ID NO: 652652 - RNA, 20 nt, Human
agagaugucccauacaccuu

SEQ ID NO: 652653 - RNA, 22 nt, Human
agcccccaacagagggauacau

SEQ ID NO: 652654 - RNA, 22 nt, Human
agggauacauuuguuaacaacu

SEQ ID NO: 652655 - RNA, 20 nt, Human
aucauuaucacccaaagucc

SEQ ID NO: 652656 - RNA, 24 nt, Human
caacuagaaaaauucaguuuucaa

SEQ ID NO: 652657 - RNA, 18 nt, Human
cacaaggaagugaauguu

SEQ ID NO: 652658 - RNA, 23 nt, Human
cauaucauuaucacccaaagucc

SEQ ID NO: 652659 - RNA, 27 nt, Human
cccaaaguccacaguuuauauuauucc

SEQ ID NO: 652660 - RNA, 24 nt, Human
cccacacaugcacagccuucccca

SEQ ID NO: 652661 - RNA, 19 nt, Human
cccagcaggcccacagccg

SEQ ID NO: 652662 - RNA, 21 nt, Human
cccauacaccuccuacuccca

SEQ ID NO: 652663 - RNA, 19 nt, Human
ccccacccccagcaggccc

SEQ ID NO: 652664 - RNA, 20 nt, Human
cgcuucgggcccccaccccc

SEQ ID NO: 652665 - RNA, 23 nt, Human
cuagaaaaauucaguuuucaaaa

SEQ ID NO: 652666 - RNA, 24 nt, Human
cuagcaauuuccucucggcuuucu

SEQ ID NO: 652667 - RNA, 23 nt, Human
cucaacucuuuuauuuaguccaa

SEQ ID NO: 652668 - RNA, 18 nt, Human
gaagccucucacauucuu

SEQ ID NO: 652669 - RNA, 20 nt, Human
gagaauuuucaaauacagaa

SEQ ID NO: 652670 - RNA, 29 nt, Human
gcccccaacagagggauacauuuguuaac

SEQ ID NO: 652671 - RNA, 23 nt, Human
gcccccacccccagcaggcccac

SEQ ID NO: 652672 - RNA, 22 nt, Human
gcuucgggcccccacccccagc

SEQ ID NO: 652673 - RNA, 21 nt, Human
ggcccccacccccagcaggcc

SEQ ID NO: 652674 - RNA, 28 nt, Human
uaagggcaacagcgaagacuggagaccc

SEQ ID NO: 652675 - RNA, 24 nt, Human
uaccaggaauaaacuagcaauuuc

SEQ ID NO: 652676 - RNA, 24 nt, Human
uagcaaaauugauuagaagguaca

SEQ ID NO: 652677 - RNA, 22 nt, Human
uaguucugaucaucuguuuaau

SEQ ID NO: 652678 - RNA, 21 nt, Human
uccaaaagaaaaagaagaaaa

SEQ ID NO: 652679 - RNA, 23 nt, Human
uccaaaagaaaaagaagaaaaug

SEQ ID NO: 652680 - RNA, 26 nt, Human
uccacaguuuauauuauuccuucugg

SEQ ID NO: 652681 - RNA, 21 nt, Human
ucccacacaugcacagccuuc

SEQ ID NO: 652682 - RNA, 21 nt, Human
uccuucuggagaauuuucaaa

SEQ ID NO: 652683 - RNA, 21 nt, Human
ucgggcccccacccccagcag

SEQ ID NO: 652684 - RNA, 20 nt, Human
ugauaguucugaucaucugu

SEQ ID NO: 652685 - RNA, 24 nt, Human
ugucccauacaccuccuacuccca

SEQ ID NO: 652686 - RNA, 18 nt, Human
uguuauaaaccaugaaaa

SEQ ID NO: 652687 - RNA, 18 nt, Human
uuacauauaucagcuuca

SEQ ID NO: 652688 - RNA, 24 nt, Human
uuagagcaguuuuaaguucauagc

SEQ ID NO: 652689 - RNA, 23 nt, Human
uuaguccaaaagaaaaagaagaa

SEQ ID NO: 652690 - RNA, 22 nt, Human
uuaucacccaaaguccacaguu

SEQ ID NO: 652691 - RNA, 18 nt, Human
uucauagcaaaauugauu

SEQ ID NO: 652692 - RNA, 20 nt, Human
aaacaucuaaaauacacuga

SEQ ID NO: 652693 - RNA, 18 nt, Human
aaccauuuaauagccaaa

SEQ ID NO: 652694 - RNA, 26 nt, Human
acggggucagaaagcaucuccaccuc

SEQ ID NO: 652695 - RNA, 19 nt, Human
agaaagcaucuccaccucu

SEQ ID NO: 652696 - RNA, 31 nt, Human
cauuuucaucacaaaaaguaacauugggagg

SEQ ID NO: 652697 - RNA, 19 nt, Human
cucuuucuaugucugguuu

SEQ ID NO: 652698 - RNA, 22 nt, Human
guaaaccauuuaauagccaaaa

SEQ ID NO: 652699 - RNA, 18 nt, Human
uaaacucucuaaauucuu

SEQ ID NO: 652700 - RNA, 25 nt, Human
uaauagccaaaagucagaauuuaaa

SEQ ID NO: 652701 - RNA, 22 nt, Human
uaguagaugcuguauucaacac

SEQ ID NO: 652702 - RNA, 21 nt, Human
uccaacggucacuuugcugcc

SEQ ID NO: 652703 - RNA, 19 nt, Human
uccacgaagcaaucggaaa

SEQ ID NO: 652704 - RNA, 18 nt, Human
ucggaaagcuucaaguuc

SEQ ID NO: 652705 - RNA, 22 nt, Human
ucuccaccucucucccgccgug

SEQ ID NO: 652706 - RNA, 23 nt, Human
ucuuucucuuucuaugucugguu

SEQ ID NO: 652707 - RNA, 21 nt, Human
uggcuuauuguguaaaccauu

SEQ ID NO: 652708 - RNA, 21 nt, Human
uggcuuauuguguaaaccauu

SEQ ID NO: 652709 - RNA, 25 nt, Human
uggcuuauuguguaaaccauuuaau

SEQ ID NO: 652710 - RNA, 18 nt, Human
uuuucgggcuccuuugca

SEQ ID NO: 652711 - RNA, 26 nt, Human
uuuuuuuuuuuuuuuuucucauaaaa

SEQ ID NO: 652712 - RNA, 18 nt, Human
aaaaccuucagcugcagc

SEQ ID NO: 652713 - RNA, 19 nt, Human
aaagcccuagagccuagca

SEQ ID NO: 652714 - RNA, 18 nt, Human
aagacaaaaucacaagga

SEQ ID NO: 652715 - RNA, 21 nt, Human
aagagaagcucacaccagcuc

SEQ ID NO: 652716 - RNA, 21 nt, Human
aagcagaugagcaggaaagcc

SEQ ID NO: 652717 - RNA, 22 nt, Human
aagcagaugagcaggaaagccc

SEQ ID NO: 652718 - RNA, 23 nt, Human
aaggagagacucuuuccuuaagg

SEQ ID NO: 652719 - RNA, 18 nt, Human
aaggugaugagaagacag

SEQ ID NO: 652720 - RNA, 24 nt, Human
acaccagcucggguucagcagccu

SEQ ID NO: 652721 - RNA, 21 nt, Human
acccccaaggaagaggcuggc

SEQ ID NO: 652722 - RNA, 22 nt, Human
accuucauucuggccccggauu

SEQ ID NO: 652723 - RNA, 24 nt, Human
acucauuccagauacaaacaacuu

SEQ ID NO: 652724 - RNA, 25 nt, Human
agaaacaaaugagaagcagaugagc

SEQ ID NO: 652725 - RNA, 21 nt, Human
agaagcagaugagcaggaaag

SEQ ID NO: 652726 - RNA, 23 nt, Human
agagaagcucacaccagcucggg

SEQ ID NO: 652727 - RNA, 22 nt, Human
aggaagaggcuggcaagcagaa

SEQ ID NO: 652728 - RNA, 19 nt, Human
agugcagaaacaaaugaga

SEQ ID NO: 652729 - RNA, 23 nt, Human
auacaaacaacuuuaaagacaaa

SEQ ID NO: 652730 - RNA, 23 nt, Human
auguucaaccugauuuucuggcu

SEQ ID NO: 652731 - RNA, 24 nt, Human
auucaaggugaugagaagacaggu

SEQ ID NO: 652732 - RNA, 22 nt, Human
auugaaugaacauauauaaaug

SEQ ID NO: 652733 - RNA, 18 nt, Human
auuguccagggggaugag

SEQ ID NO: 652734 - RNA, 19 nt, Human
caagagaagcucacaccag

SEQ ID NO: 652735 - RNA, 28 nt, Human
cacacagcagcagcggagucacguaauc

SEQ ID NO: 652736 - RNA, 22 nt, Human
caccuuuagacuuugaacauuu

SEQ ID NO: 652737 - RNA, 19 nt, Human
cagaaacaaaugagaagca

SEQ ID NO: 652738 - RNA, 19 nt, Human
cagcagccucccucuccac

SEQ ID NO: 652739 - RNA, 22 nt, Human
cagcagcggagucacguaaucc

SEQ ID NO: 652740 - RNA, 20 nt, Human
cagcuggguuagugcaucuc

SEQ ID NO: 652741 - RNA, 22 nt, Human
caggugcaggugggcacccaua

SEQ ID NO: 652742 - RNA, 22 nt, Human
cauagugcagaaacaaaugaga

SEQ ID NO: 652743 - RNA, 18 nt, Human
ccacugggcucaggaagc

SEQ ID NO: 652744 - RNA, 19 nt, Human
ccagaagaacccaaguccu

SEQ ID NO: 652745 - RNA, 25 nt, Human
ccagaagaacccaaguccugcucca

SEQ ID NO: 652746 - RNA, 24 nt, Human
ccauagcugggcugcugaccugga

SEQ ID NO: 652747 - RNA, 24 nt, Human
cccacugggcucaggaagcuccag

SEQ ID NO: 652748 - RNA, 22 nt, Human
ccccccucagaugaacaacuaa

SEQ ID NO: 652749 - RNA, 18 nt, Human
ccccugggaccucuugcc

SEQ ID NO: 652750 - RNA, 22 nt, Human
ccgccugaaaaccuucagcugc

SEQ ID NO: 652751 - RNA, 20 nt, Human
ccucuccacacagcagcagc

SEQ ID NO: 652752 - RNA, 21 nt, Human
ccuucagcccgccugaaaacc

SEQ ID NO: 652753 - RNA, 22 nt, Human
cggcaaauaaacaaucauuccc

SEQ ID NO: 652754 - RNA, 23 nt, Human
cuaacacgugcuccuggccaccc

SEQ ID NO: 652755 - RNA, 22 nt, Human
cuaaguaaaaauuaaaaccaaa

SEQ ID NO: 652756 - RNA, 24 nt, Human
cuacuucugagcagagcucuuaac

SEQ ID NO: 652757 - RNA, 20 nt, Human
cuccuggguucugagguccu

SEQ ID NO: 652758 - RNA, 21 nt, Human
cuccuggguucugagguccuc

SEQ ID NO: 652759 - RNA, 22 nt, Human
cucggguucagcagccucccuc

SEQ ID NO: 652760 - RNA, 19 nt, Human
cuggcuuccaguauuuugg

SEQ ID NO: 652761 - RNA, 20 nt, Human
gaaauaaaaucaauacagau

SEQ ID NO: 652762 - RNA, 19 nt, Human
gaagaagcggcccagccuu

SEQ ID NO: 652763 - RNA, 23 nt, Human
gaagcagaugagcaggaaagccc

SEQ ID NO: 652764 - RNA, 21 nt, Human
gaaugaacauauauaaaugaa

SEQ ID NO: 652765 - RNA, 18 nt, Human
gacacuaauuaguguugu

SEQ ID NO: 652766 - RNA, 18 nt, Human
gauucugggucaguacuc

SEQ ID NO: 652767 - RNA, 21 nt, Human
gcccgccugaaaaccuucagc

SEQ ID NO: 652768 - RNA, 19 nt, Human
ggccagcaaguggcaaagg

SEQ ID NO: 652769 - RNA, 22 nt, Human
gggcuuuuccacgaagugccag

SEQ ID NO: 652770 - RNA, 20 nt, Human
guguguuggcuguguucucu

SEQ ID NO: 652771 - RNA, 22 nt, Human
uaaaggaaucugggagucaaaa

SEQ ID NO: 652772 - RNA, 22 nt, Human
uaacacgugcuccuggccaccc

SEQ ID NO: 652773 - RNA, 23 nt, Human
uaaggacacuguuguuuuuggag

SEQ ID NO: 652774 - RNA, 20 nt, Human
uacagauugugcauggggag

SEQ ID NO: 652775 - RNA, 21 nt, Human
uauuuuggcucauuaaacagg

SEQ ID NO: 652776 - RNA, 19 nt, Human
ucaagaguaaauagcaguc

SEQ ID NO: 652777 - RNA, 21 nt, Human
ucaauguuccucuuugguuug

SEQ ID NO: 652778 - RNA, 21 nt, Human
uccacacagcagcagcggagu

SEQ ID NO: 652779 - RNA, 19 nt, Human
ucccucuccacacagcagc

SEQ ID NO: 652780 - RNA, 20 nt, Human
uccuggguucugagguccuc

SEQ ID NO: 652781 - RNA, 18 nt, Human
ucuccacggaacaaaagc

SEQ ID NO: 652782 - RNA, 25 nt, Human
ucugaaaugaaugaagaagcggccc

SEQ ID NO: 652783 - RNA, 22 nt, Human
ucuucaucuucuucuuuuucuu

SEQ ID NO: 652784 - RNA, 25 nt, Human
ucuuugguuuguaacaagaaccacu

SEQ ID NO: 652785 - RNA, 21 nt, Human
ugaaagcuguuuucccgguug

SEQ ID NO: 652786 - RNA, 23 nt, Human
ugaaagcuguuuucccgguugag

SEQ ID NO: 652787 - RNA, 19 nt, Human
ugaaugaagaagcggccca

SEQ ID NO: 652788 - RNA, 21 nt, Human
ugaccagaucaaccaguccaa

SEQ ID NO: 652789 - RNA, 24 nt, Human
ugacggcaaauaaacaaucauucc

SEQ ID NO: 652790 - RNA, 23 nt, Human
ugagaagacaggugcaggugggc

SEQ ID NO: 652791 - RNA, 20 nt, Human
ugagaagcagaugagcagga

SEQ ID NO: 652792 - RNA, 21 nt, Human
ugagaagcagaugagcaggaa

SEQ ID NO: 652793 - RNA, 23 nt, Human
ugcagaaacaaaugagaagcaga

SEQ ID NO: 652794 - RNA, 21 nt, Human
ugcagaugaaggagacauucu

SEQ ID NO: 652795 - RNA, 19 nt, Human
ugcagcggcuacuucugag

SEQ ID NO: 652796 - RNA, 23 nt, Human
ugcaucuccacggaacaaaagca

SEQ ID NO: 652797 - RNA, 19 nt, Human
ugccugaggcugacaaaga

SEQ ID NO: 652798 - RNA, 20 nt, Human
uggcaagcagaaugguggcu

SEQ ID NO: 652799 - RNA, 23 nt, Human
uggcuccuggguucugagguccu

SEQ ID NO: 652800 - RNA, 21 nt, Human
uggcuuccaguauuuuggcuc

SEQ ID NO: 652801 - RNA, 24 nt, Human
ugugaacaaggccuaguuaccaaa

SEQ ID NO: 652802 - RNA, 19 nt, Human
uguggggcucccacugggc

SEQ ID NO: 652803 - RNA, 24 nt, Human
uguguagaaggcccacuguucaag

SEQ ID NO: 652804 - RNA, 18 nt, Human
uguguuuuagaaaaccac

SEQ ID NO: 652805 - RNA, 25 nt, Human
uuaaccagacuaacacgugcuccug

SEQ ID NO: 652806 - RNA, 22 nt, Human
uucaacacauccagcuggguua

SEQ ID NO: 652807 - RNA, 21 nt, Human
uucagaauuuaugauggucaa

SEQ ID NO: 652808 - RNA, 23 nt, Human
uucagcccgccugaaaaccuuca

SEQ ID NO: 652809 - RNA, 22 nt, Human
uucauguucaaccugauuuucu

SEQ ID NO: 652810 - RNA, 19 nt, Human
uuccucuggcuccuggguu

SEQ ID NO: 652811 - RNA, 23 nt, Human
uugaaugaacauauauaaaugaa

SEQ ID NO: 652812 - RNA, 24 nt, Human
uuggccagcaaguggcaaaggaga

SEQ ID NO: 652813 - RNA, 22 nt, Human
uuucuggcuuccaguauuuugg

SEQ ID NO: 652814 - RNA, 23 nt, Human
uuuuuuuuuuuuuuuuuuuuagg

SEQ ID NO: 652815 - RNA, 25 nt, Human
acacgguagccccugaguaugucug

SEQ ID NO: 652816 - RNA, 21 nt, Human
accacugccccuuacccccac

SEQ ID NO: 652817 - RNA, 19 nt, Human
agagcauccugccuucacc

SEQ ID NO: 652818 - RNA, 19 nt, Human
aggaaauaaauuugaccag

SEQ ID NO: 652819 - RNA, 20 nt, Human
agggaccugucugaggccuc

SEQ ID NO: 652820 - RNA, 23 nt, Human
agggagcaccugggccagccugu

SEQ ID NO: 652821 - RNA, 18 nt, Human
agggagggagcaccuggg

SEQ ID NO: 652822 - RNA, 23 nt, Human
agucauaucuagaaaagguccag

SEQ ID NO: 652823 - RNA, 23 nt, Human
caaccacacccucugcuggcagg

SEQ ID NO: 652824 - RNA, 19 nt, Human
caccuucauccuugggaca

SEQ ID NO: 652825 - RNA, 25 nt, Human
caccuucauccuugggacacagcuc

SEQ ID NO: 652826 - RNA, 20 nt, Human
cacugccccuuacccccacc

SEQ ID NO: 652827 - RNA, 27 nt, Human
ccaagcaccacccucccgcaaugcuaa

SEQ ID NO: 652828 - RNA, 20 nt, Human
ccacacccucugcuggcagg

SEQ ID NO: 652829 - RNA, 23 nt, Human
ccacaccuucauccuugggacac

SEQ ID NO: 652830 - RNA, 20 nt, Human
cccacagccacaccuucauc

SEQ ID NO: 652831 - RNA, 22 nt, Human
cccacagccacaccuucauccu

SEQ ID NO: 652832 - RNA, 20 nt, Human
cccccaccaacacaaacaca

SEQ ID NO: 652833 - RNA, 23 nt, Human
ccccuuacccccaccaacacaaa

SEQ ID NO: 652834 - RNA, 24 nt, Human
ccucagacuccuucagggaccugu

SEQ ID NO: 652835 - RNA, 20 nt, Human
ccuccaaccacacccucugc

SEQ ID NO: 652836 - RNA, 26 nt, Human
ccugcaggaagggagggagcaccugg

SEQ ID NO: 652837 - RNA, 20 nt, Human
ccugggccagccugugaucg

SEQ ID NO: 652838 - RNA, 25 nt, Human
cucuggagccucagacuccuucagg

SEQ ID NO: 652839 - RNA, 21 nt, Human
cugaggccuccaaccacaccc

SEQ ID NO: 652840 - RNA, 22 nt, Human
cugaggccuccaaccacacccu

SEQ ID NO: 652841 - RNA, 23 nt, Human
cugucugaggccuccaaccacac

SEQ ID NO: 652842 - RNA, 22 nt, Human
cuuacccccaccaacacaaaca

SEQ ID NO: 652843 - RNA, 21 nt, Human
gagccgcaucccaccccuuga

SEQ ID NO: 652844 - RNA, 21 nt, Human
gccugcaggaagggagggagc

SEQ ID NO: 652845 - RNA, 22 nt, Human
gggagggagcaccugggccagc

SEQ ID NO: 652846 - RNA, 26 nt, Human
ggugaccaagcaccacccucccgcaa

SEQ ID NO: 652847 - RNA, 21 nt, Human
gugaccaagcaccacccuccc

SEQ ID NO: 652848 - RNA, 18 nt, Human
uaaaacucccauaugaca

SEQ ID NO: 652849 - RNA, 23 nt, Human
uaaaacucccauaugacauccuc

SEQ ID NO: 652850 - RNA, 19 nt, Human
uacacucaaggguccugga

SEQ ID NO: 652851 - RNA, 18 nt, Human
uacccccaccaacacaaa

SEQ ID NO: 652852 - RNA, 19 nt, Human
uaugacauccucuggagcc

SEQ ID NO: 652853 - RNA, 19 nt, Human
ucauaucuagaaaaggucc

SEQ ID NO: 652854 - RNA, 22 nt, Human
ucuccugcaggagccgcauccc

SEQ ID NO: 652855 - RNA, 22 nt, Human
uggcgaauggccauuucuauaa

SEQ ID NO: 652856 - RNA, 21 nt, Human
uucuggguugacccauuaucc

SEQ ID NO: 652857 - RNA, 23 nt, Human
uucuucuuuuuuuguuuuuguug

SEQ ID NO: 652858 - RNA, 21 nt, Human
uuuucuucuuuuuuuguuuuu

SEQ ID NO: 652859 - RNA, 20 nt, Human
uuuuuguuuuuguuguuguu

SEQ ID NO: 652860 - RNA, 24 nt, Human
uuuuuuguuuuuguuguuguuuau

SEQ ID NO: 652861 - RNA, 25 nt, Human
uuuuuuuuuuuuuuuuuuuauuuuu

SEQ ID NO: 652862 - RNA, 21 nt, Human
aaaaaaaccagcuuuuuuggg

SEQ ID NO: 652863 - RNA, 22 nt, Human
aagcuuuauugguguguuugag

SEQ ID NO: 652864 - RNA, 22 nt, Human
aagugacaaaugccgagaggaa

SEQ ID NO: 652865 - RNA, 18 nt, Human
agcggggcccucucccca

SEQ ID NO: 652866 - RNA, 19 nt, Human
agcuggugggugcauuagc

SEQ ID NO: 652867 - RNA, 19 nt, Human
augcugggccccaagccgg

SEQ ID NO: 652868 - RNA, 19 nt, Human
cagcccagcggggcccucu

SEQ ID NO: 652869 - RNA, 25 nt, Human
cagcggggcccucuccccagggguc

SEQ ID NO: 652870 - RNA, 19 nt, Human
caggaggcuuccuggaauu

SEQ ID NO: 652871 - RNA, 23 nt, Human
cagggccagcccagcggggcccc

SEQ ID NO: 652872 - RNA, 21 nt, Human
cccagcggggcccucucccca

SEQ ID NO: 652873 - RNA, 19 nt, Human
ccccaagccggcucagcuu

SEQ ID NO: 652874 - RNA, 18 nt, Human
ccccagggguccuggggg

SEQ ID NO: 652875 - RNA, 22 nt, Human
cccucuccccagggguccuggg

SEQ ID NO: 652876 - RNA, 19 nt, Human
cccuuggagggacagaggu

SEQ ID NO: 652877 - RNA, 18 nt, Human
ccugcagggccagcccag

SEQ ID NO: 652878 - RNA, 23 nt, Human
cugggccccaagccggcucagga

SEQ ID NO: 652879 - RNA, 19 nt, Human
ggagggacagaggugggug

SEQ ID NO: 652880 - RNA, 27 nt, Human
ggcaccagagaaauucaccaggaaaaa

SEQ ID NO: 652881 - RNA, 19 nt, Human
gggguccugggggccugug

SEQ ID NO: 652882 - RNA, 21 nt, Human
gguguguuugagcuggugggu

SEQ ID NO: 652883 - RNA, 19 nt, Human
uccccagggguccuggggg

SEQ ID NO: 652884 - RNA, 24 nt, Human
uccccagggguccugggggccugu

SEQ ID NO: 652885 - RNA, 25 nt, Human
ugagggcaccagagaaauuggagac

SEQ ID NO: 652886 - RNA, 26 nt, Human
ugcccuuggagggacagaggugggug

SEQ ID NO: 652887 - RNA, 21 nt, Human
ugcugggccccaagccggcuc

SEQ ID NO: 652888 - RNA, 20 nt, Human
ugggccccaagccggcucag

SEQ ID NO: 652889 - RNA, 23 nt, Human
ugggccccaagccggcucagcuu

SEQ ID NO: 652890 - RNA, 23 nt, Human
ugggggccuguguaugcugggcc

SEQ ID NO: 652891 - RNA, 18 nt, Human
uuuuuuuuuuuuuuuuug

SEQ ID NO: 652892 - RNA, 18 nt, Human
aaacaggaggccagccuu

SEQ ID NO: 652893 - RNA, 19 nt, Human
aagccugacaagcuccccc

SEQ ID NO: 652894 - RNA, 19 nt, Human
agccuuggccaucuucagc

SEQ ID NO: 652895 - RNA, 19 nt, Human
agggccaggauguccacgu

SEQ ID NO: 652896 - RNA, 22 nt, Human
agucagccucagacgguuccag

SEQ ID NO: 652897 - RNA, 24 nt, Human
aguguggagagcugaagauuucuc

SEQ ID NO: 652898 - RNA, 19 nt, Human
auccugcccucgucgcccu

SEQ ID NO: 652899 - RNA, 24 nt, Human
caccaaacaggaggccagccuugg

SEQ ID NO: 652900 - RNA, 21 nt, Human
caccaggucaauguugcucau

SEQ ID NO: 652901 - RNA, 23 nt, Human
cagggccccgucguccccgaagg

SEQ ID NO: 652902 - RNA, 19 nt, Human
cauguccuccauguaacac

SEQ ID NO: 652903 - RNA, 20 nt, Human
ccagacccagguccaccagg

SEQ ID NO: 652904 - RNA, 20 nt, Human
ccccgucguccccgaaggcc

SEQ ID NO: 652905 - RNA, 24 nt, Human
ccccgucguccccgaaggcccccc

SEQ ID NO: 652906 - RNA, 19 nt, Human
ccggagccguuccaccuuc

SEQ ID NO: 652907 - RNA, 20 nt, Human
ccuccagggccccgucgucc

SEQ ID NO: 652908 - RNA, 19 nt, Human
ccuucuuguucucccggag

SEQ ID NO: 652909 - RNA, 22 nt, Human
cucagugcgaauguccuccagg

SEQ ID NO: 652910 - RNA, 21 nt, Human
cugaagauuucucaccaccaa

SEQ ID NO: 652911 - RNA, 23 nt, Human
gcaguaggggucgucauaggcac

SEQ ID NO: 652912 - RNA, 21 nt, Human
uagcaaggccuucuuuacuuu

SEQ ID NO: 652913 - RNA, 19 nt, Human
uccaccaggaucucucuug

SEQ ID NO: 652914 - RNA, 19 nt, Human
ugacaagcucccccaggua

SEQ ID NO: 652915 - RNA, 23 nt, Human
uuuuuuuuuuuuuuuuuuauugg

SEQ ID NO: 652916 - RNA, 23 nt, Human
aaacagaaucacagcauuucugc

SEQ ID NO: 652917 - RNA, 18 nt, Human
aaagcccucaaacucucc

SEQ ID NO: 652918 - RNA, 22 nt, Human
aaguuuuuaacugcaauaaguc

SEQ ID NO: 652919 - RNA, 19 nt, Human
acaauugcaggcccauuug

SEQ ID NO: 652920 - RNA, 24 nt, Human
aguuucuuuuucuucuucuuuuuu

SEQ ID NO: 652921 - RNA, 19 nt, Human
auaaugccauggcuucucc

SEQ ID NO: 652922 - RNA, 20 nt, Human
aucccugaguuucuuuuucu

SEQ ID NO: 652923 - RNA, 18 nt, Human
augcaaggauuuauuuua

SEQ ID NO: 652924 - RNA, 26 nt, Human
caaguuuuuaacugcaauaagucaca

SEQ ID NO: 652925 - RNA, 19 nt, Human
ccagugaucccugaguuuc

SEQ ID NO: 652926 - RNA, 23 nt, Human
ccagugaucccugaguuucuuuu

SEQ ID NO: 652927 - RNA, 19 nt, Human
gaguuucuuuuucuucuuc

SEQ ID NO: 652928 - RNA, 21 nt, Human
gccuuuuuagaugugcaagag

SEQ ID NO: 652929 - RNA, 24 nt, Human
uacauacugguuauaaacaaugua

SEQ ID NO: 652930 - RNA, 19 nt, Human
uauuauaacuacauauaca

SEQ ID NO: 652931 - RNA, 25 nt, Human
ucucccagugaucccugaguuucuu

SEQ ID NO: 652932 - RNA, 24 nt, Human
ucugcgaaagcccucaaacucucc

SEQ ID NO: 652933 - RNA, 23 nt, Human
ugaagauaaugccauggcuucuc

SEQ ID NO: 652934 - RNA, 21 nt, Human
ugacacacucacguaaggcac

SEQ ID NO: 652935 - RNA, 24 nt, Human
ugcaauaagucacaauugcaggcc

SEQ ID NO: 652936 - RNA, 23 nt, Human
uguucgagaaaaccaacauaagg

SEQ ID NO: 652937 - RNA, 21 nt, Human
uuaaaacagaaucacagcauu

SEQ ID NO: 652938 - RNA, 21 nt, Human
uuucuucuucuuuuuuuuucc

SEQ ID NO: 652939 - RNA, 26 nt, Human
uuugaaguacauacugguuauaaaca

SEQ ID NO: 652940 - RNA, 23 nt, Human
agcaaucucagcaacaggucuca

SEQ ID NO: 652941 - RNA, 21 nt, Human
ccuucuguuguuagccauuau

SEQ ID NO: 652942 - RNA, 21 nt, Human
guauaacaggacauauauguu

SEQ ID NO: 652943 - RNA, 25 nt, Human
uaacaggacauauauguuuagaaaa

SEQ ID NO: 652944 - RNA, 24 nt, Human
ucuuuuauuaauguaugcuuugac

SEQ ID NO: 652945 - RNA, 20 nt, Human
uguauaacaggacauauaug

SEQ ID NO: 652946 - RNA, 24 nt, Human
aaaaaaaaaaaaaauuugggcaag

SEQ ID NO: 652947 - RNA, 23 nt, Human
aaacugauuacuauauaaucuug

SEQ ID NO: 652948 - RNA, 30 nt, Human
aaauaacaacuccauaagccauucccuuaa

SEQ ID NO: 652949 - RNA, 20 nt, Human
aacauggugaaacccugucu

SEQ ID NO: 652950 - RNA, 21 nt, Human
aacauggugaaacccugucuc

SEQ ID NO: 652951 - RNA, 23 nt, Human
aacuuguaaucccagcacuuugg

SEQ ID NO: 652952 - RNA, 24 nt, Human
aagcauaaacacagaguuugcgcc

SEQ ID NO: 652953 - RNA, 24 nt, Human
aaucgcuugaaccugggaggugga

SEQ ID NO: 652954 - RNA, 19 nt, Human
aauuucaagacccauauau

SEQ ID NO: 652955 - RNA, 24 nt, Human
acagagugagacucagucucaaaa

SEQ ID NO: 652956 - RNA, 24 nt, Human
accaacauggugaaacccugucuc

SEQ ID NO: 652957 - RNA, 24 nt, Human
accacuguacuccagcccaggcga

SEQ ID NO: 652958 - RNA, 24 nt, Human
acccugucucuacuaaaaauacaa

SEQ ID NO: 652959 - RNA, 20 nt, Human
acccuuuauauaacaagcau

SEQ ID NO: 652960 - RNA, 20 nt, Human
accuucagggaaacaacuga

SEQ ID NO: 652961 - RNA, 23 nt, Human
acuaaacacuuuaugaaaauuau

SEQ ID NO: 652962 - RNA, 24 nt, Human
acuguacuccagcccaggcgacag

SEQ ID NO: 652963 - RNA, 20 nt, Human
acuuguuguccauuuuccuu

SEQ ID NO: 652964 - RNA, 21 nt, Human
agaaagaaacauuuaauagga

SEQ ID NO: 652965 - RNA, 24 nt, Human
agacugaggcauaagaaucgcuug

SEQ ID NO: 652966 - RNA, 23 nt, Human
agagcuauguggcagagauggaa

SEQ ID NO: 652967 - RNA, 24 nt, Human
agauuuuggaaauucuaaaagguu

SEQ ID NO: 652968 - RNA, 19 nt, Human
agccaggugcaguggcuca

SEQ ID NO: 652969 - RNA, 23 nt, Human
agccuggguauuaguuguggcuc

SEQ ID NO: 652970 - RNA, 18 nt, Human
agcugggugugguggcgu

SEQ ID NO: 652971 - RNA, 23 nt, Human
aggaguucgagacccgccugacc

SEQ ID NO: 652972 - RNA, 24 nt, Human
aggcagguggaucacgaggucagg

SEQ ID NO: 652973 - RNA, 22 nt, Human
aggcauaagaaucgcuugaacc

SEQ ID NO: 652974 - RNA, 24 nt, Human
aggcauaagaaucgcuugaaccug

SEQ ID NO: 652975 - RNA, 21 nt, Human
aggccgaggcagguggaucac

SEQ ID NO: 652976 - RNA, 26 nt, Human
agguagacgaacugcccaaggccaga

SEQ ID NO: 652977 - RNA, 24 nt, Human
aggugcaguggcucaaacuuguaa

SEQ ID NO: 652978 - RNA, 20 nt, Human
agguggaaguugcagugagc

SEQ ID NO: 652979 - RNA, 24 nt, Human
agguggaaguugcagugagcugag

SEQ ID NO: 652980 - RNA, 24 nt, Human
agguggaucacgaggucaggaguu

SEQ ID NO: 652981 - RNA, 24 nt, Human
aguggcucaaacuuguaaucccag

SEQ ID NO: 652982 - RNA, 20 nt, Human
auagagcugaggaaagaaac

SEQ ID NO: 652983 - RNA, 20 nt, Human
aucgcaccacuguacuccag

SEQ ID NO: 652984 - RNA, 18 nt, Human
augaccauuuuggaguuu

SEQ ID NO: 652985 - RNA, 21 nt, Human
auuucaagacccauauauucc

SEQ ID NO: 652986 - RNA, 22 nt, Human
caaaccaagguucaacaaaaaa

SEQ ID NO: 652987 - RNA, 24 nt, Human
caaacuuguaaucccagcacuuug

SEQ ID NO: 652988 - RNA, 24 nt, Human
caacauggugaaacccugucucua

SEQ ID NO: 652989 - RNA, 25 nt, Human
caaugcaacaggcuguuuuccuaca

SEQ ID NO: 652990 - RNA, 18 nt, Human
cacagaguuugcgccccu

SEQ ID NO: 652991 - RNA, 25 nt, Human
cacauuuaacaauccuucuuuuaca

SEQ ID NO: 652992 - RNA, 21 nt, Human
cacuaaauggcggcacucacc

SEQ ID NO: 652993 - RNA, 20 nt, Human
cacuaugugugagcuuaagu

SEQ ID NO: 652994 - RNA, 19 nt, Human
cacuguacuccagcccagg

SEQ ID NO: 652995 - RNA, 20 nt, Human
cacuguacuccagcccaggc

SEQ ID NO: 652996 - RNA, 22 nt, Human
cacuguacuccagcccaggcga

SEQ ID NO: 652997 - RNA, 23 nt, Human
cacuguacuccagcccaggcgac

SEQ ID NO: 652998 - RNA, 24 nt, Human
cacuguacuccagcccaggcgaca

SEQ ID NO: 652999 - RNA, 18 nt, Human
cacuuuggaaggccgagg

SEQ ID NO: 653000 - RNA, 21 nt, Human
cagaaaggaaagaaaucugcc

SEQ ID NO: 653001 - RNA, 20 nt, Human
cagaauaaguacccaacuga

SEQ ID NO: 653002 - RNA, 24 nt, Human
cagagcuauguggcagagauggaa

SEQ ID NO: 653003 - RNA, 24 nt, Human
cagcacuuuggaaggccgaggcag

SEQ ID NO: 653004 - RNA, 24 nt, Human
cagcacuuuggaaggccgaggcag

SEQ ID NO: 653005 - RNA, 27 nt, Human
caggagacugaggcauaagaaucgcuu

SEQ ID NO: 653006 - RNA, 18 nt, Human
cauaaccaaaugucaccc

SEQ ID NO: 653007 - RNA, 18 nt, Human
cauugcugcagaauaucu

SEQ ID NO: 653008 - RNA, 21 nt, Human
cauuguuuucaaugaguuucc

SEQ ID NO: 653009 - RNA, 18 nt, Human
ccaaauaugugguuaucu

SEQ ID NO: 653010 - RNA, 22 nt, Human
ccacaagagggagauuugcagg

SEQ ID NO: 653011 - RNA, 19 nt, Human
ccacuguacuccagcccag

SEQ ID NO: 653012 - RNA, 20 nt, Human
ccacuguacuccagcccagg

SEQ ID NO: 653013 - RNA, 20 nt, Human
ccacuguacuccagcccagg

SEQ ID NO: 653014 - RNA, 21 nt, Human
ccacuguacuccagcccaggc

SEQ ID NO: 653015 - RNA, 23 nt, Human
ccagaaaggaaagaaaucugcca

SEQ ID NO: 653016 - RNA, 27 nt, Human
ccauucuuuucucaaccucaaccugaa

SEQ ID NO: 653017 - RNA, 19 nt, Human
ccuacacucgaccccucga

SEQ ID NO: 653018 - RNA, 19 nt, Human
ccuauaaauaugggaagag

SEQ ID NO: 653019 - RNA, 22 nt, Human
ccugaccaacauggugaaaccc

SEQ ID NO: 653020 - RNA, 24 nt, Human
ccugaccaacauggugaaacccug

SEQ ID NO: 653021 - RNA, 21 nt, Human
ccuguaaucccagcugcucag

SEQ ID NO: 653022 - RNA, 22 nt, Human
ccuuaugucagauguagggaau

SEQ ID NO: 653023 - RNA, 24 nt, Human
cgaggcagguggaucacgagguca

SEQ ID NO: 653024 - RNA, 21 nt, Human
cgcaccacuguacuccagccc

SEQ ID NO: 653025 - RNA, 18 nt, Human
cucaaaaaaaaaaaaaaa

SEQ ID NO: 653026 - RNA, 24 nt, Human
cucaaacuuguaaucccagcacuu

SEQ ID NO: 653027 - RNA, 24 nt, Human
cucagucucaaaaaaaaaaaaaaa

SEQ ID NO: 653028 - RNA, 19 nt, Human
cuccaaccuugcucucccu

SEQ ID NO: 653029 - RNA, 21 nt, Human
cucuuacaaugcaacaggcug

SEQ ID NO: 653030 - RNA, 24 nt, Human
cugaccaacauggugaaacccugu

SEQ ID NO: 653031 - RNA, 19 nt, Human
cuugaaccugggaggugga

SEQ ID NO: 653032 - RNA, 19 nt, Human
gaaacccugucucuacuaa

SEQ ID NO: 653033 - RNA, 31 nt, Human
gaaauaacaacuccauaagccauucccuuaa

SEQ ID NO: 653034 - RNA, 26 nt, Human
gaagguagacgaacugcccaaggcca

SEQ ID NO: 653035 - RNA, 23 nt, Human
gaaguugcagugagcugagaucg

SEQ ID NO: 653036 - RNA, 24 nt, Human
gacagagugagacucagucucaaa

SEQ ID NO: 653037 - RNA, 23 nt, Human
gaccccucgaaaccaguccuuaa

SEQ ID NO: 653038 - RNA, 21 nt, Human
gagcugaggaaagaaacuugg

SEQ ID NO: 653039 - RNA, 21 nt, Human
gaucacgaggucaggaguucg

SEQ ID NO: 653040 - RNA, 20 nt, Human
gcaauggaaauggaaaacag

SEQ ID NO: 653041 - RNA, 20 nt, Human
gcaccacuguacuccagccc

SEQ ID NO: 653042 - RNA, 22 nt, Human
gccagcugcucuucaagaugac

SEQ ID NO: 653043 - RNA, 23 nt, Human
gccugaccaacauggugaaaccc

SEQ ID NO: 653044 - RNA, 18 nt, Human
ggaaguugcagugagcug

SEQ ID NO: 653045 - RNA, 24 nt, Human
ggaaguugcagugagcugagaucg

SEQ ID NO: 653046 - RNA, 18 nt, Human
ggaccuagagggagggug

SEQ ID NO: 653047 - RNA, 19 nt, Human
ggauagagcugaggaaaga

SEQ ID NO: 653048 - RNA, 24 nt, Human
gggaaaguauagcuuagagaaggu

SEQ ID NO: 653049 - RNA, 24 nt, Human
gggugugguggcguuugccuguaa

SEQ ID NO: 653050 - RNA, 20 nt, Human
ggugcaguggcucaaacuug

SEQ ID NO: 653051 - RNA, 24 nt, Human
gguggcguuugccuguaaucccag

SEQ ID NO: 653052 - RNA, 24 nt, Human
guaaaacaaugagaaauacauaac

SEQ ID NO: 653053 - RNA, 23 nt, Human
guacuccagcccaggcgacagag

SEQ ID NO: 653054 - RNA, 18 nt, Human
guauaaauaauagaauaa

SEQ ID NO: 653055 - RNA, 20 nt, Human
guggaaguugcagugagcug

SEQ ID NO: 653056 - RNA, 25 nt, Human
guuaucuuccuucugcuuacuuuua

SEQ ID NO: 653057 - RNA, 21 nt, Human
guugcagugagcugagaucgc

SEQ ID NO: 653058 - RNA, 18 nt, Human
uaaaacaaugagaaauac

SEQ ID NO: 653059 - RNA, 23 nt, Human
uacaugccgacaaguuaaaauga

SEQ ID NO: 653060 - RNA, 19 nt, Human
uacauugauguuaaaaucu

SEQ ID NO: 653061 - RNA, 28 nt, Human
uacuaaacacuuuaugaaaauuaucucu

SEQ ID NO: 653062 - RNA, 24 nt, Human
uacuccagcccaggcgacagagug

SEQ ID NO: 653063 - RNA, 22 nt, Human
uacugcaauuauucuguugcuc

SEQ ID NO: 653064 - RNA, 18 nt, Human
uagagggagggugcuuga

SEQ ID NO: 653065 - RNA, 22 nt, Human
uagauaagcaucuuuaugaggg

SEQ ID NO: 653066 - RNA, 21 nt, Human
ucaaugccuaugaaauaacaa

SEQ ID NO: 653067 - RNA, 18 nt, Human
ucacgaggucaggaguuc

SEQ ID NO: 653068 - RNA, 24 nt, Human
ucacgaggucaggaguucgagacc

SEQ ID NO: 653069 - RNA, 22 nt, Human
ucaggauucugagaagcugcug

SEQ ID NO: 653070 - RNA, 24 nt, Human
ucagucucaaaaaaaaaaaaaaaa

SEQ ID NO: 653071 - RNA, 24 nt, Human
ucaugaaacugauuacuauauaau

SEQ ID NO: 653072 - RNA, 21 nt, Human
ucauuguuuucaaugaguuuc

SEQ ID NO: 653073 - RNA, 24 nt, Human
uccagcccaggcgacagagugaga

SEQ ID NO: 653074 - RNA, 18 nt, Human
uccaguggaauuccacaa

SEQ ID NO: 653075 - RNA, 25 nt, Human
ucccaaacguuguucuaugcaauuc

SEQ ID NO: 653076 - RNA, 25 nt, Human
ucccaucuuuccccuuaggcuccaa

SEQ ID NO: 653077 - RNA, 18 nt, Human
uccuugcacagugcaucc

SEQ ID NO: 653078 - RNA, 26 nt, Human
ucgaagaagaauuuuuuggccuccug

SEQ ID NO: 653079 - RNA, 18 nt, Human
ucgcuugaaccugggagg

SEQ ID NO: 653080 - RNA, 21 nt, Human
ucuaucucuuuucugacagcc

SEQ ID NO: 653081 - RNA, 18 nt, Human
ucuccagaaaggaaagaa

SEQ ID NO: 653082 - RNA, 22 nt, Human
ucucuacuaaaaauacaaaaaa

SEQ ID NO: 653083 - RNA, 20 nt, Human
ucucuagcugcaaauuccug

SEQ ID NO: 653084 - RNA, 26 nt, Human
ucuguacuaccggcacuguuuaaaga

SEQ ID NO: 653085 - RNA, 23 nt, Human
ucuucauaaccaaaugucacccu

SEQ ID NO: 653086 - RNA, 20 nt, Human
ugaaagcauaaacacagagu

SEQ ID NO: 653087 - RNA, 18 nt, Human
ugaaccugggagguggaa

SEQ ID NO: 653088 - RNA, 24 nt, Human
ugaaccugggagguggaaguugca

SEQ ID NO: 653089 - RNA, 21 nt, Human
ugaauggaaucuuugagccug

SEQ ID NO: 653090 - RNA, 24 nt, Human
ugaccaacauggugaaacccuguc

SEQ ID NO: 653091 - RNA, 24 nt, Human
ugagaucgcaccacuguacuccag

SEQ ID NO: 653092 - RNA, 23 nt, Human
ugagccuggguauuaguugugac

SEQ ID NO: 653093 - RNA, 22 nt, Human
ugagcugagaucgcaccacugu

SEQ ID NO: 653094 - RNA, 24 nt, Human
ugaggcauaagaaucgcuugaacc

SEQ ID NO: 653095 - RNA, 24 nt, Human
ugaggggcauuccaagguuuaugu

SEQ ID NO: 653096 - RNA, 19 nt, Human
ugccugccaaauauguggu

SEQ ID NO: 653097 - RNA, 19 nt, Human
ugccugccaaauauguggu

SEQ ID NO: 653098 - RNA, 24 nt, Human
ugccuguaaucccagcugcucagg

SEQ ID NO: 653099 - RNA, 21 nt, Human
ugcugcacuggggaccauucu

SEQ ID NO: 653100 - RNA, 24 nt, Human
uggaaggccgaggcagguggauca

SEQ ID NO: 653101 - RNA, 21 nt, Human
uggaaucuuugagccugggua

SEQ ID NO: 653102 - RNA, 22 nt, Human
uggaucacgaggucaggaguuc

SEQ ID NO: 653103 - RNA, 24 nt, Human
uggaucacgaggucaggaguucga

SEQ ID NO: 653104 - RNA, 18 nt, Human
uggcaaaacguguagcua

SEQ ID NO: 653105 - RNA, 22 nt, Human
uggcagagauggaauucaaaug

SEQ ID NO: 653106 - RNA, 22 nt, Human
uggcguuugccuguaaucccag

SEQ ID NO: 653107 - RNA, 24 nt, Human
uggcguuugccuguaaucccagcu

SEQ ID NO: 653108 - RNA, 22 nt, Human
uggcucaaacuuguaaucccag

SEQ ID NO: 653109 - RNA, 24 nt, Human
uggcucaaacuuguaaucccagca

SEQ ID NO: 653110 - RNA, 27 nt, Human
uggcuugaagaugaacggaugguucag

SEQ ID NO: 653111 - RNA, 20 nt, Human
ugggaaaauguaaugaccac

SEQ ID NO: 653112 - RNA, 29 nt, Human
ugggagguggaaguugcagugacaacggu

SEQ ID NO: 653113 - RNA, 24 nt, Human
ugggagguggaaguugcagugagc

SEQ ID NO: 653114 - RNA, 22 nt, Human
uggggagguuagauaagcaucu

SEQ ID NO: 653115 - RNA, 24 nt, Human
ugguaugcaggagucaaacagcag

SEQ ID NO: 653116 - RNA, 24 nt, Human
ugguggcguuugccuguaauccca

SEQ ID NO: 653117 - RNA, 19 nt, Human
uguacagaggaaaagauua

SEQ ID NO: 653118 - RNA, 19 nt, Human
ugugaagcuucccacauuu

SEQ ID NO: 653119 - RNA, 21 nt, Human
uguggcagagauggaauucaa

SEQ ID NO: 653120 - RNA, 26 nt, Human
uuaacaauccuucuuuuacacuuccc

SEQ ID NO: 653121 - RNA, 19 nt, Human
uuacauugauguuaaaauc

SEQ ID NO: 653122 - RNA, 18 nt, Human
uuagcugggugugguggc

SEQ ID NO: 653123 - RNA, 19 nt, Human
uuagcugggugugguggcg

SEQ ID NO: 653124 - RNA, 20 nt, Human
uuagcugggugugguggcgu

SEQ ID NO: 653125 - RNA, 23 nt, Human
uucaaugauuuuuucacuuucuc

SEQ ID NO: 653126 - RNA, 19 nt, Human
uuccaagguuuauguacuc

SEQ ID NO: 653127 - RNA, 21 nt, Human
uucucugacucaggauucuga

SEQ ID NO: 653128 - RNA, 24 nt, Human
uugaaccugggagguggaaguugc

SEQ ID NO: 653129 - RNA, 22 nt, Human
uugcaauggaaauggaaaacag

SEQ ID NO: 653130 - RNA, 20 nt, Human
uugcacugucccagaauaag

SEQ ID NO: 653131 - RNA, 18 nt, Human
uugcagugagcugagauc

SEQ ID NO: 653132 - RNA, 19 nt, Human
uugcagugagcugagaucg

SEQ ID NO: 653133 - RNA, 22 nt, Human
uugcagugagcugagaucgcac

SEQ ID NO: 653134 - RNA, 25 nt, Human
uuggaaggccgaggcagguggauca

SEQ ID NO: 653135 - RNA, 20 nt, Human
uuguauggcuuuaguaguau

SEQ ID NO: 653136 - RNA, 26 nt, Human
uuuacacuucccaauuccaauugcau

SEQ ID NO: 653137 - RNA, 18 nt, Human
uuuagcuggguguggugg

SEQ ID NO: 653138 - RNA, 23 nt, Human
uuugggaaaauguaaugaccacc

SEQ ID NO: 653139 - RNA, 21 nt, Human
uuuugcaacuuauugaccugc

SEQ ID NO: 653140 - RNA, 18 nt, Human
aacuccuagcccaguccc

SEQ ID NO: 653141 - RNA, 19 nt, Human
aagcaagagguggcccugg

SEQ ID NO: 653142 - RNA, 24 nt, Human
aaguccccucccagaucugugacc

SEQ ID NO: 653143 - RNA, 22 nt, Human
acagcuucaccauuuugguuca

SEQ ID NO: 653144 - RNA, 20 nt, Human
acagucccagaagggcccag

SEQ ID NO: 653145 - RNA, 22 nt, Human
acccucccuguccucuccuggu

SEQ ID NO: 653146 - RNA, 19 nt, Human
acccugauguccccacuuc

SEQ ID NO: 653147 - RNA, 22 nt, Human
acugaguccuggagguggucgu

SEQ ID NO: 653148 - RNA, 18 nt, Human
acuugcaugacacuuccc

SEQ ID NO: 653149 - RNA, 20 nt, Human
acuugcaugacacuucccuc

SEQ ID NO: 653150 - RNA, 19 nt, Human
agaaagacaauaggcugcc

SEQ ID NO: 653151 - RNA, 20 nt, Human
agaacccucccuguccucuc

SEQ ID NO: 653152 - RNA, 22 nt, Human
agaacccucccuguccucuccu

SEQ ID NO: 653153 - RNA, 21 nt, Human
agaggccaguguguguggggu

SEQ ID NO: 653154 - RNA, 20 nt, Human
agagggaagccgggggaguu

SEQ ID NO: 653155 - RNA, 27 nt, Human
agagggagggggggugggaaucugagc

SEQ ID NO: 653156 - RNA, 20 nt, Human
agcaggcucacggaccuugg

SEQ ID NO: 653157 - RNA, 22 nt, Human
agccuccccugcuccugccugc

SEQ ID NO: 653158 - RNA, 19 nt, Human
aggagcagaggcgagucug

SEQ ID NO: 653159 - RNA, 20 nt, Human
aggcagccagggcuggcaga

SEQ ID NO: 653160 - RNA, 22 nt, Human
aggcagccagggcuggcagagc

SEQ ID NO: 653161 - RNA, 19 nt, Human
agggcuggcagagccugcc

SEQ ID NO: 653162 - RNA, 24 nt, Human
aucuuccuccccuuucccuuccaa

SEQ ID NO: 653163 - RNA, 25 nt, Human
caaggacacacagcccccuucccuc

SEQ ID NO: 653164 - RNA, 20 nt, Human
caauaggcugccucuccccc

SEQ ID NO: 653165 - RNA, 21 nt, Human
caccccgccugagggcucuac

SEQ ID NO: 653166 - RNA, 20 nt, Human
cacugaguccuggagguggu

SEQ ID NO: 653167 - RNA, 20 nt, Human
cagauguccuccuccaucuc

SEQ ID NO: 653168 - RNA, 22 nt, Human
cagcacacccaagcuccugggc

SEQ ID NO: 653169 - RNA, 19 nt, Human
cagcccccaggcacuaccu

SEQ ID NO: 653170 - RNA, 19 nt, Human
cagcccccuucccucccuc

SEQ ID NO: 653171 - RNA, 18 nt, Human
cagcggcugcugcuaaag

SEQ ID NO: 653172 - RNA, 18 nt, Human
cagcggcugcugcuaaag

SEQ ID NO: 653173 - RNA, 20 nt, Human
cagguaccaucacagcugcu

SEQ ID NO: 653174 - RNA, 23 nt, Human
cauccuccauuccguccaacucc

SEQ ID NO: 653175 - RNA, 23 nt, Human
caugacacuucccucuauuuuca

SEQ ID NO: 653176 - RNA, 21 nt, Human
caugcaaggacacacagcccc

SEQ ID NO: 653177 - RNA, 19 nt, Human
ccaaaaagaauggcaugca

SEQ ID NO: 653178 - RNA, 19 nt, Human
ccacuuccaaguccugacu

SEQ ID NO: 653179 - RNA, 22 nt, Human
ccacuuccaaguccugacuccu

SEQ ID NO: 653180 - RNA, 24 nt, Human
ccagcaggcucacggaccuuggcc

SEQ ID NO: 653181 - RNA, 23 nt, Human
ccagccccucuuuuccaggaacc

SEQ ID NO: 653182 - RNA, 20 nt, Human
ccagcucccagccugggagu

SEQ ID NO: 653183 - RNA, 21 nt, Human
ccaggaaccuugccacgccca

SEQ ID NO: 653184 - RNA, 23 nt, Human
ccagggucccuucaguggacccu

SEQ ID NO: 653185 - RNA, 18 nt, Human
ccaguguguguggggugg

SEQ ID NO: 653186 - RNA, 23 nt, Human
ccaucuuccuccccuuucccuuc

SEQ ID NO: 653187 - RNA, 18 nt, Human
cccaagcaagagguggcc

SEQ ID NO: 653188 - RNA, 20 nt, Human
ccccagggaucacugagucc

SEQ ID NO: 653189 - RNA, 20 nt, Human
ccccuuucccuuccagcccc

SEQ ID NO: 653190 - RNA, 23 nt, Human
cccgccugagggcucuacucacc

SEQ ID NO: 653191 - RNA, 19 nt, Human
cccggggcucccccgcggg

SEQ ID NO: 653192 - RNA, 24 nt, Human
cccuccaucuuccuccccuuuccc

SEQ ID NO: 653193 - RNA, 21 nt, Human
cccucuuuuccaggaaccuug

SEQ ID NO: 653194 - RNA, 21 nt, Human
cccugccuuccccaggguccc

SEQ ID NO: 653195 - RNA, 18 nt, Human
cccugggccaguggguug

SEQ ID NO: 653196 - RNA, 22 nt, Human
cccuuccagccccucuuuucca

SEQ ID NO: 653197 - RNA, 22 nt, Human
ccuccccuuucccuuccagccc

SEQ ID NO: 653198 - RNA, 24 nt, Human
ccucccugccuuccccaggguccc

SEQ ID NO: 653199 - RNA, 19 nt, Human
ccucccuguccucuccugg

SEQ ID NO: 653200 - RNA, 22 nt, Human
ccugcccucccugccuucccca

SEQ ID NO: 653201 - RNA, 19 nt, Human
ccugccugcccaccccgcc

SEQ ID NO: 653202 - RNA, 23 nt, Human
ccugcucacuguccagauguccu

SEQ ID NO: 653203 - RNA, 20 nt, Human
ccugcuccugccugcccacc

SEQ ID NO: 653204 - RNA, 21 nt, Human
ccuuucuucucgcuguccucc

SEQ ID NO: 653205 - RNA, 22 nt, Human
cgcggagaaagacaauaggcug

SEQ ID NO: 653206 - RNA, 24 nt, Human
cggcagcagcggcugcugcuaaag

SEQ ID NO: 653207 - RNA, 20 nt, Human
cggccacuggaccacaggag

SEQ ID NO: 653208 - RNA, 19 nt, Human
cggcucccggggcuccccc

SEQ ID NO: 653209 - RNA, 23 nt, Human
cuacugaagcacuacugccagcc

SEQ ID NO: 653210 - RNA, 19 nt, Human
cuaugcaaccugcagcccc

SEQ ID NO: 653211 - RNA, 27 nt, Human
cucacuguccagauguccuccuccauc

SEQ ID NO: 653212 - RNA, 21 nt, Human
cuccagccagccaucccuuac

SEQ ID NO: 653213 - RNA, 19 nt, Human
cucccuccaucuuccuccc

SEQ ID NO: 653214 - RNA, 21 nt, Human
cucccucuucugcuuuuccca

SEQ ID NO: 653215 - RNA, 22 nt, Human
cuccuagcccagucccgggggc

SEQ ID NO: 653216 - RNA, 20 nt, Human
cuccuccaucuccgugcggc

SEQ ID NO: 653217 - RNA, 23 nt, Human
cuccugggcuauuggggcuccua

SEQ ID NO: 653218 - RNA, 24 nt, Human
cucuuccuuucuucucgcuguccu

SEQ ID NO: 653219 - RNA, 27 nt, Human
cugcccacacuuugcauuucucuuccu

SEQ ID NO: 653220 - RNA, 19 nt, Human
cugccgccuucuguccagc

SEQ ID NO: 653221 - RNA, 23 nt, Human
cuggaccucgguguccccaucug

SEQ ID NO: 653222 - RNA, 24 nt, Human
cuggaucugcugugcagugggguu

SEQ ID NO: 653223 - RNA, 21 nt, Human
cuuaaguccccucccagaucu

SEQ ID NO: 653224 - RNA, 21 nt, Human
cuuccuuucuucucgcugucc

SEQ ID NO: 653225 - RNA, 20 nt, Human
cuuggcggcugcccacacuu

SEQ ID NO: 653226 - RNA, 23 nt, Human
cuuucccuuccagccccucuuuu

SEQ ID NO: 653227 - RNA, 18 nt, Human
gaagagggaagccggggg

SEQ ID NO: 653228 - RNA, 21 nt, Human
gacaauaggcugccucucccc

SEQ ID NO: 653229 - RNA, 18 nt, Human
gagccuccccugcuccug

SEQ ID NO: 653230 - RNA, 21 nt, Human
gaucuucagagagagggaggg

SEQ ID NO: 653231 - RNA, 24 nt, Human
gcaaggcagccagggcuggcagag

SEQ ID NO: 653232 - RNA, 20 nt, Human
gcccccuucccucccuccca

SEQ ID NO: 653233 - RNA, 20 nt, Human
gccugggugcuccuggggag

SEQ ID NO: 653234 - RNA, 22 nt, Human
gcggcucccggggcucccccgc

SEQ ID NO: 653235 - RNA, 18 nt, Human
gcugcccacacuuugcau

SEQ ID NO: 653236 - RNA, 20 nt, Human
gcuggcagagccugcccccc

SEQ ID NO: 653237 - RNA, 21 nt, Human
ggaaccuugccacgcccacac

SEQ ID NO: 653238 - RNA, 22 nt, Human
ggaagauggggugaccacagaa

SEQ ID NO: 653239 - RNA, 21 nt, Human
ggcagccagggcuggcagagc

SEQ ID NO: 653240 - RNA, 18 nt, Human
ggcggcggcagcagcggc

SEQ ID NO: 653241 - RNA, 22 nt, Human
ggcugggucccuggccagcacu

SEQ ID NO: 653242 - RNA, 21 nt, Human
gggaagccgggggaguugagc

SEQ ID NO: 653243 - RNA, 18 nt, Human
gggaaucugagcacagug

SEQ ID NO: 653244 - RNA, 19 nt, Human
gggcucgucccaccugccg

SEQ ID NO: 653245 - RNA, 22 nt, Human
ggggagguggaucuuccagucg

SEQ ID NO: 653246 - RNA, 21 nt, Human
ggggcuccuagagugggcuca

SEQ ID NO: 653247 - RNA, 20 nt, Human
gggucccuggccagcacuac

SEQ ID NO: 653248 - RNA, 19 nt, Human
ggguggggaggaccgccac

SEQ ID NO: 653249 - RNA, 23 nt, Human
ggucugaacuguggguggacugc

SEQ ID NO: 653250 - RNA, 22 nt, Human
gguggggaggaccgccacagcc

SEQ ID NO: 653251 - RNA, 23 nt, Human
gucuuuuccucuggaccucggug

SEQ ID NO: 653252 - RNA, 19 nt, Human
guucaagcaguguuccuuc

SEQ ID NO: 653253 - RNA, 19 nt, Human
uacaggaagcagcugcugg

SEQ ID NO: 653254 - RNA, 24 nt, Human
uagcuucucccuccaucuuccucc

SEQ ID NO: 653255 - RNA, 20 nt, Human
uaggauaaaagccugagagu

SEQ ID NO: 653256 - RNA, 25 nt, Human
uaggcugccucucccccggcggcgg

SEQ ID NO: 653257 - RNA, 22 nt, Human
ucagcaggguucugggcaaugg

SEQ ID NO: 653258 - RNA, 21 nt, Human
ucaguggacccugggcuuucu

SEQ ID NO: 653259 - RNA, 19 nt, Human
uccacgcuaucagugaggc

SEQ ID NO: 653260 - RNA, 27 nt, Human
uccagcgcacagucccagaagggcccc

SEQ ID NO: 653261 - RNA, 23 nt, Human
ucccccgcgggccgagccgagac

SEQ ID NO: 653262 - RNA, 22 nt, Human
ucccugccuuccccaggguccc

SEQ ID NO: 653263 - RNA, 19 nt, Human
uccggccacuggaccacag

SEQ ID NO: 653264 - RNA, 21 nt, Human
uccggccacuggaccacagga

SEQ ID NO: 653265 - RNA, 19 nt, Human
uccgugcggcucccggggc

SEQ ID NO: 653266 - RNA, 22 nt, Human
uccuagagugggcucaucagca

SEQ ID NO: 653267 - RNA, 18 nt, Human
ucuacucaccacccugcu

SEQ ID NO: 653268 - RNA, 26 nt, Human
ucuagcuucucccuccaucuuccucc

SEQ ID NO: 653269 - RNA, 21 nt, Human
ucucccucuucugcuuuuccc

SEQ ID NO: 653270 - RNA, 22 nt, Human
ucugcuuuucccagcaggaagg

SEQ ID NO: 653271 - RNA, 20 nt, Human
ucugucaggcuugguggcug

SEQ ID NO: 653272 - RNA, 21 nt, Human
ucugucaggcuugguggcugu

SEQ ID NO: 653273 - RNA, 22 nt, Human
ugaccacagaagagggaagccg

SEQ ID NO: 653274 - RNA, 20 nt, Human
ugacuccuuugagccauccc

SEQ ID NO: 653275 - RNA, 18 nt, Human
ugagaaaaggcagugggg

SEQ ID NO: 653276 - RNA, 20 nt, Human
ugagaaaaggcaguggggag

SEQ ID NO: 653277 - RNA, 21 nt, Human
ugagaaaaggcaguggggagg

SEQ ID NO: 653278 - RNA, 23 nt, Human
ugagaaaaggcaguggggaggug

SEQ ID NO: 653279 - RNA, 18 nt, Human
ugagagaggccagugugu

SEQ ID NO: 653280 - RNA, 22 nt, Human
ugccagggcagguauccagcuc

SEQ ID NO: 653281 - RNA, 20 nt, Human
ugcccagagaggggccucug

SEQ ID NO: 653282 - RNA, 23 nt, Human
ugccugggugcuccuggggaguc

SEQ ID NO: 653283 - RNA, 20 nt, Human
ugcuccugccugcccacccc

SEQ ID NO: 653284 - RNA, 26 nt, Human
uggauuuccuucagcuacccugaugu

SEQ ID NO: 653285 - RNA, 20 nt, Human
ugggcuuucugacugcccag

SEQ ID NO: 653286 - RNA, 19 nt, Human
uggggagaacccucccugu

SEQ ID NO: 653287 - RNA, 18 nt, Human
ugugcuauucagccaagg

SEQ ID NO: 653288 - RNA, 24 nt, Human
uuacagcuucaccauuuugguuca

SEQ ID NO: 653289 - RNA, 23 nt, Human
uucaguggacccugggcuuucug

SEQ ID NO: 653290 - RNA, 20 nt, Human
uuccguccaacuccuagccc

SEQ ID NO: 653291 - RNA, 19 nt, Human
uugaggagggggcuguggg

SEQ ID NO: 653292 - RNA, 20 nt, Human
uuggcggcugcccacacuuu

SEQ ID NO: 653293 - RNA, 18 nt, Human
uugguggcuguugggugg

SEQ ID NO: 653294 - RNA, 18 nt, Human
uugguucaagcaguguuc

SEQ ID NO: 653295 - RNA, 19 nt, Human
uuuugaggagggggcugug

SEQ ID NO: 653296 - RNA, 21 nt, Human
aaaaaaaaaaaaaaaaagucc

SEQ ID NO: 653297 - RNA, 24 nt, Human
aaaaaugaggacauuucuguauac

SEQ ID NO: 653298 - RNA, 23 nt, Human
aaaauucucuccaccuuucccuu

SEQ ID NO: 653299 - RNA, 22 nt, Human
aaaugugaaagccaaaacacuu

SEQ ID NO: 653300 - RNA, 23 nt, Human
aagccaaaacacuucugaucuua

SEQ ID NO: 653301 - RNA, 18 nt, Human
aagcugagaauuagaucu

SEQ ID NO: 653302 - RNA, 24 nt, Human
aaucaccugagcccaggagguuga

SEQ ID NO: 653303 - RNA, 23 nt, Human
accugagcccaggagguugaggc

SEQ ID NO: 653304 - RNA, 22 nt, Human
acuguacuccagccuuuuuuga

SEQ ID NO: 653305 - RNA, 23 nt, Human
acuguacuccagccuuuuuugag

SEQ ID NO: 653306 - RNA, 18 nt, Human
agaugggagaaucaccug

SEQ ID NO: 653307 - RNA, 20 nt, Human
agcacuuuaggaggcugagg

SEQ ID NO: 653308 - RNA, 22 nt, Human
aggaggcugaggcaggcagauc

SEQ ID NO: 653309 - RNA, 20 nt, Human
aggcaggcagaucacuugag

SEQ ID NO: 653310 - RNA, 24 nt, Human
aggcgcgauggcucaugccuguaa

SEQ ID NO: 653311 - RNA, 24 nt, Human
aggcugaggcaggcagaucacuug

SEQ ID NO: 653312 - RNA, 24 nt, Human
agggaggcugagaugggagaauca

SEQ ID NO: 653313 - RNA, 24 nt, Human
agguugaggcugcaguaagcugag

SEQ ID NO: 653314 - RNA, 19 nt, Human
aguaacguaacaccacaag

SEQ ID NO: 653315 - RNA, 20 nt, Human
auagcaccacuguacuacug

SEQ ID NO: 653316 - RNA, 24 nt, Human
auagcuuuugaaagucuuggguuu

SEQ ID NO: 653317 - RNA, 23 nt, Human
aucacuaauccaaaaauucaaaa

SEQ ID NO: 653318 - RNA, 19 nt, Human
auccuccuucccuucuccu

SEQ ID NO: 653319 - RNA, 23 nt, Human
auggcucaugccuguaaucgcag

SEQ ID NO: 653320 - RNA, 24 nt, Human
auuaucucugacaaaguuuacaug

SEQ ID NO: 653321 - RNA, 20 nt, Human
auucaaaauccagaaugcuc

SEQ ID NO: 653322 - RNA, 18 nt, Human
caaaaaaaugugaaagcc

SEQ ID NO: 653323 - RNA, 28 nt, Human
caacacaaaacuaauugaaaauucucuc

SEQ ID NO: 653324 - RNA, 23 nt, Human
caccccuggcucagaaacguugu

SEQ ID NO: 653325 - RNA, 20 nt, Human
caccuguagucccagcuacu

SEQ ID NO: 653326 - RNA, 24 nt, Human
caccuguagucccagcuacuaggg

SEQ ID NO: 653327 - RNA, 18 nt, Human
cagaaugcuccgagaucc

SEQ ID NO: 653328 - RNA, 24 nt, Human
cagaucacuugaguccaugaguuc

SEQ ID NO: 653329 - RNA, 18 nt, Human
cagcacuuuaggaggcug

SEQ ID NO: 653330 - RNA, 24 nt, Human
cagcacuuuaggaggcugaggcag

SEQ ID NO: 653331 - RNA, 22 nt, Human
caugcacaaaguuauuuaaaau

SEQ ID NO: 653332 - RNA, 21 nt, Human
ccaaaacacuucugaucuuaa

SEQ ID NO: 653333 - RNA, 25 nt, Human
ccaaaacacuucugaucuuaaucau

SEQ ID NO: 653334 - RNA, 19 nt, Human
cccugucucaaaaaaaaaa

SEQ ID NO: 653335 - RNA, 19 nt, Human
ccuccuucccuucuccuuu

SEQ ID NO: 653336 - RNA, 20 nt, Human
ccuccuucccuucuccuuuc

SEQ ID NO: 653337 - RNA, 19 nt, Human
ccucuauucucuuaaucua

SEQ ID NO: 653338 - RNA, 21 nt, Human
ccugggcaauauggaaaaccc

SEQ ID NO: 653339 - RNA, 19 nt, Human
ccuguaaucgcagcacuuu

SEQ ID NO: 653340 - RNA, 26 nt, Human
ccuguaaucgcagcacuuuaggaggc

SEQ ID NO: 653341 - RNA, 22 nt, Human
ccuguagucccagcuacuaggg

SEQ ID NO: 653342 - RNA, 23 nt, Human
ccugucucaaaaaaaaaaaaaaa

SEQ ID NO: 653343 - RNA, 25 nt, Human
ccugucucaaaaaaaaaaaaaaaaa

SEQ ID NO: 653344 - RNA, 19 nt, Human
ccuucccuucuccuuucuc

SEQ ID NO: 653345 - RNA, 19 nt, Human
cgcaccuguagucccagcu

SEQ ID NO: 653346 - RNA, 21 nt, Human
cgcagcacuuuaggaggcuga

SEQ ID NO: 653347 - RNA, 24 nt, Human
cgggaccagccugggcaauaugga

SEQ ID NO: 653348 - RNA, 23 nt, Human
cuaauugaaaauucucuccaccu

SEQ ID NO: 653349 - RNA, 27 nt, Human
cuacuguacuccagccuuuuuugagac

SEQ ID NO: 653350 - RNA, 18 nt, Human
cucaaaaaaaaaaaaaaa

SEQ ID NO: 653351 - RNA, 24 nt, Human
cucaugccuguaaucgcagcacuu

SEQ ID NO: 653352 - RNA, 19 nt, Human
cugugcccgcugacccacu

SEQ ID NO: 653353 - RNA, 20 nt, Human
cuugcaucccauccccaaga

SEQ ID NO: 653354 - RNA, 21 nt, Human
cuuggcauaguggcacgcacc

SEQ ID NO: 653355 - RNA, 20 nt, Human
cuuucccaaaucaaccacug

SEQ ID NO: 653356 - RNA, 23 nt, Human
gacuuccguuccuucucauccuc

SEQ ID NO: 653357 - RNA, 19 nt, Human
gagcaucacuaauccaaaa

SEQ ID NO: 653358 - RNA, 24 nt, Human
gauggcucaugccuguaaucgcag

SEQ ID NO: 653359 - RNA, 21 nt, Human
gccagguguucaaagugugua

SEQ ID NO: 653360 - RNA, 22 nt, Human
gcccaggagguugaggcugcag

SEQ ID NO: 653361 - RNA, 22 nt, Human
ggaaaacccccaucucuacuaa

SEQ ID NO: 653362 - RNA, 22 nt, Human
ggaggcugaggcaggcagauca

SEQ ID NO: 653363 - RNA, 22 nt, Human
ggcauaguggcacgcaccugua

SEQ ID NO: 653364 - RNA, 23 nt, Human
gggaggcugagaugggagaauca

SEQ ID NO: 653365 - RNA, 18 nt, Human
gucaaaauuguguuucau

SEQ ID NO: 653366 - RNA, 24 nt, Human
guccuuuaggcgcgauggcucaug

SEQ ID NO: 653367 - RNA, 19 nt, Human
uaaaaagguccuguccuuu

SEQ ID NO: 653368 - RNA, 24 nt, Human
uaacaccacaaguggaaaauucca

SEQ ID NO: 653369 - RNA, 22 nt, Human
uaagggguacucagccuuuaua

SEQ ID NO: 653370 - RNA, 20 nt, Human
uaaucuauaacaguucccuc

SEQ ID NO: 653371 - RNA, 20 nt, Human
uacaacgugcuuucuacgug

SEQ ID NO: 653372 - RNA, 22 nt, Human
uaccuucaggccagguguucaa

SEQ ID NO: 653373 - RNA, 23 nt, Human
uacuguacuccagccuuuuuuga

SEQ ID NO: 653374 - RNA, 24 nt, Human
uaggaggcugaggcaggcagauca

SEQ ID NO: 653375 - RNA, 24 nt, Human
uaguggcacgcaccuguaguccca

SEQ ID NO: 653376 - RNA, 25 nt, Human
uauaggcaaaauuccaaaauccaaa

SEQ ID NO: 653377 - RNA, 22 nt, Human
uaucagaccuaccaaaauuaac

SEQ ID NO: 653378 - RNA, 22 nt, Human
uaucucugacaaaguuuacaug

SEQ ID NO: 653379 - RNA, 23 nt, Human
uauugugugaaauuaccuucagg

SEQ ID NO: 653380 - RNA, 24 nt, Human
ucaaagaugacuuugaaaacaagu

SEQ ID NO: 653381 - RNA, 22 nt, Human
ucaaauuaauucaaacuacuga

SEQ ID NO: 653382 - RNA, 22 nt, Human
ucaugugaugaguugcagucaa

SEQ ID NO: 653383 - RNA, 19 nt, Human
uccaaaaaaaugugaaagc

SEQ ID NO: 653384 - RNA, 26 nt, Human
ucccaaaucaaccacugauaugagag

SEQ ID NO: 653385 - RNA, 23 nt, Human
ucuacacacagugaagagguaaa

SEQ ID NO: 653386 - RNA, 22 nt, Human
ucuccuuucucuacacacagug

SEQ ID NO: 653387 - RNA, 23 nt, Human
ucucuacuaaaaauacaaaaauu

SEQ ID NO: 653388 - RNA, 24 nt, Human
ugaaaauucucuccaccuuuccca

SEQ ID NO: 653389 - RNA, 18 nt, Human
ugaaagccaaaacacuuc

SEQ ID NO: 653390 - RNA, 20 nt, Human
ugaagagguaaaaaauuuga

SEQ ID NO: 653391 - RNA, 19 nt, Human
ugaaggguugauuuuuuaa

SEQ ID NO: 653392 - RNA, 18 nt, Human
ugacaaaguuuacaugug

SEQ ID NO: 653393 - RNA, 19 nt, Human
ugacccacuuuuuggauuu

SEQ ID NO: 653394 - RNA, 18 nt, Human
ugacuuccguuccuucuc

SEQ ID NO: 653395 - RNA, 20 nt, Human
ugagaugggagaaucaccug

SEQ ID NO: 653396 - RNA, 22 nt, Human
ugagcccaggagguugaggcug

SEQ ID NO: 653397 - RNA, 21 nt, Human
ugaggacauuucuguauacag

SEQ ID NO: 653398 - RNA, 21 nt, Human
ugaggcaggcagaucacuuga

SEQ ID NO: 653399 - RNA, 25 nt, Human
ugaggcaggcagaucacuugagucc

SEQ ID NO: 653400 - RNA, 24 nt, Human
ugcagucaaaauuguguuucaugc

SEQ ID NO: 653401 - RNA, 22 nt, Human
uggcacgcaccuguagucccag

SEQ ID NO: 653402 - RNA, 18 nt, Human
uggcucaugccuguaauc

SEQ ID NO: 653403 - RNA, 24 nt, Human
uggcucaugccuguaaucgcagca

SEQ ID NO: 653404 - RNA, 21 nt, Human
uguaaacauaggaaaauagga

SEQ ID NO: 653405 - RNA, 23 nt, Human
ugugaaagccaaaacacuucuga

SEQ ID NO: 653406 - RNA, 24 nt, Human
uguguuucaugcacaaaguuauuu

SEQ ID NO: 653407 - RNA, 24 nt, Human
uuaaagaaauacaauaaaaagguc

SEQ ID NO: 653408 - RNA, 23 nt, Human
uuaaucauuuuggauaaggggua

SEQ ID NO: 653409 - RNA, 22 nt, Human
uuaaugaauaauguaaacauag

SEQ ID NO: 653410 - RNA, 20 nt, Human
uucuucuacauacuccuccc

SEQ ID NO: 653411 - RNA, 23 nt, Human
uugagcaucacuaauccaaaaau

SEQ ID NO: 653412 - RNA, 22 nt, Human
aaaagaacagagcccgugcagg

SEQ ID NO: 653413 - RNA, 20 nt, Human
aaaaggccuuucugcaaaag

SEQ ID NO: 653414 - RNA, 19 nt, Human
aaagaccuaaccagauaau

SEQ ID NO: 653415 - RNA, 19 nt, Human
aaagugcuaggauuacagg

SEQ ID NO: 653416 - RNA, 24 nt, Human
aaagugcuaggauuacaggcguga

SEQ ID NO: 653417 - RNA, 24 nt, Human
aaagugcugagaugacaggcguga

SEQ ID NO: 653418 - RNA, 20 nt, Human
aacaaaaagaccuaaccaga

SEQ ID NO: 653419 - RNA, 23 nt, Human
aagauucuuuauugcaggacuuu

SEQ ID NO: 653420 - RNA, 19 nt, Human
aaguagcugggacuacagg

SEQ ID NO: 653421 - RNA, 20 nt, Human
aaguagcugggacuacaggc

SEQ ID NO: 653422 - RNA, 26 nt, Human
aaguagcugggacuacaggcgccugc

SEQ ID NO: 653423 - RNA, 24 nt, Human
aagugauccucccgccuuggccuc

SEQ ID NO: 653424 - RNA, 25 nt, Human
aagugauccucccgccuuggccucc

SEQ ID NO: 653425 - RNA, 25 nt, Human
aagugauccucccgccuuggccucc

SEQ ID NO: 653426 - RNA, 26 nt, Human
aagugcuaggauuacaggcgugagcc

SEQ ID NO: 653427 - RNA, 27 nt, Human
aagugcucaccuucuuaggaccuuugg

SEQ ID NO: 653428 - RNA, 19 nt, Human
aaucaccccucaggaaccc

SEQ ID NO: 653429 - RNA, 24 nt, Human
acacagaccuugcccuucccacag

SEQ ID NO: 653430 - RNA, 21 nt, Human
acaggcgugagccaccgcacc

SEQ ID NO: 653431 - RNA, 19 nt, Human
acaggguuucgccaugcug

SEQ ID NO: 653432 - RNA, 20 nt, Human
acaggguuucgccaugcugg

SEQ ID NO: 653433 - RNA, 24 nt, Human
acaggguuucgccaugcuggccag

SEQ ID NO: 653434 - RNA, 23 nt, Human
acccagguuggagugcaguggug

SEQ ID NO: 653435 - RNA, 27 nt, Human
acccugcccaccgccccaugcccccca

SEQ ID NO: 653436 - RNA, 20 nt, Human
accuaguagguucaugauac

SEQ ID NO: 653437 - RNA, 18 nt, Human
acucgucacccagguugg

SEQ ID NO: 653438 - RNA, 18 nt, Human
acugcaagcuccgccucc

SEQ ID NO: 653439 - RNA, 22 nt, Human
acuucauuccaccucucuccag

SEQ ID NO: 653440 - RNA, 18 nt, Human
agacaggguuucgccaug

SEQ ID NO: 653441 - RNA, 23 nt, Human
agacucacgcuucacguucagcu

SEQ ID NO: 653442 - RNA, 23 nt, Human
agauaaugaugcgaaaaaaaucc

SEQ ID NO: 653443 - RNA, 19 nt, Human
agaugacaggcgugagcca

SEQ ID NO: 653444 - RNA, 19 nt, Human
agccaccgcacccggccua

SEQ ID NO: 653445 - RNA, 19 nt, Human
agccaccgcaccuggcuua

SEQ ID NO: 653446 - RNA, 19 nt, Human
agcccgugcaggagccugg

SEQ ID NO: 653447 - RNA, 18 nt, Human
agcuccgccuccuggguu

SEQ ID NO: 653448 - RNA, 20 nt, Human
aggcggcgugaccagggcug

SEQ ID NO: 653449 - RNA, 25 nt, Human
aggcuggagugcaguggcgcgaucu

SEQ ID NO: 653450 - RNA, 18 nt, Human
aggugacacagaccuugc

SEQ ID NO: 653451 - RNA, 25 nt, Human
agguuggagugcaguggugcgaucu

SEQ ID NO: 653452 - RNA, 22 nt, Human
aguagagacaggguuucgccau

SEQ ID NO: 653453 - RNA, 18 nt, Human
aguagcugggauuacagg

SEQ ID NO: 653454 - RNA, 23 nt, Human
agugcaguggcgcgaucuuggcu

SEQ ID NO: 653455 - RNA, 24 nt, Human
agugcaguggcgcgaucuuggcuc

SEQ ID NO: 653456 - RNA, 21 nt, Human
agugcaguggugcgaucucag

SEQ ID NO: 653457 - RNA, 23 nt, Human
agugcaguggugcgaucucagcu

SEQ ID NO: 653458 - RNA, 24 nt, Human
agugcaguggugcgaucucagcuc

SEQ ID NO: 653459 - RNA, 24 nt, Human
aguggugcgaucucagcucacugc

SEQ ID NO: 653460 - RNA, 21 nt, Human
aguucaagugauccuccugcc

SEQ ID NO: 653461 - RNA, 18 nt, Human
augggguuucaccauguu

SEQ ID NO: 653462 - RNA, 20 nt, Human
augggguuucaccauguuag

SEQ ID NO: 653463 - RNA, 24 nt, Human
caaagugcuaggauuacaggcgug

SEQ ID NO: 653464 - RNA, 24 nt, Human
caaagugcugagaugacaggcgug

SEQ ID NO: 653465 - RNA, 21 nt, Human
caaaucaccccucaggaaccc

SEQ ID NO: 653466 - RNA, 23 nt, Human
caaggcggcgugaccagggcugg

SEQ ID NO: 653467 - RNA, 27 nt, Human
caagugauccucccgccuuggccuccc

SEQ ID NO: 653468 - RNA, 22 nt, Human
caagugauccuccugccucagc

SEQ ID NO: 653469 - RNA, 27 nt, Human
caagugauccuccugccucagccuccc

SEQ ID NO: 653470 - RNA, 23 nt, Human
cacagaccuugcccuucccacag

SEQ ID NO: 653471 - RNA, 18 nt, Human
caccagggcugacaaggc

SEQ ID NO: 653472 - RNA, 18 nt, Human
caccauguuagccaggau

SEQ ID NO: 653473 - RNA, 22 nt, Human
caccauguuagccaggaugguc

SEQ ID NO: 653474 - RNA, 24 nt, Human
caccauguuagccaggauggucuc

SEQ ID NO: 653475 - RNA, 24 nt, Human
cacccaggcuggagugcaguggcg

SEQ ID NO: 653476 - RNA, 21 nt, Human
cacccagguuggagugcagug

SEQ ID NO: 653477 - RNA, 19 nt, Human
caccgcacccggccuaagu

SEQ ID NO: 653478 - RNA, 19 nt, Human
caccuggcuuuagaugucc

SEQ ID NO: 653479 - RNA, 21 nt, Human
cacucgucacccagguuggag

SEQ ID NO: 653480 - RNA, 23 nt, Human
cagcaagcaggucagagugacuu

SEQ ID NO: 653481 - RNA, 26 nt, Human
cagcaagcaggucagagugacuuccu

SEQ ID NO: 653482 - RNA, 21 nt, Human
caggagccugggggacugaga

SEQ ID NO: 653483 - RNA, 23 nt, Human
caggcgccugccaucaugccugg

SEQ ID NO: 653484 - RNA, 24 nt, Human
caggguuucgccaugcuggccagg

SEQ ID NO: 653485 - RNA, 21 nt, Human
caggugcccaccaccacaccc

SEQ ID NO: 653486 - RNA, 23 nt, Human
caggugcccaccaccacacccag

SEQ ID NO: 653487 - RNA, 19 nt, Human
caguggcgcgaucuuggcu

SEQ ID NO: 653488 - RNA, 21 nt, Human
caugccccccauuggcagccg

SEQ ID NO: 653489 - RNA, 24 nt, Human
caugcuggccaggcuggucucgaa

SEQ ID NO: 653490 - RNA, 22 nt, Human
caugucauucuccugccuuggc

SEQ ID NO: 653491 - RNA, 22 nt, Human
ccaaagugcuaggauuacaggc

SEQ ID NO: 653492 - RNA, 22 nt, Human
ccaaagugcuaggauuacaggc

SEQ ID NO: 653493 - RNA, 24 nt, Human
ccaaagugcuaggauuacaggcgu

SEQ ID NO: 653494 - RNA, 22 nt, Human
ccaaagugcugagaugacaggc

SEQ ID NO: 653495 - RNA, 24 nt, Human
ccaaagugcugagaugacaggcgu

SEQ ID NO: 653496 - RNA, 22 nt, Human
ccaaaucaccccucaggaaccc

SEQ ID NO: 653497 - RNA, 20 nt, Human
ccaccgcaccuggcuuaagu

SEQ ID NO: 653498 - RNA, 20 nt, Human
ccaccucucuccaguccugc

SEQ ID NO: 653499 - RNA, 19 nt, Human
ccaugcuggccaggcuggu

SEQ ID NO: 653500 - RNA, 22 nt, Human
ccaugcuggccaggcuggucuc

SEQ ID NO: 653501 - RNA, 23 nt, Human
ccaugcuggccaggcuggucucg

SEQ ID NO: 653502 - RNA, 19 nt, Human
cccaaaucaccccucagga

SEQ ID NO: 653503 - RNA, 23 nt, Human
cccaaguagcugggacuacaggc

SEQ ID NO: 653504 - RNA, 23 nt, Human
cccaaguagcugggacuacaggc

SEQ ID NO: 653505 - RNA, 21 nt, Human
cccaccaccacacccagcuaa

SEQ ID NO: 653506 - RNA, 26 nt, Human
ccccccgccucggccuuccaaagugc

SEQ ID NO: 653507 - RNA, 23 nt, Human
cccgaguagcugggauuacaggu

SEQ ID NO: 653508 - RNA, 24 nt, Human
cccgaguagcugggauuacaggug

SEQ ID NO: 653509 - RNA, 24 nt, Human
cccucugucacccaggcuggagug

SEQ ID NO: 653510 - RNA, 23 nt, Human
cccugcccugggugcaugccccc

SEQ ID NO: 653511 - RNA, 21 nt, Human
ccgaguagcugggauuacagg

SEQ ID NO: 653512 - RNA, 21 nt, Human
ccgugcaggagccugggggac

SEQ ID NO: 653513 - RNA, 26 nt, Human
ccucccgccuuggccucccaaagugc

SEQ ID NO: 653514 - RNA, 24 nt, Human
ccuccugccucagccucccgagua

SEQ ID NO: 653515 - RNA, 24 nt, Human
ccuccuggguucaugucauucucc

SEQ ID NO: 653516 - RNA, 18 nt, Human
ccugaccucaagugaucc

SEQ ID NO: 653517 - RNA, 23 nt, Human
ccugccucagccucccgaguagc

SEQ ID NO: 653518 - RNA, 24 nt, Human
ccugccucagccucccgaguagcu

SEQ ID NO: 653519 - RNA, 21 nt, Human
ccugggacucuugaauuucug

SEQ ID NO: 653520 - RNA, 25 nt, Human
ccuuggccucccaaguagcugggac

SEQ ID NO: 653521 - RNA, 19 nt, Human
cgaaaaaaauccccaccaa

SEQ ID NO: 653522 - RNA, 21 nt, Human
cgaaaaaaauccccaccaaga

SEQ ID NO: 653523 - RNA, 24 nt, Human
cgccaugcuggccaggcuggucuc

SEQ ID NO: 653524 - RNA, 27 nt, Human
cgccaugcuggccaggcuggucucgaa

SEQ ID NO: 653525 - RNA, 24 nt, Human
cuaguagagacaggguuucgccau

SEQ ID NO: 653526 - RNA, 24 nt, Human
cucaagugauccucccgccuuggc

SEQ ID NO: 653527 - RNA, 24 nt, Human
cucacucgucacccagguuggagu

SEQ ID NO: 653528 - RNA, 23 nt, Human
cucagccucccgaguagcuggga

SEQ ID NO: 653529 - RNA, 27 nt, Human
cucauuggaacccccucuaggagccaa

SEQ ID NO: 653530 - RNA, 21 nt, Human
cuccaucacuccccucucucg

SEQ ID NO: 653531 - RNA, 24 nt, Human
cuccugaccuugugauccccccgc

SEQ ID NO: 653532 - RNA, 21 nt, Human
cuccuggguucaugucauucu

SEQ ID NO: 653533 - RNA, 19 nt, Human
cucgcuguaaccucuaccu

SEQ ID NO: 653534 - RNA, 23 nt, Human
cucgcuguaaccucuaccucccc

SEQ ID NO: 653535 - RNA, 24 nt, Human
cucgucacccagguuggagugcag

SEQ ID NO: 653536 - RNA, 23 nt, Human
cucugucacccaggcuggagugc

SEQ ID NO: 653537 - RNA, 24 nt, Human
cugcaaaagaacagagcccgugca

SEQ ID NO: 653538 - RNA, 22 nt, Human
cugcauccugaagcuggcaggu

SEQ ID NO: 653539 - RNA, 25 nt, Human
cugcccaccgccccaugccccccau

SEQ ID NO: 653540 - RNA, 23 nt, Human
cugccuuggccucccaaguagcu

SEQ ID NO: 653541 - RNA, 22 nt, Human
cuggcuccgcguggggcaagag

SEQ ID NO: 653542 - RNA, 19 nt, Human
cuucauuccaccucucucc

SEQ ID NO: 653543 - RNA, 19 nt, Human
cuucccccugcccugggug

SEQ ID NO: 653544 - RNA, 27 nt, Human
cuugugauccccccgccucggccuucc

SEQ ID NO: 653545 - RNA, 23 nt, Human
gaccucaagugauccucccgccu

SEQ ID NO: 653546 - RNA, 22 nt, Human
gaccuugugauccccccgccuc

SEQ ID NO: 653547 - RNA, 24 nt, Human
gaccuugugauccccccgccucgg

SEQ ID NO: 653548 - RNA, 24 nt, Human
gacuacaggcgccugccaucaugc

SEQ ID NO: 653549 - RNA, 20 nt, Human
gagauggaguuucccucugu

SEQ ID NO: 653550 - RNA, 18 nt, Human
gagaugggguuucaccau

SEQ ID NO: 653551 - RNA, 24 nt, Human
gagaugggguuucaccauguuagc

SEQ ID NO: 653552 - RNA, 22 nt, Human
gaggaugccgccgucugugcag

SEQ ID NO: 653553 - RNA, 18 nt, Human
gauccucccgccuuggcc

SEQ ID NO: 653554 - RNA, 18 nt, Human
gaugacaggcgugagcca

SEQ ID NO: 653555 - RNA, 18 nt, Human
gauuacaggcgugagcca

SEQ ID NO: 653556 - RNA, 22 nt, Human
gauuacaggcgugagccaccgc

SEQ ID NO: 653557 - RNA, 23 nt, Human
gauuacaggcgugagccaccgca

SEQ ID NO: 653558 - RNA, 23 nt, Human
gccuggcuaauuuuuuguauuuu

SEQ ID NO: 653559 - RNA, 22 nt, Human
gccuuggccucccaaagugcug

SEQ ID NO: 653560 - RNA, 20 nt, Human
gccuuggccucccaaguagc

SEQ ID NO: 653561 - RNA, 22 nt, Human
gcgaaaaaaauccccaccaaga

SEQ ID NO: 653562 - RNA, 19 nt, Human
gcucacugcugcacccugc

SEQ ID NO: 653563 - RNA, 21 nt, Human
gcucgcuguaaccucuaccuc

SEQ ID NO: 653564 - RNA, 19 nt, Human
gcuggagugcaguggcgcg

SEQ ID NO: 653565 - RNA, 23 nt, Human
gcuggcaggucacaaucuuccca

SEQ ID NO: 653566 - RNA, 23 nt, Human
gcuggucucgaacuccugaccuc

SEQ ID NO: 653567 - RNA, 20 nt, Human
gcuguaaccucuaccucccc

SEQ ID NO: 653568 - RNA, 21 nt, Human
gcuguaaccucuaccucccca

SEQ ID NO: 653569 - RNA, 24 nt, Human
ggacuacaggcgccugccaucaug

SEQ ID NO: 653570 - RNA, 22 nt, Human
ggauuacaggcgugagccaccg

SEQ ID NO: 653571 - RNA, 25 nt, Human
ggcuggggagaaggugacacagacc

SEQ ID NO: 653572 - RNA, 24 nt, Human
ggcuggucucgaacuccugaccuc

SEQ ID NO: 653573 - RNA, 22 nt, Human
gggguuucaccauguuagccag

SEQ ID NO: 653574 - RNA, 19 nt, Human
ggucucgaacuccugaccu

SEQ ID NO: 653575 - RNA, 19 nt, Human
ggucucgaucuccugaccu

SEQ ID NO: 653576 - RNA, 20 nt, Human
ggucucgaucuccugaccuu

SEQ ID NO: 653577 - RNA, 18 nt, Human
gguggaccauuuuauucu

SEQ ID NO: 653578 - RNA, 24 nt, Human
gguuucaccauguuagccaggaug

SEQ ID NO: 653579 - RNA, 18 nt, Human
guagcugggauuacaggu

SEQ ID NO: 653580 - RNA, 24 nt, Human
gucucacucgucacccagguugga

SEQ ID NO: 653581 - RNA, 24 nt, Human
gugauccccccgccucggccuucc

SEQ ID NO: 653582 - RNA, 24 nt, Human
gugauccuccugccucagccuccc

SEQ ID NO: 653583 - RNA, 20 nt, Human
gugcaugcccccugcggggc

SEQ ID NO: 653584 - RNA, 23 nt, Human
uaaccagauaauccccaauucau

SEQ ID NO: 653585 - RNA, 26 nt, Human
uaaccagauaauccccaauucauguc

SEQ ID NO: 653586 - RNA, 26 nt, Human
uaauuuuucuguauuucuaguagaga

SEQ ID NO: 653587 - RNA, 24 nt, Human
uaauuuuuuguauuuuuacuagag

SEQ ID NO: 653588 - RNA, 21 nt, Human
uacaccuggcuuuagaugucc

SEQ ID NO: 653589 - RNA, 23 nt, Human
uacaggcgugagccaccgcaccc

SEQ ID NO: 653590 - RNA, 24 nt, Human
uacaggugcccaccaccacaccca

SEQ ID NO: 653591 - RNA, 22 nt, Human
uacccauagcaggagaaauuca

SEQ ID NO: 653592 - RNA, 24 nt, Human
uacuagagaugggguuucaccaug

SEQ ID NO: 653593 - RNA, 20 nt, Human
uagagacaggguuucgccau

SEQ ID NO: 653594 - RNA, 22 nt, Human
uagagaugggguuucaccaugu

SEQ ID NO: 653595 - RNA, 18 nt, Human
uaggauuacaggcgugag

SEQ ID NO: 653596 - RNA, 19 nt, Human
uaggauuacaggcgugagc

SEQ ID NO: 653597 - RNA, 22 nt, Human
uaggauuacaggcgugagccac

SEQ ID NO: 653598 - RNA, 23 nt, Human
uaggauuacaggcgugagccacc

SEQ ID NO: 653599 - RNA, 24 nt, Human
uaggauuacaggcgugagccaccg

SEQ ID NO: 653600 - RNA, 24 nt, Human
uaguagagacaggguuucgccaug

SEQ ID NO: 653601 - RNA, 18 nt, Human
ucaagugauccuccugcc

SEQ ID NO: 653602 - RNA, 24 nt, Human
ucaccauguuagccaggauggucu

SEQ ID NO: 653603 - RNA, 24 nt, Human
ucacccaggcuggagugcaguggc

SEQ ID NO: 653604 - RNA, 22 nt, Human
ucacccagguuggagugcagug

SEQ ID NO: 653605 - RNA, 18 nt, Human
ucacugcaagcuccgccu

SEQ ID NO: 653606 - RNA, 23 nt, Human
ucacugcaagcuccgccuccugg

SEQ ID NO: 653607 - RNA, 24 nt, Human
ucacugcaagcuccgccuccuggg

SEQ ID NO: 653608 - RNA, 19 nt, Human
ucacugcagcgcuggcucc

SEQ ID NO: 653609 - RNA, 23 nt, Human
ucacugcagcgcuggcuccgcgu

SEQ ID NO: 653610 - RNA, 20 nt, Human
ucagccucccgaguagcugg

SEQ ID NO: 653611 - RNA, 19 nt, Human
ucagcucacugcaagcucc

SEQ ID NO: 653612 - RNA, 20 nt, Human
ucaggaaccccuugccacuu

SEQ ID NO: 653613 - RNA, 24 nt, Human
ucccaaagugcugagaugacaggc

SEQ ID NO: 653614 - RNA, 24 nt, Human
ucccaaguagcugggacuacaggc

SEQ ID NO: 653615 - RNA, 18 nt, Human
ucccacaggcaugccggg

SEQ ID NO: 653616 - RNA, 23 nt, Human
ucccgaguagcugggauuacagg

SEQ ID NO: 653617 - RNA, 24 nt, Human
ucccgaguagcugggauuacaggu

SEQ ID NO: 653618 - RNA, 20 nt, Human
ucccucugucacccaggcug

SEQ ID NO: 653619 - RNA, 21 nt, Human
ucccucugucacccaggcugg

SEQ ID NO: 653620 - RNA, 22 nt, Human
ucccucugucacccaggcugga

SEQ ID NO: 653621 - RNA, 24 nt, Human
ucccucugucacccaggcuggagu

SEQ ID NO: 653622 - RNA, 24 nt, Human
uccuggguucaugucauucuccug

SEQ ID NO: 653623 - RNA, 19 nt, Human
ucgcuguaaccucuaccuc

SEQ ID NO: 653624 - RNA, 18 nt, Human
ucggccuuccaaagugcu

SEQ ID NO: 653625 - RNA, 21 nt, Human
ucucacucgucacccagguug

SEQ ID NO: 653626 - RNA, 23 nt, Human
ucucacucgucacccagguugga

SEQ ID NO: 653627 - RNA, 23 nt, Human
ucuccaguccugcuuuguuuuuu

SEQ ID NO: 653628 - RNA, 21 nt, Human
ucucgaacuccugaccucaag

SEQ ID NO: 653629 - RNA, 29 nt, Human
ucuggagggagcuggauaugagguggaaa

SEQ ID NO: 653630 - RNA, 24 nt, Human
ucugucacccaggcuggagugcag

SEQ ID NO: 653631 - RNA, 18 nt, Human
ucugugcaggcuuccccc

SEQ ID NO: 653632 - RNA, 23 nt, Human
ucuugaauuucuggagggagcug

SEQ ID NO: 653633 - RNA, 20 nt, Human
ugaagacagacuugaugguc

SEQ ID NO: 653634 - RNA, 18 nt, Human
ugaccucaagugauccuc

SEQ ID NO: 653635 - RNA, 20 nt, Human
ugaccucaagugauccuccc

SEQ ID NO: 653636 - RNA, 21 nt, Human
ugaccucaagugauccucccg

SEQ ID NO: 653637 - RNA, 24 nt, Human
ugaccucaagugauccucccgccu

SEQ ID NO: 653638 - RNA, 18 nt, Human
ugaccuugugaucccccc

SEQ ID NO: 653639 - RNA, 23 nt, Human
ugagaugacaggcgugagccacc

SEQ ID NO: 653640 - RNA, 24 nt, Human
ugagaugacaggcgugagccaccg

SEQ ID NO: 653641 - RNA, 18 nt, Human
ugagguggaaaaggccuu

SEQ ID NO: 653642 - RNA, 19 nt, Human
ugcacccugcccaccgccc

SEQ ID NO: 653643 - RNA, 22 nt, Human
ugcaguggugcgaucucagcuc

SEQ ID NO: 653644 - RNA, 21 nt, Human
ugcccaccaccacacccagcu

SEQ ID NO: 653645 - RNA, 24 nt, Human
ugccucagccucccgaguagcugg

SEQ ID NO: 653646 - RNA, 23 nt, Human
ugcgaaaaaaauccccaccaaga

SEQ ID NO: 653647 - RNA, 24 nt, Human
ugcuaggauuacaggcgugagcca

SEQ ID NO: 653648 - RNA, 18 nt, Human
ugcuggccaggcuggucu

SEQ ID NO: 653649 - RNA, 23 nt, Human
uggagucucacucgucacccagg

SEQ ID NO: 653650 - RNA, 23 nt, Human
uggagugcaguggcgcgaucuug

SEQ ID NO: 653651 - RNA, 24 nt, Human
uggagugcaguggcgcgaucuugg

SEQ ID NO: 653652 - RNA, 23 nt, Human
uggagugcaguggugcgaucuca

SEQ ID NO: 653653 - RNA, 24 nt, Human
uggagugcaguggugcgaucucag

SEQ ID NO: 653654 - RNA, 24 nt, Human
uggccaggcuggucucgaacuccu

SEQ ID NO: 653655 - RNA, 23 nt, Human
uggcgcgaucuuggcucgcugua

SEQ ID NO: 653656 - RNA, 20 nt, Human
uggcucgcuguaaccucuac

SEQ ID NO: 653657 - RNA, 19 nt, Human
ugggacuacaggcgccugc

SEQ ID NO: 653658 - RNA, 21 nt, Human
ugggacuacaggcgccugcca

SEQ ID NO: 653659 - RNA, 22 nt, Human
ugggacuacaggcgccugccau

SEQ ID NO: 653660 - RNA, 24 nt, Human
ugggacuacaggcgccugccauca

SEQ ID NO: 653661 - RNA, 21 nt, Human
ugggauuacaggugcccacca

SEQ ID NO: 653662 - RNA, 24 nt, Human
ugggauuacaggugcccaccacca

SEQ ID NO: 653663 - RNA, 24 nt, Human
ugggguuucaccauguuagccagg

SEQ ID NO: 653664 - RNA, 24 nt, Human
uggugcgaucucagcucacugcaa

SEQ ID NO: 653665 - RNA, 21 nt, Human
uguccauacuucuuuggccau

SEQ ID NO: 653666 - RNA, 25 nt, Human
ugucccaaaucaccccucaggaacc

SEQ ID NO: 653667 - RNA, 20 nt, Human
uguuguauauuucuuuguua

SEQ ID NO: 653668 - RNA, 20 nt, Human
uguuguguuguuguuuuuuu

SEQ ID NO: 653669 - RNA, 23 nt, Human
uguuguuguuguuguguuguugu

SEQ ID NO: 653670 - RNA, 20 nt, Human
uguuuuuuugagauggaguu

SEQ ID NO: 653671 - RNA, 18 nt, Human
uuacuagagaugggguuu

SEQ ID NO: 653672 - RNA, 24 nt, Human
uuacuagagaugggguuucaccau

SEQ ID NO: 653673 - RNA, 21 nt, Human
uucaagugauccuccugccuc

SEQ ID NO: 653674 - RNA, 23 nt, Human
uucaagugauccuccugccucag

SEQ ID NO: 653675 - RNA, 24 nt, Human
uucaagugauccuccugccucagc

SEQ ID NO: 653676 - RNA, 22 nt, Human
uucccauggugacuccacugug

SEQ ID NO: 653677 - RNA, 24 nt, Human
uucccucugucacccaggcuggag

SEQ ID NO: 653678 - RNA, 18 nt, Human
uuggccucccaaagugcu

SEQ ID NO: 653679 - RNA, 24 nt, Human
uuguuguuguguuguuguuuuuuu

SEQ ID NO: 653680 - RNA, 19 nt, Human
uuucaccauguuagccagg

SEQ ID NO: 653681 - RNA, 20 nt, Human
uuucaccauguuagccagga

SEQ ID NO: 653682 - RNA, 24 nt, Human
uuucccucugucacccaggcugga

SEQ ID NO: 653683 - RNA, 21 nt, Human
uuucgccaugcuggccaggcu

SEQ ID NO: 653684 - RNA, 23 nt, Human
uuucuaguagagacaggguuucg

SEQ ID NO: 653685 - RNA, 24 nt, Human
uuucuaguagagacaggguuucgc

SEQ ID NO: 653686 - RNA, 25 nt, Human
uuucuggagggagcuggauaugagg

SEQ ID NO: 653687 - RNA, 21 nt, Human
uuucuguauuucuaguagaga

SEQ ID NO: 653688 - RNA, 26 nt, Human
uuuuccuaacacacauaucacuaccu

SEQ ID NO: 653689 - RNA, 21 nt, Human
uuuucuguauuucuaguagag

SEQ ID NO: 653690 - RNA, 24 nt, Human
uuuuuacuagagaugggguuucac

SEQ ID NO: 653691 - RNA, 21 nt, Human
uuuuuguauuuuuacuagaga

SEQ ID NO: 653692 - RNA, 24 nt, Human
uuuuuuguauuuuuacuagagaug

SEQ ID NO: 653693 - RNA, 26 nt, Human
uuuuuuuuuuuugagauggagucuca

SEQ ID NO: 653694 - RNA, 22 nt, Human
uuuuuuuuuuuuuugagaugga

SEQ ID NO: 653695 - RNA, 18 nt, Human
uuuuuuuuuuuuuuuuug

SEQ ID NO: 653696 - RNA, 27 nt, Human
aaaaaaaaaaaaaaaaaaggcucacaa

SEQ ID NO: 653697 - RNA, 26 nt, Human
aaaaaaaaaaaaaaaaggcucacaag

SEQ ID NO: 653698 - RNA, 18 nt, Human
aaaaaaaacaaagcaaca

SEQ ID NO: 653699 - RNA, 24 nt, Human
aaaaaaaacaaagcaacaaaugca

SEQ ID NO: 653700 - RNA, 25 nt, Human
aaaaaaacaaagcaacaaaugcaga

SEQ ID NO: 653701 - RNA, 23 nt, Human
aaaaaaaggcucacaaguucuaa

SEQ ID NO: 653702 - RNA, 23 nt, Human
aaaagaacaucucccauuaagcc

SEQ ID NO: 653703 - RNA, 24 nt, Human
aaaaggaaaaaaaaacgcagugag

SEQ ID NO: 653704 - RNA, 25 nt, Human
aaaaggaaaaaaaaacgcagugagg

SEQ ID NO: 653705 - RNA, 21 nt, Human
aaacaaagccaaauuauaauc

SEQ ID NO: 653706 - RNA, 20 nt, Human
aaagcuucccacccucccgg

SEQ ID NO: 653707 - RNA, 19 nt, Human
aaaggaaacccaauaaagg

SEQ ID NO: 653708 - RNA, 19 nt, Human
aacacuuuccacacagugc

SEQ ID NO: 653709 - RNA, 20 nt, Human
aagacaaaagaacaucuccc

SEQ ID NO: 653710 - RNA, 22 nt, Human
aagaguuauccacccuacagua

SEQ ID NO: 653711 - RNA, 25 nt, Human
aaguacuauagaccacaaauaaacu

SEQ ID NO: 653712 - RNA, 28 nt, Human
aaucauuccgagagccacaaacacucaa

SEQ ID NO: 653713 - RNA, 18 nt, Human
acaaaacuuauacagaag

SEQ ID NO: 653714 - RNA, 19 nt, Human
acaaagcaacaaaugcaga

SEQ ID NO: 653715 - RNA, 20 nt, Human
acaaagcaacaaaugcagag

SEQ ID NO: 653716 - RNA, 20 nt, Human
acaaagcaacaaaugcagag

SEQ ID NO: 653717 - RNA, 21 nt, Human
acaaagcaacaaaugcagagc

SEQ ID NO: 653718 - RNA, 19 nt, Human
acagaacaccgcacaccca

SEQ ID NO: 653719 - RNA, 22 nt, Human
accacuccgcacaccaaccccg

SEQ ID NO: 653720 - RNA, 20 nt, Human
acccaauaaaggacguacuu

SEQ ID NO: 653721 - RNA, 19 nt, Human
acucuaaaauaaauguagc

SEQ ID NO: 653722 - RNA, 18 nt, Human
acuucugcccugaguccc

SEQ ID NO: 653723 - RNA, 22 nt, Human
agaaaaaaaaaaaaaaaaaaag

SEQ ID NO: 653724 - RNA, 22 nt, Human
agaacaucucccauuaagccuu

SEQ ID NO: 653725 - RNA, 19 nt, Human
agaauauaaaaggaaaccc

SEQ ID NO: 653726 - RNA, 23 nt, Human
agccacaaacacucaaaaauuac

SEQ ID NO: 653727 - RNA, 24 nt, Human
agcccggacagcacugagccuaaa

SEQ ID NO: 653728 - RNA, 23 nt, Human
agcgaaacgggagcggagacaga

SEQ ID NO: 653729 - RNA, 23 nt, Human
aggaaaaaaaaacgcagugaggg

SEQ ID NO: 653730 - RNA, 19 nt, Human
aggaaagaaaaaaaaaaaa

SEQ ID NO: 653731 - RNA, 18 nt, Human
aggcagaggggcgaccuu

SEQ ID NO: 653732 - RNA, 22 nt, Human
aggcagaggggcgaccuugggc

SEQ ID NO: 653733 - RNA, 20 nt, Human
agugaggggacacuucugcc

SEQ ID NO: 653734 - RNA, 18 nt, Human
agugugaacaccauuucc

SEQ ID NO: 653735 - RNA, 20 nt, Human
augcacacucacuccucuca

SEQ ID NO: 653736 - RNA, 24 nt, Human
auguaccuguacccauauuacuau

SEQ ID NO: 653737 - RNA, 24 nt, Human
caaaagaacaucucccauuaagcc

SEQ ID NO: 653738 - RNA, 21 nt, Human
caaaaguacuauagaccacag

SEQ ID NO: 653739 - RNA, 20 nt, Human
caaagcaacaaaugcagagc

SEQ ID NO: 653740 - RNA, 21 nt, Human
caaaugcagagcuaaguaacc

SEQ ID NO: 653741 - RNA, 18 nt, Human
caacaaaugcagagcuaa

SEQ ID NO: 653742 - RNA, 24 nt, Human
caacaugcacacucacuccucuca

SEQ ID NO: 653743 - RNA, 20 nt, Human
caagacaaaagaacaucucc

SEQ ID NO: 653744 - RNA, 21 nt, Human
caagacaaaagaacaucuccc

SEQ ID NO: 653745 - RNA, 26 nt, Human
caagacaaaagaacaucucccauuaa

SEQ ID NO: 653746 - RNA, 19 nt, Human
caaggccccaguuuuaaau

SEQ ID NO: 653747 - RNA, 21 nt, Human
cacacagugccuaauacauag

SEQ ID NO: 653748 - RNA, 22 nt, Human
cacacagugccuaauacauagu

SEQ ID NO: 653749 - RNA, 21 nt, Human
caccgcacacccagcguccca

SEQ ID NO: 653750 - RNA, 18 nt, Human
cacuccgcacaccaaccc

SEQ ID NO: 653751 - RNA, 24 nt, Human
cacucugugccccuuuguucugcu

SEQ ID NO: 653752 - RNA, 23 nt, Human
cagggccagugugaacaccauuu

SEQ ID NO: 653753 - RNA, 25 nt, Human
cagggcggggucaaagcuucccacc

SEQ ID NO: 653754 - RNA, 21 nt, Human
caguaguuaagauguacuggc

SEQ ID NO: 653755 - RNA, 25 nt, Human
caugaaaugggugcagguuuuuuaa

SEQ ID NO: 653756 - RNA, 18 nt, Human
ccaaauguaccuguaccc

SEQ ID NO: 653757 - RNA, 19 nt, Human
ccagcgucccaaacagcga

SEQ ID NO: 653758 - RNA, 24 nt, Human
ccccaguuuuaaauuuuccuccaa

SEQ ID NO: 653759 - RNA, 19 nt, Human
ccccuuuguucugcugucc

SEQ ID NO: 653760 - RNA, 18 nt, Human
cccuacaguaaaaagggg

SEQ ID NO: 653761 - RNA, 19 nt, Human
cccugagucccgcucacuc

SEQ ID NO: 653762 - RNA, 23 nt, Human
ccgcacaccaaccccgcucccaa

SEQ ID NO: 653763 - RNA, 20 nt, Human
ccgggacaggggcgaaggca

SEQ ID NO: 653764 - RNA, 20 nt, Human
ccucccgggacaggggcgaa

SEQ ID NO: 653765 - RNA, 22 nt, Human
cgagcagcuuaacaguuuugcu

SEQ ID NO: 653766 - RNA, 22 nt, Human
cgcacacccagcgucccaaaca

SEQ ID NO: 653767 - RNA, 19 nt, Human
cgcccagccugucccgggc

SEQ ID NO: 653768 - RNA, 19 nt, Human
cgggaaggaacgggcugug

SEQ ID NO: 653769 - RNA, 22 nt, Human
cgggcgacaggaaggcaagcgu

SEQ ID NO: 653770 - RNA, 18 nt, Human
cgggcgcgcgcccagccu

SEQ ID NO: 653771 - RNA, 20 nt, Human
cuaaaaaaaggaaagaaaaa

SEQ ID NO: 653772 - RNA, 22 nt, Human
cuacaacaguaguuaagaugua

SEQ ID NO: 653773 - RNA, 24 nt, Human
cuccaauguaauccacaagguacc

SEQ ID NO: 653774 - RNA, 22 nt, Human
cuccacuguaagucauugaaag

SEQ ID NO: 653775 - RNA, 21 nt, Human
cucccccaaauuauacuucag

SEQ ID NO: 653776 - RNA, 19 nt, Human
cuccgggaaggaacgggcu

SEQ ID NO: 653777 - RNA, 24 nt, Human
cuugucuaccccuuaacacuuucc

SEQ ID NO: 653778 - RNA, 20 nt, Human
gcaagcguacuaacugcccc

SEQ ID NO: 653779 - RNA, 24 nt, Human
gcagggguggcgagagaaggggca

SEQ ID NO: 653780 - RNA, 22 nt, Human
gcgaaggcagaggggcgaccuu

SEQ ID NO: 653781 - RNA, 21 nt, Human
ggaaaaaaaaacgcagugagg

SEQ ID NO: 653782 - RNA, 23 nt, Human
ggacacuucugcccugagucccg

SEQ ID NO: 653783 - RNA, 22 nt, Human
ggauaaaaggaaaaaaaaacgc

SEQ ID NO: 653784 - RNA, 18 nt, Human
ggcaagcguacuaacugc

SEQ ID NO: 653785 - RNA, 21 nt, Human
ggcagggcggggucaaagcuu

SEQ ID NO: 653786 - RNA, 21 nt, Human
ggcgaccuugggcaggggugg

SEQ ID NO: 653787 - RNA, 20 nt, Human
gggacaggggcgaaggcaga

SEQ ID NO: 653788 - RNA, 18 nt, Human
gggcagggguggcgagag

SEQ ID NO: 653789 - RNA, 23 nt, Human
gggcagggguggcgagagaaggg

SEQ ID NO: 653790 - RNA, 23 nt, Human
gucuaccccuuaacacuuuccac

SEQ ID NO: 653791 - RNA, 19 nt, Human
uaaaaacuacacaugagua

SEQ ID NO: 653792 - RNA, 24 nt, Human
uaaaaauaaaugccccuacuuuuc

SEQ ID NO: 653793 - RNA, 23 nt, Human
uaaaaggaaaaaaaaacgcagug

SEQ ID NO: 653794 - RNA, 21 nt, Human
uaacuaggacuucagacugca

SEQ ID NO: 653795 - RNA, 20 nt, Human
uacccaggauuuucacucca

SEQ ID NO: 653796 - RNA, 19 nt, Human
uaccccuuaacacuuucca

SEQ ID NO: 653797 - RNA, 20 nt, Human
uagaggcuauaaagcugaug

SEQ ID NO: 653798 - RNA, 21 nt, Human
uagcauugacaaguucuugug

SEQ ID NO: 653799 - RNA, 28 nt, Human
uaucuugucuaccccuuaacacuuucca

SEQ ID NO: 653800 - RNA, 22 nt, Human
ucagaaacuuugacaacaugca

SEQ ID NO: 653801 - RNA, 20 nt, Human
ucaucuuuuaaaggcucucc

SEQ ID NO: 653802 - RNA, 19 nt, Human
uccaaauguaccuguaccc

SEQ ID NO: 653803 - RNA, 18 nt, Human
uccacaaaguugauaaua

SEQ ID NO: 653804 - RNA, 18 nt, Human
uccccggccauugcuucu

SEQ ID NO: 653805 - RNA, 20 nt, Human
ucccgggcuccgggaaggaa

SEQ ID NO: 653806 - RNA, 22 nt, Human
uccgcacaccaaccccgcuccc

SEQ ID NO: 653807 - RNA, 19 nt, Human
ugaaagggcaaaaauuacg

SEQ ID NO: 653808 - RNA, 20 nt, Human
ugaauaaaccauacaaaauc

SEQ ID NO: 653809 - RNA, 18 nt, Human
ugaggggacacuucugcc

SEQ ID NO: 653810 - RNA, 23 nt, Human
ugaggggacacuucugcccugag

SEQ ID NO: 653811 - RNA, 20 nt, Human
ugccccguucuuuggauaaa

SEQ ID NO: 653812 - RNA, 19 nt, Human
ugcccugagucccgcucac

SEQ ID NO: 653813 - RNA, 23 nt, Human
ugcccugagucccgcucacucac

SEQ ID NO: 653814 - RNA, 25 nt, Human
ugcuauggaguuuucagaaaacaaa

SEQ ID NO: 653815 - RNA, 23 nt, Human
uggaguuuucagaaaacaaaauc

SEQ ID NO: 653816 - RNA, 23 nt, Human
ugggcagggcggggucaaagcuu

SEQ ID NO: 653817 - RNA, 20 nt, Human
uguccucgauaaucuggguu

SEQ ID NO: 653818 - RNA, 19 nt, Human
ugugaaaacugguguuccc

SEQ ID NO: 653819 - RNA, 19 nt, Human
ugugaacaccauuucccac

SEQ ID NO: 653820 - RNA, 20 nt, Human
ugugacagcgaaacgggagc

SEQ ID NO: 653821 - RNA, 21 nt, Human
uuaaucacaaacaaagccaaa

SEQ ID NO: 653822 - RNA, 20 nt, Human
uucaagagauaauauucaaa

SEQ ID NO: 653823 - RNA, 21 nt, Human
uucuucuguucacucugugcc

SEQ ID NO: 653824 - RNA, 20 nt, Human
uuggauaaaaggaaaaaaaa

SEQ ID NO: 653825 - RNA, 23 nt, Human
uuuacucuaaaaauaaaugcccc

SEQ ID NO: 653826 - RNA, 22 nt, Human
uuuauaaguccccggccauugc

SEQ ID NO: 653827 - RNA, 19 nt, Human
uuuugcuauaaaaacaaac

SEQ ID NO: 653828 - RNA, 30 nt, Human
uuuuuuuuuuuuuuuuuuuuuucuuuuaaa

SEQ ID NO: 653829 - RNA, 24 nt, Human
aaaggcuacccaugaugguacauc

SEQ ID NO: 653830 - RNA, 24 nt, Human
aaaucauagagaauugaccaaaac

SEQ ID NO: 653831 - RNA, 20 nt, Human
accauauuugugugcuuaga

SEQ ID NO: 653832 - RNA, 21 nt, Human
accgagauaauaugaaauaac

SEQ ID NO: 653833 - RNA, 19 nt, Human
agaaguaaaucauagagaa

SEQ ID NO: 653834 - RNA, 21 nt, Human
agagaaguaaaucauagagaa

SEQ ID NO: 653835 - RNA, 21 nt, Human
aggcagcggccgccucccggc

SEQ ID NO: 653836 - RNA, 26 nt, Human
aggcuacccaugaugguacaucacuu

SEQ ID NO: 653837 - RNA, 22 nt, Human
agguuuccaacagucaaagaca

SEQ ID NO: 653838 - RNA, 24 nt, Human
aguaaaucauagagaauugaccaa

SEQ ID NO: 653839 - RNA, 25 nt, Human
auagaagacaaccucugugccgaca

SEQ ID NO: 653840 - RNA, 19 nt, Human
augauacacaguauaaaac

SEQ ID NO: 653841 - RNA, 28 nt, Human
caaauaggcaucaaaagauaauaccugu

SEQ ID NO: 653842 - RNA, 23 nt, Human
caauguacagcuccucggccuug

SEQ ID NO: 653843 - RNA, 24 nt, Human
cacagucauaaaucuugaaugucc

SEQ ID NO: 653844 - RNA, 22 nt, Human
caccgugacuccaauguacagc

SEQ ID NO: 653845 - RNA, 20 nt, Human
cagggccauggcgcucagug

SEQ ID NO: 653846 - RNA, 22 nt, Human
cauagagaauugaccaaaacug

SEQ ID NO: 653847 - RNA, 24 nt, Human
caucccaccagcaauuccugaauu

SEQ ID NO: 653848 - RNA, 23 nt, Human
ccggcaggcagcggccgccuccc

SEQ ID NO: 653849 - RNA, 18 nt, Human
cggaagaguaauccgaug

SEQ ID NO: 653850 - RNA, 23 nt, Human
cggcaggcagcggccgccucccu

SEQ ID NO: 653851 - RNA, 21 nt, Human
cugcuugagcucucuggauuu

SEQ ID NO: 653852 - RNA, 19 nt, Human
cuuccaucuccuuucccac

SEQ ID NO: 653853 - RNA, 22 nt, Human
gacuucuuuucaagaacauccc

SEQ ID NO: 653854 - RNA, 28 nt, Human
gcacuggauucuuucuccaaccggaggg

SEQ ID NO: 653855 - RNA, 20 nt, Human
gcggaagaguaauccgauga

SEQ ID NO: 653856 - RNA, 22 nt, Human
ggaauaggugauggcauaccaa

SEQ ID NO: 653857 - RNA, 22 nt, Human
ggcagagaaaaaugacuuauaa

SEQ ID NO: 653858 - RNA, 18 nt, Human
ggcccggcaggcagcggc

SEQ ID NO: 653859 - RNA, 23 nt, Human
ggguaauacauuuuuuuuuucuc

SEQ ID NO: 653860 - RNA, 25 nt, Human
ggucccagaagagagggcccggcag

SEQ ID NO: 653861 - RNA, 22 nt, Human
gguuacaaauucuugcucugca

SEQ ID NO: 653862 - RNA, 19 nt, Human
guagaaguagauuuuauag

SEQ ID NO: 653863 - RNA, 22 nt, Human
gugaaugcaucacagucauaaa

SEQ ID NO: 653864 - RNA, 21 nt, Human
uacacaguauaaaacugaucc

SEQ ID NO: 653865 - RNA, 18 nt, Human
uacuuaucuguauucugc

SEQ ID NO: 653866 - RNA, 21 nt, Human
ucaaaaagguccaguagucaa

SEQ ID NO: 653867 - RNA, 23 nt, Human
ucaccgugacuccaauguacagc

SEQ ID NO: 653868 - RNA, 25 nt, Human
uccagggucccagaagagagggccc

SEQ ID NO: 653869 - RNA, 23 nt, Human
ucccagaagagagggcccggcag

SEQ ID NO: 653870 - RNA, 19 nt, Human
ucuauagguucaaacacug

SEQ ID NO: 653871 - RNA, 24 nt, Human
ucucuggauuuuccuucuucuugc

SEQ ID NO: 653872 - RNA, 19 nt, Human
ucuggacauugcacugggg

SEQ ID NO: 653873 - RNA, 18 nt, Human
ucuggauuuuccuucuuc

SEQ ID NO: 653874 - RNA, 23 nt, Human
ugaaauaacaaacauccugucca

SEQ ID NO: 653875 - RNA, 19 nt, Human
ugagagaaguaaaucauag

SEQ ID NO: 653876 - RNA, 19 nt, Human
ugagagaaguaaaucauag

SEQ ID NO: 653877 - RNA, 21 nt, Human
ugagcucucuggauuuuccuu

SEQ ID NO: 653878 - RNA, 22 nt, Human
ugcgauuaagaaauccauaucu

SEQ ID NO: 653879 - RNA, 20 nt, Human
ugcuuagagucagcagcuuu

SEQ ID NO: 653880 - RNA, 21 nt, Human
uggcaaaaugagagaaguaaa

SEQ ID NO: 653881 - RNA, 22 nt, Human
uguagggcaaguuugagguuac

SEQ ID NO: 653882 - RNA, 23 nt, Human
uguccgaaaauccagggucccag

SEQ ID NO: 653883 - RNA, 23 nt, Human
uuagagucagcagcuuuaaauac

SEQ ID NO: 653884 - RNA, 20 nt, Human
uuauaauccaccauauuugu

SEQ ID NO: 653885 - RNA, 19 nt, Human
uucaaacacugaaauggug

SEQ ID NO: 653886 - RNA, 24 nt, Human
uucagggcagagaaaaaugacuua

SEQ ID NO: 653887 - RNA, 21 nt, Human
uugaauguccggccauagaag

SEQ ID NO: 653888 - RNA, 22 nt, Human
uuuaaagacuucuuguccaggc

SEQ ID NO: 653889 - RNA, 19 nt, Human
uuuuucaccucugguucau

SEQ ID NO: 653890 - RNA, 25 nt, Human
uuuuucacugucuucaaaccuugac

SEQ ID NO: 653891 - RNA, 24 nt, Human
uuuuuuuuuuuuuuuuuuuuaaug

SEQ ID NO: 653892 - RNA, 21 nt, Human
aaaggcgggcgggccagguca

SEQ ID NO: 653893 - RNA, 23 nt, Human
aaccacaagauuuuucccagccc

SEQ ID NO: 653894 - RNA, 24 nt, Human
aaggcagggggcaggaaaaggccu

SEQ ID NO: 653895 - RNA, 18 nt, Human
aggcccccgcccggccag

SEQ ID NO: 653896 - RNA, 21 nt, Human
aggcgggcgggccaggucagg

SEQ ID NO: 653897 - RNA, 22 nt, Human
aggcgggcgggccaggucaggc

SEQ ID NO: 653898 - RNA, 23 nt, Human
caccaucagugcuugauguagcc

SEQ ID NO: 653899 - RNA, 24 nt, Human
ccacaagauuuuucccagcccaaa

SEQ ID NO: 653900 - RNA, 23 nt, Human
ccccaguguagugacagacaguc

SEQ ID NO: 653901 - RNA, 21 nt, Human
cccccgcccggccagacugga

SEQ ID NO: 653902 - RNA, 20 nt, Human
ccccgcccggccagacugga

SEQ ID NO: 653903 - RNA, 21 nt, Human
cccgcccggccagacuggaaa

SEQ ID NO: 653904 - RNA, 22 nt, Human
ccgcccggccagacuggaaagg

SEQ ID NO: 653905 - RNA, 22 nt, Human
ccuggaaccccaggcccacuga

SEQ ID NO: 653906 - RNA, 18 nt, Human
cgccgugcuucaggcccc

SEQ ID NO: 653907 - RNA, 25 nt, Human
cuaccagcccugacaccaucagugc

SEQ ID NO: 653908 - RNA, 20 nt, Human
cugugugcugauuaaauguc

SEQ ID NO: 653909 - RNA, 19 nt, Human
gaacacggucccacggccc

SEQ ID NO: 653910 - RNA, 19 nt, Human
gaacacggucccacggccc

SEQ ID NO: 653911 - RNA, 26 nt, Human
gaaggcuggagccgucaacuagaugg

SEQ ID NO: 653912 - RNA, 20 nt, Human
gcaggaaaaggccuugugga

SEQ ID NO: 653913 - RNA, 20 nt, Human
gcagggggcaggaaaaggcc

SEQ ID NO: 653914 - RNA, 26 nt, Human
gcccgagccgccgugcuucaggcccc

SEQ ID NO: 653915 - RNA, 21 nt, Human
gcuucaggcccccgcccggcc

SEQ ID NO: 653916 - RNA, 20 nt, Human
ggaaacaaaggcaccaagga

SEQ ID NO: 653917 - RNA, 18 nt, Human
ggcaggaaaaggccuugu

SEQ ID NO: 653918 - RNA, 20 nt, Human
ggccuuguggaaacaaaggc

SEQ ID NO: 653919 - RNA, 19 nt, Human
gguucuggguugcaggagg

SEQ ID NO: 653920 - RNA, 23 nt, Human
gucaagugagauuagagcaguuu

SEQ ID NO: 653921 - RNA, 20 nt, Human
gucaugacugcugcugaguu

SEQ ID NO: 653922 - RNA, 21 nt, Human
uaaaguuuuguuccuuuuuaa

SEQ ID NO: 653923 - RNA, 22 nt, Human
uaaccacaagauuuuucccagc

SEQ ID NO: 653924 - RNA, 26 nt, Human
uaacuaccagcccugacaccaucagu

SEQ ID NO: 653925 - RNA, 18 nt, Human
ucccacggcccgagccgc

SEQ ID NO: 653926 - RNA, 18 nt, Human
ucucccagcuccugcucc

SEQ ID NO: 653927 - RNA, 21 nt, Human
ucuuuggcaaggcagggggcc

SEQ ID NO: 653928 - RNA, 24 nt, Human
ugacgcacugggcacggggcucug

SEQ ID NO: 653929 - RNA, 18 nt, Human
ugauuugguaacuaccag

SEQ ID NO: 653930 - RNA, 18 nt, Human
uggcaaggcagggggcag

SEQ ID NO: 653931 - RNA, 21 nt, Human
uggcaaggcagggggcaggaa

SEQ ID NO: 653932 - RNA, 27 nt, Human
uggcaaggcagggggcaggaaaaggcc

SEQ ID NO: 653933 - RNA, 21 nt, Human
uuaaaggaaauaaccacaaga

SEQ ID NO: 653934 - RNA, 23 nt, Human
uuagagcaguuuucuccaguucu

SEQ ID NO: 653935 - RNA, 21 nt, Human
uuccagcgccaauuuuaggcc

SEQ ID NO: 653936 - RNA, 18 nt, Human
uucccagcccaaauucca

SEQ ID NO: 653937 - RNA, 24 nt, Human
uuuuuuuuuuuuuuuuuuacauug

SEQ ID NO: 653938 - RNA, 18 nt, Human
aaacaaauauaucaaaca

SEQ ID NO: 653939 - RNA, 21 nt, Human
aaacaaauauaucaaacaauu

SEQ ID NO: 653940 - RNA, 23 nt, Human
aaacaaauauaucaaacaauuac

SEQ ID NO: 653941 - RNA, 20 nt, Human
aaagguucaggagagcagag

SEQ ID NO: 653942 - RNA, 18 nt, Human
acaggccaguggcucuua

SEQ ID NO: 653943 - RNA, 22 nt, Human
acauuauacaaagaguuuaaac

SEQ ID NO: 653944 - RNA, 19 nt, Human
caaaugggccgagacaagc

SEQ ID NO: 653945 - RNA, 24 nt, Human
caacucaucuuacacauaauaacu

SEQ ID NO: 653946 - RNA, 19 nt, Human
cagaaaaauagcaacucau

SEQ ID NO: 653947 - RNA, 20 nt, Human
caggagagcagagaaaaggc

SEQ ID NO: 653948 - RNA, 24 nt, Human
cccuggcgacugucccaaucgcgc

SEQ ID NO: 653949 - RNA, 20 nt, Human
cgccaccgucucucagcagc

SEQ ID NO: 653950 - RNA, 23 nt, Human
cucagccaucccuggcgacuguc

SEQ ID NO: 653951 - RNA, 22 nt, Human
cuggcgacugucccaaucgcgc

SEQ ID NO: 653952 - RNA, 20 nt, Human
cuuuaaaaaaugcucugagg

SEQ ID NO: 653953 - RNA, 19 nt, Human
ucaaaugggccgagacaag

SEQ ID NO: 653954 - RNA, 20 nt, Human
ucagcagccucgggauugau

SEQ ID NO: 653955 - RNA, 22 nt, Human
ucccaaucgcgccaccgucucu

SEQ ID NO: 653956 - RNA, 25 nt, Human
ugagucucugacauuauacaaagag

SEQ ID NO: 653957 - RNA, 20 nt, Human
ugucccaaucgcgccaccgu

SEQ ID NO: 653958 - RNA, 21 nt, Human
uuuuuuuuuuuuauaagaauc

SEQ ID NO: 653959 - RNA, 24 nt, Human
uuuuuuuuuuuuuuuuuuauaaga

SEQ ID NO: 653960 - RNA, 25 nt, Human
aagcuggaguccaacaaucauuaac

SEQ ID NO: 653961 - RNA, 21 nt, Human
acaagagcgcaggagcucgca

SEQ ID NO: 653962 - RNA, 22 nt, Human
acagaacacacuaaacagucac

SEQ ID NO: 653963 - RNA, 20 nt, Human
acauacccgcccccacaaca

SEQ ID NO: 653964 - RNA, 19 nt, Human
accccaccucgccccucag

SEQ ID NO: 653965 - RNA, 24 nt, Human
accuggaccuccagccgccggcgc

SEQ ID NO: 653966 - RNA, 24 nt, Human
acgcugccgggccccgagcugucc

SEQ ID NO: 653967 - RNA, 22 nt, Human
acgggauggggugggaucugcc

SEQ ID NO: 653968 - RNA, 20 nt, Human
agaaggaagccccccgccac

SEQ ID NO: 653969 - RNA, 22 nt, Human
agaccagagcucggccagggga

SEQ ID NO: 653970 - RNA, 21 nt, Human
agagaagcagcuuugccugga

SEQ ID NO: 653971 - RNA, 24 nt, Human
agcacaggcagguuuagccuuggg

SEQ ID NO: 653972 - RNA, 21 nt, Human
agccgccacaagcugcuuggu

SEQ ID NO: 653973 - RNA, 18 nt, Human
agccuuggggugggggac

SEQ ID NO: 653974 - RNA, 21 nt, Human
aggacguggguggccccagcc

SEQ ID NO: 653975 - RNA, 21 nt, Human
agggaggggagguccaugaug

SEQ ID NO: 653976 - RNA, 19 nt, Human
agugguggcuguugcuagc

SEQ ID NO: 653977 - RNA, 22 nt, Human
auacagacauacccgcccccac

SEQ ID NO: 653978 - RNA, 18 nt, Human
auagacaaauauacagau

SEQ ID NO: 653979 - RNA, 21 nt, Human
cacaaagacacccaggagucc

SEQ ID NO: 653980 - RNA, 21 nt, Human
cacacacacugaucacacacc

SEQ ID NO: 653981 - RNA, 23 nt, Human
cacacacacugaucacacaccac

SEQ ID NO: 653982 - RNA, 19 nt, Human
cacauucaagccugggccc

SEQ ID NO: 653983 - RNA, 19 nt, Human
cacauucacagaacacacu

SEQ ID NO: 653984 - RNA, 20 nt, Human
caccaucuuuggggccucgg

SEQ ID NO: 653985 - RNA, 21 nt, Human
caccgggcagccggaccggca

SEQ ID NO: 653986 - RNA, 22 nt, Human
caccuggaccuccagccgccgg

SEQ ID NO: 653987 - RNA, 19 nt, Human
cacgcuggggucugcgaga

SEQ ID NO: 653988 - RNA, 18 nt, Human
cacucuccuucccaccag

SEQ ID NO: 653989 - RNA, 22 nt, Human
cagaacacacuaaacagucaca

SEQ ID NO: 653990 - RNA, 24 nt, Human
cagaacacacuaaacagucacaaa

SEQ ID NO: 653991 - RNA, 21 nt, Human
cagagcucggccaggggacac

SEQ ID NO: 653992 - RNA, 24 nt, Human
cagcagcacccuggagcccgagga

SEQ ID NO: 653993 - RNA, 23 nt, Human
cagcgccgggacccccgcagcag

SEQ ID NO: 653994 - RNA, 21 nt, Human
cagggcagaaggaagcccccc

SEQ ID NO: 653995 - RNA, 18 nt, Human
caggugggaaaugcgugu

SEQ ID NO: 653996 - RNA, 22 nt, Human
caguccccucccuuccaguccc

SEQ ID NO: 653997 - RNA, 20 nt, Human
cauucuagcuccagcaaggg

SEQ ID NO: 653998 - RNA, 19 nt, Human
ccagccguccucaaucucc

SEQ ID NO: 653999 - RNA, 23 nt, Human
ccagcgcccuccuuagagacccc

SEQ ID NO: 654000 - RNA, 23 nt, Human
ccaggagucccuuuuccaucccc

SEQ ID NO: 654001 - RNA, 26 nt, Human
ccagugguggcuguugcuagcuucuu

SEQ ID NO: 654002 - RNA, 19 nt, Human
cccaccagcccuuauccuc

SEQ ID NO: 654003 - RNA, 18 nt, Human
ccccagccaggucaggcc

SEQ ID NO: 654004 - RNA, 20 nt, Human
ccccaucuagaucugcccuc

SEQ ID NO: 654005 - RNA, 18 nt, Human
cccccacaacaauacuca

SEQ ID NO: 654006 - RNA, 21 nt, Human
cccccacaacaauacucaaau

SEQ ID NO: 654007 - RNA, 25 nt, Human
cccccacaacaauacucaaauacau

SEQ ID NO: 654008 - RNA, 25 nt, Human
cccccgcagcagcacccuggagccc

SEQ ID NO: 654009 - RNA, 19 nt, Human
cccccuuuccuccuccucu

SEQ ID NO: 654010 - RNA, 23 nt, Human
ccccugcaucaccuggaccucca

SEQ ID NO: 654011 - RNA, 19 nt, Human
ccccuuuccuccuccucuc

SEQ ID NO: 654012 - RNA, 21 nt, Human
cccgcagcagcacccuggagc

SEQ ID NO: 654013 - RNA, 26 nt, Human
cccgcccccacaacaauacucaaaua

SEQ ID NO: 654014 - RNA, 21 nt, Human
cccguuccucuuccccagcca

SEQ ID NO: 654015 - RNA, 23 nt, Human
ccgaggacgacgacgaggacgag

SEQ ID NO: 654016 - RNA, 24 nt, Human
ccgccggcgcugcuccuucucgcu

SEQ ID NO: 654017 - RNA, 20 nt, Human
ccggacaagcgcggcugagc

SEQ ID NO: 654018 - RNA, 20 nt, Human
ccggcucagcgccgggaccc

SEQ ID NO: 654019 - RNA, 23 nt, Human
ccggcucagcgccgggacccccg

SEQ ID NO: 654020 - RNA, 22 nt, Human
ccuccuccucucuaaggcuccc

SEQ ID NO: 654021 - RNA, 21 nt, Human
ccuguccccacagugcccugg

SEQ ID NO: 654022 - RNA, 22 nt, Human
ccuguccccacagugcccuggg

SEQ ID NO: 654023 - RNA, 21 nt, Human
ccuuccaguccagcauggguc

SEQ ID NO: 654024 - RNA, 25 nt, Human
ccuuuaccgggcugcugugcucuuc

SEQ ID NO: 654025 - RNA, 22 nt, Human
cgccaaggcggccucccccuca

SEQ ID NO: 654026 - RNA, 19 nt, Human
cgccgggacccccgcagcg

SEQ ID NO: 654027 - RNA, 18 nt, Human
cgcucuucagcuccuccc

SEQ ID NO: 654028 - RNA, 24 nt, Human
cgggacccccgcagcagcacccug

SEQ ID NO: 654029 - RNA, 20 nt, Human
cgggacugggggaguagggg

SEQ ID NO: 654030 - RNA, 18 nt, Human
cguguggaugacgcgcgg

SEQ ID NO: 654031 - RNA, 18 nt, Human
cuaggagggggagcggug

SEQ ID NO: 654032 - RNA, 20 nt, Human
cucaggcagcgccuucagcu

SEQ ID NO: 654033 - RNA, 22 nt, Human
cuccccagcuugcagcuucagc

SEQ ID NO: 654034 - RNA, 22 nt, Human
cuccucucuaaggcucccgcca

SEQ ID NO: 654035 - RNA, 23 nt, Human
cuccuucccaccagcccuuaucc

SEQ ID NO: 654036 - RNA, 22 nt, Human
cucuuccucuuggcuuugcugg

SEQ ID NO: 654037 - RNA, 20 nt, Human
cuggcccacaggccucaggc

SEQ ID NO: 654038 - RNA, 19 nt, Human
cuggggaagagaagcagcu

SEQ ID NO: 654039 - RNA, 22 nt, Human
cuggggaagagaagcagcuuug

SEQ ID NO: 654040 - RNA, 23 nt, Human
cuuccccagccaccagccguccu

SEQ ID NO: 654041 - RNA, 20 nt, Human
cuucguccuugacacucucc

SEQ ID NO: 654042 - RNA, 27 nt, Human
gaacacacuaaacagucacaaagacac

SEQ ID NO: 654043 - RNA, 18 nt, Human
gacacucuccuucccacc

SEQ ID NO: 654044 - RNA, 22 nt, Human
gacacucuccuucccaccagcc

SEQ ID NO: 654045 - RNA, 20 nt, Human
gacgacgaggacgaggagga

SEQ ID NO: 654046 - RNA, 21 nt, Human
gacgaggacgaggaggacacg

SEQ ID NO: 654047 - RNA, 19 nt, Human
gagauaccacuuuccgugg

SEQ ID NO: 654048 - RNA, 19 nt, Human
gagcacaggcagguuuagc

SEQ ID NO: 654049 - RNA, 23 nt, Human
gaguccaacaaucauuaacccug

SEQ ID NO: 654050 - RNA, 18 nt, Human
gauuggggguggugggag

SEQ ID NO: 654051 - RNA, 23 nt, Human
gcagaaggaagccccccgccaca

SEQ ID NO: 654052 - RNA, 20 nt, Human
gccaccagccguccucaauc

SEQ ID NO: 654053 - RNA, 21 nt, Human
gccccggggcccggcucagcg

SEQ ID NO: 654054 - RNA, 24 nt, Human
gcccgcggccccggggcccggcuc

SEQ ID NO: 654055 - RNA, 18 nt, Human
gcccuggaaggaggggug

SEQ ID NO: 654056 - RNA, 23 nt, Human
gcucccagcugcccguuccucuu

SEQ ID NO: 654057 - RNA, 25 nt, Human
gcuuccucuccagcugcaccuccau

SEQ ID NO: 654058 - RNA, 18 nt, Human
ggaaggagggguggacag

SEQ ID NO: 654059 - RNA, 18 nt, Human
ggagacagggcagaagga

SEQ ID NO: 654060 - RNA, 18 nt, Human
ggagguccaugauggggg

SEQ ID NO: 654061 - RNA, 23 nt, Human
ggauguuuugggcaucaacuuuu

SEQ ID NO: 654062 - RNA, 30 nt, Human
ggcuguagcugaaguucacuuugcaccauu

SEQ ID NO: 654063 - RNA, 20 nt, Human
gggcgcagcggcuggaggag

SEQ ID NO: 654064 - RNA, 22 nt, Human
gggggccccguggagacagggc

SEQ ID NO: 654065 - RNA, 25 nt, Human
ggggguggugggaguacaaaguugu

SEQ ID NO: 654066 - RNA, 19 nt, Human
gggguggugggaguacaaa

SEQ ID NO: 654067 - RNA, 24 nt, Human
guacaaaguugucuggaaaaacuc

SEQ ID NO: 654068 - RNA, 20 nt, Human
gucuugggaggccgcugggg

SEQ ID NO: 654069 - RNA, 19 nt, Human
uaccaaggcuugggggccc

SEQ ID NO: 654070 - RNA, 19 nt, Human
uaccgggcugcugugcucu

SEQ ID NO: 654071 - RNA, 21 nt, Human
uaccugcccgcacauucacag

SEQ ID NO: 654072 - RNA, 22 nt, Human
uagagaccccaccucgccccuc

SEQ ID NO: 654073 - RNA, 22 nt, Human
ucaaauccugacgguuuugguu

SEQ ID NO: 654074 - RNA, 20 nt, Human
ucacaaagacacccaggagu

SEQ ID NO: 654075 - RNA, 23 nt, Human
ucacacaccacauugcaugcaca

SEQ ID NO: 654076 - RNA, 19 nt, Human
ucacagagggggccuuuac

SEQ ID NO: 654077 - RNA, 20 nt, Human
ucaccuggaccuccagccgc

SEQ ID NO: 654078 - RNA, 21 nt, Human
ucagcaucucgugggcgcccc

SEQ ID NO: 654079 - RNA, 21 nt, Human
ucagcuccagcgcccuccuua

SEQ ID NO: 654080 - RNA, 19 nt, Human
ucccagaugucggucagcu

SEQ ID NO: 654081 - RNA, 23 nt, Human
uccccacagugcccuggguucau

SEQ ID NO: 654082 - RNA, 22 nt, Human
uccccagccaccagccguccuc

SEQ ID NO: 654083 - RNA, 21 nt, Human
ucccccucauucuagcuccag

SEQ ID NO: 654084 - RNA, 19 nt, Human
ucccgagauaccacuuucc

SEQ ID NO: 654085 - RNA, 21 nt, Human
ucccgccaaggcggccucccc

SEQ ID NO: 654086 - RNA, 23 nt, Human
uccucaaucuccuuuaucauuuc

SEQ ID NO: 654087 - RNA, 23 nt, Human
uccuccuccucucuaaggcuccc

SEQ ID NO: 654088 - RNA, 24 nt, Human
uccucuccagcugcaccuccauca

SEQ ID NO: 654089 - RNA, 24 nt, Human
uccuuagagaccccaccucgcccc

SEQ ID NO: 654090 - RNA, 21 nt, Human
ucgggacugggggaguagggg

SEQ ID NO: 654091 - RNA, 26 nt, Human
ucuccaagacuccguuuacuugaucc

SEQ ID NO: 654092 - RNA, 22 nt, Human
ucuucagcuccucccagauguc

SEQ ID NO: 654093 - RNA, 21 nt, Human
ugaacccagucucgggacugg

SEQ ID NO: 654094 - RNA, 20 nt, Human
ugacgcgcggggucugggac

SEQ ID NO: 654095 - RNA, 23 nt, Human
ugacuagaccagagcucggccag

SEQ ID NO: 654096 - RNA, 21 nt, Human
ugacugaaggcaugucugggu

SEQ ID NO: 654097 - RNA, 22 nt, Human
ugagcuccagucggacgcccca

SEQ ID NO: 654098 - RNA, 20 nt, Human
ugcccgcacauucacagaac

SEQ ID NO: 654099 - RNA, 24 nt, Human
ugcccuggguucauacauuucucg

SEQ ID NO: 654100 - RNA, 23 nt, Human
ugccuggaaggggccuccuagga

SEQ ID NO: 654101 - RNA, 18 nt, Human
ugcgugugugagcacagg

SEQ ID NO: 654102 - RNA, 19 nt, Human
ugcuagcuucuugacugug

SEQ ID NO: 654103 - RNA, 19 nt, Human
uggaaggagggguggacag

SEQ ID NO: 654104 - RNA, 23 nt, Human
uggaccuccagccgccggcgcug

SEQ ID NO: 654105 - RNA, 23 nt, Human
uggccgggcccuggcucaaagcu

SEQ ID NO: 654106 - RNA, 18 nt, Human
uggcucaaagcuggaguc

SEQ ID NO: 654107 - RNA, 24 nt, Human
uggcucaaagcuggaguccaacaa

SEQ ID NO: 654108 - RNA, 23 nt, Human
uggcuguugcuagcuucuugacu

SEQ ID NO: 654109 - RNA, 22 nt, Human
ugggaaaugcgugugugagcaa

SEQ ID NO: 654110 - RNA, 22 nt, Human
ugggaucugccacaagccgcca

SEQ ID NO: 654111 - RNA, 22 nt, Human
uggggagggauguuuugggcau

SEQ ID NO: 654112 - RNA, 23 nt, Human
uggggugggggacgggauggggu

SEQ ID NO: 654113 - RNA, 22 nt, Human
uggguuaccaaggcuugggggc

SEQ ID NO: 654114 - RNA, 20 nt, Human
ugugagcacaggcagguuua

SEQ ID NO: 654115 - RNA, 20 nt, Human
uguggucuugggaggccgcu

SEQ ID NO: 654116 - RNA, 22 nt, Human
uguggucuugggaggccgcugg

SEQ ID NO: 654117 - RNA, 20 nt, Human
uucauacauuucucgcguuu

SEQ ID NO: 654118 - RNA, 19 nt, Human
uugcagcuucagcucgucc

SEQ ID NO: 654119 - RNA, 20 nt, Human
uugcugggcccagugguggc

SEQ ID NO: 654120 - RNA, 25 nt, Human
uuuccuccuccucucuaaggcuccc

SEQ ID NO: 654121 - RNA, 23 nt, Human
uuugcaccaucuuuggggccucg

SEQ ID NO: 654122 - RNA, 25 nt, Human
uuuuugguuccuuaauaggagcuga

SEQ ID NO: 654123 - RNA, 19 nt, Human
aaaagccggaguucuccca

SEQ ID NO: 654124 - RNA, 18 nt, Human
aacacgugccccuacgug

SEQ ID NO: 654125 - RNA, 21 nt, Human
aaccuucggcucuucuccagc

SEQ ID NO: 654126 - RNA, 23 nt, Human
aaccuucggcucuucuccagcuc

SEQ ID NO: 654127 - RNA, 23 nt, Human
aagaagcaaacagguuuauuuua

SEQ ID NO: 654128 - RNA, 23 nt, Human
aauacacucagaaagccccaccg

SEQ ID NO: 654129 - RNA, 22 nt, Human
acugacucccuccccugcgugc

SEQ ID NO: 654130 - RNA, 18 nt, Human
acuguugggcaugccugg

SEQ ID NO: 654131 - RNA, 18 nt, Human
agaaagccccaccguuuc

SEQ ID NO: 654132 - RNA, 23 nt, Human
agccggaguucucccagggccua

SEQ ID NO: 654133 - RNA, 19 nt, Human
agcucgaggcgggcggcgc

SEQ ID NO: 654134 - RNA, 18 nt, Human
aggccaagcgcgcacgcg

SEQ ID NO: 654135 - RNA, 21 nt, Human
aggccggcgcugggccgcggg

SEQ ID NO: 654136 - RNA, 23 nt, Human
aggccggcgcugggccgcgggcg

SEQ ID NO: 654137 - RNA, 22 nt, Human
aguccuaaugcccuuccuguug

SEQ ID NO: 654138 - RNA, 18 nt, Human
agugaugaagaggguugu

SEQ ID NO: 654139 - RNA, 21 nt, Human
agugcggcagcgccucuucuu

SEQ ID NO: 654140 - RNA, 21 nt, Human
caacgcugccaccgcuucgcc

SEQ ID NO: 654141 - RNA, 26 nt, Human
caaggugggacccgaaggccggcgcu

SEQ ID NO: 654142 - RNA, 23 nt, Human
cacaacaucacccgcaagguggg

SEQ ID NO: 654143 - RNA, 22 nt, Human
cacccuguccuaguccugaggg

SEQ ID NO: 654144 - RNA, 23 nt, Human
cacccuguccuaguccugagggc

SEQ ID NO: 654145 - RNA, 19 nt, Human
caccgccuccuggacgauc

SEQ ID NO: 654146 - RNA, 21 nt, Human
cacuggcucacccuguccuag

SEQ ID NO: 654147 - RNA, 18 nt, Human
cagcgaggccgcccagcc

SEQ ID NO: 654148 - RNA, 24 nt, Human
ccaggaccaaugugagcucgaggc

SEQ ID NO: 654149 - RNA, 18 nt, Human
ccaugugacuagggcauu

SEQ ID NO: 654150 - RNA, 23 nt, Human
ccccuacgugcacaacaucaccc

SEQ ID NO: 654151 - RNA, 24 nt, Human
cccuccccugcgugcgucuccgau

SEQ ID NO: 654152 - RNA, 21 nt, Human
ccgccccucucagccgggcuc

SEQ ID NO: 654153 - RNA, 18 nt, Human
ccgccuccuggacgaucu

SEQ ID NO: 654154 - RNA, 21 nt, Human
ccgcuucgccugcaacacguc

SEQ ID NO: 654155 - RNA, 18 nt, Human
ccgggaguuggagccugc

SEQ ID NO: 654156 - RNA, 19 nt, Human
ccgggggggguggggcggc

SEQ ID NO: 654157 - RNA, 24 nt, Human
ccuccagggccgccccucucagcc

SEQ ID NO: 654158 - RNA, 20 nt, Human
ccucgggcccacccgcggcc

SEQ ID NO: 654159 - RNA, 22 nt, Human
ccucgggcccacccgcggccuc

SEQ ID NO: 654160 - RNA, 19 nt, Human
ccugcagcagggccgggag

SEQ ID NO: 654161 - RNA, 18 nt, Human
cgaaggccggcgcugggc

SEQ ID NO: 654162 - RNA, 22 nt, Human
cgccuccuggacgaucucuccc

SEQ ID NO: 654163 - RNA, 19 nt, Human
cggcagugggagcugccgg

SEQ ID NO: 654164 - RNA, 20 nt, Human
cuccagggccgccccucuca

SEQ ID NO: 654165 - RNA, 19 nt, Human
cuccaucgccgccagcccc

SEQ ID NO: 654166 - RNA, 25 nt, Human
cucccagggccuaccagguuccgac

SEQ ID NO: 654167 - RNA, 23 nt, Human
cucgcgccccuuucuggucugca

SEQ ID NO: 654168 - RNA, 22 nt, Human
cucuuucucgcgccccuuucug

SEQ ID NO: 654169 - RNA, 18 nt, Human
cugagcggcagugggagc

SEQ ID NO: 654170 - RNA, 22 nt, Human
cugaggcacgcagguccgugcu

SEQ ID NO: 654171 - RNA, 21 nt, Human
cugcagcagaucugugggcuc

SEQ ID NO: 654172 - RNA, 22 nt, Human
cugcagcagaucugugggcucu

SEQ ID NO: 654173 - RNA, 19 nt, Human
cuucguccucaucuuccuc

SEQ ID NO: 654174 - RNA, 24 nt, Human
gagcugccgggaguuggagccugc

SEQ ID NO: 654175 - RNA, 18 nt, Human
gccaccagugaugaagag

SEQ ID NO: 654176 - RNA, 23 nt, Human
gccccaccguuucccaccgccuu

SEQ ID NO: 654177 - RNA, 20 nt, Human
gccccggcgucugccucugu

SEQ ID NO: 654178 - RNA, 22 nt, Human
gccccggcugcgggaacgggcu

SEQ ID NO: 654179 - RNA, 19 nt, Human
gcuguucugccccggcugc

SEQ ID NO: 654180 - RNA, 22 nt, Human
ggccaagcgcgcacgcgcagga

SEQ ID NO: 654181 - RNA, 21 nt, Human
ggcgggaaggcugccaggacc

SEQ ID NO: 654182 - RNA, 25 nt, Human
gucuccuccagggccgccccucuca

SEQ ID NO: 654183 - RNA, 23 nt, Human
uccagcucacgcagacgaaaagc

SEQ ID NO: 654184 - RNA, 18 nt, Human
uccuaguccugagggccc

SEQ ID NO: 654185 - RNA, 18 nt, Human
uccuccgacugcugcucc

SEQ ID NO: 654186 - RNA, 22 nt, Human
uccucuugcgccucgggcccac

SEQ ID NO: 654187 - RNA, 18 nt, Human
uccuggacgaucucuccc

SEQ ID NO: 654188 - RNA, 24 nt, Human
ucgcaggccuuccgcguccuccga

SEQ ID NO: 654189 - RNA, 21 nt, Human
ucugccucuguccgcucuuuc

SEQ ID NO: 654190 - RNA, 25 nt, Human
ugacucccuccccugcgugcgucuc

SEQ ID NO: 654191 - RNA, 23 nt, Human
ugagggcccccagguuuaugcug

SEQ ID NO: 654192 - RNA, 24 nt, Human
ugagggcccccagguuuaugcuga

SEQ ID NO: 654193 - RNA, 24 nt, Human
ugccuggggugaggccaccacaac

SEQ ID NO: 654194 - RNA, 21 nt, Human
ugggaaaaagcucagccacca

SEQ ID NO: 654195 - RNA, 22 nt, Human
ugggacccgaaggccggcgcug

SEQ ID NO: 654196 - RNA, 20 nt, Human
ugugacuagggcauuuggac

SEQ ID NO: 654197 - RNA, 18 nt, Human
uucacagcggcggccacg

SEQ ID NO: 654198 - RNA, 21 nt, Human
uucacagcggcggccacggug

SEQ ID NO: 654199 - RNA, 20 nt, Human
uuccugcugggaaaaagcuc

SEQ ID NO: 654200 - RNA, 19 nt, Human
uuccuguugcccuuugccg

SEQ ID NO: 654201 - RNA, 20 nt, Human
uuuuuuuuuuuuuaagaagc

SEQ ID NO: 654202 - RNA, 19 nt, Human
uuuuuuuuuuuuuuuuuaa

SEQ ID NO: 654203 - RNA, 20 nt, Human
aaacaaaugaaacacguaaa

SEQ ID NO: 654204 - RNA, 19 nt, Human
aagcagaauacaaaugucu

SEQ ID NO: 654205 - RNA, 24 nt, Human
aaggcacaaaaaaaugacagugca

SEQ ID NO: 654206 - RNA, 21 nt, Human
aauaaugauagcaccuacaag

SEQ ID NO: 654207 - RNA, 19 nt, Human
acccugugucugguaccug

SEQ ID NO: 654208 - RNA, 24 nt, Human
acggacaaggacgcgccgccggcg

SEQ ID NO: 654209 - RNA, 19 nt, Human
acuauguggcuauacaaau

SEQ ID NO: 654210 - RNA, 24 nt, Human
agaauaagaggaucugagaaagga

SEQ ID NO: 654211 - RNA, 18 nt, Human
agaccuggguaugggggg

SEQ ID NO: 654212 - RNA, 22 nt, Human
agcuguguaauguguaaucuug

SEQ ID NO: 654213 - RNA, 24 nt, Human
aggacagaccuggguauggggggu

SEQ ID NO: 654214 - RNA, 29 nt, Human
aggcaggggguaaauggaagggggacccc

SEQ ID NO: 654215 - RNA, 19 nt, Human
aggggguaaauggaaggag

SEQ ID NO: 654216 - RNA, 18 nt, Human
auaaaacauucuccaaga

SEQ ID NO: 654217 - RNA, 20 nt, Human
auaaaacauucuccaagaua

SEQ ID NO: 654218 - RNA, 21 nt, Human
aucacaugccacaagcuacag

SEQ ID NO: 654219 - RNA, 20 nt, Human
caccuacaaguccaaaucua

SEQ ID NO: 654220 - RNA, 24 nt, Human
caggagagacaugagaaauuggua

SEQ ID NO: 654221 - RNA, 22 nt, Human
caggcagcgcacgcagcacccc

SEQ ID NO: 654222 - RNA, 23 nt, Human
caguacagucuuuuucuugguuu

SEQ ID NO: 654223 - RNA, 21 nt, Human
ccacaaggguagcaaauggug

SEQ ID NO: 654224 - RNA, 20 nt, Human
cccucuguaccuuuugagug

SEQ ID NO: 654225 - RNA, 18 nt, Human
ccuggcacacuauacaca

SEQ ID NO: 654226 - RNA, 21 nt, Human
ccugugucugguaccuggcag

SEQ ID NO: 654227 - RNA, 20 nt, Human
ccuuuuaagagcaaaggcag

SEQ ID NO: 654228 - RNA, 25 nt, Human
cgcaaauaagcaauucucaaauuag

SEQ ID NO: 654229 - RNA, 24 nt, Human
cggagugggggccuucgucgcgcu

SEQ ID NO: 654230 - RNA, 19 nt, Human
cucacggacaaggacgcgc

SEQ ID NO: 654231 - RNA, 24 nt, Human
cugcaguacagucuuuuucuuggu

SEQ ID NO: 654232 - RNA, 22 nt, Human
cuggguucaaaucccaacauuu

SEQ ID NO: 654233 - RNA, 18 nt, Human
cuuucuugauguuucaag

SEQ ID NO: 654234 - RNA, 18 nt, Human
gacagugcagaaaggcag

SEQ ID NO: 654235 - RNA, 21 nt, Human
gcagaagugccuggcacacua

SEQ ID NO: 654236 - RNA, 23 nt, Human
gcaguguuuuccucaggcgggag

SEQ ID NO: 654237 - RNA, 24 nt, Human
gcccucuguaccuuuugaguguug

SEQ ID NO: 654238 - RNA, 21 nt, Human
ggcaguccacaguggcagggc

SEQ ID NO: 654239 - RNA, 20 nt, Human
gggaauccuugcacccaucc

SEQ ID NO: 654240 - RNA, 20 nt, Human
ggguucaaaucccaacauuu

SEQ ID NO: 654241 - RNA, 24 nt, Human
guaaagcagaauacaaaugucugu

SEQ ID NO: 654242 - RNA, 18 nt, Human
uaaagcagaauacaaaug

SEQ ID NO: 654243 - RNA, 24 nt, Human
uaaagcagaauacaaaugucuguu

SEQ ID NO: 654244 - RNA, 21 nt, Human
uaagaauaacaccuuucugac

SEQ ID NO: 654245 - RNA, 21 nt, Human
uaccaggcugccugcaaggac

SEQ ID NO: 654246 - RNA, 23 nt, Human
uacuacacagcccucuguaccuu

SEQ ID NO: 654247 - RNA, 21 nt, Human
uagggugguggagcugggcag

SEQ ID NO: 654248 - RNA, 19 nt, Human
uaucuguguacuauugagc

SEQ ID NO: 654249 - RNA, 20 nt, Human
uccucagugugcuagcugug

SEQ ID NO: 654250 - RNA, 24 nt, Human
ucucacggacaaggacgcgccgcc

SEQ ID NO: 654251 - RNA, 23 nt, Human
ucuccuuuuaagagcaaaggcug

SEQ ID NO: 654252 - RNA, 18 nt, Human
ugaaacacguaaaacuua

SEQ ID NO: 654253 - RNA, 22 nt, Human
ugaaacacguaaaacuuaaaau

SEQ ID NO: 654254 - RNA, 22 nt, Human
ugaauauauuaacauucaaaac

SEQ ID NO: 654255 - RNA, 19 nt, Human
ugagaaaggaaaggcacaa

SEQ ID NO: 654256 - RNA, 18 nt, Human
uggaaggagguuauccau

SEQ ID NO: 654257 - RNA, 21 nt, Human
uggauaaaacaucucaggaga

SEQ ID NO: 654258 - RNA, 21 nt, Human
ugggcaguccacaguggcagg

SEQ ID NO: 654259 - RNA, 21 nt, Human
uucaguaaagaugggcaguug

SEQ ID NO: 654260 - RNA, 23 nt, Human
uuuaagagcaaaggcagugacuc

SEQ ID NO: 654261 - RNA, 25 nt, Human
uuucuugauguuucaagcgcaaaua

SEQ ID NO: 654262 - RNA, 21 nt, Human
uuuuuuuuuuuuuuuuuauuu

SEQ ID NO: 654263 - RNA, 22 nt, Human
uccaccagaggagugccagaag

SEQ ID NO: 654264 - RNA, 22 nt, Human
aaaaaaaaaagaaagcaaguua

SEQ ID NO: 654265 - RNA, 20 nt, Human
aaaaagaaagcaaguuaaaa

SEQ ID NO: 654266 - RNA, 22 nt, Human
aaaagaaagcaaguuaaaugga

SEQ ID NO: 654267 - RNA, 24 nt, Human
aaagagcaagacucugucucaaaa

SEQ ID NO: 654268 - RNA, 19 nt, Human
aaagguacccaacaaauca

SEQ ID NO: 654269 - RNA, 18 nt, Human
aacacuccucugcaaaua

SEQ ID NO: 654270 - RNA, 19 nt, Human
aagaaauuacuuugccucc

SEQ ID NO: 654271 - RNA, 21 nt, Human
aagagcaaucugaaaacucua

SEQ ID NO: 654272 - RNA, 18 nt, Human
acaggguuucaccauguu

SEQ ID NO: 654273 - RNA, 19 nt, Human
acaggguuucaccauguug

SEQ ID NO: 654274 - RNA, 24 nt, Human
acaggguuucaccauguugcccag

SEQ ID NO: 654275 - RNA, 20 nt, Human
accauguugcccaggcgugg

SEQ ID NO: 654276 - RNA, 26 nt, Human
acucugucgcccaggcuagagugcug

SEQ ID NO: 654277 - RNA, 18 nt, Human
acugcacuccauccuggg

SEQ ID NO: 654278 - RNA, 23 nt, Human
acuuuuuuuuuuuuuuuuuuuug

SEQ ID NO: 654279 - RNA, 23 nt, Human
agacaggguuucaccauguugcc

SEQ ID NO: 654280 - RNA, 18 nt, Human
agagcaagacucugucuc

SEQ ID NO: 654281 - RNA, 18 nt, Human
agcaagacucugucucaa

SEQ ID NO: 654282 - RNA, 24 nt, Human
aggcaggagaacugcccgaacccg

SEQ ID NO: 654283 - RNA, 21 nt, Human
aggcggagguugcagugagcc

SEQ ID NO: 654284 - RNA, 24 nt, Human
aggcggagguugcagugagccgag

SEQ ID NO: 654285 - RNA, 24 nt, Human
aggcgugguggcacaugcccguaa

SEQ ID NO: 654286 - RNA, 20 nt, Human
aggcugaggcaggagaacug

SEQ ID NO: 654287 - RNA, 21 nt, Human
aguacaguggugcaaucucag

SEQ ID NO: 654288 - RNA, 21 nt, Human
agugcuggaguacaguggugc

SEQ ID NO: 654289 - RNA, 24 nt, Human
aucgcaccacugcacuccauccug

SEQ ID NO: 654290 - RNA, 21 nt, Human
auuuuguuuaucuugcuauca

SEQ ID NO: 654291 - RNA, 22 nt, Human
caacacuuuuuaauacaguuga

SEQ ID NO: 654292 - RNA, 23 nt, Human
caaccuccaccucccgaguucaa

SEQ ID NO: 654293 - RNA, 28 nt, Human
caagcaauucuccugccucugccuccca

SEQ ID NO: 654294 - RNA, 23 nt, Human
caaggaagcaguaucagcugucc

SEQ ID NO: 654295 - RNA, 18 nt, Human
caccauguugcccaggcg

SEQ ID NO: 654296 - RNA, 18 nt, Human
caccauguugcccaggcg

SEQ ID NO: 654297 - RNA, 19 nt, Human
caccauguugcccaggcgu

SEQ ID NO: 654298 - RNA, 25 nt, Human
caccauguugcccaggcgugguggc

SEQ ID NO: 654299 - RNA, 24 nt, Human
cacucugucgcccaggcuagagug

SEQ ID NO: 654300 - RNA, 21 nt, Human
cacugcaaccuccaccucccg

SEQ ID NO: 654301 - RNA, 21 nt, Human
cacugcacuccauccugggcg

SEQ ID NO: 654302 - RNA, 26 nt, Human
cacugcacuccauccugggcgaaaga

SEQ ID NO: 654303 - RNA, 24 nt, Human
cagcuacucaggaggcugaggcag

SEQ ID NO: 654304 - RNA, 24 nt, Human
caggguuucaccauguugcccagg

SEQ ID NO: 654305 - RNA, 24 nt, Human
caguagagacaggguuucaccaug

SEQ ID NO: 654306 - RNA, 26 nt, Human
caguagagacaggguuucaccauguu

SEQ ID NO: 654307 - RNA, 19 nt, Human
cauggauacaaacacaugg

SEQ ID NO: 654308 - RNA, 23 nt, Human
cauguugcccaggcgugguggca

SEQ ID NO: 654309 - RNA, 26 nt, Human
ccaccucccgaguucaagcaauucuu

SEQ ID NO: 654310 - RNA, 20 nt, Human
ccacugcacuccauccuggg

SEQ ID NO: 654311 - RNA, 21 nt, Human
ccacugcacuccauccugggc

SEQ ID NO: 654312 - RNA, 21 nt, Human
ccacugcacuccauccugggc

SEQ ID NO: 654313 - RNA, 23 nt, Human
ccacugcacuccauccugggcga

SEQ ID NO: 654314 - RNA, 21 nt, Human
ccaggcgugguggcacaugcc

SEQ ID NO: 654315 - RNA, 23 nt, Human
ccauccugggcgaaagagcaaga

SEQ ID NO: 654316 - RNA, 23 nt, Human
cccgaguucaagcaauucuccug

SEQ ID NO: 654317 - RNA, 22 nt, Human
cccguaaucccagcuacucagg

SEQ ID NO: 654318 - RNA, 24 nt, Human
ccucccgaguucaagcaauucucc

SEQ ID NO: 654319 - RNA, 22 nt, Human
ccugggcgaaagagcaagacuc

SEQ ID NO: 654320 - RNA, 24 nt, Human
cgggaggcggagguugcagugagc

SEQ ID NO: 654321 - RNA, 24 nt, Human
cgugaccacagggguaugccgcca

SEQ ID NO: 654322 - RNA, 24 nt, Human
cucacugcaaccuccaccucccga

SEQ ID NO: 654323 - RNA, 19 nt, Human
cucugucucaaaaaaaaaa

SEQ ID NO: 654324 - RNA, 23 nt, Human
cugcaaccuccaccucccgaguu

SEQ ID NO: 654325 - RNA, 24 nt, Human
cugcaaccuccaccucccgaguuc

SEQ ID NO: 654326 - RNA, 24 nt, Human
cugcccgaacccgggaggcggagg

SEQ ID NO: 654327 - RNA, 28 nt, Human
gagaaucaaugggaaacaaccgguaccc

SEQ ID NO: 654328 - RNA, 23 nt, Human
gagguugcagugagccgagaucg

SEQ ID NO: 654329 - RNA, 24 nt, Human
gcccguaaucccagcuacucagga

SEQ ID NO: 654330 - RNA, 20 nt, Human
gccgagaucgcaccacugca

SEQ ID NO: 654331 - RNA, 20 nt, Human
ggagguugcagugagccgag

SEQ ID NO: 654332 - RNA, 22 nt, Human
ggagguugcagugagccgagau

SEQ ID NO: 654333 - RNA, 24 nt, Human
ggagguugcagugagccgagaucg

SEQ ID NO: 654334 - RNA, 20 nt, Human
ggguaugccgccacaccugg

SEQ ID NO: 654335 - RNA, 18 nt, Human
gguagcucccucccuugg

SEQ ID NO: 654336 - RNA, 24 nt, Human
gguggcacaugcccguaaucccag

SEQ ID NO: 654337 - RNA, 25 nt, Human
guaaagccuucugcuagggcauaaa

SEQ ID NO: 654338 - RNA, 22 nt, Human
guagagacagagucucacucug

SEQ ID NO: 654339 - RNA, 19 nt, Human
gucucaaaaaaaaaaaaag

SEQ ID NO: 654340 - RNA, 21 nt, Human
gucucaaaaaaaaaaaaagaa

SEQ ID NO: 654341 - RNA, 19 nt, Human
guugcagugagccgagauc

SEQ ID NO: 654342 - RNA, 21 nt, Human
guugcagugagccgagaucgc

SEQ ID NO: 654343 - RNA, 19 nt, Human
uaacaaauguaaaguaaaa

SEQ ID NO: 654344 - RNA, 22 nt, Human
uacaguggugcaaucucagcuc

SEQ ID NO: 654345 - RNA, 22 nt, Human
uagagacagagucucacucugu

SEQ ID NO: 654346 - RNA, 21 nt, Human
uagagacaggguuucaccaug

SEQ ID NO: 654347 - RNA, 22 nt, Human
uagagacaggguuucaccaugu

SEQ ID NO: 654348 - RNA, 24 nt, Human
uagagugcuggaguacaguggugc

SEQ ID NO: 654349 - RNA, 23 nt, Human
uagggcauaaauaggaauccguc

SEQ ID NO: 654350 - RNA, 20 nt, Human
uagucuagggcuuagaaaaa

SEQ ID NO: 654351 - RNA, 22 nt, Human
ucaaaaaaaaaaaaagaaagca

SEQ ID NO: 654352 - RNA, 25 nt, Human
ucaaaaaaaaaaaaagaaagcaagu

SEQ ID NO: 654353 - RNA, 27 nt, Human
ucaagaaauuacuuugccuccugaucu

SEQ ID NO: 654354 - RNA, 18 nt, Human
ucacugcaaccuccaccu

SEQ ID NO: 654355 - RNA, 19 nt, Human
ucacugcaaccuccaccuc

SEQ ID NO: 654356 - RNA, 21 nt, Human
ucacugcaaccuccaccuccc

SEQ ID NO: 654357 - RNA, 22 nt, Human
ucacugcaaccuccaccucccg

SEQ ID NO: 654358 - RNA, 27 nt, Human
ucacugcaaccuccaccucccgaguuc

SEQ ID NO: 654359 - RNA, 24 nt, Human
ucaguagagacaggguuucaccau

SEQ ID NO: 654360 - RNA, 21 nt, Human
ucccgaguucaagcaauucuc

SEQ ID NO: 654361 - RNA, 24 nt, Human
ucccgaguucaagcaauucuccug

SEQ ID NO: 654362 - RNA, 23 nt, Human
ucgcaccacugcacuccauccug

SEQ ID NO: 654363 - RNA, 18 nt, Human
ucgcccaggcuagagugc

SEQ ID NO: 654364 - RNA, 20 nt, Human
ucuauaacgucucccuccca

SEQ ID NO: 654365 - RNA, 22 nt, Human
ucucaaaaaaaaaaaaagaaag

SEQ ID NO: 654366 - RNA, 18 nt, Human
ucucacucugucgcccag

SEQ ID NO: 654367 - RNA, 19 nt, Human
ucucacucugucgcccagg

SEQ ID NO: 654368 - RNA, 22 nt, Human
ucucacucugucgcccaggcua

SEQ ID NO: 654369 - RNA, 24 nt, Human
ucucacucugucgcccaggcuaga

SEQ ID NO: 654370 - RNA, 21 nt, Human
ucugucucaaaaaaaaaaaaa

SEQ ID NO: 654371 - RNA, 22 nt, Human
ucugucucaaaaaaaaaaaaag

SEQ ID NO: 654372 - RNA, 21 nt, Human
ucuuuuguauuucaguagaga

SEQ ID NO: 654373 - RNA, 22 nt, Human
ugagccgagaucgcaccacugc

SEQ ID NO: 654374 - RNA, 24 nt, Human
ugaggcaggagaacugcccgaacc

SEQ ID NO: 654375 - RNA, 24 nt, Human
ugcccguaaucccagcuacucagg

SEQ ID NO: 654376 - RNA, 20 nt, Human
ugccucugccucccaaguag

SEQ ID NO: 654377 - RNA, 23 nt, Human
ugccucugccucccaaguagccg

SEQ ID NO: 654378 - RNA, 21 nt, Human
ugcuagggcauaaauaggaau

SEQ ID NO: 654379 - RNA, 19 nt, Human
uggaguacaguggugcaau

SEQ ID NO: 654380 - RNA, 22 nt, Human
uggcacaugcccguaaucccag

SEQ ID NO: 654381 - RNA, 21 nt, Human
ugggaaacaacguaaagccuu

SEQ ID NO: 654382 - RNA, 24 nt, Human
uggguuacuuuuuuuuuuuuuuuu

SEQ ID NO: 654383 - RNA, 24 nt, Human
uggugcaaucucagcucacugcaa

SEQ ID NO: 654384 - RNA, 24 nt, Human
ugguggcacaugcccguaauccca

SEQ ID NO: 654385 - RNA, 21 nt, Human
uucaagcaauucuccugccuc

SEQ ID NO: 654386 - RNA, 23 nt, Human
uucaagcaauucuccugccucug

SEQ ID NO: 654387 - RNA, 24 nt, Human
uucaagcaauucuccugccucugc

SEQ ID NO: 654388 - RNA, 23 nt, Human
uugaauggauaaaaacauggaua

SEQ ID NO: 654389 - RNA, 18 nt, Human
uugcagugagccgagauc

SEQ ID NO: 654390 - RNA, 19 nt, Human
uugcagugagccgagaucg

SEQ ID NO: 654391 - RNA, 22 nt, Human
uugcagugagccgagaucgcac

SEQ ID NO: 654392 - RNA, 20 nt, Human
uuucaccauguugcccaggc

SEQ ID NO: 654393 - RNA, 21 nt, Human
uuuuguauuucaguagagaca

SEQ ID NO: 654394 - RNA, 19 nt, Human
uuuuuuuguagagacagag

SEQ ID NO: 654395 - RNA, 27 nt, Human
uuuuuuuuuuguagagacagagucuca

SEQ ID NO: 654396 - RNA, 18 nt, Human
uuuuuuuuuuuuuuccug

SEQ ID NO: 654397 - RNA, 18 nt, Human
uuuuuuuuuuuuuuuuug

SEQ ID NO: 654398 - RNA, 19 nt, Human
uuuuuuuuuuuuuuuuugu

SEQ ID NO: 654399 - RNA, 24 nt, Human
aaaaaaaaaaagaaaaagaaaaag

SEQ ID NO: 654400 - RNA, 19 nt, Human
aaaaaaaagaaaaagaaaa

SEQ ID NO: 654401 - RNA, 21 nt, Human
aaaaagaaaaagaaaaaaaag

SEQ ID NO: 654402 - RNA, 22 nt, Human
aaaagaaaaagaaaaaaaagaa

SEQ ID NO: 654403 - RNA, 23 nt, Human
aaaagaaaaagaaaaagaaaaaa

SEQ ID NO: 654404 - RNA, 22 nt, Human
aaaaggcacauugucguuuuca

SEQ ID NO: 654405 - RNA, 18 nt, Human
aaacaaacacucagccuc

SEQ ID NO: 654406 - RNA, 23 nt, Human
aaacaucugcuucacacagugca

SEQ ID NO: 654407 - RNA, 21 nt, Human
aaagaacuuguaucccaaagc

SEQ ID NO: 654408 - RNA, 20 nt, Human
aaagagccaggguuccucag

SEQ ID NO: 654409 - RNA, 22 nt, Human
aaauaagggcucuucagugagg

SEQ ID NO: 654410 - RNA, 20 nt, Human
aacauggugaaacccugucu

SEQ ID NO: 654411 - RNA, 21 nt, Human
aacauggugaaacccugucuc

SEQ ID NO: 654412 - RNA, 21 nt, Human
aaccggcuucucccuagagcc

SEQ ID NO: 654413 - RNA, 20 nt, Human
aagcaaaaguccacaguuac

SEQ ID NO: 654414 - RNA, 18 nt, Human
aagcagauaugugucaau

SEQ ID NO: 654415 - RNA, 20 nt, Human
aagccgcagcccuccuuugg

SEQ ID NO: 654416 - RNA, 21 nt, Human
aaggggcugggagguugggga

SEQ ID NO: 654417 - RNA, 19 nt, Human
aagggucacugggcaggaa

SEQ ID NO: 654418 - RNA, 22 nt, Human
aagucacaacccaggcauccaa

SEQ ID NO: 654419 - RNA, 19 nt, Human
aaugaggguguggggcugg

SEQ ID NO: 654420 - RNA, 20 nt, Human
aauugcuugagcccaggagg

SEQ ID NO: 654421 - RNA, 24 nt, Human
acaaaacaucccugugcgccagau

SEQ ID NO: 654422 - RNA, 24 nt, Human
acccugucucuacaaaaaauacaa

SEQ ID NO: 654423 - RNA, 22 nt, Human
acucugaauccagggcuugcug

SEQ ID NO: 654424 - RNA, 24 nt, Human
acugcacuccagccuaggcaacag

SEQ ID NO: 654425 - RNA, 20 nt, Human
acugcagauccacacacacc

SEQ ID NO: 654426 - RNA, 18 nt, Human
agaaaaaaaagaaaaagg

SEQ ID NO: 654427 - RNA, 22 nt, Human
agaaaaaaaagaaaaaggguaa

SEQ ID NO: 654428 - RNA, 23 nt, Human
agaaaaagaaaaaaaagaaaaag

SEQ ID NO: 654429 - RNA, 21 nt, Human
agaaaaagaaaaagaaaaaaa

SEQ ID NO: 654430 - RNA, 20 nt, Human
agaaacaaacacucagccuc

SEQ ID NO: 654431 - RNA, 21 nt, Human
agaagcuugaaauggcaagga

SEQ ID NO: 654432 - RNA, 19 nt, Human
agaauauucucuaaauuuc

SEQ ID NO: 654433 - RNA, 18 nt, Human
agaccaguccugcaugcg

SEQ ID NO: 654434 - RNA, 19 nt, Human
agagccaggguuccucagg

SEQ ID NO: 654435 - RNA, 18 nt, Human
agagggaagugggagggc

SEQ ID NO: 654436 - RNA, 22 nt, Human
agagguugcagugagccgagau

SEQ ID NO: 654437 - RNA, 24 nt, Human
agagguugcagugagccgagauug

SEQ ID NO: 654438 - RNA, 24 nt, Human
agcacuuugggaggccgaggcagg

SEQ ID NO: 654439 - RNA, 19 nt, Human
agcccaggagguugagacc

SEQ ID NO: 654440 - RNA, 19 nt, Human
agccugggcaacaugguga

SEQ ID NO: 654441 - RNA, 22 nt, Human
agccugggcaacauggugaaac

SEQ ID NO: 654442 - RNA, 24 nt, Human
agccugggcaacauggugaaaccc

SEQ ID NO: 654443 - RNA, 25 nt, Human
agccugggcaacauggugaaacccu

SEQ ID NO: 654444 - RNA, 24 nt, Human
agcuauuugggaggcugagguggg

SEQ ID NO: 654445 - RNA, 23 nt, Human
agcugggcauggugguuugugcc

SEQ ID NO: 654446 - RNA, 19 nt, Human
aggaaaaccuccugcuguu

SEQ ID NO: 654447 - RNA, 24 nt, Human
aggcagaauaacagcaccccaaag

SEQ ID NO: 654448 - RNA, 21 nt, Human
aggcagagguugcagugagcc

SEQ ID NO: 654449 - RNA, 24 nt, Human
aggcagagguugcagugagccgag

SEQ ID NO: 654450 - RNA, 23 nt, Human
aggcaggaggauugcuugagccc

SEQ ID NO: 654451 - RNA, 21 nt, Human
aggccgaggcaggaggauugc

SEQ ID NO: 654452 - RNA, 24 nt, Human
aggccgaggcaggaggauugcuug

SEQ ID NO: 654453 - RNA, 21 nt, Human
aggcggugcauuuccaaggug

SEQ ID NO: 654454 - RNA, 24 nt, Human
aggcugaggugggagaauugcuug

SEQ ID NO: 654455 - RNA, 21 nt, Human
agggaccucagguaggcuccu

SEQ ID NO: 654456 - RNA, 24 nt, Human
agggaccucagguaggcuccuugg

SEQ ID NO: 654457 - RNA, 19 nt, Human
aguucuguugaggguaggc

SEQ ID NO: 654458 - RNA, 19 nt, Human
auaagggcucuucagugag

SEQ ID NO: 654459 - RNA, 21 nt, Human
auaauaaaaaggcacauuguc

SEQ ID NO: 654460 - RNA, 24 nt, Human
augaccacagcauuagagaccagu

SEQ ID NO: 654461 - RNA, 19 nt, Human
auugcuugagcccaggagg

SEQ ID NO: 654462 - RNA, 19 nt, Human
caaaauuagcugggcaugg

SEQ ID NO: 654463 - RNA, 22 nt, Human
caacagaaugagauccugucuc

SEQ ID NO: 654464 - RNA, 22 nt, Human
caacauggugaaacccugucuc

SEQ ID NO: 654465 - RNA, 24 nt, Human
caacauggugaaacccugucucua

SEQ ID NO: 654466 - RNA, 22 nt, Human
caagcuaaacaaaacaucccug

SEQ ID NO: 654467 - RNA, 18 nt, Human
caaggaaccggcuucucc

SEQ ID NO: 654468 - RNA, 21 nt, Human
caaggaaccggcuucucccua

SEQ ID NO: 654469 - RNA, 24 nt, Human
cacaucuguaaucccagcacuuug

SEQ ID NO: 654470 - RNA, 21 nt, Human
caccuaaaaaguaucugcaau

SEQ ID NO: 654471 - RNA, 21 nt, Human
caccugggggacaggcacacg

SEQ ID NO: 654472 - RNA, 19 nt, Human
cacugcacuccagccuagg

SEQ ID NO: 654473 - RNA, 21 nt, Human
cacugcacuccagccuaggca

SEQ ID NO: 654474 - RNA, 22 nt, Human
cacugcacuccagccuaggcaa

SEQ ID NO: 654475 - RNA, 23 nt, Human
cacugcacuccagccuaggcaac

SEQ ID NO: 654476 - RNA, 24 nt, Human
cacugcacuccagccuaggcaaca

SEQ ID NO: 654477 - RNA, 23 nt, Human
cagaauaacagcaccccaaagau

SEQ ID NO: 654478 - RNA, 26 nt, Human
cagaauaacagcaccccaaagauguu

SEQ ID NO: 654479 - RNA, 23 nt, Human
cagaugaaaguucuguugagggu

SEQ ID NO: 654480 - RNA, 24 nt, Human
cagcacuuugggaggccgaggcag

SEQ ID NO: 654481 - RNA, 25 nt, Human
cagcacuuugggaggccgaggcagg

SEQ ID NO: 654482 - RNA, 24 nt, Human
cagcuauuugggaggcugaggugg

SEQ ID NO: 654483 - RNA, 19 nt, Human
caggaccaccaaauaaaua

SEQ ID NO: 654484 - RNA, 24 nt, Human
caggcgagggauggaaaacugcag

SEQ ID NO: 654485 - RNA, 19 nt, Human
cagggcaccuaguccugcu

SEQ ID NO: 654486 - RNA, 21 nt, Human
caguagaaacaaacacucaac

SEQ ID NO: 654487 - RNA, 21 nt, Human
caguagaaacaaacacucagc

SEQ ID NO: 654488 - RNA, 19 nt, Human
cagucugcuaaccuuuacc

SEQ ID NO: 654489 - RNA, 20 nt, Human
cagugccauugcugcagaag

SEQ ID NO: 654490 - RNA, 23 nt, Human
caguugacucuuccuugagaccu

SEQ ID NO: 654491 - RNA, 19 nt, Human
cauaaucccucuccuucca

SEQ ID NO: 654492 - RNA, 19 nt, Human
cauaggcaacgccaagggc

SEQ ID NO: 654493 - RNA, 18 nt, Human
cauggaaacuugaggaaa

SEQ ID NO: 654494 - RNA, 20 nt, Human
ccaaaaggacaugggccuga

SEQ ID NO: 654495 - RNA, 19 nt, Human
ccacugcacuccagccuag

SEQ ID NO: 654496 - RNA, 20 nt, Human
ccacugcacuccagccuagg

SEQ ID NO: 654497 - RNA, 20 nt, Human
ccacugcacuccagccuagg

SEQ ID NO: 654498 - RNA, 21 nt, Human
ccacugcacuccagccuaggc

SEQ ID NO: 654499 - RNA, 24 nt, Human
ccacugcacuccagccuaggcaac

SEQ ID NO: 654500 - RNA, 21 nt, Human
ccacuggagccugggaaugca

SEQ ID NO: 654501 - RNA, 21 nt, Human
ccagaucuucugaucuggguu

SEQ ID NO: 654502 - RNA, 22 nt, Human
ccaggaggcagagguugcagug

SEQ ID NO: 654503 - RNA, 24 nt, Human
ccaguccugcaugcgcuggccuuc

SEQ ID NO: 654504 - RNA, 26 nt, Human
ccauugcugcagaagguuccgauccu

SEQ ID NO: 654505 - RNA, 22 nt, Human
cccuuuaugcagggucagcauc

SEQ ID NO: 654506 - RNA, 18 nt, Human
ccugcuguuccuucugua

SEQ ID NO: 654507 - RNA, 22 nt, Human
ccugggcaacauggugaaaccc

SEQ ID NO: 654508 - RNA, 24 nt, Human
ccugggcaacauggugaaacccug

SEQ ID NO: 654509 - RNA, 23 nt, Human
cgaaccgaccuagagaaucagga

SEQ ID NO: 654510 - RNA, 25 nt, Human
cgaggcaggaggauugcuugagccc

SEQ ID NO: 654511 - RNA, 19 nt, Human
cgauccugaccacgguggc

SEQ ID NO: 654512 - RNA, 24 nt, Human
cgcacagccuaaguugaggagcac

SEQ ID NO: 654513 - RNA, 19 nt, Human
cgccacugcacuccagccu

SEQ ID NO: 654514 - RNA, 24 nt, Human
cgccacugcacuccagccuaggca

SEQ ID NO: 654515 - RNA, 24 nt, Human
cucacaucuguaaucccagcacuu

SEQ ID NO: 654516 - RNA, 19 nt, Human
cucaggcgagggauggaaa

SEQ ID NO: 654517 - RNA, 22 nt, Human
cuccccaaaaggacaugggccu

SEQ ID NO: 654518 - RNA, 22 nt, Human
cugggaaaccggggccucuacu

SEQ ID NO: 654519 - RNA, 24 nt, Human
cugggcaacauggugaaacccugu

SEQ ID NO: 654520 - RNA, 21 nt, Human
cuguaaucccagcacuuuggg

SEQ ID NO: 654521 - RNA, 20 nt, Human
cuuccuggugggcuuuguaa

SEQ ID NO: 654522 - RNA, 18 nt, Human
cuuuaugcagggucagca

SEQ ID NO: 654523 - RNA, 20 nt, Human
gaaaccggggccucuacuga

SEQ ID NO: 654524 - RNA, 20 nt, Human
gaacaaguugaggcggugca

SEQ ID NO: 654525 - RNA, 20 nt, Human
gaaccgaccuagagaaucag

SEQ ID NO: 654526 - RNA, 18 nt, Human
gaagcaaaaguccacagu

SEQ ID NO: 654527 - RNA, 19 nt, Human
gaagcugaaccuccccaaa

SEQ ID NO: 654528 - RNA, 21 nt, Human
gaaggaaguuuuugccgcaga

SEQ ID NO: 654529 - RNA, 19 nt, Human
gacaagcuauaacauaauc

SEQ ID NO: 654530 - RNA, 20 nt, Human
gacagcaucugcugagccca

SEQ ID NO: 654531 - RNA, 21 nt, Human
gaccacgguggcaucgauucg

SEQ ID NO: 654532 - RNA, 23 nt, Human
gagauugcgccacugcacuccag

SEQ ID NO: 654533 - RNA, 24 nt, Human
gaggugggagaauugcuugagccc

SEQ ID NO: 654534 - RNA, 19 nt, Human
gaguagggaccucagguag

SEQ ID NO: 654535 - RNA, 18 nt, Human
gagucaguggcaggaagg

SEQ ID NO: 654536 - RNA, 19 nt, Human
gcagggcaccuaguccugc

SEQ ID NO: 654537 - RNA, 18 nt, Human
gcugcagcuaggagaacc

SEQ ID NO: 654538 - RNA, 20 nt, Human
gcugcagcuaggagaaccgc

SEQ ID NO: 654539 - RNA, 19 nt, Human
gcuggaugcgguggcucac

SEQ ID NO: 654540 - RNA, 22 nt, Human
ggacagauuguaaauuauuccc

SEQ ID NO: 654541 - RNA, 22 nt, Human
ggaggcagagguugcagugagc

SEQ ID NO: 654542 - RNA, 24 nt, Human
ggaugcgguggcucacaucuguaa

SEQ ID NO: 654543 - RNA, 23 nt, Human
ggcaagccucuguuuaacacucu

SEQ ID NO: 654544 - RNA, 19 nt, Human
ggcgguguccaggaaaacc

SEQ ID NO: 654545 - RNA, 21 nt, Human
ggcucacaucuguaaucccag

SEQ ID NO: 654546 - RNA, 20 nt, Human
ggcugggagguuggggaaug

SEQ ID NO: 654547 - RNA, 22 nt, Human
ggcugggccccuucacugaggc

SEQ ID NO: 654548 - RNA, 18 nt, Human
gggacacagugccauugc

SEQ ID NO: 654549 - RNA, 19 nt, Human
gggacugugcugacaagcu

SEQ ID NO: 654550 - RNA, 20 nt, Human
gggauggaaaacugcagcuc

SEQ ID NO: 654551 - RNA, 19 nt, Human
gggcuugugcuuguuccag

SEQ ID NO: 654552 - RNA, 22 nt, Human
gggcuuuaaagaaaagagccag

SEQ ID NO: 654553 - RNA, 20 nt, Human
ggggcugggagguuggggaa

SEQ ID NO: 654554 - RNA, 20 nt, Human
gguaaugugagcacacauug

SEQ ID NO: 654555 - RNA, 20 nt, Human
gguggaaugcagggcaccua

SEQ ID NO: 654556 - RNA, 23 nt, Human
gguggcucacaucuguaauccca

SEQ ID NO: 654557 - RNA, 24 nt, Human
gguguggggcuggaugcgguggcu

SEQ ID NO: 654558 - RNA, 18 nt, Human
guaagucaaagagggaag

SEQ ID NO: 654559 - RNA, 21 nt, Human
gucagcaucucggcucacaag

SEQ ID NO: 654560 - RNA, 21 nt, Human
gugaaguuggcgguguccagg

SEQ ID NO: 654561 - RNA, 23 nt, Human
guggcucacaucuguaaucccag

SEQ ID NO: 654562 - RNA, 23 nt, Human
guggggcuggaugcgguggcuca

SEQ ID NO: 654563 - RNA, 19 nt, Human
guugcagugagccgagauu

SEQ ID NO: 654564 - RNA, 22 nt, Human
uaaacaaaacaucccugugcgc

SEQ ID NO: 654565 - RNA, 23 nt, Human
uaaauauccuauccucuggaaag

SEQ ID NO: 654566 - RNA, 21 nt, Human
uaacacucugaauccagggcu

SEQ ID NO: 654567 - RNA, 26 nt, Human
uaacagcaccccaaagauguucuggu

SEQ ID NO: 654568 - RNA, 20 nt, Human
uaagacagcaucugcugagc

SEQ ID NO: 654569 - RNA, 24 nt, Human
uaaggaaggccaaucccaccuugg

SEQ ID NO: 654570 - RNA, 20 nt, Human
uaccaaggccauguccggug

SEQ ID NO: 654571 - RNA, 18 nt, Human
uagaaacaaacacucagc

SEQ ID NO: 654572 - RNA, 20 nt, Human
uagccgaagcacuuaaacag

SEQ ID NO: 654573 - RNA, 19 nt, Human
ucaaaugaagaggaaagaa

SEQ ID NO: 654574 - RNA, 24 nt, Human
ucaaugcugcucaaacacacacau

SEQ ID NO: 654575 - RNA, 27 nt, Human
ucacauuaaaaaaaaaaagaaaaagaa

SEQ ID NO: 654576 - RNA, 18 nt, Human
ucacugaggcacagcucc

SEQ ID NO: 654577 - RNA, 18 nt, Human
ucacugggcaggaaccag

SEQ ID NO: 654578 - RNA, 20 nt, Human
ucagggacauccauuuugga

SEQ ID NO: 654579 - RNA, 20 nt, Human
ucaguagaagucacaaccca

SEQ ID NO: 654580 - RNA, 20 nt, Human
ucccaaagccuggcuuucug

SEQ ID NO: 654581 - RNA, 19 nt, Human
uccccaaaaggacaugggc

SEQ ID NO: 654582 - RNA, 20 nt, Human
uccccaggacuauaagcuaa

SEQ ID NO: 654583 - RNA, 18 nt, Human
ucccuagagccuucagaa

SEQ ID NO: 654584 - RNA, 23 nt, Human
ucccuucugugcaaugaccacag

SEQ ID NO: 654585 - RNA, 23 nt, Human
uccgauccugaccacgguggcau

SEQ ID NO: 654586 - RNA, 22 nt, Human
uccuggaucuuccuggugggcu

SEQ ID NO: 654587 - RNA, 19 nt, Human
uccuugagaccuuucccuu

SEQ ID NO: 654588 - RNA, 22 nt, Human
ucgagaauggagggcuagggcu

SEQ ID NO: 654589 - RNA, 21 nt, Human
ugaaaguucuguugaggguag

SEQ ID NO: 654590 - RNA, 20 nt, Human
ugaaauggcaaggaaccggc

SEQ ID NO: 654591 - RNA, 22 nt, Human
ugaaauggcaaggaaccggcuu

SEQ ID NO: 654592 - RNA, 19 nt, Human
ugaauccagggcuugcugc

SEQ ID NO: 654593 - RNA, 20 nt, Human
ugacucaggccucucuccuc

SEQ ID NO: 654594 - RNA, 22 nt, Human
ugagcaaugugaaguuggcggu

SEQ ID NO: 654595 - RNA, 21 nt, Human
ugagcagugggcuggcaugca

SEQ ID NO: 654596 - RNA, 23 nt, Human
ugagcccaggagguugagaccag

SEQ ID NO: 654597 - RNA, 19 nt, Human
ugagccccagcauggccag

SEQ ID NO: 654598 - RNA, 22 nt, Human
ugagccgagauugcgccacugc

SEQ ID NO: 654599 - RNA, 23 nt, Human
ugaggugggagaauugcuugagc

SEQ ID NO: 654600 - RNA, 24 nt, Human
ugaggugggagaauugcuugagcc

SEQ ID NO: 654601 - RNA, 19 nt, Human
ugcaaugaccacagcauua

SEQ ID NO: 654602 - RNA, 22 nt, Human
ugcaaugaccacagcauuagag

SEQ ID NO: 654603 - RNA, 23 nt, Human
ugcacggcaucaaaugaagagga

SEQ ID NO: 654604 - RNA, 21 nt, Human
ugcagggggccacuguuuggu

SEQ ID NO: 654605 - RNA, 24 nt, Human
ugccagugaucccagcuauuuggg

SEQ ID NO: 654606 - RNA, 18 nt, Human
uggaaaguguucaagagg

SEQ ID NO: 654607 - RNA, 23 nt, Human
uggaaggggcugggagguugggg

SEQ ID NO: 654608 - RNA, 21 nt, Human
uggaaugcagggcaccuaguc

SEQ ID NO: 654609 - RNA, 24 nt, Human
uggaaugcagggcaccuaguccug

SEQ ID NO: 654610 - RNA, 26 nt, Human
uggaaugcagggcaccuaguccugac

SEQ ID NO: 654611 - RNA, 22 nt, Human
uggaauucugauccccaggacu

SEQ ID NO: 654612 - RNA, 19 nt, Human
uggcaggaaggugugguag

SEQ ID NO: 654613 - RNA, 21 nt, Human
uggcucacaucuguaauccca

SEQ ID NO: 654614 - RNA, 22 nt, Human
uggcucacaucuguaaucccag

SEQ ID NO: 654615 - RNA, 24 nt, Human
uggcucacaucuguaaucccagca

SEQ ID NO: 654616 - RNA, 20 nt, Human
ugggaggccgaggcaggagg

SEQ ID NO: 654617 - RNA, 22 nt, Human
ugggaggccgaggcaggaggau

SEQ ID NO: 654618 - RNA, 22 nt, Human
ugggaggcugaggugggagaau

SEQ ID NO: 654619 - RNA, 24 nt, Human
ugggaggcugaggugggagaauug

SEQ ID NO: 654620 - RNA, 24 nt, Human
ugggcaacauggugaaacccuguc

SEQ ID NO: 654621 - RNA, 21 nt, Human
ugggcagcucucacccggacc

SEQ ID NO: 654622 - RNA, 21 nt, Human
ugggcuuuaaagaaaagagcc

SEQ ID NO: 654623 - RNA, 21 nt, Human
uggggaccccagugagaguag

SEQ ID NO: 654624 - RNA, 22 nt, Human
uggggcuggaugcgguggcuca

SEQ ID NO: 654625 - RNA, 20 nt, Human
uggugaccuggugaagugga

SEQ ID NO: 654626 - RNA, 22 nt, Human
ugguuugugccagugaucccag

SEQ ID NO: 654627 - RNA, 24 nt, Human
ugguuugugccagugaucccagcu

SEQ ID NO: 654628 - RNA, 21 nt, Human
uguaaauuauucccaccaccu

SEQ ID NO: 654629 - RNA, 20 nt, Human
uguagccucuccugugggag

SEQ ID NO: 654630 - RNA, 21 nt, Human
ugucaugacuguauccagauu

SEQ ID NO: 654631 - RNA, 24 nt, Human
ugugccagugaucccagcuauuug

SEQ ID NO: 654632 - RNA, 23 nt, Human
ugugggcuguggugaccugguga

SEQ ID NO: 654633 - RNA, 22 nt, Human
uguuguuuuuaagcuaccaagu

SEQ ID NO: 654634 - RNA, 24 nt, Human
uuaaagaaaagagccaggguuccu

SEQ ID NO: 654635 - RNA, 21 nt, Human
uuacaggcuggcuaaccgcac

SEQ ID NO: 654636 - RNA, 24 nt, Human
uuagcugggcauggugguuugugc

SEQ ID NO: 654637 - RNA, 24 nt, Human
uucaaauaagggcucuucagugag

SEQ ID NO: 654638 - RNA, 20 nt, Human
uucaacaaauggcacuucac

SEQ ID NO: 654639 - RNA, 24 nt, Human
uucucuuauugcuaggacuauagg

SEQ ID NO: 654640 - RNA, 19 nt, Human
uugauccgggacacagugc

SEQ ID NO: 654641 - RNA, 18 nt, Human
uugcagugagccgagauu

SEQ ID NO: 654642 - RNA, 20 nt, Human
uugcagugagccgagauugc

SEQ ID NO: 654643 - RNA, 22 nt, Human
uugcagugagccgagauugcgc

SEQ ID NO: 654644 - RNA, 18 nt, Human
uugcuugagcccaggagg

SEQ ID NO: 654645 - RNA, 24 nt, Human
uugcuugagcccaggaggcagagg

SEQ ID NO: 654646 - RNA, 20 nt, Human
uugggaggccgaggcaggag

SEQ ID NO: 654647 - RNA, 23 nt, Human
uugggaggcugaggugggagaau

SEQ ID NO: 654648 - RNA, 24 nt, Human
uugguacauuuguuuauuuaaagc

SEQ ID NO: 654649 - RNA, 19 nt, Human
uuuccagugaagcacugca

SEQ ID NO: 654650 - RNA, 19 nt, Human
aagcaaaaccagaaagugc

SEQ ID NO: 654651 - RNA, 23 nt, Human
aagcagaaaucuggagggacccc

SEQ ID NO: 654652 - RNA, 20 nt, Human
acaagcaaaaccagaaagug

SEQ ID NO: 654653 - RNA, 23 nt, Human
acaaugaagaaaccacuacuuua

SEQ ID NO: 654654 - RNA, 18 nt, Human
acuccagagcaauaaaau

SEQ ID NO: 654655 - RNA, 21 nt, Human
agaaaaacaagcaaaaccaga

SEQ ID NO: 654656 - RNA, 22 nt, Human
agaaaaacaagcaaaaccagaa

SEQ ID NO: 654657 - RNA, 18 nt, Human
agaaagugcuuggaaagu

SEQ ID NO: 654658 - RNA, 21 nt, Human
auucaggucauacaagggcca

SEQ ID NO: 654659 - RNA, 18 nt, Human
caaaaaugcuguauaaac

SEQ ID NO: 654660 - RNA, 25 nt, Human
caaaaccagaaagugcuuggaaagu

SEQ ID NO: 654661 - RNA, 20 nt, Human
cacacuguuuacuugcugcc

SEQ ID NO: 654662 - RNA, 20 nt, Human
cacuguaugggucacacaaa

SEQ ID NO: 654663 - RNA, 21 nt, Human
cagaacauaacaguauaccag

SEQ ID NO: 654664 - RNA, 19 nt, Human
caggucauacaagggccaa

SEQ ID NO: 654665 - RNA, 19 nt, Human
ccaacuaguccaaccuggc

SEQ ID NO: 654666 - RNA, 24 nt, Human
ccaccgcuugguccugcagacuga

SEQ ID NO: 654667 - RNA, 23 nt, Human
ccaguauaagaccuucguagggc

SEQ ID NO: 654668 - RNA, 18 nt, Human
ccccaacuaguccaaccu

SEQ ID NO: 654669 - RNA, 21 nt, Human
cgagcaaacaacuccaaauau

SEQ ID NO: 654670 - RNA, 23 nt, Human
cuaaauguuuuuuacaacacugu

SEQ ID NO: 654671 - RNA, 24 nt, Human
cuagaaaaacaagcaaaaccagaa

SEQ ID NO: 654672 - RNA, 30 nt, Human
gaaaaacaagcaaaaccagaaagugcuugg

SEQ ID NO: 654673 - RNA, 20 nt, Human
gagcaaacaacuccaaauau

SEQ ID NO: 654674 - RNA, 21 nt, Human
gcugaaauuugagaacuucau

SEQ ID NO: 654675 - RNA, 18 nt, Human
ggaaacaaugaagaaacc

SEQ ID NO: 654676 - RNA, 23 nt, Human
ggaaacaaugaagaaaccacuac

SEQ ID NO: 654677 - RNA, 20 nt, Human
ggugaggaaacaaugaagaa

SEQ ID NO: 654678 - RNA, 23 nt, Human
uaaaacccuacaaaaaugcuggu

SEQ ID NO: 654679 - RNA, 20 nt, Human
uaaaauaauccacaugcuga

SEQ ID NO: 654680 - RNA, 20 nt, Human
uaacaguauaccagagguug

SEQ ID NO: 654681 - RNA, 18 nt, Human
uaagggaaaaguggugag

SEQ ID NO: 654682 - RNA, 20 nt, Human
uaagggaaaaguggugagga

SEQ ID NO: 654683 - RNA, 22 nt, Human
uagaaaaacaagcaaaaccaga

SEQ ID NO: 654684 - RNA, 24 nt, Human
uagaauguuagugcaacucaagua

SEQ ID NO: 654685 - RNA, 22 nt, Human
uagccccauuuuuuagaauaau

SEQ ID NO: 654686 - RNA, 21 nt, Human
ucacacaaaacacauccauag

SEQ ID NO: 654687 - RNA, 25 nt, Human
ucagcaagcgguggcuuaugugagu

SEQ ID NO: 654688 - RNA, 23 nt, Human
uccacaugcugaaauuugagaac

SEQ ID NO: 654689 - RNA, 20 nt, Human
ucugaacuuuuucaauagca

SEQ ID NO: 654690 - RNA, 20 nt, Human
ucuggcuugauguagucuuu

SEQ ID NO: 654691 - RNA, 22 nt, Human
ucuuuauaacugcuuaccacuu

SEQ ID NO: 654692 - RNA, 20 nt, Human
ugaaugcaauuuaaaacccu

SEQ ID NO: 654693 - RNA, 21 nt, Human
ugaggaaacaaugaagaaacc

SEQ ID NO: 654694 - RNA, 23 nt, Human
ugccaggaaagaacaaaggccuc

SEQ ID NO: 654695 - RNA, 19 nt, Human
ugcugaaauuugagaacuu

SEQ ID NO: 654696 - RNA, 23 nt, Human
uggcaaaguggagagcacaaggc

SEQ ID NO: 654697 - RNA, 22 nt, Human
uggcagugguacuguggcaaag

SEQ ID NO: 654698 - RNA, 19 nt, Human
uggcuguaaauuucgagca

SEQ ID NO: 654699 - RNA, 24 nt, Human
ugguaacaaaauaaaaaaaugacu

SEQ ID NO: 654700 - RNA, 21 nt, Human
uuaaaacccuacaaaaaugcu

SEQ ID NO: 654701 - RNA, 23 nt, Human
uuaagggaaaaguggugaggaaa

SEQ ID NO: 654702 - RNA, 25 nt, Human
uucacaaucacacuguuuacuugcu

SEQ ID NO: 654703 - RNA, 21 nt, Human
uucaccuugauugaaaacaac

SEQ ID NO: 654704 - RNA, 30 nt, Human
uuucacaaucacacuguuuacuugcugccu

SEQ ID NO: 654705 - RNA, 23 nt, Human
uuuuuuuuuuuuuuuuuacuugg

SEQ ID NO: 654706 - RNA, 25 nt, Human
uuuuuuuuuuuuuuuuuuuacuugg

SEQ ID NO: 654707 - RNA, 20 nt, Human
aaaaacagcaagaaaauggc

SEQ ID NO: 654708 - RNA, 25 nt, Human
aaacacuaaucaccuaaaucauuua

SEQ ID NO: 654709 - RNA, 18 nt, Human
aacaaaaacagcaagaaa

SEQ ID NO: 654710 - RNA, 25 nt, Human
accuaaaucauuuaaccacuaacau

SEQ ID NO: 654711 - RNA, 23 nt, Human
caacuggcuucagauaauucuca

SEQ ID NO: 654712 - RNA, 18 nt, Human
caagaauacuucauacug

SEQ ID NO: 654713 - RNA, 27 nt, Human
cacagcccaaaauaauaccccuuuuuc

SEQ ID NO: 654714 - RNA, 21 nt, Human
cagcccaaaauaauaccccuu

SEQ ID NO: 654715 - RNA, 23 nt, Human
caggaaaacagcugaauacaaug

SEQ ID NO: 654716 - RNA, 23 nt, Human
caucucaauuuccuuagucacag

SEQ ID NO: 654717 - RNA, 22 nt, Human
ccaucucaauuuccuuagucac

SEQ ID NO: 654718 - RNA, 22 nt, Human
cuaaagcagagaaccaugugcc

SEQ ID NO: 654719 - RNA, 19 nt, Human
cucaagaaacgugaagagc

SEQ ID NO: 654720 - RNA, 22 nt, Human
gcuaacugugcaaaagacacca

SEQ ID NO: 654721 - RNA, 18 nt, Human
ggaaaacagcugaauaca

SEQ ID NO: 654722 - RNA, 26 nt, Human
uaaacacuaaucaccuaaaucauuua

SEQ ID NO: 654723 - RNA, 21 nt, Human
uaaagcagagaaccaugugcc

SEQ ID NO: 654724 - RNA, 23 nt, Human
uaguaaacacuaaucaccuaaau

SEQ ID NO: 654725 - RNA, 18 nt, Human
uaguuguacauccaucuc

SEQ ID NO: 654726 - RNA, 19 nt, Human
uauccagaagcaaaggcuc

SEQ ID NO: 654727 - RNA, 18 nt, Human
uccaucucaauuuccuua

SEQ ID NO: 654728 - RNA, 23 nt, Human
ugcaguaaaacacuuacauacau

SEQ ID NO: 654729 - RNA, 21 nt, Human
ugguaccaucagcuaauauaa

SEQ ID NO: 654730 - RNA, 23 nt, Human
ugugcaaaagacaccaauucaau

SEQ ID NO: 654731 - RNA, 23 nt, Human
uuguacauccaucucaauuuccu

SEQ ID NO: 654732 - RNA, 18 nt, Human
uuuuuuuuuuuuuuuuug

SEQ ID NO: 654733 - RNA, 24 nt, Human
uuuuuuuuuuuuuuuuugcaauuu

SEQ ID NO: 654734 - RNA, 28 nt, Human
uuuuuuuuuuuuuuuuuugcaauuuuaa

SEQ ID NO: 654735 - RNA, 24 nt, Human
aaagugcagggauuacaggcauga

SEQ ID NO: 654736 - RNA, 22 nt, Human
aacaucugaaccagcucuggcu

SEQ ID NO: 654737 - RNA, 22 nt, Human
aaguccccccacugccccgauu

SEQ ID NO: 654738 - RNA, 20 nt, Human
aaucaaauggccugagcccc

SEQ ID NO: 654739 - RNA, 18 nt, Human
acaggguuucaccauguu

SEQ ID NO: 654740 - RNA, 21 nt, Human
acaggguuucaccauguuggc

SEQ ID NO: 654741 - RNA, 24 nt, Human
acaggguuucaccauguuggccag

SEQ ID NO: 654742 - RNA, 22 nt, Human
accauguuggccaggcuggucu

SEQ ID NO: 654743 - RNA, 26 nt, Human
acccaucuuauguccucaagcagccu

SEQ ID NO: 654744 - RNA, 24 nt, Human
agcccugaagccucuucuguaccc

SEQ ID NO: 654745 - RNA, 24 nt, Human
agcgauucuccugccucagccucc

SEQ ID NO: 654746 - RNA, 20 nt, Human
agcggggcagccgggaccuc

SEQ ID NO: 654747 - RNA, 22 nt, Human
agcugucuggccucacaucccu

SEQ ID NO: 654748 - RNA, 19 nt, Human
aggcagaaucaaauggccu

SEQ ID NO: 654749 - RNA, 18 nt, Human
aggcaggauguacuggaa

SEQ ID NO: 654750 - RNA, 22 nt, Human
aggcaggauguacuggaaucua

SEQ ID NO: 654751 - RNA, 22 nt, Human
agggauuacaggcaugagccac

SEQ ID NO: 654752 - RNA, 24 nt, Human
agggauuacaggcaugagccaccg

SEQ ID NO: 654753 - RNA, 20 nt, Human
aggugcccaccaccacgccc

SEQ ID NO: 654754 - RNA, 22 nt, Human
aguagagacaggguuucaccau

SEQ ID NO: 654755 - RNA, 18 nt, Human
aguagcugggauuacagg

SEQ ID NO: 654756 - RNA, 20 nt, Human
agugcaauggugugaucucg

SEQ ID NO: 654757 - RNA, 24 nt, Human
agugcaauggugugaucucggcuc

SEQ ID NO: 654758 - RNA, 22 nt, Human
caaacuccaguuuggagacuga

SEQ ID NO: 654759 - RNA, 24 nt, Human
caaagugcagggauuacaggcaug

SEQ ID NO: 654760 - RNA, 20 nt, Human
caaccuccaccucccggguu

SEQ ID NO: 654761 - RNA, 23 nt, Human
caaccuccaccucccggguucaa

SEQ ID NO: 654762 - RNA, 22 nt, Human
caagcgauucuccugccucagc

SEQ ID NO: 654763 - RNA, 23 nt, Human
caagggaccuggacauguuauuu

SEQ ID NO: 654764 - RNA, 19 nt, Human
cacaacaucugcugagccc

SEQ ID NO: 654765 - RNA, 21 nt, Human
caccauguuggccaggcuggu

SEQ ID NO: 654766 - RNA, 23 nt, Human
caccauguuggccaggcuggucu

SEQ ID NO: 654767 - RNA, 24 nt, Human
caccauguuggccaggcuggucuu

SEQ ID NO: 654768 - RNA, 27 nt, Human
caccauguuggccaggcuggucuugaa

SEQ ID NO: 654769 - RNA, 20 nt, Human
caccgcauccggccuccagc

SEQ ID NO: 654770 - RNA, 21 nt, Human
cacugcaaccuccaccucccg

SEQ ID NO: 654771 - RNA, 23 nt, Human
cacugcaaccuccaccucccggg

SEQ ID NO: 654772 - RNA, 22 nt, Human
cagcucuggcuuccuuuagucc

SEQ ID NO: 654773 - RNA, 28 nt, Human
cagcugcagcauucuuaccaagggaccu

SEQ ID NO: 654774 - RNA, 20 nt, Human
caggcagcccugaacccacc

SEQ ID NO: 654775 - RNA, 24 nt, Human
caggguuucaccauguuggccagg

SEQ ID NO: 654776 - RNA, 19 nt, Human
caggugcccaccaccacgc

SEQ ID NO: 654777 - RNA, 21 nt, Human
caggugcccaccaccacgccc

SEQ ID NO: 654778 - RNA, 22 nt, Human
cauccaugugugaaauuggggg

SEQ ID NO: 654779 - RNA, 24 nt, Human
cauguuggccaggcuggucuugaa

SEQ ID NO: 654780 - RNA, 24 nt, Human
ccaaagugcagggauuacaggcau

SEQ ID NO: 654781 - RNA, 24 nt, Human
ccaccucccggguucaagcgauuc

SEQ ID NO: 654782 - RNA, 21 nt, Human
cccaccaccacgcccagcuaa

SEQ ID NO: 654783 - RNA, 26 nt, Human
cccagcugcagcauucuuaccaaggg

SEQ ID NO: 654784 - RNA, 20 nt, Human
cccaggcuggagugcaaugg

SEQ ID NO: 654785 - RNA, 18 nt, Human
ccccuggguuuggccggg

SEQ ID NO: 654786 - RNA, 23 nt, Human
cccgaguagcugggauuacaggu

SEQ ID NO: 654787 - RNA, 24 nt, Human
cccgaguagcugggauuacaggug

SEQ ID NO: 654788 - RNA, 20 nt, Human
cccggguucaagcgauucuc

SEQ ID NO: 654789 - RNA, 23 nt, Human
cccggguucaagcgauucuccug

SEQ ID NO: 654790 - RNA, 19 nt, Human
cccuggguuuggccgggcu

SEQ ID NO: 654791 - RNA, 21 nt, Human
ccgaguagcugggauuacagg

SEQ ID NO: 654792 - RNA, 20 nt, Human
ccucacaucccucagggucc

SEQ ID NO: 654793 - RNA, 24 nt, Human
ccucccggguucaagcgauucucc

SEQ ID NO: 654794 - RNA, 22 nt, Human
ccugaagccucuucuguaccca

SEQ ID NO: 654795 - RNA, 25 nt, Human
ccugaagccucuucuguacccaucu

SEQ ID NO: 654796 - RNA, 19 nt, Human
ccugaccucucagggcagu

SEQ ID NO: 654797 - RNA, 19 nt, Human
cggccaccaaggagcuguc

SEQ ID NO: 654798 - RNA, 24 nt, Human
cucacugcaaccuccaccucccgg

SEQ ID NO: 654799 - RNA, 23 nt, Human
cucagccucccgaguagcuggga

SEQ ID NO: 654800 - RNA, 22 nt, Human
cuccugccucagccucccgagu

SEQ ID NO: 654801 - RNA, 21 nt, Human
cugaagccucuucuguaccca

SEQ ID NO: 654802 - RNA, 24 nt, Human
cugaccucaggcaucccaaagugc

SEQ ID NO: 654803 - RNA, 18 nt, Human
cugcaaccuccaccuccc

SEQ ID NO: 654804 - RNA, 24 nt, Human
cugcaaccuccaccucccggguuc

SEQ ID NO: 654805 - RNA, 23 nt, Human
cugccucagccucccgaguagcu

SEQ ID NO: 654806 - RNA, 21 nt, Human
cuguacccaucuuauguccuc

SEQ ID NO: 654807 - RNA, 30 nt, Human
cuuccugcuaaaaucucuuuccuucuggaa

SEQ ID NO: 654808 - RNA, 24 nt, Human
cuugucgcccaggcuggagugcaa

SEQ ID NO: 654809 - RNA, 21 nt, Human
cuuguguuucuaaccaugaag

SEQ ID NO: 654810 - RNA, 18 nt, Human
gaacaggccagccguucu

SEQ ID NO: 654811 - RNA, 18 nt, Human
gaaguccccccacugccc

SEQ ID NO: 654812 - RNA, 23 nt, Human
gaaguccccccacugccccgauu

SEQ ID NO: 654813 - RNA, 20 nt, Human
gagaagaaaggagaugaugg

SEQ ID NO: 654814 - RNA, 23 nt, Human
gaguccaaggugggcccgggccc

SEQ ID NO: 654815 - RNA, 18 nt, Human
gauuacaggcaugagcca

SEQ ID NO: 654816 - RNA, 22 nt, Human
gauuacaggcaugagccaccgc

SEQ ID NO: 654817 - RNA, 23 nt, Human
gauuacaggcaugagccaccgca

SEQ ID NO: 654818 - RNA, 19 nt, Human
gcaugugugggccacggca

SEQ ID NO: 654819 - RNA, 20 nt, Human
gcccaggcuggagugcaaug

SEQ ID NO: 654820 - RNA, 19 nt, Human
gccccucccaggagcagcg

SEQ ID NO: 654821 - RNA, 28 nt, Human
gcccugaagccucuucuguacccaucuu

SEQ ID NO: 654822 - RNA, 19 nt, Human
gccgggaccucaguugucc

SEQ ID NO: 654823 - RNA, 20 nt, Human
gccucagccucccgaguagc

SEQ ID NO: 654824 - RNA, 24 nt, Human
gccugagccccucccaggagcagc

SEQ ID NO: 654825 - RNA, 18 nt, Human
gccugggcucacucccag

SEQ ID NO: 654826 - RNA, 24 nt, Human
gcgauucuccugccucagccuccc

SEQ ID NO: 654827 - RNA, 21 nt, Human
gcucuugucgcccaggcugga

SEQ ID NO: 654828 - RNA, 24 nt, Human
gcucuugucgcccaggcuggagug

SEQ ID NO: 654829 - RNA, 30 nt, Human
gcuggagugcaauggugugaucucggcucc

SEQ ID NO: 654830 - RNA, 23 nt, Human
gcuggucuugaacuccugaccuc

SEQ ID NO: 654831 - RNA, 22 nt, Human
ggauuacaggcaugagccaccg

SEQ ID NO: 654832 - RNA, 20 nt, Human
ggcguguugagcggggcagc

SEQ ID NO: 654833 - RNA, 22 nt, Human
ggcuggagugcaauggugugau

SEQ ID NO: 654834 - RNA, 24 nt, Human
ggcuggucuugaacuccugaccuc

SEQ ID NO: 654835 - RNA, 22 nt, Human
gggauuacaggcaugagccacc

SEQ ID NO: 654836 - RNA, 23 nt, Human
gggauuacaggcaugagccaccg

SEQ ID NO: 654837 - RNA, 22 nt, Human
ggguuucaccauguuggccagg

SEQ ID NO: 654838 - RNA, 19 nt, Human
ggucuugaacuccugaccu

SEQ ID NO: 654839 - RNA, 21 nt, Human
gguggcuagccaggcagcccu

SEQ ID NO: 654840 - RNA, 26 nt, Human
guacccaucuuauguccucaagcagc

SEQ ID NO: 654841 - RNA, 23 nt, Human
guaccgcucugccugaaaaacca

SEQ ID NO: 654842 - RNA, 24 nt, Human
guaguagagacaggguuucaccau

SEQ ID NO: 654843 - RNA, 21 nt, Human
guccuugccgggccacacccu

SEQ ID NO: 654844 - RNA, 21 nt, Human
gugacgggcaggggcuggcac

SEQ ID NO: 654845 - RNA, 18 nt, Human
gugcagagggacagguca

SEQ ID NO: 654846 - RNA, 24 nt, Human
gugggcccgggcccggguuaacuu

SEQ ID NO: 654847 - RNA, 19 nt, Human
uaacaggagaagaaaggag

SEQ ID NO: 654848 - RNA, 24 nt, Human
uaacaggagaagaaaggagaugau

SEQ ID NO: 654849 - RNA, 24 nt, Human
uaauuuucguauuuguaguagaga

SEQ ID NO: 654850 - RNA, 23 nt, Human
uacaggcaugagccaccgcaucc

SEQ ID NO: 654851 - RNA, 24 nt, Human
uacaggugcccaccaccacgccca

SEQ ID NO: 654852 - RNA, 22 nt, Human
uaccgcucugccugaaaaacca

SEQ ID NO: 654853 - RNA, 22 nt, Human
uagagacaggguuucaccaugu

SEQ ID NO: 654854 - RNA, 23 nt, Human
uaguagagacaggguuucaccau

SEQ ID NO: 654855 - RNA, 24 nt, Human
uaguagagacaggguuucaccaug

SEQ ID NO: 654856 - RNA, 26 nt, Human
uaguagagacaggguuucaccauguu

SEQ ID NO: 654857 - RNA, 23 nt, Human
ucacugcaaccuccaccucccgg

SEQ ID NO: 654858 - RNA, 24 nt, Human
ucacugcaaccuccaccucccggg

SEQ ID NO: 654859 - RNA, 25 nt, Human
ucacugcaaccuccaccucccgggu

SEQ ID NO: 654860 - RNA, 27 nt, Human
ucacugcaaccuccaccucccggguuc

SEQ ID NO: 654861 - RNA, 20 nt, Human
ucagccucccgaguagcugg

SEQ ID NO: 654862 - RNA, 19 nt, Human
ucaggcaucccaaagugca

SEQ ID NO: 654863 - RNA, 20 nt, Human
uccaaagggccacucagcuu

SEQ ID NO: 654864 - RNA, 21 nt, Human
uccaagagaaucuucccugcu

SEQ ID NO: 654865 - RNA, 23 nt, Human
uccagaacaaaccauacuuuugc

SEQ ID NO: 654866 - RNA, 24 nt, Human
ucccaaagugcagggauuacaggc

SEQ ID NO: 654867 - RNA, 22 nt, Human
uccccccacugccccgauucac

SEQ ID NO: 654868 - RNA, 23 nt, Human
ucccgaguagcugggauuacagg

SEQ ID NO: 654869 - RNA, 24 nt, Human
ucccgaguagcugggauuacaggu

SEQ ID NO: 654870 - RNA, 21 nt, Human
ucccggguucaagcgauucuc

SEQ ID NO: 654871 - RNA, 24 nt, Human
ucccggguucaagcgauucuccug

SEQ ID NO: 654872 - RNA, 19 nt, Human
ucccucaggguccuugccg

SEQ ID NO: 654873 - RNA, 23 nt, Human
ucccucaggguccuugccgggcc

SEQ ID NO: 654874 - RNA, 25 nt, Human
ucccucaggguccuugccgggcccc

SEQ ID NO: 654875 - RNA, 25 nt, Human
uccgaacagaaaagacguuucaaaa

SEQ ID NO: 654876 - RNA, 18 nt, Human
ucgcccaggcuggagugc

SEQ ID NO: 654877 - RNA, 23 nt, Human
ucuugaacuccugaccucaggca

SEQ ID NO: 654878 - RNA, 20 nt, Human
ugccccgauucacugcacag

SEQ ID NO: 654879 - RNA, 23 nt, Human
ugccccuggguuuggccgggcuu

SEQ ID NO: 654880 - RNA, 24 nt, Human
ugccucagccucccgaguagcugg

SEQ ID NO: 654881 - RNA, 19 nt, Human
ugccugggcucacucccag

SEQ ID NO: 654882 - RNA, 22 nt, Human
ugccugggcucacucccagcac

SEQ ID NO: 654883 - RNA, 24 nt, Human
ugcucuugucgcccaggcuggagu

SEQ ID NO: 654884 - RNA, 19 nt, Human
uggagugcaauggugugau

SEQ ID NO: 654885 - RNA, 23 nt, Human
uggagugcaauggugugaucucg

SEQ ID NO: 654886 - RNA, 24 nt, Human
uggagugcaauggugugaucucgg

SEQ ID NO: 654887 - RNA, 24 nt, Human
uggccaggcuggucuugaacuccu

SEQ ID NO: 654888 - RNA, 23 nt, Human
uggccugagccccucccaggagc

SEQ ID NO: 654889 - RNA, 24 nt, Human
uggccugggcuagaaggcgguguc

SEQ ID NO: 654890 - RNA, 21 nt, Human
ugggauuacaggugcccacca

SEQ ID NO: 654891 - RNA, 24 nt, Human
ugggauuacaggugcccaccacca

SEQ ID NO: 654892 - RNA, 20 nt, Human
ugucgcccaggcuggagugc

SEQ ID NO: 654893 - RNA, 19 nt, Human
ugugugaaauugggggcag

SEQ ID NO: 654894 - RNA, 19 nt, Human
uucaaaauggaggcagaac

SEQ ID NO: 654895 - RNA, 21 nt, Human
uucaagcgauucuccugccuc

SEQ ID NO: 654896 - RNA, 23 nt, Human
uucaagcgauucuccugccucag

SEQ ID NO: 654897 - RNA, 24 nt, Human
uucaagcgauucuccugccucagc

SEQ ID NO: 654898 - RNA, 20 nt, Human
uuccuugccugucucuuccu

SEQ ID NO: 654899 - RNA, 21 nt, Human
uuccuugccugucucuuccug

SEQ ID NO: 654900 - RNA, 20 nt, Human
uugccgggccacacccuauu

SEQ ID NO: 654901 - RNA, 22 nt, Human
uugcucuugucgcccaggcugg

SEQ ID NO: 654902 - RNA, 23 nt, Human
uugcucuugucgcccaggcugga

SEQ ID NO: 654903 - RNA, 20 nt, Human
uuggaaggaaggagaaagga

SEQ ID NO: 654904 - RNA, 18 nt, Human
uugugauaaugaaguugu

SEQ ID NO: 654905 - RNA, 21 nt, Human
uuuaaaaccugaccucucagg

SEQ ID NO: 654906 - RNA, 19 nt, Human
uuuagccaccaaacuccag

SEQ ID NO: 654907 - RNA, 24 nt, Human
uuucaccauguuggccaggcuggu

SEQ ID NO: 654908 - RNA, 21 nt, Human
uuugcucucccgugucuuggu

SEQ ID NO: 654909 - RNA, 24 nt, Human
uuugcucuugucgcccaggcugga

SEQ ID NO: 654910 - RNA, 21 nt, Human
uuuggaaggaaggagaaagga

SEQ ID NO: 654911 - RNA, 24 nt, Human
uuuguaguagagacaggguuucac

SEQ ID NO: 654912 - RNA, 26 nt, Human
uuuguaguagagacaggguuucacca

SEQ ID NO: 654913 - RNA, 19 nt, Human
uuuugcucaaaauguucuc

SEQ ID NO: 654914 - RNA, 24 nt, Human
uuuugcucuugucgcccaggcugg

SEQ ID NO: 654915 - RNA, 21 nt, Human
uuuuuuuuuuuuagacggagu

SEQ ID NO: 654916 - RNA, 21 nt, Human
uuuuuuuuuuuuuuagacgga

SEQ ID NO: 654917 - RNA, 20 nt, Human
aaaacccuuuccaucaucuu

SEQ ID NO: 654918 - RNA, 23 nt, Human
aaaacccuuuccaucaucuucaa

SEQ ID NO: 654919 - RNA, 23 nt, Human
aaacauaaaaauagaacaaugug

SEQ ID NO: 654920 - RNA, 19 nt, Human
aacaaugugacugggagag

SEQ ID NO: 654921 - RNA, 19 nt, Human
aacauggugaaaccccguc

SEQ ID NO: 654922 - RNA, 20 nt, Human
aacauggugaaaccccgucu

SEQ ID NO: 654923 - RNA, 21 nt, Human
aacauggugaaaccccgucuc

SEQ ID NO: 654924 - RNA, 18 nt, Human
aacuccccaagucuccag

SEQ ID NO: 654925 - RNA, 19 nt, Human
aagauggaacaacucccca

SEQ ID NO: 654926 - RNA, 23 nt, Human
aaggcaggcaaaucacuugaggc

SEQ ID NO: 654927 - RNA, 25 nt, Human
aaggcaggcaaaucacuugaggcca

SEQ ID NO: 654928 - RNA, 30 nt, Human
aauaaugaagaaaccggggcuuuuagagaa

SEQ ID NO: 654929 - RNA, 24 nt, Human
aaucacuugaggccaggaguucga

SEQ ID NO: 654930 - RNA, 24 nt, Human
aauugcuugaacccgggaggcaga

SEQ ID NO: 654931 - RNA, 24 nt, Human
acagagcaagacuccaucucaaaa

SEQ ID NO: 654932 - RNA, 23 nt, Human
acagagcaagucguaguucuaaa

SEQ ID NO: 654933 - RNA, 24 nt, Human
accccgucucuacuaaaaauacaa

SEQ ID NO: 654934 - RNA, 21 nt, Human
acucauucaacaagcauuuaa

SEQ ID NO: 654935 - RNA, 23 nt, Human
acucuagccugggagacagagca

SEQ ID NO: 654936 - RNA, 18 nt, Human
agacagaaucuuacugca

SEQ ID NO: 654937 - RNA, 20 nt, Human
agagguugcagugagcugag

SEQ ID NO: 654938 - RNA, 24 nt, Human
agagguugcagugagcugagguug

SEQ ID NO: 654939 - RNA, 23 nt, Human
agccagucgugguggcaugugcc

SEQ ID NO: 654940 - RNA, 22 nt, Human
agccuggccaacauggugaaac

SEQ ID NO: 654941 - RNA, 24 nt, Human
agccuggccaacauggugaaaccc

SEQ ID NO: 654942 - RNA, 24 nt, Human
agccugggagacagagcaagacuc

SEQ ID NO: 654943 - RNA, 21 nt, Human
aggaaaaaugaaugcugaaag

SEQ ID NO: 654944 - RNA, 20 nt, Human
aggcagagguugcagugagc

SEQ ID NO: 654945 - RNA, 24 nt, Human
aggcagagguugcagugagcugag

SEQ ID NO: 654946 - RNA, 24 nt, Human
aggcaggagaauugcuugaacccg

SEQ ID NO: 654947 - RNA, 21 nt, Human
aggcaggcaaaucacuugagg

SEQ ID NO: 654948 - RNA, 26 nt, Human
aggcaggcaaaucacuugaggccagg

SEQ ID NO: 654949 - RNA, 24 nt, Human
aggcuaaggcaggagaauugcuug

SEQ ID NO: 654950 - RNA, 21 nt, Human
agugagcugagguugugccau

SEQ ID NO: 654951 - RNA, 23 nt, Human
auaaaaauagaacaaugugacug

SEQ ID NO: 654952 - RNA, 18 nt, Human
aucacaaaacaaaccuca

SEQ ID NO: 654953 - RNA, 22 nt, Human
aucccagcacuuugggaggcca

SEQ ID NO: 654954 - RNA, 23 nt, Human
aucucacucauucaacaagcauu

SEQ ID NO: 654955 - RNA, 19 nt, Human
augccuguaaucccagcac

SEQ ID NO: 654956 - RNA, 18 nt, Human
auugcacucuagccuggg

SEQ ID NO: 654957 - RNA, 24 nt, Human
auugcacucuagccugggagacag

SEQ ID NO: 654958 - RNA, 27 nt, Human
caaaucacuugaggccaggaguucgag

SEQ ID NO: 654959 - RNA, 24 nt, Human
caacauggugaaaccccgucucua

SEQ ID NO: 654960 - RNA, 21 nt, Human
caagacuccaucucaaaaaaa

SEQ ID NO: 654961 - RNA, 22 nt, Human
cagagguugcagugagcugagg

SEQ ID NO: 654962 - RNA, 24 nt, Human
cagcacuuugggaggccaaggcag

SEQ ID NO: 654963 - RNA, 25 nt, Human
cagcacuuugggaggccaaggcagg

SEQ ID NO: 654964 - RNA, 24 nt, Human
caggcaaaucacuugaggccagga

SEQ ID NO: 654965 - RNA, 20 nt, Human
caugccuguaaucccagcac

SEQ ID NO: 654966 - RNA, 18 nt, Human
cauugcacucuagccugg

SEQ ID NO: 654967 - RNA, 19 nt, Human
cauugcacucuagccuggg

SEQ ID NO: 654968 - RNA, 22 nt, Human
cauugcacucuagccugggaga

SEQ ID NO: 654969 - RNA, 23 nt, Human
cauugcacucuagccugggagac

SEQ ID NO: 654970 - RNA, 24 nt, Human
cauugcacucuagccugggagaca

SEQ ID NO: 654971 - RNA, 25 nt, Human
cauugcacucuagccugggagacag

SEQ ID NO: 654972 - RNA, 20 nt, Human
ccaggaguucgagaccagcc

SEQ ID NO: 654973 - RNA, 19 nt, Human
ccauugcacucuagccugg

SEQ ID NO: 654974 - RNA, 20 nt, Human
ccauugcacucuagccuggg

SEQ ID NO: 654975 - RNA, 22 nt, Human
ccauugcacucuagccugggag

SEQ ID NO: 654976 - RNA, 24 nt, Human
ccauugcacucuagccugggagac

SEQ ID NO: 654977 - RNA, 21 nt, Human
ccuauaauuccagcuacucag

SEQ ID NO: 654978 - RNA, 23 nt, Human
ccuggccaacauggugaaacccc

SEQ ID NO: 654979 - RNA, 24 nt, Human
ccuggccaacauggugaaaccccg

SEQ ID NO: 654980 - RNA, 22 nt, Human
ccugggagacagagcaagacuc

SEQ ID NO: 654981 - RNA, 20 nt, Human
ccuguaaucccagcacuuug

SEQ ID NO: 654982 - RNA, 24 nt, Human
ccuuuguaaaaacccuuuccauca

SEQ ID NO: 654983 - RNA, 24 nt, Human
cgagaccagccuggccaacauggu

SEQ ID NO: 654984 - RNA, 24 nt, Human
cgggaggcagagguugcagugagc

SEQ ID NO: 654985 - RNA, 22 nt, Human
cuaaacaucucacucauucaac

SEQ ID NO: 654986 - RNA, 19 nt, Human
cucaaaaaaaaugaaaaca

SEQ ID NO: 654987 - RNA, 24 nt, Human
cucaugccuguaaucccagcacuu

SEQ ID NO: 654988 - RNA, 21 nt, Human
cuccccaagucuccagagagg

SEQ ID NO: 654989 - RNA, 25 nt, Human
cuucugcuacgaacuacuuuuacaa

SEQ ID NO: 654990 - RNA, 23 nt, Human
gagaauugcuugaacccgggagg

SEQ ID NO: 654991 - RNA, 23 nt, Human
gauaauaaugaagaaaccggggc

SEQ ID NO: 654992 - RNA, 24 nt, Human
gcacucuagccugggagacagagc

SEQ ID NO: 654993 - RNA, 22 nt, Human
gcaugugccuauaauuccagcu

SEQ ID NO: 654994 - RNA, 24 nt, Human
gccaacauggugaaaccccgucuc

SEQ ID NO: 654995 - RNA, 20 nt, Human
gccauugcacucuagccugg

SEQ ID NO: 654996 - RNA, 21 nt, Human
ggcaugugccuauaauuccag

SEQ ID NO: 654997 - RNA, 21 nt, Human
ggcucaugccuguaaucccag

SEQ ID NO: 654998 - RNA, 23 nt, Human
ggugagguggcucaugccuguaa

SEQ ID NO: 654999 - RNA, 23 nt, Human
gguggcucaugccuguaauccca

SEQ ID NO: 655000 - RNA, 23 nt, Human
guggcucaugccuguaaucccag

SEQ ID NO: 655001 - RNA, 24 nt, Human
guugcagugagcugagguugugcc

SEQ ID NO: 655002 - RNA, 19 nt, Human
uaaaaaggcuagaauaaug

SEQ ID NO: 655003 - RNA, 21 nt, Human
uaaaaauacaaaaauuagcca

SEQ ID NO: 655004 - RNA, 22 nt, Human
uaaacuggcugaagauggaaca

SEQ ID NO: 655005 - RNA, 24 nt, Human
uaaggcaggagaauugcuugaacc

SEQ ID NO: 655006 - RNA, 25 nt, Human
uaaggcaggagaauugcuugaaccc

SEQ ID NO: 655007 - RNA, 20 nt, Human
uaagggacuguaaaccagca

SEQ ID NO: 655008 - RNA, 18 nt, Human
uaaguccaguguggcacu

SEQ ID NO: 655009 - RNA, 24 nt, Human
uaaugauaauaaugaagaaaccgg

SEQ ID NO: 655010 - RNA, 22 nt, Human
uacagccaggaaauauuaaggg

SEQ ID NO: 655011 - RNA, 23 nt, Human
ucacuugaggccaggaguucgag

SEQ ID NO: 655012 - RNA, 20 nt, Human
ucagguauagcuguuauucu

SEQ ID NO: 655013 - RNA, 22 nt, Human
ucaugccuguaaucccagcacu

SEQ ID NO: 655014 - RNA, 22 nt, Human
uccaucucaaaaaaaaugaaaa

SEQ ID NO: 655015 - RNA, 26 nt, Human
uccaucucaaaaaaaaugaaaacaua

SEQ ID NO: 655016 - RNA, 21 nt, Human
uccccaagucuccagagaggc

SEQ ID NO: 655017 - RNA, 21 nt, Human
ucucuacuaaaaauacaaaaa

SEQ ID NO: 655018 - RNA, 23 nt, Human
ugaagauggaacaacuccccaag

SEQ ID NO: 655019 - RNA, 18 nt, Human
ugaaugcugaaagaacua

SEQ ID NO: 655020 - RNA, 23 nt, Human
ugaccuggccaagaucauacagg

SEQ ID NO: 655021 - RNA, 22 nt, Human
ugcacucuagccugggagacag

SEQ ID NO: 655022 - RNA, 18 nt, Human
ugccuauaauuccagcua

SEQ ID NO: 655023 - RNA, 24 nt, Human
ugccuauaauuccagcuacucagg

SEQ ID NO: 655024 - RNA, 23 nt, Human
ugccuguaaucccagcacuuugg

SEQ ID NO: 655025 - RNA, 24 nt, Human
ugccuguaaucccagcacuuuggg

SEQ ID NO: 655026 - RNA, 19 nt, Human
uggcaucaaagguuggacc

SEQ ID NO: 655027 - RNA, 22 nt, Human
uggcaugugccuauaauuccag

SEQ ID NO: 655028 - RNA, 24 nt, Human
uggccaacauggugaaaccccguc

SEQ ID NO: 655029 - RNA, 22 nt, Human
uggcucaugccuguaaucccag

SEQ ID NO: 655030 - RNA, 24 nt, Human
uggcucaugccuguaaucccagca

SEQ ID NO: 655031 - RNA, 24 nt, Human
ugggaggccaaggcaggcaaauca

SEQ ID NO: 655032 - RNA, 24 nt, Human
ugguggcaugugccuauaauucca

SEQ ID NO: 655033 - RNA, 21 nt, Human
uuaaggguaggaaugaggagu

SEQ ID NO: 655034 - RNA, 26 nt, Human
uuacaaagacagaaucuuacugcaua

SEQ ID NO: 655035 - RNA, 18 nt, Human
uuauucuccagucacugg

SEQ ID NO: 655036 - RNA, 24 nt, Human
uucuaaacaucucacucauucaac

SEQ ID NO: 655037 - RNA, 18 nt, Human
uucuagaccgucagagga

SEQ ID NO: 655038 - RNA, 24 nt, Human
uucugcuacgaacuacuuuuacaa

SEQ ID NO: 655039 - RNA, 22 nt, Human
uugaggccaggaguucgagacc

SEQ ID NO: 655040 - RNA, 22 nt, Human
uugcagugagcugagguugugc

SEQ ID NO: 655041 - RNA, 18 nt, Human
uugcuugaacccgggagg

SEQ ID NO: 655042 - RNA, 24 nt, Human
uugcuugaacccgggaggcagagg

SEQ ID NO: 655043 - RNA, 24 nt, Human
uuuuacaaagacagaaucuuacug

SEQ ID NO: 655044 - RNA, 24 nt, Human
uuuuuuuuuuuuuuuugggucuca

SEQ ID NO: 655045 - RNA, 18 nt, Human
uuuuuuuuuuuuuuuuug

SEQ ID NO: 655046 - RNA, 22 nt, Human
uuuuuuuuuuuuuuuuuuuggg

SEQ ID NO: 655047 - RNA, 24 nt, Human
uuuuuuuuuuuuuuuuuuuggguc

SEQ ID NO: 655048 - RNA, 18 nt, Human
aaauaccuauacccacaa

SEQ ID NO: 655049 - RNA, 24 nt, Human
aacaaggaaacacagcgaugugaa

SEQ ID NO: 655050 - RNA, 25 nt, Human
aaccagaguccggaucugcacauag

SEQ ID NO: 655051 - RNA, 22 nt, Human
aacuccugcuccacuggauccc

SEQ ID NO: 655052 - RNA, 20 nt, Human
aagcuuucauucuggucauc

SEQ ID NO: 655053 - RNA, 22 nt, Human
aaggaaacacagcgaugugaac

SEQ ID NO: 655054 - RNA, 23 nt, Human
aaggaaacacagcgaugugaacg

SEQ ID NO: 655055 - RNA, 22 nt, Human
acaggcccacaaaaguacagcu

SEQ ID NO: 655056 - RNA, 23 nt, Human
agaaaaaaccaaacauuuugccc

SEQ ID NO: 655057 - RNA, 22 nt, Human
aggcccacaaaaguacagcuga

SEQ ID NO: 655058 - RNA, 19 nt, Human
auaaagcagcaaaaacaua

SEQ ID NO: 655059 - RNA, 20 nt, Human
aucccccauccagcuucacc

SEQ ID NO: 655060 - RNA, 24 nt, Human
caauaggucugcaaaaucucccac

SEQ ID NO: 655061 - RNA, 23 nt, Human
cacaaaaguacagcugagacggg

SEQ ID NO: 655062 - RNA, 20 nt, Human
cacuggaucccccauccagc

SEQ ID NO: 655063 - RNA, 21 nt, Human
cacuggaucccccauccagcu

SEQ ID NO: 655064 - RNA, 22 nt, Human
cacuggaucccccauccagcuu

SEQ ID NO: 655065 - RNA, 26 nt, Human
cagaaagaaaaauguuaacaaggaaa

SEQ ID NO: 655066 - RNA, 24 nt, Human
cagacucuagaguuucccaacuuc

SEQ ID NO: 655067 - RNA, 18 nt, Human
cccacaaaaguacagcug

SEQ ID NO: 655068 - RNA, 23 nt, Human
cccaccuucacgcuguaucccca

SEQ ID NO: 655069 - RNA, 20 nt, Human
cccaggaagaaaauaccuau

SEQ ID NO: 655070 - RNA, 23 nt, Human
cccaggaagaaaauaccuauacc

SEQ ID NO: 655071 - RNA, 20 nt, Human
ccucucugcagaaagaaaaa

SEQ ID NO: 655072 - RNA, 25 nt, Human
ccuuuucuuuugguaaugggguguu

SEQ ID NO: 655073 - RNA, 21 nt, Human
cugcugugcaacuuccccacc

SEQ ID NO: 655074 - RNA, 19 nt, Human
cuggaucccccauccagcu

SEQ ID NO: 655075 - RNA, 21 nt, Human
cuggcaggaggcagagcaagc

SEQ ID NO: 655076 - RNA, 18 nt, Human
cuuuuuccguauuuucuc

SEQ ID NO: 655077 - RNA, 25 nt, Human
gaaaaaaccaaacauuuugcccaga

SEQ ID NO: 655078 - RNA, 18 nt, Human
gaacugaauucuucccca

SEQ ID NO: 655079 - RNA, 21 nt, Human
gagaaaaaaccaaacauuuug

SEQ ID NO: 655080 - RNA, 19 nt, Human
gcaaaaacauaucuuccuc

SEQ ID NO: 655081 - RNA, 18 nt, Human
gcaaaaucucccacaggc

SEQ ID NO: 655082 - RNA, 19 nt, Human
gcaaaaucucccacaggca

SEQ ID NO: 655083 - RNA, 21 nt, Human
ggaagaaaauaccuauaccca

SEQ ID NO: 655084 - RNA, 26 nt, Human
gguugccaccuuaccuuuucuuuugg

SEQ ID NO: 655085 - RNA, 22 nt, Human
uauauauauguguguuuauaua

SEQ ID NO: 655086 - RNA, 22 nt, Human
uauccccaagucccgccaccaa

SEQ ID NO: 655087 - RNA, 20 nt, Human
uauuaaaaauaagguugcca

SEQ ID NO: 655088 - RNA, 27 nt, Human
ucaacuccugcuccacuggauccccca

SEQ ID NO: 655089 - RNA, 22 nt, Human
ucacgcuguauccccaaguccc

SEQ ID NO: 655090 - RNA, 21 nt, Human
ucaucaagaugacaggcccac

SEQ ID NO: 655091 - RNA, 20 nt, Human
uccacuggaucccccaucca

SEQ ID NO: 655092 - RNA, 22 nt, Human
ucccacucuuuuccugggccag

SEQ ID NO: 655093 - RNA, 23 nt, Human
uccccaccuucacgcuguauccc

SEQ ID NO: 655094 - RNA, 18 nt, Human
ucccgccaccaauucugg

SEQ ID NO: 655095 - RNA, 20 nt, Human
uccgucaacuccugcuccac

SEQ ID NO: 655096 - RNA, 18 nt, Human
ucugcaaaaucucccaca

SEQ ID NO: 655097 - RNA, 22 nt, Human
ucugcaaaaucucccacaggca

SEQ ID NO: 655098 - RNA, 22 nt, Human
ugccuaaaagcaagauggcaaa

SEQ ID NO: 655099 - RNA, 22 nt, Human
ugcuccacuggaucccccaucc

SEQ ID NO: 655100 - RNA, 23 nt, Human
ugggccaggcgccggacugcugc

SEQ ID NO: 655101 - RNA, 18 nt, Human
uguguguuuauauauaua

SEQ ID NO: 655102 - RNA, 22 nt, Human
uguguuuauauauauauuuuua

SEQ ID NO: 655103 - RNA, 22 nt, Human
uuucuugugguuguuuguuaau

SEQ ID NO: 655104 - RNA, 27 nt, Human
uuuuuuuuuuuuuuuuuuuucuuuaga

SEQ ID NO: 655105 - RNA, 18 nt, Human
accaauggcgaucuuccc

SEQ ID NO: 655106 - RNA, 33 nt, Human
auaugugcauauauuuucacacauauauauggu

SEQ ID NO: 655107 - RNA, 20 nt, Human
ccaaaacuuagcaacaucaa

SEQ ID NO: 655108 - RNA, 24 nt, Human
guauaaccaauggcgaucuucccu

SEQ ID NO: 655109 - RNA, 19 nt, Human
uaaaacagcacuuaauggu

SEQ ID NO: 655110 - RNA, 21 nt, Human
uaaccaauggcgaucuucccu

SEQ ID NO: 655111 - RNA, 20 nt, Human
uacaaucagggucuuuaccc

SEQ ID NO: 655112 - RNA, 23 nt, Human
uauauuuucacacauauauaugu

SEQ ID NO: 655113 - RNA, 26 nt, Human
uaugugcauauauuuucacacauaua

SEQ ID NO: 655114 - RNA, 19 nt, Human
ugcauauauuuucacacau

SEQ ID NO: 655115 - RNA, 22 nt, Human
ugcauauauuuucacacauaua

SEQ ID NO: 655116 - RNA, 24 nt, Human
ugcauauauuuucacacauauaua

SEQ ID NO: 655117 - RNA, 18 nt, Human
uuaauggucauguucuuu

SEQ ID NO: 655118 - RNA, 26 nt, Human
uucacacauauauaugucuuauauac

SEQ ID NO: 655119 - RNA, 19 nt, Human
uucagaggaaaaaaaugaa

SEQ ID NO: 655120 - RNA, 21 nt, Human
uuuuuuuuuuuuuuuuugggu

SEQ ID NO: 655121 - RNA, 26 nt, Human
uuuuuuuuuuuuuuuuuuuuuuuggg

SEQ ID NO: 655122 - RNA, 24 nt, Human
aaagugcugggauuauaagcguga

SEQ ID NO: 655123 - RNA, 19 nt, Human
aagaacccccucaaacaaa

SEQ ID NO: 655124 - RNA, 22 nt, Human
aagaacccccucaaacaaaaag

SEQ ID NO: 655125 - RNA, 21 nt, Human
aagcgugagccacugcaccca

SEQ ID NO: 655126 - RNA, 19 nt, Human
aagugcugggauuauaagc

SEQ ID NO: 655127 - RNA, 19 nt, Human
aagugcugggauuauaagc

SEQ ID NO: 655128 - RNA, 26 nt, Human
aagugcugggauuauaagcgugagcc

SEQ ID NO: 655129 - RNA, 18 nt, Human
acaacauacauguauaua

SEQ ID NO: 655130 - RNA, 18 nt, Human
acaggguuucaucauguu

SEQ ID NO: 655131 - RNA, 23 nt, Human
acaggguuucaucauguuggcca

SEQ ID NO: 655132 - RNA, 24 nt, Human
acaggguuucaucauguuggccag

SEQ ID NO: 655133 - RNA, 24 nt, Human
accacugcacucuggcuuggguga

SEQ ID NO: 655134 - RNA, 22 nt, Human
acugcaaccuccgccucccagg

SEQ ID NO: 655135 - RNA, 18 nt, Human
acugcacucuggcuuggg

SEQ ID NO: 655136 - RNA, 26 nt, Human
acugcacucuggcuugggugauggag

SEQ ID NO: 655137 - RNA, 20 nt, Human
agacagagucuugcagucuu

SEQ ID NO: 655138 - RNA, 20 nt, Human
agacgaaggacugcuugagc

SEQ ID NO: 655139 - RNA, 22 nt, Human
agcaagaacccccucaaacaaa

SEQ ID NO: 655140 - RNA, 20 nt, Human
agcuggguguguugguaugu

SEQ ID NO: 655141 - RNA, 23 nt, Human
aggcaggaaaauugcuugagccc

SEQ ID NO: 655142 - RNA, 24 nt, Human
aggcaggaaaauugcuugagccca

SEQ ID NO: 655143 - RNA, 20 nt, Human
aggcaugcuggcucacaccu

SEQ ID NO: 655144 - RNA, 25 nt, Human
aggcuggagugcaguggcacaaucu

SEQ ID NO: 655145 - RNA, 19 nt, Human
agugcaguggcacaaucug

SEQ ID NO: 655146 - RNA, 24 nt, Human
agugcugggauuauaagcgugagc

SEQ ID NO: 655147 - RNA, 18 nt, Human
auccaccugccguggccu

SEQ ID NO: 655148 - RNA, 24 nt, Human
augauccaccugccguggccuccc

SEQ ID NO: 655149 - RNA, 24 nt, Human
auuucaccacugcacucuggcuug

SEQ ID NO: 655150 - RNA, 24 nt, Human
caaagugcugggauuauaagcgug

SEQ ID NO: 655151 - RNA, 22 nt, Human
caagcaauuuuccugccucagc

SEQ ID NO: 655152 - RNA, 22 nt, Human
caaugugguaagacccugucuc

SEQ ID NO: 655153 - RNA, 22 nt, Human
cacaccuauaauuccagcacug

SEQ ID NO: 655154 - RNA, 20 nt, Human
caccacugcacucuggcuug

SEQ ID NO: 655155 - RNA, 19 nt, Human
caccaugccuaauuuuugu

SEQ ID NO: 655156 - RNA, 20 nt, Human
cacccagccucaaaaugauc

SEQ ID NO: 655157 - RNA, 21 nt, Human
caccuauaauuccagcacugg

SEQ ID NO: 655158 - RNA, 23 nt, Human
caccugccguggccucccaaagu

SEQ ID NO: 655159 - RNA, 19 nt, Human
cacugcacucuggcuuggg

SEQ ID NO: 655160 - RNA, 19 nt, Human
cacugcacucuggcuuggg

SEQ ID NO: 655161 - RNA, 19 nt, Human
cacugcacucuggcuuggg

SEQ ID NO: 655162 - RNA, 22 nt, Human
cacugcacucuggcuuggguga

SEQ ID NO: 655163 - RNA, 25 nt, Human
cacugcacucuggcuugggugaugg

SEQ ID NO: 655164 - RNA, 24 nt, Human
caggguuucaucauguuggccagg

SEQ ID NO: 655165 - RNA, 19 nt, Human
caggugcccgccaccaugc

SEQ ID NO: 655166 - RNA, 24 nt, Human
caggugcccgccaccaugccuaau

SEQ ID NO: 655167 - RNA, 23 nt, Human
caguaaccgugacuacaggugcc

SEQ ID NO: 655168 - RNA, 19 nt, Human
caucaaaaguuuuccaggg

SEQ ID NO: 655169 - RNA, 24 nt, Human
caucauguuggccaggcuggucuc

SEQ ID NO: 655170 - RNA, 27 nt, Human
caucauguuggccaggcuggucucaaa

SEQ ID NO: 655171 - RNA, 21 nt, Human
caugccuaauuuuuguauuuu

SEQ ID NO: 655172 - RNA, 18 nt, Human
cauguuggccaggcuggu

SEQ ID NO: 655173 - RNA, 21 nt, Human
cauguuggccaggcuggucuc

SEQ ID NO: 655174 - RNA, 24 nt, Human
cauguuggccaggcuggucucaaa

SEQ ID NO: 655175 - RNA, 18 nt, Human
ccaaagugcugggauuau

SEQ ID NO: 655176 - RNA, 22 nt, Human
ccaaagugcugggauuauaagc

SEQ ID NO: 655177 - RNA, 24 nt, Human
ccaaagugcugggauuauaagcgu

SEQ ID NO: 655178 - RNA, 19 nt, Human
ccacugcacccagccucaa

SEQ ID NO: 655179 - RNA, 21 nt, Human
ccacugcacccagccucaaaa

SEQ ID NO: 655180 - RNA, 21 nt, Human
ccacugcacccagccucaaaa

SEQ ID NO: 655181 - RNA, 20 nt, Human
ccacugcacucuggcuuggg

SEQ ID NO: 655182 - RNA, 20 nt, Human
ccacugcacucuggcuuggg

SEQ ID NO: 655183 - RNA, 21 nt, Human
ccacugcacucuggcuugggu

SEQ ID NO: 655184 - RNA, 21 nt, Human
ccacugcacucuggcuugggu

SEQ ID NO: 655185 - RNA, 23 nt, Human
ccacugcacucuggcuuggguga

SEQ ID NO: 655186 - RNA, 24 nt, Human
ccacugcacucuggcuugggugau

SEQ ID NO: 655187 - RNA, 20 nt, Human
ccagcacugggaggcccaag

SEQ ID NO: 655188 - RNA, 23 nt, Human
cccagguucaagcaauuuuccug

SEQ ID NO: 655189 - RNA, 26 nt, Human
ccgccucccagguucaagcaauuuuu

SEQ ID NO: 655190 - RNA, 24 nt, Human
ccucccagguucaagcaauuuucc

SEQ ID NO: 655191 - RNA, 21 nt, Human
ccugaccucagaugauccacc

SEQ ID NO: 655192 - RNA, 23 nt, Human
ccugaccucagaugauccaccug

SEQ ID NO: 655193 - RNA, 23 nt, Human
ccugaccucagaugauccaccug

SEQ ID NO: 655194 - RNA, 23 nt, Human
ccugccucagccucugcaguaac

SEQ ID NO: 655195 - RNA, 23 nt, Human
cucuauugcccaggcuggagugc

SEQ ID NO: 655196 - RNA, 23 nt, Human
cucugcaguaaccgugacuacag

SEQ ID NO: 655197 - RNA, 23 nt, Human
cugcaaccuccgccucccagguu

SEQ ID NO: 655198 - RNA, 24 nt, Human
cugcaaccuccgccucccagguuc

SEQ ID NO: 655199 - RNA, 24 nt, Human
cugccguggccucccaaagugcug

SEQ ID NO: 655200 - RNA, 18 nt, Human
cugccucagccucugcag

SEQ ID NO: 655201 - RNA, 22 nt, Human
cuuaaaaugaaaaaucuuuuga

SEQ ID NO: 655202 - RNA, 21 nt, Human
cuugagcccagaaguuccaga

SEQ ID NO: 655203 - RNA, 18 nt, Human
gaccucagaugauccacc

SEQ ID NO: 655204 - RNA, 21 nt, Human
gacuacaggugcccgccacca

SEQ ID NO: 655205 - RNA, 24 nt, Human
gacuacaggugcccgccaccaugc

SEQ ID NO: 655206 - RNA, 18 nt, Human
gauuauaagcgugagcca

SEQ ID NO: 655207 - RNA, 22 nt, Human
gauuauaagcgugagccacugc

SEQ ID NO: 655208 - RNA, 23 nt, Human
gauuauaagcgugagccacugca

SEQ ID NO: 655209 - RNA, 22 nt, Human
gcaaccuccgccucccagguuc

SEQ ID NO: 655210 - RNA, 19 nt, Human
gcccaggcuggagugcagu

SEQ ID NO: 655211 - RNA, 20 nt, Human
gcccaggcuggagugcagug

SEQ ID NO: 655212 - RNA, 24 nt, Human
gcuggagugcaguggcacaaucug

SEQ ID NO: 655213 - RNA, 24 nt, Human
gcuggcucacaccuauaauuccag

SEQ ID NO: 655214 - RNA, 23 nt, Human
gcuggucucaaacuccugaccuc

SEQ ID NO: 655215 - RNA, 23 nt, Human
ggccaggcaugcuggcucacacc

SEQ ID NO: 655216 - RNA, 24 nt, Human
ggcuggucucaaacuccugaccuc

SEQ ID NO: 655217 - RNA, 22 nt, Human
ggguuucaucauguuggccagg

SEQ ID NO: 655218 - RNA, 24 nt, Human
gucuugcucuauugcccaggcugg

SEQ ID NO: 655219 - RNA, 24 nt, Human
guugguaugucccagcuacucagg

SEQ ID NO: 655220 - RNA, 24 nt, Human
uaauagagacaggguuucaucaug

SEQ ID NO: 655221 - RNA, 24 nt, Human
uaauuuuuguauuuuuaauagaga

SEQ ID NO: 655222 - RNA, 18 nt, Human
uacugcaaccuccgccuc

SEQ ID NO: 655223 - RNA, 21 nt, Human
uacugcaaccuccgccuccca

SEQ ID NO: 655224 - RNA, 21 nt, Human
uagagacaggguuucaucaug

SEQ ID NO: 655225 - RNA, 22 nt, Human
uagagacaggguuucaucaugu

SEQ ID NO: 655226 - RNA, 19 nt, Human
uauugcccaggcuggagug

SEQ ID NO: 655227 - RNA, 19 nt, Human
ucaccacugcacucuggcu

SEQ ID NO: 655228 - RNA, 24 nt, Human
ucccaaagugcugggauuauaagc

SEQ ID NO: 655229 - RNA, 18 nt, Human
ucccagguucaagcaauu

SEQ ID NO: 655230 - RNA, 24 nt, Human
ucccagguucaagcaauuuuccug

SEQ ID NO: 655231 - RNA, 24 nt, Human
ucuauugcccaggcuggagugcag

SEQ ID NO: 655232 - RNA, 24 nt, Human
ucuggcuugggugauggagcaaga

SEQ ID NO: 655233 - RNA, 19 nt, Human
ucuugcucuauugcccagg

SEQ ID NO: 655234 - RNA, 23 nt, Human
ucuugcucuauugcccaggcugg

SEQ ID NO: 655235 - RNA, 24 nt, Human
ucuugcucuauugcccaggcugga

SEQ ID NO: 655236 - RNA, 20 nt, Human
ucuuuaaggacacaccaaau

SEQ ID NO: 655237 - RNA, 24 nt, Human
ugaaacaaauuuaugaaaaaggua

SEQ ID NO: 655238 - RNA, 19 nt, Human
ugaccucagaugauccacc

SEQ ID NO: 655239 - RNA, 20 nt, Human
ugaccucagaugauccaccu

SEQ ID NO: 655240 - RNA, 24 nt, Human
ugagcaaugugguaagacccuguc

SEQ ID NO: 655241 - RNA, 19 nt, Human
ugagcccagaaguuccaga

SEQ ID NO: 655242 - RNA, 25 nt, Human
ugcacccagccucaaaaugaucaau

SEQ ID NO: 655243 - RNA, 18 nt, Human
ugcccaggcuggagugca

SEQ ID NO: 655244 - RNA, 21 nt, Human
ugcccaggcuggagugcagug

SEQ ID NO: 655245 - RNA, 22 nt, Human
ugcccaggcuggagugcagugg

SEQ ID NO: 655246 - RNA, 24 nt, Human
ugcccaggcuggagugcaguggca

SEQ ID NO: 655247 - RNA, 21 nt, Human
ugccucagccucugcaguaac

SEQ ID NO: 655248 - RNA, 24 nt, Human
ugcucuauugcccaggcuggagug

SEQ ID NO: 655249 - RNA, 24 nt, Human
ugcugggauuauaagcgugagcca

SEQ ID NO: 655250 - RNA, 23 nt, Human
uggagugcaguggcacaaucugg

SEQ ID NO: 655251 - RNA, 24 nt, Human
uggcacaaucugggcuuacugcaa

SEQ ID NO: 655252 - RNA, 24 nt, Human
uggccaggcuggucucaaacuccu

SEQ ID NO: 655253 - RNA, 22 nt, Human
uggcucacaccuauaauuccag

SEQ ID NO: 655254 - RNA, 24 nt, Human
uggcucacaccuauaauuccagca

SEQ ID NO: 655255 - RNA, 19 nt, Human
ugggauuauaagcgugagc

SEQ ID NO: 655256 - RNA, 21 nt, Human
ugggauuauaagcgugagcca

SEQ ID NO: 655257 - RNA, 22 nt, Human
ugggauuauaagcgugagccac

SEQ ID NO: 655258 - RNA, 22 nt, Human
ugggauuauaagcgugagccac

SEQ ID NO: 655259 - RNA, 24 nt, Human
ugggauuauaagcgugagccacug

SEQ ID NO: 655260 - RNA, 19 nt, Human
ugugagcuguaauuucacc

SEQ ID NO: 655261 - RNA, 21 nt, Human
uuaauagagacaggguuucau

SEQ ID NO: 655262 - RNA, 24 nt, Human
uuaauagagacaggguuucaucau

SEQ ID NO: 655263 - RNA, 19 nt, Human
uuacugcaaccuccgccuc

SEQ ID NO: 655264 - RNA, 24 nt, Human
uuacugcaaccuccgccucccagg

SEQ ID NO: 655265 - RNA, 25 nt, Human
uuacugcaaccuccgccucccaggu

SEQ ID NO: 655266 - RNA, 19 nt, Human
uuagcuggguguguuggua

SEQ ID NO: 655267 - RNA, 22 nt, Human
uuagcuggguguguugguaugu

SEQ ID NO: 655268 - RNA, 21 nt, Human
uucaagcaauuuuccugccuc

SEQ ID NO: 655269 - RNA, 24 nt, Human
uucaagcaauuuuccugccucagc

SEQ ID NO: 655270 - RNA, 24 nt, Human
uugcucuauugcccaggcuggagu

SEQ ID NO: 655271 - RNA, 24 nt, Human
uuucaucauguuggccaggcuggu

SEQ ID NO: 655272 - RNA, 22 nt, Human
uuuuguauuuuuaauagagaca

SEQ ID NO: 655273 - RNA, 24 nt, Human
uuuuuaauagagacaggguuucau

SEQ ID NO: 655274 - RNA, 20 nt, Human
uuuuuguauuuuuaauagag

SEQ ID NO: 655275 - RNA, 20 nt, Human
uuuuuuuuuuugagacagag

SEQ ID NO: 655276 - RNA, 24 nt, Human
uuuuuuuuuuuugagacagagucu

SEQ ID NO: 655277 - RNA, 18 nt, Human
uuuuuuuuuuuuuuuuug

SEQ ID NO: 655278 - RNA, 24 nt, Human
aaaaagcaaguaauaaaaguacug

SEQ ID NO: 655279 - RNA, 19 nt, Human
aaagugcuaggauuacagg

SEQ ID NO: 655280 - RNA, 24 nt, Human
aaagugcugggauuacaggcguga

SEQ ID NO: 655281 - RNA, 24 nt, Human
aaccacgcccagcuaaucuuuaau

SEQ ID NO: 655282 - RNA, 24 nt, Human
aaccucaggugauccgcccgccuc

SEQ ID NO: 655283 - RNA, 23 nt, Human
aacuccugggcucaagcgauccu

SEQ ID NO: 655284 - RNA, 25 nt, Human
aagcgauccucuugccucagccucc

SEQ ID NO: 655285 - RNA, 26 nt, Human
aagugcuaggauuacagguauaagcu

SEQ ID NO: 655286 - RNA, 19 nt, Human
aagugcugggauuacaggc

SEQ ID NO: 655287 - RNA, 19 nt, Human
aagugcugggauuacaggc

SEQ ID NO: 655288 - RNA, 26 nt, Human
aagugcugggauuacaggcgugagcc

SEQ ID NO: 655289 - RNA, 24 nt, Human
aaugcaguggugcgaucacaacuc

SEQ ID NO: 655290 - RNA, 29 nt, Human
aaugucaaggacagcucaucugaaaggaa

SEQ ID NO: 655291 - RNA, 18 nt, Human
acaggguuucacuguguu

SEQ ID NO: 655292 - RNA, 19 nt, Human
acaggguuucacuguguug

SEQ ID NO: 655293 - RNA, 23 nt, Human
acaggguuucacuguguugccua

SEQ ID NO: 655294 - RNA, 24 nt, Human
acaggguuucacuguguugccuag

SEQ ID NO: 655295 - RNA, 20 nt, Human
acaucagaaugucaaggaca

SEQ ID NO: 655296 - RNA, 18 nt, Human
acucagacccgccaaugg

SEQ ID NO: 655297 - RNA, 22 nt, Human
acucuuguugcccaggcuggag

SEQ ID NO: 655298 - RNA, 22 nt, Human
agaaaugcuggguccacagagc

SEQ ID NO: 655299 - RNA, 18 nt, Human
agacaggguuucacugug

SEQ ID NO: 655300 - RNA, 23 nt, Human
agacaggguuucacuguguugcc

SEQ ID NO: 655301 - RNA, 19 nt, Human
agagacaggguuucacugu

SEQ ID NO: 655302 - RNA, 21 nt, Human
agcaaaaagcaaguaauaaaa

SEQ ID NO: 655303 - RNA, 18 nt, Human
agccaccacaccuggccc

SEQ ID NO: 655304 - RNA, 25 nt, Human
agcucaucugaaaggaaaaagccuc

SEQ ID NO: 655305 - RNA, 18 nt, Human
aggagcggcccacacuca

SEQ ID NO: 655306 - RNA, 24 nt, Human
aggugauccgcccgccucggccuc

SEQ ID NO: 655307 - RNA, 21 nt, Human
aguagcugggauuacaggcau

SEQ ID NO: 655308 - RNA, 24 nt, Human
agugcaaugguaugaucuuggcuc

SEQ ID NO: 655309 - RNA, 19 nt, Human
aguuagcgaggagcggccc

SEQ ID NO: 655310 - RNA, 21 nt, Human
auccuccugcuuuagccuccc

SEQ ID NO: 655311 - RNA, 20 nt, Human
aucugaaaggaaaaagccuc

SEQ ID NO: 655312 - RNA, 20 nt, Human
augggguuucuccauguugg

SEQ ID NO: 655313 - RNA, 21 nt, Human
augggguuucuccauguuggu

SEQ ID NO: 655314 - RNA, 24 nt, Human
augggguuucuccauguuggucag

SEQ ID NO: 655315 - RNA, 22 nt, Human
caaaguccaugcugcuaaccau

SEQ ID NO: 655316 - RNA, 24 nt, Human
caaagugcuaggauuacagguaua

SEQ ID NO: 655317 - RNA, 24 nt, Human
caaagugcugggauuacaggcgug

SEQ ID NO: 655318 - RNA, 22 nt, Human
caagcgauccucuugccucagc

SEQ ID NO: 655319 - RNA, 27 nt, Human
caagcgauccucuugccucagccuccc

SEQ ID NO: 655320 - RNA, 20 nt, Human
caagugauucuccugccuca

SEQ ID NO: 655321 - RNA, 22 nt, Human
caagugauucuccugccucagc

SEQ ID NO: 655322 - RNA, 18 nt, Human
caccacaccuggcccggc

SEQ ID NO: 655323 - RNA, 24 nt, Human
cacucuuguugcccaggcuggagu

SEQ ID NO: 655324 - RNA, 21 nt, Human
cacuguguugccuaggcuggu

SEQ ID NO: 655325 - RNA, 24 nt, Human
cacuguguugccuaggcuggucuc

SEQ ID NO: 655326 - RNA, 20 nt, Human
cacuuuacagaugagaaaac

SEQ ID NO: 655327 - RNA, 23 nt, Human
cagagcccacugccaagugcuga

SEQ ID NO: 655328 - RNA, 24 nt, Human
cagcagcugggacuauaggcaugu

SEQ ID NO: 655329 - RNA, 24 nt, Human
cagccucaaacuccugggcuaaag

SEQ ID NO: 655330 - RNA, 20 nt, Human
cagccuccugaguagcuggg

SEQ ID NO: 655331 - RNA, 24 nt, Human
caggguuucacuguguugccuagg

SEQ ID NO: 655332 - RNA, 22 nt, Human
caugcugcuaaccauuucaccu

SEQ ID NO: 655333 - RNA, 20 nt, Human
ccaaagugcuaggauuacag

SEQ ID NO: 655334 - RNA, 21 nt, Human
ccaaagugcuaggauuacagg

SEQ ID NO: 655335 - RNA, 21 nt, Human
ccaaagugcuaggauuacagg

SEQ ID NO: 655336 - RNA, 24 nt, Human
ccaaagugcuaggauuacagguau

SEQ ID NO: 655337 - RNA, 22 nt, Human
ccaaagugcugggauuacaggc

SEQ ID NO: 655338 - RNA, 22 nt, Human
ccaaagugcugggauuacaggc

SEQ ID NO: 655339 - RNA, 24 nt, Human
ccaaagugcugggauuacaggcgu

SEQ ID NO: 655340 - RNA, 22 nt, Human
ccacugccaagugcugacuguc

SEQ ID NO: 655341 - RNA, 25 nt, Human
ccauccuccugcuuuagccucccca

SEQ ID NO: 655342 - RNA, 22 nt, Human
ccauguuggucaggcuggccuc

SEQ ID NO: 655343 - RNA, 20 nt, Human
cccaaccucaggugauccgc

SEQ ID NO: 655344 - RNA, 24 nt, Human
cccaaccucaggugauccgcccgc

SEQ ID NO: 655345 - RNA, 19 nt, Human
cccacacucagacccgcca

SEQ ID NO: 655346 - RNA, 23 nt, Human
cccagcagcugggacuauaggca

SEQ ID NO: 655347 - RNA, 19 nt, Human
cccaggcuggagugcaaug

SEQ ID NO: 655348 - RNA, 20 nt, Human
cccaggcuggagugcaaugg

SEQ ID NO: 655349 - RNA, 24 nt, Human
cccauggccauggcacauggaagc

SEQ ID NO: 655350 - RNA, 25 nt, Human
cccauggccauggcacauggaagcu

SEQ ID NO: 655351 - RNA, 21 nt, Human
ccccaagaccagccaaaucaa

SEQ ID NO: 655352 - RNA, 23 nt, Human
ccccaagaccagccaaaucaagc

SEQ ID NO: 655353 - RNA, 23 nt, Human
ccccagcagcugggacuauaggc

SEQ ID NO: 655354 - RNA, 21 nt, Human
ccgcaaccucugcguccuggg

SEQ ID NO: 655355 - RNA, 23 nt, Human
ccgcaaccucugcguccuggguu

SEQ ID NO: 655356 - RNA, 24 nt, Human
ccgcaaccucugcguccuggguuc

SEQ ID NO: 655357 - RNA, 23 nt, Human
ccgcagccucaaacuccugggcu

SEQ ID NO: 655358 - RNA, 18 nt, Human
ccguggugcugggugugc

SEQ ID NO: 655359 - RNA, 25 nt, Human
ccuccugcuuuagccuccccagcag

SEQ ID NO: 655360 - RNA, 26 nt, Human
ccucuugccucagccucccaaagugc

SEQ ID NO: 655361 - RNA, 23 nt, Human
ccugaguagcugggauuacaggc

SEQ ID NO: 655362 - RNA, 24 nt, Human
ccugaguagcugggauuacaggca

SEQ ID NO: 655363 - RNA, 23 nt, Human
ccugccuggccagagguggaaau

SEQ ID NO: 655364 - RNA, 19 nt, Human
ccugggcucaagcgauccu

SEQ ID NO: 655365 - RNA, 20 nt, Human
ccugggcucaagcgauccuc

SEQ ID NO: 655366 - RNA, 23 nt, Human
ccuggguucaagugauucuccuc

SEQ ID NO: 655367 - RNA, 23 nt, Human
ccuggguucaagugauucuccug

SEQ ID NO: 655368 - RNA, 24 nt, Human
cgccaauggccaugcccagcagcc

SEQ ID NO: 655369 - RNA, 24 nt, Human
cgccucggccucccaaagugcugg

SEQ ID NO: 655370 - RNA, 21 nt, Human
cguccuggguucaagugauuc

SEQ ID NO: 655371 - RNA, 24 nt, Human
cguccuggguucaagugauucucc

SEQ ID NO: 655372 - RNA, 24 nt, Human
cucagccuccugaguagcugggau

SEQ ID NO: 655373 - RNA, 23 nt, Human
cuccugggcucaagcgauccucu

SEQ ID NO: 655374 - RNA, 18 nt, Human
cucuuguugcccaggcug

SEQ ID NO: 655375 - RNA, 23 nt, Human
cugaguagcugggauuacaggca

SEQ ID NO: 655376 - RNA, 24 nt, Human
cugaguagcugggauuacaggcau

SEQ ID NO: 655377 - RNA, 23 nt, Human
cugccucagccuccugaguagcu

SEQ ID NO: 655378 - RNA, 23 nt, Human
cugcuuuagccuccccagcagcu

SEQ ID NO: 655379 - RNA, 19 nt, Human
cugucagccacggccuauu

SEQ ID NO: 655380 - RNA, 23 nt, Human
cuugaucuguugcucaggcugaa

SEQ ID NO: 655381 - RNA, 20 nt, Human
cuugauggaaauucucccca

SEQ ID NO: 655382 - RNA, 24 nt, Human
cuugccucagccucccaaagugcu

SEQ ID NO: 655383 - RNA, 21 nt, Human
cuuuuuguaucuuuaguagag

SEQ ID NO: 655384 - RNA, 24 nt, Human
gagaugggguuucuccauguuggu

SEQ ID NO: 655385 - RNA, 19 nt, Human
gagggaccacaugcugugu

SEQ ID NO: 655386 - RNA, 21 nt, Human
gagguggaaauccucuccgug

SEQ ID NO: 655387 - RNA, 22 nt, Human
gaguagcugggauuacaggcau

SEQ ID NO: 655388 - RNA, 24 nt, Human
gaguagcugggauuacaggcaugc

SEQ ID NO: 655389 - RNA, 18 nt, Human
gauuacaggcaugcgcca

SEQ ID NO: 655390 - RNA, 24 nt, Human
gauuacaggcaugcgccaccaugc

SEQ ID NO: 655391 - RNA, 18 nt, Human
gauuacaggcgugagcca

SEQ ID NO: 655392 - RNA, 21 nt, Human
gauuacaggcgugagccacca

SEQ ID NO: 655393 - RNA, 22 nt, Human
gauuacaggcgugagccaccac

SEQ ID NO: 655394 - RNA, 21 nt, Human
gauuacagguauaagcuacug

SEQ ID NO: 655395 - RNA, 24 nt, Human
gauuacagguauaagcuacugugc

SEQ ID NO: 655396 - RNA, 21 nt, Human
gauucuccugccucagccucc

SEQ ID NO: 655397 - RNA, 19 nt, Human
gccuauugagggaccacau

SEQ ID NO: 655398 - RNA, 20 nt, Human
gccucagccuccugaguagc

SEQ ID NO: 655399 - RNA, 24 nt, Human
gcgauccucuugccucagccuccc

SEQ ID NO: 655400 - RNA, 23 nt, Human
gcuggccucgaacucccaaccuc

SEQ ID NO: 655401 - RNA, 23 nt, Human
ggagcggcccacacucagacccg

SEQ ID NO: 655402 - RNA, 24 nt, Human
ggauuacaggcaugcgccaccaug

SEQ ID NO: 655403 - RNA, 19 nt, Human
ggauuacaggcgugagcca

SEQ ID NO: 655404 - RNA, 22 nt, Human
ggauuacagguauaagcuacug

SEQ ID NO: 655405 - RNA, 22 nt, Human
gggcucaagcgauccucuugcc

SEQ ID NO: 655406 - RNA, 22 nt, Human
ggguuucuccauguuggucagg

SEQ ID NO: 655407 - RNA, 18 nt, Human
guagagacaggguuucac

SEQ ID NO: 655408 - RNA, 21 nt, Human
guagagacaggguuucacugu

SEQ ID NO: 655409 - RNA, 20 nt, Human
guagcugggauuacaggcau

SEQ ID NO: 655410 - RNA, 24 nt, Human
gugauccgcccgccucggccuccc

SEQ ID NO: 655411 - RNA, 24 nt, Human
gugauucuccugccucagccuccu

SEQ ID NO: 655412 - RNA, 23 nt, Human
guggugcgaucacaacucaccgc

SEQ ID NO: 655413 - RNA, 22 nt, Human
guuguuuuguuuuuguuuuuug

SEQ ID NO: 655414 - RNA, 23 nt, Human
uaaagccauccuccugcuuuagc

SEQ ID NO: 655415 - RNA, 24 nt, Human
uacaggcaugcgccaccaugccca

SEQ ID NO: 655416 - RNA, 22 nt, Human
uacaggcgugagccaccacacc

SEQ ID NO: 655417 - RNA, 22 nt, Human
uacaggcgugagccaccacacc

SEQ ID NO: 655418 - RNA, 22 nt, Human
uagagacaggguuucacugugu

SEQ ID NO: 655419 - RNA, 19 nt, Human
uaggauuacagguauaagc

SEQ ID NO: 655420 - RNA, 22 nt, Human
uaggauuacagguauaagcuac

SEQ ID NO: 655421 - RNA, 22 nt, Human
uaggauuacagguauaagcuac

SEQ ID NO: 655422 - RNA, 24 nt, Human
uaggauuacagguauaagcuacug

SEQ ID NO: 655423 - RNA, 30 nt, Human
uaggauuacagguauaagcuacugugccaa

SEQ ID NO: 655424 - RNA, 24 nt, Human
uaguagagaugggguuucuccaug

SEQ ID NO: 655425 - RNA, 19 nt, Human
ucaagugauucuccugccu

SEQ ID NO: 655426 - RNA, 21 nt, Human
ucaccacaucagaaugucaag

SEQ ID NO: 655427 - RNA, 24 nt, Human
ucaccgcaaccucugcguccuggg

SEQ ID NO: 655428 - RNA, 24 nt, Human
ucaccgcagccucaaacuccuggg

SEQ ID NO: 655429 - RNA, 23 nt, Human
ucacucuuguugcccaggcugga

SEQ ID NO: 655430 - RNA, 21 nt, Human
ucacuguguugccuaggcugg

SEQ ID NO: 655431 - RNA, 22 nt, Human
ucacuguguugccuaggcuggu

SEQ ID NO: 655432 - RNA, 22 nt, Human
ucagacccgccaauggccaugc

SEQ ID NO: 655433 - RNA, 20 nt, Human
ucagccuccugaguagcugg

SEQ ID NO: 655434 - RNA, 19 nt, Human
ucaggcugaaugcaguggu

SEQ ID NO: 655435 - RNA, 18 nt, Human
uccacagagcccacugcc

SEQ ID NO: 655436 - RNA, 23 nt, Human
ucccaaagugcuaggauuacagg

SEQ ID NO: 655437 - RNA, 24 nt, Human
ucccaaagugcugggauuacaggc

SEQ ID NO: 655438 - RNA, 24 nt, Human
uccccagcagcugggacuauaggc

SEQ ID NO: 655439 - RNA, 24 nt, Human
uccugaguagcugggauuacaggc

SEQ ID NO: 655440 - RNA, 21 nt, Human
uccugggcucaagcgauccuc

SEQ ID NO: 655441 - RNA, 21 nt, Human
uccugggcucaagcgauccuc

SEQ ID NO: 655442 - RNA, 24 nt, Human
uccugggcucaagcgauccucuug

SEQ ID NO: 655443 - RNA, 21 nt, Human
uccuggguucaagugauucuc

SEQ ID NO: 655444 - RNA, 24 nt, Human
uccuggguucaagugauucuccug

SEQ ID NO: 655445 - RNA, 22 nt, Human
ucucaaacuccugggcucaagc

SEQ ID NO: 655446 - RNA, 24 nt, Human
ucuccugccucagccuccugagua

SEQ ID NO: 655447 - RNA, 18 nt, Human
ucuggcuguuccuucccg

SEQ ID NO: 655448 - RNA, 23 nt, Human
ucuguugcucaggcugaaugcag

SEQ ID NO: 655449 - RNA, 19 nt, Human
ucuugaucuguugcucagg

SEQ ID NO: 655450 - RNA, 23 nt, Human
ucuugaucuguugcucaggcuga

SEQ ID NO: 655451 - RNA, 24 nt, Human
ucuugaucuguugcucaggcugaa

SEQ ID NO: 655452 - RNA, 22 nt, Human
ucuuguugcccaggcuggagug

SEQ ID NO: 655453 - RNA, 22 nt, Human
ucuuuaguagagaugggguuuc

SEQ ID NO: 655454 - RNA, 18 nt, Human
ugaaugcaguggugcgau

SEQ ID NO: 655455 - RNA, 20 nt, Human
ugacgcuaugagaaaugcug

SEQ ID NO: 655456 - RNA, 19 nt, Human
ugagaaaacugaggcugag

SEQ ID NO: 655457 - RNA, 22 nt, Human
ugagacagugucuugaucuguu

SEQ ID NO: 655458 - RNA, 19 nt, Human
ugaggcugagggagggggu

SEQ ID NO: 655459 - RNA, 21 nt, Human
ugagggaggggguugcccaag

SEQ ID NO: 655460 - RNA, 20 nt, Human
ugauucuccugccucagccu

SEQ ID NO: 655461 - RNA, 23 nt, Human
ugcccaagcagacaugcgcagag

SEQ ID NO: 655462 - RNA, 18 nt, Human
ugcccaggcuggagugca

SEQ ID NO: 655463 - RNA, 21 nt, Human
ugcccaggcuggagugcaaug

SEQ ID NO: 655464 - RNA, 21 nt, Human
ugcccaggcuggagugcaaug

SEQ ID NO: 655465 - RNA, 24 nt, Human
ugccuaggcuggucucaaacuccu

SEQ ID NO: 655466 - RNA, 24 nt, Human
ugccucagccucccaaagugcuag

SEQ ID NO: 655467 - RNA, 24 nt, Human
ugccucagccuccugaguagcugg

SEQ ID NO: 655468 - RNA, 24 nt, Human
ugcuaggauuacagguauaagcua

SEQ ID NO: 655469 - RNA, 23 nt, Human
ugcucaggcugaaugcaguggug

SEQ ID NO: 655470 - RNA, 24 nt, Human
ugcugggauuacaggcgugagcca

SEQ ID NO: 655471 - RNA, 19 nt, Human
ugcuggguccacagagccc

SEQ ID NO: 655472 - RNA, 19 nt, Human
ugcugggugugcccauggc

SEQ ID NO: 655473 - RNA, 21 nt, Human
ugcuuuagccuccccagcagc

SEQ ID NO: 655474 - RNA, 18 nt, Human
uggaaauccucuccgugg

SEQ ID NO: 655475 - RNA, 19 nt, Human
uggagugcaaugguaugau

SEQ ID NO: 655476 - RNA, 23 nt, Human
uggagugcaaugguaugaucuug

SEQ ID NO: 655477 - RNA, 24 nt, Human
uggagugcaaugguaugaucuugg

SEQ ID NO: 655478 - RNA, 20 nt, Human
uggccucgaacucccaaccu

SEQ ID NO: 655479 - RNA, 21 nt, Human
uggccucgaacucccaaccuc

SEQ ID NO: 655480 - RNA, 18 nt, Human
ugggacuauaggcaugug

SEQ ID NO: 655481 - RNA, 24 nt, Human
ugggacuauaggcaugugcaacca

SEQ ID NO: 655482 - RNA, 18 nt, Human
ugggauuacaggcaugcg

SEQ ID NO: 655483 - RNA, 21 nt, Human
ugggauuacaggcaugcgcca

SEQ ID NO: 655484 - RNA, 22 nt, Human
ugggauuacaggcaugcgccac

SEQ ID NO: 655485 - RNA, 24 nt, Human
ugggauuacaggcaugcgccacca

SEQ ID NO: 655486 - RNA, 18 nt, Human
ugggauuacaggcgugag

SEQ ID NO: 655487 - RNA, 19 nt, Human
ugggauuacaggcgugagc

SEQ ID NO: 655488 - RNA, 22 nt, Human
ugggauuacaggcgugagccac

SEQ ID NO: 655489 - RNA, 23 nt, Human
ugggauuacaggcgugagccacc

SEQ ID NO: 655490 - RNA, 24 nt, Human
ugggauuacaggcgugagccacca

SEQ ID NO: 655491 - RNA, 19 nt, Human
ugggcucaagcgauccucu

SEQ ID NO: 655492 - RNA, 24 nt, Human
ugggcucaagcgauccucuugccu

SEQ ID NO: 655493 - RNA, 24 nt, Human
ugggguuucuccauguuggucagg

SEQ ID NO: 655494 - RNA, 23 nt, Human
uggguucaagugauucuccugcc

SEQ ID NO: 655495 - RNA, 24 nt, Human
uggguucaagugauucuccugccu

SEQ ID NO: 655496 - RNA, 21 nt, Human
uggucaggcuggccucgaacu

SEQ ID NO: 655497 - RNA, 18 nt, Human
uggugcugggugugccca

SEQ ID NO: 655498 - RNA, 24 nt, Human
uguagagacaggguuucacugugu

SEQ ID NO: 655499 - RNA, 24 nt, Human
uguguugccuaggcuggucucaaa

SEQ ID NO: 655500 - RNA, 20 nt, Human
uguugcccaggcuggagugc

SEQ ID NO: 655501 - RNA, 22 nt, Human
uguugcccaggcuggagugcaa

SEQ ID NO: 655502 - RNA, 23 nt, Human
uuagccuccccagcagcugggac

SEQ ID NO: 655503 - RNA, 23 nt, Human
uuagcgaggagcggcccacacuc

SEQ ID NO: 655504 - RNA, 24 nt, Human
uuagcgaggagcggcccacacuca

SEQ ID NO: 655505 - RNA, 18 nt, Human
uuaguagagaugggguuu

SEQ ID NO: 655506 - RNA, 24 nt, Human
uuaguagagaugggguuucuccau

SEQ ID NO: 655507 - RNA, 21 nt, Human
uucaagugauucuccugccuc

SEQ ID NO: 655508 - RNA, 23 nt, Human
uucaagugauucuccugccucag

SEQ ID NO: 655509 - RNA, 24 nt, Human
uucaagugauucuccugccucagc

SEQ ID NO: 655510 - RNA, 24 nt, Human
uucacucuuguugcccaggcugga

SEQ ID NO: 655511 - RNA, 24 nt, Human
uugccucagccucccaaagugcua

SEQ ID NO: 655512 - RNA, 24 nt, Human
uuguagagacaggguuucacugug

SEQ ID NO: 655513 - RNA, 19 nt, Human
uuguuguuguuuuguuuuu

SEQ ID NO: 655514 - RNA, 23 nt, Human
uuguuguuuuguuuuuguuuuuu

SEQ ID NO: 655515 - RNA, 18 nt, Human
uuuaagcaaaaagcaagu

SEQ ID NO: 655516 - RNA, 24 nt, Human
uuucacucuuguugcccaggcugg

SEQ ID NO: 655517 - RNA, 19 nt, Human
uuucacuguguugccuagg

SEQ ID NO: 655518 - RNA, 23 nt, Human
uuucacuguguugccuaggcugg

SEQ ID NO: 655519 - RNA, 21 nt, Human
uuucuccauguuggucaggcu

SEQ ID NO: 655520 - RNA, 23 nt, Human
uuuguagagacaggguuucacug

SEQ ID NO: 655521 - RNA, 24 nt, Human
uuuguagagacaggguuucacugu

SEQ ID NO: 655522 - RNA, 21 nt, Human
uuuuuguaucuuuaguagaga

SEQ ID NO: 655523 - RNA, 23 nt, Human
uuuuuguaucuuuaguagagaug

SEQ ID NO: 655524 - RNA, 22 nt, Human
uuuuuuguagagacaggguuuc

SEQ ID NO: 655525 - RNA, 24 nt, Human
uuuuuuguagagacaggguuucac

SEQ ID NO: 655526 - RNA, 24 nt, Human
aaaaaaagaaaaaaauacaaugaa

SEQ ID NO: 655527 - RNA, 29 nt, Human
aaagaaaaaaauacaaugaaauaauuuaa

SEQ ID NO: 655528 - RNA, 23 nt, Human
aaagcaguuuuacuguacacaga

SEQ ID NO: 655529 - RNA, 27 nt, Human
aaauauaaaaaauacgaguauauuuug

SEQ ID NO: 655530 - RNA, 22 nt, Human
aagcauggaagacuacagucau

SEQ ID NO: 655531 - RNA, 18 nt, Human
acauauauaaaucuauag

SEQ ID NO: 655532 - RNA, 21 nt, Human
agauccaauagauucuguaac

SEQ ID NO: 655533 - RNA, 21 nt, Human
agccaccuucccuuccagggu

SEQ ID NO: 655534 - RNA, 26 nt, Human
aggaggaggcagacccggauccucgc

SEQ ID NO: 655535 - RNA, 24 nt, Human
aggaggcagacccggauccucgca

SEQ ID NO: 655536 - RNA, 19 nt, Human
aggcacuagguauggaaac

SEQ ID NO: 655537 - RNA, 27 nt, Human
cagaaaaagcucaagaaugcacaguag

SEQ ID NO: 655538 - RNA, 22 nt, Human
cagcacugacuggcaagcugga

SEQ ID NO: 655539 - RNA, 23 nt, Human
cagggaacccacgauggcccaac

SEQ ID NO: 655540 - RNA, 21 nt, Human
cgagaaggcacugcuguggug

SEQ ID NO: 655541 - RNA, 24 nt, Human
cugucuucagcaggaggaggcaga

SEQ ID NO: 655542 - RNA, 24 nt, Human
gaagaagccaccuucccuuccagg

SEQ ID NO: 655543 - RNA, 19 nt, Human
gaagcacugugggaaaagg

SEQ ID NO: 655544 - RNA, 23 nt, Human
gaggucccaggcuggcugggcuc

SEQ ID NO: 655545 - RNA, 18 nt, Human
gcagagcaucccaucccc

SEQ ID NO: 655546 - RNA, 26 nt, Human
gcccgcugcugcaugucuggggagcc

SEQ ID NO: 655547 - RNA, 19 nt, Human
uaaauaaauauccuaauug

SEQ ID NO: 655548 - RNA, 22 nt, Human
uaaguaauguugucuacaucca

SEQ ID NO: 655549 - RNA, 21 nt, Human
uagguauggaaacgugaggug

SEQ ID NO: 655550 - RNA, 22 nt, Human
uauauaaaaguucugauucaaa

SEQ ID NO: 655551 - RNA, 18 nt, Human
uauauaacacauacauau

SEQ ID NO: 655552 - RNA, 26 nt, Human
uauuuuuuccacucacauuuuucucu

SEQ ID NO: 655553 - RNA, 21 nt, Human
uccagggucccaugaugaucu

SEQ ID NO: 655554 - RNA, 22 nt, Human
ugaguauauaacacauacauau

SEQ ID NO: 655555 - RNA, 22 nt, Human
ugauucaaaugagggaaaaaaa

SEQ ID NO: 655556 - RNA, 23 nt, Human
uggaauauagccagccacaugga

SEQ ID NO: 655557 - RNA, 26 nt, Human
uggcaagcuggaagaagccaccuucc

SEQ ID NO: 655558 - RNA, 23 nt, Human
ugguaagccacccacuuugggag

SEQ ID NO: 655559 - RNA, 21 nt, Human
uguaaacaucaguguuugggu

SEQ ID NO: 655560 - RNA, 24 nt, Human
uguacacagaagugcaaugcuaca

SEQ ID NO: 655561 - RNA, 22 nt, Human
uguauacauauauaaaucuaua

SEQ ID NO: 655562 - RNA, 21 nt, Human
uuuacuguacacagaagugca

SEQ ID NO: 655563 - RNA, 18 nt, Human
uuuuucagcacugacugg

SEQ ID NO: 655564 - RNA, 20 nt, Human
aaaaaaaagcaaaggcaacu

SEQ ID NO: 655565 - RNA, 24 nt, Human
aaaaaaacauuuuacaccagggag

SEQ ID NO: 655566 - RNA, 24 nt, Human
aaaaagcaaaggcaacugaaagua

SEQ ID NO: 655567 - RNA, 20 nt, Human
aacagagccagccuccaucu

SEQ ID NO: 655568 - RNA, 18 nt, Human
aagaaacaaggcaaaggu

SEQ ID NO: 655569 - RNA, 24 nt, Human
aaggaggaaaaaaggcuuuaaaaa

SEQ ID NO: 655570 - RNA, 21 nt, Human
aauaguuugguaccuuacagc

SEQ ID NO: 655571 - RNA, 28 nt, Human
acauaacuucagagaaggggggaacgcc

SEQ ID NO: 655572 - RNA, 18 nt, Human
acugaaucaugacauucc

SEQ ID NO: 655573 - RNA, 23 nt, Human
agaaacaggaacauuguugaugc

SEQ ID NO: 655574 - RNA, 20 nt, Human
agcaaaggcaacugaaagua

SEQ ID NO: 655575 - RNA, 24 nt, Human
agccaggaguucgagguuauagug

SEQ ID NO: 655576 - RNA, 27 nt, Human
aggcacuuaacuuuaaaauagaaaaau

SEQ ID NO: 655577 - RNA, 23 nt, Human
aggcugaagugggagaucacuug

SEQ ID NO: 655578 - RNA, 19 nt, Human
agugcaguggaaauugguu

SEQ ID NO: 655579 - RNA, 24 nt, Human
aguggcucuugcuuauaaucccag

SEQ ID NO: 655580 - RNA, 18 nt, Human
aguuugguaccuuacagc

SEQ ID NO: 655581 - RNA, 25 nt, Human
auacaggaaaaauguuaugacuauc

SEQ ID NO: 655582 - RNA, 20 nt, Human
aucacuugagccaggaguuc

SEQ ID NO: 655583 - RNA, 23 nt, Human
aucacuugagccaggaguucgag

SEQ ID NO: 655584 - RNA, 24 nt, Human
aucacuugagccaggaguucgagg

SEQ ID NO: 655585 - RNA, 23 nt, Human
caaaaaaaagcaaaggcaacuga

SEQ ID NO: 655586 - RNA, 26 nt, Human
caaaaaaaagcaaaggcaacugaaag

SEQ ID NO: 655587 - RNA, 18 nt, Human
caaauaccaugagcuggg

SEQ ID NO: 655588 - RNA, 22 nt, Human
caacaaauaccaugagcuggga

SEQ ID NO: 655589 - RNA, 20 nt, Human
caacaaaugccacguaccau

SEQ ID NO: 655590 - RNA, 24 nt, Human
caacagagccagccuccaucucuu

SEQ ID NO: 655591 - RNA, 22 nt, Human
caccaacagagccagccuccau

SEQ ID NO: 655592 - RNA, 23 nt, Human
caccagggagacuggcaaauuuc

SEQ ID NO: 655593 - RNA, 22 nt, Human
caggaacagaggagaugaacaa

SEQ ID NO: 655594 - RNA, 18 nt, Human
caggaguucgagguuaua

SEQ ID NO: 655595 - RNA, 18 nt, Human
caugacauuccagcagcu

SEQ ID NO: 655596 - RNA, 19 nt, Human
cccuccaaaaaaaagcaaa

SEQ ID NO: 655597 - RNA, 22 nt, Human
ccuccaaaaaaaagcaaaggca

SEQ ID NO: 655598 - RNA, 21 nt, Human
ccuucuguggaacuuuucuca

SEQ ID NO: 655599 - RNA, 23 nt, Human
cuccaaaaaaaagcaaaggcaac

SEQ ID NO: 655600 - RNA, 22 nt, Human
cuccaaaaaaaagcaaaggcag

SEQ ID NO: 655601 - RNA, 18 nt, Human
cuuauuuuucccugaagu

SEQ ID NO: 655602 - RNA, 23 nt, Human
gaacuaugaucauggcaccgcac

SEQ ID NO: 655603 - RNA, 23 nt, Human
gaggauuuuagcagaaaucuauu

SEQ ID NO: 655604 - RNA, 23 nt, Human
gaucacuugagccaggaguucga

SEQ ID NO: 655605 - RNA, 22 nt, Human
gcuaaguaaaaagcuaacaaaa

SEQ ID NO: 655606 - RNA, 20 nt, Human
gcugaguacuauuugugggc

SEQ ID NO: 655607 - RNA, 24 nt, Human
ggaaaaaaggcuuuaaaaaaacau

SEQ ID NO: 655608 - RNA, 19 nt, Human
ggagaggauuuuagcagaa

SEQ ID NO: 655609 - RNA, 19 nt, Human
ggagaucacuugagccagg

SEQ ID NO: 655610 - RNA, 19 nt, Human
gggagaggauuuuagcaga

SEQ ID NO: 655611 - RNA, 18 nt, Human
gggaggcugaagugggag

SEQ ID NO: 655612 - RNA, 22 nt, Human
gggaggcugaagugggagauca

SEQ ID NO: 655613 - RNA, 20 nt, Human
guacuagugcaguggaaauu

SEQ ID NO: 655614 - RNA, 23 nt, Human
guauuuauaaacugagaaaaaua

SEQ ID NO: 655615 - RNA, 26 nt, Human
guggaacuuuuucagguuagacaaaa

SEQ ID NO: 655616 - RNA, 18 nt, Human
uaaaaaagacaggaggga

SEQ ID NO: 655617 - RNA, 19 nt, Human
uaaaaagcuaacaaaauca

SEQ ID NO: 655618 - RNA, 27 nt, Human
uaaaaagucauucauauucgaccagua

SEQ ID NO: 655619 - RNA, 18 nt, Human
uaacuuaaaaaagacagg

SEQ ID NO: 655620 - RNA, 18 nt, Human
uaacuucagagaagggca

SEQ ID NO: 655621 - RNA, 19 nt, Human
uaaguggauaucugccucc

SEQ ID NO: 655622 - RNA, 20 nt, Human
uaaguggauaucugccuccc

SEQ ID NO: 655623 - RNA, 24 nt, Human
uaaguggauaucugccucccaaaa

SEQ ID NO: 655624 - RNA, 24 nt, Human
uaauuugcuuauagaaaggcuuuc

SEQ ID NO: 655625 - RNA, 18 nt, Human
uaguuugguaccuuacag

SEQ ID NO: 655626 - RNA, 18 nt, Human
uauauuugcuuuaucaaa

SEQ ID NO: 655627 - RNA, 19 nt, Human
uaugaucauggcaccgcac

SEQ ID NO: 655628 - RNA, 21 nt, Human
uauuugccaugagaguauuuc

SEQ ID NO: 655629 - RNA, 19 nt, Human
ucacuaugggacagagguc

SEQ ID NO: 655630 - RNA, 24 nt, Human
ucagaaaagauaauuagcacuauu

SEQ ID NO: 655631 - RNA, 24 nt, Human
ucauauucgaccaguaguauuacu

SEQ ID NO: 655632 - RNA, 18 nt, Human
uccuucugaaaguaagau

SEQ ID NO: 655633 - RNA, 18 nt, Human
uccuugacuccgaaagga

SEQ ID NO: 655634 - RNA, 25 nt, Human
ucuagaaucugaaaaauauaagaca

SEQ ID NO: 655635 - RNA, 24 nt, Human
ucuuguguugccuaaguaaacuug

SEQ ID NO: 655636 - RNA, 25 nt, Human
ugaaauauauaaguaaaaauaagca

SEQ ID NO: 655637 - RNA, 23 nt, Human
ugaagugggagaucacuugagcc

SEQ ID NO: 655638 - RNA, 24 nt, Human
ugaagugggagaucacuugagcca

SEQ ID NO: 655639 - RNA, 23 nt, Human
ugacuacaacagaauaauagaua

SEQ ID NO: 655640 - RNA, 21 nt, Human
ugagaggauaaauauuugcca

SEQ ID NO: 655641 - RNA, 20 nt, Human
ugagaguauuucaagugaau

SEQ ID NO: 655642 - RNA, 19 nt, Human
ugcagacauauauauauau

SEQ ID NO: 655643 - RNA, 23 nt, Human
ugcuuauaaucccagauacucgg

SEQ ID NO: 655644 - RNA, 22 nt, Human
ugcuuauagaaaggcuuuccuu

SEQ ID NO: 655645 - RNA, 23 nt, Human
uggcacaaaaaugcuuaccuaua

SEQ ID NO: 655646 - RNA, 22 nt, Human
uggcucuugcuuauaaucccag

SEQ ID NO: 655647 - RNA, 18 nt, Human
ugucuuccaaauguggaa

SEQ ID NO: 655648 - RNA, 19 nt, Human
uuaaauugucuuccaaaug

SEQ ID NO: 655649 - RNA, 21 nt, Human
uuaguuguguuuuuccauaac

SEQ ID NO: 655650 - RNA, 24 nt, Human
uucaauguuacacauguuucacua

SEQ ID NO: 655651 - RNA, 20 nt, Human
uucacugccuucuguggaac

SEQ ID NO: 655652 - RNA, 21 nt, Human
uucauauguuaaaacugaugc

SEQ ID NO: 655653 - RNA, 22 nt, Human
uucauauucgaccaguaguauu

SEQ ID NO: 655654 - RNA, 18 nt, Human
uucgaccaguaguauuac

SEQ ID NO: 655655 - RNA, 21 nt, Human
uugaagugaauggccacggac

SEQ ID NO: 655656 - RNA, 22 nt, Human
uugcagacauauauauauauau

SEQ ID NO: 655657 - RNA, 22 nt, Human
uugccaugagaguauuucaagu

SEQ ID NO: 655658 - RNA, 28 nt, Human
uuuaacaaguaaagugagguuuauuauu

SEQ ID NO: 655659 - RNA, 21 nt, Human
uuuaagaagacauucaaaauc

SEQ ID NO: 655660 - RNA, 22 nt, Human
uuuacauaacuucagagaaggg

SEQ ID NO: 655661 - RNA, 19 nt, Human
uuucccuccaaaaaaaagc

SEQ ID NO: 655662 - RNA, 23 nt, Human
caaaauggaaacaguaaugaaca

SEQ ID NO: 655663 - RNA, 22 nt, Human
caaauuuucagauuagucugua

SEQ ID NO: 655664 - RNA, 20 nt, Human
uacuuuucucaguuguuugc

SEQ ID NO: 655665 - RNA, 23 nt, Human
uagccuugaaacaucaaagacau

SEQ ID NO: 655666 - RNA, 22 nt, Human
uaggauagaaugucuucuuuaa

SEQ ID NO: 655667 - RNA, 22 nt, Human
uaguaaucaaaaucuccagcac

SEQ ID NO: 655668 - RNA, 22 nt, Human
ucaauauuaagugguucucucc

SEQ ID NO: 655669 - RNA, 22 nt, Human
uuucuuguugucaucauguuuu

SEQ ID NO: 655670 - RNA, 22 nt, Human
uuuucagauuagucuguacuuc

SEQ ID NO: 655671 - RNA, 18 nt, Human
uuuuuuuuuuuuuuuuug

SEQ ID NO: 655672 - RNA, 23 nt, Human
uuuuuuuuuuuuuuuuugaacuu

SEQ ID NO: 655673 - RNA, 23 nt, Human
aaaaaaaaaaaaaaaucggcuca

SEQ ID NO: 655674 - RNA, 19 nt, Human
aaaaaaaaaaaaaaucggc

SEQ ID NO: 655675 - RNA, 20 nt, Human
aaaaaauggagacacuuguu

SEQ ID NO: 655676 - RNA, 20 nt, Human
aaaaagaaaaugaacaaaga

SEQ ID NO: 655677 - RNA, 20 nt, Human
aaaacaucagcucgcaagag

SEQ ID NO: 655678 - RNA, 19 nt, Human
aaacacuguuaaauucaug

SEQ ID NO: 655679 - RNA, 23 nt, Human
aagaaagcauucacagcaaggcc

SEQ ID NO: 655680 - RNA, 24 nt, Human
aaugacaugaaccugggaggcgga

SEQ ID NO: 655681 - RNA, 24 nt, Human
acugagccacugcacuccagccug

SEQ ID NO: 655682 - RNA, 21 nt, Human
acugcacuccagccugggcaa

SEQ ID NO: 655683 - RNA, 24 nt, Human
acugcacuccagccugggcaauag

SEQ ID NO: 655684 - RNA, 26 nt, Human
acugcacuccagccugggcaauagag

SEQ ID NO: 655685 - RNA, 24 nt, Human
agccacugcacuccagccugggca

SEQ ID NO: 655686 - RNA, 24 nt, Human
agccugggcaauagagcaagacuc

SEQ ID NO: 655687 - RNA, 22 nt, Human
aggcaggagaaugacaugaacc

SEQ ID NO: 655688 - RNA, 24 nt, Human
aggcaggagaaugacaugaaccug

SEQ ID NO: 655689 - RNA, 24 nt, Human
aggcggagcuugcaguaagccgag

SEQ ID NO: 655690 - RNA, 19 nt, Human
aggcugaggcaggagaaug

SEQ ID NO: 655691 - RNA, 24 nt, Human
auagagcaagacuccaucucaaaa

SEQ ID NO: 655692 - RNA, 18 nt, Human
caaagcccgauucucugc

SEQ ID NO: 655693 - RNA, 21 nt, Human
caagacuccaucucaaaaaaa

SEQ ID NO: 655694 - RNA, 23 nt, Human
caauagagcaagacuccaucuca

SEQ ID NO: 655695 - RNA, 21 nt, Human
cacagcaaggccuauaaucag

SEQ ID NO: 655696 - RNA, 23 nt, Human
cacuccagccugggcaauagagc

SEQ ID NO: 655697 - RNA, 18 nt, Human
cacugcacuccagccugg

SEQ ID NO: 655698 - RNA, 19 nt, Human
cacugcacuccagccuggg

SEQ ID NO: 655699 - RNA, 21 nt, Human
cacugcacuccagccugggca

SEQ ID NO: 655700 - RNA, 23 nt, Human
cacugcacuccagccugggcaau

SEQ ID NO: 655701 - RNA, 24 nt, Human
cacugcacuccagccugggcaaua

SEQ ID NO: 655702 - RNA, 26 nt, Human
cacugcacuccagccugggcaauaga

SEQ ID NO: 655703 - RNA, 20 nt, Human
cacugcacuccagccugggg

SEQ ID NO: 655704 - RNA, 24 nt, Human
cagaugcuuccaucaucaguacuc

SEQ ID NO: 655705 - RNA, 23 nt, Human
cagcucgcaagaggcugaggcag

SEQ ID NO: 655706 - RNA, 18 nt, Human
caggagaaugacaugaac

SEQ ID NO: 655707 - RNA, 24 nt, Human
cauaacuggaugccuggauugucc

SEQ ID NO: 655708 - RNA, 21 nt, Human
caugaaccugggaggcggagc

SEQ ID NO: 655709 - RNA, 19 nt, Human
ccacccagcugccaccaau

SEQ ID NO: 655710 - RNA, 20 nt, Human
ccacugcacuccagccuggg

SEQ ID NO: 655711 - RNA, 21 nt, Human
ccacugcacuccagccugggc

SEQ ID NO: 655712 - RNA, 23 nt, Human
ccacugcacuccagccugggcaa

SEQ ID NO: 655713 - RNA, 23 nt, Human
ccacugcacuccagccugggcaa

SEQ ID NO: 655714 - RNA, 24 nt, Human
ccacugcacuccagccugggcaau

SEQ ID NO: 655715 - RNA, 21 nt, Human
ccagaaagccuuacuuauuuu

SEQ ID NO: 655716 - RNA, 22 nt, Human
ccagcugccaccaauaaaauca

SEQ ID NO: 655717 - RNA, 19 nt, Human
ccugccacccagcugccac

SEQ ID NO: 655718 - RNA, 22 nt, Human
ccugggcaauagagcaagacuc

SEQ ID NO: 655719 - RNA, 18 nt, Human
cgucuugacucugccagc

SEQ ID NO: 655720 - RNA, 21 nt, Human
cucaucuuuuauugcuguugg

SEQ ID NO: 655721 - RNA, 19 nt, Human
cuccaucucaaaaaaaaaa

SEQ ID NO: 655722 - RNA, 23 nt, Human
gaaucaaagaauuaugaaaguaa

SEQ ID NO: 655723 - RNA, 23 nt, Human
gagacugagccacugcacuccag

SEQ ID NO: 655724 - RNA, 24 nt, Human
gcacuccagccugggcaauagagc

SEQ ID NO: 655725 - RNA, 22 nt, Human
gccacugcacuccagccugggc

SEQ ID NO: 655726 - RNA, 24 nt, Human
gccacugcacuccagccugggcaa

SEQ ID NO: 655727 - RNA, 19 nt, Human
gcccuuuuaauugcaaagg

SEQ ID NO: 655728 - RNA, 24 nt, Human
gcuaaaaauggcagccaaaaaaaa

SEQ ID NO: 655729 - RNA, 21 nt, Human
guggaguguucugcaaagccc

SEQ ID NO: 655730 - RNA, 23 nt, Human
uaaacagcccuuuuaauugcaaa

SEQ ID NO: 655731 - RNA, 20 nt, Human
uaaggcuuucaaaacugugg

SEQ ID NO: 655732 - RNA, 23 nt, Human
uaauacaguauacauuaucuuuc

SEQ ID NO: 655733 - RNA, 19 nt, Human
uacuugaccaccaaagaca

SEQ ID NO: 655734 - RNA, 23 nt, Human
uagagcaagacuccaucucaaaa

SEQ ID NO: 655735 - RNA, 19 nt, Human
ucaggcauaacuggaugcc

SEQ ID NO: 655736 - RNA, 22 nt, Human
ucaguaagaugugugaaaaguu

SEQ ID NO: 655737 - RNA, 23 nt, Human
uccaucucaaaaaaaaaaaaaaa

SEQ ID NO: 655738 - RNA, 23 nt, Human
uccaucucaaaaaaaaaaaaaaa

SEQ ID NO: 655739 - RNA, 19 nt, Human
ugaaauauucacaggaauc

SEQ ID NO: 655740 - RNA, 24 nt, Human
ugacaccaugccaaacacuguuaa

SEQ ID NO: 655741 - RNA, 23 nt, Human
ugaggcaggagaaugacaugaac

SEQ ID NO: 655742 - RNA, 24 nt, Human
ugaggcaggagaaugacaugaacc

SEQ ID NO: 655743 - RNA, 25 nt, Human
ugaggcaggagaaugacaugaaccu

SEQ ID NO: 655744 - RNA, 24 nt, Human
ugagguagcuaaaaauggcagcca

SEQ ID NO: 655745 - RNA, 25 nt, Human
ugcaaaggagaaaaaaauggagaca

SEQ ID NO: 655746 - RNA, 22 nt, Human
ugcaguaagccgagacugagcc

SEQ ID NO: 655747 - RNA, 22 nt, Human
ugccuggauuguccugccaccc

SEQ ID NO: 655748 - RNA, 19 nt, Human
ugcuguugguugagaugaa

SEQ ID NO: 655749 - RNA, 29 nt, Human
ugggaggcggagcuugcaguaacaacggu

SEQ ID NO: 655750 - RNA, 23 nt, Human
uguauauaucaaacuucagaucu

SEQ ID NO: 655751 - RNA, 19 nt, Human
uguugaggcuuuucucaag

SEQ ID NO: 655752 - RNA, 25 nt, Human
uguuuugaggucaauguucuuuuaa

SEQ ID NO: 655753 - RNA, 22 nt, Human
uucugcaaagcccgauucucug

SEQ ID NO: 655754 - RNA, 20 nt, Human
uugaccaccaaagacaguau

SEQ ID NO: 655755 - RNA, 24 nt, Human
uugaccaccaaagacaguauuuuu

SEQ ID NO: 655756 - RNA, 25 nt, Human
uugcaguaagccgagacugagccac

SEQ ID NO: 655757 - RNA, 25 nt, Human
uuugcuuacauucagaauaaggcuu

SEQ ID NO: 655758 - RNA, 21 nt, Human
uuuucuguaagaagaggcuuu

SEQ ID NO: 655759 - RNA, 25 nt, Human
uuuuuuuuuuuuuuuuuuuauuuuu

SEQ ID NO: 655760 - RNA, 19 nt, Human
aaaugugacccaaccuagu

SEQ ID NO: 655761 - RNA, 28 nt, Human
aacaaaaugacuuaauuucaguacccac

SEQ ID NO: 655762 - RNA, 18 nt, Human
aagcauacaguauguuac

SEQ ID NO: 655763 - RNA, 23 nt, Human
aauauuaaaagcauaccgaaaaa

SEQ ID NO: 655764 - RNA, 25 nt, Human
acaaaacacaaugcaugcagggaaa

SEQ ID NO: 655765 - RNA, 21 nt, Human
acaaaguaaguguugaaaucc

SEQ ID NO: 655766 - RNA, 22 nt, Human
accacuaguccauacuggccug

SEQ ID NO: 655767 - RNA, 20 nt, Human
acuguucugcuuccccaucu

SEQ ID NO: 655768 - RNA, 19 nt, Human
agacauuucugagcaacau

SEQ ID NO: 655769 - RNA, 19 nt, Human
aguaacaaauauaaaaaag

SEQ ID NO: 655770 - RNA, 21 nt, Human
aguaaguguugaaaucugauu

SEQ ID NO: 655771 - RNA, 20 nt, Human
auaaguccaaucauaagcuu

SEQ ID NO: 655772 - RNA, 22 nt, Human
auacuguucugcuuccccaucu

SEQ ID NO: 655773 - RNA, 21 nt, Human
caaaacacaaugcaugcaggg

SEQ ID NO: 655774 - RNA, 23 nt, Human
cacagcuuagguguaaaaaaagu

SEQ ID NO: 655775 - RNA, 23 nt, Human
ccaaaugcugcaugccacauaac

SEQ ID NO: 655776 - RNA, 21 nt, Human
cccuccaccacuaguccauac

SEQ ID NO: 655777 - RNA, 27 nt, Human
cccugaaaguaagaaaacugagggguc

SEQ ID NO: 655778 - RNA, 25 nt, Human
ccugcgaccgugguaccuucgaggc

SEQ ID NO: 655779 - RNA, 19 nt, Human
cuagucagcaacuuuacaa

SEQ ID NO: 655780 - RNA, 18 nt, Human
cucaugaaagucaggaga

SEQ ID NO: 655781 - RNA, 18 nt, Human
gccaaagccagggcccca

SEQ ID NO: 655782 - RNA, 18 nt, Human
ggauuguuuuuuuuuuuu

SEQ ID NO: 655783 - RNA, 19 nt, Human
ggcaguguguugucagcag

SEQ ID NO: 655784 - RNA, 26 nt, Human
gggggauugccuugcaaagccuaggg

SEQ ID NO: 655785 - RNA, 18 nt, Human
uaaauucaaccacacaug

SEQ ID NO: 655786 - RNA, 23 nt, Human
uaaauucaaccacacauguuuaa

SEQ ID NO: 655787 - RNA, 18 nt, Human
uaacaaauauaaaaaagu

SEQ ID NO: 655788 - RNA, 21 nt, Human
uacaaguagaaagcauacagu

SEQ ID NO: 655789 - RNA, 22 nt, Human
uacauaaacuucacacauacug

SEQ ID NO: 655790 - RNA, 23 nt, Human
uaccuucccugaaaguaagaaaa

SEQ ID NO: 655791 - RNA, 19 nt, Human
uaggaggguuccuuuuuac

SEQ ID NO: 655792 - RNA, 22 nt, Human
uauaaaaacuggguacuuagag

SEQ ID NO: 655793 - RNA, 24 nt, Human
uauaaaaacuggguacuuagagua

SEQ ID NO: 655794 - RNA, 21 nt, Human
ucagacauuucugagcaacau

SEQ ID NO: 655795 - RNA, 21 nt, Human
ucauuugcucaaggauccaga

SEQ ID NO: 655796 - RNA, 21 nt, Human
uccaaucauaagcuuuccuua

SEQ ID NO: 655797 - RNA, 21 nt, Human
ucccaguugaaagucccugcu

SEQ ID NO: 655798 - RNA, 18 nt, Human
uccucccucggcccugcg

SEQ ID NO: 655799 - RNA, 19 nt, Human
ucugagcaacaucaaauac

SEQ ID NO: 655800 - RNA, 19 nt, Human
ugaaacaauacacauacgc

SEQ ID NO: 655801 - RNA, 23 nt, Human
ugaaaguaagaaaacuauucagc

SEQ ID NO: 655802 - RNA, 23 nt, Human
ugagaaaaauaugaauguuacau

SEQ ID NO: 655803 - RNA, 21 nt, Human
ugagcaacaucaaauacagaa

SEQ ID NO: 655804 - RNA, 18 nt, Human
ugccugggugcccacagg

SEQ ID NO: 655805 - RNA, 23 nt, Human
ugccuggugcugcugccugggug

SEQ ID NO: 655806 - RNA, 23 nt, Human
ugcugcugccugggugcccacag

SEQ ID NO: 655807 - RNA, 24 nt, Human
uggaaaauaaguccaaucauaagc

SEQ ID NO: 655808 - RNA, 25 nt, Human
ugucccagcuuugccuucuucauuu

SEQ ID NO: 655809 - RNA, 22 nt, Human
uguuacaaauaucaaaaugaga

SEQ ID NO: 655810 - RNA, 18 nt, Human
uuaagaguuguugugagu

SEQ ID NO: 655811 - RNA, 19 nt, Human
uuaagaguuguugugaguc

SEQ ID NO: 655812 - RNA, 24 nt, Human
uuaguugucccagcuuugccuucu

SEQ ID NO: 655813 - RNA, 23 nt, Human
uucaaaagguugucccaguugaa

SEQ ID NO: 655814 - RNA, 19 nt, Human
uuccaaaugcugcaugcca

SEQ ID NO: 655815 - RNA, 20 nt, Human
uugcugcugcuuuuucugga

SEQ ID NO: 655816 - RNA, 22 nt, Human
uuuaaaauauuaaaagcauacc

SEQ ID NO: 655817 - RNA, 23 nt, Human
uuuaaaauauuaaaagcauaccg

SEQ ID NO: 655818 - RNA, 20 nt, Human
uuuaaaguuuucccuccacc

SEQ ID NO: 655819 - RNA, 22 nt, Human
uuuacaaguagaaagcauacag

SEQ ID NO: 655820 - RNA, 19 nt, Human
uuucaaaugugacccaacc

SEQ ID NO: 655821 - RNA, 24 nt, Human
uuuuuuuuuuuuuuuuuuuauuuu

SEQ ID NO: 655822 - RNA, 27 nt, Human
aaaaaaccagggacaaagcggugggca

SEQ ID NO: 655823 - RNA, 20 nt, Human
aaaccagggacaaagcggaa

SEQ ID NO: 655824 - RNA, 24 nt, Human
aaauaaacuugaccgacuuucauc

SEQ ID NO: 655825 - RNA, 19 nt, Human
aaccuuuguguguuuuuuu

SEQ ID NO: 655826 - RNA, 18 nt, Human
aacuccaguggcucagca

SEQ ID NO: 655827 - RNA, 19 nt, Human
aagagaucagagggugccg

SEQ ID NO: 655828 - RNA, 21 nt, Human
aagcaggaccucguccaacca

SEQ ID NO: 655829 - RNA, 19 nt, Human
aagcccccagccuugagcc

SEQ ID NO: 655830 - RNA, 18 nt, Human
aaggggaccugggauugg

SEQ ID NO: 655831 - RNA, 22 nt, Human
accaccuccccagacaaccacc

SEQ ID NO: 655832 - RNA, 24 nt, Human
accagggacaaagcggaacccagc

SEQ ID NO: 655833 - RNA, 24 nt, Human
acccuccucggcccucucuggaac

SEQ ID NO: 655834 - RNA, 21 nt, Human
agacaaccaccgggaaugaaa

SEQ ID NO: 655835 - RNA, 19 nt, Human
agcagaggauccaaccucc

SEQ ID NO: 655836 - RNA, 21 nt, Human
agcggggggcuggaggcgggg

SEQ ID NO: 655837 - RNA, 19 nt, Human
aggaguguguggcccccca

SEQ ID NO: 655838 - RNA, 20 nt, Human
aggcucgggggugggagcgg

SEQ ID NO: 655839 - RNA, 26 nt, Human
aggggaggggugugaauucccuggaa

SEQ ID NO: 655840 - RNA, 22 nt, Human
augcacugaaagcaaauaaacu

SEQ ID NO: 655841 - RNA, 21 nt, Human
caacauaagcccccagccuug

SEQ ID NO: 655842 - RNA, 24 nt, Human
caaccuccguggcugcacccuccu

SEQ ID NO: 655843 - RNA, 22 nt, Human
caaguggcacagaaaaggccga

SEQ ID NO: 655844 - RNA, 20 nt, Human
cacacagaaaaaaaaaggaa

SEQ ID NO: 655845 - RNA, 21 nt, Human
cacagaaaaaaaaaggaaaaa

SEQ ID NO: 655846 - RNA, 22 nt, Human
cagaaaaaaaaaggaaaaaacc

SEQ ID NO: 655847 - RNA, 23 nt, Human
cagaaaaggccgagaaaccucca

SEQ ID NO: 655848 - RNA, 20 nt, Human
cagagcccucgaggggugcu

SEQ ID NO: 655849 - RNA, 18 nt, Human
cagcacugcuggccuggc

SEQ ID NO: 655850 - RNA, 22 nt, Human
cagccugucuguccuuggcugu

SEQ ID NO: 655851 - RNA, 21 nt, Human
caggccccaaugggcccgaga

SEQ ID NO: 655852 - RNA, 23 nt, Human
ccaaccaccuccccagacaacca

SEQ ID NO: 655853 - RNA, 18 nt, Human
ccaaccuccguggcugca

SEQ ID NO: 655854 - RNA, 20 nt, Human
ccaagagaucagagggugcc

SEQ ID NO: 655855 - RNA, 27 nt, Human
ccaccagcacccugcuucgaggccugu

SEQ ID NO: 655856 - RNA, 22 nt, Human
ccagcaggugagaaacaggccc

SEQ ID NO: 655857 - RNA, 21 nt, Human
cccaagagaucagagggugcc

SEQ ID NO: 655858 - RNA, 19 nt, Human
cccagcagaagcgggacga

SEQ ID NO: 655859 - RNA, 22 nt, Human
cccagccuugagccuccugggg

SEQ ID NO: 655860 - RNA, 18 nt, Human
cccaugcguuucugaggc

SEQ ID NO: 655861 - RNA, 18 nt, Human
ccccagccuugagccucc

SEQ ID NO: 655862 - RNA, 23 nt, Human
cccccgaccacaacauaagcccc

SEQ ID NO: 655863 - RNA, 23 nt, Human
cccgaccacaacauaagccccca

SEQ ID NO: 655864 - RNA, 19 nt, Human
cccugccccgagaugccuc

SEQ ID NO: 655865 - RNA, 23 nt, Human
cccugcuccaacacuucuuuucu

SEQ ID NO: 655866 - RNA, 21 nt, Human
ccugggauuggggugcagggc

SEQ ID NO: 655867 - RNA, 24 nt, Human
ccuguggugugggggacacagagc

SEQ ID NO: 655868 - RNA, 23 nt, Human
ccuugagccuccuggggagccuc

SEQ ID NO: 655869 - RNA, 19 nt, Human
cgggggugggagcgggggg

SEQ ID NO: 655870 - RNA, 22 nt, Human
cgucaagggucccaccugaccc

SEQ ID NO: 655871 - RNA, 19 nt, Human
cuccguggcugcacccucc

SEQ ID NO: 655872 - RNA, 18 nt, Human
cuccucggcccucucugg

SEQ ID NO: 655873 - RNA, 20 nt, Human
cucguccaaccaccucccca

SEQ ID NO: 655874 - RNA, 22 nt, Human
cugcccccugccccgagaugcc

SEQ ID NO: 655875 - RNA, 22 nt, Human
cugcccccugccccgagaugcc

SEQ ID NO: 655876 - RNA, 23 nt, Human
cugcccccugccccgagaugccu

SEQ ID NO: 655877 - RNA, 20 nt, Human
cuuacacggucgucccccca

SEQ ID NO: 655878 - RNA, 20 nt, Human
gaacuccaguggcucagcau

SEQ ID NO: 655879 - RNA, 18 nt, Human
gacaaagcggaacccagc

SEQ ID NO: 655880 - RNA, 20 nt, Human
gagccuccuggggagccucu

SEQ ID NO: 655881 - RNA, 23 nt, Human
gagccuccuggggagccucuggg

SEQ ID NO: 655882 - RNA, 24 nt, Human
gccagcaggugagaaacaggcccc

SEQ ID NO: 655883 - RNA, 19 nt, Human
gccccccaugcguuucuga

SEQ ID NO: 655884 - RNA, 22 nt, Human
gcccuucaggggguccagccag

SEQ ID NO: 655885 - RNA, 23 nt, Human
gccuguggugugggggacacaga

SEQ ID NO: 655886 - RNA, 20 nt, Human
gcugguggaaaagggggccc

SEQ ID NO: 655887 - RNA, 18 nt, Human
ggaacccagcugggcuga

SEQ ID NO: 655888 - RNA, 23 nt, Human
ggccaggauuugggcucaggugg

SEQ ID NO: 655889 - RNA, 18 nt, Human
gggccaggcagauuuggc

SEQ ID NO: 655890 - RNA, 19 nt, Human
ggggcaggcagaggggucc

SEQ ID NO: 655891 - RNA, 18 nt, Human
gggggcuggaggcgggga

SEQ ID NO: 655892 - RNA, 19 nt, Human
gggggugggagcggggggc

SEQ ID NO: 655893 - RNA, 20 nt, Human
gggguuggggcaggcagagg

SEQ ID NO: 655894 - RNA, 20 nt, Human
gggucccaccugacccuccc

SEQ ID NO: 655895 - RNA, 18 nt, Human
gguuggggcaggcagagg

SEQ ID NO: 655896 - RNA, 18 nt, Human
guggcugcacccuccucg

SEQ ID NO: 655897 - RNA, 18 nt, Human
gugugaauucccugggga

SEQ ID NO: 655898 - RNA, 24 nt, Human
guugggcucagguccaggcagccu

SEQ ID NO: 655899 - RNA, 19 nt, Human
uaaaaugccuuuacauaga

SEQ ID NO: 655900 - RNA, 19 nt, Human
uaagcccccagccuugagc

SEQ ID NO: 655901 - RNA, 24 nt, Human
uccagccagcaggugagaaacagg

SEQ ID NO: 655902 - RNA, 24 nt, Human
ucccaggugcccccguuggaaccc

SEQ ID NO: 655903 - RNA, 19 nt, Human
uccccaagggcagggccug

SEQ ID NO: 655904 - RNA, 21 nt, Human
uccccgagccucaagcaggac

SEQ ID NO: 655905 - RNA, 22 nt, Human
uccccgagccucaagcaggacc

SEQ ID NO: 655906 - RNA, 21 nt, Human
uccccuggccacagcacugcu

SEQ ID NO: 655907 - RNA, 23 nt, Human
uccccuggccacagcacugcugg

SEQ ID NO: 655908 - RNA, 18 nt, Human
ucugaggcugaaggcugu

SEQ ID NO: 655909 - RNA, 19 nt, Human
ucugccccaccaaguggca

SEQ ID NO: 655910 - RNA, 25 nt, Human
ucugcccccugccccgagaugccuc

SEQ ID NO: 655911 - RNA, 24 nt, Human
ugaaaaaaaauccaaccauccccu

SEQ ID NO: 655912 - RNA, 20 nt, Human
ugaaagcaaauaaacuugac

SEQ ID NO: 655913 - RNA, 24 nt, Human
ugagaaacaggccccaaugggccc

SEQ ID NO: 655914 - RNA, 18 nt, Human
ugagaacagugcauuucc

SEQ ID NO: 655915 - RNA, 22 nt, Human
ugaggcugaaggcuguugggcu

SEQ ID NO: 655916 - RNA, 21 nt, Human
uggcacagaaaaggccgagaa

SEQ ID NO: 655917 - RNA, 20 nt, Human
uggccucugcccccugcccc

SEQ ID NO: 655918 - RNA, 24 nt, Human
uggcugugggagaaggggaggggu

SEQ ID NO: 655919 - RNA, 21 nt, Human
ugggagcggggggcuggaggg

SEQ ID NO: 655920 - RNA, 25 nt, Human
uggggcagagcccucgaggggugcu

SEQ ID NO: 655921 - RNA, 26 nt, Human
uguguggccccccaugcguuucugag

SEQ ID NO: 655922 - RNA, 24 nt, Human
uguguuuuuuuguccauuuuguuu

SEQ ID NO: 655923 - RNA, 23 nt, Human
uucaggggguccagccagcaggu

SEQ ID NO: 655924 - RNA, 20 nt, Human
uuccccaagggcagggccug

SEQ ID NO: 655925 - RNA, 21 nt, Human
uugaaaaaaaauccaaccauc

SEQ ID NO: 655926 - RNA, 23 nt, Human
uuucugaggcugaaggcuguugg

SEQ ID NO: 655927 - RNA, 21 nt, Human
uuuggcugguggaaaaggggg

SEQ ID NO: 655928 - RNA, 22 nt, Human
uuuggcugguggaaaagggggc

SEQ ID NO: 655929 - RNA, 22 nt, Human
uuuguguguuuuuuuguccauu

SEQ ID NO: 655930 - RNA, 23 nt, Human
uuuucuucacuugacaucguucu

SEQ ID NO: 655931 - RNA, 22 nt, Human
aauacagcugccaaggagaccc

SEQ ID NO: 655932 - RNA, 23 nt, Human
acagagcuuucaucauggcaaaa

SEQ ID NO: 655933 - RNA, 19 nt, Human
agagcaacauccagacucc

SEQ ID NO: 655934 - RNA, 19 nt, Human
agcugccaaggagacccug

SEQ ID NO: 655935 - RNA, 23 nt, Human
agggaaacagagcuuucaucaug

SEQ ID NO: 655936 - RNA, 21 nt, Human
caacauccagacuccagaaua

SEQ ID NO: 655937 - RNA, 22 nt, Human
cagagcuuucaucauggcaaaa

SEQ ID NO: 655938 - RNA, 25 nt, Human
cccuucuguucugagaugggggugg

SEQ ID NO: 655939 - RNA, 22 nt, Human
ccuucuguucugagaugggggu

SEQ ID NO: 655940 - RNA, 19 nt, Human
cucuggcuucccacccuuc

SEQ ID NO: 655941 - RNA, 21 nt, Human
cucuggcuucccacccuucug

SEQ ID NO: 655942 - RNA, 20 nt, Human
gcggcucuggcuucccaccc

SEQ ID NO: 655943 - RNA, 22 nt, Human
gcucuguucaucuaaaagugga

SEQ ID NO: 655944 - RNA, 18 nt, Human
ggcaguaucucaucuuug

SEQ ID NO: 655945 - RNA, 22 nt, Human
uccagaauacagcugccaagga

SEQ ID NO: 655946 - RNA, 22 nt, Human
uccuuuaucuugcuggccauaa

SEQ ID NO: 655947 - RNA, 19 nt, Human
ucuuguguuucucugagag

SEQ ID NO: 655948 - RNA, 22 nt, Human
ucuuuagagagcaacauccaga

SEQ ID NO: 655949 - RNA, 18 nt, Human
ugagaugggggugguggg

SEQ ID NO: 655950 - RNA, 20 nt, Human
ugagauggggguggugggca

SEQ ID NO: 655951 - RNA, 22 nt, Human
uggcaggcggcucuggcuuccc

SEQ ID NO: 655952 - RNA, 21 nt, Human
uguuaugcuguggggacuggc

SEQ ID NO: 655953 - RNA, 18 nt, Human
uucaucuaaaaguggaau

SEQ ID NO: 655954 - RNA, 27 nt, Human
uuucuuguguuucucugagagauguuc

SEQ ID NO: 655955 - RNA, 20 nt, Human
uuuuuuuucuuuguacaaaa

SEQ ID NO: 655956 - RNA, 19 nt, Human
uuuuuuuuuuuuucuuugu

SEQ ID NO: 655957 - RNA, 27 nt, Human
uuuuuuuuuuuuuuuuuuucuuugggg

SEQ ID NO: 655958 - RNA, 25 nt, Human
aaacauuagauggugcugaaaagcc

SEQ ID NO: 655959 - RNA, 23 nt, Human
aaagaaggaaaugaggaagaaaa

SEQ ID NO: 655960 - RNA, 20 nt, Human
aaaggacuguuuugugaaga

SEQ ID NO: 655961 - RNA, 24 nt, Human
aaaugucagcagaauuuaugagcu

SEQ ID NO: 655962 - RNA, 22 nt, Human
aagaaggaaaugaggaagaaaa

SEQ ID NO: 655963 - RNA, 22 nt, Human
acaagggcagcagccguagcaa

SEQ ID NO: 655964 - RNA, 20 nt, Human
accaaaagcuuuaauuaacc

SEQ ID NO: 655965 - RNA, 18 nt, Human
accagcuuuguccuucug

SEQ ID NO: 655966 - RNA, 20 nt, Human
acuuuggcaaguuuucuuuc

SEQ ID NO: 655967 - RNA, 19 nt, Human
agaaugcuaaaagccaccu

SEQ ID NO: 655968 - RNA, 23 nt, Human
agaggaaaaaggaacuugggaag

SEQ ID NO: 655969 - RNA, 20 nt, Human
agcaaaaaagagguaauugg

SEQ ID NO: 655970 - RNA, 24 nt, Human
agcagccguagcaaugcucuggag

SEQ ID NO: 655971 - RNA, 20 nt, Human
agcauucugguuucucccca

SEQ ID NO: 655972 - RNA, 20 nt, Human
aggaaaaaggaacuugggaa

SEQ ID NO: 655973 - RNA, 19 nt, Human
aggaauaaaagaaggaaau

SEQ ID NO: 655974 - RNA, 20 nt, Human
aggguaacauuuggaugaaa

SEQ ID NO: 655975 - RNA, 22 nt, Human
aggugggaguuucagaagcauu

SEQ ID NO: 655976 - RNA, 23 nt, Human
caaaaaagagguaauugguccug

SEQ ID NO: 655977 - RNA, 24 nt, Human
cagaagcauucugguuucucccca

SEQ ID NO: 655978 - RNA, 22 nt, Human
cagcagccguagcaaugcucug

SEQ ID NO: 655979 - RNA, 20 nt, Human
cagcgcgguugcguaaggug

SEQ ID NO: 655980 - RNA, 20 nt, Human
cauucugguuucuccccacu

SEQ ID NO: 655981 - RNA, 24 nt, Human
ccacuguaaaaagggugaggaaga

SEQ ID NO: 655982 - RNA, 23 nt, Human
cccacauaagaucaugacggagc

SEQ ID NO: 655983 - RNA, 24 nt, Human
cccacuccucaccccugcagcgcg

SEQ ID NO: 655984 - RNA, 19 nt, Human
cccccagauuuagaacaga

SEQ ID NO: 655985 - RNA, 21 nt, Human
ccugggaacucuaauugacca

SEQ ID NO: 655986 - RNA, 19 nt, Human
ccuuuuuuuuuaagggguu

SEQ ID NO: 655987 - RNA, 24 nt, Human
cuagcucagcagaaaggcuccaaa

SEQ ID NO: 655988 - RNA, 20 nt, Human
gaacucuaauugaccaucua

SEQ ID NO: 655989 - RNA, 18 nt, Human
gaagaugaagggaggaag

SEQ ID NO: 655990 - RNA, 20 nt, Human
gaagggaguggggacaaggg

SEQ ID NO: 655991 - RNA, 18 nt, Human
gacuuagaagagcagcau

SEQ ID NO: 655992 - RNA, 23 nt, Human
gauucgugccgucaguuuuccuc

SEQ ID NO: 655993 - RNA, 18 nt, Human
gcucuauucugaggcgau

SEQ ID NO: 655994 - RNA, 24 nt, Human
gcuuuguccuucugaccuuuuuuu

SEQ ID NO: 655995 - RNA, 21 nt, Human
ggaaaaaggaacuugggaagg

SEQ ID NO: 655996 - RNA, 18 nt, Human
ggacuuagaagagcagca

SEQ ID NO: 655997 - RNA, 21 nt, Human
gggaagggaguggggacaagg

SEQ ID NO: 655998 - RNA, 21 nt, Human
gggaggaauaaaagaaggaaa

SEQ ID NO: 655999 - RNA, 22 nt, Human
gggaguggggacaagggacagg

SEQ ID NO: 656000 - RNA, 23 nt, Human
gggguggggaggaauaaaagaag

SEQ ID NO: 656001 - RNA, 19 nt, Human
ggugaggaagaugaaggga

SEQ ID NO: 656002 - RNA, 23 nt, Human
ggugaggaagaugaagggaggaa

SEQ ID NO: 656003 - RNA, 21 nt, Human
gguggggaggaauaaaagaag

SEQ ID NO: 656004 - RNA, 22 nt, Human
gguucuugcuuuacccccagau

SEQ ID NO: 656005 - RNA, 20 nt, Human
uaaaaagggugaggaagaug

SEQ ID NO: 656006 - RNA, 24 nt, Human
uaagaauuuuaaaugccaguauua

SEQ ID NO: 656007 - RNA, 27 nt, Human
uaauuuguaaucauuuuaacagccuuu

SEQ ID NO: 656008 - RNA, 20 nt, Human
uacaggcuucaaacccuggg

SEQ ID NO: 656009 - RNA, 19 nt, Human
uacugauguuuaaaugugu

SEQ ID NO: 656010 - RNA, 22 nt, Human
uagcucagcagaaaggcuccaa

SEQ ID NO: 656011 - RNA, 18 nt, Human
uaugccaaagccuggccc

SEQ ID NO: 656012 - RNA, 18 nt, Human
ucacauggcuuggugggg

SEQ ID NO: 656013 - RNA, 18 nt, Human
ucaguccauuucccaaac

SEQ ID NO: 656014 - RNA, 22 nt, Human
uccacgcauuagcaugcgcgug

SEQ ID NO: 656015 - RNA, 21 nt, Human
ucuagcucagcagaaaggcuc

SEQ ID NO: 656016 - RNA, 20 nt, Human
ucuccacuuacaagccacaa

SEQ ID NO: 656017 - RNA, 23 nt, Human
ucugcgcauacacuccacgcagu

SEQ ID NO: 656018 - RNA, 21 nt, Human
ugccaguauuacaggguaaca

SEQ ID NO: 656019 - RNA, 20 nt, Human
ugccgccacuaccagcaaga

SEQ ID NO: 656020 - RNA, 23 nt, Human
uggaaacacagaaugcuaaaagc

SEQ ID NO: 656021 - RNA, 22 nt, Human
uggagguaguaguacaagggca

SEQ ID NO: 656022 - RNA, 19 nt, Human
ugggaagggaguggggacc

SEQ ID NO: 656023 - RNA, 18 nt, Human
ugguuucuccccacuccu

SEQ ID NO: 656024 - RNA, 21 nt, Human
ugucagcagaauuuaugagcu

SEQ ID NO: 656025 - RNA, 23 nt, Human
uuggaaacacagaaugcuaaaag

SEQ ID NO: 656026 - RNA, 23 nt, Human
uuggaugaaauucuucuccacuu

SEQ ID NO: 656027 - RNA, 19 nt, Human
uugggaagggaguggggac

SEQ ID NO: 656028 - RNA, 18 nt, Human
uuucccaaacaaaccagc

SEQ ID NO: 656029 - RNA, 24 nt, Human
uuuggaugaaauucuucuccacuu

SEQ ID NO: 656030 - RNA, 19 nt, Human
uuuuaaauuauaccaaaag

SEQ ID NO: 656031 - RNA, 20 nt, Human
uuuuuuuuuuuuuuuugcua

SEQ ID NO: 656032 - RNA, 22 nt, Human
uuuuuuuuuuuuuuuugcuacu

SEQ ID NO: 656033 - RNA, 18 nt, Human
uuuuuuuuuuuuuuuuug

SEQ ID NO: 656034 - RNA, 20 nt, Human
uuuuuuuuuuuuuuuuugcu

SEQ ID NO: 656035 - RNA, 22 nt, Human
aacaggcaauuuucuaaggcuu

SEQ ID NO: 656036 - RNA, 24 nt, Human
aagcaaaucaauaauaccuuguua

SEQ ID NO: 656037 - RNA, 21 nt, Human
aaguugauaccucccuuccua

SEQ ID NO: 656038 - RNA, 23 nt, Human
aaucauccugaaaucagccagga

SEQ ID NO: 656039 - RNA, 22 nt, Human
acaaugaacacaauuacccaau

SEQ ID NO: 656040 - RNA, 21 nt, Human
accacaguauaccuagaagca

SEQ ID NO: 656041 - RNA, 18 nt, Human
acuugaaagacaggaaau

SEQ ID NO: 656042 - RNA, 23 nt, Human
acuugacgcuugaaaucuccaau

SEQ ID NO: 656043 - RNA, 21 nt, Human
agagacagagacugaaagaga

SEQ ID NO: 656044 - RNA, 24 nt, Human
agauuuauucagaaaggcaaaaug

SEQ ID NO: 656045 - RNA, 18 nt, Human
agguauccaaagccaccu

SEQ ID NO: 656046 - RNA, 24 nt, Human
agguggguuuggggcugcugugca

SEQ ID NO: 656047 - RNA, 18 nt, Human
augaacccccugggaguu

SEQ ID NO: 656048 - RNA, 21 nt, Human
auuccuuuucagcagcuaauu

SEQ ID NO: 656049 - RNA, 24 nt, Human
caaaaugccucaggugacacuuga

SEQ ID NO: 656050 - RNA, 22 nt, Human
cacacuuuaacuagagccaucu

SEQ ID NO: 656051 - RNA, 21 nt, Human
cacaguauaccuagaagcaaa

SEQ ID NO: 656052 - RNA, 19 nt, Human
ccagcacccacagcccuac

SEQ ID NO: 656053 - RNA, 23 nt, Human
cccacagcccuacuccuuaacuc

SEQ ID NO: 656054 - RNA, 18 nt, Human
cccccugggaguuggggg

SEQ ID NO: 656055 - RNA, 20 nt, Human
ccccuggaguggcauuccug

SEQ ID NO: 656056 - RNA, 26 nt, Human
ccccuggaguggcauuccugcccugg

SEQ ID NO: 656057 - RNA, 19 nt, Human
cccuucucuuucuaaaccc

SEQ ID NO: 656058 - RNA, 19 nt, Human
cccuucucuuucuaaaccc

SEQ ID NO: 656059 - RNA, 18 nt, Human
ccuauacccugauacaac

SEQ ID NO: 656060 - RNA, 19 nt, Human
ccucaggugacacuugacu

SEQ ID NO: 656061 - RNA, 20 nt, Human
ccuccuauacccugauacaa

SEQ ID NO: 656062 - RNA, 22 nt, Human
ccuggcccauguaaucauccug

SEQ ID NO: 656063 - RNA, 20 nt, Human
ccugggaguuggggguugcc

SEQ ID NO: 656064 - RNA, 21 nt, Human
cgcuugaaaucuccaauuaga

SEQ ID NO: 656065 - RNA, 21 nt, Human
cuacuugaagcauugccuccu

SEQ ID NO: 656066 - RNA, 20 nt, Human
cucaggccuuucuuguccuc

SEQ ID NO: 656067 - RNA, 21 nt, Human
cugcaucuagcaaugccaaaa

SEQ ID NO: 656068 - RNA, 21 nt, Human
cuggcuaaaaauuugaaaauc

SEQ ID NO: 656069 - RNA, 25 nt, Human
cuuuuccgauucaccaaauacuccc

SEQ ID NO: 656070 - RNA, 21 nt, Human
gaaaacaggcaauuuucuaag

SEQ ID NO: 656071 - RNA, 21 nt, Human
gaaaaugcucacaguguucuc

SEQ ID NO: 656072 - RNA, 18 nt, Human
gacaggcugauacacaug

SEQ ID NO: 656073 - RNA, 20 nt, Human
gagagaagauaaggaagggg

SEQ ID NO: 656074 - RNA, 19 nt, Human
gauucaccaaauacucccc

SEQ ID NO: 656075 - RNA, 18 nt, Human
gcagaguaccuggcuaaa

SEQ ID NO: 656076 - RNA, 18 nt, Human
gcccauguaaucauccug

SEQ ID NO: 656077 - RNA, 20 nt, Human
gcuauuagcuguccuugacu

SEQ ID NO: 656078 - RNA, 18 nt, Human
ggaaaugucugccacuug

SEQ ID NO: 656079 - RNA, 23 nt, Human
gguggguuuggggcugcugugca

SEQ ID NO: 656080 - RNA, 21 nt, Human
gugacuggggcucuguccaca

SEQ ID NO: 656081 - RNA, 24 nt, Human
guuaauuuccauuacauuacaguu

SEQ ID NO: 656082 - RNA, 24 nt, Human
uagaagcaaaucaauaauaccuug

SEQ ID NO: 656083 - RNA, 19 nt, Human
uagagugggcuccagcacc

SEQ ID NO: 656084 - RNA, 27 nt, Human
uagaucuuuaacaaauuuugcaaaccc

SEQ ID NO: 656085 - RNA, 22 nt, Human
uagcaaugccaaaaacuguacc

SEQ ID NO: 656086 - RNA, 23 nt, Human
uagcaaugccaaaaacuguaccc

SEQ ID NO: 656087 - RNA, 24 nt, Human
ucacaguguucucuugcaagcaug

SEQ ID NO: 656088 - RNA, 23 nt, Human
uccagcacccacagcccuacucc

SEQ ID NO: 656089 - RNA, 21 nt, Human
uccauagauaugagagaagau

SEQ ID NO: 656090 - RNA, 22 nt, Human
uccccaaauaggccacaauguu

SEQ ID NO: 656091 - RNA, 20 nt, Human
ucccuucucuuucuaaaccc

SEQ ID NO: 656092 - RNA, 27 nt, Human
ucuccgggcauuuaucuuccuccucuu

SEQ ID NO: 656093 - RNA, 22 nt, Human
ucugcaucuagcaaugccaaaa

SEQ ID NO: 656094 - RNA, 19 nt, Human
ucuuccuccucuugcuuuc

SEQ ID NO: 656095 - RNA, 20 nt, Human
ugacuggggcucuguccaca

SEQ ID NO: 656096 - RNA, 21 nt, Human
ugacuggggcucuguccacaa

SEQ ID NO: 656097 - RNA, 20 nt, Human
ugcuagguagguggguuugg

SEQ ID NO: 656098 - RNA, 19 nt, Human
uggcagagagggagaccug

SEQ ID NO: 656099 - RNA, 19 nt, Human
uggcagagagggagaccug

SEQ ID NO: 656100 - RNA, 22 nt, Human
ugggagagagagacagagacug

SEQ ID NO: 656101 - RNA, 20 nt, Human
ugggaguuggggguugccau

SEQ ID NO: 656102 - RNA, 22 nt, Human
ugggcuccagcacccacagccc

SEQ ID NO: 656103 - RNA, 25 nt, Human
ugucugcuuuuauuuuauucuuuga

SEQ ID NO: 656104 - RNA, 18 nt, Human
uucaucuagggauaagaa

SEQ ID NO: 656105 - RNA, 22 nt, Human
uugaagcauugccuccuauacc

SEQ ID NO: 656106 - RNA, 23 nt, Human
uugacgcuugaaaucuccaauug

SEQ ID NO: 656107 - RNA, 24 nt, Human
uuggagagggugggcagcucagug

SEQ ID NO: 656108 - RNA, 22 nt, Human
uuucccuucucuuucuaaaccc

SEQ ID NO: 656109 - RNA, 20 nt, Human
uuuuuuuuuuggagagggug

SEQ ID NO: 656110 - RNA, 21 nt, Human
uuuuuuuuuuuuggagagggu

SEQ ID NO: 656111 - RNA, 21 nt, Human
uuuuuuuuuuuuuuggagagg

SEQ ID NO: 656112 - RNA, 18 nt, Human
uuuuuuuuuuuuuuuuug

SEQ ID NO: 656113 - RNA, 25 nt, Human
uuuuuuuuuuuuuuuuuggagaggg

SEQ ID NO: 656114 - RNA, 26 nt, Human
aaaaaagcuuuucagacccgaaggcc

SEQ ID NO: 656115 - RNA, 24 nt, Human
aaacauuuuuuaaaauccacaucc

SEQ ID NO: 656116 - RNA, 20 nt, Human
aagaaaccacagcuaagagc

SEQ ID NO: 656117 - RNA, 20 nt, Human
aagcuaccgucagaaggcaa

SEQ ID NO: 656118 - RNA, 24 nt, Human
acaaugauuggguccccaaggcac

SEQ ID NO: 656119 - RNA, 21 nt, Human
acacccccaccccacccccac

SEQ ID NO: 656120 - RNA, 23 nt, Human
accgcaaaggauguuaaaaucua

SEQ ID NO: 656121 - RNA, 19 nt, Human
aguggucauggauuaggag

SEQ ID NO: 656122 - RNA, 22 nt, Human
augccgcugguccaagaaacca

SEQ ID NO: 656123 - RNA, 24 nt, Human
auuaugccacaaaacagggacacu

SEQ ID NO: 656124 - RNA, 23 nt, Human
caaaacagggacacuuaucuauu

SEQ ID NO: 656125 - RNA, 21 nt, Human
caaaggauguuaaaaucuauc

SEQ ID NO: 656126 - RNA, 19 nt, Human
cacccccaccccaccccca

SEQ ID NO: 656127 - RNA, 20 nt, Human
cacccccaccccacccccac

SEQ ID NO: 656128 - RNA, 24 nt, Human
cauugagcucucucuggcaugcuc

SEQ ID NO: 656129 - RNA, 24 nt, Human
cauuuuuuaaaauccacauccaac

SEQ ID NO: 656130 - RNA, 27 nt, Human
ccaaaccaucccccaaggaauacaccc

SEQ ID NO: 656131 - RNA, 20 nt, Human
ccaaggaauacacccccacc

SEQ ID NO: 656132 - RNA, 22 nt, Human
ccacagcuaagagccaugaggc

SEQ ID NO: 656133 - RNA, 18 nt, Human
cccaaaccaucccccaag

SEQ ID NO: 656134 - RNA, 19 nt, Human
cccaaggaauacaccccca

SEQ ID NO: 656135 - RNA, 21 nt, Human
cccaaggaauacacccccacc

SEQ ID NO: 656136 - RNA, 19 nt, Human
ccccaaggaauacaccccc

SEQ ID NO: 656137 - RNA, 22 nt, Human
ccccaaggaauacacccccacc

SEQ ID NO: 656138 - RNA, 21 nt, Human
ccccaccccacccccacauga

SEQ ID NO: 656139 - RNA, 21 nt, Human
cccccaaggaauacaccccca

SEQ ID NO: 656140 - RNA, 18 nt, Human
cccccaccccacccccac

SEQ ID NO: 656141 - RNA, 22 nt, Human
ccuagaauuuaaaacaggaaaa

SEQ ID NO: 656142 - RNA, 24 nt, Human
cuccaaaagcuaccgucagaaggc

SEQ ID NO: 656143 - RNA, 25 nt, Human
cucucuggcaugcuccccacucuag

SEQ ID NO: 656144 - RNA, 23 nt, Human
gaauaaaucuucucaugaaauuc

SEQ ID NO: 656145 - RNA, 23 nt, Human
gagcucucucuggcaugcucccc

SEQ ID NO: 656146 - RNA, 19 nt, Human
uaaaaaagcuuuucagacc

SEQ ID NO: 656147 - RNA, 25 nt, Human
uaacaaugaucacagaaaauguguc

SEQ ID NO: 656148 - RNA, 22 nt, Human
uacacagauuugguuucaaagc

SEQ ID NO: 656149 - RNA, 21 nt, Human
uacacccccaccccaccccca

SEQ ID NO: 656150 - RNA, 24 nt, Human
uacuuggguaguuuagcaaacauu

SEQ ID NO: 656151 - RNA, 26 nt, Human
uauaaauaggaaaaaaacagugguca

SEQ ID NO: 656152 - RNA, 22 nt, Human
uauccuagaauuuaaaacagga

SEQ ID NO: 656153 - RNA, 18 nt, Human
uaugacaccagccuaccu

SEQ ID NO: 656154 - RNA, 24 nt, Human
uauuccacuccccauucggcccaa

SEQ ID NO: 656155 - RNA, 19 nt, Human
ucaaagcugaaauaccccu

SEQ ID NO: 656156 - RNA, 21 nt, Human
ucagaaggcaaacugacaaau

SEQ ID NO: 656157 - RNA, 18 nt, Human
ucaguaggcuaccuggug

SEQ ID NO: 656158 - RNA, 21 nt, Human
uccaagaaaccacagcuaaga

SEQ ID NO: 656159 - RNA, 18 nt, Human
uccccacucuaguuagag

SEQ ID NO: 656160 - RNA, 19 nt, Human
ucggaucuugucacaauga

SEQ ID NO: 656161 - RNA, 22 nt, Human
ugaucacagaaaaugugucaua

SEQ ID NO: 656162 - RNA, 20 nt, Human
uggcugcaggaaucuuccuc

SEQ ID NO: 656163 - RNA, 23 nt, Human
uggugauauaaauaggaaaaaaa

SEQ ID NO: 656164 - RNA, 25 nt, Human
uuacuuggguaguuuagcaaacauu

SEQ ID NO: 656165 - RNA, 19 nt, Human
uucaaugucucggaucuug

SEQ ID NO: 656166 - RNA, 22 nt, Human
uuuaaaacaggaaaaaugucaa

SEQ ID NO: 656167 - RNA, 27 nt, Human
uuuuuuuuuuuuuaaaaaagcuuuuca

SEQ ID NO: 656168 - RNA, 20 nt, Human
aagugugaacaguuuccacc

SEQ ID NO: 656169 - RNA, 18 nt, Human
accccgcauccugcugca

SEQ ID NO: 656170 - RNA, 21 nt, Human
acugguguuucugaaggcggg

SEQ ID NO: 656171 - RNA, 24 nt, Human
agagaagcagagcuuucugaacua

SEQ ID NO: 656172 - RNA, 19 nt, Human
agcccgggcccuggaggag

SEQ ID NO: 656173 - RNA, 24 nt, Human
aggagucuggugccauggacaggc

SEQ ID NO: 656174 - RNA, 20 nt, Human
aggcaggaugggaggcaagu

SEQ ID NO: 656175 - RNA, 20 nt, Human
aggcuggaauuucuggcaga

SEQ ID NO: 656176 - RNA, 19 nt, Human
agugguggcuacacugagg

SEQ ID NO: 656177 - RNA, 18 nt, Human
auggagccgcuggaaccu

SEQ ID NO: 656178 - RNA, 22 nt, Human
caaccgacagccgcgcaggcgc

SEQ ID NO: 656179 - RNA, 20 nt, Human
cagccuuucccuuuugagcc

SEQ ID NO: 656180 - RNA, 23 nt, Human
ccagaccugaccuccccaucaac

SEQ ID NO: 656181 - RNA, 18 nt, Human
ccaguucaaguacugcuc

SEQ ID NO: 656182 - RNA, 23 nt, Human
cccacaguggcugcacucaccca

SEQ ID NO: 656183 - RNA, 21 nt, Human
cgagaggaauuugcgcccaca

SEQ ID NO: 656184 - RNA, 24 nt, Human
cgagaggaauuugcgcccacagug

SEQ ID NO: 656185 - RNA, 25 nt, Human
cgccugaggcccucgggcaccgcuc

SEQ ID NO: 656186 - RNA, 19 nt, Human
cugugcccuuagcccgggc

SEQ ID NO: 656187 - RNA, 21 nt, Human
cuuuugagccucuggauucua

SEQ ID NO: 656188 - RNA, 19 nt, Human
gaagagaagcagagcuuuc

SEQ ID NO: 656189 - RNA, 25 nt, Human
gaggagucuggugccauggacaggc

SEQ ID NO: 656190 - RNA, 22 nt, Human
gcaagaaaagagcuuuaaugga

SEQ ID NO: 656191 - RNA, 21 nt, Human
gcaagugugaacaguuuccac

SEQ ID NO: 656192 - RNA, 19 nt, Human
gccugaggcccucgggcac

SEQ ID NO: 656193 - RNA, 26 nt, Human
gcuccuggggaguauaauuuucugua

SEQ ID NO: 656194 - RNA, 21 nt, Human
ggcaauaacauaaagcauacc

SEQ ID NO: 656195 - RNA, 24 nt, Human
gugcccuuagcccgggcccuggag

SEQ ID NO: 656196 - RNA, 22 nt, Human
guugcuuuuauuaccuuuaacu

SEQ ID NO: 656197 - RNA, 20 nt, Human
uauccaaaaguuuccauugu

SEQ ID NO: 656198 - RNA, 25 nt, Human
ucaaguacugcucuaguucugugcc

SEQ ID NO: 656199 - RNA, 20 nt, Human
ucagggaaaaccccagggcc

SEQ ID NO: 656200 - RNA, 21 nt, Human
ucagggccuggacugacgccu

SEQ ID NO: 656201 - RNA, 22 nt, Human
ucaugcuucuaucuccaguugc

SEQ ID NO: 656202 - RNA, 19 nt, Human
uccugcucagggaaaaccc

SEQ ID NO: 656203 - RNA, 19 nt, Human
ucuacuaaauucuuccuca

SEQ ID NO: 656204 - RNA, 23 nt, Human
ucuauaaucagagaacuggaaug

SEQ ID NO: 656205 - RNA, 21 nt, Human
ucucuccucacagauuuuagc

SEQ ID NO: 656206 - RNA, 24 nt, Human
ucuuacacuugggaauguguugcu

SEQ ID NO: 656207 - RNA, 23 nt, Human
ugaaggcggggagaauuucucca

SEQ ID NO: 656208 - RNA, 22 nt, Human
ugaggacacugaaugcagucug

SEQ ID NO: 656209 - RNA, 19 nt, Human
ugcuggaccucucgagccu

SEQ ID NO: 656210 - RNA, 19 nt, Human
ugcuuuuauuaccuuuaac

SEQ ID NO: 656211 - RNA, 24 nt, Human
uggaaccugaggagucuggugcca

SEQ ID NO: 656212 - RNA, 19 nt, Human
uggaauggaacugaauuuu

SEQ ID NO: 656213 - RNA, 18 nt, Human
uggcugcacucacccagc

SEQ ID NO: 656214 - RNA, 24 nt, Human
ugggaauguguugcucagccaccu

SEQ ID NO: 656215 - RNA, 20 nt, Human
uggguuuucugcaggcagga

SEQ ID NO: 656216 - RNA, 24 nt, Human
ugucucuacuaaauucuuccucaa

SEQ ID NO: 656217 - RNA, 21 nt, Human
uuagcccgggcccuggaggag

SEQ ID NO: 656218 - RNA, 20 nt, Human
uuccaccuuuggcaguuacc

SEQ ID NO: 656219 - RNA, 21 nt, Human
uucccagaccugaccucccca

SEQ ID NO: 656220 - RNA, 23 nt, Human
uucccagaccugaccuccccauc

SEQ ID NO: 656221 - RNA, 21 nt, Human
uuucccagaccugaccucccc

SEQ ID NO: 656222 - RNA, 25 nt, Human
uuuuuuuuuuugcaagaaaagagcu

SEQ ID NO: 656223 - RNA, 18 nt, Human
uuuuuuuuuuuuuuuuug

SEQ ID NO: 656224 - RNA, 18 nt, Human
aaacaggacguccccagg

SEQ ID NO: 656225 - RNA, 22 nt, Human
aaagcccuuguccacccugccu

SEQ ID NO: 656226 - RNA, 18 nt, Human
aaagugcugggauuagac

SEQ ID NO: 656227 - RNA, 21 nt, Human
aaagugcugggauuagacucc

SEQ ID NO: 656228 - RNA, 22 nt, Human
aaagugcugggauuagacucca

SEQ ID NO: 656229 - RNA, 18 nt, Human
aagugcugggauuagacu

SEQ ID NO: 656230 - RNA, 26 nt, Human
acacaaucaacacucacuggacacgu

SEQ ID NO: 656231 - RNA, 24 nt, Human
acacugccagaaaaaucucaagag

SEQ ID NO: 656232 - RNA, 18 nt, Human
acagacgagguuucaaca

SEQ ID NO: 656233 - RNA, 20 nt, Human
acagacgagguuucaacaug

SEQ ID NO: 656234 - RNA, 22 nt, Human
accccuccauaucuggaaacuu

SEQ ID NO: 656235 - RNA, 25 nt, Human
acccgccucggccucccaaagugcu

SEQ ID NO: 656236 - RNA, 24 nt, Human
acgagguuucaacauguuggccag

SEQ ID NO: 656237 - RNA, 23 nt, Human
acuccauucuugccaacugcagu

SEQ ID NO: 656238 - RNA, 23 nt, Human
agaaaguaauaggagcgauuggc

SEQ ID NO: 656239 - RNA, 18 nt, Human
agaggaccgugcaggcuu

SEQ ID NO: 656240 - RNA, 24 nt, Human
agaggagaagaggaccgugcaggc

SEQ ID NO: 656241 - RNA, 22 nt, Human
agccaacuucccucuguuuacc

SEQ ID NO: 656242 - RNA, 23 nt, Human
aggauacugaucacuacuggcuc

SEQ ID NO: 656243 - RNA, 22 nt, Human
aggcucaggugaugccagcagg

SEQ ID NO: 656244 - RNA, 24 nt, Human
aggugauccacccgccucggccuc

SEQ ID NO: 656245 - RNA, 20 nt, Human
augccacucuccuccucuca

SEQ ID NO: 656246 - RNA, 21 nt, Human
caaaacaaaauguaugcuguu

SEQ ID NO: 656247 - RNA, 25 nt, Human
caaagugcugggauuagacuccagu

SEQ ID NO: 656248 - RNA, 25 nt, Human
caaauuccugaccucaggugaucca

SEQ ID NO: 656249 - RNA, 24 nt, Human
caacauguuggccagguuggucuc

SEQ ID NO: 656250 - RNA, 22 nt, Human
caagaccacccuacagagcuga

SEQ ID NO: 656251 - RNA, 21 nt, Human
caaucaacacucacuggacac

SEQ ID NO: 656252 - RNA, 18 nt, Human
cacacaaucaacacucac

SEQ ID NO: 656253 - RNA, 23 nt, Human
cacacuugccaaacccagugaau

SEQ ID NO: 656254 - RNA, 23 nt, Human
cacccgccucggccucccaaagu

SEQ ID NO: 656255 - RNA, 23 nt, Human
caccucagacuggaauuagagac

SEQ ID NO: 656256 - RNA, 19 nt, Human
cacgcacaggcacucugcc

SEQ ID NO: 656257 - RNA, 23 nt, Human
cacugccagaaaaaucucaagag

SEQ ID NO: 656258 - RNA, 23 nt, Human
cagcacacuugccaaacccagug

SEQ ID NO: 656259 - RNA, 20 nt, Human
caggacguccccagggcaga

SEQ ID NO: 656260 - RNA, 18 nt, Human
cauguuggccagguuggu

SEQ ID NO: 656261 - RNA, 20 nt, Human
ccaaagugcugggauuagac

SEQ ID NO: 656262 - RNA, 20 nt, Human
ccaaagugcugggauuagac

SEQ ID NO: 656263 - RNA, 23 nt, Human
ccaaagugcugggauuagacucc

SEQ ID NO: 656264 - RNA, 21 nt, Human
ccacacacaaucaacacucac

SEQ ID NO: 656265 - RNA, 21 nt, Human
ccagcacacuugccaaaccca

SEQ ID NO: 656266 - RNA, 21 nt, Human
ccagggcagaaaguaauagga

SEQ ID NO: 656267 - RNA, 20 nt, Human
ccauucuugccaacugcagu

SEQ ID NO: 656268 - RNA, 21 nt, Human
ccgugcaggcuugaagcagca

SEQ ID NO: 656269 - RNA, 18 nt, Human
ccucacgcacaggcacuc

SEQ ID NO: 656270 - RNA, 18 nt, Human
ccucgcccagcaccccag

SEQ ID NO: 656271 - RNA, 23 nt, Human
ccucucaccuuucucugugcaaa

SEQ ID NO: 656272 - RNA, 22 nt, Human
ccugaccucaggugauccaccc

SEQ ID NO: 656273 - RNA, 23 nt, Human
ccugaccucaggugauccacccg

SEQ ID NO: 656274 - RNA, 24 nt, Human
cgagguuucaacauguuggccagg

SEQ ID NO: 656275 - RNA, 24 nt, Human
cgccucggccucccaaagugcugg

SEQ ID NO: 656276 - RNA, 18 nt, Human
cuccuccagccaacuucc

SEQ ID NO: 656277 - RNA, 18 nt, Human
cucuguuuaccaggcccc

SEQ ID NO: 656278 - RNA, 18 nt, Human
gaagaagcugggguaaag

SEQ ID NO: 656279 - RNA, 24 nt, Human
gaccucaggugauccacccgccuc

SEQ ID NO: 656280 - RNA, 23 nt, Human
gagacuuuauccacgugggacag

SEQ ID NO: 656281 - RNA, 20 nt, Human
gagcagaggcguuacagggg

SEQ ID NO: 656282 - RNA, 23 nt, Human
gagcagaggcguuacagggguag

SEQ ID NO: 656283 - RNA, 21 nt, Human
gauacugaucacuacuggcuc

SEQ ID NO: 656284 - RNA, 20 nt, Human
gcaaggucugugccugcaga

SEQ ID NO: 656285 - RNA, 21 nt, Human
gccagguuggucucaaauucc

SEQ ID NO: 656286 - RNA, 20 nt, Human
gccucgcccagcaccccagc

SEQ ID NO: 656287 - RNA, 24 nt, Human
ggagcucccugcacaaagcccuuc

SEQ ID NO: 656288 - RNA, 20 nt, Human
ggcucaggugaugccagcag

SEQ ID NO: 656289 - RNA, 20 nt, Human
gggcauaucugcugaaaaua

SEQ ID NO: 656290 - RNA, 20 nt, Human
ggucucaaauuccugaccuc

SEQ ID NO: 656291 - RNA, 22 nt, Human
guacgcgggguucuugcacucc

SEQ ID NO: 656292 - RNA, 20 nt, Human
gugaaauaaugcuguguugc

SEQ ID NO: 656293 - RNA, 24 nt, Human
gugauccacccgccucggccuccc

SEQ ID NO: 656294 - RNA, 21 nt, Human
guuugacaggcaugcagaugu

SEQ ID NO: 656295 - RNA, 24 nt, Human
uaaagcaaacauuaaaugaaagca

SEQ ID NO: 656296 - RNA, 19 nt, Human
uaagaggcagaggguggcg

SEQ ID NO: 656297 - RNA, 20 nt, Human
uagaccuuacacugccagaa

SEQ ID NO: 656298 - RNA, 18 nt, Human
uagcacaagugugccugg

SEQ ID NO: 656299 - RNA, 23 nt, Human
uaguacagacgagguuucaacau

SEQ ID NO: 656300 - RNA, 24 nt, Human
uaguacagacgagguuucaacaug

SEQ ID NO: 656301 - RNA, 24 nt, Human
ucaaggccccuucccaguuucucu

SEQ ID NO: 656302 - RNA, 20 nt, Human
uccagccaacuucccucugu

SEQ ID NO: 656303 - RNA, 18 nt, Human
ucccaaagugcugggauu

SEQ ID NO: 656304 - RNA, 18 nt, Human
uccuccagccaacuuccc

SEQ ID NO: 656305 - RNA, 23 nt, Human
uccuccucucaccuuucucugug

SEQ ID NO: 656306 - RNA, 18 nt, Human
ucggccucccaaagugcu

SEQ ID NO: 656307 - RNA, 21 nt, Human
ucuccuccucucaccuuucuc

SEQ ID NO: 656308 - RNA, 25 nt, Human
ucucuugcuuucugccuucucugau

SEQ ID NO: 656309 - RNA, 21 nt, Human
ucugcugaaaauaccccucca

SEQ ID NO: 656310 - RNA, 22 nt, Human
ucugcuuugaggggucacgguc

SEQ ID NO: 656311 - RNA, 24 nt, Human
ucuucugaacggacagcccagccc

SEQ ID NO: 656312 - RNA, 22 nt, Human
ugaacggacagcccagcccuug

SEQ ID NO: 656313 - RNA, 23 nt, Human
ugaacggacagcccagcccuugu

SEQ ID NO: 656314 - RNA, 18 nt, Human
ugaagcagcaggauacug

SEQ ID NO: 656315 - RNA, 21 nt, Human
ugaagguauaucaauugcuau

SEQ ID NO: 656316 - RNA, 21 nt, Human
ugaccucaggugauccacccg

SEQ ID NO: 656317 - RNA, 24 nt, Human
ugaccucaggugauccacccgccu

SEQ ID NO: 656318 - RNA, 21 nt, Human
ugcaagaccacccuacagagc

SEQ ID NO: 656319 - RNA, 20 nt, Human
ugcagaugugcggagaggag

SEQ ID NO: 656320 - RNA, 24 nt, Human
uggccagguuggucucaaauuccu

SEQ ID NO: 656321 - RNA, 23 nt, Human
ugguguagaccuuacacugccag

SEQ ID NO: 656322 - RNA, 18 nt, Human
ugugcaaagaaaugcaau

SEQ ID NO: 656323 - RNA, 26 nt, Human
ugugccugcagagcugaugaauucac

SEQ ID NO: 656324 - RNA, 21 nt, Human
uucacaugguggcgggcagca

SEQ ID NO: 656325 - RNA, 22 nt, Human
uuccuagugcaaggucugugcc

SEQ ID NO: 656326 - RNA, 19 nt, Human
uuucaacauguuggccagg

SEQ ID NO: 656327 - RNA, 20 nt, Human
uuucaacauguuggccaggu

SEQ ID NO: 656328 - RNA, 23 nt, Human
uuucucuugcuuucugccuucuc

SEQ ID NO: 656329 - RNA, 25 nt, Human
uuuuuuuuuuuuuuuuuuuauuuuu

SEQ ID NO: 656330 - RNA, 21 nt, Human
aaaagggucaacaaacuucag

SEQ ID NO: 656331 - RNA, 21 nt, Human
aaacugaugggggaggccaga

SEQ ID NO: 656332 - RNA, 19 nt, Human
aaacugaugggggaggccg

SEQ ID NO: 656333 - RNA, 22 nt, Human
aaggagccccaaaggguaacuc

SEQ ID NO: 656334 - RNA, 18 nt, Human
acagccccccuccugccc

SEQ ID NO: 656335 - RNA, 20 nt, Human
acccgggaucccccaagggc

SEQ ID NO: 656336 - RNA, 19 nt, Human
aggaauguaaaggcuaagc

SEQ ID NO: 656337 - RNA, 21 nt, Human
auaugugugugcaugugugua

SEQ ID NO: 656338 - RNA, 22 nt, Human
aucccauacaaugugauuucac

SEQ ID NO: 656339 - RNA, 21 nt, Human
caacaaacuucagcuggagua

SEQ ID NO: 656340 - RNA, 25 nt, Human
cagaacaggauccugcaccccugcu

SEQ ID NO: 656341 - RNA, 18 nt, Human
cagaagccugacugcuga

SEQ ID NO: 656342 - RNA, 24 nt, Human
cagagaacccuggagccaccgcca

SEQ ID NO: 656343 - RNA, 18 nt, Human
cagcaaggaguucagggg

SEQ ID NO: 656344 - RNA, 22 nt, Human
caggauccugcaccccugcucc

SEQ ID NO: 656345 - RNA, 19 nt, Human
cauaugugugugcaugugu

SEQ ID NO: 656346 - RNA, 22 nt, Human
caugugugugcauaugugugug

SEQ ID NO: 656347 - RNA, 21 nt, Human
ccagaagccugacugcugaga

SEQ ID NO: 656348 - RNA, 18 nt, Human
ccaggcgaguaacuucuc

SEQ ID NO: 656349 - RNA, 20 nt, Human
cccuaccucaagugcuuccc

SEQ ID NO: 656350 - RNA, 22 nt, Human
ccuccugcccuaccucaagugc

SEQ ID NO: 656351 - RNA, 24 nt, Human
ccuccugcccuaccucaagugcuu

SEQ ID NO: 656352 - RNA, 23 nt, Human
ccugcauauccagcaaauacuaa

SEQ ID NO: 656353 - RNA, 19 nt, Human
ccuggagccaccgccaggc

SEQ ID NO: 656354 - RNA, 20 nt, Human
cgggccagccagcucugaug

SEQ ID NO: 656355 - RNA, 24 nt, Human
cguacuccgcuguacacgugugca

SEQ ID NO: 656356 - RNA, 19 nt, Human
cuauguuugcacaugugug

SEQ ID NO: 656357 - RNA, 20 nt, Human
cuccagagaaccagagaacc

SEQ ID NO: 656358 - RNA, 21 nt, Human
cuccagagaaccagagaaccc

SEQ ID NO: 656359 - RNA, 18 nt, Human
cugcaccccugcuccugc

SEQ ID NO: 656360 - RNA, 22 nt, Human
cugcaccccugcuccugcaaac

SEQ ID NO: 656361 - RNA, 22 nt, Human
gaccuggggauggcaggaaggc

SEQ ID NO: 656362 - RNA, 24 nt, Human
gagaccuucccgaacacagagaca

SEQ ID NO: 656363 - RNA, 24 nt, Human
gagccugaggucucuggcggggaa

SEQ ID NO: 656364 - RNA, 18 nt, Human
gcaaauacauaauuuggu

SEQ ID NO: 656365 - RNA, 21 nt, Human
gcaccccugcuccugcaaacu

SEQ ID NO: 656366 - RNA, 21 nt, Human
gccccgggccagccagcucug

SEQ ID NO: 656367 - RNA, 18 nt, Human
ggagccuguggaaugugc

SEQ ID NO: 656368 - RNA, 22 nt, Human
gggucaggcugcagccccgggc

SEQ ID NO: 656369 - RNA, 18 nt, Human
gugccucugggcuugcug

SEQ ID NO: 656370 - RNA, 19 nt, Human
guggaaugugcugagagcc

SEQ ID NO: 656371 - RNA, 19 nt, Human
guggaaugugcugagagcc

SEQ ID NO: 656372 - RNA, 31 nt, Human
gugugugcauguguguaaugcaugugcauag

SEQ ID NO: 656373 - RNA, 21 nt, Human
uaaggagccccaaaggguaac

SEQ ID NO: 656374 - RNA, 20 nt, Human
uaccucaagugcuucccagc

SEQ ID NO: 656375 - RNA, 23 nt, Human
uauaaacacaaggcccuuucuga

SEQ ID NO: 656376 - RNA, 24 nt, Human
ucaagugcuucccagcggagggcc

SEQ ID NO: 656377 - RNA, 22 nt, Human
ucacccgggaucccccaagggc

SEQ ID NO: 656378 - RNA, 22 nt, Human
uccauaaauccccuguggacaa

SEQ ID NO: 656379 - RNA, 23 nt, Human
ucccgaacacagagacaucugau

SEQ ID NO: 656380 - RNA, 25 nt, Human
ucucuggcggggaaagggcaggggu

SEQ ID NO: 656381 - RNA, 21 nt, Human
ugagaccuggggauggcagga

SEQ ID NO: 656382 - RNA, 23 nt, Human
ugaggucucuggcggggaaaggg

SEQ ID NO: 656383 - RNA, 22 nt, Human
ugaugggggaggccagaggagg

SEQ ID NO: 656384 - RNA, 18 nt, Human
ugcauguguguaaugcau

SEQ ID NO: 656385 - RNA, 22 nt, Human
ugcccaagcuggcccaggccuc

SEQ ID NO: 656386 - RNA, 28 nt, Human
ugcccaagcuggcccaggccucggggac

SEQ ID NO: 656387 - RNA, 20 nt, Human
ugcuuuguuugacccagcuc

SEQ ID NO: 656388 - RNA, 23 nt, Human
uggcuauguuugcacaugugugu

SEQ ID NO: 656389 - RNA, 27 nt, Human
uggcuauguuugcacaugugugugcaa

SEQ ID NO: 656390 - RNA, 22 nt, Human
uggggauggcaggaaggcccgg

SEQ ID NO: 656391 - RNA, 19 nt, Human
ugggggaggccagaggagg

SEQ ID NO: 656392 - RNA, 21 nt, Human
ugggggaugggguauucagag

SEQ ID NO: 656393 - RNA, 26 nt, Human
ugguuuaaggagccccaaaggguaac

SEQ ID NO: 656394 - RNA, 23 nt, Human
ugugcauaugugugugcaugugu

SEQ ID NO: 656395 - RNA, 21 nt, Human
ugugugcauaugugugugcau

SEQ ID NO: 656396 - RNA, 23 nt, Human
ugugugcauaugugugugcaugu

SEQ ID NO: 656397 - RNA, 29 nt, Human
ugugugcauaugugugugcauguguguaa

SEQ ID NO: 656398 - RNA, 29 nt, Human
ugugugcauaugugugugcauguguguag

SEQ ID NO: 656399 - RNA, 19 nt, Human
ugugugugcauaugugugu

SEQ ID NO: 656400 - RNA, 28 nt, Human
uguuugcacaugugugugcauaugugug

SEQ ID NO: 656401 - RNA, 21 nt, Human
uucacaaccagaagccugacu

SEQ ID NO: 656402 - RNA, 18 nt, Human
uucaggggagaacuccau

SEQ ID NO: 656403 - RNA, 23 nt, Human
uucuuagcagcaaggaguucagg

SEQ ID NO: 656404 - RNA, 25 nt, Human
uucuuagcagcaaggaguucagggg

SEQ ID NO: 656405 - RNA, 21 nt, Human
uugaagaaucuguuuauuuug

SEQ ID NO: 656406 - RNA, 24 nt, Human
uuugacccagcucagaacaggauc

SEQ ID NO: 656407 - RNA, 24 nt, Human
aaagugcugggauuggaggcauga

SEQ ID NO: 656408 - RNA, 19 nt, Human
aacagcuuuacugagaugu

SEQ ID NO: 656409 - RNA, 21 nt, Human
aagugauuggcucaaaacauc

SEQ ID NO: 656410 - RNA, 19 nt, Human
aagugcugggauuggaggc

SEQ ID NO: 656411 - RNA, 26 nt, Human
aagugcugggauuggaggcaugagcc

SEQ ID NO: 656412 - RNA, 21 nt, Human
acaaaggaaaaacuuucugga

SEQ ID NO: 656413 - RNA, 23 nt, Human
acagaaaagagaaagagaggccg

SEQ ID NO: 656414 - RNA, 20 nt, Human
acagagagagacagaaaaga

SEQ ID NO: 656415 - RNA, 20 nt, Human
acaggguuucacuguauuag

SEQ ID NO: 656416 - RNA, 19 nt, Human
acccaggcuggaguacagu

SEQ ID NO: 656417 - RNA, 25 nt, Human
acccgccucagccucccaaagugcu

SEQ ID NO: 656418 - RNA, 26 nt, Human
accuaggaguggaguugccaacuggu

SEQ ID NO: 656419 - RNA, 21 nt, Human
agacagaaaagagaaagagag

SEQ ID NO: 656420 - RNA, 18 nt, Human
agacaggguuucacugua

SEQ ID NO: 656421 - RNA, 19 nt, Human
agagacagaaaagagaaag

SEQ ID NO: 656422 - RNA, 19 nt, Human
agagacaggguuucacugu

SEQ ID NO: 656423 - RNA, 20 nt, Human
agauacuucaaucacaugau

SEQ ID NO: 656424 - RNA, 21 nt, Human
agcagauucaauaaucaugga

SEQ ID NO: 656425 - RNA, 24 nt, Human
aggacaagacaggccuucugccaa

SEQ ID NO: 656426 - RNA, 19 nt, Human
aggcaugagccaccaugcc

SEQ ID NO: 656427 - RNA, 22 nt, Human
aggugccugccaccaaguccag

SEQ ID NO: 656428 - RNA, 19 nt, Human
aguacaguggugcaguggu

SEQ ID NO: 656429 - RNA, 21 nt, Human
aguagcugggauuacaggugc

SEQ ID NO: 656430 - RNA, 23 nt, Human
aucaaagugauuggcucaaaaca

SEQ ID NO: 656431 - RNA, 20 nt, Human
aucuauaaacugaggcagca

SEQ ID NO: 656432 - RNA, 21 nt, Human
auguaacucacauaccauaca

SEQ ID NO: 656433 - RNA, 22 nt, Human
augugcgugcaugugugugugu

SEQ ID NO: 656434 - RNA, 22 nt, Human
augugugugugugugugugugu

SEQ ID NO: 656435 - RNA, 23 nt, Human
auguguguguguguguguguguu

SEQ ID NO: 656436 - RNA, 19 nt, Human
auuacaggugccugccacc

SEQ ID NO: 656437 - RNA, 19 nt, Human
caaagugauuggcucaaaa

SEQ ID NO: 656438 - RNA, 24 nt, Human
caaagugcugggauuggaggcaug

SEQ ID NO: 656439 - RNA, 21 nt, Human
caaccuuugacucccagguuc

SEQ ID NO: 656440 - RNA, 18 nt, Human
cacaaucaacuuuagaac

SEQ ID NO: 656441 - RNA, 21 nt, Human
caccaaguccagcuaauuuuu

SEQ ID NO: 656442 - RNA, 18 nt, Human
caccaugccugguccauu

SEQ ID NO: 656443 - RNA, 23 nt, Human
cacccgccucagccucccaaagu

SEQ ID NO: 656444 - RNA, 18 nt, Human
cacuguauuagccaggau

SEQ ID NO: 656445 - RNA, 24 nt, Human
cacuguauuagccaggauggucuc

SEQ ID NO: 656446 - RNA, 23 nt, Human
cagaaagacacacagagagagac

SEQ ID NO: 656447 - RNA, 23 nt, Human
cagagaauacugcagcgaagcac

SEQ ID NO: 656448 - RNA, 23 nt, Human
cagcaauucagggcugagguaaa

SEQ ID NO: 656449 - RNA, 24 nt, Human
caggguuucacuguauuagccagg

SEQ ID NO: 656450 - RNA, 18 nt, Human
caggugccugccaccaag

SEQ ID NO: 656451 - RNA, 20 nt, Human
cagucuccugaguagcuggg

SEQ ID NO: 656452 - RNA, 24 nt, Human
caugagccaccaugccugguccau

SEQ ID NO: 656453 - RNA, 24 nt, Human
caugugugugugugugugugugag

SEQ ID NO: 656454 - RNA, 23 nt, Human
caugugugugugugugugugugu

SEQ ID NO: 656455 - RNA, 24 nt, Human
ccaaagugcugggauuggaggcau

SEQ ID NO: 656456 - RNA, 22 nt, Human
ccaccaugccugguccauugua

SEQ ID NO: 656457 - RNA, 19 nt, Human
ccaccccuaagcaaccacu

SEQ ID NO: 656458 - RNA, 26 nt, Human
ccacccgccucagccucccaaagugc

SEQ ID NO: 656459 - RNA, 20 nt, Human
cccagguucaagcaauuccu

SEQ ID NO: 656460 - RNA, 20 nt, Human
cccagguucaagcaauuccu

SEQ ID NO: 656461 - RNA, 24 nt, Human
ccccuaagcaaccacuaaguguuu

SEQ ID NO: 656462 - RNA, 24 nt, Human
ccgccucagccucccaaagugcug

SEQ ID NO: 656463 - RNA, 20 nt, Human
ccugaccucgugauccaccc

SEQ ID NO: 656464 - RNA, 22 nt, Human
ccugaguagcugggauuacagg

SEQ ID NO: 656465 - RNA, 23 nt, Human
ccugaguagcugggauuacaggu

SEQ ID NO: 656466 - RNA, 24 nt, Human
ccugaguagcugggauuacaggug

SEQ ID NO: 656467 - RNA, 24 nt, Human
cgccucagccucccaaagugcugg

SEQ ID NO: 656468 - RNA, 20 nt, Human
cggaaucauacaguaugugg

SEQ ID NO: 656469 - RNA, 24 nt, Human
cgugauccacccgccucagccucc

SEQ ID NO: 656470 - RNA, 21 nt, Human
cuaaucaagcuagaauagcaa

SEQ ID NO: 656471 - RNA, 24 nt, Human
cucagucuccugaguagcugggau

SEQ ID NO: 656472 - RNA, 24 nt, Human
cuccugaccucgugauccacccgc

SEQ ID NO: 656473 - RNA, 21 nt, Human
cugaguagcugggauuacagg

SEQ ID NO: 656474 - RNA, 23 nt, Human
cugccucagucuccugaguagcu

SEQ ID NO: 656475 - RNA, 21 nt, Human
cuggaagucaguagcuuaaau

SEQ ID NO: 656476 - RNA, 20 nt, Human
cuggguuaacacuccuauau

SEQ ID NO: 656477 - RNA, 23 nt, Human
gaagcacccuguguuugcuuggg

SEQ ID NO: 656478 - RNA, 22 nt, Human
gaccucgugauccacccgccuc

SEQ ID NO: 656479 - RNA, 24 nt, Human
gaccucgugauccacccgccucag

SEQ ID NO: 656480 - RNA, 21 nt, Human
gagacagagucuuucuccguc

SEQ ID NO: 656481 - RNA, 23 nt, Human
gaguugccaacugguuccauuug

SEQ ID NO: 656482 - RNA, 18 nt, Human
gauuacaggugccugcca

SEQ ID NO: 656483 - RNA, 18 nt, Human
gauuggaggcaugagcca

SEQ ID NO: 656484 - RNA, 24 nt, Human
gauuggaggcaugagccaccaugc

SEQ ID NO: 656485 - RNA, 22 nt, Human
gcaaccuuugacucccagguuc

SEQ ID NO: 656486 - RNA, 19 nt, Human
gcaugcauagcagauucaa

SEQ ID NO: 656487 - RNA, 25 nt, Human
gcaugugugugugugugugugugug

SEQ ID NO: 656488 - RNA, 22 nt, Human
gcccuuguccuuaggagucuau

SEQ ID NO: 656489 - RNA, 24 nt, Human
gccucagucuccugaguagcuggg

SEQ ID NO: 656490 - RNA, 18 nt, Human
ggaguugaaaagauggca

SEQ ID NO: 656491 - RNA, 24 nt, Human
ggauuggaggcaugagccaccaug

SEQ ID NO: 656492 - RNA, 18 nt, Human
ggccuggugauugggcug

SEQ ID NO: 656493 - RNA, 24 nt, Human
ggcuggaguacaguggugcagugg

SEQ ID NO: 656494 - RNA, 21 nt, Human
gggcaaagauagccucugaga

SEQ ID NO: 656495 - RNA, 21 nt, Human
gggcaugaucacagcgaugac

SEQ ID NO: 656496 - RNA, 20 nt, Human
ggucucgaucuccugaccuc

SEQ ID NO: 656497 - RNA, 23 nt, Human
ggugcaguggugcgaucucggcu

SEQ ID NO: 656498 - RNA, 18 nt, Human
guagcugggauuacaggu

SEQ ID NO: 656499 - RNA, 24 nt, Human
guccagcuaauuuuuuuguauuuu

SEQ ID NO: 656500 - RNA, 24 nt, Human
gugauccacccgccucagccuccc

SEQ ID NO: 656501 - RNA, 19 nt, Human
gugcaguggugcgaucucg

SEQ ID NO: 656502 - RNA, 23 nt, Human
gugcaguggugcgaucucggcuc

SEQ ID NO: 656503 - RNA, 21 nt, Human
gugugugugugugugugugug

SEQ ID NO: 656504 - RNA, 18 nt, Human
uaacacuccuauauugug

SEQ ID NO: 656505 - RNA, 20 nt, Human
uacaggugccugccaccaag

SEQ ID NO: 656506 - RNA, 18 nt, Human
uaccauacacuucauuca

SEQ ID NO: 656507 - RNA, 24 nt, Human
uaccauacacuucauucauuuaaa

SEQ ID NO: 656508 - RNA, 19 nt, Human
uaccuaggaguggaguugc

SEQ ID NO: 656509 - RNA, 18 nt, Human
uagaauagcaaguuggag

SEQ ID NO: 656510 - RNA, 19 nt, Human
uagaauagcaaguuggagg

SEQ ID NO: 656511 - RNA, 20 nt, Human
uaguagagacaggguuucac

SEQ ID NO: 656512 - RNA, 22 nt, Human
uaguagagacaggguuucacug

SEQ ID NO: 656513 - RNA, 24 nt, Human
uaguagagacaggguuucacugua

SEQ ID NO: 656514 - RNA, 19 nt, Human
uauagcuuuaggggagcca

SEQ ID NO: 656515 - RNA, 20 nt, Human
uaugugcgugcaugugugug

SEQ ID NO: 656516 - RNA, 24 nt, Human
uaugugcgugcaugugugugugug

SEQ ID NO: 656517 - RNA, 22 nt, Human
ucaaaacauccuacaaaggaaa

SEQ ID NO: 656518 - RNA, 19 nt, Human
ucacugcaaccuuugacuc

SEQ ID NO: 656519 - RNA, 24 nt, Human
ucacugcaaccuuugacucccagg

SEQ ID NO: 656520 - RNA, 24 nt, Human
ucacuguauuagccaggauggucu

SEQ ID NO: 656521 - RNA, 23 nt, Human
ucagucuccugaguagcugggau

SEQ ID NO: 656522 - RNA, 22 nt, Human
ucauuuaaaguguacaauucaa

SEQ ID NO: 656523 - RNA, 21 nt, Human
uccacccgccucagccuccca

SEQ ID NO: 656524 - RNA, 24 nt, Human
uccaucuauaaacugaggcagcau

SEQ ID NO: 656525 - RNA, 24 nt, Human
ucccaaagugcugggauuggaggc

SEQ ID NO: 656526 - RNA, 19 nt, Human
ucccagaggcagagaauac

SEQ ID NO: 656527 - RNA, 21 nt, Human
ucccagaggcagagaauacug

SEQ ID NO: 656528 - RNA, 19 nt, Human
ucccagguucaagcaauuc

SEQ ID NO: 656529 - RNA, 24 nt, Human
ucccagguucaagcaauuccucug

SEQ ID NO: 656530 - RNA, 24 nt, Human
uccgucacccaggcuggaguacag

SEQ ID NO: 656531 - RNA, 20 nt, Human
uccugaacccccaccccuaa

SEQ ID NO: 656532 - RNA, 24 nt, Human
uccugaguagcugggauuacaggu

SEQ ID NO: 656533 - RNA, 21 nt, Human
ucuccgucacccaggcuggag

SEQ ID NO: 656534 - RNA, 25 nt, Human
ucuccgucacccaggcuggaguaca

SEQ ID NO: 656535 - RNA, 24 nt, Human
ucuuucuccgucacccaggcugga

SEQ ID NO: 656536 - RNA, 21 nt, Human
ugaacccccaccccuaagcaa

SEQ ID NO: 656537 - RNA, 25 nt, Human
ugaacccccaccccuaagcaaccac

SEQ ID NO: 656538 - RNA, 25 nt, Human
ugacucccagguucaagcaauuccu

SEQ ID NO: 656539 - RNA, 27 nt, Human
ugacucccagguucaagcaauuccuuu

SEQ ID NO: 656540 - RNA, 21 nt, Human
ugagauguaacucacauacca

SEQ ID NO: 656541 - RNA, 23 nt, Human
ugcaguggugcgaucucggcucc

SEQ ID NO: 656542 - RNA, 23 nt, Human
ugcaugcauagcagauucaauaa

SEQ ID NO: 656543 - RNA, 23 nt, Human
ugccucagucuccugaguagcug

SEQ ID NO: 656544 - RNA, 24 nt, Human
ugccucagucuccugaguagcugg

SEQ ID NO: 656545 - RNA, 19 nt, Human
ugcgugcaugugugugugu

SEQ ID NO: 656546 - RNA, 19 nt, Human
ugcgugcaugugugugugu

SEQ ID NO: 656547 - RNA, 28 nt, Human
uggaguacaguggugcaguggugcgauc

SEQ ID NO: 656548 - RNA, 20 nt, Human
uggcucaaaacauccuacaa

SEQ ID NO: 656549 - RNA, 19 nt, Human
uggcuucuuucauuuagua

SEQ ID NO: 656550 - RNA, 19 nt, Human
ugggaagucugggcaaaga

SEQ ID NO: 656551 - RNA, 21 nt, Human
ugggauuacaggugccugcca

SEQ ID NO: 656552 - RNA, 22 nt, Human
ugggauuacaggugccugccac

SEQ ID NO: 656553 - RNA, 24 nt, Human
ugggauuacaggugccugccacca

SEQ ID NO: 656554 - RNA, 18 nt, Human
ugggauuggaggcaugag

SEQ ID NO: 656555 - RNA, 23 nt, Human
ugggauuggaggcaugagccacc

SEQ ID NO: 656556 - RNA, 24 nt, Human
ugggauuggaggcaugagccacca

SEQ ID NO: 656557 - RNA, 21 nt, Human
ugugcgugcaugugugugugu

SEQ ID NO: 656558 - RNA, 31 nt, Human; identical to SEQ ID NO: 542246

SEQ ID NO: 656559 - RNA, 20 nt, Human
uguguguguguguguguaug

SEQ ID NO: 656560 - RNA, 18 nt, Human
ugugugugugugugugug

SEQ ID NO: 656561 - RNA, 18 nt, Human
ugugugugugugugugug

SEQ ID NO: 656562 - RNA, 18 nt, Human
ugugugugugugugugug

SEQ ID NO: 656563 - RNA, 18 nt, Human
ugugugugugugugugug

SEQ ID NO: 656564 - RNA, 18 nt, Human
ugugugugugugugugug

SEQ ID NO: 656565 - RNA, 18 nt, Human
ugugugugugugugugug

SEQ ID NO: 656566 - RNA, 18 nt, Human
ugugugugugugugugug

SEQ ID NO: 656567 - RNA, 18 nt, Human
ugugugugugugugugug

SEQ ID NO: 656568 - RNA, 18 nt, Human
ugugugugugugugugug

SEQ ID NO: 656569 - RNA, 18 nt, Human
ugugugugugugugugug

SEQ ID NO: 656570 - RNA, 18 nt, Human
ugugugugugugugugug

SEQ ID NO: 656571 - RNA, 21 nt, Human
ugugugugugugugugugugu

SEQ ID NO: 656572 - RNA, 21 nt, Human
ugugugugugugugugugugu

SEQ ID NO: 656573 - RNA, 21 nt, Human
ugugugugugugugugugugu

SEQ ID NO: 656574 - RNA, 21 nt, Human
ugugugugugugugugugugu

SEQ ID NO: 656575 - RNA, 21 nt, Human
ugugugugugugugugugugu

SEQ ID NO: 656576 - RNA, 21 nt, Human
ugugugugugugugugugugu

SEQ ID NO: 656577 - RNA, 21 nt, Human
ugugugugugugugugugugu

SEQ ID NO: 656578 - RNA, 21 nt, Human
ugugugugugugugugugugu

SEQ ID NO: 656579 - RNA, 21 nt, Human
ugugugugugugugugugugu

SEQ ID NO: 656580 - RNA, 21 nt, Human
ugugugugugugugugugugu

SEQ ID NO: 656581 - RNA, 21 nt, Human
ugugugugugugugugugugu

SEQ ID NO: 656582 - RNA, 21 nt, Human
ugugugugugugugugugugu

SEQ ID NO: 656583 - RNA, 21 nt, Human
ugugugugugugugugugugu

SEQ ID NO: 656584 - RNA, 21 nt, Human
ugugugugugugugugugugu

SEQ ID NO: 656585 - RNA, 21 nt, Human
ugugugugugugugugugugu

SEQ ID NO: 656586 - RNA, 21 nt, Human
ugugugugugugugugugugu

SEQ ID NO: 656587 - RNA, 22 nt, Human
ugugugugugugugugugugua

SEQ ID NO: 656588 - RNA, 22 nt, Human
ugugugugugugugugugugug

SEQ ID NO: 656589 - RNA, 22 nt, Human
ugugugugugugugugugugug

SEQ ID NO: 656590 - RNA, 22 nt, Human
ugugugugugugugugugugug

SEQ ID NO: 656591 - RNA, 22 nt, Human
ugugugugugugugugugugug

SEQ ID NO: 656592 - RNA, 22 nt, Human
ugugugugugugugugugugug

SEQ ID NO: 656593 - RNA, 22 nt, Human
ugugugugugugugugugugug

SEQ ID NO: 656594 - RNA, 22 nt, Human
ugugugugugugugugugugug

SEQ ID NO: 656595 - RNA, 19 nt, Human
uguguuuaugugcgugcau

SEQ ID NO: 656596 - RNA, 19 nt, Human
uguuuaugugcgugcaugu

SEQ ID NO: 656597 - RNA, 21 nt, Human
uuaguagagacaggguuucac

SEQ ID NO: 656598 - RNA, 24 nt, Human
uuaguagagacaggguuucacugu

SEQ ID NO: 656599 - RNA, 21 nt, Human
uuaucugaaauuuuugcaugc

SEQ ID NO: 656600 - RNA, 29 nt, Human
uuaugugcgugcaugugugugugugugug

SEQ ID NO: 656601 - RNA, 24 nt, Human
uucaagcaauuccucugccucagu

SEQ ID NO: 656602 - RNA, 18 nt, Human
uucaaugcuuuuuaguau

SEQ ID NO: 656603 - RNA, 19 nt, Human
uucagggcugagguaaagg

SEQ ID NO: 656604 - RNA, 19 nt, Human
uuccucugccucagucucc

SEQ ID NO: 656605 - RNA, 21 nt, Human
uugcaugcauagcagauucaa

SEQ ID NO: 656606 - RNA, 21 nt, Human
uuuaaaguguacaauucaaug

SEQ ID NO: 656607 - RNA, 22 nt, Human
uuuacagagcugugcaaucauc

SEQ ID NO: 656608 - RNA, 24 nt, Human
uuucuccgucacccaggcuggagu

SEQ ID NO: 656609 - RNA, 24 nt, Human
uuuuuaguagagacaggguuucac

SEQ ID NO: 656610 - RNA, 21 nt, Human
uuuuuguauuuuuaguagaga

SEQ ID NO: 656611 - RNA, 21 nt, Human
uuuuuuguauuuuuaguagag

SEQ ID NO: 656612 - RNA, 24 nt, Human
uuuuuuguauuuuuaguagagaca

SEQ ID NO: 656613 - RNA, 18 nt, Human
aaagaaaggcacaucauu

SEQ ID NO: 656614 - RNA, 18 nt, Human
accgcucuucuuggucaa

SEQ ID NO: 656615 - RNA, 19 nt, Human
acuucaaccgcucuucuug

SEQ ID NO: 656616 - RNA, 21 nt, Human
agcaucuuaaacucaaauggc

SEQ ID NO: 656617 - RNA, 23 nt, Human
caggcaguuaaagaucauuacaa

SEQ ID NO: 656618 - RNA, 23 nt, Human
ccacaccgcacucccugauccug

SEQ ID NO: 656619 - RNA, 25 nt, Human
ccagcgccgacggaacucauccagg

SEQ ID NO: 656620 - RNA, 18 nt, Human
ccgcggccggaagccgcu

SEQ ID NO: 656621 - RNA, 22 nt, Human
ccggccgccgagcccgccucuc

SEQ ID NO: 656622 - RNA, 18 nt, Human
ccugcgccagcuccuccu

SEQ ID NO: 656623 - RNA, 23 nt, Human
cgccagcuccuccugccagcgcc

SEQ ID NO: 656624 - RNA, 19 nt, Human
cgcggccggaagccgcugc

SEQ ID NO: 656625 - RNA, 22 nt, Human
cuccagcuucauggcugcuucc

SEQ ID NO: 656626 - RNA, 23 nt, Human
cuccucgguuccaccgggugcca

SEQ ID NO: 656627 - RNA, 22 nt, Human
cugagcagccagaguuuccagc

SEQ ID NO: 656628 - RNA, 21 nt, Human
cugcugauucaauucaucugu

SEQ ID NO: 656629 - RNA, 21 nt, Human
cuuuaacuucaaccgcucuuc

SEQ ID NO: 656630 - RNA, 23 nt, Human
cuuuugcauugccugcugcugau

SEQ ID NO: 656631 - RNA, 24 nt, Human
gacacuccuccacuuucgcuacuc

SEQ ID NO: 656632 - RNA, 20 nt, Human
uagagcaucuuaaacucaaa

SEQ ID NO: 656633 - RNA, 22 nt, Human
uagcuuucugaggaaaacuaac

SEQ ID NO: 656634 - RNA, 24 nt, Human
uaggcgcucagcuuccagcaauuu

SEQ ID NO: 656635 - RNA, 23 nt, Human
uauacauauccaggacuucaucc

SEQ ID NO: 656636 - RNA, 20 nt, Human
uaucaaagaaaggcacauca

SEQ ID NO: 656637 - RNA, 21 nt, Human
uaucaaagaaaggcacaucau

SEQ ID NO: 656638 - RNA, 23 nt, Human
uauuuuauuaaauauuuggaagc

SEQ ID NO: 656639 - RNA, 21 nt, Human
uccuaugcugucgaaacugau

SEQ ID NO: 656640 - RNA, 26 nt, Human
uccugagcagccagaguuuccagcuu

SEQ ID NO: 656641 - RNA, 19 nt, Human
uccuuuaacuucaaccgcu

SEQ ID NO: 656642 - RNA, 19 nt, Human
ucguguacgagguccuguu

SEQ ID NO: 656643 - RNA, 18 nt, Human
ugaguuugguucuuuuac

SEQ ID NO: 656644 - RNA, 20 nt, Human
ugcauugccugcugcugauu

SEQ ID NO: 656645 - RNA, 22 nt, Human
uggcuucaaauacuagcuuucu

SEQ ID NO: 656646 - RNA, 18 nt, Human
ugugugucaggagcuggg

SEQ ID NO: 656647 - RNA, 22 nt, Human
uucauuucauucuccggccgcc

SEQ ID NO: 656648 - RNA, 23 nt, Human
uuccugagcagccagaguuucca

SEQ ID NO: 656649 - RNA, 22 nt, Human
uugccacuucuuccacaccgca

SEQ ID NO: 656650 - RNA, 19 nt, Human
uugccugcugcugauucaa

SEQ ID NO: 656651 - RNA, 19 nt, Human
aacaacagaaguagcugga

SEQ ID NO: 656652 - RNA, 18 nt, Human
aacacauuccaggagccu

SEQ ID NO: 656653 - RNA, 23 nt, Human
aaccuguccaucacugucuccua

SEQ ID NO: 656654 - RNA, 25 nt, Human
aagcaaaacacauuccaggagccug

SEQ ID NO: 656655 - RNA, 18 nt, Human
aaucuccacccuguucuc

SEQ ID NO: 656656 - RNA, 18 nt, Human
acuguaguugccauacag

SEQ ID NO: 656657 - RNA, 27 nt, Human
agaggguccaaagugcugauaugaagg

SEQ ID NO: 656658 - RNA, 25 nt, Human
aggcauauuucucaguucauacaca

SEQ ID NO: 656659 - RNA, 23 nt, Human
aguauccauuauaucuccccggc

SEQ ID NO: 656660 - RNA, 21 nt, Human
caaaacacauuccaggagccu

SEQ ID NO: 656661 - RNA, 21 nt, Human
caaaaucugggguacaguaug

SEQ ID NO: 656662 - RNA, 24 nt, Human
caaaguauccauuauaucuccccg

SEQ ID NO: 656663 - RNA, 27 nt, Human
caacggcuaaaagguuaggugcuccaa

SEQ ID NO: 656664 - RNA, 19 nt, Human
caacgucguaaacaacaga

SEQ ID NO: 656665 - RNA, 18 nt, Human
caauugaaaaauccacag

SEQ ID NO: 656666 - RNA, 26 nt, Human
cagcaguaacuccauauggacucuga

SEQ ID NO: 656667 - RNA, 27 nt, Human
cagcaguaacuccauauggacucugau

SEQ ID NO: 656668 - RNA, 22 nt, Human
caggucccaaauguuuuugagg

SEQ ID NO: 656669 - RNA, 18 nt, Human
ccaggcaacgucguaaac

SEQ ID NO: 656670 - RNA, 21 nt, Human
ccaggcaacgucguaaacaac

SEQ ID NO: 656671 - RNA, 21 nt, Human
ccauacaggucccaaauguuu

SEQ ID NO: 656672 - RNA, 24 nt, Human
ccaucuccuguuguuccucgaucu

SEQ ID NO: 656673 - RNA, 21 nt, Human
cccaaaucuccacccuguucu

SEQ ID NO: 656674 - RNA, 19 nt, Human
cccaaucugcagaacagcu

SEQ ID NO: 656675 - RNA, 24 nt, Human
gauagccaacggcuaaaagguuag

SEQ ID NO: 656676 - RNA, 18 nt, Human
uaaaaauacaucaugaca

SEQ ID NO: 656677 - RNA, 24 nt, Human
uaauaacaccccaaucugcagaac

SEQ ID NO: 656678 - RNA, 18 nt, Human
uacaggucccaaauguuu

SEQ ID NO: 656679 - RNA, 23 nt, Human
uagcaguauucacaaucagaggg

SEQ ID NO: 656680 - RNA, 23 nt, Human
uaucuccccggccaguuuccaaa

SEQ ID NO: 656681 - RNA, 18 nt, Human
uccaggagccugucgaga

SEQ ID NO: 656682 - RNA, 23 nt, Human
uccucgaucuuguucuauccacu

SEQ ID NO: 656683 - RNA, 23 nt, Human
ucuuucuuuuccuuuuccccucc

SEQ ID NO: 656684 - RNA, 20 nt, Human
ucuuuuccuuuuccccuccu

SEQ ID NO: 656685 - RNA, 20 nt, Human
ugaaaaauccacagcaguaa

SEQ ID NO: 656686 - RNA, 23 nt, Human
ugaaaaauccacagcaguaacuc

SEQ ID NO: 656687 - RNA, 18 nt, Human
ugcaaauauauaggauga

SEQ ID NO: 656688 - RNA, 22 nt, Human
ugccauugugauagccaacgga

SEQ ID NO: 656689 - RNA, 20 nt, Human
ugggaugaaaagcaaaacac

SEQ ID NO: 656690 - RNA, 23 nt, Human
uuggagauucuuccaucugcuga

SEQ ID NO: 656691 - RNA, 20 nt, Human
uuuauacacuggacccuugg

SEQ ID NO: 656692 - RNA, 19 nt, Human
uuuccccuccuuuuuuguu

SEQ ID NO: 656693 - RNA, 25 nt, Human
aaaaaaaaaaaaaaaaacaaauuua

SEQ ID NO: 656694 - RNA, 22 nt, Human
aaaaagccaaaaauaauuauag

SEQ ID NO: 656695 - RNA, 24 nt, Human
aaaaagccaaaaauaauuauagug

SEQ ID NO: 656696 - RNA, 21 nt, Human
aaaaauaaccaugcuauaguc

SEQ ID NO: 656697 - RNA, 20 nt, Human
aaaaauaucugaaacagagg

SEQ ID NO: 656698 - RNA, 23 nt, Human
aaccagucugaagacucccagac

SEQ ID NO: 656699 - RNA, 20 nt, Human
aagaaacccuauucuaaaac

SEQ ID NO: 656700 - RNA, 18 nt, Human
aagacaaacgugauaaug

SEQ ID NO: 656701 - RNA, 26 nt, Human
aagacaaacgugauaaugugauaaaa

SEQ ID NO: 656702 - RNA, 20 nt, Human
aaucucauuuccccuccauu

SEQ ID NO: 656703 - RNA, 23 nt, Human
accacauauauggaagaaaguca

SEQ ID NO: 656704 - RNA, 21 nt, Human
accuugaugacaucaacauua

SEQ ID NO: 656705 - RNA, 18 nt, Human
agaaauucagagccagcc

SEQ ID NO: 656706 - RNA, 23 nt, Human
agacagcaacacaacugaaucac

SEQ ID NO: 656707 - RNA, 20 nt, Human
agacagccaggcuuugaaug

SEQ ID NO: 656708 - RNA, 23 nt, Human
aggcugcucccagugcaucugcu

SEQ ID NO: 656709 - RNA, 19 nt, Human
aguacaauucucaaaaacc

SEQ ID NO: 656710 - RNA, 21 nt, Human
aguguucaucuccaaugaaga

SEQ ID NO: 656711 - RNA, 21 nt, Human
aguuauaauguuaccucuagg

SEQ ID NO: 656712 - RNA, 19 nt, Human
aguuuguuuaagaagugga

SEQ ID NO: 656713 - RNA, 19 nt, Human
auaaagacaaacgugauaa

SEQ ID NO: 656714 - RNA, 26 nt, Human
augaagauaaaauauaaagacaaacg

SEQ ID NO: 656715 - RNA, 23 nt, Human
auggauucugaaaaaaaaaaaaa

SEQ ID NO: 656716 - RNA, 20 nt, Human
auuuccccuccauuuguagg

SEQ ID NO: 656717 - RNA, 27 nt, Human
caaaaaccaucaauucaccccaaccaa

SEQ ID NO: 656718 - RNA, 19 nt, Human
caaaggcugcucccagugc

SEQ ID NO: 656719 - RNA, 20 nt, Human
caacugaaucacauugaccu

SEQ ID NO: 656720 - RNA, 21 nt, Human
caaguuacguggcccagccaa

SEQ ID NO: 656721 - RNA, 24 nt, Human
cacaacuucuguuuuccuuugagg

SEQ ID NO: 656722 - RNA, 22 nt, Human
cacuauauugaccaguugaagu

SEQ ID NO: 656723 - RNA, 20 nt, Human
cagaaagaugaccaaaaucu

SEQ ID NO: 656724 - RNA, 23 nt, Human
cagauggugacugcucuguacuu

SEQ ID NO: 656725 - RNA, 21 nt, Human
caggauacagauuugcagaau

SEQ ID NO: 656726 - RNA, 19 nt, Human
caggcaaaccagucugaag

SEQ ID NO: 656727 - RNA, 22 nt, Human
cauauacaggcuuaaauaccac

SEQ ID NO: 656728 - RNA, 18 nt, Human
cccaaccaaauuuucagc

SEQ ID NO: 656729 - RNA, 26 nt, Human
ccucuagggcuaaaaaaaaaaaaaaa

SEQ ID NO: 656730 - RNA, 21 nt, Human
ccuuguggcaaaggcugcucc

SEQ ID NO: 656731 - RNA, 24 nt, Human
cuaacauucacauacgcauuccaa

SEQ ID NO: 656732 - RNA, 24 nt, Human
cucagcaucuugacuauccaucuc

SEQ ID NO: 656733 - RNA, 18 nt, Human
cucauuaccaguauucua

SEQ ID NO: 656734 - RNA, 21 nt, Human
cucccagacuuugcagaagaa

SEQ ID NO: 656735 - RNA, 22 nt, Human
cuguaaaaugucuagauucucc

SEQ ID NO: 656736 - RNA, 24 nt, Human
gcaguacuagaaaaauaaccaugc

SEQ ID NO: 656737 - RNA, 23 nt, Human
gccaaucacacacuugcuaucau

SEQ ID NO: 656738 - RNA, 19 nt, Human
gccaggcuuugaaugcucu

SEQ ID NO: 656739 - RNA, 24 nt, Human
ggccaaucacacacuugcuaucau

SEQ ID NO: 656740 - RNA, 18 nt, Human
gggcuaaaaaaaaaaaaa

SEQ ID NO: 656741 - RNA, 19 nt, Human
guaggcuuuucagaaauca

SEQ ID NO: 656742 - RNA, 18 nt, Human
uaaaaauaucugaaacag

SEQ ID NO: 656743 - RNA, 23 nt, Human
uaaaauacuuucugacauacauu

SEQ ID NO: 656744 - RNA, 23 nt, Human
uaaacccaagugaagccaacaaa

SEQ ID NO: 656745 - RNA, 25 nt, Human
uaagauacaauuuaguucagauaaa

SEQ ID NO: 656746 - RNA, 23 nt, Human
uaaugacagaaguaaauuuuuua

SEQ ID NO: 656747 - RNA, 20 nt, Human
uacagauuugcagaauaaaa

SEQ ID NO: 656748 - RNA, 24 nt, Human
uaccaaucucaggauaaacacucu

SEQ ID NO: 656749 - RNA, 26 nt, Human
uaccuugaugacaucaacauuagcac

SEQ ID NO: 656750 - RNA, 21 nt, Human
uagaaauucagagccagccug

SEQ ID NO: 656751 - RNA, 22 nt, Human
uagaauuacaaacacaguucug

SEQ ID NO: 656752 - RNA, 19 nt, Human
uagauucuccauucuuucc

SEQ ID NO: 656753 - RNA, 22 nt, Human
uaggcuugacuguaaaaaccaa

SEQ ID NO: 656754 - RNA, 23 nt, Human
uaguuauuagugaggucuacaua

SEQ ID NO: 656755 - RNA, 23 nt, Human
uaguuuaauacacagaagccacc

SEQ ID NO: 656756 - RNA, 21 nt, Human
uaugcaaaaauaguguacaau

SEQ ID NO: 656757 - RNA, 21 nt, Human
uauuuugcucagauacaccug

SEQ ID NO: 656758 - RNA, 18 nt, Human
ucaaccaaaucaggauca

SEQ ID NO: 656759 - RNA, 20 nt, Human
ucagacagcaacacaacuga

SEQ ID NO: 656760 - RNA, 19 nt, Human
uccacggaauuuccccuuu

SEQ ID NO: 656761 - RNA, 19 nt, Human
uccaguggcugaaaaagcc

SEQ ID NO: 656762 - RNA, 23 nt, Human
ucccagacuuugcagaagaacuc

SEQ ID NO: 656763 - RNA, 19 nt, Human
ucccuuaugaaucaacagg

SEQ ID NO: 656764 - RNA, 21 nt, Human
uccuuugaggaagaucagaug

SEQ ID NO: 656765 - RNA, 19 nt, Human
ucuaaacccaagugaagcc

SEQ ID NO: 656766 - RNA, 26 nt, Human
ucuagggcuaaaaaaaaaaaaaaaaa

SEQ ID NO: 656767 - RNA, 18 nt, Human
ucugaaaaaaaaaaaaaa

SEQ ID NO: 656768 - RNA, 24 nt, Human
ucugaagacucccagacuuugcag

SEQ ID NO: 656769 - RNA, 22 nt, Human
ucugcaagauuaaaaaaaaaaa

SEQ ID NO: 656770 - RNA, 24 nt, Human
ucugcaagauuaaaaaaaaaaaaa

SEQ ID NO: 656771 - RNA, 22 nt, Human
ugaauacacuaagcaaauaccc

SEQ ID NO: 656772 - RNA, 24 nt, Human
ugaauguguuuacguucauagaaa

SEQ ID NO: 656773 - RNA, 28 nt, Human
ugagguaagagaccauaugcaaaaguca

SEQ ID NO: 656774 - RNA, 23 nt, Human
ugcagaagaacucacaacuucug

SEQ ID NO: 656775 - RNA, 25 nt, Human
uggaaacacaaguuaaaguacuguc

SEQ ID NO: 656776 - RNA, 24 nt, Human
uggcagcaucuuguuuucuucaau

SEQ ID NO: 656777 - RNA, 19 nt, Human
uggcuguggcucagacagc

SEQ ID NO: 656778 - RNA, 21 nt, Human
uguauucaaauuuucaguacc

SEQ ID NO: 656779 - RNA, 23 nt, Human
ugugcaaacagagacagccaggc

SEQ ID NO: 656780 - RNA, 19 nt, Human
uguuagucaucucagcauc

SEQ ID NO: 656781 - RNA, 19 nt, Human
uuaaaagcuauggccaauc

SEQ ID NO: 656782 - RNA, 23 nt, Human
uuaguuauaauguuaccucuagg

SEQ ID NO: 656783 - RNA, 18 nt, Human
uucaaauucaacuuaauu

SEQ ID NO: 656784 - RNA, 18 nt, Human
uucaacacuaccuggacu

SEQ ID NO: 656785 - RNA, 18 nt, Human
uuccaguggcugaaaaag

SEQ ID NO: 656786 - RNA, 19 nt, Human
uuccuguauuuaaaucccc

SEQ ID NO: 656787 - RNA, 18 nt, Human
uucgcugggccucaacca

SEQ ID NO: 656788 - RNA, 18 nt, Human
uucguaguuuaauacaca

SEQ ID NO: 656789 - RNA, 19 nt, Human
uucuaaaacuucuuuguga

SEQ ID NO: 656790 - RNA, 21 nt, Human
uucuccauucuuuccuuauuu

SEQ ID NO: 656791 - RNA, 24 nt, Human
uugaggaagaucagauggugacug

SEQ ID NO: 656792 - RNA, 21 nt, Human
aagauaccacuugaauacuau

SEQ ID NO: 656793 - RNA, 20 nt, Human
aauaaauauaaauccaugcg

SEQ ID NO: 656794 - RNA, 26 nt, Human
acaaugagagagauuucagacccaga

SEQ ID NO: 656795 - RNA, 27 nt, Human
acccuaaaaaugcuagauaaucagagc

SEQ ID NO: 656796 - RNA, 22 nt, Human
aggagaaugacccuaaaaaugc

SEQ ID NO: 656797 - RNA, 26 nt, Human
aguaaacaaugagagagauuucagac

SEQ ID NO: 656798 - RNA, 23 nt, Human
auaaauauaaauccaugcgucau

SEQ ID NO: 656799 - RNA, 24 nt, Human
aucucccaaacaagcucuucuaaa

SEQ ID NO: 656800 - RNA, 27 nt, Human
caaauaccaaaauggacauucuaggaa

SEQ ID NO: 656801 - RNA, 21 nt, Human
caaguacaucaccugaaauaa

SEQ ID NO: 656802 - RNA, 20 nt, Human
caccuguaucccacgauaca

SEQ ID NO: 656803 - RNA, 19 nt, Human
cucauucuuguuucuguuu

SEQ ID NO: 656804 - RNA, 19 nt, Human
cuugguuguuauggaaagu

SEQ ID NO: 656805 - RNA, 20 nt, Human
gaacucaaaaauacuuagug

SEQ ID NO: 656806 - RNA, 24 nt, Human
gacccagaaacaguauauccuaag

SEQ ID NO: 656807 - RNA, 18 nt, Human
gacuaguaaauaugauaa

SEQ ID NO: 656808 - RNA, 20 nt, Human
gccuaaagcacaaacaacuu

SEQ ID NO: 656809 - RNA, 24 nt, Human
ggacauucuaggaacucaaaaaua

SEQ ID NO: 656810 - RNA, 20 nt, Human
ggcaaucuugguuguuaugg

SEQ ID NO: 656811 - RNA, 20 nt, Human
gguaaucuuuauguaaccua

SEQ ID NO: 656812 - RNA, 18 nt, Human
guauaaaguucauaaaag

SEQ ID NO: 656813 - RNA, 26 nt, Human
uaaccaaauaccaaaauggacauucu

SEQ ID NO: 656814 - RNA, 21 nt, Human
uaaggagaaugacccuaaaaa

SEQ ID NO: 656815 - RNA, 18 nt, Human
uaauagucaagauaccac

SEQ ID NO: 656816 - RNA, 19 nt, Human
uaauauuagcugaccauau

SEQ ID NO: 656817 - RNA, 26 nt, Human
uaccaaaauggacauucuaggaacuc

SEQ ID NO: 656818 - RNA, 20 nt, Human
uaccacuugagauauuuuuc

SEQ ID NO: 656819 - RNA, 20 nt, Human
uacuauggcuaaagaaaaua

SEQ ID NO: 656820 - RNA, 21 nt, Human
uagugacuaguaaauaugaua

SEQ ID NO: 656821 - RNA, 22 nt, Human
uauauccuaagguuuugguucu

SEQ ID NO: 656822 - RNA, 21 nt, Human
uauccaagaauaaucagaucu

SEQ ID NO: 656823 - RNA, 21 nt, Human
uaucuuauucucuaaucuccc

SEQ ID NO: 656824 - RNA, 22 nt, Human
uauugugacaaaaaguuacuau

SEQ ID NO: 656825 - RNA, 25 nt, Human
ucaccugaaauaacaccuguauccc

SEQ ID NO: 656826 - RNA, 21 nt, Human
ucucccaaacaagcucuucua

SEQ ID NO: 656827 - RNA, 19 nt, Human
ugacaaaaugauuugaggg

SEQ ID NO: 656828 - RNA, 18 nt, Human
ugauguaacugacaaaau

SEQ ID NO: 656829 - RNA, 21 nt, Human
ugauuugaggguacuacauaa

SEQ ID NO: 656830 - RNA, 25 nt, Human
uggcuaaagaaaauaaugcaaguac

SEQ ID NO: 656831 - RNA, 22 nt, Human
uuagagcugguuaauguuugcc

SEQ ID NO: 656832 - RNA, 21 nt, Human
uuaucuuauucucuaaucucc

SEQ ID NO: 656833 - RNA, 20 nt, Human
uuauugugacaaaaaguuac

SEQ ID NO: 656834 - RNA, 20 nt, Human
uucauugccacuaccucauu

SEQ ID NO: 656835 - RNA, 24 nt, Human
uuggauuuuucuuuuguuuauauu

SEQ ID NO: 656836 - RNA, 22 nt, Human
uuguuagagcugguuaauguuu

SEQ ID NO: 656837 - RNA, 20 nt, Human
uuguuucuguuuucacugag

SEQ ID NO: 656838 - RNA, 23 nt, Human
uuucuguuuucacugagugaaca

SEQ ID NO: 656839 - RNA, 20 nt, Human
uuuuuuuuuuauaaugaccc

SEQ ID NO: 656840 - RNA, 21 nt, Human
aaaaaugcacauaucuuaacc

SEQ ID NO: 656841 - RNA, 21 nt, Human
aauagcaaaagguuaggaaaa

SEQ ID NO: 656842 - RNA, 20 nt, Human
agaaacucuucauguaacga

SEQ ID NO: 656843 - RNA, 19 nt, Human
agagaagacaagcugaaga

SEQ ID NO: 656844 - RNA, 19 nt, Human
agagaagacaagcugaaga

SEQ ID NO: 656845 - RNA, 23 nt, Human
aggaaaagauaacacuuuuuggg

SEQ ID NO: 656846 - RNA, 24 nt, Human
agggauauuuaaggaaaagauaac

SEQ ID NO: 656847 - RNA, 23 nt, Human
augaguucuaaaggagggaagga

SEQ ID NO: 656848 - RNA, 19 nt, Human
cugcaauuauagaccaaga

SEQ ID NO: 656849 - RNA, 19 nt, Human
gaaaacaucccaauggaaa

SEQ ID NO: 656850 - RNA, 21 nt, Human
gggaaggagacuucacuguuu

SEQ ID NO: 656851 - RNA, 21 nt, Human
uaaauuuccagcuuacaguaa

SEQ ID NO: 656852 - RNA, 30 nt, Human
uacacagagaagacaagcugaagaacaguu

SEQ ID NO: 656853 - RNA, 21 nt, Human
uaggaaaaauaccucuagagg

SEQ ID NO: 656854 - RNA, 22 nt, Human
uauagauggcaacuugccaaua

SEQ ID NO: 656855 - RNA, 22 nt, Human
uauuaugguacauucauacaau

SEQ ID NO: 656856 - RNA, 19 nt, Human
ucguucugugucuuuugaa

SEQ ID NO: 656857 - RNA, 22 nt, Human
ucuagagggauauuuaaggaaa

SEQ ID NO: 656858 - RNA, 21 nt, Human
ugaguucuaaaggagggaagg

SEQ ID NO: 656859 - RNA, 21 nt, Human
uuugaauuuugaacaauuuug

SEQ ID NO: 656860 - RNA, 18 nt, Human
uuuuuuuuuuuuuuuuug

SEQ ID NO: 656861 - RNA, 20 nt, Human
aaaaaacaacaaaaaccuca

SEQ ID NO: 656862 - RNA, 19 nt, Human
aagaaaagcaaagucaagg

SEQ ID NO: 656863 - RNA, 23 nt, Human
aagaguacaaacagaaaaaaccc

SEQ ID NO: 656864 - RNA, 19 nt, Human
acggugcgcgccgcgggcc

SEQ ID NO: 656865 - RNA, 20 nt, Human
agagaaggaagcugcaauag

SEQ ID NO: 656866 - RNA, 20 nt, Human
agcuaccaagccaagcugcc

SEQ ID NO: 656867 - RNA, 21 nt, Human
aggaaucucuucccaccguac

SEQ ID NO: 656868 - RNA, 21 nt, Human
aggcaaaucccagagcuacca

SEQ ID NO: 656869 - RNA, 19 nt, Human
agggagagggcgcuuccaa

SEQ ID NO: 656870 - RNA, 19 nt, Human
aguacaaacagaaaaaacc

SEQ ID NO: 656871 - RNA, 26 nt, Human
auugugcuguuuuuccuuucacuuaa

SEQ ID NO: 656872 - RNA, 21 nt, Human
caaaaaacaacaaaaaccuca

SEQ ID NO: 656873 - RNA, 18 nt, Human
caccagcacagugcaagg

SEQ ID NO: 656874 - RNA, 23 nt, Human
cagaaaaaacccaaguauuccca

SEQ ID NO: 656875 - RNA, 26 nt, Human
cagaaaaaacccaaguauucccaaaa

SEQ ID NO: 656876 - RNA, 22 nt, Human
cauugcuaacagauggcaaaga

SEQ ID NO: 656877 - RNA, 22 nt, Human
ccaagaguacaaacagaaaaaa

SEQ ID NO: 656878 - RNA, 18 nt, Human
ccaggcugaggaggugcu

SEQ ID NO: 656879 - RNA, 22 nt, Human
cccaagaguacaaacagaaaaa

SEQ ID NO: 656880 - RNA, 23 nt, Human
cccauaacaaggaaacucuuuag

SEQ ID NO: 656881 - RNA, 23 nt, Human
ccccaagaguacaaacagaaaaa

SEQ ID NO: 656882 - RNA, 22 nt, Human
cuaaauggauucuccuucuuga

SEQ ID NO: 656883 - RNA, 22 nt, Human
cucuauagauacguauguaucc

SEQ ID NO: 656884 - RNA, 22 nt, Human
cucuccaguugacugcauugcu

SEQ ID NO: 656885 - RNA, 26 nt, Human
cuuaacucagcccuugagccgguucc

SEQ ID NO: 656886 - RNA, 22 nt, Human
cuuccaaaaaacaacaaaaacc

SEQ ID NO: 656887 - RNA, 25 nt, Human
gaaaaaaacuuuccuaacuguaccc

SEQ ID NO: 656888 - RNA, 22 nt, Human
gccaagcugcuuucggcaaagc

SEQ ID NO: 656889 - RNA, 21 nt, Human
gccacauaugaaucacugagc

SEQ ID NO: 656890 - RNA, 20 nt, Human
ggaaucacaaguguguagag

SEQ ID NO: 656891 - RNA, 18 nt, Human
ggaccugcacugauucuu

SEQ ID NO: 656892 - RNA, 18 nt, Human
gggcugaggaaucucuuc

SEQ ID NO: 656893 - RNA, 18 nt, Human
guacaaacagaaaaaacc

SEQ ID NO: 656894 - RNA, 21 nt, Human
guaggcugcaggaagauacca

SEQ ID NO: 656895 - RNA, 19 nt, Human
uaagcccuaacacguaggc

SEQ ID NO: 656896 - RNA, 23 nt, Human
uacaaacagaaaaaacccaagua

SEQ ID NO: 656897 - RNA, 22 nt, Human
uagaugaaaaauauugagcaau

SEQ ID NO: 656898 - RNA, 23 nt, Human
uauccaagacauggauacuuuua

SEQ ID NO: 656899 - RNA, 23 nt, Human
uauguuugccuuuacuuccaaaa

SEQ ID NO: 656900 - RNA, 24 nt, Human
uauuaagaaaagcaaagucaaggg

SEQ ID NO: 656901 - RNA, 26 nt, Human
ucaccauugugcuguuuuuccuuuca

SEQ ID NO: 656902 - RNA, 24 nt, Human
uccaaaaaacaacaaaaaccucau

SEQ ID NO: 656903 - RNA, 24 nt, Human
ucccaaagccacauaugaaucacu

SEQ ID NO: 656904 - RNA, 20 nt, Human
ucccagagcuaccaagccaa

SEQ ID NO: 656905 - RNA, 21 nt, Human
ucccagagcuaccaagccaag

SEQ ID NO: 656906 - RNA, 22 nt, Human
ucccagagcuaccaagccaagc

SEQ ID NO: 656907 - RNA, 19 nt, Human
uccccaagaguacaaacag

SEQ ID NO: 656908 - RNA, 25 nt, Human
ucguacauaauaucgaauaggaauc

SEQ ID NO: 656909 - RNA, 19 nt, Human
ucuccaucguacauaauau

SEQ ID NO: 656910 - RNA, 18 nt, Human
ugcacaaugcaagugaaa

SEQ ID NO: 656911 - RNA, 22 nt, Human
ugcaggaagauaccaucugaga

SEQ ID NO: 656912 - RNA, 20 nt, Human
ugcuguuuuuccuuucacuu

SEQ ID NO: 656913 - RNA, 23 nt, Human
uggaauauaaaauuuacaaagca

SEQ ID NO: 656914 - RNA, 20 nt, Human
uggcaaagaagugauucccc

SEQ ID NO: 656915 - RNA, 24 nt, Human
uggcaaagaagugauuccccaaga

SEQ ID NO: 656916 - RNA, 18 nt, Human
uguauuaagaaaagcaaa

SEQ ID NO: 656917 - RNA, 18 nt, Human
ugugaaaccacaaggcua

SEQ ID NO: 656918 - RNA, 18 nt, Human
uguguagaggacaugaag

SEQ ID NO: 656919 - RNA, 24 nt, Human
uuaggucaugcauguugcccauaa

SEQ ID NO: 656920 - RNA, 18 nt, Human
uucaugugacccacuucc

SEQ ID NO: 656921 - RNA, 18 nt, Human
uuccaguaugucagucaa

SEQ ID NO: 656922 - RNA, 23 nt, Human
uuuuuuuuuuacacuagaaauua

SEQ ID NO: 656923 - RNA, 25 nt, Human
uuuuuuuuuuuuuuuuuuacacuag

SEQ ID NO: 656924 - RNA, 23 nt, Human
acccccagcccuggaguuggcuc

SEQ ID NO: 656925 - RNA, 25 nt, Human
accuaauuucuccaaggguccccag

SEQ ID NO: 656926 - RNA, 19 nt, Human
agccuaggacuccugaccc

SEQ ID NO: 656927 - RNA, 20 nt, Human
agggcccagugacuuugggg

SEQ ID NO: 656928 - RNA, 26 nt, Human
aguaccccccauucccagggggugac

SEQ ID NO: 656929 - RNA, 18 nt, Human
auggagugggugagggca

SEQ ID NO: 656930 - RNA, 19 nt, Human
caauggcuuuucucagggc

SEQ ID NO: 656931 - RNA, 22 nt, Human
cagcaggugacaccuaauuucu

SEQ ID NO: 656932 - RNA, 18 nt, Human
cagcccuggaguuggcuc

SEQ ID NO: 656933 - RNA, 26 nt, Human
cagggucuuugcuuugcggggcuggg

SEQ ID NO: 656934 - RNA, 24 nt, Human
cauuuugccacagcaggugacacc

SEQ ID NO: 656935 - RNA, 18 nt, Human
ccacgggcaaagcacagc

SEQ ID NO: 656936 - RNA, 24 nt, Human
cccaggagccgcugcugagcuucu

SEQ ID NO: 656937 - RNA, 23 nt, Human
cccucauccacagucaucuccuu

SEQ ID NO: 656938 - RNA, 22 nt, Human
ccgcugcugagcuucuggccac

SEQ ID NO: 656939 - RNA, 19 nt, Human
ccugacccccagcccugga

SEQ ID NO: 656940 - RNA, 25 nt, Human
ccugacccccagcccuggaguuggc

SEQ ID NO: 656941 - RNA, 22 nt, Human
ccuucgguugguaauggagcag

SEQ ID NO: 656942 - RNA, 18 nt, Human
cugcuugagguccaugga

SEQ ID NO: 656943 - RNA, 19 nt, Human
cuguucccucauccuuucc

SEQ ID NO: 656944 - RNA, 21 nt, Human
gagccgcugcugagcuucugg

SEQ ID NO: 656945 - RNA, 23 nt, Human
ggaggccugcucuggggcucagg

SEQ ID NO: 656946 - RNA, 18 nt, Human
ggccucagaguauccaga

SEQ ID NO: 656947 - RNA, 19 nt, Human
gggcacucuguggugugcc

SEQ ID NO: 656948 - RNA, 21 nt, Human
gggcagcaggggcuccagcuc

SEQ ID NO: 656949 - RNA, 18 nt, Human
gggcucaggugagugugc

SEQ ID NO: 656950 - RNA, 22 nt, Human
gggggcucaagggcuuguugag

SEQ ID NO: 656951 - RNA, 23 nt, Human
uaaacccauuuugccacagcagg

SEQ ID NO: 656952 - RNA, 23 nt, Human
uagcggucuccuucugggggcuc

SEQ ID NO: 656953 - RNA, 19 nt, Human
ucagggcauccuggagaug

SEQ ID NO: 656954 - RNA, 23 nt, Human
ucagggcccagugacuuuggggg

SEQ ID NO: 656955 - RNA, 24 nt, Human
ucauccuuuccaggccuuucccag

SEQ ID NO: 656956 - RNA, 18 nt, Human
ucccagggggugaccugc

SEQ ID NO: 656957 - RNA, 28 nt, Human
uccccagcacacagggaaggaggccugc

SEQ ID NO: 656958 - RNA, 21 nt, Human
uccccuuagacagguggggga

SEQ ID NO: 656959 - RNA, 20 nt, Human
uccuuuccaggccuuuccca

SEQ ID NO: 656960 - RNA, 19 nt, Human
ucucagggcccagugacuc

SEQ ID NO: 656961 - RNA, 20 nt, Human
ucucagggcccagugacuuu

SEQ ID NO: 656962 - RNA, 18 nt, Human
ucugggggcucaagggcu

SEQ ID NO: 656963 - RNA, 18 nt, Human
ucuguggugugcaaagcg

SEQ ID NO: 656964 - RNA, 18 nt, Human
ugagcugggcagcagggg

SEQ ID NO: 656965 - RNA, 23 nt, Human
ugcaaagcggggugcgugaguac

SEQ ID NO: 656966 - RNA, 23 nt, Human
ugcaaagguugccuuuguuccuc

SEQ ID NO: 656967 - RNA, 18 nt, Human
ugcugagcuucuggccac

SEQ ID NO: 656968 - RNA, 23 nt, Human
uggccacgggcaaagcacagcug

SEQ ID NO: 656969 - RNA, 24 nt, Human
uggugugcaaagcggggugcguga

SEQ ID NO: 656970 - RNA, 21 nt, Human
ugucagggcauccuggagaug

SEQ ID NO: 656971 - RNA, 18 nt, Human
ugugcuaauuugagaauc

SEQ ID NO: 656972 - RNA, 19 nt, Human
uugggggugcgguggcuuc

SEQ ID NO: 656973 - RNA, 19 nt, Human
uugguaauggagcaggaau

SEQ ID NO: 656974 - RNA, 23 nt, Human
uuuccaggccuuucccaggagcc

SEQ ID NO: 656975 - RNA, 19 nt, Human
uuugcggggcugggcgguc

SEQ ID NO: 656976 - RNA, 18 nt, Human
uuuguuccucgccuguuc

SEQ ID NO: 656977 - RNA, 25 nt, Human
uuuucuguuccccuuagacaggugg

SEQ ID NO: 656978 - RNA, 22 nt, Human
uuuuuuuuuuuuuuuuucacag

SEQ ID NO: 656979 - RNA, 22 nt, Human
aaaaacacaaagccuccaugug

SEQ ID NO: 656980 - RNA, 24 nt, Human
aaacaaaaauaaaagaugcaugga

SEQ ID NO: 656981 - RNA, 21 nt, Human
aaaccagaagccacaaaaaga

SEQ ID NO: 656982 - RNA, 20 nt, Human
aaaggccaaggaauguagcu

SEQ ID NO: 656983 - RNA, 21 nt, Human
aacagcuucccaggucaaagc

SEQ ID NO: 656984 - RNA, 27 nt, Human
aaccuccuucacauauacaaggaaccu

SEQ ID NO: 656985 - RNA, 18 nt, Human
aaccugcccuuuccuccu

SEQ ID NO: 656986 - RNA, 25 nt, Human
aaccugcccuuuccuccuggucucu

SEQ ID NO: 656987 - RNA, 21 nt, Human
aacuuguccuccaguggccug

SEQ ID NO: 656988 - RNA, 22 nt, Human
aagaaaaacaggcaaaggaaaa

SEQ ID NO: 656989 - RNA, 20 nt, Human
aaggaaccaaccuccuucac

SEQ ID NO: 656990 - RNA, 25 nt, Human
aauccuuaccccaaaccuccaggga

SEQ ID NO: 656991 - RNA, 24 nt, Human
acaaaaagacuacucaacuacaga

SEQ ID NO: 656992 - RNA, 21 nt, Human
acaaggaaccaaccuccuuca

SEQ ID NO: 656993 - RNA, 18 nt, Human
acacaaagccuccaugug

SEQ ID NO: 656994 - RNA, 18 nt, Human
acaggcaaaggaaaaaca

SEQ ID NO: 656995 - RNA, 21 nt, Human
accaaccuccuucacauauac

SEQ ID NO: 656996 - RNA, 24 nt, Human
accucauccucuccaccugccuga

SEQ ID NO: 656997 - RNA, 18 nt, Human
acuacagaaaaacacaaa

SEQ ID NO: 656998 - RNA, 18 nt, Human
acuccuaucucucccagg

SEQ ID NO: 656999 - RNA, 25 nt, Human
acucuguugccaaggcuggagugca

SEQ ID NO: 657000 - RNA, 21 nt, Human
acugccugagaugcggcucca

SEQ ID NO: 657001 - RNA, 20 nt, Human
agaaaaacacaaagccucca

SEQ ID NO: 657002 - RNA, 20 nt, Human
agaaaaacaggcaaaggaaa

SEQ ID NO: 657003 - RNA, 24 nt, Human
agaggugggaggaucacuuggggc

SEQ ID NO: 657004 - RNA, 21 nt, Human
agcgcccacccccucagcagc

SEQ ID NO: 657005 - RNA, 18 nt, Human
aggcaaaggaaaaacaca

SEQ ID NO: 657006 - RNA, 19 nt, Human
aggcaguguuugaacagag

SEQ ID NO: 657007 - RNA, 18 nt, Human
aggugggaggaucacuug

SEQ ID NO: 657008 - RNA, 25 nt, Human
aggugugcaggcagcaggugggagu

SEQ ID NO: 657009 - RNA, 23 nt, Human
agugcagugucaugaacauagcu

SEQ ID NO: 657010 - RNA, 23 nt, Human
agugcagugucaugaacauagcu

SEQ ID NO: 657011 - RNA, 22 nt, Human
auaaacaaaaauaaaagaugca

SEQ ID NO: 657012 - RNA, 24 nt, Human
auagcucacugcagccucaaccuc

SEQ ID NO: 657013 - RNA, 24 nt, Human
auagcucacugcagccucgaccuc

SEQ ID NO: 657014 - RNA, 18 nt, Human
augaacauagcucacugc

SEQ ID NO: 657015 - RNA, 18 nt, Human
augaacauagcucacugc

SEQ ID NO: 657016 - RNA, 23 nt, Human
auuccauucaucucucugccuca

SEQ ID NO: 657017 - RNA, 27 nt, Human
caaaccucauccucuccaccugccuga

SEQ ID NO: 657018 - RNA, 24 nt, Human
caacuacagaaaaacacaaagccu

SEQ ID NO: 657019 - RNA, 22 nt, Human
caaggaauguagcugccccuga

SEQ ID NO: 657020 - RNA, 21 nt, Human
cacgaauccugacuuggccac

SEQ ID NO: 657021 - RNA, 24 nt, Human
cacucuguugccaaggcuggagug

SEQ ID NO: 657022 - RNA, 22 nt, Human
cagcagcgucgccuaugguacu

SEQ ID NO: 657023 - RNA, 27 nt, Human
cagcagcucuucccucugcuccucaaa

SEQ ID NO: 657024 - RNA, 22 nt, Human
cagcaggugggagugggcccag

SEQ ID NO: 657025 - RNA, 24 nt, Human
cagccucaaccucuagggcucaag

SEQ ID NO: 657026 - RNA, 24 nt, Human
cagccucgaccucuagggcucaag

SEQ ID NO: 657027 - RNA, 20 nt, Human
cagccuggggcaguccagcu

SEQ ID NO: 657028 - RNA, 22 nt, Human
cagcgcccacccccucagcagc

SEQ ID NO: 657029 - RNA, 19 nt, Human
cagcucuucccucugcucc

SEQ ID NO: 657030 - RNA, 23 nt, Human
cagcuucccaggucaaagcugga

SEQ ID NO: 657031 - RNA, 22 nt, Human
caggcaaaggaaaaacacagug

SEQ ID NO: 657032 - RNA, 23 nt, Human
cauuagacuuagaggcaggaagu

SEQ ID NO: 657033 - RNA, 23 nt, Human
ccacccccucagcagcucuuccc

SEQ ID NO: 657034 - RNA, 19 nt, Human
ccagguccuugcccuccuc

SEQ ID NO: 657035 - RNA, 20 nt, Human
ccccaaaccuccagggaccc

SEQ ID NO: 657036 - RNA, 21 nt, Human
ccccaaaccuccagggacccc

SEQ ID NO: 657037 - RNA, 20 nt, Human
cccgacugcccagcgcccac

SEQ ID NO: 657038 - RNA, 25 nt, Human
cccuccugaacucacuuuugugacc

SEQ ID NO: 657039 - RNA, 20 nt, Human
ccucaaaccucauccucucc

SEQ ID NO: 657040 - RNA, 20 nt, Human
ccuccacaccuggcccugau

SEQ ID NO: 657041 - RNA, 18 nt, Human
ccuccauguggcaaaagc

SEQ ID NO: 657042 - RNA, 21 nt, Human
ccucccagccuggggcagucc

SEQ ID NO: 657043 - RNA, 24 nt, Human
ccuccugcucccccauuagacuua

SEQ ID NO: 657044 - RNA, 18 nt, Human
ccucgaccucuagggcuc

SEQ ID NO: 657045 - RNA, 22 nt, Human
ccugccaggcgugccagcguga

SEQ ID NO: 657046 - RNA, 22 nt, Human
ccuugcccuccuccugcucccc

SEQ ID NO: 657047 - RNA, 20 nt, Human
cgaccucuagggcucaagcc

SEQ ID NO: 657048 - RNA, 20 nt, Human
cgacugcccagcgcccaccc

SEQ ID NO: 657049 - RNA, 23 nt, Human
cgcccacccccucagcagcucuu

SEQ ID NO: 657050 - RNA, 20 nt, Human
cucaaaccucauccucucca

SEQ ID NO: 657051 - RNA, 20 nt, Human
cucaaaccucauccucucca

SEQ ID NO: 657052 - RNA, 22 nt, Human
cucaaaccucauccucuccacc

SEQ ID NO: 657053 - RNA, 24 nt, Human
cucaacuacagaaaaacacaaagc

SEQ ID NO: 657054 - RNA, 19 nt, Human
cucacucuguugccaaggc

SEQ ID NO: 657055 - RNA, 24 nt, Human
cucacucuguugccaaggcuggag

SEQ ID NO: 657056 - RNA, 20 nt, Human
cucacugcagccucaaccuc

SEQ ID NO: 657057 - RNA, 20 nt, Human
cucacugcagccucgaccuc

SEQ ID NO: 657058 - RNA, 18 nt, Human
cucagcagcucuucccuc

SEQ ID NO: 657059 - RNA, 21 nt, Human
cuccacaccuggcccugauuc

SEQ ID NO: 657060 - RNA, 21 nt, Human
cucccaggcugccugccaggc

SEQ ID NO: 657061 - RNA, 21 nt, Human
cuccugaggcuugagaggugg

SEQ ID NO: 657062 - RNA, 21 nt, Human
cucucacugcccuccugaacu

SEQ ID NO: 657063 - RNA, 22 nt, Human
cucucugccucauccugccagg

SEQ ID NO: 657064 - RNA, 24 nt, Human
cugaacucacuuuugugacccagc

SEQ ID NO: 657065 - RNA, 22 nt, Human
cugcagccucaaccucuagggc

SEQ ID NO: 657066 - RNA, 23 nt, Human
cugcagccucaaccucuagggcu

SEQ ID NO: 657067 - RNA, 22 nt, Human
cugcagccucgaccucuagggc

SEQ ID NO: 657068 - RNA, 19 nt, Human
cugcccagcgcccaccccc

SEQ ID NO: 657069 - RNA, 21 nt, Human
cuuaccccaaaccuccaggga

SEQ ID NO: 657070 - RNA, 23 nt, Human
cuuaccccaaaccuccagggacc

SEQ ID NO: 657071 - RNA, 20 nt, Human
cuucacauauacaaggaacc

SEQ ID NO: 657072 - RNA, 18 nt, Human
cuuggggcacaccuccac

SEQ ID NO: 657073 - RNA, 21 nt, Human
cuuuguugccaaggcuggagu

SEQ ID NO: 657074 - RNA, 19 nt, Human
gaacauagcucacugcagc

SEQ ID NO: 657075 - RNA, 19 nt, Human
gaacauagcucacugcagc

SEQ ID NO: 657076 - RNA, 18 nt, Human
gagagcccacuagggagc

SEQ ID NO: 657077 - RNA, 23 nt, Human
gagcaggugccaaauucccccac

SEQ ID NO: 657078 - RNA, 22 nt, Human
gagccgggaccaggcaaggcca

SEQ ID NO: 657079 - RNA, 21 nt, Human
gagccucaguuuucuccucug

SEQ ID NO: 657080 - RNA, 23 nt, Human
gauaagaaaaacaggcaaaggaa

SEQ ID NO: 657081 - RNA, 18 nt, Human
gcccagcacgaauccuga

SEQ ID NO: 657082 - RNA, 21 nt, Human
gcccuccuccugcucccccau

SEQ ID NO: 657083 - RNA, 22 nt, Human
gcugaaggagcagcaggugggu

SEQ ID NO: 657084 - RNA, 18 nt, Human
ggaaaaacacaguguugc

SEQ ID NO: 657085 - RNA, 19 nt, Human
ggagagcccacuagggagc

SEQ ID NO: 657086 - RNA, 24 nt, Human
ggcaguccagcuuuuccagcugaa

SEQ ID NO: 657087 - RNA, 19 nt, Human
ggcccucugcgaugucucc

SEQ ID NO: 657088 - RNA, 25 nt, Human
gggcaguccagcuuuuccagcugaa

SEQ ID NO: 657089 - RNA, 18 nt, Human
ggugguggaggcagggga

SEQ ID NO: 657090 - RNA, 23 nt, Human
gugaccuugagugacucucacug

SEQ ID NO: 657091 - RNA, 18 nt, Human
guuccugugaacagccau

SEQ ID NO: 657092 - RNA, 21 nt, Human
uaaacugauaagaaaaacaac

SEQ ID NO: 657093 - RNA, 23 nt, Human
uacagaaaaacacaaagccucca

SEQ ID NO: 657094 - RNA, 26 nt, Human
uacagaguuccucccagccuggggca

SEQ ID NO: 657095 - RNA, 20 nt, Human
uaccccaaaccuccagggac

SEQ ID NO: 657096 - RNA, 24 nt, Human
uagcucacugcagccucaaccucu

SEQ ID NO: 657097 - RNA, 24 nt, Human
uagcucacugcagccucgaccucu

SEQ ID NO: 657098 - RNA, 21 nt, Human
uagggcucaagccauccuccu

SEQ ID NO: 657099 - RNA, 27 nt, Human
uagggcucaagccaucuccugccuucg

SEQ ID NO: 657100 - RNA, 18 nt, Human
uagugaguccuuacagag

SEQ ID NO: 657101 - RNA, 18 nt, Human
uaucucucccaggcugcc

SEQ ID NO: 657102 - RNA, 22 nt, Human
ucaagccauccuccugucuccu

SEQ ID NO: 657103 - RNA, 23 nt, Human
ucaauccuuaccccaaaccucca

SEQ ID NO: 657104 - RNA, 23 nt, Human
ucacugcagccucaaccucuagg

SEQ ID NO: 657105 - RNA, 24 nt, Human
ucacugcagccucaaccucuaggg

SEQ ID NO: 657106 - RNA, 23 nt, Human
ucacugcagccucgaccucuagg

SEQ ID NO: 657107 - RNA, 24 nt, Human
ucacugcagccucgaccucuaggg

SEQ ID NO: 657108 - RNA, 24 nt, Human
ucagcagcucuucccucugcuccu

SEQ ID NO: 657109 - RNA, 22 nt, Human
uccaaaccagaagccacaaaaa

SEQ ID NO: 657110 - RNA, 19 nt, Human
ucccccacggugguggagg

SEQ ID NO: 657111 - RNA, 20 nt, Human
ucccccacggugguggaggc

SEQ ID NO: 657112 - RNA, 23 nt, Human
ucccccauuagacuuagaggcug

SEQ ID NO: 657113 - RNA, 18 nt, Human
ucccgacugcccagcgcc

SEQ ID NO: 657114 - RNA, 24 nt, Human
ucccgacugcccagcgcccacccc

SEQ ID NO: 657115 - RNA, 19 nt, Human
uccuggaugcccaaggccc

SEQ ID NO: 657116 - RNA, 18 nt, Human
uccuggggaggagagccc

SEQ ID NO: 657117 - RNA, 18 nt, Human
uccuggucucuccccugg

SEQ ID NO: 657118 - RNA, 23 nt, Human
ucuagggcucaagccaucuccug

SEQ ID NO: 657119 - RNA, 27 nt, Human
ucuagggcucaagccaucuccugccuu

SEQ ID NO: 657120 - RNA, 25 nt, Human
ucuaugugcuuuccaaaccagaagc

SEQ ID NO: 657121 - RNA, 23 nt, Human
ucucacucuguugccaaggcugg

SEQ ID NO: 657122 - RNA, 24 nt, Human
ucucacucuguugccaaggcugga

SEQ ID NO: 657123 - RNA, 23 nt, Human
ucuccccuggccugcaggaauug

SEQ ID NO: 657124 - RNA, 19 nt, Human
ucuccugaggcuugagagg

SEQ ID NO: 657125 - RNA, 22 nt, Human
ucuccugccuucgccucccgac

SEQ ID NO: 657126 - RNA, 19 nt, Human
ucuguugccaaggcuggag

SEQ ID NO: 657127 - RNA, 23 nt, Human
ucuugcuuuguugccaaggcugg

SEQ ID NO: 657128 - RNA, 24 nt, Human
ucuugcuuuguugccaaggcugga

SEQ ID NO: 657129 - RNA, 18 nt, Human
ugaacauagcucacugca

SEQ ID NO: 657130 - RNA, 18 nt, Human
ugaacauagcucacugca

SEQ ID NO: 657131 - RNA, 22 nt, Human
ugaagacagggucucacucugu

SEQ ID NO: 657132 - RNA, 24 nt, Human
ugagaggugggaggaucacuuggg

SEQ ID NO: 657133 - RNA, 21 nt, Human
ugagccgcagugaaaggccaa

SEQ ID NO: 657134 - RNA, 20 nt, Human
ugagccucaguuuucuccuc

SEQ ID NO: 657135 - RNA, 25 nt, Human
ugagugacucucacugcccuccuga

SEQ ID NO: 657136 - RNA, 21 nt, Human
ugccaaggcuggagugcagug

SEQ ID NO: 657137 - RNA, 21 nt, Human
ugccaaggcuggagugcagug

SEQ ID NO: 657138 - RNA, 18 nt, Human
ugccagcgugaccuguga

SEQ ID NO: 657139 - RNA, 24 nt, Human
ugccccgagucuucuacccacuga

SEQ ID NO: 657140 - RNA, 21 nt, Human
ugcccuccuccugcuccccca

SEQ ID NO: 657141 - RNA, 18 nt, Human
ugcuccacacggccaggc

SEQ ID NO: 657142 - RNA, 22 nt, Human
ugcucugggcaagugacugagc

SEQ ID NO: 657143 - RNA, 22 nt, Human
uggagacagggucuugcuuugu

SEQ ID NO: 657144 - RNA, 20 nt, Human
uggaggcaggggaguggcag

SEQ ID NO: 657145 - RNA, 18 nt, Human
uggagugcagugucauga

SEQ ID NO: 657146 - RNA, 18 nt, Human
uggagugcagugucauga

SEQ ID NO: 657147 - RNA, 18 nt, Human
uggcagagacuaucugug

SEQ ID NO: 657148 - RNA, 21 nt, Human
ugggcaagugacugagccuca

SEQ ID NO: 657149 - RNA, 18 nt, Human
ugguacugccauccuccu

SEQ ID NO: 657150 - RNA, 19 nt, Human
uggucuucuccccugcccc

SEQ ID NO: 657151 - RNA, 18 nt, Human
ugguggaggcaggggagu

SEQ ID NO: 657152 - RNA, 23 nt, Human
uguacaauggggagaggacguac

SEQ ID NO: 657153 - RNA, 21 nt, Human
ugugaccuugagugacucuca

SEQ ID NO: 657154 - RNA, 23 nt, Human
uguggcaaaagcccauaaacaaa

SEQ ID NO: 657155 - RNA, 21 nt, Human
uguugccaaggcuggagugca

SEQ ID NO: 657156 - RNA, 18 nt, Human
uuccuaggagugcagugc

SEQ ID NO: 657157 - RNA, 24 nt, Human
uugccaaggcuggagugcaguguc

SEQ ID NO: 657158 - RNA, 24 nt, Human
uugccaaggcuggagugcaguguc

SEQ ID NO: 657159 - RNA, 24 nt, Human
uugcuuuguugccaaggcuggagu

SEQ ID NO: 657160 - RNA, 24 nt, Human
uuuguugccaaggcuggagugcag

SEQ ID NO: 657161 - RNA, 22 nt, Human
uuuuuguuuuuugaagacaggg

SEQ ID NO: 657162 - RNA, 25 nt, Human
uuuuuuuuuuuuggagacagggucu

SEQ ID NO: 657163 - RNA, 18 nt, Human
uuuuuuuuuuuuuuuuug

SEQ ID NO: 657164 - RNA, 28 nt, Human
uuuuuuuuuuuuuuuuuuggagacaggg

SEQ ID NO: 657165 - RNA, 18 nt, Human
aaaaacaaacagaauacc

SEQ ID NO: 657166 - RNA, 19 nt, Human
aaaacaaaacgaaacaaaa

SEQ ID NO: 657167 - RNA, 24 nt, Human
aaaacaaaacgaaacaaaacaaaa

SEQ ID NO: 657168 - RNA, 20 nt, Human
aaaacgaaacaaaacaaaaa

SEQ ID NO: 657169 - RNA, 22 nt, Human
aaacaaaacaaaaacaaacaga

SEQ ID NO: 657170 - RNA, 22 nt, Human
aaacaaaacgaaacaaaacaaa

SEQ ID NO: 657171 - RNA, 18 nt, Human
aaacagaauaccagugac

SEQ ID NO: 657172 - RNA, 21 nt, Human
aaacagaauaccagugaccuc

SEQ ID NO: 657173 - RNA, 25 nt, Human
aaacagaauaccagugaccuccaac

SEQ ID NO: 657174 - RNA, 23 nt, Human
aaacgaaacaaaacaaaaacaaa

SEQ ID NO: 657175 - RNA, 23 nt, Human
aaagaagacagugcaccucugca

SEQ ID NO: 657176 - RNA, 18 nt, Human
aaauacacuaagguucac

SEQ ID NO: 657177 - RNA, 22 nt, Human
aacaaaacaaucaguucccuca

SEQ ID NO: 657178 - RNA, 19 nt, Human
aacaaaacgaaacaaaaca

SEQ ID NO: 657179 - RNA, 22 nt, Human
aacagaauaccagugaccucca

SEQ ID NO: 657180 - RNA, 21 nt, Human
aaccacacugcugaggucuuc

SEQ ID NO: 657181 - RNA, 23 nt, Human
aacgaaacaaaacaaaaacaaac

SEQ ID NO: 657182 - RNA, 23 nt, Human
aacuagcuauauacauagauuuc

SEQ ID NO: 657183 - RNA, 24 nt, Human
aaguagcccagguggguggagugc

SEQ ID NO: 657184 - RNA, 20 nt, Human
aaucacaggaacaacgagga

SEQ ID NO: 657185 - RNA, 18 nt, Human
aauggugggggggaggag

SEQ ID NO: 657186 - RNA, 20 nt, Human
acaaaacaaaaacaaacaga

SEQ ID NO: 657187 - RNA, 21 nt, Human
acaaaacaaaaacaaacagaa

SEQ ID NO: 657188 - RNA, 22 nt, Human
acaaaacgaaacaaaacaaaaa

SEQ ID NO: 657189 - RNA, 24 nt, Human
acagaacgagacccugucucaaaa

SEQ ID NO: 657190 - RNA, 18 nt, Human
acagaauaccagugaccu

SEQ ID NO: 657191 - RNA, 19 nt, Human
acagcugcccuucacacug

SEQ ID NO: 657192 - RNA, 18 nt, Human
acagugggacauacccgc

SEQ ID NO: 657193 - RNA, 18 nt, Human
acccugucucaaaaaaca

SEQ ID NO: 657194 - RNA, 23 nt, Human
accgcacuccagcuaagcgacag

SEQ ID NO: 657195 - RNA, 23 nt, Human
acgccaccgcacuccagcuaagc

SEQ ID NO: 657196 - RNA, 22 nt, Human
acuaaaaugagacaaugaucua

SEQ ID NO: 657197 - RNA, 21 nt, Human
agaaaauaaagaggaagaaga

SEQ ID NO: 657198 - RNA, 23 nt, Human
agccaaugcguaauauccagagc

SEQ ID NO: 657199 - RNA, 21 nt, Human
agcuggcaaaagcuuccaaga

SEQ ID NO: 657200 - RNA, 27 nt, Human
aggaacaacgaggagcugccgguaccc

SEQ ID NO: 657201 - RNA, 24 nt, Human
aggaacaaucacuaaaaugagaca

SEQ ID NO: 657202 - RNA, 18 nt, Human
aggaagaagagaaaucca

SEQ ID NO: 657203 - RNA, 19 nt, Human
aggaagaagagaaauccac

SEQ ID NO: 657204 - RNA, 23 nt, Human
aggcagacacucuggcucgugcc

SEQ ID NO: 657205 - RNA, 24 nt, Human
aggcagacacucuggcucgugccc

SEQ ID NO: 657206 - RNA, 23 nt, Human
aucacgccaccgcacuccagcua

SEQ ID NO: 657207 - RNA, 26 nt, Human
augcagaaaauaaagaggagggaccc

SEQ ID NO: 657208 - RNA, 26 nt, Human
caaaaaacaaaacgaaacaaaacaaa

SEQ ID NO: 657209 - RNA, 22 nt, Human
caaaacagagugaauucccuuc

SEQ ID NO: 657210 - RNA, 22 nt, Human
caaaacgaaacaaaacaaaaac

SEQ ID NO: 657211 - RNA, 24 nt, Human
caaaauaaugaagaaacacauagc

SEQ ID NO: 657212 - RNA, 23 nt, Human
caaacagaauaccagugaccucc

SEQ ID NO: 657213 - RNA, 22 nt, Human
caacaaaacaaucaguucccuc

SEQ ID NO: 657214 - RNA, 21 nt, Human
caauacagcacaaaacucuuu

SEQ ID NO: 657215 - RNA, 18 nt, Human
cacaauacagcacaaaac

SEQ ID NO: 657216 - RNA, 19 nt, Human
cacagcugcccuucacacu

SEQ ID NO: 657217 - RNA, 23 nt, Human
cacauuauccagaguccuggguc

SEQ ID NO: 657218 - RNA, 22 nt, Human
cacuccagcuaagcgacagaac

SEQ ID NO: 657219 - RNA, 18 nt, Human
cagaauaccagugaccuc

SEQ ID NO: 657220 - RNA, 22 nt, Human
caggggcuuuccuuguuagccu

SEQ ID NO: 657221 - RNA, 25 nt, Human
cauugccugaagacacugaguccca

SEQ ID NO: 657222 - RNA, 18 nt, Human
ccaaugcguaauauccag

SEQ ID NO: 657223 - RNA, 23 nt, Human
ccacacugcugaggucuucuaaa

SEQ ID NO: 657224 - RNA, 19 nt, Human
ccaccgcacuccagcuaag

SEQ ID NO: 657225 - RNA, 19 nt, Human
ccaccgcacuccagcuaag

SEQ ID NO: 657226 - RNA, 20 nt, Human
ccaccgcacuccagcuaagc

SEQ ID NO: 657227 - RNA, 21 nt, Human
ccaccgcacuccagcuaagcg

SEQ ID NO: 657228 - RNA, 19 nt, Human
ccagagcagauauuaaaca

SEQ ID NO: 657229 - RNA, 20 nt, Human
cccaacaaaacaaucaguuc

SEQ ID NO: 657230 - RNA, 19 nt, Human
ccccaaauagcuggcaaaa

SEQ ID NO: 657231 - RNA, 22 nt, Human
cccccaaauagcuggcaaaagc

SEQ ID NO: 657232 - RNA, 18 nt, Human
cccgcacacagcugcccu

SEQ ID NO: 657233 - RNA, 20 nt, Human
cccgcacacagcugcccuuc

SEQ ID NO: 657234 - RNA, 20 nt, Human
cccgcacacagcugcccuuc

SEQ ID NO: 657235 - RNA, 23 nt, Human
ccuccaacagugggacauacccg

SEQ ID NO: 657236 - RNA, 23 nt, Human
cguaaccuggcugccugccucuc

SEQ ID NO: 657237 - RNA, 21 nt, Human
cucaaaaaacaaaacgaaaca

SEQ ID NO: 657238 - RNA, 19 nt, Human
cucugguguugcuggugcu

SEQ ID NO: 657239 - RNA, 20 nt, Human
cugaagacacugagucccac

SEQ ID NO: 657240 - RNA, 25 nt, Human
cugcaaaauaaugaagaaacacaua

SEQ ID NO: 657241 - RNA, 22 nt, Human
cugcacuaaagaaaaaguagcc

SEQ ID NO: 657242 - RNA, 21 nt, Human
cuggcuaagauacucagguac

SEQ ID NO: 657243 - RNA, 22 nt, Human
cuuagagccagacuguagaauc

SEQ ID NO: 657244 - RNA, 24 nt, Human
gaaacacauagcucccgucuguaa

SEQ ID NO: 657245 - RNA, 21 nt, Human
gacagaacgagacccugucuc

SEQ ID NO: 657246 - RNA, 23 nt, Human
gacagaacgagacccugucucaa

SEQ ID NO: 657247 - RNA, 19 nt, Human
gacccuaucgcccccaccc

SEQ ID NO: 657248 - RNA, 22 nt, Human
gcaaaacagagugaauucccuu

SEQ ID NO: 657249 - RNA, 21 nt, Human
gcacuaggcaacaaaaagcca

SEQ ID NO: 657250 - RNA, 20 nt, Human
gccaugaucacgccaccgca

SEQ ID NO: 657251 - RNA, 20 nt, Human
gcccccacccuagcuggcuu

SEQ ID NO: 657252 - RNA, 23 nt, Human
gcgacagaacgagacccugucuc

SEQ ID NO: 657253 - RNA, 23 nt, Human
gggagagaaaggagucuccaccc

SEQ ID NO: 657254 - RNA, 27 nt, Human
gggccagguccaugugccggcagggaa

SEQ ID NO: 657255 - RNA, 20 nt, Human
ggguugggccagguccaugu

SEQ ID NO: 657256 - RNA, 24 nt, Human
ggucauggaaguagacacagaacc

SEQ ID NO: 657257 - RNA, 19 nt, Human
ggugggggggaggaggaug

SEQ ID NO: 657258 - RNA, 25 nt, Human
uaaagaggaagaagagaaauccacu

SEQ ID NO: 657259 - RNA, 23 nt, Human
uaaauggagugacuauccaaagu

SEQ ID NO: 657260 - RNA, 23 nt, Human
uaacaugcagaaaauaaagagga

SEQ ID NO: 657261 - RNA, 21 nt, Human
uaaccuggcugccugccucuc

SEQ ID NO: 657262 - RNA, 18 nt, Human
uacacaaucauugccuga

SEQ ID NO: 657263 - RNA, 25 nt, Human
uagagccagacuguagaaucgggag

SEQ ID NO: 657264 - RNA, 21 nt, Human
uagcuggcuuccugccuuugu

SEQ ID NO: 657265 - RNA, 25 nt, Human
uaguuucacuaguuuaaggaacaau

SEQ ID NO: 657266 - RNA, 21 nt, Human
uauuguaaauguuuuuaaauc

SEQ ID NO: 657267 - RNA, 23 nt, Human
ucacagagacccauauuuccaaa

SEQ ID NO: 657268 - RNA, 21 nt, Human
ucauaaagaacucaagucaaa

SEQ ID NO: 657269 - RNA, 18 nt, Human
uccaaagaagggaagacc

SEQ ID NO: 657270 - RNA, 23 nt, Human
uccaccccucugguguugcuggu

SEQ ID NO: 657271 - RNA, 24 nt, Human
uccuccuaccccccaaauagcugg

SEQ ID NO: 657272 - RNA, 20 nt, Human
uccugggucauaaagaacuc

SEQ ID NO: 657273 - RNA, 21 nt, Human
ucguccaaagaagggaagacc

SEQ ID NO: 657274 - RNA, 26 nt, Human
ucuaaagugccuuccuuuucuucaca

SEQ ID NO: 657275 - RNA, 24 nt, Human
ucucuaauggaaguuuauaaaaau

SEQ ID NO: 657276 - RNA, 20 nt, Human
ugaagacacugagucccaca

SEQ ID NO: 657277 - RNA, 19 nt, Human
ugaagcagugcucgggagc

SEQ ID NO: 657278 - RNA, 21 nt, Human
ugacuucagugaauaauuggc

SEQ ID NO: 657279 - RNA, 25 nt, Human
ugauaguagugugcucaaaacucaa

SEQ ID NO: 657280 - RNA, 19 nt, Human
uggaaguagacacagaacc

SEQ ID NO: 657281 - RNA, 20 nt, Human
ugggacauacccgcugaccc

SEQ ID NO: 657282 - RNA, 18 nt, Human
ugggccagguccaugugc

SEQ ID NO: 657283 - RNA, 18 nt, Human
uggugggggggaggagga

SEQ ID NO: 657284 - RNA, 20 nt, Human
uucaagaauagcagugccau

SEQ ID NO: 657285 - RNA, 22 nt, Human
uugccugaagacacugaguccc

SEQ ID NO: 657286 - RNA, 19 nt, Human
aaaaaggcagcugaugaug

SEQ ID NO: 657287 - RNA, 22 nt, Human
aaacuuugaaagucucucagcu

SEQ ID NO: 657288 - RNA, 19 nt, Human
aagaggaaacaguaaauaa

SEQ ID NO: 657289 - RNA, 25 nt, Human
aauuaugaaaucucuugccacagaa

SEQ ID NO: 657290 - RNA, 19 nt, Human
acagaaaacagcauggggu

SEQ ID NO: 657291 - RNA, 22 nt, Human
acagaaccauacagaaaaaucc

SEQ ID NO: 657292 - RNA, 19 nt, Human
agacggaauacacuugaga

SEQ ID NO: 657293 - RNA, 21 nt, Human
aggaagggacugccagcagca

SEQ ID NO: 657294 - RNA, 22 nt, Human
aggagauuuuugguccaguucu

SEQ ID NO: 657295 - RNA, 23 nt, Human
caaaauauaaacauacagacaua

SEQ ID NO: 657296 - RNA, 22 nt, Human
cauccagauuguaaauaacaac

SEQ ID NO: 657297 - RNA, 23 nt, Human
ccacagaaccauacagaaaaauc

SEQ ID NO: 657298 - RNA, 22 nt, Human
cccacauugccccauuucuucc

SEQ ID NO: 657299 - RNA, 18 nt, Human
cccauauggaaauggaac

SEQ ID NO: 657300 - RNA, 22 nt, Human
cucagaauccaaaaagcugacu

SEQ ID NO: 657301 - RNA, 19 nt, Human
gagacaccaauuucuaugg

SEQ ID NO: 657302 - RNA, 20 nt, Human
gauugcccccaugaccuccc

SEQ ID NO: 657303 - RNA, 22 nt, Human
ggagauuuuugguccaguucuu

SEQ ID NO: 657304 - RNA, 24 nt, Human
guuucuguaaagagaaaaauuauc

SEQ ID NO: 657305 - RNA, 20 nt, Human
uaagagauucuuauauccaa

SEQ ID NO: 657306 - RNA, 19 nt, Human
uaagaggaaacaguaaaua

SEQ ID NO: 657307 - RNA, 24 nt, Human
uaagcauaaaauacucagaaucca

SEQ ID NO: 657308 - RNA, 18 nt, Human
uacucagaauccaaaaag

SEQ ID NO: 657309 - RNA, 19 nt, Human
uaggguagaagguggguau

SEQ ID NO: 657310 - RNA, 21 nt, Human
ucaaaacuuugaaagucucuc

SEQ ID NO: 657311 - RNA, 19 nt, Human
ucagaauccaaaaagcuga

SEQ ID NO: 657312 - RNA, 20 nt, Human
ucagaauccaaaaagcugac

SEQ ID NO: 657313 - RNA, 19 nt, Human
ucaggaaugaaaguucaug

SEQ ID NO: 657314 - RNA, 22 nt, Human
ucaggagcaaggauucugcaag

SEQ ID NO: 657315 - RNA, 21 nt, Human
ucagguauuaaaaaggcagcu

SEQ ID NO: 657316 - RNA, 21 nt, Human
uccucaggaaugaaaguucau

SEQ ID NO: 657317 - RNA, 21 nt, Human
uccuuacuauaauagugaauc

SEQ ID NO: 657318 - RNA, 20 nt, Human
ucuccaaguuuacuaccuuc

SEQ ID NO: 657319 - RNA, 25 nt, Human
ugaaaagagauuaguaauaugaaag

SEQ ID NO: 657320 - RNA, 23 nt, Human
ugaaucaucaaguguugaaugua

SEQ ID NO: 657321 - RNA, 21 nt, Human
ugcaaggaagggacugccagc

SEQ ID NO: 657322 - RNA, 20 nt, Human
ugccccauuucuuccucagg

SEQ ID NO: 657323 - RNA, 21 nt, Human
ugccuuuguguuucuaaaugg

SEQ ID NO: 657324 - RNA, 21 nt, Human
uggaugaagccauccagauug

SEQ ID NO: 657325 - RNA, 21 nt, Human
uguuacagaaaacagcauggg

SEQ ID NO: 657326 - RNA, 22 nt, Human
uguuuugagugucugcgaccuu

SEQ ID NO: 657327 - RNA, 22 nt, Human
uuaaaacuggucucugaugccu

SEQ ID NO: 657328 - RNA, 21 nt, Human
uuaaagauauucaggagcaag

SEQ ID NO: 657329 - RNA, 23 nt, Human
uuaaagauauucaggagcaagga

SEQ ID NO: 657330 - RNA, 21 nt, Human
uucauguaacuuuuugauaac

SEQ ID NO: 657331 - RNA, 25 nt, Human
uucuugugguucuggagacagaaac

SEQ ID NO: 657332 - RNA, 18 nt, Human
uugaaagucucucagcua

SEQ ID NO: 657333 - RNA, 24 nt, Human
uugaauguaagugcaguagaaauu

SEQ ID NO: 657334 - RNA, 22 nt, Human
uuuaagauugcccccaugaccu

SEQ ID NO: 657335 - RNA, 23 nt, Human
uuuacuaccuucuucugaagggu

SEQ ID NO: 657336 - RNA, 22 nt, Human
uuugaaagucucucagcuaaca

SEQ ID NO: 657337 - RNA, 21 nt, Human
uuuuuauuuaucaaaacuuug

SEQ ID NO: 657338 - RNA, 18 nt, Human
uuuuuuuuuuuuuuuuug

SEQ ID NO: 657339 - RNA, 24 nt, Human
uuuuuuuuuuuuuuuuugacuugg

SEQ ID NO: 657340 - RNA, 22 nt, Human
aaaaugccuugucccggaucug

SEQ ID NO: 657341 - RNA, 21 nt, Human
aaacaggagccacagcaggga

SEQ ID NO: 657342 - RNA, 26 nt, Human
aacaaacaagaauuuacaauagcaau

SEQ ID NO: 657343 - RNA, 21 nt, Human
aagaggcaguggggcuugguu

SEQ ID NO: 657344 - RNA, 20 nt, Human
acgaaucaugaaaaaaugcc

SEQ ID NO: 657345 - RNA, 25 nt, Human
agaagcccucuaucuuugacaccaa

SEQ ID NO: 657346 - RNA, 21 nt, Human
agagaggaaugauuugcauuu

SEQ ID NO: 657347 - RNA, 24 nt, Human
agaucaccugagccuuccccgcuc

SEQ ID NO: 657348 - RNA, 18 nt, Human
agccuggagggcggggac

SEQ ID NO: 657349 - RNA, 19 nt, Human
agcuccuggaggcucagcu

SEQ ID NO: 657350 - RNA, 18 nt, Human
aggcaguggggcuugguu

SEQ ID NO: 657351 - RNA, 23 nt, Human
aggcaguggggcuugguuuccag

SEQ ID NO: 657352 - RNA, 18 nt, Human
aggcgggcgagggcgggc

SEQ ID NO: 657353 - RNA, 21 nt, Human
agggagccgcgcggggcuggg

SEQ ID NO: 657354 - RNA, 20 nt, Human
agucaguuuauacuuaaagu

SEQ ID NO: 657355 - RNA, 18 nt, Human
aucugcugcuucugcugc

SEQ ID NO: 657356 - RNA, 18 nt, Human
auugucuucuucaaccac

SEQ ID NO: 657357 - RNA, 20 nt, Human
auugugcucuuuguugauga

SEQ ID NO: 657358 - RNA, 21 nt, Human
caauauaacugacuagagggc

SEQ ID NO: 657359 - RNA, 21 nt, Human
caauauacacacguugauauc

SEQ ID NO: 657360 - RNA, 28 nt, Human
caaucauagaaacacugacauuuaaaac

SEQ ID NO: 657361 - RNA, 19 nt, Human
cacacguugauauccuucc

SEQ ID NO: 657362 - RNA, 22 nt, Human
caccaaccggcaucagacacac

SEQ ID NO: 657363 - RNA, 18 nt, Human
cacucaguuuugcuucca

SEQ ID NO: 657364 - RNA, 20 nt, Human
cagcaaagaggcaguggggc

SEQ ID NO: 657365 - RNA, 19 nt, Human
cagcgccgagaagcggcgg

SEQ ID NO: 657366 - RNA, 23 nt, Human
cagcuccaucuggaauuacugac

SEQ ID NO: 657367 - RNA, 22 nt, Human
caggagccacagcaggcaccag

SEQ ID NO: 657368 - RNA, 21 nt, Human
caguggagcagcaccauccuu

SEQ ID NO: 657369 - RNA, 20 nt, Human
ccacguccccggacccugcc

SEQ ID NO: 657370 - RNA, 25 nt, Human
ccaucuggaauuacugacgaaucau

SEQ ID NO: 657371 - RNA, 26 nt, Human
ccucuaucuuugacaccaaccggcau

SEQ ID NO: 657372 - RNA, 20 nt, Human
ccuggaggcucagcuuccac

SEQ ID NO: 657373 - RNA, 25 nt, Human
cgaaucaugaaaaaaugccuugucc

SEQ ID NO: 657374 - RNA, 21 nt, Human
cgccggccgccgcuagucgca

SEQ ID NO: 657375 - RNA, 22 nt, Human
cgccggccgccgcuagucgcac

SEQ ID NO: 657376 - RNA, 19 nt, Human
cggcgcgcggucgccgaag

SEQ ID NO: 657377 - RNA, 21 nt, Human
cggcgggaggaugccgcagcg

SEQ ID NO: 657378 - RNA, 23 nt, Human
cggggcuggggaaucccggggca

SEQ ID NO: 657379 - RNA, 21 nt, Human
cucaagagguuccagaucacc

SEQ ID NO: 657380 - RNA, 23 nt, Human
cugcaucugaaaaaguuccucau

SEQ ID NO: 657381 - RNA, 21 nt, Human
cuggcgcgggcuucgccggcc

SEQ ID NO: 657382 - RNA, 21 nt, Human
cuguacuuuaauaggaaaaga

SEQ ID NO: 657383 - RNA, 22 nt, Human
cuugggucauaggguaacucag

SEQ ID NO: 657384 - RNA, 18 nt, Human
gaaauaguccacgucccc

SEQ ID NO: 657385 - RNA, 18 nt, Human
gaacaagucuccuucaag

SEQ ID NO: 657386 - RNA, 19 nt, Human
gagaagcggcgggaggucc

SEQ ID NO: 657387 - RNA, 27 nt, Human
gagcgugcgggggcugggcggcgggag

SEQ ID NO: 657388 - RNA, 21 nt, Human
gaucugcugcuucugcugcuc

SEQ ID NO: 657389 - RNA, 24 nt, Human
gcaaacuucaaaggcgggcgaggg

SEQ ID NO: 657390 - RNA, 24 nt, Human
gcaggcaccaguggagcagcacca

SEQ ID NO: 657391 - RNA, 23 nt, Human
gcaucagacacacacuagguacc

SEQ ID NO: 657392 - RNA, 20 nt, Human
gccgcagcgacccgcggggc

SEQ ID NO: 657393 - RNA, 22 nt, Human
gccuggagggcggggacggagg

SEQ ID NO: 657394 - RNA, 24 nt, Human
gcggucggcacagcaaacuucaaa

SEQ ID NO: 657395 - RNA, 20 nt, Human
gcugcuucugcugcucaaga

SEQ ID NO: 657396 - RNA, 23 nt, Human
ggaaaauagaaaaaaaucccucc

SEQ ID NO: 657397 - RNA, 20 nt, Human
ggcagcgccgagaagcggcg

SEQ ID NO: 657398 - RNA, 20 nt, Human
gggagccgcgcggggcuggg

SEQ ID NO: 657399 - RNA, 22 nt, Human
gggcugggcggcgggaggaugc

SEQ ID NO: 657400 - RNA, 24 nt, Human
ggggacggaggcagauaaaagaga

SEQ ID NO: 657401 - RNA, 19 nt, Human
gugugugcaaugaauggca

SEQ ID NO: 657402 - RNA, 19 nt, Human
uaaaccggauggggaacua

SEQ ID NO: 657403 - RNA, 19 nt, Human
uaacucagugccuuccuca

SEQ ID NO: 657404 - RNA, 25 nt, Human
uaacugcuaauuucagcuccaucug

SEQ ID NO: 657405 - RNA, 22 nt, Human
uaauuuagaagcaguucaugca

SEQ ID NO: 657406 - RNA, 24 nt, Human
uaauuucagcuccaucuggaauuc

SEQ ID NO: 657407 - RNA, 20 nt, Human
uagaagcaguucaugcagug

SEQ ID NO: 657408 - RNA, 24 nt, Human
uagaagcaguucaugcagugguca

SEQ ID NO: 657409 - RNA, 19 nt, Human
uaggagaauaacucagugc

SEQ ID NO: 657410 - RNA, 23 nt, Human
uauguacaugaauauaauguaug

SEQ ID NO: 657411 - RNA, 20 nt, Human
ucaaaggcgggcgagggcgg

SEQ ID NO: 657412 - RNA, 19 nt, Human
ucaauccgcugaagugucc

SEQ ID NO: 657413 - RNA, 18 nt, Human
ucauagaaacacugacau

SEQ ID NO: 657414 - RNA, 18 nt, Human
uccucuggcagcuccugg

SEQ ID NO: 657415 - RNA, 19 nt, Human
uccuggaggcucagcuucc

SEQ ID NO: 657416 - RNA, 23 nt, Human
ucgccggccgccgcuagucgcac

SEQ ID NO: 657417 - RNA, 23 nt, Human
ucuguacuuuaauaggaaaagaa

SEQ ID NO: 657418 - RNA, 19 nt, Human
ugaaaaaaugccuuguccc

SEQ ID NO: 657419 - RNA, 18 nt, Human
ugaaaaaguuccucaucc

SEQ ID NO: 657420 - RNA, 22 nt, Human
ugaaagaagauccaacugauua

SEQ ID NO: 657421 - RNA, 24 nt, Human
ugagcugaguggaaacaggagcca

SEQ ID NO: 657422 - RNA, 19 nt, Human
ugauauaaaccggaugggg

SEQ ID NO: 657423 - RNA, 23 nt, Human
ugcgggggcugggcggcgggagg

SEQ ID NO: 657424 - RNA, 22 nt, Human
uggagcagcaccauccuuaaaa

SEQ ID NO: 657425 - RNA, 23 nt, Human
uggcaaguuccuucaagaagccc

SEQ ID NO: 657426 - RNA, 22 nt, Human
uggucaaagcaaggaauggcaa

SEQ ID NO: 657427 - RNA, 25 nt, Human
ugguguggugugcgaaauagucccg

SEQ ID NO: 657428 - RNA, 19 nt, Human
uguacaugagauacauaua

SEQ ID NO: 657429 - RNA, 22 nt, Human
ugucccggaucugcaucugaaa

SEQ ID NO: 657430 - RNA, 18 nt, Human
uuaaugaucugcugcuuc

SEQ ID NO: 657431 - RNA, 21 nt, Human
uugacaccaaccggcaucaga

SEQ ID NO: 657432 - RNA, 18 nt, Human
uuuugaaauugugcucuu

SEQ ID NO: 657433 - RNA, 23 nt, Human
uuuuuuuuuuuuuuuuuuaacag

SEQ ID NO: 657434 - RNA, 18 nt, Human
agacagggucuugcuaug

SEQ ID NO: 657435 - RNA, 23 nt, Human
agacagggucuugcuauguugcc

SEQ ID NO: 657436 - RNA, 20 nt, Human
agcacuuugggagacuaagg

SEQ ID NO: 657437 - RNA, 21 nt, Human
agcacuuugggagacuaaggc

SEQ ID NO: 657438 - RNA, 22 nt, Human
agccuugucaaaccacccgcag

SEQ ID NO: 657439 - RNA, 18 nt, Human
augagccucugugcgggg

SEQ ID NO: 657440 - RNA, 19 nt, Human
auguugcccaggcuggucu

SEQ ID NO: 657441 - RNA, 22 nt, Human
caagugaucuugcugcuucagc

SEQ ID NO: 657442 - RNA, 24 nt, Human
cagggucuugcuauguugcccagg

SEQ ID NO: 657443 - RNA, 23 nt, Human
cagguccagaaggaaucugcuag

SEQ ID NO: 657444 - RNA, 24 nt, Human
ccagaguaguugggauuggccagg

SEQ ID NO: 657445 - RNA, 27 nt, Human
ccagaguaguugggauuggccaggugu

SEQ ID NO: 657446 - RNA, 19 nt, Human
ccagccuugucaaaccacc

SEQ ID NO: 657447 - RNA, 21 nt, Human
ccaggccuggucgcuggugug

SEQ ID NO: 657448 - RNA, 22 nt, Human
cccugcgugcuucgagcuccau

SEQ ID NO: 657449 - RNA, 23 nt, Human
cgcuguaauccuagcacuuuggg

SEQ ID NO: 657450 - RNA, 23 nt, Human
cggcacccuacagguccagaagg

SEQ ID NO: 657451 - RNA, 23 nt, Human
cuuccagaguaguugggauuggc

SEQ ID NO: 657452 - RNA, 25 nt, Human
cuuuuacuuuuuuuuuuucuuuaga

SEQ ID NO: 657453 - RNA, 21 nt, Human
gcggcugggcuagggcggcac

SEQ ID NO: 657454 - RNA, 22 nt, Human
gcuccaggccuggucgcuggug

SEQ ID NO: 657455 - RNA, 24 nt, Human
gucuugcuauguugcccaggcugg

SEQ ID NO: 657456 - RNA, 23 nt, Human
gugaucuugcugcuucagcuucc

SEQ ID NO: 657457 - RNA, 20 nt, Human
uacuuuuuuuuuuucuuuag

SEQ ID NO: 657458 - RNA, 22 nt, Human
uagagacagggucuugcuaugu

SEQ ID NO: 657459 - RNA, 24 nt, Human
uagcacuuugggagacuaaggcgg

SEQ ID NO: 657460 - RNA, 23 nt, Human
uauguugcccaggcuggucuuaa

SEQ ID NO: 657461 - RNA, 24 nt, Human
uauguugcccaggcuggucuuaaa

SEQ ID NO: 657462 - RNA, 22 nt, Human
ucacgcuguaauccuagcacuu

SEQ ID NO: 657463 - RNA, 24 nt, Human
ucacgcuguaauccuagcacuuug

SEQ ID NO: 657464 - RNA, 21 nt, Human
ucagaagugugagcuccagga

SEQ ID NO: 657465 - RNA, 27 nt, Human
ucagcagcugagccaagaccggggucc

SEQ ID NO: 657466 - RNA, 20 nt, Human
ucaguaacgugaaggcccuc

SEQ ID NO: 657467 - RNA, 20 nt, Human
uccugggcucaagugaucuu

SEQ ID NO: 657468 - RNA, 23 nt, Human
ucuuaaacuccugggcucaagug

SEQ ID NO: 657469 - RNA, 18 nt, Human
ucuugcuauguugcccag

SEQ ID NO: 657470 - RNA, 19 nt, Human
ucuugcuauguugcccagg

SEQ ID NO: 657471 - RNA, 23 nt, Human
ucuugcuauguugcccaggcugg

SEQ ID NO: 657472 - RNA, 24 nt, Human
ucuugcuauguugcccaggcuggu

SEQ ID NO: 657473 - RNA, 24 nt, Human
ugcccaggcuggucuuaaacuccu

SEQ ID NO: 657474 - RNA, 28 nt, Human
ugcccaggcuggucuuaaacuccugggc

SEQ ID NO: 657475 - RNA, 27 nt, Human
ugcuauguugcccaggcuggucuuaaa

SEQ ID NO: 657476 - RNA, 20 nt, Human
ugggcucaagugaucuugcu

SEQ ID NO: 657477 - RNA, 24 nt, Human
ugggcucaagugaucuugcugcuu

SEQ ID NO: 657478 - RNA, 24 nt, Human
uuacuuuuuuuuuuucuuuagaga

SEQ ID NO: 657479 - RNA, 25 nt, Human
uuuuuuuucuuuagagacagggucu

SEQ ID NO: 657480 - RNA, 25 nt, Human
uuuuuuuuuuucuuuagagacaggg

SEQ ID NO: 657481 - RNA, 24 nt, Human
aauuuccucuugccagacucccau

SEQ ID NO: 657482 - RNA, 19 nt, Human
cuugccagacucccaucca

SEQ ID NO: 657483 - RNA, 24 nt, Human
ucuuuauuucacuuauuauuuauu

SEQ ID NO: 657484 - RNA, 25 nt, Human
uugccagacucccauccaaagaguc

SEQ ID NO: 657485 - RNA, 21 nt, Human
uuuuuuuuuuuuucuuuauuu

SEQ ID NO: 657486 - RNA, 18 nt, Human
agcccagugggggugugu

SEQ ID NO: 657487 - RNA, 21 nt, Human
aguccaguggcgcgaucucag

SEQ ID NO: 657488 - RNA, 21 nt, Human
cacugcaaccuccgccuccca

SEQ ID NO: 657489 - RNA, 21 nt, Human
caggagcccagugggggugug

SEQ ID NO: 657490 - RNA, 21 nt, Human
ccaggcuggaguccaguggcg

SEQ ID NO: 657491 - RNA, 22 nt, Human
cccggcugcggcugcgaacccc

SEQ ID NO: 657492 - RNA, 20 nt, Human
cccuaccgugcccgcccgcc

SEQ ID NO: 657493 - RNA, 21 nt, Human
ccgccccugggugcccgaucc

SEQ ID NO: 657494 - RNA, 24 nt, Human
ccgccucccagguucaagcgauuc

SEQ ID NO: 657495 - RNA, 22 nt, Human
ccucccagguucaagcgauucu

SEQ ID NO: 657496 - RNA, 24 nt, Human
cucacugcaaccuccgccucccag

SEQ ID NO: 657497 - RNA, 23 nt, Human
cugcaaccuccgccucccagguu

SEQ ID NO: 657498 - RNA, 24 nt, Human
cugcaaccuccgccucccagguuc

SEQ ID NO: 657499 - RNA, 22 nt, Human
gcccgaucccggcugcggcugc

SEQ ID NO: 657500 - RNA, 19 nt, Human
guccaguggcgcgaucuca

SEQ ID NO: 657501 - RNA, 24 nt, Human
gucuugcucuguuguccaggcugg

SEQ ID NO: 657502 - RNA, 20 nt, Human
uaccgugcccgcccgccccu

SEQ ID NO: 657503 - RNA, 19 nt, Human
ucacugcaaccuccgccuc

SEQ ID NO: 657504 - RNA, 24 nt, Human
ucacugcaaccuccgccucccagg

SEQ ID NO: 657505 - RNA, 25 nt, Human
ucacugcaaccuccgccucccaggu

SEQ ID NO: 657506 - RNA, 27 nt, Human
ucacugcaaccuccgccucccagguuc

SEQ ID NO: 657507 - RNA, 27 nt, Human
ucagcucacugcaaccuccgccuccca

SEQ ID NO: 657508 - RNA, 19 nt, Human
ucccagguucaagcgauuc

SEQ ID NO: 657509 - RNA, 21 nt, Human
ucccagguucaagcgauucuc

SEQ ID NO: 657510 - RNA, 23 nt, Human
ucccggcugcggcugcgaacccc

SEQ ID NO: 657511 - RNA, 23 nt, Human
ucuugcucuguuguccaggcugg

SEQ ID NO: 657512 - RNA, 24 nt, Human
ucuugcucuguuguccaggcugga

SEQ ID NO: 657513 - RNA, 19 nt, Human
ugcccgaucccggcugcgg

SEQ ID NO: 657514 - RNA, 19 nt, Human
uggaguccaguggcgcgau

SEQ ID NO: 657515 - RNA, 24 nt, Human
uggcgcgaucucagcucacugcaa

SEQ ID NO: 657516 - RNA, 21 nt, Human
uguccaggcuggaguccagug

SEQ ID NO: 657517 - RNA, 24 nt, Human
uguccaggcuggaguccaguggcg

SEQ ID NO: 657518 - RNA, 24 nt, Human
uugcucuguuguccaggcuggagu

SEQ ID NO: 657519 - RNA, 24 nt, Human
uuguccaggcuggaguccaguggc

SEQ ID NO: 657520 - RNA, 19 nt, Human
uuuuuauuuauuuauuuuu

SEQ ID NO: 657521 - RNA, 21 nt, Human
uuuuuuuuuuuuuuuuuauuu

SEQ ID NO: 657522 - RNA, 21 nt, Human
aaacaaacacagguuccccca

SEQ ID NO: 657523 - RNA, 19 nt, Human
aacacagguucccccaccc

SEQ ID NO: 657524 - RNA, 23 nt, Human
aacacagguucccccacccaugg

SEQ ID NO: 657525 - RNA, 21 nt, Human
aagaagcaucuugcuuacuga

SEQ ID NO: 657526 - RNA, 21 nt, Human
acagggugaucgcuucugacc

SEQ ID NO: 657527 - RNA, 19 nt, Human
acccgccaugcgccagcgg

SEQ ID NO: 657528 - RNA, 18 nt, Human
accucccuccccacccuc

SEQ ID NO: 657529 - RNA, 19 nt, Human
acucugaauaaaggaugga

SEQ ID NO: 657530 - RNA, 24 nt, Human
aggagaagaagaggguguagacgg

SEQ ID NO: 657531 - RNA, 26 nt, Human
aggaggcccuuggagggccgguagac

SEQ ID NO: 657532 - RNA, 21 nt, Human
aggauggaggagaagaagagg

SEQ ID NO: 657533 - RNA, 21 nt, Human
aggauggaggagaagaagagg

SEQ ID NO: 657534 - RNA, 22 nt, Human
aggauggaggagaagaagaggg

SEQ ID NO: 657535 - RNA, 19 nt, Human
caaagcccagccugacggc

SEQ ID NO: 657536 - RNA, 23 nt, Human
caaagcccagccugacggcccuu

SEQ ID NO: 657537 - RNA, 19 nt, Human
caauguguaucaacagggu

SEQ ID NO: 657538 - RNA, 18 nt, Human
cagccucuggggugggcc

SEQ ID NO: 657539 - RNA, 21 nt, Human
cagcggcggccggcggcgucc

SEQ ID NO: 657540 - RNA, 19 nt, Human
cagguucccccacccaugg

SEQ ID NO: 657541 - RNA, 24 nt, Human
ccagaaccaauccuacaguaucuu

SEQ ID NO: 657542 - RNA, 24 nt, Human
ccagcggcggccggcggcgucccc

SEQ ID NO: 657543 - RNA, 20 nt, Human
ccaugcgccagcggcggccg

SEQ ID NO: 657544 - RNA, 19 nt, Human
cccaaagcccagccugacg

SEQ ID NO: 657545 - RNA, 18 nt, Human
cccacugaggcagacagc

SEQ ID NO: 657546 - RNA, 23 nt, Human
cccagcccaggccucugcugccc

SEQ ID NO: 657547 - RNA, 21 nt, Human
cccccaccucccuccccaccc

SEQ ID NO: 657548 - RNA, 23 nt, Human
cccucugagagaaaagacgguuu

SEQ ID NO: 657549 - RNA, 25 nt, Human
cccuuggaggcugggggugcugccc

SEQ ID NO: 657550 - RNA, 18 nt, Human
ccgaguccugggggcaag

SEQ ID NO: 657551 - RNA, 19 nt, Human
ccucagggcugggaauggg

SEQ ID NO: 657552 - RNA, 23 nt, Human
ccucuguccagccucuggggugg

SEQ ID NO: 657553 - RNA, 24 nt, Human
ccuuggagggcaggcacacggugc

SEQ ID NO: 657554 - RNA, 23 nt, Human
cgccagcggcggccggcggcguc

SEQ ID NO: 657555 - RNA, 19 nt, Human
cuagccagccaaggccaac

SEQ ID NO: 657556 - RNA, 20 nt, Human
cucaauggcccaaagcccag

SEQ ID NO: 657557 - RNA, 26 nt, Human
cugaggcagacagcuagaggugcugc

SEQ ID NO: 657558 - RNA, 20 nt, Human
gaauagaguggggcagaagg

SEQ ID NO: 657559 - RNA, 18 nt, Human
gagaagaagaggguguag

SEQ ID NO: 657560 - RNA, 22 nt, Human
gaggagaagaagaggguguaga

SEQ ID NO: 657561 - RNA, 20 nt, Human
gagggcaggcacacggugcc

SEQ ID NO: 657562 - RNA, 22 nt, Human
gcccuuggaggcugggggugcu

SEQ ID NO: 657563 - RNA, 20 nt, Human
gcgccacagcuccuacccgc

SEQ ID NO: 657564 - RNA, 24 nt, Human
gcugcccccaccucccuccccacc

SEQ ID NO: 657565 - RNA, 23 nt, Human
ggaaggccccgcgccacagcucc

SEQ ID NO: 657566 - RNA, 23 nt, Human
ggaggcccuuggagggccgguac

SEQ ID NO: 657567 - RNA, 18 nt, Human
ggauggaggagaagaaga

SEQ ID NO: 657568 - RNA, 20 nt, Human
ggcacccagcccaggccucu

SEQ ID NO: 657569 - RNA, 22 nt, Human
ggccucugcugcccccaccucc

SEQ ID NO: 657570 - RNA, 22 nt, Human
gggaagggcgagaugacucuga

SEQ ID NO: 657571 - RNA, 24 nt, Human
gggcacccagcccaggccucugcu

SEQ ID NO: 657572 - RNA, 21 nt, Human
gggggugcugcccuugccagc

SEQ ID NO: 657573 - RNA, 18 nt, Human
ggggugggccucagggcu

SEQ ID NO: 657574 - RNA, 19 nt, Human
gucccagggguagggcgga

SEQ ID NO: 657575 - RNA, 23 nt, Human
uagaggaggcccuuggagggcag

SEQ ID NO: 657576 - RNA, 18 nt, Human
uagaguggggcagaaggu

SEQ ID NO: 657577 - RNA, 25 nt, Human
uagaguggggcagaagguggguuau

SEQ ID NO: 657578 - RNA, 21 nt, Human
uagccagccaaggccaacguc

SEQ ID NO: 657579 - RNA, 18 nt, Human
uagggcggaaguggggug

SEQ ID NO: 657580 - RNA, 22 nt, Human
ucccagggguagggcggaagug

SEQ ID NO: 657581 - RNA, 18 nt, Human
ucccucuguccagccucu

SEQ ID NO: 657582 - RNA, 23 nt, Human
ugacggcccuuggaggcuggggg

SEQ ID NO: 657583 - RNA, 18 nt, Human
ugcacacaaacaaacaca

SEQ ID NO: 657584 - RNA, 21 nt, Human
ugcacacaaacaaacacaggu

SEQ ID NO: 657585 - RNA, 22 nt, Human
ugcaugggccagaaccaauccu

SEQ ID NO: 657586 - RNA, 22 nt, Human
ugcaugggccagaaccaauccu

SEQ ID NO: 657587 - RNA, 23 nt, Human
uggcccaaagcccagccugacgg

SEQ ID NO: 657588 - RNA, 19 nt, Human
uguagacggagggcccuug

SEQ ID NO: 657589 - RNA, 26 nt, Human
uuguggguuuccuucccgacuugaau

SEQ ID NO: 657590 - RNA, 21 nt, Human
uuuuuuuuuuuugaaagggcu

SEQ ID NO: 657591 - RNA, 23 nt, Human
uuuuuuuuuuuugaaagggcuca

SEQ ID NO: 657592 - RNA, 21 nt, Human
uuuuuuuuuuuuuugaaaggg

SEQ ID NO: 657593 - RNA, 24 nt, Human
uuuuuuuuuuuuuuuuugaaaggg

SEQ ID NO: 657594 - RNA, 18 nt, Human
aagaagaucuaacauuca

SEQ ID NO: 657595 - RNA, 21 nt, Human
acccuaaggccuuucuccauu

SEQ ID NO: 657596 - RNA, 23 nt, Human
agaagaucuaacauucacaagaa

SEQ ID NO: 657597 - RNA, 21 nt, Human
aggaaagggcccgggccaccc

SEQ ID NO: 657598 - RNA, 18 nt, Human
aggaauucucaucuugcc

SEQ ID NO: 657599 - RNA, 20 nt, Human
aguacauaaccugucacccu

SEQ ID NO: 657600 - RNA, 24 nt, Human
caaacucagcgagaucaaaacucc

SEQ ID NO: 657601 - RNA, 24 nt, Human
caagaauacagggcucccucucuc

SEQ ID NO: 657602 - RNA, 23 nt, Human
caagaccacuccuuuccuccccc

SEQ ID NO: 657603 - RNA, 19 nt, Human
cacuccuuuccucccccaa

SEQ ID NO: 657604 - RNA, 20 nt, Human
cauuugaaccaagaccacuc

SEQ ID NO: 657605 - RNA, 26 nt, Human
ccacuccuuuccucccccaacuccaa

SEQ ID NO: 657606 - RNA, 23 nt, Human
cccaacuccaaacucagcgagau

SEQ ID NO: 657607 - RNA, 21 nt, Human
cccucucucuggagcuccaag

SEQ ID NO: 657608 - RNA, 24 nt, Human
cccugggcgccgccaccgagccuc

SEQ ID NO: 657609 - RNA, 20 nt, Human
cgccaccgagccucagaccc

SEQ ID NO: 657610 - RNA, 21 nt, Human
cuccaaggcagagggcugucu

SEQ ID NO: 657611 - RNA, 19 nt, Human
cuggagcuccaaggcagag

SEQ ID NO: 657612 - RNA, 19 nt, Human
cugucacccuaaggccuuu

SEQ ID NO: 657613 - RNA, 18 nt, Human
cuuccggcgcuggucgcc

SEQ ID NO: 657614 - RNA, 19 nt, Human
gaacagcgugagucgccac

SEQ ID NO: 657615 - RNA, 20 nt, Human
gacccgccucugagcggcga

SEQ ID NO: 657616 - RNA, 18 nt, Human
gagaacagcgugagucgc

SEQ ID NO: 657617 - RNA, 20 nt, Human
gagaacagcgugagucgccc

SEQ ID NO: 657618 - RNA, 21 nt, Human
gggaaauaaauauuuauuaaa

SEQ ID NO: 657619 - RNA, 22 nt, Human
gguguggcuaacggauuuccau

SEQ ID NO: 657620 - RNA, 18 nt, Human
uaggccuuuggcugaaac

SEQ ID NO: 657621 - RNA, 21 nt, Human
ucaaaacuccauucgacgggu

SEQ ID NO: 657622 - RNA, 21 nt, Human
ucacaagaacagcaaaaguga

SEQ ID NO: 657623 - RNA, 25 nt, Human
ucagcgagaucaaaacuccauucga

SEQ ID NO: 657624 - RNA, 24 nt, Human
uccaaacucagcgagaucaaaacu

SEQ ID NO: 657625 - RNA, 22 nt, Human
uccacugugaacuuucuggugu

SEQ ID NO: 657626 - RNA, 21 nt, Human
uccauucgacggguacagcca

SEQ ID NO: 657627 - RNA, 21 nt, Human
uccucagaguuucuguuuuaa

SEQ ID NO: 657628 - RNA, 23 nt, Human
ugaggucauauugauucagagac

SEQ ID NO: 657629 - RNA, 19 nt, Human
ugccuccagugugcauauu

SEQ ID NO: 657630 - RNA, 21 nt, Human
uggagcuccaaggcagagggc

SEQ ID NO: 657631 - RNA, 22 nt, Human
uuaauggucauaaggguguaug

SEQ ID NO: 657632 - RNA, 26 nt, Human
uucaagauuuuuuccacugugaacuu

SEQ ID NO: 657633 - RNA, 20 nt, Human
uucacaagaacagcaaaagu

SEQ ID NO: 657634 - RNA, 22 nt, Human
uuuccaucuguuaccuucaaga

SEQ ID NO: 657635 - RNA, 19 nt, Human
uuuuuuuuuuuuaaugguc

SEQ ID NO: 657636 - RNA, 23 nt, Human
uuuuuuuuuuuuuuuuuuaaugg

SEQ ID NO: 657637 - RNA, 18 nt, Human
aaaacauccuggugcuaa

SEQ ID NO: 657638 - RNA, 25 nt, Human
aaacaaacauauaaauaaacaacca

SEQ ID NO: 657639 - RNA, 24 nt, Human
aaagugcugggauuacaggcauga

SEQ ID NO: 657640 - RNA, 20 nt, Human
aagggcucgguccaacuugc

SEQ ID NO: 657641 - RNA, 19 nt, Human
aagugcugggauuacaggc

SEQ ID NO: 657642 - RNA, 21 nt, Human
aagugcugggauuacaggcau

SEQ ID NO: 657643 - RNA, 26 nt, Human
aagugcugggauuacaggcaugagcc

SEQ ID NO: 657644 - RNA, 20 nt, Human
aaugcaguggcgugaucuug

SEQ ID NO: 657645 - RNA, 24 nt, Human
aaugcaguggcgugaucuugguuc

SEQ ID NO: 657646 - RNA, 18 nt, Human
acaggguuucaccauguu

SEQ ID NO: 657647 - RNA, 23 nt, Human
acaggguuucaccauguuggcca

SEQ ID NO: 657648 - RNA, 24 nt, Human
acaggguuucaccauguuggccag

SEQ ID NO: 657649 - RNA, 24 nt, Human
accauguuggccaggauggucucg

SEQ ID NO: 657650 - RNA, 20 nt, Human
agacagagucuugcucugca

SEQ ID NO: 657651 - RNA, 21 nt, Human
agguucaagugauucuccugc

SEQ ID NO: 657652 - RNA, 22 nt, Human
agguucaagugauucuccugcc

SEQ ID NO: 657653 - RNA, 22 nt, Human
aguagagacaggguuucaccau

SEQ ID NO: 657654 - RNA, 18 nt, Human
agugcugggauuacaggc

SEQ ID NO: 657655 - RNA, 20 nt, Human
auccucccaccucagaaucc

SEQ ID NO: 657656 - RNA, 23 nt, Human
auggagcgaaugaaugcucuuaa

SEQ ID NO: 657657 - RNA, 24 nt, Human
auuuuuguguuuuuaguagagaca

SEQ ID NO: 657658 - RNA, 26 nt, Human
caaacaaacauauaaauaaacaacca

SEQ ID NO: 657659 - RNA, 20 nt, Human
caaacucugccugccagguu

SEQ ID NO: 657660 - RNA, 24 nt, Human
caaagugcugggauuacaggcaug

SEQ ID NO: 657661 - RNA, 20 nt, Human
caagugauucuccugccuca

SEQ ID NO: 657662 - RNA, 22 nt, Human
caagugauucuccugccucagc

SEQ ID NO: 657663 - RNA, 23 nt, Human
caccacacccagcuaauuuuugu

SEQ ID NO: 657664 - RNA, 18 nt, Human
caccauguuggccaggau

SEQ ID NO: 657665 - RNA, 22 nt, Human
caccauguuggccaggaugguc

SEQ ID NO: 657666 - RNA, 24 nt, Human
caccauguuggccaggauggucuc

SEQ ID NO: 657667 - RNA, 19 nt, Human
cacugcaaacucugccugc

SEQ ID NO: 657668 - RNA, 22 nt, Human
cagccuccugaggagcugggac

SEQ ID NO: 657669 - RNA, 21 nt, Human
caggcgcgcaccaccacaccc

SEQ ID NO: 657670 - RNA, 24 nt, Human
caggguuucaccauguuggccagg

SEQ ID NO: 657671 - RNA, 19 nt, Human
cagucagcauuccuccugc

SEQ ID NO: 657672 - RNA, 23 nt, Human
ccaaagugcugggauuacaggca

SEQ ID NO: 657673 - RNA, 24 nt, Human
ccaaagugcugggauuacaggcau

SEQ ID NO: 657674 - RNA, 18 nt, Human
ccagguucaagugauucu

SEQ ID NO: 657675 - RNA, 19 nt, Human
ccagguucaagugauucuc

SEQ ID NO: 657676 - RNA, 24 nt, Human
cccaaagugcugggauuacaggca

SEQ ID NO: 657677 - RNA, 20 nt, Human
ccugaggagcugggacuaca

SEQ ID NO: 657678 - RNA, 23 nt, Human
ccugaggagcugggacuacaggc

SEQ ID NO: 657679 - RNA, 24 nt, Human
ccugccagguucaagugauucucc

SEQ ID NO: 657680 - RNA, 18 nt, Human
cgcgcaccaccacaccca

SEQ ID NO: 657681 - RNA, 23 nt, Human
cgcgcaccaccacacccagcuaa

SEQ ID NO: 657682 - RNA, 25 nt, Human
cugccagguucaagugauucuccug

SEQ ID NO: 657683 - RNA, 23 nt, Human
cugccucagccuccugaggagcu

SEQ ID NO: 657684 - RNA, 22 nt, Human
cugugcauccucagcuggacac

SEQ ID NO: 657685 - RNA, 18 nt, Human
cuucaaagggcucggucc

SEQ ID NO: 657686 - RNA, 22 nt, Human
gaccucaugauccucccaccuc

SEQ ID NO: 657687 - RNA, 23 nt, Human
gauagauuuuuuuuaagaagaga

SEQ ID NO: 657688 - RNA, 18 nt, Human
gauuacaggcaugagcca

SEQ ID NO: 657689 - RNA, 22 nt, Human
gauuacaggcaugagccacugc

SEQ ID NO: 657690 - RNA, 22 nt, Human
gauuacaggcaugagccacugc

SEQ ID NO: 657691 - RNA, 21 nt, Human
gauucuccugccucagccucc

SEQ ID NO: 657692 - RNA, 22 nt, Human
gcaaacucugccugccagguuc

SEQ ID NO: 657693 - RNA, 23 nt, Human
gccucuuugaauuuuuuuaaaaa

SEQ ID NO: 657694 - RNA, 19 nt, Human
gcgcgcaccaccacaccca

SEQ ID NO: 657695 - RNA, 22 nt, Human
ggauuacaggcaugagccacug

SEQ ID NO: 657696 - RNA, 22 nt, Human
ggcuguaaugcaguggcgugau

SEQ ID NO: 657697 - RNA, 22 nt, Human
ggguuucaccauguuggccagg

SEQ ID NO: 657698 - RNA, 24 nt, Human
gguuucaccauguuggccaggaug

SEQ ID NO: 657699 - RNA, 24 nt, Human
gugauucuccugccucagccuccu

SEQ ID NO: 657700 - RNA, 25 nt, Human
uaaauaaacaaccaggcccucuucc

SEQ ID NO: 657701 - RNA, 22 nt, Human
uaauuuuuguguuuuuaguaga

SEQ ID NO: 657702 - RNA, 24 nt, Human
uaauuuuuguguuuuuaguagaga

SEQ ID NO: 657703 - RNA, 22 nt, Human
uacaggcaugagccacugcgcc

SEQ ID NO: 657704 - RNA, 22 nt, Human
uagagacaggguuucaccaugu

SEQ ID NO: 657705 - RNA, 24 nt, Human
uaguagagacaggguuucaccaug

SEQ ID NO: 657706 - RNA, 25 nt, Human
uaguagagacaggguuucaccaugu

SEQ ID NO: 657707 - RNA, 19 nt, Human
ucaagugauucuccugccu

SEQ ID NO: 657708 - RNA, 24 nt, Human
ucaccauguuggccaggauggucu

SEQ ID NO: 657709 - RNA, 18 nt, Human
ucacugcaaacucugccu

SEQ ID NO: 657710 - RNA, 19 nt, Human
ucacugcaaacucugccug

SEQ ID NO: 657711 - RNA, 24 nt, Human
ucacugcaaacucugccugccagg

SEQ ID NO: 657712 - RNA, 19 nt, Human
ucaugguauguugcuuccu

SEQ ID NO: 657713 - RNA, 24 nt, Human
ucccaaagugcugggauuacaggc

SEQ ID NO: 657714 - RNA, 24 nt, Human
uccugaggagcugggacuacaggc

SEQ ID NO: 657715 - RNA, 24 nt, Human
ucuccugccucagccuccugagga

SEQ ID NO: 657716 - RNA, 21 nt, Human
ugacucauaauggcuucuugc

SEQ ID NO: 657717 - RNA, 18 nt, Human
ugagacagagucuugcuc

SEQ ID NO: 657718 - RNA, 22 nt, Human
ugagacagagucuugcucugca

SEQ ID NO: 657719 - RNA, 23 nt, Human
ugauagauuuuuuuuaagaagag

SEQ ID NO: 657720 - RNA, 20 nt, Human
ugauucuccugccucagccu

SEQ ID NO: 657721 - RNA, 18 nt, Human
ugcauaggaaacaauuau

SEQ ID NO: 657722 - RNA, 24 nt, Human
ugccagguucaagugauucuccug

SEQ ID NO: 657723 - RNA, 24 nt, Human
ugccucagccuccugaggagcugg

SEQ ID NO: 657724 - RNA, 23 nt, Human
uggccaggauggucucgaucccu

SEQ ID NO: 657725 - RNA, 19 nt, Human
uggcuucuugcaaacacuc

SEQ ID NO: 657726 - RNA, 24 nt, Human
ugggacuacaggcgcgcaccacca

SEQ ID NO: 657727 - RNA, 18 nt, Human
ugggauuacaggcaugag

SEQ ID NO: 657728 - RNA, 19 nt, Human
ugggauuacaggcaugagc

SEQ ID NO: 657729 - RNA, 21 nt, Human
ugggauuacaggcaugagcca

SEQ ID NO: 657730 - RNA, 22 nt, Human
ugggauuacaggcaugagccac

SEQ ID NO: 657731 - RNA, 22 nt, Human
ugggauuacaggcaugagccac

SEQ ID NO: 657732 - RNA, 23 nt, Human
ugggauuacaggcaugagccacu

SEQ ID NO: 657733 - RNA, 24 nt, Human
ugggauuacaggcaugagccacug

SEQ ID NO: 657734 - RNA, 24 nt, Human
ugggauuacaggcaugagccacug

SEQ ID NO: 657735 - RNA, 18 nt, Human
uggugcuaaaaggcagca

SEQ ID NO: 657736 - RNA, 24 nt, Human
uguaaugcaguggcgugaucuugg

SEQ ID NO: 657737 - RNA, 24 nt, Human
uuaguagagacaggguuucaccau

SEQ ID NO: 657738 - RNA, 21 nt, Human
uucaagugauucuccugccuc

SEQ ID NO: 657739 - RNA, 23 nt, Human
uucaagugauucuccugccucag

SEQ ID NO: 657740 - RNA, 24 nt, Human
uucaagugauucuccugccucagc

SEQ ID NO: 657741 - RNA, 18 nt, Human
uucaucaaccagucagca

SEQ ID NO: 657742 - RNA, 18 nt, Human
uuccaugacucauaaugg

SEQ ID NO: 657743 - RNA, 19 nt, Human
uucugaguauucuucaaag

SEQ ID NO: 657744 - RNA, 22 nt, Human
uugaucucacugaugcacugug

SEQ ID NO: 657745 - RNA, 19 nt, Human
uuucaccauguuggccagg

SEQ ID NO: 657746 - RNA, 20 nt, Human
uuucaccauguuggccagga

SEQ ID NO: 657747 - RNA, 24 nt, Human
uuuuuaguagagacaggguuucac

SEQ ID NO: 657748 - RNA, 20 nt, Human
uuuuuguguuuuuaguagag

SEQ ID NO: 657749 - RNA, 20 nt, Human
uuuuuuuuuuugagacagag

SEQ ID NO: 657750 - RNA, 24 nt, Human
uuuuuuuuuuuugagacagagucu

SEQ ID NO: 657751 - RNA, 27 nt, Human
uuuuuuuuuuuuuuuuuuuuuuugggg

SEQ ID NO: 657752 - RNA, 27 nt, Human
aaacaggcaagucacaggauuuucaaa

SEQ ID NO: 657753 - RNA, 27 nt, Human
aaacauaaugagaagaugccgguaccc

SEQ ID NO: 657754 - RNA, 18 nt, Human
aagaaaaagauuacagga

SEQ ID NO: 657755 - RNA, 20 nt, Human
aagaggcuuuaacaugagaa

SEQ ID NO: 657756 - RNA, 19 nt, Human
acccagcgccucacagaca

SEQ ID NO: 657757 - RNA, 19 nt, Human
agaagaugcuugccagcuc

SEQ ID NO: 657758 - RNA, 20 nt, Human
agcaaacauuugagaggaug

SEQ ID NO: 657759 - RNA, 19 nt, Human
aggcuuuaacaugagaaau

SEQ ID NO: 657760 - RNA, 21 nt, Human
auauaugauccacagguuaca

SEQ ID NO: 657761 - RNA, 23 nt, Human
aucagcaaacauuugagaggaug

SEQ ID NO: 657762 - RNA, 25 nt, Human
ccagagcccuggggacgugcaccca

SEQ ID NO: 657763 - RNA, 23 nt, Human
ccagcgccucacagacagacacg

SEQ ID NO: 657764 - RNA, 20 nt, Human
ccccacuccaaaaggccaaa

SEQ ID NO: 657765 - RNA, 21 nt, Human
cccccacuccaaaaggccaaa

SEQ ID NO: 657766 - RNA, 23 nt, Human
ccgccgccuucgccccacguugc

SEQ ID NO: 657767 - RNA, 26 nt, Human
ccgccgccuucgccccacguugcucc

SEQ ID NO: 657768 - RNA, 20 nt, Human
ccggccgccaacgcucccag

SEQ ID NO: 657769 - RNA, 19 nt, Human
ccgggccuucgccgccgcc

SEQ ID NO: 657770 - RNA, 19 nt, Human
ccgggccuucgccgccgcc

SEQ ID NO: 657771 - RNA, 23 nt, Human
ccggugcgucgcagacaucgcuc

SEQ ID NO: 657772 - RNA, 19 nt, Human
ccuagcccagagcccuggg

SEQ ID NO: 657773 - RNA, 18 nt, Human
ccuucgccgccgccuucg

SEQ ID NO: 657774 - RNA, 21 nt, Human
cgccgcugccuuccuagccca

SEQ ID NO: 657775 - RNA, 18 nt, Human
cuccgagacucccacagg

SEQ ID NO: 657776 - RNA, 24 nt, Human
gacacaagggauuacuggaaagaa

SEQ ID NO: 657777 - RNA, 22 nt, Human
gcccgggccuucgccgccgccu

SEQ ID NO: 657778 - RNA, 25 nt, Human
ggauuuucaaaaaguauaacaauuc

SEQ ID NO: 657779 - RNA, 19 nt, Human
ggccaaaacguuucaacag

SEQ ID NO: 657780 - RNA, 21 nt, Human
gggacgugcacccagcgccuc

SEQ ID NO: 657781 - RNA, 20 nt, Human
uagaaugaaacacauuuuag

SEQ ID NO: 657782 - RNA, 19 nt, Human
uagcccagagcccugggga

SEQ ID NO: 657783 - RNA, 24 nt, Human
ucacagacagacacgucuccgaga

SEQ ID NO: 657784 - RNA, 23 nt, Human
ucagauuuguccuucccccacuc

SEQ ID NO: 657785 - RNA, 20 nt, Human
ucccacaggccuuccucgga

SEQ ID NO: 657786 - RNA, 20 nt, Human
uccgagacucccacaggccu

SEQ ID NO: 657787 - RNA, 21 nt, Human
uccgagacucccacaggccuu

SEQ ID NO: 657788 - RNA, 19 nt, Human
uccucggagccgcuuccgg

SEQ ID NO: 657789 - RNA, 21 nt, Human
ucgccgccgccuucgccccac

SEQ ID NO: 657790 - RNA, 27 nt, Human
ugcaacagacacaagggauuacuggaa

SEQ ID NO: 657791 - RNA, 23 nt, Human
ugccuuguccuucucccuguauc

SEQ ID NO: 657792 - RNA, 18 nt, Human
ugggacuccggccgccaa

SEQ ID NO: 657793 - RNA, 26 nt, Human
uucaaaaaguauaacaauucagguaa

SEQ ID NO: 657794 - RNA, 18 nt, Human
uuccuagcccagagcccu

SEQ ID NO: 657795 - RNA, 22 nt, Human
uuucuuauagaaagcaauucca

SEQ ID NO: 657796 - RNA, 20 nt, Human
uuuuuuuuuuuuuuuuccau

SEQ ID NO: 657797 - RNA, 24 nt, Human
uuuuuuuuuuuuuuuuuuuccaug

SEQ ID NO: 657798 - RNA, 18 nt, Human
aaaugccauuuuuguuuc

SEQ ID NO: 657799 - RNA, 24 nt, Human
aagaagaaaagaagauucugucaa

SEQ ID NO: 657800 - RNA, 21 nt, Human
aagcaguugcaguaccaaaau

SEQ ID NO: 657801 - RNA, 18 nt, Human
aagguuuuaauuuauucu

SEQ ID NO: 657802 - RNA, 23 nt, Human
aaucacuuuuuacuaagauuuau

SEQ ID NO: 657803 - RNA, 24 nt, Human
aauuauauauccaaaacaaaucca

SEQ ID NO: 657804 - RNA, 21 nt, Human
auaaaaaccuacauagacuac

SEQ ID NO: 657805 - RNA, 24 nt, Human
caagaggaaagcaguugcaguacc

SEQ ID NO: 657806 - RNA, 22 nt, Human
caccagaauauaaaauaauaaa

SEQ ID NO: 657807 - RNA, 23 nt, Human
cauuuuuguuucauagacagaga

SEQ ID NO: 657808 - RNA, 25 nt, Human
ccaaaaucuaaacacuuuuggcaag

SEQ ID NO: 657809 - RNA, 28 nt, Human
cuuguaggaaaagaagaggcaaaacauu

SEQ ID NO: 657810 - RNA, 19 nt, Human
cuuuuggcaaggcuucuaa

SEQ ID NO: 657811 - RNA, 21 nt, Human
gauaaaaaccuacauagacua

SEQ ID NO: 657812 - RNA, 24 nt, Human
gcuuucuguuuucuaggauuucua

SEQ ID NO: 657813 - RNA, 21 nt, Human
ggaaaagaagaggcaaaacau

SEQ ID NO: 657814 - RNA, 22 nt, Human
guaauauauauauauauuuaca

SEQ ID NO: 657815 - RNA, 27 nt, Human
uaagaagaaaagaagauucugucaagc

SEQ ID NO: 657816 - RNA, 22 nt, Human
uacacacacacacacauacccc

SEQ ID NO: 657817 - RNA, 20 nt, Human
uacacacacacacacauagg

SEQ ID NO: 657818 - RNA, 24 nt, Human
uacauauauauguguauuauauau

SEQ ID NO: 657819 - RNA, 19 nt, Human
uauaguaauaguaaugaua

SEQ ID NO: 657820 - RNA, 26 nt, Human
uauaguaauaguaaugauacaugaaa

SEQ ID NO: 657821 - RNA, 24 nt, Human
uauauauauauuuacauauauaug

SEQ ID NO: 657822 - RNA, 21 nt, Human
uauauauauuuacauauauau

SEQ ID NO: 657823 - RNA, 23 nt, Human
uauauauguaauauauauauaua

SEQ ID NO: 657824 - RNA, 21 nt, Human
uauauauguauauuauauaua

SEQ ID NO: 657825 - RNA, 21 nt, Human
uauauguaauauauauauaua

SEQ ID NO: 657826 - RNA, 21 nt, Human
uauauguauauuacauauaua

SEQ ID NO: 657827 - RNA, 18 nt, Human
uauauguguauauaugua

SEQ ID NO: 657828 - RNA, 19 nt, Human
uauauguguauauauguau

SEQ ID NO: 657829 - RNA, 23 nt, Human
uauauuauauauauguguauaua

SEQ ID NO: 657830 - RNA, 21 nt, Human
uauguaauauauauauauauu

SEQ ID NO: 657831 - RNA, 25 nt, Human
uauguauauuacauauauauaugua

SEQ ID NO: 657832 - RNA, 23 nt, Human
uauguauauuauauauaugugua

SEQ ID NO: 657833 - RNA, 23 nt, Human
uauguguauauauguauauuaca

SEQ ID NO: 657834 - RNA, 19 nt, Human
uauguguauuauauaugua

SEQ ID NO: 657835 - RNA, 20 nt, Human
uauguguauuauauauguau

SEQ ID NO: 657836 - RNA, 21 nt, Human
uauguguauuauauauguaua

SEQ ID NO: 657837 - RNA, 20 nt, Human
ucagugacuaucauuacugu

SEQ ID NO: 657838 - RNA, 21 nt, Human
ugggaaaucaguuuacugaaa

SEQ ID NO: 657839 - RNA, 18 nt, Human
ugggcaagaggaaagcag

SEQ ID NO: 657840 - RNA, 18 nt, Human
uguaauauauauauauau

SEQ ID NO: 657841 - RNA, 27 nt, Human
uguauauauguauauuacauauauaua

SEQ ID NO: 657842 - RNA, 20 nt, Human
uguauauuacauauauauau

SEQ ID NO: 657843 - RNA, 30 nt, Human
uguauauuauauauauguguauauauguaa

SEQ ID NO: 657844 - RNA, 23 nt, Human
uguguauauauguauauuacaua

SEQ ID NO: 657845 - RNA, 19 nt, Human
uguguauuauauauguaua

SEQ ID NO: 657846 - RNA, 22 nt, Human
uuacauauauauauguaauaua

SEQ ID NO: 657847 - RNA, 19 nt, Human
aaaaaaaaaaaaaaaaaga

SEQ ID NO: 657848 - RNA, 25 nt, Human
aaaaaaaaaaaaaaaagaauaaagg

SEQ ID NO: 657849 - RNA, 24 nt, Human
aaaaaaaaaaaaaagaauaaagag

SEQ ID NO: 657850 - RNA, 23 nt, Human
aaaaaaaaaaagaauaaagagga

SEQ ID NO: 657851 - RNA, 24 nt, Human
aaaaaaaagaauaaagaggaaagg

SEQ ID NO: 657852 - RNA, 27 nt, Human
aaaaagaauaaagaggaaaggaccggu

SEQ ID NO: 657853 - RNA, 21 nt, Human
aaaagaaaaaaaacuuaaaaa

SEQ ID NO: 657854 - RNA, 27 nt, Human
aaagaaaaaaaacuuaaaaauuuaaag

SEQ ID NO: 657855 - RNA, 21 nt, Human
aaagagaaagggugaacccgg

SEQ ID NO: 657856 - RNA, 23 nt, Human
aauaucuuuuuuucuuaaauaac

SEQ ID NO: 657857 - RNA, 20 nt, Human
acagagugagacuccgucuc

SEQ ID NO: 657858 - RNA, 21 nt, Human
acagagugagacuccgucuca

SEQ ID NO: 657859 - RNA, 26 nt, Human
acagagugagacuccgucucaguaaa

SEQ ID NO: 657860 - RNA, 24 nt, Human
acuccagccugggcgacagaguga

SEQ ID NO: 657861 - RNA, 19 nt, Human
acuccgucucaguaaaaaa

SEQ ID NO: 657862 - RNA, 24 nt, Human
acugcacuccagccugggcgacag

SEQ ID NO: 657863 - RNA, 26 nt, Human
acugcacuccagccugggcgacagag

SEQ ID NO: 657864 - RNA, 18 nt, Human
agaaagggugaacccggg

SEQ ID NO: 657865 - RNA, 24 nt, Human
agccugggcgacagagugagacuc

SEQ ID NO: 657866 - RNA, 20 nt, Human
aggaaagaaggaaggaaaag

SEQ ID NO: 657867 - RNA, 24 nt, Human
aggagggggcgagucugaccggga

SEQ ID NO: 657868 - RNA, 20 nt, Human
aggauggaggcggggaggga

SEQ ID NO: 657869 - RNA, 24 nt, Human
aggcggaguuugcagugagccgag

SEQ ID NO: 657870 - RNA, 24 nt, Human
aucgcgccacugcacuccagccug

SEQ ID NO: 657871 - RNA, 22 nt, Human
cacuccagccugggcgacagag

SEQ ID NO: 657872 - RNA, 22 nt, Human
cacuccagccugggcgacagag

SEQ ID NO: 657873 - RNA, 24 nt, Human
cacuccagccugggcgacagagug

SEQ ID NO: 657874 - RNA, 19 nt, Human
cacugcacuccagccuggg

SEQ ID NO: 657875 - RNA, 20 nt, Human
cacugcacuccagccugggc

SEQ ID NO: 657876 - RNA, 20 nt, Human
cacugcacuccagccugggc

SEQ ID NO: 657877 - RNA, 22 nt, Human
cacugcacuccagccugggcga

SEQ ID NO: 657878 - RNA, 24 nt, Human
cacugcacuccagccugggcgaca

SEQ ID NO: 657879 - RNA, 18 nt, Human
ccaaagagaacuaaaauc

SEQ ID NO: 657880 - RNA, 20 nt, Human
ccacugcacuccagccuggg

SEQ ID NO: 657881 - RNA, 21 nt, Human
ccacugcacuccagccugggc

SEQ ID NO: 657882 - RNA, 21 nt, Human
ccacugcacuccagccugggc

SEQ ID NO: 657883 - RNA, 23 nt, Human
ccacugcacuccagccugggcga

SEQ ID NO: 657884 - RNA, 24 nt, Human
ccacugcacuccagccugggcgac

SEQ ID NO: 657885 - RNA, 19 nt, Human
ccagaaggcuggucucucc

SEQ ID NO: 657886 - RNA, 19 nt, Human
cccacagaacgaggaugga

SEQ ID NO: 657887 - RNA, 23 nt, Human
ccgcugaagagggaaggagcgau

SEQ ID NO: 657888 - RNA, 22 nt, Human
ccgucucaguaaaaaaaaaaaa

SEQ ID NO: 657889 - RNA, 22 nt, Human
ccugggcgacagagugagacuc

SEQ ID NO: 657890 - RNA, 24 nt, Human
cgagaucgcgccacugcacuccag

SEQ ID NO: 657891 - RNA, 26 nt, Human
cgccacugcacuccagccugggcgac

SEQ ID NO: 657892 - RNA, 18 nt, Human
cgucucaguaaaaaaaaa

SEQ ID NO: 657893 - RNA, 23 nt, Human
cucccacagaacgaggauggagg

SEQ ID NO: 657894 - RNA, 26 nt, Human
cucucccacagaacgaggauggaggc

SEQ ID NO: 657895 - RNA, 18 nt, Human
gaggauggaggcggggag

SEQ ID NO: 657896 - RNA, 23 nt, Human
gaguuugcagugagccgagaucg

SEQ ID NO: 657897 - RNA, 24 nt, Human
gcacuccagccugggcgacagagu

SEQ ID NO: 657898 - RNA, 22 nt, Human
gccacugcacuccagccugggc

SEQ ID NO: 657899 - RNA, 24 nt, Human
gccacugcacuccagccugggcga

SEQ ID NO: 657900 - RNA, 20 nt, Human
gccgagaucgcgccacugca

SEQ ID NO: 657901 - RNA, 23 nt, Human
ggaaaaagcagcuuucacuuaca

SEQ ID NO: 657902 - RNA, 21 nt, Human
ggaaagaaggaaggaaaaagc

SEQ ID NO: 657903 - RNA, 24 nt, Human
ggaguuugcagugagccgagaucg

SEQ ID NO: 657904 - RNA, 23 nt, Human
gggaaaggggacucucagggagu

SEQ ID NO: 657905 - RNA, 21 nt, Human
gggagggauccgcugaagagg

SEQ ID NO: 657906 - RNA, 18 nt, Human
gggauaagaauaaagaga

SEQ ID NO: 657907 - RNA, 23 nt, Human
ggggagggauccgcugaagaggg

SEQ ID NO: 657908 - RNA, 25 nt, Human
uaaaacagagagaugucuuggagga

SEQ ID NO: 657909 - RNA, 21 nt, Human
uaaaagacuacuguugccuuu

SEQ ID NO: 657910 - RNA, 23 nt, Human
uacacuuuuaacagugacguuaa

SEQ ID NO: 657911 - RNA, 19 nt, Human
uacuguugccuuucugaag

SEQ ID NO: 657912 - RNA, 28 nt, Human
ucaauuuuuucuuguucuacuuucccua

SEQ ID NO: 657913 - RNA, 24 nt, Human
ucaguaaaaaaaaaaaaaaaaaaa

SEQ ID NO: 657914 - RNA, 23 nt, Human
uccagccugggcgacagagugag

SEQ ID NO: 657915 - RNA, 24 nt, Human
uccagccugggcgacagagugaga

SEQ ID NO: 657916 - RNA, 23 nt, Human
ucgcgccacugcacuccagccug

SEQ ID NO: 657917 - RNA, 19 nt, Human
ucguguaaaaauaucuuuu

SEQ ID NO: 657918 - RNA, 22 nt, Human
ucucaguaaaaaaaaaaaaaaa

SEQ ID NO: 657919 - RNA, 21 nt, Human
ucucucccacagaacgaggau

SEQ ID NO: 657920 - RNA, 24 nt, Human
ucugaagacuaaaaagaaaaaaaa

SEQ ID NO: 657921 - RNA, 23 nt, Human
ugaagacuaaaaagaaaaaaaac

SEQ ID NO: 657922 - RNA, 22 nt, Human
ugagccgagaucgcgccacugc

SEQ ID NO: 657923 - RNA, 19 nt, Human
uggaggagggggcgagucu

SEQ ID NO: 657924 - RNA, 21 nt, Human
uggagguaaaaggaaagaagg

SEQ ID NO: 657925 - RNA, 23 nt, Human
uuccucuugggaaaguaauacaa

SEQ ID NO: 657926 - RNA, 22 nt, Human
uugcagugagccgagaucgcgc

SEQ ID NO: 657927 - RNA, 19 nt, Human
uuugcagugagccgagauc

SEQ ID NO: 657928 - RNA, 21 nt, Human
uuugcagugagccgagaucgc

SEQ ID NO: 657929 - RNA, 23 nt, Human
uuuuuuuuuuuuuuuuuuccuuu

SEQ ID NO: 657930 - RNA, 25 nt, Human
uuuuuuuuuuuuuuuuuuccuuuuu

SEQ ID NO: 657931 - RNA, 22 nt, Human
aaaauuggaaacauuuccuuca

SEQ ID NO: 657932 - RNA, 22 nt, Human
aaaguagaauaugaaucaaaga

SEQ ID NO: 657933 - RNA, 19 nt, Human
aacuuuauuccccucccac

SEQ ID NO: 657934 - RNA, 24 nt, Human
aagcaaaaagccucugaagucaaa

SEQ ID NO: 657935 - RNA, 22 nt, Human
acauaauaaauguucuccaucc

SEQ ID NO: 657936 - RNA, 18 nt, Human
accaagagacagacggcc

SEQ ID NO: 657937 - RNA, 19 nt, Human
accaccccccuuaaauaua

SEQ ID NO: 657938 - RNA, 24 nt, Human
acccaauaccaagagacagacggc

SEQ ID NO: 657939 - RNA, 26 nt, Human
acuuguuccgucuuuacuugcccccu

SEQ ID NO: 657940 - RNA, 20 nt, Human
agcaaggaaauauaacagaa

SEQ ID NO: 657941 - RNA, 24 nt, Human
auuacuuuucguucagagcagaau

SEQ ID NO: 657942 - RNA, 18 nt, Human
caaacuccucuuccccuc

SEQ ID NO: 657943 - RNA, 19 nt, Human
cacccaccaccccccuuaa

SEQ ID NO: 657944 - RNA, 18 nt, Human
cagcaaaaccggaagagg

SEQ ID NO: 657945 - RNA, 22 nt, Human
ccaaagcaaaaagccucugaag

SEQ ID NO: 657946 - RNA, 22 nt, Human
cccacccaccaccccccuuaaa

SEQ ID NO: 657947 - RNA, 21 nt, Human
ccccaaugggcuucgccaccu

SEQ ID NO: 657948 - RNA, 24 nt, Human
ccccaggaacgccucccgagccag

SEQ ID NO: 657949 - RNA, 18 nt, Human
cccccucccacccaccac

SEQ ID NO: 657950 - RNA, 21 nt, Human
cccccucccacccaccacccc

SEQ ID NO: 657951 - RNA, 21 nt, Human
cccucccacccaccacccccc

SEQ ID NO: 657952 - RNA, 24 nt, Human
cccucccacccaccaccccccuua

SEQ ID NO: 657953 - RNA, 22 nt, Human
ccgagccagaccgccgcagccg

SEQ ID NO: 657954 - RNA, 21 nt, Human
ccgccgccccaaugggcuucg

SEQ ID NO: 657955 - RNA, 24 nt, Human
ccgccgcggucugcaccgccgccc

SEQ ID NO: 657956 - RNA, 20 nt, Human
ccucccacccaccacccccc

SEQ ID NO: 657957 - RNA, 18 nt, Human
ccuucaggcagcuggcca

SEQ ID NO: 657958 - RNA, 18 nt, Human
cgccucccgagccagacc

SEQ ID NO: 657959 - RNA, 19 nt, Human
cggccgggcagguguaagg

SEQ ID NO: 657960 - RNA, 19 nt, Human
cucccacccaccacccccc

SEQ ID NO: 657961 - RNA, 21 nt, Human
cuccucuuccccucuggucau

SEQ ID NO: 657962 - RNA, 24 nt, Human
gaccuggcgcuccuucaggcagcu

SEQ ID NO: 657963 - RNA, 24 nt, Human
gcgcuccuucaggcagcuggccag

SEQ ID NO: 657964 - RNA, 19 nt, Human
ggugcccccuccuuuaccc

SEQ ID NO: 657965 - RNA, 21 nt, Human
uacuauuacugcuacuaaacu

SEQ ID NO: 657966 - RNA, 24 nt, Human
uagucagauuuuuuauuuucaaac

SEQ ID NO: 657967 - RNA, 21 nt, Human
uauguaaacaugauuuacuau

SEQ ID NO: 657968 - RNA, 19 nt, Human
ucccacccaccaccccccu

SEQ ID NO: 657969 - RNA, 21 nt, Human
ucccacccaccaccccccuua

SEQ ID NO: 657970 - RNA, 22 nt, Human
ucccacccaccaccccccuuaa

SEQ ID NO: 657971 - RNA, 18 nt, Human
ucugaagacacuuuucca

SEQ ID NO: 657972 - RNA, 21 nt, Human
ucugaagucaaaacaugagac

SEQ ID NO: 657973 - RNA, 19 nt, Human
ugccagguacauuucccac

SEQ ID NO: 657974 - RNA, 24 nt, Human
ugcccccuccuuuacccaauacca

SEQ ID NO: 657975 - RNA, 19 nt, Human
uguaaacaugauuuacuau

SEQ ID NO: 657976 - RNA, 27 nt, Human
uguuccgucuuuacuugcccccuccca

SEQ ID NO: 657977 - RNA, 19 nt, Human
uuaaugcccuaacauguca

SEQ ID NO: 657978 - RNA, 26 nt, Human
uucaagucugauguccaucagugcaa

SEQ ID NO: 657979 - RNA, 22 nt, Human
uuccacacuuaggacaaguucu

SEQ ID NO: 657980 - RNA, 20 nt, Human
aaaacaaacaaaaacaugag

SEQ ID NO: 657981 - RNA, 23 nt, Human
aaaacaaacaaaaacaugaggua

SEQ ID NO: 657982 - RNA, 28 nt, Human
aaugaugaaaauaaccaggaauacggga

SEQ ID NO: 657983 - RNA, 23 nt, Human
acgguccugcuuauuguccuaca

SEQ ID NO: 657984 - RNA, 21 nt, Human
augagguaaaaaaagaguuac

SEQ ID NO: 657985 - RNA, 21 nt, Human
caggggcuucaauaccugugg

SEQ ID NO: 657986 - RNA, 21 nt, Human
caucaaauuaucacccagggg

SEQ ID NO: 657987 - RNA, 18 nt, Human
ccggcccagacgguccug

SEQ ID NO: 657988 - RNA, 22 nt, Human
gaaaauaaccaggaauacggga

SEQ ID NO: 657989 - RNA, 22 nt, Human
gaaauaaaaagaugcuucucuc

SEQ ID NO: 657990 - RNA, 21 nt, Human
gacugccuuauguuuuccucc

SEQ ID NO: 657991 - RNA, 18 nt, Human
gagaaaaagguuaaaaau

SEQ ID NO: 657992 - RNA, 18 nt, Human
gaguuuguuacagacugc

SEQ ID NO: 657993 - RNA, 22 nt, Human
gcaaaacaaacaaaaacaugag

SEQ ID NO: 657994 - RNA, 21 nt, Human
gcaaugaugaaaauaaccagg

SEQ ID NO: 657995 - RNA, 22 nt, Human
gccugcuuugauagaguuuguu

SEQ ID NO: 657996 - RNA, 25 nt, Human
gguccugcuuauuguccuacaugug

SEQ ID NO: 657997 - RNA, 19 nt, Human
uacaauuccuaugagaugg

SEQ ID NO: 657998 - RNA, 19 nt, Human
ugagaaaugugcaaaacaa

SEQ ID NO: 657999 - RNA, 19 nt, Human
ugagauggaugugcaauuc

SEQ ID NO: 658000 - RNA, 19 nt, Human
ugcaaaacaaacaaaaaca

SEQ ID NO: 658001 - RNA, 19 nt, Human
uguauacagcauuuaugca

SEQ ID NO: 658002 - RNA, 19 nt, Human
ugugcaaaacaaacaaaaa

SEQ ID NO: 658003 - RNA, 20 nt, Human
ugugcaaaacaaacaaaaac

SEQ ID NO: 658004 - RNA, 25 nt, Human
uucagauagagaaaaagguuaaaaa

SEQ ID NO: 658005 - RNA, 18 nt, Human
uuuuuuuuuuuggagaug

SEQ ID NO: 658006 - RNA, 18 nt, Human
uuuuuuuuuuuuuuuuug

SEQ ID NO: 658007 - RNA, 23 nt, Human
uuuuuuuuuuuuuuuuuggagau

SEQ ID NO: 658008 - RNA, 18 nt, Human
acuauaucaucaaagcau

SEQ ID NO: 658009 - RNA, 24 nt, Human
auaaaauauucacaaacugaucaa

SEQ ID NO: 658010 - RNA, 24 nt, Human
cuauaucaucaaagcauaaaauau

SEQ ID NO: 658011 - RNA, 23 nt, Human
uaaaauauucacaaacugaucaa

SEQ ID NO: 658012 - RNA, 18 nt, Human
uuuuuuuuuuuuuuuuug

SEQ ID NO: 658013 - RNA, 26 nt, Human
uuuuuuuuuuuuuuuuuggcguuuuu

SEQ ID NO: 658014 - RNA, 23 nt, Human
aaacccuccuuucugcaucacuu

SEQ ID NO: 658015 - RNA, 22 nt, Human
aagcaaaacauccuaucuccaa

SEQ ID NO: 658016 - RNA, 19 nt, Human
aagggucccucccagagcc

SEQ ID NO: 658017 - RNA, 20 nt, Human
aaguauuuuaaacaaaaucc

SEQ ID NO: 658018 - RNA, 21 nt, Human
accacuugagaugauuacccc

SEQ ID NO: 658019 - RNA, 18 nt, Human
acccuggggagaaaaggc

SEQ ID NO: 658020 - RNA, 20 nt, Human
acccuggggagaaaaggcuc

SEQ ID NO: 658021 - RNA, 21 nt, Human
agcaggagccauacccugggg

SEQ ID NO: 658022 - RNA, 23 nt, Human
aggccagggggacccuuccccaa

SEQ ID NO: 658023 - RNA, 18 nt, Human
aggcccugcuggacaaga

SEQ ID NO: 658024 - RNA, 23 nt, Human
aggcucagaggggugggcagcag

SEQ ID NO: 658025 - RNA, 18 nt, Human
agggagccccgcugggag

SEQ ID NO: 658026 - RNA, 21 nt, Human
agggugggggaaaggcggagc

SEQ ID NO: 658027 - RNA, 23 nt, Human
auugcacuuuguccccuucugga

SEQ ID NO: 658028 - RNA, 18 nt, Human
caaaacauccuaucucca

SEQ ID NO: 658029 - RNA, 19 nt, Human
caaacccaaccugugcccc

SEQ ID NO: 658030 - RNA, 19 nt, Human
caagccccgcagaggcugg

SEQ ID NO: 658031 - RNA, 24 nt, Human
caagccccgcagaggcugguucug

SEQ ID NO: 658032 - RNA, 21 nt, Human
cacagccaagggaugcaggaa

SEQ ID NO: 658033 - RNA, 21 nt, Human
cacccugagagccaggguggg

SEQ ID NO: 658034 - RNA, 22 nt, Human
cacuggcccauguacuuuaagc

SEQ ID NO: 658035 - RNA, 23 nt, Human
cagagccccugggaaaucgggag

SEQ ID NO: 658036 - RNA, 22 nt, Human
cagcagcagagucuuugcagag

SEQ ID NO: 658037 - RNA, 18 nt, Human
cagccccagcagaagagc

SEQ ID NO: 658038 - RNA, 21 nt, Human
ccagggugggggaaaggcgga

SEQ ID NO: 658039 - RNA, 20 nt, Human
ccagucccacuggcccaugu

SEQ ID NO: 658040 - RNA, 22 nt, Human
ccagugauggcagcaucuccuu

SEQ ID NO: 658041 - RNA, 26 nt, Human
ccagugauggcagcaucuccuugaga

SEQ ID NO: 658042 - RNA, 21 nt, Human
cccaaccugugccccacuguc

SEQ ID NO: 658043 - RNA, 23 nt, Human
ccccacugucucacucacacccu

SEQ ID NO: 658044 - RNA, 21 nt, Human
ccccugugagagcugagugca

SEQ ID NO: 658045 - RNA, 19 nt, Human
ccccuucuggacaagucag

SEQ ID NO: 658046 - RNA, 22 nt, Human
cccuggauuccugucaaggccc

SEQ ID NO: 658047 - RNA, 20 nt, Human
ccggagagaaggguccaggg

SEQ ID NO: 658048 - RNA, 23 nt, Human
ccuaucuccaauuccagcagcca

SEQ ID NO: 658049 - RNA, 28 nt, Human
ccuccagaagccgucuccgaaggugggg

SEQ ID NO: 658050 - RNA, 19 nt, Human
ccucccagugauggcagca

SEQ ID NO: 658051 - RNA, 20 nt, Human
ccucuagagcugaaucccca

SEQ ID NO: 658052 - RNA, 20 nt, Human
ccugcuggaggccaggggga

SEQ ID NO: 658053 - RNA, 24 nt, Human
cgaaaacaggucauguucaugaaa

SEQ ID NO: 658054 - RNA, 21 nt, Human
cuccugcagugggaagcaaaa

SEQ ID NO: 658055 - RNA, 18 nt, Human
cuccugcuggaggccagg

SEQ ID NO: 658056 - RNA, 21 nt, Human
cugcuggaggccagggggacc

SEQ ID NO: 658057 - RNA, 21 nt, Human
cugggaaaucgggagaggggc

SEQ ID NO: 658058 - RNA, 23 nt, Human
cuuccagucccacuggcccaugu

SEQ ID NO: 658059 - RNA, 22 nt, Human
cuucuggccaagccguuccucc

SEQ ID NO: 658060 - RNA, 19 nt, Human
cuuguacaggucacuucca

SEQ ID NO: 658061 - RNA, 20 nt, Human
gagaaaaggcucagaggggu

SEQ ID NO: 658062 - RNA, 21 nt, Human
gagcacaagccccgcagaggc

SEQ ID NO: 658063 - RNA, 25 nt, Human
gaggauacugugaccucuagagcug

SEQ ID NO: 658064 - RNA, 21 nt, Human
gcagcucuccugcagugggaa

SEQ ID NO: 658065 - RNA, 22 nt, Human
gccaagccguuccuccagaagc

SEQ ID NO: 658066 - RNA, 18 nt, Human
gcccauguacuuuaagca

SEQ ID NO: 658067 - RNA, 24 nt, Human
gcggagcccggcagggacuuggag

SEQ ID NO: 658068 - RNA, 20 nt, Human
gcuuggauucaucucaagcc

SEQ ID NO: 658069 - RNA, 18 nt, Human
ggacccuuccccaacccc

SEQ ID NO: 658070 - RNA, 19 nt, Human
ggcaaacccaaccugugcc

SEQ ID NO: 658071 - RNA, 23 nt, Human
ggcagcucuccugcagugggaag

SEQ ID NO: 658072 - RNA, 19 nt, Human
uacccuggggagaaaaggc

SEQ ID NO: 658073 - RNA, 22 nt, Human
uacccuggggagaaaaggcuca

SEQ ID NO: 658074 - RNA, 23 nt, Human
uaugcacaaaaaagaaaauagcu

SEQ ID NO: 658075 - RNA, 27 nt, Human
uauugcacuuuguccccuucuggacaa

SEQ ID NO: 658076 - RNA, 23 nt, Human
uccucugagccucccagugaugg

SEQ ID NO: 658077 - RNA, 21 nt, Human
ucucaagccagaaacccaacu

SEQ ID NO: 658078 - RNA, 24 nt, Human
ucugcaucacuuguacaggucacu

SEQ ID NO: 658079 - RNA, 19 nt, Human
ugaaagggggcagcucucc

SEQ ID NO: 658080 - RNA, 21 nt, Human
ugaagagcuuuaauauucaga

SEQ ID NO: 658081 - RNA, 21 nt, Human
ugaccucuagagcugaauccc

SEQ ID NO: 658082 - RNA, 23 nt, Human
ugaccucuagagcugaaucccuu

SEQ ID NO: 658083 - RNA, 22 nt, Human
ugauuaccccugugagagcuga

SEQ ID NO: 658084 - RNA, 23 nt, Human
ugcacaaaaaagaaaauagcucc

SEQ ID NO: 658085 - RNA, 18 nt, Human
ugccccaucuccagaaau

SEQ ID NO: 658086 - RNA, 18 nt, Human
uggcaaacccaaccugug

SEQ ID NO: 658087 - RNA, 19 nt, Human
uggcaaacccaaccugugc

SEQ ID NO: 658088 - RNA, 24 nt, Human
uggcaaggcaguaauuacaggaga

SEQ ID NO: 658089 - RNA, 21 nt, Human
uggcagcaucuccuugagagc

SEQ ID NO: 658090 - RNA, 25 nt, Human
uggccaagccguuccuccagaagcc

SEQ ID NO: 658091 - RNA, 21 nt, Human
uggcccauguacuuuaagcau

SEQ ID NO: 658092 - RNA, 24 nt, Human
uggcuacaaauaccacuugagaug

SEQ ID NO: 658093 - RNA, 22 nt, Human
ugggaagcaaaacauccuaucu

SEQ ID NO: 658094 - RNA, 24 nt, Human
ugggaggcgucaggguagggaagg

SEQ ID NO: 658095 - RNA, 23 nt, Human
uggggagaaaaggcucagagggg

SEQ ID NO: 658096 - RNA, 21 nt, Human
ugggggaaaggcggagcccgg

SEQ ID NO: 658097 - RNA, 19 nt, Human
uguggguggcgucacccug

SEQ ID NO: 658098 - RNA, 20 nt, Human
uuccacucugugugucuagu

SEQ ID NO: 658099 - RNA, 20 nt, Human
uuggcaugcuuccuggccug

SEQ ID NO: 658100 - RNA, 20 nt, Human
uuucaaacgaggauacugug

SEQ ID NO: 658101 - RNA, 26 nt, Human
uuugaaacccuccuuucugcaucacu

SEQ ID NO: 658102 - RNA, 22 nt, Human
uuuuuuuuuuuuuuuuucauuu

SEQ ID NO: 658103 - RNA, 20 nt, Human
aaaaagaaagcuugcacagu

SEQ ID NO: 658104 - RNA, 22 nt, Human
aaaaagccaugagagguacugc

SEQ ID NO: 658105 - RNA, 18 nt, Human
aaaacaaaaagauaggcc

SEQ ID NO: 658106 - RNA, 23 nt, Human
aaaagaaccuacgaaaaccagag

SEQ ID NO: 658107 - RNA, 21 nt, Human
aaacaaaaagauaggcccagu

SEQ ID NO: 658108 - RNA, 21 nt, Human
aaacaauauucugaaccaaaa

SEQ ID NO: 658109 - RNA, 23 nt, Human
aaacaggcauagaaaaccaccuc

SEQ ID NO: 658110 - RNA, 22 nt, Human
aaaguccaggaagagcaaugau

SEQ ID NO: 658111 - RNA, 19 nt, Human
aaucauuaccucagugaau

SEQ ID NO: 658112 - RNA, 21 nt, Human
acagagcuuugugagcaaugg

SEQ ID NO: 658113 - RNA, 21 nt, Human
accauugaucucaccaaugcc

SEQ ID NO: 658114 - RNA, 21 nt, Human
acccuaaggcaauaugaaaac

SEQ ID NO: 658115 - RNA, 21 nt, Human
acugcuggaaccaaaaagcca

SEQ ID NO: 658116 - RNA, 23 nt, Human
acugugcucuuucuauucagaac

SEQ ID NO: 658117 - RNA, 22 nt, Human
agacagauccacagaccaccuu

SEQ ID NO: 658118 - RNA, 19 nt, Human
agacuccuaugaaacaaag

SEQ ID NO: 658119 - RNA, 22 nt, Human
agagagacaaagcacauuugag

SEQ ID NO: 658120 - RNA, 19 nt, Human
agaggaaaacaggcauaga

SEQ ID NO: 658121 - RNA, 18 nt, Human
agccaugagagguacugc

SEQ ID NO: 658122 - RNA, 19 nt, Human
aggaaaacaggcauagaaa

SEQ ID NO: 658123 - RNA, 21 nt, Human
aggcaauaugaaaacagucau

SEQ ID NO: 658124 - RNA, 21 nt, Human
aggcaggcaacgaggggcaug

SEQ ID NO: 658125 - RNA, 23 nt, Human
aggcaggcaacgaggggcaugau

SEQ ID NO: 658126 - RNA, 18 nt, Human
aggcauccuucccauaga

SEQ ID NO: 658127 - RNA, 19 nt, Human
agggagucacagauuaggc

SEQ ID NO: 658128 - RNA, 23 nt, Human
agggguaacagacauguuucaga

SEQ ID NO: 658129 - RNA, 18 nt, Human
agugcucugaggaaggaa

SEQ ID NO: 658130 - RNA, 21 nt, Human
agugcuuggcccugaaaagcg

SEQ ID NO: 658131 - RNA, 24 nt, Human
auaacacaagacuccuaugaaaca

SEQ ID NO: 658132 - RNA, 25 nt, Human
augaaggacuaaccuuguauaacac

SEQ ID NO: 658133 - RNA, 18 nt, Human
caaaaagauaggcccagu

SEQ ID NO: 658134 - RNA, 18 nt, Human
caacuugguaagauggag

SEQ ID NO: 658135 - RNA, 25 nt, Human
cacaaccucaagucucaggaaagcc

SEQ ID NO: 658136 - RNA, 24 nt, Human
cacacagagcuuugugagcaaugg

SEQ ID NO: 658137 - RNA, 21 nt, Human
cacccaagauaaaucuagcca

SEQ ID NO: 658138 - RNA, 21 nt, Human
caccuuacaagcuacauagcc

SEQ ID NO: 658139 - RNA, 21 nt, Human
cagacagauccacagaccacc

SEQ ID NO: 658140 - RNA, 19 nt, Human
cagcacaggguccaggccu

SEQ ID NO: 658141 - RNA, 18 nt, Human
cagcucagcacagggucc

SEQ ID NO: 658142 - RNA, 19 nt, Human
cagugagucaccagcucag

SEQ ID NO: 658143 - RNA, 22 nt, Human
cauagccaucuucaaaaugaaa

SEQ ID NO: 658144 - RNA, 18 nt, Human
caucacccaagauaaauc

SEQ ID NO: 658145 - RNA, 18 nt, Human
cauguacuggcacaaaca

SEQ ID NO: 658146 - RNA, 28 nt, Human
ccaccuacacguacaguggucucauucc

SEQ ID NO: 658147 - RNA, 19 nt, Human
ccagacagcacuaauaaac

SEQ ID NO: 658148 - RNA, 22 nt, Human
ccaguacaagccacaaccucaa

SEQ ID NO: 658149 - RNA, 22 nt, Human
cccaagauaaaucuagccaccc

SEQ ID NO: 658150 - RNA, 19 nt, Human
cccaccacucccagccuuc

SEQ ID NO: 658151 - RNA, 19 nt, Human
ccuccaucacccaagauaa

SEQ ID NO: 658152 - RNA, 27 nt, Human
cguuacaaacauccacguaacauaggg

SEQ ID NO: 658153 - RNA, 21 nt, Human
cuaauacaacaaaugguuuug

SEQ ID NO: 658154 - RNA, 18 nt, Human
cucauuaacaaugcucug

SEQ ID NO: 658155 - RNA, 19 nt, Human
cucauuaacaaugcucuga

SEQ ID NO: 658156 - RNA, 19 nt, Human
cucuugaagcacuugagac

SEQ ID NO: 658157 - RNA, 19 nt, Human
cugaaccaaaagaaccuac

SEQ ID NO: 658158 - RNA, 26 nt, Human
cugaaccaaaagaaccuacgaaaacc

SEQ ID NO: 658159 - RNA, 18 nt, Human
cugcgccacagcuaaacc

SEQ ID NO: 658160 - RNA, 20 nt, Human
cuggcauuuucaagugucaa

SEQ ID NO: 658161 - RNA, 21 nt, Human
gacagauccacagaccaccuu

SEQ ID NO: 658162 - RNA, 22 nt, Human
gcacaaacaauauucugaacca

SEQ ID NO: 658163 - RNA, 23 nt, Human
gccaaauauuccccuuuucaacu

SEQ ID NO: 658164 - RNA, 19 nt, Human
gcugaagugccaaaagacu

SEQ ID NO: 658165 - RNA, 19 nt, Human
gcugaugcaugugugagcc

SEQ ID NO: 658166 - RNA, 21 nt, Human
ggaaaacaaaaagauaggccc

SEQ ID NO: 658167 - RNA, 25 nt, Human
ggaaccaaaaagccaugagagguag

SEQ ID NO: 658168 - RNA, 23 nt, Human
ggagccagacucuugaagcacuu

SEQ ID NO: 658169 - RNA, 19 nt, Human
ggcagcuauugaaguggau

SEQ ID NO: 658170 - RNA, 24 nt, Human
ggcccugaaaagcguuaacccaga

SEQ ID NO: 658171 - RNA, 21 nt, Human
ggccucagcacagagagacaa

SEQ ID NO: 658172 - RNA, 19 nt, Human
gggcauguacuuagagcuc

SEQ ID NO: 658173 - RNA, 24 nt, Human
gguaacagacauguuucagaggaa

SEQ ID NO: 658174 - RNA, 18 nt, Human
guagcaggagccagacuc

SEQ ID NO: 658175 - RNA, 26 nt, Human
uaaaaagcacaucauacaaccuucag

SEQ ID NO: 658176 - RNA, 22 nt, Human
uaaaauucauugacuuacguua

SEQ ID NO: 658177 - RNA, 25 nt, Human
uaaauuggaaacaacuuuugucuca

SEQ ID NO: 658178 - RNA, 22 nt, Human
uaacacaagacuccuaugaaac

SEQ ID NO: 658179 - RNA, 22 nt, Human
uaaggcaauaugaaaacaguca

SEQ ID NO: 658180 - RNA, 22 nt, Human
uacuuuuucuccacaacuguga

SEQ ID NO: 658181 - RNA, 25 nt, Human
uagggagaaaccaugucacauggaa

SEQ ID NO: 658182 - RNA, 21 nt, Human
uaugcacacagagcuuuguga

SEQ ID NO: 658183 - RNA, 18 nt, Human
uauggcaaucacuuucca

SEQ ID NO: 658184 - RNA, 19 nt, Human
uauggcaaucacuuuccag

SEQ ID NO: 658185 - RNA, 19 nt, Human
uauggcaaucacuuuccag

SEQ ID NO: 658186 - RNA, 21 nt, Human
uauggcaaucacuuuccagug

SEQ ID NO: 658187 - RNA, 19 nt, Human
ucaaggacguuuucuccgg

SEQ ID NO: 658188 - RNA, 22 nt, Human
ucacagggaacacuaauuauau

SEQ ID NO: 658189 - RNA, 23 nt, Human
ucacccaagauaaaucuagccac

SEQ ID NO: 658190 - RNA, 21 nt, Human
ucagugcucugaggaaggaag

SEQ ID NO: 658191 - RNA, 19 nt, Human
uccaucacccaagauaaau

SEQ ID NO: 658192 - RNA, 28 nt, Human
uccaucacccaagauaaaucuagccacc

SEQ ID NO: 658193 - RNA, 21 nt, Human
ucccagccuuccuucuacccc

SEQ ID NO: 658194 - RNA, 22 nt, Human
ucuacaaaguccaggaagagca

SEQ ID NO: 658195 - RNA, 23 nt, Human
ucuaccccggaauagcccagaug

SEQ ID NO: 658196 - RNA, 25 nt, Human
ucugaaccaaaagaaccuacgaaaa

SEQ ID NO: 658197 - RNA, 23 nt, Human
ugaaacaaagaaaagagaauaaa

SEQ ID NO: 658198 - RNA, 25 nt, Human
ugaaccaaaagaaccuacgaaaacc

SEQ ID NO: 658199 - RNA, 18 nt, Human
ugaagaaacagcuugaca

SEQ ID NO: 658200 - RNA, 21 nt, Human
ugaagcacuugagacugauuu

SEQ ID NO: 658201 - RNA, 22 nt, Human
ugaaguggauuguuggcuuugu

SEQ ID NO: 658202 - RNA, 21 nt, Human
ugacaguguacaucuuucuug

SEQ ID NO: 658203 - RNA, 22 nt, Human
ugagacaagcagcuucaaggac

SEQ ID NO: 658204 - RNA, 26 nt, Human
ugcuugaaguccuuaugcacacagag

SEQ ID NO: 658205 - RNA, 23 nt, Human
uggaaaacaaaaagauaggccca

SEQ ID NO: 658206 - RNA, 19 nt, Human
uggaaccaaaaagccauga

SEQ ID NO: 658207 - RNA, 24 nt, Human
uggauaguaaguuacugagaaaaa

SEQ ID NO: 658208 - RNA, 21 nt, Human
uggcacaaacaauauucugaa

SEQ ID NO: 658209 - RNA, 21 nt, Human
uggcaguacccacaugugcug

SEQ ID NO: 658210 - RNA, 22 nt, Human
uggcaguacccacaugugcuga

SEQ ID NO: 658211 - RNA, 24 nt, Human
ugggcccaguuaguuuuuagggag

SEQ ID NO: 658212 - RNA, 20 nt, Human
ugguugcagccccaucuaca

SEQ ID NO: 658213 - RNA, 18 nt, Human
uguggccaaauauucccc

SEQ ID NO: 658214 - RNA, 23 nt, Human
uuaacccuaaggcaauaugaaaa

SEQ ID NO: 658215 - RNA, 18 nt, Human
uucaaaaugaaaaccacc

SEQ ID NO: 658216 - RNA, 24 nt, Human
uucaaaaugaaaaccaccuuuuaa

SEQ ID NO: 658217 - RNA, 21 nt, Human
uucaagugucaacaggccaug

SEQ ID NO: 658218 - RNA, 24 nt, Human
uuccaguacaagccacaagguacc

SEQ ID NO: 658219 - RNA, 19 nt, Human
uuuaaguccucaugcugcc

SEQ ID NO: 658220 - RNA, 24 nt, Human
uuuucaagugucaacaggccaugc

SEQ ID NO: 658221 - RNA, 18 nt, Human
uuuuuuuuuuuuuaaccc

SEQ ID NO: 658222 - RNA, 20 nt, Human
aaaaaauauagcuauacccc

SEQ ID NO: 658223 - RNA, 27 nt, Human
aaaaagauacacugcaacaacagauua

SEQ ID NO: 658224 - RNA, 24 nt, Human
aaaaauacaacauuauacaucaca

SEQ ID NO: 658225 - RNA, 26 nt, Human
aauauaugugugugugugugugugug

SEQ ID NO: 658226 - RNA, 21 nt, Human
aaugcuguguuaggcauguca

SEQ ID NO: 658227 - RNA, 25 nt, Human
acaacauuauacaucacacagcauu

SEQ ID NO: 658228 - RNA, 24 nt, Human
acacagcauuuucuuugugcaaaa

SEQ ID NO: 658229 - RNA, 19 nt, Human
acuaucugauuucacauug

SEQ ID NO: 658230 - RNA, 18 nt, Human
acugauuucugggccggu

SEQ ID NO: 658231 - RNA, 19 nt, Human
acugguauuuggacugauu

SEQ ID NO: 658232 - RNA, 18 nt, Human
agcuauaucauacaaccu

SEQ ID NO: 658233 - RNA, 18 nt, Human
aggauugaaagcuaaacu

SEQ ID NO: 658234 - RNA, 22 nt, Human
augaacuuucuugauaagaucc

SEQ ID NO: 658235 - RNA, 22 nt, Human
augugugugugugugugugugu

SEQ ID NO: 658236 - RNA, 22 nt, Human
augugugugugugugugugugu

SEQ ID NO: 658237 - RNA, 18 nt, Human
cacacagcauuuucuuug

SEQ ID NO: 658238 - RNA, 23 nt, Human
cacacagcauuuucuuugugcaa

SEQ ID NO: 658239 - RNA, 25 nt, Human
caucacacagcauuuucuuugugca

SEQ ID NO: 658240 - RNA, 18 nt, Human
cauuugaaagcugguuuu

SEQ ID NO: 658241 - RNA, 20 nt, Human
cccacguguggaaaagaggu

SEQ ID NO: 658242 - RNA, 22 nt, Human
ccuccaaaucagagggaguaaa

SEQ ID NO: 658243 - RNA, 18 nt, Human
ccucuguaacaugaacuu

SEQ ID NO: 658244 - RNA, 21 nt, Human
gaaaauuaaacuaagccaaca

SEQ ID NO: 658245 - RNA, 22 nt, Human
gagaacucucagcuuuguuggu

SEQ ID NO: 658246 - RNA, 18 nt, Human
ggaagggugcagaauucu

SEQ ID NO: 658247 - RNA, 20 nt, Human
ggccgguccauuugaaagcu

SEQ ID NO: 658248 - RNA, 19 nt, Human
ggugucgaguaaaguuugg

SEQ ID NO: 658249 - RNA, 21 nt, Human
gugugugugugugugugugug

SEQ ID NO: 658250 - RNA, 21 nt, Human
gugugugugugugugugugug

SEQ ID NO: 658251 - RNA, 25 nt, Human
uaauggauuuuucccccuagaaguu

SEQ ID NO: 658252 - RNA, 25 nt, Human
uacuuuuauuuuguaggauugaaag

SEQ ID NO: 658253 - RNA, 19 nt, Human
uauacaaauauaugugugu

SEQ ID NO: 658254 - RNA, 19 nt, Human
uauacaaauauaugugugu

SEQ ID NO: 658255 - RNA, 19 nt, Human
uauaugugugugugugugu

SEQ ID NO: 658256 - RNA, 18 nt, Human
uaugugugugugugugug

SEQ ID NO: 658257 - RNA, 23 nt, Human
uaugugugugugugugugugugu

SEQ ID NO: 658258 - RNA, 20 nt, Human
uccauuugaaagcugguuuu

SEQ ID NO: 658259 - RNA, 18 nt, Human
uccccaacguauuuacag

SEQ ID NO: 658260 - RNA, 25 nt, Human
ugaacaaauccccaacguauuuaca

SEQ ID NO: 658261 - RNA, 20 nt, Human
ugcaacaacagauuaaagaa

SEQ ID NO: 658262 - RNA, 22 nt, Human
ugcuuagagggaaguaaacuuu

SEQ ID NO: 658263 - RNA, 24 nt, Human
ugggaagggugcagaauucugaga

SEQ ID NO: 658264 - RNA, 18 nt, Human
uguauauauauauaugua

SEQ ID NO: 658265 - RNA, 18 nt, Human
uguguauauauauauaug

SEQ ID NO: 658266 - RNA, 22 nt, Human
uguguauauauauauauguaug

SEQ ID NO: 658267 - RNA, 21 nt, Human
uguguguauauauauauaugu

SEQ ID NO: 658268 - RNA, 23 nt, Human
uguguguauauauauauauguau

SEQ ID NO: 658269 - RNA, 18 nt, Human
uguguguguauauauaua

SEQ ID NO: 658270 - RNA, 25 nt, Human
uguguguguauauauauauauguaa

SEQ ID NO: 658271 - RNA, 23 nt, Human
uguguguguguguauauauauau

SEQ ID NO: 658272 - RNA, 18 nt, Human
uguguguguguguguaua

SEQ ID NO: 658273 - RNA, 20 nt, Human
uguguguguguguguauaua

SEQ ID NO: 658274 - RNA, 18 nt, Human
ugugugugugugugugug

SEQ ID NO: 658275 - RNA, 18 nt, Human
ugugugugugugugugug

SEQ ID NO: 658276 - RNA, 18 nt, Human
ugugugugugugugugug

SEQ ID NO: 658277 - RNA, 18 nt, Human
ugugugugugugugugug

SEQ ID NO: 658278 - RNA, 18 nt, Human
ugugugugugugugugug

SEQ ID NO: 658279 - RNA, 18 nt, Human
ugugugugugugugugug

SEQ ID NO: 658280 - RNA, 18 nt, Human
ugugugugugugugugug

SEQ ID NO: 658281 - RNA, 24 nt, Human
uguguguguguguguguguauaua

SEQ ID NO: 658282 - RNA, 21 nt, Human
ugugugugugugugugugugu

SEQ ID NO: 658283 - RNA, 21 nt, Human
ugugugugugugugugugugu

SEQ ID NO: 658284 - RNA, 21 nt, Human
ugugugugugugugugugugu

SEQ ID NO: 658285 - RNA, 21 nt, Human
ugugugugugugugugugugu

SEQ ID NO: 658286 - RNA, 21 nt, Human
ugugugugugugugugugugu

SEQ ID NO: 658287 - RNA, 21 nt, Human
ugugugugugugugugugugu

SEQ ID NO: 658288 - RNA, 21 nt, Human
ugugugugugugugugugugu

SEQ ID NO: 658289 - RNA, 21 nt, Human
ugugugugugugugugugugu

SEQ ID NO: 658290 - RNA, 22 nt, Human
ugugugugugugugugugugua

SEQ ID NO: 658291 - RNA, 22 nt, Human
ugugugugugugugugugugug

SEQ ID NO: 658292 - RNA, 22 nt, Human
ugugugugugugugugugugug

SEQ ID NO: 658293 - RNA, 22 nt, Human
ugugugugugugugugugugug

SEQ ID NO: 658294 - RNA, 19 nt, Human
uguucuccaaaucagucug

SEQ ID NO: 658295 - RNA, 20 nt, Human
uugaacaaauccccaacgua

SEQ ID NO: 658296 - RNA, 25 nt, Human
uuuggacugauuucugggccggucc

SEQ ID NO: 658297 - RNA, 25 nt, Human
uuuuuuuuuuuuuuuuuuuauuuuu

SEQ ID NO: 658298 - RNA, 19 nt, Human
acucaucuguuucucucca

SEQ ID NO: 658299 - RNA, 22 nt, Human
acuucaaaaaauguugaucaag

SEQ ID NO: 658300 - RNA, 19 nt, Human
ucagaaaguaguuucucuu

SEQ ID NO: 658301 - RNA, 22 nt, Human
ucaucuguuucucuccaauuau

SEQ ID NO: 658302 - RNA, 20 nt, Human
uuauauaacucccacuuaaa

SEQ ID NO: 658303 - RNA, 24 nt, Human
uuuuuuuuuuuuuuuuuuucacug

SEQ ID NO: 658304 - RNA, 18 nt, Human
aaaguugcuaagauggcu

SEQ ID NO: 658305 - RNA, 21 nt, Human
aaaugagacuaagacgccuga

SEQ ID NO: 658306 - RNA, 18 nt, Human
acggggacucccagcugg

SEQ ID NO: 658307 - RNA, 19 nt, Human
agacagaagggaguaggau

SEQ ID NO: 658308 - RNA, 19 nt, Human
agagaagagccagcuggaa

SEQ ID NO: 658309 - RNA, 27 nt, Human
agagggcagggagacagaagggaguag

SEQ ID NO: 658310 - RNA, 20 nt, Human
aggaagggcaaugaagaaga

SEQ ID NO: 658311 - RNA, 19 nt, Human
aggcaguguguggcaagug

SEQ ID NO: 658312 - RNA, 20 nt, Human
agucagggggugcaacuggg

SEQ ID NO: 658313 - RNA, 22 nt, Human
agugugagguugcggggaaaga

SEQ ID NO: 658314 - RNA, 22 nt, Human
aguguguggcaagugacacaga

SEQ ID NO: 658315 - RNA, 21 nt, Human
aucacugugauuaucuuaugc

SEQ ID NO: 658316 - RNA, 19 nt, Human
auggggcggggagguugag

SEQ ID NO: 658317 - RNA, 24 nt, Human
caaaugagacuaagacgccugaug

SEQ ID NO: 658318 - RNA, 19 nt, Human
cacaaaacuugaccaggca

SEQ ID NO: 658319 - RNA, 21 nt, Human
cacaaaacuugaccaggcagg

SEQ ID NO: 658320 - RNA, 20 nt, Human
cacaaacucuuaagaugcgg

SEQ ID NO: 658321 - RNA, 23 nt, Human
caccuggcagaggaugcccuucu

SEQ ID NO: 658322 - RNA, 18 nt, Human
caccuuacacauggugag

SEQ ID NO: 658323 - RNA, 22 nt, Human
cagaacugggcuggccuggggc

SEQ ID NO: 658324 - RNA, 23 nt, Human
cagagggcagggagacagaaggg

SEQ ID NO: 658325 - RNA, 19 nt, Human
cagcccgagacagcaggau

SEQ ID NO: 658326 - RNA, 20 nt, Human
cagcuccauugcagacaaac

SEQ ID NO: 658327 - RNA, 18 nt, Human
cagcuggaagaugaguca

SEQ ID NO: 658328 - RNA, 23 nt, Human
ccaccgcauccccgacuuucagc

SEQ ID NO: 658329 - RNA, 18 nt, Human
cccugcugaaaauggggc

SEQ ID NO: 658330 - RNA, 22 nt, Human
cccuucugcccccugacaggag

SEQ ID NO: 658331 - RNA, 20 nt, Human
ccugcugaaaauggggcggg

SEQ ID NO: 658332 - RNA, 21 nt, Human
cgcauccccgacuuucagccc

SEQ ID NO: 658333 - RNA, 20 nt, Human
cggggagguugaggcagugu

SEQ ID NO: 658334 - RNA, 19 nt, Human
cuaagcccaaacccugcug

SEQ ID NO: 658335 - RNA, 21 nt, Human
cuggccuggggcucagcgaca

SEQ ID NO: 658336 - RNA, 22 nt, Human
cuguccuaucgcugcucgagau

SEQ ID NO: 658337 - RNA, 24 nt, Human
gacggggcagaacugggcuggccu

SEQ ID NO: 658338 - RNA, 22 nt, Human
gagacagaagggaguaggaugg

SEQ ID NO: 658339 - RNA, 18 nt, Human
gagcacauaugggugcca

SEQ ID NO: 658340 - RNA, 21 nt, Human
gaggaagggcaaugaagaaga

SEQ ID NO: 658341 - RNA, 22 nt, Human
gaguaggaugggagagaagagc

SEQ ID NO: 658342 - RNA, 21 nt, Human
gcagaacugggcuggccuggg

SEQ ID NO: 658343 - RNA, 18 nt, Human
gcaguguguggcaaguga

SEQ ID NO: 658344 - RNA, 18 nt, Human
gcgggagugugagguugc

SEQ ID NO: 658345 - RNA, 23 nt, Human
gcgggagugugagguugcgggga

SEQ ID NO: 658346 - RNA, 24 nt, Human
gcucagcgacagcuccauugcaga

SEQ ID NO: 658347 - RNA, 18 nt, Human
ggaggccuggccacugug

SEQ ID NO: 658348 - RNA, 18 nt, Human
ggaggggcuuggaaggaa

SEQ ID NO: 658349 - RNA, 23 nt, Human
ggcaaugaagaagagacuaggaa

SEQ ID NO: 658350 - RNA, 22 nt, Human
gggaggccuggccacugugccc

SEQ ID NO: 658351 - RNA, 19 nt, Human
ggggacucccagcuggggg

SEQ ID NO: 658352 - RNA, 24 nt, Human
guguggcaagugacacagacgggg

SEQ ID NO: 658353 - RNA, 18 nt, Human
uaagcccaaacccugcug

SEQ ID NO: 658354 - RNA, 18 nt, Human
uaugaugauaagcagggc

SEQ ID NO: 658355 - RNA, 19 nt, Human
ucagcccucacgugccauc

SEQ ID NO: 658356 - RNA, 23 nt, Human
ucagccugcugggccuaugauga

SEQ ID NO: 658357 - RNA, 21 nt, Human
uccauugcagacaaacugggc

SEQ ID NO: 658358 - RNA, 19 nt, Human
ucgcugcucgagaucagcc

SEQ ID NO: 658359 - RNA, 18 nt, Human
ucuguagcuaagcccaaa

SEQ ID NO: 658360 - RNA, 19 nt, Human
ugacacagacggggacucc

SEQ ID NO: 658361 - RNA, 21 nt, Human
ugagaaaguugcuaagauggc

SEQ ID NO: 658362 - RNA, 21 nt, Human
ugagaaaguugcuaagauggc

SEQ ID NO: 658363 - RNA, 22 nt, Human
ugagaaaguugcuaagauggcu

SEQ ID NO: 658364 - RNA, 25 nt, Human
ugagucagggggugcaacuggggag

SEQ ID NO: 658365 - RNA, 24 nt, Human
ugauaagcagggcugacccucuuc

SEQ ID NO: 658366 - RNA, 24 nt, Human
ugcuggugaggaagggcaaugaag

SEQ ID NO: 658367 - RNA, 18 nt, Human
uggaagaugagucagggg

SEQ ID NO: 658368 - RNA, 21 nt, Human
uggaaggaagaggagcacuug

SEQ ID NO: 658369 - RNA, 23 nt, Human
uggcagagggcagggagacagaa

SEQ ID NO: 658370 - RNA, 18 nt, Human
ugggaaagugcagauugc

SEQ ID NO: 658371 - RNA, 18 nt, Human
ugggcuggggaaggcagc

SEQ ID NO: 658372 - RNA, 24 nt, Human
uggggagagcagcucugaauccug

SEQ ID NO: 658373 - RNA, 22 nt, Human
uggggcaacaaucccaccugcc

SEQ ID NO: 658374 - RNA, 28 nt, Human
ugggggucccuggaauuaccgguagacc

SEQ ID NO: 658375 - RNA, 19 nt, Human
uguggcaagugacacagac

SEQ ID NO: 658376 - RNA, 20 nt, Human
uugugguuguugaggauauc

SEQ ID NO: 658377 - RNA, 20 nt, Human
aaacaggcucaggcuaagca

SEQ ID NO: 658378 - RNA, 21 nt, Human
aaauagucaacgcagggaaga

SEQ ID NO: 658379 - RNA, 22 nt, Human
acaggaagcuugguagcaacaa

SEQ ID NO: 658380 - RNA, 24 nt, Human
acauaaaacaggcucaggcuaagc

SEQ ID NO: 658381 - RNA, 18 nt, Human
acaugccggagacugugc

SEQ ID NO: 658382 - RNA, 22 nt, Human
accaaguacaacugcaccaaau

SEQ ID NO: 658383 - RNA, 18 nt, Human
agaaacuuaagacuacua

SEQ ID NO: 658384 - RNA, 22 nt, Human
agcacuuugggauuacaggugu

SEQ ID NO: 658385 - RNA, 18 nt, Human
agccaccaugcccagccc

SEQ ID NO: 658386 - RNA, 21 nt, Human
aggaacacugaaggaaggaca

SEQ ID NO: 658387 - RNA, 28 nt, Human
aggaacacugaaggaaggaccgguaccc

SEQ ID NO: 658388 - RNA, 21 nt, Human
aggugagugaaaggugguccc

SEQ ID NO: 658389 - RNA, 18 nt, Human
auaaaacaggcucaggcu

SEQ ID NO: 658390 - RNA, 20 nt, Human
caaggcccguggcgagcccu

SEQ ID NO: 658391 - RNA, 22 nt, Human
cacacacacacagcagaacccc

SEQ ID NO: 658392 - RNA, 27 nt, Human
cacacacacagcagaaccccagcugag

SEQ ID NO: 658393 - RNA, 19 nt, Human
cacacagaagacuagaaca

SEQ ID NO: 658394 - RNA, 20 nt, Human
cacauggcucaggcaaggcc

SEQ ID NO: 658395 - RNA, 24 nt, Human
caccauucauggccaugaaacucc

SEQ ID NO: 658396 - RNA, 24 nt, Human
cacgccuguaaucccagcacuuug

SEQ ID NO: 658397 - RNA, 20 nt, Human
cagcagaaccccagcugaga

SEQ ID NO: 658398 - RNA, 22 nt, Human
caggaauggguuaucuauggug

SEQ ID NO: 658399 - RNA, 18 nt, Human
caugaucuugccauccaa

SEQ ID NO: 658400 - RNA, 24 nt, Human
ccaaacccaaaaacaaaugacccu

SEQ ID NO: 658401 - RNA, 24 nt, Human
ccagcacuuugggauuacaggugu

SEQ ID NO: 658402 - RNA, 19 nt, Human
ccuccagcaugaccgugag

SEQ ID NO: 658403 - RNA, 22 nt, Human
ccuguaaucccagcacuuuggg

SEQ ID NO: 658404 - RNA, 18 nt, Human
ccuucuuccuuccuucuc

SEQ ID NO: 658405 - RNA, 24 nt, Human
cuaggccgggcgcgguggcucacg

SEQ ID NO: 658406 - RNA, 27 nt, Human
cucacagugucagugauuacuauggua

SEQ ID NO: 658407 - RNA, 22 nt, Human
cucacgccuguaaucccagcac

SEQ ID NO: 658408 - RNA, 24 nt, Human
cucacgccuguaaucccagcacuu

SEQ ID NO: 658409 - RNA, 21 nt, Human
cuccaucaugucucuuguggu

SEQ ID NO: 658410 - RNA, 21 nt, Human
cugcaucccuccagcaugacc

SEQ ID NO: 658411 - RNA, 20 nt, Human
cugcuguuuuacucccucug

SEQ ID NO: 658412 - RNA, 20 nt, Human
gaaacuccaucaugucucuu

SEQ ID NO: 658413 - RNA, 22 nt, Human
gaauauaacagaccaaguacaa

SEQ ID NO: 658414 - RNA, 20 nt, Human
gaccgugaguagcacagccc

SEQ ID NO: 658415 - RNA, 20 nt, Human
gaccuaggccgggcgcggug

SEQ ID NO: 658416 - RNA, 19 nt, Human
gagccaccaugcccagccc

SEQ ID NO: 658417 - RNA, 22 nt, Human
gauuacaggugugcaugagcca

SEQ ID NO: 658418 - RNA, 20 nt, Human
gcaagaugaguaaguagcug

SEQ ID NO: 658419 - RNA, 19 nt, Human
gcaugagccaccaugccca

SEQ ID NO: 658420 - RNA, 26 nt, Human
ggcuguaaccauccacacuggcucca

SEQ ID NO: 658421 - RNA, 24 nt, Human
gggcgcgguggcucacgccuguaa

SEQ ID NO: 658422 - RNA, 23 nt, Human
gguggcucacgccuguaauccca

SEQ ID NO: 658423 - RNA, 24 nt, Human
gguggcucacgccuguaaucccag

SEQ ID NO: 658424 - RNA, 18 nt, Human
guaauggccccaguuucc

SEQ ID NO: 658425 - RNA, 19 nt, Human
guaggaaaguuucuucccu

SEQ ID NO: 658426 - RNA, 21 nt, Human
gugugcaugagccaccaugcc

SEQ ID NO: 658427 - RNA, 21 nt, Human
uaaaacaggcucaggcuaagc

SEQ ID NO: 658428 - RNA, 19 nt, Human
uaaaagagaaacuuaagac

SEQ ID NO: 658429 - RNA, 26 nt, Human
uaaaauacacacacacacagcagaac

SEQ ID NO: 658430 - RNA, 19 nt, Human
uaacugaaaagagcugaac

SEQ ID NO: 658431 - RNA, 20 nt, Human
uaagcaucuuccuccaaguu

SEQ ID NO: 658432 - RNA, 21 nt, Human
uaaggugaaccugccagaggc

SEQ ID NO: 658433 - RNA, 19 nt, Human
uacugaccauuucuacaug

SEQ ID NO: 658434 - RNA, 21 nt, Human
uagaacaaauucuagcucaug

SEQ ID NO: 658435 - RNA, 23 nt, Human
uauaaucaaagccugcugucuua

SEQ ID NO: 658436 - RNA, 23 nt, Human
uauaaucaaagccugcugucuua

SEQ ID NO: 658437 - RNA, 24 nt, Human
uauaaucaaagccugcugucuuau

SEQ ID NO: 658438 - RNA, 24 nt, Human
ucagagcucuauaaucaaagccug

SEQ ID NO: 658439 - RNA, 21 nt, Human
ucauggccaugaaacuccauc

SEQ ID NO: 658440 - RNA, 25 nt, Human
uccaaacccaaaaacaaaugaccua

SEQ ID NO: 658441 - RNA, 22 nt, Human
uccacaaacuagaaugacaggg

SEQ ID NO: 658442 - RNA, 23 nt, Human
ucccagcacuuugggauuacagg

SEQ ID NO: 658443 - RNA, 25 nt, Human
ucccagcacuuugggauuacaggug

SEQ ID NO: 658444 - RNA, 22 nt, Human
ucccugaagaacuuucugagga

SEQ ID NO: 658445 - RNA, 22 nt, Human
ucuauaaucaaagccugcuguc

SEQ ID NO: 658446 - RNA, 23 nt, Human
ucucuuguggucaggcuugagac

SEQ ID NO: 658447 - RNA, 21 nt, Human
ugaaaagagcugaacagaaac

SEQ ID NO: 658448 - RNA, 19 nt, Human
ugaaagguggucccagaac

SEQ ID NO: 658449 - RNA, 19 nt, Human
ugaacagaaaccauacaua

SEQ ID NO: 658450 - RNA, 18 nt, Human
ugaccuaggccgggcgcg

SEQ ID NO: 658451 - RNA, 21 nt, Human
ugaguaaguagcuguggauuc

SEQ ID NO: 658452 - RNA, 20 nt, Human
ugcuguuuuacucccucugg

SEQ ID NO: 658453 - RNA, 22 nt, Human
uggcucacgccuguaaucccag

SEQ ID NO: 658454 - RNA, 24 nt, Human
uggcucacgccuguaaucccagca

SEQ ID NO: 658455 - RNA, 20 nt, Human
ugggauuacaggugugcaug

SEQ ID NO: 658456 - RNA, 25 nt, Human
ugggauuacaggugugcaugagcca

SEQ ID NO: 658457 - RNA, 26 nt, Human
ugggauuacaggugugcaugagccac

SEQ ID NO: 658458 - RNA, 28 nt, Human
ugggauuacaggugugcaugagccacca

SEQ ID NO: 658459 - RNA, 23 nt, Human
ugggauuacaggugugcaugguc

SEQ ID NO: 658460 - RNA, 21 nt, Human
ugguggugggcuggaggauca

SEQ ID NO: 658461 - RNA, 19 nt, Human
uguaaaauacacacacaca

SEQ ID NO: 658462 - RNA, 20 nt, Human
uguuuuacucccucuggaca

SEQ ID NO: 658463 - RNA, 21 nt, Human
uuaaauguugacuuuccaaca

SEQ ID NO: 658464 - RNA, 22 nt, Human
uuacuccucacccaggaacacu

SEQ ID NO: 658465 - RNA, 21 nt, Human
uucacgaauuacacaaaaaac

SEQ ID NO: 658466 - RNA, 22 nt, Human
uucuaauaaccaggucccugaa

SEQ ID NO: 658467 - RNA, 22 nt, Human
uugcuuccucaagggcucuuug

SEQ ID NO: 658468 - RNA, 18 nt, Human
uuucaggaauggguuauc

SEQ ID NO: 658469 - RNA, 23 nt, Human
uuuuucauguuuucaaaaauauu

SEQ ID NO: 658470 - RNA, 23 nt, Human
uuuuuuuuuuuuuuucauguuuu

SEQ ID NO: 658471 - RNA, 19 nt, Human
cucucuggacuggcugcag

SEQ ID NO: 658472 - RNA, 24 nt, Human
ucucucuggacuggcugcagccug

SEQ ID NO: 658473 - RNA, 18 nt, Human
ucuggacuggcugcagcc

SEQ ID NO: 658474 - RNA, 21 nt, Human
aaaaaagaaauagcugaccca

SEQ ID NO: 658475 - RNA, 24 nt, Human
aaaaaugaaacauugugaaaaaaa

SEQ ID NO: 658476 - RNA, 20 nt, Human
aaacaaaggucucugcaagc

SEQ ID NO: 658477 - RNA, 25 nt, Human
aaacacuuggcuggugaaaaaaaug

SEQ ID NO: 658478 - RNA, 19 nt, Human
aagaaggagcuaagagccc

SEQ ID NO: 658479 - RNA, 22 nt, Human
aauuuuucaauuucauaugaaa

SEQ ID NO: 658480 - RNA, 19 nt, Human
agagaagaaggagcuaaga

SEQ ID NO: 658481 - RNA, 24 nt, Human
agcaaaacacuuggcuggugaaaa

SEQ ID NO: 658482 - RNA, 22 nt, Human
auacaauaguagcuaaggguga

SEQ ID NO: 658483 - RNA, 22 nt, Human
auguguaaaaaugaaacauugu

SEQ ID NO: 658484 - RNA, 19 nt, Human
caugaagagucugacggcg

SEQ ID NO: 658485 - RNA, 22 nt, Human
cuugcuugcucaaaaugagccg

SEQ ID NO: 658486 - RNA, 21 nt, Human
ggaaauagcaaaacacuuggc

SEQ ID NO: 658487 - RNA, 18 nt, Human
ggaugaggggugguccgg

SEQ ID NO: 658488 - RNA, 21 nt, Human
uaaaaaagaaauagcugaccc

SEQ ID NO: 658489 - RNA, 25 nt, Human
uacaauaguagcuaagggugauauu

SEQ ID NO: 658490 - RNA, 21 nt, Human
ucucugcaagcaauacugauu

SEQ ID NO: 658491 - RNA, 21 nt, Human
ugaaaaaaaugaaaaucuaaa

SEQ ID NO: 658492 - RNA, 24 nt, Human
ugaaaaagucuuuuuaacugugaa

SEQ ID NO: 658493 - RNA, 22 nt, Human
ugaguagagaagaaggagcuaa

SEQ ID NO: 658494 - RNA, 19 nt, Human
uggaauguaccuacauuug

SEQ ID NO: 658495 - RNA, 20 nt, Human
uuuuuuuuuuaaaaaaaggu

SEQ ID NO: 658496 - RNA, 23 nt, Human
uuuuuuuuuuuuaaaaaaagguu

SEQ ID NO: 658497 - RNA, 27 nt, Human
uuuuuuuuuuuuuuuggccaggaauua

SEQ ID NO: 658498 - RNA, 18 nt, Human
uuuuuuuuuuuuuuuuug

SEQ ID NO: 658499 - RNA, 24 nt, Human
uuuuuuuuuuuuuuuuuggccagg

SEQ ID NO: 658500 - RNA, 22 nt, Human
uuuuuuuuuuuuuuuuuuuggc

SEQ ID NO: 658501 - RNA, 23 nt, Human
aaaaaaaacaauaaaacacgaaa

SEQ ID NO: 658502 - RNA, 28 nt, Human
aaaaaaacaauaaaacacgaaacucagg

SEQ ID NO: 658503 - RNA, 23 nt, Human
aaaacuccaccaucagaguagaa

SEQ ID NO: 658504 - RNA, 23 nt, Human
aaacacgaaacucaggcaaaaaa

SEQ ID NO: 658505 - RNA, 21 nt, Human
aaacaggauccuuuuucugca

SEQ ID NO: 658506 - RNA, 21 nt, Human
aaagaaaaaaaaaaaaaaucu

SEQ ID NO: 658507 - RNA, 27 nt, Human
aacacgaaacucaggcaaaaaacucca

SEQ ID NO: 658508 - RNA, 20 nt, Human
aacguacauguggaugugga

SEQ ID NO: 658509 - RNA, 24 nt, Human
aagccauaaaaaaaacaauaaaac

SEQ ID NO: 658510 - RNA, 21 nt, Human
aaggaacagcaauuuagaaag

SEQ ID NO: 658511 - RNA, 18 nt, Human
aauugcuugaaccuggga

SEQ ID NO: 658512 - RNA, 24 nt, Human
aauugcuugaaccugggaggcaga

SEQ ID NO: 658513 - RNA, 22 nt, Human
aauuuccucccaagcgcaucuc

SEQ ID NO: 658514 - RNA, 23 nt, Human
acaacgaaccacauggcuaagcc

SEQ ID NO: 658515 - RNA, 23 nt, Human
acagagcaagaccgcaucucaaa

SEQ ID NO: 658516 - RNA, 20 nt, Human
acaucacugcacuccagccu

SEQ ID NO: 658517 - RNA, 24 nt, Human
acaucacugcacuccagccucagc

SEQ ID NO: 658518 - RNA, 24 nt, Human
accugggaggcagaggcugcagug

SEQ ID NO: 658519 - RNA, 27 nt, Human
acgaaacucaggcaaaaaacuccacca

SEQ ID NO: 658520 - RNA, 18 nt, Human
acugcacuccagccucag

SEQ ID NO: 658521 - RNA, 24 nt, Human
acugcacuccagccucagcaacag

SEQ ID NO: 658522 - RNA, 21 nt, Human
agaaagaaacacacuuuaaaa

SEQ ID NO: 658523 - RNA, 23 nt, Human
agaaagaaacacacuuuaaaaaa

SEQ ID NO: 658524 - RNA, 24 nt, Human
agagcaagaccgcaucucaaagaa

SEQ ID NO: 658525 - RNA, 20 nt, Human
agaggcugcagugagccaag

SEQ ID NO: 658526 - RNA, 23 nt, Human
agcacuuuggaggcugagguggg

SEQ ID NO: 658527 - RNA, 24 nt, Human
aggcagaggcugcagugagccaag

SEQ ID NO: 658528 - RNA, 25 nt, Human
aggcagaggcugcagugagccaaga

SEQ ID NO: 658529 - RNA, 24 nt, Human
aggcugaggugggagaauugcuug

SEQ ID NO: 658530 - RNA, 24 nt, Human
aggugggagaauugcuugaaccug

SEQ ID NO: 658531 - RNA, 24 nt, Human
aguggcucacgccuguaaucccag

SEQ ID NO: 658532 - RNA, 20 nt, Human
aucacaucacugcacuccag

SEQ ID NO: 658533 - RNA, 24 nt, Human
caacaaaaagugguuauuuuuacu

SEQ ID NO: 658534 - RNA, 23 nt, Human
caauaaaacacgaaacucaggca

SEQ ID NO: 658535 - RNA, 24 nt, Human
caauagauucccaagcagacgccc

SEQ ID NO: 658536 - RNA, 21 nt, Human
cacaucacugcacuccagccu

SEQ ID NO: 658537 - RNA, 18 nt, Human
cacgaaacucaggcaaaa

SEQ ID NO: 658538 - RNA, 24 nt, Human
cacgccuguaaucccagcacuuug

SEQ ID NO: 658539 - RNA, 23 nt, Human
cacuccagccucagcaacagagc

SEQ ID NO: 658540 - RNA, 19 nt, Human
cacugcacuccagccucag

SEQ ID NO: 658541 - RNA, 19 nt, Human
cacugcacuccagccucag

SEQ ID NO: 658542 - RNA, 20 nt, Human
cacugcacuccagccucagc

SEQ ID NO: 658543 - RNA, 21 nt, Human
cacugcacuccagccucagca

SEQ ID NO: 658544 - RNA, 22 nt, Human
cacugcacuccagccucagcaa

SEQ ID NO: 658545 - RNA, 24 nt, Human
cacugcacuccagccucagcaaca

SEQ ID NO: 658546 - RNA, 23 nt, Human
cagcaauuuagaaagaaacacac

SEQ ID NO: 658547 - RNA, 23 nt, Human
cagcacuuuggaggcugaggugg

SEQ ID NO: 658548 - RNA, 24 nt, Human
cagcucaggucuccauccagguac

SEQ ID NO: 658549 - RNA, 23 nt, Human
caucuccuucuccagcucagguc

SEQ ID NO: 658550 - RNA, 21 nt, Human
cauggcuaagccauaaaaaaa

SEQ ID NO: 658551 - RNA, 22 nt, Human
cauggcuaagccauaaaaaaaa

SEQ ID NO: 658552 - RNA, 24 nt, Human
ccagguaccuggucaguccauacu

SEQ ID NO: 658553 - RNA, 24 nt, Human
ccgcaucucaaagaaaaaaaaaaa

SEQ ID NO: 658554 - RNA, 22 nt, Human
ccucccaagcgcaucuccuucu

SEQ ID NO: 658555 - RNA, 21 nt, Human
ccucugcaauuuccucccaag

SEQ ID NO: 658556 - RNA, 22 nt, Human
ccucugcaauuuccucccaagc

SEQ ID NO: 658557 - RNA, 21 nt, Human
ccucugcggcuccugccaccc

SEQ ID NO: 658558 - RNA, 20 nt, Human
ccuucaucagcugguauuuu

SEQ ID NO: 658559 - RNA, 27 nt, Human
cgcaucucaaagaaaaaaaaaaaaaau

SEQ ID NO: 658560 - RNA, 21 nt, Human
cggccucugcaauuuccuccc

SEQ ID NO: 658561 - RNA, 23 nt, Human
cuaagccauaaaaaaaacaauaa

SEQ ID NO: 658562 - RNA, 21 nt, Human
cuacauacaaacguacaugug

SEQ ID NO: 658563 - RNA, 23 nt, Human
cucaaagaaaaaaaaaaaaaauc

SEQ ID NO: 658564 - RNA, 22 nt, Human
cucacgccuguaaucccagcac

SEQ ID NO: 658565 - RNA, 24 nt, Human
cucacgccuguaaucccagcacuu

SEQ ID NO: 658566 - RNA, 18 nt, Human
cugggaggcagaggcugc

SEQ ID NO: 658567 - RNA, 20 nt, Human
gaauguggccgggcgcagug

SEQ ID NO: 658568 - RNA, 18 nt, Human
gaggcugcagugagccaa

SEQ ID NO: 658569 - RNA, 23 nt, Human
gaggugggagaauugcuugaacc

SEQ ID NO: 658570 - RNA, 24 nt, Human
gcacuccagccucagcaacagagc

SEQ ID NO: 658571 - RNA, 20 nt, Human
gcgcaguggcucacgccugu

SEQ ID NO: 658572 - RNA, 20 nt, Human
ggaggcagaggcugcaguga

SEQ ID NO: 658573 - RNA, 22 nt, Human
ggcaaaaaacuccaccaucaga

SEQ ID NO: 658574 - RNA, 22 nt, Human
ggccgggcgcaguggcucacgg

SEQ ID NO: 658575 - RNA, 23 nt, Human
ggcgcaguggcucacgccuguaa

SEQ ID NO: 658576 - RNA, 21 nt, Human
gguuauuucuuugauaagaac

SEQ ID NO: 658577 - RNA, 19 nt, Human
uaaaacacgaaacucaggc

SEQ ID NO: 658578 - RNA, 26 nt, Human
uaagccauaaaaaaaacaauaaaaca

SEQ ID NO: 658579 - RNA, 19 nt, Human
uacucuaguuggcgcccag

SEQ ID NO: 658580 - RNA, 24 nt, Human
uagaaagaaacacacuuuaaaaaa

SEQ ID NO: 658581 - RNA, 26 nt, Human
uagauucccaagcagacgcccaguuu

SEQ ID NO: 658582 - RNA, 24 nt, Human
uauucuacuccuuuaaaaauuuca

SEQ ID NO: 658583 - RNA, 20 nt, Human
ucacugcacuccagccucag

SEQ ID NO: 658584 - RNA, 21 nt, Human
ucacugcacuccagccucagc

SEQ ID NO: 658585 - RNA, 22 nt, Human
ucagaugccuucaucagcuggu

SEQ ID NO: 658586 - RNA, 18 nt, Human
ucaggucuccauccaggu

SEQ ID NO: 658587 - RNA, 19 nt, Human
uccaccaucagaguagaau

SEQ ID NO: 658588 - RNA, 22 nt, Human
uccaccaucagaguagaaugcu

SEQ ID NO: 658589 - RNA, 26 nt, Human
uccauacucuaguuggcgcccaggga

SEQ ID NO: 658590 - RNA, 21 nt, Human
ucccaagcagacgcccaguuu

SEQ ID NO: 658591 - RNA, 19 nt, Human
uccugccaccccgggccag

SEQ ID NO: 658592 - RNA, 22 nt, Human
ucuccagcucaggucuccaucc

SEQ ID NO: 658593 - RNA, 24 nt, Human
ugaaccugggaggcagaggcugca

SEQ ID NO: 658594 - RNA, 21 nt, Human
ugacggccucugcaauuuccu

SEQ ID NO: 658595 - RNA, 23 nt, Human
ugaggugggagaauugcuugaac

SEQ ID NO: 658596 - RNA, 24 nt, Human
ugauaagaacugaauguggccggg

SEQ ID NO: 658597 - RNA, 20 nt, Human
ugcacuccagccucagcaac

SEQ ID NO: 658598 - RNA, 18 nt, Human
ugcaguccauucucagga

SEQ ID NO: 658599 - RNA, 19 nt, Human
uggauguggacaacgaacc

SEQ ID NO: 658600 - RNA, 24 nt, Human
uggcgcccagggacuggucgggaa

SEQ ID NO: 658601 - RNA, 24 nt, Human
uggcucacgccuguaaucccagca

SEQ ID NO: 658602 - RNA, 23 nt, Human
uucucaggauuacacagcaaaca

SEQ ID NO: 658603 - RNA, 22 nt, Human
uugacggccucugcaauuuccu

SEQ ID NO: 658604 - RNA, 24 nt, Human
uugacggccucugcaauuuccucc

SEQ ID NO: 658605 - RNA, 24 nt, Human
uugcuugaaccugggaggcagagg

SEQ ID NO: 658606 - RNA, 22 nt, Human
uuggaggcugaggugggagaau

SEQ ID NO: 658607 - RNA, 18 nt, Human
uuguauuuuuuacaucau

SEQ ID NO: 658608 - RNA, 25 nt, Human
uuuagaaagaaacacacuuuaaaaa

SEQ ID NO: 658609 - RNA, 18 nt, Human
uuuuuuuuuuuuuuuuug

SEQ ID NO: 658610 - RNA, 24 nt, Human
uuuuuuuuuuuuuuuuugguguug

SEQ ID NO: 658611 - RNA, 20 nt, Human
uuuuuuuuuuuuuuuuuugg

SEQ ID NO: 658612 - RNA, 24 nt, Human
aaaaaaaacagaaagcagcuuaga

SEQ ID NO: 658613 - RNA, 24 nt, Human
aaagugcugggaucacaggcauga

SEQ ID NO: 658614 - RNA, 22 nt, Human
aaagugcuuugaaagaccccag

SEQ ID NO: 658615 - RNA, 19 nt, Human
aagacgggguugcaccaug

SEQ ID NO: 658616 - RNA, 26 nt, Human
aagugcugggaucacaggcaugagcc

SEQ ID NO: 658617 - RNA, 23 nt, Human
aauuuuguauuuuuacuaagacg

SEQ ID NO: 658618 - RNA, 21 nt, Human
accauguggccaggcuggucu

SEQ ID NO: 658619 - RNA, 21 nt, Human
accccagcucccaguggccua

SEQ ID NO: 658620 - RNA, 21 nt, Human
acccgggcuggaguggguggc

SEQ ID NO: 658621 - RNA, 21 nt, Human
acgcagaaccuggcggggggc

SEQ ID NO: 658622 - RNA, 18 nt, Human
acgccacgaggcuggaac

SEQ ID NO: 658623 - RNA, 19 nt, Human
acgggguugcaccaugugg

SEQ ID NO: 658624 - RNA, 23 nt, Human
acgggguugcaccauguggccag

SEQ ID NO: 658625 - RNA, 26 nt, Human
acuacaggugcccgcucucacgccag

SEQ ID NO: 658626 - RNA, 27 nt, Human
agaaaacaaaacccaugaugcuccuuc

SEQ ID NO: 658627 - RNA, 20 nt, Human
agaaagcagcuuagagcaau

SEQ ID NO: 658628 - RNA, 21 nt, Human
agccagagucucgcucuguca

SEQ ID NO: 658629 - RNA, 20 nt, Human
agcgcuggagccagggugcc

SEQ ID NO: 658630 - RNA, 19 nt, Human
aggaagggcucccagccuc

SEQ ID NO: 658631 - RNA, 22 nt, Human
agggugcccagcaggagguggc

SEQ ID NO: 658632 - RNA, 18 nt, Human
aggugauccacccgccuc

SEQ ID NO: 658633 - RNA, 23 nt, Human
aggugcagagccggccagcgacc

SEQ ID NO: 658634 - RNA, 18 nt, Human
aguagcugggacuacagg

SEQ ID NO: 658635 - RNA, 19 nt, Human
aguggguggcgcgaucucg

SEQ ID NO: 658636 - RNA, 23 nt, Human
aguggguggcgcgaucucggcuc

SEQ ID NO: 658637 - RNA, 23 nt, Human
auauuaaaaaaaaacagaaagca

SEQ ID NO: 658638 - RNA, 25 nt, Human
auccccucugcugcguuuuuuguua

SEQ ID NO: 658639 - RNA, 19 nt, Human
augcuccuucacuugcucu

SEQ ID NO: 658640 - RNA, 24 nt, Human
caaagugcugggaucacaggcaug

SEQ ID NO: 658641 - RNA, 20 nt, Human
caacgugugacaggaaaggc

SEQ ID NO: 658642 - RNA, 20 nt, Human
caagcgauucuccugccuca

SEQ ID NO: 658643 - RNA, 22 nt, Human
caagcgauucuccugccucagc

SEQ ID NO: 658644 - RNA, 19 nt, Human
caagcgcaggcggggcucc

SEQ ID NO: 658645 - RNA, 25 nt, Human
cacagaaacagggccacggaccaca

SEQ ID NO: 658646 - RNA, 24 nt, Human
cacaggcaugagccaccgcaccca

SEQ ID NO: 658647 - RNA, 19 nt, Human
caccagaagcgagugacga

SEQ ID NO: 658648 - RNA, 23 nt, Human
caccagaagcgagugacgacaug

SEQ ID NO: 658649 - RNA, 18 nt, Human
caccaggccccucaggga

SEQ ID NO: 658650 - RNA, 20 nt, Human
caccauguggccaggcuggu

SEQ ID NO: 658651 - RNA, 22 nt, Human
caccauguggccaggcuggucu

SEQ ID NO: 658652 - RNA, 25 nt, Human
caccgcacccagccagaagacagcc

SEQ ID NO: 658653 - RNA, 28 nt, Human
cacggaccacagaaaugcaggacggagc

SEQ ID NO: 658654 - RNA, 18 nt, Human
cacugcaaccucugccuc

SEQ ID NO: 658655 - RNA, 21 nt, Human
cacugcaaccucugccuccca

SEQ ID NO: 658656 - RNA, 22 nt, Human
cagcaggagguggcuguccccg

SEQ ID NO: 658657 - RNA, 21 nt, Human
caggaaaacuagcuccuucca

SEQ ID NO: 658658 - RNA, 21 nt, Human
caggaagggcucccagccucg

SEQ ID NO: 658659 - RNA, 21 nt, Human
caucucaauccauaaucacuc

SEQ ID NO: 658660 - RNA, 23 nt, Human
cauguggccaggcuggucuugaa

SEQ ID NO: 658661 - RNA, 24 nt, Human
ccaaagugcugggaucacaggcau

SEQ ID NO: 658662 - RNA, 22 nt, Human
ccagggugcccagcaggaggug

SEQ ID NO: 658663 - RNA, 26 nt, Human
cccagccucgguccucacgucggugg

SEQ ID NO: 658664 - RNA, 20 nt, Human
cccagguucaagcgauucuc

SEQ ID NO: 658665 - RNA, 23 nt, Human
cccagguucaagcgauucuccug

SEQ ID NO: 658666 - RNA, 20 nt, Human
ccccucagggacaggcaggc

SEQ ID NO: 658667 - RNA, 23 nt, Human
cccgaguagcugggacuacaggu

SEQ ID NO: 658668 - RNA, 24 nt, Human
cccgaguagcugggacuacaggug

SEQ ID NO: 658669 - RNA, 23 nt, Human
ccgccgaguaacgagacccgcac

SEQ ID NO: 658670 - RNA, 20 nt, Human
ccgcggccgccccgcgccgc

SEQ ID NO: 658671 - RNA, 24 nt, Human
ccucccagguucaagcgauucucc

SEQ ID NO: 658672 - RNA, 23 nt, Human
ccucuaacuaaauuccucgguuu

SEQ ID NO: 658673 - RNA, 22 nt, Human
ccugaccuuaggugauccaccc

SEQ ID NO: 658674 - RNA, 23 nt, Human
ccugccucagccucccgaguagc

SEQ ID NO: 658675 - RNA, 24 nt, Human
ccugccucagccucccgaguagcu

SEQ ID NO: 658676 - RNA, 22 nt, Human
ccugggaccugcugcucccagg

SEQ ID NO: 658677 - RNA, 21 nt, Human
cgccaaugcugacucacgguc

SEQ ID NO: 658678 - RNA, 21 nt, Human
cgccgaguaacgagacccgca

SEQ ID NO: 658679 - RNA, 21 nt, Human
cgccgcguggaucccggaggc

SEQ ID NO: 658680 - RNA, 27 nt, Human
cgucuugcucuuccagguccuucucua

SEQ ID NO: 658681 - RNA, 22 nt, Human
cuaacgcagaaccuggcggggg

SEQ ID NO: 658682 - RNA, 18 nt, Human
cucacgguccgcggccgc

SEQ ID NO: 658683 - RNA, 24 nt, Human
cucacugcaaccucugccucccag

SEQ ID NO: 658684 - RNA, 24 nt, Human
cucacugcaaccucugccucccag

SEQ ID NO: 658685 - RNA, 24 nt, Human
cucagccucccgaguagcugggac

SEQ ID NO: 658686 - RNA, 22 nt, Human
cucaugauaacguguaacaggg

SEQ ID NO: 658687 - RNA, 24 nt, Human
cucgcucugucacccgggcuggag

SEQ ID NO: 658688 - RNA, 20 nt, Human
cucugucacccgggcuggag

SEQ ID NO: 658689 - RNA, 22 nt, Human
cugaccgccgaguaacgagacc

SEQ ID NO: 658690 - RNA, 24 nt, Human
cugacucacgguccgcggccgccc

SEQ ID NO: 658691 - RNA, 23 nt, Human
cugcaaccucugccucccagguu

SEQ ID NO: 658692 - RNA, 24 nt, Human
cugcaaccucugccucccagguuc

SEQ ID NO: 658693 - RNA, 18 nt, Human
cugcucccaggucguggc

SEQ ID NO: 658694 - RNA, 18 nt, Human
cugcugcucccaggucgu

SEQ ID NO: 658695 - RNA, 18 nt, Human
cuggaacaucagccccag

SEQ ID NO: 658696 - RNA, 24 nt, Human
cuggaguggguggcgcgaucucgg

SEQ ID NO: 658697 - RNA, 21 nt, Human
cuuccagguccuucucuaggg

SEQ ID NO: 658698 - RNA, 20 nt, Human
gaagggcucccagccucggu

SEQ ID NO: 658699 - RNA, 24 nt, Human
gaccuuaggugauccacccgccuc

SEQ ID NO: 658700 - RNA, 18 nt, Human
gaucacaggcaugagcca

SEQ ID NO: 658701 - RNA, 21 nt, Human
gauucuccugccucagccucc

SEQ ID NO: 658702 - RNA, 21 nt, Human
gcaccaggccccucagggaca

SEQ ID NO: 658703 - RNA, 22 nt, Human
gcauauuaaaaaaaaacagaaa

SEQ ID NO: 658704 - RNA, 24 nt, Human
gcgauucuccugccucagccuccc

SEQ ID NO: 658705 - RNA, 20 nt, Human
gcgccgcguggaucccggag

SEQ ID NO: 658706 - RNA, 19 nt, Human
gcuggagccagggugccca

SEQ ID NO: 658707 - RNA, 22 nt, Human
ggaucacaggcaugagccaccg

SEQ ID NO: 658708 - RNA, 23 nt, Human
ggcuggucuugaacuccugaccu

SEQ ID NO: 658709 - RNA, 20 nt, Human
gggcagggagccggggaugg

SEQ ID NO: 658710 - RNA, 20 nt, Human
ggggggcgcaccuaagggag

SEQ ID NO: 658711 - RNA, 21 nt, Human
gggugcccagcaggagguggc

SEQ ID NO: 658712 - RNA, 21 nt, Human
ggguugcaccauguggccagg

SEQ ID NO: 658713 - RNA, 19 nt, Human
ggucuugaacuccugaccu

SEQ ID NO: 658714 - RNA, 19 nt, Human
gucgguggcaccagaagcg

SEQ ID NO: 658715 - RNA, 18 nt, Human
gugauccacccgccuccc

SEQ ID NO: 658716 - RNA, 19 nt, Human
gugcccagcaggagguggc

SEQ ID NO: 658717 - RNA, 23 nt, Human
uaacaggaagggcucccagccuc

SEQ ID NO: 658718 - RNA, 20 nt, Human
uaaccucuaacuaaauuccu

SEQ ID NO: 658719 - RNA, 22 nt, Human
uaaccucuaacuaaauuccuuc

SEQ ID NO: 658720 - RNA, 18 nt, Human
uacaaagugcuuugaaag

SEQ ID NO: 658721 - RNA, 19 nt, Human
uacaaagugcuuugaaaga

SEQ ID NO: 658722 - RNA, 19 nt, Human
uagauaggugacaacgugu

SEQ ID NO: 658723 - RNA, 21 nt, Human
uaggugauccacccgccuccc

SEQ ID NO: 658724 - RNA, 27 nt, Human
uaggugauccacccgccuccccugaag

SEQ ID NO: 658725 - RNA, 20 nt, Human
ucacccgggcuggagugggu

SEQ ID NO: 658726 - RNA, 19 nt, Human
ucacugcaaccucugccuc

SEQ ID NO: 658727 - RNA, 24 nt, Human
ucacugcaaccucugccucccagg

SEQ ID NO: 658728 - RNA, 25 nt, Human
ucacugcaaccucugccucccaggu

SEQ ID NO: 658729 - RNA, 23 nt, Human
ucagccucccgaguagcugggac

SEQ ID NO: 658730 - RNA, 21 nt, Human
ucaggccaagcgcaggcgggg

SEQ ID NO: 658731 - RNA, 27 nt, Human
ucaggccaagcgcaggcggggcuccca

SEQ ID NO: 658732 - RNA, 27 nt, Human
ucagggacaggcaggcggguucugugg

SEQ ID NO: 658733 - RNA, 24 nt, Human
ucccaaagugcugggaucacaggc

SEQ ID NO: 658734 - RNA, 19 nt, Human
ucccacgccacgaggcugg

SEQ ID NO: 658735 - RNA, 20 nt, Human
ucccagccucgguccucacg

SEQ ID NO: 658736 - RNA, 21 nt, Human
ucccagguucaagcgauucuc

SEQ ID NO: 658737 - RNA, 24 nt, Human
ucccagguucaagcgauucuccug

SEQ ID NO: 658738 - RNA, 23 nt, Human
ucccgaguagcugggacuacagg

SEQ ID NO: 658739 - RNA, 24 nt, Human
ucccgaguagcugggacuacaggu

SEQ ID NO: 658740 - RNA, 26 nt, Human
uccguggucaggaggagcgcuggagc

SEQ ID NO: 658741 - RNA, 25 nt, Human
uccugcucccacgccacgaggcugg

SEQ ID NO: 658742 - RNA, 24 nt, Human
ucgcucugucacccgggcuggagu

SEQ ID NO: 658743 - RNA, 24 nt, Human
ucuccugccucagccucccgagua

SEQ ID NO: 658744 - RNA, 19 nt, Human
ucucgcucugucacccggg

SEQ ID NO: 658745 - RNA, 23 nt, Human
ucucgcucugucacccgggcugg

SEQ ID NO: 658746 - RNA, 24 nt, Human
ucucgcucugucacccgggcugga

SEQ ID NO: 658747 - RNA, 22 nt, Human
ucugucacccgggcuggagugg

SEQ ID NO: 658748 - RNA, 21 nt, Human
ucuuccagguccuucucuagg

SEQ ID NO: 658749 - RNA, 23 nt, Human
ucuugaacuccugaccuuaggug

SEQ ID NO: 658750 - RNA, 24 nt, Human
ugaccuuaggugauccacccgccu

SEQ ID NO: 658751 - RNA, 18 nt, Human
ugcaccauguggccaggc

SEQ ID NO: 658752 - RNA, 22 nt, Human
ugcagagccggccagcgaccug

SEQ ID NO: 658753 - RNA, 24 nt, Human
ugccucagccucccgaguagcugg

SEQ ID NO: 658754 - RNA, 19 nt, Human
ugcugggaucacaggcaug

SEQ ID NO: 658755 - RNA, 23 nt, Human
uggaguggguggcgcgaucucgg

SEQ ID NO: 658756 - RNA, 24 nt, Human
uggccaggcuggucuugaacuccu

SEQ ID NO: 658757 - RNA, 18 nt, Human
uggcggcgcacggcugcc

SEQ ID NO: 658758 - RNA, 19 nt, Human
ugggaccugcugcucccag

SEQ ID NO: 658759 - RNA, 18 nt, Human
ugggacuacaggugcccg

SEQ ID NO: 658760 - RNA, 19 nt, Human
ugggacuacaggugcccgc

SEQ ID NO: 658761 - RNA, 20 nt, Human
ugggaggggcugggacagcg

SEQ ID NO: 658762 - RNA, 21 nt, Human
ugggaucacaggcaugagcca

SEQ ID NO: 658763 - RNA, 22 nt, Human
ugggaucacaggcaugagccac

SEQ ID NO: 658764 - RNA, 23 nt, Human
ugggaucacaggcaugagccacc

SEQ ID NO: 658765 - RNA, 24 nt, Human
ugggaucacaggcaugagccaccg

SEQ ID NO: 658766 - RNA, 24 nt, Human
ugggaucacaggcaugagccaccg

SEQ ID NO: 658767 - RNA, 26 nt, Human
ugggaucacaggcaugagccaccgca

SEQ ID NO: 658768 - RNA, 23 nt, Human
uguaaaaauccuaggucuuacua

SEQ ID NO: 658769 - RNA, 18 nt, Human
ugucaggccaagcgcagg

SEQ ID NO: 658770 - RNA, 20 nt, Human
uuaagaacaucucaauccag

SEQ ID NO: 658771 - RNA, 22 nt, Human
uuaggugauccacccgccuccc

SEQ ID NO: 658772 - RNA, 21 nt, Human
uucaagcgauucuccugccuc

SEQ ID NO: 658773 - RNA, 23 nt, Human
uucaagcgauucuccugccucag

SEQ ID NO: 658774 - RNA, 24 nt, Human
uucaagcgauucuccugccucagc

SEQ ID NO: 658775 - RNA, 20 nt, Human
uucagaauaugaaaucuaau

SEQ ID NO: 658776 - RNA, 19 nt, Human
uugcaccauguggccaggc

SEQ ID NO: 658777 - RNA, 20 nt, Human
uuugaaagaccccagcuccc

SEQ ID NO: 658778 - RNA, 19 nt, Human
uuuuuuuuuugagccagag

SEQ ID NO: 658779 - RNA, 25 nt, Human
uuuuuuuuuuuugagccagagucuc

SEQ ID NO: 658780 - RNA, 18 nt, Human
uuuuuuuuuuuuuuuuug

SEQ ID NO: 658781 - RNA, 22 nt, Human
aaacacacugggccucagacac

SEQ ID NO: 658782 - RNA, 19 nt, Human
aaccccgcgaccacccuga

SEQ ID NO: 658783 - RNA, 22 nt, Human
aaccccgcgaccacccugagag

SEQ ID NO: 658784 - RNA, 24 nt, Human
aaccgaaacucugaacaccccucg

SEQ ID NO: 658785 - RNA, 22 nt, Human
aacucuuugccuccuuagggag

SEQ ID NO: 658786 - RNA, 19 nt, Human
aagcagagagcccacaauc

SEQ ID NO: 658787 - RNA, 20 nt, Human
aagcucacccaccaauccug

SEQ ID NO: 658788 - RNA, 25 nt, Human
aaggaauaaaggcauuauuuuugag

SEQ ID NO: 658789 - RNA, 20 nt, Human
acagaaaagagaaccgaaac

SEQ ID NO: 658790 - RNA, 20 nt, Human
acagaauuucucuaagucua

SEQ ID NO: 658791 - RNA, 23 nt, Human
accccgcgaccacccugagagcc

SEQ ID NO: 658792 - RNA, 23 nt, Human
acccugagagccagcacugcagc

SEQ ID NO: 658793 - RNA, 25 nt, Human
accuuugacagcugcugaauuccaa

SEQ ID NO: 658794 - RNA, 26 nt, Human
agauccucaaagguucccugccccuu

SEQ ID NO: 658795 - RNA, 24 nt, Human
agcacugcagccaugccgcccgcc

SEQ ID NO: 658796 - RNA, 22 nt, Human
agccagcacugcagccaugccg

SEQ ID NO: 658797 - RNA, 24 nt, Human
aggcugggcuucugcccagcugcc

SEQ ID NO: 658798 - RNA, 22 nt, Human
aguaauacgaucacagaaaaga

SEQ ID NO: 658799 - RNA, 22 nt, Human
agugcuccaagagcauggccac

SEQ ID NO: 658800 - RNA, 19 nt, Human
caaccccgcgaccacccug

SEQ ID NO: 658801 - RNA, 24 nt, Human
caaccucuacccuguggauguccu

SEQ ID NO: 658802 - RNA, 21 nt, Human
cacacccaaccucuacccugu

SEQ ID NO: 658803 - RNA, 23 nt, Human
caccugccccucucuggccgcgc

SEQ ID NO: 658804 - RNA, 19 nt, Human
cacugggccuagggugcug

SEQ ID NO: 658805 - RNA, 18 nt, Human
caggacuccaaacgagca

SEQ ID NO: 658806 - RNA, 19 nt, Human
ccaaagggaguacugugga

SEQ ID NO: 658807 - RNA, 24 nt, Human
ccaaccccgcgaccacccugagag

SEQ ID NO: 658808 - RNA, 26 nt, Human
ccaaccucuacccuguggauguccua

SEQ ID NO: 658809 - RNA, 21 nt, Human
ccaagcacagcgguaagugcu

SEQ ID NO: 658810 - RNA, 20 nt, Human
ccaguggugagacauggccu

SEQ ID NO: 658811 - RNA, 19 nt, Human
ccaugacucuugucuucuu

SEQ ID NO: 658812 - RNA, 18 nt, Human
cccaacuguuccuuuguu

SEQ ID NO: 658813 - RNA, 24 nt, Human
cccaccaauccuggcccuccaccu

SEQ ID NO: 658814 - RNA, 25 nt, Human
cccuguggauguccuagauaagggu

SEQ ID NO: 658815 - RNA, 21 nt, Human
ccgaaacucugaacaccccuc

SEQ ID NO: 658816 - RNA, 22 nt, Human
ccgaaacucugaacaccccucg

SEQ ID NO: 658817 - RNA, 18 nt, Human
ccgcccgcccgccggggc

SEQ ID NO: 658818 - RNA, 19 nt, Human
ccgccgcccagcaccugcc

SEQ ID NO: 658819 - RNA, 18 nt, Human
ccggcgccggaugcgggg

SEQ ID NO: 658820 - RNA, 21 nt, Human
ccugaaauugcaccuuugaca

SEQ ID NO: 658821 - RNA, 25 nt, Human
ccuggcccuccaccugguccccugg

SEQ ID NO: 658822 - RNA, 20 nt, Human
ccugggaacuaauaucucag

SEQ ID NO: 658823 - RNA, 19 nt, Human
ccuguugcuaggacgagag

SEQ ID NO: 658824 - RNA, 22 nt, Human
cgaucacagaaaagagaaccga

SEQ ID NO: 658825 - RNA, 22 nt, Human
cgccgcccagcaccugccccuc

SEQ ID NO: 658826 - RNA, 21 nt, Human
cgcgcggcgcucccgggagcc

SEQ ID NO: 658827 - RNA, 19 nt, Human
cggcagcggcgagggcugg

SEQ ID NO: 658828 - RNA, 21 nt, Human
cguccaggacuccaaacgagc

SEQ ID NO: 658829 - RNA, 24 nt, Human
cuaaaaaacacacugggccucaau

SEQ ID NO: 658830 - RNA, 18 nt, Human
cuaaagcucacccaccaa

SEQ ID NO: 658831 - RNA, 21 nt, Human
cuaaagcucacccaccaaucc

SEQ ID NO: 658832 - RNA, 21 nt, Human
cuaaggaagcagagagcccac

SEQ ID NO: 658833 - RNA, 24 nt, Human
cuaaggaagcagagagcccacaau

SEQ ID NO: 658834 - RNA, 20 nt, Human
cuacugggguagaggccugg

SEQ ID NO: 658835 - RNA, 21 nt, Human
cucccguacacacacccaacu

SEQ ID NO: 658836 - RNA, 24 nt, Human
cuccgggcccuggcgcagggugcg

SEQ ID NO: 658837 - RNA, 22 nt, Human
cucucuggccgcgcaagugacu

SEQ ID NO: 658838 - RNA, 18 nt, Human
cucuuugccuccuuaggg

SEQ ID NO: 658839 - RNA, 20 nt, Human
cugcgcccgucagccgccgc

SEQ ID NO: 658840 - RNA, 20 nt, Human
cugcucaggugaaugucgga

SEQ ID NO: 658841 - RNA, 24 nt, Human
cuugucuucuucagaauacccugg

SEQ ID NO: 658842 - RNA, 19 nt, Human
gaaacucugaacaccccuc

SEQ ID NO: 658843 - RNA, 22 nt, Human
gagcagcugcucccuaaagcuc

SEQ ID NO: 658844 - RNA, 21 nt, Human
gagcauggccaccagcgcugc

SEQ ID NO: 658845 - RNA, 20 nt, Human
gagcauggccaccagcgcuu

SEQ ID NO: 658846 - RNA, 19 nt, Human
gcaccugccccucucuggc

SEQ ID NO: 658847 - RNA, 22 nt, Human
gcaccugccccucucuggccgc

SEQ ID NO: 658848 - RNA, 22 nt, Human
gccgcccagcaccugccccucu

SEQ ID NO: 658849 - RNA, 19 nt, Human
gccugggcuacagacacag

SEQ ID NO: 658850 - RNA, 19 nt, Human
gcgcggcagcggcgagggc

SEQ ID NO: 658851 - RNA, 21 nt, Human
gcggcagcggcgagggcuggc

SEQ ID NO: 658852 - RNA, 23 nt, Human
gcugaucccgcgcaggaccgcgc

SEQ ID NO: 658853 - RNA, 25 nt, Human
ggacauaauggaaagagccgguacc

SEQ ID NO: 658854 - RNA, 22 nt, Human
ggccggcgccggaugcggggcu

SEQ ID NO: 658855 - RNA, 24 nt, Human
uaaaaaacacacugggccucagac

SEQ ID NO: 658856 - RNA, 23 nt, Human
uacagcagaauauuuccuguaau

SEQ ID NO: 658857 - RNA, 23 nt, Human
uacaguggcaucuacacagauga

SEQ ID NO: 658858 - RNA, 20 nt, Human
uacccuguggauguccuaga

SEQ ID NO: 658859 - RNA, 21 nt, Human
ucaggugaaugucggauaucu

SEQ ID NO: 658860 - RNA, 23 nt, Human
ucaugauuuccuuugauauccag

SEQ ID NO: 658861 - RNA, 24 nt, Human
uccaccugcuacugggguagaggc

SEQ ID NO: 658862 - RNA, 21 nt, Human
ucccuaaagcucacccaccaa

SEQ ID NO: 658863 - RNA, 24 nt, Human
ucccuccaacguccaggacuccaa

SEQ ID NO: 658864 - RNA, 21 nt, Human
ucgggcccagauccucaaagg

SEQ ID NO: 658865 - RNA, 23 nt, Human
ucuccuguugcuaggacgagagc

SEQ ID NO: 658866 - RNA, 20 nt, Human
ucucuggccgcgcaagugac

SEQ ID NO: 658867 - RNA, 24 nt, Human
ucugcaguccauucugcagguauc

SEQ ID NO: 658868 - RNA, 19 nt, Human
ugaaauugcaccuuugaca

SEQ ID NO: 658869 - RNA, 23 nt, Human
ugaaugcaucaugauuuccuuug

SEQ ID NO: 658870 - RNA, 24 nt, Human
ugaaugucggauaucugcaggccc

SEQ ID NO: 658871 - RNA, 19 nt, Human
ugagagccagcacugcagc

SEQ ID NO: 658872 - RNA, 23 nt, Human
ugcuguccagacuuggaauauug

SEQ ID NO: 658873 - RNA, 21 nt, Human
uggaaagagccaucucuacgu

SEQ ID NO: 658874 - RNA, 27 nt, Human
uggcgcagggugcggccuccugggggg

SEQ ID NO: 658875 - RNA, 25 nt, Human
ugggaacuaauaucucagggguagu

SEQ ID NO: 658876 - RNA, 19 nt, Human
ugucgcagggccagagcug

SEQ ID NO: 658877 - RNA, 19 nt, Human
uuauagggucucuuaggcc

SEQ ID NO: 658878 - RNA, 21 nt, Human
uuccaugacucuugucuucuu

SEQ ID NO: 658879 - RNA, 30 nt, Human
uucccugccccugaaauugcaccuuugacu

SEQ ID NO: 658880 - RNA, 20 nt, Human
uuccuuuguuuuggcaucug

SEQ ID NO: 658881 - RNA, 18 nt, Human
uugagacuuuucugcagu

SEQ ID NO: 658882 - RNA, 20 nt, Human
uugccaaagggaguacugug

SEQ ID NO: 658883 - RNA, 22 nt, Human
uugccaaagggaguacugugga

SEQ ID NO: 658884 - RNA, 19 nt, Human
uuugccuccuuagggaggg

SEQ ID NO: 658885 - RNA, 21 nt, Human
uuuuccaugacucuugucuuc

SEQ ID NO: 658886 - RNA, 22 nt, Human
uuuuugagacuuuucugcaguc

SEQ ID NO: 658887 - RNA, 20 nt, Human
aaaaaaaaaaaaaaaaggaa

SEQ ID NO: 658888 - RNA, 23 nt, Human
aaaaaaaaaaggaaucgcuugaa

SEQ ID NO: 658889 - RNA, 24 nt, Human
aaaaaaaggaaucgcuugaaccug

SEQ ID NO: 658890 - RNA, 24 nt, Human
aaaaaaggaaucgcuugaaccugg

SEQ ID NO: 658891 - RNA, 19 nt, Human
aaaaaauacaaaaaauuag

SEQ ID NO: 658892 - RNA, 22 nt, Human
aaaccccgucucuacuaaaaaa

SEQ ID NO: 658893 - RNA, 20 nt, Human
aacacggugaaaccccgucu

SEQ ID NO: 658894 - RNA, 21 nt, Human
aacacggugaaaccccgucuc

SEQ ID NO: 658895 - RNA, 19 nt, Human
aacacggugaaacccuguc

SEQ ID NO: 658896 - RNA, 20 nt, Human
aacacggugaaacccugucu

SEQ ID NO: 658897 - RNA, 21 nt, Human
aacacggugaaacccugucuc

SEQ ID NO: 658898 - RNA, 20 nt, Human
aacauggugaaacccugucu

SEQ ID NO: 658899 - RNA, 21 nt, Human
aacauggugaaacccugucuc

SEQ ID NO: 658900 - RNA, 20 nt, Human
aagcugauaccucacccacc

SEQ ID NO: 658901 - RNA, 21 nt, Human
aaggccaaggugggcagauca

SEQ ID NO: 658902 - RNA, 18 nt, Human
aaucgcuugaaccuggga

SEQ ID NO: 658903 - RNA, 24 nt, Human
aaucgcuugaaccugggaggcaga

SEQ ID NO: 658904 - RNA, 22 nt, Human
aaucgcuugaggccaggcacgg

SEQ ID NO: 658905 - RNA, 31 nt, Human
aaucgcuugaggccaggcacgguggcucaaa

SEQ ID NO: 658906 - RNA, 18 nt, Human
aauuagccaggcauggug

SEQ ID NO: 658907 - RNA, 21 nt, Human
acagagugagacucugucuca

SEQ ID NO: 658908 - RNA, 23 nt, Human
acagagugagacucugucucaaa

SEQ ID NO: 658909 - RNA, 23 nt, Human
acagagugagacucugucucaaa

SEQ ID NO: 658910 - RNA, 24 nt, Human
acagagugagacucugucucaaaa

SEQ ID NO: 658911 - RNA, 24 nt, Human
acagagugagacucugucucaaaa

SEQ ID NO: 658912 - RNA, 25 nt, Human
accccgucucuacuaaaaaauacaa

SEQ ID NO: 658913 - RNA, 18 nt, Human
acccugucucuacuaaaa

SEQ ID NO: 658914 - RNA, 24 nt, Human
acccugucucuacuaaaaauacag

SEQ ID NO: 658915 - RNA, 20 nt, Human
acucaaaaaaaaaaaaggca

SEQ ID NO: 658916 - RNA, 24 nt, Human
acuccagccugggggacagaguga

SEQ ID NO: 658917 - RNA, 24 nt, Human
acuccagucugggugacagaguga

SEQ ID NO: 658918 - RNA, 28 nt, Human
acucugucucaaaaaaaaaaaaaaaaaa

SEQ ID NO: 658919 - RNA, 18 nt, Human
acugcacuccagccucag

SEQ ID NO: 658920 - RNA, 24 nt, Human
acugcacuccagccucagugacag

SEQ ID NO: 658921 - RNA, 18 nt, Human
acugcacuccagccuggg

SEQ ID NO: 658922 - RNA, 24 nt, Human
acugcacuccagccugggggacag

SEQ ID NO: 658923 - RNA, 24 nt, Human
acugcacuccagucugggugacag

SEQ ID NO: 658924 - RNA, 26 nt, Human
acugcacuccagucugggugacagag

SEQ ID NO: 658925 - RNA, 18 nt, Human
agagguugcagugagcug

SEQ ID NO: 658926 - RNA, 22 nt, Human
agagguugcagugagcugaaau

SEQ ID NO: 658927 - RNA, 24 nt, Human
agagguugcagugagcugaaauug

SEQ ID NO: 658928 - RNA, 23 nt, Human
agaucaccuggggucaggaauuu

SEQ ID NO: 658929 - RNA, 24 nt, Human
agaugggcggaucacgaggucaga

SEQ ID NO: 658930 - RNA, 24 nt, Human
agcacuuugggaggcugaggcggg

SEQ ID NO: 658931 - RNA, 23 nt, Human
agccaggcauggugauaggcgcc

SEQ ID NO: 658932 - RNA, 22 nt, Human
agccuggccaacauggugaaac

SEQ ID NO: 658933 - RNA, 24 nt, Human
agccuggccaacauggugaaaccc

SEQ ID NO: 658934 - RNA, 24 nt, Human
agccugggggacagagugagacuc

SEQ ID NO: 658935 - RNA, 23 nt, Human
agccuguaaucccagcacuuugg

SEQ ID NO: 658936 - RNA, 24 nt, Human
agccuguaaucccagcacuuuggg

SEQ ID NO: 658937 - RNA, 20 nt, Human
agcugggcgugguggcgcgu

SEQ ID NO: 658938 - RNA, 20 nt, Human
aggaauuugagaccagccug

SEQ ID NO: 658939 - RNA, 24 nt, Human
aggcacgguggcucaagccuguaa

SEQ ID NO: 658940 - RNA, 20 nt, Human
aggcagagguugcagugagc

SEQ ID NO: 658941 - RNA, 22 nt, Human
aggcagagguugcagugagcug

SEQ ID NO: 658942 - RNA, 24 nt, Human
aggcauggugauaggcgccuguag

SEQ ID NO: 658943 - RNA, 21 nt, Human
aggccaaggugggcagaucac

SEQ ID NO: 658944 - RNA, 23 nt, Human
aggccaggcacgguggcucaagc

SEQ ID NO: 658945 - RNA, 21 nt, Human
aggcgggcguggugggccaag

SEQ ID NO: 658946 - RNA, 24 nt, Human
aggcggguggaucacgaggucagg

SEQ ID NO: 658947 - RNA, 24 nt, Human
aggcugagcuugcagugagccgag

SEQ ID NO: 658948 - RNA, 19 nt, Human
aggcugaggcaggagaaug

SEQ ID NO: 658949 - RNA, 21 nt, Human
aggcugaggcggguggaucac

SEQ ID NO: 658950 - RNA, 22 nt, Human
aggcugaggcggguggaucacg

SEQ ID NO: 658951 - RNA, 24 nt, Human
agucugggugacagagugagacuc

SEQ ID NO: 658952 - RNA, 26 nt, Human
agugacagagcaagacucaaaaaaaa

SEQ ID NO: 658953 - RNA, 24 nt, Human
aucgcgccacugcacuccagccug

SEQ ID NO: 658954 - RNA, 24 nt, Human
aucgcgccacugcacuccagucug

SEQ ID NO: 658955 - RNA, 19 nt, Human
augccuguaaucccagcac

SEQ ID NO: 658956 - RNA, 23 nt, Human
auugcgccacugcacuccagccu

SEQ ID NO: 658957 - RNA, 24 nt, Human
caacauggugaaacccugucucua

SEQ ID NO: 658958 - RNA, 24 nt, Human
caagaucgcgccacugcacuccag

SEQ ID NO: 658959 - RNA, 24 nt, Human
caagccuguaaucccagcacuuug

SEQ ID NO: 658960 - RNA, 24 nt, Human
caaggugggcagaucaccuggggu

SEQ ID NO: 658961 - RNA, 26 nt, Human
caaggugggcagaucaccugggguca

SEQ ID NO: 658962 - RNA, 18 nt, Human
caccuggggucaggaauu

SEQ ID NO: 658963 - RNA, 23 nt, Human
cacgccuuuaaucccagcacuuu

SEQ ID NO: 658964 - RNA, 22 nt, Human
cacuccagccugggggacagag

SEQ ID NO: 658965 - RNA, 22 nt, Human
cacuccagccugggggacagag

SEQ ID NO: 658966 - RNA, 24 nt, Human
cacuccagccugggggacagagug

SEQ ID NO: 658967 - RNA, 22 nt, Human
cacuccagucugggugacagag

SEQ ID NO: 658968 - RNA, 22 nt, Human
cacuccagucugggugacagag

SEQ ID NO: 658969 - RNA, 24 nt, Human
cacuccagucugggugacagagug

SEQ ID NO: 658970 - RNA, 19 nt, Human
cacugcacuccagccucag

SEQ ID NO: 658971 - RNA, 21 nt, Human
cacugcacuccagccucagug

SEQ ID NO: 658972 - RNA, 24 nt, Human
cacugcacuccagccucagugaca

SEQ ID NO: 658973 - RNA, 24 nt, Human
cacugcacuccagccucagugaca

SEQ ID NO: 658974 - RNA, 18 nt, Human
cacugcacuccagccugg

SEQ ID NO: 658975 - RNA, 19 nt, Human
cacugcacuccagccuggg

SEQ ID NO: 658976 - RNA, 22 nt, Human
cacugcacuccagccuggggga

SEQ ID NO: 658977 - RNA, 24 nt, Human
cacugcacuccagccugggggaca

SEQ ID NO: 658978 - RNA, 24 nt, Human
cacugcacuccagccugggggaca

SEQ ID NO: 658979 - RNA, 19 nt, Human
cacugcacuccagucuggg

SEQ ID NO: 658980 - RNA, 21 nt, Human
cacugcacuccagucugggug

SEQ ID NO: 658981 - RNA, 22 nt, Human
cacugcacuccagucuggguga

SEQ ID NO: 658982 - RNA, 23 nt, Human
cacugcacuccagucugggugac

SEQ ID NO: 658983 - RNA, 24 nt, Human
cacugcacuccagucugggugaca

SEQ ID NO: 658984 - RNA, 25 nt, Human
cacugcacuccagucugggugacag

SEQ ID NO: 658985 - RNA, 22 nt, Human
cagcacuuugggaggcugaggc

SEQ ID NO: 658986 - RNA, 24 nt, Human
cagcacuuugggaggcugaggcgg

SEQ ID NO: 658987 - RNA, 24 nt, Human
cagcacuuuuuaaggccaaggugg

SEQ ID NO: 658988 - RNA, 24 nt, Human
cagcuacucgggaggcugaggcag

SEQ ID NO: 658989 - RNA, 18 nt, Human
caggcacgguggcucaag

SEQ ID NO: 658990 - RNA, 20 nt, Human
caugccuguaaucccagcac

SEQ ID NO: 658991 - RNA, 20 nt, Human
ccacugcacuccagccucag

SEQ ID NO: 658992 - RNA, 20 nt, Human
ccacugcacuccagccucag

SEQ ID NO: 658993 - RNA, 21 nt, Human
ccacugcacuccagccucagu

SEQ ID NO: 658994 - RNA, 24 nt, Human
ccacugcacuccagccucagugac

SEQ ID NO: 658995 - RNA, 19 nt, Human
ccacugcacuccagccugg

SEQ ID NO: 658996 - RNA, 20 nt, Human
ccacugcacuccagccuggg

SEQ ID NO: 658997 - RNA, 22 nt, Human
ccacugcacuccagccuggggg

SEQ ID NO: 658998 - RNA, 23 nt, Human
ccacugcacuccagccuggggga

SEQ ID NO: 658999 - RNA, 24 nt, Human
ccacugcacuccagccugggggac

SEQ ID NO: 659000 - RNA, 20 nt, Human
ccacugcacuccagucuggg

SEQ ID NO: 659001 - RNA, 20 nt, Human
ccacugcacuccagucuggg

SEQ ID NO: 659002 - RNA, 21 nt, Human
ccacugcacuccagucugggu

SEQ ID NO: 659003 - RNA, 21 nt, Human
ccacugcacuccagucugggu

SEQ ID NO: 659004 - RNA, 23 nt, Human
ccacugcacuccagucuggguga

SEQ ID NO: 659005 - RNA, 24 nt, Human
ccacugcacuccagucugggugac

SEQ ID NO: 659006 - RNA, 22 nt, Human
ccucagugacagagcaagacuc

SEQ ID NO: 659007 - RNA, 23 nt, Human
ccugacuaacacggugaaacccc

SEQ ID NO: 659008 - RNA, 24 nt, Human
ccugacuaacacggugaaaccccg

SEQ ID NO: 659009 - RNA, 22 nt, Human
ccuggccaacauggugaaaccc

SEQ ID NO: 659010 - RNA, 24 nt, Human
ccuggccaacauggugaaacccug

SEQ ID NO: 659011 - RNA, 22 nt, Human
ccuggcuaacacggugaaaccc

SEQ ID NO: 659012 - RNA, 24 nt, Human
ccuggcuaacacggugaaacccug

SEQ ID NO: 659013 - RNA, 25 nt, Human
ccugggaggcagagguugcagugag

SEQ ID NO: 659014 - RNA, 22 nt, Human
ccuggggucaggaauuugagac

SEQ ID NO: 659015 - RNA, 20 nt, Human
ccuguaaucccagcacugcg

SEQ ID NO: 659016 - RNA, 21 nt, Human
ccuguaaucccagcacugcgg

SEQ ID NO: 659017 - RNA, 22 nt, Human
ccuguaaucccagcacugcggg

SEQ ID NO: 659018 - RNA, 22 nt, Human
ccuguaaucccagcuacucaag

SEQ ID NO: 659019 - RNA, 19 nt, Human
ccuguagucccagcuacuc

SEQ ID NO: 659020 - RNA, 21 nt, Human
ccuguagucccagcuacucgg

SEQ ID NO: 659021 - RNA, 22 nt, Human
ccuguagucccagcuacucggg

SEQ ID NO: 659022 - RNA, 24 nt, Human
cgagaccauccugacuaacacggu

SEQ ID NO: 659023 - RNA, 24 nt, Human
cgagaccauccuggcuaacacggu

SEQ ID NO: 659024 - RNA, 24 nt, Human
cgagaucgcgccacugcacuccag

SEQ ID NO: 659025 - RNA, 26 nt, Human
cgccacugcacuccagccucagugac

SEQ ID NO: 659026 - RNA, 21 nt, Human
cggagaaagcugauaccucac

SEQ ID NO: 659027 - RNA, 22 nt, Human
cggggaggcugagcuugcagug

SEQ ID NO: 659028 - RNA, 19 nt, Human
cuacuaaaaaauacaaaaa

SEQ ID NO: 659029 - RNA, 18 nt, Human
cucaaaaaaaaaaaaaaa

SEQ ID NO: 659030 - RNA, 24 nt, Human
cucaagccuguaaucccagcacuu

SEQ ID NO: 659031 - RNA, 22 nt, Human
cucacgccuuuaaucccagcac

SEQ ID NO: 659032 - RNA, 24 nt, Human
cucacgccuuuaaucccagcacuu

SEQ ID NO: 659033 - RNA, 23 nt, Human
cucaugccuguaaucccagcacu

SEQ ID NO: 659034 - RNA, 23 nt, Human
cucccucacgcauuccaggggcu

SEQ ID NO: 659035 - RNA, 22 nt, Human
cucuacuaaaaaauacaaaaaa

SEQ ID NO: 659036 - RNA, 19 nt, Human
cucugucucaaaaaaaaaa

SEQ ID NO: 659037 - RNA, 18 nt, Human
cugacuaacacggugaaa

SEQ ID NO: 659038 - RNA, 21 nt, Human
cugcgggagguggagaugggc

SEQ ID NO: 659039 - RNA, 24 nt, Human
cuggccaacauggugaaacccugu

SEQ ID NO: 659040 - RNA, 18 nt, Human
cuggcuaacacggugaaa

SEQ ID NO: 659041 - RNA, 24 nt, Human
cuggcuaacacggugaaacccugu

SEQ ID NO: 659042 - RNA, 21 nt, Human
cugggugacagagugagacuc

SEQ ID NO: 659043 - RNA, 25 nt, Human
cugucucuacuaaaaaucaaaaaaa

SEQ ID NO: 659044 - RNA, 19 nt, Human
cuugcagugagccgagauc

SEQ ID NO: 659045 - RNA, 21 nt, Human
cuugcagugagccgagaucgc

SEQ ID NO: 659046 - RNA, 23 nt, Human
gaaauugcgccacugcacuccag

SEQ ID NO: 659047 - RNA, 23 nt, Human
gaacuagcggagaaagcugauag

SEQ ID NO: 659048 - RNA, 23 nt, Human
gagaccagccuggccaacauggu

SEQ ID NO: 659049 - RNA, 18 nt, Human
gagcuugcagugagccga

SEQ ID NO: 659050 - RNA, 24 nt, Human
gaucaccuggggucaggaauuuga

SEQ ID NO: 659051 - RNA, 24 nt, Human
gcacuccagccucagugacagagc

SEQ ID NO: 659052 - RNA, 24 nt, Human
gcacuccagccugggggacagagu

SEQ ID NO: 659053 - RNA, 24 nt, Human
gcacuccagucugggugacagagu

SEQ ID NO: 659054 - RNA, 23 nt, Human
gcagcugggcgcgguggcucaug

SEQ ID NO: 659055 - RNA, 24 nt, Human
gccaacauggugaaacccugucuc

SEQ ID NO: 659056 - RNA, 20 nt, Human
gccaagaucgcgccacugca

SEQ ID NO: 659057 - RNA, 19 nt, Human
gccacugcacuccagucug

SEQ ID NO: 659058 - RNA, 24 nt, Human
gccacugcacuccagucuggguga

SEQ ID NO: 659059 - RNA, 20 nt, Human
gccgagaucgcgccacugca

SEQ ID NO: 659060 - RNA, 23 nt, Human
gccuguagucccagcuacucggg

SEQ ID NO: 659061 - RNA, 23 nt, Human
gccuuuauucuugucacccagca

SEQ ID NO: 659062 - RNA, 24 nt, Human
gcuaacacggugaaacccugucuc

SEQ ID NO: 659063 - RNA, 22 nt, Human
gcugaggcaggagaauggcgug

SEQ ID NO: 659064 - RNA, 19 nt, Human
gcugggcaugguggcucac

SEQ ID NO: 659065 - RNA, 20 nt, Human
ggaauuagcugggcguggug

SEQ ID NO: 659066 - RNA, 31 nt, Human
ggaggcugagcuugcagugagccgagaucgg

SEQ ID NO: 659067 - RNA, 20 nt, Human
ggcagagccuuuauucuugu

SEQ ID NO: 659068 - RNA, 23 nt, Human
ggcgcgguggcucaugccuguaa

SEQ ID NO: 659069 - RNA, 18 nt, Human
ggcggaucacgaggucag

SEQ ID NO: 659070 - RNA, 21 nt, Human
ggcucacgccuuuaaucccag

SEQ ID NO: 659071 - RNA, 20 nt, Human
gggagguggagaugggcgga

SEQ ID NO: 659072 - RNA, 24 nt, Human
gggcaugguggcucacgccuuuaa

SEQ ID NO: 659073 - RNA, 24 nt, Human
ggugauaggcgccuguagucccag

SEQ ID NO: 659074 - RNA, 21 nt, Human
gguggaucacgaggucaggag

SEQ ID NO: 659075 - RNA, 24 nt, Human
gguggcgcguuccuguaaucccag

SEQ ID NO: 659076 - RNA, 23 nt, Human
gguggcucaagccuguaauccca

SEQ ID NO: 659077 - RNA, 24 nt, Human
gguggcucaagccuguaaucccag

SEQ ID NO: 659078 - RNA, 23 nt, Human
gguggcucaugccuguaauccca

SEQ ID NO: 659079 - RNA, 24 nt, Human
gguggcucaugccuguaaucccag

SEQ ID NO: 659080 - RNA, 21 nt, Human
gugaaacccugucucuacuaa

SEQ ID NO: 659081 - RNA, 21 nt, Human
gugaaacccugucucuacuaa

SEQ ID NO: 659082 - RNA, 24 nt, Human
gugacagagugagacucugucuca

SEQ ID NO: 659083 - RNA, 23 nt, Human
guggcucaagccuguaaucccag

SEQ ID NO: 659084 - RNA, 23 nt, Human
guggcucacgccuuuaaucccag

SEQ ID NO: 659085 - RNA, 23 nt, Human
guggcucaugccuguaaucccag

SEQ ID NO: 659086 - RNA, 21 nt, Human
guugcagugagcugaaauugc

SEQ ID NO: 659087 - RNA, 22 nt, Human
uaacacggugaaaccccgucuc

SEQ ID NO: 659088 - RNA, 24 nt, Human
uaacacggugaaaccccgucucua

SEQ ID NO: 659089 - RNA, 22 nt, Human
uaacacggugaaacccugucuc

SEQ ID NO: 659090 - RNA, 24 nt, Human
uaacacggugaaacccugucucua

SEQ ID NO: 659091 - RNA, 19 nt, Human
uaccucacccaccaccgag

SEQ ID NO: 659092 - RNA, 19 nt, Human
uaggaggcugggcauggug

SEQ ID NO: 659093 - RNA, 21 nt, Human
ucaaaaaaaaaaaaaaaaaaa

SEQ ID NO: 659094 - RNA, 26 nt, Human
ucaaaaaaaaaaaaaaaaaaaggaau

SEQ ID NO: 659095 - RNA, 21 nt, Human
ucaaaaaaaauuagccaggca

SEQ ID NO: 659096 - RNA, 25 nt, Human
ucaaaaaaauaaaagauuaaaaaaa

SEQ ID NO: 659097 - RNA, 18 nt, Human
ucacgaggucaggagauc

SEQ ID NO: 659098 - RNA, 24 nt, Human
ucacgaggucaggagaucgagacc

SEQ ID NO: 659099 - RNA, 18 nt, Human
ucagaagaucgagaccau

SEQ ID NO: 659100 - RNA, 22 nt, Human
ucaugccuguaaucccagcacu

SEQ ID NO: 659101 - RNA, 23 nt, Human
uccagccugggggacagagugag

SEQ ID NO: 659102 - RNA, 24 nt, Human
uccagccugggggacagagugaga

SEQ ID NO: 659103 - RNA, 24 nt, Human
uccagucugggugacagagugaga

SEQ ID NO: 659104 - RNA, 23 nt, Human
ucgcgccacugcacuccagccug

SEQ ID NO: 659105 - RNA, 23 nt, Human
ucgcgccacugcacuccagucug

SEQ ID NO: 659106 - RNA, 18 nt, Human
ucgcuugaaccugggagg

SEQ ID NO: 659107 - RNA, 23 nt, Human
ucucuacuaaaaaauacaaaaaa

SEQ ID NO: 659108 - RNA, 21 nt, Human
ucucuacuaaaaaucaaaaaa

SEQ ID NO: 659109 - RNA, 23 nt, Human
ucugucucaaaaaaaaaaaaaaa

SEQ ID NO: 659110 - RNA, 24 nt, Human
ugaaccugggaggcagagguugca

SEQ ID NO: 659111 - RNA, 26 nt, Human
ugacagagcaagacucaaaaaaaaaa

SEQ ID NO: 659112 - RNA, 23 nt, Human
ugagaccagccuggccaacaugg

SEQ ID NO: 659113 - RNA, 22 nt, Human
ugagccgagaucgcgccacugc

SEQ ID NO: 659114 - RNA, 22 nt, Human
ugagcugaaauugcgccacugc

SEQ ID NO: 659115 - RNA, 22 nt, Human
ugaggcaggagaauggcgugaa

SEQ ID NO: 659116 - RNA, 23 nt, Human
ugaggcaggagaauggcgugaau

SEQ ID NO: 659117 - RNA, 24 nt, Human
ugaggcggguggaucacgagguca

SEQ ID NO: 659118 - RNA, 22 nt, Human
ugccccauaaaguccugcuuau

SEQ ID NO: 659119 - RNA, 23 nt, Human
ugccuguaaucccagcacugcgg

SEQ ID NO: 659120 - RNA, 22 nt, Human
ugcgggagguggagaugggcgg

SEQ ID NO: 659121 - RNA, 25 nt, Human
uggagaugggcggaucacgagguca

SEQ ID NO: 659122 - RNA, 24 nt, Human
uggccaacauggugaaacccuguc

SEQ ID NO: 659123 - RNA, 20 nt, Human
uggcgugaaucggggaggcu

SEQ ID NO: 659124 - RNA, 22 nt, Human
uggcucaagccuguaaucccag

SEQ ID NO: 659125 - RNA, 24 nt, Human
uggcucaagccuguaaucccagca

SEQ ID NO: 659126 - RNA, 21 nt, Human
uggcucacgccuuuaauccca

SEQ ID NO: 659127 - RNA, 22 nt, Human
uggcucacgccuuuaaucccag

SEQ ID NO: 659128 - RNA, 24 nt, Human
uggcucacgccuuuaaucccagca

SEQ ID NO: 659129 - RNA, 24 nt, Human
uggcucaugccuguaaucccagca

SEQ ID NO: 659130 - RNA, 22 nt, Human
ugggaacuagcggagaaagcug

SEQ ID NO: 659131 - RNA, 24 nt, Human
ugggaggcagagguugcagugagc

SEQ ID NO: 659132 - RNA, 20 nt, Human
ugggaggcugaggcgggugg

SEQ ID NO: 659133 - RNA, 23 nt, Human
ugggaggcugaggcggguggauc

SEQ ID NO: 659134 - RNA, 24 nt, Human
ugggaggcugaggcggguggauca

SEQ ID NO: 659135 - RNA, 18 nt, Human
ugggcagaucaccugggg

SEQ ID NO: 659136 - RNA, 24 nt, Human
ugggcagaucaccuggggucagga

SEQ ID NO: 659137 - RNA, 22 nt, Human
ugggccaagaucgcgccacugc

SEQ ID NO: 659138 - RNA, 21 nt, Human
ugggggacagagugagacucu

SEQ ID NO: 659139 - RNA, 21 nt, Human
ugggugacagagugagacucu

SEQ ID NO: 659140 - RNA, 24 nt, Human
uggugauaggcgccuguaguccca

SEQ ID NO: 659141 - RNA, 24 nt, Human
ugguggcgcguuccuguaauccca

SEQ ID NO: 659142 - RNA, 24 nt, Human
ugguggcucacgccuuuaauccca

SEQ ID NO: 659143 - RNA, 19 nt, Human
ugucagaagaucgagacca

SEQ ID NO: 659144 - RNA, 18 nt, Human
uuagcugggcgugguggc

SEQ ID NO: 659145 - RNA, 20 nt, Human
uuagcugggcgugguggcgc

SEQ ID NO: 659146 - RNA, 20 nt, Human
uuagcugggcgugguggcgc

SEQ ID NO: 659147 - RNA, 23 nt, Human
uucccagugcccuuggagagagc

SEQ ID NO: 659148 - RNA, 19 nt, Human
uuccuguaaucccagcuac

SEQ ID NO: 659149 - RNA, 24 nt, Human
uugaaccugggaggcagagguugc

SEQ ID NO: 659150 - RNA, 19 nt, Human
uugcagugagccgagaucg

SEQ ID NO: 659151 - RNA, 22 nt, Human
uugcagugagccgagaucgcgc

SEQ ID NO: 659152 - RNA, 22 nt, Human
uugcagugagcugaaauugcgc

SEQ ID NO: 659153 - RNA, 25 nt, Human
uugggaggcugaggcggguggauca

SEQ ID NO: 659154 - RNA, 20 nt, Human
uuuuuuuuuuucaaagaaau

SEQ ID NO: 659155 - RNA, 23 nt, Human
uuuuuuuuuuuuuuuuuucaaag

SEQ ID NO: 659156 - RNA, 23 nt, Human
aaaaaacaaaagggcuuuaaaaa

SEQ ID NO: 659157 - RNA, 23 nt, Human
aaaacccucgguggucgacauug

SEQ ID NO: 659158 - RNA, 23 nt, Human
acagaguauauaaaucaaaaaac

SEQ ID NO: 659159 - RNA, 24 nt, Human
caaaacccucgguggucgacauug

SEQ ID NO: 659160 - RNA, 22 nt, Human
caaaagggcuuuaaaaagggga

SEQ ID NO: 659161 - RNA, 26 nt, Human
caccaaaacacugacauuuuuuuucu

SEQ ID NO: 659162 - RNA, 20 nt, Human
cugacauuuuuuuucuagcu

SEQ ID NO: 659163 - RNA, 20 nt, Human
gccacuuuccgaugcaggaa

SEQ ID NO: 659164 - RNA, 26 nt, Human
uacccaaaacccucgguggucgacau

SEQ ID NO: 659165 - RNA, 22 nt, Human
uacucugagaccucacagccac

SEQ ID NO: 659166 - RNA, 21 nt, Human
ucacagccacuuuccgaugca

SEQ ID NO: 659167 - RNA, 24 nt, Human
ucgguggucgacauugaccuggug

SEQ ID NO: 659168 - RNA, 20 nt, Human
ugcucggaguuuguacaaag

SEQ ID NO: 659169 - RNA, 23 nt, Human
uguaaaacagaguauauaaauca

SEQ ID NO: 659170 - RNA, 22 nt, Human
aaacaaaccauuuccgucgaac

SEQ ID NO: 659171 - RNA, 24 nt, Human
agaaauggaguuacaaauaacauu

SEQ ID NO: 659172 - RNA, 21 nt, Human
agcaaguagcccugauuucag

SEQ ID NO: 659173 - RNA, 19 nt, Human
agguagcuuuuacugcaga

SEQ ID NO: 659174 - RNA, 19 nt, Human
agucucaucacagcagcuu

SEQ ID NO: 659175 - RNA, 24 nt, Human
caauuaguucccucucuuuugcuc

SEQ ID NO: 659176 - RNA, 18 nt, Human
cagagaaauggaguuaca

SEQ ID NO: 659177 - RNA, 18 nt, Human
cagcuccuuuugucuacc

SEQ ID NO: 659178 - RNA, 23 nt, Human
cagguaggagcugucugcccccu

SEQ ID NO: 659179 - RNA, 25 nt, Human
caucacagcagcuuccccagugggg

SEQ ID NO: 659180 - RNA, 19 nt, Human
ccaggaagugcacgggccc

SEQ ID NO: 659181 - RNA, 21 nt, Human
ccauuuccgucgaacuagaaa

SEQ ID NO: 659182 - RNA, 22 nt, Human
ccccuauugcuguugcauuuuc

SEQ ID NO: 659183 - RNA, 22 nt, Human
cuccaggaagugcacgggcccc

SEQ ID NO: 659184 - RNA, 21 nt, Human
cucuucuguuucucuuaggga

SEQ ID NO: 659185 - RNA, 21 nt, Human
cugaguguguugaaggcucau

SEQ ID NO: 659186 - RNA, 21 nt, Human
gacuaaaacauaaagcaagua

SEQ ID NO: 659187 - RNA, 20 nt, Human
gcuuagaaugaggcugaucc

SEQ ID NO: 659188 - RNA, 21 nt, Human
guugcauuuucugaguguguu

SEQ ID NO: 659189 - RNA, 24 nt, Human
uaaaugauuccuucacaugaucaa

SEQ ID NO: 659190 - RNA, 24 nt, Human
uaguucccucucuuuugccgggcc

SEQ ID NO: 659191 - RNA, 23 nt, Human
uaucagaagagaaacaaaccauu

SEQ ID NO: 659192 - RNA, 22 nt, Human
uaugagaauauugugcuuuuaa

SEQ ID NO: 659193 - RNA, 21 nt, Human
ucagaagagaaacaaaccauu

SEQ ID NO: 659194 - RNA, 18 nt, Human
ucagaaugcgagacacug

SEQ ID NO: 659195 - RNA, 22 nt, Human
ucuuucuuucugacuccucucc

SEQ ID NO: 659196 - RNA, 22 nt, Human
ugaggcugauccuuccacuggc

SEQ ID NO: 659197 - RNA, 18 nt, Human
ugcagucuguguucuaag

SEQ ID NO: 659198 - RNA, 24 nt, Human
ugucuaccuaucagaagagaaaca

SEQ ID NO: 659199 - RNA, 22 nt, Human
ugugcuuuuaaaaaaaauucaa

SEQ ID NO: 659200 - RNA, 23 nt, Human
uugccagguagcuuuuacugcag

SEQ ID NO: 659201 - RNA, 20 nt, Human
uugcuuagaaugaggcugau

SEQ ID NO: 659202 - RNA, 18 nt, Human
uuucaacagugccuuaac

SEQ ID NO: 659203 - RNA, 24 nt, Human
uuuuuuuuuuuuuuuuuuccuggg

SEQ ID NO: 659204 - RNA, 23 nt, Human
aaaaaaaaacaaauguuugcaga

SEQ ID NO: 659205 - RNA, 21 nt, Human
aaaaaaacaaauguuugcaga

SEQ ID NO: 659206 - RNA, 20 nt, Human
aaaaaaacggauauuucaau

SEQ ID NO: 659207 - RNA, 25 nt, Human
aaaggaugggaggggaggggaggaa

SEQ ID NO: 659208 - RNA, 19 nt, Human
aagaugcuuugcccaucca

SEQ ID NO: 659209 - RNA, 26 nt, Human
aagccugcuccaccuaccuuuccacc

SEQ ID NO: 659210 - RNA, 21 nt, Human
acaacagacuauuccaccaug

SEQ ID NO: 659211 - RNA, 23 nt, Human
acaucuguaaagcauuccugcuc

SEQ ID NO: 659212 - RNA, 22 nt, Human
accacugcacuccagccugggc

SEQ ID NO: 659213 - RNA, 22 nt, Human
accagcccagcauccccuaugc

SEQ ID NO: 659214 - RNA, 24 nt, Human
acugcacuccagccugggcaacag

SEQ ID NO: 659215 - RNA, 24 nt, Human
acugcacuccagccugggcaacag

SEQ ID NO: 659216 - RNA, 21 nt, Human
agacagacagacggacacgca

SEQ ID NO: 659217 - RNA, 24 nt, Human
agcugguucugcuucuccggcccc

SEQ ID NO: 659218 - RNA, 23 nt, Human
aggacaccugagcugggcccaac

SEQ ID NO: 659219 - RNA, 18 nt, Human
aggagaggggaggagagg

SEQ ID NO: 659220 - RNA, 22 nt, Human
aggaggagcagggagccuggug

SEQ ID NO: 659221 - RNA, 27 nt, Human
aggaugggaggggaggggaggagaggg

SEQ ID NO: 659222 - RNA, 24 nt, Human
aggauugcuugagcucaggaguuc

SEQ ID NO: 659223 - RNA, 22 nt, Human
aggcagcaggauugcuugagcu

SEQ ID NO: 659224 - RNA, 21 nt, Human
aggccuccaacugcagcccag

SEQ ID NO: 659225 - RNA, 21 nt, Human
agggaguaggagggcgauggg

SEQ ID NO: 659226 - RNA, 24 nt, Human
aucgcaccacugcacuccagccug

SEQ ID NO: 659227 - RNA, 24 nt, Human
auugcuugagcucaggaguucaag

SEQ ID NO: 659228 - RNA, 20 nt, Human
caaacccagacacuagacag

SEQ ID NO: 659229 - RNA, 23 nt, Human
caacaucuguaaagcauuccugc

SEQ ID NO: 659230 - RNA, 23 nt, Human
cacauguggucccagcuacucgg

SEQ ID NO: 659231 - RNA, 19 nt, Human
caccacucaggacaccuga

SEQ ID NO: 659232 - RNA, 19 nt, Human
caccaggcaccucugucau

SEQ ID NO: 659233 - RNA, 20 nt, Human
caccaggccuccaacugcag

SEQ ID NO: 659234 - RNA, 18 nt, Human
caccucugucaucuggga

SEQ ID NO: 659235 - RNA, 18 nt, Human
cacugcacuccagccugg

SEQ ID NO: 659236 - RNA, 19 nt, Human
cacugcacuccagccuggg

SEQ ID NO: 659237 - RNA, 21 nt, Human
cacugcacuccagccugggca

SEQ ID NO: 659238 - RNA, 23 nt, Human
cacugcacuccagccugggcaac

SEQ ID NO: 659239 - RNA, 24 nt, Human
cacugcacuccagccugggcaaca

SEQ ID NO: 659240 - RNA, 18 nt, Human
cagauucccaccacucag

SEQ ID NO: 659241 - RNA, 19 nt, Human
cagcaggauugcuugagcu

SEQ ID NO: 659242 - RNA, 22 nt, Human
cagccugggcaacagagggaga

SEQ ID NO: 659243 - RNA, 22 nt, Human
cagcuuaccugggacucuccaa

SEQ ID NO: 659244 - RNA, 20 nt, Human
caggaaaugcgccugggccc

SEQ ID NO: 659245 - RNA, 22 nt, Human
cauuccugcucccgggcaggaa

SEQ ID NO: 659246 - RNA, 21 nt, Human
cauuuuaaucaaugacuguuc

SEQ ID NO: 659247 - RNA, 19 nt, Human
ccaccacucaggacaccug

SEQ ID NO: 659248 - RNA, 20 nt, Human
ccacugcacuccagccuggg

SEQ ID NO: 659249 - RNA, 21 nt, Human
ccacugcacuccagccugggc

SEQ ID NO: 659250 - RNA, 22 nt, Human
ccacugcacuccagccugggca

SEQ ID NO: 659251 - RNA, 23 nt, Human
ccacugcacuccagccugggcaa

SEQ ID NO: 659252 - RNA, 24 nt, Human
ccacugcacuccagccugggcaac

SEQ ID NO: 659253 - RNA, 22 nt, Human
cccaggugacaagaguaagaau

SEQ ID NO: 659254 - RNA, 23 nt, Human
ccccuaugcagcugguucugcuu

SEQ ID NO: 659255 - RNA, 20 nt, Human
ccgcacggacccccaccagg

SEQ ID NO: 659256 - RNA, 20 nt, Human
ccgccuggcccagccuggaa

SEQ ID NO: 659257 - RNA, 19 nt, Human
ccgugccuguuguugcucu

SEQ ID NO: 659258 - RNA, 23 nt, Human
ccucuccccuccuugcuuacaaa

SEQ ID NO: 659259 - RNA, 19 nt, Human
ccugagcugggcccaacuu

SEQ ID NO: 659260 - RNA, 22 nt, Human
ccuggcccagccuggaaucagc

SEQ ID NO: 659261 - RNA, 24 nt, Human
cgaugggaaagaggggagggcugg

SEQ ID NO: 659262 - RNA, 21 nt, Human
cgcaccacugcacuccagccu

SEQ ID NO: 659263 - RNA, 25 nt, Human
cgcagcuuaccugggacucuccaag

SEQ ID NO: 659264 - RNA, 19 nt, Human
cucaggacaccugagcugg

SEQ ID NO: 659265 - RNA, 24 nt, Human
cucgaugggaaagaggggagggcu

SEQ ID NO: 659266 - RNA, 22 nt, Human
cugcagugagccaugaucgcac

SEQ ID NO: 659267 - RNA, 19 nt, Human
cuugagcucaggaguucaa

SEQ ID NO: 659268 - RNA, 23 nt, Human
cuugagcucaggaguucaaggcu

SEQ ID NO: 659269 - RNA, 23 nt, Human
gauugcuugagcucaggaguuca

SEQ ID NO: 659270 - RNA, 20 nt, Human
gcaccacugcacuccagccu

SEQ ID NO: 659271 - RNA, 19 nt, Human
gccaugaucgcaccacugc

SEQ ID NO: 659272 - RNA, 24 nt, Human
gcucaggaguucaaggcugcagug

SEQ ID NO: 659273 - RNA, 21 nt, Human
ggaaaaacaaaaaaaaacaaa

SEQ ID NO: 659274 - RNA, 20 nt, Human
ggaaagaggggagggcuggg

SEQ ID NO: 659275 - RNA, 22 nt, Human
ggacacgcauccaguaggccaa

SEQ ID NO: 659276 - RNA, 21 nt, Human
ggacccccaccaggccuccaa

SEQ ID NO: 659277 - RNA, 21 nt, Human
ggaggagagggaguaggaggg

SEQ ID NO: 659278 - RNA, 27 nt, Human
ggaggagagggaguaggagggcgaugg

SEQ ID NO: 659279 - RNA, 21 nt, Human
ggaggagaggggaggagaggg

SEQ ID NO: 659280 - RNA, 21 nt, Human
ggaggggaggggaggagaggg

SEQ ID NO: 659281 - RNA, 23 nt, Human
ggauugcuugagcucaggaguuc

SEQ ID NO: 659282 - RNA, 22 nt, Human
gggaaaccagcccucggccucc

SEQ ID NO: 659283 - RNA, 19 nt, Human
gggaaagaggggagggcug

SEQ ID NO: 659284 - RNA, 22 nt, Human
gggaggggaggggaggagaggg

SEQ ID NO: 659285 - RNA, 21 nt, Human
gggccaaacccagacacuaga

SEQ ID NO: 659286 - RNA, 18 nt, Human
gggcuucugagccauccc

SEQ ID NO: 659287 - RNA, 18 nt, Human
gggcuucugagccauccc

SEQ ID NO: 659288 - RNA, 23 nt, Human
ggggaggagaggggaggagaggg

SEQ ID NO: 659289 - RNA, 18 nt, Human
gguaggcaguccccagag

SEQ ID NO: 659290 - RNA, 21 nt, Human
gguggaguuccgugccuguug

SEQ ID NO: 659291 - RNA, 19 nt, Human
guaaagcauuccugcuccc

SEQ ID NO: 659292 - RNA, 23 nt, Human
uaagugaguuugccaaacaccag

SEQ ID NO: 659293 - RNA, 21 nt, Human
uaggagggcgaugggaggaag

SEQ ID NO: 659294 - RNA, 21 nt, Human
uaucagagaaaacccagagca

SEQ ID NO: 659295 - RNA, 27 nt, Human
uaucagagaaaacccagagcauuuaac

SEQ ID NO: 659296 - RNA, 20 nt, Human
uccaccuaccuuuccaccua

SEQ ID NO: 659297 - RNA, 20 nt, Human
uccauauguugacaggaugg

SEQ ID NO: 659298 - RNA, 25 nt, Human
uccccagaggucugcagcccagccc

SEQ ID NO: 659299 - RNA, 23 nt, Human
ucgcaccacugcacuccagccug

SEQ ID NO: 659300 - RNA, 31 nt, Human; identical to SEQ ID NO: 301436

SEQ ID NO: 659301 - RNA, 19 nt, Human
ucgccgcacggacccccac

SEQ ID NO: 659302 - RNA, 18 nt, Human
ucggagaacugaggcagc

SEQ ID NO: 659303 - RNA, 20 nt, Human
ucggccuccucuugucucuu

SEQ ID NO: 659304 - RNA, 21 nt, Human
ucuccggccccuccuggccau

SEQ ID NO: 659305 - RNA, 18 nt, Human
ucucuauuuucccaacau

SEQ ID NO: 659306 - RNA, 19 nt, Human
ucugcagcccagccccgcc

SEQ ID NO: 659307 - RNA, 21 nt, Human
ugaggcagcaggauugcuuga

SEQ ID NO: 659308 - RNA, 21 nt, Human
ugaguuugccaaacaccaggc

SEQ ID NO: 659309 - RNA, 19 nt, Human
ugcagaagcguuuuguuuu

SEQ ID NO: 659310 - RNA, 18 nt, Human
ugcagcccagccccgccu

SEQ ID NO: 659311 - RNA, 22 nt, Human
ugcagugagccaugaucgcacc

SEQ ID NO: 659312 - RNA, 18 nt, Human
ugcuccaccuaccuuucc

SEQ ID NO: 659313 - RNA, 23 nt, Human
ugcuccaccuaccuuuccaccua

SEQ ID NO: 659314 - RNA, 19 nt, Human
uggcccagccuggaaucag

SEQ ID NO: 659315 - RNA, 18 nt, Human
ugggacucuccaaggagg

SEQ ID NO: 659316 - RNA, 18 nt, Human
ugggaggaagccggggcg

SEQ ID NO: 659317 - RNA, 19 nt, Human
ugggccaaacccagacacu

SEQ ID NO: 659318 - RNA, 22 nt, Human
ugggccugaaggcagagaccag

SEQ ID NO: 659319 - RNA, 22 nt, Human
uuacaaaaggaugggaggggag

SEQ ID NO: 659320 - RNA, 23 nt, Human
uucuacaauggacaggcauugcu

SEQ ID NO: 659321 - RNA, 24 nt, Human
uucuacaauggacaggcauugcuu

SEQ ID NO: 659322 - RNA, 18 nt, Human
uucuccggccccuccugg

SEQ ID NO: 659323 - RNA, 18 nt, Human
uugaagccugcuccaccu

SEQ ID NO: 659324 - RNA, 20 nt, Human
uugaagccugcuccaccuac

SEQ ID NO: 659325 - RNA, 24 nt, Human
uugcuugagcucaggaguucaagg

SEQ ID NO: 659326 - RNA, 21 nt, Human
uuuaggcaccuuacaagugac

SEQ ID NO: 659327 - RNA, 24 nt, Human
uuuuuuuuuuuuuuuuuuaauuag

SEQ ID NO: 659328 - RNA, 22 nt, Human
aaaccagcccagauccuccugg

SEQ ID NO: 659329 - RNA, 19 nt, Human
aaaggagauguaacagaag

SEQ ID NO: 659330 - RNA, 26 nt, Human
aaccagcccagauccuccugggcccc

SEQ ID NO: 659331 - RNA, 19 nt, Human
acacagcaaacaacugugu

SEQ ID NO: 659332 - RNA, 24 nt, Human
acagcugggauuauagucaugagc

SEQ ID NO: 659333 - RNA, 22 nt, Human
accagguuccaccccagcucca

SEQ ID NO: 659334 - RNA, 21 nt, Human
acccuacaggccaccaggaaa

SEQ ID NO: 659335 - RNA, 27 nt, Human
agacaaaccagcccagauccuccuggg

SEQ ID NO: 659336 - RNA, 21 nt, Human
agaccagguuguagaccagga

SEQ ID NO: 659337 - RNA, 21 nt, Human
agacuccuggcccccaaccaa

SEQ ID NO: 659338 - RNA, 25 nt, Human
agccaaaugagaaccauuguucgga

SEQ ID NO: 659339 - RNA, 26 nt, Human
aggcagcaguucuagggaugggagca

SEQ ID NO: 659340 - RNA, 18 nt, Human
aggcugaucucgaacucc

SEQ ID NO: 659341 - RNA, 24 nt, Human
agggaugggagcaaggccagccag

SEQ ID NO: 659342 - RNA, 26 nt, Human
cacauagaccagguuguagaccagga

SEQ ID NO: 659343 - RNA, 18 nt, Human
caccgacucccuagguga

SEQ ID NO: 659344 - RNA, 22 nt, Human
cagagguggggucucgcuaugu

SEQ ID NO: 659345 - RNA, 19 nt, Human
cagcaccgucugucggaug

SEQ ID NO: 659346 - RNA, 21 nt, Human
cagcagaagcuggcguagccc

SEQ ID NO: 659347 - RNA, 22 nt, Human
cagcccagauccuccugggccc

SEQ ID NO: 659348 - RNA, 22 nt, Human
cagcugcccccgcccccaucuc

SEQ ID NO: 659349 - RNA, 20 nt, Human
caggaaacugaucuucucca

SEQ ID NO: 659350 - RNA, 22 nt, Human
ccacaacauccugucugucucc

SEQ ID NO: 659351 - RNA, 22 nt, Human
ccagacaaaccagcccagaucc

SEQ ID NO: 659352 - RNA, 21 nt, Human
cccccaaccaaaccuccugag

SEQ ID NO: 659353 - RNA, 23 nt, Human
cccccaaccaaaccuccugaguc

SEQ ID NO: 659354 - RNA, 19 nt, Human
cccccauauguggcacuaa

SEQ ID NO: 659355 - RNA, 21 nt, Human
ccuccauaccagguuccaccc

SEQ ID NO: 659356 - RNA, 19 nt, Human
ccugagcucaaccauccuc

SEQ ID NO: 659357 - RNA, 21 nt, Human
ccuggccuggacccacuuggc

SEQ ID NO: 659358 - RNA, 22 nt, Human
ccuugaggggccgguggaagag

SEQ ID NO: 659359 - RNA, 24 nt, Human
cgaacuccugagcucaaccauccu

SEQ ID NO: 659360 - RNA, 23 nt, Human
cgcccccaucuccuggccuggac

SEQ ID NO: 659361 - RNA, 27 nt, Human
cgcuauguuacccaggcugaucucgaa

SEQ ID NO: 659362 - RNA, 20 nt, Human
cucacccuccuucuugucca

SEQ ID NO: 659363 - RNA, 19 nt, Human
cuccuggccuggacccacu

SEQ ID NO: 659364 - RNA, 23 nt, Human
cuccugggccccagaaagaugac

SEQ ID NO: 659365 - RNA, 21 nt, Human
cuccuugggagagaacuccag

SEQ ID NO: 659366 - RNA, 20 nt, Human
cugcauuggccucucaaaca

SEQ ID NO: 659367 - RNA, 20 nt, Human
cuuuggcuugcucacccucc

SEQ ID NO: 659368 - RNA, 18 nt, Human
gauuauagucaugagcca

SEQ ID NO: 659369 - RNA, 22 nt, Human
gauuauagucaugagccacagc

SEQ ID NO: 659370 - RNA, 18 nt, Human
gcagagguggggucucgc

SEQ ID NO: 659371 - RNA, 18 nt, Human
gcccagauccuccugggc

SEQ ID NO: 659372 - RNA, 21 nt, Human
gcggaacuucuucaccuucuc

SEQ ID NO: 659373 - RNA, 19 nt, Human
gcuugcucacccuccuucu

SEQ ID NO: 659374 - RNA, 22 nt, Human
ggggucucgcuauguuacccag

SEQ ID NO: 659375 - RNA, 20 nt, Human
guagaccaggauggccagga

SEQ ID NO: 659376 - RNA, 21 nt, Human
gucggauguacaugguguaca

SEQ ID NO: 659377 - RNA, 24 nt, Human
guggggucucgcuauguuacccag

SEQ ID NO: 659378 - RNA, 19 nt, Human
uaaaacggccccaccccag

SEQ ID NO: 659379 - RNA, 19 nt, Human
uaacagaaggccagcuugg

SEQ ID NO: 659380 - RNA, 19 nt, Human
uaccuggaauauuuaggaa

SEQ ID NO: 659381 - RNA, 23 nt, Human
uagaccaggauggccaggaacuu

SEQ ID NO: 659382 - RNA, 20 nt, Human
uagaugcagguaaguccgua

SEQ ID NO: 659383 - RNA, 22 nt, Human
uauaacacagcaaacaacugug

SEQ ID NO: 659384 - RNA, 23 nt, Human
uauguuacccaggcugaucucga

SEQ ID NO: 659385 - RNA, 24 nt, Human
uauguuacccaggcugaucucgaa

SEQ ID NO: 659386 - RNA, 21 nt, Human
uauuuaggaacagacuccugg

SEQ ID NO: 659387 - RNA, 24 nt, Human
ucaaccauccuccugcauuggccu

SEQ ID NO: 659388 - RNA, 20 nt, Human
uccccagacaaaccagccca

SEQ ID NO: 659389 - RNA, 21 nt, Human
ucccgcacggaacggaaggag

SEQ ID NO: 659390 - RNA, 19 nt, Human
ucccuccauaccagguucc

SEQ ID NO: 659391 - RNA, 23 nt, Human
uccuccugcauuggccucucaaa

SEQ ID NO: 659392 - RNA, 18 nt, Human
uccuccugggccccagaa

SEQ ID NO: 659393 - RNA, 20 nt, Human
uccugucugucuccccagac

SEQ ID NO: 659394 - RNA, 23 nt, Human
uccuugggagagaacuccagaag

SEQ ID NO: 659395 - RNA, 20 nt, Human
ucuccgguuccgccagcacu

SEQ ID NO: 659396 - RNA, 19 nt, Human
ucucgaacuccugagcuca

SEQ ID NO: 659397 - RNA, 19 nt, Human
ucucgcuauguuacccagg

SEQ ID NO: 659398 - RNA, 26 nt, Human
ucucgcuauguuacccaggcugaucu

SEQ ID NO: 659399 - RNA, 27 nt, Human
ucucgcuauguuacccaggcugaucuc

SEQ ID NO: 659400 - RNA, 21 nt, Human
ugacacagcugcccccgcccc

SEQ ID NO: 659401 - RNA, 22 nt, Human
ugaccucugacgucuccacccu

SEQ ID NO: 659402 - RNA, 21 nt, Human
ugcacacaaaggagauguaac

SEQ ID NO: 659403 - RNA, 20 nt, Human
ugccagagacacaggugugg

SEQ ID NO: 659404 - RNA, 23 nt, Human
ugccagagacacaggugugguuu

SEQ ID NO: 659405 - RNA, 19 nt, Human
ugccaugacugaguuaauc

SEQ ID NO: 659406 - RNA, 25 nt, Human
ugcccccgcccccaucuccuggccu

SEQ ID NO: 659407 - RNA, 18 nt, Human
uggaagagccaguagagc

SEQ ID NO: 659408 - RNA, 19 nt, Human
uggcagagguggggucucg

SEQ ID NO: 659409 - RNA, 24 nt, Human
uggcagagguggggucucgcuaug

SEQ ID NO: 659410 - RNA, 19 nt, Human
uggcccccaaccaaaccuc

SEQ ID NO: 659411 - RNA, 21 nt, Human
uggcccccaaccaaaccuccu

SEQ ID NO: 659412 - RNA, 23 nt, Human
uggccuggacccacuuggcuucc

SEQ ID NO: 659413 - RNA, 27 nt, Human
uggcuugcucacccuccuucuugucca

SEQ ID NO: 659414 - RNA, 18 nt, Human
ugggauuauagucaugag

SEQ ID NO: 659415 - RNA, 22 nt, Human
ugggauuauagucaugagccac

SEQ ID NO: 659416 - RNA, 23 nt, Human
ugggccccagaaagaugacacag

SEQ ID NO: 659417 - RNA, 24 nt, Human
uggggucucgcuauguuacccagg

SEQ ID NO: 659418 - RNA, 21 nt, Human
uggugugguugcagcagaagc

SEQ ID NO: 659419 - RNA, 21 nt, Human
ugucucagggccacuuaccug

SEQ ID NO: 659420 - RNA, 20 nt, Human
ugucugucuccccagacaaa

SEQ ID NO: 659421 - RNA, 18 nt, Human
ugucuguguccucuccuu

SEQ ID NO: 659422 - RNA, 26 nt, Human
uguguccucuccuuggggagugcccc

SEQ ID NO: 659423 - RNA, 22 nt, Human
uucuagggaugggagcaaggcc

SEQ ID NO: 659424 - RNA, 18 nt, Human
uuggagaagaggugggcc

SEQ ID NO: 659425 - RNA, 24 nt, Human
uuggcagagguggggucucgcuau

SEQ ID NO: 659426 - RNA, 20 nt, Human
uuuguugcauggggaggggg

SEQ ID NO: 659427 - RNA, 24 nt, Human
uuuuuggcagagguggggucucgc

SEQ ID NO: 659428 - RNA, 24 nt, Human
uuuuuuggcagagguggggucucg

SEQ ID NO: 659429 - RNA, 24 nt, Human
uuuuuuuuuuuuuuuggcagaggu

SEQ ID NO: 659430 - RNA, 19 nt, Human
aaacucaggggcuccaaag

SEQ ID NO: 659431 - RNA, 23 nt, Human
aacccacuucccacaagucucca

SEQ ID NO: 659432 - RNA, 24 nt, Human
aacccacuucccacaagucuccag

SEQ ID NO: 659433 - RNA, 22 nt, Human
accccggggccccacuccccac

SEQ ID NO: 659434 - RNA, 19 nt, Human
acccugguucucuucuucc

SEQ ID NO: 659435 - RNA, 20 nt, Human
acccugguucucuucuucca

SEQ ID NO: 659436 - RNA, 21 nt, Human
agaggcccaggccccaccccu

SEQ ID NO: 659437 - RNA, 19 nt, Human
aggaagaagagggaggcug

SEQ ID NO: 659438 - RNA, 21 nt, Human
aggaagaagagggaggcuggg

SEQ ID NO: 659439 - RNA, 23 nt, Human
aggcugggguuugcacgcagagg

SEQ ID NO: 659440 - RNA, 25 nt, Human
caagccaggcacccaccaaggagcc

SEQ ID NO: 659441 - RNA, 20 nt, Human
cacaccucccaccccugcug

SEQ ID NO: 659442 - RNA, 22 nt, Human
caccccaccuaccuuuuacccg

SEQ ID NO: 659443 - RNA, 20 nt, Human
cacgcagaggcccaggcccc

SEQ ID NO: 659444 - RNA, 19 nt, Human
cacuccccaccccaccuac

SEQ ID NO: 659445 - RNA, 21 nt, Human
cagaggcccaggccccacccc

SEQ ID NO: 659446 - RNA, 25 nt, Human
caggcacccaccaaggagccgcggc

SEQ ID NO: 659447 - RNA, 18 nt, Human
caggccccaccccggggc

SEQ ID NO: 659448 - RNA, 28 nt, Human
caggccccaccccggggccccacucccu

SEQ ID NO: 659449 - RNA, 22 nt, Human
caggggcuccaaagccugagga

SEQ ID NO: 659450 - RNA, 20 nt, Human
ccacuccccaccccaccuaa

SEQ ID NO: 659451 - RNA, 19 nt, Human
ccagggccucccgcugccg

SEQ ID NO: 659452 - RNA, 18 nt, Human
cccacaccucccaccccu

SEQ ID NO: 659453 - RNA, 21 nt, Human
cccacggcaacgccucccgcu

SEQ ID NO: 659454 - RNA, 21 nt, Human
cccagcccgggcccccgaggc

SEQ ID NO: 659455 - RNA, 23 nt, Human
cccagggccucccgcugccggcc

SEQ ID NO: 659456 - RNA, 24 nt, Human
ccccaccccggggccccacucccc

SEQ ID NO: 659457 - RNA, 23 nt, Human
ccccacggcaacgccucccgcuc

SEQ ID NO: 659458 - RNA, 19 nt, Human
ccccggggccccacucccc

SEQ ID NO: 659459 - RNA, 21 nt, Human
ccccggggccccacuccccac

SEQ ID NO: 659460 - RNA, 23 nt, Human
ccccggggccccacuccccaccc

SEQ ID NO: 659461 - RNA, 20 nt, Human
ccccugcccuccccccuccc

SEQ ID NO: 659462 - RNA, 22 nt, Human
ccccuuaucuucugcccacacc

SEQ ID NO: 659463 - RNA, 20 nt, Human
cccgggcccccgaggccgga

SEQ ID NO: 659464 - RNA, 22 nt, Human
cccggggccccacuccccaccc

SEQ ID NO: 659465 - RNA, 21 nt, Human
cccugcccuccccccucccug

SEQ ID NO: 659466 - RNA, 22 nt, Human
cccuggccccuuaucuucugcc

SEQ ID NO: 659467 - RNA, 20 nt, Human
ccgcccaggggacucggcgg

SEQ ID NO: 659468 - RNA, 20 nt, Human
ccgcccgcucagcgccgccc

SEQ ID NO: 659469 - RNA, 23 nt, Human
ccuccauucuccugcggcuucuc

SEQ ID NO: 659470 - RNA, 19 nt, Human
ccucccgcuccauccccgc

SEQ ID NO: 659471 - RNA, 24 nt, Human
ccuggccccuuaucuucugcccac

SEQ ID NO: 659472 - RNA, 25 nt, Human
ccuggccucccuccaacccacuucc

SEQ ID NO: 659473 - RNA, 23 nt, Human
cgcccgcucagcgccgcccaggg

SEQ ID NO: 659474 - RNA, 21 nt, Human
cucagcgccgcccaggggacu

SEQ ID NO: 659475 - RNA, 21 nt, Human
cuccagggcaugucacuuccu

SEQ ID NO: 659476 - RNA, 21 nt, Human
cuccauucuccugcggcuucu

SEQ ID NO: 659477 - RNA, 19 nt, Human
cuccccccucccugcucua

SEQ ID NO: 659478 - RNA, 24 nt, Human
cucccuccaacccacuucccacaa

SEQ ID NO: 659479 - RNA, 24 nt, Human
cucuccauuucucccagggccucc

SEQ ID NO: 659480 - RNA, 21 nt, Human
cugaggaagaagagggaggcu

SEQ ID NO: 659481 - RNA, 21 nt, Human
cugcccacaccucccaccccu

SEQ ID NO: 659482 - RNA, 19 nt, Human
cugccggccuggccucccu

SEQ ID NO: 659483 - RNA, 23 nt, Human
cugguucucuucuuccagcaucc

SEQ ID NO: 659484 - RNA, 18 nt, Human
cuucccacaagucuccag

SEQ ID NO: 659485 - RNA, 19 nt, Human
cuugaccccgcgccucucc

SEQ ID NO: 659486 - RNA, 22 nt, Human
cuugaccccgcgccucuccagc

SEQ ID NO: 659487 - RNA, 22 nt, Human
gaggaagaagagggaggcuggg

SEQ ID NO: 659488 - RNA, 26 nt, Human
gaggaagaagagggaggcugggguuu

SEQ ID NO: 659489 - RNA, 21 nt, Human
gaucccgcgacccggccucgg

SEQ ID NO: 659490 - RNA, 20 nt, Human
gcagaggcccaggccccacc

SEQ ID NO: 659491 - RNA, 20 nt, Human
gcagcggcggcggcgauggc

SEQ ID NO: 659492 - RNA, 23 nt, Human
gcccaggccccaccccggggccc

SEQ ID NO: 659493 - RNA, 22 nt, Human
gccccuuaucuucugcccacac

SEQ ID NO: 659494 - RNA, 22 nt, Human
gccgaucccgcgacccggccuc

SEQ ID NO: 659495 - RNA, 27 nt, Human
gcggcggcggcgauggcggccgauccc

SEQ ID NO: 659496 - RNA, 18 nt, Human
gcuccaaagccugaggaa

SEQ ID NO: 659497 - RNA, 20 nt, Human
gcuccauccccgcgggcucc

SEQ ID NO: 659498 - RNA, 20 nt, Human
ggcucgaggccccacggcaa

SEQ ID NO: 659499 - RNA, 19 nt, Human
uagguaauccccugcccuc

SEQ ID NO: 659500 - RNA, 19 nt, Human
ucacuuccuccacccuggu

SEQ ID NO: 659501 - RNA, 20 nt, Human
uccagggcaugucacuuccu

SEQ ID NO: 659502 - RNA, 18 nt, Human
uccccugcccuccccccu

SEQ ID NO: 659503 - RNA, 22 nt, Human
ucccuaaagguuccucuagcuc

SEQ ID NO: 659504 - RNA, 24 nt, Human
ucuagcaguugccaagccaggcac

SEQ ID NO: 659505 - RNA, 18 nt, Human
ucuccagggcaugucacu

SEQ ID NO: 659506 - RNA, 19 nt, Human
ugaccucucuccauuucuc

SEQ ID NO: 659507 - RNA, 22 nt, Human
ugaccucucuccauuucuccca

SEQ ID NO: 659508 - RNA, 23 nt, Human
ugacucaacgagaguuucagcag

SEQ ID NO: 659509 - RNA, 18 nt, Human
ugaggaagaagagggagg

SEQ ID NO: 659510 - RNA, 19 nt, Human
ugaggaagaagagggaggc

SEQ ID NO: 659511 - RNA, 22 nt, Human
ugaggaagaagagggaggcugg

SEQ ID NO: 659512 - RNA, 26 nt, Human
ugcagcggcggcggcgauggcggccu

SEQ ID NO: 659513 - RNA, 22 nt, Human
ugccccgagccgcgggcccccg

SEQ ID NO: 659514 - RNA, 19 nt, Human
uuccucuagcucccuggcc

SEQ ID NO: 659515 - RNA, 21 nt, Human
aaauccuuggcaucacaauuu

SEQ ID NO: 659516 - RNA, 21 nt, Human
agaaagaaugaauagcagcug

SEQ ID NO: 659517 - RNA, 21 nt, Human
agcaggcagcggacccccagc

SEQ ID NO: 659518 - RNA, 19 nt, Human
agcggacccccagcauccc

SEQ ID NO: 659519 - RNA, 22 nt, Human
aggcccuccgcgggagcagccc

SEQ ID NO: 659520 - RNA, 21 nt, Human
agguuugugcuuggggaaggg

SEQ ID NO: 659521 - RNA, 25 nt, Human
agucauuggaugugauuauuggagu

SEQ ID NO: 659522 - RNA, 28 nt, Human
caacaauuacauauugaaaaggguuucc

SEQ ID NO: 659523 - RNA, 21 nt, Human
caacguaaaauacauuaucuc

SEQ ID NO: 659524 - RNA, 19 nt, Human
caaguugaaaaaguucucc

SEQ ID NO: 659525 - RNA, 21 nt, Human
cacuccagagccccucggcug

SEQ ID NO: 659526 - RNA, 24 nt, Human
cacucgcguucugagccccgagag

SEQ ID NO: 659527 - RNA, 26 nt, Human
cagcggcccuccuuucucagcugcuc

SEQ ID NO: 659528 - RNA, 19 nt, Human
caugcaggaacaagacuuc

SEQ ID NO: 659529 - RNA, 18 nt, Human
ccacagaacucccaaaag

SEQ ID NO: 659530 - RNA, 19 nt, Human
ccagagccccucggcugcg

SEQ ID NO: 659531 - RNA, 21 nt, Human
ccagaggaugccucucuuuau

SEQ ID NO: 659532 - RNA, 20 nt, Human
cccagcucuguccccacaga

SEQ ID NO: 659533 - RNA, 19 nt, Human
ccccagcaucccgcguccg

SEQ ID NO: 659534 - RNA, 21 nt, Human
ccccagcaucccgcguccgcc

SEQ ID NO: 659535 - RNA, 21 nt, Human
cccccagcaucccgcguccgc

SEQ ID NO: 659536 - RNA, 23 nt, Human
ccccucggcugcgcgcuuucucc

SEQ ID NO: 659537 - RNA, 19 nt, Human
ccgcagcaggcagcggacc

SEQ ID NO: 659538 - RNA, 24 nt, Human
ccgcagcaggcagcggacccccag

SEQ ID NO: 659539 - RNA, 18 nt, Human
ccgcggccgcagcucugc

SEQ ID NO: 659540 - RNA, 18 nt, Human
ccucagagucauuggaug

SEQ ID NO: 659541 - RNA, 18 nt, Human
ccuccgcgggagcagccc

SEQ ID NO: 659542 - RNA, 25 nt, Human
ccugcagcggcccuccuuucucagc

SEQ ID NO: 659543 - RNA, 18 nt, Human
ccuuccgcggccgcagcu

SEQ ID NO: 659544 - RNA, 23 nt, Human
ccuugcuauaaguaccucuucuu

SEQ ID NO: 659545 - RNA, 24 nt, Human
ccuugcuauaaguaccucuucuug

SEQ ID NO: 659546 - RNA, 18 nt, Human
cgccugcagcggcccucc

SEQ ID NO: 659547 - RNA, 24 nt, Human
cggaggaacagaagcgcacggacc

SEQ ID NO: 659548 - RNA, 18 nt, Human
cuccagaggaugccucuc

SEQ ID NO: 659549 - RNA, 21 nt, Human
cugcuguaugcacaaucaugu

SEQ ID NO: 659550 - RNA, 20 nt, Human
gaauccucaauauagaaccc

SEQ ID NO: 659551 - RNA, 18 nt, Human
gcugcgcgcuuucuccuu

SEQ ID NO: 659552 - RNA, 22 nt, Human
gcuuucuccuucaggacuccca

SEQ ID NO: 659553 - RNA, 22 nt, Human
ggacccccagcaucccgcgucc

SEQ ID NO: 659554 - RNA, 18 nt, Human
ggagcagcccagacccca

SEQ ID NO: 659555 - RNA, 24 nt, Human
uaagaaagcaggaacauugaagaa

SEQ ID NO: 659556 - RNA, 21 nt, Human
ucaugugcagugucucugccu

SEQ ID NO: 659557 - RNA, 20 nt, Human
uccacagaacucccaaaagu

SEQ ID NO: 659558 - RNA, 20 nt, Human
uccacauuuugccuuuugga

SEQ ID NO: 659559 - RNA, 20 nt, Human
ucccgcguccgcccaggccc

SEQ ID NO: 659560 - RNA, 27 nt, Human
uccgcggccgcagcucugcucuaaggc

SEQ ID NO: 659561 - RNA, 19 nt, Human
uccuuaaagaaagaaugaa

SEQ ID NO: 659562 - RNA, 23 nt, Human
uccuucaggacucccagcucugu

SEQ ID NO: 659563 - RNA, 19 nt, Human
uccuuggcaucacaauuuc

SEQ ID NO: 659564 - RNA, 19 nt, Human
ucgcagguacuccagagga

SEQ ID NO: 659565 - RNA, 19 nt, Human
ucugcaacaaccugaaggc

SEQ ID NO: 659566 - RNA, 21 nt, Human
ucugcaacaaccugaaggcuu

SEQ ID NO: 659567 - RNA, 21 nt, Human
ugagacuaauucaauuucuuc

SEQ ID NO: 659568 - RNA, 21 nt, Human
ugcaauguuuaaugaaguacu

SEQ ID NO: 659569 - RNA, 21 nt, Human
ugcuuggggaagggggcggag

SEQ ID NO: 659570 - RNA, 22 nt, Human
ugcuuggggaagggggcggagg

SEQ ID NO: 659571 - RNA, 18 nt, Human
uggcugaagguuugugcu

SEQ ID NO: 659572 - RNA, 20 nt, Human
uggcugaagguuugugcuug

SEQ ID NO: 659573 - RNA, 20 nt, Human
uguaugcacaaucaugugca

SEQ ID NO: 659574 - RNA, 18 nt, Human
ugucaaggccugaaucug

SEQ ID NO: 659575 - RNA, 24 nt, Human
ugugcuuggggaagggggcggagg

SEQ ID NO: 659576 - RNA, 23 nt, Human
uucaauuucuucauuucuuaauu

SEQ ID NO: 659577 - RNA, 21 nt, Human
uuccgcggccgcagcucugcu

SEQ ID NO: 659578 - RNA, 18 nt, Human
uucucacaaauuacacag

SEQ ID NO: 659579 - RNA, 22 nt, Human
uucugagccccgagagcguccc

SEQ ID NO: 659580 - RNA, 21 nt, Human
uugauggggaaauccuuggca

SEQ ID NO: 659581 - RNA, 22 nt, Human
uuucucagcugcuccccuuccg

SEQ ID NO: 659582 - RNA, 18 nt, Human
uuuuuuuuuuuuuuucug

SEQ ID NO: 659583 - RNA, 19 nt, Human
uuuuuuuuuuuuuuucugc

SEQ ID NO: 659584 - RNA, 23 nt, Human
aauaaaaacaaaucuauacugaa

SEQ ID NO: 659585 - RNA, 23 nt, Human
acagaguauuuuacugccaaaac

SEQ ID NO: 659586 - RNA, 21 nt, Human
ccaaaacuuuaaauaucucaa

SEQ ID NO: 659587 - RNA, 23 nt, Human
ggaguggugggcaauuagccugu

SEQ ID NO: 659588 - RNA, 18 nt, Human
uauacugaagucauuuuc

SEQ ID NO: 659589 - RNA, 20 nt, Human
uauuucaauauuccugggag

SEQ ID NO: 659590 - RNA, 24 nt, Human
ugaagucauuuuccuuugugagag

SEQ ID NO: 659591 - RNA, 19 nt, Human
ugagaggaaauaugaaugg

SEQ ID NO: 659592 - RNA, 27 nt, Human
ugccaaaacuuuaaauaucucaagagc

SEQ ID NO: 659593 - RNA, 24 nt, Human
uuuaaauaucucaagagcauacca

SEQ ID NO: 659594 - RNA, 24 nt, Human
aaacuucugggcucaagcgauccu

SEQ ID NO: 659595 - RNA, 24 nt, Human
aaagugcugggauuacaggcauga

SEQ ID NO: 659596 - RNA, 22 nt, Human
aagagacagggucuugcucugu

SEQ ID NO: 659597 - RNA, 21 nt, Human
aagcgauucuccugccuuggc

SEQ ID NO: 659598 - RNA, 19 nt, Human
aagugcugggauuacaggc

SEQ ID NO: 659599 - RNA, 21 nt, Human
aagugcugggauuacaggcau

SEQ ID NO: 659600 - RNA, 26 nt, Human
aagugcugggauuacaggcaugagcc

SEQ ID NO: 659601 - RNA, 23 nt, Human
aauagcugggacuacaggcaugu

SEQ ID NO: 659602 - RNA, 22 nt, Human
accucacccagccuccucauca

SEQ ID NO: 659603 - RNA, 21 nt, Human
agcagcgcaggggacaggccc

SEQ ID NO: 659604 - RNA, 18 nt, Human
agccaccucacccagccu

SEQ ID NO: 659605 - RNA, 18 nt, Human
agccuccugaauagcugg

SEQ ID NO: 659606 - RNA, 23 nt, Human
agggcaguggcccgaucacggcu

SEQ ID NO: 659607 - RNA, 23 nt, Human
agggucuugcuguguugccaggc

SEQ ID NO: 659608 - RNA, 18 nt, Human
agugcugggauuacaggc

SEQ ID NO: 659609 - RNA, 19 nt, Human
agugucgacucgggggcag

SEQ ID NO: 659610 - RNA, 24 nt, Human
caaagugcugggauuacaggcaug

SEQ ID NO: 659611 - RNA, 18 nt, Human
caacagcaggagcagcag

SEQ ID NO: 659612 - RNA, 20 nt, Human
caagcgauccuccugccuca

SEQ ID NO: 659613 - RNA, 22 nt, Human
caagcgauccuccugccucagc

SEQ ID NO: 659614 - RNA, 27 nt, Human
caagcgauccuccugccucagccuccu

SEQ ID NO: 659615 - RNA, 25 nt, Human
caccucacccagccuccucaucacc

SEQ ID NO: 659616 - RNA, 21 nt, Human
cagcaggcucggccacugggu

SEQ ID NO: 659617 - RNA, 23 nt, Human
cagggucuugcucuguugcccag

SEQ ID NO: 659618 - RNA, 18 nt, Human
caucagacuggaaacucc

SEQ ID NO: 659619 - RNA, 23 nt, Human
ccaaagugcugggauuacaggca

SEQ ID NO: 659620 - RNA, 24 nt, Human
ccaaagugcugggauuacaggcau

SEQ ID NO: 659621 - RNA, 23 nt, Human
ccaccucacccagccuccucauc

SEQ ID NO: 659622 - RNA, 24 nt, Human
cccaaagugcugggauuacaggca

SEQ ID NO: 659623 - RNA, 24 nt, Human
ccccaaagugcugggauuacaggc

SEQ ID NO: 659624 - RNA, 21 nt, Human
ccucacccagccuccucauca

SEQ ID NO: 659625 - RNA, 22 nt, Human
ccuccugccucagccuccugaa

SEQ ID NO: 659626 - RNA, 24 nt, Human
ccugaauagcugggacuacaggca

SEQ ID NO: 659627 - RNA, 24 nt, Human
ccugccucagccuccugaauagcu

SEQ ID NO: 659628 - RNA, 20 nt, Human
cgacucgggggcaggagcag

SEQ ID NO: 659629 - RNA, 19 nt, Human
cggccacugggugggccuc

SEQ ID NO: 659630 - RNA, 24 nt, Human
cucaagcgauccuccugccucagc

SEQ ID NO: 659631 - RNA, 24 nt, Human
cuccugaauagcugggacuacagg

SEQ ID NO: 659632 - RNA, 23 nt, Human
cugagucuucccccgcagaguga

SEQ ID NO: 659633 - RNA, 23 nt, Human
cuucugggcucaagcgauccucc

SEQ ID NO: 659634 - RNA, 25 nt, Human
gaauagcugggacuacaggcaugug

SEQ ID NO: 659635 - RNA, 21 nt, Human
gagacagggucuugcucuguu

SEQ ID NO: 659636 - RNA, 21 nt, Human
gagcucuggagggcagaaaug

SEQ ID NO: 659637 - RNA, 18 nt, Human
gauuacaggcaugagcca

SEQ ID NO: 659638 - RNA, 23 nt, Human
gauuacaggcaugagccaccuca

SEQ ID NO: 659639 - RNA, 24 nt, Human
gauuacaggcaugagccaccucac

SEQ ID NO: 659640 - RNA, 18 nt, Human
gccuaaagcgauucuccu

SEQ ID NO: 659641 - RNA, 23 nt, Human
gcgauccuccugccucagccucc

SEQ ID NO: 659642 - RNA, 19 nt, Human
ggacuacaggcaugugcca

SEQ ID NO: 659643 - RNA, 19 nt, Human
ggauuacaggcaugagcca

SEQ ID NO: 659644 - RNA, 21 nt, Human
ggcaacagcaggagcagcagc

SEQ ID NO: 659645 - RNA, 20 nt, Human
ggcugcaagcucucccccag

SEQ ID NO: 659646 - RNA, 20 nt, Human
gggcucaagcgauccuccug

SEQ ID NO: 659647 - RNA, 22 nt, Human
gggcucaagcgauccuccugcc

SEQ ID NO: 659648 - RNA, 23 nt, Human
guggaucucuugcaggugggcag

SEQ ID NO: 659649 - RNA, 20 nt, Human
uacaggcaugagccaccuca

SEQ ID NO: 659650 - RNA, 19 nt, Human
uacaggcaugugccaccac

SEQ ID NO: 659651 - RNA, 18 nt, Human
ucacccagccuccucauc

SEQ ID NO: 659652 - RNA, 24 nt, Human
ucauugcagccucaaacuucuggg

SEQ ID NO: 659653 - RNA, 20 nt, Human
uccacagugucgacucgggg

SEQ ID NO: 659654 - RNA, 25 nt, Human
uccaucagacuggaaacucccagag

SEQ ID NO: 659655 - RNA, 20 nt, Human
ucccagagcugggggaugau

SEQ ID NO: 659656 - RNA, 20 nt, Human
uccccaaagugcugggauua

SEQ ID NO: 659657 - RNA, 24 nt, Human
uccccaaagugcugggauuacagg

SEQ ID NO: 659658 - RNA, 18 nt, Human
ucccccaggugggggaag

SEQ ID NO: 659659 - RNA, 19 nt, Human
ucccccaucaguuugggag

SEQ ID NO: 659660 - RNA, 26 nt, Human
uccuccugccucagccuccugaauag

SEQ ID NO: 659661 - RNA, 24 nt, Human
uccugaauagcugggacuacaggc

SEQ ID NO: 659662 - RNA, 19 nt, Human
ucucuguggacagggacug

SEQ ID NO: 659663 - RNA, 18 nt, Human
ucuugcucuguugcccag

SEQ ID NO: 659664 - RNA, 22 nt, Human
ucuugcucuguugcccagucua

SEQ ID NO: 659665 - RNA, 24 nt, Human
ucuugcucuguugcccagucuaaa

SEQ ID NO: 659666 - RNA, 18 nt, Human
ucuugcuguguugccagg

SEQ ID NO: 659667 - RNA, 22 nt, Human
ucuugcuguguugccaggcugg

SEQ ID NO: 659668 - RNA, 23 nt, Human
ucuugcuguguugccaggcuggu

SEQ ID NO: 659669 - RNA, 26 nt, Human
ugccaccacgcuuggcuauguuuuuu

SEQ ID NO: 659670 - RNA, 27 nt, Human
ugccucagccuccugaauagcugggac

SEQ ID NO: 659671 - RNA, 19 nt, Human
ugccuuggcuccccaaagu

SEQ ID NO: 659672 - RNA, 23 nt, Human
ugcuguguugccaggcuggucuc

SEQ ID NO: 659673 - RNA, 19 nt, Human
uggagggcagaaaugugga

SEQ ID NO: 659674 - RNA, 18 nt, Human
ugggacuacaggcaugug

SEQ ID NO: 659675 - RNA, 21 nt, Human
ugggacuacaggcaugugcca

SEQ ID NO: 659676 - RNA, 22 nt, Human
ugggacuacaggcaugugccac

SEQ ID NO: 659677 - RNA, 24 nt, Human
ugggacuacaggcaugugccacca

SEQ ID NO: 659678 - RNA, 18 nt, Human
ugggauuacaggcaugag

SEQ ID NO: 659679 - RNA, 19 nt, Human
ugggauuacaggcaugagc

SEQ ID NO: 659680 - RNA, 21 nt, Human
ugggauuacaggcaugagcca

SEQ ID NO: 659681 - RNA, 22 nt, Human
ugggauuacaggcaugagccac

SEQ ID NO: 659682 - RNA, 23 nt, Human
ugggauuacaggcaugagccacc

SEQ ID NO: 659683 - RNA, 23 nt, Human
ugggauuacaggcaugagccacc

SEQ ID NO: 659684 - RNA, 25 nt, Human
ugggauuacaggcaugagccaccuc

SEQ ID NO: 659685 - RNA, 26 nt, Human
ugggauuacaggcaugagccaccuca

SEQ ID NO: 659686 - RNA, 27 nt, Human
ugggauuacaggcaugagccaccucac

SEQ ID NO: 659687 - RNA, 24 nt, Human
ugggcucaagcgauccuccugccu

SEQ ID NO: 659688 - RNA, 19 nt, Human
ugguagagauagggucuug

SEQ ID NO: 659689 - RNA, 24 nt, Human
ugguagagauagggucuugcugug

SEQ ID NO: 659690 - RNA, 22 nt, Human
uguguugccaggcuggucucaa

SEQ ID NO: 659691 - RNA, 23 nt, Human
uguguugccaggcuggucucaaa

SEQ ID NO: 659692 - RNA, 21 nt, Human
uguugccaggcuggucucaaa

SEQ ID NO: 659693 - RNA, 24 nt, Human
uucaucacuuuuuuuuucaagaga

SEQ ID NO: 659694 - RNA, 26 nt, Human
uucaucacuuuuuuuuucaagagaca

SEQ ID NO: 659695 - RNA, 24 nt, Human
uucugggcucaagcgauccuccug

SEQ ID NO: 659696 - RNA, 23 nt, Human
uugcagccucaaacuucugggcu

SEQ ID NO: 659697 - RNA, 24 nt, Human
uugguagagauagggucuugcugu

SEQ ID NO: 659698 - RNA, 24 nt, Human
uuuuugguagagauagggucuugc

SEQ ID NO: 659699 - RNA, 22 nt, Human
uuuuuugguagagauagggucu

SEQ ID NO: 659700 - RNA, 24 nt, Human
uuuuuuuuuuuuuuuuuccucuuu

SEQ ID NO: 659701 - RNA, 23 nt, Human
aaaaaaaaaaaaaaaugaaggag

SEQ ID NO: 659702 - RNA, 18 nt, Human
aaacagaacaaagaccaa

SEQ ID NO: 659703 - RNA, 19 nt, Human
aaacagaacaaagaccaaa

SEQ ID NO: 659704 - RNA, 19 nt, Human
aaagguuuagggcaggacg

SEQ ID NO: 659705 - RNA, 24 nt, Human
aacagaacaaagaccaaaaaaaaa

SEQ ID NO: 659706 - RNA, 21 nt, Human
aagaaucaugauauuugcugg

SEQ ID NO: 659707 - RNA, 26 nt, Human
acagggaaaaauauuuaguuuguuca

SEQ ID NO: 659708 - RNA, 20 nt, Human
accaaaacagaacaaagacc

SEQ ID NO: 659709 - RNA, 22 nt, Human
agaggcggggagggagcuggag

SEQ ID NO: 659710 - RNA, 27 nt, Human
agaggcggggagggagcuggagagggc

SEQ ID NO: 659711 - RNA, 20 nt, Human
aggacgagcaacaagcagag

SEQ ID NO: 659712 - RNA, 23 nt, Human
aggcggggagggagcuggagagg

SEQ ID NO: 659713 - RNA, 24 nt, Human
aggcggggagggagcuggagaggg

SEQ ID NO: 659714 - RNA, 25 nt, Human
aggcggggagggagcuggagagggc

SEQ ID NO: 659715 - RNA, 21 nt, Human
agggcagcuggggaauaacgu

SEQ ID NO: 659716 - RNA, 19 nt, Human
auuuuucuaaccaggaaag

SEQ ID NO: 659717 - RNA, 18 nt, Human
cacagacaggcagcuuau

SEQ ID NO: 659718 - RNA, 20 nt, Human
caccaaaacagaacaaagac

SEQ ID NO: 659719 - RNA, 22 nt, Human
caccaaaacagaacaaagacca

SEQ ID NO: 659720 - RNA, 23 nt, Human
caccaaaacagaacaaagaccaa

SEQ ID NO: 659721 - RNA, 20 nt, Human
caccaccaaaacagaacaaa

SEQ ID NO: 659722 - RNA, 22 nt, Human
caccaccaaaacagaacaaaga

SEQ ID NO: 659723 - RNA, 19 nt, Human
cagcuggggaauaacgugg

SEQ ID NO: 659724 - RNA, 24 nt, Human
cccacacgugaaaugcugcaaagg

SEQ ID NO: 659725 - RNA, 27 nt, Human
cccacacgugaaaugcugcaaagggcu

SEQ ID NO: 659726 - RNA, 28 nt, Human
cuggagccuuccacacccggaggugcca

SEQ ID NO: 659727 - RNA, 19 nt, Human
gcggggagggagcuggaga

SEQ ID NO: 659728 - RNA, 19 nt, Human
ggagcuggagagggcagcu

SEQ ID NO: 659729 - RNA, 20 nt, Human
ggggagggagcuggagaggg

SEQ ID NO: 659730 - RNA, 18 nt, Human
uaccaccaccaaaacaga

SEQ ID NO: 659731 - RNA, 20 nt, Human
uagggcaggacgagcaacaa

SEQ ID NO: 659732 - RNA, 18 nt, Human
ucaccagucaaauucaag

SEQ ID NO: 659733 - RNA, 26 nt, Human
ucacuggagccuuccacaaccggagg

SEQ ID NO: 659734 - RNA, 19 nt, Human
ugaggacagguggagucca

SEQ ID NO: 659735 - RNA, 22 nt, Human
ugaggacagguggaguccauag

SEQ ID NO: 659736 - RNA, 23 nt, Human
uggguaucaucaaaagaaauucu

SEQ ID NO: 659737 - RNA, 24 nt, Human
uuuuuuuuuuuuuuuuugggaggg

SEQ ID NO: 659738 - RNA, 24 nt, Human
uuuuuuuuuuuuuuuuuuuuuggg

SEQ ID NO: 659739 - RNA, 33 nt, Human
aaaaaaucaaccaaaaaaugaaaaguaucauua

SEQ ID NO: 659740 - RNA, 20 nt, Human
aaaaagcaucccuuuaauaa

SEQ ID NO: 659741 - RNA, 18 nt, Human
aaaaaucaggaaagaccc

SEQ ID NO: 659742 - RNA, 21 nt, Human
aaacgcuuugagagaaaaggc

SEQ ID NO: 659743 - RNA, 22 nt, Human
aaagcccauuaaauaagagucu

SEQ ID NO: 659744 - RNA, 19 nt, Human
aaaugggaacaguaacaau

SEQ ID NO: 659745 - RNA, 18 nt, Human
aaccuguuucuuagccua

SEQ ID NO: 659746 - RNA, 22 nt, Human
aagagucucaaacaaagguuuu

SEQ ID NO: 659747 - RNA, 21 nt, Human
aagcagcacaggaagccguac

SEQ ID NO: 659748 - RNA, 20 nt, Human
aagcuuucuuuucugaaauu

SEQ ID NO: 659749 - RNA, 19 nt, Human
aauaaaaacaagaacuugg

SEQ ID NO: 659750 - RNA, 20 nt, Human
accaaaaaaugaaaaguauc

SEQ ID NO: 659751 - RNA, 21 nt, Human
accacaauuuauaucugcuau

SEQ ID NO: 659752 - RNA, 21 nt, Human
agaaaacagaaacugcuuguc

SEQ ID NO: 659753 - RNA, 22 nt, Human
agacagagaugauacuccaaac

SEQ ID NO: 659754 - RNA, 23 nt, Human
agacagagaugauacuccaaaca

SEQ ID NO: 659755 - RNA, 25 nt, Human
agcaccaaaauguuuaguguauuug

SEQ ID NO: 659756 - RNA, 18 nt, Human
agcagaaggcaggcaugg

SEQ ID NO: 659757 - RNA, 19 nt, Human
agcaguuacaguuuccugc

SEQ ID NO: 659758 - RNA, 22 nt, Human
agcuggggagggagcagaaggc

SEQ ID NO: 659759 - RNA, 23 nt, Human
aggcagagggcuggguacugggg

SEQ ID NO: 659760 - RNA, 20 nt, Human
aggcggcggcagcccucugg

SEQ ID NO: 659761 - RNA, 21 nt, Human
agguaggccauggcuuguugg

SEQ ID NO: 659762 - RNA, 21 nt, Human
agugcuuagaggaguguuugg

SEQ ID NO: 659763 - RNA, 22 nt, Human
auacaaaaaggaauggccaccu

SEQ ID NO: 659764 - RNA, 23 nt, Human
auacaaauuauuucaagaaacca

SEQ ID NO: 659765 - RNA, 18 nt, Human
aucuaaucccuuccucca

SEQ ID NO: 659766 - RNA, 22 nt, Human
auuagcccacaugaaagauaaa

SEQ ID NO: 659767 - RNA, 23 nt, Human
auugcaauuaauuaacuugaaaa

SEQ ID NO: 659768 - RNA, 20 nt, Human
caaagcucaaaauauccccu

SEQ ID NO: 659769 - RNA, 28 nt, Human
caauacccuaacauaaacccuagucucc

SEQ ID NO: 659770 - RNA, 22 nt, Human
caaucacuguuuuggaauugau

SEQ ID NO: 659771 - RNA, 22 nt, Human
cacaggaagccguacacuuuug

SEQ ID NO: 659772 - RNA, 23 nt, Human
cacaggaagccguacacuuuuga

SEQ ID NO: 659773 - RNA, 18 nt, Human
caccuccaagucucaauu

SEQ ID NO: 659774 - RNA, 23 nt, Human
cacuuugugccaggcagagggcu

SEQ ID NO: 659775 - RNA, 24 nt, Human
cagaagccauaauuauuuugggaa

SEQ ID NO: 659776 - RNA, 20 nt, Human
cagaauuaacaggaaaugac

SEQ ID NO: 659777 - RNA, 23 nt, Human
cagcacaggaagccguacacuuu

SEQ ID NO: 659778 - RNA, 19 nt, Human
cagcccagagcccagacag

SEQ ID NO: 659779 - RNA, 24 nt, Human
cagcccagagcccagacagagaug

SEQ ID NO: 659780 - RNA, 22 nt, Human
cagcuaaaauccugaagaaaaa

SEQ ID NO: 659781 - RNA, 19 nt, Human
caggaaaugacugcaugac

SEQ ID NO: 659782 - RNA, 18 nt, Human
caugaaaagucaccucca

SEQ ID NO: 659783 - RNA, 25 nt, Human
caugaaagauaaaauaaagggcugg

SEQ ID NO: 659784 - RNA, 18 nt, Human
ccaaaccagcuggggagg

SEQ ID NO: 659785 - RNA, 20 nt, Human
ccaaagcucaaaauaucccc

SEQ ID NO: 659786 - RNA, 24 nt, Human
ccaaagcucaaaauauccccuaaa

SEQ ID NO: 659787 - RNA, 19 nt, Human
ccaauuuuggaaauagaau

SEQ ID NO: 659788 - RNA, 22 nt, Human
ccauaaaaaucaggaaagaccc

SEQ ID NO: 659789 - RNA, 19 nt, Human
cccacaugaaagauaaaau

SEQ ID NO: 659790 - RNA, 22 nt, Human
ccccuaaaauuccauaaaaauc

SEQ ID NO: 659791 - RNA, 25 nt, Human
cccuuaaaaagugcaauugccuucu

SEQ ID NO: 659792 - RNA, 21 nt, Human
ccuugguuaucuggggaaucu

SEQ ID NO: 659793 - RNA, 22 nt, Human
cgcaaguaaaggaaagaaagug

SEQ ID NO: 659794 - RNA, 21 nt, Human
cuaagcaccaaaauguuuagu

SEQ ID NO: 659795 - RNA, 20 nt, Human
cuccaaacaugaaaagucac

SEQ ID NO: 659796 - RNA, 21 nt, Human
cuccaaacaugaaaagucacc

SEQ ID NO: 659797 - RNA, 21 nt, Human
cuucacuuuuggaaauucuuc

SEQ ID NO: 659798 - RNA, 19 nt, Human
cuuccaagucugaccagag

SEQ ID NO: 659799 - RNA, 21 nt, Human
gaaagacccuagcuauugccc

SEQ ID NO: 659800 - RNA, 20 nt, Human
gaaauucuuccaagucugac

SEQ ID NO: 659801 - RNA, 21 nt, Human
gaaauucuuccaagucugacc

SEQ ID NO: 659802 - RNA, 19 nt, Human
gaacuuggagaggcggcgg

SEQ ID NO: 659803 - RNA, 22 nt, Human
gaaguuuaagggauaugaugga

SEQ ID NO: 659804 - RNA, 21 nt, Human
gaccuuggggugaguuacuag

SEQ ID NO: 659805 - RNA, 20 nt, Human
gagauauuuuucucgggaga

SEQ ID NO: 659806 - RNA, 19 nt, Human
gagaugacagaagccauaa

SEQ ID NO: 659807 - RNA, 21 nt, Human
gcaccgcgggggccacaagaa

SEQ ID NO: 659808 - RNA, 18 nt, Human
gcaggcauggggagaaag

SEQ ID NO: 659809 - RNA, 20 nt, Human
gccgugugaccuugggguga

SEQ ID NO: 659810 - RNA, 22 nt, Human
gccuucuuugucauuucuuugu

SEQ ID NO: 659811 - RNA, 18 nt, Human
ggacugaaugagcuaaua

SEQ ID NO: 659812 - RNA, 20 nt, Human
ggagaaaggaaccaggugcu

SEQ ID NO: 659813 - RNA, 20 nt, Human
gggagggagcagaaggcagg

SEQ ID NO: 659814 - RNA, 21 nt, Human
ggucucuuuuagcuccaaacu

SEQ ID NO: 659815 - RNA, 22 nt, Human
uaaaaaaggacauaccaagaua

SEQ ID NO: 659816 - RNA, 18 nt, Human
uaaaaagaaauccacuaa

SEQ ID NO: 659817 - RNA, 20 nt, Human
uaaaaagaaauccacuaagc

SEQ ID NO: 659818 - RNA, 21 nt, Human
uaaaaagaaauccacuaagca

SEQ ID NO: 659819 - RNA, 19 nt, Human
uaaacccugucccagauau

SEQ ID NO: 659820 - RNA, 20 nt, Human
uaaagggcugagaugggggg

SEQ ID NO: 659821 - RNA, 20 nt, Human
uaacuacaccccacuccagc

SEQ ID NO: 659822 - RNA, 18 nt, Human
uaacuacaccccacuccc

SEQ ID NO: 659823 - RNA, 19 nt, Human
uaaguguugaagcauauuu

SEQ ID NO: 659824 - RNA, 21 nt, Human
uaauaacuacaccccacucca

SEQ ID NO: 659825 - RNA, 22 nt, Human
uaaucccuuccuccaaaaaccc

SEQ ID NO: 659826 - RNA, 21 nt, Human
uacaagacaaaaauagcuuag

SEQ ID NO: 659827 - RNA, 25 nt, Human
uacuucugucuuugugcuuuuagau

SEQ ID NO: 659828 - RNA, 19 nt, Human
uagaaaacagaaacugcuu

SEQ ID NO: 659829 - RNA, 20 nt, Human
uagcauaaagcuuuacuucu

SEQ ID NO: 659830 - RNA, 23 nt, Human
uaggagaagcaaaacuguagaga

SEQ ID NO: 659831 - RNA, 27 nt, Human
uaucaauacccuaacauaaacccuagu

SEQ ID NO: 659832 - RNA, 19 nt, Human
uaugcuacuuaaguguuga

SEQ ID NO: 659833 - RNA, 20 nt, Human
uccaaacaugaaaagucacc

SEQ ID NO: 659834 - RNA, 22 nt, Human
uccccaggcuucaaaucucuca

SEQ ID NO: 659835 - RNA, 21 nt, Human
uccgcaccgcgggggccacaa

SEQ ID NO: 659836 - RNA, 24 nt, Human
uccgcaccgcgggggccacaagaa

SEQ ID NO: 659837 - RNA, 24 nt, Human
ucuaaucuaucaauacccuaacau

SEQ ID NO: 659838 - RNA, 18 nt, Human
ucuagauauauuuuauau

SEQ ID NO: 659839 - RNA, 19 nt, Human
ucucgggagaugcuuaggu

SEQ ID NO: 659840 - RNA, 22 nt, Human
ucugcacaaggcaccgugcuaa

SEQ ID NO: 659841 - RNA, 24 nt, Human
ucuggcucuauuaccaauuuugga

SEQ ID NO: 659842 - RNA, 18 nt, Human
ugaaaaguaucauuucag

SEQ ID NO: 659843 - RNA, 23 nt, Human
ugaaauuagauuaugggguaaac

SEQ ID NO: 659844 - RNA, 20 nt, Human
ugagaacccaaagcucaaaa

SEQ ID NO: 659845 - RNA, 21 nt, Human
ugagaacccaaagcucaaaau

SEQ ID NO: 659846 - RNA, 19 nt, Human
ugagucucagucccaccau

SEQ ID NO: 659847 - RNA, 21 nt, Human
ugaguguuaaaauaaagcuuu

SEQ ID NO: 659848 - RNA, 22 nt, Human
ugaugugugacuaugcaacuac

SEQ ID NO: 659849 - RNA, 22 nt, Human
ugcaacagugcuauucuagugc

SEQ ID NO: 659850 - RNA, 20 nt, Human
ugcaauuaauuaacuugaaa

SEQ ID NO: 659851 - RNA, 18 nt, Human
ugcacuggaauuuccaac

SEQ ID NO: 659852 - RNA, 23 nt, Human
uggaaauagaauuuaguagagaa

SEQ ID NO: 659853 - RNA, 18 nt, Human
uggaacauccaacuuauc

SEQ ID NO: 659854 - RNA, 18 nt, Human
uggaauuuuguguuccuc

SEQ ID NO: 659855 - RNA, 22 nt, Human
uggggaaaagugcucucugagg

SEQ ID NO: 659856 - RNA, 19 nt, Human
uggggagggagcagaaggc

SEQ ID NO: 659857 - RNA, 24 nt, Human
uggggggugcuuaaauacuuugcc

SEQ ID NO: 659858 - RNA, 22 nt, Human
ugguaucuguguagagucauga

SEQ ID NO: 659859 - RNA, 24 nt, Human
ugugaaaucauugucucccagaau

SEQ ID NO: 659860 - RNA, 22 nt, Human
uguguaaagugcuuagaggagu

SEQ ID NO: 659861 - RNA, 20 nt, Human
uguguuccucuauguaaugg

SEQ ID NO: 659862 - RNA, 18 nt, Human
uguugugguccucaacaa

SEQ ID NO: 659863 - RNA, 22 nt, Human
uuaaaauaaagcuuucuuuucu

SEQ ID NO: 659864 - RNA, 22 nt, Human
uuagagggcagguuccauuuga

SEQ ID NO: 659865 - RNA, 21 nt, Human
uucaaaaauaaaaacaagaac

SEQ ID NO: 659866 - RNA, 19 nt, Human
uucaaucacuguuuuggaa

SEQ ID NO: 659867 - RNA, 22 nt, Human
uucuuagccuauacaaaaagga

SEQ ID NO: 659868 - RNA, 19 nt, Human
uugaaagauaaagguacaa

SEQ ID NO: 659869 - RNA, 19 nt, Human
uuggcaacuguggucaauc

SEQ ID NO: 659870 - RNA, 22 nt, Human
uuggcaguaguaggggcccuau

SEQ ID NO: 659871 - RNA, 22 nt, Human
uuuauucaggggugggucaaag

SEQ ID NO: 659872 - RNA, 20 nt, Human
uuucucgggagaugcuuagg

SEQ ID NO: 659873 - RNA, 20 nt, Human
aaaguguuagugccagguga

SEQ ID NO: 659874 - RNA, 18 nt, Human
aagcccauuaucuguguu

SEQ ID NO: 659875 - RNA, 25 nt, Human
aguaguuuuauuuccccuaugagaa

SEQ ID NO: 659876 - RNA, 19 nt, Human
augaagccugaagauugaa

SEQ ID NO: 659877 - RNA, 22 nt, Human
cagucuugccuuggauguuccc

SEQ ID NO: 659878 - RNA, 24 nt, Human
ccccucuucugucuuuaguauccc

SEQ ID NO: 659879 - RNA, 18 nt, Human
cccugcccuagccccuuc

SEQ ID NO: 659880 - RNA, 21 nt, Human
cccugcccuagccccuucuuc

SEQ ID NO: 659881 - RNA, 27 nt, Human
ccucaccccucagcauugcuccuucuc

SEQ ID NO: 659882 - RNA, 18 nt, Human
cuccccugcccuagcccc

SEQ ID NO: 659883 - RNA, 23 nt, Human
cucuaagggccaccuuccccucu

SEQ ID NO: 659884 - RNA, 18 nt, Human
cuggucucagagucaaaa

SEQ ID NO: 659885 - RNA, 24 nt, Human
cuguuuccuguccuggggcuggag

SEQ ID NO: 659886 - RNA, 19 nt, Human
gagagugggguaugugguc

SEQ ID NO: 659887 - RNA, 18 nt, Human
ggaaggaaugaagccuga

SEQ ID NO: 659888 - RNA, 21 nt, Human
ggagagugggguaugugguca

SEQ ID NO: 659889 - RNA, 24 nt, Human
ggcuggucucagagucaaaagcac

SEQ ID NO: 659890 - RNA, 19 nt, Human
gggaaggaaugaagccuga

SEQ ID NO: 659891 - RNA, 24 nt, Human
gggcuggagugggagagaggccuc

SEQ ID NO: 659892 - RNA, 21 nt, Human
gggggugggcuggucucagag

SEQ ID NO: 659893 - RNA, 20 nt, Human
ggggugggcuggucucagag

SEQ ID NO: 659894 - RNA, 27 nt, Human
gggguucucugggcugugccuccuuuc

SEQ ID NO: 659895 - RNA, 18 nt, Human
guggaaugugcuaggcuc

SEQ ID NO: 659896 - RNA, 22 nt, Human
uaguuuuauuuccccuaugaga

SEQ ID NO: 659897 - RNA, 18 nt, Human
uccacuagcuguuugggg

SEQ ID NO: 659898 - RNA, 20 nt, Human
uccccugcccuagccccuuc

SEQ ID NO: 659899 - RNA, 23 nt, Human
ucccuuaugggagaaauagagau

SEQ ID NO: 659900 - RNA, 22 nt, Human
uccuggagagugggguaugugg

SEQ ID NO: 659901 - RNA, 20 nt, Human
uccuguccuggggcuggagu

SEQ ID NO: 659902 - RNA, 24 nt, Human
uccuugguucacaugggagggggc

SEQ ID NO: 659903 - RNA, 23 nt, Human
ucuggcaucuguccaagcucugu

SEQ ID NO: 659904 - RNA, 21 nt, Human
ucugucuuuaguauccccaaa

SEQ ID NO: 659905 - RNA, 20 nt, Human
ugcccuagccccuucuuccu

SEQ ID NO: 659906 - RNA, 21 nt, Human
ugcccuagccccuucuuccug

SEQ ID NO: 659907 - RNA, 25 nt, Human
uggaacagagccucuggcaucuguc

SEQ ID NO: 659908 - RNA, 22 nt, Human
uggaaugugcuaggcucagggc

SEQ ID NO: 659909 - RNA, 18 nt, Human
ugggaaggaaugaagccu

SEQ ID NO: 659910 - RNA, 23 nt, Human
ugggaaggaaugaagccugaaga

SEQ ID NO: 659911 - RNA, 21 nt, Human
ugggcugugccuccuuuccuu

SEQ ID NO: 659912 - RNA, 25 nt, Human
uucaccuuuuucaggcaguucuguu

SEQ ID NO: 659913 - RNA, 24 nt, Human
uuuuuucauauuuuaguaguuuua

SEQ ID NO: 659914 - RNA, 25 nt, Human
uuuuuuuuuuuuuuuuucauauuuu

SEQ ID NO: 659915 - RNA, 21 nt, Human
aacuauuggacaaacugaugc

SEQ ID NO: 659916 - RNA, 19 nt, Human
aagauauuaaccagaaaag

SEQ ID NO: 659917 - RNA, 21 nt, Human
aaugucagaaguaucugagcc

SEQ ID NO: 659918 - RNA, 23 nt, Human
augggccugagcuuucuuccugg

SEQ ID NO: 659919 - RNA, 22 nt, Human
cagcugguuucucugaaaguuc

SEQ ID NO: 659920 - RNA, 25 nt, Human
cuauugccaaguucucuuuuucaac

SEQ ID NO: 659921 - RNA, 18 nt, Human
cugaagacgcugugguuc

SEQ ID NO: 659922 - RNA, 20 nt, Human
cugagcuuucuuccuggcuu

SEQ ID NO: 659923 - RNA, 20 nt, Human
cugggcacuaagggguccug

SEQ ID NO: 659924 - RNA, 22 nt, Human
cugugcuauguaaaggaggauc

SEQ ID NO: 659925 - RNA, 23 nt, Human
cuuuuugcuucuuuuccuggagg

SEQ ID NO: 659926 - RNA, 22 nt, Human
gcuucuuuuccuggaggaguug

SEQ ID NO: 659927 - RNA, 22 nt, Human
guguacuuauuuucucugcuga

SEQ ID NO: 659928 - RNA, 21 nt, Human
uaaggugucaacauuuuaaaa

SEQ ID NO: 659929 - RNA, 18 nt, Human
uauagcucauaccuggga

SEQ ID NO: 659930 - RNA, 21 nt, Human
ucaaugcuuucagagucauca

SEQ ID NO: 659931 - RNA, 18 nt, Human
ucacagccauuuaauuug

SEQ ID NO: 659932 - RNA, 22 nt, Human
ucacuugcuucauuuccagaag

SEQ ID NO: 659933 - RNA, 22 nt, Human
ucucugcugauuuaacuuuucu

SEQ ID NO: 659934 - RNA, 18 nt, Human
ugagcuuucuuccuggcu

SEQ ID NO: 659935 - RNA, 19 nt, Human
ugcuauguaaaggaggauc

SEQ ID NO: 659936 - RNA, 18 nt, Human
ugcuucauuuccagaagu

SEQ ID NO: 659937 - RNA, 24 nt, Human
uggaggaguugaagagagagacag

SEQ ID NO: 659938 - RNA, 19 nt, Human
uucucauuuucacccagcc

SEQ ID NO: 659939 - RNA, 19 nt, Human
uucucuuuuucaacagagg

SEQ ID NO: 659940 - RNA, 20 nt, Human
uucuuccuuuugucaugaga

SEQ ID NO: 659941 - RNA, 24 nt, Human
uucuugauuucuuccuuuugucau

SEQ ID NO: 659942 - RNA, 21 nt, Human
uugaagagagagacaguccac

SEQ ID NO: 659943 - RNA, 19 nt, Human
uugcuucauuuccagaagu

SEQ ID NO: 659944 - RNA, 24 nt, Human
uuuaacauuguucacagccauuua

SEQ ID NO: 659945 - RNA, 20 nt, Human
uuuuuuuuaauuuuacaagu

SEQ ID NO: 659946 - RNA, 24 nt, Human
uuuuuuuuuuuuuuuuuuaauuuu

SEQ ID NO: 659947 - RNA, 19 nt, Human
aaguggcccggggccgagc

SEQ ID NO: 659948 - RNA, 21 nt, Human
aggcagcacccugcccccccc

SEQ ID NO: 659949 - RNA, 24 nt, Human
aggugccggguucgagcccggaac

SEQ ID NO: 659950 - RNA, 18 nt, Human
cacccaguuuccaggagu

SEQ ID NO: 659951 - RNA, 21 nt, Human
caucuuggcucagccaauucc

SEQ ID NO: 659952 - RNA, 22 nt, Human
ccaauucccacccaguuuccag

SEQ ID NO: 659953 - RNA, 27 nt, Human
ccgggugacaggaggguggucuucccu

SEQ ID NO: 659954 - RNA, 22 nt, Human
ccucugcaggugaggcgggggc

SEQ ID NO: 659955 - RNA, 22 nt, Human
cuccccuucccgccccgugaag

SEQ ID NO: 659956 - RNA, 22 nt, Human
gaacgggcuuccacugaggucc

SEQ ID NO: 659957 - RNA, 25 nt, Human
gaaggcagcacccugccccccccca

SEQ ID NO: 659958 - RNA, 19 nt, Human
gacucuucuuccccucccc

SEQ ID NO: 659959 - RNA, 19 nt, Human
gagcagcuguccaauggga

SEQ ID NO: 659960 - RNA, 18 nt, Human
gcagcacccugccccccc

SEQ ID NO: 659961 - RNA, 22 nt, Human
ggggccgagccccgccuccauc

SEQ ID NO: 659962 - RNA, 21 nt, Human
gggggcggcacuccuggugga

SEQ ID NO: 659963 - RNA, 22 nt, Human
gggugacaggaggguggucuuc

SEQ ID NO: 659964 - RNA, 21 nt, Human
guccgggugacaggagggugg

SEQ ID NO: 659965 - RNA, 18 nt, Human
ucaaggcaggguuggagu

SEQ ID NO: 659966 - RNA, 19 nt, Human
uccagggauggggggaacg

SEQ ID NO: 659967 - RNA, 22 nt, Human
ucccucaaggcaggguuggagu

SEQ ID NO: 659968 - RNA, 25 nt, Human
ucucggacggccaccgcugaggccu

SEQ ID NO: 659969 - RNA, 26 nt, Human
ucucggacggccaccgcugaggccuc

SEQ ID NO: 659970 - RNA, 26 nt, Human
ugagacucuucuuccccuccccuucc

SEQ ID NO: 659971 - RNA, 23 nt, Human
ugagguccgggugacaggagggu

SEQ ID NO: 659972 - RNA, 18 nt, Human
ugcgaguccgugucccac

SEQ ID NO: 659973 - RNA, 20 nt, Human
uggcccggggccgagccccg

SEQ ID NO: 659974 - RNA, 22 nt, Human
uucccacccaguuuccaggagu

SEQ ID NO: 659975 - RNA, 23 nt, Human
uucuuccccuccccuucccgccc

SEQ ID NO: 659976 - RNA, 20 nt, Human
uuuuuuuuuuuuuuuugcca

SEQ ID NO: 659977 - RNA, 18 nt, Human
uuuuuuuuuuuuuuuuug

SEQ ID NO: 659978 - RNA, 23 nt, Human
uuuuuuuuuuuuuuuuugccaca

SEQ ID NO: 659979 - RNA, 22 nt, Human
aagcccauggccccgaguccaa

SEQ ID NO: 659980 - RNA, 24 nt, Human
agacgcugggaccgcuacggaacc

SEQ ID NO: 659981 - RNA, 23 nt, Human
cacggccccgaguacaaguccgg

SEQ ID NO: 659982 - RNA, 24 nt, Human
caggaggcccuucccgaguccaag

SEQ ID NO: 659983 - RNA, 22 nt, Human
ccagguccgggccgagcccacg

SEQ ID NO: 659984 - RNA, 19 nt, Human
cccacggcccuacuggcuu

SEQ ID NO: 659985 - RNA, 18 nt, Human
cccacggcgcccagcccc

SEQ ID NO: 659986 - RNA, 23 nt, Human
ccccuuguagggacaggaggcug

SEQ ID NO: 659987 - RNA, 21 nt, Human
cccgcggcugugccgcgaccg

SEQ ID NO: 659988 - RNA, 18 nt, Human
ccgcccggccggcgggac

SEQ ID NO: 659989 - RNA, 22 nt, Human
ccgcuacggaaccgccagaccc

SEQ ID NO: 659990 - RNA, 20 nt, Human
cgcaggucccugcuguccac

SEQ ID NO: 659991 - RNA, 25 nt, Human
cgcccagccccagcugagccggacu

SEQ ID NO: 659992 - RNA, 19 nt, Human
cuucccgaguccaaguccg

SEQ ID NO: 659993 - RNA, 24 nt, Human
gaaccgccagacccacggcgccca

SEQ ID NO: 659994 - RNA, 26 nt, Human
gaaccgccagacccacggcgcccagc

SEQ ID NO: 659995 - RNA, 18 nt, Human
gccccuuguagggacagg

SEQ ID NO: 659996 - RNA, 21 nt, Human
gcgcaggucccugcuguccac

SEQ ID NO: 659997 - RNA, 20 nt, Human
gguagcgcaggucccugcug

SEQ ID NO: 659998 - RNA, 24 nt, Human
ucccgcggcugugccgcgaccgcc

SEQ ID NO: 659999 - RNA, 19 nt, Human
uggccccgaguccaaaucc

SEQ ID NO: 660000 - RNA, 22 nt, Human
ugggaccgcuacggaaccgcca

SEQ ID NO: 660001 - RNA, 20 nt, Human
uuuuuuuuuuuuuuuuccau

SEQ ID NO: 660002 - RNA, 23 nt, Human
uuuuuuuuuuuuuuuuuuccaug

SEQ ID NO: 660003 - RNA, 18 nt, Human
aaaaacaaaacagacaga

SEQ ID NO: 660004 - RNA, 22 nt, Human
aaaaagucccuggcuauaaagg

SEQ ID NO: 660005 - RNA, 20 nt, Human
aaaagucaggcuagugcccu

SEQ ID NO: 660006 - RNA, 21 nt, Human
aaauaagaaaaaagucccugg

SEQ ID NO: 660007 - RNA, 23 nt, Human
aacaaaguucaaaugcccaauaa

SEQ ID NO: 660008 - RNA, 22 nt, Human
aauguugggauuacaggcauga

SEQ ID NO: 660009 - RNA, 18 nt, Human
acacuugguacacauaua

SEQ ID NO: 660010 - RNA, 18 nt, Human
acagucgucaguggacag

SEQ ID NO: 660011 - RNA, 18 nt, Human
acagugcucagaaagaca

SEQ ID NO: 660012 - RNA, 22 nt, Human
acagugcucagaaagacacacu

SEQ ID NO: 660013 - RNA, 19 nt, Human
acgcagccaccugagacuu

SEQ ID NO: 660014 - RNA, 22 nt, Human
acggaguauugcuauguugccc

SEQ ID NO: 660015 - RNA, 20 nt, Human
agccaccacacgcagccacc

SEQ ID NO: 660016 - RNA, 18 nt, Human
auugcuauguugcccagg

SEQ ID NO: 660017 - RNA, 19 nt, Human
caaaaggcugcggagaaca

SEQ ID NO: 660018 - RNA, 27 nt, Human
caagcaguucucccgccugggccuccc

SEQ ID NO: 660019 - RNA, 22 nt, Human
caccacuaggcccaauggcuca

SEQ ID NO: 660020 - RNA, 19 nt, Human
cacugccuuaaaagucagg

SEQ ID NO: 660021 - RNA, 24 nt, Human
cagaaagacacacugccuuaaaag

SEQ ID NO: 660022 - RNA, 21 nt, Human
cagcacuucuggcugguuuga

SEQ ID NO: 660023 - RNA, 26 nt, Human
caggagccuuuggucaccugagacuu

SEQ ID NO: 660024 - RNA, 21 nt, Human
caguaggucuuucaggagccc

SEQ ID NO: 660025 - RNA, 19 nt, Human
caugacaccacuaggccca

SEQ ID NO: 660026 - RNA, 18 nt, Human
ccaaaaagacugcucucc

SEQ ID NO: 660027 - RNA, 21 nt, Human
ccaccacacgcagccaccuga

SEQ ID NO: 660028 - RNA, 23 nt, Human
ccagaauguugggauuacaggca

SEQ ID NO: 660029 - RNA, 24 nt, Human
ccagaauguugggauuacaggcau

SEQ ID NO: 660030 - RNA, 24 nt, Human
cccagaauguugggauuacaggca

SEQ ID NO: 660031 - RNA, 23 nt, Human
ccccaggugcaaggcuaaaccag

SEQ ID NO: 660032 - RNA, 23 nt, Human
ccugccaacuaagcagacauccc

SEQ ID NO: 660033 - RNA, 24 nt, Human
cggaguauugcuauguugcccagg

SEQ ID NO: 660034 - RNA, 19 nt, Human
cuagcuucaggagccuuug

SEQ ID NO: 660035 - RNA, 21 nt, Human
cuaggcccaauggcucagagg

SEQ ID NO: 660036 - RNA, 21 nt, Human
cuccugggcucaagcaguucu

SEQ ID NO: 660037 - RNA, 20 nt, Human
cugguccuggcaguaggucu

SEQ ID NO: 660038 - RNA, 21 nt, Human
cuuaaaugccaccacccacca

SEQ ID NO: 660039 - RNA, 19 nt, Human
cuugacagucgucagugga

SEQ ID NO: 660040 - RNA, 23 nt, Human
gaaaaacaaaacagacagaagaa

SEQ ID NO: 660041 - RNA, 21 nt, Human
gacacauaguauccagcacca

SEQ ID NO: 660042 - RNA, 23 nt, Human
gagccaccacacgcagccaccug

SEQ ID NO: 660043 - RNA, 23 nt, Human
gagccccucagguacucucacac

SEQ ID NO: 660044 - RNA, 18 nt, Human
gauuacaggcaugagcca

SEQ ID NO: 660045 - RNA, 21 nt, Human
gauuacaggcaugagccacca

SEQ ID NO: 660046 - RNA, 22 nt, Human
gauuacaggcaugagccaccac

SEQ ID NO: 660047 - RNA, 20 nt, Human
gauucugaacuccugggcuc

SEQ ID NO: 660048 - RNA, 23 nt, Human
gcuucaggagccuuuggucaccu

SEQ ID NO: 660049 - RNA, 18 nt, Human
ggacugaaccccugccaa

SEQ ID NO: 660050 - RNA, 19 nt, Human
ggauuacaggcaugagcca

SEQ ID NO: 660051 - RNA, 21 nt, Human
guguuauggguauaauuaacu

SEQ ID NO: 660052 - RNA, 21 nt, Human
uaaaccagcagcuccaagggc

SEQ ID NO: 660053 - RNA, 24 nt, Human
uacaauacaugacaccacuaggcc

SEQ ID NO: 660054 - RNA, 21 nt, Human
uacaggcaugagccaccacac

SEQ ID NO: 660055 - RNA, 23 nt, Human
uauguugcccaggcugauucuga

SEQ ID NO: 660056 - RNA, 24 nt, Human
uauguugcccaggcugauucugaa

SEQ ID NO: 660057 - RNA, 23 nt, Human
uauuacaccaaaaagacugcucu

SEQ ID NO: 660058 - RNA, 19 nt, Human
uauugcuauguugcccagg

SEQ ID NO: 660059 - RNA, 23 nt, Human
uauugcuauguugcccaggcuga

SEQ ID NO: 660060 - RNA, 26 nt, Human
ucaaucuuuauccaaaccugguucua

SEQ ID NO: 660061 - RNA, 18 nt, Human
uccaagggcuuggucuac

SEQ ID NO: 660062 - RNA, 24 nt, Human
ucccagaauguugggauuacaggc

SEQ ID NO: 660063 - RNA, 19 nt, Human
uccugggcucaagcaguuc

SEQ ID NO: 660064 - RNA, 21 nt, Human
uccugggcucaagcaguucuc

SEQ ID NO: 660065 - RNA, 22 nt, Human
uccugggcucaagcaguucucc

SEQ ID NO: 660066 - RNA, 23 nt, Human
uccugggcucaagcaguucuccc

SEQ ID NO: 660067 - RNA, 24 nt, Human
uccugggcucaagcaguucucccg

SEQ ID NO: 660068 - RNA, 24 nt, Human
ucugaacuccugggcucaagcagg

SEQ ID NO: 660069 - RNA, 24 nt, Human
ugaacuccugggcucaagcaguuc

SEQ ID NO: 660070 - RNA, 21 nt, Human
ugagacggaguauugcuaugu

SEQ ID NO: 660071 - RNA, 21 nt, Human
ugccaacuaagcagacauccc

SEQ ID NO: 660072 - RNA, 25 nt, Human
ugcccaauaauaauuauguuuaaca

SEQ ID NO: 660073 - RNA, 24 nt, Human
ugcccaggcugauucugaacuccu

SEQ ID NO: 660074 - RNA, 23 nt, Human
ugcuauguugcccaggcugauuc

SEQ ID NO: 660075 - RNA, 31 nt, Human
ugcuauguugcccaggcugauucugaacucc

SEQ ID NO: 660076 - RNA, 27 nt, Human
uggacagacacauaguauccagcacca

SEQ ID NO: 660077 - RNA, 20 nt, Human
uggccuguggcucuucaauc

SEQ ID NO: 660078 - RNA, 18 nt, Human
ugggauuacaggcaugag

SEQ ID NO: 660079 - RNA, 19 nt, Human
ugggauuacaggcaugagc

SEQ ID NO: 660080 - RNA, 22 nt, Human
ugggauuacaggcaugagccac

SEQ ID NO: 660081 - RNA, 23 nt, Human
ugggauuacaggcaugagccacc

SEQ ID NO: 660082 - RNA, 24 nt, Human
ugggauuacaggcaugagccacca

SEQ ID NO: 660083 - RNA, 24 nt, Human
ugggauuacaggcaugagccacca

SEQ ID NO: 660084 - RNA, 24 nt, Human
ugggcucaagcaguucucccgccu

SEQ ID NO: 660085 - RNA, 24 nt, Human
uuacuuuucaauugaaaaacaaaa

SEQ ID NO: 660086 - RNA, 26 nt, Human
uugaaaaacaaaacagacagaagaaa

SEQ ID NO: 660087 - RNA, 22 nt, Human
uuuaacacuugguacacauaua

SEQ ID NO: 660088 - RNA, 22 nt, Human
uuuuuuuuuuuuuuuuccauuu

SEQ ID NO: 660089 - RNA, 20 nt, Human
aaaaaaagaaacuuccucac

SEQ ID NO: 660090 - RNA, 24 nt, Human
aaaauaucuccuugcuuacgagga

SEQ ID NO: 660091 - RNA, 24 nt, Human
aaagugcugggauuacaggcauga

SEQ ID NO: 660092 - RNA, 24 nt, Human
aaagugcugggauuacaggcauga

SEQ ID NO: 660093 - RNA, 22 nt, Human
aaagugcugggauuagguguga

SEQ ID NO: 660094 - RNA, 23 nt, Human
aaauaccuuacucuaacauccuc

SEQ ID NO: 660095 - RNA, 19 nt, Human
aacaacaacaaaaaaaggg

SEQ ID NO: 660096 - RNA, 20 nt, Human
aacaacauaaacuggaucua

SEQ ID NO: 660097 - RNA, 23 nt, Human
aagcuauucacaacccuuucuca

SEQ ID NO: 660098 - RNA, 24 nt, Human
aagcuauucacaacccuuucucag

SEQ ID NO: 660099 - RNA, 19 nt, Human
aaguagcugggauuacagg

SEQ ID NO: 660100 - RNA, 25 nt, Human
aaguagcugggauuacaggcgcccg

SEQ ID NO: 660101 - RNA, 19 nt, Human
aagugcugggauuacaggc

SEQ ID NO: 660102 - RNA, 19 nt, Human
aagugcugggauuacaggc

SEQ ID NO: 660103 - RNA, 21 nt, Human
aagugcugggauuacaggcau

SEQ ID NO: 660104 - RNA, 21 nt, Human
aagugcugggauuacaggcau

SEQ ID NO: 660105 - RNA, 26 nt, Human
aagugcugggauuacaggcaugagcc

SEQ ID NO: 660106 - RNA, 26 nt, Human
aagugcugggauuacaggcaugagcc

SEQ ID NO: 660107 - RNA, 24 nt, Human
aagugcugggauuaggugugagcc

SEQ ID NO: 660108 - RNA, 19 nt, Human
aaugauacaugggaguuca

SEQ ID NO: 660109 - RNA, 21 nt, Human
aauggcaccgucucagcucac

SEQ ID NO: 660110 - RNA, 23 nt, Human
aauucuuuuuaaggcccuucuac

SEQ ID NO: 660111 - RNA, 25 nt, Human
acaacaacaaaaaaagggauaaaga

SEQ ID NO: 660112 - RNA, 21 nt, Human
acaacaccccaaauguagaac

SEQ ID NO: 660113 - RNA, 24 nt, Human
acaguguuucaccauguuggucag

SEQ ID NO: 660114 - RNA, 20 nt, Human
acauuggccaggcuggucuu

SEQ ID NO: 660115 - RNA, 20 nt, Human
accacaaccuccacuucuca

SEQ ID NO: 660116 - RNA, 24 nt, Human
accauguuggucaggcuggucucg

SEQ ID NO: 660117 - RNA, 24 nt, Human
acccaggcuaaagugcaguggcau

SEQ ID NO: 660118 - RNA, 19 nt, Human
accugaaaucuuuaaaaaa

SEQ ID NO: 660119 - RNA, 18 nt, Human
agaaggaagggaagacca

SEQ ID NO: 660120 - RNA, 24 nt, Human
agcgauuccccugccucagccucc

SEQ ID NO: 660121 - RNA, 20 nt, Human
aggcaugagccaccgugccu

SEQ ID NO: 660122 - RNA, 23 nt, Human
aggcaugagccaccgugccuggc

SEQ ID NO: 660123 - RNA, 24 nt, Human
aggcuaaagugcaguggcaugauc

SEQ ID NO: 660124 - RNA, 23 nt, Human
aggggauguucacuaaggucaca

SEQ ID NO: 660125 - RNA, 24 nt, Human
aggugauccacccaccucagccuc

SEQ ID NO: 660126 - RNA, 21 nt, Human
aggugugagccacugugccca

SEQ ID NO: 660127 - RNA, 19 nt, Human
aguagcugggauuacaggc

SEQ ID NO: 660128 - RNA, 19 nt, Human
agugcaguggcaugaucuc

SEQ ID NO: 660129 - RNA, 21 nt, Human
agugcaguggcaugaucucag

SEQ ID NO: 660130 - RNA, 23 nt, Human
agugcaguggcaugaucucagcu

SEQ ID NO: 660131 - RNA, 18 nt, Human
agugcugggauuacaggc

SEQ ID NO: 660132 - RNA, 18 nt, Human
agugcugggauuacaggc

SEQ ID NO: 660133 - RNA, 23 nt, Human
aguguuucaccauguuggucagg

SEQ ID NO: 660134 - RNA, 19 nt, Human
auccaccugccucggccuc

SEQ ID NO: 660135 - RNA, 21 nt, Human
auccuccugccucagccuccc

SEQ ID NO: 660136 - RNA, 20 nt, Human
aucuuauacacauccugagu

SEQ ID NO: 660137 - RNA, 22 nt, Human
augagccaccguacccagccca

SEQ ID NO: 660138 - RNA, 20 nt, Human
auggaguuucaccacauugg

SEQ ID NO: 660139 - RNA, 24 nt, Human
auggaguuucaccacauuggccag

SEQ ID NO: 660140 - RNA, 24 nt, Human
auuuuuguguuuuuaguagagaca

SEQ ID NO: 660141 - RNA, 24 nt, Human
caaagugcugggauuacaggcaug

SEQ ID NO: 660142 - RNA, 24 nt, Human
caaagugcugggauuacaggcaug

SEQ ID NO: 660143 - RNA, 24 nt, Human
caacaccccaaauguagaacugag

SEQ ID NO: 660144 - RNA, 22 nt, Human
caacagguuuccuuagugaccu

SEQ ID NO: 660145 - RNA, 22 nt, Human
caagcaauucuccugccucagc

SEQ ID NO: 660146 - RNA, 27 nt, Human
caagcaauucuccugccucagccuccc

SEQ ID NO: 660147 - RNA, 22 nt, Human
caagcuauccuccugccucagc

SEQ ID NO: 660148 - RNA, 21 nt, Human
caauaaaaauggcauugaaua

SEQ ID NO: 660149 - RNA, 23 nt, Human
cacauuggccaggcuggucuugg

SEQ ID NO: 660150 - RNA, 24 nt, Human
caccaagaccagcuaauuuuugua

SEQ ID NO: 660151 - RNA, 21 nt, Human
caccacauuggccaggcuggu

SEQ ID NO: 660152 - RNA, 24 nt, Human
caccacauuggccaggcuggucuu

SEQ ID NO: 660153 - RNA, 31 nt, Human
caccacauuggccaggcuggucuuggacucc

SEQ ID NO: 660154 - RNA, 23 nt, Human
caccaugcucagcuaauuuuugu

SEQ ID NO: 660155 - RNA, 21 nt, Human
caccauguuggucaggcuggu

SEQ ID NO: 660156 - RNA, 24 nt, Human
caccauguuggucaggcuggucuc

SEQ ID NO: 660157 - RNA, 22 nt, Human
cacccaccucagccucccaaag

SEQ ID NO: 660158 - RNA, 23 nt, Human
cacccaccucagccucccaaagu

SEQ ID NO: 660159 - RNA, 23 nt, Human
cacccaggcuaaagugcaguggc

SEQ ID NO: 660160 - RNA, 24 nt, Human
caccucagccucccaaagugcugg

SEQ ID NO: 660161 - RNA, 23 nt, Human
caccugccucggccucccaaagu

SEQ ID NO: 660162 - RNA, 20 nt, Human
cacuaaggucacagcaaagu

SEQ ID NO: 660163 - RNA, 19 nt, Human
cacucuggaaaagugaagu

SEQ ID NO: 660164 - RNA, 20 nt, Human
cacucuggaaaagugaagua

SEQ ID NO: 660165 - RNA, 23 nt, Human
cacugcaaccucugcuuccuggg

SEQ ID NO: 660166 - RNA, 22 nt, Human
cagagagugaaacuguguuaca

SEQ ID NO: 660167 - RNA, 20 nt, Human
cagccucaagcuauccuccu

SEQ ID NO: 660168 - RNA, 20 nt, Human
cagccuccugaguagcuggg

SEQ ID NO: 660169 - RNA, 21 nt, Human
cagguucaagcgauuccccug

SEQ ID NO: 660170 - RNA, 18 nt, Human
cagugguuguagacuuca

SEQ ID NO: 660171 - RNA, 24 nt, Human
caguguuucaccauguuggucagg

SEQ ID NO: 660172 - RNA, 23 nt, Human
caguuggacccuuaucucaaauc

SEQ ID NO: 660173 - RNA, 23 nt, Human
ccaaaccuaagcuauucacaacc

SEQ ID NO: 660174 - RNA, 23 nt, Human
ccaaagugcugggauuacaggca

SEQ ID NO: 660175 - RNA, 23 nt, Human
ccaaagugcugggauuacaggca

SEQ ID NO: 660176 - RNA, 24 nt, Human
ccaaagugcugggauuacaggcau

SEQ ID NO: 660177 - RNA, 24 nt, Human
ccaaagugcugggauuacaggcau

SEQ ID NO: 660178 - RNA, 19 nt, Human
ccaaagugcugggauuagg

SEQ ID NO: 660179 - RNA, 21 nt, Human
ccaaagugcugggauuaggug

SEQ ID NO: 660180 - RNA, 22 nt, Human
ccaaagugcugggauuaggugu

SEQ ID NO: 660181 - RNA, 22 nt, Human
ccaaguagcugggauuacaggc

SEQ ID NO: 660182 - RNA, 18 nt, Human
ccacaaccuccacuucuc

SEQ ID NO: 660183 - RNA, 24 nt, Human
ccacaaccuccacuucucagguuc

SEQ ID NO: 660184 - RNA, 26 nt, Human
ccacccaccucagccucccaaagugc

SEQ ID NO: 660185 - RNA, 24 nt, Human
ccagaaagcaucuagccaaaccua

SEQ ID NO: 660186 - RNA, 21 nt, Human
ccauuuaaaaaaaaaaaagaa

SEQ ID NO: 660187 - RNA, 22 nt, Human
ccauuuaaaaaaaaaaaagaaa

SEQ ID NO: 660188 - RNA, 24 nt, Human
cccaaagugcugggauuacaggca

SEQ ID NO: 660189 - RNA, 24 nt, Human
cccaaagugcugggauuacaggca

SEQ ID NO: 660190 - RNA, 23 nt, Human
cccaaguagcugggauuacaggc

SEQ ID NO: 660191 - RNA, 23 nt, Human
cccaaguagcugggauuacaggc

SEQ ID NO: 660192 - RNA, 22 nt, Human
cccuucuacaacaccccaaaug

SEQ ID NO: 660193 - RNA, 18 nt, Human
ccucaagaggggauguuc

SEQ ID NO: 660194 - RNA, 19 nt, Human
ccugaaaucuuuaaaaaaa

SEQ ID NO: 660195 - RNA, 21 nt, Human
ccugaccucacgugauccacc

SEQ ID NO: 660196 - RNA, 23 nt, Human
ccugaccucacgugauccaccug

SEQ ID NO: 660197 - RNA, 24 nt, Human
ccugaccucaggugauccacccac

SEQ ID NO: 660198 - RNA, 23 nt, Human
ccugaguagcugggauuacaggc

SEQ ID NO: 660199 - RNA, 24 nt, Human
ccugaguagcugggauuacaggcg

SEQ ID NO: 660200 - RNA, 23 nt, Human
ccuggguucaagcaauucuccug

SEQ ID NO: 660201 - RNA, 18 nt, Human
ccuugcuuacgaggacaa

SEQ ID NO: 660202 - RNA, 21 nt, Human
cgacagaaggaagggaagacc

SEQ ID NO: 660203 - RNA, 22 nt, Human
cgcccaggcuggagagcaaugg

SEQ ID NO: 660204 - RNA, 24 nt, Human
cgcucugucacccaggcuaaagug

SEQ ID NO: 660205 - RNA, 25 nt, Human
cuaagcuauucacaacccuuucuca

SEQ ID NO: 660206 - RNA, 21 nt, Human
cucaagcuauccuccugccuc

SEQ ID NO: 660207 - RNA, 24 nt, Human
cucaccacaaccuccacuucucag

SEQ ID NO: 660208 - RNA, 24 nt, Human
cucacugcaaccucugcuuccugg

SEQ ID NO: 660209 - RNA, 24 nt, Human
cucagccucccaaguagcugggau

SEQ ID NO: 660210 - RNA, 24 nt, Human
cucagccuccugaguagcugggau

SEQ ID NO: 660211 - RNA, 20 nt, Human
cucagguucaagcgauuccc

SEQ ID NO: 660212 - RNA, 24 nt, Human
cuccaaaauuaauucaauaagaca

SEQ ID NO: 660213 - RNA, 20 nt, Human
cucccuccuacauuucacuc

SEQ ID NO: 660214 - RNA, 19 nt, Human
cucuugucgcccaggcugg

SEQ ID NO: 660215 - RNA, 22 nt, Human
cugaguagcugggauuacaggc

SEQ ID NO: 660216 - RNA, 24 nt, Human
cugaguagcugggauuacaggcgu

SEQ ID NO: 660217 - RNA, 23 nt, Human
cugcaaccucugcuuccuggguu

SEQ ID NO: 660218 - RNA, 24 nt, Human
cugcaaccucugcuuccuggguuc

SEQ ID NO: 660219 - RNA, 23 nt, Human
cugccucagccucccaaagugcu

SEQ ID NO: 660220 - RNA, 24 nt, Human
cugccucagccucccaaagugcug

SEQ ID NO: 660221 - RNA, 23 nt, Human
cugccucagccucccaaguagcu

SEQ ID NO: 660222 - RNA, 23 nt, Human
cugccucagccuccugaguagcu

SEQ ID NO: 660223 - RNA, 23 nt, Human
cugccucggccucccaaagugcu

SEQ ID NO: 660224 - RNA, 24 nt, Human
cuuccuggguucaagcaauucucc

SEQ ID NO: 660225 - RNA, 22 nt, Human
cuucucagguucaagcgauucc

SEQ ID NO: 660226 - RNA, 18 nt, Human
cuugguuaaaacaacaac

SEQ ID NO: 660227 - RNA, 20 nt, Human
cuugucgcccaggcuggaga

SEQ ID NO: 660228 - RNA, 18 nt, Human
cuuucucagucucuacua

SEQ ID NO: 660229 - RNA, 24 nt, Human
gaccucacgugauccaccugccuc

SEQ ID NO: 660230 - RNA, 24 nt, Human
gaccucacgugauccaccugccuc

SEQ ID NO: 660231 - RNA, 26 nt, Human
gaccucacgugauccaccugccucgg

SEQ ID NO: 660232 - RNA, 24 nt, Human
gaccucaggugauccacccaccuc

SEQ ID NO: 660233 - RNA, 20 nt, Human
gaguagcugggauuacaggc

SEQ ID NO: 660234 - RNA, 24 nt, Human
gaguagcugggauuacaggcguga

SEQ ID NO: 660235 - RNA, 27 nt, Human
gaguagcugggauuacaggcgugagcc

SEQ ID NO: 660236 - RNA, 18 nt, Human
gauuacaggcaugagcca

SEQ ID NO: 660237 - RNA, 18 nt, Human
gauuacaggcaugagcca

SEQ ID NO: 660238 - RNA, 21 nt, Human
gauuacaggcaugagccaccg

SEQ ID NO: 660239 - RNA, 21 nt, Human
gauuacaggcaugagccaccg

SEQ ID NO: 660240 - RNA, 24 nt, Human
gauuacaggcaugagccaccguac

SEQ ID NO: 660241 - RNA, 24 nt, Human
gauuacaggcaugagccaccgugc

SEQ ID NO: 660242 - RNA, 18 nt, Human
gauuacaggcgcccgcca

SEQ ID NO: 660243 - RNA, 18 nt, Human
gauuacaggcgugagcca

SEQ ID NO: 660244 - RNA, 21 nt, Human
gauuacaggcgugagccacca

SEQ ID NO: 660245 - RNA, 24 nt, Human
gauuacaggcgugagccaccaugc

SEQ ID NO: 660246 - RNA, 19 nt, Human
gauuaggugugagccacug

SEQ ID NO: 660247 - RNA, 23 nt, Human
gccuaaguuaugcuagauucuga

SEQ ID NO: 660248 - RNA, 20 nt, Human
gccucagccucccaaguagc

SEQ ID NO: 660249 - RNA, 23 nt, Human
gcgauuccccugccucagccucc

SEQ ID NO: 660250 - RNA, 18 nt, Human
gcgcccgccaccaagacc

SEQ ID NO: 660251 - RNA, 19 nt, Human
gcuaaagugcaguggcaug

SEQ ID NO: 660252 - RNA, 18 nt, Human
gcuacacuacaauagguu

SEQ ID NO: 660253 - RNA, 25 nt, Human
gcucugucacccaggcuaaagugca

SEQ ID NO: 660254 - RNA, 23 nt, Human
gcuggucucgaacuccugaccuc

SEQ ID NO: 660255 - RNA, 23 nt, Human
gcuggucuuggacuccugaccuc

SEQ ID NO: 660256 - RNA, 23 nt, Human
gcugguuuugaacucccagccuc

SEQ ID NO: 660257 - RNA, 22 nt, Human
ggaguuucaccacauuggccag

SEQ ID NO: 660258 - RNA, 22 nt, Human
ggauuacaggcaugagccaccg

SEQ ID NO: 660259 - RNA, 24 nt, Human
ggauuacaggcaugagccaccgug

SEQ ID NO: 660260 - RNA, 24 nt, Human
ggauuacaggcgugagccaccaug

SEQ ID NO: 660261 - RNA, 24 nt, Human
ggcuggucucgaacuccugaccuc

SEQ ID NO: 660262 - RNA, 24 nt, Human
ggcuggucuuggacuccugaccuc

SEQ ID NO: 660263 - RNA, 24 nt, Human
ggcugguuuugaacucccagccuc

SEQ ID NO: 660264 - RNA, 21 nt, Human
gggauaaagaauauuuacugu

SEQ ID NO: 660265 - RNA, 18 nt, Human
gggauuaggugugagcca

SEQ ID NO: 660266 - RNA, 22 nt, Human
gggucuugcuauguugcccagg

SEQ ID NO: 660267 - RNA, 19 nt, Human
ggucucgaacuccugaccu

SEQ ID NO: 660268 - RNA, 18 nt, Human
guagagauggggucuugc

SEQ ID NO: 660269 - RNA, 18 nt, Human
guagcugggauuacaggc

SEQ ID NO: 660270 - RNA, 18 nt, Human
guagcugggauuacaggc

SEQ ID NO: 660271 - RNA, 24 nt, Human
guagcugggauuacaggcgugagc

SEQ ID NO: 660272 - RNA, 20 nt, Human
guauuuuuagaagagaugga

SEQ ID NO: 660273 - RNA, 24 nt, Human
gugauccacccaccucagccuccc

SEQ ID NO: 660274 - RNA, 24 nt, Human
gugauccaccugccucggccuccc

SEQ ID NO: 660275 - RNA, 25 nt, Human
uaaaaaaaaaaaagaaacuuccuca

SEQ ID NO: 660276 - RNA, 23 nt, Human
uaaaaaaauaggaaauacuaauc

SEQ ID NO: 660277 - RNA, 18 nt, Human
uaaaccaguuggacccuu

SEQ ID NO: 660278 - RNA, 22 nt, Human
uaaagaauauuuacuguguuuu

SEQ ID NO: 660279 - RNA, 23 nt, Human
uaaaguaacaaagguuugaaagg

SEQ ID NO: 660280 - RNA, 19 nt, Human
uaaagugcaguggcaugau

SEQ ID NO: 660281 - RNA, 23 nt, Human
uaaagugcaguggcaugaucuca

SEQ ID NO: 660282 - RNA, 20 nt, Human
uaaauuuuuagcuguacuua

SEQ ID NO: 660283 - RNA, 24 nt, Human
uaauuuuuguauuuuuagaagaga

SEQ ID NO: 660284 - RNA, 24 nt, Human
uaauuuuuguguuuuuaguagaga

SEQ ID NO: 660285 - RNA, 23 nt, Human
uacaacaccccaaauguagaacu

SEQ ID NO: 660286 - RNA, 24 nt, Human
uacaggcaugagccaccguaccca

SEQ ID NO: 660287 - RNA, 22 nt, Human
uacaggcaugagccaccgugcc

SEQ ID NO: 660288 - RNA, 20 nt, Human
uacaggcgcccgccaccaag

SEQ ID NO: 660289 - RNA, 18 nt, Human
uacaggcgugagccacca

SEQ ID NO: 660290 - RNA, 22 nt, Human
uacaggcgugagccaccaugcu

SEQ ID NO: 660291 - RNA, 19 nt, Human
uacauuucacucuggaaaa

SEQ ID NO: 660292 - RNA, 24 nt, Human
uagaagagauggaguuucaccaca

SEQ ID NO: 660293 - RNA, 20 nt, Human
uagaaugugcucccuccuac

SEQ ID NO: 660294 - RNA, 22 nt, Human
uagagacaguguuucaccaugu

SEQ ID NO: 660295 - RNA, 22 nt, Human
uagagauggggucuugcuaugu

SEQ ID NO: 660296 - RNA, 26 nt, Human
uaggaaauacuaaucaguuuaaccau

SEQ ID NO: 660297 - RNA, 24 nt, Human
uaguagagacaguguuucaccaug

SEQ ID NO: 660298 - RNA, 23 nt, Human
uauguugcccaggcugguuuuga

SEQ ID NO: 660299 - RNA, 24 nt, Human
uauguugcccaggcugguuuugaa

SEQ ID NO: 660300 - RNA, 23 nt, Human
uauuuuuagaagagauggaguuu

SEQ ID NO: 660301 - RNA, 19 nt, Human
ucaagcaauucuccugccu

SEQ ID NO: 660302 - RNA, 24 nt, Human
ucaccacaaccuccacuucucagg

SEQ ID NO: 660303 - RNA, 26 nt, Human
ucacuaaggucacagcaaaguugcac

SEQ ID NO: 660304 - RNA, 24 nt, Human
ucacugcaaccucugcuuccuggg

SEQ ID NO: 660305 - RNA, 18 nt, Human
ucagccucccaaagugcu

SEQ ID NO: 660306 - RNA, 20 nt, Human
ucagccucccaaguagcugg

SEQ ID NO: 660307 - RNA, 20 nt, Human
ucagccuccugaguagcugg

SEQ ID NO: 660308 - RNA, 27 nt, Human
ucagcucaccacaaccuccacuucuca

SEQ ID NO: 660309 - RNA, 20 nt, Human
ucaggugauccacccaccuc

SEQ ID NO: 660310 - RNA, 21 nt, Human
uccacccaccucagccuccca

SEQ ID NO: 660311 - RNA, 24 nt, Human
ucccaaagugcugggauuacaggc

SEQ ID NO: 660312 - RNA, 24 nt, Human
ucccaaagugcugggauuacaggc

SEQ ID NO: 660313 - RNA, 21 nt, Human
ucccaaagugcugggauuagg

SEQ ID NO: 660314 - RNA, 24 nt, Human
ucccaaguagcugggauuacaggc

SEQ ID NO: 660315 - RNA, 24 nt, Human
uccccugccucagccuccugagua

SEQ ID NO: 660316 - RNA, 18 nt, Human
uccuaaguuuaccaaacc

SEQ ID NO: 660317 - RNA, 27 nt, Human
uccuccugccucagccucccaaagugc

SEQ ID NO: 660318 - RNA, 24 nt, Human
uccugaguagcugggauuacaggc

SEQ ID NO: 660319 - RNA, 20 nt, Human
uccuggguucaagcaauucu

SEQ ID NO: 660320 - RNA, 21 nt, Human
uccuggguucaagcaauucuc

SEQ ID NO: 660321 - RNA, 24 nt, Human
uccuggguucaagcaauucuccug

SEQ ID NO: 660322 - RNA, 18 nt, Human
ucgcccaggcuggagagc

SEQ ID NO: 660323 - RNA, 22 nt, Human
ucgcucuugucgcccaggcugg

SEQ ID NO: 660324 - RNA, 23 nt, Human
ucgcucuugucgcccaggcugga

SEQ ID NO: 660325 - RNA, 18 nt, Human
ucggccucccaaagugcu

SEQ ID NO: 660326 - RNA, 19 nt, Human
ucucagguucaagcgauuc

SEQ ID NO: 660327 - RNA, 24 nt, Human
ucucagguucaagcgauuccccug

SEQ ID NO: 660328 - RNA, 26 nt, Human
ucuccugccucagccucccaaguagc

SEQ ID NO: 660329 - RNA, 21 nt, Human
ucucgaacuccugaccucacg

SEQ ID NO: 660330 - RNA, 19 nt, Human
ucucgcucugucacccagg

SEQ ID NO: 660331 - RNA, 23 nt, Human
ucucgcucugucacccaggcuaa

SEQ ID NO: 660332 - RNA, 26 nt, Human
ucucgcucugucacccaggcuaaagu

SEQ ID NO: 660333 - RNA, 27 nt, Human
ucucgcucugucacccaggcuaaagug

SEQ ID NO: 660334 - RNA, 18 nt, Human
ucuggcuuauacccagaa

SEQ ID NO: 660335 - RNA, 24 nt, Human
ucugucacccaggcuaaagugcag

SEQ ID NO: 660336 - RNA, 18 nt, Human
ucuugcuauguugcccag

SEQ ID NO: 660337 - RNA, 19 nt, Human
ucuugcuauguugcccagg

SEQ ID NO: 660338 - RNA, 23 nt, Human
ucuugcuauguugcccaggcugg

SEQ ID NO: 660339 - RNA, 24 nt, Human
ucuugcuauguugcccaggcuggu

SEQ ID NO: 660340 - RNA, 23 nt, Human
ucuuggacuccugaccucaggug

SEQ ID NO: 660341 - RNA, 19 nt, Human
ucuugguuaaaacaacaac

SEQ ID NO: 660342 - RNA, 24 nt, Human
ugaccucacgugauccaccugccu

SEQ ID NO: 660343 - RNA, 21 nt, Human
ugaccucaggugauccaccca

SEQ ID NO: 660344 - RNA, 24 nt, Human
ugaccucaggugauccacccaccu

SEQ ID NO: 660345 - RNA, 18 nt, Human
ugagacagagucucgcuc

SEQ ID NO: 660346 - RNA, 22 nt, Human
ugagacagagucucgcucuguc

SEQ ID NO: 660347 - RNA, 24 nt, Human
ugauccacccaccucagccuccca

SEQ ID NO: 660348 - RNA, 19 nt, Human
ugcaaccucugcuuccugg

SEQ ID NO: 660349 - RNA, 22 nt, Human
ugcaguggcaugaucucagcuc

SEQ ID NO: 660350 - RNA, 21 nt, Human
ugcccaggcugguuuugaacu

SEQ ID NO: 660351 - RNA, 24 nt, Human
ugccucagccucccaaagugcugg

SEQ ID NO: 660352 - RNA, 24 nt, Human
ugccucagccucccaaguagcugg

SEQ ID NO: 660353 - RNA, 24 nt, Human
ugccucagccuccugaguagcugg

SEQ ID NO: 660354 - RNA, 21 nt, Human
ugccucggccucccaaagugc

SEQ ID NO: 660355 - RNA, 24 nt, Human
ugccucggccucccaaagugcugg

SEQ ID NO: 660356 - RNA, 31 nt, Human
ugcuauguugcccaggcugguuuugaacucc

SEQ ID NO: 660357 - RNA, 24 nt, Human
uggaguuucaccacauuggccagg

SEQ ID NO: 660358 - RNA, 21 nt, Human
uggaucuauaucucgaaacua

SEQ ID NO: 660359 - RNA, 24 nt, Human
uggcaccgucucagcucacugcaa

SEQ ID NO: 660360 - RNA, 24 nt, Human
uggcaugaucucagcucaccacaa

SEQ ID NO: 660361 - RNA, 24 nt, Human
uggccaggcuggucuuggacuccu

SEQ ID NO: 660362 - RNA, 18 nt, Human
ugggauuacaggcaugag

SEQ ID NO: 660363 - RNA, 18 nt, Human
ugggauuacaggcaugag

SEQ ID NO: 660364 - RNA, 21 nt, Human
ugggauuacaggcaugagcca

SEQ ID NO: 660365 - RNA, 21 nt, Human
ugggauuacaggcaugagcca

SEQ ID NO: 660366 - RNA, 22 nt, Human
ugggauuacaggcaugagccac

SEQ ID NO: 660367 - RNA, 22 nt, Human
ugggauuacaggcaugagccac

SEQ ID NO: 660368 - RNA, 23 nt, Human
ugggauuacaggcaugagccacc

SEQ ID NO: 660369 - RNA, 23 nt, Human
ugggauuacaggcaugagccacc

SEQ ID NO: 660370 - RNA, 23 nt, Human
ugggauuacaggcaugagccacc

SEQ ID NO: 660371 - RNA, 23 nt, Human
ugggauuacaggcaugagccacc

SEQ ID NO: 660372 - RNA, 24 nt, Human
ugggauuacaggcaugagccaccg

SEQ ID NO: 660373 - RNA, 24 nt, Human
ugggauuacaggcaugagccaccg

SEQ ID NO: 660374 - RNA, 26 nt, Human
ugggauuacaggcaugagccaccgua

SEQ ID NO: 660375 - RNA, 21 nt, Human
ugggauuacaggcgcccgcca

SEQ ID NO: 660376 - RNA, 22 nt, Human
ugggauuacaggcgcccgccac

SEQ ID NO: 660377 - RNA, 24 nt, Human
ugggauuacaggcgcccgccacca

SEQ ID NO: 660378 - RNA, 18 nt, Human
ugggauuacaggcgugag

SEQ ID NO: 660379 - RNA, 22 nt, Human
ugggauuacaggcgugagccac

SEQ ID NO: 660380 - RNA, 23 nt, Human
ugggauuacaggcgugagccacc

SEQ ID NO: 660381 - RNA, 24 nt, Human
ugggauuacaggcgugagccacca

SEQ ID NO: 660382 - RNA, 25 nt, Human
ugggauuacaggcgugagccaccau

SEQ ID NO: 660383 - RNA, 20 nt, Human
ugggauuaggugugagccac

SEQ ID NO: 660384 - RNA, 20 nt, Human
ugggauuaggugugagccac

SEQ ID NO: 660385 - RNA, 22 nt, Human
ugggauuaggugugagccacug

SEQ ID NO: 660386 - RNA, 24 nt, Human
uggggucuugcuauguugcccagg

SEQ ID NO: 660387 - RNA, 21 nt, Human
uggguucaagcaauucuccug

SEQ ID NO: 660388 - RNA, 23 nt, Human
uggguucaagcaauucuccugcc

SEQ ID NO: 660389 - RNA, 24 nt, Human
uggguucaagcaauucuccugccu

SEQ ID NO: 660390 - RNA, 24 nt, Human
ugguagagauggggucuugcuaug

SEQ ID NO: 660391 - RNA, 24 nt, Human
uggucaggcuggucucgaacuccu

SEQ ID NO: 660392 - RNA, 18 nt, Human
uuagaagagauggaguuu

SEQ ID NO: 660393 - RNA, 24 nt, Human
uuaguagagacaguguuucaccau

SEQ ID NO: 660394 - RNA, 20 nt, Human
uuauggucuuuucaauaacu

SEQ ID NO: 660395 - RNA, 21 nt, Human
uucaagcaauucuccugccuc

SEQ ID NO: 660396 - RNA, 24 nt, Human
uucaagcaauucuccugccucagc

SEQ ID NO: 660397 - RNA, 21 nt, Human
uucaagcgauuccccugccuc

SEQ ID NO: 660398 - RNA, 23 nt, Human
uucaagcgauuccccugccucag

SEQ ID NO: 660399 - RNA, 24 nt, Human
uucaagcgauuccccugccucagc

SEQ ID NO: 660400 - RNA, 19 nt, Human
uuccccugccucagccucc

SEQ ID NO: 660401 - RNA, 24 nt, Human
uucgcucuugucgcccaggcugga

SEQ ID NO: 660402 - RNA, 20 nt, Human
uugcacuauacgacucuggc

SEQ ID NO: 660403 - RNA, 24 nt, Human
uugguagagauggggucuugcuau

SEQ ID NO: 660404 - RNA, 24 nt, Human
uuucaccauguuggucaggcuggu

SEQ ID NO: 660405 - RNA, 24 nt, Human
uuucgcucuugucgcccaggcugg

SEQ ID NO: 660406 - RNA, 18 nt, Human
uuuucuuuuuuuuuuuug

SEQ ID NO: 660407 - RNA, 24 nt, Human
uuuuuagaagagauggaguuucac

SEQ ID NO: 660408 - RNA, 24 nt, Human
uuuuuaguagagacaguguuucac

SEQ ID NO: 660409 - RNA, 24 nt, Human
uuuuugguagagauggggucuugc

SEQ ID NO: 660410 - RNA, 20 nt, Human
uuuuuguauuuuuagaagag

SEQ ID NO: 660411 - RNA, 23 nt, Human
uuuuuguauuuuuagaagagaug

SEQ ID NO: 660412 - RNA, 20 nt, Human
uuuuuguguuuuuaguagag

SEQ ID NO: 660413 - RNA, 22 nt, Human
uuuuuugguagagauggggucu

SEQ ID NO: 660414 - RNA, 25 nt, Human
uuuuuuuuuuuugagacagagucuc

SEQ ID NO: 660415 - RNA, 25 nt, Human
uuuuuuuuuuuugagacggaguuuc

SEQ ID NO: 660416 - RNA, 18 nt, Human
uuuuuuuuuuuuuuuuug

SEQ ID NO: 660417 - RNA, 21 nt, Human
uuuuuuuuuuuuuuuuuuaca

SEQ ID NO: 660418 - RNA, 24 nt, Human
acagcugcugaaagcaucucacau

SEQ ID NO: 660419 - RNA, 19 nt, Human
acuggggagagaagagagg

SEQ ID NO: 660420 - RNA, 21 nt, Human
agaggaaauuaagaccccuag

SEQ ID NO: 660421 - RNA, 22 nt, Human
agcuguugggcugaacagagac

SEQ ID NO: 660422 - RNA, 19 nt, Human
aggaaauuaagaccccuag

SEQ ID NO: 660423 - RNA, 19 nt, Human
aggcaguuccagagcuggg

SEQ ID NO: 660424 - RNA, 19 nt, Human
agggacuggggagagaaga

SEQ ID NO: 660425 - RNA, 19 nt, Human
caacacagcugcugaaagc

SEQ ID NO: 660426 - RNA, 18 nt, Human
cacauugcuuagacugcu

SEQ ID NO: 660427 - RNA, 18 nt, Human
caccuccaccugcggccc

SEQ ID NO: 660428 - RNA, 20 nt, Human
cagaauccuucuguguccuc

SEQ ID NO: 660429 - RNA, 27 nt, Human
caucaaaagagaggaaauuaagacccc

SEQ ID NO: 660430 - RNA, 23 nt, Human
ccaacaccuccaccugcggccca

SEQ ID NO: 660431 - RNA, 25 nt, Human
ccaacaccuccaccugcggcccaca

SEQ ID NO: 660432 - RNA, 25 nt, Human
cccaacaccuccaccugcggcccac

SEQ ID NO: 660433 - RNA, 21 nt, Human
ccuccaccugcggcccacaca

SEQ ID NO: 660434 - RNA, 22 nt, Human
cguuacagaaccccggccaggg

SEQ ID NO: 660435 - RNA, 19 nt, Human
cucacagggaaucucccca

SEQ ID NO: 660436 - RNA, 20 nt, Human
cuccgcgcuuucccaacacc

SEQ ID NO: 660437 - RNA, 19 nt, Human
cuccugccccagcaaaggc

SEQ ID NO: 660438 - RNA, 19 nt, Human
cuuucccaacaccuccacc

SEQ ID NO: 660439 - RNA, 22 nt, Human
gcggguaagguucagccuccag

SEQ ID NO: 660440 - RNA, 19 nt, Human
gcuccugccccagcaaagg

SEQ ID NO: 660441 - RNA, 18 nt, Human
gggcauuggccuaagacu

SEQ ID NO: 660442 - RNA, 21 nt, Human
gggcauuggccuaagacuuuu

SEQ ID NO: 660443 - RNA, 19 nt, Human
uaaaugguaaacgcaguau

SEQ ID NO: 660444 - RNA, 21 nt, Human
uaaaugguaaacgcaguauga

SEQ ID NO: 660445 - RNA, 18 nt, Human
uaggagcagauggcuccu

SEQ ID NO: 660446 - RNA, 24 nt, Human
uauaguaagucgggggcauuggcc

SEQ ID NO: 660447 - RNA, 20 nt, Human
ucagccuccaggggaaggcu

SEQ ID NO: 660448 - RNA, 19 nt, Human
uccaccugcggcccacaca

SEQ ID NO: 660449 - RNA, 23 nt, Human
ucccaacaccuccaccugcggcc

SEQ ID NO: 660450 - RNA, 22 nt, Human
ucccaauggcugcucccagagu

SEQ ID NO: 660451 - RNA, 23 nt, Human
ucccagaguuccacucuagggug

SEQ ID NO: 660452 - RNA, 21 nt, Human
ugaaagcaucucacauacuug

SEQ ID NO: 660453 - RNA, 23 nt, Human
ugaaagcaucucacauacuuggc

SEQ ID NO: 660454 - RNA, 22 nt, Human
ugagaccacucacaacaccuuu

SEQ ID NO: 660455 - RNA, 22 nt, Human
ugcaacacagcugcugaaagca

SEQ ID NO: 660456 - RNA, 21 nt, Human
ugccagaugguaggagcagau

SEQ ID NO: 660457 - RNA, 27 nt, Human
ugcuaguuccccaccauuaccaagugg

SEQ ID NO: 660458 - RNA, 19 nt, Human
uggcugcucccagaguucc

SEQ ID NO: 660459 - RNA, 30 nt, Human
uggggagagaagagaggucugcccgucacc

SEQ ID NO: 660460 - RNA, 28 nt, Human
uucacuucuuacugaugguuccggaucg

SEQ ID NO: 660461 - RNA, 21 nt, Human
uuccacucuagggugagcugu

SEQ ID NO: 660462 - RNA, 18 nt, Human
uuuuuuuuuuuuuuuuug

SEQ ID NO: 660463 - RNA, 19 nt, Human
uuuuuuuuuuuuuuuuugg

SEQ ID NO: 660464 - RNA, 23 nt, Human
aagaagaaaggaagucaaaugga

SEQ ID NO: 660465 - RNA, 25 nt, Human
aagaagaaaggaagucaaaugggaa

SEQ ID NO: 660466 - RNA, 23 nt, Human
aagaaucaaugaauaauggauaa

SEQ ID NO: 660467 - RNA, 20 nt, Human
aagguaaagaaagccugaaa

SEQ ID NO: 660468 - RNA, 19 nt, Human
aaucggcuuccaugauguc

SEQ ID NO: 660469 - RNA, 19 nt, Human
aauggauaaacagugggag

SEQ ID NO: 660470 - RNA, 24 nt, Human
acuuacuccucccucuaucccuac

SEQ ID NO: 660471 - RNA, 18 nt, Human
acuucccuauccaccaac

SEQ ID NO: 660472 - RNA, 24 nt, Human
agcacaaaggaguuacagaaagaa

SEQ ID NO: 660473 - RNA, 22 nt, Human
agcacccagcuuguaaaguggc

SEQ ID NO: 660474 - RNA, 23 nt, Human
agcacuguuguggaaugccauuu

SEQ ID NO: 660475 - RNA, 21 nt, Human
agccagccccuuccgccuugg

SEQ ID NO: 660476 - RNA, 21 nt, Human
agccccuuccgccuuggcuuc

SEQ ID NO: 660477 - RNA, 19 nt, Human
aggagaaaagaaggaacua

SEQ ID NO: 660478 - RNA, 18 nt, Human
aggaugaagacaggaugg

SEQ ID NO: 660479 - RNA, 24 nt, Human
agguaaagaaagccugaaagaaga

SEQ ID NO: 660480 - RNA, 22 nt, Human
agucccuggggacagagcagcu

SEQ ID NO: 660481 - RNA, 19 nt, Human
augaaugaaugcuuacuga

SEQ ID NO: 660482 - RNA, 23 nt, Human
augacaugaagguaaagaaagcc

SEQ ID NO: 660483 - RNA, 23 nt, Human
auuuuaaaaauacauacaucuua

SEQ ID NO: 660484 - RNA, 22 nt, Human
caacgcucguucuaaagggaag

SEQ ID NO: 660485 - RNA, 22 nt, Human
caagaacaccaucugguagcuc

SEQ ID NO: 660486 - RNA, 24 nt, Human
caagccgagucuaucucuaaacuu

SEQ ID NO: 660487 - RNA, 25 nt, Human
cacugaacugugagucccuggggac

SEQ ID NO: 660488 - RNA, 20 nt, Human
cacuguaaucaaaacaaagc

SEQ ID NO: 660489 - RNA, 21 nt, Human
cagaacaugauuauaguagca

SEQ ID NO: 660490 - RNA, 20 nt, Human
cagagguguugguacuuucu

SEQ ID NO: 660491 - RNA, 18 nt, Human
cagauucaagaacaccau

SEQ ID NO: 660492 - RNA, 20 nt, Human
cagcauacaccauuccaccu

SEQ ID NO: 660493 - RNA, 20 nt, Human
cagugggagccuuggccaca

SEQ ID NO: 660494 - RNA, 30 nt, Human
ccacagaaucugucagccuuugcagagacc

SEQ ID NO: 660495 - RNA, 21 nt, Human
ccacucugcuuucuggcugaa

SEQ ID NO: 660496 - RNA, 19 nt, Human
ccacugcacauuagccagc

SEQ ID NO: 660497 - RNA, 20 nt, Human
ccagccccuuccgccuuggc

SEQ ID NO: 660498 - RNA, 19 nt, Human
ccaguaaguggcaggcagc

SEQ ID NO: 660499 - RNA, 20 nt, Human
cccacauuugaucaaacacc

SEQ ID NO: 660500 - RNA, 18 nt, Human
ccccagguacuccguggu

SEQ ID NO: 660501 - RNA, 18 nt, Human
cccuacuacaucuuucuu

SEQ ID NO: 660502 - RNA, 28 nt, Human
ccgaggccagugggacaccaaagugucc

SEQ ID NO: 660503 - RNA, 22 nt, Human
ccgcuuccuuuagcccugacuu

SEQ ID NO: 660504 - RNA, 25 nt, Human
ccuaaucacaaccauuucagucacu

SEQ ID NO: 660505 - RNA, 24 nt, Human
ccuauccaccaacagcauacacca

SEQ ID NO: 660506 - RNA, 21 nt, Human
ccuuuagcccugacuuacacu

SEQ ID NO: 660507 - RNA, 27 nt, Human
cgaggccagugggacaccaaagugucc

SEQ ID NO: 660508 - RNA, 20 nt, Human
cuauaaagaaaaaaagaauc

SEQ ID NO: 660509 - RNA, 19 nt, Human
cucagcagccaucucuucc

SEQ ID NO: 660510 - RNA, 19 nt, Human
cuccugagaguucuccgag

SEQ ID NO: 660511 - RNA, 19 nt, Human
cugagaguucuccgagcug

SEQ ID NO: 660512 - RNA, 21 nt, Human
cuggaaaaauugugcuagaag

SEQ ID NO: 660513 - RNA, 21 nt, Human
cuggaccgaggccagugggac

SEQ ID NO: 660514 - RNA, 26 nt, Human
cuguaaucaaaacaaagccggggucc

SEQ ID NO: 660515 - RNA, 21 nt, Human
cuuguaaaguggcaggcaggg

SEQ ID NO: 660516 - RNA, 20 nt, Human
gaaaccaauaaucuaaauaa

SEQ ID NO: 660517 - RNA, 18 nt, Human
gaacaugauuauaguagc

SEQ ID NO: 660518 - RNA, 22 nt, Human
gaaguaggagaaaagaaggaac

SEQ ID NO: 660519 - RNA, 25 nt, Human
gaauggggguuguaccagccacuuc

SEQ ID NO: 660520 - RNA, 22 nt, Human
gauaaacagugggagccuuggc

SEQ ID NO: 660521 - RNA, 25 nt, Human
gcuggggcuggaucaguucgucuuu

SEQ ID NO: 660522 - RNA, 18 nt, Human
ggaccgaggccaguggga

SEQ ID NO: 660523 - RNA, 21 nt, Human
ggccagugggacaccaaagug

SEQ ID NO: 660524 - RNA, 22 nt, Human
ggcucugugguucaucgcuagg

SEQ ID NO: 660525 - RNA, 24 nt, Human
gggaaguaggagaaaagaaggaac

SEQ ID NO: 660526 - RNA, 23 nt, Human
gggacaaaucucucugcuguugc

SEQ ID NO: 660527 - RNA, 24 nt, Human
gguaaagaaagccugaaagaagaa

SEQ ID NO: 660528 - RNA, 22 nt, Human
gucccuggggacagagcagcug

SEQ ID NO: 660529 - RNA, 19 nt, Human
gugagucccuggggacaga

SEQ ID NO: 660530 - RNA, 23 nt, Human
gugaugccacucugcuuucuggc

SEQ ID NO: 660531 - RNA, 25 nt, Human
uaaaaauacauacaucuuacacugu

SEQ ID NO: 660532 - RNA, 23 nt, Human
uaaagaaagccugaaagaagaaa

SEQ ID NO: 660533 - RNA, 20 nt, Human
uacugugcaggcaugaagau

SEQ ID NO: 660534 - RNA, 21 nt, Human
uacuugaggagagcacccagc

SEQ ID NO: 660535 - RNA, 25 nt, Human
uagaaacccauguucucaacccaac

SEQ ID NO: 660536 - RNA, 20 nt, Human
uagaacuccugacaguucac

SEQ ID NO: 660537 - RNA, 21 nt, Human
uagccagccccuuccgccuug

SEQ ID NO: 660538 - RNA, 18 nt, Human
uaguagcauggggaaaau

SEQ ID NO: 660539 - RNA, 18 nt, Human
ucaaaagcuucucuccug

SEQ ID NO: 660540 - RNA, 22 nt, Human
ucacugaggcuugcaugcccca

SEQ ID NO: 660541 - RNA, 21 nt, Human
ucagcagccaucucuuccucc

SEQ ID NO: 660542 - RNA, 22 nt, Human
ucauccccgcuccacugcacau

SEQ ID NO: 660543 - RNA, 20 nt, Human
ucauccuaagcaauuuuaaa

SEQ ID NO: 660544 - RNA, 20 nt, Human
uccaugaugucaugguccuc

SEQ ID NO: 660545 - RNA, 22 nt, Human
uccaugauuuuuccacgggcgg

SEQ ID NO: 660546 - RNA, 19 nt, Human
ucccccauuuuacagagag

SEQ ID NO: 660547 - RNA, 22 nt, Human
uccgagcuggggcuggaucagu

SEQ ID NO: 660548 - RNA, 21 nt, Human
uccuggguuucacuuugauuu

SEQ ID NO: 660549 - RNA, 22 nt, Human
ucucucugcuguugcuguuggc

SEQ ID NO: 660550 - RNA, 18 nt, Human
ucugucagccuuugcaga

SEQ ID NO: 660551 - RNA, 21 nt, Human
ucuguggccgccgggggugac

SEQ ID NO: 660552 - RNA, 21 nt, Human
ugaacaaaugacaugaaggua

SEQ ID NO: 660553 - RNA, 21 nt, Human
ugaagaugugaugccacucug

SEQ ID NO: 660554 - RNA, 21 nt, Human
ugcacugaacugugagucccu

SEQ ID NO: 660555 - RNA, 23 nt, Human
uggaaugccauuuagucuagaaa

SEQ ID NO: 660556 - RNA, 22 nt, Human
uggaggcucuccuccuggguuu

SEQ ID NO: 660557 - RNA, 23 nt, Human
uggcagguaggguuccugaaggc

SEQ ID NO: 660558 - RNA, 27 nt, Human
uggccacagaaucugucagccuuugca

SEQ ID NO: 660559 - RNA, 20 nt, Human
ugggacaccaaagugucccc

SEQ ID NO: 660560 - RNA, 22 nt, Human
ugucaccagcuggaauuuuccu

SEQ ID NO: 660561 - RNA, 19 nt, Human
ugugcuagaagacugugau

SEQ ID NO: 660562 - RNA, 22 nt, Human
ugugguccaggcccaagccagg

SEQ ID NO: 660563 - RNA, 23 nt, Human
uuaauccuuacaaauauguuguu

SEQ ID NO: 660564 - RNA, 25 nt, Human
uuacugaaauagaacaaggaaacca

SEQ ID NO: 660565 - RNA, 23 nt, Human
uuaggucgcuaaaauauacuuga

SEQ ID NO: 660566 - RNA, 24 nt, Human
uucaagaacaccaucugguagcuc

SEQ ID NO: 660567 - RNA, 18 nt, Human
uucuaaagggaaggacuc

SEQ ID NO: 660568 - RNA, 23 nt, Human
uugaugcuggugauggauguccc

SEQ ID NO: 660569 - RNA, 20 nt, Human
uuuaaaaauacauacaucuu

SEQ ID NO: 660570 - RNA, 20 nt, Human
uuugcagagacauaaacacc

SEQ ID NO: 660571 - RNA, 25 nt, Human
uuuucaaguuuacugaaauagaaca

SEQ ID NO: 660572 - RNA, 20 nt, Human
uuuuuuuuuuuuuugcuuuu

SEQ ID NO: 660573 - RNA, 27 nt, Human
uuuuuuuuuuuuuuuuuuuuuuugggg

SEQ ID NO: 660574 - RNA, 21 nt, Human
aaaaacaaaauuaaacaaaaa

SEQ ID NO: 660575 - RNA, 20 nt, Human
aaaacaaaauuaaacaaaaa

SEQ ID NO: 660576 - RNA, 19 nt, Human
aagaaguaugagcugaaau

SEQ ID NO: 660577 - RNA, 24 nt, Human
aauaaacaaaaagguaaaacuaag

SEQ ID NO: 660578 - RNA, 20 nt, Human
acagugggguaauuggauug

SEQ ID NO: 660579 - RNA, 21 nt, Human
acuuugggaaugaaugaggag

SEQ ID NO: 660580 - RNA, 20 nt, Human
agggauacuaaagguauaau

SEQ ID NO: 660581 - RNA, 24 nt, Human
auucaaaacagugcaagauuuaau

SEQ ID NO: 660582 - RNA, 22 nt, Human
caaaaacugaaacuaccauuua

SEQ ID NO: 660583 - RNA, 19 nt, Human
caaaagugcauauacucau

SEQ ID NO: 660584 - RNA, 25 nt, Human
caauucccaagcguuuucucucagc

SEQ ID NO: 660585 - RNA, 24 nt, Human
caccaauacaacaacuguggaaau

SEQ ID NO: 660586 - RNA, 20 nt, Human
caugacacucuagaggggga

SEQ ID NO: 660587 - RNA, 26 nt, Human
cauuacuagaagaucucuauaaaagg

SEQ ID NO: 660588 - RNA, 26 nt, Human
cauuuuccuucaaaaguucaugagaa

SEQ ID NO: 660589 - RNA, 21 nt, Human
ccaauacaacaacuguggaaa

SEQ ID NO: 660590 - RNA, 22 nt, Human
cccacggucucuggaauccauu

SEQ ID NO: 660591 - RNA, 24 nt, Human
ccccaaauaaauacugauguaaau

SEQ ID NO: 660592 - RNA, 18 nt, Human
ccuuguuuuucucuuucu

SEQ ID NO: 660593 - RNA, 21 nt, Human
cuacuuuuguuuuaaaaaaag

SEQ ID NO: 660594 - RNA, 22 nt, Human
cuauaaaaggucaccaagacua

SEQ ID NO: 660595 - RNA, 18 nt, Human
cuaugccuuguuuuucuc

SEQ ID NO: 660596 - RNA, 21 nt, Human
cuggaauccauuacccaacca

SEQ ID NO: 660597 - RNA, 24 nt, Human
gaaaagcaaaaccuagcaucaaaa

SEQ ID NO: 660598 - RNA, 18 nt, Human
gacagugggguaauugga

SEQ ID NO: 660599 - RNA, 23 nt, Human
gugcuaugccuuguuuuucucuu

SEQ ID NO: 660600 - RNA, 21 nt, Human
guuuuuguaaaaccauggcuu

SEQ ID NO: 660601 - RNA, 25 nt, Human
uaaaccucuaauauguaaucagcuu

SEQ ID NO: 660602 - RNA, 22 nt, Human
uaagaaagcucuaagaagagaa

SEQ ID NO: 660603 - RNA, 22 nt, Human
uacccaaccaacaugacacucu

SEQ ID NO: 660604 - RNA, 18 nt, Human
uaggaucuuguaaccuag

SEQ ID NO: 660605 - RNA, 24 nt, Human
uauagaaucauaaaaauaaaccuc

SEQ ID NO: 660606 - RNA, 24 nt, Human
uauccuuguuugugaaaucaggga

SEQ ID NO: 660607 - RNA, 19 nt, Human
ucaugagaaggaugcugga

SEQ ID NO: 660608 - RNA, 21 nt, Human
ucuaagaagagaauacaacau

SEQ ID NO: 660609 - RNA, 21 nt, Human
ucucacaaaaacugaaacuac

SEQ ID NO: 660610 - RNA, 19 nt, Human
ucuucgacgauacuugugg

SEQ ID NO: 660611 - RNA, 19 nt, Human
ucuuucuuuuucuucuuuc

SEQ ID NO: 660612 - RNA, 24 nt, Human
ugaaaaagaaaucugagaucaaaa

SEQ ID NO: 660613 - RNA, 23 nt, Human
ugaaacuaccauuuacaucaggu

SEQ ID NO: 660614 - RNA, 20 nt, Human
ugagaccacaggacacaggc

SEQ ID NO: 660615 - RNA, 23 nt, Human
ugagauaugacuggggggagaaa

SEQ ID NO: 660616 - RNA, 22 nt, Human
uggaaaucaugagauaugacug

SEQ ID NO: 660617 - RNA, 18 nt, Human
uggguaaagccauuuucc

SEQ ID NO: 660618 - RNA, 20 nt, Human
uggguaaagccauuuuccuu

SEQ ID NO: 660619 - RNA, 20 nt, Human
uguauaaauagcagaugcag

SEQ ID NO: 660620 - RNA, 21 nt, Human
uguuggguaaagccauuuucc

SEQ ID NO: 660621 - RNA, 23 nt, Human
uguuggguaaagccauuuuccuu

SEQ ID NO: 660622 - RNA, 19 nt, Human
uuccuggcccacggucucu

SEQ ID NO: 660623 - RNA, 20 nt, Human
uugacagugggguaauuggg

SEQ ID NO: 660624 - RNA, 23 nt, Human
uuguggauucuuuaagaaagcuc

SEQ ID NO: 660625 - RNA, 22 nt, Human
uuuagaauuuaucuuguuagaa

SEQ ID NO: 660626 - RNA, 24 nt, Human
uuucaccauuucuugagaccacag

SEQ ID NO: 660627 - RNA, 23 nt, Human
uuuccuucaaaaguucaugagaa

SEQ ID NO: 660628 - RNA, 27 nt, Human
uuuucagaauaagugcuucgggucacc

SEQ ID NO: 660629 - RNA, 22 nt, Human
uuuuuuuuuuuuuuuuuuucag

SEQ ID NO: 660630 - RNA, 23 nt, Human
aaauaauugggggugggaggaaa

SEQ ID NO: 660631 - RNA, 25 nt, Human
aagcaaucuaaugaaagcaccaaac

SEQ ID NO: 660632 - RNA, 21 nt, Human
aagcuggaucccauucccagc

SEQ ID NO: 660633 - RNA, 21 nt, Human
aauaauugggggugggaggaa

SEQ ID NO: 660634 - RNA, 24 nt, Human
acagcaacagagcaagguuacauc

SEQ ID NO: 660635 - RNA, 24 nt, Human
acgcaagcacacugcugggccacu

SEQ ID NO: 660636 - RNA, 23 nt, Human
acuuccucaaggccucucugcua

SEQ ID NO: 660637 - RNA, 21 nt, Human
agaaacuaguauaggaaauaa

SEQ ID NO: 660638 - RNA, 22 nt, Human
agcagccauaaugaagcuggau

SEQ ID NO: 660639 - RNA, 23 nt, Human
aggaaauaauugggggugggagg

SEQ ID NO: 660640 - RNA, 26 nt, Human
agguaaaaauacgcaguuucgcaauc

SEQ ID NO: 660641 - RNA, 22 nt, Human
caaauuaaaaacugcaggcuca

SEQ ID NO: 660642 - RNA, 22 nt, Human
caacaccgaguccacagugccc

SEQ ID NO: 660643 - RNA, 19 nt, Human
caagcaaucuaaugaaagc

SEQ ID NO: 660644 - RNA, 22 nt, Human
caagcaaucuaaugaaagcacc

SEQ ID NO: 660645 - RNA, 23 nt, Human
caagcaaucuaaugaaagcacca

SEQ ID NO: 660646 - RNA, 26 nt, Human
caaugauuuuuuucucugagguaaaa

SEQ ID NO: 660647 - RNA, 23 nt, Human
cagagcuuaaauccaaaagaaau

SEQ ID NO: 660648 - RNA, 21 nt, Human
cagcagcaccccagcagccau

SEQ ID NO: 660649 - RNA, 24 nt, Human
cagcagcaccccagcagccauaau

SEQ ID NO: 660650 - RNA, 20 nt, Human
cagcagcagggcugggucag

SEQ ID NO: 660651 - RNA, 23 nt, Human
cauucagacaccuucacugccau

SEQ ID NO: 660652 - RNA, 25 nt, Human
cccccaaacauguaaaagauaaaaa

SEQ ID NO: 660653 - RNA, 18 nt, Human
cuagcccucaggaccauu

SEQ ID NO: 660654 - RNA, 21 nt, Human
cuuuucuuguuguuguuuauu

SEQ ID NO: 660655 - RNA, 18 nt, Human
gagcagcagcagggcugg

SEQ ID NO: 660656 - RNA, 18 nt, Human
gagcagcagcagggcugg

SEQ ID NO: 660657 - RNA, 25 nt, Human
gagcagcagcagggcugggucagca

SEQ ID NO: 660658 - RNA, 20 nt, Human
gcuauaguccagagcuuaaa

SEQ ID NO: 660659 - RNA, 20 nt, Human
ggaaauaauugggggugggg

SEQ ID NO: 660660 - RNA, 24 nt, Human
ggaggaaagcaggagugaauucaa

SEQ ID NO: 660661 - RNA, 18 nt, Human
gggggugggaggaaagca

SEQ ID NO: 660662 - RNA, 24 nt, Human
gggggugggaggaaagcaggagug

SEQ ID NO: 660663 - RNA, 23 nt, Human
uaaaaauacgcaguuucgcaauc

SEQ ID NO: 660664 - RNA, 27 nt, Human
uaaaaauacgcaguuucgcaaucaccc

SEQ ID NO: 660665 - RNA, 23 nt, Human
uaacaagcaaucuaaugaaagca

SEQ ID NO: 660666 - RNA, 26 nt, Human
uaacaagcaaucuaaugaaagcacca

SEQ ID NO: 660667 - RNA, 19 nt, Human
uaggcugagguccaggacu

SEQ ID NO: 660668 - RNA, 23 nt, Human
uauaguccagagcuuaaauccaa

SEQ ID NO: 660669 - RNA, 19 nt, Human
ucacugccaucagaaacua

SEQ ID NO: 660670 - RNA, 20 nt, Human
uccacagugccaggccucua

SEQ ID NO: 660671 - RNA, 23 nt, Human
ucccagccccugugcagcagguu

SEQ ID NO: 660672 - RNA, 19 nt, Human
uccuuggaaacgcaagcac

SEQ ID NO: 660673 - RNA, 19 nt, Human
ucuaggcugagguccagga

SEQ ID NO: 660674 - RNA, 26 nt, Human
ugaaaaaaguuuuguacacaaaguca

SEQ ID NO: 660675 - RNA, 20 nt, Human
ugaaagcaccaaaccuaaac

SEQ ID NO: 660676 - RNA, 21 nt, Human
ugagguaaaaauacgcaguuu

SEQ ID NO: 660677 - RNA, 25 nt, Human
ugcugggccacuuccucaaggccuc

SEQ ID NO: 660678 - RNA, 21 nt, Human
uguaaaagauaaaaacuuucc

SEQ ID NO: 660679 - RNA, 19 nt, Human
uuuuuuuuuuuucaggcgc

SEQ ID NO: 660680 - RNA, 25 nt, Human
uuuuuuuuuuuuuuuuuuuuucagg

SEQ ID NO: 660681 - RNA, 23 nt, Human
aaaaacccugacacauguagccc

SEQ ID NO: 660682 - RNA, 19 nt, Human
aaacaguaugaugauucau

SEQ ID NO: 660683 - RNA, 18 nt, Human
aagcaccuggagaaaaac

SEQ ID NO: 660684 - RNA, 24 nt, Human
acauucagccuaauuuuaaaaaua

SEQ ID NO: 660685 - RNA, 18 nt, Human
agaaaaaguaaaaaugaa

SEQ ID NO: 660686 - RNA, 19 nt, Human
agcgccccuggcacgcgcc

SEQ ID NO: 660687 - RNA, 24 nt, Human
aguguuacuuacucugucauuagc

SEQ ID NO: 660688 - RNA, 22 nt, Human
caaaauucuaaaacaaaagcca

SEQ ID NO: 660689 - RNA, 25 nt, Human
caaaauucuaaaacaaaagccacac

SEQ ID NO: 660690 - RNA, 26 nt, Human
caaaucacaugaaguacauucagccu

SEQ ID NO: 660691 - RNA, 19 nt, Human
caagaaugcaaugguuuca

SEQ ID NO: 660692 - RNA, 22 nt, Human
ccagguggggaaggaauggagu

SEQ ID NO: 660693 - RNA, 21 nt, Human
ccccccuucuuuuucaaacac

SEQ ID NO: 660694 - RNA, 18 nt, Human
cccuccuagcgcuuggca

SEQ ID NO: 660695 - RNA, 21 nt, Human
ccuggaauucucccccccuuc

SEQ ID NO: 660696 - RNA, 27 nt, Human
cucccccccuucuuuuucaaacaccag

SEQ ID NO: 660697 - RNA, 24 nt, Human
gaaaaacccugacacauguagccc

SEQ ID NO: 660698 - RNA, 26 nt, Human
gaaaaacccugacacauguagcccaa

SEQ ID NO: 660699 - RNA, 21 nt, Human
gaaguacauucagccuaauuu

SEQ ID NO: 660700 - RNA, 22 nt, Human
gcaccuggagaaaaacccugac

SEQ ID NO: 660701 - RNA, 20 nt, Human
gcaguucccuagcgccccug

SEQ ID NO: 660702 - RNA, 23 nt, Human
gccacacagaguacaaauaaagu

SEQ ID NO: 660703 - RNA, 19 nt, Human
gccccuggcacgcgcccuc

SEQ ID NO: 660704 - RNA, 22 nt, Human
ggaaggaauggagugagacugg

SEQ ID NO: 660705 - RNA, 19 nt, Human
ggacccuggucuugagcag

SEQ ID NO: 660706 - RNA, 18 nt, Human
gguggggaaggaauggag

SEQ ID NO: 660707 - RNA, 18 nt, Human
uaaagagaaucaauacaa

SEQ ID NO: 660708 - RNA, 19 nt, Human
uaauagaaacuaggcccug

SEQ ID NO: 660709 - RNA, 22 nt, Human
uaauuuuagcccauuuaggucc

SEQ ID NO: 660710 - RNA, 21 nt, Human
uacaagaaugcaaugguuuca

SEQ ID NO: 660711 - RNA, 22 nt, Human
uacacaguauuuuuguaaggaa

SEQ ID NO: 660712 - RNA, 19 nt, Human
uacagcauuucaaaucagu

SEQ ID NO: 660713 - RNA, 22 nt, Human
uacauuuuauauuuaaagagaa

SEQ ID NO: 660714 - RNA, 26 nt, Human
uacuuacucugucauuagcaauuuca

SEQ ID NO: 660715 - RNA, 21 nt, Human
uagcgccccuggcacgcgccc

SEQ ID NO: 660716 - RNA, 18 nt, Human
uaggcccugauuggcagu

SEQ ID NO: 660717 - RNA, 20 nt, Human
ucaaguugaugucacuaaua

SEQ ID NO: 660718 - RNA, 22 nt, Human
ucaaugaccaauauuaguguua

SEQ ID NO: 660719 - RNA, 18 nt, Human
ucauccauucagcaaaca

SEQ ID NO: 660720 - RNA, 19 nt, Human
ucaugaacgaagaucaaug

SEQ ID NO: 660721 - RNA, 19 nt, Human
ucccuagcgccccuggcac

SEQ ID NO: 660722 - RNA, 20 nt, Human
ugaacaaaauucuaaaacaa

SEQ ID NO: 660723 - RNA, 19 nt, Human
ugaacgaagaucaaugacc

SEQ ID NO: 660724 - RNA, 19 nt, Human
ugacuucuugaagacaguu

SEQ ID NO: 660725 - RNA, 18 nt, Human
ugagacuggggagcugcg

SEQ ID NO: 660726 - RNA, 24 nt, Human
ugagaggaaacuugccuaugaaaa

SEQ ID NO: 660727 - RNA, 21 nt, Human
ugagcaggugcgcgccaggug

SEQ ID NO: 660728 - RNA, 22 nt, Human
ugagcuuuugaaaaaucccaca

SEQ ID NO: 660729 - RNA, 24 nt, Human
ugaugucacuaauauaccaaucaa

SEQ ID NO: 660730 - RNA, 23 nt, Human
ugccgcagaugcagcuccucgga

SEQ ID NO: 660731 - RNA, 24 nt, Human
ugccgcagaugcagcuccucggag

SEQ ID NO: 660732 - RNA, 20 nt, Human
uggaaaaaaguuaacagguu

SEQ ID NO: 660733 - RNA, 21 nt, Human
uggaaaaaaguuaacagguua

SEQ ID NO: 660734 - RNA, 18 nt, Human
uggggagcugcgagcuac

SEQ ID NO: 660735 - RNA, 22 nt, Human
ugucaaguugaugucacuaaua

SEQ ID NO: 660736 - RNA, 22 nt, Human
uucaacagacuaauuuuacaga

SEQ ID NO: 660737 - RNA, 20 nt, Human
uuccagaucaauauaagcac

SEQ ID NO: 660738 - RNA, 23 nt, Human
uucucccccccuucuuuuucaaa

SEQ ID NO: 660739 - RNA, 21 nt, Human
uugaaaaaucccacaaguuug

SEQ ID NO: 660740 - RNA, 18 nt, Human
uugacaaaucacaugaag

SEQ ID NO: 660741 - RNA, 18 nt, Human
uuucauuaagauacuauc

SEQ ID NO: 660742 - RNA, 24 nt, Human
uuuuuacauuacaauuccagauca

SEQ ID NO: 660743 - RNA, 28 nt, Human
aaaaaagcauuccucuacuuagaauaga

SEQ ID NO: 660744 - RNA, 21 nt, Human
aaagagaaacuuucaagaaaa

SEQ ID NO: 660745 - RNA, 24 nt, Human
aaagcgccuccaccucugccuccg

SEQ ID NO: 660746 - RNA, 27 nt, Human
aaagcgccuccaccucugccuccgccu

SEQ ID NO: 660747 - RNA, 19 nt, Human
aagaaaaggaaaaaagcau

SEQ ID NO: 660748 - RNA, 25 nt, Human
aagaauaaacagaucuggccaggaa

SEQ ID NO: 660749 - RNA, 21 nt, Human
aagcaaugcagauaccaaaau

SEQ ID NO: 660750 - RNA, 20 nt, Human
aaucaugaucuucacauuua

SEQ ID NO: 660751 - RNA, 22 nt, Human
aaugauauaugagguuucuucc

SEQ ID NO: 660752 - RNA, 23 nt, Human
acagaaaaacaagaaucaugauc

SEQ ID NO: 660753 - RNA, 22 nt, Human
acuuucaagaaaaggaaaaaag

SEQ ID NO: 660754 - RNA, 21 nt, Human
aggaaaaaagcauuccucuac

SEQ ID NO: 660755 - RNA, 22 nt, Human
aggaaaaaagcauuccucuacu

SEQ ID NO: 660756 - RNA, 21 nt, Human
agugacagagcagggauuaga

SEQ ID NO: 660757 - RNA, 26 nt, Human
auggauaaaaauaaauaaaauacauc

SEQ ID NO: 660758 - RNA, 19 nt, Human
caagaaaaggaaaaaagca

SEQ ID NO: 660759 - RNA, 18 nt, Human
cacaugauacagaaaaac

SEQ ID NO: 660760 - RNA, 22 nt, Human
caccucugccuccgccuccgcc

SEQ ID NO: 660761 - RNA, 22 nt, Human
cagauaccaaaauaugcuuucc

SEQ ID NO: 660762 - RNA, 24 nt, Human
cauaaaauuauuccugaaugugag

SEQ ID NO: 660763 - RNA, 22 nt, Human
ccgaagaucacgcagcuuguua

SEQ ID NO: 660764 - RNA, 28 nt, Human
ccucugcaaccauuuuacuuuauuacuu

SEQ ID NO: 660765 - RNA, 24 nt, Human
cgccccugccccggcaaccagccu

SEQ ID NO: 660766 - RNA, 21 nt, Human
cugauucugaagcaaugggau

SEQ ID NO: 660767 - RNA, 19 nt, Human
gcaaagcaaugcagauacc

SEQ ID NO: 660768 - RNA, 19 nt, Human
uaaaaaaucuucucugaug

SEQ ID NO: 660769 - RNA, 24 nt, Human
uaaaagaauaaacagaucuggcca

SEQ ID NO: 660770 - RNA, 18 nt, Human
uaaacagaucuggccagg

SEQ ID NO: 660771 - RNA, 19 nt, Human
uauauuuacagacuuaaaa

SEQ ID NO: 660772 - RNA, 20 nt, Human
uauauuuacagacuuaaaaa

SEQ ID NO: 660773 - RNA, 21 nt, Human
uauggaaaaagcuauggauaa

SEQ ID NO: 660774 - RNA, 23 nt, Human
uauuugaaagagaaacuuucaag

SEQ ID NO: 660775 - RNA, 24 nt, Human
ucuaaauacauuuuuaagauacaa

SEQ ID NO: 660776 - RNA, 18 nt, Human
ucugccuccgccuccgcc

SEQ ID NO: 660777 - RNA, 19 nt, Human
ugaaagacucuagaggccu

SEQ ID NO: 660778 - RNA, 19 nt, Human
ugaaagagaaacuuucaag

SEQ ID NO: 660779 - RNA, 21 nt, Human
ugacagagcagggauuagaaa

SEQ ID NO: 660780 - RNA, 24 nt, Human
ugaguuugucucuuucagcaguuc

SEQ ID NO: 660781 - RNA, 24 nt, Human
ugcaaagcaaugcagauaccaaaa

SEQ ID NO: 660782 - RNA, 20 nt, Human
ugccacacaaugacggcuuu

SEQ ID NO: 660783 - RNA, 19 nt, Human
ugccuccgccuccgccccu

SEQ ID NO: 660784 - RNA, 23 nt, Human
ugccuccgccuccgccccugccc

SEQ ID NO: 660785 - RNA, 25 nt, Human
uuaaaauauauuuacagacuuaaaa

SEQ ID NO: 660786 - RNA, 20 nt, Human
uucaaagcgccuccaccucc

SEQ ID NO: 660787 - RNA, 22 nt, Human
uucaaagcgccuccaccucugc

SEQ ID NO: 660788 - RNA, 22 nt, Human
uuccaagaggauuacuuuuuuc

SEQ ID NO: 660789 - RNA, 18 nt, Human
uucuuuuuuuuuccucug

SEQ ID NO: 660790 - RNA, 25 nt, Human
uuucaagaaaaggaaaaaagcauuc

SEQ ID NO: 660791 - RNA, 22 nt, Human
aaaagggcagggcggaaaagca

SEQ ID NO: 660792 - RNA, 24 nt, Human
aaaccaccagacaagccccaacag

SEQ ID NO: 660793 - RNA, 19 nt, Human
aaaguggucaggcagagac

SEQ ID NO: 660794 - RNA, 18 nt, Human
aacaaggcguuccagagc

SEQ ID NO: 660795 - RNA, 19 nt, Human
aacacggugaaaccccauc

SEQ ID NO: 660796 - RNA, 20 nt, Human
aacacggugaaaccccaucu

SEQ ID NO: 660797 - RNA, 20 nt, Human
aacacggugaaaccccaucu

SEQ ID NO: 660798 - RNA, 21 nt, Human
aacacggugaaaccccaucuc

SEQ ID NO: 660799 - RNA, 22 nt, Human
aaccacaagaaaccaccagaca

SEQ ID NO: 660800 - RNA, 18 nt, Human
aacccagagagacgaggg

SEQ ID NO: 660801 - RNA, 18 nt, Human
aagaaaccaccagacaag

SEQ ID NO: 660802 - RNA, 21 nt, Human
aagagccucaggagaugaccc

SEQ ID NO: 660803 - RNA, 21 nt, Human
aagcagacccugccuggaggu

SEQ ID NO: 660804 - RNA, 24 nt, Human
aauggcaugaacuugggaggcgga

SEQ ID NO: 660805 - RNA, 21 nt, Human
acaaacaaggcguuccagagc

SEQ ID NO: 660806 - RNA, 19 nt, Human
acaaagccagagaccuccc

SEQ ID NO: 660807 - RNA, 21 nt, Human
acaaagccagagaccucccag

SEQ ID NO: 660808 - RNA, 23 nt, Human
acaagaaaccaccagacaagccc

SEQ ID NO: 660809 - RNA, 22 nt, Human
acaggccggagauuuugcaugc

SEQ ID NO: 660810 - RNA, 19 nt, Human
accacugcacuccagccug

SEQ ID NO: 660811 - RNA, 24 nt, Human
accacugcacuccagccuggguga

SEQ ID NO: 660812 - RNA, 21 nt, Human
accagacaagccccaacagag

SEQ ID NO: 660813 - RNA, 22 nt, Human
acccacccccagaaaggccacc

SEQ ID NO: 660814 - RNA, 24 nt, Human
accccaucucuacuaaaaguacaa

SEQ ID NO: 660815 - RNA, 21 nt, Human
acccccagaaaggccaccaug

SEQ ID NO: 660816 - RNA, 20 nt, Human
acccugaagccuccccaggc

SEQ ID NO: 660817 - RNA, 20 nt, Human
acccugaagccuccccaggc

SEQ ID NO: 660818 - RNA, 22 nt, Human
acccugaagccuccccaggcac

SEQ ID NO: 660819 - RNA, 22 nt, Human
acccugaagccuccccaggcac

SEQ ID NO: 660820 - RNA, 18 nt, Human
acccugccuggaggugcu

SEQ ID NO: 660821 - RNA, 21 nt, Human
accggagccagagacccacug

SEQ ID NO: 660822 - RNA, 22 nt, Human
accucggcccacccaccucagc

SEQ ID NO: 660823 - RNA, 20 nt, Human
acuagcccagaggcugggcu

SEQ ID NO: 660824 - RNA, 20 nt, Human
acuagcccagaggcugggcu

SEQ ID NO: 660825 - RNA, 24 nt, Human
acugcacuccagccugggugacag

SEQ ID NO: 660826 - RNA, 26 nt, Human
acugcacuccagccugggugacagag

SEQ ID NO: 660827 - RNA, 18 nt, Human
agaaauaagcggaucuga

SEQ ID NO: 660828 - RNA, 19 nt, Human
agacaagccccaacagagg

SEQ ID NO: 660829 - RNA, 19 nt, Human
agacagagggcugagggcc

SEQ ID NO: 660830 - RNA, 21 nt, Human
agacaggagaauggcaugaac

SEQ ID NO: 660831 - RNA, 24 nt, Human
agacaggagaauggcaugaacuug

SEQ ID NO: 660832 - RNA, 18 nt, Human
agaccaccaagaacccag

SEQ ID NO: 660833 - RNA, 22 nt, Human
agaggccccugguaccaacugg

SEQ ID NO: 660834 - RNA, 24 nt, Human
agcagggcaggaaccuggagagga

SEQ ID NO: 660835 - RNA, 24 nt, Human
agcagggcaggaaccuggagagga

SEQ ID NO: 660836 - RNA, 19 nt, Human
agccugccccaccagcacc

SEQ ID NO: 660837 - RNA, 21 nt, Human
agcuuggguaaugcagaugcc

SEQ ID NO: 660838 - RNA, 24 nt, Human
aggacaggcagacugugcgggcca

SEQ ID NO: 660839 - RNA, 21 nt, Human
aggaggcuuggauggccagga

SEQ ID NO: 660840 - RNA, 21 nt, Human
aggaggcuuggauggccagga

SEQ ID NO: 660841 - RNA, 21 nt, Human
aggcacugaucagucacagga

SEQ ID NO: 660842 - RNA, 18 nt, Human
aggcagagacagccaccc

SEQ ID NO: 660843 - RNA, 18 nt, Human
aggcagagacagccaccc

SEQ ID NO: 660844 - RNA, 18 nt, Human
aggcagagggaagaggac

SEQ ID NO: 660845 - RNA, 20 nt, Human
aggcaggcggaucacgaggu

SEQ ID NO: 660846 - RNA, 24 nt, Human
aggcaggcggaucacgaggucagg

SEQ ID NO: 660847 - RNA, 24 nt, Human
aggcaggcugcccacaaagccaga

SEQ ID NO: 660848 - RNA, 19 nt, Human
aggcaguggcgucacagug

SEQ ID NO: 660849 - RNA, 22 nt, Human
aggccaggcgugguggcucacg

SEQ ID NO: 660850 - RNA, 24 nt, Human
aggccaggcgugguggcucacgcc

SEQ ID NO: 660851 - RNA, 21 nt, Human
aggccgaggcaggcggaucac

SEQ ID NO: 660852 - RNA, 23 nt, Human
aggccgaggcaggcggaucacga

SEQ ID NO: 660853 - RNA, 24 nt, Human
aggcggagcuugcagugagccaag

SEQ ID NO: 660854 - RNA, 22 nt, Human
aggcggaucacgaggucaggau

SEQ ID NO: 660855 - RNA, 24 nt, Human
aggcgugguggcucacgccuguaa

SEQ ID NO: 660856 - RNA, 20 nt, Human
aggcucccuggaagcagcag

SEQ ID NO: 660857 - RNA, 20 nt, Human
aggcucccuggaagcagcag

SEQ ID NO: 660858 - RNA, 18 nt, Human
agggaccagcacccaccc

SEQ ID NO: 660859 - RNA, 19 nt, Human
agggagggagaggagcuga

SEQ ID NO: 660860 - RNA, 18 nt, Human
agggcuaaggagacagag

SEQ ID NO: 660861 - RNA, 19 nt, Human
agggguggguggggugggg

SEQ ID NO: 660862 - RNA, 21 nt, Human
aucagggguggggcagggggc

SEQ ID NO: 660863 - RNA, 24 nt, Human
aucgcaccacugcacuccagccug

SEQ ID NO: 660864 - RNA, 20 nt, Human
augcaaccccagcugcccuu

SEQ ID NO: 660865 - RNA, 19 nt, Human
augcggggagggguggguc

SEQ ID NO: 660866 - RNA, 19 nt, Human
augcggggagggguggguc

SEQ ID NO: 660867 - RNA, 25 nt, Human
caaaaagaaacacaagaaucacauc

SEQ ID NO: 660868 - RNA, 19 nt, Human
caaaauauacuggcagaaa

SEQ ID NO: 660869 - RNA, 22 nt, Human
caaaccugacacuacuugaaau

SEQ ID NO: 660870 - RNA, 21 nt, Human
caaagccagagaccucccagg

SEQ ID NO: 660871 - RNA, 23 nt, Human
caacaggaccgcuugagaggcuc

SEQ ID NO: 660872 - RNA, 19 nt, Human
caaccgacccgaagcacgu

SEQ ID NO: 660873 - RNA, 27 nt, Human
caagaaaccaccagacaagccccaaca

SEQ ID NO: 660874 - RNA, 20 nt, Human
caagaggccccugguaccaa

SEQ ID NO: 660875 - RNA, 20 nt, Human
cacaaacaaggcguuccaga

SEQ ID NO: 660876 - RNA, 24 nt, Human
cacaaacaaggcguuccagagcaa

SEQ ID NO: 660877 - RNA, 22 nt, Human
cacaaagccagagaccucccag

SEQ ID NO: 660878 - RNA, 24 nt, Human
cacaagaaaccaccagacaagccc

SEQ ID NO: 660879 - RNA, 20 nt, Human
cacaguguccgaagcaagac

SEQ ID NO: 660880 - RNA, 20 nt, Human
cacaguuucacaggccggag

SEQ ID NO: 660881 - RNA, 28 nt, Human
caccacccagccucugugggcaccuccu

SEQ ID NO: 660882 - RNA, 26 nt, Human
caccacugcacuccagccugggugac

SEQ ID NO: 660883 - RNA, 22 nt, Human
caccagcaccccaaggccaccc

SEQ ID NO: 660884 - RNA, 25 nt, Human
caccagcaccccaaggccaccccga

SEQ ID NO: 660885 - RNA, 21 nt, Human
cacccugaagccuccccaggc

SEQ ID NO: 660886 - RNA, 20 nt, Human
caccucggcccacccaccuc

SEQ ID NO: 660887 - RNA, 18 nt, Human
caccugccaagcacuggc

SEQ ID NO: 660888 - RNA, 18 nt, Human
caccugccaagcacuggc

SEQ ID NO: 660889 - RNA, 22 nt, Human
caccugccaagcacuggccugg

SEQ ID NO: 660890 - RNA, 22 nt, Human
caccugccaagcacuggccugg

SEQ ID NO: 660891 - RNA, 19 nt, Human
cacgccuguaaucccagca

SEQ ID NO: 660892 - RNA, 22 nt, Human
cacuccagccugggugacagag

SEQ ID NO: 660893 - RNA, 19 nt, Human
cacugcacuccagccuggg

SEQ ID NO: 660894 - RNA, 19 nt, Human
cacugcacuccagccuggg

SEQ ID NO: 660895 - RNA, 19 nt, Human
cacugcacuccagccuggg

SEQ ID NO: 660896 - RNA, 22 nt, Human
cacugcacuccagccuggguga

SEQ ID NO: 660897 - RNA, 24 nt, Human
cacugcacuccagccugggugaca

SEQ ID NO: 660898 - RNA, 25 nt, Human
cacugcacuccagccugggugacag

SEQ ID NO: 660899 - RNA, 22 nt, Human
cagaccaccaagaacccagaga

SEQ ID NO: 660900 - RNA, 21 nt, Human
cagagggagccgccacccgcc

SEQ ID NO: 660901 - RNA, 20 nt, Human
cagagggcugagggccacgc

SEQ ID NO: 660902 - RNA, 24 nt, Human
cagcaauuuaggaggccgaggcag

SEQ ID NO: 660903 - RNA, 24 nt, Human
cagcaccccaaggccaccccgaga

SEQ ID NO: 660904 - RNA, 22 nt, Human
cagcacccuccccaccuuuguc

SEQ ID NO: 660905 - RNA, 24 nt, Human
cagcccgggaagccccugccucuc

SEQ ID NO: 660906 - RNA, 21 nt, Human
cagccucugugggcaccuccu

SEQ ID NO: 660907 - RNA, 24 nt, Human
cagccucugugggcaccuccuccu

SEQ ID NO: 660908 - RNA, 22 nt, Human
cagccugggaugggcacagcug

SEQ ID NO: 660909 - RNA, 23 nt, Human
cagcuuccugagucugugugccu

SEQ ID NO: 660910 - RNA, 20 nt, Human
cagcuuggcagggacaagca

SEQ ID NO: 660911 - RNA, 18 nt, Human
caggaagagccucaggag

SEQ ID NO: 660912 - RNA, 21 nt, Human
caggcugcccacaaagccaga

SEQ ID NO: 660913 - RNA, 23 nt, Human
caggcugcccacaaagccagaga

SEQ ID NO: 660914 - RNA, 18 nt, Human
cagggcaggaaccuggag

SEQ ID NO: 660915 - RNA, 18 nt, Human
cagggcaggaaccuggag

SEQ ID NO: 660916 - RNA, 21 nt, Human
caggggcuggugggccccagg

SEQ ID NO: 660917 - RNA, 19 nt, Human
cagguacacaggaccaccu

SEQ ID NO: 660918 - RNA, 21 nt, Human
cagguacacaggaccaccuca

SEQ ID NO: 660919 - RNA, 22 nt, Human
caguggcaaaggguggugacau

SEQ ID NO: 660920 - RNA, 21 nt, Human
caguggccgcccaccucggcc

SEQ ID NO: 660921 - RNA, 21 nt, Human
cauccagaagccccagaaagu

SEQ ID NO: 660922 - RNA, 19 nt, Human
caugggcagcagagcuugg

SEQ ID NO: 660923 - RNA, 19 nt, Human
ccacaagaaaccaccagac

SEQ ID NO: 660924 - RNA, 20 nt, Human
ccacugcacuccagccuggg

SEQ ID NO: 660925 - RNA, 20 nt, Human
ccacugcacuccagccuggg

SEQ ID NO: 660926 - RNA, 20 nt, Human
ccacugcacuccagccuggg

SEQ ID NO: 660927 - RNA, 20 nt, Human
ccacugcacuccagccuggg

SEQ ID NO: 660928 - RNA, 21 nt, Human
ccacugcacuccagccugggu

SEQ ID NO: 660929 - RNA, 21 nt, Human
ccacugcacuccagccugggu

SEQ ID NO: 660930 - RNA, 24 nt, Human
ccacugcacuccagccugggugac

SEQ ID NO: 660931 - RNA, 25 nt, Human
ccacugcacuccagccugggugaca

SEQ ID NO: 660932 - RNA, 23 nt, Human
ccacuggccaguggccgcccacc

SEQ ID NO: 660933 - RNA, 23 nt, Human
ccagaaaggccaccaugggcagc

SEQ ID NO: 660934 - RNA, 24 nt, Human
ccaggcacucguguccugcuugug

SEQ ID NO: 660935 - RNA, 24 nt, Human
ccaggcaggcugcccacaaagcca

SEQ ID NO: 660936 - RNA, 22 nt, Human
ccagugaggaagacgaaaaggg

SEQ ID NO: 660937 - RNA, 24 nt, Human
ccaguggccgcccaccucggccca

SEQ ID NO: 660938 - RNA, 24 nt, Human
cccacccaccucagcccaugcugc

SEQ ID NO: 660939 - RNA, 20 nt, Human
cccaccucggcccacccacc

SEQ ID NO: 660940 - RNA, 23 nt, Human
cccacggcacacuagcccagagg

SEQ ID NO: 660941 - RNA, 23 nt, Human
cccacggcacacuagcccagagg

SEQ ID NO: 660942 - RNA, 18 nt, Human
cccacggcacacuagccu

SEQ ID NO: 660943 - RNA, 21 nt, Human
cccagccucugugggcaccuc

SEQ ID NO: 660944 - RNA, 20 nt, Human
ccccaccagcaccccaaggc

SEQ ID NO: 660945 - RNA, 22 nt, Human
ccccacggcacacuagcccaga

SEQ ID NO: 660946 - RNA, 22 nt, Human
ccccacggcacacuagcccaga

SEQ ID NO: 660947 - RNA, 18 nt, Human
ccccagaaaggccaccau

SEQ ID NO: 660948 - RNA, 19 nt, Human
ccccagaaaggccaccaug

SEQ ID NO: 660949 - RNA, 21 nt, Human
cccccagcuuccugagucugu

SEQ ID NO: 660950 - RNA, 25 nt, Human
cccccagcuuccugagucugugugc

SEQ ID NO: 660951 - RNA, 19 nt, Human
cccgccagccugccccacc

SEQ ID NO: 660952 - RNA, 20 nt, Human
cccggccacaguguccgaag

SEQ ID NO: 660953 - RNA, 21 nt, Human
cccucagaccaccaagaaccc

SEQ ID NO: 660954 - RNA, 23 nt, Human
cccucagaccaccaagaacccag

SEQ ID NO: 660955 - RNA, 19 nt, Human
cccugaagccuccccaggc

SEQ ID NO: 660956 - RNA, 20 nt, Human
cccugagagcacagcucagg

SEQ ID NO: 660957 - RNA, 20 nt, Human
cccugagagcacagcucagg

SEQ ID NO: 660958 - RNA, 24 nt, Human
cccuucagaaagacggccaacagg

SEQ ID NO: 660959 - RNA, 21 nt, Human
ccgaagcaagacagagcaggg

SEQ ID NO: 660960 - RNA, 25 nt, Human
ccgccacccgccagccugccccacc

SEQ ID NO: 660961 - RNA, 26 nt, Human
ccuccgcaaaccugacacuacuuuuc

SEQ ID NO: 660962 - RNA, 19 nt, Human
ccuccugccccacagaggg

SEQ ID NO: 660963 - RNA, 21 nt, Human
ccugcaggagccuggccaggg

SEQ ID NO: 660964 - RNA, 21 nt, Human
ccugccaagcacuggccuggg

SEQ ID NO: 660965 - RNA, 21 nt, Human
ccugccaagcacuggccuggg

SEQ ID NO: 660966 - RNA, 28 nt, Human
ccugccccacggcacacuagcccagagg

SEQ ID NO: 660967 - RNA, 28 nt, Human
ccugccccacggcacacuagcccagagg

SEQ ID NO: 660968 - RNA, 19 nt, Human
ccugcccucgugucuccaa

SEQ ID NO: 660969 - RNA, 24 nt, Human
ccugcuugugaagcugcuggguuu

SEQ ID NO: 660970 - RNA, 19 nt, Human
ccuguggucccagcuacuc

SEQ ID NO: 660971 - RNA, 21 nt, Human
ccuguggucccagcuacucgg

SEQ ID NO: 660972 - RNA, 22 nt, Human
ccuguggucccagcuacucggg

SEQ ID NO: 660973 - RNA, 22 nt, Human
cgaagcacgugagcaaaaccga

SEQ ID NO: 660974 - RNA, 24 nt, Human
cgaggcaggcggaucacgagguca

SEQ ID NO: 660975 - RNA, 21 nt, Human
cgcaccacugcacuccagccu

SEQ ID NO: 660976 - RNA, 24 nt, Human
cgccuguggucccagcuacucggg

SEQ ID NO: 660977 - RNA, 19 nt, Human
cggagccagagacccacug

SEQ ID NO: 660978 - RNA, 27 nt, Human
cggaggggacccaagcuguguccugcc

SEQ ID NO: 660979 - RNA, 22 nt, Human
cgggacagcagcagcccgggaa

SEQ ID NO: 660980 - RNA, 21 nt, Human
cucacgccuguaaucccagca

SEQ ID NO: 660981 - RNA, 21 nt, Human
cucacgccuguaaucccagca

SEQ ID NO: 660982 - RNA, 18 nt, Human
cucagaccaccaagaacc

SEQ ID NO: 660983 - RNA, 24 nt, Human
cuccccaggcacaggcccugaaua

SEQ ID NO: 660984 - RNA, 24 nt, Human
cuccccaggcacaggcccugaaua

SEQ ID NO: 660985 - RNA, 24 nt, Human
cuccucacacuggauguccaggcu

SEQ ID NO: 660986 - RNA, 22 nt, Human
cuccuggcuaucaccacccagc

SEQ ID NO: 660987 - RNA, 25 nt, Human
cucggcccaucuagcgucgcucagc

SEQ ID NO: 660988 - RNA, 28 nt, Human
cucugcaccaggcuacagcacauccccc

SEQ ID NO: 660989 - RNA, 18 nt, Human
cugccccaccagcacccc

SEQ ID NO: 660990 - RNA, 18 nt, Human
cuggaauggguuuuacau

SEQ ID NO: 660991 - RNA, 18 nt, Human
cuggagcagagggaggag

SEQ ID NO: 660992 - RNA, 23 nt, Human
cuggcuaacacggugaaacccca

SEQ ID NO: 660993 - RNA, 18 nt, Human
cugggcagacacuuccuc

SEQ ID NO: 660994 - RNA, 20 nt, Human
cugugugccuggcacuccuc

SEQ ID NO: 660995 - RNA, 19 nt, Human
cuucagaggcggcuggucc

SEQ ID NO: 660996 - RNA, 22 nt, Human
gaaaccaccagacaagccccaa

SEQ ID NO: 660997 - RNA, 24 nt, Human
gacaggcagacugugcgggccagg

SEQ ID NO: 660998 - RNA, 20 nt, Human
gacaggguaggguggggugg

SEQ ID NO: 660999 - RNA, 23 nt, Human
gaccacuuggcacugcuggagca

SEQ ID NO: 661000 - RNA, 20 nt, Human
gacccgaagcacgugagcaa

SEQ ID NO: 661001 - RNA, 21 nt, Human
gacgaaaagggcagggcggaa

SEQ ID NO: 661002 - RNA, 22 nt, Human
gagccgccacccgccagccugc

SEQ ID NO: 661003 - RNA, 24 nt, Human
gagccuggaggccccagcagggga

SEQ ID NO: 661004 - RNA, 18 nt, Human
gagcuugcagugagccaa

SEQ ID NO: 661005 - RNA, 23 nt, Human
gagcuugcagugagccaagaucg

SEQ ID NO: 661006 - RNA, 23 nt, Human
gaggaagacgaaaagggcagggc

SEQ ID NO: 661007 - RNA, 22 nt, Human
gaggaccucgagggccgaggac

SEQ ID NO: 661008 - RNA, 21 nt, Human
gaggagcucggcccaucuagc

SEQ ID NO: 661009 - RNA, 19 nt, Human
gaggcagaggcaagaggac

SEQ ID NO: 661010 - RNA, 22 nt, Human
gcaaugcacccuucagagggag

SEQ ID NO: 661011 - RNA, 20 nt, Human
gcaccacugcacuccagccu

SEQ ID NO: 661012 - RNA, 23 nt, Human
gcacccacccccagaaaggccac

SEQ ID NO: 661013 - RNA, 26 nt, Human
gcaccccaaggccaccccgagagcaa

SEQ ID NO: 661014 - RNA, 24 nt, Human
gcacuccagccugggugacagagc

SEQ ID NO: 661015 - RNA, 20 nt, Human
gcagggacaagcagcgcccc

SEQ ID NO: 661016 - RNA, 20 nt, Human
gccaagaucgcaccacugca

SEQ ID NO: 661017 - RNA, 21 nt, Human
gccagacccucagaccaccaa

SEQ ID NO: 661018 - RNA, 23 nt, Human
gccccacagagggcgggacagca

SEQ ID NO: 661019 - RNA, 19 nt, Human
gcccugaauauggaaggag

SEQ ID NO: 661020 - RNA, 20 nt, Human
gcccugaauauggaaggagg

SEQ ID NO: 661021 - RNA, 19 nt, Human
gcccugacacccccagcuu

SEQ ID NO: 661022 - RNA, 18 nt, Human
gccgaggacucccagccc

SEQ ID NO: 661023 - RNA, 18 nt, Human
gccgcccaccucggccca

SEQ ID NO: 661024 - RNA, 20 nt, Human
gccuccccaggcacaggccc

SEQ ID NO: 661025 - RNA, 20 nt, Human
gccuccccaggcacaggccc

SEQ ID NO: 661026 - RNA, 20 nt, Human
gccugggaugggcacagcug

SEQ ID NO: 661027 - RNA, 23 nt, Human
gcgggacagcagcagcccgggaa

SEQ ID NO: 661028 - RNA, 24 nt, Human
gcuaacacggugaaaccccaucuc

SEQ ID NO: 661029 - RNA, 18 nt, Human
gcuacagcacauccccug

SEQ ID NO: 661030 - RNA, 20 nt, Human
gcugggugggucagccuggg

SEQ ID NO: 661031 - RNA, 20 nt, Human
gcugggugggucagccuggg

SEQ ID NO: 661032 - RNA, 18 nt, Human
ggaccagcacccaccccc

SEQ ID NO: 661033 - RNA, 21 nt, Human
ggagacagagggcugagggcc

SEQ ID NO: 661034 - RNA, 24 nt, Human
ggagagggcucucauccagaagcc

SEQ ID NO: 661035 - RNA, 24 nt, Human
ggagcuugcagugagccaagaucg

SEQ ID NO: 661036 - RNA, 20 nt, Human
ggaggcagaggcaagaggac

SEQ ID NO: 661037 - RNA, 18 nt, Human
ggaggcagagggaagagg

SEQ ID NO: 661038 - RNA, 24 nt, Human
ggagguuccugaggcccugagagc

SEQ ID NO: 661039 - RNA, 24 nt, Human
ggagguuccugaggcccugagagc

SEQ ID NO: 661040 - RNA, 23 nt, Human
ggcacugcuggagcagagggagg

SEQ ID NO: 661041 - RNA, 20 nt, Human
ggcagaaauaagcggaucug

SEQ ID NO: 661042 - RNA, 24 nt, Human
ggcaggggcuggugggccccaggg

SEQ ID NO: 661043 - RNA, 22 nt, Human
ggccgcccaccucggcccaccc

SEQ ID NO: 661044 - RNA, 22 nt, Human
ggcuacagcacauccccugccc

SEQ ID NO: 661045 - RNA, 20 nt, Human
gggaaaguggucaggcagag

SEQ ID NO: 661046 - RNA, 20 nt, Human
gggaaaguggucaggcagag

SEQ ID NO: 661047 - RNA, 24 nt, Human
gggacccaagcuguguccugcccu

SEQ ID NO: 661048 - RNA, 20 nt, Human
gggaggcagaggcaagagga

SEQ ID NO: 661049 - RNA, 19 nt, Human
gggaggcagagggaagagg

SEQ ID NO: 661050 - RNA, 21 nt, Human
gggaggcagagggaagaggac

SEQ ID NO: 661051 - RNA, 24 nt, Human
gggcaaggacaggguagggugggg

SEQ ID NO: 661052 - RNA, 28 nt, Human
gggcaggaaccuggagaggaggcuugga

SEQ ID NO: 661053 - RNA, 28 nt, Human
gggcaggaaccuggagaggaggcuugga

SEQ ID NO: 661054 - RNA, 18 nt, Human
gggcuggugggccccagg

SEQ ID NO: 661055 - RNA, 22 nt, Human
ggggaggggugggugggguggg

SEQ ID NO: 661056 - RNA, 21 nt, Human
ggggcagggggcagggaccag

SEQ ID NO: 661057 - RNA, 18 nt, Human
gggguggggcagggggca

SEQ ID NO: 661058 - RNA, 18 nt, Human
ggguggguggggugggga

SEQ ID NO: 661059 - RNA, 24 nt, Human
gguggcucacgccuguaaucccag

SEQ ID NO: 661060 - RNA, 18 nt, Human
ggugggaggcagagggaa

SEQ ID NO: 661061 - RNA, 20 nt, Human
ggugggguggucugugagcc

SEQ ID NO: 661062 - RNA, 22 nt, Human
gucacaguggagaggguggcag

SEQ ID NO: 661063 - RNA, 19 nt, Human
gucuuguccgaauccccuc

SEQ ID NO: 661064 - RNA, 23 nt, Human
guggcucacgccuguaaucccag

SEQ ID NO: 661065 - RNA, 21 nt, Human
gugggguggggagagggcucu

SEQ ID NO: 661066 - RNA, 18 nt, Human
uaaaguaucucucgaagg

SEQ ID NO: 661067 - RNA, 19 nt, Human
uaaauugucaaaaagaaac

SEQ ID NO: 661068 - RNA, 22 nt, Human
uaacacggugaaaccccaucuc

SEQ ID NO: 661069 - RNA, 24 nt, Human
uaacacggugaaaccccaucucua

SEQ ID NO: 661070 - RNA, 23 nt, Human
uaacuccuccgcaaaccugacac

SEQ ID NO: 661071 - RNA, 24 nt, Human
uaggaggccgaggcaggcggauca

SEQ ID NO: 661072 - RNA, 21 nt, Human
uaggccaggcgugguggcuca

SEQ ID NO: 661073 - RNA, 24 nt, Human
uauggaaggagguuccugaggccc

SEQ ID NO: 661074 - RNA, 22 nt, Human
ucaaaaagaaacacaagaauca

SEQ ID NO: 661075 - RNA, 24 nt, Human
ucacgaggucaggauaucaagacc

SEQ ID NO: 661076 - RNA, 21 nt, Human
ucacggaggggacccaagcug

SEQ ID NO: 661077 - RNA, 20 nt, Human
ucaugguggaggugaagagu

SEQ ID NO: 661078 - RNA, 20 nt, Human
uccacacgccugggcgcccg

SEQ ID NO: 661079 - RNA, 18 nt, Human
uccagccugggugacaga

SEQ ID NO: 661080 - RNA, 25 nt, Human
ucccacggccccacauggaggaacu

SEQ ID NO: 661081 - RNA, 18 nt, Human
uccccaggcacaggcccu

SEQ ID NO: 661082 - RNA, 19 nt, Human
uccccaggcacaggcccug

SEQ ID NO: 661083 - RNA, 21 nt, Human
uccccaggcacaggcccugaa

SEQ ID NO: 661084 - RNA, 21 nt, Human
uccccaggcacaggcccugaa

SEQ ID NO: 661085 - RNA, 18 nt, Human
ucccugagcaccugccaa

SEQ ID NO: 661086 - RNA, 18 nt, Human
ucccugagcaccugccaa

SEQ ID NO: 661087 - RNA, 19 nt, Human
uccgcaaaccugacacuac

SEQ ID NO: 661088 - RNA, 23 nt, Human
ucgcaccacugcacuccagccug

SEQ ID NO: 661089 - RNA, 26 nt, Human
ucggcccacccaccucagcccaugcu

SEQ ID NO: 661090 - RNA, 22 nt, Human
ucucuacuaaaaguacaaaaaa

SEQ ID NO: 661091 - RNA, 19 nt, Human
ugaaaccccaucucuacua

SEQ ID NO: 661092 - RNA, 24 nt, Human
ugacgggcgccuguggucccagcu

SEQ ID NO: 661093 - RNA, 20 nt, Human
ugagacaccggagccagaga

SEQ ID NO: 661094 - RNA, 23 nt, Human
ugagacaggagaauggcaugaac

SEQ ID NO: 661095 - RNA, 24 nt, Human
ugagacaggagaauggcaugaacu

SEQ ID NO: 661096 - RNA, 21 nt, Human
ugagcaaaaccgaccagggug

SEQ ID NO: 661097 - RNA, 20 nt, Human
ugaggaagacgaaaagggca

SEQ ID NO: 661098 - RNA, 20 nt, Human
ugaggaagacgaaaagggca

SEQ ID NO: 661099 - RNA, 22 nt, Human
ugaggaagacgaaaagggcagg

SEQ ID NO: 661100 - RNA, 22 nt, Human
ugaggcccugagagcacagcuc

SEQ ID NO: 661101 - RNA, 22 nt, Human
ugaggcccugagagcacagcuc

SEQ ID NO: 661102 - RNA, 18 nt, Human
ugaguggaggcaagaggc

SEQ ID NO: 661103 - RNA, 20 nt, Human
ugcaaccccagcugcccuuc

SEQ ID NO: 661104 - RNA, 22 nt, Human
ugcagaugccagcccaucuccu

SEQ ID NO: 661105 - RNA, 18 nt, Human
ugccaagcacuggccugg

SEQ ID NO: 661106 - RNA, 18 nt, Human
ugccaagcacuggccugg

SEQ ID NO: 661107 - RNA, 25 nt, Human
ugccagcccaucuccuggcuaucac

SEQ ID NO: 661108 - RNA, 18 nt, Human
ugccccacagagggcggg

SEQ ID NO: 661109 - RNA, 24 nt, Human
ugccccaccagcaccccaaggcca

SEQ ID NO: 661110 - RNA, 18 nt, Human
ugcccugacacccccagc

SEQ ID NO: 661111 - RNA, 23 nt, Human
ugcccugacacccccagcuuccu

SEQ ID NO: 661112 - RNA, 20 nt, Human
uggaagcagcagcacugaug

SEQ ID NO: 661113 - RNA, 20 nt, Human
uggaagcagcagcacugaug

SEQ ID NO: 661114 - RNA, 22 nt, Human
uggaggccccagcaggggagca

SEQ ID NO: 661115 - RNA, 18 nt, Human
uggaggugcugggccaga

SEQ ID NO: 661116 - RNA, 18 nt, Human
uggauggccaggaaggcu

SEQ ID NO: 661117 - RNA, 18 nt, Human
uggauggccaggaaggcu

SEQ ID NO: 661118 - RNA, 18 nt, Human
uggcaugaacuugggagg

SEQ ID NO: 661119 - RNA, 24 nt, Human
uggcucacgccuguaaucccagca

SEQ ID NO: 661120 - RNA, 23 nt, Human
ugggaggaaagacgcaaggcugg

SEQ ID NO: 661121 - RNA, 19 nt, Human
ugggaggcagaggcaagag

SEQ ID NO: 661122 - RNA, 20 nt, Human
ugggaggcagaggcaagagg

SEQ ID NO: 661123 - RNA, 29 nt, Human
ugggaggcggagcuugcagugacaacggu

SEQ ID NO: 661124 - RNA, 24 nt, Human
ugggaggcggagcuugcagugagc

SEQ ID NO: 661125 - RNA, 21 nt, Human
ugggcaaggacaggguagggu

SEQ ID NO: 661126 - RNA, 19 nt, Human
ugggcaccuccuccugccc

SEQ ID NO: 661127 - RNA, 22 nt, Human
ugggcucggguccacacgccug

SEQ ID NO: 661128 - RNA, 24 nt, Human
uggggaaaguggucaggcagagac

SEQ ID NO: 661129 - RNA, 19 nt, Human
uggggcagggggcagggac

SEQ ID NO: 661130 - RNA, 19 nt, Human
ugggugggguggggagagg

SEQ ID NO: 661131 - RNA, 24 nt, Human
ugguggcucacgccuguaauccca

SEQ ID NO: 661132 - RNA, 19 nt, Human
uguccugcccucgugucuc

SEQ ID NO: 661133 - RNA, 20 nt, Human
uguccugcccucgugucucc

SEQ ID NO: 661134 - RNA, 21 nt, Human
ugucuguggagcagacaucag

SEQ ID NO: 661135 - RNA, 23 nt, Human
ugucuguggagcagacaucaggg

SEQ ID NO: 661136 - RNA, 21 nt, Human
uuaaugauuauaaagugucca

SEQ ID NO: 661137 - RNA, 27 nt, Human
uuccauggcccccuucugggguugggg

SEQ ID NO: 661138 - RNA, 22 nt, Human
uugaaaucaccagguaaaagga

SEQ ID NO: 661139 - RNA, 23 nt, Human
uugagacaggagaauggcaugaa

SEQ ID NO: 661140 - RNA, 22 nt, Human
uugcagugagccaagaucgcac

SEQ ID NO: 661141 - RNA, 21 nt, Human
uuuaaaguaucucucgaaggc

SEQ ID NO: 661142 - RNA, 23 nt, Human
uuuuuuuuuuuuaaaauuaggcc

SEQ ID NO: 661143 - RNA, 22 nt, Human
cuuuauuuuaaggucauaagag

SEQ ID NO: 661144 - RNA, 22 nt, Human
gucacaauacguuuaagucaaa

SEQ ID NO: 661145 - RNA, 24 nt, Human
ucucuggccugguucuuuuucagg

SEQ ID NO: 661146 - RNA, 24 nt, Human
uuucagggcugagguggcaccuuu

SEQ ID NO: 661147 - RNA, 21 nt, Human
uuuuucagggcugaggugggg

SEQ ID NO: 661148 - RNA, 24 nt, Human
aaaagaacacuucgaggaguaaga

SEQ ID NO: 661149 - RNA, 20 nt, Human
aaacaaccagaucucacgag

SEQ ID NO: 661150 - RNA, 23 nt, Human
aaacaaccagaucucacgagaac

SEQ ID NO: 661151 - RNA, 24 nt, Human
aaacaguagauccaaaagggcaac

SEQ ID NO: 661152 - RNA, 18 nt, Human
aaagaaauccccaagacc

SEQ ID NO: 661153 - RNA, 21 nt, Human
aaagaaauccccaagaccagg

SEQ ID NO: 661154 - RNA, 25 nt, Human
aaagaauuuuauuccuuuggccuuc

SEQ ID NO: 661155 - RNA, 24 nt, Human
aaaggguuggaauuauaggcauga

SEQ ID NO: 661156 - RNA, 22 nt, Human
aacaagauacuuauugaaucca

SEQ ID NO: 661157 - RNA, 24 nt, Human
aacaagauacuuauugaauccaaa

SEQ ID NO: 661158 - RNA, 23 nt, Human
aacaguagauccaaaagggcaac

SEQ ID NO: 661159 - RNA, 18 nt, Human
aaccagaucucacgagaa

SEQ ID NO: 661160 - RNA, 19 nt, Human
aacuuccgccucccgguuc

SEQ ID NO: 661161 - RNA, 19 nt, Human
aaggagguguugggaagga

SEQ ID NO: 661162 - RNA, 22 nt, Human
aaguagcugggauugcaggcau

SEQ ID NO: 661163 - RNA, 24 nt, Human
aaguagcugggauugcaggcaugu

SEQ ID NO: 661164 - RNA, 18 nt, Human
acacagauccaaaccgua

SEQ ID NO: 661165 - RNA, 24 nt, Human
acaggguuucuccauguuggucag

SEQ ID NO: 661166 - RNA, 18 nt, Human
acaguucugcaggcugua

SEQ ID NO: 661167 - RNA, 23 nt, Human
acaugaaggacugacccaaucug

SEQ ID NO: 661168 - RNA, 22 nt, Human
acaugacccucuuaacaucucu

SEQ ID NO: 661169 - RNA, 22 nt, Human
acaugacccucuuagcaucucu

SEQ ID NO: 661170 - RNA, 19 nt, Human
acccccaugaccucacgau

SEQ ID NO: 661171 - RNA, 20 nt, Human
accucacgauccagcugccu

SEQ ID NO: 661172 - RNA, 24 nt, Human
acucuaaaagaacacuucgaggag

SEQ ID NO: 661173 - RNA, 18 nt, Human
agacaggguuucuccaug

SEQ ID NO: 661174 - RNA, 18 nt, Human
agacaggguuucuccaug

SEQ ID NO: 661175 - RNA, 24 nt, Human
agaccagguaauuuauaagaaaag

SEQ ID NO: 661176 - RNA, 20 nt, Human
agaccucaggugauccaccu

SEQ ID NO: 661177 - RNA, 21 nt, Human
agagcaagcugaucuuggcug

SEQ ID NO: 661178 - RNA, 21 nt, Human
agccugaucagcuaucacauc

SEQ ID NO: 661179 - RNA, 24 nt, Human
agcucucugccuuuguuuuccuau

SEQ ID NO: 661180 - RNA, 19 nt, Human
aggaagcguggcagcaucu

SEQ ID NO: 661181 - RNA, 23 nt, Human
aggaaguguuggggaaggaggug

SEQ ID NO: 661182 - RNA, 22 nt, Human
aggagguguugggaaggcggug

SEQ ID NO: 661183 - RNA, 21 nt, Human
aggcaugaaccaccacgucca

SEQ ID NO: 661184 - RNA, 20 nt, Human
aggcaugugccacaaugccc

SEQ ID NO: 661185 - RNA, 19 nt, Human
agggacacagauccaaacc

SEQ ID NO: 661186 - RNA, 24 nt, Human
aggugauccaccugucccggccuc

SEQ ID NO: 661187 - RNA, 23 nt, Human
agugauucuccugccccagccuc

SEQ ID NO: 661188 - RNA, 24 nt, Human
agugcaauggcaugaucuuggcuc

SEQ ID NO: 661189 - RNA, 24 nt, Human
aguuuuguauuuuuaguagagaca

SEQ ID NO: 661190 - RNA, 24 nt, Human
auacuuauugaauccaaaaggcca

SEQ ID NO: 661191 - RNA, 22 nt, Human
auggcagcagcagggggcagag

SEQ ID NO: 661192 - RNA, 22 nt, Human
caaguagcugggauugcaggca

SEQ ID NO: 661193 - RNA, 23 nt, Human
caaguagcugggauugcaggcau

SEQ ID NO: 661194 - RNA, 18 nt, Human
caaucugugucuguggug

SEQ ID NO: 661195 - RNA, 18 nt, Human
caaugcccagcuaguuuu

SEQ ID NO: 661196 - RNA, 19 nt, Human
caauggauucaccagaauc

SEQ ID NO: 661197 - RNA, 18 nt, Human
cacacaaacaccaaacau

SEQ ID NO: 661198 - RNA, 24 nt, Human
caccagaaucacuggaagcaauga

SEQ ID NO: 661199 - RNA, 20 nt, Human
cacucugucucagcacucug

SEQ ID NO: 661200 - RNA, 21 nt, Human
cacugcaacuuccgccucccg

SEQ ID NO: 661201 - RNA, 22 nt, Human
cagcagcagggggcagagcugg

SEQ ID NO: 661202 - RNA, 26 nt, Human
cagcagcagggggcagagcuggacag

SEQ ID NO: 661203 - RNA, 22 nt, Human
cagcugccucccaccaggcucc

SEQ ID NO: 661204 - RNA, 18 nt, Human
caggaagcuuucacuugc

SEQ ID NO: 661205 - RNA, 24 nt, Human
caggguuucuccauguuggucagg

SEQ ID NO: 661206 - RNA, 20 nt, Human
caggugauccaccugucccc

SEQ ID NO: 661207 - RNA, 19 nt, Human
cauccugguucugcugcca

SEQ ID NO: 661208 - RNA, 21 nt, Human
cauuuguuucccagagcuggu

SEQ ID NO: 661209 - RNA, 24 nt, Human
ccaaaggguuggaauuauaggcau

SEQ ID NO: 661210 - RNA, 21 nt, Human
ccaccaggcuccaucuccaac

SEQ ID NO: 661211 - RNA, 20 nt, Human
ccauguuggucagguuguuc

SEQ ID NO: 661212 - RNA, 22 nt, Human
ccauguuggucagguuguucuc

SEQ ID NO: 661213 - RNA, 22 nt, Human
cccccagguucuccaaucaugc

SEQ ID NO: 661214 - RNA, 22 nt, Human
ccucccaccaggcuccaucucc

SEQ ID NO: 661215 - RNA, 24 nt, Human
ccucuuguugcccaggcuggagug

SEQ ID NO: 661216 - RNA, 20 nt, Human
ccugguucugcugccauggg

SEQ ID NO: 661217 - RNA, 19 nt, Human
ccuucacaucuugaguggc

SEQ ID NO: 661218 - RNA, 24 nt, Human
cuaguuuuguauuuuuaguagaga

SEQ ID NO: 661219 - RNA, 23 nt, Human
cucaaguagcugggauugcaggc

SEQ ID NO: 661220 - RNA, 24 nt, Human
cucacugcaacuuccgccucccgg

SEQ ID NO: 661221 - RNA, 21 nt, Human
cuccaacaccggggaccacag

SEQ ID NO: 661222 - RNA, 19 nt, Human
cucucugccuuuguuuucc

SEQ ID NO: 661223 - RNA, 21 nt, Human
cugcugaacauuuuaauaucu

SEQ ID NO: 661224 - RNA, 24 nt, Human
cuggagugcaauggcaugaucuug

SEQ ID NO: 661225 - RNA, 25 nt, Human
cuuaacaaagaaggaauugugugga

SEQ ID NO: 661226 - RNA, 30 nt, Human
cuuaacaucucugauacaauaaccagagaa

SEQ ID NO: 661227 - RNA, 22 nt, Human
cuuccaauucccccagguucuc

SEQ ID NO: 661228 - RNA, 26 nt, Human
cuuccagagaccuggucuggaccauc

SEQ ID NO: 661229 - RNA, 24 nt, Human
cuuguugcccaggcuggagugcaa

SEQ ID NO: 661230 - RNA, 22 nt, Human
cuuuuaaacaaccagaucucac

SEQ ID NO: 661231 - RNA, 22 nt, Human
gaccucacgauccagcugccuc

SEQ ID NO: 661232 - RNA, 18 nt, Human
gaccucaggugauccacc

SEQ ID NO: 661233 - RNA, 18 nt, Human
gaccucaggugauccacc

SEQ ID NO: 661234 - RNA, 22 nt, Human
gaccucaggugauccaccuguc

SEQ ID NO: 661235 - RNA, 20 nt, Human
gagacaggguuucuccaugu

SEQ ID NO: 661236 - RNA, 18 nt, Human
gagagugagcggagaggu

SEQ ID NO: 661237 - RNA, 23 nt, Human
gagcugguuuuagauucuugggg

SEQ ID NO: 661238 - RNA, 22 nt, Human
gaggaagagagugagcggagag

SEQ ID NO: 661239 - RNA, 18 nt, Human
gauugcaggcaugugcca

SEQ ID NO: 661240 - RNA, 24 nt, Human
gauugcaggcaugugccacaaugc

SEQ ID NO: 661241 - RNA, 21 nt, Human
gcagcagcagggggcagagcu

SEQ ID NO: 661242 - RNA, 24 nt, Human
gcccaggcuggagugcaauggcau

SEQ ID NO: 661243 - RNA, 24 nt, Human
gccucccgguucuagugauucucc

SEQ ID NO: 661244 - RNA, 19 nt, Human
gcuggagugcaauggcaug

SEQ ID NO: 661245 - RNA, 20 nt, Human
gcuuuagcucucugccuuug

SEQ ID NO: 661246 - RNA, 21 nt, Human
ggaaggagguguugggaagga

SEQ ID NO: 661247 - RNA, 21 nt, Human
ggaaggagguguugggaagga

SEQ ID NO: 661248 - RNA, 21 nt, Human
ggaaggagguguugggaagga

SEQ ID NO: 661249 - RNA, 21 nt, Human
ggaaggagguguugggaagga

SEQ ID NO: 661250 - RNA, 22 nt, Human
ggaaggagguguuugggaagga

SEQ ID NO: 661251 - RNA, 20 nt, Human
ggaaggcgguguugggaagg

SEQ ID NO: 661252 - RNA, 20 nt, Human
ggaaucuugccuucuugcag

SEQ ID NO: 661253 - RNA, 20 nt, Human
gggaaggaaguguuggggaa

SEQ ID NO: 661254 - RNA, 24 nt, Human
gggaaggagggguuugggaaggag

SEQ ID NO: 661255 - RNA, 22 nt, Human
gggaaggagguguugggaagga

SEQ ID NO: 661256 - RNA, 22 nt, Human
gggaaggagguguugggaagga

SEQ ID NO: 661257 - RNA, 22 nt, Human
gggaaggagguguugggaagga

SEQ ID NO: 661258 - RNA, 22 nt, Human
gggaaggagguguugggaagga

SEQ ID NO: 661259 - RNA, 23 nt, Human
gggaaggagguguugggaaggag

SEQ ID NO: 661260 - RNA, 23 nt, Human
gggaaggagguguugggaaggag

SEQ ID NO: 661261 - RNA, 23 nt, Human
gggaaggagguguugggaaggau

SEQ ID NO: 661262 - RNA, 24 nt, Human
gggaaggagguguuggggaaggag

SEQ ID NO: 661263 - RNA, 24 nt, Human
gggaaggagguguuggggaaggag

SEQ ID NO: 661264 - RNA, 21 nt, Human
ggggaaggagguguuggggaa

SEQ ID NO: 661265 - RNA, 21 nt, Human
ggggaaggagguguuggggaa

SEQ ID NO: 661266 - RNA, 24 nt, Human
gguguuugggaaggagauguuugg

SEQ ID NO: 661267 - RNA, 19 nt, Human
guaagauaaugauucucuu

SEQ ID NO: 661268 - RNA, 21 nt, Human
gucucagcacucuggccugug

SEQ ID NO: 661269 - RNA, 18 nt, Human
gugaagcgugguaaaaua

SEQ ID NO: 661270 - RNA, 24 nt, Human
gugauccaccugucccggccuccc

SEQ ID NO: 661271 - RNA, 22 nt, Human
gugauucuccugccccagccuc

SEQ ID NO: 661272 - RNA, 23 nt, Human
guguuggggaaggagguguuggg

SEQ ID NO: 661273 - RNA, 23 nt, Human
uaaaacugcugcgaccuucuaaa

SEQ ID NO: 661274 - RNA, 22 nt, Human
uaaaagaacacuucgaggagua

SEQ ID NO: 661275 - RNA, 27 nt, Human
uaaaauacucuuucugaagccuguuuu

SEQ ID NO: 661276 - RNA, 18 nt, Human
uaaacaaccagaucucac

SEQ ID NO: 661277 - RNA, 19 nt, Human
uaaagaaauccccaagacc

SEQ ID NO: 661278 - RNA, 28 nt, Human
uaacuccuucgugagaacuccacccccu

SEQ ID NO: 661279 - RNA, 18 nt, Human
uaagaaaagagguuugau

SEQ ID NO: 661280 - RNA, 23 nt, Human
uaagauaaugauucucuuccuuc

SEQ ID NO: 661281 - RNA, 19 nt, Human
uacaaacaguacugcagua

SEQ ID NO: 661282 - RNA, 22 nt, Human
uagagacaggguuucuccaugu

SEQ ID NO: 661283 - RNA, 21 nt, Human
uaggcaugaaccaccacgucc

SEQ ID NO: 661284 - RNA, 24 nt, Human
uaguagagacaggguuucuccaug

SEQ ID NO: 661285 - RNA, 23 nt, Human
uauuugcaacuguaugucccuua

SEQ ID NO: 661286 - RNA, 18 nt, Human
ucaaauccaaguucaacu

SEQ ID NO: 661287 - RNA, 24 nt, Human
ucaaguagcugggauugcaggcau

SEQ ID NO: 661288 - RNA, 19 nt, Human
ucacugcaacuuccgccuc

SEQ ID NO: 661289 - RNA, 23 nt, Human
ucacugcaacuuccgccucccgg

SEQ ID NO: 661290 - RNA, 24 nt, Human
ucacugcaacuuccgccucccggu

SEQ ID NO: 661291 - RNA, 26 nt, Human
ucacugcaacuuccgccucccgguuc

SEQ ID NO: 661292 - RNA, 19 nt, Human
ucagugauaugaaaucaga

SEQ ID NO: 661293 - RNA, 19 nt, Human
ucaugccacaugacccucu

SEQ ID NO: 661294 - RNA, 19 nt, Human
uccacaguucugcaggcuu

SEQ ID NO: 661295 - RNA, 24 nt, Human
uccauccugguucugcugccaugg

SEQ ID NO: 661296 - RNA, 24 nt, Human
ucccaaaggguuggaauuauaggc

SEQ ID NO: 661297 - RNA, 23 nt, Human
ucccgguucuagugauucuccug

SEQ ID NO: 661298 - RNA, 22 nt, Human
ucccuugggaaucuugccuuca

SEQ ID NO: 661299 - RNA, 20 nt, Human
uccucuuguugcccaggcug

SEQ ID NO: 661300 - RNA, 21 nt, Human
uccucuuguugcccaggcugg

SEQ ID NO: 661301 - RNA, 22 nt, Human
uccucuuguugcccaggcugga

SEQ ID NO: 661302 - RNA, 24 nt, Human
uccucuuguugcccaggcuggagu

SEQ ID NO: 661303 - RNA, 21 nt, Human
ucgaggaguaagauaaugauu

SEQ ID NO: 661304 - RNA, 23 nt, Human
ucuagugauucuccugccccagc

SEQ ID NO: 661305 - RNA, 24 nt, Human
ucucaaguagcugggauugcaggc

SEQ ID NO: 661306 - RNA, 30 nt, Human
ucucacauuaaauaaagaaauccccaagaa

SEQ ID NO: 661307 - RNA, 26 nt, Human
ucuccugccccagccucucaaguagc

SEQ ID NO: 661308 - RNA, 19 nt, Human
ucuggaccaucaguuucaa

SEQ ID NO: 661309 - RNA, 22 nt, Human
ucuuguugcccaggcuggagug

SEQ ID NO: 661310 - RNA, 24 nt, Human
ugaaacuuggagaaacaaagaaaa

SEQ ID NO: 661311 - RNA, 20 nt, Human
ugaagagaggcagguguuug

SEQ ID NO: 661312 - RNA, 23 nt, Human
ugaagagaggcagguguuuggga

SEQ ID NO: 661313 - RNA, 21 nt, Human
ugacccaaucugugucugugg

SEQ ID NO: 661314 - RNA, 21 nt, Human
ugagauaauaaggccuuccaa

SEQ ID NO: 661315 - RNA, 21 nt, Human
ugaguauuugcaacuguaugu

SEQ ID NO: 661316 - RNA, 20 nt, Human
ugauucuccugccccagccu

SEQ ID NO: 661317 - RNA, 18 nt, Human
ugcccaggcuggagugca

SEQ ID NO: 661318 - RNA, 21 nt, Human
ugcccaggcuggagugcaaug

SEQ ID NO: 661319 - RNA, 24 nt, Human
ugcccaggcuggagugcaauggca

SEQ ID NO: 661320 - RNA, 24 nt, Human
ugccccagccucucaaguagcugg

SEQ ID NO: 661321 - RNA, 23 nt, Human
ugccucccaccaggcuccaucuc

SEQ ID NO: 661322 - RNA, 22 nt, Human
ugccugcugaacauuuuaauau

SEQ ID NO: 661323 - RNA, 24 nt, Human
ugcuuuagcucucugccuuuguuu

SEQ ID NO: 661324 - RNA, 24 nt, Human
uggaauuauaggcaugaaccacca

SEQ ID NO: 661325 - RNA, 19 nt, Human
uggagugcaauggcaugau

SEQ ID NO: 661326 - RNA, 24 nt, Human
uggagugcaauggcaugaucuugg

SEQ ID NO: 661327 - RNA, 18 nt, Human
uggcagcagcagggggca

SEQ ID NO: 661328 - RNA, 18 nt, Human
uggcagcagcagggggca

SEQ ID NO: 661329 - RNA, 19 nt, Human
uggcagcagcagggggcag

SEQ ID NO: 661330 - RNA, 21 nt, Human
uggcagcagcagggggcagag

SEQ ID NO: 661331 - RNA, 23 nt, Human
uggcagcagcagggggcagagcu

SEQ ID NO: 661332 - RNA, 19 nt, Human
uggcagcaucugcuuccgg

SEQ ID NO: 661333 - RNA, 19 nt, Human
uggcaugaucuuggcucac

SEQ ID NO: 661334 - RNA, 21 nt, Human
uggcaugaucuuggcucacug

SEQ ID NO: 661335 - RNA, 18 nt, Human
ugggaaagagguguuugg

SEQ ID NO: 661336 - RNA, 25 nt, Human
ugggaaggaaguguuggggaaggag

SEQ ID NO: 661337 - RNA, 26 nt, Human
ugggaaggagauguuugggaaagggg

SEQ ID NO: 661338 - RNA, 25 nt, Human
ugggaaggaggugucugggaaggag

SEQ ID NO: 661339 - RNA, 24 nt, Human
ugggaaggagguguugggaaggaa

SEQ ID NO: 661340 - RNA, 25 nt, Human
ugggaaggagguguugggaaggcgg

SEQ ID NO: 661341 - RNA, 25 nt, Human
ugggaaggagguguuggggaaggag

SEQ ID NO: 661342 - RNA, 18 nt, Human
ugggaaggagguguuugg

SEQ ID NO: 661343 - RNA, 18 nt, Human
ugggaaggagguguuugg

SEQ ID NO: 661344 - RNA, 18 nt, Human
ugggaaggagguguuugg

SEQ ID NO: 661345 - RNA, 18 nt, Human
ugggaaggagguguuugg

SEQ ID NO: 661346 - RNA, 18 nt, Human
ugggaaggagguguuugg

SEQ ID NO: 661347 - RNA, 25 nt, Human
ugggaaggagguguuugggaaggag

SEQ ID NO: 661348 - RNA, 25 nt, Human
ugggaaggagguguuugggaaggag

SEQ ID NO: 661349 - RNA, 25 nt, Human
ugggaaggagguguuugggaaggag

SEQ ID NO: 661350 - RNA, 19 nt, Human
ugggaaggauguuggggaa

SEQ ID NO: 661351 - RNA, 18 nt, Human
ugggauugcaggcaugug

SEQ ID NO: 661352 - RNA, 21 nt, Human
ugggauugcaggcaugugcca

SEQ ID NO: 661353 - RNA, 24 nt, Human
uggguuuuccucuuguugcccagg

SEQ ID NO: 661354 - RNA, 19 nt, Human
ugucugggaagccugauca

SEQ ID NO: 661355 - RNA, 21 nt, Human
uguuaagaugcagaugcagaa

SEQ ID NO: 661356 - RNA, 20 nt, Human
uguugcccaggcuggagugc

SEQ ID NO: 661357 - RNA, 21 nt, Human
uguugggaaggaggugucugg

SEQ ID NO: 661358 - RNA, 21 nt, Human
uguugggaaggagguguuugg

SEQ ID NO: 661359 - RNA, 21 nt, Human
uguugggaaggagguguuugg

SEQ ID NO: 661360 - RNA, 19 nt, Human
uguugggaaggauguuggg

SEQ ID NO: 661361 - RNA, 18 nt, Human
uguuggggaaggaggggu

SEQ ID NO: 661362 - RNA, 24 nt, Human
uguuggggaaggagggguuuggga

SEQ ID NO: 661363 - RNA, 20 nt, Human
uguuggggaaggagguguug

SEQ ID NO: 661364 - RNA, 20 nt, Human
uguuugggaaagagguguuu

SEQ ID NO: 661365 - RNA, 20 nt, Human
uguuugggaaggagguguug

SEQ ID NO: 661366 - RNA, 24 nt, Human
uuaguagagacaggguuucuccau

SEQ ID NO: 661367 - RNA, 18 nt, Human
uucaucucuccggggcuc

SEQ ID NO: 661368 - RNA, 23 nt, Human
uuccucuuguugcccaggcugga

SEQ ID NO: 661369 - RNA, 24 nt, Human
uuccucuuguugcccaggcuggag

SEQ ID NO: 661370 - RNA, 18 nt, Human
uucuagugauucuccugc

SEQ ID NO: 661371 - RNA, 22 nt, Human
uucucacauuaaauaaagaaau

SEQ ID NO: 661372 - RNA, 22 nt, Human
uucuuccagagaccuggucugg

SEQ ID NO: 661373 - RNA, 18 nt, Human
uugcccaggcuggagugc

SEQ ID NO: 661374 - RNA, 24 nt, Human
uuuccucuuguugcccaggcugga

SEQ ID NO: 661375 - RNA, 21 nt, Human
uuuccuguuccugcuccauau

SEQ ID NO: 661376 - RNA, 19 nt, Human
uuucuccauguuggucagg

SEQ ID NO: 661377 - RNA, 20 nt, Human
uuucuccauguuggucaggu

SEQ ID NO: 661378 - RNA, 22 nt, Human
uuugcucuaacaccccccgauu

SEQ ID NO: 661379 - RNA, 19 nt, Human
uuuguuagggacacagauc

SEQ ID NO: 661380 - RNA, 20 nt, Human
uuuuacacacaaacaccaaa

SEQ ID NO: 661381 - RNA, 24 nt, Human
uuuuccucuuguugcccaggcugg

SEQ ID NO: 661382 - RNA, 21 nt, Human
uuuugagacuggguuuuccuu

SEQ ID NO: 661383 - RNA, 19 nt, Human
uuuuguauuuuuaguagag

SEQ ID NO: 661384 - RNA, 20 nt, Human
uuuuguauuuuuaguagaga

SEQ ID NO: 661385 - RNA, 18 nt, Human
aaaauucuucuaauggua

SEQ ID NO: 661386 - RNA, 21 nt, Human
aaauaaacaucuccacucucu

SEQ ID NO: 661387 - RNA, 24 nt, Human
acagcaugaaaacaagccugacgc

SEQ ID NO: 661388 - RNA, 23 nt, Human
acuguaauuuaucaaagguaguu

SEQ ID NO: 661389 - RNA, 21 nt, Human
agaaaaacagcuuuucacagg

SEQ ID NO: 661390 - RNA, 22 nt, Human
agaaaauauauucuucaaggcc

SEQ ID NO: 661391 - RNA, 21 nt, Human
aggugacacaaucuuugacug

SEQ ID NO: 661392 - RNA, 24 nt, Human
aguguggcggccagguggcagaag

SEQ ID NO: 661393 - RNA, 21 nt, Human
caagccugacgcuuaggccag

SEQ ID NO: 661394 - RNA, 24 nt, Human
cacacaguauuacauuaauuuaua

SEQ ID NO: 661395 - RNA, 20 nt, Human
cacagcaugaaaacaagccu

SEQ ID NO: 661396 - RNA, 21 nt, Human
cacaguaaauuuucuagugcc

SEQ ID NO: 661397 - RNA, 19 nt, Human
cagaaaagccacaguaaau

SEQ ID NO: 661398 - RNA, 22 nt, Human
cagcaugaaaacaagccugacg

SEQ ID NO: 661399 - RNA, 19 nt, Human
caguaaauuuucuagugcc

SEQ ID NO: 661400 - RNA, 22 nt, Human
ccaagugucauaugacagacau

SEQ ID NO: 661401 - RNA, 19 nt, Human
ccacucucucuaagugugg

SEQ ID NO: 661402 - RNA, 27 nt, Human
ccagauaucauagccaucuaguugaau

SEQ ID NO: 661403 - RNA, 18 nt, Human
cugaagcacagcagugga

SEQ ID NO: 661404 - RNA, 24 nt, Human
cuuggcacugagcaggacaguuuu

SEQ ID NO: 661405 - RNA, 23 nt, Human
gaaauaaacaucuccacucucuc

SEQ ID NO: 661406 - RNA, 22 nt, Human
ggcagugugcucaaacauucuu

SEQ ID NO: 661407 - RNA, 19 nt, Human
gggguaccagucagugaug

SEQ ID NO: 661408 - RNA, 21 nt, Human
uaaaaugaggugcaagcuguu

SEQ ID NO: 661409 - RNA, 19 nt, Human
uaauagucugaauucacac

SEQ ID NO: 661410 - RNA, 22 nt, Human
uaauuuaucaaagguaguuuua

SEQ ID NO: 661411 - RNA, 21 nt, Human
uacagugcuugauaauuugaa

SEQ ID NO: 661412 - RNA, 20 nt, Human
uagcaccuuggcacugagca

SEQ ID NO: 661413 - RNA, 21 nt, Human
uaggaaacagaugaaagauaa

SEQ ID NO: 661414 - RNA, 22 nt, Human
uaugacagacauacaaaaauuc

SEQ ID NO: 661415 - RNA, 23 nt, Human
ucaccacguuuucuaaaggagcg

SEQ ID NO: 661416 - RNA, 23 nt, Human
ucagugaugugcacaaguuccuu

SEQ ID NO: 661417 - RNA, 20 nt, Human
ucaguguggcggccaggugg

SEQ ID NO: 661418 - RNA, 23 nt, Human
uccuuacacacuccaguaggcca

SEQ ID NO: 661419 - RNA, 22 nt, Human
ugaaaacaagccugacgcuuag

SEQ ID NO: 661420 - RNA, 23 nt, Human
ugaggugcaagcuguucacaugu

SEQ ID NO: 661421 - RNA, 19 nt, Human
ugccuugguguauaugggg

SEQ ID NO: 661422 - RNA, 19 nt, Human
uggcagaagucucuggagu

SEQ ID NO: 661423 - RNA, 23 nt, Human
uguccucaucaaucucuccuuca

SEQ ID NO: 661424 - RNA, 24 nt, Human
ugugcucaaacauucuuauuugcc

SEQ ID NO: 661425 - RNA, 20 nt, Human
uucacaggaaaagaaacaua

SEQ ID NO: 661426 - RNA, 21 nt, Human
uuuauaaaaacaacaaaauau

SEQ ID NO: 661427 - RNA, 20 nt, Human
uuuauacugaaauguucuuc

SEQ ID NO: 661428 - RNA, 24 nt, Human
uuuauacugaaauguucuucuagu

SEQ ID NO: 661429 - RNA, 21 nt, Human
uuuuuuuuuuuuuuuuugccu

SEQ ID NO: 661430 - RNA, 26 nt, Human
uuuuuuuuuuuuuuuuugccuauuag

SEQ ID NO: 661431 - RNA, 27 nt, Human
uuuuuuuuuuuuuuuuuuuuuuugggg

SEQ ID NO: 661432 - RNA, 19 nt, Human
aaguagugaacccaaacuc

SEQ ID NO: 661433 - RNA, 23 nt, Human
acaccccuagaaacagagaaaaa

SEQ ID NO: 661434 - RNA, 23 nt, Human
acagagaaaaaccaacugcuggg

SEQ ID NO: 661435 - RNA, 21 nt, Human
accuucuaggaccuucuacug

SEQ ID NO: 661436 - RNA, 21 nt, Human
agaaaaaccaacugcuggggg

SEQ ID NO: 661437 - RNA, 20 nt, Human
agaaacagagaaaaaccaac

SEQ ID NO: 661438 - RNA, 20 nt, Human
caaaaguacugccuagaucc

SEQ ID NO: 661439 - RNA, 27 nt, Human
caaauaucuuucaugaucuuaagucuu

SEQ ID NO: 661440 - RNA, 18 nt, Human
cacaccucuccccauccg

SEQ ID NO: 661441 - RNA, 19 nt, Human
cagccaguuccuuucuccu

SEQ ID NO: 661442 - RNA, 21 nt, Human
cauaacccagaucuaacucca

SEQ ID NO: 661443 - RNA, 18 nt, Human
cccuagaaacagagaaaa

SEQ ID NO: 661444 - RNA, 26 nt, Human
cuaguaaugauauuuguaacuucucu

SEQ ID NO: 661445 - RNA, 21 nt, Human
cucuccccauccgacuucaaa

SEQ ID NO: 661446 - RNA, 18 nt, Human
gaucuaacuccacaccuc

SEQ ID NO: 661447 - RNA, 20 nt, Human
ggaaagcugaagggacaacu

SEQ ID NO: 661448 - RNA, 21 nt, Human
gggaaagcugaagggacaacu

SEQ ID NO: 661449 - RNA, 21 nt, Human
gggacaacucuuccauaaccc

SEQ ID NO: 661450 - RNA, 24 nt, Human
uagugaacccaaacucuagaaauu

SEQ ID NO: 661451 - RNA, 22 nt, Human
uauacuuuaacaaucaugcaga

SEQ ID NO: 661452 - RNA, 24 nt, Human
ucacaccccuagaaacagagaaaa

SEQ ID NO: 661453 - RNA, 23 nt, Human
uccauaacccagaucuaacucca

SEQ ID NO: 661454 - RNA, 18 nt, Human
ucuguaaucacggugaga

SEQ ID NO: 661455 - RNA, 24 nt, Human
ucuuucaugaucuuaagucuuggu

SEQ ID NO: 661456 - RNA, 23 nt, Human
ugagaacacagcuguucacaguc

SEQ ID NO: 661457 - RNA, 24 nt, Human
ugagacaaaguagugaacccaaac

SEQ ID NO: 661458 - RNA, 22 nt, Human
ugccuagaucccagauguuaac

SEQ ID NO: 661459 - RNA, 21 nt, Human
uggguaagaaaaggaaaugag

SEQ ID NO: 661460 - RNA, 23 nt, Human
uuaauacgaugacagugucuucu

SEQ ID NO: 661461 - RNA, 22 nt, Human
uuaguuuuuguacaaauucaca

SEQ ID NO: 661462 - RNA, 22 nt, Human
uucagagggagagauacgagaa

SEQ ID NO: 661463 - RNA, 25 nt, Human
uuuuuuuuuuuuuuuuuuuuucagg

SEQ ID NO: 661464 - RNA, 24 nt, Human
aaaccaaaagcuuuauucucuagu

SEQ ID NO: 661465 - RNA, 18 nt, Human
agaaaguaaaauauggca

SEQ ID NO: 661466 - RNA, 20 nt, Human
cauuacucucaacgcagaga

SEQ ID NO: 661467 - RNA, 19 nt, Human
cucuugcgugaggcuuucu

SEQ ID NO: 661468 - RNA, 21 nt, Human
uauggcaccauaauccaauug

SEQ ID NO: 661469 - RNA, 19 nt, Human
ucaaauaaaaccaaaagcu

SEQ ID NO: 661470 - RNA, 19 nt, Human
aaaaagcucuuccaccucc

SEQ ID NO: 661471 - RNA, 20 nt, Human
aaaccaaaaacuaguuuaca

SEQ ID NO: 661472 - RNA, 27 nt, Human
aaacuccaucucaaaagaaauaaaaaa

SEQ ID NO: 661473 - RNA, 24 nt, Human
aaacuucugggcucaagugauccu

SEQ ID NO: 661474 - RNA, 29 nt, Human
aaagaccuuuuuuuuuuuuuuuuuuuuuu

SEQ ID NO: 661475 - RNA, 20 nt, Human
aaagcucuuccaccucccuu

SEQ ID NO: 661476 - RNA, 22 nt, Human
aaauaaaaacuucucauauucc

SEQ ID NO: 661477 - RNA, 19 nt, Human
aaauacaaaaauuagcugg

SEQ ID NO: 661478 - RNA, 19 nt, Human
aacacggugaaaccccguc

SEQ ID NO: 661479 - RNA, 20 nt, Human
aacacggugaaaccccgucu

SEQ ID NO: 661480 - RNA, 21 nt, Human
aacacggugaaaccccgucuc

SEQ ID NO: 661481 - RNA, 23 nt, Human
aacacuuuggugaucaugaaaau

SEQ ID NO: 661482 - RNA, 25 nt, Human
aaccaauacacaacagcccgaguca

SEQ ID NO: 661483 - RNA, 20 nt, Human
aaccauggucuucacauuuu

SEQ ID NO: 661484 - RNA, 24 nt, Human
aagaaauaaaaaauaaaggccagg

SEQ ID NO: 661485 - RNA, 19 nt, Human
aagaccuuuuuuuuuuuuu

SEQ ID NO: 661486 - RNA, 26 nt, Human
aagcaagagaacagugaguuccagaa

SEQ ID NO: 661487 - RNA, 20 nt, Human
aagcaugcacaagauuuugg

SEQ ID NO: 661488 - RNA, 22 nt, Human
aagcaugcacaagauuuugggu

SEQ ID NO: 661489 - RNA, 25 nt, Human
aagcgauccucccgccucagccucc

SEQ ID NO: 661490 - RNA, 25 nt, Human
aagugauccuucugccucagccucc

SEQ ID NO: 661491 - RNA, 25 nt, Human
aagugccggaauuacggagugagcc

SEQ ID NO: 661492 - RNA, 18 nt, Human
aauaaaaaauaaaggcca

SEQ ID NO: 661493 - RNA, 22 nt, Human
aaucaugauguauggagacucg

SEQ ID NO: 661494 - RNA, 18 nt, Human
aaucgcuugaacccggga

SEQ ID NO: 661495 - RNA, 23 nt, Human
acacacacacacacacacacaca

SEQ ID NO: 661496 - RNA, 23 nt, Human
acacacacacacacacacacaca

SEQ ID NO: 661497 - RNA, 23 nt, Human
acacacacacacacacacacaca

SEQ ID NO: 661498 - RNA, 23 nt, Human
acacacacacacacacacacaca

SEQ ID NO: 661499 - RNA, 23 nt, Human
acacacacacacacacacacaca

SEQ ID NO: 661500 - RNA, 23 nt, Human
acacacacacacacacacacaca

SEQ ID NO: 661501 - RNA, 23 nt, Human
acacacacacacacacacacaca

SEQ ID NO: 661502 - RNA, 28 nt, Human
acacacacacacacacacacacaggacc

SEQ ID NO: 661503 - RNA, 20 nt, Human
acacacacacacacacagga

SEQ ID NO: 661504 - RNA, 19 nt, Human
acagagcaaaacuccaucu

SEQ ID NO: 661505 - RNA, 20 nt, Human
acagagcaaaacuccaucuc

SEQ ID NO: 661506 - RNA, 24 nt, Human
acagagcaaaacuccaucucaaaa

SEQ ID NO: 661507 - RNA, 20 nt, Human
acagagcaagacuccgucuc

SEQ ID NO: 661508 - RNA, 24 nt, Human
acagagcaagacuccgucucaaaa

SEQ ID NO: 661509 - RNA, 19 nt, Human
acagcucacugcagccgca

SEQ ID NO: 661510 - RNA, 24 nt, Human
acagucgcccaggcuggagugcag

SEQ ID NO: 661511 - RNA, 20 nt, Human
acauggugaagcccggucuc

SEQ ID NO: 661512 - RNA, 19 nt, Human
accaccgguacuccagccu

SEQ ID NO: 661513 - RNA, 24 nt, Human
accccgucucugcuaaaaauacaa

SEQ ID NO: 661514 - RNA, 24 nt, Human
accugaggucaggaguucgagacc

SEQ ID NO: 661515 - RNA, 24 nt, Human
acgcucaccugaggucaggaguuc

SEQ ID NO: 661516 - RNA, 24 nt, Human
acugcacuccagccugggcgacag

SEQ ID NO: 661517 - RNA, 26 nt, Human
acugcacuccagccugggcgacagag

SEQ ID NO: 661518 - RNA, 19 nt, Human
agaaaccucaaaaccaugg

SEQ ID NO: 661519 - RNA, 22 nt, Human
agaccuuuuuuuuuuuuuuuuu

SEQ ID NO: 661520 - RNA, 23 nt, Human
agaggugcagugagccgagaucg

SEQ ID NO: 661521 - RNA, 22 nt, Human
agcacaccaccacccccagcua

SEQ ID NO: 661522 - RNA, 22 nt, Human
agcagaaaaggucucaggccca

SEQ ID NO: 661523 - RNA, 24 nt, Human
agccuggccaacauggugaagccc

SEQ ID NO: 661524 - RNA, 24 nt, Human
agccugggcgacagagcaagacuc

SEQ ID NO: 661525 - RNA, 22 nt, Human
agccugggugacagagcaaaac

SEQ ID NO: 661526 - RNA, 24 nt, Human
agccugggugacagagcaaaacuc

SEQ ID NO: 661527 - RNA, 18 nt, Human
aggacagggaacagagcu

SEQ ID NO: 661528 - RNA, 19 nt, Human
aggaggcugaggcuggaga

SEQ ID NO: 661529 - RNA, 24 nt, Human
aggcaagaaccaauacacaacagc

SEQ ID NO: 661530 - RNA, 20 nt, Human
aggcagaggugcagugagcc

SEQ ID NO: 661531 - RNA, 23 nt, Human
aggcagaggugcagugagccgag

SEQ ID NO: 661532 - RNA, 18 nt, Human
aggcaggagaauggugug

SEQ ID NO: 661533 - RNA, 20 nt, Human
aggcaggagaauggugugaa

SEQ ID NO: 661534 - RNA, 24 nt, Human
aggcaggagaauggugugaaucca

SEQ ID NO: 661535 - RNA, 19 nt, Human
aggcaggguggaaggaagc

SEQ ID NO: 661536 - RNA, 22 nt, Human
aggccaggcgcggugacucacg

SEQ ID NO: 661537 - RNA, 19 nt, Human
aggcgcaaguugcagugag

SEQ ID NO: 661538 - RNA, 21 nt, Human
aggcgcggugacucacgccag

SEQ ID NO: 661539 - RNA, 20 nt, Human
aggcgggaggaucacaaggu

SEQ ID NO: 661540 - RNA, 24 nt, Human
aggcgggaggaucacaaggucagg

SEQ ID NO: 661541 - RNA, 22 nt, Human
aggcgguggcacacgccuguaa

SEQ ID NO: 661542 - RNA, 19 nt, Human
aggcugaggcaggagaaug

SEQ ID NO: 661543 - RNA, 19 nt, Human
aggcugaggcgggaggauc

SEQ ID NO: 661544 - RNA, 24 nt, Human
aggcugaggcuggagaaucgcuug

SEQ ID NO: 661545 - RNA, 24 nt, Human
aggcuggagaaucgcuugaacccg

SEQ ID NO: 661546 - RNA, 21 nt, Human
agugcaguggugcaaucacag

SEQ ID NO: 661547 - RNA, 24 nt, Human
agugcaguggugcaaucacagcuc

SEQ ID NO: 661548 - RNA, 24 nt, Human
aguggcucacgccuguaaucccag

SEQ ID NO: 661549 - RNA, 22 nt, Human
aucccagcacuuugggaggcca

SEQ ID NO: 661550 - RNA, 24 nt, Human
aucgugccacugcacuccagccug

SEQ ID NO: 661551 - RNA, 22 nt, Human
caaaacuccaucucaaaagaaa

SEQ ID NO: 661552 - RNA, 21 nt, Human
caaaaggcaggcaagaaacaa

SEQ ID NO: 661553 - RNA, 22 nt, Human
caaaaggcaggcaagaaacaac

SEQ ID NO: 661554 - RNA, 20 nt, Human
caaaccaaaaacuaguuuac

SEQ ID NO: 661555 - RNA, 25 nt, Human
caaaccccugggcucaagcgauccu

SEQ ID NO: 661556 - RNA, 23 nt, Human
caaagugccggaauuacggagug

SEQ ID NO: 661557 - RNA, 24 nt, Human
caacauggugaagcccggucucua

SEQ ID NO: 661558 - RNA, 23 nt, Human
caagagaacagugaguuccagaa

SEQ ID NO: 661559 - RNA, 20 nt, Human
caagcgauccucccgccuca

SEQ ID NO: 661560 - RNA, 27 nt, Human
caagcgauccucccgccucagccuccu

SEQ ID NO: 661561 - RNA, 24 nt, Human
caaggcaggacgcucaccugaggu

SEQ ID NO: 661562 - RNA, 22 nt, Human
caagugauccuucugccucagc

SEQ ID NO: 661563 - RNA, 27 nt, Human
caagugauccuucugccucagccuccc

SEQ ID NO: 661564 - RNA, 20 nt, Human
cacacacacacacacacaca

SEQ ID NO: 661565 - RNA, 20 nt, Human
cacacacacacacacacaca

SEQ ID NO: 661566 - RNA, 20 nt, Human
cacacacacacacacacaca

SEQ ID NO: 661567 - RNA, 20 nt, Human
cacacacacacacacacaca

SEQ ID NO: 661568 - RNA, 20 nt, Human
cacacacacacacacacaca

SEQ ID NO: 661569 - RNA, 20 nt, Human
cacacacacacacacacaca

SEQ ID NO: 661570 - RNA, 20 nt, Human
cacacacacacacacacaca

SEQ ID NO: 661571 - RNA, 20 nt, Human
cacacacacacacacacaca

SEQ ID NO: 661572 - RNA, 20 nt, Human
cacacacacacacacacaca

SEQ ID NO: 661573 - RNA, 20 nt, Human
cacacacacacacacacaca

SEQ ID NO: 661574 - RNA, 20 nt, Human
cacacacacacacacacaca

SEQ ID NO: 661575 - RNA, 20 nt, Human
cacacacacacacacacaca

SEQ ID NO: 661576 - RNA, 22 nt, Human
cacacacacacacacacacaca

SEQ ID NO: 661577 - RNA, 22 nt, Human
cacacacacacacacacacaca

SEQ ID NO: 661578 - RNA, 22 nt, Human
cacacacacacacacacacaca

SEQ ID NO: 661579 - RNA, 22 nt, Human
cacacacacacacacacacaca

SEQ ID NO: 661580 - RNA, 26 nt, Human
cacacacacacacacacacacacaca

SEQ ID NO: 661581 - RNA, 26 nt, Human
cacacacacacacacacacacacaca

SEQ ID NO: 661582 - RNA, 26 nt, Human
cacacacacacacacacacacacaca

SEQ ID NO: 661583 - RNA, 26 nt, Human
cacacacacacacacacacacacaca

SEQ ID NO: 661584 - RNA, 26 nt, Human
cacacacacacacacacacacacaca

SEQ ID NO: 661585 - RNA, 26 nt, Human
cacacacacacacacacacacacaca

SEQ ID NO: 661586 - RNA, 26 nt, Human
cacacacacacacacacacacacaca

SEQ ID NO: 661587 - RNA, 20 nt, Human
cacaggaccuggcccugccc

SEQ ID NO: 661588 - RNA, 23 nt, Human
cacaggaccuggcccugcccuag

SEQ ID NO: 661589 - RNA, 20 nt, Human
cacagucgcccaggcuggag

SEQ ID NO: 661590 - RNA, 23 nt, Human
cacagucgcccaggcuggagugc

SEQ ID NO: 661591 - RNA, 24 nt, Human
caccgguacuccagccugggugac

SEQ ID NO: 661592 - RNA, 21 nt, Human
caccugaauuuauuaagaaac

SEQ ID NO: 661593 - RNA, 23 nt, Human
caccugaggucaggaguucgaga

SEQ ID NO: 661594 - RNA, 23 nt, Human
cacgccaguaaucccucccuuug

SEQ ID NO: 661595 - RNA, 18 nt, Human
cacgccuguaaucccagc

SEQ ID NO: 661596 - RNA, 24 nt, Human
cacgccuguaaucccagcacuuug

SEQ ID NO: 661597 - RNA, 19 nt, Human
cacgccuguaaucccagcu

SEQ ID NO: 661598 - RNA, 23 nt, Human
cacuccagccugggcgacagagc

SEQ ID NO: 661599 - RNA, 19 nt, Human
cacugcacuccagccuggg

SEQ ID NO: 661600 - RNA, 20 nt, Human
cacugcacuccagccugggc

SEQ ID NO: 661601 - RNA, 22 nt, Human
cacugcacuccagccugggcga

SEQ ID NO: 661602 - RNA, 23 nt, Human
cacugcacuccagccugggcgac

SEQ ID NO: 661603 - RNA, 24 nt, Human
cacugcacuccagccugggcgaca

SEQ ID NO: 661604 - RNA, 26 nt, Human
cacugcacuccagccugggcgacaga

SEQ ID NO: 661605 - RNA, 19 nt, Human
cagaucgaggcaagaacca

SEQ ID NO: 661606 - RNA, 24 nt, Human
cagcacuuugggaggccaaggcag

SEQ ID NO: 661607 - RNA, 25 nt, Human
cagcacuuugggaggccaaggcagg

SEQ ID NO: 661608 - RNA, 21 nt, Human
cagccuccugaguagcuggag

SEQ ID NO: 661609 - RNA, 24 nt, Human
caggacgcucaccugaggucagga

SEQ ID NO: 661610 - RNA, 20 nt, Human
cagugaggcgagaucccacc

SEQ ID NO: 661611 - RNA, 23 nt, Human
cagugaguuccagaaggccaagc

SEQ ID NO: 661612 - RNA, 23 nt, Human
cauggugaagcccggucucuacu

SEQ ID NO: 661613 - RNA, 19 nt, Human
ccaaagugccggaauuacg

SEQ ID NO: 661614 - RNA, 23 nt, Human
ccaaagugccggaauuacggagu

SEQ ID NO: 661615 - RNA, 20 nt, Human
ccaauacacaacagcccgag

SEQ ID NO: 661616 - RNA, 25 nt, Human
ccaccagcaccuaacuaggguccac

SEQ ID NO: 661617 - RNA, 24 nt, Human
ccaccgguacuccagccuggguga

SEQ ID NO: 661618 - RNA, 20 nt, Human
ccacugcacuccagccuggg

SEQ ID NO: 661619 - RNA, 21 nt, Human
ccacugcacuccagccugggc

SEQ ID NO: 661620 - RNA, 21 nt, Human
ccacugcacuccagccugggc

SEQ ID NO: 661621 - RNA, 24 nt, Human
ccacugcacuccagccugggcgac

SEQ ID NO: 661622 - RNA, 21 nt, Human
cccacaauuccacuuacucca

SEQ ID NO: 661623 - RNA, 24 nt, Human
ccccugggcucaagcgauccuccc

SEQ ID NO: 661624 - RNA, 23 nt, Human
cccgccucagccuccugaguagc

SEQ ID NO: 661625 - RNA, 24 nt, Human
cccgccucagccuccugaguagcu

SEQ ID NO: 661626 - RNA, 23 nt, Human
cccggucucuacuaaaaauacaa

SEQ ID NO: 661627 - RNA, 22 nt, Human
ccgguacuccagccugggugac

SEQ ID NO: 661628 - RNA, 24 nt, Human
ccgguacuccagccugggugacag

SEQ ID NO: 661629 - RNA, 26 nt, Human
ccuccauugacagggucucuauugug

SEQ ID NO: 661630 - RNA, 22 nt, Human
ccugaggucaggaguucgagac

SEQ ID NO: 661631 - RNA, 22 nt, Human
ccuggccaacauggugaagccc

SEQ ID NO: 661632 - RNA, 23 nt, Human
ccuggccaacauggugaagcccg

SEQ ID NO: 661633 - RNA, 23 nt, Human
ccuggcuaacacggugaaacccc

SEQ ID NO: 661634 - RNA, 24 nt, Human
ccuggcuaacacggugaaaccccg

SEQ ID NO: 661635 - RNA, 22 nt, Human
ccugggcgacagagcaagacuc

SEQ ID NO: 661636 - RNA, 20 nt, Human
ccugggcucaagcgauccuc

SEQ ID NO: 661637 - RNA, 22 nt, Human
ccugggugacagagcaaaacuc

SEQ ID NO: 661638 - RNA, 24 nt, Human
ccugggugacagagcaaaacucca

SEQ ID NO: 661639 - RNA, 19 nt, Human
ccuguaaucccagcuacuc

SEQ ID NO: 661640 - RNA, 21 nt, Human
ccuguaaucccagcuacucag

SEQ ID NO: 661641 - RNA, 22 nt, Human
ccuguaaucccagcuacucagg

SEQ ID NO: 661642 - RNA, 19 nt, Human
ccuguagucccagcuacuc

SEQ ID NO: 661643 - RNA, 22 nt, Human
ccuguagucccagcuacucugg

SEQ ID NO: 661644 - RNA, 23 nt, Human
ccuguagucccagcuacucugga

SEQ ID NO: 661645 - RNA, 26 nt, Human
ccuucugccucagccucccaaagugc

SEQ ID NO: 661646 - RNA, 18 nt, Human
ccuuggagaguacugcug

SEQ ID NO: 661647 - RNA, 24 nt, Human
cgagaccagccuggccaacauggu

SEQ ID NO: 661648 - RNA, 23 nt, Human
cgagaucccaccaccgguacucc

SEQ ID NO: 661649 - RNA, 24 nt, Human
cgcccaggcuggagugcaguggug

SEQ ID NO: 661650 - RNA, 24 nt, Human
cgccucagccuccugaguagcugg

SEQ ID NO: 661651 - RNA, 24 nt, Human
cgccuguaaucccagcacuuuggg

SEQ ID NO: 661652 - RNA, 22 nt, Human
cggggucucacagucgcccagg

SEQ ID NO: 661653 - RNA, 18 nt, Human
cucaaaaccauggucuuc

SEQ ID NO: 661654 - RNA, 24 nt, Human
cucaagcgauccucccgccucagc

SEQ ID NO: 661655 - RNA, 24 nt, Human
cucaagugauccuucugccucagc

SEQ ID NO: 661656 - RNA, 21 nt, Human
cucacacacacacacacacac

SEQ ID NO: 661657 - RNA, 21 nt, Human
cucacagucgcccaggcugga

SEQ ID NO: 661658 - RNA, 27 nt, Human
cucacgccaguaaucccucccuuugga

SEQ ID NO: 661659 - RNA, 22 nt, Human
cucacgccuguaaucccagcac

SEQ ID NO: 661660 - RNA, 24 nt, Human
cucacgccuguaaucccagcacuu

SEQ ID NO: 661661 - RNA, 31 nt, Human
cucucucacacacacacacacacacacacag

SEQ ID NO: 661662 - RNA, 31 nt, Human
cucucucucacacacacacacacacacacag

SEQ ID NO: 661663 - RNA, 21 nt, Human
cucugcuaaaaauacaaaaaa

SEQ ID NO: 661664 - RNA, 24 nt, Human
cugagcuaagauuccaucaaaaac

SEQ ID NO: 661665 - RNA, 23 nt, Human
cuggcccugcccuagguacacau

SEQ ID NO: 661666 - RNA, 18 nt, Human
cuggcuaacacggugaaa

SEQ ID NO: 661667 - RNA, 18 nt, Human
cugggcucaagugauccu

SEQ ID NO: 661668 - RNA, 24 nt, Human
gacagagcaagacuccgucucaaa

SEQ ID NO: 661669 - RNA, 25 nt, Human
gaccuggcccugcccuagguacaca

SEQ ID NO: 661670 - RNA, 20 nt, Human
gaccuuuuuuuuuuuuuuuu

SEQ ID NO: 661671 - RNA, 23 nt, Human
gagaucgugccacugcacuccag

SEQ ID NO: 661672 - RNA, 18 nt, Human
gaggcugaggcuggagaa

SEQ ID NO: 661673 - RNA, 20 nt, Human
gagugcacccacaauuccac

SEQ ID NO: 661674 - RNA, 24 nt, Human
gagugcaguggugcaaucacagcu

SEQ ID NO: 661675 - RNA, 22 nt, Human
gaucaccuuuauguuucucucu

SEQ ID NO: 661676 - RNA, 24 nt, Human
gcacuccagccugggcgacagagc

SEQ ID NO: 661677 - RNA, 24 nt, Human
gccaacauggugaagcccggucuc

SEQ ID NO: 661678 - RNA, 22 nt, Human
gccacugcacuccagccugggc

SEQ ID NO: 661679 - RNA, 24 nt, Human
gccacugcacuccagccugggcga

SEQ ID NO: 661680 - RNA, 24 nt, Human
gccaucacaaucaugauguaugga

SEQ ID NO: 661681 - RNA, 19 nt, Human
gcccaggcuggagugcagu

SEQ ID NO: 661682 - RNA, 20 nt, Human
gcccaggcuggagugcagug

SEQ ID NO: 661683 - RNA, 23 nt, Human
gcccaggcuggagugcaguggug

SEQ ID NO: 661684 - RNA, 20 nt, Human
gccgagaucgugccacugca

SEQ ID NO: 661685 - RNA, 23 nt, Human
gccuguaaucccagcuacucagg

SEQ ID NO: 661686 - RNA, 24 nt, Human
gcgauccucccgccucagccuccu

SEQ ID NO: 661687 - RNA, 24 nt, Human
gcuaacacggugaaaccccgucuc

SEQ ID NO: 661688 - RNA, 24 nt, Human
gcucaccugaggucaggaguucga

SEQ ID NO: 661689 - RNA, 21 nt, Human
gcuggguguaguggcucacgc

SEQ ID NO: 661690 - RNA, 21 nt, Human
ggaaggaagcaagagaacagu

SEQ ID NO: 661691 - RNA, 22 nt, Human
ggacagggaacagagcuuauga

SEQ ID NO: 661692 - RNA, 21 nt, Human
ggacccaagcaggacagggaa

SEQ ID NO: 661693 - RNA, 20 nt, Human
ggaggacccaagcaggacag

SEQ ID NO: 661694 - RNA, 18 nt, Human
ggaggaucacaaggucag

SEQ ID NO: 661695 - RNA, 23 nt, Human
ggaguccuccaaggaucugcacu

SEQ ID NO: 661696 - RNA, 18 nt, Human
ggcaagaaccaauacaca

SEQ ID NO: 661697 - RNA, 18 nt, Human
ggcugggagcaucacuug

SEQ ID NO: 661698 - RNA, 19 nt, Human
ggcuggguguaguggcuca

SEQ ID NO: 661699 - RNA, 21 nt, Human
gggcucaagugauccuucugc

SEQ ID NO: 661700 - RNA, 22 nt, Human
gggcucaagugauccuucugcc

SEQ ID NO: 661701 - RNA, 20 nt, Human
gggguuucuacauucugucu

SEQ ID NO: 661702 - RNA, 25 nt, Human
gguagggaggcaggguggaaggaag

SEQ ID NO: 661703 - RNA, 23 nt, Human
gguggcacacgccuguaauccca

SEQ ID NO: 661704 - RNA, 24 nt, Human
gguggcacacgccuguaaucccag

SEQ ID NO: 661705 - RNA, 23 nt, Human
gguguaguggcucacgccuguaa

SEQ ID NO: 661706 - RNA, 24 nt, Human
guacuccagccugggugacagagc

SEQ ID NO: 661707 - RNA, 19 nt, Human
guauggagacucgugcugc

SEQ ID NO: 661708 - RNA, 23 nt, Human
gucucacagucgcccaggcugga

SEQ ID NO: 661709 - RNA, 21 nt, Human
gugaaaccccgucucugcuaa

SEQ ID NO: 661710 - RNA, 24 nt, Human
gugauccuucugccucagccuccc

SEQ ID NO: 661711 - RNA, 19 nt, Human
gugcaccacaaauaaaaac

SEQ ID NO: 661712 - RNA, 22 nt, Human
gugcagugagccgagaucgugc

SEQ ID NO: 661713 - RNA, 23 nt, Human
guggcacacgccuguaaucccag

SEQ ID NO: 661714 - RNA, 23 nt, Human
guggugcaaucacagcucacugc

SEQ ID NO: 661715 - RNA, 21 nt, Human
uaaaaagcucuuccaccuccc

SEQ ID NO: 661716 - RNA, 22 nt, Human
uaacacggugaaaccccgucuc

SEQ ID NO: 661717 - RNA, 23 nt, Human
uaacacggugaaaccccgucucu

SEQ ID NO: 661718 - RNA, 22 nt, Human
uacuccagccugggugacagag

SEQ ID NO: 661719 - RNA, 19 nt, Human
uacucuggaggcugaggca

SEQ ID NO: 661720 - RNA, 21 nt, Human
uagcaaagcggguagggaggc

SEQ ID NO: 661721 - RNA, 19 nt, Human
uagcuggagcuauaggagc

SEQ ID NO: 661722 - RNA, 24 nt, Human
uaguggcucacgccuguaauccca

SEQ ID NO: 661723 - RNA, 18 nt, Human
ucacaaggucaggagauc

SEQ ID NO: 661724 - RNA, 21 nt, Human
ucacagcucacugcagccgca

SEQ ID NO: 661725 - RNA, 20 nt, Human
ucaccugaggucaggaguuc

SEQ ID NO: 661726 - RNA, 20 nt, Human
ucaccugaggucaggaguuc

SEQ ID NO: 661727 - RNA, 22 nt, Human
ucaccugaggucaggaguucga

SEQ ID NO: 661728 - RNA, 22 nt, Human
ucacugcagccgcaaaccccug

SEQ ID NO: 661729 - RNA, 23 nt, Human
ucacugcagccgcaaaccccugg

SEQ ID NO: 661730 - RNA, 24 nt, Human
ucacugcagccgcaaaccccuggg

SEQ ID NO: 661731 - RNA, 23 nt, Human
ucagccuccugaguagcuggagc

SEQ ID NO: 661732 - RNA, 24 nt, Human
uccagccugggcgacagagcaaga

SEQ ID NO: 661733 - RNA, 18 nt, Human
uccagccugggugacaga

SEQ ID NO: 661734 - RNA, 27 nt, Human
ucccaccaccgguacuccagccugggu

SEQ ID NO: 661735 - RNA, 24 nt, Human
ucccagccagccccugaccuggag

SEQ ID NO: 661736 - RNA, 20 nt, Human
ucccuuuggaaggcugaggc

SEQ ID NO: 661737 - RNA, 26 nt, Human
uccucccgccucagccuccugaguag

SEQ ID NO: 661738 - RNA, 18 nt, Human
uccuggggacaugaacag

SEQ ID NO: 661739 - RNA, 24 nt, Human
ucgcccaggcuggagugcaguggu

SEQ ID NO: 661740 - RNA, 18 nt, Human
ucgcuugaacccgggagg

SEQ ID NO: 661741 - RNA, 23 nt, Human
ucgugccacugcacuccagccug

SEQ ID NO: 661742 - RNA, 20 nt, Human
ucuauugugcuaggccuaug

SEQ ID NO: 661743 - RNA, 21 nt, Human
ucucacacacacacacacaca

SEQ ID NO: 661744 - RNA, 19 nt, Human
ucucacagucgcccaggcu

SEQ ID NO: 661745 - RNA, 22 nt, Human
ucucacagucgcccaggcugga

SEQ ID NO: 661746 - RNA, 24 nt, Human
ucucacagucgcccaggcuggagu

SEQ ID NO: 661747 - RNA, 21 nt, Human
ucucuacuaaaaauacaaaaa

SEQ ID NO: 661748 - RNA, 21 nt, Human
ucucucucucucucucucaca

SEQ ID NO: 661749 - RNA, 21 nt, Human
ucucucucucucucucucuca

SEQ ID NO: 661750 - RNA, 24 nt, Human
ucucugcuaaaaauacaaaaaauu

SEQ ID NO: 661751 - RNA, 20 nt, Human
ucugggcucaagugauccuu

SEQ ID NO: 661752 - RNA, 22 nt, Human
ucugggcucaagugauccuucu

SEQ ID NO: 661753 - RNA, 18 nt, Human
ucugucucucucucucuc

SEQ ID NO: 661754 - RNA, 18 nt, Human
ucuugcuuuguugcccag

SEQ ID NO: 661755 - RNA, 22 nt, Human
ucuugcuuuguugcccagccua

SEQ ID NO: 661756 - RNA, 23 nt, Human
ucuuguagcaaagcggguaggga

SEQ ID NO: 661757 - RNA, 19 nt, Human
ucuuuuuucauuucuuccc

SEQ ID NO: 661758 - RNA, 22 nt, Human
ugagccgagaucgugccacugc

SEQ ID NO: 661759 - RNA, 22 nt, Human
ugaggcaggagaauggugugaa

SEQ ID NO: 661760 - RNA, 25 nt, Human
ugaggcaggagaauggugugaaucc

SEQ ID NO: 661761 - RNA, 20 nt, Human
ugaggcgagaucccaccacc

SEQ ID NO: 661762 - RNA, 21 nt, Human
ugaggcgggaggaucacaagg

SEQ ID NO: 661763 - RNA, 24 nt, Human
ugaggcgggaggaucacaagguca

SEQ ID NO: 661764 - RNA, 24 nt, Human
ugaggcuggagaaucgcuugaacc

SEQ ID NO: 661765 - RNA, 22 nt, Human
ugccgaucaccuuuauguuucu

SEQ ID NO: 661766 - RNA, 24 nt, Human
ugccucagccucccaaagugccgg

SEQ ID NO: 661767 - RNA, 24 nt, Human
ugccuguagucccagcuacucugg

SEQ ID NO: 661768 - RNA, 23 nt, Human
uggaaggaagcaagagaacagug

SEQ ID NO: 661769 - RNA, 20 nt, Human
uggaaggaagcaagagaacu

SEQ ID NO: 661770 - RNA, 24 nt, Human
uggaaggcugaggcgggaggauca

SEQ ID NO: 661771 - RNA, 18 nt, Human
uggagugcaguggugcaa

SEQ ID NO: 661772 - RNA, 19 nt, Human
uggagugcaguggugcaau

SEQ ID NO: 661773 - RNA, 21 nt, Human
uggagugcaguggugcaauca

SEQ ID NO: 661774 - RNA, 21 nt, Human
uggcacacgccuguaauccca

SEQ ID NO: 661775 - RNA, 22 nt, Human
uggcacacgccuguaaucccag

SEQ ID NO: 661776 - RNA, 24 nt, Human
uggccaacauggugaagcccgguc

SEQ ID NO: 661777 - RNA, 24 nt, Human
uggcgggugccuguagucccagcu

SEQ ID NO: 661778 - RNA, 22 nt, Human
uggcucacgccuguaaucccag

SEQ ID NO: 661779 - RNA, 24 nt, Human
uggcucacgccuguaaucccagca

SEQ ID NO: 661780 - RNA, 19 nt, Human
uggcuggguguaguggcuc

SEQ ID NO: 661781 - RNA, 24 nt, Human
ugggcucaagcgauccucccgccu

SEQ ID NO: 661782 - RNA, 20 nt, Human
ugggcucaagugauccuucu

SEQ ID NO: 661783 - RNA, 24 nt, Human
ugggcucaagugauccuucugccu

SEQ ID NO: 661784 - RNA, 24 nt, Human
uggugcaaucacagcucacugcag

SEQ ID NO: 661785 - RNA, 24 nt, Human
ugguggcgggugccuguaguccca

SEQ ID NO: 661786 - RNA, 21 nt, Human
uguauggagacucgugcugcu

SEQ ID NO: 661787 - RNA, 19 nt, Human
uguugcccagccuagucug

SEQ ID NO: 661788 - RNA, 24 nt, Human
uuagucgggcgugguggcgggugc

SEQ ID NO: 661789 - RNA, 20 nt, Human
uucacauuuuuaccuggaca

SEQ ID NO: 661790 - RNA, 20 nt, Human
uucccaaaaggcaggcaaga

SEQ ID NO: 661791 - RNA, 24 nt, Human
uucugggcucaagugauccuucug

SEQ ID NO: 661792 - RNA, 21 nt, Human
uucuucccaaaaggcaggcaa

SEQ ID NO: 661793 - RNA, 22 nt, Human
uugcagugaggcgagaucccac

SEQ ID NO: 661794 - RNA, 25 nt, Human
uuggaaggcugaggcgggaggauca

SEQ ID NO: 661795 - RNA, 23 nt, Human
uuggcuggguguaguggcucacg

SEQ ID NO: 661796 - RNA, 23 nt, Human
uuuucauuucuucccaaaaggca

SEQ ID NO: 661797 - RNA, 27 nt, Human
uuuuuuuuucuuaaagacggggucuca

SEQ ID NO: 661798 - RNA, 22 nt, Human
uuuuuuuuuugggagagaccgg

SEQ ID NO: 661799 - RNA, 25 nt, Human
uuuuuuuuuuuuugggagagaccgg

SEQ ID NO: 661800 - RNA, 31 nt, Human
uuuuuuuuuuuuuuuuucuuaaagacggggg

SEQ ID NO: 661801 - RNA, 18 nt, Human
uuuuuuuuuuuuuuuuug

SEQ ID NO: 661802 - RNA, 21 nt, Human
uuuuuuuuuuuuuuuuugcaa

SEQ ID NO: 661803 - RNA, 24 nt, Human
uuuuuuuuuuuuuuuuuuuuuggg

SEQ ID NO: 661804 - RNA, 24 nt, Human
aaaaaacagacacacuuagccaaa

SEQ ID NO: 661805 - RNA, 21 nt, Human
aaaaaggagcuauaaagaaaa

SEQ ID NO: 661806 - RNA, 23 nt, Human
aaacagaaauaaacauuagaaau

SEQ ID NO: 661807 - RNA, 20 nt, Human
aacacuguuuuauucaacaa

SEQ ID NO: 661808 - RNA, 21 nt, Human
aagaaaaaccaguaaauacau

SEQ ID NO: 661809 - RNA, 18 nt, Human
aagcaguggaauuguucu

SEQ ID NO: 661810 - RNA, 23 nt, Human
aaggagggcuggagugaaaaaga

SEQ ID NO: 661811 - RNA, 28 nt, Human
aauuaaagauaacacuguuuuauucaac

SEQ ID NO: 661812 - RNA, 19 nt, Human
aauuagaauaagcccaccc

SEQ ID NO: 661813 - RNA, 19 nt, Human
accagauacaagaaaaacc

SEQ ID NO: 661814 - RNA, 18 nt, Human
acgaugaaggagggcugg

SEQ ID NO: 661815 - RNA, 22 nt, Human
agaaucuguugaauaaguaaac

SEQ ID NO: 661816 - RNA, 23 nt, Human
agaaucuguugaauaaguaaacu

SEQ ID NO: 661817 - RNA, 18 nt, Human
agcugagacacagaggca

SEQ ID NO: 661818 - RNA, 22 nt, Human
aggagggcuggagugaaaaaga

SEQ ID NO: 661819 - RNA, 19 nt, Human
agguagaaaacacuguccu

SEQ ID NO: 661820 - RNA, 24 nt, Human
aguaaaaaggagcuauaaagaaaa

SEQ ID NO: 661821 - RNA, 25 nt, Human
aguaaaaaggagcuauaaagaaaaa

SEQ ID NO: 661822 - RNA, 20 nt, Human
agugaaaaagauacaggaga

SEQ ID NO: 661823 - RNA, 27 nt, Human
auuaaagauaacacuguuuuauucaac

SEQ ID NO: 661824 - RNA, 22 nt, Human
caaugcacauguuauauuucag

SEQ ID NO: 661825 - RNA, 23 nt, Human
cagacacacuuagccaaaucuug

SEQ ID NO: 661826 - RNA, 22 nt, Human
ccccuaaacacauaggcuaaca

SEQ ID NO: 661827 - RNA, 20 nt, Human
cuccccuaaacacauaggcu

SEQ ID NO: 661828 - RNA, 21 nt, Human
cuuccccucuagauuuguucc

SEQ ID NO: 661829 - RNA, 23 nt, Human
cuucugaauacuuggaguaaaua

SEQ ID NO: 661830 - RNA, 26 nt, Human
gaaaaaacagacacacuuagccaaag

SEQ ID NO: 661831 - RNA, 18 nt, Human
gaauuaaagauaacacug

SEQ ID NO: 661832 - RNA, 21 nt, Human
gauacaggagaguaaaaagga

SEQ ID NO: 661833 - RNA, 20 nt, Human
gggaaaaaacagacacacuu

SEQ ID NO: 661834 - RNA, 22 nt, Human
uaaaaacaauuagaauaagccc

SEQ ID NO: 661835 - RNA, 23 nt, Human
uaaaguuacgcuauuuuccuaag

SEQ ID NO: 661836 - RNA, 23 nt, Human
uaacacagagcugagacacagag

SEQ ID NO: 661837 - RNA, 21 nt, Human
uaagcccacccaaaucagaga

SEQ ID NO: 661838 - RNA, 20 nt, Human
uaauugcauauccuuucuag

SEQ ID NO: 661839 - RNA, 20 nt, Human
uacagcacuguuuuggguau

SEQ ID NO: 661840 - RNA, 21 nt, Human
uacuuggcuugaguuagauga

SEQ ID NO: 661841 - RNA, 23 nt, Human
uagaaaacacuguccuuguccau

SEQ ID NO: 661842 - RNA, 23 nt, Human
uagaauaagcccacccaaaucag

SEQ ID NO: 661843 - RNA, 20 nt, Human
uagccaaaucuuggcuuccc

SEQ ID NO: 661844 - RNA, 18 nt, Human
uaggcuaacacagagcug

SEQ ID NO: 661845 - RNA, 24 nt, Human
ucaacacuuauucaacuauaauua

SEQ ID NO: 661846 - RNA, 22 nt, Human
ucuaguaauauuugugaccugu

SEQ ID NO: 661847 - RNA, 21 nt, Human
ucuuggggucaggagaaaauc

SEQ ID NO: 661848 - RNA, 18 nt, Human
ugaaguggcaguaaacca

SEQ ID NO: 661849 - RNA, 23 nt, Human
ugaccacauaaaaguaaaaauua

SEQ ID NO: 661850 - RNA, 18 nt, Human
ugagccuuuuacucagcu

SEQ ID NO: 661851 - RNA, 20 nt, Human
uggggucaggagaaaaucaa

SEQ ID NO: 661852 - RNA, 19 nt, Human
ugucagcguuucaacuguu

SEQ ID NO: 661853 - RNA, 22 nt, Human
uuaaaauacauuagucaacacu

SEQ ID NO: 661854 - RNA, 18 nt, Human
uuacucagcuuuacaaag

SEQ ID NO: 661855 - RNA, 24 nt, Human
uucacagaaacaaaauaaugcauc

SEQ ID NO: 661856 - RNA, 21 nt, Human
uuuuuuuuuuuuuuuuucauu

SEQ ID NO: 661857 - RNA, 18 nt, Human
aaaaaaaauagggaaaaa

SEQ ID NO: 661858 - RNA, 24 nt, Human
aaaaaacaaaaacaaaaacaaaaa

SEQ ID NO: 661859 - RNA, 24 nt, Human
aaaaacaaaaacaaaaacaaaaac

SEQ ID NO: 661860 - RNA, 22 nt, Human
aaaacaaaaacaaaaacaaaaa

SEQ ID NO: 661861 - RNA, 19 nt, Human
aaaagaagaaaaaaaauag

SEQ ID NO: 661862 - RNA, 26 nt, Human
aaaagaagaaaaaaaauagggaaaaa

SEQ ID NO: 661863 - RNA, 19 nt, Human
aaacaaaaacaaaaacaaa

SEQ ID NO: 661864 - RNA, 25 nt, Human
aaacaaaaacaaaaacaaauucugg

SEQ ID NO: 661865 - RNA, 22 nt, Human
aaacaaacucaaacuuugacaa

SEQ ID NO: 661866 - RNA, 21 nt, Human
aaagaagaaaaaaaauaggga

SEQ ID NO: 661867 - RNA, 22 nt, Human
aaagcagcuaaaaaaacaaaaa

SEQ ID NO: 661868 - RNA, 33 nt, Human
aaagcagcuaaaaaaacaaaaacaaaaacaaag

SEQ ID NO: 661869 - RNA, 18 nt, Human
aaaggcaaauaaccuuau

SEQ ID NO: 661870 - RNA, 25 nt, Human
aaauaaccuuaugaaucugguaagu

SEQ ID NO: 661871 - RNA, 23 nt, Human
aaauaucagacaucccaauaacu

SEQ ID NO: 661872 - RNA, 19 nt, Human
aagaaaauguaaaaauaac

SEQ ID NO: 661873 - RNA, 20 nt, Human
aagacuacagggagguuagg

SEQ ID NO: 661874 - RNA, 20 nt, Human
aagcaaacccaaacaaauua

SEQ ID NO: 661875 - RNA, 21 nt, Human
aagcaaacccaaacaaauuaa

SEQ ID NO: 661876 - RNA, 24 nt, Human
aaucacuugaaccugggaggcaga

SEQ ID NO: 661877 - RNA, 22 nt, Human
acaaagccagggccuacaggug

SEQ ID NO: 661878 - RNA, 21 nt, Human
acaaaguuaauuguaaaacag

SEQ ID NO: 661879 - RNA, 23 nt, Human
acaggagaaucacuugaaccugg

SEQ ID NO: 661880 - RNA, 18 nt, Human
acagggaaaaacaaacuc

SEQ ID NO: 661881 - RNA, 21 nt, Human
accccagccagacaucacaaa

SEQ ID NO: 661882 - RNA, 24 nt, Human
acccugucucuacuaaaaauacaa

SEQ ID NO: 661883 - RNA, 22 nt, Human
acucauaacacauauacacaga

SEQ ID NO: 661884 - RNA, 21 nt, Human
acucuaacucauaucuggaaa

SEQ ID NO: 661885 - RNA, 22 nt, Human
agaaaagaguacuaugaaaaaa

SEQ ID NO: 661886 - RNA, 24 nt, Human
agaacuuugggaggccgagguggg

SEQ ID NO: 661887 - RNA, 22 nt, Human
agaagaaaaaaaauagggaaaa

SEQ ID NO: 661888 - RNA, 22 nt, Human
agacaggagaaucacuugaacc

SEQ ID NO: 661889 - RNA, 24 nt, Human
agacaggagaaucacuugaaccug

SEQ ID NO: 661890 - RNA, 18 nt, Human
agacuguuaucuggaagc

SEQ ID NO: 661891 - RNA, 23 nt, Human
agagcaaauauaguaucuucuga

SEQ ID NO: 661892 - RNA, 22 nt, Human
agagguugcagugaaccgagau

SEQ ID NO: 661893 - RNA, 24 nt, Human
agagguugcagugaaccgagauug

SEQ ID NO: 661894 - RNA, 22 nt, Human
agagguuguaugaugaaggucg

SEQ ID NO: 661895 - RNA, 23 nt, Human
agcaugguggcgggcaccuguaa

SEQ ID NO: 661896 - RNA, 18 nt, Human
agccagggccuacaggug

SEQ ID NO: 661897 - RNA, 24 nt, Human
aggagcucgagaccagccuggcca

SEQ ID NO: 661898 - RNA, 19 nt, Human
aggaucaccugaggucagg

SEQ ID NO: 661899 - RNA, 24 nt, Human
aggaucaccugaggucaggagcuc

SEQ ID NO: 661900 - RNA, 21 nt, Human
aggcagagguugcagugaacc

SEQ ID NO: 661901 - RNA, 24 nt, Human
aggcagagguugcagugaaccgag

SEQ ID NO: 661902 - RNA, 24 nt, Human
aggccgaggugggaggaucaccug

SEQ ID NO: 661903 - RNA, 24 nt, Human
aggcugagacaggagaaucacuug

SEQ ID NO: 661904 - RNA, 18 nt, Human
aggugggaggaucaccug

SEQ ID NO: 661905 - RNA, 22 nt, Human
aggugggaggaucaccugaggu

SEQ ID NO: 661906 - RNA, 23 nt, Human
aggugggaggaucaccugagguc

SEQ ID NO: 661907 - RNA, 24 nt, Human
aguggcucaccccuguaaucccag

SEQ ID NO: 661908 - RNA, 24 nt, Human
auauacacagaaaagaguacuaug

SEQ ID NO: 661909 - RNA, 20 nt, Human
augaugaaggucggaaagua

SEQ ID NO: 661910 - RNA, 24 nt, Human
auugcacucuagccugggcaacaa

SEQ ID NO: 661911 - RNA, 25 nt, Human
auugcacucuagccugggcaacaag

SEQ ID NO: 661912 - RNA, 19 nt, Human
auuggacuucuuugaagag

SEQ ID NO: 661913 - RNA, 20 nt, Human
caaacccaaacaaauuaagu

SEQ ID NO: 661914 - RNA, 20 nt, Human
caaaccuggaaaacaguuaa

SEQ ID NO: 661915 - RNA, 24 nt, Human
caaaguauucauuaacccauuaaa

SEQ ID NO: 661916 - RNA, 24 nt, Human
caaaguguaugccaaacgaauuuc

SEQ ID NO: 661917 - RNA, 24 nt, Human
caccccuguaaucccagaacuuug

SEQ ID NO: 661918 - RNA, 23 nt, Human
caccuguaaucccagcuacuugg

SEQ ID NO: 661919 - RNA, 24 nt, Human
caccuguaaucccagcuacuuggg

SEQ ID NO: 661920 - RNA, 24 nt, Human
cagaacuuugggaggccgaggugg

SEQ ID NO: 661921 - RNA, 20 nt, Human
cagcuaaaaaaacaaaaaca

SEQ ID NO: 661922 - RNA, 20 nt, Human
cauugacaaauucaccucuu

SEQ ID NO: 661923 - RNA, 19 nt, Human
cauugcacucuagccuggg

SEQ ID NO: 661924 - RNA, 21 nt, Human
cauugcacucuagccugggca

SEQ ID NO: 661925 - RNA, 22 nt, Human
cauugcacucuagccugggcaa

SEQ ID NO: 661926 - RNA, 24 nt, Human
cauugcacucuagccugggcaaca

SEQ ID NO: 661927 - RNA, 23 nt, Human
cauuuaucaaccuuuaccuucuc

SEQ ID NO: 661928 - RNA, 22 nt, Human
ccauacaaauuccauauccagu

SEQ ID NO: 661929 - RNA, 20 nt, Human
ccaugacaauguaagaaagu

SEQ ID NO: 661930 - RNA, 20 nt, Human
ccauugcacucuagccuggg

SEQ ID NO: 661931 - RNA, 21 nt, Human
ccauugcacucuagccugggc

SEQ ID NO: 661932 - RNA, 23 nt, Human
ccauugcacucuagccugggcaa

SEQ ID NO: 661933 - RNA, 24 nt, Human
ccauugcacucuagccugggcaac

SEQ ID NO: 661934 - RNA, 25 nt, Human
cccagccagacaucacaaacucaua

SEQ ID NO: 661935 - RNA, 20 nt, Human
ccccuguaaucccagaacuu

SEQ ID NO: 661936 - RNA, 23 nt, Human
ccccuguaaucccagaacuuugg

SEQ ID NO: 661937 - RNA, 21 nt, Human
ccuacaaacauaaacagugcu

SEQ ID NO: 661938 - RNA, 22 nt, Human
ccugaggucaggagcucgagac

SEQ ID NO: 661939 - RNA, 25 nt, Human
ccugggaggcagagguugcagugaa

SEQ ID NO: 661940 - RNA, 22 nt, Human
ccuguaaucccagaacuuuggg

SEQ ID NO: 661941 - RNA, 21 nt, Human
ccuguaaucccagcuacuugg

SEQ ID NO: 661942 - RNA, 22 nt, Human
cgagaccagccuggccaacccu

SEQ ID NO: 661943 - RNA, 20 nt, Human
cgaggugggaggaucaccug

SEQ ID NO: 661944 - RNA, 24 nt, Human
cgaggugggaggaucaccugaggu

SEQ ID NO: 661945 - RNA, 26 nt, Human
cgaggugggaggaucaccugagguca

SEQ ID NO: 661946 - RNA, 18 nt, Human
cgcagaacaaaaaagauc

SEQ ID NO: 661947 - RNA, 31 nt, Human
cuaaaaaaacaaaaacaaaaacaaaaacaaa

SEQ ID NO: 661948 - RNA, 22 nt, Human
cuacaggugguuuccagacuuu

SEQ ID NO: 661949 - RNA, 20 nt, Human
cuagagcaaauauaguaucc

SEQ ID NO: 661950 - RNA, 24 nt, Human
cucaccccuguaaucccagaacuu

SEQ ID NO: 661951 - RNA, 21 nt, Human
cucuaugugaccacacagaac

SEQ ID NO: 661952 - RNA, 21 nt, Human
cuguaaucccagcuacuuggg

SEQ ID NO: 661953 - RNA, 18 nt, Human
cuugcgcagaacaaaaaa

SEQ ID NO: 661954 - RNA, 23 nt, Human
gagaaucacuugaaccugggagg

SEQ ID NO: 661955 - RNA, 21 nt, Human
gagccaaucuucaacucuugg

SEQ ID NO: 661956 - RNA, 22 nt, Human
gaggugggaggaucaccugagg

SEQ ID NO: 661957 - RNA, 23 nt, Human
gaggugggaggaucaccugaggu

SEQ ID NO: 661958 - RNA, 18 nt, Human
gaucaccugaggucagga

SEQ ID NO: 661959 - RNA, 24 nt, Human
gaucaccugaggucaggagcucga

SEQ ID NO: 661960 - RNA, 19 nt, Human
gaucacuuaaaggcaaaua

SEQ ID NO: 661961 - RNA, 24 nt, Human
gcaaaguauucauuaacccauuaa

SEQ ID NO: 661962 - RNA, 24 nt, Human
gccauugcacucuagccugggcaa

SEQ ID NO: 661963 - RNA, 20 nt, Human
gcgggcaccuguaaucccag

SEQ ID NO: 661964 - RNA, 24 nt, Human
ggaaauggugugauuucuaacagc

SEQ ID NO: 661965 - RNA, 23 nt, Human
ggaggaugguuuguggcagaggc

SEQ ID NO: 661966 - RNA, 18 nt, Human
ggaucaccugaggucagg

SEQ ID NO: 661967 - RNA, 19 nt, Human
ggaucaccugaggucagga

SEQ ID NO: 661968 - RNA, 19 nt, Human
ggauuagguuuaaaagcag

SEQ ID NO: 661969 - RNA, 22 nt, Human
ggauugcuacuuugaaacaguu

SEQ ID NO: 661970 - RNA, 24 nt, Human
ggcaccuguaaucccagcuacuug

SEQ ID NO: 661971 - RNA, 24 nt, Human
gggcacaguggcucaccccuguaa

SEQ ID NO: 661972 - RNA, 24 nt, Human
gguggcgggcaccuguaaucccag

SEQ ID NO: 661973 - RNA, 18 nt, Human
guaaaacucugcuucaga

SEQ ID NO: 661974 - RNA, 22 nt, Human
guaaaacucugcuucagaaaaa

SEQ ID NO: 661975 - RNA, 23 nt, Human
uaaaacaaaucaccuuguuuuga

SEQ ID NO: 661976 - RNA, 23 nt, Human
uaacacauauacacagaaaagaa

SEQ ID NO: 661977 - RNA, 18 nt, Human
uaacagcaccuagcauac

SEQ ID NO: 661978 - RNA, 21 nt, Human
uacaaauuccauauccaguga

SEQ ID NO: 661979 - RNA, 19 nt, Human
uaccccagccagacaucac

SEQ ID NO: 661980 - RNA, 19 nt, Human
uacgugccauccucaaagc

SEQ ID NO: 661981 - RNA, 24 nt, Human
uagaacagcccuugcuuacauaau

SEQ ID NO: 661982 - RNA, 20 nt, Human
uagauaugaagagccaaacc

SEQ ID NO: 661983 - RNA, 22 nt, Human
uagcagaaauaaaggguaaugg

SEQ ID NO: 661984 - RNA, 19 nt, Human
uagcagcugugauuucuuu

SEQ ID NO: 661985 - RNA, 20 nt, Human
uaggaggaugguuuguggca

SEQ ID NO: 661986 - RNA, 25 nt, Human
uagggaaaaauucacaaauguccaa

SEQ ID NO: 661987 - RNA, 19 nt, Human
uagugugcuaauaauauga

SEQ ID NO: 661988 - RNA, 22 nt, Human
uauaaaauuauggccgggcaca

SEQ ID NO: 661989 - RNA, 20 nt, Human
uaucagaagacuguuaucuu

SEQ ID NO: 661990 - RNA, 21 nt, Human
uaucagacaucccaauaacuu

SEQ ID NO: 661991 - RNA, 22 nt, Human
uaugccaaacgaauuucagucc

SEQ ID NO: 661992 - RNA, 25 nt, Human
uauugcuucauaucuuuuuuucacu

SEQ ID NO: 661993 - RNA, 19 nt, Human
ucaccugaggucaggagcu

SEQ ID NO: 661994 - RNA, 25 nt, Human
ucacuugaaccugggaggcagaggu

SEQ ID NO: 661995 - RNA, 22 nt, Human
ucgagaccagccuggccaaccc

SEQ ID NO: 661996 - RNA, 18 nt, Human
ucuccuguuucaucucuu

SEQ ID NO: 661997 - RNA, 21 nt, Human
ucucuacuaaaaauacaaaaa

SEQ ID NO: 661998 - RNA, 18 nt, Human
ucugucugucucucucuc

SEQ ID NO: 661999 - RNA, 23 nt, Human
ucugugccacaauuugccucuag

SEQ ID NO: 662000 - RNA, 19 nt, Human
ucuugaguucaaagggcuu

SEQ ID NO: 662001 - RNA, 22 nt, Human
ugaaccgagauugugccauugc

SEQ ID NO: 662002 - RNA, 24 nt, Human
ugaaccugggaggcagagguugca

SEQ ID NO: 662003 - RNA, 21 nt, Human
ugacaaagccagggccuacag

SEQ ID NO: 662004 - RNA, 26 nt, Human
ugacaacauccacagaauguuccagu

SEQ ID NO: 662005 - RNA, 22 nt, Human
ugaccacacagaacucuuuuaa

SEQ ID NO: 662006 - RNA, 20 nt, Human
ugagacaggagaaucacuug

SEQ ID NO: 662007 - RNA, 24 nt, Human
ugagacaggagaaucacuugaacc

SEQ ID NO: 662008 - RNA, 27 nt, Human
ugaguauaaauaaaagaagaaaaaaaa

SEQ ID NO: 662009 - RNA, 19 nt, Human
ugcacucuagccugggcaa

SEQ ID NO: 662010 - RNA, 23 nt, Human
ugcgcagaacaaaaaagaucgua

SEQ ID NO: 662011 - RNA, 18 nt, Human
uggaaaacaguuaaggag

SEQ ID NO: 662012 - RNA, 18 nt, Human
uggaacuauuuauuuugu

SEQ ID NO: 662013 - RNA, 19 nt, Human
uggacaaaacucuacugac

SEQ ID NO: 662014 - RNA, 19 nt, Human
uggagaaguaauaaagcca

SEQ ID NO: 662015 - RNA, 20 nt, Human
uggagaaguaauaaagccag

SEQ ID NO: 662016 - RNA, 21 nt, Human
uggcucaccccuguaauccca

SEQ ID NO: 662017 - RNA, 22 nt, Human
uggcucaccccuguaaucccag

SEQ ID NO: 662018 - RNA, 19 nt, Human
ugggaggccgaggugggag

SEQ ID NO: 662019 - RNA, 24 nt, Human
ugggaggccgaggugggaggauca

SEQ ID NO: 662020 - RNA, 24 nt, Human
ugggaggcugagacaggagaauca

SEQ ID NO: 662021 - RNA, 23 nt, Human
ugggaugaaaucccaaaggaacu

SEQ ID NO: 662022 - RNA, 18 nt, Human
uggguucuuuggaaaugg

SEQ ID NO: 662023 - RNA, 24 nt, Human
ugguggcgggcaccuguaauccca

SEQ ID NO: 662024 - RNA, 19 nt, Human
ugugcuaauaauaugaaca

SEQ ID NO: 662025 - RNA, 21 nt, Human
uuaaaagcagcuaaaaaaaca

SEQ ID NO: 662026 - RNA, 18 nt, Human
uuagcugagcaugguggc

SEQ ID NO: 662027 - RNA, 18 nt, Human
uucacagccacucuaacu

SEQ ID NO: 662028 - RNA, 24 nt, Human
uugaaccugggaggcagagguugc

SEQ ID NO: 662029 - RNA, 22 nt, Human
uugcagugaaccgagauugugc

SEQ ID NO: 662030 - RNA, 25 nt, Human
uugggaggccgaggugggaggauca

SEQ ID NO: 662031 - RNA, 25 nt, Human
uugggaggcugagacaggagaauca

SEQ ID NO: 662032 - RNA, 23 nt, Human
uuggucccaaggaagugacaaaa

SEQ ID NO: 662033 - RNA, 26 nt, Human
uuuaaaccaugacaauguaagaaagu

SEQ ID NO: 662034 - RNA, 18 nt, Human
uuuguggcagaggcgagg

SEQ ID NO: 662035 - RNA, 19 nt, Human
uuuguuguuguuguugcuu

SEQ ID NO: 662036 - RNA, 18 nt, Human
cagaauuaaaaaaaucac

SEQ ID NO: 662037 - RNA, 25 nt, Human
uuuuuuuuuuuuuuuuuuaauuuuu

SEQ ID NO: 662038 - RNA, 23 nt, Human
aagagaaaaaaauucagaugcuu

SEQ ID NO: 662039 - RNA, 19 nt, Human
acagcauccucuccucuga

SEQ ID NO: 662040 - RNA, 23 nt, Human
accgcagaguggagccucccuuu

SEQ ID NO: 662041 - RNA, 20 nt, Human
acuccgcugccggccugggg

SEQ ID NO: 662042 - RNA, 22 nt, Human
acuuugggaggcagaguagaau

SEQ ID NO: 662043 - RNA, 19 nt, Human
agccagugaaggcuggagg

SEQ ID NO: 662044 - RNA, 18 nt, Human
agcugggagacccuugac

SEQ ID NO: 662045 - RNA, 19 nt, Human
aggaaggcugcugcccagc

SEQ ID NO: 662046 - RNA, 22 nt, Human
aggaaggcugcugcccagcccc

SEQ ID NO: 662047 - RNA, 23 nt, Human
aggaaggcugcugcccagccccu

SEQ ID NO: 662048 - RNA, 18 nt, Human
aggacaucuuggccagaa

SEQ ID NO: 662049 - RNA, 21 nt, Human
agugaaggcuggaggccaugg

SEQ ID NO: 662050 - RNA, 21 nt, Human
agugaccuugcagcugaagau

SEQ ID NO: 662051 - RNA, 18 nt, Human
cacuuugggaggcagagu

SEQ ID NO: 662052 - RNA, 25 nt, Human
cagcagugaccuugcagcugaagau

SEQ ID NO: 662053 - RNA, 18 nt, Human
cagccacugccuguuccu

SEQ ID NO: 662054 - RNA, 25 nt, Human
cagcuccuggacuccgcugccggcc

SEQ ID NO: 662055 - RNA, 24 nt, Human
ccagugggcguggucugcccuaga

SEQ ID NO: 662056 - RNA, 19 nt, Human
cccccugguggccugacuc

SEQ ID NO: 662057 - RNA, 19 nt, Human
ccuagagaaugaaguccuc

SEQ ID NO: 662058 - RNA, 22 nt, Human
ccucccuuugaagcugacagga

SEQ ID NO: 662059 - RNA, 20 nt, Human
ccuuguaccuggaucucuuc

SEQ ID NO: 662060 - RNA, 22 nt, Human
cgacccuuugugggccacacca

SEQ ID NO: 662061 - RNA, 22 nt, Human
cgaggaucacccacuuugggag

SEQ ID NO: 662062 - RNA, 19 nt, Human
cuccagugggcguggucug

SEQ ID NO: 662063 - RNA, 19 nt, Human
cucguguauucuguggagc

SEQ ID NO: 662064 - RNA, 19 nt, Human
cuggaggccaugguaggcu

SEQ ID NO: 662065 - RNA, 20 nt, Human
cuggggacucucugucuuag

SEQ ID NO: 662066 - RNA, 21 nt, Human
cuuggagacugucccucacag

SEQ ID NO: 662067 - RNA, 23 nt, Human
gagaaugaaguccucacucugcu

SEQ ID NO: 662068 - RNA, 23 nt, Human
gaucacccacuuugggaggcaga

SEQ ID NO: 662069 - RNA, 19 nt, Human
gcagaguggagccucccuu

SEQ ID NO: 662070 - RNA, 22 nt, Human
gcgcccccugguggccugacuc

SEQ ID NO: 662071 - RNA, 19 nt, Human
gcucuccaacauccucauc

SEQ ID NO: 662072 - RNA, 19 nt, Human
ggagcccucucugccagcu

SEQ ID NO: 662073 - RNA, 22 nt, Human
ggcaggaaggcugcugcccagc

SEQ ID NO: 662074 - RNA, 22 nt, Human
ggccacaccagcuccuggacuc

SEQ ID NO: 662075 - RNA, 24 nt, Human
ggccugagucuacuuuuuaaagcc

SEQ ID NO: 662076 - RNA, 18 nt, Human
ggccuggggguccuggga

SEQ ID NO: 662077 - RNA, 20 nt, Human
ggcuggaggccaugguaggc

SEQ ID NO: 662078 - RNA, 18 nt, Human
gggguccugggagcuggg

SEQ ID NO: 662079 - RNA, 20 nt, Human
guggccccaguacagcaguc

SEQ ID NO: 662080 - RNA, 19 nt, Human
guggccugacucuccuggc

SEQ ID NO: 662081 - RNA, 22 nt, Human
ucaggcccagcuuugccaccgc

SEQ ID NO: 662082 - RNA, 20 nt, Human
uccaggcuuccucuucucca

SEQ ID NO: 662083 - RNA, 18 nt, Human
uccagugggcguggucug

SEQ ID NO: 662084 - RNA, 24 nt, Human
uccauagccagugaaggccggggc

SEQ ID NO: 662085 - RNA, 21 nt, Human
ucccaggauguacauuccuuc

SEQ ID NO: 662086 - RNA, 20 nt, Human
ucccaggugccuccuggccc

SEQ ID NO: 662087 - RNA, 23 nt, Human
ucccaggugccuccuggcccugg

SEQ ID NO: 662088 - RNA, 18 nt, Human
uccgcugccggccugggg

SEQ ID NO: 662089 - RNA, 20 nt, Human
uccuggaucuccugugguuc

SEQ ID NO: 662090 - RNA, 21 nt, Human
uccuggaucuccugugguucu

SEQ ID NO: 662091 - RNA, 22 nt, Human
uccuggaucuccugugguucuc

SEQ ID NO: 662092 - RNA, 18 nt, Human
uccuggcccuggggacuc

SEQ ID NO: 662093 - RNA, 24 nt, Human
ucgaggcucuccaacauccucauc

SEQ ID NO: 662094 - RNA, 19 nt, Human
ucuccaguaugugagcugc

SEQ ID NO: 662095 - RNA, 19 nt, Human
ucuccugcaggagccuggg

SEQ ID NO: 662096 - RNA, 23 nt, Human
ucugcugggagcccucucugcca

SEQ ID NO: 662097 - RNA, 21 nt, Human
ugagucuggggagcuuagagg

SEQ ID NO: 662098 - RNA, 21 nt, Human
ugcccagccccucugcacccu

SEQ ID NO: 662099 - RNA, 21 nt, Human
ugccugugggccucucacucc

SEQ ID NO: 662100 - RNA, 19 nt, Human
ugcugggagcccucucugc

SEQ ID NO: 662101 - RNA, 20 nt, Human
uggaguucugcaacauccuc

SEQ ID NO: 662102 - RNA, 18 nt, Human
uggccagaagggucaggc

SEQ ID NO: 662103 - RNA, 20 nt, Human
ugggagcccucucugccagc

SEQ ID NO: 662104 - RNA, 19 nt, Human
ugggaggcagaguagaauc

SEQ ID NO: 662105 - RNA, 18 nt, Human
ugggccucucacucccag

SEQ ID NO: 662106 - RNA, 24 nt, Human
ugucccuggucaucuccugcagga

SEQ ID NO: 662107 - RNA, 19 nt, Human
uguccugaggacucugggc

SEQ ID NO: 662108 - RNA, 21 nt, Human
ugugagcugcuggcauuugag

SEQ ID NO: 662109 - RNA, 23 nt, Human
uuccuggaucuccugugguucuc

SEQ ID NO: 662110 - RNA, 23 nt, Human
uuccuggaucuccugugguucuc

SEQ ID NO: 662111 - RNA, 18 nt, Human
uucucuggcgcccccugg

SEQ ID NO: 662112 - RNA, 20 nt, Human
uuggagacugucccucacag

SEQ ID NO: 662113 - RNA, 23 nt, Human
uuuccugccccuacuguucucac

SEQ ID NO: 662114 - RNA, 19 nt, Human
cccgcugggcacacagcag

SEQ ID NO: 662115 - RNA, 23 nt, Human
cugguaaguaaugugcccuuuuc

SEQ ID NO: 662116 - RNA, 21 nt, Human
gucccggcgucgaagaaugcc

SEQ ID NO: 662117 - RNA, 19 nt, Human
uaaugugcccuuuucccuc

SEQ ID NO: 662118 - RNA, 23 nt, Human
uaucuugcccaaagcuuuucaaa

SEQ ID NO: 662119 - RNA, 22 nt, Human
ucccucggugucguaucuugcc

SEQ ID NO: 662120 - RNA, 23 nt, Human
ugcccuuuucccucggugucgua

SEQ ID NO: 662121 - RNA, 24 nt, Human
uggugugaggggaauaucaaaacc

SEQ ID NO: 662122 - RNA, 22 nt, Human
uguggcugucgucccgcugggc

SEQ ID NO: 662123 - RNA, 22 nt, Human
uuucuagaaaauucuuagacaa

SEQ ID NO: 662124 - RNA, 23 nt, Human
uuuuuuuuuuuuuuuuuccaaau

SEQ ID NO: 662125 - RNA, 23 nt, Human
uuuuuuuuuuuuuuuuuuuucca

SEQ ID NO: 662126 - RNA, 24 nt, Human
uuuuuuuuuuuuuuuuuuuuuccu

SEQ ID NO: 662127 - RNA, 23 nt, Human
aacagggagucaacagguaaugu

SEQ ID NO: 662128 - RNA, 19 nt, Human
aacccgcccaguucucccu

SEQ ID NO: 662129 - RNA, 23 nt, Human
aaugaacuggaagugacugcugg

SEQ ID NO: 662130 - RNA, 23 nt, Human
acacugcugcaugaggagugggc

SEQ ID NO: 662131 - RNA, 19 nt, Human
accuugaagaaggcccggg

SEQ ID NO: 662132 - RNA, 19 nt, Human
acguaggcgcagcagguau

SEQ ID NO: 662133 - RNA, 19 nt, Human
acuguguaauuccacauua

SEQ ID NO: 662134 - RNA, 18 nt, Human
agcagccccaggacagga

SEQ ID NO: 662135 - RNA, 22 nt, Human
agcagcucaggucucaggcggc

SEQ ID NO: 662136 - RNA, 24 nt, Human
aggaagcagaccagcagccccagg

SEQ ID NO: 662137 - RNA, 22 nt, Human
aggaagcgggugcuuaagagag

SEQ ID NO: 662138 - RNA, 24 nt, Human
aggcggccgccagccccucgcucc

SEQ ID NO: 662139 - RNA, 21 nt, Human
aguacuagagaaugggagaga

SEQ ID NO: 662140 - RNA, 23 nt, Human
auagcuaugacaagaaaggcccc

SEQ ID NO: 662141 - RNA, 19 nt, Human
auaguaauagaaauaguaa

SEQ ID NO: 662142 - RNA, 19 nt, Human
augaacacuuacuguccuc

SEQ ID NO: 662143 - RNA, 22 nt, Human
caaaagagagcuaaagccucau

SEQ ID NO: 662144 - RNA, 18 nt, Human
caacagggagucaacagg

SEQ ID NO: 662145 - RNA, 19 nt, Human
caagaaaggccccgccuuu

SEQ ID NO: 662146 - RNA, 20 nt, Human
caagcaagagucauauaagc

SEQ ID NO: 662147 - RNA, 23 nt, Human
caccaauucuccuuguccuuaau

SEQ ID NO: 662148 - RNA, 25 nt, Human
cagcagccccaggacaggacggguu

SEQ ID NO: 662149 - RNA, 19 nt, Human
cagcagccccaggacaggg

SEQ ID NO: 662150 - RNA, 20 nt, Human
cauguugacgugggcacuca

SEQ ID NO: 662151 - RNA, 25 nt, Human
ccaaggcccugaaccacggcgugca

SEQ ID NO: 662152 - RNA, 19 nt, Human
ccacuaaacccgcccaguu

SEQ ID NO: 662153 - RNA, 20 nt, Human
ccagcaccuugaugaugucu

SEQ ID NO: 662154 - RNA, 18 nt, Human
ccagccccucgcucccag

SEQ ID NO: 662155 - RNA, 19 nt, Human
cccagcacacugcugcaug

SEQ ID NO: 662156 - RNA, 26 nt, Human
cccagcacacugcugcaugaggagug

SEQ ID NO: 662157 - RNA, 19 nt, Human
ccccuggcaccagcaaggg

SEQ ID NO: 662158 - RNA, 24 nt, Human
ccucccgcucucgcagugucugau

SEQ ID NO: 662159 - RNA, 20 nt, Human
ccugaaccacggcgugcagc

SEQ ID NO: 662160 - RNA, 25 nt, Human
ccugaaccacggcgugcagcuugag

SEQ ID NO: 662161 - RNA, 21 nt, Human
ccuggcaccagcaaggguacc

SEQ ID NO: 662162 - RNA, 20 nt, Human
cgaagcaccagcaccuugau

SEQ ID NO: 662163 - RNA, 24 nt, Human
cguuguacaggaagcagaccagca

SEQ ID NO: 662164 - RNA, 22 nt, Human
cugcacuguuucuugcuucaug

SEQ ID NO: 662165 - RNA, 20 nt, Human
cugcugcaugaggagugggc

SEQ ID NO: 662166 - RNA, 23 nt, Human
cugggaacuucccacccacauga

SEQ ID NO: 662167 - RNA, 27 nt, Human
cugggcauaugucucccauuucauccu

SEQ ID NO: 662168 - RNA, 21 nt, Human
cuucccacccacaugacuuga

SEQ ID NO: 662169 - RNA, 22 nt, Human
cuucucgaagcaccagcaccuu

SEQ ID NO: 662170 - RNA, 24 nt, Human
gaaaggccccgccuuuccugcuaa

SEQ ID NO: 662171 - RNA, 18 nt, Human
ggaacuucccacccacau

SEQ ID NO: 662172 - RNA, 22 nt, Human
ggcacucagcaggggugcacuu

SEQ ID NO: 662173 - RNA, 18 nt, Human
ggcagggaauagagcgcc

SEQ ID NO: 662174 - RNA, 22 nt, Human
gggccugcagguaggcgcgggc

SEQ ID NO: 662175 - RNA, 23 nt, Human
ggggagacgagcugucgccccag

SEQ ID NO: 662176 - RNA, 18 nt, Human
ggguuggugcugugggag

SEQ ID NO: 662177 - RNA, 18 nt, Human
ggugaggaagcgggugcu

SEQ ID NO: 662178 - RNA, 22 nt, Human
ggugcuuaagagaggggagacg

SEQ ID NO: 662179 - RNA, 25 nt, Human
guugagguguucugcaggugaagug

SEQ ID NO: 662180 - RNA, 21 nt, Human
uaaaaauagcugaaugaacug

SEQ ID NO: 662181 - RNA, 23 nt, Human
uaccuugaagaaggcccggggca

SEQ ID NO: 662182 - RNA, 21 nt, Human
uacuauaggcccaacaguggg

SEQ ID NO: 662183 - RNA, 22 nt, Human
uacuauaggcccaacagugggg

SEQ ID NO: 662184 - RNA, 23 nt, Human
uagaaagacaccaauucuccuug

SEQ ID NO: 662185 - RNA, 23 nt, Human
uaguaaguggguauguguuuuua

SEQ ID NO: 662186 - RNA, 25 nt, Human
uauaggcccaacaguggggguggug

SEQ ID NO: 662187 - RNA, 21 nt, Human
ucaagcaagagucauauaagc

SEQ ID NO: 662188 - RNA, 22 nt, Human
ucacaauuucucucuagugugu

SEQ ID NO: 662189 - RNA, 21 nt, Human
ucucaggcggccgccagcccc

SEQ ID NO: 662190 - RNA, 22 nt, Human
ucugagaugcccuuguuacuga

SEQ ID NO: 662191 - RNA, 22 nt, Human
ugaaugaacuggaagugacugc

SEQ ID NO: 662192 - RNA, 20 nt, Human
ugacaacagggagucaacag

SEQ ID NO: 662193 - RNA, 19 nt, Human
ugacaagaaaggccccgcc

SEQ ID NO: 662194 - RNA, 21 nt, Human
ugagcuuaaagguggggccaa

SEQ ID NO: 662195 - RNA, 18 nt, Human
ugaggagugggccugggg

SEQ ID NO: 662196 - RNA, 21 nt, Human
ugcaugaggagugggccuggg

SEQ ID NO: 662197 - RNA, 19 nt, Human
ugcccugggaacuucccac

SEQ ID NO: 662198 - RNA, 25 nt, Human
ugcuuuaugaacacuuacuguccuc

SEQ ID NO: 662199 - RNA, 19 nt, Human
uggacucgagggccugcag

SEQ ID NO: 662200 - RNA, 19 nt, Human
ugggcacccugcacuguuu

SEQ ID NO: 662201 - RNA, 18 nt, Human
ugggggaggguugcugac

SEQ ID NO: 662202 - RNA, 23 nt, Human
ugggggaggguugcugacaaaag

SEQ ID NO: 662203 - RNA, 21 nt, Human
uggggguggugaggaagcggg

SEQ ID NO: 662204 - RNA, 21 nt, Human
ugugaccacugcccugggaac

SEQ ID NO: 662205 - RNA, 23 nt, Human
ugugcaggggcuuucacagcagc

SEQ ID NO: 662206 - RNA, 19 nt, Human
uuagugguagguacauaau

SEQ ID NO: 662207 - RNA, 18 nt, Human
uucacaauuucucucuag

SEQ ID NO: 662208 - RNA, 21 nt, Human
uuucacgaugugaccacugcc

SEQ ID NO: 662209 - RNA, 23 nt, Human
uuuuuuuuuuuuacaaggaaggu

SEQ ID NO: 662210 - RNA, 23 nt, Human
uuuuuuuuuuuuuuuuacaagga

SEQ ID NO: 662211 - RNA, 26 nt, Human
uuuuuuuuuuuuuuuuuuuuacaagg

SEQ ID NO: 662212 - RNA, 21 nt, Human
aaaauuauaagugucuuuuug

SEQ ID NO: 662213 - RNA, 24 nt, Human
aaacuaaacuuaaauaugaagcaa

SEQ ID NO: 662214 - RNA, 22 nt, Human
aaagaaauauucacauaaccac

SEQ ID NO: 662215 - RNA, 24 nt, Human
aaauuagaagaagugaagaagccc

SEQ ID NO: 662216 - RNA, 22 nt, Human
aaccacaauuuccuaauuuucu

SEQ ID NO: 662217 - RNA, 21 nt, Human
aagaaaaggauauggaaaugu

SEQ ID NO: 662218 - RNA, 22 nt, Human
accacagcuuaauuuuggccug

SEQ ID NO: 662219 - RNA, 21 nt, Human
accacauagacaacacguaca

SEQ ID NO: 662220 - RNA, 19 nt, Human
agaagaagugaagaagccc

SEQ ID NO: 662221 - RNA, 21 nt, Human
agaagaagugaagaagcccau

SEQ ID NO: 662222 - RNA, 22 nt, Human
augccuuuccaugauuuuacug

SEQ ID NO: 662223 - RNA, 20 nt, Human
cacaauuuccuaauuuucuc

SEQ ID NO: 662224 - RNA, 28 nt, Human
cacuucuguuuuauacaaagauuagaaa

SEQ ID NO: 662225 - RNA, 25 nt, Human
cauccccaccacauagacaacacgu

SEQ ID NO: 662226 - RNA, 21 nt, Human
ccagauaaaagucaaaagucc

SEQ ID NO: 662227 - RNA, 18 nt, Human
cuuacaaguugccuucag

SEQ ID NO: 662228 - RNA, 25 nt, Human
gagggggagaugaguaaaaccagua

SEQ ID NO: 662229 - RNA, 20 nt, Human
uaaaauuauauaagaaaugu

SEQ ID NO: 662230 - RNA, 21 nt, Human
uaagugucuuuuuguucaaaa

SEQ ID NO: 662231 - RNA, 25 nt, Human
uacaaaacaccuuuuuucugauuca

SEQ ID NO: 662232 - RNA, 21 nt, Human
uagguauggaaaauuauaagu

SEQ ID NO: 662233 - RNA, 24 nt, Human
uagguauggaaaauuauaaguguc

SEQ ID NO: 662234 - RNA, 22 nt, Human
uauccagauaaaagucaaaagu

SEQ ID NO: 662235 - RNA, 21 nt, Human
ucaaaaguccuuuuaguuucu

SEQ ID NO: 662236 - RNA, 23 nt, Human
ucaaucaccugguuaucuguuac

SEQ ID NO: 662237 - RNA, 19 nt, Human
ucaguugaaaauagguaug

SEQ ID NO: 662238 - RNA, 21 nt, Human
uccaugauuuuacuguagaaa

SEQ ID NO: 662239 - RNA, 21 nt, Human
ucuguuaccuuuaaaauacaa

SEQ ID NO: 662240 - RNA, 19 nt, Human
ugacugaguuaaaucuuac

SEQ ID NO: 662241 - RNA, 21 nt, Human
uggaaaugucuuuaaggcccu

SEQ ID NO: 662242 - RNA, 26 nt, Human
ugucuuagauucaaucaccugguuag

SEQ ID NO: 662243 - RNA, 23 nt, Human
uuaauuuuggccugauuucuacc

SEQ ID NO: 662244 - RNA, 21 nt, Human
uucacauaaccacaauuuccu

SEQ ID NO: 662245 - RNA, 21 nt, Human
uucaucuugcucacuucuguu

SEQ ID NO: 662246 - RNA, 22 nt, Human
uucaucuugcucacuucuguuu

SEQ ID NO: 662247 - RNA, 21 nt, Human
uugcaaugcugaugccuuucc

SEQ ID NO: 662248 - RNA, 21 nt, Human
uuucuuauuaaugacccagcg

SEQ ID NO: 662249 - RNA, 21 nt, Human
aaaaacugccaauaccucccc

SEQ ID NO: 662250 - RNA, 21 nt, Human
aaaaguccagaagggugucac

SEQ ID NO: 662251 - RNA, 24 nt, Human
aaggugcuggccccaugcuucccu

SEQ ID NO: 662252 - RNA, 27 nt, Human
aauuacaaaaccucauugaacauaagg

SEQ ID NO: 662253 - RNA, 21 nt, Human
acaaagccacaagaggacaag

SEQ ID NO: 662254 - RNA, 19 nt, Human
acagcuuucuuugcagcug

SEQ ID NO: 662255 - RNA, 22 nt, Human
accgucacuagaaagcuuugac

SEQ ID NO: 662256 - RNA, 22 nt, Human
acuuaaguacagaggccaagca

SEQ ID NO: 662257 - RNA, 23 nt, Human
agaagggugucacagacaugaua

SEQ ID NO: 662258 - RNA, 26 nt, Human
agaccacagcuuucuuugcagcugcc

SEQ ID NO: 662259 - RNA, 21 nt, Human
agcagcacggauggcugcggc

SEQ ID NO: 662260 - RNA, 21 nt, Human
aggagccauuacuuucuccag

SEQ ID NO: 662261 - RNA, 20 nt, Human
aggguaggagcggggaagga

SEQ ID NO: 662262 - RNA, 21 nt, Human
aggucaggggguugggaaagu

SEQ ID NO: 662263 - RNA, 19 nt, Human
aggugcaucugagacaggg

SEQ ID NO: 662264 - RNA, 22 nt, Human
augaagugcuuguguggcacag

SEQ ID NO: 662265 - RNA, 25 nt, Human
auugauggguccaggggggugucuu

SEQ ID NO: 662266 - RNA, 26 nt, Human
auugauggguccaggggggugucuuu

SEQ ID NO: 662267 - RNA, 23 nt, Human
auuucauuuccuucucuccucca

SEQ ID NO: 662268 - RNA, 24 nt, Human
auuucauuuccuucucuccuccag

SEQ ID NO: 662269 - RNA, 22 nt, Human
caaacccugcccaauuuccaaa

SEQ ID NO: 662270 - RNA, 23 nt, Human
caacccagcuucuccucagcuaa

SEQ ID NO: 662271 - RNA, 19 nt, Human
cacaacacaguauaccaca

SEQ ID NO: 662272 - RNA, 18 nt, Human
cacagcccaggcucaccu

SEQ ID NO: 662273 - RNA, 19 nt, Human
cacaguguaaguacaaagu

SEQ ID NO: 662274 - RNA, 22 nt, Human
cacuuaaguacagaggccaagc

SEQ ID NO: 662275 - RNA, 21 nt, Human
cagcacggauggcugcggcag

SEQ ID NO: 662276 - RNA, 18 nt, Human
caggagggcagagcgaug

SEQ ID NO: 662277 - RNA, 18 nt, Human
caggcggccaccgcacuu

SEQ ID NO: 662278 - RNA, 21 nt, Human
caugaagugugccaugagaac

SEQ ID NO: 662279 - RNA, 19 nt, Human
ccaaagguagacuccaugg

SEQ ID NO: 662280 - RNA, 20 nt, Human
ccaggagggcagagcgaugg

SEQ ID NO: 662281 - RNA, 19 nt, Human
ccaugcuucccuuucccug

SEQ ID NO: 662282 - RNA, 20 nt, Human
cccacaguguaaguacaaag

SEQ ID NO: 662283 - RNA, 18 nt, Human
cccaggagggcagagcga

SEQ ID NO: 662284 - RNA, 21 nt, Human
ccccauuauaaaaugugucua

SEQ ID NO: 662285 - RNA, 22 nt, Human
cccccagcucccucuugacuuc

SEQ ID NO: 662286 - RNA, 22 nt, Human
cccccgaugaagugcuugugug

SEQ ID NO: 662287 - RNA, 18 nt, Human
ccccgggcgccccccagc

SEQ ID NO: 662288 - RNA, 20 nt, Human
ccccgggcgccccccagcuc

SEQ ID NO: 662289 - RNA, 20 nt, Human
ccgccauggcagcacagccu

SEQ ID NO: 662290 - RNA, 20 nt, Human
ccguguuguucuuguaguac

SEQ ID NO: 662291 - RNA, 21 nt, Human
ccuucgcgccccggcccgucc

SEQ ID NO: 662292 - RNA, 24 nt, Human
cgccccccagcucccucuugacuu

SEQ ID NO: 662293 - RNA, 23 nt, Human
cgccuucgcgccccggcccgucc

SEQ ID NO: 662294 - RNA, 23 nt, Human
cuaggcuccugcauaaaguuugg

SEQ ID NO: 662295 - RNA, 18 nt, Human
cuccccgggcgcccccca

SEQ ID NO: 662296 - RNA, 22 nt, Human
cucgcugcacccgcccgccacc

SEQ ID NO: 662297 - RNA, 21 nt, Human
cucucuuuguggcaggauauc

SEQ ID NO: 662298 - RNA, 22 nt, Human
cucuucuauuuaaauuugucuc

SEQ ID NO: 662299 - RNA, 20 nt, Human
cugcccaucauccguguugu

SEQ ID NO: 662300 - RNA, 23 nt, Human
cugcuaggcuccugcauaaaguu

SEQ ID NO: 662301 - RNA, 22 nt, Human
cuggccccaugcuucccuuucc

SEQ ID NO: 662302 - RNA, 24 nt, Human
cuucagaaaacccugccaacccag

SEQ ID NO: 662303 - RNA, 18 nt, Human
gaaagaaauggguauggg

SEQ ID NO: 662304 - RNA, 21 nt, Human
gaccgccuucgcgccccggcc

SEQ ID NO: 662305 - RNA, 18 nt, Human
gagacaguagaagggcug

SEQ ID NO: 662306 - RNA, 19 nt, Human
gagacaguagaagggcugc

SEQ ID NO: 662307 - RNA, 22 nt, Human
gaucacaaaaguccagaagggu

SEQ ID NO: 662308 - RNA, 19 nt, Human
gcacuuaaguacagaggcc

SEQ ID NO: 662309 - RNA, 18 nt, Human
gcgaccgccuucgcgccc

SEQ ID NO: 662310 - RNA, 18 nt, Human
ggucaggggguugggaaa

SEQ ID NO: 662311 - RNA, 24 nt, Human
gugaaagaaauggguaugggagca

SEQ ID NO: 662312 - RNA, 22 nt, Human
gugcaaagaagcaaguguccug

SEQ ID NO: 662313 - RNA, 24 nt, Human
gugucacagacaugauaaccuaag

SEQ ID NO: 662314 - RNA, 25 nt, Human
uaaaaaaauuacaaaaccucauuga

SEQ ID NO: 662315 - RNA, 21 nt, Human
uaaauuugucucauuuaaccu

SEQ ID NO: 662316 - RNA, 19 nt, Human
uaaguacaaaguguaaggu

SEQ ID NO: 662317 - RNA, 21 nt, Human
uacccaggguggacccgccaa

SEQ ID NO: 662318 - RNA, 19 nt, Human
uaccuggagcuggcucuug

SEQ ID NO: 662319 - RNA, 23 nt, Human
ucagaggaaccuggucuggggca

SEQ ID NO: 662320 - RNA, 24 nt, Human
ucagccuaaaaaaauuacaaaacc

SEQ ID NO: 662321 - RNA, 21 nt, Human
uccccgggcgccccccagcuc

SEQ ID NO: 662322 - RNA, 26 nt, Human
ucgaugguaaagugggugucucuuuu

SEQ ID NO: 662323 - RNA, 24 nt, Human
ucgcgccccggcccgucccaagca

SEQ ID NO: 662324 - RNA, 23 nt, Human
ucgguaggugccgauggaaaaag

SEQ ID NO: 662325 - RNA, 24 nt, Human
ucuuugcagcugccucuugagggg

SEQ ID NO: 662326 - RNA, 19 nt, Human
ugaaagaaauggguauggg

SEQ ID NO: 662327 - RNA, 19 nt, Human
ugaagugcuuguguggcac

SEQ ID NO: 662328 - RNA, 24 nt, Human
ugacuucagaaaacccugccaacc

SEQ ID NO: 662329 - RNA, 20 nt, Human
ugagaaaggagaugcucgcc

SEQ ID NO: 662330 - RNA, 22 nt, Human
ugagguauaucugugcugccau

SEQ ID NO: 662331 - RNA, 22 nt, Human
ugccaugaagugugccaugaga

SEQ ID NO: 662332 - RNA, 27 nt, Human
ugcuggccccaugcuucccuuucccug

SEQ ID NO: 662333 - RNA, 23 nt, Human
uggaaaaaggucaggggguuggg

SEQ ID NO: 662334 - RNA, 22 nt, Human
uggaugcgaccgccuucgcgcc

SEQ ID NO: 662335 - RNA, 22 nt, Human
uggcuggaguuuaugguucucu

SEQ ID NO: 662336 - RNA, 22 nt, Human
ugggaauaccucauugugagcu

SEQ ID NO: 662337 - RNA, 18 nt, Human
ugggauggguuggugaug

SEQ ID NO: 662338 - RNA, 19 nt, Human
ugggauggguuggugaugg

SEQ ID NO: 662339 - RNA, 21 nt, Human
ugggauggguuggugaugggg

SEQ ID NO: 662340 - RNA, 20 nt, Human
ugggauggguuggugauggu

SEQ ID NO: 662341 - RNA, 24 nt, Human
uggucacgccgaggccagaggugc

SEQ ID NO: 662342 - RNA, 22 nt, Human
uggucuggggcagguggugagg

SEQ ID NO: 662343 - RNA, 23 nt, Human
uggucuggggcagguggugaggg

SEQ ID NO: 662344 - RNA, 21 nt, Human
uguauguauauggguagaagu

SEQ ID NO: 662345 - RNA, 26 nt, Human
uguggcaggauaucugcuccuaggcc

SEQ ID NO: 662346 - RNA, 20 nt, Human
uucccuuucccugagaaagg

SEQ ID NO: 662347 - RNA, 19 nt, Human
uuccugcuaggcuccugca

SEQ ID NO: 662348 - RNA, 20 nt, Human
uucuccagggugaacucugg

SEQ ID NO: 662349 - RNA, 22 nt, Human
uucugcauucucccuuuauucu

SEQ ID NO: 662350 - RNA, 18 nt, Human
uugaccacaugcccacag

SEQ ID NO: 662351 - RNA, 20 nt, Human
uuuccugcuaggcuccugca

SEQ ID NO: 662352 - RNA, 22 nt, Human
aaacaugaauuccauagaucug

SEQ ID NO: 662353 - RNA, 19 nt, Human
aaagccgcagaguuacuga

SEQ ID NO: 662354 - RNA, 19 nt, Human
aaaggaaagaaucauucaa

SEQ ID NO: 662355 - RNA, 19 nt, Human
aagaacauuuuuugugaac

SEQ ID NO: 662356 - RNA, 23 nt, Human
aagccguucuuucucagagccaa

SEQ ID NO: 662357 - RNA, 25 nt, Human
aaucauucaaguucagccaaucuga

SEQ ID NO: 662358 - RNA, 23 nt, Human
aaugcaaacaugaauuccauaga

SEQ ID NO: 662359 - RNA, 19 nt, Human
acaagaaaggcuauuggug

SEQ ID NO: 662360 - RNA, 18 nt, Human
accaucuagaguuuggcc

SEQ ID NO: 662361 - RNA, 25 nt, Human
acccacagcugucucugcagugucc

SEQ ID NO: 662362 - RNA, 26 nt, Human
agacugaaaucuuccccaaccggagg

SEQ ID NO: 662363 - RNA, 25 nt, Human
agagaaaagugcagaguuagaacuc

SEQ ID NO: 662364 - RNA, 23 nt, Human
agagauuuaaugagguuuaauaa

SEQ ID NO: 662365 - RNA, 27 nt, Human
agccaauuuccucccaaauugauuggu

SEQ ID NO: 662366 - RNA, 18 nt, Human
aggaggcacugcagaagg

SEQ ID NO: 662367 - RNA, 21 nt, Human
agugguggaggagcagcucag

SEQ ID NO: 662368 - RNA, 25 nt, Human
auagcaagcaaaggacaaauauauc

SEQ ID NO: 662369 - RNA, 21 nt, Human
augauuugguuguauugucuu

SEQ ID NO: 662370 - RNA, 22 nt, Human
auucaaguucagccaaucugau

SEQ ID NO: 662371 - RNA, 19 nt, Human
caaaauaaaugccauagua

SEQ ID NO: 662372 - RNA, 21 nt, Human
caacuccauaaauacauuccu

SEQ ID NO: 662373 - RNA, 18 nt, Human
caaguucagccaaucuga

SEQ ID NO: 662374 - RNA, 18 nt, Human
cacacagccucacauuuc

SEQ ID NO: 662375 - RNA, 19 nt, Human
cagaaggagcuguccucuu

SEQ ID NO: 662376 - RNA, 21 nt, Human
cagacuaguagcaaguaugaa

SEQ ID NO: 662377 - RNA, 19 nt, Human
cagaguuagaacucgaugc

SEQ ID NO: 662378 - RNA, 24 nt, Human
cagcaagaaaacaacugagacuga

SEQ ID NO: 662379 - RNA, 24 nt, Human
caguccagcacauuaauucacauu

SEQ ID NO: 662380 - RNA, 20 nt, Human
cauagcaagcaaaggacaaa

SEQ ID NO: 662381 - RNA, 20 nt, Human
cauccagaugauuugguugu

SEQ ID NO: 662382 - RNA, 21 nt, Human
cauggccugauucaaaacagg

SEQ ID NO: 662383 - RNA, 23 nt, Human
cauuucaugaggagagcuaaagg

SEQ ID NO: 662384 - RNA, 22 nt, Human
ccaccaagccguucuuucucag

SEQ ID NO: 662385 - RNA, 21 nt, Human
ccagugguccucuguagucag

SEQ ID NO: 662386 - RNA, 19 nt, Human
cucugggccaguccagcac

SEQ ID NO: 662387 - RNA, 19 nt, Human
cucuuguguggcucugucc

SEQ ID NO: 662388 - RNA, 23 nt, Human
cugagacugaaaucuuccccagu

SEQ ID NO: 662389 - RNA, 23 nt, Human
cugguagucagcuaaugucccca

SEQ ID NO: 662390 - RNA, 21 nt, Human
cuuucugccaauaaauucaug

SEQ ID NO: 662391 - RNA, 18 nt, Human
gaggcccaccucccugcu

SEQ ID NO: 662392 - RNA, 21 nt, Human
gcagagagggcacacagccuc

SEQ ID NO: 662393 - RNA, 19 nt, Human
ggagcagcucagacaaguu

SEQ ID NO: 662394 - RNA, 20 nt, Human
ggaggcccaccucccugcuu

SEQ ID NO: 662395 - RNA, 23 nt, Human
ggauaggggaggggugcaugggc

SEQ ID NO: 662396 - RNA, 19 nt, Human
gggaggggugcaugggcug

SEQ ID NO: 662397 - RNA, 21 nt, Human
ggggaggggugcaugggcugg

SEQ ID NO: 662398 - RNA, 21 nt, Human
uaaagggcccaucuugcugug

SEQ ID NO: 662399 - RNA, 24 nt, Human
uaaggaaggcuuugaaaaaauuaa

SEQ ID NO: 662400 - RNA, 20 nt, Human
uagaauugaggugacaugua

SEQ ID NO: 662401 - RNA, 24 nt, Human
uagcucugaggcugucuccuuuca

SEQ ID NO: 662402 - RNA, 18 nt, Human
uauagaagauaaacuaca

SEQ ID NO: 662403 - RNA, 19 nt, Human
uaugaucaggcuguacugc

SEQ ID NO: 662404 - RNA, 23 nt, Human
uccagguguaagaacuguaaaaa

SEQ ID NO: 662405 - RNA, 22 nt, Human
ucucugcaguguccuuagggca

SEQ ID NO: 662406 - RNA, 22 nt, Human
ucugcaguguccuuagggcauc

SEQ ID NO: 662407 - RNA, 18 nt, Human
ucuguagucagaggaagg

SEQ ID NO: 662408 - RNA, 23 nt, Human
ugaaaacagucaguguugcaaga

SEQ ID NO: 662409 - RNA, 23 nt, Human
ugaaaguucagaaucuuucucca

SEQ ID NO: 662410 - RNA, 21 nt, Human
ugaacucaggucuuucugccc

SEQ ID NO: 662411 - RNA, 24 nt, Human
ugacauguacaaagucagagagaa

SEQ ID NO: 662412 - RNA, 22 nt, Human
ugaccagcaagaaaacaacuga

SEQ ID NO: 662413 - RNA, 23 nt, Human
ugacuuguacaagauuuacaucu

SEQ ID NO: 662414 - RNA, 19 nt, Human
ugaggagagcuaaagggcc

SEQ ID NO: 662415 - RNA, 22 nt, Human
ugaggugacauguacaaaguca

SEQ ID NO: 662416 - RNA, 22 nt, Human
ugcaaaauaaaugccauaguaa

SEQ ID NO: 662417 - RNA, 21 nt, Human
ugcacugggagaugcaugauu

SEQ ID NO: 662418 - RNA, 21 nt, Human
ugcaugauuuauauauuuuga

SEQ ID NO: 662419 - RNA, 19 nt, Human
uggaaaguugguacuacug

SEQ ID NO: 662420 - RNA, 22 nt, Human
uggaggcccaccucccugcuuu

SEQ ID NO: 662421 - RNA, 22 nt, Human
uggccugauucaaaacaggggg

SEQ ID NO: 662422 - RNA, 26 nt, Human
uggcucuguccuucuuuuggaagacc

SEQ ID NO: 662423 - RNA, 25 nt, Human
ugguggaggagcagcucagacaagu

SEQ ID NO: 662424 - RNA, 19 nt, Human
uuacagaugugccaagaac

SEQ ID NO: 662425 - RNA, 20 nt, Human
uuacuccaaguuugcacuuu

SEQ ID NO: 662426 - RNA, 24 nt, Human
uucaccaucuagaguuuggccauu

SEQ ID NO: 662427 - RNA, 24 nt, Human
uucaugaggagagcuaaagggccc

SEQ ID NO: 662428 - RNA, 21 nt, Human
uucauuguacccacagcuguc

SEQ ID NO: 662429 - RNA, 21 nt, Human
uucccuagaaccugaagccca

SEQ ID NO: 662430 - RNA, 20 nt, Human
uugguuguauugucuuggcc

SEQ ID NO: 662431 - RNA, 21 nt, Human
uugguuguauugucuuggccu

SEQ ID NO: 662432 - RNA, 23 nt, Human
uuuuacagagcuuucagguggaa

SEQ ID NO: 662433 - RNA, 24 nt, Human
uuuucauuguacccacagcugucu

SEQ ID NO: 662434 - RNA, 24 nt, Human
uuuuuuuuuuuuuuuuuuuuucag

SEQ ID NO: 662435 - RNA, 24 nt, Human
aagcaagaauugcacugcagcagc

SEQ ID NO: 662436 - RNA, 18 nt, Human
agaaagaaaaaaggcaga

SEQ ID NO: 662437 - RNA, 22 nt, Human
agauauugguacauccagauaa

SEQ ID NO: 662438 - RNA, 22 nt, Human
agugauccagagaguugagggc

SEQ ID NO: 662439 - RNA, 20 nt, Human
caccacgccucuauggcaau

SEQ ID NO: 662440 - RNA, 24 nt, Human
cagcagcaggaugcuuuuuagugg

SEQ ID NO: 662441 - RNA, 20 nt, Human
cagcaggaugcuuuuuagug

SEQ ID NO: 662442 - RNA, 24 nt, Human
gccagccugcaccacccaccacgc

SEQ ID NO: 662443 - RNA, 24 nt, Human
uaaauaaauccuuuguuauacaaa

SEQ ID NO: 662444 - RNA, 18 nt, Human
ugcaccacccaccacgcc

SEQ ID NO: 662445 - RNA, 18 nt, Human
ugcacugcagcagcagga

SEQ ID NO: 662446 - RNA, 21 nt, Human
ugcuuuuuaguggcugacacu

SEQ ID NO: 662447 - RNA, 20 nt, Human
uggcaauuuccacuggcuuu

SEQ ID NO: 662448 - RNA, 22 nt, Human
uggcugacacuauaaagcuaac

SEQ ID NO: 662449 - RNA, 18 nt, Human
uucaagagguggaacugc

SEQ ID NO: 662450 - RNA, 19 nt, Human
uucaagagguggaacugcu

SEQ ID NO: 662451 - RNA, 24 nt, Human
aaaaaaaaucccuuuauauugcaa

SEQ ID NO: 662452 - RNA, 22 nt, Human
accuggaggucugauccgggcu

SEQ ID NO: 662453 - RNA, 21 nt, Human
acgcacggggcgggagacgau

SEQ ID NO: 662454 - RNA, 21 nt, Human
agccagggcaauagagggccu

SEQ ID NO: 662455 - RNA, 19 nt, Human
auuuuguccauuccgcucc

SEQ ID NO: 662456 - RNA, 24 nt, Human
cacgccagggcggccgccaaugcc

SEQ ID NO: 662457 - RNA, 21 nt, Human
cagcugcugccaccccuaacg

SEQ ID NO: 662458 - RNA, 20 nt, Human
caggcagcgguagcugcccu

SEQ ID NO: 662459 - RNA, 20 nt, Human
caggccuugggcagcugcag

SEQ ID NO: 662460 - RNA, 21 nt, Human
caggcgugguaggagguaccg

SEQ ID NO: 662461 - RNA, 18 nt, Human
cagggcggccgccaaugc

SEQ ID NO: 662462 - RNA, 24 nt, Human
ccagggcggccgccaaugcccucu

SEQ ID NO: 662463 - RNA, 24 nt, Human
ccaggugcccugugucccuguccc

SEQ ID NO: 662464 - RNA, 20 nt, Human
ccaggugcccugugucccuu

SEQ ID NO: 662465 - RNA, 27 nt, Human
cccaagggccgcccuggacgccucccu

SEQ ID NO: 662466 - RNA, 19 nt, Human
cccuggagguuguggcacu

SEQ ID NO: 662467 - RNA, 23 nt, Human
ccgcagccagggcaauagagggc

SEQ ID NO: 662468 - RNA, 19 nt, Human
ccgccaaugcccucucccg

SEQ ID NO: 662469 - RNA, 22 nt, Human
ccuaacgcggggucugcccccu

SEQ ID NO: 662470 - RNA, 18 nt, Human
ccucgguggcugacggug

SEQ ID NO: 662471 - RNA, 22 nt, Human
cgaggcccagggccgcagccag

SEQ ID NO: 662472 - RNA, 22 nt, Human
cgccagggcggccgccaaugcc

SEQ ID NO: 662473 - RNA, 20 nt, Human
cguccaggugcccugugucc

SEQ ID NO: 662474 - RNA, 23 nt, Human
cuaacgcggggucugcccccucu

SEQ ID NO: 662475 - RNA, 18 nt, Human
cugcccccucucccgcgc

SEQ ID NO: 662476 - RNA, 21 nt, Human
cugcccccucucccgcgcguc

SEQ ID NO: 662477 - RNA, 19 nt, Human
cugcugccaccccuaacgc

SEQ ID NO: 662478 - RNA, 21 nt, Human
cuggggggcacaggcagcggu

SEQ ID NO: 662479 - RNA, 20 nt, Human
cugucgggggucaaggcugu

SEQ ID NO: 662480 - RNA, 20 nt, Human
cuuuauauugcaacaggguu

SEQ ID NO: 662481 - RNA, 24 nt, Human
gacccaggcgugguaggagguacc

SEQ ID NO: 662482 - RNA, 19 nt, Human
gaccuggaggucugauccg

SEQ ID NO: 662483 - RNA, 25 nt, Human
gcccuggacgccucccucugugagg

SEQ ID NO: 662484 - RNA, 24 nt, Human
gcgacagcugcugccaccccuaac

SEQ ID NO: 662485 - RNA, 18 nt, Human
gcuuccccgggcccugcc

SEQ ID NO: 662486 - RNA, 22 nt, Human
ggagagagacccaggcguggua

SEQ ID NO: 662487 - RNA, 23 nt, Human
gggcggaucagaccuggaggucu

SEQ ID NO: 662488 - RNA, 20 nt, Human
gggcuuccccgggcccugcc

SEQ ID NO: 662489 - RNA, 20 nt, Human
ggucaaggcugugcgcaggg

SEQ ID NO: 662490 - RNA, 20 nt, Human
uaacgcggggucugcccccu

SEQ ID NO: 662491 - RNA, 23 nt, Human
ucagaccuggaggucugauccgg

SEQ ID NO: 662492 - RNA, 23 nt, Human
ucgcugucgggggucaaggcugu

SEQ ID NO: 662493 - RNA, 26 nt, Human
ucgguggcugacgguggucacauuuu

SEQ ID NO: 662494 - RNA, 24 nt, Human
ugacccaaggucucgcugacgcac

SEQ ID NO: 662495 - RNA, 20 nt, Human
ugaggggcggaucagaccug

SEQ ID NO: 662496 - RNA, 21 nt, Human
ugaggucagguccucgcuguc

SEQ ID NO: 662497 - RNA, 20 nt, Human
ugaggugcaggccuugccgu

SEQ ID NO: 662498 - RNA, 20 nt, Human
ugcccuggagguuguggcac

SEQ ID NO: 662499 - RNA, 21 nt, Human
ugccugcgggacuggccaccc

SEQ ID NO: 662500 - RNA, 21 nt, Human
uggagguuguggcacugguag

SEQ ID NO: 662501 - RNA, 19 nt, Human
uggggggcacaggcagcgg

SEQ ID NO: 662502 - RNA, 20 nt, Human
uggggggcacaggcagcggu

SEQ ID NO: 662503 - RNA, 18 nt, Human
ugucgggggucaaggcug

SEQ ID NO: 662504 - RNA, 22 nt, Human
cccucccucgagcccacucacu

SEQ ID NO: 662505 - RNA, 20 nt, Human
cccucgagcccacucacuag

SEQ ID NO: 662506 - RNA, 23 nt, Human
uauuuucgaauuuaaaacucagg

SEQ ID NO: 662507 - RNA, 18 nt, Human
ucgaauuuaaaacucagg

SEQ ID NO: 662508 - RNA, 24 nt, Human
uuaaaacucagggucaauuccugg

SEQ ID NO: 662509 - RNA, 22 nt, Human
uuuucgugugucccagccccac

SEQ ID NO: 662510 - RNA, 20 nt, Human
uuuuuuuuuuuuuuuuucgu

SEQ ID NO: 662511 - RNA, 24 nt, Human
uuuuuuuuuuuuuuuuuuuuucgu

SEQ ID NO: 662512 - RNA, 27 nt, Human
uuuuuuuuuuuuuuuuuuuuuucgggg

SEQ ID NO: 662513 - RNA, 19 nt, Human
aaaagaaaccaaaaucacc

SEQ ID NO: 662514 - RNA, 18 nt, Human
aaagugcugggauuacaa

SEQ ID NO: 662515 - RNA, 24 nt, Human
aaagugcugggauuacaagcguga

SEQ ID NO: 662516 - RNA, 18 nt, Human
aaccaaaaucaccugucu

SEQ ID NO: 662517 - RNA, 21 nt, Human
aacuuccuuccuuagcacccc

SEQ ID NO: 662518 - RNA, 19 nt, Human
aagugcugggauuacaagc

SEQ ID NO: 662519 - RNA, 19 nt, Human
aagugcugggauuacaagc

SEQ ID NO: 662520 - RNA, 26 nt, Human
aagugcugggauuacaagcgugagcc

SEQ ID NO: 662521 - RNA, 24 nt, Human
acaugacacucccucuaagccccc

SEQ ID NO: 662522 - RNA, 22 nt, Human
accaaaagaaaccaaaaucacc

SEQ ID NO: 662523 - RNA, 21 nt, Human
acccaauaaagccagcaguuc

SEQ ID NO: 662524 - RNA, 31 nt, Human
acccaauaaagccagcaguucagccuugccc

SEQ ID NO: 662525 - RNA, 28 nt, Human
acccaggcuggauggagugcaguggcgu

SEQ ID NO: 662526 - RNA, 18 nt, Human
accuugcagcucgguggg

SEQ ID NO: 662527 - RNA, 18 nt, Human
acgggguuucaccauggu

SEQ ID NO: 662528 - RNA, 20 nt, Human
acgggguuucaccauggucu

SEQ ID NO: 662529 - RNA, 22 nt, Human
acgggguuucaccauggucucg

SEQ ID NO: 662530 - RNA, 18 nt, Human
acucccucuaagccccca

SEQ ID NO: 662531 - RNA, 21 nt, Human
acugcaagcuccgccuuccgg

SEQ ID NO: 662532 - RNA, 21 nt, Human
agcugggauuacaggggcccg

SEQ ID NO: 662533 - RNA, 25 nt, Human
agggguuccaggauuccucacugcu

SEQ ID NO: 662534 - RNA, 22 nt, Human
aguagagacgggguuucaccau

SEQ ID NO: 662535 - RNA, 18 nt, Human
aguagcugggauuacagg

SEQ ID NO: 662536 - RNA, 25 nt, Human
aguagcugggauuacaggggcccgc

SEQ ID NO: 662537 - RNA, 19 nt, Human
agugcaguggcgugaucuc

SEQ ID NO: 662538 - RNA, 20 nt, Human
agugcaguggcgugaucucg

SEQ ID NO: 662539 - RNA, 23 nt, Human
agugcaguggcgugaucucggcu

SEQ ID NO: 662540 - RNA, 24 nt, Human
agugcaguggcgugaucucggcuc

SEQ ID NO: 662541 - RNA, 24 nt, Human
agugcugggauuacaagcgugagc

SEQ ID NO: 662542 - RNA, 20 nt, Human
aucauuuucacaccaaaaga

SEQ ID NO: 662543 - RNA, 21 nt, Human
auucuccugccucagccuccc

SEQ ID NO: 662544 - RNA, 24 nt, Human
caaagugcugggauuacaagcgug

SEQ ID NO: 662545 - RNA, 21 nt, Human
caacucccuaagucccggccu

SEQ ID NO: 662546 - RNA, 22 nt, Human
caagccauucuccugccucagc

SEQ ID NO: 662547 - RNA, 24 nt, Human
cacaccaaaagaaaccaaaaucac

SEQ ID NO: 662548 - RNA, 23 nt, Human
cacagcucugagcgcagccaccu

SEQ ID NO: 662549 - RNA, 19 nt, Human
caccaucauuuucacacca

SEQ ID NO: 662550 - RNA, 22 nt, Human
caccauggucucgaucuccuga

SEQ ID NO: 662551 - RNA, 20 nt, Human
caccuugcagcucggugggu

SEQ ID NO: 662552 - RNA, 23 nt, Human
cagccaacccuccuuagugacgc

SEQ ID NO: 662553 - RNA, 20 nt, Human
cagcuccccagagaagauga

SEQ ID NO: 662554 - RNA, 21 nt, Human
ccaaaagaaaccaaaaucacc

SEQ ID NO: 662555 - RNA, 22 nt, Human
ccaaagugcugggauuacaagc

SEQ ID NO: 662556 - RNA, 24 nt, Human
ccaaagugcugggauuacaagcgu

SEQ ID NO: 662557 - RNA, 24 nt, Human
ccagccaacccuccuuagugacgc

SEQ ID NO: 662558 - RNA, 21 nt, Human
ccccagagagcagggcaaacc

SEQ ID NO: 662559 - RNA, 24 nt, Human
cccccugcagccuuuagugggagc

SEQ ID NO: 662560 - RNA, 23 nt, Human
cccgaguagcugggauuacaggg

SEQ ID NO: 662561 - RNA, 24 nt, Human
ccgccucagccucccaaagugcug

SEQ ID NO: 662562 - RNA, 19 nt, Human
ccggguucaagccauucuc

SEQ ID NO: 662563 - RNA, 22 nt, Human
ccggguucaagccauucuccug

SEQ ID NO: 662564 - RNA, 19 nt, Human
ccuaccuucuggcccaacu

SEQ ID NO: 662565 - RNA, 20 nt, Human
ccugcagccuuuagugggag

SEQ ID NO: 662566 - RNA, 23 nt, Human
ccugccucagccucccgaguagc

SEQ ID NO: 662567 - RNA, 25 nt, Human
ccuggccccuacccuaccuucuggc

SEQ ID NO: 662568 - RNA, 28 nt, Human
ccugucacccaggcuggauggagugcag

SEQ ID NO: 662569 - RNA, 23 nt, Human
ccuuggaugauagccuuggugac

SEQ ID NO: 662570 - RNA, 23 nt, Human
ccuuuagugggagcuccagggac

SEQ ID NO: 662571 - RNA, 22 nt, Human
cgcccugucacccaggcuggau

SEQ ID NO: 662572 - RNA, 24 nt, Human
cgccucagccucccaaagugcugg

SEQ ID NO: 662573 - RNA, 19 nt, Human
cgccuuccggguucaagcc

SEQ ID NO: 662574 - RNA, 20 nt, Human
cuaagucccggccuggauuu

SEQ ID NO: 662575 - RNA, 23 nt, Human
cucacagcucugagcgcagccac

SEQ ID NO: 662576 - RNA, 24 nt, Human
cucagccucccgaguagcugggau

SEQ ID NO: 662577 - RNA, 24 nt, Human
cuccugaccucgugaucugcccgc

SEQ ID NO: 662578 - RNA, 23 nt, Human
cugccucagccucccgaguagcu

SEQ ID NO: 662579 - RNA, 20 nt, Human
cuggauggagugcaguggcg

SEQ ID NO: 662580 - RNA, 20 nt, Human
cugggccucucaucccugcc

SEQ ID NO: 662581 - RNA, 22 nt, Human
cuuccggguucaagccauucuc

SEQ ID NO: 662582 - RNA, 26 nt, Human
cuuucaugagcguggguuggggugag

SEQ ID NO: 662583 - RNA, 24 nt, Human
gaccucgugaucugcccgccucag

SEQ ID NO: 662584 - RNA, 18 nt, Human
gaccuggccccuacccua

SEQ ID NO: 662585 - RNA, 21 nt, Human
gacgggguuucaccauggucu

SEQ ID NO: 662586 - RNA, 19 nt, Human
gagacgggguuucaccaug

SEQ ID NO: 662587 - RNA, 25 nt, Human
gagccuuuuaguucugcaacaguuu

SEQ ID NO: 662588 - RNA, 24 nt, Human
gagcuccagggacaccaaaugguu

SEQ ID NO: 662589 - RNA, 26 nt, Human
gaggagacugaggcaccucccuacca

SEQ ID NO: 662590 - RNA, 18 nt, Human
gauuacaagcgugagcca

SEQ ID NO: 662591 - RNA, 24 nt, Human
gcccggcuaauuuuuuuguauuuu

SEQ ID NO: 662592 - RNA, 25 nt, Human
gccuuccggguucaagccauucucc

SEQ ID NO: 662593 - RNA, 18 nt, Human
gguuggggugaggagacu

SEQ ID NO: 662594 - RNA, 20 nt, Human
guagcugggauuacaggggc

SEQ ID NO: 662595 - RNA, 21 nt, Human
gugaucucggcucacugcaag

SEQ ID NO: 662596 - RNA, 24 nt, Human
gugaucugcccgccucagccuccc

SEQ ID NO: 662597 - RNA, 21 nt, Human
uaagucccggccuggauuuca

SEQ ID NO: 662598 - RNA, 19 nt, Human
uaaucuguccccagagagc

SEQ ID NO: 662599 - RNA, 26 nt, Human
uaauuuuuuuguauuuuuaguagaga

SEQ ID NO: 662600 - RNA, 24 nt, Human
uacaagcgugagccaccgcgccca

SEQ ID NO: 662601 - RNA, 23 nt, Human
uacaggggcccgccaccacgccc

SEQ ID NO: 662602 - RNA, 24 nt, Human
uaguagagacgggguuucaccaug

SEQ ID NO: 662603 - RNA, 25 nt, Human
ucaagccauucuccugccucagccu

SEQ ID NO: 662604 - RNA, 23 nt, Human
ucacaccaaaagaaaccaaaauc

SEQ ID NO: 662605 - RNA, 18 nt, Human
ucacugcaagcuccgccu

SEQ ID NO: 662606 - RNA, 19 nt, Human
ucacugcaagcuccgccuu

SEQ ID NO: 662607 - RNA, 24 nt, Human
ucacugcaagcuccgccuuccggg

SEQ ID NO: 662608 - RNA, 22 nt, Human
ucacugcuggcugcuucugacc

SEQ ID NO: 662609 - RNA, 20 nt, Human
ucagccucccgaguagcugg

SEQ ID NO: 662610 - RNA, 20 nt, Human
uccaggauuccucacugcug

SEQ ID NO: 662611 - RNA, 18 nt, Human
ucccaaagugcugggauu

SEQ ID NO: 662612 - RNA, 24 nt, Human
ucccaaagugcugggauuacaagc

SEQ ID NO: 662613 - RNA, 23 nt, Human
ucccgaguagcugggauuacagg

SEQ ID NO: 662614 - RNA, 25 nt, Human
ucccgaguagcugggauuacagggg

SEQ ID NO: 662615 - RNA, 22 nt, Human
uccgccuuccggguucaagccg

SEQ ID NO: 662616 - RNA, 19 nt, Human
uccugggggccuggcuggg

SEQ ID NO: 662617 - RNA, 18 nt, Human
uccuuagcacccccugca

SEQ ID NO: 662618 - RNA, 25 nt, Human
ucucacagcucugagcgcagccacc

SEQ ID NO: 662619 - RNA, 24 nt, Human
ucuccugccucagccucccgagua

SEQ ID NO: 662620 - RNA, 23 nt, Human
ucucgcccugucacccaggcugg

SEQ ID NO: 662621 - RNA, 24 nt, Human
ucucgcccugucacccaggcugga

SEQ ID NO: 662622 - RNA, 25 nt, Human
ucucgcccugucacccaggcuggau

SEQ ID NO: 662623 - RNA, 26 nt, Human
ucucgcccugucacccaggcuggaug

SEQ ID NO: 662624 - RNA, 21 nt, Human
ucugcccgccucagccuccca

SEQ ID NO: 662625 - RNA, 19 nt, Human
ucuggccacagaugcaggg

SEQ ID NO: 662626 - RNA, 22 nt, Human
ucuguccccagagagcagggca

SEQ ID NO: 662627 - RNA, 21 nt, Human
ugaccuggccccuacccuacc

SEQ ID NO: 662628 - RNA, 18 nt, Human
ugagacagagucucgccc

SEQ ID NO: 662629 - RNA, 22 nt, Human
ugagacagagucucgcccuguc

SEQ ID NO: 662630 - RNA, 23 nt, Human
ugaguugaaauguaagccacaga

SEQ ID NO: 662631 - RNA, 24 nt, Human
ugccucagccucccgaguagcugg

SEQ ID NO: 662632 - RNA, 24 nt, Human
ugcugggauuacaagcgugagcca

SEQ ID NO: 662633 - RNA, 19 nt, Human
uggagugcaguggcgugau

SEQ ID NO: 662634 - RNA, 23 nt, Human
uggagugcaguggcgugaucucg

SEQ ID NO: 662635 - RNA, 24 nt, Human
uggagugcaguggcgugaucucgg

SEQ ID NO: 662636 - RNA, 23 nt, Human
uggauggagugcaguggcgugau

SEQ ID NO: 662637 - RNA, 20 nt, Human
uggcgugaucucggcucacu

SEQ ID NO: 662638 - RNA, 21 nt, Human
uggcugggccucucaucccug

SEQ ID NO: 662639 - RNA, 23 nt, Human
uggcugggccucucaucccugcc

SEQ ID NO: 662640 - RNA, 19 nt, Human
ugggauuacaagcgugagc

SEQ ID NO: 662641 - RNA, 21 nt, Human
ugggauuacaagcgugagcca

SEQ ID NO: 662642 - RNA, 22 nt, Human
ugggauuacaagcgugagccac

SEQ ID NO: 662643 - RNA, 23 nt, Human
ugggauuacaagcgugagccacc

SEQ ID NO: 662644 - RNA, 24 nt, Human
ugggauuacaagcgugagccaccg

SEQ ID NO: 662645 - RNA, 22 nt, Human
ugggauuacaggggcccgccac

SEQ ID NO: 662646 - RNA, 24 nt, Human
ugggauuacaggggcccgccacca

SEQ ID NO: 662647 - RNA, 21 nt, Human
uguauuuuuaguagagacggg

SEQ ID NO: 662648 - RNA, 19 nt, Human
uguccagcucuggccacag

SEQ ID NO: 662649 - RNA, 18 nt, Human
uuaguagagacgggguuu

SEQ ID NO: 662650 - RNA, 22 nt, Human
uuaguagagacgggguuucacc

SEQ ID NO: 662651 - RNA, 24 nt, Human
uuaguagagacgggguuucaccau

SEQ ID NO: 662652 - RNA, 18 nt, Human
uucaagccauucuccugc

SEQ ID NO: 662653 - RNA, 21 nt, Human
uucaagccauucuccugccuc

SEQ ID NO: 662654 - RNA, 24 nt, Human
uuccggguucaagccauucuccug

SEQ ID NO: 662655 - RNA, 25 nt, Human
uuccucacugcuggcugcuucugac

SEQ ID NO: 662656 - RNA, 21 nt, Human
uuccucugcauauucuguguc

SEQ ID NO: 662657 - RNA, 23 nt, Human
uuguauuuuuaguagagacgggg

SEQ ID NO: 662658 - RNA, 24 nt, Human
uuuuuaguagagacgggguuucac

SEQ ID NO: 662659 - RNA, 21 nt, Human
uuuuuguauuuuuaguagaga

SEQ ID NO: 662660 - RNA, 21 nt, Human
uuuuuuguauuuuuaguagag

SEQ ID NO: 662661 - RNA, 24 nt, Human
uuuuuuguauuuuuaguagagacg

SEQ ID NO: 662662 - RNA, 20 nt, Human
uuuuuuuuuuugagacagag

SEQ ID NO: 662663 - RNA, 25 nt, Human
uuuuuuuuuuuugagacagagucuc

SEQ ID NO: 662664 - RNA, 18 nt, Human
uuuuuuuuuuuuuuuuug

SEQ ID NO: 662665 - RNA, 21 nt, Human
aaaaggaagacagaaccaaga

SEQ ID NO: 662666 - RNA, 22 nt, Human
aaaauacauaaacacuugcuga

SEQ ID NO: 662667 - RNA, 20 nt, Human
aaccaaacagcaauucagga

SEQ ID NO: 662668 - RNA, 20 nt, Human
aaccuccaucuccugggccc

SEQ ID NO: 662669 - RNA, 18 nt, Human
aagcaauucuucccccuc

SEQ ID NO: 662670 - RNA, 19 nt, Human
aagcauaacuggguccaga

SEQ ID NO: 662671 - RNA, 19 nt, Human
aaguagaaaaggaagacag

SEQ ID NO: 662672 - RNA, 24 nt, Human
acucuguugcucaggcuggaugca

SEQ ID NO: 662673 - RNA, 18 nt, Human
agaaaaauacaaucagcu

SEQ ID NO: 662674 - RNA, 22 nt, Human
agaccacaaauugggcucuaaa

SEQ ID NO: 662675 - RNA, 21 nt, Human
agcauacaaaauacauaaaca

SEQ ID NO: 662676 - RNA, 22 nt, Human
aggaaaagcauaacugggucca

SEQ ID NO: 662677 - RNA, 23 nt, Human
aggaaaauaaaaguagaaaagga

SEQ ID NO: 662678 - RNA, 23 nt, Human
caaacagcaauucaggaaaagca

SEQ ID NO: 662679 - RNA, 23 nt, Human
caaccuccaucuccugggcccaa

SEQ ID NO: 662680 - RNA, 24 nt, Human
caaccuccaucuccugggcccaag

SEQ ID NO: 662681 - RNA, 24 nt, Human
caagaucucacucuguugcucagg

SEQ ID NO: 662682 - RNA, 21 nt, Human
cacucuguugcucaggcugga

SEQ ID NO: 662683 - RNA, 27 nt, Human
caggaaaagcauaacuggguccagaga

SEQ ID NO: 662684 - RNA, 23 nt, Human
ccaagcaauucuucccccucagc

SEQ ID NO: 662685 - RNA, 23 nt, Human
cccccucagccucccgaguagcu

SEQ ID NO: 662686 - RNA, 24 nt, Human
ccccucagccucccgaguagcugg

SEQ ID NO: 662687 - RNA, 22 nt, Human
ccgcaaccuccaucuccugggc

SEQ ID NO: 662688 - RNA, 23 nt, Human
ccgcaaccuccaucuccugggcc

SEQ ID NO: 662689 - RNA, 24 nt, Human
cucagccucccgaguagcugggac

SEQ ID NO: 662690 - RNA, 21 nt, Human
cuccugggcccaagcaauucu

SEQ ID NO: 662691 - RNA, 24 nt, Human
cuccugggcccaagcaauucuucc

SEQ ID NO: 662692 - RNA, 23 nt, Human
cuuuacaguauccacagcaauua

SEQ ID NO: 662693 - RNA, 23 nt, Human
gaguagcugggaccacagugugc

SEQ ID NO: 662694 - RNA, 22 nt, Human
gauccccacucaccgcaaccuc

SEQ ID NO: 662695 - RNA, 26 nt, Human
guagaaaaggaagacagaaccaagaa

SEQ ID NO: 662696 - RNA, 21 nt, Human
uaacuggguccagagaaaauu

SEQ ID NO: 662697 - RNA, 24 nt, Human
uaagguaaaaaccaaacagcaauu

SEQ ID NO: 662698 - RNA, 24 nt, Human
uacaaaaaggcuuacaagaugcag

SEQ ID NO: 662699 - RNA, 21 nt, Human
uacaaucagcugaauauuuag

SEQ ID NO: 662700 - RNA, 24 nt, Human
ucaccgcaaccuccaucuccuggg

SEQ ID NO: 662701 - RNA, 26 nt, Human
ucaccgcaaccuccaucuccugggcc

SEQ ID NO: 662702 - RNA, 23 nt, Human
ucagccucccgaguagcugggac

SEQ ID NO: 662703 - RNA, 22 nt, Human
ucaggcuggaugcagcggcacg

SEQ ID NO: 662704 - RNA, 21 nt, Human
uccagagaaaauuucucccac

SEQ ID NO: 662705 - RNA, 24 nt, Human
uccaucuccugggcccaagcaauu

SEQ ID NO: 662706 - RNA, 21 nt, Human
ucccagccucugccuccucuc

SEQ ID NO: 662707 - RNA, 22 nt, Human
ucccgaguagcugggaccacag

SEQ ID NO: 662708 - RNA, 23 nt, Human
ucccgaguagcugggaccacagu

SEQ ID NO: 662709 - RNA, 21 nt, Human
uccugggcccaagcaauucuu

SEQ ID NO: 662710 - RNA, 19 nt, Human
ucucacucuguugcucagg

SEQ ID NO: 662711 - RNA, 23 nt, Human
ucucacucuguugcucaggcugg

SEQ ID NO: 662712 - RNA, 24 nt, Human
ucucacucuguugcucaggcugga

SEQ ID NO: 662713 - RNA, 23 nt, Human
ucuguugcucaggcuggaugcag

SEQ ID NO: 662714 - RNA, 22 nt, Human
ugagacaagaucucacucuguu

SEQ ID NO: 662715 - RNA, 24 nt, Human
uuaagguaaaaaccaaacagcaau

SEQ ID NO: 662716 - RNA, 21 nt, Human
aaaguacuggauuacaggcau

SEQ ID NO: 662717 - RNA, 23 nt, Human
aaaguacuggauuacaggcauga

SEQ ID NO: 662718 - RNA, 24 nt, Human
aaagugcugggauuacaggcguga

SEQ ID NO: 662719 - RNA, 19 nt, Human
aagugcugggauuacaggc

SEQ ID NO: 662720 - RNA, 19 nt, Human
aagugcugggauuacaggc

SEQ ID NO: 662721 - RNA, 26 nt, Human
aagugcugggauuacaggcgugagcc

SEQ ID NO: 662722 - RNA, 25 nt, Human
accauguugcccaggcuagucucaa

SEQ ID NO: 662723 - RNA, 18 nt, Human
acucugccacccaggcug

SEQ ID NO: 662724 - RNA, 24 nt, Human
acucugccacccaggcugcaguga

SEQ ID NO: 662725 - RNA, 18 nt, Human
acuggcuaauuuuuguau

SEQ ID NO: 662726 - RNA, 24 nt, Human
agagauuugccugcuuuggccucc

SEQ ID NO: 662727 - RNA, 18 nt, Human
agaguuccuuuuucuuuu

SEQ ID NO: 662728 - RNA, 18 nt, Human
aggaucuuuuucuugaga

SEQ ID NO: 662729 - RNA, 23 nt, Human
aggcugcagugaaguggcgccau

SEQ ID NO: 662730 - RNA, 18 nt, Human
aguagagaugggguuuca

SEQ ID NO: 662731 - RNA, 22 nt, Human
aguagagaugggguuucaccau

SEQ ID NO: 662732 - RNA, 23 nt, Human
aguagagaugggguuucaccaug

SEQ ID NO: 662733 - RNA, 23 nt, Human
aguagcugggaccauagguaugu

SEQ ID NO: 662734 - RNA, 21 nt, Human
agugcaguggcucaaucacag

SEQ ID NO: 662735 - RNA, 18 nt, Human
agugcugggauuacaggc

SEQ ID NO: 662736 - RNA, 25 nt, Human
aguuccuuuuucuuuuuucagggaa

SEQ ID NO: 662737 - RNA, 24 nt, Human
augauccaccugccucggccuccc

SEQ ID NO: 662738 - RNA, 19 nt, Human
augggguuucaccauguua

SEQ ID NO: 662739 - RNA, 24 nt, Human
augggguuucaccauguuagccag

SEQ ID NO: 662740 - RNA, 19 nt, Human
augggguuucaccauguug

SEQ ID NO: 662741 - RNA, 24 nt, Human
caaagugcugggauuacaggcgug

SEQ ID NO: 662742 - RNA, 24 nt, Human
caccaugacuggcuaauuuuugua

SEQ ID NO: 662743 - RNA, 21 nt, Human
caccauguuagccagcauggu

SEQ ID NO: 662744 - RNA, 24 nt, Human
caccauguuagccagcauggucuc

SEQ ID NO: 662745 - RNA, 24 nt, Human
caccauguugcccaggcuagucuc

SEQ ID NO: 662746 - RNA, 27 nt, Human
caccauguugcccaggcuagucucaaa

SEQ ID NO: 662747 - RNA, 23 nt, Human
caccugccucggccucccaaagu

SEQ ID NO: 662748 - RNA, 18 nt, Human
cacucugccacccaggcu

SEQ ID NO: 662749 - RNA, 22 nt, Human
cagccuugaccuccuugggcuc

SEQ ID NO: 662750 - RNA, 24 nt, Human
cagcucacuacagccuugaccucc

SEQ ID NO: 662751 - RNA, 24 nt, Human
cauguugcccaggcuagucucaaa

SEQ ID NO: 662752 - RNA, 22 nt, Human
ccaaagugcugggauuacaggc

SEQ ID NO: 662753 - RNA, 22 nt, Human
ccaaagugcugggauuacaggc

SEQ ID NO: 662754 - RNA, 24 nt, Human
ccaaagugcugggauuacaggcgu

SEQ ID NO: 662755 - RNA, 24 nt, Human
ccuaaaguacuggauuacaggcau

SEQ ID NO: 662756 - RNA, 20 nt, Human
ccucuuuuuuucauuugaga

SEQ ID NO: 662757 - RNA, 19 nt, Human
ccugaccucaugauccacc

SEQ ID NO: 662758 - RNA, 22 nt, Human
ccugggcucaagagauuugccu

SEQ ID NO: 662759 - RNA, 23 nt, Human
ccuugaccuccuugggcucaggu

SEQ ID NO: 662760 - RNA, 24 nt, Human
ccuugggcucaggugauccuccca

SEQ ID NO: 662761 - RNA, 23 nt, Human
cuaaaguacuggauuacaggcau

SEQ ID NO: 662762 - RNA, 24 nt, Human
cucagccuguugaguagcugggac

SEQ ID NO: 662763 - RNA, 24 nt, Human
cuccugaccucaugauccaccugc

SEQ ID NO: 662764 - RNA, 19 nt, Human
cuccugggcucaagagauu

SEQ ID NO: 662765 - RNA, 23 nt, Human
cugccucggccucccaaagugcu

SEQ ID NO: 662766 - RNA, 19 nt, Human
cugcgccuggccccccacu

SEQ ID NO: 662767 - RNA, 22 nt, Human
cuuuuuuuuuuuugagacgggg

SEQ ID NO: 662768 - RNA, 24 nt, Human
gaagaggaucuuuuucuugagaga

SEQ ID NO: 662769 - RNA, 22 nt, Human
gaccucaugauccaccugccuc

SEQ ID NO: 662770 - RNA, 22 nt, Human
gaccucaugauccaccugccuc

SEQ ID NO: 662771 - RNA, 24 nt, Human
gaccucaugauccaccugccucgg

SEQ ID NO: 662772 - RNA, 18 nt, Human
gagaugggguuucaccau

SEQ ID NO: 662773 - RNA, 20 nt, Human
gagaugggguuucaccaugu

SEQ ID NO: 662774 - RNA, 24 nt, Human
gagaugggguuucaccauguuagc

SEQ ID NO: 662775 - RNA, 23 nt, Human
gagaugggguuucaccauguugc

SEQ ID NO: 662776 - RNA, 19 nt, Human
gaguagcugggaccauagg

SEQ ID NO: 662777 - RNA, 24 nt, Human
gagugcaguggcucaaucacagcu

SEQ ID NO: 662778 - RNA, 22 nt, Human
gaugggguuucaccauguugcc

SEQ ID NO: 662779 - RNA, 18 nt, Human
gauuacaggcaugagcca

SEQ ID NO: 662780 - RNA, 18 nt, Human
gauuacaggcaugagcca

SEQ ID NO: 662781 - RNA, 22 nt, Human
gauuacaggcaugagccaucac

SEQ ID NO: 662782 - RNA, 18 nt, Human
gauuacaggcgugagcca

SEQ ID NO: 662783 - RNA, 19 nt, Human
gauuacaggcgugagccac

SEQ ID NO: 662784 - RNA, 22 nt, Human
gauuacaggcgugagccacugc

SEQ ID NO: 662785 - RNA, 19 nt, Human
gcuagucucaaacuccugg

SEQ ID NO: 662786 - RNA, 21 nt, Human
ggauuacaggcaugagccauc

SEQ ID NO: 662787 - RNA, 22 nt, Human
ggauuacaggcaugagccauca

SEQ ID NO: 662788 - RNA, 23 nt, Human
ggauuacaggcaugagccaucac

SEQ ID NO: 662789 - RNA, 23 nt, Human
gggcucaggugauccucccaacc

SEQ ID NO: 662790 - RNA, 18 nt, Human
gggguuucaccauguuag

SEQ ID NO: 662791 - RNA, 22 nt, Human
gggguuucaccauguuagccag

SEQ ID NO: 662792 - RNA, 22 nt, Human
gggguuucaccauguugcccag

SEQ ID NO: 662793 - RNA, 23 nt, Human
gggguuucaccauguugcccagg

SEQ ID NO: 662794 - RNA, 19 nt, Human
guagagaugggguuucacc

SEQ ID NO: 662795 - RNA, 21 nt, Human
guagagaugggguuucaccau

SEQ ID NO: 662796 - RNA, 21 nt, Human
guagagaugggguuucaccau

SEQ ID NO: 662797 - RNA, 22 nt, Human
guagagaugggguuucaccaug

SEQ ID NO: 662798 - RNA, 23 nt, Human
guagagaugggguuucaccaugu

SEQ ID NO: 662799 - RNA, 19 nt, Human
guauuuuuuguagagaugg

SEQ ID NO: 662800 - RNA, 24 nt, Human
uaaaguacuggauuacaggcauga

SEQ ID NO: 662801 - RNA, 24 nt, Human
uaauuuuuguauuuuuuguagaga

SEQ ID NO: 662802 - RNA, 22 nt, Human
uacaggcaugagccaucacacc

SEQ ID NO: 662803 - RNA, 22 nt, Human
uacaggcgugagccacugcgcc

SEQ ID NO: 662804 - RNA, 22 nt, Human
uacaggcgugagccacugcgcc

SEQ ID NO: 662805 - RNA, 23 nt, Human
uacaggcgugagccacugcgccu

SEQ ID NO: 662806 - RNA, 22 nt, Human
uagagaugggguuucaccaugu

SEQ ID NO: 662807 - RNA, 22 nt, Human
uagagaugggguuucaccaugu

SEQ ID NO: 662808 - RNA, 21 nt, Human
uagguucccaugaaucagaag

SEQ ID NO: 662809 - RNA, 25 nt, Human
ucacuacagccuugaccuccuuggg

SEQ ID NO: 662810 - RNA, 23 nt, Human
ucagccuguugaguagcugggac

SEQ ID NO: 662811 - RNA, 24 nt, Human
ucccaaagugcugggauuacaggc

SEQ ID NO: 662812 - RNA, 18 nt, Human
ucccaaccucagccuguu

SEQ ID NO: 662813 - RNA, 23 nt, Human
uccuaaaguacuggauuacaggc

SEQ ID NO: 662814 - RNA, 19 nt, Human
uccugggcucaagagauuu

SEQ ID NO: 662815 - RNA, 24 nt, Human
uccuugggcucaggugauccuccc

SEQ ID NO: 662816 - RNA, 18 nt, Human
ucggccucccaaagugcu

SEQ ID NO: 662817 - RNA, 23 nt, Human
ucucaaacuccugggcucaagag

SEQ ID NO: 662818 - RNA, 26 nt, Human
ucucacucugccacccaggcugcagu

SEQ ID NO: 662819 - RNA, 19 nt, Human
ucugucacccagauuggag

SEQ ID NO: 662820 - RNA, 24 nt, Human
ucugucacccagauuggagugcag

SEQ ID NO: 662821 - RNA, 24 nt, Human
ucuuauucugucacccagauugga

SEQ ID NO: 662822 - RNA, 22 nt, Human
ugagacggggucuuauucuguc

SEQ ID NO: 662823 - RNA, 20 nt, Human
ugaguagcugggaccauagg

SEQ ID NO: 662824 - RNA, 21 nt, Human
ugccacccaggcugcagugaa

SEQ ID NO: 662825 - RNA, 28 nt, Human
ugcccaggcuagucucaaacuccugggc

SEQ ID NO: 662826 - RNA, 21 nt, Human
ugccucggccucccaaagugc

SEQ ID NO: 662827 - RNA, 24 nt, Human
ugccucggccucccaaagugcugg

SEQ ID NO: 662828 - RNA, 24 nt, Human
ugcugggauuacaggcgugagcca

SEQ ID NO: 662829 - RNA, 20 nt, Human
ugcuuuggccuccuaaagua

SEQ ID NO: 662830 - RNA, 19 nt, Human
uggagugcaguggcucaau

SEQ ID NO: 662831 - RNA, 20 nt, Human
uggauuacaggcaugagcca

SEQ ID NO: 662832 - RNA, 21 nt, Human
uggauuacaggcaugagccau

SEQ ID NO: 662833 - RNA, 23 nt, Human
uggauuacaggcaugagccauca

SEQ ID NO: 662834 - RNA, 25 nt, Human
uggauuacaggcaugagccaucaca

SEQ ID NO: 662835 - RNA, 23 nt, Human
uggcucaaucacagcucacuaca

SEQ ID NO: 662836 - RNA, 24 nt, Human
ugggaccauagguauguggcacca

SEQ ID NO: 662837 - RNA, 18 nt, Human
ugggauuacaggcgugag

SEQ ID NO: 662838 - RNA, 19 nt, Human
ugggauuacaggcgugagc

SEQ ID NO: 662839 - RNA, 21 nt, Human
ugggauuacaggcgugagcca

SEQ ID NO: 662840 - RNA, 22 nt, Human
ugggauuacaggcgugagccac

SEQ ID NO: 662841 - RNA, 22 nt, Human
ugggauuacaggcgugagccac

SEQ ID NO: 662842 - RNA, 24 nt, Human
ugggauuacaggcgugagccacug

SEQ ID NO: 662843 - RNA, 24 nt, Human
ugggauuacaggcgugagccacug

SEQ ID NO: 662844 - RNA, 20 nt, Human
ugggcucaagagauuugccu

SEQ ID NO: 662845 - RNA, 19 nt, Human
ugggcucaggugauccucc

SEQ ID NO: 662846 - RNA, 21 nt, Human
ugggcucaggugauccuccca

SEQ ID NO: 662847 - RNA, 25 nt, Human
ugggcucaggugauccucccaaccu

SEQ ID NO: 662848 - RNA, 19 nt, Human
ugggguuucaccauguuag

SEQ ID NO: 662849 - RNA, 24 nt, Human
ugggguuucaccauguugcccagg

SEQ ID NO: 662850 - RNA, 23 nt, Human
ugggucucacucugccacccagg

SEQ ID NO: 662851 - RNA, 24 nt, Human
uguagagaugggguuucaccaugu

SEQ ID NO: 662852 - RNA, 24 nt, Human
uguugaguagcugggaccauaggu

SEQ ID NO: 662853 - RNA, 19 nt, Human
uuauucugcuuagagccug

SEQ ID NO: 662854 - RNA, 22 nt, Human
uuccuuuuucuuuuuucaggga

SEQ ID NO: 662855 - RNA, 24 nt, Human
uuguagagaugggguuucaccaug

SEQ ID NO: 662856 - RNA, 18 nt, Human
uuucaccauguuagccag

SEQ ID NO: 662857 - RNA, 24 nt, Human
uuucaccauguugcccaggcuagu

SEQ ID NO: 662858 - RNA, 24 nt, Human
uuuguagagaugggguuucaccau

SEQ ID NO: 662859 - RNA, 20 nt, Human
uuuuguauuuuuuguagaga

SEQ ID NO: 662860 - RNA, 20 nt, Human
uuuuuguauuuuuuguagag

SEQ ID NO: 662861 - RNA, 22 nt, Human
uuuuuuguagagaugggguuuc

SEQ ID NO: 662862 - RNA, 24 nt, Human
uuuuuuguagagaugggguuucac

SEQ ID NO: 662863 - RNA, 20 nt, Human
uuuuuuuugagacggggucu

SEQ ID NO: 662864 - RNA, 19 nt, Human
uuuuuuuuuuugagacggg

SEQ ID NO: 662865 - RNA, 24 nt, Human
uuuuuuuuuuuugagacggggucu

SEQ ID NO: 662866 - RNA, 24 nt, Human
aacccuggagacccucaaccggga

SEQ ID NO: 662867 - RNA, 22 nt, Human
agaauacccaaagucacaagaa

SEQ ID NO: 662868 - RNA, 18 nt, Human
caaccgggacacaggugg

SEQ ID NO: 662869 - RNA, 23 nt, Human
caagucaaaagaauaaaugcuua

SEQ ID NO: 662870 - RNA, 21 nt, Human
caccugggccccgccgaaguc

SEQ ID NO: 662871 - RNA, 26 nt, Human
caggugggccuuucucaccugggccc

SEQ ID NO: 662872 - RNA, 21 nt, Human
ccccaaagaacccuggagacc

SEQ ID NO: 662873 - RNA, 23 nt, Human
ccccaaagaacccuggagacccu

SEQ ID NO: 662874 - RNA, 27 nt, Human
ccccaaagaacccuggagacccucuuc

SEQ ID NO: 662875 - RNA, 24 nt, Human
cccucaaccgggacacaggugggc

SEQ ID NO: 662876 - RNA, 18 nt, Human
ccucgggccccaaagaac

SEQ ID NO: 662877 - RNA, 23 nt, Human
cgggccccaaagaacccuggaga

SEQ ID NO: 662878 - RNA, 21 nt, Human
gccuuucucaccugggccccg

SEQ ID NO: 662879 - RNA, 25 nt, Human
uaaauucacaugaaaaggagacaau

SEQ ID NO: 662880 - RNA, 21 nt, Human
ucgggccccaaagaacccugg

SEQ ID NO: 662881 - RNA, 25 nt, Human
uuccucgggccccaaagaacccugg

SEQ ID NO: 662882 - RNA, 18 nt, Human
aaaaaagagaacauggga

SEQ ID NO: 662883 - RNA, 23 nt, Human
aaaaagagaacaugggaaaccaa

SEQ ID NO: 662884 - RNA, 22 nt, Human
aaaaagcaauaaacacaucaau

SEQ ID NO: 662885 - RNA, 22 nt, Human
aagaugaagaagauuccaaaga

SEQ ID NO: 662886 - RNA, 22 nt, Human
acaggaucugacacccuuccca

SEQ ID NO: 662887 - RNA, 22 nt, Human
agaacaugggaaaccaaauccu

SEQ ID NO: 662888 - RNA, 22 nt, Human
agaugaagaagauuccaaagag

SEQ ID NO: 662889 - RNA, 23 nt, Human
caagcuccccucuccucagccuc

SEQ ID NO: 662890 - RNA, 25 nt, Human
caagcuccccucuccucagccuccu

SEQ ID NO: 662891 - RNA, 23 nt, Human
caauaaacacaucaauagaauaa

SEQ ID NO: 662892 - RNA, 22 nt, Human
cagaaagaucauuuuaaagcua

SEQ ID NO: 662893 - RNA, 21 nt, Human
cagcaggcgccccccaagcuc

SEQ ID NO: 662894 - RNA, 18 nt, Human
cagccucagcucccgcuc

SEQ ID NO: 662895 - RNA, 24 nt, Human
caggaucugacacccuucccacag

SEQ ID NO: 662896 - RNA, 18 nt, Human
caggcgccccccaagcuc

SEQ ID NO: 662897 - RNA, 18 nt, Human
caggcgccccccaagcuc

SEQ ID NO: 662898 - RNA, 24 nt, Human
ccaagaugaagaagauuccaaaga

SEQ ID NO: 662899 - RNA, 22 nt, Human
ccaagcuccccucuccucagcc

SEQ ID NO: 662900 - RNA, 21 nt, Human
ccaggauaaagugugcaagaa

SEQ ID NO: 662901 - RNA, 23 nt, Human
cccaagcuccccucuccucagcc

SEQ ID NO: 662902 - RNA, 21 nt, Human
cccacagccuucacugcagcu

SEQ ID NO: 662903 - RNA, 23 nt, Human
cccacagccuucacugcagcuag

SEQ ID NO: 662904 - RNA, 24 nt, Human
cccccaagcuccccucuccucagc

SEQ ID NO: 662905 - RNA, 18 nt, Human
ccccccaagcuccccucu

SEQ ID NO: 662906 - RNA, 18 nt, Human
ccccccaagcuccccucu

SEQ ID NO: 662907 - RNA, 19 nt, Human
ccccccaagcuccccucuc

SEQ ID NO: 662908 - RNA, 20 nt, Human
ccuucccacagccuucacug

SEQ ID NO: 662909 - RNA, 23 nt, Human
cgccccccaagcuccccucuccu

SEQ ID NO: 662910 - RNA, 20 nt, Human
cuccccucuccucagccuca

SEQ ID NO: 662911 - RNA, 21 nt, Human
cuccccucuccucagccucag

SEQ ID NO: 662912 - RNA, 18 nt, Human
cuccucagccucagcucc

SEQ ID NO: 662913 - RNA, 19 nt, Human
cuucccacagccuucacug

SEQ ID NO: 662914 - RNA, 26 nt, Human
cuuuucauuauugcugguuuugaaaa

SEQ ID NO: 662915 - RNA, 18 nt, Human
gggcagccaagaugaaga

SEQ ID NO: 662916 - RNA, 22 nt, Human
uaaaaagcaauaaacacaucaa

SEQ ID NO: 662917 - RNA, 20 nt, Human
uaugguaguacaaaaagagu

SEQ ID NO: 662918 - RNA, 18 nt, Human
ucaaaaaaagagaacaug

SEQ ID NO: 662919 - RNA, 19 nt, Human
uccucagccucagcucccg

SEQ ID NO: 662920 - RNA, 22 nt, Human
ucuaggaaaaggacagaaagau

SEQ ID NO: 662921 - RNA, 20 nt, Human
ucuccucagccucagcuccc

SEQ ID NO: 662922 - RNA, 21 nt, Human
ucuucacaggaucugacaccc

SEQ ID NO: 662923 - RNA, 20 nt, Human
ugccauucuucacaggaucu

SEQ ID NO: 662924 - RNA, 18 nt, Human
uggcagcaggcgcccccc

SEQ ID NO: 662925 - RNA, 22 nt, Human
uucaaaaaaagagaacauggga

SEQ ID NO: 662926 - RNA, 23 nt, Human
auccaugcugauuccagggucca

SEQ ID NO: 662927 - RNA, 19 nt, Human
cacccccgcccaccacagc

SEQ ID NO: 662928 - RNA, 21 nt, Human
cauaaugucaggugaagcccu

SEQ ID NO: 662929 - RNA, 18 nt, Human
cccacacucugucgcaac

SEQ ID NO: 662930 - RNA, 21 nt, Human
ccugagggcacacagugaggc

SEQ ID NO: 662931 - RNA, 24 nt, Human
gaagcccugcccauaccauugccu

SEQ ID NO: 662932 - RNA, 19 nt, Human
gccaacacccccgcccacc

SEQ ID NO: 662933 - RNA, 21 nt, Human
gccaacacccccgcccaccac

SEQ ID NO: 662934 - RNA, 23 nt, Human
gccaacacccccgcccaccacag

SEQ ID NO: 662935 - RNA, 21 nt, Human
gccuaguggccaacacccccg

SEQ ID NO: 662936 - RNA, 23 nt, Human
uaguggccaacacccccgcccac

SEQ ID NO: 662937 - RNA, 21 nt, Human
uccauaccuccucuggucuca

SEQ ID NO: 662938 - RNA, 18 nt, Human
ugccucaugcuuuauuuu

SEQ ID NO: 662939 - RNA, 18 nt, Human
uguuuccauccauaccuc

SEQ ID NO: 662940 - RNA, 20 nt, Human
uguuuccauccauaccuccu

SEQ ID NO: 662941 - RNA, 20 nt, Human
uuccauagagcuuguuucca

SEQ ID NO: 662942 - RNA, 21 nt, Human
agcgcgcggcccgguggccuc

SEQ ID NO: 662943 - RNA, 18 nt, Human
agcugggagcgcgcggcc

SEQ ID NO: 662944 - RNA, 23 nt, Human
agggagcggcgcggcugccggag

SEQ ID NO: 662945 - RNA, 25 nt, Human
ccgaagccgcguccgagcgaagcug

SEQ ID NO: 662946 - RNA, 18 nt, Human
ccugggcccagcucucgc

SEQ ID NO: 662947 - RNA, 18 nt, Human
ccugggcccagcucucgc

SEQ ID NO: 662948 - RNA, 19 nt, Human
cucugcgucuccgcccucc

SEQ ID NO: 662949 - RNA, 20 nt, Human
cugcgucuccgcccuccccg

SEQ ID NO: 662950 - RNA, 18 nt, Human
cugggcgugcagcggagg

SEQ ID NO: 662951 - RNA, 20 nt, Human
gagcggcgcggcugccggag

SEQ ID NO: 662952 - RNA, 22 nt, Human
gagggcgcccggccgggccguc

SEQ ID NO: 662953 - RNA, 21 nt, Human
ggcccagcucucgccgcgucc

SEQ ID NO: 662954 - RNA, 22 nt, Human
ucacauuuuggggaccgggagg

SEQ ID NO: 662955 - RNA, 22 nt, Human
uccccgcuucacauuuugggga

SEQ ID NO: 662956 - RNA, 21 nt, Human
ucucugcgucuccgcccuccc

SEQ ID NO: 662957 - RNA, 21 nt, Human
ugcgggccgaagccgcguccg

SEQ ID NO: 662958 - RNA, 21 nt, Human
uggugcgagcagccgcgggcg

SEQ ID NO: 662959 - RNA, 18 nt, Human
aaaaguccagagcgggca

SEQ ID NO: 662960 - RNA, 22 nt, Human
aaagugcugggauuacaggcau

SEQ ID NO: 662961 - RNA, 24 nt, Human
aaagugcugggauuacaggcauga

SEQ ID NO: 662962 - RNA, 24 nt, Human
aagcaauccuccugccuuggccuc

SEQ ID NO: 662963 - RNA, 25 nt, Human
aagcaauccuccugccuuggccucc

SEQ ID NO: 662964 - RNA, 18 nt, Human
aaggacuucggcuuucuu

SEQ ID NO: 662965 - RNA, 19 nt, Human
aagugcugggauuacaggc

SEQ ID NO: 662966 - RNA, 21 nt, Human
aagugcugggauuacaggcau

SEQ ID NO: 662967 - RNA, 26 nt, Human
aagugcugggauuacaggcaugagcc

SEQ ID NO: 662968 - RNA, 21 nt, Human
acacaguuacaaaugcauaau

SEQ ID NO: 662969 - RNA, 20 nt, Human
acuguauuuggagacagggc

SEQ ID NO: 662970 - RNA, 25 nt, Human
agauaauuuaaaagaaccuggauaa

SEQ ID NO: 662971 - RNA, 21 nt, Human
agcaauccuccugccuuggcc

SEQ ID NO: 662972 - RNA, 19 nt, Human
agccaccacaccuggcuuc

SEQ ID NO: 662973 - RNA, 20 nt, Human
agccaccacaccuggcuucc

SEQ ID NO: 662974 - RNA, 22 nt, Human
agcuccugggcucaagcaaucc

SEQ ID NO: 662975 - RNA, 18 nt, Human
agugcugggauuacaggc

SEQ ID NO: 662976 - RNA, 19 nt, Human
agugcugggauuacaggca

SEQ ID NO: 662977 - RNA, 19 nt, Human
caaaaguccagagcgggca

SEQ ID NO: 662978 - RNA, 22 nt, Human
caagcaauccuccugccuuggc

SEQ ID NO: 662979 - RNA, 20 nt, Human
cacauuacugcuagaaugau

SEQ ID NO: 662980 - RNA, 28 nt, Human
cagcuccugggcucaagcaauccuccuu

SEQ ID NO: 662981 - RNA, 19 nt, Human
caggcugaucuccagcucc

SEQ ID NO: 662982 - RNA, 22 nt, Human
cauugggcaggguauccugcug

SEQ ID NO: 662983 - RNA, 19 nt, Human
ccacaccuggcuuccaaau

SEQ ID NO: 662984 - RNA, 24 nt, Human
ccacagaguccacuaugcugucau

SEQ ID NO: 662985 - RNA, 19 nt, Human
ccagagcgggcacaacugg

SEQ ID NO: 662986 - RNA, 21 nt, Human
cccccaaugugacuguauuug

SEQ ID NO: 662987 - RNA, 23 nt, Human
ccgaaagugcugggauuacaggc

SEQ ID NO: 662988 - RNA, 18 nt, Human
ccuccugccuuggccucc

SEQ ID NO: 662989 - RNA, 23 nt, Human
ccugggcucaagcaauccuccug

SEQ ID NO: 662990 - RNA, 18 nt, Human
ccuguguugcccaggcug

SEQ ID NO: 662991 - RNA, 24 nt, Human
cgaaagugcugggauuacaggcau

SEQ ID NO: 662992 - RNA, 24 nt, Human
cucaagcaauccuccugccuuggc

SEQ ID NO: 662993 - RNA, 25 nt, Human
cuccugggcucaagcaauccuccug

SEQ ID NO: 662994 - RNA, 21 nt, Human
cuuggccuccgaaagugcugg

SEQ ID NO: 662995 - RNA, 24 nt, Human
gaaagugcugggauuacaggcaug

SEQ ID NO: 662996 - RNA, 19 nt, Human
gaacacaguuacaaaugca

SEQ ID NO: 662997 - RNA, 18 nt, Human
gauuacaggcaugagcca

SEQ ID NO: 662998 - RNA, 21 nt, Human
gauuacaggcaugagccacca

SEQ ID NO: 662999 - RNA, 22 nt, Human
gauuacaggcaugagccaccac

SEQ ID NO: 663000 - RNA, 22 nt, Human
gccuuggccuccgaaagugcug

SEQ ID NO: 663001 - RNA, 19 nt, Human
ggauuacaggcaugagcca

SEQ ID NO: 663002 - RNA, 22 nt, Human
gggcucaagcaauccuccugcc

SEQ ID NO: 663003 - RNA, 19 nt, Human
gugcugggauuacaggcau

SEQ ID NO: 663004 - RNA, 25 nt, Human
uaaaagaaccuggauaacuguagca

SEQ ID NO: 663005 - RNA, 23 nt, Human
uaaaugcuucugucuugaaaggg

SEQ ID NO: 663006 - RNA, 22 nt, Human
uacaggcaugagccaccacacc

SEQ ID NO: 663007 - RNA, 23 nt, Human
uaugcugucauuguucauggacc

SEQ ID NO: 663008 - RNA, 22 nt, Human
uauuuauauuuuuuuguagaga

SEQ ID NO: 663009 - RNA, 19 nt, Human
ucagaagaggaagaacaca

SEQ ID NO: 663010 - RNA, 22 nt, Human
ucagaagaggaagaacacaguu

SEQ ID NO: 663011 - RNA, 21 nt, Human
ucccuguguugcccaggcuga

SEQ ID NO: 663012 - RNA, 24 nt, Human
uccgaaagugcugggauuacaggc

SEQ ID NO: 663013 - RNA, 18 nt, Human
uccugggcucaagcaauc

SEQ ID NO: 663014 - RNA, 21 nt, Human
uccugggcucaagcaauccuc

SEQ ID NO: 663015 - RNA, 22 nt, Human
uccugggcucaagcaauccucc

SEQ ID NO: 663016 - RNA, 24 nt, Human
uccugggcucaagcaauccuccug

SEQ ID NO: 663017 - RNA, 21 nt, Human
ucggcuuucuucuucuccacc

SEQ ID NO: 663018 - RNA, 18 nt, Human
ucuccaccccauucuuca

SEQ ID NO: 663019 - RNA, 20 nt, Human
ucuccaccccauucuucaca

SEQ ID NO: 663020 - RNA, 23 nt, Human
ucuccagcuccugggcucaagca

SEQ ID NO: 663021 - RNA, 19 nt, Human
ucucccuguguugcccagg

SEQ ID NO: 663022 - RNA, 25 nt, Human
ugaaaugcagccauaaggguggcua

SEQ ID NO: 663023 - RNA, 24 nt, Human
ugacugaugucuucagaagaggaa

SEQ ID NO: 663024 - RNA, 24 nt, Human
ugaugucuucagaagaggaagaac

SEQ ID NO: 663025 - RNA, 19 nt, Human
ugcuucugucuugaaaggg

SEQ ID NO: 663026 - RNA, 18 nt, Human
ugggauuacaggcaugag

SEQ ID NO: 663027 - RNA, 19 nt, Human
ugggauuacaggcaugagc

SEQ ID NO: 663028 - RNA, 22 nt, Human
ugggauuacaggcaugagccac

SEQ ID NO: 663029 - RNA, 23 nt, Human
ugggauuacaggcaugagccacc

SEQ ID NO: 663030 - RNA, 24 nt, Human
ugggauuacaggcaugagccacca

SEQ ID NO: 663031 - RNA, 24 nt, Human
ugggauuacaggcaugagccacca

SEQ ID NO: 663032 - RNA, 24 nt, Human
ugggcucaagcaauccuccugccu

SEQ ID NO: 663033 - RNA, 19 nt, Human
uguguugcccaggcugauc

SEQ ID NO: 663034 - RNA, 24 nt, Human
uguguugcccaggcugaucuccag

SEQ ID NO: 663035 - RNA, 21 nt, Human
uguugcccaggcugaucucca

SEQ ID NO: 663036 - RNA, 22 nt, Human
uuuguagagaugagucucccug

SEQ ID NO: 663037 - RNA, 18 nt, Human
aacauacccacaugugca

SEQ ID NO: 663038 - RNA, 18 nt, Human
aagcagagagugggcagg

SEQ ID NO: 663039 - RNA, 19 nt, Human
aagcgcccccgcccgcccc

SEQ ID NO: 663040 - RNA, 19 nt, Human
aagcgcccccgcccgcccc

SEQ ID NO: 663041 - RNA, 18 nt, Human
accccauggauccacacc

SEQ ID NO: 663042 - RNA, 23 nt, Human
acguggcccaugagcuggcuggg

SEQ ID NO: 663043 - RNA, 18 nt, Human
acuccacucagcaaccag

SEQ ID NO: 663044 - RNA, 23 nt, Human
acugccgaggggcccaggccggc

SEQ ID NO: 663045 - RNA, 23 nt, Human
agauauauacccacaaauauaua

SEQ ID NO: 663046 - RNA, 19 nt, Human
agccugaagcagagagugg

SEQ ID NO: 663047 - RNA, 22 nt, Human
agcugaacccgcugcuggccug

SEQ ID NO: 663048 - RNA, 18 nt, Human
augaagacaaaagggugg

SEQ ID NO: 663049 - RNA, 23 nt, Human
augagcuggcugggguggagggg

SEQ ID NO: 663050 - RNA, 19 nt, Human
caaccagaagagguaccca

SEQ ID NO: 663051 - RNA, 20 nt, Human
cacagcgcuuccaacagggc

SEQ ID NO: 663052 - RNA, 20 nt, Human
caggauggggucugucagua

SEQ ID NO: 663053 - RNA, 18 nt, Human
ccacccagcccagccuag

SEQ ID NO: 663054 - RNA, 20 nt, Human
ccacugugcccacccagccc

SEQ ID NO: 663055 - RNA, 23 nt, Human
cccacagcgcuuccaacagggcu

SEQ ID NO: 663056 - RNA, 19 nt, Human
cccagcccagccuagggga

SEQ ID NO: 663057 - RNA, 21 nt, Human
cccccagcuccagccugaagc

SEQ ID NO: 663058 - RNA, 19 nt, Human
cccccgucgccgggucccg

SEQ ID NO: 663059 - RNA, 19 nt, Human
ccccugaggcauaagcagg

SEQ ID NO: 663060 - RNA, 23 nt, Human
cccugggugcugaggcugggcca

SEQ ID NO: 663061 - RNA, 23 nt, Human
ccgcccccgucgccggguccccc

SEQ ID NO: 663062 - RNA, 19 nt, Human
ccgcccgcccccgucgccg

SEQ ID NO: 663063 - RNA, 24 nt, Human
ccgcccgcccccgucgccgggucc

SEQ ID NO: 663064 - RNA, 20 nt, Human
ccuuaugguguccacucccc

SEQ ID NO: 663065 - RNA, 19 nt, Human
cuaggggacuaggagacca

SEQ ID NO: 663066 - RNA, 20 nt, Human
cuccagccagggcucuguuc

SEQ ID NO: 663067 - RNA, 18 nt, Human
cuccagccugaagcagag

SEQ ID NO: 663068 - RNA, 19 nt, Human
cuggcacuccuccccuucc

SEQ ID NO: 663069 - RNA, 22 nt, Human
cuggcccccagcuccagccuga

SEQ ID NO: 663070 - RNA, 22 nt, Human
cuguacacucaacaguaaacac

SEQ ID NO: 663071 - RNA, 20 nt, Human
gaagacaaaaggguggagga

SEQ ID NO: 663072 - RNA, 19 nt, Human
gaauuauacacauggcuga

SEQ ID NO: 663073 - RNA, 20 nt, Human
gagcuggcugggguggaggg

SEQ ID NO: 663074 - RNA, 22 nt, Human
gcaggauggggucugucaguac

SEQ ID NO: 663075 - RNA, 19 nt, Human
gccaggccacguggcccau

SEQ ID NO: 663076 - RNA, 20 nt, Human
gccuaggggacuaggagacc

SEQ ID NO: 663077 - RNA, 23 nt, Human
gcugggccaggccacguggccca

SEQ ID NO: 663078 - RNA, 18 nt, Human
gcugggguggaggggcag

SEQ ID NO: 663079 - RNA, 18 nt, Human
ggaggagccccugaggca

SEQ ID NO: 663080 - RNA, 19 nt, Human
ggcccccagcuccagccug

SEQ ID NO: 663081 - RNA, 20 nt, Human
ggcccccagcuccagccuga

SEQ ID NO: 663082 - RNA, 20 nt, Human
gguggaggagccccugaggc

SEQ ID NO: 663083 - RNA, 21 nt, Human
gguggggcugcuggugcacuc

SEQ ID NO: 663084 - RNA, 21 nt, Human
uacacagguugggggcuaugu

SEQ ID NO: 663085 - RNA, 22 nt, Human
uacacauggcugagaacauacc

SEQ ID NO: 663086 - RNA, 24 nt, Human
uacccacaugugcacauucauaua

SEQ ID NO: 663087 - RNA, 27 nt, Human
uauacacauggcugagaacauacccac

SEQ ID NO: 663088 - RNA, 25 nt, Human
uauauaucaaucacacauaugcaua

SEQ ID NO: 663089 - RNA, 22 nt, Human
uauaucuacauacuuuccccac

SEQ ID NO: 663090 - RNA, 20 nt, Human
ucaggcacacccacugugcc

SEQ ID NO: 663091 - RNA, 20 nt, Human
uccagccagggcucuguuca

SEQ ID NO: 663092 - RNA, 19 nt, Human
ucuacauacuuuccccaca

SEQ ID NO: 663093 - RNA, 25 nt, Human
ucucugggguggggcugcuggugca

SEQ ID NO: 663094 - RNA, 19 nt, Human
ugagcuggcugggguggag

SEQ ID NO: 663095 - RNA, 21 nt, Human
ugcaguaugaagacaaaaggg

SEQ ID NO: 663096 - RNA, 23 nt, Human
uggagcuggcacuccuccccuuc

SEQ ID NO: 663097 - RNA, 20 nt, Human
uggcccaugagcuggcuggg

SEQ ID NO: 663098 - RNA, 19 nt, Human
uggcccccagcuccagccu

SEQ ID NO: 663099 - RNA, 18 nt, Human
ugggcuagggcugcccag

SEQ ID NO: 663100 - RNA, 19 nt, Human
uggguuggggcaagucagg

SEQ ID NO: 663101 - RNA, 21 nt, Human
uggguuggggcaagucaggua

SEQ ID NO: 663102 - RNA, 19 nt, Human
uggugcacuccacucagca

SEQ ID NO: 663103 - RNA, 18 nt, Human
uucacugacacauucaga

SEQ ID NO: 663104 - RNA, 24 nt, Human
uucucugggguggggcugcuggug

SEQ ID NO: 663105 - RNA, 21 nt, Human
uucuggcccccagcuccagcc

SEQ ID NO: 663106 - RNA, 19 nt, Human
caacacauacaggcauaug

SEQ ID NO: 663107 - RNA, 22 nt, Human
cauaauaucuaaaaccagaaug

SEQ ID NO: 663108 - RNA, 21 nt, Human
ccaaaaucuaauuuauuagca

SEQ ID NO: 663109 - RNA, 21 nt, Human
uaucuaaaaccagaauggauu

SEQ ID NO: 663110 - RNA, 21 nt, Human
ucaaauagcugguccaggagc

SEQ ID NO: 663111 - RNA, 18 nt, Human
ugaaugaaguccaaaaau

SEQ ID NO: 663112 - RNA, 21 nt, Human
uuauuagcaacacauacaggc

SEQ ID NO: 663113 - RNA, 18 nt, Human
uuuccaguuaagaaaauu

SEQ ID NO: 663114 - RNA, 19 nt, Human
uuugcgaauuccagauagu

SEQ ID NO: 663115 - RNA, 27 nt, Human
agggcagguggguagggcugaccaucc

SEQ ID NO: 663116 - RNA, 24 nt, Human
cagucccaccucucucuggaacag

SEQ ID NO: 663117 - RNA, 21 nt, Human
cauccucuccuugcaguccca

SEQ ID NO: 663118 - RNA, 20 nt, Human
ccuugcagucccaccucucu

SEQ ID NO: 663119 - RNA, 20 nt, Human
cugaccauccucuccuugca

SEQ ID NO: 663120 - RNA, 19 nt, Human
gagggcaucaaaaccccug

SEQ ID NO: 663121 - RNA, 18 nt, Human
gcagggccugugggcugc

SEQ ID NO: 663122 - RNA, 22 nt, Human
gcugaccauccucuccuugcag

SEQ ID NO: 663123 - RNA, 20 nt, Human
ggcagggccugugggcugca

SEQ ID NO: 663124 - RNA, 22 nt, Human
gggcagguggguagggcugacc

SEQ ID NO: 663125 - RNA, 20 nt, Human
ugagggcaucaaaaccccug

SEQ ID NO: 663126 - RNA, 24 nt, Human
ugaugcgaugggcagggccugugg

SEQ ID NO: 663127 - RNA, 22 nt, Human
ugcgaugggcagggccuguggg

SEQ ID NO: 663128 - RNA, 21 nt, Human
uggguagggcugaccauccuc

SEQ ID NO: 663129 - RNA, 24 nt, Human
ugguggucaugcugccccguggug

SEQ ID NO: 663130 - RNA, 19 nt, Human
aaagcccuuuugcccacca

SEQ ID NO: 663131 - RNA, 19 nt, Human
acaagcaaccguuccaaag

SEQ ID NO: 663132 - RNA, 26 nt, Human
agaaaagacaagcaaccguuccaaag

SEQ ID NO: 663133 - RNA, 25 nt, Human
agacaagcaaccguuccagcuucca

SEQ ID NO: 663134 - RNA, 20 nt, Human
caaagcccuuuugcccacca

SEQ ID NO: 663135 - RNA, 19 nt, Human
caagcaaccguuccaaagc

SEQ ID NO: 663136 - RNA, 23 nt, Human
cagaccaguggggggaaaauccc

SEQ ID NO: 663137 - RNA, 22 nt, Human
cccaccacaggcguguuuacag

SEQ ID NO: 663138 - RNA, 22 nt, Human
cccccuuuucuucuuaugggcc

SEQ ID NO: 663139 - RNA, 21 nt, Human
cgccuucugagccugaagccu

SEQ ID NO: 663140 - RNA, 21 nt, Human
cguuccaaagcccuuuugccc

SEQ ID NO: 663141 - RNA, 25 nt, Human
cucccccuuuucuucuuaugggcca

SEQ ID NO: 663142 - RNA, 21 nt, Human
gaaaagacaagcaaccguucc

SEQ ID NO: 663143 - RNA, 21 nt, Human
ugacagggggagcuugccuug

SEQ ID NO: 663144 - RNA, 20 nt, Human
ugcuuugacagggggagcuu

SEQ ID NO: 663145 - RNA, 23 nt, Human
uggccucugaguuacaggagagc

SEQ ID NO: 663146 - RNA, 24 nt, Human
ugggggcgccuucugaaggacacc

SEQ ID NO: 663147 - RNA, 19 nt, Human
uuugacagggggagcuugc

SEQ ID NO: 663148 - RNA, 18 nt, Human
auuuauuggcucuccuua

SEQ ID NO: 663149 - RNA, 23 nt, Human
acagucuuaucugggagguccuu

SEQ ID NO: 663150 - RNA, 19 nt, Human
accuccucggccgggcucc

SEQ ID NO: 663151 - RNA, 20 nt, Human
agcuccuucccgggaccccc

SEQ ID NO: 663152 - RNA, 23 nt, Human
caaaggacugccccacgggcuaa

SEQ ID NO: 663153 - RNA, 18 nt, Human
cagcuccuucccgggacc

SEQ ID NO: 663154 - RNA, 22 nt, Human
cccacaucaccuggaaugguua

SEQ ID NO: 663155 - RNA, 21 nt, Human
ccuucccgggacccccaagcu

SEQ ID NO: 663156 - RNA, 18 nt, Human
cgccuagguccucccagc

SEQ ID NO: 663157 - RNA, 21 nt, Human
cucaaguaguuaacauaggga

SEQ ID NO: 663158 - RNA, 18 nt, Human
cuccuucccgggaccccc

SEQ ID NO: 663159 - RNA, 20 nt, Human
ggccggaagcugaagagagu

SEQ ID NO: 663160 - RNA, 21 nt, Human
gggccggaagcugaagagagu

SEQ ID NO: 663161 - RNA, 21 nt, Human
ggugacaaugguacagaggaa

SEQ ID NO: 663162 - RNA, 23 nt, Human
uagggaccuccucggccgggcuc

SEQ ID NO: 663163 - RNA, 23 nt, Human
uccucggccgggcuccgcggaac

SEQ ID NO: 663164 - RNA, 23 nt, Human
ucuaaguggucugaacuuggucu

SEQ ID NO: 663165 - RNA, 23 nt, Human
ugaguggggugacaaugguacag

SEQ ID NO: 663166 - RNA, 23 nt, Human
ugccccacgggcuaaacagcuga

SEQ ID NO: 663167 - RNA, 21 nt, Human
ugguacagaggaaaugggacu

SEQ ID NO: 663168 - RNA, 19 nt, Human
ugucuuauuuaaaugggaa

SEQ ID NO: 663169 - RNA, 22 nt, Human
uucuaaguggucugaacuuggu

SEQ ID NO: 663170 - RNA, 24 nt, Human
uuuacagaugccacuguugagggc

SEQ ID NO: 663171 - RNA, 19 nt, Human
aagcccagcagccccggga

SEQ ID NO: 663172 - RNA, 20 nt, Human
aaggguucgagaugccuggu

SEQ ID NO: 663173 - RNA, 18 nt, Human
aggagcugccuuguccug

SEQ ID NO: 663174 - RNA, 23 nt, Human
cacagcuuuucauaaaaagcaag

SEQ ID NO: 663175 - RNA, 20 nt, Human
cagcagccccgggauccgcc

SEQ ID NO: 663176 - RNA, 19 nt, Human
gacucaggaagcccagcag

SEQ ID NO: 663177 - RNA, 23 nt, Human
gagcugccuuguccuggcagggc

SEQ ID NO: 663178 - RNA, 22 nt, Human
uagguguguguugagagccgcu

SEQ ID NO: 663179 - RNA, 20 nt, Human
uggacguggguccuggugga

SEQ ID NO: 663180 - RNA, 20 nt, Human
aagcugcacgaaccucuucu

SEQ ID NO: 663181 - RNA, 22 nt, Human
aaguagccaagagcagaggaac

SEQ ID NO: 663182 - RNA, 24 nt, Human
aaguagccaagagcagaggaacaa

SEQ ID NO: 663183 - RNA, 24 nt, Human
aggaaggaagucccaccaguguuu

SEQ ID NO: 663184 - RNA, 18 nt, Human
aggagguaauaaagucaa

SEQ ID NO: 663185 - RNA, 19 nt, Human
auacauuugugauaucuga

SEQ ID NO: 663186 - RNA, 23 nt, Human
auaguaacaccucuugcagacaa

SEQ ID NO: 663187 - RNA, 21 nt, Human
augcuggguuaauacuugcau

SEQ ID NO: 663188 - RNA, 19 nt, Human
auggucauuauuccacuuu

SEQ ID NO: 663189 - RNA, 19 nt, Human
augguccauaucucuaaug

SEQ ID NO: 663190 - RNA, 23 nt, Human
caacuaaaauaguaacaccucuu

SEQ ID NO: 663191 - RNA, 24 nt, Human
caagacaauaguagaagucugaac

SEQ ID NO: 663192 - RNA, 22 nt, Human
cauucuucuccagacuuaagga

SEQ ID NO: 663193 - RNA, 20 nt, Human
ccagcucuagaaugagccag

SEQ ID NO: 663194 - RNA, 20 nt, Human
ccaugaaguuaguuacagga

SEQ ID NO: 663195 - RNA, 25 nt, Human
ccucuugcagacaaaguaauauggu

SEQ ID NO: 663196 - RNA, 22 nt, Human
cuaaaauaguaacaccucuugc

SEQ ID NO: 663197 - RNA, 23 nt, Human
cucuagaaugagccaggcuugcu

SEQ ID NO: 663198 - RNA, 24 nt, Human
gagcagaggaacaagcugcacgaa

SEQ ID NO: 663199 - RNA, 19 nt, Human
gauuccauuauauuuggca

SEQ ID NO: 663200 - RNA, 20 nt, Human
gcuccuucccucuuuuaaag

SEQ ID NO: 663201 - RNA, 18 nt, Human
gggaauccuuggucuuuu

SEQ ID NO: 663202 - RNA, 24 nt, Human
uaaaauaguaacaccucuugcaga

SEQ ID NO: 663203 - RNA, 24 nt, Human
uacaggagguaauaaagucaaaga

SEQ ID NO: 663204 - RNA, 21 nt, Human
uagagauggaaugccucccuc

SEQ ID NO: 663205 - RNA, 20 nt, Human
uagccaagagcagaggaaca

SEQ ID NO: 663206 - RNA, 21 nt, Human
uagccaagagcagaggaacaa

SEQ ID NO: 663207 - RNA, 18 nt, Human
uagccaguacaacaaucu

SEQ ID NO: 663208 - RNA, 25 nt, Human
uagguuuuaauuuucuucggugcuc

SEQ ID NO: 663209 - RNA, 19 nt, Human
uaguaacaccucuugcaga

SEQ ID NO: 663210 - RNA, 21 nt, Human
uccagacuuaaggaaggaagu

SEQ ID NO: 663211 - RNA, 21 nt, Human
ucccaugaaguuaguuacagg

SEQ ID NO: 663212 - RNA, 22 nt, Human
ucccucuuuuaaagauaggaau

SEQ ID NO: 663213 - RNA, 19 nt, Human
ucugcaggcucuggguugg

SEQ ID NO: 663214 - RNA, 21 nt, Human
ucugcaggcucuggguuggcu

SEQ ID NO: 663215 - RNA, 24 nt, Human
ugaaaaagaaaaaauauuauggga

SEQ ID NO: 663216 - RNA, 19 nt, Human
ugaaaugcugccauugccu

SEQ ID NO: 663217 - RNA, 19 nt, Human
ugacagcacagcgagagug

SEQ ID NO: 663218 - RNA, 24 nt, Human
ugacuuuagccaguacaacaaucu

SEQ ID NO: 663219 - RNA, 23 nt, Human
ugcuucugggauaccagcucuag

SEQ ID NO: 663220 - RNA, 18 nt, Human
uggaaugccucccgcuuc

SEQ ID NO: 663221 - RNA, 20 nt, Human
uggaugguccuccauucuuc

SEQ ID NO: 663222 - RNA, 22 nt, Human
uggcuuucuggacauguuuccc

SEQ ID NO: 663223 - RNA, 24 nt, Human
ugggaauccuuggucuuuuuuguu

SEQ ID NO: 663224 - RNA, 22 nt, Human
ugggauuccauuauauuuggca

SEQ ID NO: 663225 - RNA, 24 nt, Human
ugugguaaaugcuucugggauacc

SEQ ID NO: 663226 - RNA, 19 nt, Human
uguuucccaaguugguuca

SEQ ID NO: 663227 - RNA, 20 nt, Human
uucccgaguacaaaugauag

SEQ ID NO: 663228 - RNA, 19 nt, Human
uucuuggucuugauacauu

SEQ ID NO: 663229 - RNA, 24 nt, Human
uucuuggucuugauacauuuguga

SEQ ID NO: 663230 - RNA, 24 nt, Human
uuuaauuuucuucggugcuccuuc

SEQ ID NO: 663231 - RNA, 22 nt, Human
aacaagagcaaaacuccaucug

SEQ ID NO: 663232 - RNA, 21 nt, Human
aacacaguaagggacccccau

SEQ ID NO: 663233 - RNA, 19 nt, Human
aacauggugaaaccccauc

SEQ ID NO: 663234 - RNA, 20 nt, Human
aacauggugaaaccccaucu

SEQ ID NO: 663235 - RNA, 21 nt, Human
aacauggugaaaccccaucuc

SEQ ID NO: 663236 - RNA, 21 nt, Human
aacauggugaaaccccaucuc

SEQ ID NO: 663237 - RNA, 19 nt, Human
aagaggcacuuccagugac

SEQ ID NO: 663238 - RNA, 20 nt, Human
aaggcaggaggaucaaggcc

SEQ ID NO: 663239 - RNA, 22 nt, Human
aaguagcugagcaugguggggg

SEQ ID NO: 663240 - RNA, 24 nt, Human
aauugcuugaaccuaggaugcgga

SEQ ID NO: 663241 - RNA, 20 nt, Human
acaagagcaaaacuccaucu

SEQ ID NO: 663242 - RNA, 21 nt, Human
accccaucuccacuaaauaca

SEQ ID NO: 663243 - RNA, 20 nt, Human
acccccauuuuacaacacag

SEQ ID NO: 663244 - RNA, 20 nt, Human
acuggucuguacucgugggc

SEQ ID NO: 663245 - RNA, 23 nt, Human
agaggauaguucuuugcugcugc

SEQ ID NO: 663246 - RNA, 19 nt, Human
agaggcacuuccagugacc

SEQ ID NO: 663247 - RNA, 19 nt, Human
agccacagauuuuggaccc

SEQ ID NO: 663248 - RNA, 22 nt, Human
agccuggccaacauggugaaac

SEQ ID NO: 663249 - RNA, 24 nt, Human
agccuggccaacauggugaaaccc

SEQ ID NO: 663250 - RNA, 19 nt, Human
agccuuugucuuuucuggc

SEQ ID NO: 663251 - RNA, 23 nt, Human
agcugagcaugguggggggugcc

SEQ ID NO: 663252 - RNA, 19 nt, Human
aggcaggaggaucaaggcc

SEQ ID NO: 663253 - RNA, 20 nt, Human
aggcuaaggcaggaggauca

SEQ ID NO: 663254 - RNA, 24 nt, Human
aggcugcggcaggagaauugcuug

SEQ ID NO: 663255 - RNA, 19 nt, Human
agggaguuugagaccagcc

SEQ ID NO: 663256 - RNA, 24 nt, Human
augaugccauggcacuccagccug

SEQ ID NO: 663257 - RNA, 24 nt, Human
augcggagguugcagugagccgag

SEQ ID NO: 663258 - RNA, 24 nt, Human
auggcacuccagccugggugacag

SEQ ID NO: 663259 - RNA, 25 nt, Human
auggcacuucagccugggcaacaag

SEQ ID NO: 663260 - RNA, 24 nt, Human
auugcaccauggcacuucagccug

SEQ ID NO: 663261 - RNA, 21 nt, Human
caacaagagcaaaacuccauc

SEQ ID NO: 663262 - RNA, 18 nt, Human
caacauggugaaacccca

SEQ ID NO: 663263 - RNA, 22 nt, Human
cacuccagccugggugacagag

SEQ ID NO: 663264 - RNA, 24 nt, Human
cacuucagccugggcaacaagagc

SEQ ID NO: 663265 - RNA, 24 nt, Human
caggggagauucaccacuuucuug

SEQ ID NO: 663266 - RNA, 19 nt, Human
cauggcacuccagccuggg

SEQ ID NO: 663267 - RNA, 19 nt, Human
cauggcacuccagccuggg

SEQ ID NO: 663268 - RNA, 23 nt, Human
cauggcacuccagccugggugac

SEQ ID NO: 663269 - RNA, 24 nt, Human
cauggcacuccagccugggugaca

SEQ ID NO: 663270 - RNA, 25 nt, Human
cauggcacuccagccugggugacag

SEQ ID NO: 663271 - RNA, 19 nt, Human
cauggcacuucagccuggg

SEQ ID NO: 663272 - RNA, 19 nt, Human
cauggcacuucagccuggg

SEQ ID NO: 663273 - RNA, 22 nt, Human
cauggcacuucagccugggcaa

SEQ ID NO: 663274 - RNA, 23 nt, Human
cauggcacuucagccugggcaac

SEQ ID NO: 663275 - RNA, 24 nt, Human
cauggcacuucagccugggcaaca

SEQ ID NO: 663276 - RNA, 20 nt, Human
ccauggcacuccagccuggg

SEQ ID NO: 663277 - RNA, 21 nt, Human
ccauggcacuccagccugggu

SEQ ID NO: 663278 - RNA, 21 nt, Human
ccauggcacuccagccugggu

SEQ ID NO: 663279 - RNA, 23 nt, Human
ccauggcacuccagccuggguga

SEQ ID NO: 663280 - RNA, 24 nt, Human
ccauggcacuccagccugggugac

SEQ ID NO: 663281 - RNA, 20 nt, Human
ccauggcacuucagccuggg

SEQ ID NO: 663282 - RNA, 21 nt, Human
ccauggcacuucagccugggc

SEQ ID NO: 663283 - RNA, 24 nt, Human
ccauggcacuucagccugggcaac

SEQ ID NO: 663284 - RNA, 23 nt, Human
cccccauuuuacaacacagggcu

SEQ ID NO: 663285 - RNA, 26 nt, Human
ccggcagccuuccaaucgaaucuccc

SEQ ID NO: 663286 - RNA, 23 nt, Human
ccuggccaacauggugaaacccc

SEQ ID NO: 663287 - RNA, 24 nt, Human
ccuggccaacauggugaaacccca

SEQ ID NO: 663288 - RNA, 20 nt, Human
ccugggugacagagcaagac

SEQ ID NO: 663289 - RNA, 21 nt, Human
ccuguaaucccagcuacucag

SEQ ID NO: 663290 - RNA, 22 nt, Human
ccuguaaucccagcuacucagg

SEQ ID NO: 663291 - RNA, 23 nt, Human
cggcaggagaauugcuugaaccu

SEQ ID NO: 663292 - RNA, 18 nt, Human
cggccgaacucaguagca

SEQ ID NO: 663293 - RNA, 18 nt, Human
cuacucaggaggcugcgg

SEQ ID NO: 663294 - RNA, 21 nt, Human
cuacucaggaggcugcggcag

SEQ ID NO: 663295 - RNA, 23 nt, Human
cuggccaacauggugaaacccca

SEQ ID NO: 663296 - RNA, 24 nt, Human
cugggcaacaagagcaaaacucca

SEQ ID NO: 663297 - RNA, 21 nt, Human
cuggguaaacugguuaaucac

SEQ ID NO: 663298 - RNA, 21 nt, Human
gaacucaguagcacgccggca

SEQ ID NO: 663299 - RNA, 24 nt, Human
gagcaugguggggggugccuguaa

SEQ ID NO: 663300 - RNA, 21 nt, Human
gagguugcagugagccgagau

SEQ ID NO: 663301 - RNA, 23 nt, Human
gagguugcagugagccgagauug

SEQ ID NO: 663302 - RNA, 21 nt, Human
gcacuccagccugggugacag

SEQ ID NO: 663303 - RNA, 23 nt, Human
gcacuccagccugggugacagag

SEQ ID NO: 663304 - RNA, 24 nt, Human
gcacuccagccugggugacagagc

SEQ ID NO: 663305 - RNA, 18 nt, Human
gcaggaggaucaaggcca

SEQ ID NO: 663306 - RNA, 24 nt, Human
gccaacauggugaaaccccaucuc

SEQ ID NO: 663307 - RNA, 19 nt, Human
gccauggcacuccagccug

SEQ ID NO: 663308 - RNA, 19 nt, Human
gcggagguugcagugagcc

SEQ ID NO: 663309 - RNA, 22 nt, Human
ggagguugcagugagccgagau

SEQ ID NO: 663310 - RNA, 24 nt, Human
ggagguugcagugagccgagauug

SEQ ID NO: 663311 - RNA, 19 nt, Human
ggaguuugagaccagccug

SEQ ID NO: 663312 - RNA, 23 nt, Human
ggauguccuguccagugcuaaaa

SEQ ID NO: 663313 - RNA, 21 nt, Human
ggcaggagaauugcuugaacc

SEQ ID NO: 663314 - RNA, 20 nt, Human
ggccccagccaucuucuucc

SEQ ID NO: 663315 - RNA, 19 nt, Human
ggggugccuguaaucccag

SEQ ID NO: 663316 - RNA, 23 nt, Human
gggugacagagcaagacccuggg

SEQ ID NO: 663317 - RNA, 19 nt, Human
gguagggaguuugagacca

SEQ ID NO: 663318 - RNA, 24 nt, Human
gguggggggugccuguaaucccag

SEQ ID NO: 663319 - RNA, 22 nt, Human
guagcacgccggcagccuucca

SEQ ID NO: 663320 - RNA, 21 nt, Human
guccuuuuccgccggaaguaa

SEQ ID NO: 663321 - RNA, 21 nt, Human
guugcagugagccgagauugc

SEQ ID NO: 663322 - RNA, 18 nt, Human
uaaggcaggaggaucaag

SEQ ID NO: 663323 - RNA, 21 nt, Human
uaaggcaggaggaucaaggcc

SEQ ID NO: 663324 - RNA, 22 nt, Human
uaaggcaggaggaucaaggcca

SEQ ID NO: 663325 - RNA, 21 nt, Human
uacaacacagggcuggcagga

SEQ ID NO: 663326 - RNA, 23 nt, Human
uacaacacagggcuggcaggaag

SEQ ID NO: 663327 - RNA, 24 nt, Human
uaggaugcggagguugcagugagc

SEQ ID NO: 663328 - RNA, 22 nt, Human
ucacaccguggucugagguagg

SEQ ID NO: 663329 - RNA, 18 nt, Human
ucauuguaauugauccug

SEQ ID NO: 663330 - RNA, 20 nt, Human
uccacuaaauacaaaaagua

SEQ ID NO: 663331 - RNA, 24 nt, Human
uccagccugggugacagagcaaga

SEQ ID NO: 663332 - RNA, 21 nt, Human
ucccaaaguuuagcuaaagcu

SEQ ID NO: 663333 - RNA, 23 nt, Human
uccccauugaugguggaucucau

SEQ ID NO: 663334 - RNA, 21 nt, Human
ucccgcguccuuuuccgccgg

SEQ ID NO: 663335 - RNA, 24 nt, Human
ucuucaugacagcaggggcccuuc

SEQ ID NO: 663336 - RNA, 20 nt, Human
ucuucaugacagcaggggcu

SEQ ID NO: 663337 - RNA, 26 nt, Human
ucuugcuuugucacuggaggucggac

SEQ ID NO: 663338 - RNA, 25 nt, Human
ucuugcuuugucacuggaggucggc

SEQ ID NO: 663339 - RNA, 21 nt, Human
ucuuugauaacacaguaaggg

SEQ ID NO: 663340 - RNA, 19 nt, Human
ugaaaccccaucuccacua

SEQ ID NO: 663341 - RNA, 22 nt, Human
ugaaggugacaaugaugcaggu

SEQ ID NO: 663342 - RNA, 21 nt, Human
ugacagagcaagacccugggg

SEQ ID NO: 663343 - RNA, 23 nt, Human
ugacagagcaagacccuggggga

SEQ ID NO: 663344 - RNA, 21 nt, Human
ugaccuacagaggauaguucu

SEQ ID NO: 663345 - RNA, 23 nt, Human
ugagaccagccuggccaacaugg

SEQ ID NO: 663346 - RNA, 24 nt, Human
ugagaccagccuggccaacauggu

SEQ ID NO: 663347 - RNA, 23 nt, Human
ugccauggcacuccagccugggu

SEQ ID NO: 663348 - RNA, 24 nt, Human
ugccuguaaucccagcuacucagg

SEQ ID NO: 663349 - RNA, 21 nt, Human
ugcggagguugcagugagccg

SEQ ID NO: 663350 - RNA, 24 nt, Human
ugcggcaggagaauugcuugaacc

SEQ ID NO: 663351 - RNA, 28 nt, Human
uggauguccuguccagugcuaaaauucu

SEQ ID NO: 663352 - RNA, 24 nt, Human
uggccaacauggugaaaccccauc

SEQ ID NO: 663353 - RNA, 24 nt, Human
ugggaggcuaaggcaggaggauca

SEQ ID NO: 663354 - RNA, 21 nt, Human
ugggccaacaauuccugcuuc

SEQ ID NO: 663355 - RNA, 18 nt, Human
uggggaugucuccauugc

SEQ ID NO: 663356 - RNA, 21 nt, Human
ugggguggauguccuguccag

SEQ ID NO: 663357 - RNA, 24 nt, Human
ugguggggggugccuguaauccca

SEQ ID NO: 663358 - RNA, 18 nt, Human
uguacagaaaacucaaca

SEQ ID NO: 663359 - RNA, 23 nt, Human
uuaaccccugcuugaaggacagg

SEQ ID NO: 663360 - RNA, 22 nt, Human
uucuuugcugcugcaaccuaau

SEQ ID NO: 663361 - RNA, 23 nt, Human
uucuuugcugcugcaaccuaaua

SEQ ID NO: 663362 - RNA, 22 nt, Human
uugauccugaagcucccaaagu

SEQ ID NO: 663363 - RNA, 18 nt, Human
uugcagugagccgagauu

SEQ ID NO: 663364 - RNA, 22 nt, Human
uugcagugagccgagauugcac

SEQ ID NO: 663365 - RNA, 24 nt, Human
uugcuugaaccuaggaugcggagg

SEQ ID NO: 663366 - RNA, 25 nt, Human
uugggaggcuaaggcaggaggauca

SEQ ID NO: 663367 - RNA, 20 nt, Human
uuuauuaucuuucuguacag

SEQ ID NO: 663368 - RNA, 20 nt, Human
uuuuuuagccuuugucuuuu

SEQ ID NO: 663369 - RNA, 23 nt, Human
aaaacaaauugaaacuaaaccuc

SEQ ID NO: 663370 - RNA, 22 nt, Human
aaacacaacuuaauuccuucau

SEQ ID NO: 663371 - RNA, 24 nt, Human
aagcaacuuagucuccaugaaaac

SEQ ID NO: 663372 - RNA, 20 nt, Human
aagcuuuuuccagucaugau

SEQ ID NO: 663373 - RNA, 24 nt, Human
aauaauacagacacaaagaaaaga

SEQ ID NO: 663374 - RNA, 18 nt, Human
acaaagaaaagaaaaagu

SEQ ID NO: 663375 - RNA, 19 nt, Human
acaugaaauccaaugccuc

SEQ ID NO: 663376 - RNA, 23 nt, Human
cacccagaaauacauagauucau

SEQ ID NO: 663377 - RNA, 24 nt, Human
ccagaaauacauagauucaugcag

SEQ ID NO: 663378 - RNA, 21 nt, Human
cccagaaauacauagauucau

SEQ ID NO: 663379 - RNA, 23 nt, Human
ccuuuuggcgacaugaaauccaa

SEQ ID NO: 663380 - RNA, 23 nt, Human
ccuuuuggcgacaugaaauccaa

SEQ ID NO: 663381 - RNA, 18 nt, Human
gacaugaaauccaaugcc

SEQ ID NO: 663382 - RNA, 18 nt, Human
gcagaucuugucuuugca

SEQ ID NO: 663383 - RNA, 20 nt, Human
uaaaaacacaacuuaauucc

SEQ ID NO: 663384 - RNA, 23 nt, Human
uaaaaacacaacuuaauuccuuc

SEQ ID NO: 663385 - RNA, 27 nt, Human
uaaauaaucaccaauguuacuucuccu

SEQ ID NO: 663386 - RNA, 20 nt, Human
uaauacagacacaaagaaaa

SEQ ID NO: 663387 - RNA, 19 nt, Human
uacagacacaaagaaaaga

SEQ ID NO: 663388 - RNA, 18 nt, Human
uacauagauucaugcaga

SEQ ID NO: 663389 - RNA, 20 nt, Human
uagauucaugcagaucuugg

SEQ ID NO: 663390 - RNA, 22 nt, Human
uauacuccucuacuaaacuucc

SEQ ID NO: 663391 - RNA, 30 nt, Human
ucaccuaaaguggccuucaccagacacccc

SEQ ID NO: 663392 - RNA, 18 nt, Human
uccuagcaguauggcugu

SEQ ID NO: 663393 - RNA, 20 nt, Human
ucuccaugaaaacuauacuu

SEQ ID NO: 663394 - RNA, 26 nt, Human
ucucuggccagucaccuaaaguggcc

SEQ ID NO: 663395 - RNA, 20 nt, Human
uuuuuccagucaugauucuu

SEQ ID NO: 663396 - RNA, 21 nt, Human
acauaagugauauuuauacaa

SEQ ID NO: 663397 - RNA, 23 nt, Human
uaaaaagaaagcccuuaaaauca

SEQ ID NO: 663398 - RNA, 24 nt, Human
uaaaaagaaagcccuuaaaaucau

SEQ ID NO: 663399 - RNA, 23 nt, Human
ugcuagacauaagugauauuuau

SEQ ID NO: 663400 - RNA, 22 nt, Human
uuucuggcauuuuguaugcuag

SEQ ID NO: 663401 - RNA, 18 nt, Human
aaauacaacaggcaaaua

SEQ ID NO: 663402 - RNA, 20 nt, Human
acaacucuuugcaaggcacu

SEQ ID NO: 663403 - RNA, 21 nt, Human
agaagaggguggacagccugc

SEQ ID NO: 663404 - RNA, 22 nt, Human
caaccuccaguaacuucuccug

SEQ ID NO: 663405 - RNA, 30 nt, Human
cacagcaugauccggugggcuaaagcaagg

SEQ ID NO: 663406 - RNA, 23 nt, Human
cagugaccuuucuuuggagauuu

SEQ ID NO: 663407 - RNA, 20 nt, Human
ccaccuggaggcucccacug

SEQ ID NO: 663408 - RNA, 21 nt, Human
ccucccaccuggaggcuccca

SEQ ID NO: 663409 - RNA, 22 nt, Human
ccugccacaaucacagcaugau

SEQ ID NO: 663410 - RNA, 21 nt, Human
cggaaggagagauagaagagg

SEQ ID NO: 663411 - RNA, 24 nt, Human
cuaaagcaagccugcaucuaagcc

SEQ ID NO: 663412 - RNA, 18 nt, Human
cuccucccaccuggaggc

SEQ ID NO: 663413 - RNA, 24 nt, Human
cucucauccucaaucacacauccc

SEQ ID NO: 663414 - RNA, 24 nt, Human
cuggaggcucccacugacaucuga

SEQ ID NO: 663415 - RNA, 19 nt, Human
cuucaagauauuuuugggc

SEQ ID NO: 663416 - RNA, 23 nt, Human
cuucuucuucuucuuguuguucu

SEQ ID NO: 663417 - RNA, 20 nt, Human
ggaaggagagauagaagagg

SEQ ID NO: 663418 - RNA, 20 nt, Human
ggaaggagagauagaagagg

SEQ ID NO: 663419 - RNA, 18 nt, Human
uaaacaacucuuugcaag

SEQ ID NO: 663420 - RNA, 21 nt, Human
uagaagaggguggacagccug

SEQ ID NO: 663421 - RNA, 22 nt, Human
uagaagaggguggacagccugc

SEQ ID NO: 663422 - RNA, 23 nt, Human
uccuuaguacagaacaauggcca

SEQ ID NO: 663423 - RNA, 21 nt, Human
ucuaagccucucauccucaau

SEQ ID NO: 663424 - RNA, 24 nt, Human
ucucuuauagacggaaggagagau

SEQ ID NO: 663425 - RNA, 23 nt, Human
ucuucuucuucuuuuacuucucu

SEQ ID NO: 663426 - RNA, 24 nt, Human
ucuucuuuccacagguugccuugg

SEQ ID NO: 663427 - RNA, 18 nt, Human
ucuuguuguucuucuucu

SEQ ID NO: 663428 - RNA, 21 nt, Human
ucuuucucuucuuuagacucc

SEQ ID NO: 663429 - RNA, 24 nt, Human
ucuuucucuucuuuagacuccuuu

SEQ ID NO: 663430 - RNA, 22 nt, Human
ugaccugacuucuucuucuucu

SEQ ID NO: 663431 - RNA, 18 nt, Human
ugaugaaguuucucauau

SEQ ID NO: 663432 - RNA, 24 nt, Human
ugggcuaaagcaagccugcaucua

SEQ ID NO: 663433 - RNA, 24 nt, Human
uucaucuugauuuucuuucucuuc

SEQ ID NO: 663434 - RNA, 23 nt, Human
uugcuuagcugacucucucuuau

SEQ ID NO: 663435 - RNA, 25 nt, Human
aagguugucuuuauuguuggcuauc

SEQ ID NO: 663436 - RNA, 19 nt, Human
auggcuucucuucuccauc

SEQ ID NO: 663437 - RNA, 20 nt, Human
caauuugauaacagaagacc

SEQ ID NO: 663438 - RNA, 18 nt, Human
ccgcagcccagguccggc

SEQ ID NO: 663439 - RNA, 25 nt, Human
ccuccauacacugcccucugucaug

SEQ ID NO: 663440 - RNA, 23 nt, Human
ccucgguccgggcgccaaagcgg

SEQ ID NO: 663441 - RNA, 19 nt, Human
uccgcagcccagguccggc

SEQ ID NO: 663442 - RNA, 18 nt, Human
uucaauuugauaacagaa

SEQ ID NO: 663443 - RNA, 19 nt, Human
uucugugccuuuguaugua

SEQ ID NO: 663444 - RNA, 21 nt, Human
aaaacaaacaaauuccacaag

SEQ ID NO: 663445 - RNA, 28 nt, Human
aaaacaaacaaauuccacaagccaccga

SEQ ID NO: 663446 - RNA, 20 nt, Human
aaacaaauuccacaagccaa

SEQ ID NO: 663447 - RNA, 24 nt, Human
aaacacuggauuuagaacagucac

SEQ ID NO: 663448 - RNA, 18 nt, Human
aaauauuagaagcaaccu

SEQ ID NO: 663449 - RNA, 18 nt, Human
aaccaggcucgcugcagc

SEQ ID NO: 663450 - RNA, 19 nt, Human
aagcaacccagagacaaag

SEQ ID NO: 663451 - RNA, 21 nt, Human
aagcaacccagagacaaagaa

SEQ ID NO: 663452 - RNA, 22 nt, Human
aauauuagaagcaacccagaga

SEQ ID NO: 663453 - RNA, 24 nt, Human
acacuggauuuagaacagucacau

SEQ ID NO: 663454 - RNA, 18 nt, Human
acagucacaugacaaaaa

SEQ ID NO: 663455 - RNA, 21 nt, Human
caaaacaaacaaauuccacaa

SEQ ID NO: 663456 - RNA, 22 nt, Human
caaauuccacaagccaccgaaa

SEQ ID NO: 663457 - RNA, 23 nt, Human
cacccccuuccccaggggaggcc

SEQ ID NO: 663458 - RNA, 19 nt, Human
cacggaccaacgaaccaac

SEQ ID NO: 663459 - RNA, 21 nt, Human
cagcgaguccgcccccagccc

SEQ ID NO: 663460 - RNA, 18 nt, Human
caggacuggccucuaaac

SEQ ID NO: 663461 - RNA, 21 nt, Human
cagucaaaacaaacaaauucc

SEQ ID NO: 663462 - RNA, 27 nt, Human
caugacaaaaaacaucaacuggaaaag

SEQ ID NO: 663463 - RNA, 23 nt, Human
ccaccgaaagucaggagggcagg

SEQ ID NO: 663464 - RNA, 21 nt, Human
cccacccccuuccccagggga

SEQ ID NO: 663465 - RNA, 19 nt, Human
cccagagacaaagaaaguc

SEQ ID NO: 663466 - RNA, 20 nt, Human
ccccagcgaguccgccccca

SEQ ID NO: 663467 - RNA, 18 nt, Human
ccccaggggaggcccggg

SEQ ID NO: 663468 - RNA, 23 nt, Human
cccucguaagaaagguaucaguc

SEQ ID NO: 663469 - RNA, 19 nt, Human
ccgcccccagcccgaacca

SEQ ID NO: 663470 - RNA, 25 nt, Human
cgaaccaggcucgcugcagccccca

SEQ ID NO: 663471 - RNA, 23 nt, Human
cgcccccagcccgaaccaggcuc

SEQ ID NO: 663472 - RNA, 24 nt, Human
gccagagugcagucagcacauguu

SEQ ID NO: 663473 - RNA, 18 nt, Human
gcccgggucugugcucag

SEQ ID NO: 663474 - RNA, 21 nt, Human
ggaccaacgaaccaacuggca

SEQ ID NO: 663475 - RNA, 21 nt, Human
ggagccuuacucccuccaccu

SEQ ID NO: 663476 - RNA, 21 nt, Human
ggugcuccuucuuuuccaccu

SEQ ID NO: 663477 - RNA, 18 nt, Human
uaagaaagguaucaguca

SEQ ID NO: 663478 - RNA, 21 nt, Human
ucaaaacaaacaaauuccaca

SEQ ID NO: 663479 - RNA, 24 nt, Human
ucaaaacaaacaaauuccacaagc

SEQ ID NO: 663480 - RNA, 21 nt, Human
ucagaggccuccacggaccaa

SEQ ID NO: 663481 - RNA, 23 nt, Human
ucagucaaaacaaacaaauucca

SEQ ID NO: 663482 - RNA, 19 nt, Human
uccaccucggggucuuccc

SEQ ID NO: 663483 - RNA, 21 nt, Human
uccagcucaaggugcuccuuc

SEQ ID NO: 663484 - RNA, 18 nt, Human
uccccaggggaggcccgg

SEQ ID NO: 663485 - RNA, 25 nt, Human
ucccucguaagaaagguaucaguca

SEQ ID NO: 663486 - RNA, 24 nt, Human
ucugugcucagaggccuccacgga

SEQ ID NO: 663487 - RNA, 20 nt, Human
ugcuccuucuuuuccaccuc

SEQ ID NO: 663488 - RNA, 22 nt, Human
uggaaaagggucgccagagugc

SEQ ID NO: 663489 - RNA, 20 nt, Human
auggugaugauagcgauggu

SEQ ID NO: 663490 - RNA, 20 nt, Human
gguggagguagaggugaaug

SEQ ID NO: 663491 - RNA, 18 nt, Human
guagaggugaaugugaug

SEQ ID NO: 663492 - RNA, 24 nt, Human
guagugauggugaugguggagguu

SEQ ID NO: 663493 - RNA, 20 nt, Human
guaguggugauggugaugau

SEQ ID NO: 663494 - RNA, 20 nt, Human
gugauggugaugauagcgau

SEQ ID NO: 663495 - RNA, 22 nt, Human
uauccccuuccccuggccucua

SEQ ID NO: 663496 - RNA, 18 nt, Human
ugaugguagagccccgcu

SEQ ID NO: 663497 - RNA, 21 nt, Human
uggcuguggcagaaguagugg

SEQ ID NO: 663498 - RNA, 24 nt, Human
ugggaaagaacuugccuuuucuca

SEQ ID NO: 663499 - RNA, 22 nt, Human
uuauuuaugaugcuuagccaua

SEQ ID NO: 663500 - RNA, 20 nt, Human
uucgaaaugggaaagaacuu

SEQ ID NO: 663501 - RNA, 21 nt, Human
uucuuuuuuuuuuaaaaguug

SEQ ID NO: 663502 - RNA, 24 nt, Human
uugaguagugauggugaugguuuu

SEQ ID NO: 663503 - RNA, 23 nt, Human
uuuucuuugcccucccuuuaucc

SEQ ID NO: 663504 - RNA, 19 nt, Human
uuuuuuucuuuuuuuuuua

SEQ ID NO: 663505 - RNA, 23 nt, Human
uuuuuuucuuuuuuuuuuaaaag

SEQ ID NO: 663506 - RNA, 22 nt, Human
uuuuuuuuuuuuuuuucuuuuu

SEQ ID NO: 663507 - RNA, 23 nt, Human
aaccaaaacacagcucuuuccaa

SEQ ID NO: 663508 - RNA, 22 nt, Human
aaggcaacagguucaccaccga

SEQ ID NO: 663509 - RNA, 22 nt, Human
aaugauggauacuuuggccuuc

SEQ ID NO: 663510 - RNA, 21 nt, Human
acaggauuugucuuccacauc

SEQ ID NO: 663511 - RNA, 18 nt, Human
accuuaucugcuugaggc

SEQ ID NO: 663512 - RNA, 19 nt, Human
caaaaggacuuucucccac

SEQ ID NO: 663513 - RNA, 19 nt, Human
caaaaggacuuucucccac

SEQ ID NO: 663514 - RNA, 20 nt, Human
caacagguucaccaccgauc

SEQ ID NO: 663515 - RNA, 18 nt, Human
cacacauaauuaugaggu

SEQ ID NO: 663516 - RNA, 21 nt, Human
caccgauccacucccaguggc

SEQ ID NO: 663517 - RNA, 21 nt, Human
cccccuguagggucuguuaua

SEQ ID NO: 663518 - RNA, 19 nt, Human
ccuuccuuuugugaguugg

SEQ ID NO: 663519 - RNA, 25 nt, Human
cuuaucugcuugaggcaguucugcc

SEQ ID NO: 663520 - RNA, 22 nt, Human
gucuugguuuggggacuccagg

SEQ ID NO: 663521 - RNA, 18 nt, Human
uacaguuacaagguugcc

SEQ ID NO: 663522 - RNA, 21 nt, Human
uagaugaugucuguuccauuu

SEQ ID NO: 663523 - RNA, 19 nt, Human
ucaaggaaacuaucccaug

SEQ ID NO: 663524 - RNA, 22 nt, Human
uccaaaaggacuuucucccacc

SEQ ID NO: 663525 - RNA, 24 nt, Human
uccaccuuaucugcuugaggcagu

SEQ ID NO: 663526 - RNA, 19 nt, Human
uccagagugcaguucuuug

SEQ ID NO: 663527 - RNA, 22 nt, Human
ucguucaaaccuauccaaaagg

SEQ ID NO: 663528 - RNA, 21 nt, Human
ugaaaaacaguugucuugguu

SEQ ID NO: 663529 - RNA, 22 nt, Human
ugacaguagccugagugcuggu

SEQ ID NO: 663530 - RNA, 18 nt, Human
ugacuaaugauggauacu

SEQ ID NO: 663531 - RNA, 20 nt, Human
ugccauuucccuugucuuug

SEQ ID NO: 663532 - RNA, 25 nt, Human
ugcuggugccacccggcuggacagg

SEQ ID NO: 663533 - RNA, 23 nt, Human
uggacaggauuugucuuccacag

SEQ ID NO: 663534 - RNA, 24 nt, Human
uggugaaggcaacagguucaccac

SEQ ID NO: 663535 - RNA, 20 nt, Human
uguuugccauuucccuuguc

SEQ ID NO: 663536 - RNA, 21 nt, Human
uuccaggugccuuucugcucu

SEQ ID NO: 663537 - RNA, 24 nt, Human
uucuuuggaaaugagggcaacugg

SEQ ID NO: 663538 - RNA, 19 nt, Human
uugaaccaaaacacagcuc

SEQ ID NO: 663539 - RNA, 20 nt, Human
uuguggcugacuaaugaugg

SEQ ID NO: 663540 - RNA, 24 nt, Human
uuucaaggaaacuaucccaugaua

SEQ ID NO: 663541 - RNA, 21 nt, Human
uuuccaggcgaucccauugca

SEQ ID NO: 663542 - RNA, 21 nt, Human
agaagaaggcagguguuggca

SEQ ID NO: 663543 - RNA, 20 nt, Human
aggcagguguuggcaggcuu

SEQ ID NO: 663544 - RNA, 21 nt, Human
augcugcgggggugggggugg

SEQ ID NO: 663545 - RNA, 20 nt, Human
caccacaagggcagguaugc

SEQ ID NO: 663546 - RNA, 19 nt, Human
cagcggucucucuccacuu

SEQ ID NO: 663547 - RNA, 24 nt, Human
ccagcggucucucuccacuucucc

SEQ ID NO: 663548 - RNA, 24 nt, Human
ccugacccagagcaagcagugugg

SEQ ID NO: 663549 - RNA, 18 nt, Human
ccugccagcggucucucu

SEQ ID NO: 663550 - RNA, 21 nt, Human
ccugccagcggucucucucca

SEQ ID NO: 663551 - RNA, 25 nt, Human
cggggguggggguggcaggggaagc

SEQ ID NO: 663552 - RNA, 21 nt, Human
cuagagcugggcaggcaccac

SEQ ID NO: 663553 - RNA, 20 nt, Human
cucucuccacuucucccuuc

SEQ ID NO: 663554 - RNA, 21 nt, Human
cugcggggguggggguggcag

SEQ ID NO: 663555 - RNA, 19 nt, Human
gacucugcccaccaaaugg

SEQ ID NO: 663556 - RNA, 19 nt, Human
gcggcuaggucaccuccuc

SEQ ID NO: 663557 - RNA, 22 nt, Human
gcugcggggguggggguggcag

SEQ ID NO: 663558 - RNA, 18 nt, Human
ggcucagguagccagcga

SEQ ID NO: 663559 - RNA, 21 nt, Human
ggcuggugggaggaaggacug

SEQ ID NO: 663560 - RNA, 23 nt, Human
uaaggggagacccaggaucuacu

SEQ ID NO: 663561 - RNA, 18 nt, Human
uagcagagaagaaggcag

SEQ ID NO: 663562 - RNA, 19 nt, Human
ugacccagagcaagcagug

SEQ ID NO: 663563 - RNA, 18 nt, Human
ugccagcggucucucucc

SEQ ID NO: 663564 - RNA, 19 nt, Human
uggacagugcuguccuccu

SEQ ID NO: 663565 - RNA, 21 nt, Human
uggcaggcucagguagccagc

SEQ ID NO: 663566 - RNA, 18 nt, Human
uggggcacaaguagugca

SEQ ID NO: 663567 - RNA, 18 nt, Human
uggguggacagugcuguc

SEQ ID NO: 663568 - RNA, 18 nt, Human
uggugggaggaaggacug

SEQ ID NO: 663569 - RNA, 24 nt, Human
aagccugucuucaggagaccccga

SEQ ID NO: 663570 - RNA, 21 nt, Human
aagggcuuuccggagggaggc

SEQ ID NO: 663571 - RNA, 25 nt, Human
aggcaccgaagggucucugagagcc

SEQ ID NO: 663572 - RNA, 22 nt, Human
cagagccagaugcucguuggcc

SEQ ID NO: 663573 - RNA, 22 nt, Human
ccugucuucaggagaccccgag

SEQ ID NO: 663574 - RNA, 22 nt, Human
cgaagggucucugagagccugg

SEQ ID NO: 663575 - RNA, 22 nt, Human
cgcuccgagcucccguaaacgu

SEQ ID NO: 663576 - RNA, 24 nt, Human
cggagggaggccaaggaaagccug

SEQ ID NO: 663577 - RNA, 20 nt, Human
gaaguccuaaaugucucuuc

SEQ ID NO: 663578 - RNA, 24 nt, Human
gaggcaccgaagggucucugagag

SEQ ID NO: 663579 - RNA, 18 nt, Human
gcaauaagggcuuuccgg

SEQ ID NO: 663580 - RNA, 24 nt, Human
ggagaccccgaggcaccgaagggu

SEQ ID NO: 663581 - RNA, 23 nt, Human
ggaggccaaggaaagccugucuu

SEQ ID NO: 663582 - RNA, 24 nt, Human
ggcaauaagggcuuuccggaggga

SEQ ID NO: 663583 - RNA, 24 nt, Human
uacaaguuaaaaguucugaagucc

SEQ ID NO: 663584 - RNA, 22 nt, Human
uaugaucaaacacuucauaugc

SEQ ID NO: 663585 - RNA, 22 nt, Human
uccccggccaggaaacaggggc

SEQ ID NO: 663586 - RNA, 21 nt, Human
uccggagggaggccaaggaaa

SEQ ID NO: 663587 - RNA, 23 nt, Human
ucuccugcuccugucgcgcgcac

SEQ ID NO: 663588 - RNA, 19 nt, Human
ucucugagagccugggauu

SEQ ID NO: 663589 - RNA, 22 nt, Human
aaaaaggaaacacagauaaaga

SEQ ID NO: 663590 - RNA, 27 nt, Human
aaaaaggaaacacagauaaagagaccu

SEQ ID NO: 663591 - RNA, 29 nt, Human
aaaaaggaaacacagauaaagagaccuca

SEQ ID NO: 663592 - RNA, 18 nt, Human
aaaauaccaaaaccuuag

SEQ ID NO: 663593 - RNA, 22 nt, Human
aacuaaaaaggaaacacagaua

SEQ ID NO: 663594 - RNA, 24 nt, Human
aagggcgaggcggaggcagaaccc

SEQ ID NO: 663595 - RNA, 18 nt, Human
acagauaaagagaccuca

SEQ ID NO: 663596 - RNA, 21 nt, Human
aggcacgugcggcuggaaggg

SEQ ID NO: 663597 - RNA, 21 nt, Human
aggcggaggcagaacccaggg

SEQ ID NO: 663598 - RNA, 19 nt, Human
caaaacaagugguucuaac

SEQ ID NO: 663599 - RNA, 27 nt, Human
caaaacaagugguucuaacucagacca

SEQ ID NO: 663600 - RNA, 21 nt, Human
caaaggaccucacucgaggcu

SEQ ID NO: 663601 - RNA, 22 nt, Human
caaaggaccucacucgaggcuc

SEQ ID NO: 663602 - RNA, 19 nt, Human
cacgugcggcuggaagggc

SEQ ID NO: 663603 - RNA, 22 nt, Human
cagggaagacugaacaauggcg

SEQ ID NO: 663604 - RNA, 19 nt, Human
ccaaaggaccucacucgag

SEQ ID NO: 663605 - RNA, 24 nt, Human
cccaugaauacuuccccaaaacaa

SEQ ID NO: 663606 - RNA, 24 nt, Human
cccccgcagggauccccccaggcu

SEQ ID NO: 663607 - RNA, 18 nt, Human
cccgcagggaucccccca

SEQ ID NO: 663608 - RNA, 22 nt, Human
cgcccugcuccucggagcuggc

SEQ ID NO: 663609 - RNA, 19 nt, Human
cggaaagggcuguaaggca

SEQ ID NO: 663610 - RNA, 18 nt, Human
cgugcggcuggaagggcg

SEQ ID NO: 663611 - RNA, 19 nt, Human
cugagcuuucggagguuca

SEQ ID NO: 663612 - RNA, 22 nt, Human
gcaacuaaaaaggaaacacaga

SEQ ID NO: 663613 - RNA, 23 nt, Human
gcgcaacuaaaaaggaaacacag

SEQ ID NO: 663614 - RNA, 20 nt, Human
ggcgaggcggaggcagaacc

SEQ ID NO: 663615 - RNA, 21 nt, Human
ggcgaggcggaggcagaaccc

SEQ ID NO: 663616 - RNA, 24 nt, Human
ggcgaggcggaggcagaacccagg

SEQ ID NO: 663617 - RNA, 23 nt, Human
uaaaaaggaaacacagauaaaga

SEQ ID NO: 663618 - RNA, 23 nt, Human
ucacucgaggcucccccgcaggg

SEQ ID NO: 663619 - RNA, 23 nt, Human
uccccccaggcuggcggggagga

SEQ ID NO: 663620 - RNA, 19 nt, Human
ugaauacuuccccaaaaca

SEQ ID NO: 663621 - RNA, 21 nt, Human
ugccaaaggaccucacucgag

SEQ ID NO: 663622 - RNA, 31 nt, Human
ugccaaaggaccucacucgaggcucccccgg

SEQ ID NO: 663623 - RNA, 22 nt, Human
ugcgcaacuaaaaaggaaacac

SEQ ID NO: 663624 - RNA, 20 nt, Human
ugcggcuggaagggcgaggc

SEQ ID NO: 663625 - RNA, 23 nt, Human
ugggacggucuucagugccaaag

SEQ ID NO: 663626 - RNA, 19 nt, Human
aaaaagaaauaggcacaaa

SEQ ID NO: 663627 - RNA, 25 nt, Human
aaaauacagaacauguaauggaaag

SEQ ID NO: 663628 - RNA, 18 nt, Human
aaaaugaaaaagacagga

SEQ ID NO: 663629 - RNA, 26 nt, Human
aaacaaugcaguaaauauauuaagac

SEQ ID NO: 663630 - RNA, 26 nt, Human
aaguauugaaaaucaauucgagucac

SEQ ID NO: 663631 - RNA, 27 nt, Human
acaguaacaaauauuaaguuauaugcc

SEQ ID NO: 663632 - RNA, 19 nt, Human
agagcuaaaaaaauaguac

SEQ ID NO: 663633 - RNA, 21 nt, Human
agcuagguaacacaacccuca

SEQ ID NO: 663634 - RNA, 21 nt, Human
auggcacaaaauuuaaguugu

SEQ ID NO: 663635 - RNA, 23 nt, Human
caacccucauuuuuacuucuuuc

SEQ ID NO: 663636 - RNA, 19 nt, Human
ccaauucugaaguacucag

SEQ ID NO: 663637 - RNA, 22 nt, Human
ccagccagcuagguaacacaac

SEQ ID NO: 663638 - RNA, 25 nt, Human
ccuguaaacuauaaaaaaguaaauu

SEQ ID NO: 663639 - RNA, 25 nt, Human
cuaaaaaaauaguaccuuaccacaa

SEQ ID NO: 663640 - RNA, 23 nt, Human
gaaauaggcacaaaaaauaaaau

SEQ ID NO: 663641 - RNA, 19 nt, Human
gauauaucccuagagcuaa

SEQ ID NO: 663642 - RNA, 20 nt, Human
ggcacaaaaaauaaaauucc

SEQ ID NO: 663643 - RNA, 22 nt, Human
gggacugaguggggagccccug

SEQ ID NO: 663644 - RNA, 18 nt, Human
gggagccccuggaagugu

SEQ ID NO: 663645 - RNA, 24 nt, Human
guaauggaaagauguuuagaacac

SEQ ID NO: 663646 - RNA, 21 nt, Human
uaaaaaacucauauggcaaag

SEQ ID NO: 663647 - RNA, 23 nt, Human
uaaauaugaaacccauguaugac

SEQ ID NO: 663648 - RNA, 20 nt, Human
uaagacacaaaagggaaaga

SEQ ID NO: 663649 - RNA, 27 nt, Human
uaugacaauaaauuaaaaaugaaaaag

SEQ ID NO: 663650 - RNA, 21 nt, Human
ucacaauacugcaaccauggg

SEQ ID NO: 663651 - RNA, 18 nt, Human
ucccuagagcuaaaaaaa

SEQ ID NO: 663652 - RNA, 22 nt, Human
ucuacaaaaacuuccuagaucu

SEQ ID NO: 663653 - RNA, 20 nt, Human
ugaaauagagucuuuauuuc

SEQ ID NO: 663654 - RNA, 21 nt, Human
ugauacaucuuaauucucuca

SEQ ID NO: 663655 - RNA, 19 nt, Human
ugcaaugagcucaugaugc

SEQ ID NO: 663656 - RNA, 19 nt, Human
ugcauucauuuccagaagc

SEQ ID NO: 663657 - RNA, 21 nt, Human
uggcacaaaauuuaaguuguu

SEQ ID NO: 663658 - RNA, 18 nt, Human
uggggacugaguggggag

SEQ ID NO: 663659 - RNA, 19 nt, Human
uggguuugagaauguugca

SEQ ID NO: 663660 - RNA, 18 nt, Human
uguauuaaaauacagaac

SEQ ID NO: 663661 - RNA, 19 nt, Human
uuaaaaaacucauauggca

SEQ ID NO: 663662 - RNA, 19 nt, Human
uuaguauugcuuuauuuga

SEQ ID NO: 663663 - RNA, 24 nt, Human
uuaguauugcuuuauuugagguuu

SEQ ID NO: 663664 - RNA, 25 nt, Human
uucaaauuauguugugcucauucaa

SEQ ID NO: 663665 - RNA, 24 nt, Human
uucugcugucugguuaucuccuug

SEQ ID NO: 663666 - RNA, 25 nt, Human
uuuuacuucuuucccauuuuucaag

SEQ ID NO: 663667 - RNA, 24 nt, Human
aacuccuucuuaccuucagaucuu

SEQ ID NO: 663668 - RNA, 25 nt, Human
aacucguucaccaggaccucuucca

SEQ ID NO: 663669 - RNA, 23 nt, Human
aagccaagaucagggguaaaaga

SEQ ID NO: 663670 - RNA, 19 nt, Human
accagagcaugucccacaa

SEQ ID NO: 663671 - RNA, 21 nt, Human
agaaagccaagaucaggggua

SEQ ID NO: 663672 - RNA, 20 nt, Human
agaagagaccaagcaucccc

SEQ ID NO: 663673 - RNA, 19 nt, Human
agagaaaggcaagguagca

SEQ ID NO: 663674 - RNA, 24 nt, Human
aggaaagucagggaaaucaugcaa

SEQ ID NO: 663675 - RNA, 22 nt, Human
aggcaagguagcaccggggagc

SEQ ID NO: 663676 - RNA, 19 nt, Human
agggccuuuccaacugagc

SEQ ID NO: 663677 - RNA, 21 nt, Human
agggguaaaagagaaaggcaa

SEQ ID NO: 663678 - RNA, 21 nt, Human
augacacagaaacaucucugc

SEQ ID NO: 663679 - RNA, 26 nt, Human
caaaucuuugagcucagcaguuguua

SEQ ID NO: 663680 - RNA, 18 nt, Human
cacccuuuuccccugucu

SEQ ID NO: 663681 - RNA, 20 nt, Human
caccuuauagaaggaaaaac

SEQ ID NO: 663682 - RNA, 25 nt, Human
cagaagagaccaagcauccccagug

SEQ ID NO: 663683 - RNA, 26 nt, Human
cagcagaagagaccaagcauccccag

SEQ ID NO: 663684 - RNA, 24 nt, Human
caucucugcuuuuaccagcagaag

SEQ ID NO: 663685 - RNA, 21 nt, Human
cauuggucugaauaauuugga

SEQ ID NO: 663686 - RNA, 19 nt, Human
cauuuguaaucaagugacu

SEQ ID NO: 663687 - RNA, 18 nt, Human
ccaggaccucuuccaggc

SEQ ID NO: 663688 - RNA, 19 nt, Human
ccucaauacaauacagucu

SEQ ID NO: 663689 - RNA, 24 nt, Human
ccuuuuccccugucuggcaccuua

SEQ ID NO: 663690 - RNA, 18 nt, Human
cugagcaaaacuguacag

SEQ ID NO: 663691 - RNA, 24 nt, Human
gaccaagcauccccagugaagggg

SEQ ID NO: 663692 - RNA, 20 nt, Human
gagguucccugggaaaggug

SEQ ID NO: 663693 - RNA, 20 nt, Human
gccucuugagggccuuucca

SEQ ID NO: 663694 - RNA, 21 nt, Human
ggguaaaagagaaaggcaagg

SEQ ID NO: 663695 - RNA, 20 nt, Human
guucaccaggaccucuucca

SEQ ID NO: 663696 - RNA, 19 nt, Human
uaacuuuggaucccagaaa

SEQ ID NO: 663697 - RNA, 21 nt, Human
uaacuuuggaucccagaaaca

SEQ ID NO: 663698 - RNA, 18 nt, Human
uaccagagcaugucccac

SEQ ID NO: 663699 - RNA, 23 nt, Human
uaccuucagaucuuuaccuucaa

SEQ ID NO: 663700 - RNA, 21 nt, Human
uaugcaacccauaucugugug

SEQ ID NO: 663701 - RNA, 24 nt, Human
ucaacucucuccuuaauguuuccu

SEQ ID NO: 663702 - RNA, 18 nt, Human
ucaagugacuuuaccuac

SEQ ID NO: 663703 - RNA, 19 nt, Human
ugaaggggcuggcagugug

SEQ ID NO: 663704 - RNA, 22 nt, Human
ugacaucccagauguaccccca

SEQ ID NO: 663705 - RNA, 23 nt, Human
ugagguucccugggaaagguguu

SEQ ID NO: 663706 - RNA, 18 nt, Human
ugagguuucccuguuggc

SEQ ID NO: 663707 - RNA, 26 nt, Human
ugcggcggguaaacucguucaccaac

SEQ ID NO: 663708 - RNA, 22 nt, Human
ugcugcguggacacggcuaugg

SEQ ID NO: 663709 - RNA, 23 nt, Human
uggagggggaaauccuaaggugg

SEQ ID NO: 663710 - RNA, 19 nt, Human
uggaguugcugcguggaca

SEQ ID NO: 663711 - RNA, 19 nt, Human
ugggagaggccauuuggca

SEQ ID NO: 663712 - RNA, 19 nt, Human
uguaaucaagugacuuuac

SEQ ID NO: 663713 - RNA, 20 nt, Human
uguacccccacccuuuuccc

SEQ ID NO: 663714 - RNA, 19 nt, Human
ugucaguaggcugaccuaa

SEQ ID NO: 663715 - RNA, 21 nt, Human
uguuuggaauucucauccuga

SEQ ID NO: 663716 - RNA, 21 nt, Human
uguuugucagcugucaguagg

SEQ ID NO: 663717 - RNA, 24 nt, Human
uuaaaugccagagaaguuuuaaca

SEQ ID NO: 663718 - RNA, 22 nt, Human
uuaccagcagaagagaccaagc

SEQ ID NO: 663719 - RNA, 22 nt, Human
uucauuuuauggaccuuagcag

SEQ ID NO: 663720 - RNA, 19 nt, Human
uuggaucccagaaacacua

SEQ ID NO: 663721 - RNA, 18 nt, Human
uuuccccugucuggcacc

SEQ ID NO: 663722 - RNA, 24 nt, Human
aaagugcugggauuacagguguga

SEQ ID NO: 663723 - RNA, 18 nt, Human
aagugcugggauuacagg

SEQ ID NO: 663724 - RNA, 19 nt, Human
aagugcugggauuacaggu

SEQ ID NO: 663725 - RNA, 26 nt, Human
aagugcugggauuacaggugugagcc

SEQ ID NO: 663726 - RNA, 23 nt, Human
acagauaugcccaccaugacuag

SEQ ID NO: 663727 - RNA, 23 nt, Human
accuuagccucccacauagcugg

SEQ ID NO: 663728 - RNA, 24 nt, Human
acucacucuguugcccaggcugga

SEQ ID NO: 663729 - RNA, 27 nt, Human
acucuguugcccaggcuggagaacacu

SEQ ID NO: 663730 - RNA, 18 nt, Human
agacagggucucgccaug

SEQ ID NO: 663731 - RNA, 23 nt, Human
agacagggucucgccauguugcc

SEQ ID NO: 663732 - RNA, 23 nt, Human
agcauuuuugcuuugugucuucg

SEQ ID NO: 663733 - RNA, 18 nt, Human
agccuugaccucccaggc

SEQ ID NO: 663734 - RNA, 20 nt, Human
aggaagugaggugugaauag

SEQ ID NO: 663735 - RNA, 25 nt, Human
agguaauccuccuuccucggccucc

SEQ ID NO: 663736 - RNA, 20 nt, Human
aggugguguggucugaaggc

SEQ ID NO: 663737 - RNA, 19 nt, Human
aucauccauucaucaagga

SEQ ID NO: 663738 - RNA, 18 nt, Human
auccauucaucaaggaca

SEQ ID NO: 663739 - RNA, 24 nt, Human
caaagugcugggauuacaggugug

SEQ ID NO: 663740 - RNA, 22 nt, Human
cacucuguugcccaggcuggag

SEQ ID NO: 663741 - RNA, 22 nt, Human
cacugcagccuugaccucccag

SEQ ID NO: 663742 - RNA, 20 nt, Human
cagccuugaccucccaggcu

SEQ ID NO: 663743 - RNA, 24 nt, Human
cagccuugaccucccaggcugaaa

SEQ ID NO: 663744 - RNA, 24 nt, Human
cagcucacugcagccuugaccucc

SEQ ID NO: 663745 - RNA, 18 nt, Human
caggcuggagaacacuga

SEQ ID NO: 663746 - RNA, 24 nt, Human
cagggacucacucuguugcccagg

SEQ ID NO: 663747 - RNA, 24 nt, Human
cagggucucgccauguugcccagg

SEQ ID NO: 663748 - RNA, 23 nt, Human
cauagcugggacuacagauaugc

SEQ ID NO: 663749 - RNA, 19 nt, Human
cauguugcccaggcugguc

SEQ ID NO: 663750 - RNA, 21 nt, Human
cauguugcccaggcuggucuc

SEQ ID NO: 663751 - RNA, 23 nt, Human
cauguugcccaggcuggucucga

SEQ ID NO: 663752 - RNA, 24 nt, Human
cauguugcccaggcuggucucgaa

SEQ ID NO: 663753 - RNA, 21 nt, Human
ccaaagugcugggauuacagg

SEQ ID NO: 663754 - RNA, 21 nt, Human
ccaaagugcugggauuacagg

SEQ ID NO: 663755 - RNA, 24 nt, Human
ccaaagugcugggauuacaggugu

SEQ ID NO: 663756 - RNA, 19 nt, Human
ccacauagcugggacuaca

SEQ ID NO: 663757 - RNA, 23 nt, Human
ccacgcccagccuauuucuuuga

SEQ ID NO: 663758 - RNA, 25 nt, Human
ccagccuauuucuuugauuuguguc

SEQ ID NO: 663759 - RNA, 22 nt, Human
ccauguugcccaggcuggucuc

SEQ ID NO: 663760 - RNA, 23 nt, Human
cccaccuuagccucccacauagc

SEQ ID NO: 663761 - RNA, 22 nt, Human
cccaggcuggagaacacugacg

SEQ ID NO: 663762 - RNA, 26 nt, Human
ccucccaccuuagccucccacauagc

SEQ ID NO: 663763 - RNA, 20 nt, Human
ccuccuuccucggccuccca

SEQ ID NO: 663764 - RNA, 18 nt, Human
ccugggcucagguaaucc

SEQ ID NO: 663765 - RNA, 25 nt, Human
cgaacuccugggcucagguaauccu

SEQ ID NO: 663766 - RNA, 24 nt, Human
cgccauguugcccaggcuggucuc

SEQ ID NO: 663767 - RNA, 27 nt, Human
cgccauguugcccaggcuggucucgaa

SEQ ID NO: 663768 - RNA, 23 nt, Human
cucacucuguugcccaggcugga

SEQ ID NO: 663769 - RNA, 24 nt, Human
cucacucuguugcccaggcuggag

SEQ ID NO: 663770 - RNA, 23 nt, Human
cucccacauagcugggacuacag

SEQ ID NO: 663771 - RNA, 24 nt, Human
cugaaacgauccucccaccuuagc

SEQ ID NO: 663772 - RNA, 23 nt, Human
cugagucccugaggaaagcucag

SEQ ID NO: 663773 - RNA, 24 nt, Human
cugagucccugaggaaagcucagg

SEQ ID NO: 663774 - RNA, 22 nt, Human
cugggcucagguaauccuccuu

SEQ ID NO: 663775 - RNA, 24 nt, Human
cuuagccucccacauagcugggac

SEQ ID NO: 663776 - RNA, 20 nt, Human
gagacagggacucacucugu

SEQ ID NO: 663777 - RNA, 21 nt, Human
gauuacaggugugagccccac

SEQ ID NO: 663778 - RNA, 24 nt, Human
gccauguugcccaggcuggucucg

SEQ ID NO: 663779 - RNA, 23 nt, Human
ggacuuuucccugggaacuuggg

SEQ ID NO: 663780 - RNA, 23 nt, Human
ggauuacaggugugagccccacg

SEQ ID NO: 663781 - RNA, 19 nt, Human
ggggacuuuucccugggaa

SEQ ID NO: 663782 - RNA, 22 nt, Human
uagagacagggucucgccaugu

SEQ ID NO: 663783 - RNA, 19 nt, Human
uagauauaaugcaggaaca

SEQ ID NO: 663784 - RNA, 19 nt, Human
uauaaugcaggaacaguuu

SEQ ID NO: 663785 - RNA, 24 nt, Human
ucaaggacaauggggacuuuuccc

SEQ ID NO: 663786 - RNA, 19 nt, Human
ucacugcagccuugaccuc

SEQ ID NO: 663787 - RNA, 23 nt, Human
ucacugcagccuugaccucccag

SEQ ID NO: 663788 - RNA, 24 nt, Human
ucacugcagccuugaccucccagg

SEQ ID NO: 663789 - RNA, 23 nt, Human
ucccaaagugcugggauuacagg

SEQ ID NO: 663790 - RNA, 20 nt, Human
ucccugaggaaagcucaggc

SEQ ID NO: 663791 - RNA, 21 nt, Human
uccuccuuccucggccuccca

SEQ ID NO: 663792 - RNA, 22 nt, Human
uccugggcucagguaauccucc

SEQ ID NO: 663793 - RNA, 19 nt, Human
uccuuccucggccucccaa

SEQ ID NO: 663794 - RNA, 23 nt, Human
ucucgaacuccugggcucaggua

SEQ ID NO: 663795 - RNA, 23 nt, Human
ucucgccauguugcccaggcugg

SEQ ID NO: 663796 - RNA, 24 nt, Human
ucucgccauguugcccaggcuggu

SEQ ID NO: 663797 - RNA, 26 nt, Human
ucucgccauguugcccaggcuggucu

SEQ ID NO: 663798 - RNA, 27 nt, Human
ucucgccauguugcccaggcuggucuc

SEQ ID NO: 663799 - RNA, 22 nt, Human
ucugagucccugaggaaagcuc

SEQ ID NO: 663800 - RNA, 18 nt, Human
ucuguugcccaggcugga

SEQ ID NO: 663801 - RNA, 24 nt, Human
ucuuugauuugugucuguaugacc

SEQ ID NO: 663802 - RNA, 19 nt, Human
ugacagccucaguauauau

SEQ ID NO: 663803 - RNA, 24 nt, Human
ugacgccaucacagcucacugcag

SEQ ID NO: 663804 - RNA, 24 nt, Human
ugcccaggcuggucucgaacuccu

SEQ ID NO: 663805 - RNA, 28 nt, Human
ugcccaggcuggucucgaacuccugggc

SEQ ID NO: 663806 - RNA, 25 nt, Human
ugcugggauuacaggugugagcccc

SEQ ID NO: 663807 - RNA, 24 nt, Human
ugggaaucuggguaugacagccuc

SEQ ID NO: 663808 - RNA, 23 nt, Human
ugggacuacagauaugcccacca

SEQ ID NO: 663809 - RNA, 18 nt, Human
ugggauuacaggugugag

SEQ ID NO: 663810 - RNA, 19 nt, Human
ugggauuacaggugugagc

SEQ ID NO: 663811 - RNA, 23 nt, Human
ugggauuacaggugugagcccca

SEQ ID NO: 663812 - RNA, 23 nt, Human
ugggauuacaggugugagcccca

SEQ ID NO: 663813 - RNA, 24 nt, Human
uguagagacagggucucgccaugu

SEQ ID NO: 663814 - RNA, 23 nt, Human
uuccucggccucccaaagugcug

SEQ ID NO: 663815 - RNA, 24 nt, Human
uugcuuugugucuucgucccugau

SEQ ID NO: 663816 - RNA, 24 nt, Human
uuguagagacagggucucgccaug

SEQ ID NO: 663817 - RNA, 18 nt, Human
uuuguagagacagggucu

SEQ ID NO: 663818 - RNA, 24 nt, Human
uuuguagagacagggucucgccau

SEQ ID NO: 663819 - RNA, 23 nt, Human
uuuuuuguagagacagggucucg

SEQ ID NO: 663820 - RNA, 26 nt, Human
aagugccucuucagugccaagauaaa

SEQ ID NO: 663821 - RNA, 22 nt, Human
aaguguuggggggcugcccggc

SEQ ID NO: 663822 - RNA, 19 nt, Human
aauggcaaaaguuagauac

SEQ ID NO: 663823 - RNA, 23 nt, Human
accccacccaauggcaaaaguua

SEQ ID NO: 663824 - RNA, 23 nt, Human
acuggggcugcaaagcuggccag

SEQ ID NO: 663825 - RNA, 24 nt, Human
agcugcugggggggcagagguugu

SEQ ID NO: 663826 - RNA, 24 nt, Human
aggagcagugacugggccucagag

SEQ ID NO: 663827 - RNA, 19 nt, Human
aggcaggggagggguuggu

SEQ ID NO: 663828 - RNA, 23 nt, Human
agggccguggggagggaggggca

SEQ ID NO: 663829 - RNA, 21 nt, Human
aggggagggguugguuggagc

SEQ ID NO: 663830 - RNA, 22 nt, Human
agugaaauggaaaacccuuuga

SEQ ID NO: 663831 - RNA, 18 nt, Human
caccccugggguaccccc

SEQ ID NO: 663832 - RNA, 20 nt, Human
caccuugaggucugcuccag

SEQ ID NO: 663833 - RNA, 19 nt, Human
cacucuucucucuucucuu

SEQ ID NO: 663834 - RNA, 18 nt, Human
cagcggagcagguuggcu

SEQ ID NO: 663835 - RNA, 18 nt, Human
cagcugcugggggggcag

SEQ ID NO: 663836 - RNA, 23 nt, Human
cagggcaggagaaguguuggggg

SEQ ID NO: 663837 - RNA, 19 nt, Human
cagugccaagauaaacuaa

SEQ ID NO: 663838 - RNA, 18 nt, Human
ccaagauaaacuaacaag

SEQ ID NO: 663839 - RNA, 18 nt, Human
ccaccccacccaauggca

SEQ ID NO: 663840 - RNA, 19 nt, Human
ccacgggaaagacuggccc

SEQ ID NO: 663841 - RNA, 24 nt, Human
ccacuccugagccuuaacaccccu

SEQ ID NO: 663842 - RNA, 18 nt, Human
cccacaauccucucugcc

SEQ ID NO: 663843 - RNA, 24 nt, Human
cccauaaagacugcuuacucugga

SEQ ID NO: 663844 - RNA, 28 nt, Human
ccccagaccccuguucuaaagggugccc

SEQ ID NO: 663845 - RNA, 21 nt, Human
cccggccagggcccccccaga

SEQ ID NO: 663846 - RNA, 20 nt, Human
cccugacugcugcccacucc

SEQ ID NO: 663847 - RNA, 22 nt, Human
cccugggguacccccagacccc

SEQ ID NO: 663848 - RNA, 19 nt, Human
cccuggugggcuggagggg

SEQ ID NO: 663849 - RNA, 26 nt, Human
ccggccagggcccccccagacgagaa

SEQ ID NO: 663850 - RNA, 19 nt, Human
ccucagagacucuggucuc

SEQ ID NO: 663851 - RNA, 22 nt, Human
ccucagagacucuggucuccug

SEQ ID NO: 663852 - RNA, 21 nt, Human
ccugagucuaugcccugccau

SEQ ID NO: 663853 - RNA, 18 nt, Human
cgccgugcagcccccgca

SEQ ID NO: 663854 - RNA, 23 nt, Human
cgggaaagacuggccccguagca

SEQ ID NO: 663855 - RNA, 24 nt, Human
cucacucuucucucuucucuuucc

SEQ ID NO: 663856 - RNA, 18 nt, Human
cucccacaauccucucug

SEQ ID NO: 663857 - RNA, 24 nt, Human
cuccgucuaucucucucucucucu

SEQ ID NO: 663858 - RNA, 20 nt, Human
cuccugagccuuaacacccc

SEQ ID NO: 663859 - RNA, 22 nt, Human
cucucuucucuuuccgcuccuu

SEQ ID NO: 663860 - RNA, 18 nt, Human
cugagccuuaacaccccu

SEQ ID NO: 663861 - RNA, 20 nt, Human
cugcucacucuucucucuuc

SEQ ID NO: 663862 - RNA, 19 nt, Human
cugcugcccacuccugagc

SEQ ID NO: 663863 - RNA, 20 nt, Human
cuguccccaccccacccaau

SEQ ID NO: 663864 - RNA, 24 nt, Human
cuugggaacagaaagacccacaac

SEQ ID NO: 663865 - RNA, 23 nt, Human
cuuuccgcuccuucaauugggaa

SEQ ID NO: 663866 - RNA, 23 nt, Human
gagcaaaaacggauuccucccac

SEQ ID NO: 663867 - RNA, 19 nt, Human
gagcagcuguccccacccc

SEQ ID NO: 663868 - RNA, 19 nt, Human
gaggcaggggagggguugg

SEQ ID NO: 663869 - RNA, 20 nt, Human
gaggcaggggagggguuggu

SEQ ID NO: 663870 - RNA, 22 nt, Human
gcagcggagcagguuggcuaga

SEQ ID NO: 663871 - RNA, 20 nt, Human
gccagggcccccccagacga

SEQ ID NO: 663872 - RNA, 22 nt, Human
gcccuggugggcuggaggggcu

SEQ ID NO: 663873 - RNA, 22 nt, Human
ggagaaguguuggggggcugcc

SEQ ID NO: 663874 - RNA, 18 nt, Human
ggaggggcuggcgccgug

SEQ ID NO: 663875 - RNA, 27 nt, Human
ggauuccucccacaauccucucugccu

SEQ ID NO: 663876 - RNA, 22 nt, Human
gggaugggggugggugggggga

SEQ ID NO: 663877 - RNA, 19 nt, Human
ggggacugggucccaggag

SEQ ID NO: 663878 - RNA, 19 nt, Human
ggggagggguugguuggag

SEQ ID NO: 663879 - RNA, 18 nt, Human
ggggaggguaguuggggg

SEQ ID NO: 663880 - RNA, 20 nt, Human
ggggaugggggugggugggg

SEQ ID NO: 663881 - RNA, 23 nt, Human
ggggaugggggugggugggggga

SEQ ID NO: 663882 - RNA, 19 nt, Human
ggggguggguggggggagg

SEQ ID NO: 663883 - RNA, 19 nt, Human
gggguggguggggggaggg

SEQ ID NO: 663884 - RNA, 19 nt, Human
gggguggguggggggaggg

SEQ ID NO: 663885 - RNA, 20 nt, Human
ggguggggggaggguaguug

SEQ ID NO: 663886 - RNA, 21 nt, Human
ggguggggggaggguaguugg

SEQ ID NO: 663887 - RNA, 20 nt, Human
gguggguggggggaggguag

SEQ ID NO: 663888 - RNA, 23 nt, Human
guggagcaaaaacggauuccucc

SEQ ID NO: 663889 - RNA, 18 nt, Human
guggauaugguggaggca

SEQ ID NO: 663890 - RNA, 20 nt, Human
guuucauucgcugguggcag

SEQ ID NO: 663891 - RNA, 22 nt, Human
uagcacugauuuuccaccuccc

SEQ ID NO: 663892 - RNA, 23 nt, Human
uaucucucucucucucucucaaa

SEQ ID NO: 663893 - RNA, 19 nt, Human
ucacucuucucucuucucu

SEQ ID NO: 663894 - RNA, 23 nt, Human
uccaccuccccuccaggggacug

SEQ ID NO: 663895 - RNA, 20 nt, Human
uccagagaucuccgucuauc

SEQ ID NO: 663896 - RNA, 22 nt, Human
uccagagaucuccgucuaucuc

SEQ ID NO: 663897 - RNA, 20 nt, Human
uccauguucaggaucuuggg

SEQ ID NO: 663898 - RNA, 19 nt, Human
ucccuacaaauagggguag

SEQ ID NO: 663899 - RNA, 20 nt, Human
ucccuacaaauagggguagg

SEQ ID NO: 663900 - RNA, 24 nt, Human
ucccuacaaauagggguaggaaac

SEQ ID NO: 663901 - RNA, 23 nt, Human
uccgcgagcagcuguccccaccc

SEQ ID NO: 663902 - RNA, 22 nt, Human
ucucucucucucucucucaauc

SEQ ID NO: 663903 - RNA, 24 nt, Human
ucucucuucucuuuccgcuccuuc

SEQ ID NO: 663904 - RNA, 23 nt, Human
ucugccugagucuaugcccugcc

SEQ ID NO: 663905 - RNA, 21 nt, Human
ucugcuguucugugguccaug

SEQ ID NO: 663906 - RNA, 20 nt, Human
ucuucucuuuccgcuccuuc

SEQ ID NO: 663907 - RNA, 20 nt, Human
ucuugggaacagaaagaccc

SEQ ID NO: 663908 - RNA, 19 nt, Human
ugaaauggaaaacccuuug

SEQ ID NO: 663909 - RNA, 18 nt, Human
ugacugcugcccacuccu

SEQ ID NO: 663910 - RNA, 22 nt, Human
ugacugggccucagagaaagcc

SEQ ID NO: 663911 - RNA, 23 nt, Human
ugcaaagcuggccagcugcuggg

SEQ ID NO: 663912 - RNA, 23 nt, Human
ugccaagauaaacuaacaagugg

SEQ ID NO: 663913 - RNA, 22 nt, Human
ugcccggccagggcccccccag

SEQ ID NO: 663914 - RNA, 19 nt, Human
uggaggggcuggcgccgug

SEQ ID NO: 663915 - RNA, 28 nt, Human
uggcaaaaguuagauacucgaaagugcc

SEQ ID NO: 663916 - RNA, 21 nt, Human
uggcagggccguggggaggga

SEQ ID NO: 663917 - RNA, 20 nt, Human
ugggauuugaguuuucccuu

SEQ ID NO: 663918 - RNA, 20 nt, Human
uggggagggaggggcaugcg

SEQ ID NO: 663919 - RNA, 20 nt, Human
uggggggaggguaguugggg

SEQ ID NO: 663920 - RNA, 19 nt, Human
uggggguggguggggggag

SEQ ID NO: 663921 - RNA, 18 nt, Human
ugggguacccccagaccc

SEQ ID NO: 663922 - RNA, 22 nt, Human
uggguggggggaggguaguugg

SEQ ID NO: 663923 - RNA, 24 nt, Human
ugguggaggcaggggagggguugg

SEQ ID NO: 663924 - RNA, 22 nt, Human
ugucucucccugacugcugccc

SEQ ID NO: 663925 - RNA, 22 nt, Human
uucagugccaagauaaacuaac

SEQ ID NO: 663926 - RNA, 19 nt, Human
uugcuuuuucccuuuuuau

SEQ ID NO: 663927 - RNA, 19 nt, Human
uuucauucgcugguggcag

SEQ ID NO: 663928 - RNA, 19 nt, Human
aaagcaagauaaguacaug

SEQ ID NO: 663929 - RNA, 22 nt, Human
aagaacccuucauggugaaaag

SEQ ID NO: 663930 - RNA, 18 nt, Human
aagcaagauaaguacaug

SEQ ID NO: 663931 - RNA, 20 nt, Human
aaucuaucgagauuuucccc

SEQ ID NO: 663932 - RNA, 22 nt, Human
aauguaguuuaaaguuuaugua

SEQ ID NO: 663933 - RNA, 18 nt, Human
agaaacaaaauaaauucu

SEQ ID NO: 663934 - RNA, 21 nt, Human
agaagaacccuucauggugaa

SEQ ID NO: 663935 - RNA, 22 nt, Human
agacaagauagaggcuugcugg

SEQ ID NO: 663936 - RNA, 22 nt, Human
agagauucuaggaccuucuuac

SEQ ID NO: 663937 - RNA, 25 nt, Human
agccagcaccggccacgcacccgcg

SEQ ID NO: 663938 - RNA, 24 nt, Human
auaucuaaaaaauauuaaaaucac

SEQ ID NO: 663939 - RNA, 22 nt, Human
cacaaucccauuaaaccaacac

SEQ ID NO: 663940 - RNA, 21 nt, Human
ccagaagaacccuucauggug

SEQ ID NO: 663941 - RNA, 22 nt, Human
ccccaccuugccugagaccaga

SEQ ID NO: 663942 - RNA, 19 nt, Human
ccuccagaagaacccuuca

SEQ ID NO: 663943 - RNA, 25 nt, Human
cugaaugauagcaauauaauuuuua

SEQ ID NO: 663944 - RNA, 19 nt, Human
cuguuggugaaaaagcaag

SEQ ID NO: 663945 - RNA, 19 nt, Human
gaagggguacggagacagg

SEQ ID NO: 663946 - RNA, 20 nt, Human
gaaguacguugaaaguuuau

SEQ ID NO: 663947 - RNA, 26 nt, Human
gaaugccaaggagacuuuaagccaaa

SEQ ID NO: 663948 - RNA, 23 nt, Human
gcaguucuuggacgguggcugau

SEQ ID NO: 663949 - RNA, 22 nt, Human
gccaaggagacuuuaagccaaa

SEQ ID NO: 663950 - RNA, 23 nt, Human
gcccaguccccaccuugccugag

SEQ ID NO: 663951 - RNA, 26 nt, Human
gggcaagaaacaaaauaaagggaccc

SEQ ID NO: 663952 - RNA, 21 nt, Human
uaauaaagcagggcuauuaua

SEQ ID NO: 663953 - RNA, 18 nt, Human
uagaggcuugcugguguc

SEQ ID NO: 663954 - RNA, 22 nt, Human
uauguggauauuaucugugugg

SEQ ID NO: 663955 - RNA, 21 nt, Human
uccuugacagcacuuagacaa

SEQ ID NO: 663956 - RNA, 21 nt, Human
ugaaaaagcaagauaaguaca

SEQ ID NO: 663957 - RNA, 21 nt, Human
ugaaacaaaauggaaaaaaag

SEQ ID NO: 663958 - RNA, 21 nt, Human
ugccugagaccagaacuccca

SEQ ID NO: 663959 - RNA, 23 nt, Human
ugcuggugucuggagagauucua

SEQ ID NO: 663960 - RNA, 21 nt, Human
uguauguggauauuaucugug

SEQ ID NO: 663961 - RNA, 19 nt, Human
ugugcaguucuuggacggu

SEQ ID NO: 663962 - RNA, 22 nt, Human
acccccugcaggccuuagagac

SEQ ID NO: 663963 - RNA, 23 nt, Human
agagggagaagaggcagggcuug

SEQ ID NO: 663964 - RNA, 25 nt, Human
aggaccugggcucggcgcgggccug

SEQ ID NO: 663965 - RNA, 19 nt, Human
aggagcacagauggggagc

SEQ ID NO: 663966 - RNA, 20 nt, Human
aggcagggcuuguccugccc

SEQ ID NO: 663967 - RNA, 21 nt, Human
aggcagggcuuguccugccuc

SEQ ID NO: 663968 - RNA, 22 nt, Human
aggccuuagagacgcuggagcc

SEQ ID NO: 663969 - RNA, 22 nt, Human
cccaggaggggagccagguggc

SEQ ID NO: 663970 - RNA, 20 nt, Human
ccccauggggcuggaccccc

SEQ ID NO: 663971 - RNA, 19 nt, Human
cccccugcaggccuuagag

SEQ ID NO: 663972 - RNA, 21 nt, Human
ccucccaggaggggagccagg

SEQ ID NO: 663973 - RNA, 24 nt, Human
ccugcccccaaggcuuggccugug

SEQ ID NO: 663974 - RNA, 19 nt, Human
ccugggcucggcgcgggcc

SEQ ID NO: 663975 - RNA, 24 nt, Human
ccuuagagacgcuggagccgccau

SEQ ID NO: 663976 - RNA, 26 nt, Human
gaccugggcucggcgcgggccugggc

SEQ ID NO: 663977 - RNA, 21 nt, Human
gagccagguggcugaaggcaa

SEQ ID NO: 663978 - RNA, 20 nt, Human
gagccgccauccugcuggag

SEQ ID NO: 663979 - RNA, 21 nt, Human
gagccgccauccugcuggagc

SEQ ID NO: 663980 - RNA, 20 nt, Human
ggccgcgggcgcgggggggc

SEQ ID NO: 663981 - RNA, 18 nt, Human
ggccugggcucgggaacc

SEQ ID NO: 663982 - RNA, 19 nt, Human
ggcuuggccugugcccuug

SEQ ID NO: 663983 - RNA, 19 nt, Human
ggggccgcgggcgcggggg

SEQ ID NO: 663984 - RNA, 22 nt, Human
gguaaugucuaacauguugcag

SEQ ID NO: 663985 - RNA, 19 nt, Human
gguggcugaaggcaagcac

SEQ ID NO: 663986 - RNA, 22 nt, Human
guucugcccugggggauccugg

SEQ ID NO: 663987 - RNA, 18 nt, Human
ucuucuggauccagcaga

SEQ ID NO: 663988 - RNA, 18 nt, Human
ugcccccuuugccugccc

SEQ ID NO: 663989 - RNA, 24 nt, Human
ugcccuuggugcccccuuugccug

SEQ ID NO: 663990 - RNA, 22 nt, Human
ugccugcccaagucuacugguc

SEQ ID NO: 663991 - RNA, 18 nt, Human
uggcugaaggcaagcacu

SEQ ID NO: 663992 - RNA, 19 nt, Human
uggcugaaggcaagcacug

SEQ ID NO: 663993 - RNA, 23 nt, Human
ugggcucggcgcgggccugggcu

SEQ ID NO: 663994 - RNA, 24 nt, Human
uggggccgcgggcgcgggggggcg

SEQ ID NO: 663995 - RNA, 20 nt, Human
aaaaaguccaaaaucaaagg

SEQ ID NO: 663996 - RNA, 24 nt, Human
aaaacaaaaaaguccaaaaucaaa

SEQ ID NO: 663997 - RNA, 18 nt, Human
aaacaaaaaaguccaaaa

SEQ ID NO: 663998 - RNA, 23 nt, Human
aaacaaaaaaguccaaaaucaaa

SEQ ID NO: 663999 - RNA, 24 nt, Human
aaaggaaagcacccguuuuaaacc

SEQ ID NO: 664000 - RNA, 19 nt, Human
acccugaaauuucaggaaa

SEQ ID NO: 664001 - RNA, 30 nt, Human
agcuccgucccucuaggcucucaguuccaa

SEQ ID NO: 664002 - RNA, 26 nt, Human
aggaaagcacccguuuuaaacccuca

SEQ ID NO: 664003 - RNA, 23 nt, Human
caaaaaaaacuaaauucuaagug

SEQ ID NO: 664004 - RNA, 23 nt, Human
cauccaacuucuuuauucuugag

SEQ ID NO: 664005 - RNA, 22 nt, Human
cccccaacuccgagcgcguccg

SEQ ID NO: 664006 - RNA, 22 nt, Human
cccugaaauuucaggaaauaaa

SEQ ID NO: 664007 - RNA, 20 nt, Human
ccgcagaccgcgagccggaa

SEQ ID NO: 664008 - RNA, 24 nt, Human
ccucuuccgaaccuuggcgaggac

SEQ ID NO: 664009 - RNA, 19 nt, Human
ccuugggccccgggagccu

SEQ ID NO: 664010 - RNA, 20 nt, Human
ccuugggccccgggagccuc

SEQ ID NO: 664011 - RNA, 20 nt, Human
cgagccggaaggcggcuugg

SEQ ID NO: 664012 - RNA, 22 nt, Human
cgcuguggcgcaugcccagaag

SEQ ID NO: 664013 - RNA, 22 nt, Human
cggccuugggccccgggagccu

SEQ ID NO: 664014 - RNA, 23 nt, Human
cucagggcucacugcagucuggc

SEQ ID NO: 664015 - RNA, 23 nt, Human
cucccgaggcguggcaaaggccu

SEQ ID NO: 664016 - RNA, 23 nt, Human
gagcuccgucccucuaggcucuc

SEQ ID NO: 664017 - RNA, 22 nt, Human
gaggcguggcaaaggccuaaaa

SEQ ID NO: 664018 - RNA, 22 nt, Human
gcccccaacuccgagcgcgucc

SEQ ID NO: 664019 - RNA, 18 nt, Human
gccuugggccccgggagc

SEQ ID NO: 664020 - RNA, 18 nt, Human
gcucacugcagucuggcc

SEQ ID NO: 664021 - RNA, 22 nt, Human
gcugagacccugaaauuucagg

SEQ ID NO: 664022 - RNA, 22 nt, Human
ggaaagcacccguuuuaaaccc

SEQ ID NO: 664023 - RNA, 20 nt, Human
gggcggcuguugaguucgug

SEQ ID NO: 664024 - RNA, 20 nt, Human
guccaaaaucaaaggaaagc

SEQ ID NO: 664025 - RNA, 19 nt, Human
guccaauggcuuggaacau

SEQ ID NO: 664026 - RNA, 18 nt, Human
uccaaaaucaaaggaaag

SEQ ID NO: 664027 - RNA, 21 nt, Human
ucccucuaggcucucaguucc

SEQ ID NO: 664028 - RNA, 21 nt, Human
uccgaaccuuggcgaggaccc

SEQ ID NO: 664029 - RNA, 21 nt, Human
uccgcagaccgcgagccggaa

SEQ ID NO: 664030 - RNA, 22 nt, Human
ugaaauuucaggaaauaaacau

SEQ ID NO: 664031 - RNA, 22 nt, Human
ugagagaaucagcacugacuca

SEQ ID NO: 664032 - RNA, 22 nt, Human
uucaagguccucuuccgaaccu

SEQ ID NO: 664033 - RNA, 21 nt, Human
uuggcgaaggcccccaacucc

SEQ ID NO: 664034 - RNA, 22 nt, Human
uuguugaaacaaaaaugaagau

SEQ ID NO: 664035 - RNA, 21 nt, Human
aaaaaaaacuuuguuaaggca

SEQ ID NO: 664036 - RNA, 25 nt, Human
aaaaaaaagggaguuuccaaggaaa

SEQ ID NO: 664037 - RNA, 18 nt, Human
aacacuuugggaggcuga

SEQ ID NO: 664038 - RNA, 24 nt, Human
aacacuuugggaggcugaggcggg

SEQ ID NO: 664039 - RNA, 20 nt, Human
aacauagugaaauccugucu

SEQ ID NO: 664040 - RNA, 19 nt, Human
aaccuggccaacauaguga

SEQ ID NO: 664041 - RNA, 24 nt, Human
aaucgcuugaacccaggaggcaga

SEQ ID NO: 664042 - RNA, 19 nt, Human
acaaauaaaaaccagggag

SEQ ID NO: 664043 - RNA, 19 nt, Human
acaagagcgaaacuccauc

SEQ ID NO: 664044 - RNA, 20 nt, Human
acaagagcgaaacuccaucu

SEQ ID NO: 664045 - RNA, 21 nt, Human
acaagagcgaaacuccaucuc

SEQ ID NO: 664046 - RNA, 20 nt, Human
acagggcucaauacauaaaa

SEQ ID NO: 664047 - RNA, 19 nt, Human
acaguggcucacaccugaa

SEQ ID NO: 664048 - RNA, 22 nt, Human
accacuguacuccagccugggc

SEQ ID NO: 664049 - RNA, 24 nt, Human
accacuguacuccagccugggcaa

SEQ ID NO: 664050 - RNA, 24 nt, Human
accagcugggcgcggugacucacg

SEQ ID NO: 664051 - RNA, 24 nt, Human
acccaggaggcagaggcugcagug

SEQ ID NO: 664052 - RNA, 25 nt, Human
acuguacuccagccugggcaacaag

SEQ ID NO: 664053 - RNA, 23 nt, Human
acuguagcauguauguccaaagg

SEQ ID NO: 664054 - RNA, 22 nt, Human
agaaucgcuugaacccaggagg

SEQ ID NO: 664055 - RNA, 20 nt, Human
agaggcugcagugagccaag

SEQ ID NO: 664056 - RNA, 20 nt, Human
agcaauaccagcugggcgcg

SEQ ID NO: 664057 - RNA, 23 nt, Human
agcugggcaugguggugggugcc

SEQ ID NO: 664058 - RNA, 18 nt, Human
aggaggcagaggcugcag

SEQ ID NO: 664059 - RNA, 21 nt, Human
aggaggcagaggcugcaguga

SEQ ID NO: 664060 - RNA, 24 nt, Human
aggcagaggcaggagaaucgcuug

SEQ ID NO: 664061 - RNA, 24 nt, Human
aggcagaggcugcagugagccaag

SEQ ID NO: 664062 - RNA, 25 nt, Human
aggcagaggcugcagugagccaaga

SEQ ID NO: 664063 - RNA, 23 nt, Human
aggcaggagaaucgcuugaaccc

SEQ ID NO: 664064 - RNA, 24 nt, Human
aggcaggagaaucgcuugaaccca

SEQ ID NO: 664065 - RNA, 20 nt, Human
aggccgaggcugguagauca

SEQ ID NO: 664066 - RNA, 23 nt, Human
aggcugcagugagccaagaucau

SEQ ID NO: 664067 - RNA, 26 nt, Human
aggcugguagaucaucugaggucagg

SEQ ID NO: 664068 - RNA, 24 nt, Human
auaccacuguacuccagccugggc

SEQ ID NO: 664069 - RNA, 22 nt, Human
auacuaacagaaauaaaacauu

SEQ ID NO: 664070 - RNA, 24 nt, Human
aucauaccacuguacuccagccug

SEQ ID NO: 664071 - RNA, 21 nt, Human
aucucaaaaaaaaaaaaaaag

SEQ ID NO: 664072 - RNA, 24 nt, Human
auggaauuaaaauauuaacaauga

SEQ ID NO: 664073 - RNA, 19 nt, Human
caaaaaaaaaaaaaaaggg

SEQ ID NO: 664074 - RNA, 24 nt, Human
caacacuuugggaggcugaggcgg

SEQ ID NO: 664075 - RNA, 21 nt, Human
caacauagugaaauccugucu

SEQ ID NO: 664076 - RNA, 24 nt, Human
caacauagugaaauccugucucua

SEQ ID NO: 664077 - RNA, 23 nt, Human
caagauaauucuuagaaagauga

SEQ ID NO: 664078 - RNA, 18 nt, Human
cacaccugaaucccagca

SEQ ID NO: 664079 - RNA, 20 nt, Human
cacagcacagccuacaaagc

SEQ ID NO: 664080 - RNA, 24 nt, Human
cacgccuguaaucccaacacuuug

SEQ ID NO: 664081 - RNA, 21 nt, Human
cacgcugcccaggacucugaa

SEQ ID NO: 664082 - RNA, 18 nt, Human
cacuguacuccagccugg

SEQ ID NO: 664083 - RNA, 19 nt, Human
cacuguacuccagccuggg

SEQ ID NO: 664084 - RNA, 20 nt, Human
cacuguacuccagccugggc

SEQ ID NO: 664085 - RNA, 21 nt, Human
cacuguacuccagccugggca

SEQ ID NO: 664086 - RNA, 23 nt, Human
cacuguacuccagccugggcaac

SEQ ID NO: 664087 - RNA, 24 nt, Human
cacuguacuccagccugggcaaca

SEQ ID NO: 664088 - RNA, 22 nt, Human
cagacacagcacagccuacaaa

SEQ ID NO: 664089 - RNA, 25 nt, Human
cagaggcaggagaaucgcuugaacc

SEQ ID NO: 664090 - RNA, 22 nt, Human
caugguggugggugccuguaau

SEQ ID NO: 664091 - RNA, 21 nt, Human
cauucagugaccacaacuuuc

SEQ ID NO: 664092 - RNA, 20 nt, Human
ccacuguacuccagccuggg

SEQ ID NO: 664093 - RNA, 20 nt, Human
ccacuguacuccagccuggg

SEQ ID NO: 664094 - RNA, 21 nt, Human
ccacuguacuccagccugggc

SEQ ID NO: 664095 - RNA, 22 nt, Human
ccacuguacuccagccugggca

SEQ ID NO: 664096 - RNA, 23 nt, Human
ccacuguacuccagccugggcaa

SEQ ID NO: 664097 - RNA, 24 nt, Human
ccacuguacuccagccugggcaac

SEQ ID NO: 664098 - RNA, 24 nt, Human
cccugcugggcacaguggcucaca

SEQ ID NO: 664099 - RNA, 22 nt, Human
ccuggccaacauagugaaaucc

SEQ ID NO: 664100 - RNA, 24 nt, Human
ccuggccaacauagugaaauccug

SEQ ID NO: 664101 - RNA, 22 nt, Human
ccuguaaucccaacacuuuggg

SEQ ID NO: 664102 - RNA, 18 nt, Human
ccuguaaucccagcuacu

SEQ ID NO: 664103 - RNA, 21 nt, Human
ccuguaaucccagcuacuugg

SEQ ID NO: 664104 - RNA, 22 nt, Human
ccugucucuacuaaaaauacaa

SEQ ID NO: 664105 - RNA, 23 nt, Human
cgaaacuccaucucaaaaaaaaa

SEQ ID NO: 664106 - RNA, 19 nt, Human
cgcacgcugcccaggacuc

SEQ ID NO: 664107 - RNA, 26 nt, Human
cucaaaaaaaaaaaaaaagggaguuu

SEQ ID NO: 664108 - RNA, 23 nt, Human
cucacaccugaaucccagcacuu

SEQ ID NO: 664109 - RNA, 23 nt, Human
cucacaccugaaucccagcacuu

SEQ ID NO: 664110 - RNA, 22 nt, Human
cucacgccuguaaucccaacac

SEQ ID NO: 664111 - RNA, 24 nt, Human
cucacgccuguaaucccaacacuu

SEQ ID NO: 664112 - RNA, 19 nt, Human
cuccaucucaaaaaaaaaa

SEQ ID NO: 664113 - RNA, 20 nt, Human
cuuagaaagaugaagcaucc

SEQ ID NO: 664114 - RNA, 23 nt, Human
gagaccaaccuggccaacauagu

SEQ ID NO: 664115 - RNA, 18 nt, Human
gaggcugcagugagccaa

SEQ ID NO: 664116 - RNA, 25 nt, Human
gaggcugguagaucaucugagguca

SEQ ID NO: 664117 - RNA, 24 nt, Human
gaucaucugaggucaggagcuuga

SEQ ID NO: 664118 - RNA, 22 nt, Human
gcaggagaaucgcuugaaccca

SEQ ID NO: 664119 - RNA, 20 nt, Human
gcauaaagauuucacugaca

SEQ ID NO: 664120 - RNA, 24 nt, Human
gccaacauagugaaauccugucuc

SEQ ID NO: 664121 - RNA, 28 nt, Human
gcgcagccgccaggaagaggggaacgcc

SEQ ID NO: 664122 - RNA, 20 nt, Human
ggcacaguggcucacaccug

SEQ ID NO: 664123 - RNA, 23 nt, Human
ggcaugguggugggugccuguaa

SEQ ID NO: 664124 - RNA, 23 nt, Human
ggcgcggugacucacgccuguaa

SEQ ID NO: 664125 - RNA, 19 nt, Human
ggugacucacgccuguaau

SEQ ID NO: 664126 - RNA, 24 nt, Human
ggugccuguaaucccagcuacuug

SEQ ID NO: 664127 - RNA, 21 nt, Human
ggugggugccuguaaucccag

SEQ ID NO: 664128 - RNA, 24 nt, Human
gguggugggugccuguaaucccag

SEQ ID NO: 664129 - RNA, 25 nt, Human
guacuccagccugggcaacaagagc

SEQ ID NO: 664130 - RNA, 23 nt, Human
guggcucacaccugaaucccagc

SEQ ID NO: 664131 - RNA, 22 nt, Human
uaacagaaauaaaacauuuaug

SEQ ID NO: 664132 - RNA, 20 nt, Human
uaagcuucugcuuuuccaca

SEQ ID NO: 664133 - RNA, 22 nt, Human
uaccacuguacuccagccuggg

SEQ ID NO: 664134 - RNA, 24 nt, Human
uacuccagccugggcaacaagagc

SEQ ID NO: 664135 - RNA, 25 nt, Human
uacuccagccugggcaacaagagcg

SEQ ID NO: 664136 - RNA, 23 nt, Human
uagaucaucugaggucaggagcu

SEQ ID NO: 664137 - RNA, 24 nt, Human
uagaucaucugaggucaggagcuu

SEQ ID NO: 664138 - RNA, 23 nt, Human
uaugaauaaaguccaaagccaag

SEQ ID NO: 664139 - RNA, 23 nt, Human
ucaaaaaaaaaaaaaaagggagu

SEQ ID NO: 664140 - RNA, 21 nt, Human
ucacaccugaaucccagcacu

SEQ ID NO: 664141 - RNA, 23 nt, Human
ucauaccacuguacuccagccug

SEQ ID NO: 664142 - RNA, 23 nt, Human
uccaucucaaaaaaaaaaaaaaa

SEQ ID NO: 664143 - RNA, 28 nt, Human
ucucaaaaaaaaaaaaaaagggaguuuc

SEQ ID NO: 664144 - RNA, 24 nt, Human
ucucuacuaaaaauacaaaaaauu

SEQ ID NO: 664145 - RNA, 22 nt, Human
ucugaggucaggagcuugagac

SEQ ID NO: 664146 - RNA, 23 nt, Human
ucugaggucaggagcuugagacc

SEQ ID NO: 664147 - RNA, 18 nt, Human
ucuuugguuuuaucacuu

SEQ ID NO: 664148 - RNA, 21 nt, Human
ugaaauguuaacacagggcuc

SEQ ID NO: 664149 - RNA, 22 nt, Human
ugaauaaaguccaaagccaaga

SEQ ID NO: 664150 - RNA, 21 nt, Human
ugacucacgccuguaauccca

SEQ ID NO: 664151 - RNA, 24 nt, Human
ugccuguaaucccagcuacuuggg

SEQ ID NO: 664152 - RNA, 25 nt, Human
ugcucuucuuaagugaaauguuaau

SEQ ID NO: 664153 - RNA, 23 nt, Human
uggcagcuauauuagucagaagc

SEQ ID NO: 664154 - RNA, 24 nt, Human
uggccaacauagugaaauccuguc

SEQ ID NO: 664155 - RNA, 21 nt, Human
uggcucacaccugaaucccag

SEQ ID NO: 664156 - RNA, 23 nt, Human
uggcucacaccugaaucccagca

SEQ ID NO: 664157 - RNA, 20 nt, Human
ugggaggcagaggcaggaga

SEQ ID NO: 664158 - RNA, 24 nt, Human
ugggaggcagaggcaggagaaucg

SEQ ID NO: 664159 - RNA, 19 nt, Human
ugggaggcugaggcgggug

SEQ ID NO: 664160 - RNA, 20 nt, Human
ugggaggcugaggcgggugg

SEQ ID NO: 664161 - RNA, 23 nt, Human
ugguagaucaucugaggucagga

SEQ ID NO: 664162 - RNA, 22 nt, Human
uggugggugccuguaaucccag

SEQ ID NO: 664163 - RNA, 24 nt, Human
uggugggugccuguaaucccagcu

SEQ ID NO: 664164 - RNA, 24 nt, Human
ugguggugggugccuguaauccca

SEQ ID NO: 664165 - RNA, 18 nt, Human
uguccaaagggaauagaa

SEQ ID NO: 664166 - RNA, 24 nt, Human
uuagcugggcaugguggugggugc

SEQ ID NO: 664167 - RNA, 22 nt, Human
uuaugaauaaaguccaaagcca

SEQ ID NO: 664168 - RNA, 24 nt, Human
uucagacacagcacagccuacaaa

SEQ ID NO: 664169 - RNA, 20 nt, Human
uugggaggcagaggcaggag

SEQ ID NO: 664170 - RNA, 19 nt, Human
aaaaaaagaagagacaaca

SEQ ID NO: 664171 - RNA, 23 nt, Human
aaaaagaagagacaacagugaag

SEQ ID NO: 664172 - RNA, 21 nt, Human
aaagugcagggaccaaaacca

SEQ ID NO: 664173 - RNA, 24 nt, Human
aaagugcagggaccaaaaccagag

SEQ ID NO: 664174 - RNA, 20 nt, Human
aacgaugaagccgacagaau

SEQ ID NO: 664175 - RNA, 23 nt, Human
aagaagagacaacagugacauca

SEQ ID NO: 664176 - RNA, 20 nt, Human
aagguggaugaagguggcuu

SEQ ID NO: 664177 - RNA, 21 nt, Human
acagauaugauaaucugugcu

SEQ ID NO: 664178 - RNA, 18 nt, Human
accccuugcauccaguca

SEQ ID NO: 664179 - RNA, 19 nt, Human
acccuccaguaacauccau

SEQ ID NO: 664180 - RNA, 19 nt, Human
acuuuguaacacaggcaug

SEQ ID NO: 664181 - RNA, 25 nt, Human
agacagcucccuacagagcagaaag

SEQ ID NO: 664182 - RNA, 28 nt, Human
agccaaaaggcggaggagcuccccaggg

SEQ ID NO: 664183 - RNA, 20 nt, Human
aggcaccggagucacaccac

SEQ ID NO: 664184 - RNA, 20 nt, Human
aggcagagggaaagagcaga

SEQ ID NO: 664185 - RNA, 20 nt, Human
agggagugggggaacacgga

SEQ ID NO: 664186 - RNA, 21 nt, Human
aguaacuaccuuacuaacaaa

SEQ ID NO: 664187 - RNA, 23 nt, Human
agugaccagccccauccugaagc

SEQ ID NO: 664188 - RNA, 24 nt, Human
auuuuucuggcucucccuccucuc

SEQ ID NO: 664189 - RNA, 19 nt, Human
caaacagugccuggcacac

SEQ ID NO: 664190 - RNA, 22 nt, Human
caaagugcagggaccaaaacca

SEQ ID NO: 664191 - RNA, 24 nt, Human
caacuuaagagaaugaaccuauga

SEQ ID NO: 664192 - RNA, 25 nt, Human
caauucaaaucaguggucaagucaa

SEQ ID NO: 664193 - RNA, 23 nt, Human
cacaaagugcagggaccaaaacc

SEQ ID NO: 664194 - RNA, 21 nt, Human
cacaauaucacaggauaauaa

SEQ ID NO: 664195 - RNA, 22 nt, Human
caccccccgaccccagguggca

SEQ ID NO: 664196 - RNA, 18 nt, Human
cacuuagggacacacacc

SEQ ID NO: 664197 - RNA, 22 nt, Human
cagacacaauaaagaacuaaag

SEQ ID NO: 664198 - RNA, 19 nt, Human
cagaguccuggcagaaaca

SEQ ID NO: 664199 - RNA, 20 nt, Human
cagcauauaaaaagacauca

SEQ ID NO: 664200 - RNA, 23 nt, Human
cagcuaggcugaaggcauaaaac

SEQ ID NO: 664201 - RNA, 19 nt, Human
caggaauucauuugggggg

SEQ ID NO: 664202 - RNA, 19 nt, Human
cauccuucuaauccugcug

SEQ ID NO: 664203 - RNA, 23 nt, Human
caugugguucaccaggaggcacc

SEQ ID NO: 664204 - RNA, 21 nt, Human
ccaugugucuuaucauccugg

SEQ ID NO: 664205 - RNA, 21 nt, Human
ccauugcccuuuaccccaaac

SEQ ID NO: 664206 - RNA, 24 nt, Human
cccaaacucuccaaccaccagcau

SEQ ID NO: 664207 - RNA, 24 nt, Human
cccaucccugggaagaagacuguu

SEQ ID NO: 664208 - RNA, 23 nt, Human
cccauccugaagcuacccagggg

SEQ ID NO: 664209 - RNA, 20 nt, Human
cccauucuccuuuacccucc

SEQ ID NO: 664210 - RNA, 21 nt, Human
ccccaaacucuccaaccacca

SEQ ID NO: 664211 - RNA, 23 nt, Human
ccccuuugcaccccccgacccca

SEQ ID NO: 664212 - RNA, 22 nt, Human
cccuaccugcuuucucucccug

SEQ ID NO: 664213 - RNA, 22 nt, Human
ccggagucacaccacaaagugc

SEQ ID NO: 664214 - RNA, 19 nt, Human
ccuagacuaaaggggcagc

SEQ ID NO: 664215 - RNA, 27 nt, Human
ccugcuuucucucccugucuuuuuccc

SEQ ID NO: 664216 - RNA, 21 nt, Human
ccugucuuuuucccauucucc

SEQ ID NO: 664217 - RNA, 20 nt, Human
cuccaccaacaaaccacugu

SEQ ID NO: 664218 - RNA, 22 nt, Human
cuccaugugucuuaucauccug

SEQ ID NO: 664219 - RNA, 18 nt, Human
cuccccagauguugaugg

SEQ ID NO: 664220 - RNA, 20 nt, Human
cucccuccucuccauccuua

SEQ ID NO: 664221 - RNA, 20 nt, Human
cucccugucuuuuucccaac

SEQ ID NO: 664222 - RNA, 23 nt, Human
cuugaaguuucuucugggaugug

SEQ ID NO: 664223 - RNA, 18 nt, Human
gaagccaaaaggcggagg

SEQ ID NO: 664224 - RNA, 26 nt, Human
gaccccagguggcacccuccaguaac

SEQ ID NO: 664225 - RNA, 23 nt, Human
ggaccaaaaccagagaaggugga

SEQ ID NO: 664226 - RNA, 20 nt, Human
ggagacuuuguaacacaggc

SEQ ID NO: 664227 - RNA, 25 nt, Human
ggaggagcuccccagggaguggggg

SEQ ID NO: 664228 - RNA, 18 nt, Human
gggaacacggaggucagc

SEQ ID NO: 664229 - RNA, 18 nt, Human
gugcagggaccaaaacca

SEQ ID NO: 664230 - RNA, 22 nt, Human
uaaaaagacaucacuuuggaga

SEQ ID NO: 664231 - RNA, 19 nt, Human
uaaaacccuaccugcuuuc

SEQ ID NO: 664232 - RNA, 19 nt, Human
uaaagaacuaaagagacag

SEQ ID NO: 664233 - RNA, 22 nt, Human
uaaucacugcaauaguccagau

SEQ ID NO: 664234 - RNA, 21 nt, Human
uaccccaaacucuccaaccac

SEQ ID NO: 664235 - RNA, 21 nt, Human
uacuccuuccccuuugcaccc

SEQ ID NO: 664236 - RNA, 22 nt, Human
uagacuaaaggggcagccccua

SEQ ID NO: 664237 - RNA, 22 nt, Human
uagauaucaggaauucauuugg

SEQ ID NO: 664238 - RNA, 20 nt, Human
uagcaguggaaguguugaaa

SEQ ID NO: 664239 - RNA, 22 nt, Human
uaggaaaaagggauaauccauc

SEQ ID NO: 664240 - RNA, 21 nt, Human
uaucaggaauucauuuggggg

SEQ ID NO: 664241 - RNA, 20 nt, Human
uauccagaagcucucugaac

SEQ ID NO: 664242 - RNA, 20 nt, Human
uauuucacaauaucacagga

SEQ ID NO: 664243 - RNA, 22 nt, Human
uauuucacaauaucacaggaua

SEQ ID NO: 664244 - RNA, 21 nt, Human
ucaaggcagagggaaagagca

SEQ ID NO: 664245 - RNA, 20 nt, Human
ucaguugcccuccuccccag

SEQ ID NO: 664246 - RNA, 22 nt, Human
ucaguugcccuccuccccagau

SEQ ID NO: 664247 - RNA, 21 nt, Human
ucaugagaggcaucgggugcc

SEQ ID NO: 664248 - RNA, 24 nt, Human
uccauguguucagguauccagaag

SEQ ID NO: 664249 - RNA, 18 nt, Human
ucccaacgggucauguuu

SEQ ID NO: 664250 - RNA, 21 nt, Human
ucccuacagagcagaaagccc

SEQ ID NO: 664251 - RNA, 18 nt, Human
ucccugggaagaagacug

SEQ ID NO: 664252 - RNA, 25 nt, Human
uccuaucucuuacgguuggugggag

SEQ ID NO: 664253 - RNA, 20 nt, Human
uccugguuccuagacuaaag

SEQ ID NO: 664254 - RNA, 23 nt, Human
ucuccuuuacccuccucuccuuc

SEQ ID NO: 664255 - RNA, 27 nt, Human
ucucugaacccaguccuuugggagcuu

SEQ ID NO: 664256 - RNA, 22 nt, Human
ucuucuguguuauacauugugc

SEQ ID NO: 664257 - RNA, 18 nt, Human
ugaaggaaagggugcgga

SEQ ID NO: 664258 - RNA, 20 nt, Human
ugaaggcauaaaacccuacc

SEQ ID NO: 664259 - RNA, 21 nt, Human
ugaagguuuugaacaaaugaa

SEQ ID NO: 664260 - RNA, 21 nt, Human
ugagcacuguuuucagcacug

SEQ ID NO: 664261 - RNA, 20 nt, Human
ugcaauaauaccaccaagaa

SEQ ID NO: 664262 - RNA, 19 nt, Human
ugcaccccccgaccccagg

SEQ ID NO: 664263 - RNA, 18 nt, Human
ugcagcaauagcauugga

SEQ ID NO: 664264 - RNA, 21 nt, Human
ugcccaggacucuguccacac

SEQ ID NO: 664265 - RNA, 22 nt, Human
ugcuaagugccuuacauuaccu

SEQ ID NO: 664266 - RNA, 22 nt, Human
uggaaagaugaugggaucuuca

SEQ ID NO: 664267 - RNA, 19 nt, Human
uggugguuauagcagugga

SEQ ID NO: 664268 - RNA, 25 nt, Human
uguccacacuuagggacacacaccc

SEQ ID NO: 664269 - RNA, 19 nt, Human
uguucagguauccagaagc

SEQ ID NO: 664270 - RNA, 23 nt, Human
uguucagguauccagaagcucuc

SEQ ID NO: 664271 - RNA, 24 nt, Human
uucauauauuuuucuggcucuccc

SEQ ID NO: 664272 - RNA, 24 nt, Human
uuccagugaccagccccauccuga

SEQ ID NO: 664273 - RNA, 20 nt, Human
uuccauacuccuuccccuuu

SEQ ID NO: 664274 - RNA, 20 nt, Human
uugcaccccccgaccccagg

SEQ ID NO: 664275 - RNA, 22 nt, Human
uugcaccccccgaccccaggug

SEQ ID NO: 664276 - RNA, 24 nt, Human
uuucccauucuccuuuacccuccu

SEQ ID NO: 664277 - RNA, 22 nt, Human
uuuccugacuuucgucucucuc

SEQ ID NO: 664278 - RNA, 24 nt, Human
uuuucuggcucucccuccucucca

SEQ ID NO: 664279 - RNA, 23 nt, Human
aaaaaaaaaaaaaaaagcaaaaa

SEQ ID NO: 664280 - RNA, 26 nt, Human
aaaaaaaaaaaaaaaagcaaaaacca

SEQ ID NO: 664281 - RNA, 25 nt, Human
aaaaaaaaaaaaaagcaaaaaccaa

SEQ ID NO: 664282 - RNA, 26 nt, Human
aaaaaaaaaaagcaaaaaccaaaaaa

SEQ ID NO: 664283 - RNA, 22 nt, Human
aaaaaaaaccaaaaaaaaccau

SEQ ID NO: 664284 - RNA, 20 nt, Human
aaaaaaaaccaucugggucc

SEQ ID NO: 664285 - RNA, 22 nt, Human
aaaaaaaagcaaaaaccaaaaa

SEQ ID NO: 664286 - RNA, 18 nt, Human
aaaaaaaccaaaaaaaac

SEQ ID NO: 664287 - RNA, 22 nt, Human
aaaaaaaccaucuggguccaaa

SEQ ID NO: 664288 - RNA, 25 nt, Human
aaaccaaaaaaaaccaucugggucc

SEQ ID NO: 664289 - RNA, 22 nt, Human
aaagaaaagcaagaugaaacaa

SEQ ID NO: 664290 - RNA, 20 nt, Human
aaagaaaggaguugaagaau

SEQ ID NO: 664291 - RNA, 19 nt, Human
aaagcaagaugaaacaaaa

SEQ ID NO: 664292 - RNA, 23 nt, Human
aagaaaagcaagaugaaacaaaa

SEQ ID NO: 664293 - RNA, 22 nt, Human
aagacuguaacuuccugagaac

SEQ ID NO: 664294 - RNA, 20 nt, Human
aaggcaaagccaccucuauu

SEQ ID NO: 664295 - RNA, 21 nt, Human
acaaugucaacaucaauguua

SEQ ID NO: 664296 - RNA, 18 nt, Human
acauucuucaggauuuaa

SEQ ID NO: 664297 - RNA, 18 nt, Human
accaaaaaaaaaaaaaaa

SEQ ID NO: 664298 - RNA, 20 nt, Human
acccuuuaaaagcaaagauu

SEQ ID NO: 664299 - RNA, 24 nt, Human
acuuuguacauucaugagaagcug

SEQ ID NO: 664300 - RNA, 26 nt, Human
agacagauguaaaagacuucaguuuc

SEQ ID NO: 664301 - RNA, 20 nt, Human
agacagauguaaaagacuuu

SEQ ID NO: 664302 - RNA, 18 nt, Human
agagaaaaaaaagagaga

SEQ ID NO: 664303 - RNA, 21 nt, Human
agcaaaaaccaaaaaaaaaaa

SEQ ID NO: 664304 - RNA, 18 nt, Human
agcaucuuucuacuccug

SEQ ID NO: 664305 - RNA, 21 nt, Human
agcaucuuucuacuccugcca

SEQ ID NO: 664306 - RNA, 21 nt, Human
aggauuuaacaagucaaaaua

SEQ ID NO: 664307 - RNA, 21 nt, Human
agguugugccaaaguuuacau

SEQ ID NO: 664308 - RNA, 25 nt, Human
aguucugucgcucagggcaccagcg

SEQ ID NO: 664309 - RNA, 18 nt, Human
aucuagacagauguaaaa

SEQ ID NO: 664310 - RNA, 23 nt, Human
augaaucaguacaggguugguga

SEQ ID NO: 664311 - RNA, 24 nt, Human
auggguucuuuucauauugaauuu

SEQ ID NO: 664312 - RNA, 26 nt, Human
augucaacaucaauguuaauaaaaau

SEQ ID NO: 664313 - RNA, 18 nt, Human
auuuacagggccuuccuu

SEQ ID NO: 664314 - RNA, 24 nt, Human
caaaaaaaaaaaaaaaagcaaaaa

SEQ ID NO: 664315 - RNA, 18 nt, Human
cagaauucaaaucuagac

SEQ ID NO: 664316 - RNA, 20 nt, Human
cagcuaaacuauagauaacc

SEQ ID NO: 664317 - RNA, 20 nt, Human
caugacccuuuaaaagcaaa

SEQ ID NO: 664318 - RNA, 25 nt, Human
ccaaaaaaaaaaaaaaaaaccaaaa

SEQ ID NO: 664319 - RNA, 22 nt, Human
cccuaccagaguucugucgcuc

SEQ ID NO: 664320 - RNA, 19 nt, Human
cugauugagauauucaguc

SEQ ID NO: 664321 - RNA, 20 nt, Human
gaaaauccuuuauuuuguag

SEQ ID NO: 664322 - RNA, 21 nt, Human
gaauggaacaucuguuuaacc

SEQ ID NO: 664323 - RNA, 18 nt, Human
gagaugcugcuuugcugu

SEQ ID NO: 664324 - RNA, 22 nt, Human
gaggaaaggcugggucuggaaa

SEQ ID NO: 664325 - RNA, 24 nt, Human
gcaaugaaucaguacaggguuggu

SEQ ID NO: 664326 - RNA, 30 nt, Human
gcacuaauuagcuguguguguguaugagaa

SEQ ID NO: 664327 - RNA, 21 nt, Human
ggaaaggggagggagagcagc

SEQ ID NO: 664328 - RNA, 21 nt, Human
ggcaaugauuuuaacaauuau

SEQ ID NO: 664329 - RNA, 22 nt, Human
uaaaagacuucaguuucaaauu

SEQ ID NO: 664330 - RNA, 19 nt, Human
uaaagucauugaacccaug

SEQ ID NO: 664331 - RNA, 21 nt, Human
uaaaugaaaauccuuuauuuu

SEQ ID NO: 664332 - RNA, 24 nt, Human
uaaaugaaaauccuuuauuuugua

SEQ ID NO: 664333 - RNA, 21 nt, Human
uaacaagucaaaauaaaagca

SEQ ID NO: 664334 - RNA, 26 nt, Human
uaaccaaaaaaaaaaaaaaaagcaaa

SEQ ID NO: 664335 - RNA, 20 nt, Human
uaagcugcaaaaagaaaguu

SEQ ID NO: 664336 - RNA, 18 nt, Human
uacagccagcccccuacc

SEQ ID NO: 664337 - RNA, 19 nt, Human
uaucauacauauugcgugu

SEQ ID NO: 664338 - RNA, 21 nt, Human
ucaguacaggguuggugacau

SEQ ID NO: 664339 - RNA, 19 nt, Human
ucgcucagggcaccagcgg

SEQ ID NO: 664340 - RNA, 20 nt, Human
ucuguaaggaauuaaauugc

SEQ ID NO: 664341 - RNA, 21 nt, Human
ugaaaauucuagguuucaaca

SEQ ID NO: 664342 - RNA, 19 nt, Human
ugagcaucuuucuacuccu

SEQ ID NO: 664343 - RNA, 18 nt, Human
ugcaaaaagaaaguuaca

SEQ ID NO: 664344 - RNA, 22 nt, Human
ugcaggaaaggggagggagagc

SEQ ID NO: 664345 - RNA, 22 nt, Human
ugccagauugaaaauucuaggu

SEQ ID NO: 664346 - RNA, 20 nt, Human
ugcugcuuugcugucugcau

SEQ ID NO: 664347 - RNA, 19 nt, Human
ugcugucugcauuuuuagg

SEQ ID NO: 664348 - RNA, 21 nt, Human
uuccaugccacgucaauuuac

SEQ ID NO: 664349 - RNA, 19 nt, Human
uugaucuuagagaaacaug

SEQ ID NO: 664350 - RNA, 20 nt, Human
uugaucuuagagaaacaugg

SEQ ID NO: 664351 - RNA, 21 nt, Human
aauacacuucuaguccaacug

SEQ ID NO: 664352 - RNA, 25 nt, Human
acagaacaacaaugcuuacgcgaaa

SEQ ID NO: 664353 - RNA, 21 nt, Human
acgccaagacggcugggaagc

SEQ ID NO: 664354 - RNA, 22 nt, Human
acgcggagcggcggggguugga

SEQ ID NO: 664355 - RNA, 18 nt, Human
acucggcccgcccugcga

SEQ ID NO: 664356 - RNA, 22 nt, Human
agacggcugggaagccccaggc

SEQ ID NO: 664357 - RNA, 21 nt, Human
agagugccgcgggagcuugac

SEQ ID NO: 664358 - RNA, 24 nt, Human
caauaacccucaaaacagaacaac

SEQ ID NO: 664359 - RNA, 24 nt, Human
caaugaguucuucucagcugguuu

SEQ ID NO: 664360 - RNA, 18 nt, Human
cacucggcccgcccugcg

SEQ ID NO: 664361 - RNA, 24 nt, Human
ccacgcuucuuucccccgcgcccc

SEQ ID NO: 664362 - RNA, 25 nt, Human
ccccaggccagcagcggaaguccac

SEQ ID NO: 664363 - RNA, 23 nt, Human
ccugagagcggcguucuacgcgg

SEQ ID NO: 664364 - RNA, 23 nt, Human
ccuggcccuggugagagacugaa

SEQ ID NO: 664365 - RNA, 21 nt, Human
cgccaagacggcugggaagcc

SEQ ID NO: 664366 - RNA, 27 nt, Human
cgcccugcgacuuugaaaccggugccc

SEQ ID NO: 664367 - RNA, 22 nt, Human
cgcgaaauaacacaagccuuaa

SEQ ID NO: 664368 - RNA, 23 nt, Human
cggcggggguuggagaggacaac

SEQ ID NO: 664369 - RNA, 18 nt, Human
cuacgcggagcggcgggg

SEQ ID NO: 664370 - RNA, 19 nt, Human
cuaguccaacugcuuuccc

SEQ ID NO: 664371 - RNA, 21 nt, Human
cuccuuggagacgguggcgcc

SEQ ID NO: 664372 - RNA, 23 nt, Human
cuggggacuccacguucaaccga

SEQ ID NO: 664373 - RNA, 20 nt, Human
gaaguccacucggcccgccc

SEQ ID NO: 664374 - RNA, 20 nt, Human
gacugaagauugcuggggac

SEQ ID NO: 664375 - RNA, 30 nt, Human
gggaagccccaggccagcagcggaaguccc

SEQ ID NO: 664376 - RNA, 21 nt, Human
uacacuucuaguccaacugcu

SEQ ID NO: 664377 - RNA, 19 nt, Human
uacaggaaguggucacugc

SEQ ID NO: 664378 - RNA, 26 nt, Human
uacaggaaguggucacugcucuguuu

SEQ ID NO: 664379 - RNA, 20 nt, Human
uaggagagugccgcgggagc

SEQ ID NO: 664380 - RNA, 19 nt, Human
uaguuuagagcuuucacca

SEQ ID NO: 664381 - RNA, 20 nt, Human
ucccaacucuaaaguucugu

SEQ ID NO: 664382 - RNA, 20 nt, Human
uccuuggagacgguggcgcc

SEQ ID NO: 664383 - RNA, 23 nt, Human
ucuuuacuuacaggaagugguca

SEQ ID NO: 664384 - RNA, 23 nt, Human
ugcaaucugcauccuacucacgc

SEQ ID NO: 664385 - RNA, 24 nt, Human
ugccccggaccacuccuuggagac

SEQ ID NO: 664386 - RNA, 18 nt, Human
ugcgggaaaacaaaacua

SEQ ID NO: 664387 - RNA, 23 nt, Human
ugcucuguuuuccaauaacccuc

SEQ ID NO: 664388 - RNA, 24 nt, Human
ugcucuguuuuccaauaacccuca

SEQ ID NO: 664389 - RNA, 21 nt, Human
uggucacugcucuguuuucca

SEQ ID NO: 664390 - RNA, 18 nt, Human
uggugagagacugaagau

SEQ ID NO: 664391 - RNA, 27 nt, Human
uggugagagacugaagauugcugggga

SEQ ID NO: 664392 - RNA, 21 nt, Human
uggugggaagaggacgcgguc

SEQ ID NO: 664393 - RNA, 21 nt, Human
uucaauacacuucuaguccaa

SEQ ID NO: 664394 - RNA, 20 nt, Human
uugcuggggacuccacguuc

SEQ ID NO: 664395 - RNA, 21 nt, Human
uuggagacgguggcgccucuu

SEQ ID NO: 664396 - RNA, 24 nt, Human
uuucaccaccuuuaccuuccucug

SEQ ID NO: 664397 - RNA, 21 nt, Human
uuugcaggcuuuaccauuuca

SEQ ID NO: 664398 - RNA, 20 nt, Human
aaaaagauuucacagggaca

SEQ ID NO: 664399 - RNA, 19 nt, Human
aaaaggaaagguaugucac

SEQ ID NO: 664400 - RNA, 24 nt, Human
aaacaaacaaacaaacaaauaccc

SEQ ID NO: 664401 - RNA, 21 nt, Human
aaacaaacaaacaaauaccca

SEQ ID NO: 664402 - RNA, 27 nt, Human
aaacacugauaaagugucuuuaaacaa

SEQ ID NO: 664403 - RNA, 19 nt, Human
aaauaugcuugagauggau

SEQ ID NO: 664404 - RNA, 20 nt, Human
aacaaugaauacuuuuacua

SEQ ID NO: 664405 - RNA, 18 nt, Human
aagaggaaaguuguuccu

SEQ ID NO: 664406 - RNA, 24 nt, Human
aauguacauguguacaugugcaca

SEQ ID NO: 664407 - RNA, 19 nt, Human
acaaagacacacucccuca

SEQ ID NO: 664408 - RNA, 21 nt, Human
acauuuuaccuaaaugcaugu

SEQ ID NO: 664409 - RNA, 21 nt, Human
agacaucucucuggccaaaau

SEQ ID NO: 664410 - RNA, 23 nt, Human
agcaacaaucauucagcauucac

SEQ ID NO: 664411 - RNA, 20 nt, Human
aggaagccgguccugcggga

SEQ ID NO: 664412 - RNA, 23 nt, Human
aggccgugagagucggcgaggaa

SEQ ID NO: 664413 - RNA, 23 nt, Human
caaacaaacaaauacccauagaa

SEQ ID NO: 664414 - RNA, 21 nt, Human
caaagacacacucccucaagg

SEQ ID NO: 664415 - RNA, 19 nt, Human
caaccacagcagccgcaac

SEQ ID NO: 664416 - RNA, 18 nt, Human
caacccgccaaaugacaa

SEQ ID NO: 664417 - RNA, 20 nt, Human
caauucacugcauauaaaug

SEQ ID NO: 664418 - RNA, 23 nt, Human
cacagaaaauucacagaaccuaa

SEQ ID NO: 664419 - RNA, 24 nt, Human
caccaggucucuccccucgauuau

SEQ ID NO: 664420 - RNA, 27 nt, Human
cacugcauauaaauguacauguguaca

SEQ ID NO: 664421 - RNA, 20 nt, Human
cagccgcaaccuaacggcgg

SEQ ID NO: 664422 - RNA, 18 nt, Human
cccaggaaggguuuugca

SEQ ID NO: 664423 - RNA, 22 nt, Human
ccuaaaugcauguuaaccacca

SEQ ID NO: 664424 - RNA, 20 nt, Human
cggcgccgccucugcgcgcc

SEQ ID NO: 664425 - RNA, 21 nt, Human
cuaacggcggacgaagacugg

SEQ ID NO: 664426 - RNA, 25 nt, Human
cugccauaaaaagauuucacaggga

SEQ ID NO: 664427 - RNA, 24 nt, Human
cuuuauauuucucacaaagacaca

SEQ ID NO: 664428 - RNA, 19 nt, Human
gacaucucucuggccaaaa

SEQ ID NO: 664429 - RNA, 22 nt, Human
gcauucacuaauucagugugca

SEQ ID NO: 664430 - RNA, 24 nt, Human
gccaaaugacaaacugucauaaac

SEQ ID NO: 664431 - RNA, 19 nt, Human
gcgcgccgugaggacacag

SEQ ID NO: 664432 - RNA, 20 nt, Human
gcucugggcugcgagggacc

SEQ ID NO: 664433 - RNA, 19 nt, Human
gguccaacucuccuggcuc

SEQ ID NO: 664434 - RNA, 21 nt, Human
gguccuauccuccucacuguc

SEQ ID NO: 664435 - RNA, 26 nt, Human
guggccccugucuggcguucuacccc

SEQ ID NO: 664436 - RNA, 25 nt, Human
uaaacaaacaaacaaacaaauaccc

SEQ ID NO: 664437 - RNA, 24 nt, Human
uaagacaucucucuggccaaaaua

SEQ ID NO: 664438 - RNA, 24 nt, Human
uaagaggaaaguuguuccugacau

SEQ ID NO: 664439 - RNA, 21 nt, Human
uacauguguacaugugcacau

SEQ ID NO: 664440 - RNA, 18 nt, Human
uauucaagaaacacugau

SEQ ID NO: 664441 - RNA, 22 nt, Human
ucaagccuuuauauuucucaca

SEQ ID NO: 664442 - RNA, 23 nt, Human
uccaucccccaacccgccaaaug

SEQ ID NO: 664443 - RNA, 22 nt, Human
uccccuagcaacaaucauucag

SEQ ID NO: 664444 - RNA, 21 nt, Human
ucuagauuguuuccuccaucu

SEQ ID NO: 664445 - RNA, 21 nt, Human
ucuuuaaacaaacaaacaaac

SEQ ID NO: 664446 - RNA, 18 nt, Human
ugacaagugauuaccugc

SEQ ID NO: 664447 - RNA, 18 nt, Human
ugacauaaaagcguguaa

SEQ ID NO: 664448 - RNA, 22 nt, Human
ugcacagaaaauucacagaacc

SEQ ID NO: 664449 - RNA, 18 nt, Human
uggcaaccacagcagccg

SEQ ID NO: 664450 - RNA, 20 nt, Human
ugguccaacucuccuggcuc

SEQ ID NO: 664451 - RNA, 19 nt, Human
ugguugauaaaaauguuug

SEQ ID NO: 664452 - RNA, 24 nt, Human
ugguugauaaaaauguuuggauca

SEQ ID NO: 664453 - RNA, 19 nt, Human
uguguacaugugcacaugu

SEQ ID NO: 664454 - RNA, 20 nt, Human
uguguacaugugcacaugug

SEQ ID NO: 664455 - RNA, 18 nt, Human
uuagagauauauauaugu

SEQ ID NO: 664456 - RNA, 24 nt, Human
uuagagauauauauauguaaaaca

SEQ ID NO: 664457 - RNA, 26 nt, Human
uuauacucaaaaggaaagguauguca

SEQ ID NO: 664458 - RNA, 24 nt, Human
aacuaaagaauaccagggcaacag

SEQ ID NO: 664459 - RNA, 23 nt, Human
aagaauaccagggcaacagaaug

SEQ ID NO: 664460 - RNA, 19 nt, Human
aagacuaaucaagcuguag

SEQ ID NO: 664461 - RNA, 21 nt, Human
aaugcaguuaucuugaaaugc

SEQ ID NO: 664462 - RNA, 26 nt, Human
agaaagaagauguaauggcuacaaaa

SEQ ID NO: 664463 - RNA, 20 nt, Human
agaaugcaguuaucuugaaa

SEQ ID NO: 664464 - RNA, 21 nt, Human
agagaagaagaaagaagaugu

SEQ ID NO: 664465 - RNA, 19 nt, Human
agagauuguagcucgggug

SEQ ID NO: 664466 - RNA, 20 nt, Human
agcucggguguggugcgguu

SEQ ID NO: 664467 - RNA, 18 nt, Human
agggguuaaaaacuaaau

SEQ ID NO: 664468 - RNA, 21 nt, Human
caaaaacaagacuaaucaagc

SEQ ID NO: 664469 - RNA, 23 nt, Human
cacaccuguuacgaagccaaaag

SEQ ID NO: 664470 - RNA, 24 nt, Human
cagcggaacccagaucaggccgcu

SEQ ID NO: 664471 - RNA, 21 nt, Human
caggcggauucagcgagauuu

SEQ ID NO: 664472 - RNA, 22 nt, Human
cgaaaggaaucagcggaaccca

SEQ ID NO: 664473 - RNA, 25 nt, Human
cgaaaggaaucagcggaacccagau

SEQ ID NO: 664474 - RNA, 19 nt, Human
cuaaagaauaccagggcaa

SEQ ID NO: 664475 - RNA, 20 nt, Human
gaugauaggaaaaggagaga

SEQ ID NO: 664476 - RNA, 24 nt, Human
gaugauaggaaaaggagagaagaa

SEQ ID NO: 664477 - RNA, 22 nt, Human
gcaaugcugaaaugucuuuagu

SEQ ID NO: 664478 - RNA, 19 nt, Human
ggaaucagcggaacccaga

SEQ ID NO: 664479 - RNA, 18 nt, Human
ggcaacagaaugcaguua

SEQ ID NO: 664480 - RNA, 20 nt, Human
ggcuacaaaaacaagacuaa

SEQ ID NO: 664481 - RNA, 26 nt, Human
guuacgaaaggaaucagcggaaccca

SEQ ID NO: 664482 - RNA, 21 nt, Human
uagcaacuugauaagcaaugc

SEQ ID NO: 664483 - RNA, 18 nt, Human
ucaggguuaaacugcuga

SEQ ID NO: 664484 - RNA, 23 nt, Human
ucaguuaaaaaaauacucucuca

SEQ ID NO: 664485 - RNA, 23 nt, Human
ucccaacuaaagaauaccagggc

SEQ ID NO: 664486 - RNA, 18 nt, Human
uccugggucuccagugcc

SEQ ID NO: 664487 - RNA, 18 nt, Human
ugaaaugcacaccuguua

SEQ ID NO: 664488 - RNA, 22 nt, Human
ugaaaugcacaccuguuacgaa

SEQ ID NO: 664489 - RNA, 18 nt, Human
ugacugccauccucaauc

SEQ ID NO: 664490 - RNA, 28 nt, Human
ugccaacccacguccauauauggucacc

SEQ ID NO: 664491 - RNA, 20 nt, Human
uggaugauaggaaaaggaga

SEQ ID NO: 664492 - RNA, 18 nt, Human
uucacagaauacguccgu

SEQ ID NO: 664493 - RNA, 18 nt, Human
aaaaagccaaaaagaaau

SEQ ID NO: 664494 - RNA, 19 nt, Human
aaaaaugagaauaggaagg

SEQ ID NO: 664495 - RNA, 24 nt, Human
aaaaauucuccaccaaagcacauc

SEQ ID NO: 664496 - RNA, 23 nt, Human
aaagugcugggauuagaggcgug

SEQ ID NO: 664497 - RNA, 24 nt, Human
aaagugcugggauuagaggcgugg

SEQ ID NO: 664498 - RNA, 25 nt, Human
aaagugcugggauuagaggcguggg

SEQ ID NO: 664499 - RNA, 19 nt, Human
aaccaccccaauggacucu

SEQ ID NO: 664500 - RNA, 18 nt, Human
aagcugcucauuggaaac

SEQ ID NO: 664501 - RNA, 21 nt, Human
aaguaauucuccugccucagc

SEQ ID NO: 664502 - RNA, 25 nt, Human
aaguagccucacauuuucuuagagc

SEQ ID NO: 664503 - RNA, 19 nt, Human
aagugcugggauuagaggc

SEQ ID NO: 664504 - RNA, 20 nt, Human
aaugguaccuucugggcacc

SEQ ID NO: 664505 - RNA, 24 nt, Human
aaugguaccuucugggcaccugcu

SEQ ID NO: 664506 - RNA, 18 nt, Human
acaaggaaaaaauucucc

SEQ ID NO: 664507 - RNA, 21 nt, Human
acaggguuucaccauguuggu

SEQ ID NO: 664508 - RNA, 23 nt, Human
acaggguuucaccauguugguca

SEQ ID NO: 664509 - RNA, 24 nt, Human
acaggguuucaccauguuggucag

SEQ ID NO: 664510 - RNA, 24 nt, Human
accauguuggucaggcuggucucg

SEQ ID NO: 664511 - RNA, 20 nt, Human
acccagaggugcucugagaa

SEQ ID NO: 664512 - RNA, 24 nt, Human
agaaguagccucacauuuucuuag

SEQ ID NO: 664513 - RNA, 24 nt, Human
agcaaccuccuugcagacuucagc

SEQ ID NO: 664514 - RNA, 23 nt, Human
agcugggauuacaggugugugcc

SEQ ID NO: 664515 - RNA, 22 nt, Human
aggaaaaaauucuccaccaaag

SEQ ID NO: 664516 - RNA, 25 nt, Human
aggaaaaccacuauuuuuuuuucuc

SEQ ID NO: 664517 - RNA, 23 nt, Human
aggagaagagaagagaaaaaugu

SEQ ID NO: 664518 - RNA, 19 nt, Human
aggcaaaaaagccaaaagg

SEQ ID NO: 664519 - RNA, 20 nt, Human
aggcgugggcuaccacaccc

SEQ ID NO: 664520 - RNA, 25 nt, Human
aggcuggagugcaguagcgcaaucu

SEQ ID NO: 664521 - RNA, 23 nt, Human
aguagcugggauuacaggugugu

SEQ ID NO: 664522 - RNA, 25 nt, Human
aguagcugggauuacaggugugugc

SEQ ID NO: 664523 - RNA, 20 nt, Human
agugcaguagcgcaaucuag

SEQ ID NO: 664524 - RNA, 20 nt, Human
aguggaguuaaaugaugugg

SEQ ID NO: 664525 - RNA, 21 nt, Human
auccacagcaaaccuuggcag

SEQ ID NO: 664526 - RNA, 23 nt, Human
augagacagagucucccucuguu

SEQ ID NO: 664527 - RNA, 24 nt, Human
augucugcaggccuaggaggggac

SEQ ID NO: 664528 - RNA, 24 nt, Human
auuuuuguauuuuuaguagagaca

SEQ ID NO: 664529 - RNA, 19 nt, Human
caaagguagauaaagagcc

SEQ ID NO: 664530 - RNA, 24 nt, Human
caaagugcugggauuagaggcgug

SEQ ID NO: 664531 - RNA, 24 nt, Human
caacacgcccagcuaauuuuugua

SEQ ID NO: 664532 - RNA, 22 nt, Human
cacaucgacacguuuguccucc

SEQ ID NO: 664533 - RNA, 21 nt, Human
caccauguuggucaggcuggu

SEQ ID NO: 664534 - RNA, 24 nt, Human
caccauguuggucaggcuggucuc

SEQ ID NO: 664535 - RNA, 26 nt, Human
cacguuuguccuccccaccccuuuuu

SEQ ID NO: 664536 - RNA, 20 nt, Human
cagccuccugaguagcuggg

SEQ ID NO: 664537 - RNA, 21 nt, Human
caggagagugaaaaucucccg

SEQ ID NO: 664538 - RNA, 24 nt, Human
caggguuucaccauguuggucagg

SEQ ID NO: 664539 - RNA, 18 nt, Human
caguagcgcaaucuaggc

SEQ ID NO: 664540 - RNA, 20 nt, Human
caugcaggggaaaauaaauc

SEQ ID NO: 664541 - RNA, 23 nt, Human
ccaaaaagaaaugggaaaggaca

SEQ ID NO: 664542 - RNA, 22 nt, Human
ccaaagugcugggauuagaggc

SEQ ID NO: 664543 - RNA, 24 nt, Human
ccaaagugcugggauuagaggcgu

SEQ ID NO: 664544 - RNA, 20 nt, Human
ccaacacgcccagcuaauuu

SEQ ID NO: 664545 - RNA, 25 nt, Human
ccacagcaaaccuuggcaggaacau

SEQ ID NO: 664546 - RNA, 23 nt, Human
ccaggcauuucacuuuguuuuuu

SEQ ID NO: 664547 - RNA, 21 nt, Human
ccccaccccuuuuuaacugaa

SEQ ID NO: 664548 - RNA, 21 nt, Human
ccgcaaagguagauaaagagc

SEQ ID NO: 664549 - RNA, 24 nt, Human
ccgccucagccucccaaagugcug

SEQ ID NO: 664550 - RNA, 22 nt, Human
ccugaguagcugggauuacagg

SEQ ID NO: 664551 - RNA, 23 nt, Human
ccugaguagcugggauuacaggu

SEQ ID NO: 664552 - RNA, 24 nt, Human
ccugaguagcugggauuacaggug

SEQ ID NO: 664553 - RNA, 24 nt, Human
cgccucagccucccaaagugcugg

SEQ ID NO: 664554 - RNA, 24 nt, Human
cucagccuccugaguagcugggau

SEQ ID NO: 664555 - RNA, 26 nt, Human
cuccccgccucagccucccaaagugc

SEQ ID NO: 664556 - RNA, 24 nt, Human
cucccucuguugccuaggcuggag

SEQ ID NO: 664557 - RNA, 21 nt, Human
cuccguccggaccaagcgucc

SEQ ID NO: 664558 - RNA, 24 nt, Human
cuccugaccuugugaucuccccgc

SEQ ID NO: 664559 - RNA, 21 nt, Human
cugaguagcugggauuacagg

SEQ ID NO: 664560 - RNA, 24 nt, Human
cugaguagcugggauuacaggugu

SEQ ID NO: 664561 - RNA, 23 nt, Human
cugccucagccuccugaguagcu

SEQ ID NO: 664562 - RNA, 27 nt, Human
cuugugaucuccccgccucagccuccc

SEQ ID NO: 664563 - RNA, 19 nt, Human
gaagaagaggaguggagag

SEQ ID NO: 664564 - RNA, 18 nt, Human
gacacguuuguccucccc

SEQ ID NO: 664565 - RNA, 23 nt, Human
gacacguuuguccuccccacccc

SEQ ID NO: 664566 - RNA, 24 nt, Human
gaccuugugaucuccccgccucag

SEQ ID NO: 664567 - RNA, 22 nt, Human
gacgucaggagaagagaagaga

SEQ ID NO: 664568 - RNA, 23 nt, Human
gagaauaggaaggaaguuuuugc

SEQ ID NO: 664569 - RNA, 22 nt, Human
gaguacuuaaauccaaaguucc

SEQ ID NO: 664570 - RNA, 19 nt, Human
gaguagcugggauuacagg

SEQ ID NO: 664571 - RNA, 19 nt, Human
gaguugaucuuucucuucc

SEQ ID NO: 664572 - RNA, 18 nt, Human
gauuacaggugugugcca

SEQ ID NO: 664573 - RNA, 20 nt, Human
gcaaaaaagccaaaaagaaa

SEQ ID NO: 664574 - RNA, 22 nt, Human
gcccagcuaauuuuuguauuuu

SEQ ID NO: 664575 - RNA, 20 nt, Human
gccuaggcuggagugcagua

SEQ ID NO: 664576 - RNA, 20 nt, Human
gccucagccuccugaguagc

SEQ ID NO: 664577 - RNA, 24 nt, Human
gcgcaaucuaggcuccccccgcag

SEQ ID NO: 664578 - RNA, 22 nt, Human
gcucacuuugucauuuuccccc

SEQ ID NO: 664579 - RNA, 24 nt, Human
gcuggagugcaguagcgcaaucua

SEQ ID NO: 664580 - RNA, 19 nt, Human
ggauuuucuuuaagcaagc

SEQ ID NO: 664581 - RNA, 23 nt, Human
ggcuggucucgaucuccugaccu

SEQ ID NO: 664582 - RNA, 24 nt, Human
gggaaaauaaaucaaagagaaggc

SEQ ID NO: 664583 - RNA, 19 nt, Human
gggcuaaaagguggaggca

SEQ ID NO: 664584 - RNA, 21 nt, Human
gggcuaaaagguggaggcaaa

SEQ ID NO: 664585 - RNA, 22 nt, Human
ggguuucaccauguuggucagg

SEQ ID NO: 664586 - RNA, 20 nt, Human
ggucucgaucuccugaccuu

SEQ ID NO: 664587 - RNA, 24 nt, Human
guaauucuccugccucagccuccu

SEQ ID NO: 664588 - RNA, 18 nt, Human
guagcugggauuacaggu

SEQ ID NO: 664589 - RNA, 24 nt, Human
gugaucuccccgccucagccuccc

SEQ ID NO: 664590 - RNA, 21 nt, Human
uaagaaaaaaugagaauagga

SEQ ID NO: 664591 - RNA, 22 nt, Human
uaagaaaaaaugagaauaggaa

SEQ ID NO: 664592 - RNA, 18 nt, Human
uaagcauggcaugaaacc

SEQ ID NO: 664593 - RNA, 20 nt, Human
uaauucuccugccucagccu

SEQ ID NO: 664594 - RNA, 24 nt, Human
uaauuuuuguauuuuuaguagaga

SEQ ID NO: 664595 - RNA, 18 nt, Human
uacaaaggagcagaucau

SEQ ID NO: 664596 - RNA, 22 nt, Human
uagagacaggguuucaccaugu

SEQ ID NO: 664597 - RNA, 24 nt, Human
uaguagagacaggguuucaccaug

SEQ ID NO: 664598 - RNA, 25 nt, Human
uaguagagacaggguuucaccaugu

SEQ ID NO: 664599 - RNA, 18 nt, Human
ucacuuugucauuuuccc

SEQ ID NO: 664600 - RNA, 22 nt, Human
ucagaaccaggaauucugcacc

SEQ ID NO: 664601 - RNA, 21 nt, Human
ucagcccaagccagcaaccuc

SEQ ID NO: 664602 - RNA, 20 nt, Human
ucagccuccugaguagcugg

SEQ ID NO: 664603 - RNA, 21 nt, Human
ucauuggaaacaagagggccc

SEQ ID NO: 664604 - RNA, 21 nt, Human
uccacagcaaaccuuggcagg

SEQ ID NO: 664605 - RNA, 24 nt, Human
ucccaaagugcugggauuagaggc

SEQ ID NO: 664606 - RNA, 24 nt, Human
ucccucuguugccuaggcuggagu

SEQ ID NO: 664607 - RNA, 24 nt, Human
uccugaguagcugggauuacaggu

SEQ ID NO: 664608 - RNA, 19 nt, Human
ucucccucuguugccuagg

SEQ ID NO: 664609 - RNA, 23 nt, Human
ucucccucuguugccuaggcugg

SEQ ID NO: 664610 - RNA, 24 nt, Human
ucucccucuguugccuaggcugga

SEQ ID NO: 664611 - RNA, 24 nt, Human
ucuccugccucagccuccugagua

SEQ ID NO: 664612 - RNA, 21 nt, Human
ucucuaaacgccauucaauuc

SEQ ID NO: 664613 - RNA, 21 nt, Human
ucugcaccucucucuaagcuc

SEQ ID NO: 664614 - RNA, 22 nt, Human
ucugcaggccuaggaggggacu

SEQ ID NO: 664615 - RNA, 24 nt, Human
ucuguugccuaggcuggagugcag

SEQ ID NO: 664616 - RNA, 18 nt, Human
ugagaagcagguaaauca

SEQ ID NO: 664617 - RNA, 22 nt, Human
ugagacagagucucccucuguu

SEQ ID NO: 664618 - RNA, 24 nt, Human
ugagacagagucucccucuguugc

SEQ ID NO: 664619 - RNA, 23 nt, Human
ugcagacuucagccccacuguau

SEQ ID NO: 664620 - RNA, 19 nt, Human
ugccuaggcuggagugcag

SEQ ID NO: 664621 - RNA, 20 nt, Human
ugccuaggcuggagugcagu

SEQ ID NO: 664622 - RNA, 24 nt, Human
ugccuaggcuggagugcaguagcg

SEQ ID NO: 664623 - RNA, 24 nt, Human
ugccucagccuccugaguagcugg

SEQ ID NO: 664624 - RNA, 21 nt, Human
uggaagaagaggaguggagag

SEQ ID NO: 664625 - RNA, 24 nt, Human
uggagugcaguagcgcaaucuagg

SEQ ID NO: 664626 - RNA, 19 nt, Human
ugggauuacaggugugugc

SEQ ID NO: 664627 - RNA, 21 nt, Human
ugggauuacaggugugugcca

SEQ ID NO: 664628 - RNA, 18 nt, Human
ugggauuagaggcguggg

SEQ ID NO: 664629 - RNA, 19 nt, Human
ugggauuagaggcgugggc

SEQ ID NO: 664630 - RNA, 22 nt, Human
ugggauuagaggcgugggcuac

SEQ ID NO: 664631 - RNA, 23 nt, Human
ugggauuagaggcgugggcuacc

SEQ ID NO: 664632 - RNA, 24 nt, Human
ugggauuagaggcgugggcuacca

SEQ ID NO: 664633 - RNA, 24 nt, Human
uggucaggcuggucucgaucuccu

SEQ ID NO: 664634 - RNA, 19 nt, Human
uguauguuuucuaggucuc

SEQ ID NO: 664635 - RNA, 24 nt, Human
ugugaucuccccgccucagccucc

SEQ ID NO: 664636 - RNA, 18 nt, Human
uguguccagugagaaagu

SEQ ID NO: 664637 - RNA, 20 nt, Human
uguugccuaggcuggagugc

SEQ ID NO: 664638 - RNA, 18 nt, Human
uuagagcucacuuuguca

SEQ ID NO: 664639 - RNA, 24 nt, Human
uuaguagagacaggguuucaccau

SEQ ID NO: 664640 - RNA, 24 nt, Human
uucaauucucuccucucuuuaauu

SEQ ID NO: 664641 - RNA, 20 nt, Human
uucacucccucaugucugca

SEQ ID NO: 664642 - RNA, 22 nt, Human
uucccagcgccgagcuccgucc

SEQ ID NO: 664643 - RNA, 24 nt, Human
uuccuggaaaaauaggauguaaaa

SEQ ID NO: 664644 - RNA, 20 nt, Human
uugaucuuucucuuccuuug

SEQ ID NO: 664645 - RNA, 24 nt, Human
uuucaccauguuggucaggcuggu

SEQ ID NO: 664646 - RNA, 22 nt, Human
uuucugaacugcuucucacaug

SEQ ID NO: 664647 - RNA, 21 nt, Human
uuugcaaacaaggaaaaccac

SEQ ID NO: 664648 - RNA, 24 nt, Human
uuugcaaacaaggaaaaccacuau

SEQ ID NO: 664649 - RNA, 24 nt, Human
uuuuuaguagagacaggguuucac

SEQ ID NO: 664650 - RNA, 20 nt, Human
uuuuuguauuuuuaguagag

SEQ ID NO: 664651 - RNA, 19 nt, Human
aaguuuguugagaauuuau

SEQ ID NO: 664652 - RNA, 21 nt, Human
agagauauaccaccccccagc

SEQ ID NO: 664653 - RNA, 22 nt, Human
ccaccccccagcuaagaguggg

SEQ ID NO: 664654 - RNA, 18 nt, Human
ccaguauuuuucugcugu

SEQ ID NO: 664655 - RNA, 20 nt, Human
cccucccucccggccgccca

SEQ ID NO: 664656 - RNA, 24 nt, Human
cccuccgagcgucuggcggcccgg

SEQ ID NO: 664657 - RNA, 18 nt, Human
ccucccggccgcccaguc

SEQ ID NO: 664658 - RNA, 22 nt, Human
cgcccucccucccggccgccca

SEQ ID NO: 664659 - RNA, 18 nt, Human
cggcccgggagccggcaa

SEQ ID NO: 664660 - RNA, 24 nt, Human
cgggagccggcaaacaacucaagc

SEQ ID NO: 664661 - RNA, 21 nt, Human
ggccagaggggcaguggggcc

SEQ ID NO: 664662 - RNA, 22 nt, Human
ggccgggcucccuccgagcguc

SEQ ID NO: 664663 - RNA, 19 nt, Human
ggugcacgucccggccgcg

SEQ ID NO: 664664 - RNA, 18 nt, Human
gucgugacccggggcgcc

SEQ ID NO: 664665 - RNA, 26 nt, Human
uaaaaaugccaguauuuuucugcugu

SEQ ID NO: 664666 - RNA, 21 nt, Human
uagagauauaccaccccccuc

SEQ ID NO: 664667 - RNA, 18 nt, Human
ucccggccgcccaguccg

SEQ ID NO: 664668 - RNA, 22 nt, Human
ucugugucucugaguuugugug

SEQ ID NO: 664669 - RNA, 20 nt, Human
ugacccggggcgcccucccu

SEQ ID NO: 664670 - RNA, 19 nt, Human
ugugucucugaguuugugu

SEQ ID NO: 664671 - RNA, 28 nt, Human
acacggccuccuccccaccagguccucc

SEQ ID NO: 664672 - RNA, 26 nt, Human
acagaacugguggaagaucuccuucc

SEQ ID NO: 664673 - RNA, 19 nt, Human
agaaacauuuaggacucag

SEQ ID NO: 664674 - RNA, 21 nt, Human
agguccucccacacuggccuc

SEQ ID NO: 664675 - RNA, 21 nt, Human
caccagguccucccacacugg

SEQ ID NO: 664676 - RNA, 24 nt, Human
caccagguccucccacacuggccu

SEQ ID NO: 664677 - RNA, 18 nt, Human
cacuccucagcccacucc

SEQ ID NO: 664678 - RNA, 18 nt, Human
cacuggccucuccccggc

SEQ ID NO: 664679 - RNA, 23 nt, Human
cacuggccucuccccggccuucc

SEQ ID NO: 664680 - RNA, 19 nt, Human
cagcccacucccgaccugc

SEQ ID NO: 664681 - RNA, 20 nt, Human
ccacuccucagcccacuccc

SEQ ID NO: 664682 - RNA, 25 nt, Human
cccccggaggacacaaaggggccgg

SEQ ID NO: 664683 - RNA, 20 nt, Human
ccccggaggacacaaagggg

SEQ ID NO: 664684 - RNA, 21 nt, Human
ccccggccuuccagagagccc

SEQ ID NO: 664685 - RNA, 22 nt, Human
ccucccacacuggccucucccc

SEQ ID NO: 664686 - RNA, 20 nt, Human
cgagcuuccggagacccaca

SEQ ID NO: 664687 - RNA, 21 nt, Human
cggugcagcuccgcgcagggu

SEQ ID NO: 664688 - RNA, 21 nt, Human
cugcagcuccgagccuggccc

SEQ ID NO: 664689 - RNA, 23 nt, Human
cugcagcuccgagccuggcccgg

SEQ ID NO: 664690 - RNA, 21 nt, Human
cuggccucuccccggccuucc

SEQ ID NO: 664691 - RNA, 18 nt, Human
cugguggaagaucuccuu

SEQ ID NO: 664692 - RNA, 23 nt, Human
cuuccggagacccacacgccacu

SEQ ID NO: 664693 - RNA, 24 nt, Human
gaagcgccucagcugccuccgccc

SEQ ID NO: 664694 - RNA, 23 nt, Human
gcagcagcggugcagcuccgcgc

SEQ ID NO: 664695 - RNA, 19 nt, Human
gcagcuccgagccuggccc

SEQ ID NO: 664696 - RNA, 20 nt, Human
gcagcuccgcgcaggguuug

SEQ ID NO: 664697 - RNA, 20 nt, Human
gccuccuccccaccaggucc

SEQ ID NO: 664698 - RNA, 25 nt, Human
ggaaauagcaguggccucagaugac

SEQ ID NO: 664699 - RNA, 21 nt, Human
ggccuccuccccaccaggucc

SEQ ID NO: 664700 - RNA, 19 nt, Human
guaacacggccuccucccc

SEQ ID NO: 664701 - RNA, 20 nt, Human
gucgcagugucuggcagcag

SEQ ID NO: 664702 - RNA, 19 nt, Human
uagaaaaggucgcggcguc

SEQ ID NO: 664703 - RNA, 23 nt, Human
uagcaguggccucagaugacucc

SEQ ID NO: 664704 - RNA, 20 nt, Human
uaguuggauggaacccagcc

SEQ ID NO: 664705 - RNA, 18 nt, Human
ucagaccaaggugacaac

SEQ ID NO: 664706 - RNA, 18 nt, Human
ucagaccaaggugacaac

SEQ ID NO: 664707 - RNA, 18 nt, Human
uccccaccagguccuccc

SEQ ID NO: 664708 - RNA, 20 nt, Human
ucccugcagcuccgagccug

SEQ ID NO: 664709 - RNA, 24 nt, Human
ucuggcagcagcggugcagcuccu

SEQ ID NO: 664710 - RNA, 22 nt, Human
ucuuucuuccuccuggcucuuc

SEQ ID NO: 664711 - RNA, 18 nt, Human
uguaacacggccuccucc

SEQ ID NO: 664712 - RNA, 18 nt, Human
uucccugcagcuccgagc

SEQ ID NO: 664713 - RNA, 18 nt, Human
uucuagaaacauuuagga

SEQ ID NO: 664714 - RNA, 19 nt, Human
uuguaacacggccuccucc

SEQ ID NO: 664715 - RNA, 21 nt, Human
uuucuuccuccuggcucuucu

SEQ ID NO: 664716 - RNA, 21 nt, Human
aaaauuccuccaguguagcuu

SEQ ID NO: 664717 - RNA, 24 nt, Human
agacuugaauagcauguuuagugg

SEQ ID NO: 664718 - RNA, 21 nt, Human
auaaaaauuccuccaguguag

SEQ ID NO: 664719 - RNA, 18 nt, Human
auguuuagugcauaugag

SEQ ID NO: 664720 - RNA, 18 nt, Human
cacaucucuuggcauguu

SEQ ID NO: 664721 - RNA, 18 nt, Human
cacuggcauuacauucuu

SEQ ID NO: 664722 - RNA, 20 nt, Human
cauguauaugcaugcauuca

SEQ ID NO: 664723 - RNA, 24 nt, Human
cauuucacaucucuuggcauguua

SEQ ID NO: 664724 - RNA, 23 nt, Human
cauuuuugacaauuaugaucuga

SEQ ID NO: 664725 - RNA, 18 nt, Human
ccgcgcccccggcagccc

SEQ ID NO: 664726 - RNA, 21 nt, Human
ccgcgcccccggcagcccagg

SEQ ID NO: 664727 - RNA, 23 nt, Human
ccgcgcccccggcagcccagggc

SEQ ID NO: 664728 - RNA, 24 nt, Human
cgcccccggcagcccagggcgcgc

SEQ ID NO: 664729 - RNA, 19 nt, Human
cgcgcccccggcagcccag

SEQ ID NO: 664730 - RNA, 21 nt, Human
cggccgcgcccccggcagccc

SEQ ID NO: 664731 - RNA, 18 nt, Human
cucacaucucuuuggcca

SEQ ID NO: 664732 - RNA, 19 nt, Human
cuucugguuccucucuugg

SEQ ID NO: 664733 - RNA, 22 nt, Human
gagcugccgccuccucgggucc

SEQ ID NO: 664734 - RNA, 19 nt, Human
gccgcgcccccggcagccc

SEQ ID NO: 664735 - RNA, 23 nt, Human
guccaagugccaccgcggccgcg

SEQ ID NO: 664736 - RNA, 24 nt, Human
uaaaauuuucuuugauaugaauuu

SEQ ID NO: 664737 - RNA, 23 nt, Human
uaacuuuugcucuugauaaaauu

SEQ ID NO: 664738 - RNA, 18 nt, Human
uagaauuucaagggcuga

SEQ ID NO: 664739 - RNA, 18 nt, Human
uauaaaaauuccuccagu

SEQ ID NO: 664740 - RNA, 24 nt, Human
uauaugcaugcauucaaaggcuau

SEQ ID NO: 664741 - RNA, 20 nt, Human
uccaagugccaccgcggccg

SEQ ID NO: 664742 - RNA, 22 nt, Human
uccaagugccaccgcggccgcg

SEQ ID NO: 664743 - RNA, 20 nt, Human
ucucuuggggaagggcagag

SEQ ID NO: 664744 - RNA, 22 nt, Human
ugaucugaacaauuuacaucca

SEQ ID NO: 664745 - RNA, 22 nt, Human
uggaauguguuagaaauaaaau

SEQ ID NO: 664746 - RNA, 22 nt, Human
ugguuccucucuuggggaaggg

SEQ ID NO: 664747 - RNA, 19 nt, Human
uucaagggcugauaggucc

SEQ ID NO: 664748 - RNA, 20 nt, Human
uucacugccuggauguuugg

SEQ ID NO: 664749 - RNA, 21 nt, Human
uucauguauaugcaugcauuc

SEQ ID NO: 664750 - RNA, 25 nt, Human
uuuagaauuucaagggcugauaggu

SEQ ID NO: 664751 - RNA, 21 nt, Human
uuuucagacuuaggauaaagg

SEQ ID NO: 664752 - RNA, 22 nt, Human
aaaaacaaaacaaaacaaaaac

SEQ ID NO: 664753 - RNA, 20 nt, Human
aaaacaaaacaaaacaaaaa

SEQ ID NO: 664754 - RNA, 21 nt, Human
aaaacaaaacaaaacaaaaac

SEQ ID NO: 664755 - RNA, 21 nt, Human
aaaagcuauaaaagagaccuu

SEQ ID NO: 664756 - RNA, 18 nt, Human
aaaauuagcugggcgugg

SEQ ID NO: 664757 - RNA, 19 nt, Human
aaacaaaacaaaacaaaaa

SEQ ID NO: 664758 - RNA, 23 nt, Human
aaacaaaacaaaacaaaaacuaa

SEQ ID NO: 664759 - RNA, 22 nt, Human
aacauggugaaaucccccgucu

SEQ ID NO: 664760 - RNA, 21 nt, Human
aagguggguggaucaugaggu

SEQ ID NO: 664761 - RNA, 24 nt, Human
aaguggcucuuauaaagguaaggu

SEQ ID NO: 664762 - RNA, 24 nt, Human
aaucauuugaacucaggaggcaga

SEQ ID NO: 664763 - RNA, 22 nt, Human
acaaaacaaaaacuaaggaagc

SEQ ID NO: 664764 - RNA, 18 nt, Human
acaaaacaaaacaaaaac

SEQ ID NO: 664765 - RNA, 18 nt, Human
acaaaacaaaacaaaaac

SEQ ID NO: 664766 - RNA, 21 nt, Human
acaaaacaaaacaaaaacuaa

SEQ ID NO: 664767 - RNA, 21 nt, Human
acacauuuucuaaaggaagcc

SEQ ID NO: 664768 - RNA, 24 nt, Human
acagagugagacuccaucucaaaa

SEQ ID NO: 664769 - RNA, 19 nt, Human
acagcucccgccggaagcc

SEQ ID NO: 664770 - RNA, 24 nt, Human
acucaggaggcagagguugcagug

SEQ ID NO: 664771 - RNA, 24 nt, Human
acugcauuccagccugggcgacag

SEQ ID NO: 664772 - RNA, 26 nt, Human
acugcauuccagccugggcgacagag

SEQ ID NO: 664773 - RNA, 18 nt, Human
agagguugcagugagcug

SEQ ID NO: 664774 - RNA, 22 nt, Human
agagguugcagugagcugagau

SEQ ID NO: 664775 - RNA, 23 nt, Human
agagguugcagugagcugagauc

SEQ ID NO: 664776 - RNA, 24 nt, Human
agagguugcagugagcugagauca

SEQ ID NO: 664777 - RNA, 20 nt, Human
agagguugcagugagcuggc

SEQ ID NO: 664778 - RNA, 24 nt, Human
agcacuuugggaggcuaagguggg

SEQ ID NO: 664779 - RNA, 24 nt, Human
agccuggccaacauggugaaaucc

SEQ ID NO: 664780 - RNA, 24 nt, Human
agccugggcgacagagugagacuc

SEQ ID NO: 664781 - RNA, 23 nt, Human
agcugggcgugguggcaggugcc

SEQ ID NO: 664782 - RNA, 20 nt, Human
aggcagagguugcagugagc

SEQ ID NO: 664783 - RNA, 24 nt, Human
aggcagagguugcagugagcugag

SEQ ID NO: 664784 - RNA, 18 nt, Human
aggcaggagaaucauuug

SEQ ID NO: 664785 - RNA, 21 nt, Human
aggcaggagaaucauuugaac

SEQ ID NO: 664786 - RNA, 20 nt, Human
aggcugaggcaggagaauca

SEQ ID NO: 664787 - RNA, 24 nt, Human
aggcugaggcaggagaaucauuug

SEQ ID NO: 664788 - RNA, 22 nt, Human
aggugcgguggcucacaccuaa

SEQ ID NO: 664789 - RNA, 18 nt, Human
aguggcagagcaagacuc

SEQ ID NO: 664790 - RNA, 22 nt, Human
aucaugaggucaggaguucaag

SEQ ID NO: 664791 - RNA, 24 nt, Human
aucaugccacugcauuccagccug

SEQ ID NO: 664792 - RNA, 24 nt, Human
aucggccaggugcgguggcucaca

SEQ ID NO: 664793 - RNA, 19 nt, Human
aucuacuccaucaaguggc

SEQ ID NO: 664794 - RNA, 22 nt, Human
augccacugcauuccagccugg

SEQ ID NO: 664795 - RNA, 22 nt, Human
auucaagaagcauauuuauaaa

SEQ ID NO: 664796 - RNA, 22 nt, Human
caaaacaaaacaaaaacuaagg

SEQ ID NO: 664797 - RNA, 25 nt, Human
caaaacaaaacaaaaacuaaggaag

SEQ ID NO: 664798 - RNA, 24 nt, Human
caaagauaccaaaauccaaauuua

SEQ ID NO: 664799 - RNA, 23 nt, Human
caacauggugaaaucccccgucu

SEQ ID NO: 664800 - RNA, 24 nt, Human
caagaccagccuggccaacauggu

SEQ ID NO: 664801 - RNA, 22 nt, Human
cacaccuaaucccagcacuuug

SEQ ID NO: 664802 - RNA, 19 nt, Human
cacugcauuccagccuggg

SEQ ID NO: 664803 - RNA, 22 nt, Human
cacugcauuccagccugggcga

SEQ ID NO: 664804 - RNA, 23 nt, Human
cacugcauuccagccugggcgac

SEQ ID NO: 664805 - RNA, 24 nt, Human
cacugcauuccagccugggcgaca

SEQ ID NO: 664806 - RNA, 19 nt, Human
cagagcaagacuccgucuc

SEQ ID NO: 664807 - RNA, 19 nt, Human
cagagcaagacuccgucuc

SEQ ID NO: 664808 - RNA, 24 nt, Human
cagcacuuugggaggcuaaggugg

SEQ ID NO: 664809 - RNA, 20 nt, Human
cagccugggcgacagaguga

SEQ ID NO: 664810 - RNA, 24 nt, Human
cagcuacucgggaggcugaggcag

SEQ ID NO: 664811 - RNA, 23 nt, Human
caucucaaaaaacaaaacaaaac

SEQ ID NO: 664812 - RNA, 26 nt, Human
caucucaaaaaacaaaacaaaacaaa

SEQ ID NO: 664813 - RNA, 22 nt, Human
cauuccagccugggcgacagag

SEQ ID NO: 664814 - RNA, 24 nt, Human
cauuccagccugggcgacagagug

SEQ ID NO: 664815 - RNA, 20 nt, Human
ccaaaauccaaauuuaaaga

SEQ ID NO: 664816 - RNA, 20 nt, Human
ccacugcauuccagccuggg

SEQ ID NO: 664817 - RNA, 21 nt, Human
ccacugcauuccagccugggc

SEQ ID NO: 664818 - RNA, 21 nt, Human
ccacugcauuccagccugggc

SEQ ID NO: 664819 - RNA, 23 nt, Human
ccacugcauuccagccugggcga

SEQ ID NO: 664820 - RNA, 24 nt, Human
ccacugcauuccagccugggcgac

SEQ ID NO: 664821 - RNA, 23 nt, Human
ccccgucuuuacuaaaaauacaa

SEQ ID NO: 664822 - RNA, 23 nt, Human
ccuggccaacauggugaaauccc

SEQ ID NO: 664823 - RNA, 24 nt, Human
ccuggccaacauggugaaaucccc

SEQ ID NO: 664824 - RNA, 26 nt, Human
ccuggccaacauggugaaaucccccg

SEQ ID NO: 664825 - RNA, 22 nt, Human
ccugggcgacagagugagacuc

SEQ ID NO: 664826 - RNA, 19 nt, Human
ccuguaaucccagcuacuc

SEQ ID NO: 664827 - RNA, 21 nt, Human
ccuguaaucccagcuacucgg

SEQ ID NO: 664828 - RNA, 22 nt, Human
ccuguaaucccagcuacucggg

SEQ ID NO: 664829 - RNA, 24 nt, Human
cggccaggugcgguggcucacacc

SEQ ID NO: 664830 - RNA, 24 nt, Human
cgggaggcugaggcaggagaauca

SEQ ID NO: 664831 - RNA, 23 nt, Human
cgguggcucacaccuaaucccag

SEQ ID NO: 664832 - RNA, 22 nt, Human
cucacaccuaaucccagcacuu

SEQ ID NO: 664833 - RNA, 23 nt, Human
cuccaucucaaaaaacaaaacaa

SEQ ID NO: 664834 - RNA, 24 nt, Human
gacagagugagacuccaucucaaa

SEQ ID NO: 664835 - RNA, 23 nt, Human
gagaaucauuugaacucaggagg

SEQ ID NO: 664836 - RNA, 21 nt, Human
gaggcagagguugcagugagc

SEQ ID NO: 664837 - RNA, 24 nt, Human
gaucaugaggucaggaguucaaga

SEQ ID NO: 664838 - RNA, 24 nt, Human
gcauuccagccugggcgacagagu

SEQ ID NO: 664839 - RNA, 25 nt, Human
gccaacauggugaaaucccccgucu

SEQ ID NO: 664840 - RNA, 22 nt, Human
gccacugcauuccagccugggc

SEQ ID NO: 664841 - RNA, 24 nt, Human
gccacugcauuccagccugggcga

SEQ ID NO: 664842 - RNA, 20 nt, Human
gcugagaucaugccacugca

SEQ ID NO: 664843 - RNA, 21 nt, Human
ggcagagcaagacuccgucuc

SEQ ID NO: 664844 - RNA, 21 nt, Human
ggcaggugccuguaaucccag

SEQ ID NO: 664845 - RNA, 24 nt, Human
gggcgugguggcaggugccuguaa

SEQ ID NO: 664846 - RNA, 23 nt, Human
gguggaucaugaggucaggaguu

SEQ ID NO: 664847 - RNA, 24 nt, Human
gguggcaggugccuguaaucccag

SEQ ID NO: 664848 - RNA, 23 nt, Human
gguggguggaucaugaggucagg

SEQ ID NO: 664849 - RNA, 20 nt, Human
guacuaaaauuuuuaaagga

SEQ ID NO: 664850 - RNA, 23 nt, Human
guggaucaugaggucaggaguuc

SEQ ID NO: 664851 - RNA, 22 nt, Human
guggcucacaccuaaucccagc

SEQ ID NO: 664852 - RNA, 24 nt, Human
uaagguggguggaucaugagguca

SEQ ID NO: 664853 - RNA, 24 nt, Human
uacaaaaccaaagauaccaaaauc

SEQ ID NO: 664854 - RNA, 25 nt, Human
uaccaaaauccaaauuuaaagaaac

SEQ ID NO: 664855 - RNA, 25 nt, Human
uauaaaagagaccuuuacuuuuuga

SEQ ID NO: 664856 - RNA, 18 nt, Human
ucaaagaaaaauuuagca

SEQ ID NO: 664857 - RNA, 24 nt, Human
ucaugaggucaggaguucaagacc

SEQ ID NO: 664858 - RNA, 23 nt, Human
ucaugccacugcauuccagccug

SEQ ID NO: 664859 - RNA, 23 nt, Human
uccaaaauuucugcuaaaaauuu

SEQ ID NO: 664860 - RNA, 19 nt, Human
uccagccugggcgacagag

SEQ ID NO: 664861 - RNA, 23 nt, Human
uccagccugggcgacagagugag

SEQ ID NO: 664862 - RNA, 24 nt, Human
uccagccugggcgacagagugaga

SEQ ID NO: 664863 - RNA, 26 nt, Human
ucccccgucuuuacuaaaaauacaaa

SEQ ID NO: 664864 - RNA, 19 nt, Human
ucggaaaaaaaaagaaaua

SEQ ID NO: 664865 - RNA, 25 nt, Human
ucgggaggcugaggcaggagaauca

SEQ ID NO: 664866 - RNA, 25 nt, Human
ucucaaaaaacaaaacaaaacaaaa

SEQ ID NO: 664867 - RNA, 24 nt, Human
ugagaucaugccacugcauuccag

SEQ ID NO: 664868 - RNA, 22 nt, Human
ugagcugagaucaugccacugc

SEQ ID NO: 664869 - RNA, 20 nt, Human
ugaggcaggagaaucauuug

SEQ ID NO: 664870 - RNA, 23 nt, Human
ugaggcaggagaaucauuugaac

SEQ ID NO: 664871 - RNA, 23 nt, Human
ugaggcaggagaaucauuugaac

SEQ ID NO: 664872 - RNA, 24 nt, Human
ugaggcaggagaaucauuugaacu

SEQ ID NO: 664873 - RNA, 24 nt, Human
ugccuguaaucccagcuacucggg

SEQ ID NO: 664874 - RNA, 22 nt, Human
uggaucaugaggucaggaguuc

SEQ ID NO: 664875 - RNA, 24 nt, Human
uggaucaugaggucaggaguucaa

SEQ ID NO: 664876 - RNA, 19 nt, Human
uggccaacauggugaaauc

SEQ ID NO: 664877 - RNA, 22 nt, Human
uggcucacaccuaaucccagca

SEQ ID NO: 664878 - RNA, 20 nt, Human
ugggaggcuaaggugggugg

SEQ ID NO: 664879 - RNA, 23 nt, Human
ugggaggcuaagguggguggauc

SEQ ID NO: 664880 - RNA, 24 nt, Human
ugggaggcuaagguggguggauca

SEQ ID NO: 664881 - RNA, 24 nt, Human
ugguggcaggugccuguaauccca

SEQ ID NO: 664882 - RNA, 23 nt, Human
ugugaacaagacuacuauuaucu

SEQ ID NO: 664883 - RNA, 25 nt, Human
ugugaacaagacuacuauuaucuaa

SEQ ID NO: 664884 - RNA, 24 nt, Human
uuagcugggcgugguggcaggugc

SEQ ID NO: 664885 - RNA, 21 nt, Human
uucaggagaaccucaaagaaa

SEQ ID NO: 664886 - RNA, 18 nt, Human
uugcagugagcugagauc

SEQ ID NO: 664887 - RNA, 20 nt, Human
uugcagugagcugagaucau

SEQ ID NO: 664888 - RNA, 21 nt, Human
uugcagugagcugagaucaug

SEQ ID NO: 664889 - RNA, 23 nt, Human
uugcagugagcugagaucaugcc

SEQ ID NO: 664890 - RNA, 25 nt, Human
uugggaggcuaagguggguggauca

SEQ ID NO: 664891 - RNA, 20 nt, Human
uuuuucccuuucccaaaaug

SEQ ID NO: 664892 - RNA, 22 nt, Human
aaaaaacucaucagacacaaac

SEQ ID NO: 664893 - RNA, 21 nt, Human
aaacaaaggcagaacacagga

SEQ ID NO: 664894 - RNA, 21 nt, Human
aaacaagagaagcugaaacaa

SEQ ID NO: 664895 - RNA, 23 nt, Human
aaagaugcagggggaguuuugga

SEQ ID NO: 664896 - RNA, 19 nt, Human
aaaguagagggaaaccaug

SEQ ID NO: 664897 - RNA, 21 nt, Human
aaaugaaacaagagaagcuga

SEQ ID NO: 664898 - RNA, 19 nt, Human
aacaagagaagcugaaaca

SEQ ID NO: 664899 - RNA, 22 nt, Human
aaccacaccaaacacucauccc

SEQ ID NO: 664900 - RNA, 21 nt, Human
aaccaugagcccccacccucu

SEQ ID NO: 664901 - RNA, 21 nt, Human
aagaacaucaggccccagggc

SEQ ID NO: 664902 - RNA, 23 nt, Human
aagaacuuucccauuacccaaaa

SEQ ID NO: 664903 - RNA, 22 nt, Human
aagcagccucagaaggggaggu

SEQ ID NO: 664904 - RNA, 26 nt, Human
aagcagccucagaagggggggaacgc

SEQ ID NO: 664905 - RNA, 22 nt, Human
aauacacaugcaugcacaggug

SEQ ID NO: 664906 - RNA, 22 nt, Human
aaugacccccuacuacacacac

SEQ ID NO: 664907 - RNA, 25 nt, Human
acacacacacgcaaaguuaggucca

SEQ ID NO: 664908 - RNA, 21 nt, Human
acaucaggccccagggcagca

SEQ ID NO: 664909 - RNA, 22 nt, Human
agaacuuucccauuacccaaaa

SEQ ID NO: 664910 - RNA, 19 nt, Human
agacacaaaccacaccaaa

SEQ ID NO: 664911 - RNA, 25 nt, Human
agacacaaaccacaccaaacacuca

SEQ ID NO: 664912 - RNA, 24 nt, Human
aggcagaaauacacaugcaugcag

SEQ ID NO: 664913 - RNA, 18 nt, Human
aggccaagcacagaaagc

SEQ ID NO: 664914 - RNA, 22 nt, Human
agguucuuccaaaagccugcuc

SEQ ID NO: 664915 - RNA, 22 nt, Human
augcacacacauccacacacca

SEQ ID NO: 664916 - RNA, 22 nt, Human
augcagggggaguuuugggaaa

SEQ ID NO: 664917 - RNA, 24 nt, Human
augccacagcauuaccucugcaau

SEQ ID NO: 664918 - RNA, 23 nt, Human
caaacagguucuuccaaaagccu

SEQ ID NO: 664919 - RNA, 20 nt, Human
caaaccacaccaaacacuca

SEQ ID NO: 664920 - RNA, 23 nt, Human
caacuggaaacugggaccuagag

SEQ ID NO: 664921 - RNA, 22 nt, Human
caagagaagcugaaacaaucua

SEQ ID NO: 664922 - RNA, 19 nt, Human
cacaaaccacaccaaacac

SEQ ID NO: 664923 - RNA, 23 nt, Human
cacacaccauagaaccaggcaga

SEQ ID NO: 664924 - RNA, 20 nt, Human
cacacauccacacaccauag

SEQ ID NO: 664925 - RNA, 18 nt, Human
cacagcauuaccucugca

SEQ ID NO: 664926 - RNA, 22 nt, Human
cacaugcaugcacagguggcua

SEQ ID NO: 664927 - RNA, 18 nt, Human
caccaaacacucauccca

SEQ ID NO: 664928 - RNA, 22 nt, Human
cacccucuaucccuccccauug

SEQ ID NO: 664929 - RNA, 25 nt, Human
cacccucuaucccuccccauugaca

SEQ ID NO: 664930 - RNA, 18 nt, Human
caccugaauguuaaaaaa

SEQ ID NO: 664931 - RNA, 19 nt, Human
cacucuuaagaacuuuccc

SEQ ID NO: 664932 - RNA, 23 nt, Human
cagcucggacccccucuauauga

SEQ ID NO: 664933 - RNA, 25 nt, Human
caggaugggaaaaagggcugaucaa

SEQ ID NO: 664934 - RNA, 20 nt, Human
caggccaagcacagaaagcc

SEQ ID NO: 664935 - RNA, 23 nt, Human
cauaggccaaagucaggccaagc

SEQ ID NO: 664936 - RNA, 22 nt, Human
ccaaaguagagggaaaccauga

SEQ ID NO: 664937 - RNA, 18 nt, Human
cccaaaaagaaaugaccc

SEQ ID NO: 664938 - RNA, 21 nt, Human
cccacccucuaucccucccca

SEQ ID NO: 664939 - RNA, 21 nt, Human
ccccacccucuaucccucccc

SEQ ID NO: 664940 - RNA, 20 nt, Human
ccccauaauaagguuuuggg

SEQ ID NO: 664941 - RNA, 26 nt, Human
cccccuacuacacacacacacacgca

SEQ ID NO: 664942 - RNA, 19 nt, Human
ccgaagggcccccauaaua

SEQ ID NO: 664943 - RNA, 19 nt, Human
ccugaauguuaaaaaacuc

SEQ ID NO: 664944 - RNA, 19 nt, Human
ccugcucacaagguagaca

SEQ ID NO: 664945 - RNA, 19 nt, Human
cuccagugauacacugagg

SEQ ID NO: 664946 - RNA, 26 nt, Human
cugaauguuaaaaaacucaucagaca

SEQ ID NO: 664947 - RNA, 23 nt, Human
cugaggcagaagcaauaugccac

SEQ ID NO: 664948 - RNA, 19 nt, Human
gccccagggcagcaaugcu

SEQ ID NO: 664949 - RNA, 25 nt, Human
gcccccacccucuaucccuccccau

SEQ ID NO: 664950 - RNA, 22 nt, Human
ggcaggguccugugacuccagu

SEQ ID NO: 664951 - RNA, 20 nt, Human
guccagcauaggccaaaguc

SEQ ID NO: 664952 - RNA, 22 nt, Human
uaaaauuaaaacaaaggcagaa

SEQ ID NO: 664953 - RNA, 23 nt, Human
uaagaacuuucccauuacccaaa

SEQ ID NO: 664954 - RNA, 24 nt, Human
uacacacacacacacgcaaaguua

SEQ ID NO: 664955 - RNA, 19 nt, Human
uacccaaaaagaaaugacc

SEQ ID NO: 664956 - RNA, 28 nt, Human
uauaugacagauucaugcacacagugug

SEQ ID NO: 664957 - RNA, 23 nt, Human
uccacacaccauagaaccaggca

SEQ ID NO: 664958 - RNA, 20 nt, Human
ucccaaaguagagggaaacc

SEQ ID NO: 664959 - RNA, 18 nt, Human
ucccauuacccaaaaaga

SEQ ID NO: 664960 - RNA, 19 nt, Human
uccccauugacacucuuaa

SEQ ID NO: 664961 - RNA, 18 nt, Human
ucugcaaucugugcccuc

SEQ ID NO: 664962 - RNA, 19 nt, Human
ucuuccaaaagccugcuca

SEQ ID NO: 664963 - RNA, 18 nt, Human
ugacccccuacuacacac

SEQ ID NO: 664964 - RNA, 23 nt, Human
ugacuccagugauacacugaggc

SEQ ID NO: 664965 - RNA, 21 nt, Human
ugaggcagaagcaauaugcca

SEQ ID NO: 664966 - RNA, 23 nt, Human
ugcacacacauccacacaccaua

SEQ ID NO: 664967 - RNA, 24 nt, Human
ugggaaagcagccucagaagggga

SEQ ID NO: 664968 - RNA, 19 nt, Human
ugggauguucagacaagag

SEQ ID NO: 664969 - RNA, 21 nt, Human
uguuuuguuuuucauuuucuu

SEQ ID NO: 664970 - RNA, 22 nt, Human
uuacaugcucugaggaagccaa

SEQ ID NO: 664971 - RNA, 18 nt, Human
uuacccaaaaagaaauga

SEQ ID NO: 664972 - RNA, 19 nt, Human
uucuaagaccgaagggccc

SEQ ID NO: 664973 - RNA, 27 nt, Human
uuuugcaucaaacagguucuuccaaaa

SEQ ID NO: 664974 - RNA, 26 nt, Human
aaacaaugccaucuuugaaaaauccc

SEQ ID NO: 664975 - RNA, 24 nt, Human
aaacagaaaaucaaaaguuucaac

SEQ ID NO: 664976 - RNA, 20 nt, Human
aaagauaccccaaacaaagg

SEQ ID NO: 664977 - RNA, 24 nt, Human
aaagcccuuucauuuccuuacaaa

SEQ ID NO: 664978 - RNA, 21 nt, Human
aaguguccacugccaacaucc

SEQ ID NO: 664979 - RNA, 24 nt, Human
aaucacuugaauccgggaggcaga

SEQ ID NO: 664980 - RNA, 26 nt, Human
aauuuugcuaacuacagcucuuacca

SEQ ID NO: 664981 - RNA, 24 nt, Human
acagagcgagacuccaucucaaaa

SEQ ID NO: 664982 - RNA, 24 nt, Human
accccaucucuacuaaaaauacaa

SEQ ID NO: 664983 - RNA, 24 nt, Human
accugaggucaggaguucaagacc

SEQ ID NO: 664984 - RNA, 21 nt, Human
acuccagcauuuuuuccgaau

SEQ ID NO: 664985 - RNA, 24 nt, Human
acugcacuccagucugggugacag

SEQ ID NO: 664986 - RNA, 26 nt, Human
acugcacuccagucugggugacagag

SEQ ID NO: 664987 - RNA, 18 nt, Human
acuugaauccgggaggca

SEQ ID NO: 664988 - RNA, 24 nt, Human
agagauugcagugagccgagaucg

SEQ ID NO: 664989 - RNA, 22 nt, Human
agaucaccugaggucaggaguu

SEQ ID NO: 664990 - RNA, 23 nt, Human
agaucaccugaggucaggaguuc

SEQ ID NO: 664991 - RNA, 19 nt, Human
agcauggugaaaccccauc

SEQ ID NO: 664992 - RNA, 20 nt, Human
agcauggugaaaccccaucu

SEQ ID NO: 664993 - RNA, 22 nt, Human
agccuggccagcauggugaaac

SEQ ID NO: 664994 - RNA, 24 nt, Human
agccuggccagcauggugaaaccc

SEQ ID NO: 664995 - RNA, 19 nt, Human
agcgcuuugggaggcuggg

SEQ ID NO: 664996 - RNA, 21 nt, Human
aggcagagauugcagugagcc

SEQ ID NO: 664997 - RNA, 24 nt, Human
aggcagagauugcagugagccgag

SEQ ID NO: 664998 - RNA, 18 nt, Human
aggcaggagaaucacuug

SEQ ID NO: 664999 - RNA, 24 nt, Human
aggcaggagaaucacuugaauccg

SEQ ID NO: 665000 - RNA, 24 nt, Human
aggcugaggcaggagaaucacuug

SEQ ID NO: 665001 - RNA, 24 nt, Human
agucugggugacagagcgagacuc

SEQ ID NO: 665002 - RNA, 24 nt, Human
aguggcucacaccuguaaucccag

SEQ ID NO: 665003 - RNA, 19 nt, Human
auacaauacaacggaauuc

SEQ ID NO: 665004 - RNA, 19 nt, Human
auacuucugcauccauaua

SEQ ID NO: 665005 - RNA, 24 nt, Human
auugcagugagccgagaucgugcc

SEQ ID NO: 665006 - RNA, 18 nt, Human
caaaaacuacuccggugu

SEQ ID NO: 665007 - RNA, 22 nt, Human
caaaagauaccccaaacaaagc

SEQ ID NO: 665008 - RNA, 24 nt, Human
caagaccagccuggccagcauggu

SEQ ID NO: 665009 - RNA, 23 nt, Human
caauuuuaagacaaaagauaccc

SEQ ID NO: 665010 - RNA, 24 nt, Human
cacacagaucaccugaggucagga

SEQ ID NO: 665011 - RNA, 24 nt, Human
cacaccuguaaucccagcgcuuug

SEQ ID NO: 665012 - RNA, 19 nt, Human
cacccuaaagaggaugcca

SEQ ID NO: 665013 - RNA, 23 nt, Human
caccugaggucaggaguucaaga

SEQ ID NO: 665014 - RNA, 23 nt, Human
caccuguaaucccagcgcuuugg

SEQ ID NO: 665015 - RNA, 24 nt, Human
caccuguaaucccagcgcuuuggg

SEQ ID NO: 665016 - RNA, 22 nt, Human
cacuccagucugggugacagag

SEQ ID NO: 665017 - RNA, 24 nt, Human
cacuccagucugggugacagagcg

SEQ ID NO: 665018 - RNA, 19 nt, Human
cacugcacuccagucuggg

SEQ ID NO: 665019 - RNA, 21 nt, Human
cacugcacuccagucugggug

SEQ ID NO: 665020 - RNA, 22 nt, Human
cacugcacuccagucuggguga

SEQ ID NO: 665021 - RNA, 23 nt, Human
cacugcacuccagucugggugac

SEQ ID NO: 665022 - RNA, 24 nt, Human
cacugcacuccagucugggugaca

SEQ ID NO: 665023 - RNA, 25 nt, Human
cacugcacuccagucugggugacag

SEQ ID NO: 665024 - RNA, 24 nt, Human
cagaucaccugaggucaggaguuc

SEQ ID NO: 665025 - RNA, 27 nt, Human
cagaucaccugaggucaggaguucaag

SEQ ID NO: 665026 - RNA, 20 nt, Human
cagcacagaauugacacccu

SEQ ID NO: 665027 - RNA, 24 nt, Human
cagcauggugaaaccccaucucua

SEQ ID NO: 665028 - RNA, 23 nt, Human
cagcauuuuuuccgaauauaguc

SEQ ID NO: 665029 - RNA, 23 nt, Human
cagcgcuuugggaggcuggggca

SEQ ID NO: 665030 - RNA, 24 nt, Human
cagcuacuugggaggcugaggcag

SEQ ID NO: 665031 - RNA, 20 nt, Human
cauggaaaaccuuuaagcua

SEQ ID NO: 665032 - RNA, 18 nt, Human
cauggugaaaccccaucu

SEQ ID NO: 665033 - RNA, 19 nt, Human
cauggugaaaccccaucuc

SEQ ID NO: 665034 - RNA, 21 nt, Human
cauggugaaaccccaucucua

SEQ ID NO: 665035 - RNA, 22 nt, Human
ccaaacagaaaaucaaaaguuu

SEQ ID NO: 665036 - RNA, 20 nt, Human
ccacugcacuccagucuggg

SEQ ID NO: 665037 - RNA, 20 nt, Human
ccacugcacuccagucuggg

SEQ ID NO: 665038 - RNA, 21 nt, Human
ccacugcacuccagucugggu

SEQ ID NO: 665039 - RNA, 21 nt, Human
ccacugcacuccagucugggu

SEQ ID NO: 665040 - RNA, 23 nt, Human
ccacugcacuccagucuggguga

SEQ ID NO: 665041 - RNA, 24 nt, Human
ccacugcacuccagucugggugac

SEQ ID NO: 665042 - RNA, 23 nt, Human
ccuggccagcauggugaaacccc

SEQ ID NO: 665043 - RNA, 24 nt, Human
ccuggccagcauggugaaacccca

SEQ ID NO: 665044 - RNA, 24 nt, Human
cgagaucgugccacugcacuccag

SEQ ID NO: 665045 - RNA, 24 nt, Human
cggagcccaaacaaguagggggcu

SEQ ID NO: 665046 - RNA, 26 nt, Human
cggagcccaaacaaguagggggcugg

SEQ ID NO: 665047 - RNA, 20 nt, Human
cggugugguggcacaggccu

SEQ ID NO: 665048 - RNA, 20 nt, Human
cucacaccuguaaucccagc

SEQ ID NO: 665049 - RNA, 24 nt, Human
cucacaccuguaaucccagcgcuu

SEQ ID NO: 665050 - RNA, 24 nt, Human
cugccaacauccuuggacgaaaac

SEQ ID NO: 665051 - RNA, 23 nt, Human
cuggccagcauggugaaacccca

SEQ ID NO: 665052 - RNA, 21 nt, Human
cugggugacagagcgagacuc

SEQ ID NO: 665053 - RNA, 25 nt, Human
cuuuauaauacuuccuaaauggcug

SEQ ID NO: 665054 - RNA, 23 nt, Human
gagaaucacuugaauccgggagg

SEQ ID NO: 665055 - RNA, 23 nt, Human
gaucaccugaggucaggaguuca

SEQ ID NO: 665056 - RNA, 24 nt, Human
gaucaccugaggucaggaguucaa

SEQ ID NO: 665057 - RNA, 24 nt, Human
gcacuccagucugggugacagagc

SEQ ID NO: 665058 - RNA, 23 nt, Human
gcaggagaaucacuugaauccgg

SEQ ID NO: 665059 - RNA, 19 nt, Human
gccacugcacuccagucug

SEQ ID NO: 665060 - RNA, 19 nt, Human
gccacugcacuccagucug

SEQ ID NO: 665061 - RNA, 24 nt, Human
gccacugcacuccagucuggguga

SEQ ID NO: 665062 - RNA, 24 nt, Human
gccagcauggugaaaccccaucuc

SEQ ID NO: 665063 - RNA, 20 nt, Human
gccgagaucgugccacugca

SEQ ID NO: 665064 - RNA, 27 nt, Human
gccgcaguacaaacaaauuacagaaua

SEQ ID NO: 665065 - RNA, 24 nt, Human
gcucaucugugauugcacaaccga

SEQ ID NO: 665066 - RNA, 21 nt, Human
gcucuuaccacucuucuccau

SEQ ID NO: 665067 - RNA, 26 nt, Human
ggacgaaaaccaagucccccgggaga

SEQ ID NO: 665068 - RNA, 21 nt, Human
ggcacacagaucaccugaggu

SEQ ID NO: 665069 - RNA, 24 nt, Human
ggccuguuuucccagcuacuuggg

SEQ ID NO: 665070 - RNA, 23 nt, Human
ggcucaguggcucacaccuguaa

SEQ ID NO: 665071 - RNA, 18 nt, Human
ggcuggcccucuucuggc

SEQ ID NO: 665072 - RNA, 19 nt, Human
ggugugguggcacaggccu

SEQ ID NO: 665073 - RNA, 22 nt, Human
guacaaacaaauuacagaauaa

SEQ ID NO: 665074 - RNA, 18 nt, Human
uaaaaauacaaaaacuac

SEQ ID NO: 665075 - RNA, 22 nt, Human
uaagacaaaagauaccccaaac

SEQ ID NO: 665076 - RNA, 23 nt, Human
uacuccggugugguggcacaggc

SEQ ID NO: 665077 - RNA, 23 nt, Human
uacuucguaaaaacaauacuuuu

SEQ ID NO: 665078 - RNA, 23 nt, Human
uagaaacuccaauuucuacaaag

SEQ ID NO: 665079 - RNA, 23 nt, Human
ucaacaauuugcaaagcagcaca

SEQ ID NO: 665080 - RNA, 23 nt, Human
ucaccugaggucaggaguucaag

SEQ ID NO: 665081 - RNA, 21 nt, Human
ucagauauugcagauuuaaaa

SEQ ID NO: 665082 - RNA, 21 nt, Human
uccacugccaacauccuugga

SEQ ID NO: 665083 - RNA, 23 nt, Human
uccacugccaacauccuuggacg

SEQ ID NO: 665084 - RNA, 24 nt, Human
uccacugccaacauccuuggacga

SEQ ID NO: 665085 - RNA, 23 nt, Human
uccagucugggugacagagcgag

SEQ ID NO: 665086 - RNA, 24 nt, Human
uccagucugggugacagagcgaga

SEQ ID NO: 665087 - RNA, 18 nt, Human
uccggugugguggcacag

SEQ ID NO: 665088 - RNA, 23 nt, Human
ucgugccacugcacuccagucug

SEQ ID NO: 665089 - RNA, 19 nt, Human
ucuccauggaaaaccuuua

SEQ ID NO: 665090 - RNA, 21 nt, Human
ucucuacuaaaaauacaaaaa

SEQ ID NO: 665091 - RNA, 18 nt, Human
ucuuaccacucuucucca

SEQ ID NO: 665092 - RNA, 19 nt, Human
ugaaaccccaucucuacua

SEQ ID NO: 665093 - RNA, 24 nt, Human
ugacaagaguuagcuuuggacguc

SEQ ID NO: 665094 - RNA, 22 nt, Human
ugagccgagaucgugccacugc

SEQ ID NO: 665095 - RNA, 20 nt, Human
ugaggcaggagaaucacuug

SEQ ID NO: 665096 - RNA, 24 nt, Human
ugaggcaggagaaucacuugaauc

SEQ ID NO: 665097 - RNA, 25 nt, Human
ugaggcaggagaaucacuugaaucc

SEQ ID NO: 665098 - RNA, 24 nt, Human
ugccacugcacuccagucugggug

SEQ ID NO: 665099 - RNA, 24 nt, Human
uggccagcauggugaaaccccauc

SEQ ID NO: 665100 - RNA, 21 nt, Human
uggcucacaccuguaauccca

SEQ ID NO: 665101 - RNA, 22 nt, Human
uggcucacaccuguaaucccag

SEQ ID NO: 665102 - RNA, 24 nt, Human
uggcucacaccuguaaucccagcg

SEQ ID NO: 665103 - RNA, 19 nt, Human
ugggaggcugaggcaggag

SEQ ID NO: 665104 - RNA, 24 nt, Human
ugggaggcugaggcaggagaauca

SEQ ID NO: 665105 - RNA, 24 nt, Human
ugggaggcuggggcacacagauca

SEQ ID NO: 665106 - RNA, 20 nt, Human
uggggcacacagaucaccug

SEQ ID NO: 665107 - RNA, 24 nt, Human
uggggcacacagaucaccugaggu

SEQ ID NO: 665108 - RNA, 24 nt, Human
uuaagggccuuuauaauacuuccu

SEQ ID NO: 665109 - RNA, 24 nt, Human
uuacagcaaauuuacuucuccucu

SEQ ID NO: 665110 - RNA, 19 nt, Human
uuccuaaauggcugggcuc

SEQ ID NO: 665111 - RNA, 18 nt, Human
uugcagugagccgagauc

SEQ ID NO: 665112 - RNA, 21 nt, Human
uugcagugagccgagaucgug

SEQ ID NO: 665113 - RNA, 22 nt, Human
uugcagugagccgagaucgugc

SEQ ID NO: 665114 - RNA, 25 nt, Human
uugggaggcugaggcaggagaauca

SEQ ID NO: 665115 - RNA, 19 nt, Human
cagcuggggccgacacagg

SEQ ID NO: 665116 - RNA, 19 nt, Human
caggggaggacagcaggca

SEQ ID NO: 665117 - RNA, 18 nt, Human
cagugcaggggaggacag

SEQ ID NO: 665118 - RNA, 20 nt, Human
ccuccacacugagcugggcc

SEQ ID NO: 665119 - RNA, 21 nt, Human
ccuccacacugagcugggccu

SEQ ID NO: 665120 - RNA, 22 nt, Human
cgggcggggcgggcacccaaac

SEQ ID NO: 665121 - RNA, 21 nt, Human
cggggcgggcacccaaacauc

SEQ ID NO: 665122 - RNA, 23 nt, Human
cucagcuggggccgacacagggg

SEQ ID NO: 665123 - RNA, 20 nt, Human
cuccaucagcucccagcucc

SEQ ID NO: 665124 - RNA, 20 nt, Human
cucggguccauugcaggcca

SEQ ID NO: 665125 - RNA, 21 nt, Human
gcaggggaggacagcaggcag

SEQ ID NO: 665126 - RNA, 19 nt, Human
gccgacacaggggcgagug

SEQ ID NO: 665127 - RNA, 27 nt, Human
gcgggcgaggcgggcggggcgggcacc

SEQ ID NO: 665128 - RNA, 18 nt, Human
gggcgaggcgggcggggc

SEQ ID NO: 665129 - RNA, 22 nt, Human
guuuauucgggugcucagcugg

SEQ ID NO: 665130 - RNA, 21 nt, Human
ugcaggggaggacagcaggca

SEQ ID NO: 665131 - RNA, 21 nt, Human
uggcagggccagcagccucca

SEQ ID NO: 665132 - RNA, 21 nt, Human
uugcaggccaggugacggcau

SEQ ID NO: 665133 - RNA, 21 nt, Human
aaacaauccacacacaggcca

SEQ ID NO: 665134 - RNA, 25 nt, Human
aaacaauccacacacaggccacugg

SEQ ID NO: 665135 - RNA, 18 nt, Human
aaaggcagaaacaaucca

SEQ ID NO: 665136 - RNA, 20 nt, Human
aaaggcagaaacaauccaca

SEQ ID NO: 665137 - RNA, 20 nt, Human
aaccucugccucccaggcuc

SEQ ID NO: 665138 - RNA, 23 nt, Human
aacuccucccccagaaccuucug

SEQ ID NO: 665139 - RNA, 20 nt, Human
aagaacuccucccccagaac

SEQ ID NO: 665140 - RNA, 23 nt, Human
aagauacuuuuuuccuucaacug

SEQ ID NO: 665141 - RNA, 19 nt, Human
aaguagagagaguaagagg

SEQ ID NO: 665142 - RNA, 18 nt, Human
aaguccccaagagagcag

SEQ ID NO: 665143 - RNA, 24 nt, Human
aagugaucugccugccucagccuc

SEQ ID NO: 665144 - RNA, 22 nt, Human
aauaggaagugaccuuggggga

SEQ ID NO: 665145 - RNA, 18 nt, Human
acaggguuucaccauguu

SEQ ID NO: 665146 - RNA, 23 nt, Human
acaggguuucaccauguuggcca

SEQ ID NO: 665147 - RNA, 24 nt, Human
acaggguuucaccauguuggccag

SEQ ID NO: 665148 - RNA, 24 nt, Human
accauguuggccaggcuggucuug

SEQ ID NO: 665149 - RNA, 18 nt, Human
acucccaucccaggucca

SEQ ID NO: 665150 - RNA, 22 nt, Human
agacagaagccaaaagguaggg

SEQ ID NO: 665151 - RNA, 24 nt, Human
agacagaagccaaaagguagggga

SEQ ID NO: 665152 - RNA, 21 nt, Human
agagcucugggcgucagcaac

SEQ ID NO: 665153 - RNA, 21 nt, Human
agcacacugcccagccccucc

SEQ ID NO: 665154 - RNA, 22 nt, Human
agcacacugcccagccccucca

SEQ ID NO: 665155 - RNA, 24 nt, Human
agcgauucuccugccucagccucc

SEQ ID NO: 665156 - RNA, 20 nt, Human
aggugcuaggcacaccuggc

SEQ ID NO: 665157 - RNA, 18 nt, Human
aguagcuggaauuauagg

SEQ ID NO: 665158 - RNA, 24 nt, Human
agugaucugccugccucagccucc

SEQ ID NO: 665159 - RNA, 20 nt, Human
agugcaguggugcggucucg

SEQ ID NO: 665160 - RNA, 23 nt, Human
agugcaguggugcggucucggcu

SEQ ID NO: 665161 - RNA, 24 nt, Human
agugcaguggugcggucucggcuc

SEQ ID NO: 665162 - RNA, 20 nt, Human
aguuccuguccuucuucuuc

SEQ ID NO: 665163 - RNA, 18 nt, Human
auccugagggaugggaaa

SEQ ID NO: 665164 - RNA, 22 nt, Human
augccugcagccagagcucugg

SEQ ID NO: 665165 - RNA, 24 nt, Human
auuuuuguauuuuuaguagagaca

SEQ ID NO: 665166 - RNA, 23 nt, Human
caaccucugccucccaggcucaa

SEQ ID NO: 665167 - RNA, 20 nt, Human
caagcgauucuccugccuca

SEQ ID NO: 665168 - RNA, 22 nt, Human
caagcgauucuccugccucagc

SEQ ID NO: 665169 - RNA, 21 nt, Human
cacaacaccaugcccagcuaa

SEQ ID NO: 665170 - RNA, 22 nt, Human
cacaggaguuccguggugauuu

SEQ ID NO: 665171 - RNA, 24 nt, Human
caccaugcccagcuaauuuuugua

SEQ ID NO: 665172 - RNA, 19 nt, Human
caccaugccuggcccacuu

SEQ ID NO: 665173 - RNA, 21 nt, Human
caccauguuggccaggcuggu

SEQ ID NO: 665174 - RNA, 22 nt, Human
caccauguuggccaggcugguc

SEQ ID NO: 665175 - RNA, 23 nt, Human
caccauguuggccaggcuggucu

SEQ ID NO: 665176 - RNA, 24 nt, Human
caccauguuggccaggcuggucuu

SEQ ID NO: 665177 - RNA, 21 nt, Human
cacugcccagccccuccaggc

SEQ ID NO: 665178 - RNA, 19 nt, Human
cacuuugcccacguugggg

SEQ ID NO: 665179 - RNA, 21 nt, Human
cagacaguuccugggggauaa

SEQ ID NO: 665180 - RNA, 24 nt, Human
cagcaaccucugccucccaggcuc

SEQ ID NO: 665181 - RNA, 19 nt, Human
cagcagcccggccagcaca

SEQ ID NO: 665182 - RNA, 19 nt, Human
cagccuccugaguagcugg

SEQ ID NO: 665183 - RNA, 20 nt, Human
caggagcccaggugcugaga

SEQ ID NO: 665184 - RNA, 18 nt, Human
caggauaacccuaggaga

SEQ ID NO: 665185 - RNA, 20 nt, Human
caggcucagcccucgacugc

SEQ ID NO: 665186 - RNA, 24 nt, Human
caggguuucaccauguuggccagg

SEQ ID NO: 665187 - RNA, 24 nt, Human
cauguuggccaggcuggucuugaa

SEQ ID NO: 665188 - RNA, 20 nt, Human
ccacgugcuaggauuacagg

SEQ ID NO: 665189 - RNA, 23 nt, Human
ccauggaaggaauaggaagugac

SEQ ID NO: 665190 - RNA, 18 nt, Human
ccauggugccuugguggg

SEQ ID NO: 665191 - RNA, 21 nt, Human
cccacucccaucccaggucca

SEQ ID NO: 665192 - RNA, 21 nt, Human
cccagcagcccggccagcaca

SEQ ID NO: 665193 - RNA, 20 nt, Human
cccaggcucaagcgauucuc

SEQ ID NO: 665194 - RNA, 21 nt, Human
cccaggcucaagcgauucucc

SEQ ID NO: 665195 - RNA, 19 nt, Human
cccaggcuggagugcagug

SEQ ID NO: 665196 - RNA, 20 nt, Human
ccccacucucuuagcccaaa

SEQ ID NO: 665197 - RNA, 22 nt, Human
cccccagaaccuucugagccag

SEQ ID NO: 665198 - RNA, 26 nt, Human
cccccagaaccuucugagccagccuu

SEQ ID NO: 665199 - RNA, 22 nt, Human
cccucuaugaaguccccaagag

SEQ ID NO: 665200 - RNA, 23 nt, Human
cccugcccagacccacacauacc

SEQ ID NO: 665201 - RNA, 21 nt, Human
ccuaagugaucugccugccuc

SEQ ID NO: 665202 - RNA, 23 nt, Human
ccuaagugaucugccugccucag

SEQ ID NO: 665203 - RNA, 20 nt, Human
ccuagccuaagugaucugcc

SEQ ID NO: 665204 - RNA, 24 nt, Human
ccucccaggcucaagcgauucucc

SEQ ID NO: 665205 - RNA, 21 nt, Human
ccucuagcuccauccuacccc

SEQ ID NO: 665206 - RNA, 22 nt, Human
ccugagggaugggaaaggaggu

SEQ ID NO: 665207 - RNA, 19 nt, Human
ccugaguagcuggaauuau

SEQ ID NO: 665208 - RNA, 21 nt, Human
ccugcagccagagcucugggc

SEQ ID NO: 665209 - RNA, 23 nt, Human
ccugccucagccuccugaguagc

SEQ ID NO: 665210 - RNA, 24 nt, Human
cgcucugucgcccaggcuggagug

SEQ ID NO: 665211 - RNA, 21 nt, Human
cggaagacagggagaggagug

SEQ ID NO: 665212 - RNA, 22 nt, Human
cuaugaaguccccaagagagca

SEQ ID NO: 665213 - RNA, 24 nt, Human
cucaagcgauucuccugccucagc

SEQ ID NO: 665214 - RNA, 24 nt, Human
cucacagcaaccucugccucccag

SEQ ID NO: 665215 - RNA, 19 nt, Human
cuccaggccagcccuucug

SEQ ID NO: 665216 - RNA, 21 nt, Human
cuccaggcucagcccucgacu

SEQ ID NO: 665217 - RNA, 23 nt, Human
cuccaggcucagcccucgacugc

SEQ ID NO: 665218 - RNA, 21 nt, Human
cucgcucugucgcccaggcug

SEQ ID NO: 665219 - RNA, 24 nt, Human
cucgcucugucgcccaggcuggag

SEQ ID NO: 665220 - RNA, 25 nt, Human
cugcccugcccagacccacacauac

SEQ ID NO: 665221 - RNA, 23 nt, Human
cugccucagccuccccacgugcu

SEQ ID NO: 665222 - RNA, 23 nt, Human
cugccucagccuccugaguagcu

SEQ ID NO: 665223 - RNA, 19 nt, Human
cuggcaggagcccaggugc

SEQ ID NO: 665224 - RNA, 21 nt, Human
cuguccuucuucuuccccucu

SEQ ID NO: 665225 - RNA, 27 nt, Human
cuuugcccuagccuugauaccgguucc

SEQ ID NO: 665226 - RNA, 21 nt, Human
gaccucuacugcccugcccag

SEQ ID NO: 665227 - RNA, 22 nt, Human
gacguugaagcucgccuccagg

SEQ ID NO: 665228 - RNA, 21 nt, Human
gagauggagucucgcucuguc

SEQ ID NO: 665229 - RNA, 18 nt, Human
gauuacaggugugagcca

SEQ ID NO: 665230 - RNA, 21 nt, Human
gauuacaggugugagccacca

SEQ ID NO: 665231 - RNA, 24 nt, Human
gauuacaggugugagccaccaugc

SEQ ID NO: 665232 - RNA, 19 nt, Human
gcaaaugcagcagccggcc

SEQ ID NO: 665233 - RNA, 20 nt, Human
gcagccaaauccauggugcc

SEQ ID NO: 665234 - RNA, 22 nt, Human
gcccagcuaauuuuuguauuuu

SEQ ID NO: 665235 - RNA, 19 nt, Human
gcccaggcuggagugcagu

SEQ ID NO: 665236 - RNA, 20 nt, Human
gcccaggcuggagugcagug

SEQ ID NO: 665237 - RNA, 23 nt, Human
gcccaggcuggagugcaguggug

SEQ ID NO: 665238 - RNA, 24 nt, Human
gccuaagugaucugccugccucag

SEQ ID NO: 665239 - RNA, 19 nt, Human
gccuuucgcuuugucuugg

SEQ ID NO: 665240 - RNA, 24 nt, Human
gcgauucuccugccucagccuccu

SEQ ID NO: 665241 - RNA, 25 nt, Human
gcucugucgcccaggcuggagugca

SEQ ID NO: 665242 - RNA, 23 nt, Human
ggagucucgcucugucgcccagg

SEQ ID NO: 665243 - RNA, 22 nt, Human
ggauuacaggugugagccacca

SEQ ID NO: 665244 - RNA, 24 nt, Human
ggauuacaggugugagccaccaug

SEQ ID NO: 665245 - RNA, 22 nt, Human
ggccauggagaugccugcagcc

SEQ ID NO: 665246 - RNA, 18 nt, Human
gggaaaggaggugggagu

SEQ ID NO: 665247 - RNA, 20 nt, Human
gggaggcaaaugcagcagcc

SEQ ID NO: 665248 - RNA, 22 nt, Human
ggguuucaccauguuggccagg

SEQ ID NO: 665249 - RNA, 21 nt, Human
ggucucggcucacagcaaccu

SEQ ID NO: 665250 - RNA, 19 nt, Human
guccuucuucuuccccucu

SEQ ID NO: 665251 - RNA, 24 nt, Human
gugaucugccugccucagccuccc

SEQ ID NO: 665252 - RNA, 21 nt, Human
gugcuaggauuacagguguga

SEQ ID NO: 665253 - RNA, 21 nt, Human
guggugcggucucggcucaca

SEQ ID NO: 665254 - RNA, 24 nt, Human
uaauuuuuguauuuuuaguagaga

SEQ ID NO: 665255 - RNA, 22 nt, Human
uacaggugugagccaccaugcc

SEQ ID NO: 665256 - RNA, 22 nt, Human
uacaggugugagccaccaugcc

SEQ ID NO: 665257 - RNA, 23 nt, Human
uacaggugugagccaccaugccu

SEQ ID NO: 665258 - RNA, 21 nt, Human
uaccagagaaggaaacuccca

SEQ ID NO: 665259 - RNA, 22 nt, Human
uagagacaggguuucaccaugu

SEQ ID NO: 665260 - RNA, 18 nt, Human
uaggauuacaggugugag

SEQ ID NO: 665261 - RNA, 22 nt, Human
uaggauuacaggugugagccac

SEQ ID NO: 665262 - RNA, 24 nt, Human
uaggauuacaggugugagccacca

SEQ ID NO: 665263 - RNA, 25 nt, Human
uaggauuacaggugugagccaccau

SEQ ID NO: 665264 - RNA, 24 nt, Human
uaguagagacaggguuucaccaug

SEQ ID NO: 665265 - RNA, 26 nt, Human
uaguagagacaggguuucaccauguu

SEQ ID NO: 665266 - RNA, 24 nt, Human
ucacagcaaccucugccucccagg

SEQ ID NO: 665267 - RNA, 25 nt, Human
ucacagcaaccucugccucccaggc

SEQ ID NO: 665268 - RNA, 19 nt, Human
ucagcaccugaggggcgag

SEQ ID NO: 665269 - RNA, 22 nt, Human
ucagccuccugaguagcuggaa

SEQ ID NO: 665270 - RNA, 22 nt, Human
uccacacacaggccacugggau

SEQ ID NO: 665271 - RNA, 18 nt, Human
uccacucaccugggugag

SEQ ID NO: 665272 - RNA, 21 nt, Human
uccauccuaccccacucccau

SEQ ID NO: 665273 - RNA, 19 nt, Human
uccauggugccuugguggg

SEQ ID NO: 665274 - RNA, 18 nt, Human
ucccacaaaggcagaaac

SEQ ID NO: 665275 - RNA, 21 nt, Human
ucccaggcucaagcgauucuc

SEQ ID NO: 665276 - RNA, 24 nt, Human
ucccaggcucaagcgauucuccug

SEQ ID NO: 665277 - RNA, 24 nt, Human
ucccauggaaggaauaggaaguga

SEQ ID NO: 665278 - RNA, 22 nt, Human
ucccccagaaccuucugagcca

SEQ ID NO: 665279 - RNA, 18 nt, Human
ucccucuaugaagucccc

SEQ ID NO: 665280 - RNA, 20 nt, Human
uccuaccccacucccauccc

SEQ ID NO: 665281 - RNA, 24 nt, Human
uccugaguagcuggaauuauaggu

SEQ ID NO: 665282 - RNA, 24 nt, Human
ucgcccaggcuggagugcaguggu

SEQ ID NO: 665283 - RNA, 24 nt, Human
ucgcucugucgcccaggcuggagu

SEQ ID NO: 665284 - RNA, 24 nt, Human
ucuccugccucagccuccugagua

SEQ ID NO: 665285 - RNA, 19 nt, Human
ucucgcucugucgcccagg

SEQ ID NO: 665286 - RNA, 22 nt, Human
ucucgcucugucgcccaggcug

SEQ ID NO: 665287 - RNA, 23 nt, Human
ucucgcucugucgcccaggcugg

SEQ ID NO: 665288 - RNA, 24 nt, Human
ucucgcucugucgcccaggcugga

SEQ ID NO: 665289 - RNA, 26 nt, Human
ucucgcucugucgcccaggcuggagu

SEQ ID NO: 665290 - RNA, 27 nt, Human
ucucgcucugucgcccaggcuggagug

SEQ ID NO: 665291 - RNA, 25 nt, Human
ucugccucucccucuaugaaguccc

SEQ ID NO: 665292 - RNA, 24 nt, Human
ucugucgcccaggcuggagugcag

SEQ ID NO: 665293 - RNA, 23 nt, Human
ugaaauucaaggagaccagauga

SEQ ID NO: 665294 - RNA, 23 nt, Human
ugaauuccuagccuaagugaucu

SEQ ID NO: 665295 - RNA, 19 nt, Human
ugagaaaagaacuccuccc

SEQ ID NO: 665296 - RNA, 21 nt, Human
ugagaaaagaacuccuccccc

SEQ ID NO: 665297 - RNA, 21 nt, Human
ugcagugcccauggggcuucc

SEQ ID NO: 665298 - RNA, 21 nt, Human
ugcccagccccuccaggcuca

SEQ ID NO: 665299 - RNA, 24 nt, Human
ugccucagccuccccacgugcuag

SEQ ID NO: 665300 - RNA, 24 nt, Human
ugccucagccuccugaguagcugg

SEQ ID NO: 665301 - RNA, 25 nt, Human
ugccucucccucuaugaagucccca

SEQ ID NO: 665302 - RNA, 24 nt, Human
ugcuaggauuacaggugugagcca

SEQ ID NO: 665303 - RNA, 23 nt, Human
ugcugaaucugauaggaccagca

SEQ ID NO: 665304 - RNA, 18 nt, Human
uggaaggaauaggaagug

SEQ ID NO: 665305 - RNA, 19 nt, Human
uggaaggaauaggaaguga

SEQ ID NO: 665306 - RNA, 24 nt, Human
uggaauuauaggugcacaacacca

SEQ ID NO: 665307 - RNA, 25 nt, Human
uggaauuauaggugcacaacaccau

SEQ ID NO: 665308 - RNA, 20 nt, Human
uggagugcaguggugcgguc

SEQ ID NO: 665309 - RNA, 23 nt, Human
uggagugcaguggugcggucucg

SEQ ID NO: 665310 - RNA, 24 nt, Human
uggagugcaguggugcggucucgg

SEQ ID NO: 665311 - RNA, 24 nt, Human
uggcaaucaaucgguguaaguucc

SEQ ID NO: 665312 - RNA, 24 nt, Human
uggccaggcuggucuugaauuccu

SEQ ID NO: 665313 - RNA, 21 nt, Human
ugggaaaggaggugggagugg

SEQ ID NO: 665314 - RNA, 20 nt, Human
uggggaagcuggaugcagug

SEQ ID NO: 665315 - RNA, 20 nt, Human
ugggggaggcaaaugcagca

SEQ ID NO: 665316 - RNA, 19 nt, Human
ugggggcagacaguuccug

SEQ ID NO: 665317 - RNA, 20 nt, Human
uggguauccugagggauggg

SEQ ID NO: 665318 - RNA, 21 nt, Human
ugugacugguucuuugcccua

SEQ ID NO: 665319 - RNA, 24 nt, Human
uuaguagagacaggguuucaccau

SEQ ID NO: 665320 - RNA, 27 nt, Human
uuccccacucucuuagcccaaagucua

SEQ ID NO: 665321 - RNA, 18 nt, Human
uugccuuucgcuuugucu

SEQ ID NO: 665322 - RNA, 24 nt, Human
uuucaccauguuggccaggcuggu

SEQ ID NO: 665323 - RNA, 24 nt, Human
uuuuuaguagagacaggguuucac

SEQ ID NO: 665324 - RNA, 20 nt, Human
uuuuuguauuuuuaguagag

SEQ ID NO: 665325 - RNA, 19 nt, Human
acuccagccucaggggcca

SEQ ID NO: 665326 - RNA, 21 nt, Human
acucuuucucauuucucuguu

SEQ ID NO: 665327 - RNA, 19 nt, Human
agacagaguugcauggagg

SEQ ID NO: 665328 - RNA, 23 nt, Human
agcuaagagaaugagauucauga

SEQ ID NO: 665329 - RNA, 24 nt, Human
aggaagcagagggugugaucaucc

SEQ ID NO: 665330 - RNA, 20 nt, Human
aggcuggcagguggccagga

SEQ ID NO: 665331 - RNA, 22 nt, Human
agggaggaagggaggcaggggc

SEQ ID NO: 665332 - RNA, 20 nt, Human
agggaggguggggaccaaga

SEQ ID NO: 665333 - RNA, 20 nt, Human
agguggccaggaagcagagg

SEQ ID NO: 665334 - RNA, 18 nt, Human
aggugguuuuauuuaccc

SEQ ID NO: 665335 - RNA, 22 nt, Human
aguugcauggaggcuggcaggu

SEQ ID NO: 665336 - RNA, 21 nt, Human
auggaggcuggcagguggcca

SEQ ID NO: 665337 - RNA, 21 nt, Human
augggcagcagacagacagag

SEQ ID NO: 665338 - RNA, 24 nt, Human
auucaugagcccuggcccugaccg

SEQ ID NO: 665339 - RNA, 20 nt, Human
cacagcucuguugacccuuu

SEQ ID NO: 665340 - RNA, 22 nt, Human
cagacagacagaguugcaugga

SEQ ID NO: 665341 - RNA, 19 nt, Human
cagaggcccacccacagac

SEQ ID NO: 665342 - RNA, 21 nt, Human
cagcagacagacagaguugca

SEQ ID NO: 665343 - RNA, 18 nt, Human
cagcagcccagggugcca

SEQ ID NO: 665344 - RNA, 20 nt, Human
cagguggccaggaagcagag

SEQ ID NO: 665345 - RNA, 19 nt, Human
ccagggaggaagggaggca

SEQ ID NO: 665346 - RNA, 23 nt, Human
ccagggugccaggguccagaagu

SEQ ID NO: 665347 - RNA, 25 nt, Human
ccagggugccaggguccagaaguug

SEQ ID NO: 665348 - RNA, 18 nt, Human
cccccgggcaggcuuggg

SEQ ID NO: 665349 - RNA, 27 nt, Human
cccccgggcaggcuugggacuuggccc

SEQ ID NO: 665350 - RNA, 22 nt, Human
cccucaggcugugcuggccuag

SEQ ID NO: 665351 - RNA, 24 nt, Human
cccugacagaggccacuuccccca

SEQ ID NO: 665352 - RNA, 18 nt, Human
cccuuugcuguaccccuc

SEQ ID NO: 665353 - RNA, 21 nt, Human
ccgaacuccuccaggccagca

SEQ ID NO: 665354 - RNA, 25 nt, Human
ccucaggggccagcaaagggucccc

SEQ ID NO: 665355 - RNA, 19 nt, Human
ccuccaggccagcagccca

SEQ ID NO: 665356 - RNA, 21 nt, Human
cgccagggaggaagggaggca

SEQ ID NO: 665357 - RNA, 21 nt, Human
cuauauugcugcccacacaaa

SEQ ID NO: 665358 - RNA, 19 nt, Human
cucagaggcccacccacag

SEQ ID NO: 665359 - RNA, 18 nt, Human
cucucauuucuuccccag

SEQ ID NO: 665360 - RNA, 21 nt, Human
cugacagaggccacuuccccc

SEQ ID NO: 665361 - RNA, 19 nt, Human
cugggccucagggggcugu

SEQ ID NO: 665362 - RNA, 21 nt, Human
cuucagggcucccaugcaagu

SEQ ID NO: 665363 - RNA, 21 nt, Human
gaggaugugcgagaagugcag

SEQ ID NO: 665364 - RNA, 23 nt, Human
gaggcaggggccgcgacuccugg

SEQ ID NO: 665365 - RNA, 22 nt, Human
gcaguggccugccccucuccaa

SEQ ID NO: 665366 - RNA, 24 nt, Human
gcccuggcccugacagaggccacu

SEQ ID NO: 665367 - RNA, 19 nt, Human
gccugcccgucccaccagc

SEQ ID NO: 665368 - RNA, 21 nt, Human
gcuggcagguggccaggaagc

SEQ ID NO: 665369 - RNA, 24 nt, Human
ggagaauggcugcuggggaggaga

SEQ ID NO: 665370 - RNA, 20 nt, Human
ggaggaagggaggcaggggc

SEQ ID NO: 665371 - RNA, 22 nt, Human
ggcaggugaggaucgccaggga

SEQ ID NO: 665372 - RNA, 19 nt, Human
gggaaaggggagaauggcu

SEQ ID NO: 665373 - RNA, 18 nt, Human
gggaaggggugccagacu

SEQ ID NO: 665374 - RNA, 24 nt, Human
ggggaggagaugcggagugcaggg

SEQ ID NO: 665375 - RNA, 22 nt, Human
ggggccagcaaaggguccccuu

SEQ ID NO: 665376 - RNA, 21 nt, Human
gguuguggacagagagcugca

SEQ ID NO: 665377 - RNA, 20 nt, Human
guagugcgggugugcaggaa

SEQ ID NO: 665378 - RNA, 20 nt, Human
guccagaaguugcuugcaca

SEQ ID NO: 665379 - RNA, 19 nt, Human
gugcagggaggguggggac

SEQ ID NO: 665380 - RNA, 19 nt, Human
gugguggcacccugcacag

SEQ ID NO: 665381 - RNA, 22 nt, Human
uacccuauauugcugcccacac

SEQ ID NO: 665382 - RNA, 19 nt, Human
uagggcagacccggccugc

SEQ ID NO: 665383 - RNA, 20 nt, Human
ucacaagggaaaggggagaa

SEQ ID NO: 665384 - RNA, 23 nt, Human
uccuccaggccagcagcccaggg

SEQ ID NO: 665385 - RNA, 21 nt, Human
ucugggccucagggggcuguc

SEQ ID NO: 665386 - RNA, 19 nt, Human
ugagauggaggcagaggcc

SEQ ID NO: 665387 - RNA, 19 nt, Human
ugagcccuggcccugacag

SEQ ID NO: 665388 - RNA, 23 nt, Human
ugccagacuccagccucaggggc

SEQ ID NO: 665389 - RNA, 19 nt, Human
ugcuggggaggagaugcgg

SEQ ID NO: 665390 - RNA, 18 nt, Human
uggacagagagcugcaug

SEQ ID NO: 665391 - RNA, 21 nt, Human
uggacccagucauuaccgggc

SEQ ID NO: 665392 - RNA, 20 nt, Human
uggccaggaagcagagggug

SEQ ID NO: 665393 - RNA, 24 nt, Human
uggcugcuggggaggagaugcggg

SEQ ID NO: 665394 - RNA, 22 nt, Human
uggcugggcaggugaggaucgc

SEQ ID NO: 665395 - RNA, 18 nt, Human
uggcugggcaggugaggg

SEQ ID NO: 665396 - RNA, 21 nt, Human
uguggggugucugguuuucug

SEQ ID NO: 665397 - RNA, 24 nt, Human
aaagugcugggauuacaggcguga

SEQ ID NO: 665398 - RNA, 23 nt, Human
aaaguguuggcauuacggcguga

SEQ ID NO: 665399 - RNA, 24 nt, Human
aaggguuucaccauguuggccagg

SEQ ID NO: 665400 - RNA, 19 nt, Human
aaguagcugggacuacagg

SEQ ID NO: 665401 - RNA, 20 nt, Human
aaguagcugggacuacaggu

SEQ ID NO: 665402 - RNA, 24 nt, Human
aaguagcugggacuacagguaugc

SEQ ID NO: 665403 - RNA, 19 nt, Human
aagugcugggauuacaggc

SEQ ID NO: 665404 - RNA, 19 nt, Human
aagugcugggauuacaggc

SEQ ID NO: 665405 - RNA, 26 nt, Human
aagugcugggauuacaggcgugagcc

SEQ ID NO: 665406 - RNA, 21 nt, Human
accauguuggccaggcugguc

SEQ ID NO: 665407 - RNA, 22 nt, Human
acccaggcuggagugcacuggu

SEQ ID NO: 665408 - RNA, 23 nt, Human
accucagccucccaaagugcugg

SEQ ID NO: 665409 - RNA, 20 nt, Human
acgagguuucaccauauuag

SEQ ID NO: 665410 - RNA, 18 nt, Human
agacuacaggcacgcacc

SEQ ID NO: 665411 - RNA, 20 nt, Human
aggcacgcaccaccaugccc

SEQ ID NO: 665412 - RNA, 22 nt, Human
agguuucaccauauuagccagg

SEQ ID NO: 665413 - RNA, 22 nt, Human
aguagagacgagguuucaccau

SEQ ID NO: 665414 - RNA, 23 nt, Human
aguagcugagacuacaggcacgc

SEQ ID NO: 665415 - RNA, 24 nt, Human
agugcacuggugaaaucucggcuc

SEQ ID NO: 665416 - RNA, 18 nt, Human
agugcugggauuacaggc

SEQ ID NO: 665417 - RNA, 20 nt, Human
aguucaagugauucuccugc

SEQ ID NO: 665418 - RNA, 18 nt, Human
auucuccugccucagccu

SEQ ID NO: 665419 - RNA, 24 nt, Human
auuuuuguauuuuuaguagagacg

SEQ ID NO: 665420 - RNA, 24 nt, Human
caaagugcugggauuacaggcgug

SEQ ID NO: 665421 - RNA, 22 nt, Human
caagugauucuccugccucagc

SEQ ID NO: 665422 - RNA, 27 nt, Human
caagugauucuccugccucagccuccc

SEQ ID NO: 665423 - RNA, 24 nt, Human
caccacaccuggcuaauuuuugua

SEQ ID NO: 665424 - RNA, 22 nt, Human
caccaccaugcccagcuaauuu

SEQ ID NO: 665425 - RNA, 21 nt, Human
caccauauuagccaggcuggu

SEQ ID NO: 665426 - RNA, 27 nt, Human
caccauauuagccaggcuggucuggaa

SEQ ID NO: 665427 - RNA, 24 nt, Human
caccaugcccagcuaauuuuugua

SEQ ID NO: 665428 - RNA, 21 nt, Human
caccauguuggccaggcuggu

SEQ ID NO: 665429 - RNA, 22 nt, Human
caccauguuggccaggcugguc

SEQ ID NO: 665430 - RNA, 31 nt, Human
caccauguuggccaggcuggucgugaacucc

SEQ ID NO: 665431 - RNA, 23 nt, Human
cacgcaccaccaugcccagcuaa

SEQ ID NO: 665432 - RNA, 21 nt, Human
cacugcaaccuucgccucccg

SEQ ID NO: 665433 - RNA, 20 nt, Human
cagccuccugaguagcugag

SEQ ID NO: 665434 - RNA, 21 nt, Human
cagcggcagcggcgcgcaucg

SEQ ID NO: 665435 - RNA, 22 nt, Human
caggcgauucuccugccucagc

SEQ ID NO: 665436 - RNA, 23 nt, Human
caguagagaaggguuucaccaug

SEQ ID NO: 665437 - RNA, 21 nt, Human
cauauuagccaggcuggucug

SEQ ID NO: 665438 - RNA, 24 nt, Human
cauauuagccaggcuggucuggaa

SEQ ID NO: 665439 - RNA, 24 nt, Human
cauguuggccaggcuggucgugaa

SEQ ID NO: 665440 - RNA, 22 nt, Human
ccaaagugcugggauuacaggc

SEQ ID NO: 665441 - RNA, 22 nt, Human
ccaaagugcugggauuacaggc

SEQ ID NO: 665442 - RNA, 24 nt, Human
ccaaagugcugggauuacaggcgu

SEQ ID NO: 665443 - RNA, 23 nt, Human
ccaaaguguuggcauuacggcgu

SEQ ID NO: 665444 - RNA, 30 nt, Human
ccaccagacugauccccucacccccacgcu

SEQ ID NO: 665445 - RNA, 22 nt, Human
ccacugcacccaccacauuaac

SEQ ID NO: 665446 - RNA, 22 nt, Human
ccacugccacccucugcccugc

SEQ ID NO: 665447 - RNA, 22 nt, Human
cccaaguagcugggacuacagg

SEQ ID NO: 665448 - RNA, 23 nt, Human
cccaaguagcugggacuacaggu

SEQ ID NO: 665449 - RNA, 20 nt, Human
ccccucacccccacgcagcg

SEQ ID NO: 665450 - RNA, 22 nt, Human
ccccucgagacaagagucuggc

SEQ ID NO: 665451 - RNA, 23 nt, Human
cccgaguucaagugauucuccug

SEQ ID NO: 665452 - RNA, 20 nt, Human
cccggguucaggcgauucuc

SEQ ID NO: 665453 - RNA, 23 nt, Human
cccggguucaggcgauucuccug

SEQ ID NO: 665454 - RNA, 24 nt, Human
cccugacauuauugugaagcucug

SEQ ID NO: 665455 - RNA, 24 nt, Human
ccgcccggguucaggcgauucucc

SEQ ID NO: 665456 - RNA, 24 nt, Human
ccucccgaguucaagugauucucc

SEQ ID NO: 665457 - RNA, 24 nt, Human
ccugaccucaggugaucugcccac

SEQ ID NO: 665458 - RNA, 22 nt, Human
ccugaccuuguaauccacucac

SEQ ID NO: 665459 - RNA, 19 nt, Human
ccugaguagcugagacuac

SEQ ID NO: 665460 - RNA, 24 nt, Human
ccugaguagcugagacuacaggca

SEQ ID NO: 665461 - RNA, 23 nt, Human
ccugccucagccucccaaguagc

SEQ ID NO: 665462 - RNA, 24 nt, Human
ccugccucagccucccaaguagcu

SEQ ID NO: 665463 - RNA, 23 nt, Human
ccugccucagccuccugaguagc

SEQ ID NO: 665464 - RNA, 23 nt, Human
cgcccaggcuggaucuuggcuca

SEQ ID NO: 665465 - RNA, 20 nt, Human
cgccucacuccugcagcugc

SEQ ID NO: 665466 - RNA, 22 nt, Human
cgccucccgaguucaagugauu

SEQ ID NO: 665467 - RNA, 23 nt, Human
cgccucccgaguucaagugauuc

SEQ ID NO: 665468 - RNA, 23 nt, Human
cuaauuuuuguauuuucaguaga

SEQ ID NO: 665469 - RNA, 24 nt, Human
cuacaaccuccaccgcccggguuc

SEQ ID NO: 665470 - RNA, 24 nt, Human
cucacuacaaccuccaccgcccgg

SEQ ID NO: 665471 - RNA, 24 nt, Human
cucacugcaaccuucgccucccga

SEQ ID NO: 665472 - RNA, 24 nt, Human
cucagccucccaaguagcugggac

SEQ ID NO: 665473 - RNA, 19 nt, Human
cucccgaguucaagugauu

SEQ ID NO: 665474 - RNA, 18 nt, Human
cuccugaccuuguaaucc

SEQ ID NO: 665475 - RNA, 25 nt, Human
cuccugaccuuguaauccacucacc

SEQ ID NO: 665476 - RNA, 20 nt, Human
cucugagaagaugucaugca

SEQ ID NO: 665477 - RNA, 20 nt, Human
cucugucacccaggcuggag

SEQ ID NO: 665478 - RNA, 25 nt, Human
cucugucacccaggcuggagugcac

SEQ ID NO: 665479 - RNA, 23 nt, Human
cugcaaccuucgccucccgaguu

SEQ ID NO: 665480 - RNA, 23 nt, Human
cugccucagccuccugaguagcu

SEQ ID NO: 665481 - RNA, 21 nt, Human
cuggcucugucgcccaggcug

SEQ ID NO: 665482 - RNA, 18 nt, Human
cugucacccaggcuggag

SEQ ID NO: 665483 - RNA, 20 nt, Human
cuugccuaugugccacugcc

SEQ ID NO: 665484 - RNA, 23 nt, Human
cuuuccaccagacugauccccuc

SEQ ID NO: 665485 - RNA, 24 nt, Human
gaaggguuucaccauguuggccag

SEQ ID NO: 665486 - RNA, 24 nt, Human
gaccucaggugaucugcccacuuc

SEQ ID NO: 665487 - RNA, 22 nt, Human
gaccuuguaauccacucaccuc

SEQ ID NO: 665488 - RNA, 24 nt, Human
gaccuuguaauccacucaccucag

SEQ ID NO: 665489 - RNA, 22 nt, Human
gacuacaggcacgcaccaccau

SEQ ID NO: 665490 - RNA, 22 nt, Human
gagacaagagucuggcucuguc

SEQ ID NO: 665491 - RNA, 22 nt, Human
gaguucaagugauucuccugcc

SEQ ID NO: 665492 - RNA, 18 nt, Human
gauuacaggcgugagcca

SEQ ID NO: 665493 - RNA, 22 nt, Human
gauuacaggcgugagccacugc

SEQ ID NO: 665494 - RNA, 23 nt, Human
gauuacaggcgugagccacugca

SEQ ID NO: 665495 - RNA, 21 nt, Human
gauucuccugccucagccucc

SEQ ID NO: 665496 - RNA, 21 nt, Human
gauucuccugccucagccucc

SEQ ID NO: 665497 - RNA, 19 nt, Human
gcacgcaccaccaugccca

SEQ ID NO: 665498 - RNA, 23 nt, Human
gcauuuuuuuuuauuuauuuuuu

SEQ ID NO: 665499 - RNA, 22 nt, Human
gcccagcuaauuuuuguauuuu

SEQ ID NO: 665500 - RNA, 24 nt, Human
gcccggguucaggcgauucuccug

SEQ ID NO: 665501 - RNA, 23 nt, Human
gcgauucuccugccucagccucc

SEQ ID NO: 665502 - RNA, 26 nt, Human
gcucugucgcccaggcuggaucuugg

SEQ ID NO: 665503 - RNA, 23 nt, Human
gcuggucgugaacuccugaccuc

SEQ ID NO: 665504 - RNA, 25 nt, Human
gcuggucuggaacuccugaccuugu

SEQ ID NO: 665505 - RNA, 19 nt, Human
ggacuacagguaugcgcca

SEQ ID NO: 665506 - RNA, 19 nt, Human
ggccaggcuggucgugaac

SEQ ID NO: 665507 - RNA, 19 nt, Human
ggcucugucgcccaggcug

SEQ ID NO: 665508 - RNA, 23 nt, Human
ggcuggaucuuggcucacuacaa

SEQ ID NO: 665509 - RNA, 24 nt, Human
ggcuggucgugaacuccugaccuc

SEQ ID NO: 665510 - RNA, 23 nt, Human
ggcuggucuggaacuccugaccu

SEQ ID NO: 665511 - RNA, 21 nt, Human
ggguuucaccauguuggccag

SEQ ID NO: 665512 - RNA, 22 nt, Human
ggguuucaccauguuggccagg

SEQ ID NO: 665513 - RNA, 20 nt, Human
ggucuggaacuccugaccuu

SEQ ID NO: 665514 - RNA, 24 nt, Human
guaauccacucaccucagccuccc

SEQ ID NO: 665515 - RNA, 24 nt, Human
gugauucuccugccucagccuccc

SEQ ID NO: 665516 - RNA, 24 nt, Human
uaauccacucaccucagccuccca

SEQ ID NO: 665517 - RNA, 24 nt, Human
uaauuuuuguauuuucaguagaga

SEQ ID NO: 665518 - RNA, 24 nt, Human
uaauuuuuguauuuuuaguagaga

SEQ ID NO: 665519 - RNA, 19 nt, Human
uacaggcgugagccacugc

SEQ ID NO: 665520 - RNA, 24 nt, Human
uacaggcgugagccacugcaccca

SEQ ID NO: 665521 - RNA, 22 nt, Human
uacagguaugcgccaccacacc

SEQ ID NO: 665522 - RNA, 22 nt, Human
uaccuccaagcgccucacuccu

SEQ ID NO: 665523 - RNA, 21 nt, Human
uagagaaggguuucaccaugu

SEQ ID NO: 665524 - RNA, 24 nt, Human
uagccaggcuggucuggaacuccu

SEQ ID NO: 665525 - RNA, 23 nt, Human
uaguagagacgagguuucaccau

SEQ ID NO: 665526 - RNA, 26 nt, Human
uaguagagacgagguuucaccauauu

SEQ ID NO: 665527 - RNA, 28 nt, Human
uauuuauuuuuuuuuugagauggagucu

SEQ ID NO: 665528 - RNA, 18 nt, Human
ucaagugauucuccugcc

SEQ ID NO: 665529 - RNA, 18 nt, Human
ucacccaggcuggagugc

SEQ ID NO: 665530 - RNA, 24 nt, Human
ucaccucagccucccaaagugcug

SEQ ID NO: 665531 - RNA, 18 nt, Human
ucacuacaaccuccaccg

SEQ ID NO: 665532 - RNA, 24 nt, Human
ucacuacaaccuccaccgcccggg

SEQ ID NO: 665533 - RNA, 27 nt, Human
ucacuacaaccuccaccgcccggguuc

SEQ ID NO: 665534 - RNA, 18 nt, Human
ucacugcaaccuucgccu

SEQ ID NO: 665535 - RNA, 19 nt, Human
ucacugcaaccuucgccuc

SEQ ID NO: 665536 - RNA, 22 nt, Human
ucacugcaaccuucgccucccg

SEQ ID NO: 665537 - RNA, 24 nt, Human
ucacugcaaccuucgccucccgag

SEQ ID NO: 665538 - RNA, 18 nt, Human
ucagccucccaaguagcu

SEQ ID NO: 665539 - RNA, 20 nt, Human
ucagccucccaaguagcugg

SEQ ID NO: 665540 - RNA, 23 nt, Human
ucaguagagaaggguuucaccau

SEQ ID NO: 665541 - RNA, 24 nt, Human
ucaguagagaaggguuucaccaug

SEQ ID NO: 665542 - RNA, 19 nt, Human
uccaagcgccucacuccug

SEQ ID NO: 665543 - RNA, 23 nt, Human
uccaccagacugauccccucacc

SEQ ID NO: 665544 - RNA, 21 nt, Human
uccacucaccucagccuccca

SEQ ID NO: 665545 - RNA, 24 nt, Human
ucccaaagugcugggauuacaggc

SEQ ID NO: 665546 - RNA, 23 nt, Human
ucccaaguagcugggacuacagg

SEQ ID NO: 665547 - RNA, 21 nt, Human
ucccgaguucaagugauucuc

SEQ ID NO: 665548 - RNA, 24 nt, Human
ucccgaguucaagugauucuccug

SEQ ID NO: 665549 - RNA, 24 nt, Human
uccugaguagcugagacuacaggc

SEQ ID NO: 665550 - RNA, 26 nt, Human
ucuccugccucagccucccaaguagc

SEQ ID NO: 665551 - RNA, 24 nt, Human
ucuccugccucagccuccugagua

SEQ ID NO: 665552 - RNA, 19 nt, Human
ucuggcucugucgcccagg

SEQ ID NO: 665553 - RNA, 23 nt, Human
ucuggcucugucgcccaggcugg

SEQ ID NO: 665554 - RNA, 24 nt, Human
ucuggcucugucgcccaggcugga

SEQ ID NO: 665555 - RNA, 18 nt, Human
ucugucacccaggcugga

SEQ ID NO: 665556 - RNA, 18 nt, Human
ucugucgcccaggcugga

SEQ ID NO: 665557 - RNA, 23 nt, Human
ucuugcucugucacccaggcugg

SEQ ID NO: 665558 - RNA, 24 nt, Human
ucuugcucugucacccaggcugga

SEQ ID NO: 665559 - RNA, 18 nt, Human
ugaccucaggugaucugc

SEQ ID NO: 665560 - RNA, 20 nt, Human
ugaccucaggugaucugccc

SEQ ID NO: 665561 - RNA, 21 nt, Human
ugaccucaggugaucugccca

SEQ ID NO: 665562 - RNA, 22 nt, Human
ugaccucaggugaucugcccac

SEQ ID NO: 665563 - RNA, 23 nt, Human
ugaccuuguaauccacucaccuc

SEQ ID NO: 665564 - RNA, 21 nt, Human
ugagacuacaggcacgcacca

SEQ ID NO: 665565 - RNA, 24 nt, Human
ugagacuacaggcacgcaccacca

SEQ ID NO: 665566 - RNA, 22 nt, Human
ugagauggagucuugcucuguc

SEQ ID NO: 665567 - RNA, 19 nt, Human
ugagcacuuccugugagcc

SEQ ID NO: 665568 - RNA, 20 nt, Human
ugaucugcccacuucggucu

SEQ ID NO: 665569 - RNA, 22 nt, Human
ugcacuggugaaaucucggcuc

SEQ ID NO: 665570 - RNA, 21 nt, Human
ugccacccucugcccugcucu

SEQ ID NO: 665571 - RNA, 19 nt, Human
ugcccugcucuuuggguca

SEQ ID NO: 665572 - RNA, 24 nt, Human
ugccucagccucccaaguagcugg

SEQ ID NO: 665573 - RNA, 24 nt, Human
ugccucagccuccugaguagcuga

SEQ ID NO: 665574 - RNA, 24 nt, Human
ugcugggauuacaggcgugagcca

SEQ ID NO: 665575 - RNA, 19 nt, Human
uggagucuugcucugucac

SEQ ID NO: 665576 - RNA, 24 nt, Human
uggagugcacuggugaaaucucgg

SEQ ID NO: 665577 - RNA, 23 nt, Human
uggaucuuggcucacuacaaccu

SEQ ID NO: 665578 - RNA, 27 nt, Human
uggcauuacggcgugagcaccuggcca

SEQ ID NO: 665579 - RNA, 24 nt, Human
uggccaggcuggucgugaacuccu

SEQ ID NO: 665580 - RNA, 21 nt, Human
ugggacuacagguaugcgcca

SEQ ID NO: 665581 - RNA, 22 nt, Human
ugggacuacagguaugcgccac

SEQ ID NO: 665582 - RNA, 24 nt, Human
ugggacuacagguaugcgccacca

SEQ ID NO: 665583 - RNA, 18 nt, Human
ugggauuacaggcgugag

SEQ ID NO: 665584 - RNA, 19 nt, Human
ugggauuacaggcgugagc

SEQ ID NO: 665585 - RNA, 21 nt, Human
ugggauuacaggcgugagcca

SEQ ID NO: 665586 - RNA, 22 nt, Human
ugggauuacaggcgugagccac

SEQ ID NO: 665587 - RNA, 22 nt, Human
ugggauuacaggcgugagccac

SEQ ID NO: 665588 - RNA, 24 nt, Human
ugggauuacaggcgugagccacug

SEQ ID NO: 665589 - RNA, 26 nt, Human
ugggauuacaggcgugagccacugca

SEQ ID NO: 665590 - RNA, 21 nt, Human
ugugaagcucugagaagaugu

SEQ ID NO: 665591 - RNA, 24 nt, Human
uuaguagagacgagguuucaccau

SEQ ID NO: 665592 - RNA, 21 nt, Human
uucaagugauucuccugccuc

SEQ ID NO: 665593 - RNA, 23 nt, Human
uucaagugauucuccugccucag

SEQ ID NO: 665594 - RNA, 24 nt, Human
uucaagugauucuccugccucagc

SEQ ID NO: 665595 - RNA, 18 nt, Human
uucaggcgauucuccugc

SEQ ID NO: 665596 - RNA, 21 nt, Human
uucaggcgauucuccugccuc

SEQ ID NO: 665597 - RNA, 23 nt, Human
uucaggcgauucuccugccucag

SEQ ID NO: 665598 - RNA, 24 nt, Human
uucaguagagaaggguuucaccau

SEQ ID NO: 665599 - RNA, 24 nt, Human
uuccaccagacugauccccucacc

SEQ ID NO: 665600 - RNA, 21 nt, Human
uugagauggagucuugcucug

SEQ ID NO: 665601 - RNA, 24 nt, Human
uugcucugucacccaggcuggagu

SEQ ID NO: 665602 - RNA, 24 nt, Human
uuucaccauguuggccaggcuggu

SEQ ID NO: 665603 - RNA, 23 nt, Human
uuuucaguagagaaggguuucac

SEQ ID NO: 665604 - RNA, 24 nt, Human
uuuuuaguagagacgagguuucac

SEQ ID NO: 665605 - RNA, 20 nt, Human
uuuuuguauuuucaguagag

SEQ ID NO: 665606 - RNA, 20 nt, Human
uuuuuguauuuuuaguagag

SEQ ID NO: 665607 - RNA, 22 nt, Human
uuuuuuuuuugagauggagucu

SEQ ID NO: 665608 - RNA, 22 nt, Human
aagaaaccucaugucugagggc

SEQ ID NO: 665609 - RNA, 20 nt, Human
aagcugccuggagacuguag

SEQ ID NO: 665610 - RNA, 20 nt, Human
aaggagcaggugagagccag

SEQ ID NO: 665611 - RNA, 18 nt, Human
accaaacccagccucagc

SEQ ID NO: 665612 - RNA, 22 nt, Human
acccacaugcaccaaacccagc

SEQ ID NO: 665613 - RNA, 20 nt, Human
accucaugucugagggcaag

SEQ ID NO: 665614 - RNA, 22 nt, Human
agaaagcauaaaccccagcgcu

SEQ ID NO: 665615 - RNA, 24 nt, Human
auagccagagccucuggcagagga

SEQ ID NO: 665616 - RNA, 21 nt, Human
caaaaugaaauaaggaaccug

SEQ ID NO: 665617 - RNA, 20 nt, Human
caaacccagccucagcaccu

SEQ ID NO: 665618 - RNA, 24 nt, Human
cacaaggcagcccggacaagacac

SEQ ID NO: 665619 - RNA, 19 nt, Human
caccaaacccagccucagc

SEQ ID NO: 665620 - RNA, 18 nt, Human
cagcaccuagcccacccc

SEQ ID NO: 665621 - RNA, 25 nt, Human
cagcagcugaagcugaagacuccag

SEQ ID NO: 665622 - RNA, 19 nt, Human
cagccuaaaggagcaggug

SEQ ID NO: 665623 - RNA, 18 nt, Human
ccagacagcagcugaagc

SEQ ID NO: 665624 - RNA, 19 nt, Human
ccagggccaggccaucggg

SEQ ID NO: 665625 - RNA, 23 nt, Human
cccagccucagcaccuagcccac

SEQ ID NO: 665626 - RNA, 18 nt, Human
ccccagacagcagcugaa

SEQ ID NO: 665627 - RNA, 22 nt, Human
ccccugagagcccugagaucga

SEQ ID NO: 665628 - RNA, 23 nt, Human
ccuagcccaccccgaugggacgg

SEQ ID NO: 665629 - RNA, 23 nt, Human
ccucaacccacaugcaccaaacc

SEQ ID NO: 665630 - RNA, 23 nt, Human
cgacauuucugaagcccugccac

SEQ ID NO: 665631 - RNA, 18 nt, Human
cucagcaccuagcccacc

SEQ ID NO: 665632 - RNA, 22 nt, Human
gaggcugcucaggaagcacaga

SEQ ID NO: 665633 - RNA, 23 nt, Human
gcaccaaacccagccucagcacc

SEQ ID NO: 665634 - RNA, 19 nt, Human
gcagggacugcccccugag

SEQ ID NO: 665635 - RNA, 18 nt, Human
uacagccuaaaggagcag

SEQ ID NO: 665636 - RNA, 20 nt, Human
uagcagcuacgguugaggcu

SEQ ID NO: 665637 - RNA, 20 nt, Human
uagggaucugagacuugaaa

SEQ ID NO: 665638 - RNA, 24 nt, Human
uagggucguccucucaagucaagc

SEQ ID NO: 665639 - RNA, 18 nt, Human
ucugaagcccugccaccu

SEQ ID NO: 665640 - RNA, 23 nt, Human
ugaccuccuggggaaggagggag

SEQ ID NO: 665641 - RNA, 19 nt, Human
ugagaucaaaaugaaauaa

SEQ ID NO: 665642 - RNA, 20 nt, Human
ugagauggaccagaggcucc

SEQ ID NO: 665643 - RNA, 24 nt, Human
uggcagaggagaugggggaaacuu

SEQ ID NO: 665644 - RNA, 24 nt, Human
uggggaaggagggagcugagauca

SEQ ID NO: 665645 - RNA, 21 nt, Human
ugggggaaacugagguagccc

SEQ ID NO: 665646 - RNA, 20 nt, Human
agccagaaagagcuuccugu

SEQ ID NO: 665647 - RNA, 21 nt, Human
agcugagcucagaaagaagcu

SEQ ID NO: 665648 - RNA, 25 nt, Human
agcuucaguugggagccagaaagag

SEQ ID NO: 665649 - RNA, 27 nt, Human
aggagaagggaaaccaaaaucacagaa

SEQ ID NO: 665650 - RNA, 20 nt, Human
aggcagaggcagcagaguua

SEQ ID NO: 665651 - RNA, 20 nt, Human
cagaaagaagcuaaugauug

SEQ ID NO: 665652 - RNA, 22 nt, Human
cagaaagaagcuaaugauugcg

SEQ ID NO: 665653 - RNA, 21 nt, Human
cuaaguccauaaaauaucagc

SEQ ID NO: 665654 - RNA, 20 nt, Human
gaagaaaucuuguugccuuc

SEQ ID NO: 665655 - RNA, 19 nt, Human
ugaauaggcaggcagaggc

SEQ ID NO: 665656 - RNA, 19 nt, Human
ugagcucagaaagaagcua

SEQ ID NO: 665657 - RNA, 20 nt, Human
ugagcucagaaagaagcuaa

SEQ ID NO: 665658 - RNA, 22 nt, Human
ugccugccugcacucugugaac

SEQ ID NO: 665659 - RNA, 20 nt, Human
uguugaaaagaauucuguaa

SEQ ID NO: 665660 - RNA, 21 nt, Human
uugacggcggcugcuggccuc

SEQ ID NO: 665661 - RNA, 25 nt, Human
aaaaaaaaaagaaagaaagaaagaa

SEQ ID NO: 665662 - RNA, 20 nt, Human
aaaaaaaaucguaaaaagca

SEQ ID NO: 665663 - RNA, 23 nt, Human
aaaaagcaauugaggaggauggc

SEQ ID NO: 665664 - RNA, 22 nt, Human
aaaacggaacagaaaaugaaug

SEQ ID NO: 665665 - RNA, 22 nt, Human
aaaaggacaaaacggaacagaa

SEQ ID NO: 665666 - RNA, 24 nt, Human
aaaaggacaaaacggaacagaaaa

SEQ ID NO: 665667 - RNA, 21 nt, Human
aagaaagaaagaaagaaagaa

SEQ ID NO: 665668 - RNA, 20 nt, Human
aagugcaaaacaagccauag

SEQ ID NO: 665669 - RNA, 19 nt, Human
agaaagaaagaaacuauaa

SEQ ID NO: 665670 - RNA, 21 nt, Human
aggacaaaacggaacagaaaa

SEQ ID NO: 665671 - RNA, 21 nt, Human
aggcagugaaauuauucugaa

SEQ ID NO: 665672 - RNA, 20 nt, Human
aggcccgagccgggcagcag

SEQ ID NO: 665673 - RNA, 26 nt, Human
aggcccgagccgggcagcagcagcgg

SEQ ID NO: 665674 - RNA, 26 nt, Human
caccgugcuaaccagucgcgcaggac

SEQ ID NO: 665675 - RNA, 20 nt, Human
cagagugcugagauccugcg

SEQ ID NO: 665676 - RNA, 24 nt, Human
cauacagauuuaaaaaaaaaaaga

SEQ ID NO: 665677 - RNA, 22 nt, Human
ccaccgugcuaaccagucgcgc

SEQ ID NO: 665678 - RNA, 22 nt, Human
cccgcgccgcauccuccggccg

SEQ ID NO: 665679 - RNA, 21 nt, Human
ccgcauccuccggccgccccc

SEQ ID NO: 665680 - RNA, 21 nt, Human
ccgcauccuccggccgccccc

SEQ ID NO: 665681 - RNA, 23 nt, Human
ccgcauccuccggccgcccccuc

SEQ ID NO: 665682 - RNA, 22 nt, Human
ccgcgccgcauccuccggccgc

SEQ ID NO: 665683 - RNA, 19 nt, Human
ccuccggccgcccccuccc

SEQ ID NO: 665684 - RNA, 22 nt, Human
ccuccggccgcccccuccccgc

SEQ ID NO: 665685 - RNA, 20 nt, Human
cgcagccccgcgccgcaucc

SEQ ID NO: 665686 - RNA, 23 nt, Human
cgccgcugucgccgccgccaccg

SEQ ID NO: 665687 - RNA, 25 nt, Human
cgccuuaaaaaggacaaaacggaac

SEQ ID NO: 665688 - RNA, 24 nt, Human
cgcgcgcgcggcucggcggggcgg

SEQ ID NO: 665689 - RNA, 25 nt, Human
cuuaaaaaggacaaaacggaacaga

SEQ ID NO: 665690 - RNA, 22 nt, Human
gcgcagccccgcgccgcauccu

SEQ ID NO: 665691 - RNA, 21 nt, Human
gcgugccgcacgcggguggcu

SEQ ID NO: 665692 - RNA, 21 nt, Human
ggauccugcucggcgcucagg

SEQ ID NO: 665693 - RNA, 23 nt, Human
ggcagcagcagcggacguagcga

SEQ ID NO: 665694 - RNA, 21 nt, Human
ggcguggcuaccagcuccacc

SEQ ID NO: 665695 - RNA, 19 nt, Human
gggcagcagcagcggacca

SEQ ID NO: 665696 - RNA, 27 nt, Human
gggcagcagcagcggacguagcgagcg

SEQ ID NO: 665697 - RNA, 21 nt, Human
uaaaaaaaaaaagaaagaaag

SEQ ID NO: 665698 - RNA, 20 nt, Human
uaaaaagcaauugaggagga

SEQ ID NO: 665699 - RNA, 22 nt, Human
uaaaaagcaauugaggaggaug

SEQ ID NO: 665700 - RNA, 19 nt, Human
uaaaaaggacaaaacggaa

SEQ ID NO: 665701 - RNA, 20 nt, Human
uaaaaaggacaaaacggaac

SEQ ID NO: 665702 - RNA, 23 nt, Human
uaagugcaaaacaagccauaggc

SEQ ID NO: 665703 - RNA, 23 nt, Human
uacagauuuaaaaaaaaaaagaa

SEQ ID NO: 665704 - RNA, 24 nt, Human
uacagauuuaaaaaaaaaaagaaa

SEQ ID NO: 665705 - RNA, 24 nt, Human
ugaaugcaugcacaaaaaaaaucg

SEQ ID NO: 665706 - RNA, 26 nt, Human
ugcacaaaaaaaaucguaaaaagcaa

SEQ ID NO: 665707 - RNA, 22 nt, Human
ugcgguccacaccuguucacgc

SEQ ID NO: 665708 - RNA, 23 nt, Human
ugggauccugcucggcgcucagg

SEQ ID NO: 665709 - RNA, 21 nt, Human
uuuaaaaaaaaaaagaaagaa

SEQ ID NO: 665710 - RNA, 19 nt, Human
aaaagguccacuccaaaag

SEQ ID NO: 665711 - RNA, 18 nt, Human
aagcggcgguggcggcag

SEQ ID NO: 665712 - RNA, 23 nt, Human
aauaacaaggaacagccaagcca

SEQ ID NO: 665713 - RNA, 22 nt, Human
accaaaaggaauauaaugaauc

SEQ ID NO: 665714 - RNA, 22 nt, Human
accucaagaccucugaucauca

SEQ ID NO: 665715 - RNA, 25 nt, Human
agaccucugaucaucaagacccguc

SEQ ID NO: 665716 - RNA, 22 nt, Human
agaugucaagaccucaagaccu

SEQ ID NO: 665717 - RNA, 25 nt, Human
aggacaacagaaggaaaccgguacc

SEQ ID NO: 665718 - RNA, 24 nt, Human
aggacacacauacauacaaccccc

SEQ ID NO: 665719 - RNA, 19 nt, Human
aguaccccuucacauacuc

SEQ ID NO: 665720 - RNA, 18 nt, Human
auaaugcacaggacaacc

SEQ ID NO: 665721 - RNA, 18 nt, Human
auauuauaaugcacagga

SEQ ID NO: 665722 - RNA, 18 nt, Human
auggaaaccaaaauguau

SEQ ID NO: 665723 - RNA, 23 nt, Human
caaacacagaaaaccaggagcuc

SEQ ID NO: 665724 - RNA, 22 nt, Human
cagaagcggcgguggcggcagc

SEQ ID NO: 665725 - RNA, 21 nt, Human
cagaaggaaccauccugggca

SEQ ID NO: 665726 - RNA, 22 nt, Human
ccaaaaggacuggugcccagug

SEQ ID NO: 665727 - RNA, 24 nt, Human
ccaaacacagaaaaccaggagcuc

SEQ ID NO: 665728 - RNA, 23 nt, Human
ccaccucucaagaacauugcacc

SEQ ID NO: 665729 - RNA, 22 nt, Human
cccaucccagcauuuuuaagag

SEQ ID NO: 665730 - RNA, 26 nt, Human
ccgaagcccgcgcggacccgcccccu

SEQ ID NO: 665731 - RNA, 19 nt, Human
ccuccgaagcccgcgcgga

SEQ ID NO: 665732 - RNA, 19 nt, Human
ccucucccuucacuuagaa

SEQ ID NO: 665733 - RNA, 19 nt, Human
cggaaggggagggauccua

SEQ ID NO: 665734 - RNA, 21 nt, Human
cucccaggccugcccgccgcg

SEQ ID NO: 665735 - RNA, 22 nt, Human
cuccucuggcagggcgggcucc

SEQ ID NO: 665736 - RNA, 19 nt, Human
cugaucaucaaaauaaguu

SEQ ID NO: 665737 - RNA, 20 nt, Human
cuggcagggcgggcuccucc

SEQ ID NO: 665738 - RNA, 24 nt, Human
cuuuacgccgugaccucccucucc

SEQ ID NO: 665739 - RNA, 18 nt, Human
cuuucuuggaaggugaug

SEQ ID NO: 665740 - RNA, 22 nt, Human
gacaaagagcuucagggaggga

SEQ ID NO: 665741 - RNA, 18 nt, Human
gccccaaaccagggcuuu

SEQ ID NO: 665742 - RNA, 20 nt, Human
ggaacagccaagccagccuc

SEQ ID NO: 665743 - RNA, 23 nt, Human
ggacacacauacauacaaccccc

SEQ ID NO: 665744 - RNA, 23 nt, Human
gggaauagacauuccagaaggaa

SEQ ID NO: 665745 - RNA, 23 nt, Human
gguauaaaaucuaccaaaaggaa

SEQ ID NO: 665746 - RNA, 21 nt, Human
uaauucacaacguuuccucuc

SEQ ID NO: 665747 - RNA, 20 nt, Human
uagaaagggauuaugaaugg

SEQ ID NO: 665748 - RNA, 23 nt, Human
uaggacacacauacauacaaccc

SEQ ID NO: 665749 - RNA, 22 nt, Human
uaguagauauggccccaucccu

SEQ ID NO: 665750 - RNA, 18 nt, Human
ucaaaaguggcggccaca

SEQ ID NO: 665751 - RNA, 22 nt, Human
ucaacaccuacauggaaaccaa

SEQ ID NO: 665752 - RNA, 26 nt, Human
ucaacaccuacauggaaaccaaaaug

SEQ ID NO: 665753 - RNA, 23 nt, Human
uccaaacacagaaaaccaggagc

SEQ ID NO: 665754 - RNA, 18 nt, Human
ucccucuccucuggcagg

SEQ ID NO: 665755 - RNA, 20 nt, Human
ucccucuccucuggcaggag

SEQ ID NO: 665756 - RNA, 25 nt, Human
uccucucuugcugcuacucugguaa

SEQ ID NO: 665757 - RNA, 18 nt, Human
uccugggcaaagccuucc

SEQ ID NO: 665758 - RNA, 21 nt, Human
ucuaccaaaaggaauauaaug

SEQ ID NO: 665759 - RNA, 18 nt, Human
ucuugcugcuacucuggu

SEQ ID NO: 665760 - RNA, 21 nt, Human
ugacaaggccuuuugcaaaag

SEQ ID NO: 665761 - RNA, 18 nt, Human
ugagagccagugugaaca

SEQ ID NO: 665762 - RNA, 20 nt, Human
ugcaaaagguccacuccaaa

SEQ ID NO: 665763 - RNA, 22 nt, Human
ugcacaggacaacagaaggaaa

SEQ ID NO: 665764 - RNA, 20 nt, Human
ugcccagugccuuguggccu

SEQ ID NO: 665765 - RNA, 19 nt, Human
uggaaggugaugacaaggc

SEQ ID NO: 665766 - RNA, 18 nt, Human
uucagggagggaaggagg

SEQ ID NO: 665767 - RNA, 25 nt, Human
uucggaauaacaaggaacagccaag

SEQ ID NO: 665768 - RNA, 22 nt, Human
uugcugagcuuauucagcacau

SEQ ID NO: 665769 - RNA, 19 nt, Human
uuucuuggaaggugaugac

SEQ ID NO: 665770 - RNA, 18 nt, Human
aaaaggcauuuucaaugc

SEQ ID NO: 665771 - RNA, 24 nt, Human
aaacagaagcuacaagauguugcc

SEQ ID NO: 665772 - RNA, 19 nt, Human
aaagugcugggauuacagg

SEQ ID NO: 665773 - RNA, 23 nt, Human
aaagugcugggauuacaggcgua

SEQ ID NO: 665774 - RNA, 22 nt, Human
aacacauaaaauuaaccaacac

SEQ ID NO: 665775 - RNA, 21 nt, Human
aacagaacgaacacacccaga

SEQ ID NO: 665776 - RNA, 19 nt, Human
aagauguugccagugggag

SEQ ID NO: 665777 - RNA, 27 nt, Human
aagcaggaagcuaaauugaggggaccc

SEQ ID NO: 665778 - RNA, 19 nt, Human
aagugcugggauuacaggc

SEQ ID NO: 665779 - RNA, 19 nt, Human
aagugcugggauuacaggc

SEQ ID NO: 665780 - RNA, 26 nt, Human
aagugcugggauuacaggcguaagcc

SEQ ID NO: 665781 - RNA, 19 nt, Human
acagcagcuucaaaugucc

SEQ ID NO: 665782 - RNA, 18 nt, Human
acaggcguaagccaccau

SEQ ID NO: 665783 - RNA, 23 nt, Human
acagugcuaaaaacagaagcuac

SEQ ID NO: 665784 - RNA, 24 nt, Human
accauguuggccaggcuggucuug

SEQ ID NO: 665785 - RNA, 22 nt, Human
acuacauccaccaagucacgcc

SEQ ID NO: 665786 - RNA, 23 nt, Human
agagaccaggcaccagccccagu

SEQ ID NO: 665787 - RNA, 20 nt, Human
agcaauucuucaucucagcc

SEQ ID NO: 665788 - RNA, 24 nt, Human
agcagcuucaaauguccaguaacg

SEQ ID NO: 665789 - RNA, 20 nt, Human
agccuuucuuucugggaguu

SEQ ID NO: 665790 - RNA, 25 nt, Human
agcggagugcuggagugcaguggcg

SEQ ID NO: 665791 - RNA, 19 nt, Human
agcuugaaaaacaacggca

SEQ ID NO: 665792 - RNA, 21 nt, Human
aggcauugauggaagaugaaa

SEQ ID NO: 665793 - RNA, 22 nt, Human
agggaaaugaggagagaccagg

SEQ ID NO: 665794 - RNA, 18 nt, Human
aguagcugggauuacagg

SEQ ID NO: 665795 - RNA, 25 nt, Human
aguagcugggauuacaggugcacac

SEQ ID NO: 665796 - RNA, 20 nt, Human
agugcaguggcgggaucuug

SEQ ID NO: 665797 - RNA, 23 nt, Human
agugcaguggcgggaucuuggcu

SEQ ID NO: 665798 - RNA, 24 nt, Human
agugcaguggcgggaucuuggcuc

SEQ ID NO: 665799 - RNA, 18 nt, Human
agugcuaaaaacagaagc

SEQ ID NO: 665800 - RNA, 18 nt, Human
agugcugggauuacaggc

SEQ ID NO: 665801 - RNA, 18 nt, Human
aucaucacugugccacag

SEQ ID NO: 665802 - RNA, 18 nt, Human
augggguuucaccauguu

SEQ ID NO: 665803 - RNA, 22 nt, Human
augggguuucaccauguuggcc

SEQ ID NO: 665804 - RNA, 24 nt, Human
augggguuucaccauguuggccag

SEQ ID NO: 665805 - RNA, 27 nt, Human
auugaaauuagguuuuaaauuuuaauu

SEQ ID NO: 665806 - RNA, 24 nt, Human
caaagugcugggauuacaggcgua

SEQ ID NO: 665807 - RNA, 21 nt, Human
caacacauaaaauuaaccaac

SEQ ID NO: 665808 - RNA, 19 nt, Human
caaguaucuauugaggauc

SEQ ID NO: 665809 - RNA, 24 nt, Human
caagucaacacauaaaauuaacca

SEQ ID NO: 665810 - RNA, 21 nt, Human
caaugcuggugguaauauaaa

SEQ ID NO: 665811 - RNA, 19 nt, Human
cacaccaccacaccuggcu

SEQ ID NO: 665812 - RNA, 24 nt, Human
caccacaccuggcuaauuuuugua

SEQ ID NO: 665813 - RNA, 21 nt, Human
caccauguuggccaggcuggu

SEQ ID NO: 665814 - RNA, 23 nt, Human
caccauguuggccaggcuggucu

SEQ ID NO: 665815 - RNA, 24 nt, Human
caccauguuggccaggcuggucuu

SEQ ID NO: 665816 - RNA, 27 nt, Human
caccauguuggccaggcuggucuugaa

SEQ ID NO: 665817 - RNA, 22 nt, Human
cacccaccucggccucccaaag

SEQ ID NO: 665818 - RNA, 23 nt, Human
cacccaccucggccucccaaagu

SEQ ID NO: 665819 - RNA, 24 nt, Human
caccucggccucccaaagugcugg

SEQ ID NO: 665820 - RNA, 22 nt, Human
cacgccuacuucaaagucaucc

SEQ ID NO: 665821 - RNA, 18 nt, Human
cacuauauuacuuuugca

SEQ ID NO: 665822 - RNA, 24 nt, Human
cacugcagccuuugccuccugggu

SEQ ID NO: 665823 - RNA, 20 nt, Human
cagaacgaacacacccagaa

SEQ ID NO: 665824 - RNA, 21 nt, Human
cagaacgaacacacccagaaa

SEQ ID NO: 665825 - RNA, 21 nt, Human
cagagaaacagaacgaacaca

SEQ ID NO: 665826 - RNA, 27 nt, Human
cagagaaacagaacgaacacacccaga

SEQ ID NO: 665827 - RNA, 21 nt, Human
cagauaauaagagccaacacu

SEQ ID NO: 665828 - RNA, 19 nt, Human
cagccuuucuuucugggag

SEQ ID NO: 665829 - RNA, 20 nt, Human
cagccuuugccuccuggguu

SEQ ID NO: 665830 - RNA, 23 nt, Human
caggauuuuaugcuaaggucagg

SEQ ID NO: 665831 - RNA, 21 nt, Human
caggugcacaccaccacaccu

SEQ ID NO: 665832 - RNA, 19 nt, Human
cauaaaaugacaggaagga

SEQ ID NO: 665833 - RNA, 21 nt, Human
cauaaaauuaaccaacacucu

SEQ ID NO: 665834 - RNA, 19 nt, Human
caucgcaagucacccucca

SEQ ID NO: 665835 - RNA, 20 nt, Human
caucgcaagucacccuccau

SEQ ID NO: 665836 - RNA, 24 nt, Human
caucucagccucccgaguagcugg

SEQ ID NO: 665837 - RNA, 22 nt, Human
caugacagggaaaugaggagag

SEQ ID NO: 665838 - RNA, 23 nt, Human
caugacagggaaaugaggagaga

SEQ ID NO: 665839 - RNA, 24 nt, Human
cauguuggccaggcuggucuugaa

SEQ ID NO: 665840 - RNA, 20 nt, Human
cauuguuaucaucaucaucc

SEQ ID NO: 665841 - RNA, 20 nt, Human
ccaaagugcugggauuacag

SEQ ID NO: 665842 - RNA, 22 nt, Human
ccaaagugcugggauuacaggc

SEQ ID NO: 665843 - RNA, 22 nt, Human
ccaaagugcugggauuacaggc

SEQ ID NO: 665844 - RNA, 24 nt, Human
ccaaagugcugggauuacaggcgu

SEQ ID NO: 665845 - RNA, 20 nt, Human
ccaacauauggaaaucagga

SEQ ID NO: 665846 - RNA, 18 nt, Human
ccaccaugccuggccaac

SEQ ID NO: 665847 - RNA, 18 nt, Human
ccagagaaacagaacgaa

SEQ ID NO: 665848 - RNA, 19 nt, Human
cccagaaauaauguuuuac

SEQ ID NO: 665849 - RNA, 19 nt, Human
cccagagaaacagaacgaa

SEQ ID NO: 665850 - RNA, 23 nt, Human
cccgaguagcugggauuacaggu

SEQ ID NO: 665851 - RNA, 24 nt, Human
cccgaguagcugggauuacaggug

SEQ ID NO: 665852 - RNA, 21 nt, Human
ccgaguagcugggauuacagg

SEQ ID NO: 665853 - RNA, 20 nt, Human
ccgccgccgcccggcgcugu

SEQ ID NO: 665854 - RNA, 24 nt, Human
ccuccuggguuuaagcaauucuuc

SEQ ID NO: 665855 - RNA, 24 nt, Human
cuaauuuuuguauuuuuguagaga

SEQ ID NO: 665856 - RNA, 21 nt, Human
cuauauuacacuauauuacuu

SEQ ID NO: 665857 - RNA, 21 nt, Human
cucacugcagccuuugccucc

SEQ ID NO: 665858 - RNA, 24 nt, Human
cucacugcagccuuugccuccugg

SEQ ID NO: 665859 - RNA, 23 nt, Human
cucagccucccgaguagcuggga

SEQ ID NO: 665860 - RNA, 21 nt, Human
cuccuggguuuaagcaauucu

SEQ ID NO: 665861 - RNA, 18 nt, Human
cucuugacuucgugaucc

SEQ ID NO: 665862 - RNA, 25 nt, Human
cucuugacuucgugauccacccacc

SEQ ID NO: 665863 - RNA, 25 nt, Human
cuggagugcaguggcgggaucuugg

SEQ ID NO: 665864 - RNA, 19 nt, Human
gaaaaggcauuuucaaugc

SEQ ID NO: 665865 - RNA, 22 nt, Human
gacuucgugauccacccaccuc

SEQ ID NO: 665866 - RNA, 24 nt, Human
gacuucgugauccacccaccucgg

SEQ ID NO: 665867 - RNA, 22 nt, Human
gagaaacagaacgaacacaccc

SEQ ID NO: 665868 - RNA, 20 nt, Human
gagaugggguuucaccaugu

SEQ ID NO: 665869 - RNA, 24 nt, Human
gagaugggguuucaccauguuggc

SEQ ID NO: 665870 - RNA, 26 nt, Human
gagccaacacuccuauggcucuucuc

SEQ ID NO: 665871 - RNA, 23 nt, Human
gaucuuuggacccggcaaucuua

SEQ ID NO: 665872 - RNA, 18 nt, Human
gauuacaggcguaagcca

SEQ ID NO: 665873 - RNA, 21 nt, Human
gauuacaggcguaagccacca

SEQ ID NO: 665874 - RNA, 24 nt, Human
gauuacaggcguaagccaccaugc

SEQ ID NO: 665875 - RNA, 19 nt, Human
gcuaaaaacagaagcuaca

SEQ ID NO: 665876 - RNA, 21 nt, Human
gcucacugcagccuuugccuc

SEQ ID NO: 665877 - RNA, 25 nt, Human
ggagugcuggagugcaguggcggga

SEQ ID NO: 665878 - RNA, 24 nt, Human
ggauuacaggcguaagccaccaug

SEQ ID NO: 665879 - RNA, 22 nt, Human
ggcucuucucagaacugggagu

SEQ ID NO: 665880 - RNA, 22 nt, Human
gggguuucaccauguuggccag

SEQ ID NO: 665881 - RNA, 18 nt, Human
ggguuucaccauguuggc

SEQ ID NO: 665882 - RNA, 22 nt, Human
ggguuucaccauguuggccagg

SEQ ID NO: 665883 - RNA, 19 nt, Human
guagagaugggguuucacc

SEQ ID NO: 665884 - RNA, 21 nt, Human
guagagaugggguuucaccau

SEQ ID NO: 665885 - RNA, 22 nt, Human
guagagaugggguuucaccaug

SEQ ID NO: 665886 - RNA, 18 nt, Human
guagcugggauuacaggu

SEQ ID NO: 665887 - RNA, 24 nt, Human
gugauccacccaccucggccuccc

SEQ ID NO: 665888 - RNA, 21 nt, Human
uaaaauuaaccaacacucuua

SEQ ID NO: 665889 - RNA, 23 nt, Human
uaauuuuuguauuuuuguagaga

SEQ ID NO: 665890 - RNA, 22 nt, Human
uacagcagcuucaaauguccag

SEQ ID NO: 665891 - RNA, 22 nt, Human
uacaggcguaagccaccaugcc

SEQ ID NO: 665892 - RNA, 22 nt, Human
uacaggugcacaccaccacacc

SEQ ID NO: 665893 - RNA, 22 nt, Human
uagagaugggguuucaccaugu

SEQ ID NO: 665894 - RNA, 23 nt, Human
uagaucuuuggacccggcaaucu

SEQ ID NO: 665895 - RNA, 22 nt, Human
uaucaucgcaagucacccucca

SEQ ID NO: 665896 - RNA, 24 nt, Human
uauucauucaucaaguaucuauug

SEQ ID NO: 665897 - RNA, 24 nt, Human
ucacugcagccuuugccuccuggg

SEQ ID NO: 665898 - RNA, 25 nt, Human
ucacugcagccuuugccuccugggu

SEQ ID NO: 665899 - RNA, 26 nt, Human
ucacugcagccuuugccuccuggguc

SEQ ID NO: 665900 - RNA, 20 nt, Human
ucacugugccacagcagcuu

SEQ ID NO: 665901 - RNA, 18 nt, Human
ucagaaaagcgagucaca

SEQ ID NO: 665902 - RNA, 20 nt, Human
ucagccucccgaguagcugg

SEQ ID NO: 665903 - RNA, 22 nt, Human
uccaccaagucacgccuacuuc

SEQ ID NO: 665904 - RNA, 24 nt, Human
uccaugggcuggcaugcccaaaga

SEQ ID NO: 665905 - RNA, 19 nt, Human
uccaugugcugggcgaggu

SEQ ID NO: 665906 - RNA, 19 nt, Human
uccauuuuuaauuugggua

SEQ ID NO: 665907 - RNA, 24 nt, Human
ucccaaagugcugggauuacaggc

SEQ ID NO: 665908 - RNA, 23 nt, Human
ucccagagaaacagaacgaacac

SEQ ID NO: 665909 - RNA, 20 nt, Human
uccccgccgccgcccggcgc

SEQ ID NO: 665910 - RNA, 23 nt, Human
ucccgaguagcugggauuacagg

SEQ ID NO: 665911 - RNA, 24 nt, Human
ucccgaguagcugggauuacaggu

SEQ ID NO: 665912 - RNA, 21 nt, Human
uccuggguuuaagcaauucuu

SEQ ID NO: 665913 - RNA, 23 nt, Human
uccuggguuuaagcaauucuuca

SEQ ID NO: 665914 - RNA, 18 nt, Human
ucggccucccaaagugcu

SEQ ID NO: 665915 - RNA, 20 nt, Human
ucuucuuuaaacccuuucag

SEQ ID NO: 665916 - RNA, 22 nt, Human
ucuucuuuaaacccuuucagua

SEQ ID NO: 665917 - RNA, 24 nt, Human
ugaaaaacaacggcaugaccacau

SEQ ID NO: 665918 - RNA, 20 nt, Human
ugacaggaaggauuugcacu

SEQ ID NO: 665919 - RNA, 19 nt, Human
ugacagggaaaugaggaga

SEQ ID NO: 665920 - RNA, 20 nt, Human
ugacuucgugauccacccac

SEQ ID NO: 665921 - RNA, 24 nt, Human
ugauccacccaccucggccuccca

SEQ ID NO: 665922 - RNA, 20 nt, Human
ugcagccuuugccuccuggg

SEQ ID NO: 665923 - RNA, 22 nt, Human
ugcaguggcgggaucuuggcuc

SEQ ID NO: 665924 - RNA, 18 nt, Human
ugccacagcagcuugaaa

SEQ ID NO: 665925 - RNA, 22 nt, Human
ugccacagcagcuugaaaaaca

SEQ ID NO: 665926 - RNA, 23 nt, Human
ugccacagcagcuugaaaaacaa

SEQ ID NO: 665927 - RNA, 26 nt, Human
ugccagugggagagcacuccaugggc

SEQ ID NO: 665928 - RNA, 25 nt, Human
ugcccaaagaaggcauugauggaag

SEQ ID NO: 665929 - RNA, 24 nt, Human
ugcugggauuacaggcguaagcca

SEQ ID NO: 665930 - RNA, 23 nt, Human
uggagugcaguggcgggaucuug

SEQ ID NO: 665931 - RNA, 24 nt, Human
uggagugcaguggcgggaucuugg

SEQ ID NO: 665932 - RNA, 24 nt, Human
uggccaggcuggucuugaacucuu

SEQ ID NO: 665933 - RNA, 21 nt, Human
uggcgggaucuuggcucacug

SEQ ID NO: 665934 - RNA, 18 nt, Human
ugggauuacaggcguaag

SEQ ID NO: 665935 - RNA, 22 nt, Human
ugggauuacaggcguaagccac

SEQ ID NO: 665936 - RNA, 24 nt, Human
ugggauuacaggcguaagccacca

SEQ ID NO: 665937 - RNA, 25 nt, Human
ugggauuacaggcguaagccaccau

SEQ ID NO: 665938 - RNA, 21 nt, Human
ugggauuacaggugcacacca

SEQ ID NO: 665939 - RNA, 22 nt, Human
ugggauuacaggugcacaccac

SEQ ID NO: 665940 - RNA, 24 nt, Human
ugggauuacaggugcacaccacca

SEQ ID NO: 665941 - RNA, 24 nt, Human
ugggguuucaccauguuggccagg

SEQ ID NO: 665942 - RNA, 24 nt, Human
uguagagaugggguuucaccaugu

SEQ ID NO: 665943 - RNA, 22 nt, Human
uuagucugggaucccagagaaa

SEQ ID NO: 665944 - RNA, 25 nt, Human
uucaaugcuggugguaauauaaauu

SEQ ID NO: 665945 - RNA, 24 nt, Human
uucaucucagccucccgaguagcu

SEQ ID NO: 665946 - RNA, 22 nt, Human
uucauuguuaucaucaucaucc

SEQ ID NO: 665947 - RNA, 18 nt, Human
uuccagugaaagacaagg

SEQ ID NO: 665948 - RNA, 27 nt, Human
uugaaaaacaacggcaugaccacauaa

SEQ ID NO: 665949 - RNA, 24 nt, Human
uuguagagaugggguuucaccaug

SEQ ID NO: 665950 - RNA, 20 nt, Human
uugugucuacagugcuaaaa

SEQ ID NO: 665951 - RNA, 24 nt, Human
uuucaccauguuggccaggcuggu

SEQ ID NO: 665952 - RNA, 21 nt, Human
uuucaguauuuuuccauguuu

SEQ ID NO: 665953 - RNA, 21 nt, Human
uuugccuccuggguuuaagca

SEQ ID NO: 665954 - RNA, 24 nt, Human
uuugccuccuggguuuaagcaauu

SEQ ID NO: 665955 - RNA, 24 nt, Human
uuuguagagaugggguuucaccau

SEQ ID NO: 665956 - RNA, 23 nt, Human
uuuuuguagagaugggguuucac

SEQ ID NO: 665957 - RNA, 21 nt, Human
uuuuuguauuuuuguagagau

SEQ ID NO: 665958 - RNA, 19 nt, Human
aaacagcaaagaccccggc

SEQ ID NO: 665959 - RNA, 22 nt, Human
aaacagcaaagaccccggccgu

SEQ ID NO: 665960 - RNA, 24 nt, Human
aaauauaaaaaguuacaaaauucc

SEQ ID NO: 665961 - RNA, 18 nt, Human
aagacccccgacccccgc

SEQ ID NO: 665962 - RNA, 18 nt, Human
aagcacacacuccaagca

SEQ ID NO: 665963 - RNA, 18 nt, Human
aagcggaaacccgggccg

SEQ ID NO: 665964 - RNA, 23 nt, Human
aagcugcuuuugcauaaaaaaau

SEQ ID NO: 665965 - RNA, 18 nt, Human
aaggaggguuuggcuggg

SEQ ID NO: 665966 - RNA, 24 nt, Human
aaggccugugggacagaaaugggg

SEQ ID NO: 665967 - RNA, 21 nt, Human
acacacacacgcgcgcgcgcg

SEQ ID NO: 665968 - RNA, 18 nt, Human
acacacacagacacacac

SEQ ID NO: 665969 - RNA, 24 nt, Human
acacacacagacacacacacacgc

SEQ ID NO: 665970 - RNA, 33 nt, Human
acacacagacacacacacacgcgcgcgcgcggu

SEQ ID NO: 665971 - RNA, 20 nt, Human
accaagugcagacaaaccca

SEQ ID NO: 665972 - RNA, 20 nt, Human
acccaugcccucucuuuuuc

SEQ ID NO: 665973 - RNA, 25 nt, Human
acccuccuccagggccucuuuguug

SEQ ID NO: 665974 - RNA, 20 nt, Human
acucagaaguccaggccucc

SEQ ID NO: 665975 - RNA, 24 nt, Human
acucgcugucuccggucuaacuuc

SEQ ID NO: 665976 - RNA, 21 nt, Human
agacaaacccaccggggccug

SEQ ID NO: 665977 - RNA, 22 nt, Human
agaggacucucagaccugcaag

SEQ ID NO: 665978 - RNA, 21 nt, Human
agcagcauggaacaccugcug

SEQ ID NO: 665979 - RNA, 19 nt, Human
aggaagaaggaggguuugg

SEQ ID NO: 665980 - RNA, 23 nt, Human
aggaagaaggaggguuuggcugg

SEQ ID NO: 665981 - RNA, 21 nt, Human
aggccuccgcuccaacgccag

SEQ ID NO: 665982 - RNA, 21 nt, Human
aggcuacaaaugcuccaaaca

SEQ ID NO: 665983 - RNA, 23 nt, Human
aggcugggcucaggcagaaccug

SEQ ID NO: 665984 - RNA, 18 nt, Human
aggcuguagggggccugc

SEQ ID NO: 665985 - RNA, 27 nt, Human
agggucauugucaccaaaguggcuggu

SEQ ID NO: 665986 - RNA, 18 nt, Human
agugcugagcugaggggc

SEQ ID NO: 665987 - RNA, 18 nt, Human
auggaacaccugcugccc

SEQ ID NO: 665988 - RNA, 22 nt, Human
caacacaucucucucucucaca

SEQ ID NO: 665989 - RNA, 18 nt, Human
caagcgcagcuccaggca

SEQ ID NO: 665990 - RNA, 22 nt, Human
caaggcaaaggucaauuucucc

SEQ ID NO: 665991 - RNA, 20 nt, Human
cacacacacacacacacaca

SEQ ID NO: 665992 - RNA, 22 nt, Human
cacacacacacgcgcgcgcgcg

SEQ ID NO: 665993 - RNA, 22 nt, Human
cacacacacagacacacacaca

SEQ ID NO: 665994 - RNA, 24 nt, Human
cacacacaggcacgcacaucugca

SEQ ID NO: 665995 - RNA, 20 nt, Human
cacacgcaagagaauaaggc

SEQ ID NO: 665996 - RNA, 21 nt, Human
caccccuccuguccccggcca

SEQ ID NO: 665997 - RNA, 22 nt, Human
cacguguauuuuugcuaaaacu

SEQ ID NO: 665998 - RNA, 18 nt, Human
cagcccccucugcaacuc

SEQ ID NO: 665999 - RNA, 19 nt, Human
cagcguggucaacagugcu

SEQ ID NO: 666000 - RNA, 28 nt, Human
caggcacacacacagacacacacacacg

SEQ ID NO: 666001 - RNA, 19 nt, Human
caugguuucugucuuuguu

SEQ ID NO: 666002 - RNA, 23 nt, Human
ccaacacaucucucucucucaca

SEQ ID NO: 666003 - RNA, 18 nt, Human
cccacccuccuccagggc

SEQ ID NO: 666004 - RNA, 23 nt, Human
cccagaagacaugguuuccaagg

SEQ ID NO: 666005 - RNA, 19 nt, Human
cccauagaccugcccugag

SEQ ID NO: 666006 - RNA, 22 nt, Human
cccccagaagacaugguuucca

SEQ ID NO: 666007 - RNA, 21 nt, Human
ccccggccagccccacccucc

SEQ ID NO: 666008 - RNA, 19 nt, Human
ccccggccgugaugucggc

SEQ ID NO: 666009 - RNA, 21 nt, Human
ccccuauccagaagggcuguc

SEQ ID NO: 666010 - RNA, 26 nt, Human
ccccugugaggcgcagggguggaggc

SEQ ID NO: 666011 - RNA, 24 nt, Human
ccggggcucggccuggcuccccuc

SEQ ID NO: 666012 - RNA, 20 nt, Human
ccucauacgcagcgugguca

SEQ ID NO: 666013 - RNA, 22 nt, Human
ccuccagggccucuuuguuggc

SEQ ID NO: 666014 - RNA, 23 nt, Human
ccuccuguccccggccagcccca

SEQ ID NO: 666015 - RNA, 18 nt, Human
ccuggcuccccucuucuc

SEQ ID NO: 666016 - RNA, 20 nt, Human
ccugucaugguuucugucuu

SEQ ID NO: 666017 - RNA, 21 nt, Human
ccugugaggcgcaggggugga

SEQ ID NO: 666018 - RNA, 19 nt, Human
ccugugggacagaaauggg

SEQ ID NO: 666019 - RNA, 20 nt, Human
ccuguuagugaaacagaaga

SEQ ID NO: 666020 - RNA, 20 nt, Human
cgacuuucuuggccaccccu

SEQ ID NO: 666021 - RNA, 21 nt, Human
cgcaagagaauaaggcuacaa

SEQ ID NO: 666022 - RNA, 23 nt, Human
cggaaacccgggccgucugcccc

SEQ ID NO: 666023 - RNA, 26 nt, Human
cggggcucggccuggcuccccucuuc

SEQ ID NO: 666024 - RNA, 21 nt, Human
cucacacacacacacacacac

SEQ ID NO: 666025 - RNA, 19 nt, Human
cucggccuggcuccccucu

SEQ ID NO: 666026 - RNA, 26 nt, Human
cugaagccugauacaauacccaacag

SEQ ID NO: 666027 - RNA, 21 nt, Human
cugagcugaggggcaagccug

SEQ ID NO: 666028 - RNA, 19 nt, Human
cugcacccgccucccccaa

SEQ ID NO: 666029 - RNA, 22 nt, Human
cugggcucuaggaagaaggagg

SEQ ID NO: 666030 - RNA, 19 nt, Human
gaaacagucuuagacccag

SEQ ID NO: 666031 - RNA, 20 nt, Human
gaacacagaaggcuggucuc

SEQ ID NO: 666032 - RNA, 23 nt, Human
gaacccaggcgucuaaacagcaa

SEQ ID NO: 666033 - RNA, 21 nt, Human
gaccugcaguccccccacccc

SEQ ID NO: 666034 - RNA, 25 nt, Human
gaggcgcagggguggaggccugugu

SEQ ID NO: 666035 - RNA, 18 nt, Human
gcagagacguuaaagggc

SEQ ID NO: 666036 - RNA, 18 nt, Human
gccccacuuccugggcga

SEQ ID NO: 666037 - RNA, 18 nt, Human
gcccggagggaagcggaa

SEQ ID NO: 666038 - RNA, 18 nt, Human
gccugcuguguccgcagc

SEQ ID NO: 666039 - RNA, 25 nt, Human
gcgcagcuccaggcacacacacaga

SEQ ID NO: 666040 - RNA, 26 nt, Human
gcgcgcaaacacacacaggcacgcac

SEQ ID NO: 666041 - RNA, 24 nt, Human
gcgcgcgcaaacacacacaggcac

SEQ ID NO: 666042 - RNA, 21 nt, Human
gcuccaaacauggguccagaa

SEQ ID NO: 666043 - RNA, 18 nt, Human
gcucuaggaagaaggagg

SEQ ID NO: 666044 - RNA, 29 nt, Human
ggcacacacacagacacacacacacgcgg

SEQ ID NO: 666045 - RNA, 19 nt, Human
ggcagagacguuaaagggc

SEQ ID NO: 666046 - RNA, 18 nt, Human
ggccggggcucggccugg

SEQ ID NO: 666047 - RNA, 24 nt, Human
ggccgugaugucggcuccgcaacc

SEQ ID NO: 666048 - RNA, 21 nt, Human
ggccuggcuccccucuucucg

SEQ ID NO: 666049 - RNA, 18 nt, Human
ggcgcagggguggaggcc

SEQ ID NO: 666050 - RNA, 19 nt, Human
gggacagaaauggggagaa

SEQ ID NO: 666051 - RNA, 21 nt, Human
ggggccuggcggggcagcccu

SEQ ID NO: 666052 - RNA, 23 nt, Human
ggggccuggcggggcagcccugu

SEQ ID NO: 666053 - RNA, 21 nt, Human
gguggaggccuguguggcuca

SEQ ID NO: 666054 - RNA, 20 nt, Human
gugaaacagaagacccccga

SEQ ID NO: 666055 - RNA, 24 nt, Human
gugaaacagaagacccccgacccc

SEQ ID NO: 666056 - RNA, 20 nt, Human
guuuggcugggcccgcccag

SEQ ID NO: 666057 - RNA, 20 nt, Human
uaaacagcaaagaccccggc

SEQ ID NO: 666058 - RNA, 22 nt, Human
uagcagcauggaacaccugcug

SEQ ID NO: 666059 - RNA, 21 nt, Human
ucaacagugcugagcugaggg

SEQ ID NO: 666060 - RNA, 23 nt, Human
uccaagcaaguggucagucuggc

SEQ ID NO: 666061 - RNA, 22 nt, Human
uccagggccucuuuguuggcug

SEQ ID NO: 666062 - RNA, 20 nt, Human
ucggcuccgcaacccaugcc

SEQ ID NO: 666063 - RNA, 18 nt, Human
ucgguccugcacccgccu

SEQ ID NO: 666064 - RNA, 21 nt, Human
ucucacacacacacacacaca

SEQ ID NO: 666065 - RNA, 20 nt, Human
ucugccccuauccagaaggg

SEQ ID NO: 666066 - RNA, 24 nt, Human
ugaaacagaagacccccgaccccc

SEQ ID NO: 666067 - RNA, 22 nt, Human
ugaccugcaguccccccacccc

SEQ ID NO: 666068 - RNA, 21 nt, Human
ugaggccuagagucacagaaa

SEQ ID NO: 666069 - RNA, 21 nt, Human
ugcacccgccucccccaaccc

SEQ ID NO: 666070 - RNA, 20 nt, Human
ugcagacaaacccaccgggg

SEQ ID NO: 666071 - RNA, 19 nt, Human
ugcugagcugaggggcaag

SEQ ID NO: 666072 - RNA, 20 nt, Human
uggaggccuguguggcucag

SEQ ID NO: 666073 - RNA, 23 nt, Human
uggcggggcagcccugucauggu

SEQ ID NO: 666074 - RNA, 21 nt, Human
uggcucagguugccaaggcac

SEQ ID NO: 666075 - RNA, 18 nt, Human
uggcugggcccgcccagc

SEQ ID NO: 666076 - RNA, 20 nt, Human
ugggagguguuaguuauggg

SEQ ID NO: 666077 - RNA, 24 nt, Human
ugggagguguuaguuaugggugcc

SEQ ID NO: 666078 - RNA, 21 nt, Human
ugggauacccaagaugcccuc

SEQ ID NO: 666079 - RNA, 19 nt, Human
ugggcucuaggaagaagga

SEQ ID NO: 666080 - RNA, 24 nt, Human
ugggcucuaggaagaaggaggguu

SEQ ID NO: 666081 - RNA, 18 nt, Human
uguagggggccugcugug

SEQ ID NO: 666082 - RNA, 21 nt, Human
uuagugaaacagaagaccccc

SEQ ID NO: 666083 - RNA, 23 nt, Human
uucaagcacacacuccaagcaag

SEQ ID NO: 666084 - RNA, 19 nt, Human
uucuugcgacuuucuuggc

SEQ ID NO: 666085 - RNA, 22 nt, Human
aaugaagaaacaaaaaaaauug

SEQ ID NO: 666086 - RNA, 21 nt, Human
aauuaacugcuaccaaauucc

SEQ ID NO: 666087 - RNA, 18 nt, Human
accuuggucacaguguac

SEQ ID NO: 666088 - RNA, 21 nt, Human
acucuaaggaaauuuucugaa

SEQ ID NO: 666089 - RNA, 25 nt, Human
aggcuuucauggauugggggagggg

SEQ ID NO: 666090 - RNA, 19 nt, Human
augcacacgcacacaagca

SEQ ID NO: 666091 - RNA, 20 nt, Human
cacacgcacacaagcagcaa

SEQ ID NO: 666092 - RNA, 25 nt, Human
cacacgcacacaagcagcaaaugua

SEQ ID NO: 666093 - RNA, 25 nt, Human
cacaguguacugauucacccuccca

SEQ ID NO: 666094 - RNA, 23 nt, Human
cacgcacacaagcagcaaaugua

SEQ ID NO: 666095 - RNA, 22 nt, Human
ccaacauugaacucuguaagcc

SEQ ID NO: 666096 - RNA, 21 nt, Human
ccuucaacaccaaaaaggccc

SEQ ID NO: 666097 - RNA, 24 nt, Human
cguguucacaaaugcacacgcaca

SEQ ID NO: 666098 - RNA, 19 nt, Human
gcacacgcacacaagcagc

SEQ ID NO: 666099 - RNA, 24 nt, Human
gcagaauuuuguauagauaugcug

SEQ ID NO: 666100 - RNA, 25 nt, Human
ggaauucuuucaaauuuugaagcuu

SEQ ID NO: 666101 - RNA, 21 nt, Human
ggaggcagagauggugagucc

SEQ ID NO: 666102 - RNA, 24 nt, Human
guucaauaaaguuuauguccugaa

SEQ ID NO: 666103 - RNA, 21 nt, Human
uaacauaaaguccagaaacau

SEQ ID NO: 666104 - RNA, 22 nt, Human
uaacauaaaguccagaaacauu

SEQ ID NO: 666105 - RNA, 22 nt, Human
ucaauccaacacggugacuuau

SEQ ID NO: 666106 - RNA, 18 nt, Human
ucacaguguacugauuca

SEQ ID NO: 666107 - RNA, 19 nt, Human
ucauggauugggggagggg

SEQ ID NO: 666108 - RNA, 21 nt, Human
ucuguaagccucaugggaggc

SEQ ID NO: 666109 - RNA, 25 nt, Human
ugaagaaacaaaaaaaauuggcuug

SEQ ID NO: 666110 - RNA, 22 nt, Human
ugauauagcgaugauucaaagu

SEQ ID NO: 666111 - RNA, 19 nt, Human
ugauggaauucuuucaaau

SEQ ID NO: 666112 - RNA, 18 nt, Human
uggauugggggaggggaa

SEQ ID NO: 666113 - RNA, 20 nt, Human
uggauugggggaggggaaau

SEQ ID NO: 666114 - RNA, 23 nt, Human
uguauagauaugcuguacguggu

SEQ ID NO: 666115 - RNA, 18 nt, Human
ugucugagagaugcagga

SEQ ID NO: 666116 - RNA, 21 nt, Human
uucauggauugggggagggga

SEQ ID NO: 666117 - RNA, 18 nt, Human
uuugaggaccuuggucac

SEQ ID NO: 666118 - RNA, 20 nt, Human
gacacuagggauuacuuccu

SEQ ID NO: 666119 - RNA, 24 nt, Human
gcugaaucugcugacacuagggau

SEQ ID NO: 666120 - RNA, 18 nt, Human
ggguucuugugaugaugg

SEQ ID NO: 666121 - RNA, 21 nt, Human
uauacaccaguaccgcugaau

SEQ ID NO: 666122 - RNA, 21 nt, Human
uaucacaaugaaguuugguau

SEQ ID NO: 666123 - RNA, 23 nt, Human
ugaugauggugcucuugaguaua

SEQ ID NO: 666124 - RNA, 22 nt, Human
uuauacaccaguaccgcugaau

SEQ ID NO: 666125 - RNA, 23 nt, Human
uucaagcucaugaaguucauucu

SEQ ID NO: 666126 - RNA, 23 nt, Human
uuucaagcucaugaaguucauuc

SEQ ID NO: 666127 - RNA, 21 nt, Human
uuuucuggccaggcaaugaga

SEQ ID NO: 666128 - RNA, 19 nt, Human
uuuuucaagcucaugaagu

SEQ ID NO: 666129 - RNA, 19 nt, Human
aaacacaaaaaaggauaaa

SEQ ID NO: 666130 - RNA, 22 nt, Human
aaauaaauguacagaaucucuc

SEQ ID NO: 666131 - RNA, 18 nt, Human
aaauguacagaaucucuc

SEQ ID NO: 666132 - RNA, 25 nt, Human
aagccagagcagaaaucauaaggga

SEQ ID NO: 666133 - RNA, 21 nt, Human
aagggaccuuagcuggcagcc

SEQ ID NO: 666134 - RNA, 25 nt, Human
acaaauauuaacaaccagagucacu

SEQ ID NO: 666135 - RNA, 22 nt, Human
agaaaucauaagggaccuuagc

SEQ ID NO: 666136 - RNA, 20 nt, Human
agcccagacccggaggcacc

SEQ ID NO: 666137 - RNA, 23 nt, Human
aggaagaaaaaguuggugaagaa

SEQ ID NO: 666138 - RNA, 22 nt, Human
auaaaauuuucucccaaauaaa

SEQ ID NO: 666139 - RNA, 24 nt, Human
auagcacacucacauacgcacaaa

SEQ ID NO: 666140 - RNA, 19 nt, Human
cacacaucaacaguaagau

SEQ ID NO: 666141 - RNA, 21 nt, Human
cacacucacauacgcacaaaa

SEQ ID NO: 666142 - RNA, 23 nt, Human
cacaugcacgcugaacauccgca

SEQ ID NO: 666143 - RNA, 19 nt, Human
caccggaguccucucccca

SEQ ID NO: 666144 - RNA, 24 nt, Human
caggcagcaggagcccagagucca

SEQ ID NO: 666145 - RNA, 19 nt, Human
caugcacgcugaacauccg

SEQ ID NO: 666146 - RNA, 21 nt, Human
caugcacgcugaacauccgca

SEQ ID NO: 666147 - RNA, 18 nt, Human
cauugcacuauuuguuuu

SEQ ID NO: 666148 - RNA, 25 nt, Human
ccagaguccacacccuuaacuaugc

SEQ ID NO: 666149 - RNA, 18 nt, Human
ccaggaaucaccugcagg

SEQ ID NO: 666150 - RNA, 19 nt, Human
cccagaguccacacccuua

SEQ ID NO: 666151 - RNA, 25 nt, Human
ccccacccuagggcguaagaccaaa

SEQ ID NO: 666152 - RNA, 21 nt, Human
cccgcgccgggcccaggcccc

SEQ ID NO: 666153 - RNA, 22 nt, Human
cccuuaacuaugccauguugcu

SEQ ID NO: 666154 - RNA, 23 nt, Human
ccggaggcaccggaguccucucc

SEQ ID NO: 666155 - RNA, 23 nt, Human
ccugcagggucucggccucugcu

SEQ ID NO: 666156 - RNA, 24 nt, Human
ccuuagcuggcagccccaggaauc

SEQ ID NO: 666157 - RNA, 22 nt, Human
cguaagaccaaaaaaacgccaa

SEQ ID NO: 666158 - RNA, 19 nt, Human
cuacuguuuuuagcuguuu

SEQ ID NO: 666159 - RNA, 22 nt, Human
cucacauacgcacaaaauccua

SEQ ID NO: 666160 - RNA, 20 nt, Human
cucggccucugcucccggcc

SEQ ID NO: 666161 - RNA, 20 nt, Human
cugaaaacugcaaagccaga

SEQ ID NO: 666162 - RNA, 18 nt, Human
cugcagggucucggccuc

SEQ ID NO: 666163 - RNA, 21 nt, Human
gaaaagccuaaaauaugauaa

SEQ ID NO: 666164 - RNA, 20 nt, Human
gaagaaaaaguuggugaaga

SEQ ID NO: 666165 - RNA, 19 nt, Human
gaccuuagcuggcagcccc

SEQ ID NO: 666166 - RNA, 23 nt, Human
gcaaagccagagcagaaaucaua

SEQ ID NO: 666167 - RNA, 24 nt, Human
gcaucagaucugcaacaugauuug

SEQ ID NO: 666168 - RNA, 18 nt, Human
gcuccaauuguguaaaga

SEQ ID NO: 666169 - RNA, 20 nt, Human
gcugaaaauuucccucuauu

SEQ ID NO: 666170 - RNA, 18 nt, Human
gcugaacauccgcaaguu

SEQ ID NO: 666171 - RNA, 18 nt, Human
gucucggccucugcuccc

SEQ ID NO: 666172 - RNA, 19 nt, Human
uaagugcuuugaaaauguu

SEQ ID NO: 666173 - RNA, 23 nt, Human
uaaugcaaaacuugacugacauu

SEQ ID NO: 666174 - RNA, 21 nt, Human
uacaauacaaauauuaacaac

SEQ ID NO: 666175 - RNA, 22 nt, Human
uacaauacaaauauuaacaacc

SEQ ID NO: 666176 - RNA, 19 nt, Human
uaccagugucuuugcaguu

SEQ ID NO: 666177 - RNA, 22 nt, Human
uagaaaagccuaaaauaugaua

SEQ ID NO: 666178 - RNA, 23 nt, Human
uagaccucaaagcaauccuaaga

SEQ ID NO: 666179 - RNA, 25 nt, Human
uagcacacucacauacgcacaaaau

SEQ ID NO: 666180 - RNA, 19 nt, Human
uagcuguuuaaaaacagcu

SEQ ID NO: 666181 - RNA, 18 nt, Human
uagggcguaagaccaaaa

SEQ ID NO: 666182 - RNA, 19 nt, Human
ucaacaguaagauacauaa

SEQ ID NO: 666183 - RNA, 24 nt, Human
ucagacacuauucuaagugcuuug

SEQ ID NO: 666184 - RNA, 25 nt, Human
ucggccucugcucccggcccgcgcc

SEQ ID NO: 666185 - RNA, 21 nt, Human
ucuaccagugucuuugcaguu

SEQ ID NO: 666186 - RNA, 22 nt, Human
ucucggccucugcucccggccc

SEQ ID NO: 666187 - RNA, 23 nt, Human
ugaaaacugcaaagccagagcag

SEQ ID NO: 666188 - RNA, 20 nt, Human
ugaaagguuuccuuccuguu

SEQ ID NO: 666189 - RNA, 22 nt, Human
ugacuucugaaagguuuccuuc

SEQ ID NO: 666190 - RNA, 27 nt, Human
ugauuuguaguauaacuguuucccucu

SEQ ID NO: 666191 - RNA, 25 nt, Human
ugcaaaacaaaaguaugacuucuga

SEQ ID NO: 666192 - RNA, 18 nt, Human
ugcagggucucggccucu

SEQ ID NO: 666193 - RNA, 22 nt, Human
ugccauguugcuucuaugaggg

SEQ ID NO: 666194 - RNA, 21 nt, Human
ugggaaaggcugaaaacugca

SEQ ID NO: 666195 - RNA, 18 nt, Human
ugggaacugaggcacaga

SEQ ID NO: 666196 - RNA, 21 nt, Human
ugggaugggaacugaggcaca

SEQ ID NO: 666197 - RNA, 22 nt, Human
ugggaugggaacugaggcacag

SEQ ID NO: 666198 - RNA, 22 nt, Human
uguuaacucauuuagaccucaa

SEQ ID NO: 666199 - RNA, 21 nt, Human
uguuuugaaggauuaauucag

SEQ ID NO: 666200 - RNA, 24 nt, Human
uuaacucauuuagaccucaaagca

SEQ ID NO: 666201 - RNA, 21 nt, Human
uuaaguagcaugccccaugcu

SEQ ID NO: 666202 - RNA, 25 nt, Human
uuaauucagucaagagaauuuccca

SEQ ID NO: 666203 - RNA, 23 nt, Human
uuaccacugucuauauccauuua

SEQ ID NO: 666204 - RNA, 18 nt, Human
uuagaaaagccuaaaaua

SEQ ID NO: 666205 - RNA, 19 nt, Human
uucacaaaauacaaauaau

SEQ ID NO: 666206 - RNA, 21 nt, Human
uuggugaagaacauuuaggac

SEQ ID NO: 666207 - RNA, 24 nt, Human
uuuaaaauaucuauccaaguacca

SEQ ID NO: 666208 - RNA, 23 nt, Human
uuugaauuuuuauugaacaccuu

SEQ ID NO: 666209 - RNA, 22 nt, Human
uuuguaguauaacuguuucccu

SEQ ID NO: 666210 - RNA, 19 nt, Human
uuugugagcuuuuggaugu

SEQ ID NO: 666211 - RNA, 25 nt, Human
uuuuacaauuugcaugacuucugcc

SEQ ID NO: 666212 - RNA, 19 nt, Human
aaagcacauacaaaguaug

SEQ ID NO: 666213 - RNA, 18 nt, Human
aaccgcaaagacagggag

SEQ ID NO: 666214 - RNA, 20 nt, Human
aagcagacuccaaaguguuu

SEQ ID NO: 666215 - RNA, 20 nt, Human
aagcaucauuccugcugcuu

SEQ ID NO: 666216 - RNA, 20 nt, Human
aagugcccacccaccccuuc

SEQ ID NO: 666217 - RNA, 19 nt, Human
aaugucaguuuccugccug

SEQ ID NO: 666218 - RNA, 21 nt, Human
acagccagcgaaguauacaac

SEQ ID NO: 666219 - RNA, 18 nt, Human
agcaucauuccugcugcu

SEQ ID NO: 666220 - RNA, 27 nt, Human
agugcccacccaccccuucccuaaagc

SEQ ID NO: 666221 - RNA, 25 nt, Human
aucucauuuucauuccucaaaucag

SEQ ID NO: 666222 - RNA, 20 nt, Human
auuacauuccccccucccca

SEQ ID NO: 666223 - RNA, 21 nt, Human
caagugcccacccaccccuuc

SEQ ID NO: 666224 - RNA, 24 nt, Human
cacacagccagcgaaguauacaac

SEQ ID NO: 666225 - RNA, 24 nt, Human
caccccuucccuaaagcacauaca

SEQ ID NO: 666226 - RNA, 22 nt, Human
cacuucugccuccuucuuucca

SEQ ID NO: 666227 - RNA, 19 nt, Human
cagaacaugaauuccaucu

SEQ ID NO: 666228 - RNA, 24 nt, Human
cagacuccaaaguguucaucagag

SEQ ID NO: 666229 - RNA, 20 nt, Human
cagucuacauccaaauuugc

SEQ ID NO: 666230 - RNA, 21 nt, Human
caguuucugaaguugcugagg

SEQ ID NO: 666231 - RNA, 18 nt, Human
caucagaguuuuaguuua

SEQ ID NO: 666232 - RNA, 19 nt, Human
ccaagugcccacccacccc

SEQ ID NO: 666233 - RNA, 19 nt, Human
ccacugagaguacuuccug

SEQ ID NO: 666234 - RNA, 22 nt, Human
cccaccccuucccuaaagcaca

SEQ ID NO: 666235 - RNA, 23 nt, Human
cccaccccuucccuaaagcacau

SEQ ID NO: 666236 - RNA, 22 nt, Human
cccacugagaguacuuccugga

SEQ ID NO: 666237 - RNA, 19 nt, Human
cccauggagagugaaaguu

SEQ ID NO: 666238 - RNA, 18 nt, Human
ccccacugagaguacuuc

SEQ ID NO: 666239 - RNA, 21 nt, Human
cccuccccaguucuaccugua

SEQ ID NO: 666240 - RNA, 19 nt, Human
ccucaugcucuuuauccuc

SEQ ID NO: 666241 - RNA, 22 nt, Human
ccuccuucuuuccaugcugucc

SEQ ID NO: 666242 - RNA, 24 nt, Human
cgucauaaaguucaagagucucag

SEQ ID NO: 666243 - RNA, 21 nt, Human
cuccuucuuuccaugcugucc

SEQ ID NO: 666244 - RNA, 20 nt, Human
cugauuuuauuucucucuca

SEQ ID NO: 666245 - RNA, 23 nt, Human
cuucugccuccuucuuuccaugc

SEQ ID NO: 666246 - RNA, 19 nt, Human
cuuggaaugucaguuuccu

SEQ ID NO: 666247 - RNA, 21 nt, Human
gaaaaguacacccagggccuc

SEQ ID NO: 666248 - RNA, 21 nt, Human
gagaaacgggguggaggagag

SEQ ID NO: 666249 - RNA, 26 nt, Human
gcccuaaagcccuucccaaccggagg

SEQ ID NO: 666250 - RNA, 22 nt, Human
ggauugaaaaguacacccaggg

SEQ ID NO: 666251 - RNA, 21 nt, Human
gggguggaggagagggcuggu

SEQ ID NO: 666252 - RNA, 20 nt, Human
ggguggaggagagggcuggu

SEQ ID NO: 666253 - RNA, 23 nt, Human
gguugaauuuucuucacaaaccu

SEQ ID NO: 666254 - RNA, 23 nt, Human
gucuccuucacuaaagcagacuc

SEQ ID NO: 666255 - RNA, 19 nt, Human
gucugucagucuacaucca

SEQ ID NO: 666256 - RNA, 23 nt, Human
uaaaaaauuacauuccccccucc

SEQ ID NO: 666257 - RNA, 19 nt, Human
uaaagcagacuccaaagug

SEQ ID NO: 666258 - RNA, 21 nt, Human
uaaauaugacacauccuuguc

SEQ ID NO: 666259 - RNA, 20 nt, Human
uaccuguagccaugaugaau

SEQ ID NO: 666260 - RNA, 22 nt, Human
uacuucacacagccagcgaagu

SEQ ID NO: 666261 - RNA, 22 nt, Human
uagauccuuggaaugucaguuu

SEQ ID NO: 666262 - RNA, 20 nt, Human
uauccucacuuccucagucc

SEQ ID NO: 666263 - RNA, 20 nt, Human
ucaaaauauugaagacuccg

SEQ ID NO: 666264 - RNA, 22 nt, Human
ucaagagucucagauuacauga

SEQ ID NO: 666265 - RNA, 23 nt, Human
ucagugcccuaaagcccuuccca

SEQ ID NO: 666266 - RNA, 25 nt, Human
ucccaaaccgcaaagacagggaguc

SEQ ID NO: 666267 - RNA, 20 nt, Human
ucccaaagugcaaauauugc

SEQ ID NO: 666268 - RNA, 19 nt, Human
ucccauggagagugaaagu

SEQ ID NO: 666269 - RNA, 22 nt, Human
uccucacuuccucagucccuuc

SEQ ID NO: 666270 - RNA, 19 nt, Human
uccucagucccuucaacac

SEQ ID NO: 666271 - RNA, 26 nt, Human
ucucccacaaugucaggggaugaaag

SEQ ID NO: 666272 - RNA, 27 nt, Human
ucucccacaaugucaggggaugaaagc

SEQ ID NO: 666273 - RNA, 24 nt, Human
ucucucacacguaucaggggcagu

SEQ ID NO: 666274 - RNA, 23 nt, Human
ucugaaaaacacuuuuugagcca

SEQ ID NO: 666275 - RNA, 27 nt, Human
ucugccuccuucuuuccaugcuguccu

SEQ ID NO: 666276 - RNA, 22 nt, Human
ucugucccauggagagugaaag

SEQ ID NO: 666277 - RNA, 21 nt, Human
ucuuugauuucauuucagugc

SEQ ID NO: 666278 - RNA, 22 nt, Human
ugaaaaacacuuuuugagccaa

SEQ ID NO: 666279 - RNA, 19 nt, Human
ugaaagcagguggucccca

SEQ ID NO: 666280 - RNA, 22 nt, Human
ugaaagcaggugguccccacug

SEQ ID NO: 666281 - RNA, 24 nt, Human
ugaaagcaggugguccccacugag

SEQ ID NO: 666282 - RNA, 18 nt, Human
ugagaguacuuccuggau

SEQ ID NO: 666283 - RNA, 20 nt, Human
ugcccuaaagcccuucccac

SEQ ID NO: 666284 - RNA, 30 nt, Human
ugcccuaaagcccuucccacuuuggucucu

SEQ ID NO: 666285 - RNA, 22 nt, Human
ugcuacuaaaaauaaaauaaag

SEQ ID NO: 666286 - RNA, 22 nt, Human
ugcucuuuauccucacuuccuc

SEQ ID NO: 666287 - RNA, 22 nt, Human
ugcuucuucaucuuugauuuca

SEQ ID NO: 666288 - RNA, 21 nt, Human
uggcauuugcagagugugauc

SEQ ID NO: 666289 - RNA, 19 nt, Human
uucagacuugauaaugaga

SEQ ID NO: 666290 - RNA, 18 nt, Human
uucagcuaugucugucag

SEQ ID NO: 666291 - RNA, 20 nt, Human
uuccuggauuagauccuugg

SEQ ID NO: 666292 - RNA, 19 nt, Human
uugcugagguugaauuuuc

SEQ ID NO: 666293 - RNA, 20 nt, Human
uuuauuucucucucacacgu

SEQ ID NO: 666294 - RNA, 24 nt, Human
aaaaagaaagguuucuaccaucag

SEQ ID NO: 666295 - RNA, 24 nt, Human
aaacagcugggauuacagguguga

SEQ ID NO: 666296 - RNA, 25 nt, Human
aaacagcugggauuacaggugugag

SEQ ID NO: 666297 - RNA, 18 nt, Human
aaaucaguccugaaagac

SEQ ID NO: 666298 - RNA, 22 nt, Human
aaccagacuucccaccagcaca

SEQ ID NO: 666299 - RNA, 21 nt, Human
aagaacucgagaacuccagcc

SEQ ID NO: 666300 - RNA, 19 nt, Human
aagccagcauuuucucuug

SEQ ID NO: 666301 - RNA, 21 nt, Human
aaguagcugggauacaggcau

SEQ ID NO: 666302 - RNA, 24 nt, Human
acagcugggauuacaggugugagc

SEQ ID NO: 666303 - RNA, 21 nt, Human
acagugacaugaucucagcuc

SEQ ID NO: 666304 - RNA, 25 nt, Human
acucuguugcccaggcuggaguaca

SEQ ID NO: 666305 - RNA, 30 nt, Human
agaaucuuucccaaguuuguucaccguacu

SEQ ID NO: 666306 - RNA, 22 nt, Human
agccagaaaugggggagcucca

SEQ ID NO: 666307 - RNA, 24 nt, Human
agcuggucuugaacuccugaccuc

SEQ ID NO: 666308 - RNA, 20 nt, Human
aggaaccccugaaaggagag

SEQ ID NO: 666309 - RNA, 20 nt, Human
aggcaugcaccaccaugccc

SEQ ID NO: 666310 - RNA, 24 nt, Human
aggugauccaccugccucagccuc

SEQ ID NO: 666311 - RNA, 23 nt, Human
aggugugagccaccgugccuggc

SEQ ID NO: 666312 - RNA, 23 nt, Human
augcuucagccucccaaguagcu

SEQ ID NO: 666313 - RNA, 24 nt, Human
augcuucagccucccaaguagcug

SEQ ID NO: 666314 - RNA, 19 nt, Human
augcuucugcagaaaacaa

SEQ ID NO: 666315 - RNA, 18 nt, Human
augggguuucuccauguu

SEQ ID NO: 666316 - RNA, 20 nt, Human
augggguuucuccauguugg

SEQ ID NO: 666317 - RNA, 24 nt, Human
auuuuuguauuuuuaguagagaug

SEQ ID NO: 666318 - RNA, 22 nt, Human
caaacuacacgaagucacauaa

SEQ ID NO: 666319 - RNA, 22 nt, Human
caagugauucucaugcuucagc

SEQ ID NO: 666320 - RNA, 27 nt, Human
caagugauucucaugcuucagccuccc

SEQ ID NO: 666321 - RNA, 22 nt, Human
caccaccaugcccugcuaauuu

SEQ ID NO: 666322 - RNA, 25 nt, Human
caccacugcugaaaagaguuggggg

SEQ ID NO: 666323 - RNA, 24 nt, Human
caccaugcccugcuaauuuuugua

SEQ ID NO: 666324 - RNA, 23 nt, Human
cacgaagucacauaaaagaacuc

SEQ ID NO: 666325 - RNA, 22 nt, Human
cacucuguugcccaggcuggag

SEQ ID NO: 666326 - RNA, 18 nt, Human
cacugcaaccucugccuc

SEQ ID NO: 666327 - RNA, 22 nt, Human
cagcaaagauaaauucaggaaa

SEQ ID NO: 666328 - RNA, 23 nt, Human
cagcaaagauaaauucaggaaac

SEQ ID NO: 666329 - RNA, 24 nt, Human
cagcaagcuaaaguuccuuuagaa

SEQ ID NO: 666330 - RNA, 23 nt, Human
cagccucccaaacagcugggauu

SEQ ID NO: 666331 - RNA, 22 nt, Human
caggugauccaccugccucagc

SEQ ID NO: 666332 - RNA, 23 nt, Human
cauaaaagaacucgagaacucca

SEQ ID NO: 666333 - RNA, 24 nt, Human
cauguuggccaagcuggucuugaa

SEQ ID NO: 666334 - RNA, 21 nt, Human
ccaaacagcugggauuacagg

SEQ ID NO: 666335 - RNA, 24 nt, Human
ccaaacagcugggauuacaggugu

SEQ ID NO: 666336 - RNA, 22 nt, Human
ccaccgccugcugucuucuucc

SEQ ID NO: 666337 - RNA, 23 nt, Human
ccaccgccugcugucuucuucca

SEQ ID NO: 666338 - RNA, 23 nt, Human
ccaccugccucagccucccaaac

SEQ ID NO: 666339 - RNA, 20 nt, Human
ccaggauucaagugauucuc

SEQ ID NO: 666340 - RNA, 21 nt, Human
ccauguuggccaagcuggucu

SEQ ID NO: 666341 - RNA, 21 nt, Human
ccauguuggccaagcuggucu

SEQ ID NO: 666342 - RNA, 24 nt, Human
cccaaacagcugggauuacaggug

SEQ ID NO: 666343 - RNA, 25 nt, Human
cccaagcccuaaaugaauacagcaa

SEQ ID NO: 666344 - RNA, 22 nt, Human
cccaaguagcugggauacaggc

SEQ ID NO: 666345 - RNA, 21 nt, Human
cccaccgccugcugucuucuu

SEQ ID NO: 666346 - RNA, 19 nt, Human
cccaggcuggaguacagug

SEQ ID NO: 666347 - RNA, 27 nt, Human
ccccugaaaggagagccagaaaugggg

SEQ ID NO: 666348 - RNA, 21 nt, Human
ccugaccucaggugauccacc

SEQ ID NO: 666349 - RNA, 23 nt, Human
ccugaccucaggugauccaccug

SEQ ID NO: 666350 - RNA, 23 nt, Human
ccugaccucaggugauccaccug

SEQ ID NO: 666351 - RNA, 24 nt, Human
ccugccucagccucccaaacagcu

SEQ ID NO: 666352 - RNA, 24 nt, Human
cucacucuguugcccaggcuggag

SEQ ID NO: 666353 - RNA, 24 nt, Human
cucacugcaaccucugccuccagg

SEQ ID NO: 666354 - RNA, 23 nt, Human
cucaggugauccaccugccucag

SEQ ID NO: 666355 - RNA, 19 nt, Human
cuccaggauucaagugauu

SEQ ID NO: 666356 - RNA, 24 nt, Human
cugcaaccucugccuccaggauuc

SEQ ID NO: 666357 - RNA, 24 nt, Human
cuguaagcuccuaacagaccaugc

SEQ ID NO: 666358 - RNA, 19 nt, Human
cuguugcccaggcuggagu

SEQ ID NO: 666359 - RNA, 25 nt, Human
cuucagccucccaaguagcugggau

SEQ ID NO: 666360 - RNA, 24 nt, Human
cuuucuggcugcaagagucagggg

SEQ ID NO: 666361 - RNA, 20 nt, Human
gaagucacauaaaagaacuc

SEQ ID NO: 666362 - RNA, 24 nt, Human
gaccucaggugauccaccugccuc

SEQ ID NO: 666363 - RNA, 18 nt, Human
gagaugggguuucuccau

SEQ ID NO: 666364 - RNA, 24 nt, Human
gagaugggguuucuccauguuggc

SEQ ID NO: 666365 - RNA, 21 nt, Human
gauccaccugccucagccucc

SEQ ID NO: 666366 - RNA, 18 nt, Human
gauuacaggugugagcca

SEQ ID NO: 666367 - RNA, 21 nt, Human
gauuacaggugugagccaccg

SEQ ID NO: 666368 - RNA, 24 nt, Human
gauuacaggugugagccaccgugc

SEQ ID NO: 666369 - RNA, 21 nt, Human
gauucucaugcuucagccucc

SEQ ID NO: 666370 - RNA, 22 nt, Human
gcaaccucugccuccaggauuc

SEQ ID NO: 666371 - RNA, 19 nt, Human
gcccaggcuggaguacagu

SEQ ID NO: 666372 - RNA, 22 nt, Human
gcccugcuaauuuuuguauuuu

SEQ ID NO: 666373 - RNA, 23 nt, Human
gcuaaaguuccuuuagaaaacca

SEQ ID NO: 666374 - RNA, 19 nt, Human
gcuggaguacagugacaug

SEQ ID NO: 666375 - RNA, 19 nt, Human
gcugggauuacagguguga

SEQ ID NO: 666376 - RNA, 20 nt, Human
gcuucugcagaaaacaauuc

SEQ ID NO: 666377 - RNA, 24 nt, Human
ggauacaggcaugcaccaccaugc

SEQ ID NO: 666378 - RNA, 22 nt, Human
gggacucucccaagcccuaaau

SEQ ID NO: 666379 - RNA, 24 nt, Human
gggggagcuccaaacucuuugugu

SEQ ID NO: 666380 - RNA, 18 nt, Human
gggguuucuccauguugg

SEQ ID NO: 666381 - RNA, 19 nt, Human
ggucuugaacuccugaccu

SEQ ID NO: 666382 - RNA, 18 nt, Human
gugauccaccugccucag

SEQ ID NO: 666383 - RNA, 24 nt, Human
gugauccaccugccucagccuccc

SEQ ID NO: 666384 - RNA, 24 nt, Human
gugauucucaugcuucagccuccc

SEQ ID NO: 666385 - RNA, 25 nt, Human
uaaagcaacaaacuacacgaaguca

SEQ ID NO: 666386 - RNA, 19 nt, Human
uaaccagacuucccaccag

SEQ ID NO: 666387 - RNA, 19 nt, Human
uaacugacuugugaacuaa

SEQ ID NO: 666388 - RNA, 24 nt, Human
uaauuuuuguauuuuuaguagaga

SEQ ID NO: 666389 - RNA, 22 nt, Human
uacaggugugagccaccgugcc

SEQ ID NO: 666390 - RNA, 22 nt, Human
uacaggugugagccaccgugcc

SEQ ID NO: 666391 - RNA, 24 nt, Human
uaguagagaugggguuucuccaug

SEQ ID NO: 666392 - RNA, 21 nt, Human
uauucugauaacaaacucugg

SEQ ID NO: 666393 - RNA, 19 nt, Human
ucaagugauucucaugcuu

SEQ ID NO: 666394 - RNA, 19 nt, Human
ucacugcaaccucugccuc

SEQ ID NO: 666395 - RNA, 23 nt, Human
ucacugcaaccucugccuccagg

SEQ ID NO: 666396 - RNA, 27 nt, Human
ucacugcaaccucugccuccaggauuc

SEQ ID NO: 666397 - RNA, 18 nt, Human
ucagccucccaaacagcu

SEQ ID NO: 666398 - RNA, 20 nt, Human
ucagccucccaaacagcugg

SEQ ID NO: 666399 - RNA, 18 nt, Human
ucagccucccaaguagcu

SEQ ID NO: 666400 - RNA, 20 nt, Human
ucagccucccaaguagcugg

SEQ ID NO: 666401 - RNA, 22 nt, Human
ucaggugauccaccugccucag

SEQ ID NO: 666402 - RNA, 23 nt, Human
ucauugauuuuuaaagagaaucu

SEQ ID NO: 666403 - RNA, 19 nt, Human
uccagcgcgucaagcucca

SEQ ID NO: 666404 - RNA, 19 nt, Human
uccauguuggccaagcugg

SEQ ID NO: 666405 - RNA, 23 nt, Human
ucccaaacagcugggauuacagg

SEQ ID NO: 666406 - RNA, 23 nt, Human
ucccaaacagcugggauuacagg

SEQ ID NO: 666407 - RNA, 24 nt, Human
ucccaaacagcugggauuacaggu

SEQ ID NO: 666408 - RNA, 23 nt, Human
ucccaaguagcugggauacaggc

SEQ ID NO: 666409 - RNA, 18 nt, Human
uccuauggccuguaagcu

SEQ ID NO: 666410 - RNA, 23 nt, Human
ucucacucuguugcccaggcugg

SEQ ID NO: 666411 - RNA, 24 nt, Human
ucucacucuguugcccaggcugga

SEQ ID NO: 666412 - RNA, 25 nt, Human
ucucacucuguugcccaggcuggag

SEQ ID NO: 666413 - RNA, 26 nt, Human
ucucacucuguugcccaggcuggagu

SEQ ID NO: 666414 - RNA, 22 nt, Human
ucucccaagcccuaaaugaaua

SEQ ID NO: 666415 - RNA, 22 nt, Human
ucugcagaaaacaauucuggac

SEQ ID NO: 666416 - RNA, 18 nt, Human
ucuguugcccaggcugga

SEQ ID NO: 666417 - RNA, 23 nt, Human
ucuugaacuccugaccucaggug

SEQ ID NO: 666418 - RNA, 22 nt, Human
ugaaaagaguugggggaggaaa

SEQ ID NO: 666419 - RNA, 24 nt, Human
ugaaaagaguugggggaggaaccc

SEQ ID NO: 666420 - RNA, 19 nt, Human
ugaaaggagagccagaaau

SEQ ID NO: 666421 - RNA, 24 nt, Human
ugacaugaucucagcucacugcaa

SEQ ID NO: 666422 - RNA, 24 nt, Human
ugaccucaggugauccaccugccu

SEQ ID NO: 666423 - RNA, 21 nt, Human
ugacugaauuaucuugggacu

SEQ ID NO: 666424 - RNA, 23 nt, Human
ugacugaauuaucuugggacucu

SEQ ID NO: 666425 - RNA, 21 nt, Human
ugauucuguuguauuuacaga

SEQ ID NO: 666426 - RNA, 21 nt, Human
ugcccaggcuggaguacagug

SEQ ID NO: 666427 - RNA, 24 nt, Human
ugcccaggcuggaguacagugaca

SEQ ID NO: 666428 - RNA, 26 nt, Human
ugccucagccucccaaacagcuggga

SEQ ID NO: 666429 - RNA, 24 nt, Human
ugcuucagccucccaaguagcugg

SEQ ID NO: 666430 - RNA, 19 nt, Human
uggaguacagugacaugau

SEQ ID NO: 666431 - RNA, 23 nt, Human
uggaguacagugacaugaucuca

SEQ ID NO: 666432 - RNA, 24 nt, Human
uggccaagcuggucuugaacuccu

SEQ ID NO: 666433 - RNA, 23 nt, Human
ugggauacaggcaugcaccacca

SEQ ID NO: 666434 - RNA, 18 nt, Human
ugggauuacaggugugag

SEQ ID NO: 666435 - RNA, 21 nt, Human
ugggauuacaggugugagcca

SEQ ID NO: 666436 - RNA, 22 nt, Human
ugggauuacaggugugagccac

SEQ ID NO: 666437 - RNA, 23 nt, Human
ugggauuacaggugugagccacc

SEQ ID NO: 666438 - RNA, 23 nt, Human
ugggauuacaggugugagccacc

SEQ ID NO: 666439 - RNA, 24 nt, Human
ugggauuacaggugugagccaccg

SEQ ID NO: 666440 - RNA, 19 nt, Human
ugggguuucuccauguugg

SEQ ID NO: 666441 - RNA, 18 nt, Human
uggguuucuaauauuaac

SEQ ID NO: 666442 - RNA, 23 nt, Human
uuaaagcaacaaacuacacgaag

SEQ ID NO: 666443 - RNA, 18 nt, Human
uuaguagagaugggguuu

SEQ ID NO: 666444 - RNA, 24 nt, Human
uuaguagagaugggguuucuccau

SEQ ID NO: 666445 - RNA, 23 nt, Human
uucaagugauucucaugcuucag

SEQ ID NO: 666446 - RNA, 19 nt, Human
uuccuuuagaaaaccacca

SEQ ID NO: 666447 - RNA, 20 nt, Human
uugagacagucucacucugu

SEQ ID NO: 666448 - RNA, 24 nt, Human
uugagacagucucacucuguugcc

SEQ ID NO: 666449 - RNA, 24 nt, Human
uugcccaggcuggaguacagugac

SEQ ID NO: 666450 - RNA, 23 nt, Human
uuguauuuuuaguagagaugggg

SEQ ID NO: 666451 - RNA, 21 nt, Human
uuucuccauguuggccaagcu

SEQ ID NO: 666452 - RNA, 21 nt, Human
uuugcuagaauuccuuucuua

SEQ ID NO: 666453 - RNA, 22 nt, Human
uuuuuaguagagaugggguuuc

SEQ ID NO: 666454 - RNA, 20 nt, Human
uuuuuguauuuuuaguagag

SEQ ID NO: 666455 - RNA, 25 nt, Human
uuuuuuuuuuuuugagacagucuca

SEQ ID NO: 666456 - RNA, 18 nt, Human
uuuuuuuuuuuuuuuuug

SEQ ID NO: 666457 - RNA, 22 nt, Human
aaaaacacgcccuucccacaua

SEQ ID NO: 666458 - RNA, 19 nt, Human
aaaacuugaagcaaggaca

SEQ ID NO: 666459 - RNA, 21 nt, Human
aacccuugggccccucagagg

SEQ ID NO: 666460 - RNA, 23 nt, Human
aagcccugcagacccaagcucca

SEQ ID NO: 666461 - RNA, 23 nt, Human
aagcgucgaaacccgcuuucacc

SEQ ID NO: 666462 - RNA, 18 nt, Human
aaggcuggaggcugguga

SEQ ID NO: 666463 - RNA, 19 nt, Human
acccaaagccucaggccuc

SEQ ID NO: 666464 - RNA, 20 nt, Human
acccacaagaggugggaaac

SEQ ID NO: 666465 - RNA, 19 nt, Human
acccagagcugugugucag

SEQ ID NO: 666466 - RNA, 18 nt, Human
acccuggacccaaagccu

SEQ ID NO: 666467 - RNA, 22 nt, Human
accgaacgcuucccacagcaac

SEQ ID NO: 666468 - RNA, 22 nt, Human
acucacgacuaacauuuucuag

SEQ ID NO: 666469 - RNA, 22 nt, Human
acuccagauucagaccaggcca

SEQ ID NO: 666470 - RNA, 22 nt, Human
acugcacugggcccacgugauc

SEQ ID NO: 666471 - RNA, 18 nt, Human
agacauccuaaaacuuga

SEQ ID NO: 666472 - RNA, 23 nt, Human
agacauccuaaaacuugaagcaa

SEQ ID NO: 666473 - RNA, 18 nt, Human
agacaugaaagccauaac

SEQ ID NO: 666474 - RNA, 21 nt, Human
agagcugugugucagagagca

SEQ ID NO: 666475 - RNA, 24 nt, Human
agcaguccucucacggcugggagc

SEQ ID NO: 666476 - RNA, 19 nt, Human
aggcaggcgggaggagucu

SEQ ID NO: 666477 - RNA, 24 nt, Human
agguacgguggaggucaggcaucu

SEQ ID NO: 666478 - RNA, 23 nt, Human
caacccagucacucaugcaccuc

SEQ ID NO: 666479 - RNA, 24 nt, Human
caccuagacaugaaagccauaacc

SEQ ID NO: 666480 - RNA, 20 nt, Human
caccuccaucaggacuggcu

SEQ ID NO: 666481 - RNA, 27 nt, Human
cagaaggauaugggaugaaugcagugg

SEQ ID NO: 666482 - RNA, 23 nt, Human
cagcaacgcccugcccuggcuuu

SEQ ID NO: 666483 - RNA, 23 nt, Human
cagguaaucaaauucucucccaa

SEQ ID NO: 666484 - RNA, 23 nt, Human
caugauggcgcggcuggccccgg

SEQ ID NO: 666485 - RNA, 19 nt, Human
ccacaccaaagcccuaagg

SEQ ID NO: 666486 - RNA, 19 nt, Human
ccacagcaacgcccugccc

SEQ ID NO: 666487 - RNA, 21 nt, Human
ccaucaggacuggcuggugaa

SEQ ID NO: 666488 - RNA, 18 nt, Human
cccaaagccucaggccuc

SEQ ID NO: 666489 - RNA, 20 nt, Human
cccaaagccucaggccucca

SEQ ID NO: 666490 - RNA, 24 nt, Human
cccaaagccucaggccuccaucuc

SEQ ID NO: 666491 - RNA, 21 nt, Human
cccacagcaacgcccugccuu

SEQ ID NO: 666492 - RNA, 19 nt, Human
cccacauagugcgugaggc

SEQ ID NO: 666493 - RNA, 22 nt, Human
ccccacaccuagacaugaaagc

SEQ ID NO: 666494 - RNA, 22 nt, Human
ccccggacugaccucgcugugu

SEQ ID NO: 666495 - RNA, 24 nt, Human
cccuccuaagcgucgaaacccgcu

SEQ ID NO: 666496 - RNA, 21 nt, Human
cccugcccuggcuuugccuuc

SEQ ID NO: 666497 - RNA, 22 nt, Human
cccugcccuggcuuugccuucu

SEQ ID NO: 666498 - RNA, 18 nt, Human
cccuggacccaaagccuc

SEQ ID NO: 666499 - RNA, 25 nt, Human
cccuggacccaaagccucaggccuc

SEQ ID NO: 666500 - RNA, 22 nt, Human
ccgcccgggccaucgaccggcc

SEQ ID NO: 666501 - RNA, 18 nt, Human
ccgcugaggcugguuuua

SEQ ID NO: 666502 - RNA, 22 nt, Human
ccuccucuguccccacaccuag

SEQ ID NO: 666503 - RNA, 20 nt, Human
ccucugcugcuuccaguuaa

SEQ ID NO: 666504 - RNA, 24 nt, Human
ccugaaaaccaguuccccuuuccc

SEQ ID NO: 666505 - RNA, 23 nt, Human
ccugccaaaggcuggaggcuggu

SEQ ID NO: 666506 - RNA, 19 nt, Human
cgcuguguggcugcaaagc

SEQ ID NO: 666507 - RNA, 25 nt, Human
cggcacgagauccaagcuaguuguu

SEQ ID NO: 666508 - RNA, 20 nt, Human
cuagaaggacaugaauagug

SEQ ID NO: 666509 - RNA, 22 nt, Human
cuagacaugaaagccauaaccc

SEQ ID NO: 666510 - RNA, 19 nt, Human
cucccucggcccuccuaag

SEQ ID NO: 666511 - RNA, 21 nt, Human
cugucagaguccugagaucac

SEQ ID NO: 666512 - RNA, 24 nt, Human
cuuucccugucccagucaacccag

SEQ ID NO: 666513 - RNA, 20 nt, Human
gaaggcaggcgggaggaguc

SEQ ID NO: 666514 - RNA, 20 nt, Human
gacauccauccccggguccc

SEQ ID NO: 666515 - RNA, 18 nt, Human
gaccaggccauccucucc

SEQ ID NO: 666516 - RNA, 20 nt, Human
gaccaggccauccucucccg

SEQ ID NO: 666517 - RNA, 18 nt, Human
gaccucgcuguguggcug

SEQ ID NO: 666518 - RNA, 27 nt, Human
gacugcuuucuacccacuaucuuuagg

SEQ ID NO: 666519 - RNA, 18 nt, Human
gcacagaaggauauggga

SEQ ID NO: 666520 - RNA, 19 nt, Human
gccccggacugaccucgcu

SEQ ID NO: 666521 - RNA, 19 nt, Human
gcccugcccuggcuuugcc

SEQ ID NO: 666522 - RNA, 19 nt, Human
gcccuggcuuugccuucuc

SEQ ID NO: 666523 - RNA, 18 nt, Human
gcugcaaagcccugcaga

SEQ ID NO: 666524 - RNA, 22 nt, Human
ggaaucuucucccucggcccuc

SEQ ID NO: 666525 - RNA, 24 nt, Human
ggacaaggaagacugcacguccuc

SEQ ID NO: 666526 - RNA, 18 nt, Human
ggagccucugcugcuucc

SEQ ID NO: 666527 - RNA, 21 nt, Human
ggagccucugcugcuuccagu

SEQ ID NO: 666528 - RNA, 22 nt, Human
ggcgaggccaccauuaccauga

SEQ ID NO: 666529 - RNA, 19 nt, Human
gggugcgaggggugggggg

SEQ ID NO: 666530 - RNA, 18 nt, Human
ggguggcauuaauuacuc

SEQ ID NO: 666531 - RNA, 20 nt, Human
guggaggucaggcaucuaca

SEQ ID NO: 666532 - RNA, 18 nt, Human
guuccccuuucccugucc

SEQ ID NO: 666533 - RNA, 22 nt, Human
uaaggaauccacaggcaugcaa

SEQ ID NO: 666534 - RNA, 20 nt, Human
uagacaugaaagccauaacc

SEQ ID NO: 666535 - RNA, 19 nt, Human
uaggagaggacaaggaaga

SEQ ID NO: 666536 - RNA, 22 nt, Human
uaggagaggacaaggaagacug

SEQ ID NO: 666537 - RNA, 23 nt, Human
uagugcgugaggcaugugcacau

SEQ ID NO: 666538 - RNA, 23 nt, Human
uauuugaacugcacugggcccac

SEQ ID NO: 666539 - RNA, 21 nt, Human
uccacaccaaagcccuaaggc

SEQ ID NO: 666540 - RNA, 19 nt, Human
ucccacagcaacgcccugc

SEQ ID NO: 666541 - RNA, 24 nt, Human
ucccacagcaacgcccugcccugg

SEQ ID NO: 666542 - RNA, 19 nt, Human
ucccacauagugcgugagg

SEQ ID NO: 666543 - RNA, 21 nt, Human
uccccacaccuagacaugaaa

SEQ ID NO: 666544 - RNA, 24 nt, Human
uccccauugucguaaggaauccac

SEQ ID NO: 666545 - RNA, 21 nt, Human
uccugccaaaggcuggaggcu

SEQ ID NO: 666546 - RNA, 22 nt, Human
ucgaccggccccgccgccgccg

SEQ ID NO: 666547 - RNA, 25 nt, Human
ucucagggucacgcgggcgauuugc

SEQ ID NO: 666548 - RNA, 24 nt, Human
ucucugagugugcacccagagcug

SEQ ID NO: 666549 - RNA, 18 nt, Human
ucugccucucccuccucu

SEQ ID NO: 666550 - RNA, 26 nt, Human
ugaaaacaugaaagcugaaaguucag

SEQ ID NO: 666551 - RNA, 19 nt, Human
ugaaaaccaguuccccuuu

SEQ ID NO: 666552 - RNA, 22 nt, Human
ugaaaauaagccucuauugucc

SEQ ID NO: 666553 - RNA, 19 nt, Human
ugaaagccauaacccuugg

SEQ ID NO: 666554 - RNA, 22 nt, Human
ugacauggauggggcgaggcca

SEQ ID NO: 666555 - RNA, 18 nt, Human
ugaccucgcuguguggcu

SEQ ID NO: 666556 - RNA, 22 nt, Human
ugagcaguccucucacggcugg

SEQ ID NO: 666557 - RNA, 18 nt, Human
ugccaaaggcuggaggcu

SEQ ID NO: 666558 - RNA, 21 nt, Human
ugcccuggcuuugccuucucg

SEQ ID NO: 666559 - RNA, 22 nt, Human
ugcccuggcuuugccuucucgc

SEQ ID NO: 666560 - RNA, 18 nt, Human
ugcgaggggugggggggc

SEQ ID NO: 666561 - RNA, 18 nt, Human
ugcgaggggugggggggc

SEQ ID NO: 666562 - RNA, 20 nt, Human
ugcgaggggugggggggcgg

SEQ ID NO: 666563 - RNA, 22 nt, Human
uggacccaaagccucaggccuc

SEQ ID NO: 666564 - RNA, 22 nt, Human
uggcgcggcuggccccggacug

SEQ ID NO: 666565 - RNA, 21 nt, Human
uggcgcuuguuccuuccuggu

SEQ ID NO: 666566 - RNA, 18 nt, Human
uggcugcaaagcccugca

SEQ ID NO: 666567 - RNA, 22 nt, Human
ugggaaacaccgcguuccccau

SEQ ID NO: 666568 - RNA, 20 nt, Human
ugggaugaaugcaguggcuc

SEQ ID NO: 666569 - RNA, 21 nt, Human
uggugaacacgccugggacag

SEQ ID NO: 666570 - RNA, 19 nt, Human
uguuuugcuuuugccuuuc

SEQ ID NO: 666571 - RNA, 23 nt, Human
aacacuccauguauaucaaaucu

SEQ ID NO: 666572 - RNA, 24 nt, Human
acaguggugcaauuuuccaggcac

SEQ ID NO: 666573 - RNA, 23 nt, Human
cuaaaaaaguacaaaccaagcac

SEQ ID NO: 666574 - RNA, 24 nt, Human
cuaaaaaaguacaaaccaagcaca

SEQ ID NO: 666575 - RNA, 20 nt, Human
gugcuauuuuggcuuguugg

SEQ ID NO: 666576 - RNA, 21 nt, Human
uaaauuuuaacauuugcacag

SEQ ID NO: 666577 - RNA, 24 nt, Human
uaacauuugcacagcuccaaauau

SEQ ID NO: 666578 - RNA, 24 nt, Human
uaagcaauaauuaagcaaauugaa

SEQ ID NO: 666579 - RNA, 23 nt, Human
uaaucgcuguauauuuuccaaaa

SEQ ID NO: 666580 - RNA, 21 nt, Human
uacaaaccaagcacaguggug

SEQ ID NO: 666581 - RNA, 25 nt, Human
ucauugucacguacaucugcauuuc

SEQ ID NO: 666582 - RNA, 20 nt, Human
ucucauugucacguacaucu

SEQ ID NO: 666583 - RNA, 21 nt, Human
uuaacauuugcacagcuccaa

SEQ ID NO: 666584 - RNA, 21 nt, Human
uuucaaguugcuuauuuacaa

SEQ ID NO: 666585 - RNA, 20 nt, Human
uuuuaacauuugcacagcuc

SEQ ID NO: 666586 - RNA, 24 nt, Human
aaacaggaggcaagcagaccagag

SEQ ID NO: 666587 - RNA, 18 nt, Human
aaagagaaacaggaggca

SEQ ID NO: 666588 - RNA, 18 nt, Human
agacgcggcccucucccc

SEQ ID NO: 666589 - RNA, 21 nt, Human
aggcaagcagaccagagcuag

SEQ ID NO: 666590 - RNA, 24 nt, Human
cacagagucuggagaaugcagagc

SEQ ID NO: 666591 - RNA, 20 nt, Human
ccaagcuccuccacagaccg

SEQ ID NO: 666592 - RNA, 19 nt, Human
cccacgcgaggccuccaaa

SEQ ID NO: 666593 - RNA, 23 nt, Human
ccuccacagacgcggcccucucc

SEQ ID NO: 666594 - RNA, 23 nt, Human
cugaaacagccauucuuucuccc

SEQ ID NO: 666595 - RNA, 22 nt, Human
gaggcaagcagaccagagcuag

SEQ ID NO: 666596 - RNA, 21 nt, Human
gcagaccagagcuaguauggc

SEQ ID NO: 666597 - RNA, 19 nt, Human
gccaagcuccuccacagac

SEQ ID NO: 666598 - RNA, 20 nt, Human
gcggcccucuccccacgcga

SEQ ID NO: 666599 - RNA, 23 nt, Human
gcugcaagaaaugaucaguccuc

SEQ ID NO: 666600 - RNA, 19 nt, Human
gugcaguucaggguccaag

SEQ ID NO: 666601 - RNA, 18 nt, Human
uccccacgcgaggccucc

SEQ ID NO: 666602 - RNA, 23 nt, Human
uccccugggcucuugacagaggu

SEQ ID NO: 666603 - RNA, 26 nt, Human
uccccugggcucuugacagaggugca

SEQ ID NO: 666604 - RNA, 21 nt, Human
ugacagaggugcaguucaggg

SEQ ID NO: 666605 - RNA, 18 nt, Human
ugcggagccaagcuccuc

SEQ ID NO: 666606 - RNA, 21 nt, Human
uggcucccggguuccaagccc

SEQ ID NO: 666607 - RNA, 18 nt, Human
ugggcucuugacagaggu

SEQ ID NO: 666608 - RNA, 25 nt, Human
ugggcucuugacagaggugcaguuc

SEQ ID NO: 666609 - RNA, 24 nt, Human
uuccaagcccaauuucggguucgc

SEQ ID NO: 666610 - RNA, 25 nt, Human
aaauaaacaggugggaggcugggca

SEQ ID NO: 666611 - RNA, 22 nt, Human
agccccugggggcaguggaggu

SEQ ID NO: 666612 - RNA, 21 nt, Human
aggugaauacagggcccuucu

SEQ ID NO: 666613 - RNA, 18 nt, Human
agucaaggcaaggucccc

SEQ ID NO: 666614 - RNA, 23 nt, Human
ccccugguccauaugggcccccc

SEQ ID NO: 666615 - RNA, 19 nt, Human
cccugguccauaugggccc

SEQ ID NO: 666616 - RNA, 22 nt, Human
cuguguggagccccuggccagc

SEQ ID NO: 666617 - RNA, 24 nt, Human
ucaaggcaagguccccugguccau

SEQ ID NO: 666618 - RNA, 22 nt, Human
ucacugagcucaugaagugccu

SEQ ID NO: 666619 - RNA, 20 nt, Human
uccccugguccauaugggcc

SEQ ID NO: 666620 - RNA, 23 nt, Human
uggccagcgggggagaaaaaggu

SEQ ID NO: 666621 - RNA, 23 nt, Human
ugggaggcugggcagucccccag

SEQ ID NO: 666622 - RNA, 18 nt, Human
ugggguugggcugguccu

SEQ ID NO: 666623 - RNA, 25 nt, Human
ugggguugggcugguccuuauagug

SEQ ID NO: 666624 - RNA, 22 nt, Human
uguuuccuuuauuauaaagcac

SEQ ID NO: 666625 - RNA, 21 nt, Human
aacaugauuuuaaaggugguc

SEQ ID NO: 666626 - RNA, 21 nt, Human
aaggugguauaucucuugugg

SEQ ID NO: 666627 - RNA, 20 nt, Human
acacaaaauauacacauaua

SEQ ID NO: 666628 - RNA, 21 nt, Human
auaguuugguuugugggggug

SEQ ID NO: 666629 - RNA, 23 nt, Human
caacaaauuaacaauuauauaga

SEQ ID NO: 666630 - RNA, 19 nt, Human
caacaugauccaaauaguu

SEQ ID NO: 666631 - RNA, 22 nt, Human
cucuaaaugaaagaauuaagga

SEQ ID NO: 666632 - RNA, 24 nt, Human
cucucuaaaugaaagaauuaagga

SEQ ID NO: 666633 - RNA, 23 nt, Human
cuguuucugacccggcagcucua

SEQ ID NO: 666634 - RNA, 22 nt, Human
gaaaaccauacucuuugucucc

SEQ ID NO: 666635 - RNA, 23 nt, Human
ggugaaagagggaaugagaaaaa

SEQ ID NO: 666636 - RNA, 21 nt, Human
guuaugguggguaaacagcca

SEQ ID NO: 666637 - RNA, 19 nt, Human
ucaugccaggaaaaccaua

SEQ ID NO: 666638 - RNA, 21 nt, Human
uccuuggaacaauuuaacaca

SEQ ID NO: 666639 - RNA, 24 nt, Human
ugacccggcagcucuaaucagcaa

SEQ ID NO: 666640 - RNA, 24 nt, Human
ugccaggaaaaccauacucuuugg

SEQ ID NO: 666641 - RNA, 18 nt, Human
uggagggaaaucuugcug

SEQ ID NO: 666642 - RNA, 18 nt, Human
ugggggugaaagagggaa

SEQ ID NO: 666643 - RNA, 21 nt, Human
ugucucacagcuguuucugac

SEQ ID NO: 666644 - RNA, 21 nt, Human
uugcugaaauuacagcuucuu

SEQ ID NO: 666645 - RNA, 18 nt, Human
uuuacaaaaauuagaaca

SEQ ID NO: 666646 - RNA, 19 nt, Human
uuuacaaaaauuagaacau

SEQ ID NO: 666647 - RNA, 18 nt, Human
aaaaggcaggaccuggug

SEQ ID NO: 666648 - RNA, 20 nt, Human
aaacaaagcaagggcagugu

SEQ ID NO: 666649 - RNA, 19 nt, Human
aaacuuuagccccagcacc

SEQ ID NO: 666650 - RNA, 21 nt, Human
aagaacagcagggcaggaccg

SEQ ID NO: 666651 - RNA, 21 nt, Human
aagcaaccaguuaagaggccg

SEQ ID NO: 666652 - RNA, 20 nt, Human
aagcagcaagucugggaggg

SEQ ID NO: 666653 - RNA, 23 nt, Human
aagcaggagugcaggguguuggc

SEQ ID NO: 666654 - RNA, 20 nt, Human
acacuggagggaugcccaga

SEQ ID NO: 666655 - RNA, 21 nt, Human
accccaaacuuuagccccagc

SEQ ID NO: 666656 - RNA, 20 nt, Human
acuuccagcucugacugccu

SEQ ID NO: 666657 - RNA, 23 nt, Human
agaacagcagggcaggaccugaa

SEQ ID NO: 666658 - RNA, 20 nt, Human
agaccagggcagggcuggaa

SEQ ID NO: 666659 - RNA, 20 nt, Human
agagcaguucugggauacag

SEQ ID NO: 666660 - RNA, 19 nt, Human
agagcccucucacccagcc

SEQ ID NO: 666661 - RNA, 21 nt, Human
agccccugggcugcagguccu

SEQ ID NO: 666662 - RNA, 18 nt, Human
aggcaggaccuggugggc

SEQ ID NO: 666663 - RNA, 22 nt, Human
auacagugucugaauccucagu

SEQ ID NO: 666664 - RNA, 22 nt, Human
auccucaguggucacugcucuc

SEQ ID NO: 666665 - RNA, 19 nt, Human
caagauccugucugaggag

SEQ ID NO: 666666 - RNA, 21 nt, Human
caagcagcaagucugggaggg

SEQ ID NO: 666667 - RNA, 23 nt, Human
caagcagcaagucugggagggcc

SEQ ID NO: 666668 - RNA, 22 nt, Human
caccacggccuccagcugccgg

SEQ ID NO: 666669 - RNA, 18 nt, Human
cagcaucugggccagcuu

SEQ ID NO: 666670 - RNA, 21 nt, Human
cagcaucugggccagcuuugg

SEQ ID NO: 666671 - RNA, 19 nt, Human
cagcugccggcgcaagcag

SEQ ID NO: 666672 - RNA, 22 nt, Human
caucguaggacaccugcccuuc

SEQ ID NO: 666673 - RNA, 22 nt, Human
caucugggccagcuuugggaac

SEQ ID NO: 666674 - RNA, 23 nt, Human
cauugauaauccgagucucuggg

SEQ ID NO: 666675 - RNA, 22 nt, Human
ccaaagguuucuacaagccacc

SEQ ID NO: 666676 - RNA, 23 nt, Human
ccagcaccuguuccucaucucca

SEQ ID NO: 666677 - RNA, 23 nt, Human
cccaaacucacaucuccggaugc

SEQ ID NO: 666678 - RNA, 23 nt, Human
cccaaagguuucuacaagccacc

SEQ ID NO: 666679 - RNA, 20 nt, Human
cccaguaauggccugucagg

SEQ ID NO: 666680 - RNA, 19 nt, Human
ccccuaucugagaaugaua

SEQ ID NO: 666681 - RNA, 20 nt, Human
ccgagucucugggccucauc

SEQ ID NO: 666682 - RNA, 19 nt, Human
ccucaguggucacugcucu

SEQ ID NO: 666683 - RNA, 19 nt, Human
ccuccugucuucucugagg

SEQ ID NO: 666684 - RNA, 22 nt, Human
ccucucacccagccaacuccaa

SEQ ID NO: 666685 - RNA, 23 nt, Human
ccugauccuggccagcugccagc

SEQ ID NO: 666686 - RNA, 26 nt, Human
cggaacccacggucucccugccuccu

SEQ ID NO: 666687 - RNA, 22 nt, Human
cucuaccccaaacuuuagcccc

SEQ ID NO: 666688 - RNA, 25 nt, Human
cucuuggucacacuggagggaugcc

SEQ ID NO: 666689 - RNA, 23 nt, Human
cugcccaaagguuucuacaagcc

SEQ ID NO: 666690 - RNA, 20 nt, Human
cuuggaagccccugggcugc

SEQ ID NO: 666691 - RNA, 22 nt, Human
cuugugcucuaccccaaacuuu

SEQ ID NO: 666692 - RNA, 21 nt, Human
gaacagcagggcaggaccuga

SEQ ID NO: 666693 - RNA, 22 nt, Human
gaagccccugggcugcaggucc

SEQ ID NO: 666694 - RNA, 24 nt, Human
gaauuggagaccuggaucuaaaca

SEQ ID NO: 666695 - RNA, 25 nt, Human
gaccaagcaagcagcaagucuggga

SEQ ID NO: 666696 - RNA, 20 nt, Human
gagagucuaaauccagggau

SEQ ID NO: 666697 - RNA, 18 nt, Human
gccugucaggaacuccuc

SEQ ID NO: 666698 - RNA, 20 nt, Human
gcuagggauagggcaggcag

SEQ ID NO: 666699 - RNA, 23 nt, Human
gcucuuggucacacuggagggau

SEQ ID NO: 666700 - RNA, 21 nt, Human
gcugucuugaagauggcuguu

SEQ ID NO: 666701 - RNA, 21 nt, Human
ggagaagcaaccaguuaaggg

SEQ ID NO: 666702 - RNA, 21 nt, Human
ggccagcuuugggaaccugug

SEQ ID NO: 666703 - RNA, 24 nt, Human
ggcuugauccucauugaauucaga

SEQ ID NO: 666704 - RNA, 21 nt, Human
gggcuggaacuagggagaagc

SEQ ID NO: 666705 - RNA, 19 nt, Human
ggggacccaagcaaugcag

SEQ ID NO: 666706 - RNA, 24 nt, Human
ggggcaaggccagaccuuaggaga

SEQ ID NO: 666707 - RNA, 21 nt, Human
gggucgggaugaccgggaagu

SEQ ID NO: 666708 - RNA, 22 nt, Human
guaggacaccugcccuuccucu

SEQ ID NO: 666709 - RNA, 26 nt, Human
gugcucuaccccaaacuuuagcccca

SEQ ID NO: 666710 - RNA, 20 nt, Human
guggaccaagcaagcagcaa

SEQ ID NO: 666711 - RNA, 22 nt, Human
guguaucagcaucugggccagc

SEQ ID NO: 666712 - RNA, 21 nt, Human
uaaguuguaaagucacucugc

SEQ ID NO: 666713 - RNA, 19 nt, Human
uagcaaauggagagcccuc

SEQ ID NO: 666714 - RNA, 22 nt, Human
uagcaaauggagagcccucuca

SEQ ID NO: 666715 - RNA, 21 nt, Human
uagcagacaugaggcugccca

SEQ ID NO: 666716 - RNA, 18 nt, Human
uaucaccgcaaaaggcag

SEQ ID NO: 666717 - RNA, 22 nt, Human
ucacacuggagggaugcccaga

SEQ ID NO: 666718 - RNA, 18 nt, Human
ucacauggguuuccuagu

SEQ ID NO: 666719 - RNA, 21 nt, Human
ucacauggguuuccuaguuaa

SEQ ID NO: 666720 - RNA, 22 nt, Human
ucacccagccaacuccaagagu

SEQ ID NO: 666721 - RNA, 26 nt, Human
ucacgaacacagagacgucaucguag

SEQ ID NO: 666722 - RNA, 20 nt, Human
ucacugcucucuuggcccug

SEQ ID NO: 666723 - RNA, 21 nt, Human
ucagccacucuucuucagccc

SEQ ID NO: 666724 - RNA, 24 nt, Human
ucagugcucugucuucucagccau

SEQ ID NO: 666725 - RNA, 18 nt, Human
ucaguggucacugcucuc

SEQ ID NO: 666726 - RNA, 18 nt, Human
ucccugugugcuguguau

SEQ ID NO: 666727 - RNA, 21 nt, Human
ucuacaagccaccugcgugga

SEQ ID NO: 666728 - RNA, 23 nt, Human
ucuacaagccaccugcguggacu

SEQ ID NO: 666729 - RNA, 18 nt, Human
ucuccggaugcacagcuu

SEQ ID NO: 666730 - RNA, 22 nt, Human
ucuucagccccaaacucacauc

SEQ ID NO: 666731 - RNA, 24 nt, Human
ucuucagccccaaacucacaucuc

SEQ ID NO: 666732 - RNA, 26 nt, Human
ugaacacaugcccugauaaccaugaa

SEQ ID NO: 666733 - RNA, 24 nt, Human
ugaauccucaguggucacugcucu

SEQ ID NO: 666734 - RNA, 20 nt, Human
ugaauucagauuucucugca

SEQ ID NO: 666735 - RNA, 22 nt, Human
ugagaaugauacuuugggcugu

SEQ ID NO: 666736 - RNA, 22 nt, Human
ugagagcacugggcgguggcua

SEQ ID NO: 666737 - RNA, 28 nt, Human
ugagagcacugggcgguggcuagggaua

SEQ ID NO: 666738 - RNA, 24 nt, Human
ugcccaaagguuucuacaagccac

SEQ ID NO: 666739 - RNA, 18 nt, Human
ugccugguauaaauguuc

SEQ ID NO: 666740 - RNA, 18 nt, Human
ugcucugucuucucagcc

SEQ ID NO: 666741 - RNA, 22 nt, Human
ugcuguguaucagcaucugggc

SEQ ID NO: 666742 - RNA, 24 nt, Human
uggaccaagcaagcagcaagucug

SEQ ID NO: 666743 - RNA, 18 nt, Human
ugggagggccacgggcug

SEQ ID NO: 666744 - RNA, 26 nt, Human
ugucaggaacuccucugggcacaggg

SEQ ID NO: 666745 - RNA, 20 nt, Human
ugucugaauccucagugguc

SEQ ID NO: 666746 - RNA, 23 nt, Human
uguguaucagcaucugggccagc

SEQ ID NO: 666747 - RNA, 19 nt, Human
uguuuuagcagacaugagg

SEQ ID NO: 666748 - RNA, 18 nt, Human
aagaggcaaggcagcacg

SEQ ID NO: 666749 - RNA, 20 nt, Human
aagcagugcccgccaggccu

SEQ ID NO: 666750 - RNA, 19 nt, Human
aagcgccaaggacugcagc

SEQ ID NO: 666751 - RNA, 21 nt, Human
aaggacugcagccaggagaga

SEQ ID NO: 666752 - RNA, 20 nt, Human
acacucuccgcagugcugug

SEQ ID NO: 666753 - RNA, 18 nt, Human
acaggcguccugugccuc

SEQ ID NO: 666754 - RNA, 25 nt, Human
accaaagcgccaaggacugcagcca

SEQ ID NO: 666755 - RNA, 22 nt, Human
agaaacaggcacuguuaugacc

SEQ ID NO: 666756 - RNA, 18 nt, Human
agaaagauaaaucccaag

SEQ ID NO: 666757 - RNA, 24 nt, Human
agauaaaucccaagauucuuggca

SEQ ID NO: 666758 - RNA, 20 nt, Human
agcacuuugggaggucgagg

SEQ ID NO: 666759 - RNA, 22 nt, Human
agcagugcccgccaggccuggg

SEQ ID NO: 666760 - RNA, 20 nt, Human
agcaucuuucugaaccaccc

SEQ ID NO: 666761 - RNA, 25 nt, Human
agccugggcaacauagcccugacuc

SEQ ID NO: 666762 - RNA, 23 nt, Human
agcuagcaucuuucugaaccacc

SEQ ID NO: 666763 - RNA, 19 nt, Human
aggaacccaggaaaaagga

SEQ ID NO: 666764 - RNA, 25 nt, Human
aggaagaacaaaaggaaccgguacc

SEQ ID NO: 666765 - RNA, 18 nt, Human
aggcaggaaggucguuug

SEQ ID NO: 666766 - RNA, 23 nt, Human
aggcaggaaggucguuugaggcc

SEQ ID NO: 666767 - RNA, 20 nt, Human
aggcaggucacccacucccc

SEQ ID NO: 666768 - RNA, 23 nt, Human
aggcccgggcaucacgccuguaa

SEQ ID NO: 666769 - RNA, 21 nt, Human
aggucgaggcaggaaggucgu

SEQ ID NO: 666770 - RNA, 24 nt, Human
aggucgaggcaggaaggucguuug

SEQ ID NO: 666771 - RNA, 24 nt, Human
auccucggcgacccacugcacaag

SEQ ID NO: 666772 - RNA, 23 nt, Human
auuagagguguguggcgggaggu

SEQ ID NO: 666773 - RNA, 23 nt, Human
caaagcgccaaggacugcagcca

SEQ ID NO: 666774 - RNA, 19 nt, Human
caagaggugccgagggaug

SEQ ID NO: 666775 - RNA, 19 nt, Human
cacccacucccccguccug

SEQ ID NO: 666776 - RNA, 21 nt, Human
cacccugagggcaguucugcu

SEQ ID NO: 666777 - RNA, 22 nt, Human
cacccugagggcaguucugcuc

SEQ ID NO: 666778 - RNA, 24 nt, Human
cacgccuguaaucccagcacuuug

SEQ ID NO: 666779 - RNA, 18 nt, Human
cagcaaggcauagaaaga

SEQ ID NO: 666780 - RNA, 24 nt, Human
cagcacuuugggaggucgaggcag

SEQ ID NO: 666781 - RNA, 25 nt, Human
cagcacuuugggaggucgaggcagg

SEQ ID NO: 666782 - RNA, 18 nt, Human
cagcaucucuucaguccc

SEQ ID NO: 666783 - RNA, 20 nt, Human
cagcgcucuucgcacccuuc

SEQ ID NO: 666784 - RNA, 22 nt, Human
caggcguccugugccucuuccu

SEQ ID NO: 666785 - RNA, 22 nt, Human
caucacgccuguaaucccagca

SEQ ID NO: 666786 - RNA, 21 nt, Human
ccacugcacaagcaggccgcu

SEQ ID NO: 666787 - RNA, 19 nt, Human
ccaggaaaaaggaaaacaa

SEQ ID NO: 666788 - RNA, 22 nt, Human
cccagcgcucuucgcacccuuc

SEQ ID NO: 666789 - RNA, 19 nt, Human
cccuccuuucuuucgaucc

SEQ ID NO: 666790 - RNA, 21 nt, Human
cccugacuccacaugcccucc

SEQ ID NO: 666791 - RNA, 19 nt, Human
ccuccuuucuuucgauccc

SEQ ID NO: 666792 - RNA, 24 nt, Human
ccucuagugaggccggagggacca

SEQ ID NO: 666793 - RNA, 27 nt, Human
ccugacuccacaugcccuccuuucuuu

SEQ ID NO: 666794 - RNA, 23 nt, Human
ccugcuuggccuuaucauggcaa

SEQ ID NO: 666795 - RNA, 18 nt, Human
cgccaggccugggccagg

SEQ ID NO: 666796 - RNA, 23 nt, Human
cgccuguaaucccagcacuuugg

SEQ ID NO: 666797 - RNA, 24 nt, Human
cgccuguaaucccagcacuuuggg

SEQ ID NO: 666798 - RNA, 19 nt, Human
cgcugggcuggagacagcc

SEQ ID NO: 666799 - RNA, 23 nt, Human
cggcccagcgcucuucgcacccu

SEQ ID NO: 666800 - RNA, 24 nt, Human
cgggcaucacgccuguaaucccag

SEQ ID NO: 666801 - RNA, 23 nt, Human
cuagcccagcugagugggguggg

SEQ ID NO: 666802 - RNA, 21 nt, Human
cuagugaggccggagggaccc

SEQ ID NO: 666803 - RNA, 21 nt, Human
cucuucgcacccuucuggacc

SEQ ID NO: 666804 - RNA, 22 nt, Human
cuguaaauaaaccuuuuuuucu

SEQ ID NO: 666805 - RNA, 23 nt, Human
cuugugaggugguguuugagggc

SEQ ID NO: 666806 - RNA, 21 nt, Human
gaagaacaaaaggaacccagg

SEQ ID NO: 666807 - RNA, 21 nt, Human
gagcuucgcugggcuggagac

SEQ ID NO: 666808 - RNA, 19 nt, Human
gagguuuggagccagacug

SEQ ID NO: 666809 - RNA, 19 nt, Human
gccugggccaggagagcuc

SEQ ID NO: 666810 - RNA, 23 nt, Human
ggcaggaaggucguuugaggcca

SEQ ID NO: 666811 - RNA, 22 nt, Human
ggcaucacgccuguaaucccag

SEQ ID NO: 666812 - RNA, 24 nt, Human
ggcaucacgccuguaaucccagca

SEQ ID NO: 666813 - RNA, 18 nt, Human
ggcuucuugugagguggu

SEQ ID NO: 666814 - RNA, 23 nt, Human
ggucguuugaggccagaguucga

SEQ ID NO: 666815 - RNA, 21 nt, Human
ggugccgagggaugagaggaa

SEQ ID NO: 666816 - RNA, 24 nt, Human
guggcauaguugguuaauguuaga

SEQ ID NO: 666817 - RNA, 19 nt, Human
guggggggcucagaagggu

SEQ ID NO: 666818 - RNA, 18 nt, Human
guuaugaccauuuuacag

SEQ ID NO: 666819 - RNA, 21 nt, Human
uaacccccacccugcuggugu

SEQ ID NO: 666820 - RNA, 19 nt, Human
uacccuauuugccccucuc

SEQ ID NO: 666821 - RNA, 22 nt, Human
uagcccagcugagugggguggg

SEQ ID NO: 666822 - RNA, 19 nt, Human
uaguucgcagaaacaggca

SEQ ID NO: 666823 - RNA, 24 nt, Human
uauagagccuccuuuuucuacucc

SEQ ID NO: 666824 - RNA, 25 nt, Human
ucaauaguucgcagaaacaggccga

SEQ ID NO: 666825 - RNA, 23 nt, Human
ucacgccuguaaucccagcacuu

SEQ ID NO: 666826 - RNA, 21 nt, Human
uccaaaagauggaagaaggcc

SEQ ID NO: 666827 - RNA, 22 nt, Human
uccccaccgccacaggcguccu

SEQ ID NO: 666828 - RNA, 22 nt, Human
ucccuaacuucccaccuggcuu

SEQ ID NO: 666829 - RNA, 18 nt, Human
uccucggaggggccgugg

SEQ ID NO: 666830 - RNA, 21 nt, Human
ucuggaccaaagcgccaagga

SEQ ID NO: 666831 - RNA, 22 nt, Human
ucuggaccaaagcgccaaggac

SEQ ID NO: 666832 - RNA, 23 nt, Human
ucuuucugaaccaccccaggggg

SEQ ID NO: 666833 - RNA, 21 nt, Human
ugaaaaguggggggcucagaa

SEQ ID NO: 666834 - RNA, 19 nt, Human
ugagggggacccaaucugg

SEQ ID NO: 666835 - RNA, 21 nt, Human
ugaggugguguuugagggcca

SEQ ID NO: 666836 - RNA, 23 nt, Human
ugagucuccaguauguucggccc

SEQ ID NO: 666837 - RNA, 22 nt, Human
ugcugggugucugguaacagcc

SEQ ID NO: 666838 - RNA, 22 nt, Human
uggaagaaggcccgggcaucac

SEQ ID NO: 666839 - RNA, 20 nt, Human
uggcagugaugaggcagguc

SEQ ID NO: 666840 - RNA, 21 nt, Human
uggggcgccaaugagguuugg

SEQ ID NO: 666841 - RNA, 23 nt, Human
uggugcugggugucugguaacag

SEQ ID NO: 666842 - RNA, 18 nt, Human
ugucagcaaggcauagaa

SEQ ID NO: 666843 - RNA, 20 nt, Human
uguggcgggagguaacacaa

SEQ ID NO: 666844 - RNA, 19 nt, Human
uguuuuguuuuguuuuuua

SEQ ID NO: 666845 - RNA, 22 nt, Human
uuagagguguguggcgggaggu

SEQ ID NO: 666846 - RNA, 20 nt, Human
uucccaccuggcuucuugug

SEQ ID NO: 666847 - RNA, 20 nt, Human
uugaagaggcaaggcagcac

SEQ ID NO: 666848 - RNA, 20 nt, Human
uugagggccaagguaggugu

SEQ ID NO: 666849 - RNA, 20 nt, Human
uugguuuccccuccuuucca

SEQ ID NO: 666850 - RNA, 24 nt, Human
uuguuuuguuuuuuaacaucagua

SEQ ID NO: 666851 - RNA, 25 nt, Human
uuucauggcuucuccgcgccggggu

SEQ ID NO: 666852 - RNA, 22 nt, Human
uuugaggccagaguucgagacc

SEQ ID NO: 666853 - RNA, 18 nt, Human
uuuguuuuguuuuguuuu

SEQ ID NO: 666854 - RNA, 18 nt, Human
uuuuucccauuaauuuuc

SEQ ID NO: 666855 - RNA, 20 nt, Human
aacaccccagcccaccagcu

SEQ ID NO: 666856 - RNA, 20 nt, Human
aaccucccccucaggcccug

SEQ ID NO: 666857 - RNA, 22 nt, Human
aagcagccaaggaucccucucg

SEQ ID NO: 666858 - RNA, 24 nt, Human
aagcagccaaggaucccucucgag

SEQ ID NO: 666859 - RNA, 19 nt, Human
aagcucccaaggggcccca

SEQ ID NO: 666860 - RNA, 20 nt, Human
aagcugccccucuccccggg

SEQ ID NO: 666861 - RNA, 18 nt, Human
acaaugaagcagccaagg

SEQ ID NO: 666862 - RNA, 18 nt, Human
acaccacucaggacucug

SEQ ID NO: 666863 - RNA, 20 nt, Human
acccaacccaggaggcagcc

SEQ ID NO: 666864 - RNA, 22 nt, Human
acccacaccacucaggacucug

SEQ ID NO: 666865 - RNA, 22 nt, Human
acccacacccacaccacucagg

SEQ ID NO: 666866 - RNA, 22 nt, Human
accccagcccaccagcugaguc

SEQ ID NO: 666867 - RNA, 18 nt, Human
acucagaauccagcaccc

SEQ ID NO: 666868 - RNA, 22 nt, Human
acucagggccugggggccagcc

SEQ ID NO: 666869 - RNA, 19 nt, Human
agacaaugaagcagccaag

SEQ ID NO: 666870 - RNA, 25 nt, Human
agaccagggccaacguaccuugaga

SEQ ID NO: 666871 - RNA, 23 nt, Human
agagaaaaaaaaaugaacccuaa

SEQ ID NO: 666872 - RNA, 24 nt, Human
agagccugcaucccccaaaaccag

SEQ ID NO: 666873 - RNA, 24 nt, Human
agcaccuucucagagccugcaucc

SEQ ID NO: 666874 - RNA, 19 nt, Human
agccaccacggagacacag

SEQ ID NO: 666875 - RNA, 22 nt, Human
agccagcccaggccaggagccc

SEQ ID NO: 666876 - RNA, 18 nt, Human
agccuggggccggaguuc

SEQ ID NO: 666877 - RNA, 22 nt, Human
agcgcuuugucuccugggcggc

SEQ ID NO: 666878 - RNA, 19 nt, Human
aggaggugucccagccccg

SEQ ID NO: 666879 - RNA, 19 nt, Human
aggaguauggggguggggg

SEQ ID NO: 666880 - RNA, 23 nt, Human
aggcaagcucccaaggggcccca

SEQ ID NO: 666881 - RNA, 20 nt, Human
aggcacagagccaggccagc

SEQ ID NO: 666882 - RNA, 23 nt, Human
aggcaggcaggcacagagccagg

SEQ ID NO: 666883 - RNA, 18 nt, Human
aggccaggcccaggugug

SEQ ID NO: 666884 - RNA, 26 nt, Human
aggggaccggcggucagccccgaagc

SEQ ID NO: 666885 - RNA, 21 nt, Human
agggggccaccgguguggggc

SEQ ID NO: 666886 - RNA, 22 nt, Human
agguguccucagggggccaccg

SEQ ID NO: 666887 - RNA, 19 nt, Human
agguguggcugccaugacc

SEQ ID NO: 666888 - RNA, 19 nt, Human
agguugcgggguggcccgg

SEQ ID NO: 666889 - RNA, 24 nt, Human
agucacuacccucccagccaccgu

SEQ ID NO: 666890 - RNA, 23 nt, Human
agucugccaggacacggggcucu

SEQ ID NO: 666891 - RNA, 20 nt, Human
augaagcagccaaggauccc

SEQ ID NO: 666892 - RNA, 20 nt, Human
augcagucaaggagugucug

SEQ ID NO: 666893 - RNA, 23 nt, Human
augcagucaaggagugucuggag

SEQ ID NO: 666894 - RNA, 18 nt, Human
auguuagagggggcugcc

SEQ ID NO: 666895 - RNA, 26 nt, Human
caaggccaggcccagguguggcugcc

SEQ ID NO: 666896 - RNA, 22 nt, Human
cacccacaccacucaggacucu

SEQ ID NO: 666897 - RNA, 26 nt, Human
cacccacacccacaccacucaggacu

SEQ ID NO: 666898 - RNA, 19 nt, Human
caccccagcccaccagcug

SEQ ID NO: 666899 - RNA, 27 nt, Human
caccccuccauauuuccccaagcucaa

SEQ ID NO: 666900 - RNA, 23 nt, Human
caccccucucucccaggagacca

SEQ ID NO: 666901 - RNA, 19 nt, Human
cacccuuccgguccugcac

SEQ ID NO: 666902 - RNA, 19 nt, Human
cacuaggucagcaccuggg

SEQ ID NO: 666903 - RNA, 20 nt, Human
cagacagggcccgcggccag

SEQ ID NO: 666904 - RNA, 18 nt, Human
cagcaccugggccuuccu

SEQ ID NO: 666905 - RNA, 20 nt, Human
cagccaccguccugcuccug

SEQ ID NO: 666906 - RNA, 18 nt, Human
cagccagcccaggccagg

SEQ ID NO: 666907 - RNA, 18 nt, Human
cagcccaagcugccccuc

SEQ ID NO: 666908 - RNA, 26 nt, Human
cagcccaggccaggagccccgaggac

SEQ ID NO: 666909 - RNA, 19 nt, Human
caggaggcagccugauccc

SEQ ID NO: 666910 - RNA, 21 nt, Human
caggaggcagccugaucccac

SEQ ID NO: 666911 - RNA, 24 nt, Human
caggaggggacauguuagaggggg

SEQ ID NO: 666912 - RNA, 21 nt, Human
caggaucugcucccccagucu

SEQ ID NO: 666913 - RNA, 21 nt, Human
caggccacagaucgcccucag

SEQ ID NO: 666914 - RNA, 22 nt, Human
cagggcccgcggccagagagcc

SEQ ID NO: 666915 - RNA, 23 nt, Human
cagggugagggccaggagguguc

SEQ ID NO: 666916 - RNA, 22 nt, Human
caggucccggagcaaggccagg

SEQ ID NO: 666917 - RNA, 20 nt, Human
caugaccgauccucccucug

SEQ ID NO: 666918 - RNA, 21 nt, Human
ccacccacacccacaccacuc

SEQ ID NO: 666919 - RNA, 25 nt, Human
ccacccacacccacaccacucagga

SEQ ID NO: 666920 - RNA, 21 nt, Human
ccaccucacccuuccgguccu

SEQ ID NO: 666921 - RNA, 19 nt, Human
ccacucagaauccagcacc

SEQ ID NO: 666922 - RNA, 25 nt, Human
ccagauccugugccacccacaccca

SEQ ID NO: 666923 - RNA, 20 nt, Human
ccagcccaagcugccccucu

SEQ ID NO: 666924 - RNA, 23 nt, Human
ccagcccaccagcugagucugcc

SEQ ID NO: 666925 - RNA, 21 nt, Human
ccagccccgagguucucccug

SEQ ID NO: 666926 - RNA, 24 nt, Human
ccagccccgagguucucccugaug

SEQ ID NO: 666927 - RNA, 26 nt, Human
ccaggaagggaggucaggcaagcucc

SEQ ID NO: 666928 - RNA, 19 nt, Human
ccaggacacggggcucugg

SEQ ID NO: 666929 - RNA, 19 nt, Human
ccaggaggcagccugaucc

SEQ ID NO: 666930 - RNA, 24 nt, Human
ccaggcccagguguggcugccaug

SEQ ID NO: 666931 - RNA, 18 nt, Human
ccauauuuccccaagcuc

SEQ ID NO: 666932 - RNA, 24 nt, Human
ccaugccccagauccugugccacc

SEQ ID NO: 666933 - RNA, 20 nt, Human
cccaagcucaagggucucca

SEQ ID NO: 666934 - RNA, 25 nt, Human
cccacaccacucaggacucuggaag

SEQ ID NO: 666935 - RNA, 22 nt, Human
cccacucagaauccagcaccuu

SEQ ID NO: 666936 - RNA, 22 nt, Human
cccagagcaaguccagagucac

SEQ ID NO: 666937 - RNA, 25 nt, Human
ccccagauccugugccacccacacc

SEQ ID NO: 666938 - RNA, 22 nt, Human
ccccagucucuccaggacccgg

SEQ ID NO: 666939 - RNA, 28 nt, Human
cccccagucucuccaggacccggccugu

SEQ ID NO: 666940 - RNA, 24 nt, Human
ccccgaggaccaggccaccucacc

SEQ ID NO: 666941 - RNA, 18 nt, Human
cccgacacccaacccagg

SEQ ID NO: 666942 - RNA, 19 nt, Human
cccucagucccagugaccc

SEQ ID NO: 666943 - RNA, 24 nt, Human
ccgaagccaagcaagaccuggucc

SEQ ID NO: 666944 - RNA, 19 nt, Human
ccucaggaucugcuccccc

SEQ ID NO: 666945 - RNA, 22 nt, Human
ccuccauauuuccccaagcuca

SEQ ID NO: 666946 - RNA, 18 nt, Human
ccucccagccaccguccu

SEQ ID NO: 666947 - RNA, 20 nt, Human
ccucccagccaccguccugc

SEQ ID NO: 666948 - RNA, 23 nt, Human
ccucccccucaggcccuggauuc

SEQ ID NO: 666949 - RNA, 24 nt, Human
ccucgggccauggcuacccagccc

SEQ ID NO: 666950 - RNA, 18 nt, Human
ccuggagcugaagagggg

SEQ ID NO: 666951 - RNA, 24 nt, Human
ccuggagcugaagaggggcucugg

SEQ ID NO: 666952 - RNA, 20 nt, Human
ccugugccacccacacccac

SEQ ID NO: 666953 - RNA, 24 nt, Human
ccugugccacccacacccacacca

SEQ ID NO: 666954 - RNA, 19 nt, Human
ccuugcccaugauuucccu

SEQ ID NO: 666955 - RNA, 27 nt, Human
cggacagcucccccgacacccaaccca

SEQ ID NO: 666956 - RNA, 18 nt, Human
cggcagcucaggccagcc

SEQ ID NO: 666957 - RNA, 21 nt, Human
cggccagagagccacugccac

SEQ ID NO: 666958 - RNA, 18 nt, Human
cggcggucagccccgaag

SEQ ID NO: 666959 - RNA, 24 nt, Human
cucagaauccagcaccuucucaga

SEQ ID NO: 666960 - RNA, 21 nt, Human
cuccagcccaagcugccccuc

SEQ ID NO: 666961 - RNA, 23 nt, Human
cugcaccuguguccccagucacu

SEQ ID NO: 666962 - RNA, 22 nt, Human
cuggaagccacacucggugugc

SEQ ID NO: 666963 - RNA, 19 nt, Human
cuggagcugaagaggggcu

SEQ ID NO: 666964 - RNA, 20 nt, Human
cugucaccaagaggcagcgu

SEQ ID NO: 666965 - RNA, 20 nt, Human
cugugccacccacacccaca

SEQ ID NO: 666966 - RNA, 22 nt, Human
cuuccgguccugcacuaacacc

SEQ ID NO: 666967 - RNA, 25 nt, Human
cuugcccaugauuucccucaggauc

SEQ ID NO: 666968 - RNA, 25 nt, Human
gaaccccucccaugccccagauccu

SEQ ID NO: 666969 - RNA, 20 nt, Human
gaagcagccaaggaucccuc

SEQ ID NO: 666970 - RNA, 20 nt, Human
gacaaugaagcagccaagga

SEQ ID NO: 666971 - RNA, 20 nt, Human
gaccaggccaccucacccuu

SEQ ID NO: 666972 - RNA, 18 nt, Human
gagcagggcuugcugggg

SEQ ID NO: 666973 - RNA, 22 nt, Human
gagccacugccaccaggagcac

SEQ ID NO: 666974 - RNA, 21 nt, Human
gagccugcaucccccaaaacc

SEQ ID NO: 666975 - RNA, 21 nt, Human
gagucugccaggacacggggc

SEQ ID NO: 666976 - RNA, 21 nt, Human
gcaaacaggaaacuaaagcag

SEQ ID NO: 666977 - RNA, 19 nt, Human
gcagaguccugccucagcc

SEQ ID NO: 666978 - RNA, 21 nt, Human
gcagaguccugccucagccag

SEQ ID NO: 666979 - RNA, 23 nt, Human
gcagggcuugcuggggggaagac

SEQ ID NO: 666980 - RNA, 18 nt, Human
gccaugguucgggacugg

SEQ ID NO: 666981 - RNA, 23 nt, Human
gccccgaagccaagcaagaccug

SEQ ID NO: 666982 - RNA, 22 nt, Human
gccuugcccaugauuucccuca

SEQ ID NO: 666983 - RNA, 29 nt, Human
gcgacggcggcggcagcgcuuugucuccu

SEQ ID NO: 666984 - RNA, 18 nt, Human
gggacauguuagaggggg

SEQ ID NO: 666985 - RNA, 28 nt, Human
gggcacugaggacuguaaacaugaccca

SEQ ID NO: 666986 - RNA, 19 nt, Human
ggggcucugucucuggcug

SEQ ID NO: 666987 - RNA, 20 nt, Human
gggggcugagcucaggaggg

SEQ ID NO: 666988 - RNA, 23 nt, Human
gggucuccagagacagaaggaag

SEQ ID NO: 666989 - RNA, 20 nt, Human
gggugggggcugagcucagg

SEQ ID NO: 666990 - RNA, 25 nt, Human
gguggcggcgacggcggcggcagcg

SEQ ID NO: 666991 - RNA, 25 nt, Human
gugccacccacacccacaccacuca

SEQ ID NO: 666992 - RNA, 22 nt, Human
uaacaccugcaccugugucccc

SEQ ID NO: 666993 - RNA, 22 nt, Human
uaguguugcacgugacguuccc

SEQ ID NO: 666994 - RNA, 20 nt, Human
uaugggggugggggcugagc

SEQ ID NO: 666995 - RNA, 19 nt, Human
ucaaggguaggccuucugg

SEQ ID NO: 666996 - RNA, 22 nt, Human
ucaccccucucucccaggagac

SEQ ID NO: 666997 - RNA, 20 nt, Human
ucacuacccucccagccacc

SEQ ID NO: 666998 - RNA, 24 nt, Human
ucagccagcccaggccaggagccc

SEQ ID NO: 666999 - RNA, 21 nt, Human
ucagccccgaagccaagcaag

SEQ ID NO: 667000 - RNA, 20 nt, Human
ucaggaaaccucccccucaa

SEQ ID NO: 667001 - RNA, 22 nt, Human
ucaggccacagaucgcccucag

SEQ ID NO: 667002 - RNA, 23 nt, Human
ucccagccaccguccugcuccug

SEQ ID NO: 667003 - RNA, 19 nt, Human
ucccaggagaccagggcca

SEQ ID NO: 667004 - RNA, 20 nt, Human
uccccaccaggaguaugggg

SEQ ID NO: 667005 - RNA, 22 nt, Human
ucccccagucucuccaggaccc

SEQ ID NO: 667006 - RNA, 21 nt, Human
uccccucccaccagcaaacag

SEQ ID NO: 667007 - RNA, 20 nt, Human
ucccucaccccucucuccca

SEQ ID NO: 667008 - RNA, 18 nt, Human
ucccugggggaaccugcu

SEQ ID NO: 667009 - RNA, 20 nt, Human
uccuaggcggugagucagcu

SEQ ID NO: 667010 - RNA, 18 nt, Human
uccucuggcaggucccgg

SEQ ID NO: 667011 - RNA, 19 nt, Human
ucucagagccugcaucccc

SEQ ID NO: 667012 - RNA, 23 nt, Human
ucuccagagacagaaggaagggg

SEQ ID NO: 667013 - RNA, 21 nt, Human
ucuccagcccaagcugccccu

SEQ ID NO: 667014 - RNA, 20 nt, Human
ucucccaggagaccagggcc

SEQ ID NO: 667015 - RNA, 21 nt, Human
ucugaaccccucccaugcccc

SEQ ID NO: 667016 - RNA, 26 nt, Human
ugacccagggugagggccaggaggug

SEQ ID NO: 667017 - RNA, 20 nt, Human
ugagcucaggaggggacaug

SEQ ID NO: 667018 - RNA, 18 nt, Human
ugaggccuggcaggggac

SEQ ID NO: 667019 - RNA, 22 nt, Human
ugauugcagacacacaccccuc

SEQ ID NO: 667020 - RNA, 19 nt, Human
ugcacgugacguuccccuc

SEQ ID NO: 667021 - RNA, 24 nt, Human
ugccacccacacccacaccacuca

SEQ ID NO: 667022 - RNA, 18 nt, Human
ugccaggacacggggcuc

SEQ ID NO: 667023 - RNA, 22 nt, Human
ugccaggcugccggacagcucc

SEQ ID NO: 667024 - RNA, 26 nt, Human
ugccccagauccugugccacccacac

SEQ ID NO: 667025 - RNA, 19 nt, Human
ugccuguggagagcagggc

SEQ ID NO: 667026 - RNA, 19 nt, Human
uggaaggaggugagcgggg

SEQ ID NO: 667027 - RNA, 21 nt, Human
uggaaggaggugagcggggac

SEQ ID NO: 667028 - RNA, 22 nt, Human
uggcccggccaugguucgggac

SEQ ID NO: 667029 - RNA, 26 nt, Human
uggcccggccaugguucgggacuggc

SEQ ID NO: 667030 - RNA, 22 nt, Human
uggcccgguggcggcgacggcg

SEQ ID NO: 667031 - RNA, 18 nt, Human
uggcggcgacggcggcgg

SEQ ID NO: 667032 - RNA, 24 nt, Human
uggcggcgacggcggcggcagcgc

SEQ ID NO: 667033 - RNA, 18 nt, Human
ugggcugagucugucacc

SEQ ID NO: 667034 - RNA, 21 nt, Human
ugggggaaccugcuagaaggu

SEQ ID NO: 667035 - RNA, 21 nt, Human
uggugagaagaaaggggaccg

SEQ ID NO: 667036 - RNA, 19 nt, Human
uguaaaccuacgccaggac

SEQ ID NO: 667037 - RNA, 19 nt, Human
ugucccagagggcauagag

SEQ ID NO: 667038 - RNA, 23 nt, Human
ugucccagccccgagguucuccc

SEQ ID NO: 667039 - RNA, 21 nt, Human
ugucuggagagcccugugaga

SEQ ID NO: 667040 - RNA, 23 nt, Human
uuccccaagcucaagggucucca

SEQ ID NO: 667041 - RNA, 21 nt, Human
uugacaaaauuuuacuuuagc

SEQ ID NO: 667042 - RNA, 20 nt, Human
uugcacgugacguuccccuu

SEQ ID NO: 667043 - RNA, 22 nt, Human
uuguugccagagaaaaaaaaag

SEQ ID NO: 667044 - RNA, 26 nt, Human
aaaugggauucaggggccgucuucuc

SEQ ID NO: 667045 - RNA, 19 nt, Human
aagaugacacaaaagagcc

SEQ ID NO: 667046 - RNA, 23 nt, Human
aaugcaggccccgaaggcugccu

SEQ ID NO: 667047 - RNA, 30 nt, Human
agacccagcuggccugagugugcacgaaaa

SEQ ID NO: 667048 - RNA, 23 nt, Human
agcaaggggccaaaugggauuca

SEQ ID NO: 667049 - RNA, 23 nt, Human
aggccccgaaggcugccuccacc

SEQ ID NO: 667050 - RNA, 18 nt, Human
auggaaacggugaggugg

SEQ ID NO: 667051 - RNA, 21 nt, Human
cacccuuauucucaaaugcag

SEQ ID NO: 667052 - RNA, 21 nt, Human
ccaggacucauguccuguacu

SEQ ID NO: 667053 - RNA, 18 nt, Human
ccccgaaggcugccuccc

SEQ ID NO: 667054 - RNA, 18 nt, Human
ccuccagccagcaagggg

SEQ ID NO: 667055 - RNA, 23 nt, Human
ccucgggucccucaccaggacuc

SEQ ID NO: 667056 - RNA, 25 nt, Human
cuccuuggguccaccaggcugggag

SEQ ID NO: 667057 - RNA, 23 nt, Human
cuguacuguccuccucgcuuaca

SEQ ID NO: 667058 - RNA, 22 nt, Human
gggagucugaaccgauuuagcu

SEQ ID NO: 667059 - RNA, 20 nt, Human
uaagaugacacaaaagagcc

SEQ ID NO: 667060 - RNA, 21 nt, Human
ucagcagacgccuggaacuag

SEQ ID NO: 667061 - RNA, 19 nt, Human
uccaccaggcugggaggca

SEQ ID NO: 667062 - RNA, 18 nt, Human
uccuguacuguccuccuc

SEQ ID NO: 667063 - RNA, 19 nt, Human
ucuuucagcagacgccugg

SEQ ID NO: 667064 - RNA, 22 nt, Human
ugagugugcacgaaaugggacc

SEQ ID NO: 667065 - RNA, 20 nt, Human
uguacuguccuccucgcuua

SEQ ID NO: 667066 - RNA, 23 nt, Human
uguccugcuccucgggucccuca

SEQ ID NO: 667067 - RNA, 20 nt, Human
uguccuguacuguccuccuc

SEQ ID NO: 667068 - RNA, 19 nt, Human
uucucuguccugcuccucg

SEQ ID NO: 667069 - RNA, 18 nt, Human
aagccgaggaguugucgg

SEQ ID NO: 667070 - RNA, 24 nt, Human
aagggacuuagggggauggggucu

SEQ ID NO: 667071 - RNA, 20 nt, Human
acuuagggggauggggucug

SEQ ID NO: 667072 - RNA, 18 nt, Human
agaaggaaguagaggagg

SEQ ID NO: 667073 - RNA, 22 nt, Human
agaguuggggagggggccuagg

SEQ ID NO: 667074 - RNA, 22 nt, Human
aggaggagggugggaggugggu

SEQ ID NO: 667075 - RNA, 21 nt, Human
aggaguugucggugugggguc

SEQ ID NO: 667076 - RNA, 18 nt, Human
aggauggaggucagggca

SEQ ID NO: 667077 - RNA, 23 nt, Human
aggcaguguccaggauggagguc

SEQ ID NO: 667078 - RNA, 23 nt, Human
agggaagggauggaaauguagua

SEQ ID NO: 667079 - RNA, 24 nt, Human
agggauggaaauguaguacccgga

SEQ ID NO: 667080 - RNA, 22 nt, Human
agggggauggggucugguuaga

SEQ ID NO: 667081 - RNA, 18 nt, Human
aggguuccagagucuggu

SEQ ID NO: 667082 - RNA, 22 nt, Human
cagaaggaaguagaggaggggu

SEQ ID NO: 667083 - RNA, 18 nt, Human
ccugggguugggggaggg

SEQ ID NO: 667084 - RNA, 21 nt, Human
ccugguguccaagaguugggg

SEQ ID NO: 667085 - RNA, 21 nt, Human
cgguggggcugagacugucgg

SEQ ID NO: 667086 - RNA, 23 nt, Human
cgguguggggucggaaagcugga

SEQ ID NO: 667087 - RNA, 25 nt, Human
cgguguggggucggaaagcuggagg

SEQ ID NO: 667088 - RNA, 18 nt, Human
cucagaaggaaguagagg

SEQ ID NO: 667089 - RNA, 18 nt, Human
cucaguugggucuugaag

SEQ ID NO: 667090 - RNA, 21 nt, Human
cugacuggccugggguugggg

SEQ ID NO: 667091 - RNA, 23 nt, Human
cuggauggucuggagugggaggu

SEQ ID NO: 667092 - RNA, 18 nt, Human
cuggggagguuggggugg

SEQ ID NO: 667093 - RNA, 18 nt, Human
gaaagacuaagggagugg

SEQ ID NO: 667094 - RNA, 21 nt, Human
gaaggagaagaggaggagggu

SEQ ID NO: 667095 - RNA, 22 nt, Human
gagaagaggaggagggugggag

SEQ ID NO: 667096 - RNA, 22 nt, Human
gaggaggagggugggagguggg

SEQ ID NO: 667097 - RNA, 23 nt, Human
gaggaggagggugggaggugggu

SEQ ID NO: 667098 - RNA, 20 nt, Human
gagugguggcagggagaaag

SEQ ID NO: 667099 - RNA, 20 nt, Human
gccugguguccaagaguugg

SEQ ID NO: 667100 - RNA, 19 nt, Human
ggaggagggugggaggugg

SEQ ID NO: 667101 - RNA, 21 nt, Human
ggagggggcaguuguagacug

SEQ ID NO: 667102 - RNA, 25 nt, Human
gggcugagacugucggcugaggguu

SEQ ID NO: 667103 - RNA, 24 nt, Human
ggggagggggccuaggacauccgu

SEQ ID NO: 667104 - RNA, 19 nt, Human
gggucuggaagccgaggag

SEQ ID NO: 667105 - RNA, 18 nt, Human
ggucugguuagaguuggg

SEQ ID NO: 667106 - RNA, 21 nt, Human
ggugucaaaauagggaaggga

SEQ ID NO: 667107 - RNA, 19 nt, Human
gguguccaagaguuggggc

SEQ ID NO: 667108 - RNA, 20 nt, Human
gguguuggguguucuaguug

SEQ ID NO: 667109 - RNA, 19 nt, Human
gugcagagucuggggaggu

SEQ ID NO: 667110 - RNA, 24 nt, Human
guggcagggagaaaggcugugggg

SEQ ID NO: 667111 - RNA, 20 nt, Human
guggggucggaaagcuggag

SEQ ID NO: 667112 - RNA, 20 nt, Human
gugguggcagggagaaaggc

SEQ ID NO: 667113 - RNA, 22 nt, Human
uaagccugggaaagacuaaggg

SEQ ID NO: 667114 - RNA, 18 nt, Human
uccagagucugguguggc

SEQ ID NO: 667115 - RNA, 18 nt, Human
ugaaggagaagaggagga

SEQ ID NO: 667116 - RNA, 23 nt, Human
uggagggggcaguuguagacugu

SEQ ID NO: 667117 - RNA, 20 nt, Human
uggcagggagaaaggcugug

SEQ ID NO: 667118 - RNA, 22 nt, Human
uggccugggguugggggagggc

SEQ ID NO: 667119 - RNA, 22 nt, Human
uggcugggcggagucagaucgg

SEQ ID NO: 667120 - RNA, 23 nt, Human
ugggaaagacuaagggaguggug

SEQ ID NO: 667121 - RNA, 21 nt, Human
uggggagggggccuaggacau

SEQ ID NO: 667122 - RNA, 18 nt, Human
uggggcagucgaaaaagg

SEQ ID NO: 667123 - RNA, 22 nt, Human
uggggcugagacugucggcuga

SEQ ID NO: 667124 - RNA, 20 nt, Human
ugguagggucuggaagccga

SEQ ID NO: 667125 - RNA, 21 nt, Human
ugguguccaagaguuggggca

SEQ ID NO: 667126 - RNA, 19 nt, Human
ugguguggcuggcuggggu

SEQ ID NO: 667127 - RNA, 24 nt, Human
caggucccgggccaggccgccccu

SEQ ID NO: 667128 - RNA, 20 nt, Human
ccccuggacuccggcgcggg

SEQ ID NO: 667129 - RNA, 18 nt, Human
cccgggccaggccgcccc

SEQ ID NO: 667130 - RNA, 19 nt, Human
ccuggacuccggcgcgggg

SEQ ID NO: 667131 - RNA, 25 nt, Human
cguccagaaggggccccuggacucc

SEQ ID NO: 667132 - RNA, 20 nt, Human
cuggagcagcagcagguccc

SEQ ID NO: 667133 - RNA, 20 nt, Human
gagcagcagcaggucccggg

SEQ ID NO: 667134 - RNA, 22 nt, Human
gagcagcagcaggucccgggcc

SEQ ID NO: 667135 - RNA, 18 nt, Human
uuuuuuuuuuuuuugccg

SEQ ID NO: 667136 - RNA, 18 nt, Human
uuuuuuuuuuuuuuuuug

SEQ ID NO: 667137 - RNA, 23 nt, Human
aaaacgcuucguucaucaucccu

SEQ ID NO: 667138 - RNA, 19 nt, Human
aagaguugccccuaccucc

SEQ ID NO: 667139 - RNA, 22 nt, Human
aauagcgauggcggcccucggc

SEQ ID NO: 667140 - RNA, 18 nt, Human
agaaccagggugacggaa

SEQ ID NO: 667141 - RNA, 22 nt, Human
agacaggaagagaagaggggac

SEQ ID NO: 667142 - RNA, 20 nt, Human
caagcgagaaaaagagggag

SEQ ID NO: 667143 - RNA, 23 nt, Human
ccgcaauagcgauggcggcccuc

SEQ ID NO: 667144 - RNA, 24 nt, Human
ccggcggccaugacagcuaccgag

SEQ ID NO: 667145 - RNA, 24 nt, Human
cggagaaccgagacuacagaacca

SEQ ID NO: 667146 - RNA, 22 nt, Human
gaaaaccaggacggcgccaagc

SEQ ID NO: 667147 - RNA, 19 nt, Human
gcuucguucaucaucccuu

SEQ ID NO: 667148 - RNA, 25 nt, Human
ggucuuuuucccagacaggaagaga

SEQ ID NO: 667149 - RNA, 24 nt, Human
uagcgauggcggcccucggcgcag

SEQ ID NO: 667150 - RNA, 20 nt, Human
uccacaagcgagaaaaagag

SEQ ID NO: 667151 - RNA, 21 nt, Human
uccacaagcgagaaaaagagg

SEQ ID NO: 667152 - RNA, 20 nt, Human
ugacccggcggccaugacag

SEQ ID NO: 667153 - RNA, 22 nt, Human
ugacggaaaaccaggacggcgc

SEQ ID NO: 667154 - RNA, 23 nt, Human
ugcaguccccucaaaacgcuucg

SEQ ID NO: 667155 - RNA, 18 nt, Human
uugagcuauggucuuuuu

SEQ ID NO: 667156 - RNA, 23 nt, Human
acaaagaugaaaagacaaagccc

SEQ ID NO: 667157 - RNA, 18 nt, Human
agcccuagcuagaucagc

SEQ ID NO: 667158 - RNA, 18 nt, Human
augagaaugaguugggca

SEQ ID NO: 667159 - RNA, 21 nt, Human
cagcggccauggcgcuuggag

SEQ ID NO: 667160 - RNA, 20 nt, Human
ccccugaagucgagccuggg

SEQ ID NO: 667161 - RNA, 21 nt, Human
cgacccgggcucgggcggcag

SEQ ID NO: 667162 - RNA, 24 nt, Human
cuggugcuaguguuucuaucagau

SEQ ID NO: 667163 - RNA, 18 nt, Human
gcgacccgggcucgggcg

SEQ ID NO: 667164 - RNA, 20 nt, Human
gggucuaacauaguggucau

SEQ ID NO: 667165 - RNA, 24 nt, Human
guauaucccaccuauacugguaac

SEQ ID NO: 667166 - RNA, 21 nt, Human
uaacauaguggucauuugucc

SEQ ID NO: 667167 - RNA, 21 nt, Human
uagaaaagugcugccagaaac

SEQ ID NO: 667168 - RNA, 27 nt, Human
ugaaaagacaaagcccuagcuagauca

SEQ ID NO: 667169 - RNA, 20 nt, Human
ugaccccugaagucgagccu

SEQ ID NO: 667170 - RNA, 24 nt, Human
ugauagauacugaguuuuugcuca

SEQ ID NO: 667171 - RNA, 18 nt, Human
ugggggucuaacauagug

SEQ ID NO: 667172 - RNA, 20 nt, Human
ugggguuugggacaggaaca

SEQ ID NO: 667173 - RNA, 20 nt, Human
uugcucauuugcuacaugaa

SEQ ID NO: 667174 - RNA, 20 nt, Human
aaggaaccauggccaaaugc

SEQ ID NO: 667175 - RNA, 23 nt, Human
agacgaaaaggaaccauggccaa

SEQ ID NO: 667176 - RNA, 25 nt, Human
auggccaaaugccuaucaaucagcc

SEQ ID NO: 667177 - RNA, 21 nt, Human
caaaugccuaucaaucagccc

SEQ ID NO: 667178 - RNA, 24 nt, Human
cagcccuucccucagcaugugguu

SEQ ID NO: 667179 - RNA, 26 nt, Human
cauggccaaaugccuaucaaucagcc

SEQ ID NO: 667180 - RNA, 22 nt, Human
ccagcgucugggugcacgcugg

SEQ ID NO: 667181 - RNA, 23 nt, Human
ccccaaagguagacgaaaaggaa

SEQ ID NO: 667182 - RNA, 20 nt, Human
cccccaaagguagacgaaaa

SEQ ID NO: 667183 - RNA, 22 nt, Human
cccccaaagguagacgaaaagg

SEQ ID NO: 667184 - RNA, 24 nt, Human
ccugagaaggcccccaaagguaga

SEQ ID NO: 667185 - RNA, 23 nt, Human
cuccauggucuugaacgccugcu

SEQ ID NO: 667186 - RNA, 24 nt, Human
ggcaggagcugcucauggaaaggu

SEQ ID NO: 667187 - RNA, 21 nt, Human
uaacaacagccuuguucuggg

SEQ ID NO: 667188 - RNA, 18 nt, Human
uaaugaacagaggauacu

SEQ ID NO: 667189 - RNA, 19 nt, Human
ucaaucagcccgguaccua

SEQ ID NO: 667190 - RNA, 24 nt, Human
ucagcccuucccucagcauguggu

SEQ ID NO: 667191 - RNA, 18 nt, Human
ugggugcacgcuggcugu

SEQ ID NO: 667192 - RNA, 21 nt, Human
uuccacauaguaacaacagcc

SEQ ID NO: 667193 - RNA, 20 nt, Human
uucugggccugagaaggccc

SEQ ID NO: 667194 - RNA, 21 nt, Human
acuaaggugucuugauaaggu

SEQ ID NO: 667195 - RNA, 19 nt, Human
agacgaaggucguccaaac

SEQ ID NO: 667196 - RNA, 19 nt, Human
agacgaaggucguccaaac

SEQ ID NO: 667197 - RNA, 22 nt, Human
agaggagaaacaguauuaugaa

SEQ ID NO: 667198 - RNA, 18 nt, Human
aggcagcauggacuuaca

SEQ ID NO: 667199 - RNA, 19 nt, Human
caagaguacaaagacaacu

SEQ ID NO: 667200 - RNA, 21 nt, Human
cacucaguaccucugugccag

SEQ ID NO: 667201 - RNA, 26 nt, Human
caggagccaaaccaaauaaauaagag

SEQ ID NO: 667202 - RNA, 22 nt, Human
ccguucaguacuuuucuccuca

SEQ ID NO: 667203 - RNA, 22 nt, Human
cuggaggcagguugccuuuucu

SEQ ID NO: 667204 - RNA, 24 nt, Human
cuuuccuaagcacaucucauuucc

SEQ ID NO: 667205 - RNA, 18 nt, Human
gaaacaguauuaugaaca

SEQ ID NO: 667206 - RNA, 18 nt, Human
gccaaaccaaauaaauaa

SEQ ID NO: 667207 - RNA, 19 nt, Human
ggaggucagggagcaaucc

SEQ ID NO: 667208 - RNA, 18 nt, Human
uaccucugugccagaaga

SEQ ID NO: 667209 - RNA, 19 nt, Human
uagaacccaauuucuggga

SEQ ID NO: 667210 - RNA, 23 nt, Human
uagggaagugggguagaaggggg

SEQ ID NO: 667211 - RNA, 20 nt, Human
ucaggccaaguggaagaaua

SEQ ID NO: 667212 - RNA, 22 nt, Human
ucaggccaaguggaagaauaag

SEQ ID NO: 667213 - RNA, 20 nt, Human
ucaguaccucugugccagaa

SEQ ID NO: 667214 - RNA, 24 nt, Human
ugaaaaggcugcaggcauauggug

SEQ ID NO: 667215 - RNA, 18 nt, Human
ugaggcuuuauguauuuc

SEQ ID NO: 667216 - RNA, 24 nt, Human
ugccuuuucuccugaggaaucuca

SEQ ID NO: 667217 - RNA, 24 nt, Human
ugguaagaaagccccuugcucucu

SEQ ID NO: 667218 - RNA, 24 nt, Human
ugucuugauaagguccagagacaa

SEQ ID NO: 667219 - RNA, 18 nt, Human
aaagugcuguuuccuccu

SEQ ID NO: 667220 - RNA, 21 nt, Human
aagagucagacaaaaucaaga

SEQ ID NO: 667221 - RNA, 20 nt, Human
aagugcuguuuccuccugcu

SEQ ID NO: 667222 - RNA, 22 nt, Human
acagcagacagaaaaagucaaa

SEQ ID NO: 667223 - RNA, 18 nt, Human
acccugagaaugccucgg

SEQ ID NO: 667224 - RNA, 18 nt, Human
acugaaccgcaggagacu

SEQ ID NO: 667225 - RNA, 18 nt, Human
agacaaaaucaagacgua

SEQ ID NO: 667226 - RNA, 19 nt, Human
agagggggugggggaagag

SEQ ID NO: 667227 - RNA, 22 nt, Human
agcacagauacccugagaaugc

SEQ ID NO: 667228 - RNA, 21 nt, Human
agccaggccuugccuuucccg

SEQ ID NO: 667229 - RNA, 20 nt, Human
agcucuaaguaagccaggcc

SEQ ID NO: 667230 - RNA, 24 nt, Human
aggauagugaggaacugcuccagc

SEQ ID NO: 667231 - RNA, 22 nt, Human
aggguccucccuuccucugccc

SEQ ID NO: 667232 - RNA, 24 nt, Human
aggguccugacugagcugcuccuc

SEQ ID NO: 667233 - RNA, 19 nt, Human
agguagugcuugcuccugg

SEQ ID NO: 667234 - RNA, 22 nt, Human
auccagcaguaaagaacccagc

SEQ ID NO: 667235 - RNA, 20 nt, Human
caacgcacaacccccagagg

SEQ ID NO: 667236 - RNA, 21 nt, Human
caacgcacaacccccagaggc

SEQ ID NO: 667237 - RNA, 22 nt, Human
caacucuuucuccaguuucacc

SEQ ID NO: 667238 - RNA, 21 nt, Human
caaugaccccuccugaaacuc

SEQ ID NO: 667239 - RNA, 18 nt, Human
cacagauacccugagaau

SEQ ID NO: 667240 - RNA, 18 nt, Human
caccauggcggccagggc

SEQ ID NO: 667241 - RNA, 21 nt, Human
caccccgcaaggcccugcagu

SEQ ID NO: 667242 - RNA, 20 nt, Human
caccuugcaccccgcaaggc

SEQ ID NO: 667243 - RNA, 22 nt, Human
cacgugucaagguuuugccuuu

SEQ ID NO: 667244 - RNA, 23 nt, Human
cagagcuccuggagcucccuaag

SEQ ID NO: 667245 - RNA, 24 nt, Human
cagcaguaaagaacccagcugcca

SEQ ID NO: 667246 - RNA, 25 nt, Human
cagcaguaaagaacccagcugccau

SEQ ID NO: 667247 - RNA, 22 nt, Human
cagccaucaccuugcaccccgg

SEQ ID NO: 667248 - RNA, 21 nt, Human
cagcuaugcucucuggaagcu

SEQ ID NO: 667249 - RNA, 25 nt, Human
cagcugccaucucuuggucucuggg

SEQ ID NO: 667250 - RNA, 20 nt, Human
caggcaagacagagcccuca

SEQ ID NO: 667251 - RNA, 22 nt, Human
ccacggcauucccacggccagg

SEQ ID NO: 667252 - RNA, 23 nt, Human
ccacuuggguaagagauggaagc

SEQ ID NO: 667253 - RNA, 26 nt, Human
ccagugcucuuucugucagguccucc

SEQ ID NO: 667254 - RNA, 20 nt, Human
ccagugcuuuccugcagcca

SEQ ID NO: 667255 - RNA, 18 nt, Human
ccccaacgcacaaccccc

SEQ ID NO: 667256 - RNA, 21 nt, Human
ccccagcuggaugccuggcuc

SEQ ID NO: 667257 - RNA, 22 nt, Human
ccgcaggagacugcuucccuca

SEQ ID NO: 667258 - RNA, 18 nt, Human
ccggauccaggcguagaa

SEQ ID NO: 667259 - RNA, 19 nt, Human
ccucgggucaugggcuguc

SEQ ID NO: 667260 - RNA, 22 nt, Human
ccucugcaaagugcuguuuccu

SEQ ID NO: 667261 - RNA, 19 nt, Human
ccuggagcucccuaagagc

SEQ ID NO: 667262 - RNA, 22 nt, Human
ccugggguccagcugccuccug

SEQ ID NO: 667263 - RNA, 24 nt, Human
ccuguggcauggaacccaccgccu

SEQ ID NO: 667264 - RNA, 19 nt, Human
cgccagugcuauccgcggu

SEQ ID NO: 667265 - RNA, 19 nt, Human
cuaggguccucccuuccuc

SEQ ID NO: 667266 - RNA, 20 nt, Human
cucauucaccacggcauucc

SEQ ID NO: 667267 - RNA, 22 nt, Human
cucauucaccacggcauuccca

SEQ ID NO: 667268 - RNA, 21 nt, Human
cucgggccucagccaccgacc

SEQ ID NO: 667269 - RNA, 22 nt, Human
cucuaaguaagccaggccuugc

SEQ ID NO: 667270 - RNA, 21 nt, Human
cucucugggccaugcucccgg

SEQ ID NO: 667271 - RNA, 22 nt, Human
cucuuggucucugggauucacu

SEQ ID NO: 667272 - RNA, 23 nt, Human
cugcuccagcaccagcagcucca

SEQ ID NO: 667273 - RNA, 20 nt, Human
cuggccccagcuggaugccu

SEQ ID NO: 667274 - RNA, 18 nt, Human
cuggcucccaagcgccuc

SEQ ID NO: 667275 - RNA, 26 nt, Human
cugucgcaugcauccccaacgcacaa

SEQ ID NO: 667276 - RNA, 20 nt, Human
gaaguuuuacagaugaggau

SEQ ID NO: 667277 - RNA, 19 nt, Human
gacucccuccgaggagacu

SEQ ID NO: 667278 - RNA, 19 nt, Human
gagggaagauccagcacgg

SEQ ID NO: 667279 - RNA, 21 nt, Human
gcuuccugggguccagcugcc

SEQ ID NO: 667280 - RNA, 23 nt, Human
gcuugaccuccacuggccccagc

SEQ ID NO: 667281 - RNA, 23 nt, Human
ggaccagugcuuuccugcagcca

SEQ ID NO: 667282 - RNA, 18 nt, Human
ggcaggaguggucauggg

SEQ ID NO: 667283 - RNA, 19 nt, Human
ggcaggauagugaggaacu

SEQ ID NO: 667284 - RNA, 18 nt, Human
ggccccaaccugcgaucc

SEQ ID NO: 667285 - RNA, 23 nt, Human
ggccuugccuuucccgcguuggc

SEQ ID NO: 667286 - RNA, 18 nt, Human
ggcguagaacucgcgggg

SEQ ID NO: 667287 - RNA, 24 nt, Human
gggaagauccagcacggggcagga

SEQ ID NO: 667288 - RNA, 20 nt, Human
gggcaggaguggucauggga

SEQ ID NO: 667289 - RNA, 23 nt, Human
gggcaucccccauucaggcuuga

SEQ ID NO: 667290 - RNA, 25 nt, Human
gggcaucccccauucaggcuugacc

SEQ ID NO: 667291 - RNA, 21 nt, Human
uaaaaacugcaaguggagaca

SEQ ID NO: 667292 - RNA, 23 nt, Human
uacagcagacagaaaaagucaaa

SEQ ID NO: 667293 - RNA, 20 nt, Human
uagaacucgcggggcaggau

SEQ ID NO: 667294 - RNA, 23 nt, Human
uaugacccugcaggcaagacaga

SEQ ID NO: 667295 - RNA, 18 nt, Human
ucaaauggaagcaacucu

SEQ ID NO: 667296 - RNA, 26 nt, Human
ucaauggaaaagagaggggguggggg

SEQ ID NO: 667297 - RNA, 20 nt, Human
ucaggaagaugaggucccag

SEQ ID NO: 667298 - RNA, 24 nt, Human
uccagcacggggcaggagggcagg

SEQ ID NO: 667299 - RNA, 25 nt, Human
uccaguuucaccacaggaauaccca

SEQ ID NO: 667300 - RNA, 20 nt, Human
uccccaacgcacaacccccc

SEQ ID NO: 667301 - RNA, 22 nt, Human
ucccggauccaggcguagaacu

SEQ ID NO: 667302 - RNA, 23 nt, Human
ucccggauccaggcguagaacuc

SEQ ID NO: 667303 - RNA, 21 nt, Human
uccuggaaggcccgugucuca

SEQ ID NO: 667304 - RNA, 18 nt, Human
ucgcggggcaggauagug

SEQ ID NO: 667305 - RNA, 19 nt, Human
ucugagcuaugacccugca

SEQ ID NO: 667306 - RNA, 20 nt, Human
ucuuuaaauggccccaaccu

SEQ ID NO: 667307 - RNA, 21 nt, Human
ugagaaagaugaaugauggug

SEQ ID NO: 667308 - RNA, 22 nt, Human
ugcagccaucaccuugcacccc

SEQ ID NO: 667309 - RNA, 22 nt, Human
ugcauccccaacgcacaacccc

SEQ ID NO: 667310 - RNA, 18 nt, Human
ugccaucucuuggucucu

SEQ ID NO: 667311 - RNA, 21 nt, Human
ugccuguggcauggaacccac

SEQ ID NO: 667312 - RNA, 30 nt, Human
uggaaaagagagggggugggggaagagucc

SEQ ID NO: 667313 - RNA, 26 nt, Human
uggccuccagugcucuuucugucagg

SEQ ID NO: 667314 - RNA, 22 nt, Human
ugggaccagugcuuuccugcag

SEQ ID NO: 667315 - RNA, 23 nt, Human
ugggggaagagucuuccgguccg

SEQ ID NO: 667316 - RNA, 25 nt, Human
ugucgcaugcauccccaacgcacag

SEQ ID NO: 667317 - RNA, 20 nt, Human
ugugauggugcgcucaaccc

SEQ ID NO: 667318 - RNA, 19 nt, Human
uuaaauggccccaaccugc

SEQ ID NO: 667319 - RNA, 20 nt, Human
uuacucccagcuuuguucgg

SEQ ID NO: 667320 - RNA, 19 nt, Human
uuagaucagggugguggca

SEQ ID NO: 667321 - RNA, 25 nt, Human
uuccuaauaguugguguguugacag

SEQ ID NO: 667322 - RNA, 23 nt, Human
uuccugggguccagcugccuccu

SEQ ID NO: 667323 - RNA, 24 nt, Human
uucuccaguuucaccacaggaaua

SEQ ID NO: 667324 - RNA, 24 nt, Human
uuuccugcagccaucaccuugcac

SEQ ID NO: 667325 - RNA, 20 nt, Human
aaaaaaguccuuccaucccu

SEQ ID NO: 667326 - RNA, 27 nt, Human
aaaaagaggguauaugaaguaccuagg

SEQ ID NO: 667327 - RNA, 21 nt, Human
aaaaagccaaacucgaaauac

SEQ ID NO: 667328 - RNA, 25 nt, Human
aaaguccuuccaucccucaccccug

SEQ ID NO: 667329 - RNA, 23 nt, Human
aacauaguaaugguaauccaccu

SEQ ID NO: 667330 - RNA, 24 nt, Human
acagagcaagaccccuucucuuug

SEQ ID NO: 667331 - RNA, 19 nt, Human
acugcacuccagacugggu

SEQ ID NO: 667332 - RNA, 24 nt, Human
acugcacuccagacugggugacag

SEQ ID NO: 667333 - RNA, 26 nt, Human
acugcacuccagacugggugacagag

SEQ ID NO: 667334 - RNA, 20 nt, Human
agaaaaagccaaacucgaaa

SEQ ID NO: 667335 - RNA, 19 nt, Human
agaaaagaccucccugagg

SEQ ID NO: 667336 - RNA, 23 nt, Human
agaaaucagaaaagaccucccug

SEQ ID NO: 667337 - RNA, 20 nt, Human
agaggcuauuugggaggcug

SEQ ID NO: 667338 - RNA, 18 nt, Human
agaugggaggaucacuug

SEQ ID NO: 667339 - RNA, 24 nt, Human
agccugggcaacacagcgagaccc

SEQ ID NO: 667340 - RNA, 18 nt, Human
agcugccaaacacucuuc

SEQ ID NO: 667341 - RNA, 22 nt, Human
aggagguugaaaccagccuggg

SEQ ID NO: 667342 - RNA, 21 nt, Human
aggaucacuugaggccaggag

SEQ ID NO: 667343 - RNA, 22 nt, Human
aggaucacuugaggccaggagg

SEQ ID NO: 667344 - RNA, 24 nt, Human
aggaucacuugaggccaggagguu

SEQ ID NO: 667345 - RNA, 24 nt, Human
aggaucacuugugcccaggagcuc

SEQ ID NO: 667346 - RNA, 18 nt, Human
aggcaagaggaucacuug

SEQ ID NO: 667347 - RNA, 21 nt, Human
aggcauuguggcgugcaccug

SEQ ID NO: 667348 - RNA, 24 nt, Human
aggcugaggcaagaggaucacuug

SEQ ID NO: 667349 - RNA, 18 nt, Human
aucccauucucuuccagg

SEQ ID NO: 667350 - RNA, 26 nt, Human
aucuuccugcagacaucucauuucca

SEQ ID NO: 667351 - RNA, 20 nt, Human
auucaguggccugggcuaca

SEQ ID NO: 667352 - RNA, 24 nt, Human
auuuugccacugcacuccagacug

SEQ ID NO: 667353 - RNA, 24 nt, Human
caagaggaucacuugaggccagga

SEQ ID NO: 667354 - RNA, 20 nt, Human
caaggcacagaaaaagccaa

SEQ ID NO: 667355 - RNA, 22 nt, Human
caaggcacagaaaaagccaaac

SEQ ID NO: 667356 - RNA, 24 nt, Human
caccaagaaaucagaaaagaccuc

SEQ ID NO: 667357 - RNA, 22 nt, Human
caccacuuuuccucaaggcaca

SEQ ID NO: 667358 - RNA, 19 nt, Human
caccugaagucccagcuac

SEQ ID NO: 667359 - RNA, 22 nt, Human
caccugaagucccagcuacuca

SEQ ID NO: 667360 - RNA, 23 nt, Human
cacuccagacugggugacagagc

SEQ ID NO: 667361 - RNA, 19 nt, Human
cacugcacuccagacuggg

SEQ ID NO: 667362 - RNA, 23 nt, Human
cacugcacuccagacugggugac

SEQ ID NO: 667363 - RNA, 24 nt, Human
cacugcacuccagacugggugaca

SEQ ID NO: 667364 - RNA, 24 nt, Human
cacugcacuccagacugggugaca

SEQ ID NO: 667365 - RNA, 22 nt, Human
cagaaaaagccaaacucgaaau

SEQ ID NO: 667366 - RNA, 21 nt, Human
cagaaaagaccucccugagga

SEQ ID NO: 667367 - RNA, 25 nt, Human
cagcgcagccagccuaaccccuugg

SEQ ID NO: 667368 - RNA, 26 nt, Human
ccacugagauaaauaucaggggcggg

SEQ ID NO: 667369 - RNA, 20 nt, Human
ccacugcacuccagacuggg

SEQ ID NO: 667370 - RNA, 20 nt, Human
ccacugcacuccagacuggg

SEQ ID NO: 667371 - RNA, 21 nt, Human
ccacugcacuccagacugggu

SEQ ID NO: 667372 - RNA, 24 nt, Human
ccacugcacuccagacugggugac

SEQ ID NO: 667373 - RNA, 22 nt, Human
ccaggagcuccaggcugcagug

SEQ ID NO: 667374 - RNA, 22 nt, Human
ccauuguccuuuuccggccacc

SEQ ID NO: 667375 - RNA, 22 nt, Human
cccaccaagaaaucagaaaaga

SEQ ID NO: 667376 - RNA, 19 nt, Human
ccuauuucuuuguaaaucc

SEQ ID NO: 667377 - RNA, 18 nt, Human
ccucgugagcuuacaauc

SEQ ID NO: 667378 - RNA, 26 nt, Human
ccugaagucccagcuacucaaggcag

SEQ ID NO: 667379 - RNA, 22 nt, Human
ccugggcaacacagcgagaccc

SEQ ID NO: 667380 - RNA, 18 nt, Human
ccuuggguuucagcugcc

SEQ ID NO: 667381 - RNA, 20 nt, Human
cucaaggcacagaaaaagcc

SEQ ID NO: 667382 - RNA, 22 nt, Human
cucucugagacagaaaaacaag

SEQ ID NO: 667383 - RNA, 24 nt, Human
cugagauaaauaucaggggcgggg

SEQ ID NO: 667384 - RNA, 18 nt, Human
cuuuguauggucaaugau

SEQ ID NO: 667385 - RNA, 18 nt, Human
gaaaaagccaaacucgaa

SEQ ID NO: 667386 - RNA, 24 nt, Human
gacccugugucuacaaaaaauuaa

SEQ ID NO: 667387 - RNA, 21 nt, Human
gacgcacuuccuuucuuuccc

SEQ ID NO: 667388 - RNA, 19 nt, Human
gacuaucucucugagacag

SEQ ID NO: 667389 - RNA, 18 nt, Human
gaucacuugaggccagga

SEQ ID NO: 667390 - RNA, 24 nt, Human
gaucacuugaggccaggagguuga

SEQ ID NO: 667391 - RNA, 18 nt, Human
gaucacuugugcccagga

SEQ ID NO: 667392 - RNA, 21 nt, Human
gauuuugccacugcacuccag

SEQ ID NO: 667393 - RNA, 20 nt, Human
gcacagaaaaagccaaacuc

SEQ ID NO: 667394 - RNA, 18 nt, Human
gcacaggcuagcuccugg

SEQ ID NO: 667395 - RNA, 24 nt, Human
gcacuccagacugggugacagagc

SEQ ID NO: 667396 - RNA, 21 nt, Human
gccacugcacuccagacuggg

SEQ ID NO: 667397 - RNA, 24 nt, Human
gcccaggagcuccaggaccaaagu

SEQ ID NO: 667398 - RNA, 19 nt, Human
gccugaacucugacuaucc

SEQ ID NO: 667399 - RNA, 21 nt, Human
ggcacagaaaaagccaaacuc

SEQ ID NO: 667400 - RNA, 19 nt, Human
ggggagagcguuuauccgc

SEQ ID NO: 667401 - RNA, 23 nt, Human
gggguggggcagagaacgaauac

SEQ ID NO: 667402 - RNA, 19 nt, Human
gugaaguguaccguccaua

SEQ ID NO: 667403 - RNA, 18 nt, Human
uacacuucagaagggcac

SEQ ID NO: 667404 - RNA, 26 nt, Human
uauagcagugagcaagaugugaacaa

SEQ ID NO: 667405 - RNA, 19 nt, Human
ucaaauucuuccuccucau

SEQ ID NO: 667406 - RNA, 18 nt, Human
ucacuggaucucuugguu

SEQ ID NO: 667407 - RNA, 21 nt, Human
uccaggguaaaauccauguuc

SEQ ID NO: 667408 - RNA, 18 nt, Human
ucccaaagauuaauucac

SEQ ID NO: 667409 - RNA, 23 nt, Human
ucccgcguggggcauauaaggau

SEQ ID NO: 667410 - RNA, 24 nt, Human
ucccuaaaccaagguacuugaucu

SEQ ID NO: 667411 - RNA, 24 nt, Human
ucccuuggguuucagcugccaaac

SEQ ID NO: 667412 - RNA, 20 nt, Human
uccucagcacguacucacua

SEQ ID NO: 667413 - RNA, 26 nt, Human
ucucagagcaaacuguaaugaaggca

SEQ ID NO: 667414 - RNA, 18 nt, Human
ucucugcccucgugagcu

SEQ ID NO: 667415 - RNA, 21 nt, Human
ucuugcucugucggucacugg

SEQ ID NO: 667416 - RNA, 22 nt, Human
ucuugcucugucggucacugga

SEQ ID NO: 667417 - RNA, 21 nt, Human
ugaaggcagggaauagggccu

SEQ ID NO: 667418 - RNA, 20 nt, Human
ugacauggaaaccauugucc

SEQ ID NO: 667419 - RNA, 19 nt, Human
ugagauaaauaucaggggc

SEQ ID NO: 667420 - RNA, 23 nt, Human
ugagauagucaaauucuuccucc

SEQ ID NO: 667421 - RNA, 21 nt, Human
ugagccaugauuuugccacug

SEQ ID NO: 667422 - RNA, 25 nt, Human
ugaggaaggaacauuuaggaucagc

SEQ ID NO: 667423 - RNA, 18 nt, Human
ugaggcaagaggaucacu

SEQ ID NO: 667424 - RNA, 20 nt, Human
ugaggcaagaggaucacuug

SEQ ID NO: 667425 - RNA, 24 nt, Human
ugaggcaagaggaucacuugaggc

SEQ ID NO: 667426 - RNA, 26 nt, Human
ugaggcaagaggaucacuugaggcca

SEQ ID NO: 667427 - RNA, 21 nt, Human
ugaggccaggagguugaaacc

SEQ ID NO: 667428 - RNA, 23 nt, Human
ugaggccaggagguugaaaccag

SEQ ID NO: 667429 - RNA, 19 nt, Human
ugcagacaucucauuucca

SEQ ID NO: 667430 - RNA, 22 nt, Human
ugcagugagccaugauuuugcc

SEQ ID NO: 667431 - RNA, 18 nt, Human
ugccaaaaaaguccuucc

SEQ ID NO: 667432 - RNA, 21 nt, Human
ugccuacaacuccgugagauc

SEQ ID NO: 667433 - RNA, 24 nt, Human
ugggaggaucacuugugcccagga

SEQ ID NO: 667434 - RNA, 19 nt, Human
ugggaggcugaggcaagag

SEQ ID NO: 667435 - RNA, 24 nt, Human
ugggaggcugaggcaagaggauca

SEQ ID NO: 667436 - RNA, 21 nt, Human
ugggggcaaaaaaaaagaggg

SEQ ID NO: 667437 - RNA, 18 nt, Human
ugugaacaagaucucugc

SEQ ID NO: 667438 - RNA, 24 nt, Human
ugugaacaagaucucugcccucgu

SEQ ID NO: 667439 - RNA, 24 nt, Human
ugugcucagcaaugagaauauagc

SEQ ID NO: 667440 - RNA, 21 nt, Human
ugugugcucagcaaugagaau

SEQ ID NO: 667441 - RNA, 21 nt, Human
uuaggcauuguggcgugcacc

SEQ ID NO: 667442 - RNA, 22 nt, Human
uucaggaguugcgggguggggc

SEQ ID NO: 667443 - RNA, 18 nt, Human
uugcaggugugugaagug

SEQ ID NO: 667444 - RNA, 19 nt, Human
uugcaggugugugaaguga

SEQ ID NO: 667445 - RNA, 25 nt, Human
uugggaggcugaggcaagaggauca

SEQ ID NO: 667446 - RNA, 25 nt, Human
aacaauggggaucccaguggagaga

SEQ ID NO: 667447 - RNA, 19 nt, Human
aacugccaacuccugagca

SEQ ID NO: 667448 - RNA, 19 nt, Human
aagcuaccagccucccucc

SEQ ID NO: 667449 - RNA, 23 nt, Human
aaucacugaggcccugaccccaa

SEQ ID NO: 667450 - RNA, 21 nt, Human
agcuggcccgagcacuccugg

SEQ ID NO: 667451 - RNA, 18 nt, Human
agggaugggaaaaggacc

SEQ ID NO: 667452 - RNA, 22 nt, Human
aggggacaggagaaucacugag

SEQ ID NO: 667453 - RNA, 18 nt, Human
aguugggggaggugcgcg

SEQ ID NO: 667454 - RNA, 21 nt, Human
cagcauuaaaaaacuaggaga

SEQ ID NO: 667455 - RNA, 26 nt, Human
cagcauuaaaaaacuaggagacuuca

SEQ ID NO: 667456 - RNA, 27 nt, Human
cagcauuaaaaaacuaggagacuucac

SEQ ID NO: 667457 - RNA, 18 nt, Human
cccacagcugcccucgcc

SEQ ID NO: 667458 - RNA, 18 nt, Human
cccacugcacacugaggc

SEQ ID NO: 667459 - RNA, 19 nt, Human
cccgagcacuccuggagcc

SEQ ID NO: 667460 - RNA, 19 nt, Human
cccugaccccaaggcaacc

SEQ ID NO: 667461 - RNA, 23 nt, Human
ccugaccccaaggcaaccgagac

SEQ ID NO: 667462 - RNA, 19 nt, Human
ccugccgcggcgcagcugc

SEQ ID NO: 667463 - RNA, 20 nt, Human
cggacauccacgaacgacga

SEQ ID NO: 667464 - RNA, 21 nt, Human
cugaccccaaggcaaccgaga

SEQ ID NO: 667465 - RNA, 24 nt, Human
cuggcaaagcuaccagccucccuc

SEQ ID NO: 667466 - RNA, 18 nt, Human
gaaaugucagcauuaaaa

SEQ ID NO: 667467 - RNA, 22 nt, Human
gacaggagaaucacugaggccc

SEQ ID NO: 667468 - RNA, 21 nt, Human
gcaaagcuaccagccucccuc

SEQ ID NO: 667469 - RNA, 20 nt, Human
gggagggaugggaaaaggac

SEQ ID NO: 667470 - RNA, 23 nt, Human
ggggaucccaguggagagagggc

SEQ ID NO: 667471 - RNA, 18 nt, Human
guccuagucucgggacac

SEQ ID NO: 667472 - RNA, 22 nt, Human
uaagaaaugucagcauuaaaaa

SEQ ID NO: 667473 - RNA, 22 nt, Human
uccugagcaugagggaggggac

SEQ ID NO: 667474 - RNA, 18 nt, Human
uggcaaagcuaccagccu

SEQ ID NO: 667475 - RNA, 19 nt, Human
uggcaaagcuaccagccuc

SEQ ID NO: 667476 - RNA, 19 nt, Human
ugggaaaaggaccagcugg

SEQ ID NO: 667477 - RNA, 18 nt, Human
uggggagggaugggaaaa

SEQ ID NO: 667478 - RNA, 22 nt, Human
uggggaucccaguggagagagg

SEQ ID NO: 667479 - RNA, 18 nt, Human
uucauggggagggauggg

SEQ ID NO: 667480 - RNA, 19 nt, Human
aaagagaaugucugcccuc

SEQ ID NO: 667481 - RNA, 23 nt, Human
agcaagcagaugcuaagaugagu

SEQ ID NO: 667482 - RNA, 22 nt, Human
aggugugcuccaaagagaaugu

SEQ ID NO: 667483 - RNA, 19 nt, Human
caagcagaugcuaagauga

SEQ ID NO: 667484 - RNA, 21 nt, Human
caagcccccaccucgguucua

SEQ ID NO: 667485 - RNA, 18 nt, Human
caagucccagccugguca

SEQ ID NO: 667486 - RNA, 25 nt, Human
caauccacuggagaagugagacaau

SEQ ID NO: 667487 - RNA, 20 nt, Human
cacacucugcagcaaguccc

SEQ ID NO: 667488 - RNA, 23 nt, Human
caccaagcccccaccucgguucu

SEQ ID NO: 667489 - RNA, 22 nt, Human
cacucugcagcaagucccagcc

SEQ ID NO: 667490 - RNA, 19 nt, Human
cacuucuauccccugggug

SEQ ID NO: 667491 - RNA, 24 nt, Human
caugaaguucacuugagauugggg

SEQ ID NO: 667492 - RNA, 21 nt, Human
ccaagcccccaccucgguucu

SEQ ID NO: 667493 - RNA, 22 nt, Human
ccccugggugaagacucaauuu

SEQ ID NO: 667494 - RNA, 19 nt, Human
cccucugucuccacuggag

SEQ ID NO: 667495 - RNA, 20 nt, Human
ccugaggugugcuccaaaga

SEQ ID NO: 667496 - RNA, 21 nt, Human
ccuucaccaagcccccaccuc

SEQ ID NO: 667497 - RNA, 19 nt, Human
gagauugggguuuugccau

SEQ ID NO: 667498 - RNA, 20 nt, Human
gcgcagccugcucuuccugg

SEQ ID NO: 667499 - RNA, 24 nt, Human
uaaaauacaccaucuugauggccu

SEQ ID NO: 667500 - RNA, 25 nt, Human
uagcuuuuuuggggaaaaguguuaa

SEQ ID NO: 667501 - RNA, 23 nt, Human
uaguuccaugaaguucacuugag

SEQ ID NO: 667502 - RNA, 22 nt, Human
ucaccaagcccccaccucgguu

SEQ ID NO: 667503 - RNA, 18 nt, Human
uccacuggagaagugaga

SEQ ID NO: 667504 - RNA, 19 nt, Human
ucugcagcaagucccagcc

SEQ ID NO: 667505 - RNA, 18 nt, Human
ucugcccucugucuccac

SEQ ID NO: 667506 - RNA, 19 nt, Human
ugccacuggguuuauugaa

SEQ ID NO: 667507 - RNA, 23 nt, Human
ugcuuaaaauacaccaucuugau

SEQ ID NO: 667508 - RNA, 21 nt, Human
uuccaugaaguucacuugaga

SEQ ID NO: 667509 - RNA, 21 nt, Human
uugagauugggguuuugccau

SEQ ID NO: 667510 - RNA, 23 nt, Human
uuugcuuaaaauacaccaucuug

SEQ ID NO: 667511 - RNA, 18 nt, Human
cacagugaaauugugggu

SEQ ID NO: 667512 - RNA, 21 nt, Human
cagcugacucuucacagugaa

SEQ ID NO: 667513 - RNA, 21 nt, Human
cgagcuggacugacuggaccg

SEQ ID NO: 667514 - RNA, 20 nt, Human
cuucacagugaaauuguggg

SEQ ID NO: 667515 - RNA, 21 nt, Human
ggcaguuaugggagauguggu

SEQ ID NO: 667516 - RNA, 26 nt, Human
ggcucaggacgaugugcuggggcagg

SEQ ID NO: 667517 - RNA, 21 nt, Human
gggcggcucaggacgaugugc

SEQ ID NO: 667518 - RNA, 21 nt, Human
uaugggagaugugguuaccua

SEQ ID NO: 667519 - RNA, 21 nt, Human
ucaggacauucuggaacaagg

SEQ ID NO: 667520 - RNA, 23 nt, Human
ucaggggugguggcugcacucuu

SEQ ID NO: 667521 - RNA, 20 nt, Human
ugacuggaccgcaggcucac

SEQ ID NO: 667522 - RNA, 20 nt, Human
ugagacuccacagaaggugg

SEQ ID NO: 667523 - RNA, 20 nt, Human
ugaggcccacgggggaaaau

SEQ ID NO: 667524 - RNA, 21 nt, Human
ugcuggggcaguuaugggaga

SEQ ID NO: 667525 - RNA, 18 nt, Human
uggacugacuggaccgca

SEQ ID NO: 667526 - RNA, 18 nt, Human
uggagacagguugggcgg

SEQ ID NO: 667527 - RNA, 25 nt, Human
ugucucaggacauucuggaacaagg

SEQ ID NO: 667528 - RNA, 19 nt, Human
uguuucucccuucggccua

SEQ ID NO: 667529 - RNA, 24 nt, Human
uguuucucccuucggccuacaggg

SEQ ID NO: 667530 - RNA, 22 nt, Human
uuucucccuucggccuacaggg

SEQ ID NO: 667531 - RNA, 22 nt, Human
aagcauacuguaguuaaaaaua

SEQ ID NO: 667532 - RNA, 21 nt, Human
aauauuaaaagaccaagaaaa

SEQ ID NO: 667533 - RNA, 22 nt, Human
aaugcuaaaagcucacguagcu

SEQ ID NO: 667534 - RNA, 22 nt, Human
acaagcauacuguaguuaaaaa

SEQ ID NO: 667535 - RNA, 18 nt, Human
acacaaacucagggaaaa

SEQ ID NO: 667536 - RNA, 18 nt, Human
aggaggcuuggaucucac

SEQ ID NO: 667537 - RNA, 25 nt, Human
agggaaaaaagaaaaguuuauccag

SEQ ID NO: 667538 - RNA, 19 nt, Human
auggugcucagcuccuugg

SEQ ID NO: 667539 - RNA, 21 nt, Human
cagcuccuuggccuuuaggag

SEQ ID NO: 667540 - RNA, 30 nt, Human
caggaguuaaaagaagcauacaagcauacc

SEQ ID NO: 667541 - RNA, 18 nt, Human
cauacaagcauacuguag

SEQ ID NO: 667542 - RNA, 22 nt, Human
cauacaagcauacuguaguuaa

SEQ ID NO: 667543 - RNA, 23 nt, Human
ccaaaauagcauuaugcuucuga

SEQ ID NO: 667544 - RNA, 20 nt, Human
ccgccgcguuucccccaacc

SEQ ID NO: 667545 - RNA, 23 nt, Human
ccgccgcguuucccccaaccccc

SEQ ID NO: 667546 - RNA, 20 nt, Human
ccgcuuccgcgacgcagaag

SEQ ID NO: 667547 - RNA, 24 nt, Human
ccucccgcuguacggugccaaacc

SEQ ID NO: 667548 - RNA, 22 nt, Human
cgggacgggggcggcguccgcc

SEQ ID NO: 667549 - RNA, 23 nt, Human
cuaaugcuaaaagcucacguagc

SEQ ID NO: 667550 - RNA, 21 nt, Human
cuagauggugcucagcuccuu

SEQ ID NO: 667551 - RNA, 25 nt, Human
cugauggcugcgucggauucuuucu

SEQ ID NO: 667552 - RNA, 21 nt, Human
cuuucaagcgaucccgcucac

SEQ ID NO: 667553 - RNA, 23 nt, Human
ggguggggcccuuaaccucccgc

SEQ ID NO: 667554 - RNA, 19 nt, Human
gucauugugcuggucccaa

SEQ ID NO: 667555 - RNA, 23 nt, Human
guccccuucgggacgggggcggc

SEQ ID NO: 667556 - RNA, 20 nt, Human
gugaacuccaaaauaggcac

SEQ ID NO: 667557 - RNA, 19 nt, Human
gugcucagcuccuuggccu

SEQ ID NO: 667558 - RNA, 25 nt, Human
uagauggugcucagcuccuuggccu

SEQ ID NO: 667559 - RNA, 22 nt, Human
ucccccaaccguggcgaccugc

SEQ ID NO: 667560 - RNA, 19 nt, Human
ucuagauggugcucagcuc

SEQ ID NO: 667561 - RNA, 21 nt, Human
ucuuucuucaauguuaaugau

SEQ ID NO: 667562 - RNA, 23 nt, Human
uguuaaugauaaacccuugcaca

SEQ ID NO: 667563 - RNA, 20 nt, Human
uguuuuuuuuuuuuuuuugg

SEQ ID NO: 667564 - RNA, 24 nt, Human
uguuuuuuuuuuuuuuuuggauuu

SEQ ID NO: 667565 - RNA, 21 nt, Human
uucaaaggaagaaaauuaugu

SEQ ID NO: 667566 - RNA, 23 nt, Human
accgcguucaucaaacccgcggc

SEQ ID NO: 667567 - RNA, 25 nt, Human
cguaccagucuccccgggaaccgcg

SEQ ID NO: 667568 - RNA, 22 nt, Human
uaagcaccacauauacuauauu

SEQ ID NO: 667569 - RNA, 22 nt, Human
uuucaugauaaaugaugcuacu

SEQ ID NO: 667570 - RNA, 18 nt, Human
aaaggcacccuacccaca

SEQ ID NO: 667571 - RNA, 18 nt, Human
acagacagaagccaggcu

SEQ ID NO: 667572 - RNA, 21 nt, Human
agacagaagccaggcugcacc

SEQ ID NO: 667573 - RNA, 19 nt, Human
agccaggcugcaccugggg

SEQ ID NO: 667574 - RNA, 21 nt, Human
aggcaggccugugagagggag

SEQ ID NO: 667575 - RNA, 24 nt, Human
caaaggcacccuacccacaaugcc

SEQ ID NO: 667576 - RNA, 21 nt, Human
cacccuacccacaaugccagc

SEQ ID NO: 667577 - RNA, 18 nt, Human
cauugcaguucuucgcac

SEQ ID NO: 667578 - RNA, 24 nt, Human
cccaugauccccauuccccaggca

SEQ ID NO: 667579 - RNA, 21 nt, Human
cccuacccacaaugccagcac

SEQ ID NO: 667580 - RNA, 19 nt, Human
ccugugagagggaggcaaa

SEQ ID NO: 667581 - RNA, 21 nt, Human
cgaggucuggcucugaccagc

SEQ ID NO: 667582 - RNA, 22 nt, Human
cgcacccuagacccagcuccac

SEQ ID NO: 667583 - RNA, 23 nt, Human
cuacccacaaugccagcacccca

SEQ ID NO: 667584 - RNA, 21 nt, Human
gcacccuagacccagcuccac

SEQ ID NO: 667585 - RNA, 27 nt, Human
gcagcagccauugcaguucuucgcacc

SEQ ID NO: 667586 - RNA, 24 nt, Human
gcucugaccagcuucccuguggcu

SEQ ID NO: 667587 - RNA, 20 nt, Human
gggagaggguggugcugaga

SEQ ID NO: 667588 - RNA, 18 nt, Human
guggacucagcugcuccc

SEQ ID NO: 667589 - RNA, 21 nt, Human
uacccacaaugccagcaccca

SEQ ID NO: 667590 - RNA, 19 nt, Human
uccccaggcacgaggucug

SEQ ID NO: 667591 - RNA, 23 nt, Human
uccccaggcacgaggucuggcuc

SEQ ID NO: 667592 - RNA, 19 nt, Human
ucccuguggcugauaggag

SEQ ID NO: 667593 - RNA, 20 nt, Human
ugagauacagacagaagccg

SEQ ID NO: 667594 - RNA, 19 nt, Human
ugcaguucuucgcacccua

SEQ ID NO: 667595 - RNA, 24 nt, Human
aaaaaacuuauuccucccugcuga

SEQ ID NO: 667596 - RNA, 20 nt, Human
aaaaggcccggccucugcgc

SEQ ID NO: 667597 - RNA, 18 nt, Human
agacggaagccugaaaac

SEQ ID NO: 667598 - RNA, 24 nt, Human
caccugaaucugaaaccagugauu

SEQ ID NO: 667599 - RNA, 19 nt, Human
cagcaaagaccgccgggca

SEQ ID NO: 667600 - RNA, 24 nt, Human
ccacucucugaagguuugggagac

SEQ ID NO: 667601 - RNA, 21 nt, Human
ccgccgggcacccgccgccuc

SEQ ID NO: 667602 - RNA, 18 nt, Human
ccucagacuccagcaccu

SEQ ID NO: 667603 - RNA, 24 nt, Human
ccucccugcugagacugugggaag

SEQ ID NO: 667604 - RNA, 20 nt, Human
ccugaaaacuccucagacuc

SEQ ID NO: 667605 - RNA, 21 nt, Human
ccugaaucugaaaccagugau

SEQ ID NO: 667606 - RNA, 23 nt, Human
ccuguaaagccuguuucaauugc

SEQ ID NO: 667607 - RNA, 20 nt, Human
cgccgggcacccgccgccgg

SEQ ID NO: 667608 - RNA, 20 nt, Human
cuccagcaccucccuuuuac

SEQ ID NO: 667609 - RNA, 21 nt, Human
cuccucagacuccagcaccuc

SEQ ID NO: 667610 - RNA, 24 nt, Human
cuccuuacuucgcucccauccacu

SEQ ID NO: 667611 - RNA, 22 nt, Human
cugaaaccagugauuuucuugu

SEQ ID NO: 667612 - RNA, 19 nt, Human
gcaaagaccgccgggcacc

SEQ ID NO: 667613 - RNA, 24 nt, Human
gcggcagcaaagaccgccgggcac

SEQ ID NO: 667614 - RNA, 18 nt, Human
ggagacuuuuccaaagua

SEQ ID NO: 667615 - RNA, 18 nt, Human
ggcagcaaagaccgccgg

SEQ ID NO: 667616 - RNA, 20 nt, Human
gggaagucgggugacugggc

SEQ ID NO: 667617 - RNA, 23 nt, Human
gggaagucgggugacugggcggu

SEQ ID NO: 667618 - RNA, 19 nt, Human
uaccauguaucugcucagg

SEQ ID NO: 667619 - RNA, 21 nt, Human
ucagaaacucuauuagcaucu

SEQ ID NO: 667620 - RNA, 21 nt, Human
ucagcaucuaacaaaacuuga

SEQ ID NO: 667621 - RNA, 22 nt, Human
uccaaauuacagaugaaaaaaa

SEQ ID NO: 667622 - RNA, 18 nt, Human
ucccugcugagacugugg

SEQ ID NO: 667623 - RNA, 21 nt, Human
ucccugcugagacugugggaa

SEQ ID NO: 667624 - RNA, 21 nt, Human
uccgagccugccagacuuccu

SEQ ID NO: 667625 - RNA, 26 nt, Human
ucugaaaccagugauuuucuuguuuc

SEQ ID NO: 667626 - RNA, 18 nt, Human
ucuguggauauucuugga

SEQ ID NO: 667627 - RNA, 24 nt, Human
ugaaagaaaaggcccggccucugc

SEQ ID NO: 667628 - RNA, 24 nt, Human
ugacugggcgguuuggccuugcug

SEQ ID NO: 667629 - RNA, 18 nt, Human
ugcaucuguuuguauuca

SEQ ID NO: 667630 - RNA, 30 nt, Human
ugccagacuuccuucgagacggaagccugg

SEQ ID NO: 667631 - RNA, 20 nt, Human
ugcuuagcuuuuucagcuuc

SEQ ID NO: 667632 - RNA, 23 nt, Human
uuccuguaaagccuguuucaauu

SEQ ID NO: 667633 - RNA, 21 nt, Human
uucgagacggaagccugaaaa

SEQ ID NO: 667634 - RNA, 24 nt, Human
uucucaauuuccagacgugcuacu

SEQ ID NO: 667635 - RNA, 20 nt, Human
uucuucacuguuuucacagc

SEQ ID NO: 667636 - RNA, 18 nt, Human
uugcauuguugucucagu

SEQ ID NO: 667637 - RNA, 18 nt, Human
uugcauuguugucucagu

SEQ ID NO: 667638 - RNA, 22 nt, Human
uugucuuuuuucuucacuguuu

SEQ ID NO: 667639 - RNA, 18 nt, Human
uugugcugaaagaaaagg

SEQ ID NO: 667640 - RNA, 20 nt, Human
uuuccagcaccaacuucucc

SEQ ID NO: 667641 - RNA, 22 nt, Human
uuucuucacuguuuucacagcu

SEQ ID NO: 667642 - RNA, 24 nt, Human
uuucuuguuucuuucuccaauggu

SEQ ID NO: 667643 - RNA, 21 nt, Human
agagaagccagcccuccugga

SEQ ID NO: 667644 - RNA, 21 nt, Human
aggaaaguagcugggcagggg

SEQ ID NO: 667645 - RNA, 22 nt, Human
aggucggggagaggcugcagga

SEQ ID NO: 667646 - RNA, 27 nt, Human
cagggggccuuuccucugcagaggcuc

SEQ ID NO: 667647 - RNA, 23 nt, Human
ccccugggggauggagugggggu

SEQ ID NO: 667648 - RNA, 18 nt, Human
cccuaggauugacaaacc

SEQ ID NO: 667649 - RNA, 21 nt, Human
cugcagaggcucugaggucgg

SEQ ID NO: 667650 - RNA, 24 nt, Human
cugggggauggaguggggguacag

SEQ ID NO: 667651 - RNA, 21 nt, Human
gaagcagagcucugcagagaa

SEQ ID NO: 667652 - RNA, 18 nt, Human
gagcucugcagagaagcc

SEQ ID NO: 667653 - RNA, 24 nt, Human
gcaggaagcagagcucugcagaga

SEQ ID NO: 667654 - RNA, 20 nt, Human
ggcagggccccagggggccu

SEQ ID NO: 667655 - RNA, 20 nt, Human
ggcagggguguuccccuggg

SEQ ID NO: 667656 - RNA, 18 nt, Human
gggagaggcugcaggaag

SEQ ID NO: 667657 - RNA, 20 nt, Human
gggagaggcugcaggaagca

SEQ ID NO: 667658 - RNA, 19 nt, Human
uagccuggcuccugucccc

SEQ ID NO: 667659 - RNA, 24 nt, Human
uccccugggggauggagugggggu

SEQ ID NO: 667660 - RNA, 18 nt, Human
ucugaggucggggagagg

SEQ ID NO: 667661 - RNA, 24 nt, Human
ugggcagggguguuccccuggggg

SEQ ID NO: 667662 - RNA, 18 nt, Human
ugggggauggaguggggg

SEQ ID NO: 667663 - RNA, 19 nt, Human
aacucguccccuccccagc

SEQ ID NO: 667664 - RNA, 20 nt, Human
accccgaggccucugccaac

SEQ ID NO: 667665 - RNA, 18 nt, Human
accucgcggcccuggccc

SEQ ID NO: 667666 - RNA, 20 nt, Human
accucgcggcccuggcccug

SEQ ID NO: 667667 - RNA, 22 nt, Human
accucgcggcccuggcccugac

SEQ ID NO: 667668 - RNA, 20 nt, Human
agcaagaagggagggucugg

SEQ ID NO: 667669 - RNA, 23 nt, Human
agcugugggaccagaggacuguu

SEQ ID NO: 667670 - RNA, 23 nt, Human
agugccaguguggggaggugggu

SEQ ID NO: 667671 - RNA, 21 nt, Human
caaguauaauaaacucagcug

SEQ ID NO: 667672 - RNA, 26 nt, Human
ccaacuaccucgcggcccuggcccug

SEQ ID NO: 667673 - RNA, 18 nt, Human
ccccuuccaggaggaccc

SEQ ID NO: 667674 - RNA, 23 nt, Human
cgcggcccuggcccugacguugc

SEQ ID NO: 667675 - RNA, 22 nt, Human
cugugggaccagaggacuguug

SEQ ID NO: 667676 - RNA, 22 nt, Human
uaaaagaaaacaaguauaauaa

SEQ ID NO: 667677 - RNA, 26 nt, Human
uccaggaggaccccgaggccucugcc

SEQ ID NO: 667678 - RNA, 22 nt, Human
uccccuccccagcaagaaggga

SEQ ID NO: 667679 - RNA, 27 nt, Human
ugccaacuaccucgcggcccuggcccu

SEQ ID NO: 667680 - RNA, 18 nt, Human
uggaaggaggcagcuggc

SEQ ID NO: 667681 - RNA, 23 nt, Human
ugggaccagaggacuguugcuaa

SEQ ID NO: 667682 - RNA, 24 nt, Human
uggguagaacucguccccucccca

SEQ ID NO: 667683 - RNA, 25 nt, Human
uggguagaacucguccccuccccag

SEQ ID NO: 667684 - RNA, 24 nt, Human
aagagaaggauguggccacagaca

SEQ ID NO: 667685 - RNA, 21 nt, Human
acacagaucaaacauagacca

SEQ ID NO: 667686 - RNA, 23 nt, Human
acacuguacuaugcaacugggag

SEQ ID NO: 667687 - RNA, 23 nt, Human
acagacaauaucauaauaguagc

SEQ ID NO: 667688 - RNA, 21 nt, Human
agaacugcucugacuccgccc

SEQ ID NO: 667689 - RNA, 22 nt, Human
agccauuuguucagcaaguuuu

SEQ ID NO: 667690 - RNA, 22 nt, Human
aggaagucagggagguuggggu

SEQ ID NO: 667691 - RNA, 22 nt, Human
aggcuuccaggaagaggugauc

SEQ ID NO: 667692 - RNA, 22 nt, Human
agucagggagguuggggucugg

SEQ ID NO: 667693 - RNA, 22 nt, Human
aguggaccuccccacacaguuc

SEQ ID NO: 667694 - RNA, 18 nt, Human
aguguccgaguuguaggg

SEQ ID NO: 667695 - RNA, 23 nt, Human
aguuacugaaggaagucaggggg

SEQ ID NO: 667696 - RNA, 22 nt, Human
auucucauuuuaaagaugaaga

SEQ ID NO: 667697 - RNA, 23 nt, Human
caaacuaaucaagaacaaugcua

SEQ ID NO: 667698 - RNA, 24 nt, Human
caaauacuuucacaauuagcuaca

SEQ ID NO: 667699 - RNA, 18 nt, Human
cacucauccagccauuug

SEQ ID NO: 667700 - RNA, 30 nt, Human
cacugagcuccuugcuguuccuaagaccuu

SEQ ID NO: 667701 - RNA, 23 nt, Human
cacuguacuaugcaacugggaga

SEQ ID NO: 667702 - RNA, 21 nt, Human
cagcaacaacgauuucucaag

SEQ ID NO: 667703 - RNA, 19 nt, Human
cagcuuaggacagaucccc

SEQ ID NO: 667704 - RNA, 19 nt, Human
ccacacaguucuggucccc

SEQ ID NO: 667705 - RNA, 23 nt, Human
ccccuggcugcuguacucagcuu

SEQ ID NO: 667706 - RNA, 22 nt, Human
ccucaagaacugcucugacucc

SEQ ID NO: 667707 - RNA, 19 nt, Human
cucaggucucccccgccuc

SEQ ID NO: 667708 - RNA, 25 nt, Human
cuccagccacacugagcuccuugcu

SEQ ID NO: 667709 - RNA, 20 nt, Human
cucuuccucuugcccugagg

SEQ ID NO: 667710 - RNA, 19 nt, Human
cugacauuuuagggagaag

SEQ ID NO: 667711 - RNA, 19 nt, Human
cugcaugcaacuuuguucu

SEQ ID NO: 667712 - RNA, 20 nt, Human
cugcuguacucagcuuagga

SEQ ID NO: 667713 - RNA, 19 nt, Human
cuggcuugcuccauuccug

SEQ ID NO: 667714 - RNA, 19 nt, Human
gaagaaacugaagcacaga

SEQ ID NO: 667715 - RNA, 22 nt, Human
gaaggauguggccacagacaaa

SEQ ID NO: 667716 - RNA, 19 nt, Human
gacagauccccacuaggcc

SEQ ID NO: 667717 - RNA, 18 nt, Human
gagaacucccugucuagu

SEQ ID NO: 667718 - RNA, 19 nt, Human
gcugcuguacucagcuuag

SEQ ID NO: 667719 - RNA, 18 nt, Human
gcuugcuccauuccuguu

SEQ ID NO: 667720 - RNA, 19 nt, Human
gguccccuggcugcuguac

SEQ ID NO: 667721 - RNA, 22 nt, Human
gucagacacuguacuaugcaac

SEQ ID NO: 667722 - RNA, 21 nt, Human
guucugcugcuucugagcugu

SEQ ID NO: 667723 - RNA, 19 nt, Human
uaaacaaauacuuucacaa

SEQ ID NO: 667724 - RNA, 23 nt, Human
uccagcagaacagagugcuguaa

SEQ ID NO: 667725 - RNA, 22 nt, Human
ucucccccgccuccuugaaccu

SEQ ID NO: 667726 - RNA, 22 nt, Human
ugaagaaacugaagcacagaag

SEQ ID NO: 667727 - RNA, 21 nt, Human
ugaagggugaacagugcaagu

SEQ ID NO: 667728 - RNA, 22 nt, Human
ugagcucaggucucccccgccu

SEQ ID NO: 667729 - RNA, 23 nt, Human
ugcacaaccuaacauuucagcac

SEQ ID NO: 667730 - RNA, 18 nt, Human
ugccaaacuaaucaagaa

SEQ ID NO: 667731 - RNA, 22 nt, Human
ugccaaacuaaucaagaacaau

SEQ ID NO: 667732 - RNA, 20 nt, Human
ugcccaaaccagcuaguaag

SEQ ID NO: 667733 - RNA, 21 nt, Human
ugcugugacuucugucucagc

SEQ ID NO: 667734 - RNA, 21 nt, Human
uggaaggaacuaggugcagca

SEQ ID NO: 667735 - RNA, 23 nt, Human
uggaccugggucccaaugucagu

SEQ ID NO: 667736 - RNA, 21 nt, Human
uggcaagagcaauggcaggga

SEQ ID NO: 667737 - RNA, 19 nt, Human
uggggacacagaucaaaca

SEQ ID NO: 667738 - RNA, 21 nt, Human
uguacuggcuugcuccauucc

SEQ ID NO: 667739 - RNA, 26 nt, Human
uguuucacucauccagccauuuguuc

SEQ ID NO: 667740 - RNA, 28 nt, Human
uuacggcggcaguuucugaacucuuccu

SEQ ID NO: 667741 - RNA, 22 nt, Human
uuagcuacaacuacaauaagug

SEQ ID NO: 667742 - RNA, 20 nt, Human
uucagcaaguuuuguguuug

SEQ ID NO: 667743 - RNA, 22 nt, Human
uuccaggcugagggcauggcau

SEQ ID NO: 667744 - RNA, 21 nt, Human
uuucucaguaaggaaucccga

SEQ ID NO: 667745 - RNA, 21 nt, Human
aagagauucucugaggccuuc

SEQ ID NO: 667746 - RNA, 18 nt, Human
acagcuggggacucgggg

SEQ ID NO: 667747 - RNA, 21 nt, Human
acugugcuccagccaugccag

SEQ ID NO: 667748 - RNA, 20 nt, Human
agaagcacaaacagcuggcg

SEQ ID NO: 667749 - RNA, 27 nt, Human
agacaccagagguauguagucgaagcu

SEQ ID NO: 667750 - RNA, 23 nt, Human
agcacaaacagcuggcgggcagc

SEQ ID NO: 667751 - RNA, 19 nt, Human
agccaccaacucccacuca

SEQ ID NO: 667752 - RNA, 18 nt, Human
aggaggccgaacugugcu

SEQ ID NO: 667753 - RNA, 19 nt, Human
aggcuccggaggccagcuu

SEQ ID NO: 667754 - RNA, 19 nt, Human
cagaagcaccgugcuucuc

SEQ ID NO: 667755 - RNA, 19 nt, Human
cagcggccuugagugugcc

SEQ ID NO: 667756 - RNA, 21 nt, Human
caggcccagcuugcccuuggc

SEQ ID NO: 667757 - RNA, 19 nt, Human
cagugccgcagaagcacaa

SEQ ID NO: 667758 - RNA, 18 nt, Human
caugucagcaauuuccug

SEQ ID NO: 667759 - RNA, 18 nt, Human
ccacucagugaaguagga

SEQ ID NO: 667760 - RNA, 21 nt, Human
ccacuugagcuucuccauggg

SEQ ID NO: 667761 - RNA, 21 nt, Human
cccacagcuucccagugugcu

SEQ ID NO: 667762 - RNA, 20 nt, Human
cccucggcuccaggcccagc

SEQ ID NO: 667763 - RNA, 23 nt, Human
cggcuccaggcccagcuugcccu

SEQ ID NO: 667764 - RNA, 23 nt, Human
cguugagcaggaaggcuccggag

SEQ ID NO: 667765 - RNA, 26 nt, Human
cuucccagugugcuccaccacugccc

SEQ ID NO: 667766 - RNA, 19 nt, Human
cuugagcuucuccaugggg

SEQ ID NO: 667767 - RNA, 22 nt, Human
cuuggcagccaccaacucccac

SEQ ID NO: 667768 - RNA, 25 nt, Human
gaagcaccgugcuucucgcggccga

SEQ ID NO: 667769 - RNA, 18 nt, Human
gagacaccagagguaugu

SEQ ID NO: 667770 - RNA, 23 nt, Human
gagauucucugaggccuucaugg

SEQ ID NO: 667771 - RNA, 22 nt, Human
gccagccccaccaccguggccc

SEQ ID NO: 667772 - RNA, 18 nt, Human
gcuccaccacugcccucg

SEQ ID NO: 667773 - RNA, 20 nt, Human
gcuccaggcccagcuugccc

SEQ ID NO: 667774 - RNA, 19 nt, Human
ggaggccgaacugugcucc

SEQ ID NO: 667775 - RNA, 27 nt, Human
gggcagcggccuugagugugcccugcg

SEQ ID NO: 667776 - RNA, 19 nt, Human
guaccggcgccucuuguca

SEQ ID NO: 667777 - RNA, 20 nt, Human
gugcguggccucacagaagg

SEQ ID NO: 667778 - RNA, 19 nt, Human
guggcccacagcuucccag

SEQ ID NO: 667779 - RNA, 19 nt, Human
uagccaggcugcgcugggg

SEQ ID NO: 667780 - RNA, 21 nt, Human
uagccaggcugcgcuggggac

SEQ ID NO: 667781 - RNA, 22 nt, Human
ucagcaauuuccugaagacugg

SEQ ID NO: 667782 - RNA, 19 nt, Human
uccaaagagauucucugag

SEQ ID NO: 667783 - RNA, 18 nt, Human
ucgauggcaggugaaggg

SEQ ID NO: 667784 - RNA, 24 nt, Human
ugagcaggaaggcuccggaggcca

SEQ ID NO: 667785 - RNA, 24 nt, Human
ugcccucggcuccaggcccagcuu

SEQ ID NO: 667786 - RNA, 19 nt, Human
ugccgcagaagcacaaaca

SEQ ID NO: 667787 - RNA, 24 nt, Human
ugccgcagaagcacaaacagcugg

SEQ ID NO: 667788 - RNA, 23 nt, Human
ugcuccagccaugccagccccac

SEQ ID NO: 667789 - RNA, 20 nt, Human
uggcgggcagcggccuugag

SEQ ID NO: 667790 - RNA, 23 nt, Human
ugggauuggagaugugcaaagaa

SEQ ID NO: 667791 - RNA, 23 nt, Human
uguagccaggcugcgcuggggac

SEQ ID NO: 667792 - RNA, 23 nt, Human
uguugagauuuagccaggaucca

SEQ ID NO: 667793 - RNA, 22 nt, Human
aaaaaacuaaaagacaccagcc

SEQ ID NO: 667794 - RNA, 24 nt, Human
aaagacaccagccaaagaaucaca

SEQ ID NO: 667795 - RNA, 25 nt, Human
aaagacaccagccaaagaaucacaa

SEQ ID NO: 667796 - RNA, 22 nt, Human
aagaaucacaagagaaacuggc

SEQ ID NO: 667797 - RNA, 21 nt, Human
agaaacagcuggacccauggc

SEQ ID NO: 667798 - RNA, 24 nt, Human
caagagaaacuggcugauagaauu

SEQ ID NO: 667799 - RNA, 23 nt, Human
caucagcagagcagguuuuccaa

SEQ ID NO: 667800 - RNA, 18 nt, Human
gcuggacccauggccagg

SEQ ID NO: 667801 - RNA, 23 nt, Human
guagaacauucuuccguggguaa

SEQ ID NO: 667802 - RNA, 21 nt, Human
uaaaaaacuaaaagacaccaa

SEQ ID NO: 667803 - RNA, 18 nt, Human
cuggugaggcaggucucu

SEQ ID NO: 667804 - RNA, 21 nt, Human
ugcagcuuccagcucuggguc

SEQ ID NO: 667805 - RNA, 23 nt, Human
ugucuuucagcacaacggcagca

SEQ ID NO: 667806 - RNA, 22 nt, Human
uugcagcuuccagcucuggguc

SEQ ID NO: 667807 - RNA, 23 nt, Human
acccccaaacccccaggccacac

SEQ ID NO: 667808 - RNA, 19 nt, Human
accgcccugcccaggcccc

SEQ ID NO: 667809 - RNA, 18 nt, Human
agacaccgcccugcccag

SEQ ID NO: 667810 - RNA, 23 nt, Human
agacagaggcagcagggccaagg

SEQ ID NO: 667811 - RNA, 22 nt, Human
aggagcaguucagguugggagg

SEQ ID NO: 667812 - RNA, 21 nt, Human
aggcacgcaccgcaccgcaga

SEQ ID NO: 667813 - RNA, 21 nt, Human
aggcagcagggccaagggcga

SEQ ID NO: 667814 - RNA, 24 nt, Human
aucuuucuguaagaauaauuugug

SEQ ID NO: 667815 - RNA, 23 nt, Human
caccgcaccgcagacggggaaug

SEQ ID NO: 667816 - RNA, 20 nt, Human
cagcccagcuagcgcagccc

SEQ ID NO: 667817 - RNA, 20 nt, Human
cagcggggugcagcccccuu

SEQ ID NO: 667818 - RNA, 18 nt, Human
cagggccaagggcgagcg

SEQ ID NO: 667819 - RNA, 22 nt, Human
caugggccagacuccaaagccc

SEQ ID NO: 667820 - RNA, 22 nt, Human
ccagcccagcuagcgcagcccc

SEQ ID NO: 667821 - RNA, 22 nt, Human
ccagcggggugcagcccccuuu

SEQ ID NO: 667822 - RNA, 22 nt, Human
ccaggccccuguaccacuggcu

SEQ ID NO: 667823 - RNA, 24 nt, Human
cccaggccacacugucagucugcc

SEQ ID NO: 667824 - RNA, 24 nt, Human
ccccaggccacacugucagucugc

SEQ ID NO: 667825 - RNA, 19 nt, Human
cccccaaacccccaggcca

SEQ ID NO: 667826 - RNA, 18 nt, Human
cccccaggccacacuguc

SEQ ID NO: 667827 - RNA, 23 nt, Human
cccccaggccacacugucagucu

SEQ ID NO: 667828 - RNA, 24 nt, Human
cccccaggccacacugucagucug

SEQ ID NO: 667829 - RNA, 23 nt, Human
cccccagugaugggcagggguug

SEQ ID NO: 667830 - RNA, 18 nt, Human
cccccuuuccugcugucc

SEQ ID NO: 667831 - RNA, 21 nt, Human
ccccugcuucccuggcacccc

SEQ ID NO: 667832 - RNA, 26 nt, Human
ccccuguaccacuggcucugccgccc

SEQ ID NO: 667833 - RNA, 21 nt, Human
cccuguaccacuggcucugcc

SEQ ID NO: 667834 - RNA, 18 nt, Human
ccgcccaggccucccgcc

SEQ ID NO: 667835 - RNA, 20 nt, Human
ccgcccaggccucccgccug

SEQ ID NO: 667836 - RNA, 18 nt, Human
ccgcccugcccaggcccc

SEQ ID NO: 667837 - RNA, 19 nt, Human
ccuccccagaaacccuccu

SEQ ID NO: 667838 - RNA, 23 nt, Human
ccuggcacccccaaacccccagg

SEQ ID NO: 667839 - RNA, 24 nt, Human
cggggugcagcccccuuuccugcu

SEQ ID NO: 667840 - RNA, 22 nt, Human
cuccuggcuugggaugaggggc

SEQ ID NO: 667841 - RNA, 21 nt, Human
cucugccgcccaggccucccg

SEQ ID NO: 667842 - RNA, 20 nt, Human
gaggggccccaggccccacc

SEQ ID NO: 667843 - RNA, 23 nt, Human
gcaccccuccccagaaacccucc

SEQ ID NO: 667844 - RNA, 21 nt, Human
gccacacugucagucugccag

SEQ ID NO: 667845 - RNA, 19 nt, Human
gcccaggccccuguaccac

SEQ ID NO: 667846 - RNA, 19 nt, Human
gcccccuuuccugcugucc

SEQ ID NO: 667847 - RNA, 19 nt, Human
gggaaugagaauuucugga

SEQ ID NO: 667848 - RNA, 24 nt, Human
ggggugcagcccccuuuccugcug

SEQ ID NO: 667849 - RNA, 19 nt, Human
uaggagaggugugcaggca

SEQ ID NO: 667850 - RNA, 22 nt, Human
uccccagaaacccuccuggcuu

SEQ ID NO: 667851 - RNA, 22 nt, Human
ucccuggcacccccaaaccccc

SEQ ID NO: 667852 - RNA, 27 nt, Human
ucugccaggggcugcaccccuccccaa

SEQ ID NO: 667853 - RNA, 24 nt, Human
ucuggauaacuaucuuucuguaag

SEQ ID NO: 667854 - RNA, 22 nt, Human
ugcugccagacaccgcccugcc

SEQ ID NO: 667855 - RNA, 24 nt, Human
uggauaacuaucuuucuguaagaa

SEQ ID NO: 667856 - RNA, 20 nt, Human
uggcacccccaaacccccag

SEQ ID NO: 667857 - RNA, 21 nt, Human
ugggccagacuccaaagcccu

SEQ ID NO: 667858 - RNA, 19 nt, Human
ugggggaaagagaaccgca

SEQ ID NO: 667859 - RNA, 26 nt, Human
uguaagaauaauuuguggguucagga

SEQ ID NO: 667860 - RNA, 23 nt, Human
ugucagucugccaggggcugcac

SEQ ID NO: 667861 - RNA, 22 nt, Human
uucuguaagaauaauuuguggg

SEQ ID NO: 667862 - RNA, 21 nt, Human
accaguacuguccaauagaac

SEQ ID NO: 667863 - RNA, 20 nt, Human
agaaugaguuguggaaucug

SEQ ID NO: 667864 - RNA, 18 nt, Human
agacagagucuuguuaug

SEQ ID NO: 667865 - RNA, 26 nt, Human
auguugcccuggaugguuggucaacc

SEQ ID NO: 667866 - RNA, 18 nt, Human
cagagucuuguuauguug

SEQ ID NO: 667867 - RNA, 18 nt, Human
ccaacaucugaauaaacc

SEQ ID NO: 667868 - RNA, 18 nt, Human
ccuggccuugagugaucc

SEQ ID NO: 667869 - RNA, 21 nt, Human
cuuuggcuuuggguuuccauu

SEQ ID NO: 667870 - RNA, 19 nt, Human
gcaauuggcuacaucauac

SEQ ID NO: 667871 - RNA, 18 nt, Human
ggcgugacucuccuuugc

SEQ ID NO: 667872 - RNA, 22 nt, Human
uagagacagagucuuguuaugu

SEQ ID NO: 667873 - RNA, 24 nt, Human
uauagagacagagucuuguuaugu

SEQ ID NO: 667874 - RNA, 26 nt, Human
uauguuacuguugcuaggucauugug

SEQ ID NO: 667875 - RNA, 21 nt, Human
ucauacagccuagguguguug

SEQ ID NO: 667876 - RNA, 19 nt, Human
ucucuauaccaguacuguc

SEQ ID NO: 667877 - RNA, 23 nt, Human
ugcccuggauggucuugcacucc

SEQ ID NO: 667878 - RNA, 24 nt, Human
uguuauguugcccuggauggucuu

SEQ ID NO: 667879 - RNA, 19 nt, Human
uguugcccuggauggucuu

SEQ ID NO: 667880 - RNA, 19 nt, Human
uguugggauuggauguaga

SEQ ID NO: 667881 - RNA, 23 nt, Human
uuauagagacagagucuuguuau

SEQ ID NO: 667882 - RNA, 24 nt, Human
uuauagagacagagucuuguuaug

SEQ ID NO: 667883 - RNA, 22 nt, Human
uucugggugaaauaaagcccuc

SEQ ID NO: 667884 - RNA, 23 nt, Human
uuucugggugaaauaaagcccuc

SEQ ID NO: 667885 - RNA, 23 nt, Human
uuuggcuuuggguuuccauuuug

SEQ ID NO: 667886 - RNA, 19 nt, Human
aacacggagaaaccccguc

SEQ ID NO: 667887 - RNA, 20 nt, Human
aacacggagaaaccccgucu

SEQ ID NO: 667888 - RNA, 21 nt, Human
aacacggagaaaccccgucuc

SEQ ID NO: 667889 - RNA, 20 nt, Human
aacuuagcuccauucuguga

SEQ ID NO: 667890 - RNA, 24 nt, Human
aagucagcuucuggcuugagcugg

SEQ ID NO: 667891 - RNA, 24 nt, Human
aaucacuugaacccgggaggcaga

SEQ ID NO: 667892 - RNA, 20 nt, Human
acaagagcgaaacucugucu

SEQ ID NO: 667893 - RNA, 21 nt, Human
acaagagcgaaacucugucuc

SEQ ID NO: 667894 - RNA, 23 nt, Human
acaccaggcccauagugaccgac

SEQ ID NO: 667895 - RNA, 27 nt, Human
acaggaagaaacggugguggcagaggg

SEQ ID NO: 667896 - RNA, 25 nt, Human
acccccaacaaaaagggcuaaaaac

SEQ ID NO: 667897 - RNA, 24 nt, Human
accccgucucuacuaaaaauacaa

SEQ ID NO: 667898 - RNA, 21 nt, Human
acccugggguugaacagggcc

SEQ ID NO: 667899 - RNA, 24 nt, Human
acuuugggaggcugaggugggcag

SEQ ID NO: 667900 - RNA, 19 nt, Human
agacaggagcuggcugggg

SEQ ID NO: 667901 - RNA, 25 nt, Human
agaccagagcaagggaaacaaggaa

SEQ ID NO: 667902 - RNA, 19 nt, Human
agagagggguccugccccc

SEQ ID NO: 667903 - RNA, 22 nt, Human
agagcgaaacucugucucaaaa

SEQ ID NO: 667904 - RNA, 22 nt, Human
agagguugcagugagcugagau

SEQ ID NO: 667905 - RNA, 24 nt, Human
agagguugcagugagcugagaucg

SEQ ID NO: 667906 - RNA, 22 nt, Human
agauugccugaggucagggguu

SEQ ID NO: 667907 - RNA, 24 nt, Human
agcacuuugggaggcugagguggg

SEQ ID NO: 667908 - RNA, 18 nt, Human
agccugaccaacacggag

SEQ ID NO: 667909 - RNA, 22 nt, Human
agcugggcgugguggugcaugc

SEQ ID NO: 667910 - RNA, 23 nt, Human
agcugggcgugguggugcaugcc

SEQ ID NO: 667911 - RNA, 24 nt, Human
agcugguguuucuaggcagggccu

SEQ ID NO: 667912 - RNA, 23 nt, Human
aggaagaaacggugguggcagag

SEQ ID NO: 667913 - RNA, 19 nt, Human
aggagcaugccucugcccc

SEQ ID NO: 667914 - RNA, 20 nt, Human
aggcagagguugcagugagc

SEQ ID NO: 667915 - RNA, 24 nt, Human
aggcagagguugcagugagcugag

SEQ ID NO: 667916 - RNA, 18 nt, Human
aggcaggagaaucacuug

SEQ ID NO: 667917 - RNA, 24 nt, Human
aggcaggagaaucacuugaacccg

SEQ ID NO: 667918 - RNA, 21 nt, Human
aggcagggccugucccaugca

SEQ ID NO: 667919 - RNA, 24 nt, Human
aggcugaggcaggagaaucacuug

SEQ ID NO: 667920 - RNA, 20 nt, Human
aggcugaggugggcagauug

SEQ ID NO: 667921 - RNA, 21 nt, Human
aggcugaggugggcagauugc

SEQ ID NO: 667922 - RNA, 19 nt, Human
agggaaacaaggaacucga

SEQ ID NO: 667923 - RNA, 24 nt, Human
agggcuaaaaacuaguggugagcc

SEQ ID NO: 667924 - RNA, 20 nt, Human
agggguuugagaccagccug

SEQ ID NO: 667925 - RNA, 22 nt, Human
aggugggcagauugccugaggu

SEQ ID NO: 667926 - RNA, 23 nt, Human
aguauauauuuacaugcacauuu

SEQ ID NO: 667927 - RNA, 24 nt, Human
aguggcucacgccuguaaucccag

SEQ ID NO: 667928 - RNA, 24 nt, Human
aucauuguacuccagccuggguga

SEQ ID NO: 667929 - RNA, 24 nt, Human
aucgcaucauuguacuccagccug

SEQ ID NO: 667930 - RNA, 20 nt, Human
aucugggugggacaguguug

SEQ ID NO: 667931 - RNA, 24 nt, Human
auugccugaggucagggguuugag

SEQ ID NO: 667932 - RNA, 21 nt, Human
auuguacuccagccuggguga

SEQ ID NO: 667933 - RNA, 25 nt, Human
auuguacuccagccugggugacaag

SEQ ID NO: 667934 - RNA, 25 nt, Human
caaaaagggcuaaaaacuaguggug

SEQ ID NO: 667935 - RNA, 21 nt, Human
caaaauaagcugggcguggug

SEQ ID NO: 667936 - RNA, 19 nt, Human
caacaaaaagggcuaaaaa

SEQ ID NO: 667937 - RNA, 24 nt, Human
caacacggagaaaccccgucucua

SEQ ID NO: 667938 - RNA, 22 nt, Human
caacauccacgaaggaggcaac

SEQ ID NO: 667939 - RNA, 20 nt, Human
cacacccugugcccucaccc

SEQ ID NO: 667940 - RNA, 18 nt, Human
caccccacccccaacaaa

SEQ ID NO: 667941 - RNA, 24 nt, Human
cacccccaacaaaaagggcuaaaa

SEQ ID NO: 667942 - RNA, 24 nt, Human
cacgccuguaaucccagcacuuug

SEQ ID NO: 667943 - RNA, 24 nt, Human
cagauugccugaggucagggguuu

SEQ ID NO: 667944 - RNA, 21 nt, Human
cagcacuuugggaggcugagg

SEQ ID NO: 667945 - RNA, 24 nt, Human
cagcacuuugggaggcugaggugg

SEQ ID NO: 667946 - RNA, 21 nt, Human
cagcauggagggucaggacag

SEQ ID NO: 667947 - RNA, 24 nt, Human
cagcuacucgggaggcugaggcag

SEQ ID NO: 667948 - RNA, 18 nt, Human
cagcuucuggcuugagcu

SEQ ID NO: 667949 - RNA, 21 nt, Human
caggagaccaagaucucagag

SEQ ID NO: 667950 - RNA, 23 nt, Human
caguguugagaacuggggacccu

SEQ ID NO: 667951 - RNA, 19 nt, Human
cauuguacuccagccuggg

SEQ ID NO: 667952 - RNA, 19 nt, Human
cauuguacuccagccuggg

SEQ ID NO: 667953 - RNA, 19 nt, Human
cauuguacuccagccuggg

SEQ ID NO: 667954 - RNA, 20 nt, Human
cauuguacuccagccugggu

SEQ ID NO: 667955 - RNA, 21 nt, Human
cauuguacuccagccugggug

SEQ ID NO: 667956 - RNA, 22 nt, Human
cauuguacuccagccuggguga

SEQ ID NO: 667957 - RNA, 23 nt, Human
cauuguacuccagccugggugac

SEQ ID NO: 667958 - RNA, 24 nt, Human
cauuguacuccagccugggugaca

SEQ ID NO: 667959 - RNA, 25 nt, Human
cauuguacuccagccugggugacaa

SEQ ID NO: 667960 - RNA, 21 nt, Human
ccaaccaaaaaugucuccaga

SEQ ID NO: 667961 - RNA, 22 nt, Human
ccacacccugugcccucacccc

SEQ ID NO: 667962 - RNA, 18 nt, Human
ccauacagacaggagcug

SEQ ID NO: 667963 - RNA, 18 nt, Human
cccauggcggccaaaguc

SEQ ID NO: 667964 - RNA, 23 nt, Human
ccccaacaaaaagggcuaaaaac

SEQ ID NO: 667965 - RNA, 21 nt, Human
ccccaccccacccccaacaaa

SEQ ID NO: 667966 - RNA, 20 nt, Human
ccccgugguucugccagcgc

SEQ ID NO: 667967 - RNA, 21 nt, Human
ccccgugguucugccagcgcc

SEQ ID NO: 667968 - RNA, 21 nt, Human
cccugugcccucaccccauuc

SEQ ID NO: 667969 - RNA, 18 nt, Human
ccgugguucugccagcgc

SEQ ID NO: 667970 - RNA, 23 nt, Human
ccguugggaaaaccagcacccca

SEQ ID NO: 667971 - RNA, 25 nt, Human
ccucagcaggaccaggcuggaaccc

SEQ ID NO: 667972 - RNA, 21 nt, Human
ccucuggaaggcugauagcuc

SEQ ID NO: 667973 - RNA, 18 nt, Human
ccucuggucgaagccugg

SEQ ID NO: 667974 - RNA, 19 nt, Human
ccucuggucgaagccuggg

SEQ ID NO: 667975 - RNA, 23 nt, Human
ccugaccaacacggagaaacccc

SEQ ID NO: 667976 - RNA, 24 nt, Human
ccugaccaacacggagaaaccccg

SEQ ID NO: 667977 - RNA, 22 nt, Human
ccugaggucagggguuugagac

SEQ ID NO: 667978 - RNA, 19 nt, Human
ccuguaaucccagcuacuc

SEQ ID NO: 667979 - RNA, 21 nt, Human
ccuguaaucccagcuacucgg

SEQ ID NO: 667980 - RNA, 22 nt, Human
ccuguaaucccagcuacucggg

SEQ ID NO: 667981 - RNA, 21 nt, Human
cgcaucauuguacuccagccu

SEQ ID NO: 667982 - RNA, 23 nt, Human
cgccuguaaucccagcacuuugg

SEQ ID NO: 667983 - RNA, 24 nt, Human
cgccuguaaucccagcacuuuggg

SEQ ID NO: 667984 - RNA, 23 nt, Human
cgcuucagucagaggauggggcu

SEQ ID NO: 667985 - RNA, 24 nt, Human
cgggaggcagagguugcagugagc

SEQ ID NO: 667986 - RNA, 24 nt, Human
cgggaggcugaggcaggagaauca

SEQ ID NO: 667987 - RNA, 22 nt, Human
cucacgccuguaaucccagcac

SEQ ID NO: 667988 - RNA, 24 nt, Human
cucacgccuguaaucccagcacuu

SEQ ID NO: 667989 - RNA, 24 nt, Human
cucagggaguacccguugggaaaa

SEQ ID NO: 667990 - RNA, 25 nt, Human
cucagggaguacccguugggaaaac

SEQ ID NO: 667991 - RNA, 22 nt, Human
cucuccucugcccccaccccac

SEQ ID NO: 667992 - RNA, 21 nt, Human
cugcaggggacccuggcuucc

SEQ ID NO: 667993 - RNA, 22 nt, Human
cugcccccaccccacccccaac

SEQ ID NO: 667994 - RNA, 19 nt, Human
cugcugccaugcugagcug

SEQ ID NO: 667995 - RNA, 19 nt, Human
cugggccugagaaccccau

SEQ ID NO: 667996 - RNA, 20 nt, Human
cuucccagcuggcaggaccu

SEQ ID NO: 667997 - RNA, 22 nt, Human
gacaagagcgaaacucugucuc

SEQ ID NO: 667998 - RNA, 24 nt, Human
gacccuggcuuccacgaaguugga

SEQ ID NO: 667999 - RNA, 21 nt, Human
gagaaaccccgucucuacuaa

SEQ ID NO: 668000 - RNA, 23 nt, Human
gagaaucacuugaacccgggagg

SEQ ID NO: 668001 - RNA, 23 nt, Human
gaggugggcagauugccugaggu

SEQ ID NO: 668002 - RNA, 24 nt, Human
gauugccugaggucagggguuuga

SEQ ID NO: 668003 - RNA, 23 nt, Human
gcaggagaaucacuugaacccgg

SEQ ID NO: 668004 - RNA, 20 nt, Human
gcaucauuguacuccagccu

SEQ ID NO: 668005 - RNA, 24 nt, Human
gccugaggucagggguuugagacc

SEQ ID NO: 668006 - RNA, 18 nt, Human
gccugggccugagaaccc

SEQ ID NO: 668007 - RNA, 21 nt, Human
gcucaaggacaggaagaaaag

SEQ ID NO: 668008 - RNA, 19 nt, Human
ggagcuggcuggggagggc

SEQ ID NO: 668009 - RNA, 24 nt, Human
ggagcuggcuggggagggcaggug

SEQ ID NO: 668010 - RNA, 18 nt, Human
ggauggggcuucccccuc

SEQ ID NO: 668011 - RNA, 18 nt, Human
ggccuggggucaugaguu

SEQ ID NO: 668012 - RNA, 22 nt, Human
ggccuuggagccaucugggugg

SEQ ID NO: 668013 - RNA, 23 nt, Human
ggcuaaaaacuaguggugagccg

SEQ ID NO: 668014 - RNA, 18 nt, Human
ggcugguggcugggugac

SEQ ID NO: 668015 - RNA, 21 nt, Human
gggcaggugugucugcuuggc

SEQ ID NO: 668016 - RNA, 24 nt, Human
gggcgugguggugcaugccuguaa

SEQ ID NO: 668017 - RNA, 24 nt, Human
gggcuucccccuccuaggagcccc

SEQ ID NO: 668018 - RNA, 21 nt, Human
ggguggugggggaggggagac

SEQ ID NO: 668019 - RNA, 19 nt, Human
ggucagggguuugagacca

SEQ ID NO: 668020 - RNA, 23 nt, Human
ggugagccgggugcaguggcuca

SEQ ID NO: 668021 - RNA, 23 nt, Human
ggugcaguggcucacgccuguaa

SEQ ID NO: 668022 - RNA, 24 nt, Human
gguggugcaugccuguaaucccag

SEQ ID NO: 668023 - RNA, 18 nt, Human
ggugguggcagagggucc

SEQ ID NO: 668024 - RNA, 25 nt, Human
guacuccagccugggugacaagagc

SEQ ID NO: 668025 - RNA, 20 nt, Human
guauauauuuacaugcacau

SEQ ID NO: 668026 - RNA, 24 nt, Human
gugagccgggugcaguggcucacg

SEQ ID NO: 668027 - RNA, 21 nt, Human
guggagcaggggccugggguc

SEQ ID NO: 668028 - RNA, 19 nt, Human
guugcagugagcugagauc

SEQ ID NO: 668029 - RNA, 18 nt, Human
uaaaaauacaaaauaagc

SEQ ID NO: 668030 - RNA, 24 nt, Human
uaagcugggcgugguggugcaugc

SEQ ID NO: 668031 - RNA, 21 nt, Human
uacuccagccugggugacaag

SEQ ID NO: 668032 - RNA, 24 nt, Human
uacuccagccugggugacaagagc

SEQ ID NO: 668033 - RNA, 25 nt, Human
uacuccagccugggugacaagagcg

SEQ ID NO: 668034 - RNA, 24 nt, Human
ucagcuucuggcuugagcugggca

SEQ ID NO: 668035 - RNA, 24 nt, Human
ucauuguacuccagccugggugac

SEQ ID NO: 668036 - RNA, 23 nt, Human
uccacacccugugcccucacccc

SEQ ID NO: 668037 - RNA, 19 nt, Human
uccagccugggugacaaga

SEQ ID NO: 668038 - RNA, 20 nt, Human
uccauucugugacucagaga

SEQ ID NO: 668039 - RNA, 20 nt, Human
ucccucagcaggaccaggcu

SEQ ID NO: 668040 - RNA, 22 nt, Human
uccuuggccuuggagccaucuu

SEQ ID NO: 668041 - RNA, 23 nt, Human
ucgcaucauuguacuccagccug

SEQ ID NO: 668042 - RNA, 25 nt, Human
ucgggaggcugaggcaggagaauca

SEQ ID NO: 668043 - RNA, 25 nt, Human
ucucagagguggcgucauccugggg

SEQ ID NO: 668044 - RNA, 22 nt, Human
ucuccagaccuugccugauguc

SEQ ID NO: 668045 - RNA, 20 nt, Human
ucucuacuaaaaauacaaaa

SEQ ID NO: 668046 - RNA, 19 nt, Human
ucucuggucuccacccacu

SEQ ID NO: 668047 - RNA, 19 nt, Human
ucuuggguuguggucagag

SEQ ID NO: 668048 - RNA, 21 nt, Human
ugacaagagcgaaacucuguc

SEQ ID NO: 668049 - RNA, 18 nt, Human
ugacuggucucacggcuc

SEQ ID NO: 668050 - RNA, 24 nt, Human
ugagaaccccaucauacacgugga

SEQ ID NO: 668051 - RNA, 18 nt, Human
ugagaacuggggacccug

SEQ ID NO: 668052 - RNA, 24 nt, Human
ugagaccagccugaccaacacgga

SEQ ID NO: 668053 - RNA, 22 nt, Human
ugagcugagaucgcaucauugu

SEQ ID NO: 668054 - RNA, 24 nt, Human
ugagcugguguuucuaggcagggc

SEQ ID NO: 668055 - RNA, 20 nt, Human
ugaggcaggagaaucacuug

SEQ ID NO: 668056 - RNA, 24 nt, Human
ugaggcaggagaaucacuugaacc

SEQ ID NO: 668057 - RNA, 25 nt, Human
ugaggcaggagaaucacuugaaccc

SEQ ID NO: 668058 - RNA, 18 nt, Human
ugaggucagggguuugag

SEQ ID NO: 668059 - RNA, 24 nt, Human
ugaggugggcagauugccugaggu

SEQ ID NO: 668060 - RNA, 26 nt, Human
ugaggugggcagauugccugagguca

SEQ ID NO: 668061 - RNA, 19 nt, Human
ugcaggauguugagcggcu

SEQ ID NO: 668062 - RNA, 24 nt, Human
ugcccccaccccacccccaacaaa

SEQ ID NO: 668063 - RNA, 24 nt, Human
ugccuguaaucccagcuacucggg

SEQ ID NO: 668064 - RNA, 18 nt, Human
ugcuuggcgucccucagc

SEQ ID NO: 668065 - RNA, 20 nt, Human
uggaaggcugauagcucagg

SEQ ID NO: 668066 - RNA, 21 nt, Human
uggagcaggggccugggguca

SEQ ID NO: 668067 - RNA, 18 nt, Human
uggcaggaccugggggac

SEQ ID NO: 668068 - RNA, 23 nt, Human
uggcaggaccugggggacauccu

SEQ ID NO: 668069 - RNA, 19 nt, Human
uggccuuggagccaucugg

SEQ ID NO: 668070 - RNA, 25 nt, Human
uggcgucauccugggggauggcuca

SEQ ID NO: 668071 - RNA, 24 nt, Human
uggcucacgccuguaaucccagca

SEQ ID NO: 668072 - RNA, 18 nt, Human
uggcucaucuagggugug

SEQ ID NO: 668073 - RNA, 20 nt, Human
ugggaggcugaggugggcag

SEQ ID NO: 668074 - RNA, 22 nt, Human
ugggaggcugaggugggcagau

SEQ ID NO: 668075 - RNA, 24 nt, Human
ugggaggcugaggugggcagauug

SEQ ID NO: 668076 - RNA, 19 nt, Human
ugggggacauccuggugga

SEQ ID NO: 668077 - RNA, 23 nt, Human
uggucccggggugccgcucgcuu

SEQ ID NO: 668078 - RNA, 24 nt, Human
uggucccggggugccgcucgcuuc

SEQ ID NO: 668079 - RNA, 18 nt, Human
uggugagccgggugcagu

SEQ ID NO: 668080 - RNA, 21 nt, Human
uggugcaugccuguaauccca

SEQ ID NO: 668081 - RNA, 22 nt, Human
uggugcaugccuguaaucccag

SEQ ID NO: 668082 - RNA, 23 nt, Human
ugguggcagaggguccucugguc

SEQ ID NO: 668083 - RNA, 21 nt, Human
uggugggggaggggagacacc

SEQ ID NO: 668084 - RNA, 24 nt, Human
ugguggugcaugccuguaauccca

SEQ ID NO: 668085 - RNA, 23 nt, Human
ugguucugccagcgccucugugc

SEQ ID NO: 668086 - RNA, 23 nt, Human
uguacuccagccugggugacaag

SEQ ID NO: 668087 - RNA, 23 nt, Human
uguccccauggcggccaaaguca

SEQ ID NO: 668088 - RNA, 20 nt, Human
ugugacucagagaggggucc

SEQ ID NO: 668089 - RNA, 20 nt, Human
uguguccuuugaacccuggg

SEQ ID NO: 668090 - RNA, 20 nt, Human
uucccagcuggcaggaccug

SEQ ID NO: 668091 - RNA, 18 nt, Human
uugcagugagcugagauc

SEQ ID NO: 668092 - RNA, 19 nt, Human
uugcagugagcugagaucg

SEQ ID NO: 668093 - RNA, 20 nt, Human
uugcagugagcugagaucgc

SEQ ID NO: 668094 - RNA, 21 nt, Human
uugcagugagcugagaucgca

SEQ ID NO: 668095 - RNA, 20 nt, Human
uuggagccaucuggguggga

SEQ ID NO: 668096 - RNA, 22 nt, Human
uugggaggcugaggugggcaga

SEQ ID NO: 668097 - RNA, 25 nt, Human
uuguggucagagacggagccaggag

SEQ ID NO: 668098 - RNA, 20 nt, Human
uuuccuggccuccgcacuga

SEQ ID NO: 668099 - RNA, 21 nt, Human
uuuccuggccuccgcacugcu

SEQ ID NO: 668100 - RNA, 19 nt, Human
aacucagcucaaggagcca

SEQ ID NO: 668101 - RNA, 24 nt, Human
aaggcaucaccaggaaaggugaaa

SEQ ID NO: 668102 - RNA, 21 nt, Human
caucaccaggaaaggugaaag

SEQ ID NO: 668103 - RNA, 26 nt, Human
cucccucaugagccccacucgggcaa

SEQ ID NO: 668104 - RNA, 23 nt, Human
gagccaaaggcaucaccaggaaa

SEQ ID NO: 668105 - RNA, 25 nt, Human
aagaggcggaggggacgaagggcgg

SEQ ID NO: 668106 - RNA, 25 nt, Human
acugucuugucuucccuuccagaag

SEQ ID NO: 668107 - RNA, 21 nt, Human
agaauccguuccucaaccuuc

SEQ ID NO: 668108 - RNA, 24 nt, Human
agacauuuagagaagacacccaga

SEQ ID NO: 668109 - RNA, 21 nt, Human
agaggcaagcaggugggaggg

SEQ ID NO: 668110 - RNA, 20 nt, Human
agcuggguaagcgggggcag

SEQ ID NO: 668111 - RNA, 23 nt, Human
aggcggaggggacgaagggcggg

SEQ ID NO: 668112 - RNA, 18 nt, Human
agggcaggggagaucuga

SEQ ID NO: 668113 - RNA, 30 nt, Human
caacagacuuuguuauuggucugagaucuu

SEQ ID NO: 668114 - RNA, 21 nt, Human
cacccagaauccguuccucaa

SEQ ID NO: 668115 - RNA, 22 nt, Human
cacccagaauccguuccucaac

SEQ ID NO: 668116 - RNA, 23 nt, Human
caccuuccacaaguugauggccu

SEQ ID NO: 668117 - RNA, 20 nt, Human
cagaauccguuccucaaccu

SEQ ID NO: 668118 - RNA, 22 nt, Human
cagccgcggaucgucuaaggug

SEQ ID NO: 668119 - RNA, 23 nt, Human
cagcuccuauaauuccuucuccc

SEQ ID NO: 668120 - RNA, 25 nt, Human
caguggguuccccuccagagacacc

SEQ ID NO: 668121 - RNA, 20 nt, Human
ccauggccucauccucccug

SEQ ID NO: 668122 - RNA, 20 nt, Human
cccacacagggacaggaggu

SEQ ID NO: 668123 - RNA, 27 nt, Human
cccuccagagacaccuuccugagggcu

SEQ ID NO: 668124 - RNA, 24 nt, Human
ccuauaauuccuucuccccaucca

SEQ ID NO: 668125 - RNA, 29 nt, Human
ccuccagagacaccuuccugagggcaggg

SEQ ID NO: 668126 - RNA, 23 nt, Human
ccuguagcuggguaagcgggggc

SEQ ID NO: 668127 - RNA, 19 nt, Human
cgggugggggcggggccgg

SEQ ID NO: 668128 - RNA, 22 nt, Human
cuuccagaagauguuguuucuc

SEQ ID NO: 668129 - RNA, 20 nt, Human
cuugaugggaucccuuggca

SEQ ID NO: 668130 - RNA, 21 nt, Human
gacuugcuguccuccugcucc

SEQ ID NO: 668131 - RNA, 19 nt, Human
gagacaccuuccugagggc

SEQ ID NO: 668132 - RNA, 24 nt, Human
gaggucaccccacacagggaccag

SEQ ID NO: 668133 - RNA, 24 nt, Human
gagucuuagaggcaagcagguggg

SEQ ID NO: 668134 - RNA, 23 nt, Human
gcacugguacuccucuguagggg

SEQ ID NO: 668135 - RNA, 21 nt, Human
gccccgagucuuagaggcaag

SEQ ID NO: 668136 - RNA, 20 nt, Human
gcgggugggggcggggccgg

SEQ ID NO: 668137 - RNA, 26 nt, Human
gcuccuauaauuccuucuccccaucc

SEQ ID NO: 668138 - RNA, 19 nt, Human
gcucggcgaagucggucuc

SEQ ID NO: 668139 - RNA, 19 nt, Human
gcuggguaagcgggggcag

SEQ ID NO: 668140 - RNA, 23 nt, Human
gcuuuugggcuccuccuccccca

SEQ ID NO: 668141 - RNA, 18 nt, Human
gggaucccuuggcaacau

SEQ ID NO: 668142 - RNA, 19 nt, Human
gggcgggugggggcggggc

SEQ ID NO: 668143 - RNA, 20 nt, Human
gggugggggcggggccgguu

SEQ ID NO: 668144 - RNA, 18 nt, Human
guagauuuccuucacuga

SEQ ID NO: 668145 - RNA, 23 nt, Human
gucuucccuuccagaagauguug

SEQ ID NO: 668146 - RNA, 24 nt, Human
uagagaagacacccagaauccguu

SEQ ID NO: 668147 - RNA, 19 nt, Human
ucccccacgggaggcagaa

SEQ ID NO: 668148 - RNA, 19 nt, Human
ucccuuggcaacaucagcu

SEQ ID NO: 668149 - RNA, 23 nt, Human
ucccuuggcaacaucagcuccug

SEQ ID NO: 668150 - RNA, 24 nt, Human
ucccuuggcaacaucagcuccugg

SEQ ID NO: 668151 - RNA, 18 nt, Human
uccuccugcuccagcucc

SEQ ID NO: 668152 - RNA, 21 nt, Human
uccugcuccagcuccaccugg

SEQ ID NO: 668153 - RNA, 26 nt, Human
ugagggcaggggagaucuccccgagg

SEQ ID NO: 668154 - RNA, 24 nt, Human
uggaugaacagagaggcaggagcu

SEQ ID NO: 668155 - RNA, 22 nt, Human
uggauggugggccggaagaaca

SEQ ID NO: 668156 - RNA, 18 nt, Human
ugggagggggcuagggga

SEQ ID NO: 668157 - RNA, 25 nt, Human
uguagccccgagucuuagaggcaag

SEQ ID NO: 668158 - RNA, 24 nt, Human
uuggccuugaugggaucccuuggc

SEQ ID NO: 668159 - RNA, 25 nt, Human
uuuggccuugaugggaucccuuggc

SEQ ID NO: 668160 - RNA, 26 nt, Human
aaaaagaagaagaaaguggucaaaga

SEQ ID NO: 668161 - RNA, 26 nt, Human
aaaagaagaagaaaguggucaaagaa

SEQ ID NO: 668162 - RNA, 22 nt, Human
aaaaucuccccagaccccagac

SEQ ID NO: 668163 - RNA, 21 nt, Human
aaagugagcuucucaaaacca

SEQ ID NO: 668164 - RNA, 22 nt, Human
aaaugcaauguccauaucaaau

SEQ ID NO: 668165 - RNA, 19 nt, Human
aacacagugaaaucccauc

SEQ ID NO: 668166 - RNA, 20 nt, Human
aacacagugaaaucccaucu

SEQ ID NO: 668167 - RNA, 21 nt, Human
aacacagugaaaucccaucuc

SEQ ID NO: 668168 - RNA, 19 nt, Human
aagaaaaagaagaaagaga

SEQ ID NO: 668169 - RNA, 26 nt, Human
aagaagaaaguggucaaaggggaccc

SEQ ID NO: 668170 - RNA, 20 nt, Human
aagaagaagaaaguggucaa

SEQ ID NO: 668171 - RNA, 21 nt, Human
aagugagcuucucaaaaccag

SEQ ID NO: 668172 - RNA, 22 nt, Human
acagagugagacacugccucaa

SEQ ID NO: 668173 - RNA, 19 nt, Human
acggacagagaagucaucc

SEQ ID NO: 668174 - RNA, 24 nt, Human
acuccagccuggacaacagaguga

SEQ ID NO: 668175 - RNA, 20 nt, Human
agaaaaagaagaaagagaag

SEQ ID NO: 668176 - RNA, 21 nt, Human
agaaaaagaagaaagagaagg

SEQ ID NO: 668177 - RNA, 21 nt, Human
agaaaaagaagaaagagaagg

SEQ ID NO: 668178 - RNA, 24 nt, Human
agaaagagaagggugucagcaccc

SEQ ID NO: 668179 - RNA, 20 nt, Human
agaagaaaaagaagaagaaa

SEQ ID NO: 668180 - RNA, 24 nt, Human
agaagaaaaggaagucaucucugg

SEQ ID NO: 668181 - RNA, 24 nt, Human
agacagggugaggaggaaaccaga

SEQ ID NO: 668182 - RNA, 19 nt, Human
agagaagaaaaagaagaag

SEQ ID NO: 668183 - RNA, 25 nt, Human
agagaagccacgcgugcaacccgaa

SEQ ID NO: 668184 - RNA, 21 nt, Human
agagaagucauccagcccaag

SEQ ID NO: 668185 - RNA, 20 nt, Human
agaguuggcaagaagcuuaa

SEQ ID NO: 668186 - RNA, 24 nt, Human
agcacuuugggaggcugaggcggg

SEQ ID NO: 668187 - RNA, 23 nt, Human
aggaguucgagaccaguuuggcc

SEQ ID NO: 668188 - RNA, 20 nt, Human
aggcggguggaucccgaggu

SEQ ID NO: 668189 - RNA, 24 nt, Human
aggcggguggaucccgaggucagg

SEQ ID NO: 668190 - RNA, 18 nt, Human
aggcugaggcggguggau

SEQ ID NO: 668191 - RNA, 22 nt, Human
aggcugaggcggguggaucccg

SEQ ID NO: 668192 - RNA, 27 nt, Human
auaucgcugcacuccagccuggacaac

SEQ ID NO: 668193 - RNA, 20 nt, Human
aucuccccagaccccagaca

SEQ ID NO: 668194 - RNA, 23 nt, Human
cacgggcaggcaccugagaugcc

SEQ ID NO: 668195 - RNA, 22 nt, Human
cacuccagccuggacaacagag

SEQ ID NO: 668196 - RNA, 24 nt, Human
cacuccagccuggacaacagagug

SEQ ID NO: 668197 - RNA, 19 nt, Human
cagaagaaaaggaagucau

SEQ ID NO: 668198 - RNA, 22 nt, Human
cagaccccagacagggugagga

SEQ ID NO: 668199 - RNA, 21 nt, Human
cagagaagaaaaagaagaaga

SEQ ID NO: 668200 - RNA, 24 nt, Human
cagcacuuugggaggcugaggcgg

SEQ ID NO: 668201 - RNA, 21 nt, Human
caggccuuagcugagguggca

SEQ ID NO: 668202 - RNA, 21 nt, Human
cagucuugcugucucaggagg

SEQ ID NO: 668203 - RNA, 24 nt, Human
caguuuggccaacacagugaaauc

SEQ ID NO: 668204 - RNA, 18 nt, Human
caucaucuucauguugag

SEQ ID NO: 668205 - RNA, 26 nt, Human
caucuucauguugaguaggccaagga

SEQ ID NO: 668206 - RNA, 23 nt, Human
ccagaccccagacagggugagga

SEQ ID NO: 668207 - RNA, 24 nt, Human
ccagagaagaaaaagaagaagaaa

SEQ ID NO: 668208 - RNA, 22 nt, Human
ccaggaguucgaggcugcagug

SEQ ID NO: 668209 - RNA, 21 nt, Human
cccagagaagaaaaagaagaa

SEQ ID NO: 668210 - RNA, 22 nt, Human
cccgaggucaggaguucgagac

SEQ ID NO: 668211 - RNA, 19 nt, Human
ccggaaaguagaccugggc

SEQ ID NO: 668212 - RNA, 21 nt, Human
ccuauaaaagccacagccccc

SEQ ID NO: 668213 - RNA, 21 nt, Human
ccugggcccugggaucccaga

SEQ ID NO: 668214 - RNA, 24 nt, Human
cgagaccaguuuggccaacacagu

SEQ ID NO: 668215 - RNA, 24 nt, Human
cgcugcacuccagccuggacaaca

SEQ ID NO: 668216 - RNA, 27 nt, Human
cggcugggcgcggucgcucagggcugu

SEQ ID NO: 668217 - RNA, 24 nt, Human
cucagggcuguaaucccagcacuu

SEQ ID NO: 668218 - RNA, 19 nt, Human
cugcacuccagccuggaca

SEQ ID NO: 668219 - RNA, 23 nt, Human
cugcacuccagccuggacaacag

SEQ ID NO: 668220 - RNA, 19 nt, Human
cuguaaucccagcacuuug

SEQ ID NO: 668221 - RNA, 22 nt, Human
cuugagcccaggaguucgaggc

SEQ ID NO: 668222 - RNA, 21 nt, Human
cuuugcccauguuucuccuau

SEQ ID NO: 668223 - RNA, 26 nt, Human
gaaaaagaagaagaaaguggucaaag

SEQ ID NO: 668224 - RNA, 20 nt, Human
gaagaaaaagaagaagaaag

SEQ ID NO: 668225 - RNA, 24 nt, Human
gaagaaaaagaagaagaaaguggu

SEQ ID NO: 668226 - RNA, 21 nt, Human
gagaagccacgcgugcaaccc

SEQ ID NO: 668227 - RNA, 18 nt, Human
gagcccaggaguucgagg

SEQ ID NO: 668228 - RNA, 18 nt, Human
gaguggcagaaguggaag

SEQ ID NO: 668229 - RNA, 21 nt, Human
gaucccgaggucaggaguucg

SEQ ID NO: 668230 - RNA, 22 nt, Human
gaucccgaggucaggaguucga

SEQ ID NO: 668231 - RNA, 24 nt, Human
gaucccgaggucaggaguucgaga

SEQ ID NO: 668232 - RNA, 24 nt, Human
gcacuccagccuggacaacagagu

SEQ ID NO: 668233 - RNA, 23 nt, Human
gcccccucuaagaguguggucca

SEQ ID NO: 668234 - RNA, 24 nt, Human
gcugcacuccagccuggacaacag

SEQ ID NO: 668235 - RNA, 21 nt, Human
ggucaaagaaccagggacuca

SEQ ID NO: 668236 - RNA, 24 nt, Human
ggucgcucagggcuguaaucccag

SEQ ID NO: 668237 - RNA, 23 nt, Human
gguggaucccgaggucaggaguu

SEQ ID NO: 668238 - RNA, 21 nt, Human
gucaaagaaccagggacucaa

SEQ ID NO: 668239 - RNA, 23 nt, Human
guggaucccgaggucaggaguuc

SEQ ID NO: 668240 - RNA, 24 nt, Human
uaaaagccacagcccccucuaaga

SEQ ID NO: 668241 - RNA, 20 nt, Human
uaaguaugaaauccugugac

SEQ ID NO: 668242 - RNA, 23 nt, Human
uaauaaguaugaaauccugugac

SEQ ID NO: 668243 - RNA, 21 nt, Human
uacugcaggccuuagcugagg

SEQ ID NO: 668244 - RNA, 21 nt, Human
uagaaccugagaccacgcugg

SEQ ID NO: 668245 - RNA, 22 nt, Human
uaucgcugcacuccagccugga

SEQ ID NO: 668246 - RNA, 24 nt, Human
uaucgcugcacuccagccuggaca

SEQ ID NO: 668247 - RNA, 23 nt, Human
ucagcacccuuugcgaggggcac

SEQ ID NO: 668248 - RNA, 23 nt, Human
uccagccuggacaacagagugag

SEQ ID NO: 668249 - RNA, 24 nt, Human
uccagccuggacaacagagugaga

SEQ ID NO: 668250 - RNA, 24 nt, Human
ucccgaggucaggaguucgagacc

SEQ ID NO: 668251 - RNA, 23 nt, Human
ucccuugagcccaggaguucgag

SEQ ID NO: 668252 - RNA, 24 nt, Human
ucgcucagggcuguaaucccagca

SEQ ID NO: 668253 - RNA, 18 nt, Human
ucgcugcacuccagccug

SEQ ID NO: 668254 - RNA, 19 nt, Human
ucgcugcacuccagccugg

SEQ ID NO: 668255 - RNA, 21 nt, Human
ucgcugcacuccagccuggac

SEQ ID NO: 668256 - RNA, 25 nt, Human
ucucccaugccucuggggugaaaau

SEQ ID NO: 668257 - RNA, 26 nt, Human
ucucuugcuccuucucuucgggccgc

SEQ ID NO: 668258 - RNA, 19 nt, Human
ucuuagcuacugcaggccu

SEQ ID NO: 668259 - RNA, 23 nt, Human
ucuucucuugcuccuucucuucu

SEQ ID NO: 668260 - RNA, 18 nt, Human
ucuucuucucuugcuccu

SEQ ID NO: 668261 - RNA, 19 nt, Human
ugaaaaucuccccagaccc

SEQ ID NO: 668262 - RNA, 23 nt, Human
ugaccauaucgcugcacuccagc

SEQ ID NO: 668263 - RNA, 20 nt, Human
ugagaccacgcugcgugcca

SEQ ID NO: 668264 - RNA, 18 nt, Human
ugagaucuucuucucuug

SEQ ID NO: 668265 - RNA, 19 nt, Human
ugagaugccucuagugaag

SEQ ID NO: 668266 - RNA, 19 nt, Human
ugagaugccucuagugaag

SEQ ID NO: 668267 - RNA, 23 nt, Human
ugagaugccucuagugaagaaaa

SEQ ID NO: 668268 - RNA, 18 nt, Human
ugagcccaggaguucgag

SEQ ID NO: 668269 - RNA, 21 nt, Human
ugaggaggaaaccagaguugg

SEQ ID NO: 668270 - RNA, 24 nt, Human
ugaggcggguggaucccgagguca

SEQ ID NO: 668271 - RNA, 24 nt, Human
ugagguggcaggaucccuugagcc

SEQ ID NO: 668272 - RNA, 20 nt, Human
ugaguaggccaaggaggagg

SEQ ID NO: 668273 - RNA, 21 nt, Human
ugccucuagugaagaaaaaga

SEQ ID NO: 668274 - RNA, 21 nt, Human
uggaggcggggaaguuuggcc

SEQ ID NO: 668275 - RNA, 22 nt, Human
uggaucccgaggucaggaguuc

SEQ ID NO: 668276 - RNA, 19 nt, Human
uggcaagaagcuuaaaaaa

SEQ ID NO: 668277 - RNA, 19 nt, Human
uggcagaaguggaagaaaa

SEQ ID NO: 668278 - RNA, 20 nt, Human
uggccaacacagugaaaucc

SEQ ID NO: 668279 - RNA, 22 nt, Human
uggccaacacagugaaauccca

SEQ ID NO: 668280 - RNA, 20 nt, Human
ugggaggcugaggcgggugg

SEQ ID NO: 668281 - RNA, 23 nt, Human
ugggaggcugaggcggguggauc

SEQ ID NO: 668282 - RNA, 20 nt, Human
ugggcagaagaaaaggaagu

SEQ ID NO: 668283 - RNA, 21 nt, Human
ugggcagaagaaaaggaaguc

SEQ ID NO: 668284 - RNA, 20 nt, Human
uuaaacaaugaugauuacuu

SEQ ID NO: 668285 - RNA, 25 nt, Human
uuacuuugcccauguuucuccuaua

SEQ ID NO: 668286 - RNA, 23 nt, Human
uuggccaacacagugaaauccca

SEQ ID NO: 668287 - RNA, 22 nt, Human
aaagagcuagguuaucucaaac

SEQ ID NO: 668288 - RNA, 19 nt, Human
aaauagaaagaccaggucu

SEQ ID NO: 668289 - RNA, 23 nt, Human
aaccucaggugaucugcccgccu

SEQ ID NO: 668290 - RNA, 21 nt, Human
aagggcccguacuaauuugac

SEQ ID NO: 668291 - RNA, 18 nt, Human
aauccugugaaagaaguu

SEQ ID NO: 668292 - RNA, 18 nt, Human
acaggguuucaccauguu

SEQ ID NO: 668293 - RNA, 21 nt, Human
acaggguuucaccauguuggc

SEQ ID NO: 668294 - RNA, 24 nt, Human
acaggguuucaccauguuggccag

SEQ ID NO: 668295 - RNA, 24 nt, Human
accauguuggccaggcugaucuug

SEQ ID NO: 668296 - RNA, 21 nt, Human
acugaagcacagcaacucaua

SEQ ID NO: 668297 - RNA, 25 nt, Human
aggcuggagugcaguggcacgaucu

SEQ ID NO: 668298 - RNA, 24 nt, Human
aggugaucugcccgccuuggccuc

SEQ ID NO: 668299 - RNA, 23 nt, Human
aguagcugguauuacaggcgcgu

SEQ ID NO: 668300 - RNA, 20 nt, Human
agugcaguggcacgaucucg

SEQ ID NO: 668301 - RNA, 18 nt, Human
caacacagcucucuuccu

SEQ ID NO: 668302 - RNA, 25 nt, Human
caacacagcucucuuccuuaugcuu

SEQ ID NO: 668303 - RNA, 22 nt, Human
caagugacucuccugccucagc

SEQ ID NO: 668304 - RNA, 24 nt, Human
cacacugaagcacagcaacucaua

SEQ ID NO: 668305 - RNA, 21 nt, Human
caccauguuggccaggcugau

SEQ ID NO: 668306 - RNA, 23 nt, Human
caccauguuggccaggcugaucu

SEQ ID NO: 668307 - RNA, 24 nt, Human
caccauguuggccaggcugaucuu

SEQ ID NO: 668308 - RNA, 27 nt, Human
caccauguuggccaggcugaucuugaa

SEQ ID NO: 668309 - RNA, 22 nt, Human
caccuucagguccuuauuucaa

SEQ ID NO: 668310 - RNA, 23 nt, Human
cacugcagccuccgccucccggg

SEQ ID NO: 668311 - RNA, 19 nt, Human
cagccuccugaguagcugg

SEQ ID NO: 668312 - RNA, 24 nt, Human
caggguuucaccauguuggccagg

SEQ ID NO: 668313 - RNA, 24 nt, Human
cauguuggccaggcugaucuugaa

SEQ ID NO: 668314 - RNA, 18 nt, Human
cauucaaguaaaaaaaaa

SEQ ID NO: 668315 - RNA, 21 nt, Human
ccaaugauaggugaaguccuu

SEQ ID NO: 668316 - RNA, 23 nt, Human
cccagcuaauuuugguauuuuua

SEQ ID NO: 668317 - RNA, 20 nt, Human
cccggguucaagugacucuc

SEQ ID NO: 668318 - RNA, 23 nt, Human
cccggguucaagugacucuccug

SEQ ID NO: 668319 - RNA, 24 nt, Human
ccgccucccggguucaagugacuc

SEQ ID NO: 668320 - RNA, 22 nt, Human
ccuaaccucaggugaucugccc

SEQ ID NO: 668321 - RNA, 22 nt, Human
ccucccggguucaagugacucu

SEQ ID NO: 668322 - RNA, 18 nt, Human
ccuccugaguagcuggua

SEQ ID NO: 668323 - RNA, 23 nt, Human
ccugaguagcugguauuacaggc

SEQ ID NO: 668324 - RNA, 24 nt, Human
ccugccucagccuccugaguagcu

SEQ ID NO: 668325 - RNA, 24 nt, Human
cgcucuugucgcccaggcuggagu

SEQ ID NO: 668326 - RNA, 24 nt, Human
cucacugcagccuccgccucccgg

SEQ ID NO: 668327 - RNA, 26 nt, Human
cuccuaaccucaggugaucugcccgc

SEQ ID NO: 668328 - RNA, 24 nt, Human
cucgcucuugucgcccaggcugga

SEQ ID NO: 668329 - RNA, 26 nt, Human
cucuccugccucagccuccugaguag

SEQ ID NO: 668330 - RNA, 23 nt, Human
cugcagccuccgccucccggguu

SEQ ID NO: 668331 - RNA, 20 nt, Human
cuuuuuuuuuugagacagag

SEQ ID NO: 668332 - RNA, 21 nt, Human
gcccagcaacuuaaaaaacac

SEQ ID NO: 668333 - RNA, 23 nt, Human
gcccaggcuggagugcaguggca

SEQ ID NO: 668334 - RNA, 20 nt, Human
gccucagccuccugaguagc

SEQ ID NO: 668335 - RNA, 24 nt, Human
gcucuugucgcccaggcuggagug

SEQ ID NO: 668336 - RNA, 23 nt, Human
gcugaucuugaacuccuaaccuc

SEQ ID NO: 668337 - RNA, 19 nt, Human
gcuggagugcaguggcacg

SEQ ID NO: 668338 - RNA, 22 nt, Human
ggguuucaccauguuggccagg

SEQ ID NO: 668339 - RNA, 23 nt, Human
gugacucuccugccucagccucc

SEQ ID NO: 668340 - RNA, 28 nt, Human
uaaaaaacacacacugaagccggggccc

SEQ ID NO: 668341 - RNA, 18 nt, Human
uaaccucaggugaucugc

SEQ ID NO: 668342 - RNA, 24 nt, Human
uaaccucaggugaucugcccgccu

SEQ ID NO: 668343 - RNA, 24 nt, Human
uaauagagacaggguuucaccaug

SEQ ID NO: 668344 - RNA, 26 nt, Human
uaauagagacaggguuucaccauguu

SEQ ID NO: 668345 - RNA, 24 nt, Human
uaauuuugguauuuuuaauagaga

SEQ ID NO: 668346 - RNA, 22 nt, Human
uaccaaugugauauauagcuag

SEQ ID NO: 668347 - RNA, 21 nt, Human
uagagacaggguuucaccaug

SEQ ID NO: 668348 - RNA, 22 nt, Human
uagagacaggguuucaccaugu

SEQ ID NO: 668349 - RNA, 22 nt, Human
uaggaaagaccaaugauaggug

SEQ ID NO: 668350 - RNA, 22 nt, Human
uauagcuaggaaagaccggggc

SEQ ID NO: 668351 - RNA, 22 nt, Human
uauuuacauucaaguaaaaaaa

SEQ ID NO: 668352 - RNA, 23 nt, Human
ucacugcagccuccgccucccgg

SEQ ID NO: 668353 - RNA, 23 nt, Human
ucacugcagccuccgccucccgg

SEQ ID NO: 668354 - RNA, 24 nt, Human
ucacugcagccuccgccucccggg

SEQ ID NO: 668355 - RNA, 20 nt, Human
ucagccuccugaguagcugg

SEQ ID NO: 668356 - RNA, 21 nt, Human
ucccggguucaagugacucuc

SEQ ID NO: 668357 - RNA, 24 nt, Human
ucccggguucaagugacucuccug

SEQ ID NO: 668358 - RNA, 21 nt, Human
ucccucccaaaaugugaggau

SEQ ID NO: 668359 - RNA, 24 nt, Human
uccugaguagcugguauuacaggc

SEQ ID NO: 668360 - RNA, 19 nt, Human
uccugcuuucuacugucuu

SEQ ID NO: 668361 - RNA, 22 nt, Human
ucgcccaggcuggagugcagug

SEQ ID NO: 668362 - RNA, 24 nt, Human
ucucgcucuugucgcccaggcugg

SEQ ID NO: 668363 - RNA, 25 nt, Human
ucucgcucuugucgcccaggcugga

SEQ ID NO: 668364 - RNA, 25 nt, Human
ucuuuuuuuuuugagacagagucuc

SEQ ID NO: 668365 - RNA, 20 nt, Human
ugacaaaauagaaagaccag

SEQ ID NO: 668366 - RNA, 18 nt, Human
ugagacagagucucgcuc

SEQ ID NO: 668367 - RNA, 24 nt, Human
ugcccagcaacuuaaaaaacacac

SEQ ID NO: 668368 - RNA, 24 nt, Human
ugccucagccuccugaguagcugg

SEQ ID NO: 668369 - RNA, 23 nt, Human
uggagugcaguggcacgaucucg

SEQ ID NO: 668370 - RNA, 24 nt, Human
uggccaggcugaucuugaacuccu

SEQ ID NO: 668371 - RNA, 21 nt, Human
ugguauuacaggcgcgugcca

SEQ ID NO: 668372 - RNA, 22 nt, Human
ugguauuacaggcgcgugccac

SEQ ID NO: 668373 - RNA, 24 nt, Human
ugguauuacaggcgcgugccacca

SEQ ID NO: 668374 - RNA, 25 nt, Human
ugguauuacaggcgcgugccaccau

SEQ ID NO: 668375 - RNA, 21 nt, Human
ugucgcccaggcuggagugca

SEQ ID NO: 668376 - RNA, 26 nt, Human
ugucuugccaccuucagguccuuauu

SEQ ID NO: 668377 - RNA, 22 nt, Human
uuaaaaaacacacacugaagca

SEQ ID NO: 668378 - RNA, 25 nt, Human
uuaaaaaacacacacugaagcacag

SEQ ID NO: 668379 - RNA, 24 nt, Human
uuaauagagacaggguuucaccau

SEQ ID NO: 668380 - RNA, 24 nt, Human
uuacauucaaguaaaaaaaaaaaa

SEQ ID NO: 668381 - RNA, 23 nt, Human
uucaagugacucuccugccucag

SEQ ID NO: 668382 - RNA, 24 nt, Human
uucaagugacucuccugccucagc

SEQ ID NO: 668383 - RNA, 21 nt, Human
uuucaccauguuggccaggcu

SEQ ID NO: 668384 - RNA, 24 nt, Human
uuuuuaauagagacaggguuucac

SEQ ID NO: 668385 - RNA, 18 nt, Human
aaaggaaacuggagugcu

SEQ ID NO: 668386 - RNA, 19 nt, Human
aacaugaaacuguuggaaa

SEQ ID NO: 668387 - RNA, 20 nt, Human
aacgccgcuccuccugccag

SEQ ID NO: 668388 - RNA, 24 nt, Human
aacuggagugcugggccaguggag

SEQ ID NO: 668389 - RNA, 20 nt, Human
acgccgcuccuccugccagg

SEQ ID NO: 668390 - RNA, 22 nt, Human
acugaacucuccucucuuaaaa

SEQ ID NO: 668391 - RNA, 19 nt, Human
agacuccaggggagccucg

SEQ ID NO: 668392 - RNA, 24 nt, Human
agagaaccaaguugaaaaggucaa

SEQ ID NO: 668393 - RNA, 23 nt, Human
aggaaaagguggagacuccaggg

SEQ ID NO: 668394 - RNA, 21 nt, Human
aggagcagggguagagccacu

SEQ ID NO: 668395 - RNA, 19 nt, Human
aggcagggaaaggaaacug

SEQ ID NO: 668396 - RNA, 21 nt, Human
aggcggcagggucgggcagga

SEQ ID NO: 668397 - RNA, 21 nt, Human
agggaauagcccuggaaucca

SEQ ID NO: 668398 - RNA, 23 nt, Human
aggggucaagggcuucaggaccu

SEQ ID NO: 668399 - RNA, 25 nt, Human
auaccaaagccugucuggcucccca

SEQ ID NO: 668400 - RNA, 22 nt, Human
caccugcauccuucaaggguuc

SEQ ID NO: 668401 - RNA, 30 nt, Human
cacuggccuggguaagccccuggcugcacc

SEQ ID NO: 668402 - RNA, 21 nt, Human
caggcccccaggggucaaggg

SEQ ID NO: 668403 - RNA, 19 nt, Human
cagggaaaggaaacuggag

SEQ ID NO: 668404 - RNA, 20 nt, Human
cauaacugagacuguccucc

SEQ ID NO: 668405 - RNA, 24 nt, Human
ccaaagccugucuggcuccccagg

SEQ ID NO: 668406 - RNA, 24 nt, Human
ccagcccagcgagauccuacacua

SEQ ID NO: 668407 - RNA, 18 nt, Human
ccauagacacagagaucc

SEQ ID NO: 668408 - RNA, 24 nt, Human
cccagcgagauccuacacuaccca

SEQ ID NO: 668409 - RNA, 22 nt, Human
ccccggcugaacgccgcuccuc

SEQ ID NO: 668410 - RNA, 20 nt, Human
cccggagcguuucuucaggc

SEQ ID NO: 668411 - RNA, 24 nt, Human
cccggcugaacgccgcuccuccug

SEQ ID NO: 668412 - RNA, 22 nt, Human
ccgccgcuuccgggacgcgaau

SEQ ID NO: 668413 - RNA, 23 nt, Human
ccgcggccgccaccgccgcuucc

SEQ ID NO: 668414 - RNA, 23 nt, Human
ccucuuguaggagagaaccaagu

SEQ ID NO: 668415 - RNA, 18 nt, Human
ccuggcugcacagccccg

SEQ ID NO: 668416 - RNA, 26 nt, Human
cgagauccuacacuacccaggccccc

SEQ ID NO: 668417 - RNA, 19 nt, Human
cgauaccaaagccugucug

SEQ ID NO: 668418 - RNA, 22 nt, Human
cggccgccaccgccgcuuccgg

SEQ ID NO: 668419 - RNA, 21 nt, Human
cucagcuccggcccacucccc

SEQ ID NO: 668420 - RNA, 22 nt, Human
cuccaguguaaagaaagcacgg

SEQ ID NO: 668421 - RNA, 22 nt, Human
cuccccagggcuguggcaccuc

SEQ ID NO: 668422 - RNA, 19 nt, Human
cugagcccguaagagucca

SEQ ID NO: 668423 - RNA, 19 nt, Human
gaacucuccucucuuaaaa

SEQ ID NO: 668424 - RNA, 21 nt, Human
gacaagaggcagggaaaggaa

SEQ ID NO: 668425 - RNA, 24 nt, Human
gcagggucgggcaggagcaggggu

SEQ ID NO: 668426 - RNA, 25 nt, Human
gccccggagcguuucuucaggccuc

SEQ ID NO: 668427 - RNA, 21 nt, Human
gcugcuuggcucggcaagaaa

SEQ ID NO: 668428 - RNA, 21 nt, Human
ggaaagaaauggagaccccca

SEQ ID NO: 668429 - RNA, 19 nt, Human
ggaaaggaaacuggagugc

SEQ ID NO: 668430 - RNA, 22 nt, Human
ggaauagcccuggaauccagga

SEQ ID NO: 668431 - RNA, 21 nt, Human
ggacaagaggcagggaaagga

SEQ ID NO: 668432 - RNA, 19 nt, Human
ggagugcugggccagugga

SEQ ID NO: 668433 - RNA, 20 nt, Human
ggccgccaccgccgcuuccc

SEQ ID NO: 668434 - RNA, 24 nt, Human
gguaagccccuggcugcacagccc

SEQ ID NO: 668435 - RNA, 21 nt, Human
guccgaaaaucuccuccgccu

SEQ ID NO: 668436 - RNA, 18 nt, Human
guggaggacugcccgugc

SEQ ID NO: 668437 - RNA, 18 nt, Human
uaacugagacuguccucc

SEQ ID NO: 668438 - RNA, 19 nt, Human
uaagccccuggcugcacag

SEQ ID NO: 668439 - RNA, 19 nt, Human
uaagcugcuuggcucggca

SEQ ID NO: 668440 - RNA, 23 nt, Human
uagaaauagacaaauuauuugcu

SEQ ID NO: 668441 - RNA, 23 nt, Human
ucagcuccggcccacuccccuca

SEQ ID NO: 668442 - RNA, 19 nt, Human
uccagggaauagcccugga

SEQ ID NO: 668443 - RNA, 19 nt, Human
uccagguagaucuccagcc

SEQ ID NO: 668444 - RNA, 19 nt, Human
ucccccggcugaacgccgc

SEQ ID NO: 668445 - RNA, 21 nt, Human
ucccccggcugaacgccgcuc

SEQ ID NO: 668446 - RNA, 24 nt, Human
uccgaaaaucuccuccgccuacgc

SEQ ID NO: 668447 - RNA, 19 nt, Human
uccgccuacgccgcggccg

SEQ ID NO: 668448 - RNA, 18 nt, Human
uccuucaaggguuccagg

SEQ ID NO: 668449 - RNA, 24 nt, Human
ucucuuaaaaggacacagaggcug

SEQ ID NO: 668450 - RNA, 19 nt, Human
ugcccgugcaguucccuuu

SEQ ID NO: 668451 - RNA, 23 nt, Human
ugcuccacucaccuggccuccca

SEQ ID NO: 668452 - RNA, 20 nt, Human
uggaaagaaauggagacccc

SEQ ID NO: 668453 - RNA, 22 nt, Human
uggaaagaaauggagaccccca

SEQ ID NO: 668454 - RNA, 24 nt, Human
uggaauccaggacccagcccagcg

SEQ ID NO: 668455 - RNA, 18 nt, Human
uggcaccuccacuggccu

SEQ ID NO: 668456 - RNA, 21 nt, Human
uggccuggguaagccccuggc

SEQ ID NO: 668457 - RNA, 24 nt, Human
uggccuggguaagccccuggcugc

SEQ ID NO: 668458 - RNA, 19 nt, Human
uggcucggcaagaaagcgg

SEQ ID NO: 668459 - RNA, 19 nt, Human
uugaaaaggucaaacgcug

SEQ ID NO: 668460 - RNA, 21 nt, Human
uuggacaagaggcagggaaag

SEQ ID NO: 668461 - RNA, 24 nt, Human
aaaaagacagaggccugccacugg

SEQ ID NO: 668462 - RNA, 18 nt, Human
aaaagacagagacccaca

SEQ ID NO: 668463 - RNA, 21 nt, Human
aaacaggaggugggggaucca

SEQ ID NO: 668464 - RNA, 21 nt, Human
aaagaccccacagagagccag

SEQ ID NO: 668465 - RNA, 20 nt, Human
aagaccccacagagagccag

SEQ ID NO: 668466 - RNA, 18 nt, Human
aagcccagagaacaggag

SEQ ID NO: 668467 - RNA, 18 nt, Human
acaaaaaaagaccccaca

SEQ ID NO: 668468 - RNA, 20 nt, Human
acaaaaaaagaccccacaga

SEQ ID NO: 668469 - RNA, 22 nt, Human
acaaaaaaagaccccacagaga

SEQ ID NO: 668470 - RNA, 22 nt, Human
acagggaaggggcagauaugga

SEQ ID NO: 668471 - RNA, 18 nt, Human
acccacaaggcaaacagg

SEQ ID NO: 668472 - RNA, 23 nt, Human
agaaaaagacagagacccacaag

SEQ ID NO: 668473 - RNA, 22 nt, Human
agacagggaaggggcagauaug

SEQ ID NO: 668474 - RNA, 23 nt, Human
agacagggaaggggcagauaugg

SEQ ID NO: 668475 - RNA, 20 nt, Human
agacagggacacaggaugcg

SEQ ID NO: 668476 - RNA, 22 nt, Human
agacggacagacacugaccagg

SEQ ID NO: 668477 - RNA, 18 nt, Human
agaugaggagagagagcc

SEQ ID NO: 668478 - RNA, 21 nt, Human
aggaggugggggauccacagg

SEQ ID NO: 668479 - RNA, 25 nt, Human
aggaggugggggauccacagggggc

SEQ ID NO: 668480 - RNA, 24 nt, Human
agugucaggagcagagagaaagga

SEQ ID NO: 668481 - RNA, 20 nt, Human
augaagggcagaugaaaaca

SEQ ID NO: 668482 - RNA, 23 nt, Human
caaaaaaagaccccacagagagc

SEQ ID NO: 668483 - RNA, 21 nt, Human
cacaccugucagcacuggggg

SEQ ID NO: 668484 - RNA, 18 nt, Human
cagacagggaaggggcag

SEQ ID NO: 668485 - RNA, 18 nt, Human
cagcagacagggaagggg

SEQ ID NO: 668486 - RNA, 19 nt, Human
caggagaucaggagucaga

SEQ ID NO: 668487 - RNA, 21 nt, Human
caggagaucaggagucagaaa

SEQ ID NO: 668488 - RNA, 26 nt, Human
gaaaacaguugaaggggcaaaaagac

SEQ ID NO: 668489 - RNA, 23 nt, Human
gaaaagcagugucaggagcagag

SEQ ID NO: 668490 - RNA, 24 nt, Human
gaaaagcagugucaggagcagaga

SEQ ID NO: 668491 - RNA, 24 nt, Human
gagccggaaacaggagguggggga

SEQ ID NO: 668492 - RNA, 20 nt, Human
gaguaaggagcuacagagac

SEQ ID NO: 668493 - RNA, 21 nt, Human
ggaaaagcagugucaggagca

SEQ ID NO: 668494 - RNA, 21 nt, Human
ggagauggagaugaggagaga

SEQ ID NO: 668495 - RNA, 22 nt, Human
ggagcagagagaaaggaaccgg

SEQ ID NO: 668496 - RNA, 20 nt, Human
gggagauggagaugaggaga

SEQ ID NO: 668497 - RNA, 22 nt, Human
gggcagggugggggcugcgugc

SEQ ID NO: 668498 - RNA, 25 nt, Human
gggccagggcucagcagacagggaa

SEQ ID NO: 668499 - RNA, 19 nt, Human
gggcucuuggggaguaagg

SEQ ID NO: 668500 - RNA, 18 nt, Human
gugggggcugcgugcccc

SEQ ID NO: 668501 - RNA, 24 nt, Human
uauggagacaagacggacagacac

SEQ ID NO: 668502 - RNA, 20 nt, Human
ucagcagacagggaaggggc

SEQ ID NO: 668503 - RNA, 21 nt, Human
uccacacauauacuuuauuuc

SEQ ID NO: 668504 - RNA, 24 nt, Human
ucccaugcugaaccuggcgucuuc

SEQ ID NO: 668505 - RNA, 20 nt, Human
ucccauuuucccaugcugaa

SEQ ID NO: 668506 - RNA, 18 nt, Human
ugaagggcagaugaaaac

SEQ ID NO: 668507 - RNA, 18 nt, Human
ugaaggggcaaaaagaca

SEQ ID NO: 668508 - RNA, 18 nt, Human
ugaaggggcaaaaagaca

SEQ ID NO: 668509 - RNA, 19 nt, Human
ugaccaggaagcccagaga

SEQ ID NO: 668510 - RNA, 22 nt, Human
ugaggagagagagccggaaaca

SEQ ID NO: 668511 - RNA, 18 nt, Human
ugaugaagggcagaugaa

SEQ ID NO: 668512 - RNA, 23 nt, Human
aagggcugcugcccgugcuuccu

SEQ ID NO: 668513 - RNA, 21 nt, Human
aggaucaggaagagagggagg

SEQ ID NO: 668514 - RNA, 24 nt, Human
aggcaguagagaccuggaugaacc

SEQ ID NO: 668515 - RNA, 18 nt, Human
aggggagaugcacacacg

SEQ ID NO: 668516 - RNA, 22 nt, Human
caagugaggcaguagagaccug

SEQ ID NO: 668517 - RNA, 21 nt, Human
cacuuuugguuuauuuggggg

SEQ ID NO: 668518 - RNA, 22 nt, Human
cagcuccagguccagguccccc

SEQ ID NO: 668519 - RNA, 18 nt, Human
caggaagagagggaggug

SEQ ID NO: 668520 - RNA, 26 nt, Human
ccaugccugcucaggguccuuccuuu

SEQ ID NO: 668521 - RNA, 25 nt, Human
ccucugcugaggccccuucuccuca

SEQ ID NO: 668522 - RNA, 20 nt, Human
ccugcucaggguccuuccuu

SEQ ID NO: 668523 - RNA, 20 nt, Human
ccugguaggagaggggagau

SEQ ID NO: 668524 - RNA, 23 nt, Human
cggagcagguauuguccaggagg

SEQ ID NO: 668525 - RNA, 25 nt, Human
cugcugcccgugcuuccucugcuga

SEQ ID NO: 668526 - RNA, 21 nt, Human
gacaggcugaugggcuucagg

SEQ ID NO: 668527 - RNA, 22 nt, Human
gaggugagagagggacugaggg

SEQ ID NO: 668528 - RNA, 18 nt, Human
gaucaggaagagagggag

SEQ ID NO: 668529 - RNA, 22 nt, Human
gcugcagccagccauagcugag

SEQ ID NO: 668530 - RNA, 19 nt, Human
gcuggugagaaugcugaca

SEQ ID NO: 668531 - RNA, 23 nt, Human
ggcugcugcccgugcuuccucug

SEQ ID NO: 668532 - RNA, 19 nt, Human
gggugggugggaaggauca

SEQ ID NO: 668533 - RNA, 21 nt, Human
gugcuuccucugcugaggccc

SEQ ID NO: 668534 - RNA, 22 nt, Human
ucaggguccuuccuuugagcug

SEQ ID NO: 668535 - RNA, 18 nt, Human
ucagguggucuguggggc

SEQ ID NO: 668536 - RNA, 21 nt, Human
uccaggucccccugguaggag

SEQ ID NO: 668537 - RNA, 19 nt, Human
ucuccaggagaugcccgcu

SEQ ID NO: 668538 - RNA, 19 nt, Human
ucugaagcuggaguggggg

SEQ ID NO: 668539 - RNA, 25 nt, Human
ugagaccaaaugucugccugucucc

SEQ ID NO: 668540 - RNA, 18 nt, Human
ugagagagggacugaggg

SEQ ID NO: 668541 - RNA, 20 nt, Human
ugagcugcagccagccauag

SEQ ID NO: 668542 - RNA, 18 nt, Human
ugaggcaguagagaccug

SEQ ID NO: 668543 - RNA, 20 nt, Human
ugcuuccucugcugaggccc

SEQ ID NO: 668544 - RNA, 21 nt, Human
ugcuuccucugcugaggcccc

SEQ ID NO: 668545 - RNA, 18 nt, Human
uggagugggggcuccuuu

SEQ ID NO: 668546 - RNA, 20 nt, Human
uggagugggggcuccuuuag

SEQ ID NO: 668547 - RNA, 23 nt, Human
uggggggugggugggaaggauca

SEQ ID NO: 668548 - RNA, 18 nt, Human
ugucucagguggucugug

SEQ ID NO: 668549 - RNA, 25 nt, Human
aacaauaccaguaagguuuaacaau

SEQ ID NO: 668550 - RNA, 23 nt, Human
acagaaaagaaauaucccuucca

SEQ ID NO: 668551 - RNA, 21 nt, Human
agaacaaaagaaaccuauggg

SEQ ID NO: 668552 - RNA, 22 nt, Human
auugcaauaaaccuuuaggaaa

SEQ ID NO: 668553 - RNA, 19 nt, Human
caucauaacacuccaaacc

SEQ ID NO: 668554 - RNA, 21 nt, Human
cccgcccagcauccgcucacu

SEQ ID NO: 668555 - RNA, 23 nt, Human
cgaaacagaauccacaucuaugu

SEQ ID NO: 668556 - RNA, 25 nt, Human
cucagaacaaaagaaaccuauggga

SEQ ID NO: 668557 - RNA, 21 nt, Human
cuucaagaggcguaucaggaa

SEQ ID NO: 668558 - RNA, 22 nt, Human
cuugaaagaacagaagucaaga

SEQ ID NO: 668559 - RNA, 22 nt, Human
gaaacagaauccacaucuaugu

SEQ ID NO: 668560 - RNA, 18 nt, Human
gaaagaacagaagucaag

SEQ ID NO: 668561 - RNA, 22 nt, Human
gaacaaaagaaaccuaugggaa

SEQ ID NO: 668562 - RNA, 19 nt, Human
gaagagugccccgcccagc

SEQ ID NO: 668563 - RNA, 18 nt, Human
guccuuuggcauauguua

SEQ ID NO: 668564 - RNA, 24 nt, Human
gugaugccagacauggucuacaag

SEQ ID NO: 668565 - RNA, 20 nt, Human
ucauaacacuccaaaccuga

SEQ ID NO: 668566 - RNA, 19 nt, Human
ugaaagaacagaagucaag

SEQ ID NO: 668567 - RNA, 20 nt, Human
ugaaagaacagaagucaaga

SEQ ID NO: 668568 - RNA, 27 nt, Human
ugagggagacgggaugguuggggaggc

SEQ ID NO: 668569 - RNA, 21 nt, Human
uggaacaauaccaguaagguu

SEQ ID NO: 668570 - RNA, 20 nt, Human
uggaagagugccccgcccag

SEQ ID NO: 668571 - RNA, 21 nt, Human
uggaagagugccccgcccagc

SEQ ID NO: 668572 - RNA, 19 nt, Human
ugggaacuuacgaaacaga

SEQ ID NO: 668573 - RNA, 20 nt, Human
ugggaagagcaauagccugu

SEQ ID NO: 668574 - RNA, 25 nt, Human
agaagaagaagcaacagucuucuag

SEQ ID NO: 668575 - RNA, 20 nt, Human
aggaggaaaaugagaaccca

SEQ ID NO: 668576 - RNA, 26 nt, Human
cccacugguagaagaagaagcaacag

SEQ ID NO: 668577 - RNA, 22 nt, Human
gaagaagcaacagucuucuagg

SEQ ID NO: 668578 - RNA, 23 nt, Human
uaggaggaaaaugagaacccacu

SEQ ID NO: 668579 - RNA, 18 nt, Human
ucuugcauuaaaugagga

SEQ ID NO: 668580 - RNA, 19 nt, Human
ugaagaagcugaauccaag

SEQ ID NO: 668581 - RNA, 21 nt, Human
ugaagaagcugaauccaagug

SEQ ID NO: 668582 - RNA, 21 nt, Human
uggaagcuucugaguaugagg

SEQ ID NO: 668583 - RNA, 21 nt, Human
uucaaggggggaggaaaaaag

SEQ ID NO: 668584 - RNA, 20 nt, Human
uuuggaagcuucugaguaug

SEQ ID NO: 668585 - RNA, 19 nt, Human
uuuuuuuuuuuuuuucugu

SEQ ID NO: 668586 - RNA, 20 nt, Human
uuuuuuuuuuuuuuuucugg

SEQ ID NO: 668587 - RNA, 23 nt, Human
auccaaaguaagucucucccuuc

SEQ ID NO: 668588 - RNA, 22 nt, Human
caaaggcucuuuaucuuccaga

SEQ ID NO: 668589 - RNA, 19 nt, Human
cacucacagaugacagggc

SEQ ID NO: 668590 - RNA, 21 nt, Human
cacugugccacacucacagau

SEQ ID NO: 668591 - RNA, 22 nt, Human
ccaaaggcucuuuaucuuccag

SEQ ID NO: 668592 - RNA, 20 nt, Human
gaugacagggcuugcgguac

SEQ ID NO: 668593 - RNA, 21 nt, Human
ucuccaggccuucacugugcc

SEQ ID NO: 668594 - RNA, 20 nt, Human
ugacucuccaggccuucacu

SEQ ID NO: 668595 - RNA, 23 nt, Human
aaagagcagguaucauccaaaca

SEQ ID NO: 668596 - RNA, 21 nt, Human
aauucuuuuuguacaacacau

SEQ ID NO: 668597 - RNA, 20 nt, Human
accgauagugucuggugguu

SEQ ID NO: 668598 - RNA, 26 nt, Human
accgauagugucuggugguuucuccc

SEQ ID NO: 668599 - RNA, 23 nt, Human
augugcagcagccauuucugauu

SEQ ID NO: 668600 - RNA, 20 nt, Human
caccagaacucccuaagcaa

SEQ ID NO: 668601 - RNA, 23 nt, Human
caccagagaugaccgauaguguc

SEQ ID NO: 668602 - RNA, 24 nt, Human
cagaacucccuaagcaaucuuucc

SEQ ID NO: 668603 - RNA, 19 nt, Human
cccguugcgcuccaaggcc

SEQ ID NO: 668604 - RNA, 24 nt, Human
cuaaugcuguugauuucauuuguu

SEQ ID NO: 668605 - RNA, 19 nt, Human
cucccuaagcaaucuuucc

SEQ ID NO: 668606 - RNA, 23 nt, Human
cugaaauaaagagcagguaucau

SEQ ID NO: 668607 - RNA, 18 nt, Human
gccuaaacuucuggcugc

SEQ ID NO: 668608 - RNA, 22 nt, Human
gccuaaacuucuggcugcuugc

SEQ ID NO: 668609 - RNA, 20 nt, Human
ggccaggaccagcugcuggu

SEQ ID NO: 668610 - RNA, 24 nt, Human
uaaacuucuggcugcuugcugcuu

SEQ ID NO: 668611 - RNA, 22 nt, Human
uaaagagcagguaucauccaaa

SEQ ID NO: 668612 - RNA, 24 nt, Human
uaaagagcagguaucauccaaacc

SEQ ID NO: 668613 - RNA, 24 nt, Human
ucucauccugaaauaaagagcagg

SEQ ID NO: 668614 - RNA, 19 nt, Human
ucuugcuguggaguaaggu

SEQ ID NO: 668615 - RNA, 18 nt, Human
ugacaccagagaugaccg

SEQ ID NO: 668616 - RNA, 21 nt, Human
ugaccgauagugucugguggu

SEQ ID NO: 668617 - RNA, 20 nt, Human
ugcgcuccaaggccaggacc

SEQ ID NO: 668618 - RNA, 24 nt, Human
uggaaagcuaaacauugauaacca

SEQ ID NO: 668619 - RNA, 20 nt, Human
uggaguaaggugaccaaugg

SEQ ID NO: 668620 - RNA, 19 nt, Human
ugguguuuuucuugggcuu

SEQ ID NO: 668621 - RNA, 23 nt, Human
ugucuggugguuucucccucuca

SEQ ID NO: 668622 - RNA, 26 nt, Human
uuuuaugugcagcagccauuucugau

SEQ ID NO: 668623 - RNA, 20 nt, Human
aaaaucacauagucaaacua

SEQ ID NO: 668624 - RNA, 21 nt, Human
aaaaugcuucuuuccugucca

SEQ ID NO: 668625 - RNA, 20 nt, Human
aaaugcuucuuuccugucca

SEQ ID NO: 668626 - RNA, 21 nt, Human
aggccauauuugcuuugugaa

SEQ ID NO: 668627 - RNA, 21 nt, Human
agugugggggguggaaaggga

SEQ ID NO: 668628 - RNA, 21 nt, Human
auagaacaaauuugaauuaca

SEQ ID NO: 668629 - RNA, 20 nt, Human
aucacauagucaaacuaaaa

SEQ ID NO: 668630 - RNA, 22 nt, Human
aucauuucgagcaaagacaauu

SEQ ID NO: 668631 - RNA, 20 nt, Human
auuaguuuauuuuuuaacca

SEQ ID NO: 668632 - RNA, 20 nt, Human
cacgcacauugcugugcaca

SEQ ID NO: 668633 - RNA, 22 nt, Human
cagcccuugagucaaggcucaa

SEQ ID NO: 668634 - RNA, 19 nt, Human
cccacgcacauugcugugc

SEQ ID NO: 668635 - RNA, 22 nt, Human
cccacgcacauugcugugcaca

SEQ ID NO: 668636 - RNA, 23 nt, Human
ccucacagaauuuccuaaugaaa

SEQ ID NO: 668637 - RNA, 25 nt, Human
ccuuccaauaaaacacuugauucca

SEQ ID NO: 668638 - RNA, 21 nt, Human
cgagccccaagaagauuaaaa

SEQ ID NO: 668639 - RNA, 20 nt, Human
cucaaggguacaacugcacc

SEQ ID NO: 668640 - RNA, 19 nt, Human
cugugcacaggugcuugca

SEQ ID NO: 668641 - RNA, 20 nt, Human
gaaaauucaagcucgagaac

SEQ ID NO: 668642 - RNA, 24 nt, Human
gaacaaauuugaauuacaggccau

SEQ ID NO: 668643 - RNA, 18 nt, Human
gacaauuuucugcaugua

SEQ ID NO: 668644 - RNA, 21 nt, Human
gcagacccagaaaucugguua

SEQ ID NO: 668645 - RNA, 21 nt, Human
gcccucaaggcauuuuucugu

SEQ ID NO: 668646 - RNA, 18 nt, Human
gcuugcagagaaguuuug

SEQ ID NO: 668647 - RNA, 23 nt, Human
guccuuuuccuuucaacugccgg

SEQ ID NO: 668648 - RNA, 21 nt, Human
guggcagacccagaaaucugg

SEQ ID NO: 668649 - RNA, 22 nt, Human
ucacauagaacaaauuugaauu

SEQ ID NO: 668650 - RNA, 22 nt, Human
ucacuccacugaggugaaugac

SEQ ID NO: 668651 - RNA, 21 nt, Human
ucagaaaaugcuucuuuccug

SEQ ID NO: 668652 - RNA, 26 nt, Human
ucucacagaugcccacgcacauugcu

SEQ ID NO: 668653 - RNA, 18 nt, Human
ugaggugaaugacaaacu

SEQ ID NO: 668654 - RNA, 23 nt, Human
ugaguuuuuacucagagaguauc

SEQ ID NO: 668655 - RNA, 23 nt, Human
ugcauguaugaguuuuucccucg

SEQ ID NO: 668656 - RNA, 22 nt, Human
ugcuugcagagaaguuuugucu

SEQ ID NO: 668657 - RNA, 23 nt, Human
ugguuacaagcuccucacagaau

SEQ ID NO: 668658 - RNA, 21 nt, Human
ugugaacacgcaccaagugug

SEQ ID NO: 668659 - RNA, 18 nt, Human
ugugcacaggugcuugca

SEQ ID NO: 668660 - RNA, 24 nt, Human
uguuuugccuauauuuugcccuca

SEQ ID NO: 668661 - RNA, 20 nt, Human
uuucaacugccgguguuugc

SEQ ID NO: 668662 - RNA, 22 nt, Human
uuuccagauauucagauggagg

SEQ ID NO: 668663 - RNA, 24 nt, Human
uuugcccucaaggcauuuuucugu

SEQ ID NO: 668664 - RNA, 25 nt, Human
aaaaacaaggggaaggggcucugac

SEQ ID NO: 668665 - RNA, 20 nt, Human
aaaaacucucccacccaaag

SEQ ID NO: 668666 - RNA, 23 nt, Human
aaaaacucucccacccaaagagc

SEQ ID NO: 668667 - RNA, 19 nt, Human
aaaacucucccacccaagg

SEQ ID NO: 668668 - RNA, 18 nt, Human
aaaagauccaugcucccc

SEQ ID NO: 668669 - RNA, 19 nt, Human
aaacccccacagcacaacc

SEQ ID NO: 668670 - RNA, 20 nt, Human
aaagacacaaaauggccaua

SEQ ID NO: 668671 - RNA, 22 nt, Human
aaagcccccaaauuuaggcccc

SEQ ID NO: 668672 - RNA, 24 nt, Human
aaaugccaaggaagcagcuuaaaa

SEQ ID NO: 668673 - RNA, 21 nt, Human
aagauccaugcucccccggga

SEQ ID NO: 668674 - RNA, 23 nt, Human
aagcccccaaauuuaggccccaa

SEQ ID NO: 668675 - RNA, 21 nt, Human
aaucuuccccuccuuccacug

SEQ ID NO: 668676 - RNA, 20 nt, Human
acacggagagguugcccaaa

SEQ ID NO: 668677 - RNA, 21 nt, Human
acccaaacccccacagcacaa

SEQ ID NO: 668678 - RNA, 19 nt, Human
acccaaagagccaaagagg

SEQ ID NO: 668679 - RNA, 21 nt, Human
acccugcucccuucccucaaa

SEQ ID NO: 668680 - RNA, 21 nt, Human
agacacaaaauggccauaacc

SEQ ID NO: 668681 - RNA, 24 nt, Human
agacacaaaauggccauaaccuag

SEQ ID NO: 668682 - RNA, 21 nt, Human
agcagcuuaaaacacagcccc

SEQ ID NO: 668683 - RNA, 21 nt, Human
agcccccgguccacucaccuc

SEQ ID NO: 668684 - RNA, 22 nt, Human
agcccccgguccacucaccucc

SEQ ID NO: 668685 - RNA, 21 nt, Human
agcccucagcccuccccauua

SEQ ID NO: 668686 - RNA, 22 nt, Human
agcggcaagugcugcugugcac

SEQ ID NO: 668687 - RNA, 20 nt, Human
agcuuaaaacacagcccccg

SEQ ID NO: 668688 - RNA, 24 nt, Human
aggacaaaagauccaugcuccccc

SEQ ID NO: 668689 - RNA, 21 nt, Human
caaaagacacaaaauggccau

SEQ ID NO: 668690 - RNA, 19 nt, Human
caaaagauccaugcucccc

SEQ ID NO: 668691 - RNA, 25 nt, Human
caaaagcccccaaauuuaggcccca

SEQ ID NO: 668692 - RNA, 18 nt, Human
caaaaucuuccccuccuu

SEQ ID NO: 668693 - RNA, 24 nt, Human
cacacagcaccaaggggcaguggc

SEQ ID NO: 668694 - RNA, 21 nt, Human
cacaucaaaagccucguuacu

SEQ ID NO: 668695 - RNA, 19 nt, Human
cacucaccuccagcucaac

SEQ ID NO: 668696 - RNA, 21 nt, Human
cacugggaccacacagcacca

SEQ ID NO: 668697 - RNA, 20 nt, Human
cagcacaaccucaaaagaca

SEQ ID NO: 668698 - RNA, 20 nt, Human
cagcccccgguccacucacc

SEQ ID NO: 668699 - RNA, 23 nt, Human
cagccgaggcugcagcuuguauu

SEQ ID NO: 668700 - RNA, 18 nt, Human
cagcggcaagugcugcug

SEQ ID NO: 668701 - RNA, 20 nt, Human
ccaaacccccacagcacaac

SEQ ID NO: 668702 - RNA, 23 nt, Human
ccacagcacaaccucaaaagaca

SEQ ID NO: 668703 - RNA, 21 nt, Human
ccaugcucccccgggaacaga

SEQ ID NO: 668704 - RNA, 21 nt, Human
cccaaacccccacagcacaac

SEQ ID NO: 668705 - RNA, 21 nt, Human
cccacagcacaaccucaaaag

SEQ ID NO: 668706 - RNA, 24 nt, Human
cccacccaaagagccaaagaggug

SEQ ID NO: 668707 - RNA, 20 nt, Human
ccccacagcacaaccucaaa

SEQ ID NO: 668708 - RNA, 21 nt, Human
ccuuacugguggcuaccaggu

SEQ ID NO: 668709 - RNA, 23 nt, Human
ccuuacugguggcuaccagguuu

SEQ ID NO: 668710 - RNA, 23 nt, Human
cuagaaaaaucuaaaaucuggaa

SEQ ID NO: 668711 - RNA, 21 nt, Human
cucaaaagacacaaaauggcc

SEQ ID NO: 668712 - RNA, 21 nt, Human
cuccagcucaacacaucaaaa

SEQ ID NO: 668713 - RNA, 19 nt, Human
cucccuucccucaaaccca

SEQ ID NO: 668714 - RNA, 24 nt, Human
cucucccacccaaagagccaaaga

SEQ ID NO: 668715 - RNA, 21 nt, Human
gaaaaacucucccacccaaag

SEQ ID NO: 668716 - RNA, 23 nt, Human
gacaaaagauccaugcucccccg

SEQ ID NO: 668717 - RNA, 20 nt, Human
gagcaaguguggggcugggg

SEQ ID NO: 668718 - RNA, 24 nt, Human
gcacaaccucaaaagacacaaaau

SEQ ID NO: 668719 - RNA, 21 nt, Human
ggacaaaagauccaugcuccc

SEQ ID NO: 668720 - RNA, 24 nt, Human
ggccauaaccuagaaaaaucuaaa

SEQ ID NO: 668721 - RNA, 22 nt, Human
ggcgacaauaagucaaaaggga

SEQ ID NO: 668722 - RNA, 21 nt, Human
uaaaacacagcccccggucca

SEQ ID NO: 668723 - RNA, 24 nt, Human
uaccagagcgccucauacacaccu

SEQ ID NO: 668724 - RNA, 23 nt, Human
uagaaagcagugaggacaaaaga

SEQ ID NO: 668725 - RNA, 20 nt, Human
uaggccccaacagggcagag

SEQ ID NO: 668726 - RNA, 19 nt, Human
uauaacaguaaaauaaaaa

SEQ ID NO: 668727 - RNA, 24 nt, Human
ucaaaagacacaaaauggccauaa

SEQ ID NO: 668728 - RNA, 20 nt, Human
ucaaaagccucguuacugac

SEQ ID NO: 668729 - RNA, 24 nt, Human
ucaaaagccucguuacugacagac

SEQ ID NO: 668730 - RNA, 19 nt, Human
ucaaacccaaacccccaca

SEQ ID NO: 668731 - RNA, 24 nt, Human
ucaaacccaaacccccacagcaca

SEQ ID NO: 668732 - RNA, 25 nt, Human
ucaaccgccacccugcucccuuccc

SEQ ID NO: 668733 - RNA, 21 nt, Human
ucagagcaaguguggggcugg

SEQ ID NO: 668734 - RNA, 22 nt, Human
ucagcccuccccauuagaaagc

SEQ ID NO: 668735 - RNA, 22 nt, Human
uccagcucaacacaucaaaagc

SEQ ID NO: 668736 - RNA, 22 nt, Human
ucccccgggaacagaaggcagu

SEQ ID NO: 668737 - RNA, 21 nt, Human
ucccucaaacccaaaccccca

SEQ ID NO: 668738 - RNA, 19 nt, Human
uccucaaccgccacccugc

SEQ ID NO: 668739 - RNA, 20 nt, Human
ucuaaaaucuggaaaaacuc

SEQ ID NO: 668740 - RNA, 21 nt, Human
ugcacagaagacaggaaccga

SEQ ID NO: 668741 - RNA, 20 nt, Human
ugccaaggaagcagcuuaaa

SEQ ID NO: 668742 - RNA, 23 nt, Human
ugcccaaaagcccccaaauuuag

SEQ ID NO: 668743 - RNA, 23 nt, Human
ugcuguggggacagggagcccuc

SEQ ID NO: 668744 - RNA, 22 nt, Human
uggaaaaacucucccacccaaa

SEQ ID NO: 668745 - RNA, 24 nt, Human
uggcagccgaggcugcagcuugua

SEQ ID NO: 668746 - RNA, 21 nt, Human
uggcgacaauaagucaaaaga

SEQ ID NO: 668747 - RNA, 18 nt, Human
ugggaccacacagcacca

SEQ ID NO: 668748 - RNA, 20 nt, Human
uggggcccaaucgagugugg

SEQ ID NO: 668749 - RNA, 21 nt, Human
uuccaaaaucuuccccuccuu

SEQ ID NO: 668750 - RNA, 22 nt, Human
uuuucagagcaaguguggggcu

SEQ ID NO: 668751 - RNA, 23 nt, Human
aaaaaagagacagugagagagaa

SEQ ID NO: 668752 - RNA, 18 nt, Human
aaaagguccuccaacccc

SEQ ID NO: 668753 - RNA, 20 nt, Human
aacacaaugcucccccacug

SEQ ID NO: 668754 - RNA, 22 nt, Human
aacaguccagcugcaccuuggu

SEQ ID NO: 668755 - RNA, 26 nt, Human
aagagacagugagagagaaaucaggc

SEQ ID NO: 668756 - RNA, 20 nt, Human
aaguccucggggucaggagg

SEQ ID NO: 668757 - RNA, 19 nt, Human
acacagaaaagguccucca

SEQ ID NO: 668758 - RNA, 20 nt, Human
acacugucugacacagacaa

SEQ ID NO: 668759 - RNA, 23 nt, Human
agaaacucagggcuucccuggcc

SEQ ID NO: 668760 - RNA, 27 nt, Human
agacacccacaacacaaagugguccca

SEQ ID NO: 668761 - RNA, 22 nt, Human
agacagugagagagaaaucagg

SEQ ID NO: 668762 - RNA, 22 nt, Human
agagagaaaucaggcccccugg

SEQ ID NO: 668763 - RNA, 20 nt, Human
aggccgaggccggcgucuga

SEQ ID NO: 668764 - RNA, 21 nt, Human
cacacagacacccacaacaca

SEQ ID NO: 668765 - RNA, 20 nt, Human
cacaucgcucaggccggucc

SEQ ID NO: 668766 - RNA, 20 nt, Human
caccagagagaccagaccaa

SEQ ID NO: 668767 - RNA, 24 nt, Human
cacccacaacacaaugcuccccuu

SEQ ID NO: 668768 - RNA, 27 nt, Human
cagacacccacaacacaaugcuccccc

SEQ ID NO: 668769 - RNA, 20 nt, Human
caggccgguccaugugccag

SEQ ID NO: 668770 - RNA, 26 nt, Human
caugcuggcgcgggcugggggugcgg

SEQ ID NO: 668771 - RNA, 21 nt, Human
ccaccagagagaccagaccaa

SEQ ID NO: 668772 - RNA, 23 nt, Human
ccaccagagagaccagaccaagu

SEQ ID NO: 668773 - RNA, 29 nt, Human
ccaucaauggugacagacaagguccccuu

SEQ ID NO: 668774 - RNA, 19 nt, Human
ccaugugccaggccgcucc

SEQ ID NO: 668775 - RNA, 24 nt, Human
cccacaacacaaugcucccccacu

SEQ ID NO: 668776 - RNA, 20 nt, Human
cccagccucugccccugagc

SEQ ID NO: 668777 - RNA, 25 nt, Human
cccagccucugccccugagccuggc

SEQ ID NO: 668778 - RNA, 19 nt, Human
cccagcugagcugcaugac

SEQ ID NO: 668779 - RNA, 21 nt, Human
ccccccauggggcagagccgu

SEQ ID NO: 668780 - RNA, 27 nt, Human
ccccgccagaaacucagggcuucccug

SEQ ID NO: 668781 - RNA, 24 nt, Human
ccccuagaaagcugggccucgcag

SEQ ID NO: 668782 - RNA, 20 nt, Human
ccucauaucacauucccagg

SEQ ID NO: 668783 - RNA, 22 nt, Human
ccugagccuggccccagucggc

SEQ ID NO: 668784 - RNA, 20 nt, Human
ccugcugguugggggcuguu

SEQ ID NO: 668785 - RNA, 20 nt, Human
ccuggccccagucggccuca

SEQ ID NO: 668786 - RNA, 22 nt, Human
ccuuaaaacucugggguuguag

SEQ ID NO: 668787 - RNA, 18 nt, Human
cgcuccugcugguugggg

SEQ ID NO: 668788 - RNA, 21 nt, Human
cucaucgcccaggccgaggcc

SEQ ID NO: 668789 - RNA, 23 nt, Human
cugaggcuggggaggcacuuuug

SEQ ID NO: 668790 - RNA, 24 nt, Human
cugaggcuggggaggcacuuuugg

SEQ ID NO: 668791 - RNA, 20 nt, Human
cugccccugagccuggcccc

SEQ ID NO: 668792 - RNA, 21 nt, Human
cuggccucgcagcccucgcca

SEQ ID NO: 668793 - RNA, 23 nt, Human
gcgcggugggguggggaggcugg

SEQ ID NO: 668794 - RNA, 21 nt, Human
gcggugggguggggaggcugg

SEQ ID NO: 668795 - RNA, 21 nt, Human
gcggugggguggggaggcugg

SEQ ID NO: 668796 - RNA, 21 nt, Human
gcuguuuucuucucugauugu

SEQ ID NO: 668797 - RNA, 22 nt, Human
ggacacugucugacacagacaa

SEQ ID NO: 668798 - RNA, 18 nt, Human
ggagugucagugaccacg

SEQ ID NO: 668799 - RNA, 20 nt, Human
ggccggggcuagggccgcgg

SEQ ID NO: 668800 - RNA, 20 nt, Human
gggagugucagugaccacgu

SEQ ID NO: 668801 - RNA, 22 nt, Human
gggcugaggcuggggaggcacu

SEQ ID NO: 668802 - RNA, 19 nt, Human
gggugcggccggggcuagg

SEQ ID NO: 668803 - RNA, 20 nt, Human
ggugggguggggaggcuggg

SEQ ID NO: 668804 - RNA, 23 nt, Human
gucccagccucugccccugagcc

SEQ ID NO: 668805 - RNA, 23 nt, Human
gugcggugggguggggaggcugg

SEQ ID NO: 668806 - RNA, 18 nt, Human
guggcccucaggacacuc

SEQ ID NO: 668807 - RNA, 18 nt, Human
gugggggcugaggcuggg

SEQ ID NO: 668808 - RNA, 22 nt, Human
guguaaaaaaggccccccaugg

SEQ ID NO: 668809 - RNA, 22 nt, Human
guguguguguguaaugugugug

SEQ ID NO: 668810 - RNA, 25 nt, Human
guuguagccaccagagagaccagac

SEQ ID NO: 668811 - RNA, 27 nt, Human
uaaaaaaggccccccauggggcagagc

SEQ ID NO: 668812 - RNA, 18 nt, Human
uaagcagcucccagcuga

SEQ ID NO: 668813 - RNA, 27 nt, Human
ucaauggugacagacaagguccccgag

SEQ ID NO: 668814 - RNA, 22 nt, Human
ucagugaccacguggcccucag

SEQ ID NO: 668815 - RNA, 19 nt, Human
ucaugcuggcgcgggcugg

SEQ ID NO: 668816 - RNA, 22 nt, Human
ucccagggagggacacuguccu

SEQ ID NO: 668817 - RNA, 19 nt, Human
ucccccacugcucagcccc

SEQ ID NO: 668818 - RNA, 19 nt, Human
uccccuagaaagcugggcc

SEQ ID NO: 668819 - RNA, 23 nt, Human
uccuuaaaacucugggguuguag

SEQ ID NO: 668820 - RNA, 18 nt, Human
ugacagacaagguccccg

SEQ ID NO: 668821 - RNA, 26 nt, Human
ugagagagaaaucaggcccccuggga

SEQ ID NO: 668822 - RNA, 25 nt, Human
uggcacauuuguguguguguguguu

SEQ ID NO: 668823 - RNA, 18 nt, Human
uggcuuggguggagugca

SEQ ID NO: 668824 - RNA, 22 nt, Human
ugggggcugaggcuggggaggc

SEQ ID NO: 668825 - RNA, 19 nt, Human
ugggguggggaggcugggc

SEQ ID NO: 668826 - RNA, 19 nt, Human
ugggguggggaggcugggc

SEQ ID NO: 668827 - RNA, 33 nt, Human
uggguguggcacauuuguguguguguguguggu

SEQ ID NO: 668828 - RNA, 21 nt, Human
ugucacauuccagggagggac

SEQ ID NO: 668829 - RNA, 20 nt, Human
ugucccagccucugccccug

SEQ ID NO: 668830 - RNA, 24 nt, Human
ugucucaucgcccaggccgaggcc

SEQ ID NO: 668831 - RNA, 27 nt, Human
ugucuggguguggcacauuugugugug

SEQ ID NO: 668832 - RNA, 21 nt, Human
uguggcacauuugugugugug

SEQ ID NO: 668833 - RNA, 33 nt, Human
uguggcacauuuguguguguguguguguguggu

SEQ ID NO: 668834 - RNA, 19 nt, Human
uguggcuggaggugggggc

SEQ ID NO: 668835 - RNA, 18 nt, Human
uguguggcuggagguggg

SEQ ID NO: 668836 - RNA, 18 nt, Human
uguguguguaaugugugu

SEQ ID NO: 668837 - RNA, 22 nt, Human
uguguguguggcuggagguggg

SEQ ID NO: 668838 - RNA, 21 nt, Human
uguguguguguaaugugugug

SEQ ID NO: 668839 - RNA, 22 nt, Human
uguguguguguaaugugugugu

SEQ ID NO: 668840 - RNA, 21 nt, Human
uguguguguguguaaugugug

SEQ ID NO: 668841 - RNA, 22 nt, Human
uguguguguguguaaugugugu

SEQ ID NO: 668842 - RNA, 22 nt, Human
uguguguguguguguaaugugu

SEQ ID NO: 668843 - RNA, 24 nt, Human
uguguguguguguguaaugugugu

SEQ ID NO: 668844 - RNA, 22 nt, Human
uguguguguguguguguaaugu

SEQ ID NO: 668845 - RNA, 24 nt, Human
uguguguguguguguguaaugugu

SEQ ID NO: 668846 - RNA, 18 nt, Human
ugugugugugugugugug

SEQ ID NO: 668847 - RNA, 18 nt, Human
ugugugugugugugugug

SEQ ID NO: 668848 - RNA, 18 nt, Human
ugugugugugugugugug

SEQ ID NO: 668849 - RNA, 20 nt, Human
ugugugugugugugugugua

SEQ ID NO: 668850 - RNA, 23 nt, Human
uguguguguguguguguguaaug

SEQ ID NO: 668851 - RNA, 21 nt, Human
ugugugugugugugugugugu

SEQ ID NO: 668852 - RNA, 21 nt, Human
ugugugugugugugugugugu

SEQ ID NO: 668853 - RNA, 23 nt, Human
uguguguguguguguguguguaa

SEQ ID NO: 668854 - RNA, 23 nt, Human
ugugugugugugugugugugugu

SEQ ID NO: 668855 - RNA, 19 nt, Human
uucacuucacccccaaggc

SEQ ID NO: 668856 - RNA, 24 nt, Human
uuugugugugugugugugugugug

SEQ ID NO: 668857 - RNA, 24 nt, Human
ccaagccgggugacagcccuuucc

SEQ ID NO: 668858 - RNA, 23 nt, Human
cugugugccuacguauccucccc

SEQ ID NO: 668859 - RNA, 19 nt, Human
gguguggaaggggccaagc

SEQ ID NO: 668860 - RNA, 22 nt, Human
uggaaggggccaagccggguga

SEQ ID NO: 668861 - RNA, 21 nt, Human
aaccccucggcccaccgcucc

SEQ ID NO: 668862 - RNA, 22 nt, Human
accacauacaaacccagccuug

SEQ ID NO: 668863 - RNA, 20 nt, Human
accucgcucccccgccccac

SEQ ID NO: 668864 - RNA, 20 nt, Human
caaacccagccuuggugcuc

SEQ ID NO: 668865 - RNA, 23 nt, Human
caaccccucggcccaccgcuccu

SEQ ID NO: 668866 - RNA, 19 nt, Human
cacauuguccccaauuacu

SEQ ID NO: 668867 - RNA, 19 nt, Human
caccacauacaaacccagc

SEQ ID NO: 668868 - RNA, 18 nt, Human
caccuccaaccccucggc

SEQ ID NO: 668869 - RNA, 25 nt, Human
ccacauacaaacccagccuuggugc

SEQ ID NO: 668870 - RNA, 22 nt, Human
ccaccucgcucccccgccccac

SEQ ID NO: 668871 - RNA, 26 nt, Human
cccacagcccgagguccuccuggggc

SEQ ID NO: 668872 - RNA, 24 nt, Human
ccccacuccccgacuccgcucucc

SEQ ID NO: 668873 - RNA, 21 nt, Human
ccccgccccacuccccgacuc

SEQ ID NO: 668874 - RNA, 22 nt, Human
ccccggcgccaccucgcucccc

SEQ ID NO: 668875 - RNA, 26 nt, Human
ccgacuccgcucucccggcccacugu

SEQ ID NO: 668876 - RNA, 18 nt, Human
ccgccccacuccccgacu

SEQ ID NO: 668877 - RNA, 24 nt, Human
ccucgcucccccgccccacucccc

SEQ ID NO: 668878 - RNA, 21 nt, Human
cgacuccgcucucccggccca

SEQ ID NO: 668879 - RNA, 24 nt, Human
cuccgcucucccggcccacagccc

SEQ ID NO: 668880 - RNA, 20 nt, Human
cucggcccaccgcuccuucc

SEQ ID NO: 668881 - RNA, 21 nt, Human
gacuccgcucucccggcccac

SEQ ID NO: 668882 - RNA, 23 nt, Human
gagguccuccuggggccccaccu

SEQ ID NO: 668883 - RNA, 22 nt, Human
gccaccucgcucccccgcccca

SEQ ID NO: 668884 - RNA, 26 nt, Human
gccccaccuccaaccccucggcccac

SEQ ID NO: 668885 - RNA, 19 nt, Human
guggcgcgcgccgcgaacc

SEQ ID NO: 668886 - RNA, 22 nt, Human
uccccggcgccaccucgcuccc

SEQ ID NO: 668887 - RNA, 22 nt, Human
uccgcgcuaccgcgugaacaga

SEQ ID NO: 668888 - RNA, 20 nt, Human
uccuggggccccaccuccaa

SEQ ID NO: 668889 - RNA, 21 nt, Human
ucgcucccccgccccacuccc

SEQ ID NO: 668890 - RNA, 26 nt, Human
uguguuuauucccccaccacauacaa

SEQ ID NO: 668891 - RNA, 22 nt, Human
uucccccaccacauacaaaccc

SEQ ID NO: 668892 - RNA, 24 nt, Human
uucccccaccacauacaaacccag

SEQ ID NO: 668893 - RNA, 24 nt, Human
uuuuuuuuuuuuuuuuuuaauuuu

SEQ ID NO: 668894 - RNA, 21 nt, Human
aggggaagggagggcaggggc

SEQ ID NO: 668895 - RNA, 23 nt, Human
gggacaggggaagggagggcagg

SEQ ID NO: 668896 - RNA, 18 nt, Human
ggggaagggagggcaggg

SEQ ID NO: 668897 - RNA, 19 nt, Human
ggggacggggacaggggaa

SEQ ID NO: 668898 - RNA, 23 nt, Human
ggggacggggacaggggaaggga

SEQ ID NO: 668899 - RNA, 30 nt, Human
aaaaagaagcacacacacacacacacacag

SEQ ID NO: 668900 - RNA, 30 nt, Human
aaagaagcacacacacacacacacacacag

SEQ ID NO: 668901 - RNA, 30 nt, Human
aagaagcacacacacacacacacacacaca

SEQ ID NO: 668902 - RNA, 22 nt, Human
aaguggaccauaagguguaugg

SEQ ID NO: 668903 - RNA, 23 nt, Human
acacacacacacacacacacaca

SEQ ID NO: 668904 - RNA, 23 nt, Human
acacacacacacacacacacaca

SEQ ID NO: 668905 - RNA, 23 nt, Human
acacacacacacacacacacaca

SEQ ID NO: 668906 - RNA, 23 nt, Human
acacacacacacacacacacaca

SEQ ID NO: 668907 - RNA, 23 nt, Human
acacacacacacacacacacaca

SEQ ID NO: 668908 - RNA, 23 nt, Human
acacacacacacacacacacaca

SEQ ID NO: 668909 - RNA, 23 nt, Human
acacacacacacacacacacaca

SEQ ID NO: 668910 - RNA, 23 nt, Human
acacacacacacacacacacaca

SEQ ID NO: 668911 - RNA, 23 nt, Human
acacacacacacacacacacaca

SEQ ID NO: 668912 - RNA, 23 nt, Human
acacacacacacacacaugcgcg

SEQ ID NO: 668913 - RNA, 23 nt, Human
acacacacacacacaugcgcgcg

SEQ ID NO: 668914 - RNA, 27 nt, Human
acacacacacacaugcgcgcgcgcuuu

SEQ ID NO: 668915 - RNA, 21 nt, Human
acacacacacaugcgcgcgcg

SEQ ID NO: 668916 - RNA, 22 nt, Human
acagcucagcaacaugaacauc

SEQ ID NO: 668917 - RNA, 25 nt, Human
agagaagaaauacagucccuuugga

SEQ ID NO: 668918 - RNA, 20 nt, Human
agguuccaucccucuucagg

SEQ ID NO: 668919 - RNA, 20 nt, Human
cacacacacacacacacaca

SEQ ID NO: 668920 - RNA, 20 nt, Human
cacacacacacacacacaca

SEQ ID NO: 668921 - RNA, 20 nt, Human
cacacacacacacacacaca

SEQ ID NO: 668922 - RNA, 20 nt, Human
cacacacacacacacacaca

SEQ ID NO: 668923 - RNA, 20 nt, Human
cacacacacacacacacaca

SEQ ID NO: 668924 - RNA, 20 nt, Human
cacacacacacacacacaca

SEQ ID NO: 668925 - RNA, 20 nt, Human
cacacacacacacacacaca

SEQ ID NO: 668926 - RNA, 20 nt, Human
cacacacacacacacacaca

SEQ ID NO: 668927 - RNA, 20 nt, Human
cacacacacacacacacaca

SEQ ID NO: 668928 - RNA, 20 nt, Human
cacacacacacacacacaca

SEQ ID NO: 668929 - RNA, 20 nt, Human
cacacacacacacacacaca

SEQ ID NO: 668930 - RNA, 22 nt, Human
cacacacacacacacacacaca

SEQ ID NO: 668931 - RNA, 26 nt, Human
cacacacacacacacacacacacaca

SEQ ID NO: 668932 - RNA, 26 nt, Human
cacacacacacacacacacacacaca

SEQ ID NO: 668933 - RNA, 26 nt, Human
cacacacacacacacacacacacaca

SEQ ID NO: 668934 - RNA, 26 nt, Human
cacacacacacacacacacacacaca

SEQ ID NO: 668935 - RNA, 26 nt, Human
cacacacacacacacacacacacaug

SEQ ID NO: 668936 - RNA, 26 nt, Human
cacacacacacacacacacacaugcg

SEQ ID NO: 668937 - RNA, 19 nt, Human
caugaaguggaccauaagg

SEQ ID NO: 668938 - RNA, 24 nt, Human
cccgccaccacugccgggaauacg

SEQ ID NO: 668939 - RNA, 19 nt, Human
cccgcgggcgccgccgccg

SEQ ID NO: 668940 - RNA, 23 nt, Human
cccgcgggcgccgccgccgcccc

SEQ ID NO: 668941 - RNA, 20 nt, Human
ccgcccccgccaccacugcc

SEQ ID NO: 668942 - RNA, 25 nt, Human
ccgccgcccccgccaccacugccgg

SEQ ID NO: 668943 - RNA, 20 nt, Human
ccgccgccgcccccgccacc

SEQ ID NO: 668944 - RNA, 21 nt, Human
ccgccgccgcccccgccacca

SEQ ID NO: 668945 - RNA, 21 nt, Human
ccgcgggcgccgccgccgccc

SEQ ID NO: 668946 - RNA, 18 nt, Human
cgaugggguccgcagccg

SEQ ID NO: 668947 - RNA, 23 nt, Human
cucccgcgccuuccucucccugc

SEQ ID NO: 668948 - RNA, 22 nt, Human
cugacccagagguuccaucccu

SEQ ID NO: 668949 - RNA, 21 nt, Human
cuugccaaggcuggaaccucc

SEQ ID NO: 668950 - RNA, 22 nt, Human
gcacauucacugauaaaacauc

SEQ ID NO: 668951 - RNA, 18 nt, Human
gcgccgccgccgcccccg

SEQ ID NO: 668952 - RNA, 19 nt, Human
ggaaagaagcaugauccaa

SEQ ID NO: 668953 - RNA, 23 nt, Human
ggugcuccugcuuacagcucagg

SEQ ID NO: 668954 - RNA, 19 nt, Human
gucugaaaggcacaugaag

SEQ ID NO: 668955 - RNA, 22 nt, Human
uaaaacauccccuauucccucc

SEQ ID NO: 668956 - RNA, 24 nt, Human
uaaaacauccccuauucccuccca

SEQ ID NO: 668957 - RNA, 27 nt, Human
uaauuucagcaaacugauuuccaguac

SEQ ID NO: 668958 - RNA, 27 nt, Human
uccaggaagggccacacuccucuugcc

SEQ ID NO: 668959 - RNA, 22 nt, Human
ucccucccaagaaagcggagau

SEQ ID NO: 668960 - RNA, 21 nt, Human
ucccucuucagguggagcuac

SEQ ID NO: 668961 - RNA, 19 nt, Human
uccgcagccggcugcgggg

SEQ ID NO: 668962 - RNA, 18 nt, Human
ucugaaaggcacaugaag

SEQ ID NO: 668963 - RNA, 23 nt, Human
ugaaaggcacaugaaguggacca

SEQ ID NO: 668964 - RNA, 21 nt, Human
ugaacaucucugaauaugaaa

SEQ ID NO: 668965 - RNA, 19 nt, Human
ugaguguggauuccagcug

SEQ ID NO: 668966 - RNA, 23 nt, Human
ugcuaggaggguguguccagagg

SEQ ID NO: 668967 - RNA, 28 nt, Human
uggcacauucacugauaaaacauccccc

SEQ ID NO: 668968 - RNA, 24 nt, Human
ugugaacacguguuggaaagaagc

SEQ ID NO: 668969 - RNA, 18 nt, Human
uguuugcgucccccuccc

SEQ ID NO: 668970 - RNA, 26 nt, Human
aaaaaaaagacaacuguuaaagaaaa

SEQ ID NO: 668971 - RNA, 28 nt, Human
aaaaaaagcaagagaaagaccgguaccc

SEQ ID NO: 668972 - RNA, 18 nt, Human
aaaauagagucccugguc

SEQ ID NO: 668973 - RNA, 20 nt, Human
aaacuugaaaagaucaagug

SEQ ID NO: 668974 - RNA, 24 nt, Human
aaauccuuuauccuuuagaauguc

SEQ ID NO: 668975 - RNA, 19 nt, Human
aagggucacagaaagacag

SEQ ID NO: 668976 - RNA, 26 nt, Human
agaaaaaaaagacaacuguuaaagaa

SEQ ID NO: 668977 - RNA, 28 nt, Human
agaaaaaaaagacaacuguuaaagaaaa

SEQ ID NO: 668978 - RNA, 18 nt, Human
agauccucaacauaaaac

SEQ ID NO: 668979 - RNA, 22 nt, Human
auucuugauacagaaucaaaag

SEQ ID NO: 668980 - RNA, 24 nt, Human
caaaauagaugcucaaaauaaugc

SEQ ID NO: 668981 - RNA, 21 nt, Human
caagugcaguugauccaggcu

SEQ ID NO: 668982 - RNA, 21 nt, Human
caccucaaaauagaugcucaa

SEQ ID NO: 668983 - RNA, 19 nt, Human
cagcaaaaccaccuguuuc

SEQ ID NO: 668984 - RNA, 25 nt, Human
cgauaacaauacuuaaaugcacuuu

SEQ ID NO: 668985 - RNA, 28 nt, Human
cucaaaauagaugcucaaaauaaugccc

SEQ ID NO: 668986 - RNA, 25 nt, Human
cucaauagcagggaaaaaaaagcaa

SEQ ID NO: 668987 - RNA, 22 nt, Human
cugaauuuagaaaaaaaagaca

SEQ ID NO: 668988 - RNA, 24 nt, Human
cuguuucuuaggaguuucaccaua

SEQ ID NO: 668989 - RNA, 21 nt, Human
cuuaaggcaauauauuuaaau

SEQ ID NO: 668990 - RNA, 24 nt, Human
cuucuuccuccuuuucuaaagccc

SEQ ID NO: 668991 - RNA, 22 nt, Human
gcacauucuuuaguagguccuu

SEQ ID NO: 668992 - RNA, 23 nt, Human
gguggcacauucuuuaguagguc

SEQ ID NO: 668993 - RNA, 23 nt, Human
gucuccuuucucucagcaaacuc

SEQ ID NO: 668994 - RNA, 19 nt, Human
uaaacaucaccucaaaaua

SEQ ID NO: 668995 - RNA, 22 nt, Human
uaaaguaaaucaaaucaccuca

SEQ ID NO: 668996 - RNA, 24 nt, Human
uaagauccucaacauaaaacuuga

SEQ ID NO: 668997 - RNA, 23 nt, Human
uaauaauugauaaaaauguacaa

SEQ ID NO: 668998 - RNA, 23 nt, Human
uacaaaaauauucaaaucagaaa

SEQ ID NO: 668999 - RNA, 19 nt, Human
uacaaauccuuuauccuuu

SEQ ID NO: 669000 - RNA, 23 nt, Human
uagacaaggauauugcaacuauc

SEQ ID NO: 669001 - RNA, 19 nt, Human
uagaucuucaaaauccagc

SEQ ID NO: 669002 - RNA, 21 nt, Human
uagcagggaaaaaaaagcaag

SEQ ID NO: 669003 - RNA, 23 nt, Human
uagcagggaaaaaaaagcaagag

SEQ ID NO: 669004 - RNA, 22 nt, Human
uaguugaucuuuuaguugaacu

SEQ ID NO: 669005 - RNA, 23 nt, Human
uaucgccacaaaaucuucaaaag

SEQ ID NO: 669006 - RNA, 20 nt, Human
ucaaagcaaauuaaugcauc

SEQ ID NO: 669007 - RNA, 21 nt, Human
ucagaacuaauaguuggauac

SEQ ID NO: 669008 - RNA, 26 nt, Human
uccauccuacagugcccugugaaagg

SEQ ID NO: 669009 - RNA, 18 nt, Human
ucuccuuucucucagcaa

SEQ ID NO: 669010 - RNA, 22 nt, Human
ugaaaagaucaagugcaguuga

SEQ ID NO: 669011 - RNA, 19 nt, Human
ugaaagggucacagaaaga

SEQ ID NO: 669012 - RNA, 19 nt, Human
ugaccaagcauauuaguga

SEQ ID NO: 669013 - RNA, 24 nt, Human
ugcuuuaagauccucaacauaaaa

SEQ ID NO: 669014 - RNA, 24 nt, Human
ugugaaagggucacagaaagacag

SEQ ID NO: 669015 - RNA, 21 nt, Human
uuaauccauccuacagugccc

SEQ ID NO: 669016 - RNA, 23 nt, Human
uucagauguuugauaaaaaauaa

SEQ ID NO: 669017 - RNA, 23 nt, Human
uuccagcaaaaccaccuguuucu

SEQ ID NO: 669018 - RNA, 19 nt, Human
uucuuuguccauauuuugu

SEQ ID NO: 669019 - RNA, 23 nt, Human
uugauccaggcugaccaagcaua

SEQ ID NO: 669020 - RNA, 20 nt, Human
uugccaccuuuaauccaucc

SEQ ID NO: 669021 - RNA, 23 nt, Human
uuuaagauccucaacauaaaacu

SEQ ID NO: 669022 - RNA, 21 nt, Human
uuuagaaaaaaaagacaacug

SEQ ID NO: 669023 - RNA, 20 nt, Human
uuucuucuucuuccuccuuu

SEQ ID NO: 669024 - RNA, 23 nt, Human
uuucuucuucuuccuccuuuucu

SEQ ID NO: 669025 - RNA, 21 nt, Human
uuuuucgcugucgucuccuuu

SEQ ID NO: 669026 - RNA, 22 nt, Human
aggcaggaccuccaccaacagc

SEQ ID NO: 669027 - RNA, 21 nt, Human
agguuguuggaagaaccccag

SEQ ID NO: 669028 - RNA, 27 nt, Human
caacagcgcuguaggucccccgaaucg

SEQ ID NO: 669029 - RNA, 19 nt, Human
caccaacagcgcuguaggu

SEQ ID NO: 669030 - RNA, 21 nt, Human
ccaucuauuccuggaggcagg

SEQ ID NO: 669031 - RNA, 23 nt, Human
uccaccaacagcgcuguaggucc

SEQ ID NO: 669032 - RNA, 28 nt, Human
uccaccaacagcgcuguagguccaggcu

SEQ ID NO: 669033 - RNA, 18 nt, Human
uggaagaaccccagagga

SEQ ID NO: 669034 - RNA, 22 nt, Human
uguuggaagaaccccagaggac

SEQ ID NO: 669035 - RNA, 21 nt, Human
uuccuggaggcaggaccucca

SEQ ID NO: 669036 - RNA, 20 nt, Human
uuguuggaagaaccccagag

SEQ ID NO: 669037 - RNA, 21 nt, Human
aaccccgccccaccgggccac

SEQ ID NO: 669038 - RNA, 18 nt, Human
acccgcuccccugacccc

SEQ ID NO: 669039 - RNA, 20 nt, Human
acucugaggggucgcucggg

SEQ ID NO: 669040 - RNA, 22 nt, Human
agcgagagguuguggcggaugc

SEQ ID NO: 669041 - RNA, 20 nt, Human
agcgcgauguacgaggaggg

SEQ ID NO: 669042 - RNA, 24 nt, Human
aggugcccgcccagcaccgcgccc

SEQ ID NO: 669043 - RNA, 25 nt, Human
aggugcccgcccagcaccgcgcccu

SEQ ID NO: 669044 - RNA, 19 nt, Human
auguacgaggaggggggcu

SEQ ID NO: 669045 - RNA, 21 nt, Human
caccgggccaccugcagcccc

SEQ ID NO: 669046 - RNA, 18 nt, Human
cagccccuguacccgcuc

SEQ ID NO: 669047 - RNA, 20 nt, Human
cagccccuguacccgcuccc

SEQ ID NO: 669048 - RNA, 19 nt, Human
ccaccugcagccccggcug

SEQ ID NO: 669049 - RNA, 18 nt, Human
cccggaggcugcgcugcg

SEQ ID NO: 669050 - RNA, 22 nt, Human
cccucugccaccgccugauacc

SEQ ID NO: 669051 - RNA, 21 nt, Human
ccgccgccgcccucgaugugc

SEQ ID NO: 669052 - RNA, 19 nt, Human
ccguuggcgcaguccuccu

SEQ ID NO: 669053 - RNA, 20 nt, Human
ccguuggcgcaguccuccuc

SEQ ID NO: 669054 - RNA, 24 nt, Human
ccuccucgucuucaucuuccuccu

SEQ ID NO: 669055 - RNA, 20 nt, Human
ccucgucuucaucuuccucc

SEQ ID NO: 669056 - RNA, 18 nt, Human
ccugggaggcgggguccc

SEQ ID NO: 669057 - RNA, 19 nt, Human
cgauuuuaccgucuucccc

SEQ ID NO: 669058 - RNA, 20 nt, Human
cgccccaccgggccaccugc

SEQ ID NO: 669059 - RNA, 21 nt, Human
cgccugauaccgcagcagcgc

SEQ ID NO: 669060 - RNA, 20 nt, Human
cgcucgggccgccgccgccc

SEQ ID NO: 669061 - RNA, 21 nt, Human
cgcucgggccgccgccgcccu

SEQ ID NO: 669062 - RNA, 23 nt, Human
cgcugagcgugaggcgcuugugc

SEQ ID NO: 669063 - RNA, 25 nt, Human
cgucuucaucuuccuccucucccaa

SEQ ID NO: 669064 - RNA, 20 nt, Human
cugccaggcggggaacuugc

SEQ ID NO: 669065 - RNA, 22 nt, Human
cuucagaggccgccgcagaccu

SEQ ID NO: 669066 - RNA, 22 nt, Human
gaagcgcaaccccgccccaccg

SEQ ID NO: 669067 - RNA, 20 nt, Human
gacgcggccgacaggugccc

SEQ ID NO: 669068 - RNA, 21 nt, Human
gagcgcgauguacgaggaggg

SEQ ID NO: 669069 - RNA, 21 nt, Human
gcagaccuuggcggugcccug

SEQ ID NO: 669070 - RNA, 25 nt, Human
gcgcagccccuguacccgcuccccu

SEQ ID NO: 669071 - RNA, 19 nt, Human
gcgggcuuugcaggauggc

SEQ ID NO: 669072 - RNA, 24 nt, Human
gcugcgcugcgguguggagcgaag

SEQ ID NO: 669073 - RNA, 18 nt, Human
ggccauggugaugagcgc

SEQ ID NO: 669074 - RNA, 25 nt, Human
ggcucgccgccuccuccucgucuuc

SEQ ID NO: 669075 - RNA, 20 nt, Human
gggaagcgcaaccccgcccc

SEQ ID NO: 669076 - RNA, 24 nt, Human
gggcuuugccggcugccgggcauc

SEQ ID NO: 669077 - RNA, 22 nt, Human
gucgcucgggccgccgccgccc

SEQ ID NO: 669078 - RNA, 27 nt, Human
gucgcucgggccgccgccgcccucgau

SEQ ID NO: 669079 - RNA, 22 nt, Human
uccccaucggagucccggaggc

SEQ ID NO: 669080 - RNA, 23 nt, Human
uccuccuccugaugccgcugcug

SEQ ID NO: 669081 - RNA, 28 nt, Human
uccuccugaugccgcugcuguugcugcc

SEQ ID NO: 669082 - RNA, 23 nt, Human
ucugccaggcggggaacuugcgg

SEQ ID NO: 669083 - RNA, 21 nt, Human
ucuucagaggccgccgcagac

SEQ ID NO: 669084 - RNA, 22 nt, Human
ugacggucgcuggagcaggggg

SEQ ID NO: 669085 - RNA, 23 nt, Human
ugccaaacucugaggggucgcuc

SEQ ID NO: 669086 - RNA, 19 nt, Human
ugcccuugccugggcggcc

SEQ ID NO: 669087 - RNA, 19 nt, Human
ugcgcagccccuguacccg

SEQ ID NO: 669088 - RNA, 21 nt, Human
ugggaggcgggguccaggcuc

SEQ ID NO: 669089 - RNA, 19 nt, Human
ugucgaacauguccuggga

SEQ ID NO: 669090 - RNA, 22 nt, Human
ugucgaacauguccugggaggc

SEQ ID NO: 669091 - RNA, 21 nt, Human
uguggcggaugcuguucugcc

SEQ ID NO: 669092 - RNA, 18 nt, Human
uugcaggauggccauggu

SEQ ID NO: 669093 - RNA, 19 nt, Human
aagggggaggggagggaag

SEQ ID NO: 669094 - RNA, 18 nt, Human
acccuaggaacaagaggg

SEQ ID NO: 669095 - RNA, 19 nt, Human
agaaggcagggccgggacc

SEQ ID NO: 669096 - RNA, 22 nt, Human
agacagcgugggcaggggccug

SEQ ID NO: 669097 - RNA, 25 nt, Human
aggaacaagagggggacacauugac

SEQ ID NO: 669098 - RNA, 20 nt, Human
aggccucagucuccaccccu

SEQ ID NO: 669099 - RNA, 19 nt, Human
aggggagggaagggaggaa

SEQ ID NO: 669100 - RNA, 23 nt, Human
aucauucggauggaagggggagg

SEQ ID NO: 669101 - RNA, 21 nt, Human
cagcgugggcaggggccuggc

SEQ ID NO: 669102 - RNA, 22 nt, Human
ccaagcucccaaggcguggggc

SEQ ID NO: 669103 - RNA, 21 nt, Human
cccaugccaagcucccaaggc

SEQ ID NO: 669104 - RNA, 24 nt, Human
ccuuuggguggccaggcccggcuu

SEQ ID NO: 669105 - RNA, 22 nt, Human
cgggagggaggagcggccccug

SEQ ID NO: 669106 - RNA, 22 nt, Human
cgugggcaggggccuggccggg

SEQ ID NO: 669107 - RNA, 18 nt, Human
gaagggggaggggaggga

SEQ ID NO: 669108 - RNA, 24 nt, Human
gagcaugccgagggcuuccacaau

SEQ ID NO: 669109 - RNA, 20 nt, Human
gagggaagggaggaagaggc

SEQ ID NO: 669110 - RNA, 20 nt, Human
gcccgcacccuaggaacaag

SEQ ID NO: 669111 - RNA, 18 nt, Human
gccgccucccuugcuccc

SEQ ID NO: 669112 - RNA, 18 nt, Human
gccuuuggguggccaggc

SEQ ID NO: 669113 - RNA, 20 nt, Human
ggaagaggcugugggggagg

SEQ ID NO: 669114 - RNA, 24 nt, Human
ggaccugaggccgggcuggggcag

SEQ ID NO: 669115 - RNA, 19 nt, Human
ggagggaggagcggccccu

SEQ ID NO: 669116 - RNA, 22 nt, Human
ggcagagagcauucuagugggg

SEQ ID NO: 669117 - RNA, 21 nt, Human
ggccgggaccugaggccgggc

SEQ ID NO: 669118 - RNA, 23 nt, Human
ggccgggcuggggcaggcgggcu

SEQ ID NO: 669119 - RNA, 21 nt, Human
gggaagggaggaagaggcugu

SEQ ID NO: 669120 - RNA, 18 nt, Human
gggaggggagcaugccga

SEQ ID NO: 669121 - RNA, 23 nt, Human
gggcaggggccuggccgggugga

SEQ ID NO: 669122 - RNA, 30 nt, Human
gggcaggggccuggccggguggagggugcc

SEQ ID NO: 669123 - RNA, 19 nt, Human
gggcaguguagaaggcagg

SEQ ID NO: 669124 - RNA, 21 nt, Human
gggcgguggggcaguguagaa

SEQ ID NO: 669125 - RNA, 27 nt, Human
gggcuggggcaggcgggcuggggccuu

SEQ ID NO: 669126 - RNA, 20 nt, Human
gggggaguauuuagcccaug

SEQ ID NO: 669127 - RNA, 18 nt, Human
ggggugggagcgggaggg

SEQ ID NO: 669128 - RNA, 21 nt, Human
gguggagggugcagggcggug

SEQ ID NO: 669129 - RNA, 21 nt, Human
uaggaacaagagggggacaca

SEQ ID NO: 669130 - RNA, 24 nt, Human
uagugggggcuucuccugaggccu

SEQ ID NO: 669131 - RNA, 24 nt, Human
uaucccgucuucccuggucagguu

SEQ ID NO: 669132 - RNA, 24 nt, Human
ucaaaggggcugcgaugacccaug

SEQ ID NO: 669133 - RNA, 19 nt, Human
ucgcagacagccgccuccc

SEQ ID NO: 669134 - RNA, 18 nt, Human
ugcagggcgguggggcag

SEQ ID NO: 669135 - RNA, 19 nt, Human
ugccuuuggguggccaggc

SEQ ID NO: 669136 - RNA, 23 nt, Human
ugcuaguaggcccugaacuaugg

SEQ ID NO: 669137 - RNA, 23 nt, Human
uggaagggaggggcagagagcau

SEQ ID NO: 669138 - RNA, 20 nt, Human
ugggcaggggccuggccggg

SEQ ID NO: 669139 - RNA, 19 nt, Human
uggggcaggcgggcugggg

SEQ ID NO: 669140 - RNA, 18 nt, Human
ugggggugggagcgggag

SEQ ID NO: 669141 - RNA, 24 nt, Human
ugugggggaggggagcaugccgag

SEQ ID NO: 669142 - RNA, 20 nt, Human
uuagcccaugccaagcuccc

SEQ ID NO: 669143 - RNA, 20 nt, Human
uuccuggaggagaaggccau

SEQ ID NO: 669144 - RNA, 18 nt, Human
aaacacggaacaaugaaa

SEQ ID NO: 669145 - RNA, 25 nt, Human
aaaccaccaaacccaaacuuccagc

SEQ ID NO: 669146 - RNA, 23 nt, Human
aaacuuccagcugcucucagccu

SEQ ID NO: 669147 - RNA, 25 nt, Human
aaauugccccacggggcaggagggu

SEQ ID NO: 669148 - RNA, 22 nt, Human
aacaaugaaacacuguguguac

SEQ ID NO: 669149 - RNA, 22 nt, Human
aaccaccaaacccaaacuucca

SEQ ID NO: 669150 - RNA, 19 nt, Human
aaggcacgccccacgcccc

SEQ ID NO: 669151 - RNA, 20 nt, Human
accaaacccaaacuuccagc

SEQ ID NO: 669152 - RNA, 18 nt, Human
acccaaacuuccagcugc

SEQ ID NO: 669153 - RNA, 23 nt, Human
accccgggggcgccuccuccgaa

SEQ ID NO: 669154 - RNA, 21 nt, Human
acggccucccggacgcgcgcu

SEQ ID NO: 669155 - RNA, 21 nt, Human
agagaccuggggaagcagggg

SEQ ID NO: 669156 - RNA, 22 nt, Human
agagaccuggggaagcaggggg

SEQ ID NO: 669157 - RNA, 19 nt, Human
agccugccccggccccagg

SEQ ID NO: 669158 - RNA, 19 nt, Human
agcuugguugccccggccc

SEQ ID NO: 669159 - RNA, 19 nt, Human
aggcacgccccacgccccc

SEQ ID NO: 669160 - RNA, 21 nt, Human
caaugaaacacuguguguaca

SEQ ID NO: 669161 - RNA, 19 nt, Human
cacagccugccccggcccc

SEQ ID NO: 669162 - RNA, 21 nt, Human
caccaaacccaaacuuccagc

SEQ ID NO: 669163 - RNA, 25 nt, Human
cacgcccccgaggagugcaggcagg

SEQ ID NO: 669164 - RNA, 20 nt, Human
cagcccagggaguccgggug

SEQ ID NO: 669165 - RNA, 22 nt, Human
ccaaaccaccaaacccaaacuu

SEQ ID NO: 669166 - RNA, 19 nt, Human
ccacgggcugagccgggug

SEQ ID NO: 669167 - RNA, 21 nt, Human
cccacgcccccgaggagugca

SEQ ID NO: 669168 - RNA, 20 nt, Human
ccccaaaccaccaaacccaa

SEQ ID NO: 669169 - RNA, 24 nt, Human
ccccaaaccaccaaacccaaacuu

SEQ ID NO: 669170 - RNA, 23 nt, Human
ccccacgcccccgaggagugcag

SEQ ID NO: 669171 - RNA, 23 nt, Human
ccccagacucccguuacacggcc

SEQ ID NO: 669172 - RNA, 18 nt, Human
ccccagccugacccgggc

SEQ ID NO: 669173 - RNA, 19 nt, Human
cccccaaaccaccaaaccc

SEQ ID NO: 669174 - RNA, 29 nt, Human
cccccaaaccaccaaacccaaacuuccag

SEQ ID NO: 669175 - RNA, 21 nt, Human
cccccgaggagugcaggcagg

SEQ ID NO: 669176 - RNA, 24 nt, Human
ccccgaggagugcaggcaggggcg

SEQ ID NO: 669177 - RNA, 20 nt, Human
ccccggccccagggaggcuc

SEQ ID NO: 669178 - RNA, 21 nt, Human
cccgcccccuagggauggggc

SEQ ID NO: 669179 - RNA, 18 nt, Human
cccggcccccaaaccacc

SEQ ID NO: 669180 - RNA, 20 nt, Human
cccucccaguuaagccucag

SEQ ID NO: 669181 - RNA, 18 nt, Human
cccucguuuucagccucc

SEQ ID NO: 669182 - RNA, 20 nt, Human
cccugcuccgccccauccac

SEQ ID NO: 669183 - RNA, 20 nt, Human
ccggcccccaaaccaccaaa

SEQ ID NO: 669184 - RNA, 19 nt, Human
ccuccaggccucggcucuc

SEQ ID NO: 669185 - RNA, 20 nt, Human
ccugggcccucguuuucagc

SEQ ID NO: 669186 - RNA, 22 nt, Human
cgccgcgcucucuggcccgcug

SEQ ID NO: 669187 - RNA, 18 nt, Human
cgcugaguccccagacuc

SEQ ID NO: 669188 - RNA, 22 nt, Human
cgcuucuuggucccaguaguuc

SEQ ID NO: 669189 - RNA, 21 nt, Human
cggcccccaaaccaccaaacc

SEQ ID NO: 669190 - RNA, 22 nt, Human
cggcccccaaaccaccaaaccc

SEQ ID NO: 669191 - RNA, 24 nt, Human
cggcccccaaaccaccaaacccaa

SEQ ID NO: 669192 - RNA, 22 nt, Human
cuccccgcccccuagggauggg

SEQ ID NO: 669193 - RNA, 23 nt, Human
cucccguuacacggccucccgga

SEQ ID NO: 669194 - RNA, 19 nt, Human
cucucugcccccuccccca

SEQ ID NO: 669195 - RNA, 23 nt, Human
cuguuccuccccagccuggugac

SEQ ID NO: 669196 - RNA, 19 nt, Human
gcagcgauucugguccugg

SEQ ID NO: 669197 - RNA, 24 nt, Human
gccuuggagcccuggcccagcccc

SEQ ID NO: 669198 - RNA, 20 nt, Human
gcucugggagggcccaguuc

SEQ ID NO: 669199 - RNA, 20 nt, Human
gcuggggcugguggccaugu

SEQ ID NO: 669200 - RNA, 19 nt, Human
ggagaagccuccagggggu

SEQ ID NO: 669201 - RNA, 18 nt, Human
gggaagcggaggugcucu

SEQ ID NO: 669202 - RNA, 24 nt, Human
ggggaagcggaggugcucugggag

SEQ ID NO: 669203 - RNA, 18 nt, Human
gggguaccccgcuucuug

SEQ ID NO: 669204 - RNA, 20 nt, Human
gguggggcagggccuggccu

SEQ ID NO: 669205 - RNA, 21 nt, Human
gugcaggcaggggcguggggu

SEQ ID NO: 669206 - RNA, 19 nt, Human
guggagcaaggcacgcccc

SEQ ID NO: 669207 - RNA, 20 nt, Human
guuacacggccucccggacg

SEQ ID NO: 669208 - RNA, 24 nt, Human
guuuuggacccugacuugggcacu

SEQ ID NO: 669209 - RNA, 19 nt, Human
uaaguauguggugccugcg

SEQ ID NO: 669210 - RNA, 23 nt, Human
uaauuagcauuuguuguaccugg

SEQ ID NO: 669211 - RNA, 18 nt, Human
uacaagguggggcugggg

SEQ ID NO: 669212 - RNA, 30 nt, Human
uaccccgcuucuuggucccaguaguuccaa

SEQ ID NO: 669213 - RNA, 20 nt, Human
uccacgggcugagccgggug

SEQ ID NO: 669214 - RNA, 21 nt, Human
uccgagggggcggucagcauc

SEQ ID NO: 669215 - RNA, 23 nt, Human
uccugggcccucguuucucgggg

SEQ ID NO: 669216 - RNA, 19 nt, Human
uccuuuagccgguuucugg

SEQ ID NO: 669217 - RNA, 25 nt, Human
ucgggcuuaaagauuagggauuuac

SEQ ID NO: 669218 - RNA, 22 nt, Human
ucucagccucaagucgggcuua

SEQ ID NO: 669219 - RNA, 18 nt, Human
ucucauggugcagggucc

SEQ ID NO: 669220 - RNA, 18 nt, Human
ucuccgagggggcgguca

SEQ ID NO: 669221 - RNA, 18 nt, Human
ucucucugcccccucccc

SEQ ID NO: 669222 - RNA, 22 nt, Human
ucucuggcccgcugagucccca

SEQ ID NO: 669223 - RNA, 21 nt, Human
ucuguccugccccauacagcu

SEQ ID NO: 669224 - RNA, 21 nt, Human
ucuguggaccuguguuggggg

SEQ ID NO: 669225 - RNA, 18 nt, Human
ugacuugggcacugucca

SEQ ID NO: 669226 - RNA, 24 nt, Human
ugccaggagaagccuccagggggu

SEQ ID NO: 669227 - RNA, 22 nt, Human
ugccccggccccagggaggcuc

SEQ ID NO: 669228 - RNA, 24 nt, Human
ugcucucagccucaagucgggcuu

SEQ ID NO: 669229 - RNA, 23 nt, Human
uggaccuguguuggggggcaguu

SEQ ID NO: 669230 - RNA, 20 nt, Human
uggcaccaccucauuuuggu

SEQ ID NO: 669231 - RNA, 18 nt, Human
uggccauguggccuuugg

SEQ ID NO: 669232 - RNA, 24 nt, Human
uggcccgccgcgcucucuggcccg

SEQ ID NO: 669233 - RNA, 23 nt, Human
ugggaaaacacggaacaaugaaa

SEQ ID NO: 669234 - RNA, 21 nt, Human
uggggccaggcaaagacccca

SEQ ID NO: 669235 - RNA, 23 nt, Human
uggggcuggggaaaggaggcagc

SEQ ID NO: 669236 - RNA, 24 nt, Human
uggucuccucucucugcccccucc

SEQ ID NO: 669237 - RNA, 22 nt, Human
uguaaauaacuuucaugaaaaa

SEQ ID NO: 669238 - RNA, 20 nt, Human
agagcgaaguccaugaugcu

SEQ ID NO: 669239 - RNA, 18 nt, Human
agcgggcuggggcugagg

SEQ ID NO: 669240 - RNA, 22 nt, Human
augcgccacggccacuguggug

SEQ ID NO: 669241 - RNA, 27 nt, Human
cacccgaggcagggguuaaccgggucg

SEQ ID NO: 669242 - RNA, 20 nt, Human
caccucaguguucaugucgg

SEQ ID NO: 669243 - RNA, 20 nt, Human
cacggccacugugguggcgu

SEQ ID NO: 669244 - RNA, 18 nt, Human
cacugugguggcgugagu

SEQ ID NO: 669245 - RNA, 19 nt, Human
cagccgaggcacauccacc

SEQ ID NO: 669246 - RNA, 24 nt, Human
cagggcgugcaguggcggggucug

SEQ ID NO: 669247 - RNA, 21 nt, Human
cagggguuaggccugaggccc

SEQ ID NO: 669248 - RNA, 19 nt, Human
caucaguggcugggguggg

SEQ ID NO: 669249 - RNA, 24 nt, Human
ccacgacagcgacugcaggucccc

SEQ ID NO: 669250 - RNA, 20 nt, Human
cucauccuucaucuccuccc

SEQ ID NO: 669251 - RNA, 21 nt, Human
cugcagccgaggcacauccac

SEQ ID NO: 669252 - RNA, 21 nt, Human
cugugguggcgugagucagca

SEQ ID NO: 669253 - RNA, 24 nt, Human
cugugguggcgugagucagcacgg

SEQ ID NO: 669254 - RNA, 23 nt, Human
gacugcagggacagggucaucag

SEQ ID NO: 669255 - RNA, 20 nt, Human
gagcgggcuggggcugaggu

SEQ ID NO: 669256 - RNA, 22 nt, Human
gagcgggcuggggcugaggucc

SEQ ID NO: 669257 - RNA, 21 nt, Human
gaggcacauccaccgccguga

SEQ ID NO: 669258 - RNA, 21 nt, Human
gcgugcaguggcggggucugg

SEQ ID NO: 669259 - RNA, 21 nt, Human
ggagcgggcuggggcugaggu

SEQ ID NO: 669260 - RNA, 20 nt, Human
gggcuggggcugagguccgg

SEQ ID NO: 669261 - RNA, 25 nt, Human
ggggugggggagcgggcuggggcug

SEQ ID NO: 669262 - RNA, 18 nt, Human
gggugggagcugggagac

SEQ ID NO: 669263 - RNA, 19 nt, Human
gggugggggagcgggcugg

SEQ ID NO: 669264 - RNA, 22 nt, Human
gggugggggagcgggcuggggc

SEQ ID NO: 669265 - RNA, 18 nt, Human
ggguuaggccugaggccc

SEQ ID NO: 669266 - RNA, 24 nt, Human
ggugcagggggacugacugcaggg

SEQ ID NO: 669267 - RNA, 20 nt, Human
ggugcuggagagucuggagc

SEQ ID NO: 669268 - RNA, 19 nt, Human
gugcaguggcggggucugg

SEQ ID NO: 669269 - RNA, 20 nt, Human
guggcuggggugggagcugg

SEQ ID NO: 669270 - RNA, 19 nt, Human
ucaguggcuggggugggag

SEQ ID NO: 669271 - RNA, 21 nt, Human
ucaucaguggcuggggugggg

SEQ ID NO: 669272 - RNA, 20 nt, Human
uccccugcagagcgaagucc

SEQ ID NO: 669273 - RNA, 22 nt, Human
uccccugcagagcgaaguccau

SEQ ID NO: 669274 - RNA, 21 nt, Human
ucccucauccuucaucuccuc

SEQ ID NO: 669275 - RNA, 23 nt, Human
uccucccacagguuccccugcag

SEQ ID NO: 669276 - RNA, 21 nt, Human
ucgcugccacccgaggcaggu

SEQ ID NO: 669277 - RNA, 23 nt, Human
ugaggcccccaggucacagccaa

SEQ ID NO: 669278 - RNA, 20 nt, Human
uggcggggucugggcuggug

SEQ ID NO: 669279 - RNA, 23 nt, Human
uggcgugagucagcacgggggcc

SEQ ID NO: 669280 - RNA, 18 nt, Human
ugggaaggacuggucgcg

SEQ ID NO: 669281 - RNA, 18 nt, Human
ugggcuggugcuggagag

SEQ ID NO: 669282 - RNA, 24 nt, Human
uggggugggagcugggagacagcc

SEQ ID NO: 669283 - RNA, 21 nt, Human
ugugguggcgugagucagcac

SEQ ID NO: 669284 - RNA, 22 nt, Human
aaaaaauaaaggaaagacagaa

SEQ ID NO: 669285 - RNA, 23 nt, Human
aagaagggggagcagcagcccag

SEQ ID NO: 669286 - RNA, 22 nt, Human
aauaaaggaaagacagaaagaa

SEQ ID NO: 669287 - RNA, 22 nt, Human
agaaagaagggggagcagcagc

SEQ ID NO: 669288 - RNA, 22 nt, Human
agaagggggagcagcagcccag

SEQ ID NO: 669289 - RNA, 23 nt, Human
agaagggggagcagcagcccagc

SEQ ID NO: 669290 - RNA, 22 nt, Human
agcaccaaagaagagagaagga

SEQ ID NO: 669291 - RNA, 18 nt, Human
agcccggggacugcgcgg

SEQ ID NO: 669292 - RNA, 29 nt, Human
aggaaagacagaaagaagggggaggaaac

SEQ ID NO: 669293 - RNA, 25 nt, Human
agggggagcagcagcccagcgggug

SEQ ID NO: 669294 - RNA, 23 nt, Human
caaaaaauaaaggaaagacagaa

SEQ ID NO: 669295 - RNA, 23 nt, Human
caaaggguuuucucuguaggucu

SEQ ID NO: 669296 - RNA, 26 nt, Human
caccccccacccggucgaauggcccg

SEQ ID NO: 669297 - RNA, 22 nt, Human
cagcccccuccccccgccgccc

SEQ ID NO: 669298 - RNA, 22 nt, Human
cagcggguguucgcagagguuc

SEQ ID NO: 669299 - RNA, 24 nt, Human
cagcucccucuccccucuucgccc

SEQ ID NO: 669300 - RNA, 27 nt, Human
ccaccucccaguccugccgcgcccgcc

SEQ ID NO: 669301 - RNA, 21 nt, Human
cccagccgcaggucccucccg

SEQ ID NO: 669302 - RNA, 19 nt, Human
ccccccgucaccccccacc

SEQ ID NO: 669303 - RNA, 22 nt, Human
ccccccgucaccccccacccgg

SEQ ID NO: 669304 - RNA, 19 nt, Human
ccccggccaggccgcgaug

SEQ ID NO: 669305 - RNA, 19 nt, Human
ccccgucaccccccacccg

SEQ ID NO: 669306 - RNA, 19 nt, Human
cccgcggcgccgccgcuca

SEQ ID NO: 669307 - RNA, 21 nt, Human
cccgcugccgccaccucccag

SEQ ID NO: 669308 - RNA, 23 nt, Human
cccgcugccgccaccucccaguc

SEQ ID NO: 669309 - RNA, 21 nt, Human
cccgggccggagccccguccu

SEQ ID NO: 669310 - RNA, 19 nt, Human
ccgcaggucccucccgggc

SEQ ID NO: 669311 - RNA, 24 nt, Human
ccgccgcccagccgcaggucccuc

SEQ ID NO: 669312 - RNA, 22 nt, Human
ccgccgcucaagucugugcugu

SEQ ID NO: 669313 - RNA, 23 nt, Human
ccgccgcucaagucugugcuguc

SEQ ID NO: 669314 - RNA, 24 nt, Human
ccgcgcccgccucccaggaacagg

SEQ ID NO: 669315 - RNA, 18 nt, Human
ccgcggucagagcccgag

SEQ ID NO: 669316 - RNA, 28 nt, Human
ccucccaggaacaggaggaccugaagac

SEQ ID NO: 669317 - RNA, 20 nt, Human
ccuccccccgccgcccagcc

SEQ ID NO: 669318 - RNA, 23 nt, Human
ccuccccccgccgcccagccgca

SEQ ID NO: 669319 - RNA, 22 nt, Human
ccuccgcgaccccccgucaccc

SEQ ID NO: 669320 - RNA, 20 nt, Human
ccucgcgcggggcagccccc

SEQ ID NO: 669321 - RNA, 23 nt, Human
ccucuucgcccgcgggccagagg

SEQ ID NO: 669322 - RNA, 24 nt, Human
ccugccgcgcccgccucccaggaa

SEQ ID NO: 669323 - RNA, 23 nt, Human
ccuggggaagcaccaaagaagag

SEQ ID NO: 669324 - RNA, 18 nt, Human
cgaccccccgucaccccc

SEQ ID NO: 669325 - RNA, 22 nt, Human
cgaccccccgucaccccccacc

SEQ ID NO: 669326 - RNA, 23 nt, Human
cgaccccccgucaccccccaccc

SEQ ID NO: 669327 - RNA, 19 nt, Human
cgagcgaaucgacggccuc

SEQ ID NO: 669328 - RNA, 19 nt, Human
cgaguccucgcccgcugcc

SEQ ID NO: 669329 - RNA, 19 nt, Human
cgcagagguucgagcccgg

SEQ ID NO: 669330 - RNA, 24 nt, Human
cgcagaugggcccuugucacuucc

SEQ ID NO: 669331 - RNA, 20 nt, Human
cgccgcucaagucugugcug

SEQ ID NO: 669332 - RNA, 24 nt, Human
cgccggggcggggugcagcggggg

SEQ ID NO: 669333 - RNA, 21 nt, Human
cgccuccgcgaccccccguca

SEQ ID NO: 669334 - RNA, 18 nt, Human
cggcucccgggcgccgcc

SEQ ID NO: 669335 - RNA, 19 nt, Human
cggcucuucuccccuuucc

SEQ ID NO: 669336 - RNA, 23 nt, Human
cggggacugcgcgggcagcuccc

SEQ ID NO: 669337 - RNA, 18 nt, Human
cggggcggggagaagggg

SEQ ID NO: 669338 - RNA, 22 nt, Human
cuccgcccccuucccagucggg

SEQ ID NO: 669339 - RNA, 24 nt, Human
gagaaggagaguugguuaucccgg

SEQ ID NO: 669340 - RNA, 21 nt, Human
gagcagauuuggcaaaggguu

SEQ ID NO: 669341 - RNA, 18 nt, Human
gagcagcagcccagcggg

SEQ ID NO: 669342 - RNA, 18 nt, Human
gagcagcagcccagcggg

SEQ ID NO: 669343 - RNA, 20 nt, Human
gcccggcggggacggccacu

SEQ ID NO: 669344 - RNA, 18 nt, Human
gccgccaccucccagucc

SEQ ID NO: 669345 - RNA, 22 nt, Human
gccggagccccguccucggcga

SEQ ID NO: 669346 - RNA, 26 nt, Human
gcgccggggcggggugcagcggggga

SEQ ID NO: 669347 - RNA, 20 nt, Human
gcggggagaagggggagggg

SEQ ID NO: 669348 - RNA, 22 nt, Human
ggaaagacagaaagaaggggga

SEQ ID NO: 669349 - RNA, 25 nt, Human
ggaccugaagacgugcggccagcgg

SEQ ID NO: 669350 - RNA, 21 nt, Human
ggaggggcgcccgggggaggg

SEQ ID NO: 669351 - RNA, 18 nt, Human
ggaggggcggccgcgccu

SEQ ID NO: 669352 - RNA, 21 nt, Human
ggcggggcggggagaaggggg

SEQ ID NO: 669353 - RNA, 21 nt, Human
gggagaagggggaggggcgcc

SEQ ID NO: 669354 - RNA, 18 nt, Human
gggagcagcagcccagcg

SEQ ID NO: 669355 - RNA, 21 nt, Human
gggcggggagaagggggaggg

SEQ ID NO: 669356 - RNA, 23 nt, Human
ggggaggggcgcccgggggaggg

SEQ ID NO: 669357 - RNA, 20 nt, Human
gggugcagcgggggagggac

SEQ ID NO: 669358 - RNA, 23 nt, Human
gucugugcugucuucggcucuuc

SEQ ID NO: 669359 - RNA, 21 nt, Human
uaaagcgggcagcggccggag

SEQ ID NO: 669360 - RNA, 25 nt, Human
uaaaggaaagacagaaagaaggggg

SEQ ID NO: 669361 - RNA, 24 nt, Human
ucacuguccacuugcugagagcag

SEQ ID NO: 669362 - RNA, 26 nt, Human
ucacuguccacuugcugagagcagau

SEQ ID NO: 669363 - RNA, 22 nt, Human
ucacuuccaaaaaauaaaggaa

SEQ ID NO: 669364 - RNA, 21 nt, Human
uccaaggguaagugcuucacc

SEQ ID NO: 669365 - RNA, 19 nt, Human
ucccaggaacaggaggacc

SEQ ID NO: 669366 - RNA, 20 nt, Human
uccccccgccgcccagccgc

SEQ ID NO: 669367 - RNA, 23 nt, Human
ucccgggccggagccccguccuc

SEQ ID NO: 669368 - RNA, 21 nt, Human
ucccgggcgccgccgccgccg

SEQ ID NO: 669369 - RNA, 18 nt, Human
uccgggggagggagcgag

SEQ ID NO: 669370 - RNA, 23 nt, Human
uccugccgcgcccgccucccagg

SEQ ID NO: 669371 - RNA, 19 nt, Human
ucgcccgcgggccagaggg

SEQ ID NO: 669372 - RNA, 20 nt, Human
ucucgcgccggggcggggug

SEQ ID NO: 669373 - RNA, 23 nt, Human
ucugcuggguuaggaaaauggcg

SEQ ID NO: 669374 - RNA, 23 nt, Human
ugcuuugcccacuuccccuuccu

SEQ ID NO: 669375 - RNA, 19 nt, Human
uggcgcagccgagccgcgg

SEQ ID NO: 669376 - RNA, 23 nt, Human
uuagaguucuguuccaaggguaa

SEQ ID NO: 669377 - RNA, 25 nt, Human
uucgcagagguucgagcccggcggg

SEQ ID NO: 669378 - RNA, 18 nt, Human
uuggcaaaggguuuucuc

SEQ ID NO: 669379 - RNA, 25 nt, Human
aaaaaaaaaaaaaaagcaauacauu

SEQ ID NO: 669380 - RNA, 25 nt, Human
aaaaaaaaaaaaaagcaauacauua

SEQ ID NO: 669381 - RNA, 28 nt, Human
aaaaaaaaaaagcaauacauuaaaaagg

SEQ ID NO: 669382 - RNA, 23 nt, Human
aaaaaaaaaauaaaagaaaagaa

SEQ ID NO: 669383 - RNA, 21 nt, Human
aaaaaaaaagcaauacauuaa

SEQ ID NO: 669384 - RNA, 21 nt, Human
aaaaaagaaaauccgaaacac

SEQ ID NO: 669385 - RNA, 23 nt, Human
aaaaauaaaaacaaacugaagga

SEQ ID NO: 669386 - RNA, 21 nt, Human
aaaaggucacgucuuaccccu

SEQ ID NO: 669387 - RNA, 21 nt, Human
aaacaaaaguggcauacaauc

SEQ ID NO: 669388 - RNA, 24 nt, Human
aaacaaaaguggcauacaaucuaa

SEQ ID NO: 669389 - RNA, 19 nt, Human
aaacaccccucccccgaac

SEQ ID NO: 669390 - RNA, 23 nt, Human
aaaccaacccacacccguuaucg

SEQ ID NO: 669391 - RNA, 22 nt, Human
aaagcaaucuucaguuauaguc

SEQ ID NO: 669392 - RNA, 23 nt, Human
aaaggccuuccccaucccaacug

SEQ ID NO: 669393 - RNA, 21 nt, Human
aaauguaguugacaccaagcc

SEQ ID NO: 669394 - RNA, 23 nt, Human
aacaaaaaguagaaaaaucaaaa

SEQ ID NO: 669395 - RNA, 23 nt, Human
aacaccccucccccgaaccaccc

SEQ ID NO: 669396 - RNA, 23 nt, Human
aaccaacccacacccguuaucgc

SEQ ID NO: 669397 - RNA, 28 nt, Human
aagaaaauccgaaacaccccucccccga

SEQ ID NO: 669398 - RNA, 22 nt, Human
aaggaaaaauaacuacuagaaa

SEQ ID NO: 669399 - RNA, 22 nt, Human
aaugagugacagaaagcuacaa

SEQ ID NO: 669400 - RNA, 27 nt, Human
aaugguugcugcaaaaaaaaaaaaauu

SEQ ID NO: 669401 - RNA, 27 nt, Human
acaccaagcccugguuagccaccuggc

SEQ ID NO: 669402 - RNA, 20 nt, Human
acaccccucccccgaaccac

SEQ ID NO: 669403 - RNA, 22 nt, Human
acaccccucccccgaaccaccc

SEQ ID NO: 669404 - RNA, 23 nt, Human
acaccccucccccgaaccacccc

SEQ ID NO: 669405 - RNA, 25 nt, Human
acauucaucacaagguacagaaaac

SEQ ID NO: 669406 - RNA, 18 nt, Human
accccucccccgaaccac

SEQ ID NO: 669407 - RNA, 20 nt, Human
accuggccaugcugagcccc

SEQ ID NO: 669408 - RNA, 23 nt, Human
accuggccaugcugagccccagc

SEQ ID NO: 669409 - RNA, 20 nt, Human
accuguaaccaucacauuuc

SEQ ID NO: 669410 - RNA, 19 nt, Human
acugagguuguacugaccu

SEQ ID NO: 669411 - RNA, 23 nt, Human
agaaaaaagguacaaagaaagaa

SEQ ID NO: 669412 - RNA, 27 nt, Human
agaaaaaggaaaaauaacuacuagaaa

SEQ ID NO: 669413 - RNA, 24 nt, Human
agaaaagaaaaaaagaaaauccga

SEQ ID NO: 669414 - RNA, 19 nt, Human
agagccuuccaaggccaua

SEQ ID NO: 669415 - RNA, 18 nt, Human
agaggccaucggcccaaa

SEQ ID NO: 669416 - RNA, 21 nt, Human
agaguuugucucucuuuuuuu

SEQ ID NO: 669417 - RNA, 19 nt, Human
aggaaagugggugcagagc

SEQ ID NO: 669418 - RNA, 23 nt, Human
aguggaugggaguguuacuuuuc

SEQ ID NO: 669419 - RNA, 27 nt, Human
auaaaacagagaacauaauuuaccuuu

SEQ ID NO: 669420 - RNA, 18 nt, Human
auaaagcauaaaacagag

SEQ ID NO: 669421 - RNA, 20 nt, Human
augcauaaugccacaggacu

SEQ ID NO: 669422 - RNA, 22 nt, Human
auggaggccugaggucagaacu

SEQ ID NO: 669423 - RNA, 22 nt, Human
caaagucugcugcuaaaaguga

SEQ ID NO: 669424 - RNA, 22 nt, Human
caaauguaguugacaccaagcc

SEQ ID NO: 669425 - RNA, 20 nt, Human
caacuggaagcaaaaaaaaa

SEQ ID NO: 669426 - RNA, 19 nt, Human
caacuuugguuccauuauc

SEQ ID NO: 669427 - RNA, 27 nt, Human
cacaaaaagaaaaaggaaaaauaacua

SEQ ID NO: 669428 - RNA, 19 nt, Human
cacaaaggccuuccccauc

SEQ ID NO: 669429 - RNA, 22 nt, Human
cacagccauaaaaagccugggg

SEQ ID NO: 669430 - RNA, 21 nt, Human
cacaggacugcaacacacaga

SEQ ID NO: 669431 - RNA, 18 nt, Human
cacaguucuuaaacaaaa

SEQ ID NO: 669432 - RNA, 18 nt, Human
caccccucccccgaacca

SEQ ID NO: 669433 - RNA, 19 nt, Human
caccccucccccgaaccac

SEQ ID NO: 669434 - RNA, 22 nt, Human
caccccucccccgaaccacccc

SEQ ID NO: 669435 - RNA, 19 nt, Human
caccuggccaugcugagcc

SEQ ID NO: 669436 - RNA, 20 nt, Human
cagcgccgccgccgccaccc

SEQ ID NO: 669437 - RNA, 23 nt, Human
caguucuuaaacaaaaguggcau

SEQ ID NO: 669438 - RNA, 22 nt, Human
cauaaaaagccuggggucacug

SEQ ID NO: 669439 - RNA, 25 nt, Human
cauuuugcaaacaaaaccaacccac

SEQ ID NO: 669440 - RNA, 24 nt, Human
ccaaauggaggccugaggucagaa

SEQ ID NO: 669441 - RNA, 25 nt, Human
ccaauacugcugcguggaaugaauc

SEQ ID NO: 669442 - RNA, 23 nt, Human
ccaugcugagccccagcaccaag

SEQ ID NO: 669443 - RNA, 22 nt, Human
cccccaaagcccagggccuaca

SEQ ID NO: 669444 - RNA, 19 nt, Human
cccccaauacugcugcgug

SEQ ID NO: 669445 - RNA, 19 nt, Human
ccccccaauacacacacaa

SEQ ID NO: 669446 - RNA, 28 nt, Human
ccccccaauacacacacaaaggccuucc

SEQ ID NO: 669447 - RNA, 18 nt, Human
cccccgaaccacccccaa

SEQ ID NO: 669448 - RNA, 19 nt, Human
ccccucccccgaaccaccc

SEQ ID NO: 669449 - RNA, 22 nt, Human
cccuccccccaauacacacaca

SEQ ID NO: 669450 - RNA, 20 nt, Human
ccgaaacaccccucccccga

SEQ ID NO: 669451 - RNA, 22 nt, Human
ccucaaaaggucacgucuuacc

SEQ ID NO: 669452 - RNA, 21 nt, Human
ccuccaagaggccaucggccc

SEQ ID NO: 669453 - RNA, 23 nt, Human
ccuccccccaauacacacacaaa

SEQ ID NO: 669454 - RNA, 24 nt, Human
ccucccccgaaccacccccaauac

SEQ ID NO: 669455 - RNA, 19 nt, Human
ccuggccaugcugagcccc

SEQ ID NO: 669456 - RNA, 22 nt, Human
ccuggccaugcugagccccagc

SEQ ID NO: 669457 - RNA, 21 nt, Human
ccuuccccaucccaacuggaa

SEQ ID NO: 669458 - RNA, 19 nt, Human
cuaaaaaaaacuacagucc

SEQ ID NO: 669459 - RNA, 22 nt, Human
cuccaagugucaucaucccaaa

SEQ ID NO: 669460 - RNA, 18 nt, Human
cucccuuccuucuguagc

SEQ ID NO: 669461 - RNA, 20 nt, Human
cugguagaaugugguggcau

SEQ ID NO: 669462 - RNA, 24 nt, Human
cuguuagcaguggcgacuccugcu

SEQ ID NO: 669463 - RNA, 23 nt, Human
cuucaaaaguaacugccagagaa

SEQ ID NO: 669464 - RNA, 20 nt, Human
gaaggaaaaaaaaaaaaaaa

SEQ ID NO: 669465 - RNA, 18 nt, Human
gaagggaucgaagcccuc

SEQ ID NO: 669466 - RNA, 22 nt, Human
gacugcccuuuauacagaaagc

SEQ ID NO: 669467 - RNA, 22 nt, Human
gacuguacaacaaauggagaac

SEQ ID NO: 669468 - RNA, 19 nt, Human
gagccccagcaccaagcug

SEQ ID NO: 669469 - RNA, 23 nt, Human
gcaaaaaaaaaaaaaaaaaaaaa

SEQ ID NO: 669470 - RNA, 23 nt, Human
gccucuaaauucuuuugccuccu

SEQ ID NO: 669471 - RNA, 19 nt, Human
ggacccccccaaagcccag

SEQ ID NO: 669472 - RNA, 19 nt, Human
ggaccuuuuugaaaaagac

SEQ ID NO: 669473 - RNA, 22 nt, Human
ggagagccuuccaaggccauau

SEQ ID NO: 669474 - RNA, 21 nt, Human
ggcaacuugguuccacaaggg

SEQ ID NO: 669475 - RNA, 19 nt, Human
ggcuucuguaaagcaaucu

SEQ ID NO: 669476 - RNA, 19 nt, Human
ggugcagagcugaagugug

SEQ ID NO: 669477 - RNA, 22 nt, Human
gguugcugcaaaaaaaaaaaaa

SEQ ID NO: 669478 - RNA, 22 nt, Human
guaaagcaaucuucaguuauag

SEQ ID NO: 669479 - RNA, 23 nt, Human
guuaacucccuuaacaaguucaa

SEQ ID NO: 669480 - RNA, 18 nt, Human
uaaaaauaaaaacaaacu

SEQ ID NO: 669481 - RNA, 18 nt, Human
uaaacugucuccuuuauu

SEQ ID NO: 669482 - RNA, 22 nt, Human
uaaagcauaaaacagagaacau

SEQ ID NO: 669483 - RNA, 23 nt, Human
uaaaggcagugauaaucaacaug

SEQ ID NO: 669484 - RNA, 25 nt, Human
uaaugccacaggacugcaacacagu

SEQ ID NO: 669485 - RNA, 22 nt, Human
uacagaaaacuuuaagccucca

SEQ ID NO: 669486 - RNA, 18 nt, Human
uaccuuuguguaauaucu

SEQ ID NO: 669487 - RNA, 22 nt, Human
uagagugcagcauuugggaccu

SEQ ID NO: 669488 - RNA, 25 nt, Human
uagcaaauuuacaacacugauguug

SEQ ID NO: 669489 - RNA, 20 nt, Human
ucacagcacaguucuuaaac

SEQ ID NO: 669490 - RNA, 21 nt, Human
uccgaaacaccccucccccga

SEQ ID NO: 669491 - RNA, 22 nt, Human
uccgaaacaccccucccccgaa

SEQ ID NO: 669492 - RNA, 25 nt, Human
uccgaaacaccccucccccgaacca

SEQ ID NO: 669493 - RNA, 18 nt, Human
ucggaaaaaaaggaaaaa

SEQ ID NO: 669494 - RNA, 19 nt, Human
ucggcccaaauggaggccu

SEQ ID NO: 669495 - RNA, 19 nt, Human
ucgggguuggcccgccccg

SEQ ID NO: 669496 - RNA, 22 nt, Human
ucugggacacucuggcuguuag

SEQ ID NO: 669497 - RNA, 20 nt, Human
ucugggcaaaggcuuggucu

SEQ ID NO: 669498 - RNA, 20 nt, Human
ucugucauucauucucuuuc

SEQ ID NO: 669499 - RNA, 19 nt, Human
ugaaaucgaauuugcauuc

SEQ ID NO: 669500 - RNA, 24 nt, Human
ugacguguuuuuuuuuuuuccuuu

SEQ ID NO: 669501 - RNA, 19 nt, Human
ugacucuaaacugucuccu

SEQ ID NO: 669502 - RNA, 22 nt, Human
ugagaugggacucccuuccuuc

SEQ ID NO: 669503 - RNA, 20 nt, Human
ugagugacagaaagcuacaa

SEQ ID NO: 669504 - RNA, 21 nt, Human
ugagugacagaaagcuacaac

SEQ ID NO: 669505 - RNA, 20 nt, Human
ugcaacacacagagggaagc

SEQ ID NO: 669506 - RNA, 23 nt, Human
ugcauaaugccacaggacugcaa

SEQ ID NO: 669507 - RNA, 20 nt, Human
ugcauaccauguuugggacc

SEQ ID NO: 669508 - RNA, 25 nt, Human
ugccacaggacugcaacacacagag

SEQ ID NO: 669509 - RNA, 22 nt, Human
ugcugguagaaugugguggcau

SEQ ID NO: 669510 - RNA, 22 nt, Human
uggcaggacugcaguucaaagu

SEQ ID NO: 669511 - RNA, 21 nt, Human
uggccaugcugagccccagca

SEQ ID NO: 669512 - RNA, 27 nt, Human
ugggcaaaggcuuggucuuccgguccg

SEQ ID NO: 669513 - RNA, 23 nt, Human
ugggguucuugauggcacuaaga

SEQ ID NO: 669514 - RNA, 19 nt, Human
ugucucacagccauaaaaa

SEQ ID NO: 669515 - RNA, 19 nt, Human
ugucugaaggaagauggaa

SEQ ID NO: 669516 - RNA, 22 nt, Human
uguguagagugcagcauuuggg

SEQ ID NO: 669517 - RNA, 23 nt, Human
uguuccuagaguuugucucucuu

SEQ ID NO: 669518 - RNA, 20 nt, Human
uuaaccccuccccccaauac

SEQ ID NO: 669519 - RNA, 26 nt, Human
uuaaccccuccccccaauacacacac

SEQ ID NO: 669520 - RNA, 25 nt, Human
uucauguguagagugcagcauuugg

SEQ ID NO: 669521 - RNA, 20 nt, Human
uugaaaaagaccaaaacgga

SEQ ID NO: 669522 - RNA, 22 nt, Human
uugacaccaagcccugguuagc

SEQ ID NO: 669523 - RNA, 25 nt, Human
uugcaaacaaaaccaacccacaccc

SEQ ID NO: 669524 - RNA, 23 nt, Human
uuggcuucuguaaagcaaucuuc

SEQ ID NO: 669525 - RNA, 22 nt, Human
uuugcaaacaaaaccaacccac

SEQ ID NO: 669526 - RNA, 25 nt, Human
uuuuuuuuuuuuuuuuuuuuuaagg

SEQ ID NO: 669527 - RNA, 27 nt, Human
aaaaaaaaacacgcacauaaguaucau

SEQ ID NO: 669528 - RNA, 18 nt, Human
aaaaauacugauacacau

SEQ ID NO: 669529 - RNA, 21 nt, Human
aaacacauaacuugagauucu

SEQ ID NO: 669530 - RNA, 23 nt, Human
aaacacgcacauaaguaucauaa

SEQ ID NO: 669531 - RNA, 22 nt, Human
aaagacauaacauccucugaaa

SEQ ID NO: 669532 - RNA, 25 nt, Human
aaagacauaacauccucugaaaaau

SEQ ID NO: 669533 - RNA, 23 nt, Human
aagugccagugaauacuuagaac

SEQ ID NO: 669534 - RNA, 23 nt, Human
acaguauuccuacacuacucuga

SEQ ID NO: 669535 - RNA, 22 nt, Human
acuaccacuucccccacagaua

SEQ ID NO: 669536 - RNA, 18 nt, Human
agaggucuuuguaucuag

SEQ ID NO: 669537 - RNA, 20 nt, Human
agugaauacuuagaacuuca

SEQ ID NO: 669538 - RNA, 19 nt, Human
aguguauaauacauaugua

SEQ ID NO: 669539 - RNA, 21 nt, Human
auacacauccaaaauaguauc

SEQ ID NO: 669540 - RNA, 24 nt, Human
caaaaaagauggaaaaauuccaaa

SEQ ID NO: 669541 - RNA, 22 nt, Human
caaaaaauaagaugaaaacuaa

SEQ ID NO: 669542 - RNA, 22 nt, Human
cagcaucaccagcauguggaca

SEQ ID NO: 669543 - RNA, 19 nt, Human
cauguggacaaaaaauaag

SEQ ID NO: 669544 - RNA, 20 nt, Human
cccaccuucccugagaccgc

SEQ ID NO: 669545 - RNA, 19 nt, Human
cccugagaccgcgccgcac

SEQ ID NO: 669546 - RNA, 26 nt, Human
cucaaaaaagauggaaaaauuccaaa

SEQ ID NO: 669547 - RNA, 24 nt, Human
gccugcuucuugaugucugcauuu

SEQ ID NO: 669548 - RNA, 20 nt, Human
ggccaauuauuguuucucag

SEQ ID NO: 669549 - RNA, 21 nt, Human
gugaaaaaacaaugcuccaca

SEQ ID NO: 669550 - RNA, 18 nt, Human
uaaaaaaacacacugaca

SEQ ID NO: 669551 - RNA, 23 nt, Human
uaaaaacaaaaauacugauacac

SEQ ID NO: 669552 - RNA, 26 nt, Human
uaaaaacaaaaauacugauacacauc

SEQ ID NO: 669553 - RNA, 25 nt, Human
uaaaauuaaugagauacaaauuuua

SEQ ID NO: 669554 - RNA, 19 nt, Human
uaagaugaaaacuaaaguc

SEQ ID NO: 669555 - RNA, 19 nt, Human
uacaaacacauguucaagu

SEQ ID NO: 669556 - RNA, 18 nt, Human
uacaacaauuauguuaau

SEQ ID NO: 669557 - RNA, 23 nt, Human
uacacauccaaaauaguaucucu

SEQ ID NO: 669558 - RNA, 19 nt, Human
uacacuacucugaagaccc

SEQ ID NO: 669559 - RNA, 21 nt, Human
uacuucuaguuuaccaauuuu

SEQ ID NO: 669560 - RNA, 19 nt, Human
uagaaaauuaccuuuaaaa

SEQ ID NO: 669561 - RNA, 20 nt, Human
uaggagauaaugcaaguaau

SEQ ID NO: 669562 - RNA, 26 nt, Human
uauacaaacacauguucaaguguaua

SEQ ID NO: 669563 - RNA, 29 nt, Human
uauacaaacacauguucaaguguauaauu

SEQ ID NO: 669564 - RNA, 23 nt, Human
ucacuggaccaaaagccucaaaa

SEQ ID NO: 669565 - RNA, 20 nt, Human
ucccccacagauaacugagu

SEQ ID NO: 669566 - RNA, 18 nt, Human
ucccugagaccgcgccgc

SEQ ID NO: 669567 - RNA, 21 nt, Human
uccuauggaauggacauaaag

SEQ ID NO: 669568 - RNA, 22 nt, Human
ugaaaaaacaaugcuccacaaa

SEQ ID NO: 669569 - RNA, 25 nt, Human
ugaaaaaacaaugcuccacaaauca

SEQ ID NO: 669570 - RNA, 22 nt, Human
ugaaacagccuaccaaaaauac

SEQ ID NO: 669571 - RNA, 23 nt, Human
ugaaguuuugugagaaggacuga

SEQ ID NO: 669572 - RNA, 21 nt, Human
ugagaaggacugauaggagau

SEQ ID NO: 669573 - RNA, 19 nt, Human
ugcauaugugugucuuccu

SEQ ID NO: 669574 - RNA, 23 nt, Human
uggacaaaaaauaagaugaaaac

SEQ ID NO: 669575 - RNA, 27 nt, Human
ugggaaaaacuuuggaaaaaaaaacac

SEQ ID NO: 669576 - RNA, 27 nt, Human
uuaaaacuaauuaugugaaaaaacaau

SEQ ID NO: 669577 - RNA, 24 nt, Human
uuauuacuaccacuucccccacag

SEQ ID NO: 669578 - RNA, 22 nt, Human
uucacuggaccaaaagccucaa

SEQ ID NO: 669579 - RNA, 24 nt, Human
uugucagcuauggauucguuucug

SEQ ID NO: 669580 - RNA, 21 nt, Human
uuuuuaaacaauagcuaccau

SEQ ID NO: 669581 - RNA, 19 nt, Human
aagccagaacuuucagaag

SEQ ID NO: 669582 - RNA, 20 nt, Human
acccgaugacaucagaacca

SEQ ID NO: 669583 - RNA, 23 nt, Human
agaacaccugagcaacuuuagca

SEQ ID NO: 669584 - RNA, 18 nt, Human
agacaggagauaccaggg

SEQ ID NO: 669585 - RNA, 25 nt, Human
agagaggaugugggguggggaaggc

SEQ ID NO: 669586 - RNA, 20 nt, Human
agagaucugcaucugacccc

SEQ ID NO: 669587 - RNA, 20 nt, Human
agcaggucauccuuuaggua

SEQ ID NO: 669588 - RNA, 20 nt, Human
agguggcccggggucggggg

SEQ ID NO: 669589 - RNA, 22 nt, Human
aucguguuucuuguuucugggc

SEQ ID NO: 669590 - RNA, 24 nt, Human
caaaucaaaaaggugaagucagga

SEQ ID NO: 669591 - RNA, 18 nt, Human
cacccaucccccgccaga

SEQ ID NO: 669592 - RNA, 20 nt, Human
cagcagcacuggggugagcc

SEQ ID NO: 669593 - RNA, 21 nt, Human
cagcagcacuggggugagccu

SEQ ID NO: 669594 - RNA, 23 nt, Human
cagccacugcucaggggcuccug

SEQ ID NO: 669595 - RNA, 22 nt, Human
caggccuggaugugcacaguag

SEQ ID NO: 669596 - RNA, 21 nt, Human
caucuucaguaaggccaagag

SEQ ID NO: 669597 - RNA, 22 nt, Human
ccacccaucccccgccagacac

SEQ ID NO: 669598 - RNA, 24 nt, Human
ccagacacauggacacaccgaggc

SEQ ID NO: 669599 - RNA, 23 nt, Human
cuaucccauaccuuugcaaagga

SEQ ID NO: 669600 - RNA, 18 nt, Human
cucagcuucuuggggccu

SEQ ID NO: 669601 - RNA, 25 nt, Human
cucagguaaaggugauguuugagga

SEQ ID NO: 669602 - RNA, 18 nt, Human
cuggugcuguuucuggag

SEQ ID NO: 669603 - RNA, 18 nt, Human
gaggagaagccagcagca

SEQ ID NO: 669604 - RNA, 19 nt, Human
gcacuggggugagccuugg

SEQ ID NO: 669605 - RNA, 18 nt, Human
gccagaaugguaucgugu

SEQ ID NO: 669606 - RNA, 18 nt, Human
gcggugguggcgagagug

SEQ ID NO: 669607 - RNA, 19 nt, Human
gcucaggggcuccugaccc

SEQ ID NO: 669608 - RNA, 18 nt, Human
ggagcagccacugcucag

SEQ ID NO: 669609 - RNA, 22 nt, Human
ggagcaguagggaagacaggag

SEQ ID NO: 669610 - RNA, 18 nt, Human
ggcccggggucgggggcu

SEQ ID NO: 669611 - RNA, 23 nt, Human
gggaagacaggagauaccaggga

SEQ ID NO: 669612 - RNA, 21 nt, Human
gggaaggguacauacccuagg

SEQ ID NO: 669613 - RNA, 25 nt, Human
gggcacacaccaaaucaaaaaggug

SEQ ID NO: 669614 - RNA, 21 nt, Human
gggcuggucagagcgcgaacg

SEQ ID NO: 669615 - RNA, 19 nt, Human
gggucgggggcuggcucug

SEQ ID NO: 669616 - RNA, 19 nt, Human
gugcagagaaauggcugug

SEQ ID NO: 669617 - RNA, 20 nt, Human
gugggguggggaaggccaga

SEQ ID NO: 669618 - RNA, 28 nt, Human
uaaggccaagagaggauguggggugggg

SEQ ID NO: 669619 - RNA, 19 nt, Human
uacaguccacccauccccc

SEQ ID NO: 669620 - RNA, 23 nt, Human
uagaacaccugagcaacuuuagc

SEQ ID NO: 669621 - RNA, 23 nt, Human
uaucccauaccuuugcaaaggag

SEQ ID NO: 669622 - RNA, 20 nt, Human
ucagaagagaagaaaauaca

SEQ ID NO: 669623 - RNA, 23 nt, Human
ucagacccacgcggugguggcga

SEQ ID NO: 669624 - RNA, 20 nt, Human
ucagugaaaggugacugugu

SEQ ID NO: 669625 - RNA, 18 nt, Human
ugaaauacauuaguccua

SEQ ID NO: 669626 - RNA, 18 nt, Human
ugcaaaggaggggagggg

SEQ ID NO: 669627 - RNA, 18 nt, Human
ugccggcggaacccgggg

SEQ ID NO: 669628 - RNA, 26 nt, Human
uggagcaguagggaagacaggagaua

SEQ ID NO: 669629 - RNA, 19 nt, Human
uggcccggggucgggggcu

SEQ ID NO: 669630 - RNA, 21 nt, Human
uggcccggggucgggggcugg

SEQ ID NO: 669631 - RNA, 20 nt, Human
uggggaaggccagaauggua

SEQ ID NO: 669632 - RNA, 21 nt, Human
uggucagagcgcgaacggcgg

SEQ ID NO: 669633 - RNA, 21 nt, Human
ugugcuggugcuguuucugga

SEQ ID NO: 669634 - RNA, 20 nt, Human
uguguaaaggccagaaacug

SEQ ID NO: 669635 - RNA, 19 nt, Human
uuaggguuuggagcaguag

SEQ ID NO: 669636 - RNA, 18 nt, Human
uucagaagagaagaaaau

SEQ ID NO: 669637 - RNA, 24 nt, Human
uuggagcaguagggaagacaggag

SEQ ID NO: 669638 - RNA, 21 nt, Human
uuuuuagcaccaaauggugga

SEQ ID NO: 669639 - RNA, 21 nt, Human
uuuuuuagcaccaaauggugg

SEQ ID NO: 669640 - RNA, 19 nt, Human
uuuuuuuuagcaccaaaug

SEQ ID NO: 669641 - RNA, 18 nt, Human
uuuuuuuuuuuuuuuuug

SEQ ID NO: 669642 - RNA, 20 nt, Human
uuuuuuuuuuuuuuuuuguu

SEQ ID NO: 669643 - RNA, 22 nt, Human
uuuuuuuuuuuuuuuuuguugg

SEQ ID NO: 669644 - RNA, 20 nt, Human
aaacuggcuacucugucccg

SEQ ID NO: 669645 - RNA, 23 nt, Human
aaaucugccuuaaauagggccaa

SEQ ID NO: 669646 - RNA, 20 nt, Human
aaauggccccggagagccca

SEQ ID NO: 669647 - RNA, 18 nt, Human
aacacauuuauucaaagc

SEQ ID NO: 669648 - RNA, 22 nt, Human
aacccaggcccccaggauccca

SEQ ID NO: 669649 - RNA, 21 nt, Human
aacugcagcccucaagggaac

SEQ ID NO: 669650 - RNA, 19 nt, Human
aagcacagacgcccagcac

SEQ ID NO: 669651 - RNA, 21 nt, Human
aagcacagacgcccagcacgu

SEQ ID NO: 669652 - RNA, 21 nt, Human
aagcagcaccuccaaagacac

SEQ ID NO: 669653 - RNA, 18 nt, Human
aagcaggcauuucaguua

SEQ ID NO: 669654 - RNA, 21 nt, Human
acacugcgcucuucuccgagc

SEQ ID NO: 669655 - RNA, 24 nt, Human
acacugcgcucuucuccgagcacc

SEQ ID NO: 669656 - RNA, 22 nt, Human
acccgcgaaacacucgcgauuu

SEQ ID NO: 669657 - RNA, 19 nt, Human
acccggagcugugcgggcg

SEQ ID NO: 669658 - RNA, 24 nt, Human
acccgugucguacagccuuccccc

SEQ ID NO: 669659 - RNA, 26 nt, Human
accgaagcacagacgcccagcacguc

SEQ ID NO: 669660 - RNA, 20 nt, Human
accggcagaaacuggcuacu

SEQ ID NO: 669661 - RNA, 24 nt, Human
accuccaaagacacaagaugguuu

SEQ ID NO: 669662 - RNA, 23 nt, Human
agaagagagacaguugcaaagag

SEQ ID NO: 669663 - RNA, 23 nt, Human
agacgcccagcacguccgcgcuu

SEQ ID NO: 669664 - RNA, 20 nt, Human
agacuccagcacuugcaaaa

SEQ ID NO: 669665 - RNA, 19 nt, Human
agcagcaccuccaaagaca

SEQ ID NO: 669666 - RNA, 21 nt, Human
agcccugaaaagguaaagcaa

SEQ ID NO: 669667 - RNA, 21 nt, Human
agccugaguagaacugcagcc

SEQ ID NO: 669668 - RNA, 25 nt, Human
aggcuggcgcuguggccaccccggg

SEQ ID NO: 669669 - RNA, 21 nt, Human
agguaaagcaaguaacuggca

SEQ ID NO: 669670 - RNA, 22 nt, Human
aguuuccgugaaagcccggagc

SEQ ID NO: 669671 - RNA, 22 nt, Human
aucuacucauguucuccucccc

SEQ ID NO: 669672 - RNA, 23 nt, Human
caaaagccagaguucuccaccag

SEQ ID NO: 669673 - RNA, 21 nt, Human
caaagggucccuucauggcac

SEQ ID NO: 669674 - RNA, 19 nt, Human
caccuccuuuccccacccg

SEQ ID NO: 669675 - RNA, 20 nt, Human
cacuuuagacagggcguggg

SEQ ID NO: 669676 - RNA, 21 nt, Human
cagcuguuauugcaaauggcc

SEQ ID NO: 669677 - RNA, 20 nt, Human
caggaucccagagccacccc

SEQ ID NO: 669678 - RNA, 18 nt, Human
cagggcccggucucggga

SEQ ID NO: 669679 - RNA, 23 nt, Human
cagggcccggucucgggaguuuc

SEQ ID NO: 669680 - RNA, 19 nt, Human
cauguucuccucccccaaa

SEQ ID NO: 669681 - RNA, 22 nt, Human
ccagagccacccgcuugaguag

SEQ ID NO: 669682 - RNA, 20 nt, Human
ccagaguucuccaccagccu

SEQ ID NO: 669683 - RNA, 22 nt, Human
ccagaguucuccaccagccuga

SEQ ID NO: 669684 - RNA, 20 nt, Human
ccaggaucccagagccaccc

SEQ ID NO: 669685 - RNA, 19 nt, Human
cccaaaguggaucaggagc

SEQ ID NO: 669686 - RNA, 18 nt, Human
cccaggaucccagagcca

SEQ ID NO: 669687 - RNA, 22 nt, Human
cccaggcccccaggaucccaga

SEQ ID NO: 669688 - RNA, 22 nt, Human
cccccaggaucccagagccacc

SEQ ID NO: 669689 - RNA, 23 nt, Human
cccccaggaucccagagccaccc

SEQ ID NO: 669690 - RNA, 27 nt, Human
ccccgcccccaccuccuuuccccaccc

SEQ ID NO: 669691 - RNA, 26 nt, Human
cccgcaacccagugcgugcccaggaa

SEQ ID NO: 669692 - RNA, 23 nt, Human
cccgcccccaccuccuuucccca

SEQ ID NO: 669693 - RNA, 24 nt, Human
cccgcccccaccuccuuuccccac

SEQ ID NO: 669694 - RNA, 24 nt, Human
cccugucugggcacccggagcugu

SEQ ID NO: 669695 - RNA, 18 nt, Human
ccgcggcggagcgggcgc

SEQ ID NO: 669696 - RNA, 19 nt, Human
ccucaggagacuccagcac

SEQ ID NO: 669697 - RNA, 25 nt, Human
ccucaggagacuccagcacuugcaa

SEQ ID NO: 669698 - RNA, 27 nt, Human
ccuucccccaccacucugagaagagag

SEQ ID NO: 669699 - RNA, 19 nt, Human
ccuuuagagugagugaaca

SEQ ID NO: 669700 - RNA, 21 nt, Human
cgcggcggagcgggcgcggag

SEQ ID NO: 669701 - RNA, 23 nt, Human
cggagcccgccaggcacucuagg

SEQ ID NO: 669702 - RNA, 19 nt, Human
cuaccgaagcacagacgcc

SEQ ID NO: 669703 - RNA, 21 nt, Human
cuccgcgccucucuacccuuc

SEQ ID NO: 669704 - RNA, 24 nt, Human
cuccgugguuccggcgcaccgcga

SEQ ID NO: 669705 - RNA, 24 nt, Human
cucuacccuuccaccaccauucaa

SEQ ID NO: 669706 - RNA, 20 nt, Human
gcccccaacccaggccccca

SEQ ID NO: 669707 - RNA, 21 nt, Human
gcccccaccuccuuuccccac

SEQ ID NO: 669708 - RNA, 20 nt, Human
gcgcggccaggggcgguggu

SEQ ID NO: 669709 - RNA, 21 nt, Human
gcgcggugggccgcggcggag

SEQ ID NO: 669710 - RNA, 20 nt, Human
gcugggggcucggcugccgg

SEQ ID NO: 669711 - RNA, 26 nt, Human
ggaccggggccggggcggacgcggaa

SEQ ID NO: 669712 - RNA, 21 nt, Human
ggagagcccauuauaagcugc

SEQ ID NO: 669713 - RNA, 24 nt, Human
ggagaggaggaacccagggcccgg

SEQ ID NO: 669714 - RNA, 24 nt, Human
ggcgugggguucacuccgcgccuc

SEQ ID NO: 669715 - RNA, 21 nt, Human
ggcugugugucccuggagugu

SEQ ID NO: 669716 - RNA, 23 nt, Human
gggaaccccuugcccuccagucc

SEQ ID NO: 669717 - RNA, 20 nt, Human
gggccgcggcggagcgggcg

SEQ ID NO: 669718 - RNA, 19 nt, Human
gggggaggggcagagggag

SEQ ID NO: 669719 - RNA, 23 nt, Human
guccucaggagacuccagcacuu

SEQ ID NO: 669720 - RNA, 19 nt, Human
guggauuguggccacaugg

SEQ ID NO: 669721 - RNA, 19 nt, Human
guggauuguggccacaugg

SEQ ID NO: 669722 - RNA, 19 nt, Human
uaacuccuauucaaccccc

SEQ ID NO: 669723 - RNA, 18 nt, Human
uaagcagcaccuccaaag

SEQ ID NO: 669724 - RNA, 19 nt, Human
uaagucuggaccggggccg

SEQ ID NO: 669725 - RNA, 21 nt, Human
uagcccccaacccaggccccc

SEQ ID NO: 669726 - RNA, 21 nt, Human
uaggcugugugucccuggagu

SEQ ID NO: 669727 - RNA, 23 nt, Human
ucacauggcgucucccuagcccc

SEQ ID NO: 669728 - RNA, 22 nt, Human
ucaggagacuccagcacuugca

SEQ ID NO: 669729 - RNA, 18 nt, Human
ucauguucuccuccccca

SEQ ID NO: 669730 - RNA, 23 nt, Human
uccaaaagccagaguucuccacc

SEQ ID NO: 669731 - RNA, 21 nt, Human
uccagacacuccggugcgaag

SEQ ID NO: 669732 - RNA, 22 nt, Human
uccccgcccccaccuccuuucc

SEQ ID NO: 669733 - RNA, 22 nt, Human
ucccuagcccccaacccaggcc

SEQ ID NO: 669734 - RNA, 19 nt, Human
uccggcgcaccgcgauccg

SEQ ID NO: 669735 - RNA, 24 nt, Human
ucucuacccuuccaccaccauuca

SEQ ID NO: 669736 - RNA, 21 nt, Human
ucugaaaauacacuuuagaca

SEQ ID NO: 669737 - RNA, 23 nt, Human
ugaacaguauguuccaagcacuu

SEQ ID NO: 669738 - RNA, 19 nt, Human
ugagaagagagacaguugc

SEQ ID NO: 669739 - RNA, 18 nt, Human
ugaggcuggcgcuguggc

SEQ ID NO: 669740 - RNA, 23 nt, Human
ugagugaacaguauguuccaagc

SEQ ID NO: 669741 - RNA, 20 nt, Human
ugagugaacaguauguuccc

SEQ ID NO: 669742 - RNA, 19 nt, Human
ugcaaagagagcgcagggg

SEQ ID NO: 669743 - RNA, 20 nt, Human
ugcagcccucaagggaaccc

SEQ ID NO: 669744 - RNA, 18 nt, Human
ugcccaggaaacagugac

SEQ ID NO: 669745 - RNA, 19 nt, Human
uggaugaugaacaagccau

SEQ ID NO: 669746 - RNA, 20 nt, Human
uggauuguggccacaugguc

SEQ ID NO: 669747 - RNA, 20 nt, Human
uggcaaagcuggcagcuucu

SEQ ID NO: 669748 - RNA, 23 nt, Human
uguucuccucccccaaaguggau

SEQ ID NO: 669749 - RNA, 19 nt, Human
uguuugauauuaagcagca

SEQ ID NO: 669750 - RNA, 21 nt, Human
uuaacuccuauucaaccccca

SEQ ID NO: 669751 - RNA, 21 nt, Human
uuaagcagcaccuccaaagac

SEQ ID NO: 669752 - RNA, 25 nt, Human
uuccaaaagccagaguucuccaccu

SEQ ID NO: 669753 - RNA, 23 nt, Human
uugauauuaagcagcaccuccaa

SEQ ID NO: 669754 - RNA, 19 nt, Human
uuuuucgguuccucgucau

SEQ ID NO: 669755 - RNA, 22 nt, Human
aaaaaaaaaagaggggggcaag

SEQ ID NO: 669756 - RNA, 23 nt, Human
aaaaaaaaaccucacuuucccca

SEQ ID NO: 669757 - RNA, 21 nt, Human
aaaaccucacuuuccccacaa

SEQ ID NO: 669758 - RNA, 24 nt, Human
aaaaccucacuuuccccacaaaaa

SEQ ID NO: 669759 - RNA, 20 nt, Human
aaaaggccaaagggcaggac

SEQ ID NO: 669760 - RNA, 21 nt, Human
aaaaggccaaagggcaggacg

SEQ ID NO: 669761 - RNA, 22 nt, Human
aaagaccucccucauccucuca

SEQ ID NO: 669762 - RNA, 24 nt, Human
aaagcacaauacuguuaucacaaa

SEQ ID NO: 669763 - RNA, 23 nt, Human
aaagcagauaggaaggagggaag

SEQ ID NO: 669764 - RNA, 19 nt, Human
aacauucuccuaagucacc

SEQ ID NO: 669765 - RNA, 18 nt, Human
aaccacugaccccauccc

SEQ ID NO: 669766 - RNA, 20 nt, Human
aaccgcgcugggaacagggu

SEQ ID NO: 669767 - RNA, 20 nt, Human
aacucuucucuccuucccuu

SEQ ID NO: 669768 - RNA, 25 nt, Human
aagaauucuagacccaggccuggcc

SEQ ID NO: 669769 - RNA, 22 nt, Human
aagaccucccucauccucucag

SEQ ID NO: 669770 - RNA, 18 nt, Human
aagcagauaggaaggagg

SEQ ID NO: 669771 - RNA, 22 nt, Human
aagcauuucaggggaggagaug

SEQ ID NO: 669772 - RNA, 20 nt, Human
acacaccagcagccacgcaa

SEQ ID NO: 669773 - RNA, 22 nt, Human
acaccaggcagcagcaacaguu

SEQ ID NO: 669774 - RNA, 19 nt, Human
acagccacgcagccccaca

SEQ ID NO: 669775 - RNA, 19 nt, Human
acagccugccucuccagga

SEQ ID NO: 669776 - RNA, 24 nt, Human
acaugacacauucaucugcuggaa

SEQ ID NO: 669777 - RNA, 27 nt, Human
accccaucccugcaggauguugguggg

SEQ ID NO: 669778 - RNA, 19 nt, Human
acgcuacgaggaagaggac

SEQ ID NO: 669779 - RNA, 24 nt, Human
acugaccccacacaccagcagcca

SEQ ID NO: 669780 - RNA, 24 nt, Human
acuguuaucacaaaaaaaaucauc

SEQ ID NO: 669781 - RNA, 21 nt, Human
agaaaugugguggcccagggc

SEQ ID NO: 669782 - RNA, 21 nt, Human
agaccccaggucagagcccag

SEQ ID NO: 669783 - RNA, 23 nt, Human
agagaggcaaaucgagccucagg

SEQ ID NO: 669784 - RNA, 20 nt, Human
agagagggcaggaggcugcc

SEQ ID NO: 669785 - RNA, 18 nt, Human
agagcaucugaagcgagc

SEQ ID NO: 669786 - RNA, 19 nt, Human
agaggccuggggagaggag

SEQ ID NO: 669787 - RNA, 20 nt, Human
agaggccuggggagaggagg

SEQ ID NO: 669788 - RNA, 22 nt, Human
agagggcaggaggcugcccaca

SEQ ID NO: 669789 - RNA, 22 nt, Human
agaggggugucugggaaacgcu

SEQ ID NO: 669790 - RNA, 25 nt, Human
agauaggaaggagggaaggcagagc

SEQ ID NO: 669791 - RNA, 21 nt, Human
agauguccccuguucauccuc

SEQ ID NO: 669792 - RNA, 23 nt, Human
agcagggagccgacuggcagggg

SEQ ID NO: 669793 - RNA, 21 nt, Human
agccacgcagccccacacggc

SEQ ID NO: 669794 - RNA, 23 nt, Human
agccacgcagccccacacggcaa

SEQ ID NO: 669795 - RNA, 20 nt, Human
agcccugggagcugaggaca

SEQ ID NO: 669796 - RNA, 22 nt, Human
aggaaggccagacacaccgaag

SEQ ID NO: 669797 - RNA, 21 nt, Human
aggagcagacgcuacgaggaa

SEQ ID NO: 669798 - RNA, 23 nt, Human
aggagggggcagagaucgguccc

SEQ ID NO: 669799 - RNA, 22 nt, Human
aggcaccuggcucaggauucug

SEQ ID NO: 669800 - RNA, 26 nt, Human
aggcaccuggcucaggauucugcggc

SEQ ID NO: 669801 - RNA, 19 nt, Human
aggcagccaaguccuuggu

SEQ ID NO: 669802 - RNA, 24 nt, Human
agggaaaagggguuuggcaggagg

SEQ ID NO: 669803 - RNA, 19 nt, Human
aggggaggagaugucagua

SEQ ID NO: 669804 - RNA, 23 nt, Human
aggugagugguucccaggcaucc

SEQ ID NO: 669805 - RNA, 20 nt, Human
agucggcgugggcagguggg

SEQ ID NO: 669806 - RNA, 20 nt, Human
agucggcgugggcagguggg

SEQ ID NO: 669807 - RNA, 19 nt, Human
augcaguuuacuggaaaaa

SEQ ID NO: 669808 - RNA, 18 nt, Human
auggggcaacugagaccc

SEQ ID NO: 669809 - RNA, 22 nt, Human
auggggcaacugagacccagag

SEQ ID NO: 669810 - RNA, 20 nt, Human
augugggccgcagccccagg

SEQ ID NO: 669811 - RNA, 19 nt, Human
caaaagccuuuuauucauu

SEQ ID NO: 669812 - RNA, 21 nt, Human
caaaauaaaaaacaaaagcac

SEQ ID NO: 669813 - RNA, 22 nt, Human
caaaauaaaaaacaaaagcaca

SEQ ID NO: 669814 - RNA, 25 nt, Human
caaacaccaaagcaagaguugagaa

SEQ ID NO: 669815 - RNA, 18 nt, Human
caaagagcaagggccgga

SEQ ID NO: 669816 - RNA, 23 nt, Human
caaagcaagaguugagaaaccua

SEQ ID NO: 669817 - RNA, 20 nt, Human
caaagcagcagcaagaauuc

SEQ ID NO: 669818 - RNA, 18 nt, Human
caagaccaaccagcccgg

SEQ ID NO: 669819 - RNA, 27 nt, Human
caagcauaccaucugcuaaggccagaa

SEQ ID NO: 669820 - RNA, 18 nt, Human
caaggaggcggggguccc

SEQ ID NO: 669821 - RNA, 18 nt, Human
cacaccaggcagcagcaa

SEQ ID NO: 669822 - RNA, 21 nt, Human
cacagcaucaccagccacagg

SEQ ID NO: 669823 - RNA, 23 nt, Human
caccaaagcaagaguugagaaac

SEQ ID NO: 669824 - RNA, 24 nt, Human
caccaacccccuccgaaaaaacac

SEQ ID NO: 669825 - RNA, 24 nt, Human
caccagccacaggaaacugaaccc

SEQ ID NO: 669826 - RNA, 19 nt, Human
caccucuccccucuccaaa

SEQ ID NO: 669827 - RNA, 20 nt, Human
caccucuccccucuccaaaa

SEQ ID NO: 669828 - RNA, 24 nt, Human
cacggcaacgucacuacggcagag

SEQ ID NO: 669829 - RNA, 20 nt, Human
cacuuuccccacaaaaagca

SEQ ID NO: 669830 - RNA, 23 nt, Human
cagagggugacacguacgcuugc

SEQ ID NO: 669831 - RNA, 18 nt, Human
cagaguucucugaggucc

SEQ ID NO: 669832 - RNA, 20 nt, Human
cagaguucucugaggucccc

SEQ ID NO: 669833 - RNA, 19 nt, Human
cagauggggcaacugagac

SEQ ID NO: 669834 - RNA, 22 nt, Human
cagcaccccgccagggccggga

SEQ ID NO: 669835 - RNA, 24 nt, Human
cagcagggaaaagggguuuggcag

SEQ ID NO: 669836 - RNA, 22 nt, Human
cagccccacacggcaacgucac

SEQ ID NO: 669837 - RNA, 18 nt, Human
cagcccccuccucgccuc

SEQ ID NO: 669838 - RNA, 18 nt, Human
caggucagagcccagcug

SEQ ID NO: 669839 - RNA, 25 nt, Human
cauggaaaagggccuucaagaccag

SEQ ID NO: 669840 - RNA, 24 nt, Human
ccaacccccuccgaaaaaacacaa

SEQ ID NO: 669841 - RNA, 21 nt, Human
ccacaccuguggcuucaaacc

SEQ ID NO: 669842 - RNA, 20 nt, Human
ccacaugcuuaagcccagaa

SEQ ID NO: 669843 - RNA, 24 nt, Human
ccaccaacccccuccgaaaaaaca

SEQ ID NO: 669844 - RNA, 23 nt, Human
ccaccauguucguucccugcccc

SEQ ID NO: 669845 - RNA, 25 nt, Human
ccagaagccacaccuguggcuucaa

SEQ ID NO: 669846 - RNA, 21 nt, Human
ccaggcaaacucuagugaaaa

SEQ ID NO: 669847 - RNA, 22 nt, Human
cccacaaucaaagagcaagggc

SEQ ID NO: 669848 - RNA, 20 nt, Human
cccacacaccagcagccacg

SEQ ID NO: 669849 - RNA, 23 nt, Human
cccaccaacccccuccgaaaaaa

SEQ ID NO: 669850 - RNA, 20 nt, Human
cccagggccucugaggacuc

SEQ ID NO: 669851 - RNA, 18 nt, Human
ccccagaccccaggucag

SEQ ID NO: 669852 - RNA, 20 nt, Human
cccccuccucgccuccccgc

SEQ ID NO: 669853 - RNA, 24 nt, Human
ccccgccagggccgggaagggcgg

SEQ ID NO: 669854 - RNA, 19 nt, Human
ccccgcccccccgggccgg

SEQ ID NO: 669855 - RNA, 25 nt, Human
ccccgcccccccgggccggacccgg

SEQ ID NO: 669856 - RNA, 20 nt, Human
ccccgcuccagccucccucc

SEQ ID NO: 669857 - RNA, 20 nt, Human
ccccuagacacccucggccc

SEQ ID NO: 669858 - RNA, 23 nt, Human
cccgggccggacccgguuggggc

SEQ ID NO: 669859 - RNA, 19 nt, Human
cccugccccagaccccagg

SEQ ID NO: 669860 - RNA, 22 nt, Human
cccuggccccagugcgaggcuc

SEQ ID NO: 669861 - RNA, 18 nt, Human
cccugugcaaggacuccu

SEQ ID NO: 669862 - RNA, 25 nt, Human
ccguggccgacuggccgccuggggc

SEQ ID NO: 669863 - RNA, 20 nt, Human
ccucaaagaauccacccuuc

SEQ ID NO: 669864 - RNA, 25 nt, Human
ccucauccucucagcccaaagccac

SEQ ID NO: 669865 - RNA, 24 nt, Human
ccucccgggucaagggcagccggc

SEQ ID NO: 669866 - RNA, 21 nt, Human
ccucggcccacccacagccuc

SEQ ID NO: 669867 - RNA, 21 nt, Human
ccucggcggccgcggcccccg

SEQ ID NO: 669868 - RNA, 24 nt, Human
ccucucagcccaaagccaccaugu

SEQ ID NO: 669869 - RNA, 20 nt, Human
ccucugaggacucacagccc

SEQ ID NO: 669870 - RNA, 19 nt, Human
ccugcgaggcagccaaguc

SEQ ID NO: 669871 - RNA, 21 nt, Human
ccuggcccugacagucuggga

SEQ ID NO: 669872 - RNA, 18 nt, Human
ccuggggccgcaccugcc

SEQ ID NO: 669873 - RNA, 20 nt, Human
ccuucaagaccaaccagccc

SEQ ID NO: 669874 - RNA, 22 nt, Human
cgaaggacgagggacgagggca

SEQ ID NO: 669875 - RNA, 21 nt, Human
cgagccucaggcagaggccaa

SEQ ID NO: 669876 - RNA, 18 nt, Human
cgagggcaaggcagaguu

SEQ ID NO: 669877 - RNA, 27 nt, Human
cgcagauauuaaaaaaaaaaaaaaaaa

SEQ ID NO: 669878 - RNA, 27 nt, Human
cggcaacgucacuacggcagaggccuu

SEQ ID NO: 669879 - RNA, 21 nt, Human
cggcccccgcccccccgggcc

SEQ ID NO: 669880 - RNA, 24 nt, Human
cggcggccgcggcccccgcccccc

SEQ ID NO: 669881 - RNA, 21 nt, Human
cgggcugugggcccaccggca

SEQ ID NO: 669882 - RNA, 19 nt, Human
cggggacagaggcagcagg

SEQ ID NO: 669883 - RNA, 23 nt, Human
cuagacccaggccuggcccugac

SEQ ID NO: 669884 - RNA, 19 nt, Human
cucacuuuccccacaaaaa

SEQ ID NO: 669885 - RNA, 23 nt, Human
cuccccaccaacccccuccgaaa

SEQ ID NO: 669886 - RNA, 24 nt, Human
cuccccaccaacccccuccgaaaa

SEQ ID NO: 669887 - RNA, 18 nt, Human
cucccucauccucucagc

SEQ ID NO: 669888 - RNA, 23 nt, Human
cucccucauccucucagcccaaa

SEQ ID NO: 669889 - RNA, 18 nt, Human
cuccuucccucccuccca

SEQ ID NO: 669890 - RNA, 21 nt, Human
cucucagcccaaagccaccau

SEQ ID NO: 669891 - RNA, 25 nt, Human
cugccaggcaaacucuagugaaaau

SEQ ID NO: 669892 - RNA, 23 nt, Human
cugcuggaacugaccccacacac

SEQ ID NO: 669893 - RNA, 18 nt, Human
cuggggccgcaccugccu

SEQ ID NO: 669894 - RNA, 21 nt, Human
cuggggcuggugccugcccug

SEQ ID NO: 669895 - RNA, 18 nt, Human
cuguguguggaugcggaa

SEQ ID NO: 669896 - RNA, 22 nt, Human
gaacucuucucuccuucccucc

SEQ ID NO: 669897 - RNA, 21 nt, Human
gaaggcuggguggacgcacgg

SEQ ID NO: 669898 - RNA, 21 nt, Human
gaagggguccacaugcuuaag

SEQ ID NO: 669899 - RNA, 24 nt, Human
gaaugcuccagccaaggggaacag

SEQ ID NO: 669900 - RNA, 19 nt, Human
gacucacagcccccuccuc

SEQ ID NO: 669901 - RNA, 18 nt, Human
gagcaucugaagcgagcc

SEQ ID NO: 669902 - RNA, 20 nt, Human
gaggggggcaaggcuuccca

SEQ ID NO: 669903 - RNA, 24 nt, Human
gagucccaggucgcccgggccagc

SEQ ID NO: 669904 - RNA, 24 nt, Human
gaugguccuggggccgcaccugcc

SEQ ID NO: 669905 - RNA, 23 nt, Human
gcaaagcagcagcaagaauucua

SEQ ID NO: 669906 - RNA, 22 nt, Human
gcacgggguuggugucagggcu

SEQ ID NO: 669907 - RNA, 21 nt, Human
gcaggaggcauucgggcugga

SEQ ID NO: 669908 - RNA, 23 nt, Human
gcccagggccucugaggacucac

SEQ ID NO: 669909 - RNA, 24 nt, Human
gccccagaccccaggucagagccc

SEQ ID NO: 669910 - RNA, 19 nt, Human
gccuggggagaggaggggg

SEQ ID NO: 669911 - RNA, 22 nt, Human
gcucugggcuggcucgggcugu

SEQ ID NO: 669912 - RNA, 18 nt, Human
gcuggcucgggcuguggg

SEQ ID NO: 669913 - RNA, 19 nt, Human
gcugugacucagacagucc

SEQ ID NO: 669914 - RNA, 18 nt, Human
ggaaccacugaccccauc

SEQ ID NO: 669915 - RNA, 18 nt, Human
ggaaccgaggaccaaagu

SEQ ID NO: 669916 - RNA, 21 nt, Human
ggaacugaccccacacaccag

SEQ ID NO: 669917 - RNA, 21 nt, Human
ggaaggccagacacaccgaag

SEQ ID NO: 669918 - RNA, 19 nt, Human
ggacaaggugugccacaug

SEQ ID NO: 669919 - RNA, 19 nt, Human
ggacgagggcaaggcagag

SEQ ID NO: 669920 - RNA, 19 nt, Human
ggagaggagagccggggcc

SEQ ID NO: 669921 - RNA, 20 nt, Human
ggcaggcaccgcuggaagcc

SEQ ID NO: 669922 - RNA, 23 nt, Human
ggccgacuggccgccuggggcug

SEQ ID NO: 669923 - RNA, 22 nt, Human
ggccgcggcccccgcccccccg

SEQ ID NO: 669924 - RNA, 19 nt, Human
ggccuggggagaggagggg

SEQ ID NO: 669925 - RNA, 21 nt, Human
ggcugagguggccucauggca

SEQ ID NO: 669926 - RNA, 19 nt, Human
ggcuucuuggccgcugcag

SEQ ID NO: 669927 - RNA, 22 nt, Human
gggcaggugggucagggcgugc

SEQ ID NO: 669928 - RNA, 19 nt, Human
gggcugagguggccucaug

SEQ ID NO: 669929 - RNA, 22 nt, Human
gggcuggcucgggcugugggcc

SEQ ID NO: 669930 - RNA, 22 nt, Human
ggggaggggggguuaccguggg

SEQ ID NO: 669931 - RNA, 23 nt, Human
ggggcugccaaugaacgccucag

SEQ ID NO: 669932 - RNA, 21 nt, Human
gggguuggcugaaugcuccag

SEQ ID NO: 669933 - RNA, 23 nt, Human
ggguuggugucagggcugaggug

SEQ ID NO: 669934 - RNA, 20 nt, Human
ggucaagggcagccggcugu

SEQ ID NO: 669935 - RNA, 22 nt, Human
ggucccaaagagcgcucaaggg

SEQ ID NO: 669936 - RNA, 19 nt, Human
gguccccuugauuucugcu

SEQ ID NO: 669937 - RNA, 20 nt, Human
ggucccugccaggcaaacuc

SEQ ID NO: 669938 - RNA, 27 nt, Human
ggugcaggacaggggagaggggaacgc

SEQ ID NO: 669939 - RNA, 21 nt, Human
ggugcugagucccaggucgcc

SEQ ID NO: 669940 - RNA, 23 nt, Human
guauauaaaaaaaaaaccucacu

SEQ ID NO: 669941 - RNA, 19 nt, Human
guggaaccacugaccccau

SEQ ID NO: 669942 - RNA, 24 nt, Human
uaaaaaaaaaaaaaaaaagagggg

SEQ ID NO: 669943 - RNA, 23 nt, Human
uaaaaaaaaaaccucacuuuccc

SEQ ID NO: 669944 - RNA, 28 nt, Human
uaaaaaaaaaaccucacuuuccccacaa

SEQ ID NO: 669945 - RNA, 23 nt, Human
uaaaaaacaaaagcacacgcgca

SEQ ID NO: 669946 - RNA, 26 nt, Human
uaaaaaacaaaagcacacgcgcaaga

SEQ ID NO: 669947 - RNA, 21 nt, Human
uaagcccagacacccucagcc

SEQ ID NO: 669948 - RNA, 21 nt, Human
ucaaaauaaaaaacaaaagca

SEQ ID NO: 669949 - RNA, 21 nt, Human
ucaaagaccaccucuccugac

SEQ ID NO: 669950 - RNA, 22 nt, Human
ucaagggcagccggcugugugu

SEQ ID NO: 669951 - RNA, 25 nt, Human
ucauaauuaaucauccuagccacgc

SEQ ID NO: 669952 - RNA, 19 nt, Human
uccaccucuccccucucca

SEQ ID NO: 669953 - RNA, 25 nt, Human
uccaccucuccccucuccaaaaauc

SEQ ID NO: 669954 - RNA, 19 nt, Human
uccagggauggccuagcag

SEQ ID NO: 669955 - RNA, 19 nt, Human
uccaugcugcggcaaacac

SEQ ID NO: 669956 - RNA, 24 nt, Human
uccaugcugcggcaaacaccaaag

SEQ ID NO: 669957 - RNA, 19 nt, Human
ucccucgggcugcuggggu

SEQ ID NO: 669958 - RNA, 22 nt, Human
ucccugccccagaccccagguc

SEQ ID NO: 669959 - RNA, 23 nt, Human
uccuaagucaccaucaacacaaa

SEQ ID NO: 669960 - RNA, 22 nt, Human
ucggcggccgcggcccccgccc

SEQ ID NO: 669961 - RNA, 20 nt, Human
ucuagacccaggccuggccc

SEQ ID NO: 669962 - RNA, 18 nt, Human
ucuccccucuccaaaaau

SEQ ID NO: 669963 - RNA, 22 nt, Human
ucugcaucagagcaucugaagc

SEQ ID NO: 669964 - RNA, 21 nt, Human
ucugcggcaucacugcagcca

SEQ ID NO: 669965 - RNA, 19 nt, Human
ucugcuggaacugacccca

SEQ ID NO: 669966 - RNA, 18 nt, Human
ucuugaaauccccucccc

SEQ ID NO: 669967 - RNA, 21 nt, Human
ugaaaauggccaguguccagc

SEQ ID NO: 669968 - RNA, 18 nt, Human
ugaaaccccaggugcacu

SEQ ID NO: 669969 - RNA, 18 nt, Human
ugacaugaugucggcaug

SEQ ID NO: 669970 - RNA, 22 nt, Human
ugaccccacacaccagcagcca

SEQ ID NO: 669971 - RNA, 20 nt, Human
ugacuaggcagaaccccuag

SEQ ID NO: 669972 - RNA, 19 nt, Human
ugacucugcaaagcagcag

SEQ ID NO: 669973 - RNA, 22 nt, Human
ugacucugcaaagcagcagcaa

SEQ ID NO: 669974 - RNA, 23 nt, Human
ugaggacacaccaggcagcagca

SEQ ID NO: 669975 - RNA, 21 nt, Human
ugagugguucccaggcaucca

SEQ ID NO: 669976 - RNA, 20 nt, Human
ugcacauguaaacggugggc

SEQ ID NO: 669977 - RNA, 19 nt, Human
ugccccuucuuccagcucc

SEQ ID NO: 669978 - RNA, 24 nt, Human
ugccucaguggcaggccguccccg

SEQ ID NO: 669979 - RNA, 20 nt, Human
ugcugagucccaggucgccc

SEQ ID NO: 669980 - RNA, 27 nt, Human
ugcugagucccaggucgcccgggccag

SEQ ID NO: 669981 - RNA, 22 nt, Human
ugcugcgggaagggacaaggug

SEQ ID NO: 669982 - RNA, 22 nt, Human
ugcuggcaauuggagccggugg

SEQ ID NO: 669983 - RNA, 19 nt, Human
uggaaaaagcagauaggaa

SEQ ID NO: 669984 - RNA, 22 nt, Human
uggaggccugcuugcugagggu

SEQ ID NO: 669985 - RNA, 22 nt, Human
uggcgggugggcaauggaggcu

SEQ ID NO: 669986 - RNA, 24 nt, Human
ugggaagcggcuucucaaggacac

SEQ ID NO: 669987 - RNA, 21 nt, Human
ugggcuggcucgggcuguggg

SEQ ID NO: 669988 - RNA, 22 nt, Human
uggggcuggugccugcccuggc

SEQ ID NO: 669989 - RNA, 19 nt, Human
ugggggaggggggguuacc

SEQ ID NO: 669990 - RNA, 21 nt, Human
ugggugcaggacaggggagag

SEQ ID NO: 669991 - RNA, 19 nt, Human
ugguccaggguggccucgc

SEQ ID NO: 669992 - RNA, 19 nt, Human
ugguucccaggcauccagc

SEQ ID NO: 669993 - RNA, 20 nt, Human
ugguucccaggcauccagcu

SEQ ID NO: 669994 - RNA, 21 nt, Human
ugucagucugugucuucuagg

SEQ ID NO: 669995 - RNA, 21 nt, Human
uguggagaggcgcacgggcug

SEQ ID NO: 669996 - RNA, 21 nt, Human
ugugguggcccagggccucug

SEQ ID NO: 669997 - RNA, 22 nt, Human
uucaaaauaaaaaacaaaagca

SEQ ID NO: 669998 - RNA, 24 nt, Human
uuccccacaaaaagcacaauacug

SEQ ID NO: 669999 - RNA, 22 nt, Human
uuccucgggcuggaggccugcu

SEQ ID NO: 670000 - RNA, 27 nt, Human
uucuaggacagaagguaguuguuuuuu

SEQ ID NO: 670001 - RNA, 22 nt, Human
uucugggucccaaagagcgcuc

SEQ ID NO: 670002 - RNA, 22 nt, Human
uucuuccagcucccagccuuag

SEQ ID NO: 670003 - RNA, 23 nt, Human
uuggccgcugcaggccaccaucc

SEQ ID NO: 670004 - RNA, 19 nt, Human
uuucaggggaggagauguc

SEQ ID NO: 670005 - RNA, 22 nt, Human
uuuggcaggaggcauucgggcu

SEQ ID NO: 670006 - RNA, 19 nt, Human
aaagugcuaggauuacagg

SEQ ID NO: 670007 - RNA, 24 nt, Human
aaagugcuaggauuacaggcauga

SEQ ID NO: 670008 - RNA, 25 nt, Human
aaauguagaaaaucaaagcuaaacc

SEQ ID NO: 670009 - RNA, 26 nt, Human
aagugcuaggauuacaggcaugagcc

SEQ ID NO: 670010 - RNA, 18 nt, Human
acauguauggccuauggc

SEQ ID NO: 670011 - RNA, 21 nt, Human
accacacugguauauggcaca

SEQ ID NO: 670012 - RNA, 23 nt, Human
accucagccucccaaagugcuag

SEQ ID NO: 670013 - RNA, 23 nt, Human
acucuaucuuagaguaucacaga

SEQ ID NO: 670014 - RNA, 18 nt, Human
acucugucacccaggcug

SEQ ID NO: 670015 - RNA, 25 nt, Human
acucugucacccaggcuggagggca

SEQ ID NO: 670016 - RNA, 20 nt, Human
agaaaaagagaggucuaaua

SEQ ID NO: 670017 - RNA, 24 nt, Human
agaaagggacaccugggaagagaa

SEQ ID NO: 670018 - RNA, 22 nt, Human
agauuuuccugacucagccucc

SEQ ID NO: 670019 - RNA, 18 nt, Human
agccacagcgcacccagc

SEQ ID NO: 670020 - RNA, 19 nt, Human
agccacagcgcacccagcc

SEQ ID NO: 670021 - RNA, 22 nt, Human
agcuaaaccccucaguuaucuc

SEQ ID NO: 670022 - RNA, 18 nt, Human
aggagaaagggacaccug

SEQ ID NO: 670023 - RNA, 23 nt, Human
aggaggacuuaaggacacuaggg

SEQ ID NO: 670024 - RNA, 18 nt, Human
aucucacucugucaccca

SEQ ID NO: 670025 - RNA, 19 nt, Human
augagccacagcgcaccca

SEQ ID NO: 670026 - RNA, 24 nt, Human
auggcauuucaucauguuggucag

SEQ ID NO: 670027 - RNA, 24 nt, Human
auuuuuauauuuuuaguggagaug

SEQ ID NO: 670028 - RNA, 24 nt, Human
caaagugcuaggauuacaggcaug

SEQ ID NO: 670029 - RNA, 27 nt, Human
cacacagacaccacacugguauauggc

SEQ ID NO: 670030 - RNA, 24 nt, Human
cacaccaccaugccuggcuaauuu

SEQ ID NO: 670031 - RNA, 22 nt, Human
cacucugucacccaggcuggag

SEQ ID NO: 670032 - RNA, 25 nt, Human
cacucugucacccaggcuggagggc

SEQ ID NO: 670033 - RNA, 22 nt, Human
cagcuucacacacagacaccac

SEQ ID NO: 670034 - RNA, 20 nt, Human
cauguuggucaggcugaucu

SEQ ID NO: 670035 - RNA, 21 nt, Human
cauguuggucaggcugaucuc

SEQ ID NO: 670036 - RNA, 22 nt, Human
cauguuggucaggcugaucucg

SEQ ID NO: 670037 - RNA, 19 nt, Human
ccaaagugcuaggauuaca

SEQ ID NO: 670038 - RNA, 24 nt, Human
ccaaagugcuaggauuacaggcau

SEQ ID NO: 670039 - RNA, 23 nt, Human
cccagguagcugggacugcaggc

SEQ ID NO: 670040 - RNA, 23 nt, Human
ccccucaguuaucucgaacucau

SEQ ID NO: 670041 - RNA, 22 nt, Human
ccucaagugaucugcccaccuc

SEQ ID NO: 670042 - RNA, 24 nt, Human
ccucccagguagcugggacugcag

SEQ ID NO: 670043 - RNA, 19 nt, Human
ccugacucagccucccagg

SEQ ID NO: 670044 - RNA, 22 nt, Human
ccugguucaagagauuuuccug

SEQ ID NO: 670045 - RNA, 24 nt, Human
cucaagugaucugcccaccucagc

SEQ ID NO: 670046 - RNA, 24 nt, Human
cucacucugucacccaggcuggag

SEQ ID NO: 670047 - RNA, 24 nt, Human
cucagccucccagguagcugggac

SEQ ID NO: 670048 - RNA, 22 nt, Human
cuggagggcaguggcacaaucu

SEQ ID NO: 670049 - RNA, 20 nt, Human
cuuuguuagcuauuucuacu

SEQ ID NO: 670050 - RNA, 24 nt, Human
cuuuuacccaacaaugcagcuuca

SEQ ID NO: 670051 - RNA, 22 nt, Human
gaaaggauggucucuacccaca

SEQ ID NO: 670052 - RNA, 22 nt, Human
gacugcaggcccacaccaccau

SEQ ID NO: 670053 - RNA, 24 nt, Human
gagauggcauuucaucauguuggu

SEQ ID NO: 670054 - RNA, 18 nt, Human
gauuacaggcaugagcca

SEQ ID NO: 670055 - RNA, 22 nt, Human
gauuacaggcaugagccacagc

SEQ ID NO: 670056 - RNA, 21 nt, Human
gcaacguccaccuccugguuc

SEQ ID NO: 670057 - RNA, 18 nt, Human
ggagaaagggacaccugg

SEQ ID NO: 670058 - RNA, 19 nt, Human
ggauggucucuacccacac

SEQ ID NO: 670059 - RNA, 22 nt, Human
ggauuacaggcaugagccacag

SEQ ID NO: 670060 - RNA, 22 nt, Human
ggauuacaggcaugagccacag

SEQ ID NO: 670061 - RNA, 22 nt, Human
ggcauuucaucauguuggucag

SEQ ID NO: 670062 - RNA, 24 nt, Human
ggcauuucaucauguuggucaggc

SEQ ID NO: 670063 - RNA, 23 nt, Human
gggacaauagagaaacuaguagc

SEQ ID NO: 670064 - RNA, 24 nt, Human
gugaucugcccaccucagccuccc

SEQ ID NO: 670065 - RNA, 18 nt, Human
uaacucuuacagcagaac

SEQ ID NO: 670066 - RNA, 25 nt, Human
uaagaaaggaaauuaggauauaaaa

SEQ ID NO: 670067 - RNA, 24 nt, Human
uaauuuuuauauuuuuaguggaga

SEQ ID NO: 670068 - RNA, 26 nt, Human
uacaggcaugagccacagcgcaccca

SEQ ID NO: 670069 - RNA, 21 nt, Human
uagaguaucacagauagagua

SEQ ID NO: 670070 - RNA, 18 nt, Human
uaggauuacaggcaugag

SEQ ID NO: 670071 - RNA, 21 nt, Human
uaggauuacaggcaugagcca

SEQ ID NO: 670072 - RNA, 22 nt, Human
uaggauuacaggcaugagccac

SEQ ID NO: 670073 - RNA, 24 nt, Human
uaggauuacaggcaugagccacag

SEQ ID NO: 670074 - RNA, 25 nt, Human
uaggauuacaggcaugagccacagc

SEQ ID NO: 670075 - RNA, 24 nt, Human
uaguggagauggcauuucaucaug

SEQ ID NO: 670076 - RNA, 27 nt, Human
uauaaaacaaggaggauuggcugaagc

SEQ ID NO: 670077 - RNA, 23 nt, Human
uauauggcacaagcuggccuaau

SEQ ID NO: 670078 - RNA, 24 nt, Human
uaucaauaaggaaagaaaugggau

SEQ ID NO: 670079 - RNA, 19 nt, Human
ucaaagcuaaaccccucag

SEQ ID NO: 670080 - RNA, 23 nt, Human
ucacugcaacguccaccuccugg

SEQ ID NO: 670081 - RNA, 24 nt, Human
ucacugcaacguccaccuccuggu

SEQ ID NO: 670082 - RNA, 27 nt, Human
ucacugcaacguccaccuccugguuca

SEQ ID NO: 670083 - RNA, 25 nt, Human
ucagaaaaagagaggucuaauaucu

SEQ ID NO: 670084 - RNA, 18 nt, Human
ucagccucccaaagugcu

SEQ ID NO: 670085 - RNA, 24 nt, Human
ucaguuaucucgaacucaugcaac

SEQ ID NO: 670086 - RNA, 24 nt, Human
ucccaaagugcuaggauuacaggc

SEQ ID NO: 670087 - RNA, 24 nt, Human
ucccagguagcugggacugcaggc

SEQ ID NO: 670088 - RNA, 23 nt, Human
uccugguucaagagauuuuccug

SEQ ID NO: 670089 - RNA, 18 nt, Human
ucucaaacaugagaccca

SEQ ID NO: 670090 - RNA, 22 nt, Human
ucucacucugucacccaggcug

SEQ ID NO: 670091 - RNA, 23 nt, Human
ucucacucugucacccaggcugg

SEQ ID NO: 670092 - RNA, 24 nt, Human
ucucacucugucacccaggcugga

SEQ ID NO: 670093 - RNA, 26 nt, Human
ucucacucugucacccaggcuggagg

SEQ ID NO: 670094 - RNA, 27 nt, Human
ucucacucugucacccaggcuggaggg

SEQ ID NO: 670095 - RNA, 21 nt, Human
ucugcccaccucagccuccca

SEQ ID NO: 670096 - RNA, 18 nt, Human
ucugucacccaggcugga

SEQ ID NO: 670097 - RNA, 20 nt, Human
ugacucagccucccagguag

SEQ ID NO: 670098 - RNA, 24 nt, Human
ugacucagccucccagguagcugg

SEQ ID NO: 670099 - RNA, 22 nt, Human
ugagacccagcuuuuuuccaga

SEQ ID NO: 670100 - RNA, 24 nt, Human
ugaucugcccaccucagccuccca

SEQ ID NO: 670101 - RNA, 18 nt, Human
ugauucuuaaacguuuuc

SEQ ID NO: 670102 - RNA, 23 nt, Human
uggagggcaguggcacaaucugg

SEQ ID NO: 670103 - RNA, 24 nt, Human
uggcacaaucugggaucacugcaa

SEQ ID NO: 670104 - RNA, 24 nt, Human
uggcauuucaucauguuggucagg

SEQ ID NO: 670105 - RNA, 18 nt, Human
uggccucaagugaucugc

SEQ ID NO: 670106 - RNA, 22 nt, Human
uggccucaagugaucugcccac

SEQ ID NO: 670107 - RNA, 24 nt, Human
ugggaacuugucucaaacaugaga

SEQ ID NO: 670108 - RNA, 25 nt, Human
ugggaagagaaucacaccacagaga

SEQ ID NO: 670109 - RNA, 18 nt, Human
ugggaucuuguuaugcag

SEQ ID NO: 670110 - RNA, 24 nt, Human
uggucaggcugaucucgaacuauu

SEQ ID NO: 670111 - RNA, 22 nt, Human
ugguucaagagauuuuccugac

SEQ ID NO: 670112 - RNA, 20 nt, Human
uguuggaccauaauugauuc

SEQ ID NO: 670113 - RNA, 19 nt, Human
uucaagagauuuuccugac

SEQ ID NO: 670114 - RNA, 19 nt, Human
uuuaaacugaccucagaag

SEQ ID NO: 670115 - RNA, 21 nt, Human
uuucaucauguuggucaggcu

SEQ ID NO: 670116 - RNA, 20 nt, Human
uuuguagacagaaucucacu

SEQ ID NO: 670117 - RNA, 23 nt, Human
uuuuuaguggagauggcauuuca

SEQ ID NO: 670118 - RNA, 20 nt, Human
uuuuuauauuuuuaguggag

SEQ ID NO: 670119 - RNA, 18 nt, Human
aguaggcaguuucugaaa

SEQ ID NO: 670120 - RNA, 19 nt, Human
caggauauucccaaauuaa

SEQ ID NO: 670121 - RNA, 22 nt, Human
uaaaguaauuuggccaaaauca

SEQ ID NO: 670122 - RNA, 20 nt, Human
uaucucaaaagaaaauaauu

SEQ ID NO: 670123 - RNA, 24 nt, Human
ucaaaagaaaauaauuagaaaauu

SEQ ID NO: 670124 - RNA, 22 nt, Human
uuaaaguaauuuggccaaaauc

SEQ ID NO: 670125 - RNA, 24 nt, Human
ccauuuaguguaguaguuuuuccu

SEQ ID NO: 670126 - RNA, 24 nt, Human
cccaccagauguucccagagagaa

SEQ ID NO: 670127 - RNA, 22 nt, Human
cccccccguggugagguuccac

SEQ ID NO: 670128 - RNA, 22 nt, Human
cgggagcauugugacugugagg

SEQ ID NO: 670129 - RNA, 20 nt, Human
gagggcagccucuuaucaca

SEQ ID NO: 670130 - RNA, 19 nt, Human
gcccagcaccucugugacc

SEQ ID NO: 670131 - RNA, 25 nt, Human
gcuaaacuggguaggaaaaguugua

SEQ ID NO: 670132 - RNA, 19 nt, Human
ggcccagcccucccccccg

SEQ ID NO: 670133 - RNA, 21 nt, Human
ggcugacaccacaggugaugu

SEQ ID NO: 670134 - RNA, 22 nt, Human
uaaaacagguguuuugcuaaac

SEQ ID NO: 670135 - RNA, 25 nt, Human
uaacagauguucuucucuuggaucu

SEQ ID NO: 670136 - RNA, 19 nt, Human
uacccaccagauguuccca

SEQ ID NO: 670137 - RNA, 22 nt, Human
uaguaguuuuuccuggaggauu

SEQ ID NO: 670138 - RNA, 21 nt, Human
ucucuuggaucuugacucuga

SEQ ID NO: 670139 - RNA, 18 nt, Human
uggaauagggccuguagu

SEQ ID NO: 670140 - RNA, 21 nt, Human
uguaacagauguucuucucuu

SEQ ID NO: 670141 - RNA, 20 nt, Human
uuccuggaggauuuggauuu

SEQ ID NO: 670142 - RNA, 23 nt, Human
aagcagcaagugacagaggaggg

SEQ ID NO: 670143 - RNA, 22 nt, Human
acccccccaucuggaguuaagg

SEQ ID NO: 670144 - RNA, 22 nt, Human
agaggagggugccuggcuccag

SEQ ID NO: 670145 - RNA, 23 nt, Human
agugacagaggagggugccuggu

SEQ ID NO: 670146 - RNA, 18 nt, Human
cagcagccugggcuuggc

SEQ ID NO: 670147 - RNA, 20 nt, Human
cagggugcccacucccucuu

SEQ ID NO: 670148 - RNA, 19 nt, Human
ccagcagccugggcuuggc

SEQ ID NO: 670149 - RNA, 24 nt, Human
cccccaaaaacaccccagcugggu

SEQ ID NO: 670150 - RNA, 23 nt, Human
ccccggcccggcccgcgggcccc

SEQ ID NO: 670151 - RNA, 19 nt, Human
ccgcgggccccgcgcacgc

SEQ ID NO: 670152 - RNA, 18 nt, Human
ccggcccgcgggccccgc

SEQ ID NO: 670153 - RNA, 18 nt, Human
ccggcccgcgggccccgc

SEQ ID NO: 670154 - RNA, 19 nt, Human
ccuggccagugucugaccu

SEQ ID NO: 670155 - RNA, 22 nt, Human
cgccagggugcccacucccucu

SEQ ID NO: 670156 - RNA, 20 nt, Human
cuggcuccagcagccugggc

SEQ ID NO: 670157 - RNA, 20 nt, Human
gacucccccaaaaacacccc

SEQ ID NO: 670158 - RNA, 19 nt, Human
gagggcccgccagggugcc

SEQ ID NO: 670159 - RNA, 21 nt, Human
gcgacucccccaaaaacaccc

SEQ ID NO: 670160 - RNA, 25 nt, Human
gcugcagcccaggucaccccggccc

SEQ ID NO: 670161 - RNA, 20 nt, Human
ggagagggcccgccagggug

SEQ ID NO: 670162 - RNA, 21 nt, Human
ggagggugccuggcuccagca

SEQ ID NO: 670163 - RNA, 24 nt, Human
gguggggagagggcccgccagggu

SEQ ID NO: 670164 - RNA, 18 nt, Human
ucccccaaaaacacccca

SEQ ID NO: 670165 - RNA, 20 nt, Human
ucccccaaaaacaccccagc

SEQ ID NO: 670166 - RNA, 21 nt, Human
ucuggaguuaaggcuccaagc

SEQ ID NO: 670167 - RNA, 23 nt, Human
ugacagaggagggugccuggcuc

SEQ ID NO: 670168 - RNA, 18 nt, Human
ugccuggccagugucuga

SEQ ID NO: 670169 - RNA, 18 nt, Human
ugggugggugccuggggg

SEQ ID NO: 670170 - RNA, 18 nt, Human
uuuuuuuuuuuuuugccu

SEQ ID NO: 670171 - RNA, 20 nt, Human
uuuuuuuuuuuuuugccugg

SEQ ID NO: 670172 - RNA, 22 nt, Human
uuuuuuuuuuuuuuuugccugg

SEQ ID NO: 670173 - RNA, 21 nt, Human
uuuuuuuuuuuuuuuuugccu

SEQ ID NO: 670174 - RNA, 20 nt, Human
uuuuuuuuuuuuuuuuuugg

SEQ ID NO: 670175 - RNA, 22 nt, Human
aaggguggacgggaacugagga

SEQ ID NO: 670176 - RNA, 21 nt, Human
aauuauuuuuuaauggagaac

SEQ ID NO: 670177 - RNA, 24 nt, Human
agacaggaggcuggcugggcaggg

SEQ ID NO: 670178 - RNA, 18 nt, Human
caggagccacugguugaa

SEQ ID NO: 670179 - RNA, 20 nt, Human
gggcagggagcugaggcagg

SEQ ID NO: 670180 - RNA, 18 nt, Human
ucucugggcagauggaag

SEQ ID NO: 670181 - RNA, 21 nt, Human
ugaggacagggccaguaccgu

SEQ ID NO: 670182 - RNA, 21 nt, Human
ugaggcagggaggaaaagucu

SEQ ID NO: 670183 - RNA, 23 nt, Human
ugaggcagggaggaaaagucucc

SEQ ID NO: 670184 - RNA, 19 nt, Human
ugcaccugggaagcgaggc

SEQ ID NO: 670185 - RNA, 21 nt, Human
uggcugggcagggagcugagg

SEQ ID NO: 670186 - RNA, 22 nt, Human
uggcugggcagggagcugaggc

SEQ ID NO: 670187 - RNA, 19 nt, Human
uguccagaccugccgggag

SEQ ID NO: 670188 - RNA, 22 nt, Human
agacccguccugggagccagga

SEQ ID NO: 670189 - RNA, 21 nt, Human
aggaggguuggaaggaccgcg

SEQ ID NO: 670190 - RNA, 21 nt, Human
aggccagagcccgugagggga

SEQ ID NO: 670191 - RNA, 25 nt, Human
cacccaggcucaagagggagggggc

SEQ ID NO: 670192 - RNA, 24 nt, Human
cagacccguccugggagccaggag

SEQ ID NO: 670193 - RNA, 21 nt, Human
cagagggcguccaagaugcag

SEQ ID NO: 670194 - RNA, 24 nt, Human
cccagccaagggcugcuucugacu

SEQ ID NO: 670195 - RNA, 23 nt, Human
cgcgagcucugguuaaggccaga

SEQ ID NO: 670196 - RNA, 21 nt, Human
gagccgcagccccgaaacuga

SEQ ID NO: 670197 - RNA, 24 nt, Human
ggaggugcugugcacccaggcuca

SEQ ID NO: 670198 - RNA, 18 nt, Human
ggaggugggaccuguccc

SEQ ID NO: 670199 - RNA, 22 nt, Human
ggaggugggaccuguccccgcc

SEQ ID NO: 670200 - RNA, 24 nt, Human
gggacuuucuucucacaaagaccu

SEQ ID NO: 670201 - RNA, 24 nt, Human
gggcacaccucacccagccaaggg

SEQ ID NO: 670202 - RNA, 22 nt, Human
gguagcaggaggguuggaagga

SEQ ID NO: 670203 - RNA, 23 nt, Human
uagacuucugugagccgcagccc

SEQ ID NO: 670204 - RNA, 22 nt, Human
ucccgggcagguuagacuucug

SEQ ID NO: 670205 - RNA, 21 nt, Human
ucugugagccgcagccccgaa

SEQ ID NO: 670206 - RNA, 23 nt, Human
ucugugagccgcagccccgaaac

SEQ ID NO: 670207 - RNA, 21 nt, Human
uggaaggaccgcgcgcaggag

SEQ ID NO: 670208 - RNA, 18 nt, Human
ugggagccaggagguggg

SEQ ID NO: 670209 - RNA, 19 nt, Human
uggugcagacccguccugg

SEQ ID NO: 670210 - RNA, 20 nt, Human
ugugcaggcaggagggcuuc

SEQ ID NO: 670211 - RNA, 22 nt, Human
uucuucucacaaagaccuuucu

SEQ ID NO: 670212 - RNA, 21 nt, Human
aaaaaaacaacacaacacuag

SEQ ID NO: 670213 - RNA, 23 nt, Human
aacacuuuuucucccuccugcca

SEQ ID NO: 670214 - RNA, 21 nt, Human
aaccugcucucucuauaccuc

SEQ ID NO: 670215 - RNA, 22 nt, Human
aaccugcucucucuauaccucu

SEQ ID NO: 670216 - RNA, 20 nt, Human
acaguaaguaauuugcuuaa

SEQ ID NO: 670217 - RNA, 19 nt, Human
accccagugccuucaaugc

SEQ ID NO: 670218 - RNA, 21 nt, Human
accuaugcauacauggaaaac

SEQ ID NO: 670219 - RNA, 22 nt, Human
cacccuaagacacuucugacag

SEQ ID NO: 670220 - RNA, 25 nt, Human
cagaaaaauacuuacuuaagccuca

SEQ ID NO: 670221 - RNA, 27 nt, Human
cauaaaaauacaguaaguaauuugcuu

SEQ ID NO: 670222 - RNA, 23 nt, Human
caucucccgccgcagcgccagcc

SEQ ID NO: 670223 - RNA, 22 nt, Human
ccaaaucuucugucuucggcau

SEQ ID NO: 670224 - RNA, 26 nt, Human
ccacccuaagacacuucugacagaag

SEQ ID NO: 670225 - RNA, 21 nt, Human
cgcggcccgacagcaucuccc

SEQ ID NO: 670226 - RNA, 21 nt, Human
cuaugcauacauggaaaacac

SEQ ID NO: 670227 - RNA, 22 nt, Human
cuccuggcugccaagcgccgcc

SEQ ID NO: 670228 - RNA, 19 nt, Human
cugccauaaaaauacagua

SEQ ID NO: 670229 - RNA, 24 nt, Human
cuuaagccucaagguccccaauaa

SEQ ID NO: 670230 - RNA, 22 nt, Human
gaaaccacugauuuauaaacua

SEQ ID NO: 670231 - RNA, 20 nt, Human
gaagccguuguaacacuuuu

SEQ ID NO: 670232 - RNA, 21 nt, Human
gacagcaucucccgccgcagc

SEQ ID NO: 670233 - RNA, 21 nt, Human
gcucucucuauaccucuccau

SEQ ID NO: 670234 - RNA, 19 nt, Human
gcugagcuauggaaccugc

SEQ ID NO: 670235 - RNA, 28 nt, Human
uaaaaaaaacaacacaacacuaggaaca

SEQ ID NO: 670236 - RNA, 19 nt, Human
uaagacacuucugacagaa

SEQ ID NO: 670237 - RNA, 23 nt, Human
uaaguaauuugcuuaaaaaaaac

SEQ ID NO: 670238 - RNA, 19 nt, Human
uaccggacuucauuagaag

SEQ ID NO: 670239 - RNA, 24 nt, Human
uacugaacuagauaaccacccuaa

SEQ ID NO: 670240 - RNA, 22 nt, Human
uagauaaccacccuaagacacu

SEQ ID NO: 670241 - RNA, 22 nt, Human
uaggccagagucuagcaggaaa

SEQ ID NO: 670242 - RNA, 18 nt, Human
ucauuuaucauuuaaaua

SEQ ID NO: 670243 - RNA, 19 nt, Human
ugaacuagauaaccacccu

SEQ ID NO: 670244 - RNA, 23 nt, Human
ugcaggcuacaaaucagugcagg

SEQ ID NO: 670245 - RNA, 23 nt, Human
ugcauacauggaaaacacuggca

SEQ ID NO: 670246 - RNA, 28 nt, Human
ugcauuacuuagagacagguuuccaaag

SEQ ID NO: 670247 - RNA, 21 nt, Human
ugccaagcgccgccgcggccc

SEQ ID NO: 670248 - RNA, 22 nt, Human
aaaauaaagauguaacauuuuc

SEQ ID NO: 670249 - RNA, 18 nt, Human
aaaucccagguacugcuu

SEQ ID NO: 670250 - RNA, 23 nt, Human
acacaccaguugcucaaggaccu

SEQ ID NO: 670251 - RNA, 25 nt, Human
acuccugaagagguuuaaagaagag

SEQ ID NO: 670252 - RNA, 18 nt, Human
acuuucaugguuucuuuc

SEQ ID NO: 670253 - RNA, 19 nt, Human
cacugcaguacagacagac

SEQ ID NO: 670254 - RNA, 22 nt, Human
cagggcuuguuuguccaggccu

SEQ ID NO: 670255 - RNA, 24 nt, Human
cccgggggggcaagccuaugggcu

SEQ ID NO: 670256 - RNA, 22 nt, Human
ccgggggggcaagccuaugggc

SEQ ID NO: 670257 - RNA, 25 nt, Human
ccucagggcuuguuuguccaggccu

SEQ ID NO: 670258 - RNA, 21 nt, Human
cuuguugucuucaggguuguu

SEQ ID NO: 670259 - RNA, 20 nt, Human
gagagcgcaaacgggcgaca

SEQ ID NO: 670260 - RNA, 18 nt, Human
gcagaucccuccucaggg

SEQ ID NO: 670261 - RNA, 20 nt, Human
gccgacaguccacugaugcc

SEQ ID NO: 670262 - RNA, 20 nt, Human
gcucaaggaccugccgacag

SEQ ID NO: 670263 - RNA, 22 nt, Human
gcuucuauccagguuaagaauc

SEQ ID NO: 670264 - RNA, 22 nt, Human
uaacugguuuguauugguggga

SEQ ID NO: 670265 - RNA, 19 nt, Human
uaauacaucaacuuacagg

SEQ ID NO: 670266 - RNA, 21 nt, Human
uacugcuuuuacuacugugau

SEQ ID NO: 670267 - RNA, 20 nt, Human
uauccagguuaagaaucccu

SEQ ID NO: 670268 - RNA, 22 nt, Human
uccaagaggugacaaauaugaa

SEQ ID NO: 670269 - RNA, 21 nt, Human
ucccacugcaguacagacaga

SEQ ID NO: 670270 - RNA, 20 nt, Human
ucgcccagguuccggcgggc

SEQ ID NO: 670271 - RNA, 23 nt, Human
ugacaaauaugaacaauacuuca

SEQ ID NO: 670272 - RNA, 20 nt, Human
ugaugagaugauauuuugaa

SEQ ID NO: 670273 - RNA, 20 nt, Human
ugcccgggggggcaagccua

SEQ ID NO: 670274 - RNA, 24 nt, Human
ugcccgggggggcaagccuauggg

SEQ ID NO: 670275 - RNA, 21 nt, Human
ugccgacaguccacugaugcc

SEQ ID NO: 670276 - RNA, 21 nt, Human
ugccuuuagggaaaauucugg

SEQ ID NO: 670277 - RNA, 26 nt, Human
uguauuggugggaaaaucccagguac

SEQ ID NO: 670278 - RNA, 23 nt, Human
uuaaagaagagguaagaccucac

SEQ ID NO: 670279 - RNA, 20 nt, Human
uuaguuuucggagcagggug

SEQ ID NO: 670280 - RNA, 22 nt, Human
uuccaucaaguucaugguuacc

SEQ ID NO: 670281 - RNA, 21 nt, Human
uucccacugcaguacagacag

SEQ ID NO: 670282 - RNA, 23 nt, Human
uugcagaucccuccucagggcuu

SEQ ID NO: 670283 - RNA, 18 nt, Human
uuucaugguuucuuuccu

SEQ ID NO: 670284 - RNA, 25 nt, Human
uuuccugacauugagcaguuucuga

SEQ ID NO: 670285 - RNA, 23 nt, Human
uuuuauguuacauuacaguugcu

SEQ ID NO: 670286 - RNA, 18 nt, Human
aggaauaggaugggggug

SEQ ID NO: 670287 - RNA, 22 nt, Human
aggcaggaggacauccuccucu

SEQ ID NO: 670288 - RNA, 19 nt, Human
aggcaggcaggaggacauc

SEQ ID NO: 670289 - RNA, 23 nt, Human
caaucuagacccagagccgcuuu

SEQ ID NO: 670290 - RNA, 21 nt, Human
cacccuuccuccuagucccca

SEQ ID NO: 670291 - RNA, 21 nt, Human
cacuccaccucacuguucuuc

SEQ ID NO: 670292 - RNA, 23 nt, Human
cacuguucuucagacagcuguga

SEQ ID NO: 670293 - RNA, 19 nt, Human
ccacacccuuccuccuagu

SEQ ID NO: 670294 - RNA, 26 nt, Human
ccacacccuuccuccuaguccccaug

SEQ ID NO: 670295 - RNA, 22 nt, Human
ccaugccacacccuuccuccua

SEQ ID NO: 670296 - RNA, 22 nt, Human
ccgguaaucaagggggccagac

SEQ ID NO: 670297 - RNA, 22 nt, Human
cuagacccagagccgcuuucuc

SEQ ID NO: 670298 - RNA, 23 nt, Human
cuccugggagccuggcagcucug

SEQ ID NO: 670299 - RNA, 19 nt, Human
cugcucaggaccaccacgg

SEQ ID NO: 670300 - RNA, 19 nt, Human
gaaagggggaguaucccuc

SEQ ID NO: 670301 - RNA, 20 nt, Human
gaaagggggaguaucccuca

SEQ ID NO: 670302 - RNA, 21 nt, Human
gaauaggauggggguggggag

SEQ ID NO: 670303 - RNA, 18 nt, Human
gacauccuccucucugcu

SEQ ID NO: 670304 - RNA, 22 nt, Human
gagaccuucaggcaggcaggag

SEQ ID NO: 670305 - RNA, 20 nt, Human
gaggacauccuccucucugc

SEQ ID NO: 670306 - RNA, 23 nt, Human
gaguaucgcuccaacaccgaacu

SEQ ID NO: 670307 - RNA, 23 nt, Human
gccacacccuuccuccuaguccc

SEQ ID NO: 670308 - RNA, 19 nt, Human
ggacauccuccucucugcu

SEQ ID NO: 670309 - RNA, 24 nt, Human
ggacauccuccucucugcucagga

SEQ ID NO: 670310 - RNA, 23 nt, Human
ggagaccuucaggcaggcaggag

SEQ ID NO: 670311 - RNA, 18 nt, Human
ggcccacacguccaggug

SEQ ID NO: 670312 - RNA, 21 nt, Human
ggggagggcuuaaguggccca

SEQ ID NO: 670313 - RNA, 20 nt, Human
ggggguggggagggcuuaag

SEQ ID NO: 670314 - RNA, 19 nt, Human
gggguggggagggcuuaag

SEQ ID NO: 670315 - RNA, 22 nt, Human
uaacgguuuaaaaaaaggguca

SEQ ID NO: 670316 - RNA, 21 nt, Human
ucacuguucuucagacagcug

SEQ ID NO: 670317 - RNA, 21 nt, Human
ucagacagcugugaugugagc

SEQ ID NO: 670318 - RNA, 22 nt, Human
uccaacaccgaacuucccuuua

SEQ ID NO: 670319 - RNA, 24 nt, Human
uccaacaccgaacuucccuuuaac

SEQ ID NO: 670320 - RNA, 22 nt, Human
ugacuacauugaguaucgcucc

SEQ ID NO: 670321 - RNA, 21 nt, Human
uggggguggggagggcuuaag

SEQ ID NO: 670322 - RNA, 19 nt, Human
ugugagcaggggcuaggcc

SEQ ID NO: 670323 - RNA, 22 nt, Human
ugugaugugagcaggggcuagg

SEQ ID NO: 670324 - RNA, 23 nt, Human
uucaugggagaccuucaggcagg

SEQ ID NO: 670325 - RNA, 21 nt, Human
uuuuuuuuuuuuuuuuccauu

SEQ ID NO: 670326 - RNA, 22 nt, Human
aaaaaaaaaaaaaaaaggaaaa

SEQ ID NO: 670327 - RNA, 25 nt, Human
aaaaaaaaaaaggaaacacuauuuu

SEQ ID NO: 670328 - RNA, 24 nt, Human
acauuugcuggaauguguacaucu

SEQ ID NO: 670329 - RNA, 19 nt, Human
aggcauuuggaaagugaaa

SEQ ID NO: 670330 - RNA, 20 nt, Human
aucaagucgucugcauccau

SEQ ID NO: 670331 - RNA, 22 nt, Human
caggcauuuggaaagugaaaga

SEQ ID NO: 670332 - RNA, 22 nt, Human
gaauguguacaucuacacuaaa

SEQ ID NO: 670333 - RNA, 28 nt, Human
guacauuuucaaaaaaaaaaaaaaaaaa

SEQ ID NO: 670334 - RNA, 20 nt, Human
uaaaccaaaaacaaaauuaa

SEQ ID NO: 670335 - RNA, 22 nt, Human
uaacaaagguuuuuuuccccca

SEQ ID NO: 670336 - RNA, 22 nt, Human
ucaaaaaaaaaaaaaaaaaaaa

SEQ ID NO: 670337 - RNA, 20 nt, Human
ucaguagugauagauauuuu

SEQ ID NO: 670338 - RNA, 19 nt, Human
ugcaaauacauuugcugga

SEQ ID NO: 670339 - RNA, 18 nt, Human
uguaaagcacaaaacagg

SEQ ID NO: 670340 - RNA, 18 nt, Human
aaaaaccagaaacuguaa

SEQ ID NO: 670341 - RNA, 20 nt, Human
aaaaccaaaccaaaccaaaa

SEQ ID NO: 670342 - RNA, 21 nt, Human
aaacccuacaaaaugccccuc

SEQ ID NO: 670343 - RNA, 21 nt, Human
aaauaaaaaggacacaaaacc

SEQ ID NO: 670344 - RNA, 22 nt, Human
acaaaaugccccucccaacccc

SEQ ID NO: 670345 - RNA, 24 nt, Human
acacaaaaccaaaccaaaccaaaa

SEQ ID NO: 670346 - RNA, 24 nt, Human
acaccuuggaauuaaaaauaguua

SEQ ID NO: 670347 - RNA, 22 nt, Human
agaaaaaacugcaaauaaaaag

SEQ ID NO: 670348 - RNA, 24 nt, Human
agaaaaaacugcaaauaaaaagga

SEQ ID NO: 670349 - RNA, 21 nt, Human
agaaaugcaagaaaaaauagc

SEQ ID NO: 670350 - RNA, 22 nt, Human
aucuguacaagauacacuacag

SEQ ID NO: 670351 - RNA, 24 nt, Human
caaaaccaucauguugaaauguca

SEQ ID NO: 670352 - RNA, 22 nt, Human
caacaguucuucaucaaaaggu

SEQ ID NO: 670353 - RNA, 22 nt, Human
caagauacacuacaguaaacac

SEQ ID NO: 670354 - RNA, 21 nt, Human
cacaaaaccaaaccaaaccaa

SEQ ID NO: 670355 - RNA, 25 nt, Human
cagaaaaaacugcaaauaaaaagga

SEQ ID NO: 670356 - RNA, 18 nt, Human
cagaacaaaacaacaguu

SEQ ID NO: 670357 - RNA, 22 nt, Human
cagaacaaaacaacaguucuuc

SEQ ID NO: 670358 - RNA, 18 nt, Human
ccaagauacaagaaauua

SEQ ID NO: 670359 - RNA, 19 nt, Human
ccccgccgccgucgccgcc

SEQ ID NO: 670360 - RNA, 28 nt, Human
ccccgccgccgucgccgccgccgccgac

SEQ ID NO: 670361 - RNA, 27 nt, Human
ccgcccccgccgccgucgccgccgccg

SEQ ID NO: 670362 - RNA, 25 nt, Human
ccgccgacgccgccgacgccgccgc

SEQ ID NO: 670363 - RNA, 27 nt, Human
ccgccgacgccgccgacgccgccgcuc

SEQ ID NO: 670364 - RNA, 18 nt, Human
ccgccgccgucgccgccg

SEQ ID NO: 670365 - RNA, 24 nt, Human
ccgccgccgucgccgccgccgccg

SEQ ID NO: 670366 - RNA, 22 nt, Human
ccgccgucgccgccgccgccga

SEQ ID NO: 670367 - RNA, 23 nt, Human
ccgccgucgccgccgccgccgac

SEQ ID NO: 670368 - RNA, 21 nt, Human
ccuaagacuuccaagccacuu

SEQ ID NO: 670369 - RNA, 21 nt, Human
cgcccccgccgccgucgccgc

SEQ ID NO: 670370 - RNA, 25 nt, Human
cgccgccgccgacgccgccgacgcc

SEQ ID NO: 670371 - RNA, 22 nt, Human
cggcuccccgguccggccuccc

SEQ ID NO: 670372 - RNA, 22 nt, Human
cgucgccgccgccgccgacgcc

SEQ ID NO: 670373 - RNA, 19 nt, Human
cuacaaaaugccccuccca

SEQ ID NO: 670374 - RNA, 24 nt, Human
cuacaaaaugccccucccaacccc

SEQ ID NO: 670375 - RNA, 18 nt, Human
cucccgcuccgcuugggg

SEQ ID NO: 670376 - RNA, 23 nt, Human
cucggcuccccgguccggccucc

SEQ ID NO: 670377 - RNA, 19 nt, Human
cugcaaauaaaaaggacac

SEQ ID NO: 670378 - RNA, 21 nt, Human
gcaacagaaaaaacugcaaau

SEQ ID NO: 670379 - RNA, 24 nt, Human
gccgccgccgacgccgccgacgcc

SEQ ID NO: 670380 - RNA, 22 nt, Human
gguaauggaggcaugagaaaaa

SEQ ID NO: 670381 - RNA, 19 nt, Human
gguuuuuuguuuuguuuua

SEQ ID NO: 670382 - RNA, 26 nt, Human
guuaucuguacaagauacacuacagu

SEQ ID NO: 670383 - RNA, 19 nt, Human
uaaaagaaaaaagcaaaca

SEQ ID NO: 670384 - RNA, 23 nt, Human
uaaaagaaaaaagcaaacaacac

SEQ ID NO: 670385 - RNA, 22 nt, Human
uaacaaaaauaaugaaacaaaa

SEQ ID NO: 670386 - RNA, 20 nt, Human
uaagaauacuuaaauacugc

SEQ ID NO: 670387 - RNA, 20 nt, Human
uaauagagaaagguuuuuug

SEQ ID NO: 670388 - RNA, 21 nt, Human
uacaaauagguuuucuuugac

SEQ ID NO: 670389 - RNA, 19 nt, Human
uaucugucucaguucagaa

SEQ ID NO: 670390 - RNA, 25 nt, Human
ucagaauucacaucauucauuacaa

SEQ ID NO: 670391 - RNA, 20 nt, Human
ucagucaaauaaaaagaaca

SEQ ID NO: 670392 - RNA, 24 nt, Human
ucagucaaauaaaaagaacacuuu

SEQ ID NO: 670393 - RNA, 23 nt, Human
ucccgcuccgcuuggggacccgu

SEQ ID NO: 670394 - RNA, 21 nt, Human
ucgccgccgccgccgacgccg

SEQ ID NO: 670395 - RNA, 24 nt, Human
ucgccgccgccgccgacgccgccg

SEQ ID NO: 670396 - RNA, 21 nt, Human
ugaaauaacaaaaauaaugaa

SEQ ID NO: 670397 - RNA, 19 nt, Human
ugaaaugucacagcucuga

SEQ ID NO: 670398 - RNA, 22 nt, Human
ugacuuuguagguauugcucca

SEQ ID NO: 670399 - RNA, 23 nt, Human
ugagaaaaacguaggcuaaacac

SEQ ID NO: 670400 - RNA, 24 nt, Human
ugagaaaaacguaggcuaaacagu

SEQ ID NO: 670401 - RNA, 20 nt, Human
ugcaacagaaaaaacugcaa

SEQ ID NO: 670402 - RNA, 21 nt, Human
ugcaagaaaaaauagcuucaa

SEQ ID NO: 670403 - RNA, 24 nt, Human
ugcaagaaaaaauagcuucaauuc

SEQ ID NO: 670404 - RNA, 18 nt, Human
uggaggcaugagaaaaac

SEQ ID NO: 670405 - RNA, 25 nt, Human
uuaauaguuagacauuucaagcauu

SEQ ID NO: 670406 - RNA, 19 nt, Human
uuauacaaacccuacaaaa

SEQ ID NO: 670407 - RNA, 24 nt, Human
uuauauuaccccuuucgaacucua

SEQ ID NO: 670408 - RNA, 20 nt, Human
uucacagaacaaaacaacug

SEQ ID NO: 670409 - RNA, 21 nt, Human
uuucacagaacaaaacaacag

SEQ ID NO: 670410 - RNA, 20 nt, Human
acccacuucccacaggcacc

SEQ ID NO: 670411 - RNA, 18 nt, Human
acuggcaggucaggauga

SEQ ID NO: 670412 - RNA, 23 nt, Human
acuucccacaggcaccaggucac

SEQ ID NO: 670413 - RNA, 21 nt, Human
aggaaggugggggacacugua

SEQ ID NO: 670414 - RNA, 20 nt, Human
aggccugggauggcagugaa

SEQ ID NO: 670415 - RNA, 25 nt, Human
aguaggagguggagguucccauggg

SEQ ID NO: 670416 - RNA, 24 nt, Human
aguaggagguggagguucgggacc

SEQ ID NO: 670417 - RNA, 22 nt, Human
auggggcaaggaagguggggga

SEQ ID NO: 670418 - RNA, 25 nt, Human
caaagggccucuucaggguuggccu

SEQ ID NO: 670419 - RNA, 21 nt, Human
cacagugaagccugcccgggc

SEQ ID NO: 670420 - RNA, 24 nt, Human
caccaggucacaguccugucccag

SEQ ID NO: 670421 - RNA, 23 nt, Human
caccaggucacuuggcacgcucc

SEQ ID NO: 670422 - RNA, 21 nt, Human
cacgcuucucuggguccucca

SEQ ID NO: 670423 - RNA, 23 nt, Human
cacggccaguaacagcgucccag

SEQ ID NO: 670424 - RNA, 24 nt, Human
cacucucugcuugcccagaucuug

SEQ ID NO: 670425 - RNA, 23 nt, Human
cacugcuaccaacuuggcaaggg

SEQ ID NO: 670426 - RNA, 20 nt, Human
cagaaugaggauccaggccu

SEQ ID NO: 670427 - RNA, 19 nt, Human
cagcagccaccagcagggc

SEQ ID NO: 670428 - RNA, 23 nt, Human
cagcagccaccagcagggcguug

SEQ ID NO: 670429 - RNA, 24 nt, Human
cagccaccagcagggcguugaggg

SEQ ID NO: 670430 - RNA, 21 nt, Human
caggacaucggaugugaccac

SEQ ID NO: 670431 - RNA, 24 nt, Human
ccaggccgagugcaggacaucgga

SEQ ID NO: 670432 - RNA, 24 nt, Human
ccccuguccaccaggucacagucc

SEQ ID NO: 670433 - RNA, 20 nt, Human
cuaggccccuguccaccagg

SEQ ID NO: 670434 - RNA, 21 nt, Human
cucccuucggcugcuccauuc

SEQ ID NO: 670435 - RNA, 26 nt, Human
cugagaacccacuucccacaggcacc

SEQ ID NO: 670436 - RNA, 25 nt, Human
cugcccacacgcuucucuggguccu

SEQ ID NO: 670437 - RNA, 21 nt, Human
cuguagcuccagguuuucucc

SEQ ID NO: 670438 - RNA, 19 nt, Human
cuuccugccgucgcccggc

SEQ ID NO: 670439 - RNA, 21 nt, Human
cuugggaccuuccuaugucca

SEQ ID NO: 670440 - RNA, 22 nt, Human
gagugaauuuauuccaagaaug

SEQ ID NO: 670441 - RNA, 24 nt, Human
gagugcaggacaucggaugugacc

SEQ ID NO: 670442 - RNA, 27 nt, Human
ggaguaggagguggagguucgggaccc

SEQ ID NO: 670443 - RNA, 18 nt, Human
gggcguugaggguggcuc

SEQ ID NO: 670444 - RNA, 18 nt, Human
guacuggcaggucaggau

SEQ ID NO: 670445 - RNA, 21 nt, Human
uacaucuaggccccuguccac

SEQ ID NO: 670446 - RNA, 19 nt, Human
uagcuccagguuuucuccu

SEQ ID NO: 670447 - RNA, 26 nt, Human
uaggagguggagguucccauggggca

SEQ ID NO: 670448 - RNA, 18 nt, Human
uaggccccuguccaccag

SEQ ID NO: 670449 - RNA, 18 nt, Human
ucacugcuaccaacuugg

SEQ ID NO: 670450 - RNA, 26 nt, Human
uccacggccaguaacagcgucccagc

SEQ ID NO: 670451 - RNA, 20 nt, Human
ucuacaacucuaagccauaa

SEQ ID NO: 670452 - RNA, 19 nt, Human
ucucucugaaagaccugga

SEQ ID NO: 670453 - RNA, 22 nt, Human
ugaaagaccuggacacugucau

SEQ ID NO: 670454 - RNA, 18 nt, Human
ugagaaggccagccauag

SEQ ID NO: 670455 - RNA, 23 nt, Human
ugcagaaugaggauccaggccga

SEQ ID NO: 670456 - RNA, 23 nt, Human
ugcuaguuaaggccugggauggc

SEQ ID NO: 670457 - RNA, 20 nt, Human
uucucuggguccuccacggc

SEQ ID NO: 670458 - RNA, 24 nt, Human
uugcuaagggacucccagccauau

SEQ ID NO: 670459 - RNA, 19 nt, Human
uuuuuuuuuuugcaaggac

SEQ ID NO: 670460 - RNA, 21 nt, Human
uuuuuuuuuuuuuugcaagga

SEQ ID NO: 670461 - RNA, 18 nt, Human
uuuuuuuuuuuuuuuuug

SEQ ID NO: 670462 - RNA, 21 nt, Human
uuuuuuuuuuuuuuuuugcaa

SEQ ID NO: 670463 - RNA, 18 nt, Human
aaaagaacuaauccacac

SEQ ID NO: 670464 - RNA, 23 nt, Human
aaacaauuuauuauaacucuagu

SEQ ID NO: 670465 - RNA, 22 nt, Human
aaaccgaaauugaaaaaaguaa

SEQ ID NO: 670466 - RNA, 24 nt, Human
aaagugcugggauuacagguguga

SEQ ID NO: 670467 - RNA, 23 nt, Human
aaauaaacacagaugccaacaaa

SEQ ID NO: 670468 - RNA, 20 nt, Human
aaccagaaaaaaagcaguga

SEQ ID NO: 670469 - RNA, 19 nt, Human
aaccccacaacuuuccucu

SEQ ID NO: 670470 - RNA, 21 nt, Human
aacugcccuucuuugguucuu

SEQ ID NO: 670471 - RNA, 24 nt, Human
aagaauauuccuuuuuccuuaaaa

SEQ ID NO: 670472 - RNA, 24 nt, Human
aagcagaaaacacuggcaccaaaa

SEQ ID NO: 670473 - RNA, 22 nt, Human
aagccuagauuacuaaaaccga

SEQ ID NO: 670474 - RNA, 23 nt, Human
aagggaauuaucuauuuuucuca

SEQ ID NO: 670475 - RNA, 22 nt, Human
aagucacuuuuguccccaaaac

SEQ ID NO: 670476 - RNA, 18 nt, Human
aagugcugggauuacagg

SEQ ID NO: 670477 - RNA, 19 nt, Human
aagugcugggauuacaggu

SEQ ID NO: 670478 - RNA, 26 nt, Human
aagugcugggauuacaggugugagcc

SEQ ID NO: 670479 - RNA, 21 nt, Human
aauaaaccaguuuauuacaga

SEQ ID NO: 670480 - RNA, 19 nt, Human
acaaagcaaaugauuaagc

SEQ ID NO: 670481 - RNA, 24 nt, Human
acaaagcaaaugauuaagcagaaa

SEQ ID NO: 670482 - RNA, 26 nt, Human
acaacuuuccucuuugcuagaacugu

SEQ ID NO: 670483 - RNA, 21 nt, Human
acacaaaaccuacuuugaaac

SEQ ID NO: 670484 - RNA, 19 nt, Human
acagaaucaccuagaauga

SEQ ID NO: 670485 - RNA, 23 nt, Human
accaaauaugaauaugaaaguuu

SEQ ID NO: 670486 - RNA, 23 nt, Human
accaacagaggcacuguaagaga

SEQ ID NO: 670487 - RNA, 25 nt, Human
accacacaauuacuuauccuugauc

SEQ ID NO: 670488 - RNA, 18 nt, Human
accagaaaaaaagcagug

SEQ ID NO: 670489 - RNA, 24 nt, Human
accguguuggucaggcuggucucg

SEQ ID NO: 670490 - RNA, 21 nt, Human
acgggguuucaccguguuggu

SEQ ID NO: 670491 - RNA, 23 nt, Human
acgggguuucaccguguugguca

SEQ ID NO: 670492 - RNA, 24 nt, Human
acgggguuucaccguguuggucag

SEQ ID NO: 670493 - RNA, 18 nt, Human
acuaauccuuuuccccaa

SEQ ID NO: 670494 - RNA, 25 nt, Human
acucuguugcccaggcuggagugca

SEQ ID NO: 670495 - RNA, 18 nt, Human
acugcagcaccuuccacc

SEQ ID NO: 670496 - RNA, 18 nt, Human
agaaaaaaagcagugaag

SEQ ID NO: 670497 - RNA, 22 nt, Human
agaaagaaaauacaaaguuuaa

SEQ ID NO: 670498 - RNA, 19 nt, Human
agacagaccaacagaggca

SEQ ID NO: 670499 - RNA, 24 nt, Human
agacauaaagguccacccugaacc

SEQ ID NO: 670500 - RNA, 21 nt, Human
agacauccuaguuuccaauaa

SEQ ID NO: 670501 - RNA, 19 nt, Human
agauuacaggcaugugcca

SEQ ID NO: 670502 - RNA, 26 nt, Human
agccaccacgcccagccgggccuaga

SEQ ID NO: 670503 - RNA, 20 nt, Human
aggcacacacacacaaaacc

SEQ ID NO: 670504 - RNA, 18 nt, Human
aggccucccucauaaaga

SEQ ID NO: 670505 - RNA, 18 nt, Human
aggcuggagugcaguggc

SEQ ID NO: 670506 - RNA, 20 nt, Human
aguagagacgggguuucacc

SEQ ID NO: 670507 - RNA, 21 nt, Human
aguagcugagauuacaggcau

SEQ ID NO: 670508 - RNA, 23 nt, Human
aguagcugagauuacaggcaugu

SEQ ID NO: 670509 - RNA, 23 nt, Human
agugcaguggcgugauuuuggcu

SEQ ID NO: 670510 - RNA, 24 nt, Human
agugcaguggcgugauuuuggcuc

SEQ ID NO: 670511 - RNA, 20 nt, Human
auaaaauguacauguaaauc

SEQ ID NO: 670512 - RNA, 22 nt, Human
auaaacacagaugccaacaaag

SEQ ID NO: 670513 - RNA, 19 nt, Human
auccaucguuguauucuuu

SEQ ID NO: 670514 - RNA, 19 nt, Human
aucuugacaagacauaaag

SEQ ID NO: 670515 - RNA, 21 nt, Human
augugucugagcagucagugg

SEQ ID NO: 670516 - RNA, 18 nt, Human
auuaagcagaaaacacug

SEQ ID NO: 670517 - RNA, 24 nt, Human
auuuuuguauuuuuaguagagacg

SEQ ID NO: 670518 - RNA, 18 nt, Human
caaaaauauacagagaca

SEQ ID NO: 670519 - RNA, 24 nt, Human
caaaaauauacagagacaccacaa

SEQ ID NO: 670520 - RNA, 19 nt, Human
caaaauaaacaaaggcaag

SEQ ID NO: 670521 - RNA, 19 nt, Human
caaacaguaaagaaaugaa

SEQ ID NO: 670522 - RNA, 24 nt, Human
caaagugcugggauuacaggugug

SEQ ID NO: 670523 - RNA, 21 nt, Human
caaaugcacgagccaagugcu

SEQ ID NO: 670524 - RNA, 23 nt, Human
caacuucuaccucccagguucaa

SEQ ID NO: 670525 - RNA, 22 nt, Human
caagacagugggguuaacaaaa

SEQ ID NO: 670526 - RNA, 20 nt, Human
caagcgauucucuugccuca

SEQ ID NO: 670527 - RNA, 22 nt, Human
caagcgauucucuugccucagc

SEQ ID NO: 670528 - RNA, 23 nt, Human
caauucaguuugagacagaccaa

SEQ ID NO: 670529 - RNA, 23 nt, Human
cacacaaaaccuacuuugaaaca

SEQ ID NO: 670530 - RNA, 24 nt, Human
cacacaaaaccuacuuugaaacaa

SEQ ID NO: 670531 - RNA, 21 nt, Human
caccguguuggucaggcuggu

SEQ ID NO: 670532 - RNA, 24 nt, Human
caccguguuggucaggcuggucuc

SEQ ID NO: 670533 - RNA, 24 nt, Human
cacucuguugcccaggcuggagug

SEQ ID NO: 670534 - RNA, 21 nt, Human
cacugcaacuucuaccuccca

SEQ ID NO: 670535 - RNA, 20 nt, Human
cagccuccugaguagcugag

SEQ ID NO: 670536 - RNA, 24 nt, Human
cauaacauuaaacaaacuggacuc

SEQ ID NO: 670537 - RNA, 20 nt, Human
cauccaggaaaaucuaaaag

SEQ ID NO: 670538 - RNA, 21 nt, Human
caucuuuucaccaaauacuuc

SEQ ID NO: 670539 - RNA, 19 nt, Human
cauguaguuuucgauaaca

SEQ ID NO: 670540 - RNA, 21 nt, Human
caugucaagucacuuuugucc

SEQ ID NO: 670541 - RNA, 20 nt, Human
cauuccccaagacagugggg

SEQ ID NO: 670542 - RNA, 21 nt, Human
ccaaagugcugggauuacagg

SEQ ID NO: 670543 - RNA, 21 nt, Human
ccaaagugcugggauuacagg

SEQ ID NO: 670544 - RNA, 24 nt, Human
ccaaagugcugggauuacaggugu

SEQ ID NO: 670545 - RNA, 21 nt, Human
cccaggcuggagugcaguggc

SEQ ID NO: 670546 - RNA, 20 nt, Human
cccagguucaagcgauucuc

SEQ ID NO: 670547 - RNA, 21 nt, Human
cccagguucaagcgauucucu

SEQ ID NO: 670548 - RNA, 23 nt, Human
cccauaacauuaaacaaacugga

SEQ ID NO: 670549 - RNA, 23 nt, Human
ccccaaaacgaucuuucagagaa

SEQ ID NO: 670550 - RNA, 19 nt, Human
ccccacaacuuuccucuuu

SEQ ID NO: 670551 - RNA, 20 nt, Human
ccuaguuuccaauaauuuau

SEQ ID NO: 670552 - RNA, 24 nt, Human
ccucccagguucaagcgauucucu

SEQ ID NO: 670553 - RNA, 19 nt, Human
ccugaguagcugagauuac

SEQ ID NO: 670554 - RNA, 23 nt, Human
ccugaguagcugagauuacaggc

SEQ ID NO: 670555 - RNA, 24 nt, Human
ccugaguagcugagauuacaggca

SEQ ID NO: 670556 - RNA, 19 nt, Human
ccuuuaaacacauuccaca

SEQ ID NO: 670557 - RNA, 24 nt, Human
cggagucucacucuguugcccagg

SEQ ID NO: 670558 - RNA, 24 nt, Human
cgggguuucaccguguuggucagg

SEQ ID NO: 670559 - RNA, 24 nt, Human
cucacucuguugcccaggcuggag

SEQ ID NO: 670560 - RNA, 24 nt, Human
cucacugcaacuucuaccucccag

SEQ ID NO: 670561 - RNA, 24 nt, Human
cuccugaccucgugauccgcccgc

SEQ ID NO: 670562 - RNA, 23 nt, Human
cugaguagcugagauuacaggca

SEQ ID NO: 670563 - RNA, 24 nt, Human
cugaguagcugagauuacaggcau

SEQ ID NO: 670564 - RNA, 23 nt, Human
cugcaacuucuaccucccagguu

SEQ ID NO: 670565 - RNA, 24 nt, Human
cugcaacuucuaccucccagguuc

SEQ ID NO: 670566 - RNA, 26 nt, Human
cuguuacccaugaaucaauauaaacc

SEQ ID NO: 670567 - RNA, 23 nt, Human
cuugccucagccuccugaguagc

SEQ ID NO: 670568 - RNA, 24 nt, Human
cuugccucagccuccugaguagcu

SEQ ID NO: 670569 - RNA, 19 nt, Human
cuuuacaaaaauauacaga

SEQ ID NO: 670570 - RNA, 22 nt, Human
gaccucgugauccgcccgccuc

SEQ ID NO: 670571 - RNA, 22 nt, Human
gaccucgugauccgcccgccuc

SEQ ID NO: 670572 - RNA, 24 nt, Human
gaccucgugauccgcccgccucgg

SEQ ID NO: 670573 - RNA, 20 nt, Human
gagacaccacaaauugguag

SEQ ID NO: 670574 - RNA, 23 nt, Human
gagacgggguuucaccguguugg

SEQ ID NO: 670575 - RNA, 24 nt, Human
gagacgggguuucaccguguuggu

SEQ ID NO: 670576 - RNA, 22 nt, Human
gaguagcugagauuacaggcau

SEQ ID NO: 670577 - RNA, 25 nt, Human
gaguagcugagauuacaggcaugug

SEQ ID NO: 670578 - RNA, 18 nt, Human
gauuacaggcaugugcca

SEQ ID NO: 670579 - RNA, 24 nt, Human
gauuacaggcaugugccaccaugc

SEQ ID NO: 670580 - RNA, 18 nt, Human
gauuacaggugugagcca

SEQ ID NO: 670581 - RNA, 21 nt, Human
gauuacaggugugagccacca

SEQ ID NO: 670582 - RNA, 22 nt, Human
gauuacaggugugagccaccac

SEQ ID NO: 670583 - RNA, 21 nt, Human
gauucucuugccucagccucc

SEQ ID NO: 670584 - RNA, 22 nt, Human
gcaacuucuaccucccagguuc

SEQ ID NO: 670585 - RNA, 19 nt, Human
gcagcaccuuccacccacc

SEQ ID NO: 670586 - RNA, 20 nt, Human
gccuagacaucuugacaaga

SEQ ID NO: 670587 - RNA, 23 nt, Human
gccucggccucccaaagugcugg

SEQ ID NO: 670588 - RNA, 24 nt, Human
gcgauucucuugccucagccuccu

SEQ ID NO: 670589 - RNA, 21 nt, Human
gcucacugcaacuucuaccuc

SEQ ID NO: 670590 - RNA, 18 nt, Human
gcucaguagacauuuacu

SEQ ID NO: 670591 - RNA, 23 nt, Human
gcuggucucgaacuccugaccuc

SEQ ID NO: 670592 - RNA, 23 nt, Human
ggaaaaucuaaaaaaauuaaaga

SEQ ID NO: 670593 - RNA, 25 nt, Human
ggaaaaucuaaaaaaauuaaagaaa

SEQ ID NO: 670594 - RNA, 23 nt, Human
ggagucucacucuguugcccagg

SEQ ID NO: 670595 - RNA, 22 nt, Human
ggcuggagugcaguggcgugau

SEQ ID NO: 670596 - RNA, 24 nt, Human
ggcuggucucgaacuccugaccuc

SEQ ID NO: 670597 - RNA, 18 nt, Human
gguccacccugaaccuaa

SEQ ID NO: 670598 - RNA, 19 nt, Human
ggucucgaacuccugaccu

SEQ ID NO: 670599 - RNA, 21 nt, Human
guaaauaaacacagaugccaa

SEQ ID NO: 670600 - RNA, 23 nt, Human
guagagacgggguuucaccgugu

SEQ ID NO: 670601 - RNA, 20 nt, Human
guagcugagauuacaggcau

SEQ ID NO: 670602 - RNA, 21 nt, Human
gugaaaagcaggccucccuca

SEQ ID NO: 670603 - RNA, 24 nt, Human
gugauccgcccgccucggccuccc

SEQ ID NO: 670604 - RNA, 22 nt, Human
uaaaaagaacauauaaaaauac

SEQ ID NO: 670605 - RNA, 23 nt, Human
uaaaaaugaccaugguuuauacu

SEQ ID NO: 670606 - RNA, 21 nt, Human
uaaacaaaggcaagauuugcc

SEQ ID NO: 670607 - RNA, 24 nt, Human
uaaauaaacacagaugccaacaaa

SEQ ID NO: 670608 - RNA, 25 nt, Human
uaaauaaacacagaugccaacaaag

SEQ ID NO: 670609 - RNA, 23 nt, Human
uaaauaaacugaggugugaaaag

SEQ ID NO: 670610 - RNA, 22 nt, Human
uaacagcaguaagaaaacuaag

SEQ ID NO: 670611 - RNA, 24 nt, Human
uaacauuaaacaaacuggacucuu

SEQ ID NO: 670612 - RNA, 20 nt, Human
uaaccacacaauuacuuauc

SEQ ID NO: 670613 - RNA, 21 nt, Human
uaacgggcucagcaaaccguc

SEQ ID NO: 670614 - RNA, 23 nt, Human
uaagggaauuaucuauuuuucuc

SEQ ID NO: 670615 - RNA, 19 nt, Human
uaaguaaaccaaacuauga

SEQ ID NO: 670616 - RNA, 18 nt, Human
uaaucuaauuauagcacc

SEQ ID NO: 670617 - RNA, 24 nt, Human
uaauuuaaguaaaccaaacuauga

SEQ ID NO: 670618 - RNA, 24 nt, Human
uaauuuuuguauuuuuaguagaga

SEQ ID NO: 670619 - RNA, 23 nt, Human
uacaggcaugugccaccaugccc

SEQ ID NO: 670620 - RNA, 24 nt, Human
uacaggugugagccaccacgccca

SEQ ID NO: 670621 - RNA, 20 nt, Human
uaccuuaaauuucauggcac

SEQ ID NO: 670622 - RNA, 23 nt, Human
uagcauguguuuggugaggcaga

SEQ ID NO: 670623 - RNA, 21 nt, Human
uaggcacacacacacaaaacc

SEQ ID NO: 670624 - RNA, 21 nt, Human
uaguagagacgggguuucacc

SEQ ID NO: 670625 - RNA, 24 nt, Human
uaguagagacgggguuucaccgug

SEQ ID NO: 670626 - RNA, 26 nt, Human
uaguagagacgggguuucaccguguu

SEQ ID NO: 670627 - RNA, 26 nt, Human
uaguagagacgggguuucaccguugg

SEQ ID NO: 670628 - RNA, 21 nt, Human
uauaaccauugccugguacag

SEQ ID NO: 670629 - RNA, 24 nt, Human
uauuacagauuaaaucauuuuuuc

SEQ ID NO: 670630 - RNA, 19 nt, Human
ucaaaaacucaauuuccca

SEQ ID NO: 670631 - RNA, 20 nt, Human
ucaauuacagaacauacuaa

SEQ ID NO: 670632 - RNA, 24 nt, Human
ucaccguguuggucaggcuggucu

SEQ ID NO: 670633 - RNA, 24 nt, Human
ucacucuguugcccaggcuggagu

SEQ ID NO: 670634 - RNA, 24 nt, Human
ucacugcaacuucuaccucccagg

SEQ ID NO: 670635 - RNA, 25 nt, Human
ucacugcaacuucuaccucccaggu

SEQ ID NO: 670636 - RNA, 24 nt, Human
ucagacauccuaguuuccaauaau

SEQ ID NO: 670637 - RNA, 19 nt, Human
ucaguagacauuuacugaa

SEQ ID NO: 670638 - RNA, 23 nt, Human
uccacaaacaguauuuaaaaucc

SEQ ID NO: 670639 - RNA, 24 nt, Human
uccacccacccuuuggucgcuuga

SEQ ID NO: 670640 - RNA, 23 nt, Human
ucccaaagugcugggauuacagg

SEQ ID NO: 670641 - RNA, 21 nt, Human
ucccagguucaagcgauucuc

SEQ ID NO: 670642 - RNA, 21 nt, Human
ucccagguucaagcgauucuc

SEQ ID NO: 670643 - RNA, 24 nt, Human
ucccagguucaagcgauucucuug

SEQ ID NO: 670644 - RNA, 24 nt, Human
uccugaguagcugagauuacaggc

SEQ ID NO: 670645 - RNA, 24 nt, Human
uccuuuauaccuaaugcaaaguua

SEQ ID NO: 670646 - RNA, 24 nt, Human
ucgcuugaacugcccuucuuuggu

SEQ ID NO: 670647 - RNA, 18 nt, Human
ucggccucccaaagugcu

SEQ ID NO: 670648 - RNA, 23 nt, Human
ucucacucuguugcccaggcugg

SEQ ID NO: 670649 - RNA, 24 nt, Human
ucucacucuguugcccaggcugga

SEQ ID NO: 670650 - RNA, 26 nt, Human
ucucacucuguugcccaggcuggagu

SEQ ID NO: 670651 - RNA, 19 nt, Human
ucucgaacuccugaccucg

SEQ ID NO: 670652 - RNA, 18 nt, Human
ucuguugcccaggcugga

SEQ ID NO: 670653 - RNA, 24 nt, Human
ucuguugcccaggcuggagugcag

SEQ ID NO: 670654 - RNA, 23 nt, Human
ugaauaacacaccucaaacaaaa

SEQ ID NO: 670655 - RNA, 22 nt, Human
ugacaagacauaaagguccacc

SEQ ID NO: 670656 - RNA, 23 nt, Human
ugacuaggaaagaggugagaaga

SEQ ID NO: 670657 - RNA, 19 nt, Human
ugagaagagaugggcccuc

SEQ ID NO: 670658 - RNA, 21 nt, Human
ugagacagaccaacagaggca

SEQ ID NO: 670659 - RNA, 22 nt, Human
ugagacggagucucacucuguu

SEQ ID NO: 670660 - RNA, 18 nt, Human
ugagauuacaggcaugug

SEQ ID NO: 670661 - RNA, 21 nt, Human
ugagauuacaggcaugugcca

SEQ ID NO: 670662 - RNA, 22 nt, Human
ugagauuacaggcaugugccac

SEQ ID NO: 670663 - RNA, 24 nt, Human
ugagauuacaggcaugugccacca

SEQ ID NO: 670664 - RNA, 21 nt, Human
ugcaaacaguaaagaaaugaa

SEQ ID NO: 670665 - RNA, 18 nt, Human
ugcccaggcuggagugca

SEQ ID NO: 670666 - RNA, 21 nt, Human
ugcccaggcuggagugcagug

SEQ ID NO: 670667 - RNA, 22 nt, Human
ugcccaggcuggagugcagugg

SEQ ID NO: 670668 - RNA, 24 nt, Human
ugcccaggcuggagugcaguggcg

SEQ ID NO: 670669 - RNA, 24 nt, Human
ugccucagccuccugaguagcuga

SEQ ID NO: 670670 - RNA, 24 nt, Human
ugcugggauuacaggugugagcca

SEQ ID NO: 670671 - RNA, 19 nt, Human
uggagugcaguggcgugau

SEQ ID NO: 670672 - RNA, 23 nt, Human
uggagugcaguggcgugauuuug

SEQ ID NO: 670673 - RNA, 24 nt, Human
uggagugcaguggcgugauuuugg

SEQ ID NO: 670674 - RNA, 24 nt, Human
uggcgugauuuuggcucacugcaa

SEQ ID NO: 670675 - RNA, 18 nt, Human
ugggauuacaggugugag

SEQ ID NO: 670676 - RNA, 19 nt, Human
ugggauuacaggugugagc

SEQ ID NO: 670677 - RNA, 22 nt, Human
ugggauuacaggugugagccac

SEQ ID NO: 670678 - RNA, 23 nt, Human
ugggauuacaggugugagccacc

SEQ ID NO: 670679 - RNA, 24 nt, Human
ugggauuacaggugugagccacca

SEQ ID NO: 670680 - RNA, 24 nt, Human
uggucaggcuggucucgaacuccu

SEQ ID NO: 670681 - RNA, 21 nt, Human
uguauuuuuaguagagacggg

SEQ ID NO: 670682 - RNA, 19 nt, Human
uguguuuggugaggcagag

SEQ ID NO: 670683 - RNA, 18 nt, Human
uuaguagagacgggguuu

SEQ ID NO: 670684 - RNA, 22 nt, Human
uuaguagagacgggguuucacc

SEQ ID NO: 670685 - RNA, 24 nt, Human
uuaguagagacgggguuucaccgu

SEQ ID NO: 670686 - RNA, 23 nt, Human
uucaagcgauucucuugccucag

SEQ ID NO: 670687 - RNA, 18 nt, Human
uugaacugcccuucuuug

SEQ ID NO: 670688 - RNA, 24 nt, Human
uugcccaggcuggagugcaguggc

SEQ ID NO: 670689 - RNA, 23 nt, Human
uuggaauuuaccugggaaggagu

SEQ ID NO: 670690 - RNA, 21 nt, Human
uuggaccauaccuuuucccac

SEQ ID NO: 670691 - RNA, 23 nt, Human
uuguauuuuuaguagagacgggg

SEQ ID NO: 670692 - RNA, 18 nt, Human
uuuaaacuauacauccag

SEQ ID NO: 670693 - RNA, 25 nt, Human
uuuacacuaggcacacacacacaaa

SEQ ID NO: 670694 - RNA, 22 nt, Human
uuuagucagguacuacacugau

SEQ ID NO: 670695 - RNA, 18 nt, Human
uuugcccacaguaagggc

SEQ ID NO: 670696 - RNA, 25 nt, Human
uuuguuguuuaaacuauacauccag

SEQ ID NO: 670697 - RNA, 24 nt, Human
uuuuuaguagagacgggguuucac

SEQ ID NO: 670698 - RNA, 20 nt, Human
uuuuuguauuuuuaguagag

SEQ ID NO: 670699 - RNA, 26 nt, Human
uuuuuuuuuuuugagacggagucuca

SEQ ID NO: 670700 - RNA, 22 nt, Human
uuuuuuuuuuuuuugagacgga

SEQ ID NO: 670701 - RNA, 23 nt, Human
aaaccaacagaugggaucucuca

SEQ ID NO: 670702 - RNA, 20 nt, Human
aaagugagagagguggcuca

SEQ ID NO: 670703 - RNA, 19 nt, Human
aaauaagaaggaaucaaaa

SEQ ID NO: 670704 - RNA, 19 nt, Human
aagaaagugagagaggugg

SEQ ID NO: 670705 - RNA, 18 nt, Human
aagaaggcucuagucugu

SEQ ID NO: 670706 - RNA, 26 nt, Human
aaucuauagcuagaucgucucccucu

SEQ ID NO: 670707 - RNA, 19 nt, Human
acagacacggacauggaag

SEQ ID NO: 670708 - RNA, 19 nt, Human
acauggaaagaaaacauga

SEQ ID NO: 670709 - RNA, 23 nt, Human
acucacucuaggugaauuuccac

SEQ ID NO: 670710 - RNA, 19 nt, Human
agaauagcuauuauguuca

SEQ ID NO: 670711 - RNA, 23 nt, Human
agacacggacauggaagauaacc

SEQ ID NO: 670712 - RNA, 22 nt, Human
agagugaggugaguaucaagaa

SEQ ID NO: 670713 - RNA, 19 nt, Human
aggaaaguacucacucuag

SEQ ID NO: 670714 - RNA, 22 nt, Human
aggcaguaaguaugugggucca

SEQ ID NO: 670715 - RNA, 18 nt, Human
aggcuaucaucagagcag

SEQ ID NO: 670716 - RNA, 20 nt, Human
agguggcucaggguauggag

SEQ ID NO: 670717 - RNA, 21 nt, Human
aguauguggguccacagacac

SEQ ID NO: 670718 - RNA, 20 nt, Human
auggagaagaagguagacac

SEQ ID NO: 670719 - RNA, 19 nt, Human
caaaaaaauucucgcgcgg

SEQ ID NO: 670720 - RNA, 22 nt, Human
caaacuuccccagcucaaccau

SEQ ID NO: 670721 - RNA, 19 nt, Human
cacaacaguggcaacaggc

SEQ ID NO: 670722 - RNA, 18 nt, Human
cagaagggguaaguggua

SEQ ID NO: 670723 - RNA, 24 nt, Human
cagacaaaucagcuucagcacaau

SEQ ID NO: 670724 - RNA, 20 nt, Human
cagcccagagcccgagacaa

SEQ ID NO: 670725 - RNA, 19 nt, Human
caucucacuaaucaaaaca

SEQ ID NO: 670726 - RNA, 19 nt, Human
ccagacaggagagcugaac

SEQ ID NO: 670727 - RNA, 19 nt, Human
cccagacaggagagcugaa

SEQ ID NO: 670728 - RNA, 19 nt, Human
ccugaaucauaagcauagc

SEQ ID NO: 670729 - RNA, 21 nt, Human
ccugcugggaccaggucucca

SEQ ID NO: 670730 - RNA, 19 nt, Human
cggacauggaagauaacca

SEQ ID NO: 670731 - RNA, 26 nt, Human
cuagaaaccuccccucccucacaugg

SEQ ID NO: 670732 - RNA, 21 nt, Human
cucaaccaugaccugguuacc

SEQ ID NO: 670733 - RNA, 19 nt, Human
cucaggguauggagaagaa

SEQ ID NO: 670734 - RNA, 18 nt, Human
cugcacugccauuccugc

SEQ ID NO: 670735 - RNA, 24 nt, Human
gaaaugacaggaaaugcccacaaa

SEQ ID NO: 670736 - RNA, 23 nt, Human
gaacagacaaaucagcuucagca

SEQ ID NO: 670737 - RNA, 19 nt, Human
gagcagcuggagauuucuc

SEQ ID NO: 670738 - RNA, 21 nt, Human
gcaaccuagaaaauaaaccuc

SEQ ID NO: 670739 - RNA, 21 nt, Human
gccaauuuccugcacugccau

SEQ ID NO: 670740 - RNA, 20 nt, Human
ggaaagaaaacaugagccag

SEQ ID NO: 670741 - RNA, 22 nt, Human
guccacagacacggacauggaa

SEQ ID NO: 670742 - RNA, 19 nt, Human
uaagugguaacaucucacu

SEQ ID NO: 670743 - RNA, 23 nt, Human
uacuuugaagggaaaaugggagg

SEQ ID NO: 670744 - RNA, 19 nt, Human
uagggcaaggcacaacuaa

SEQ ID NO: 670745 - RNA, 21 nt, Human
ucacuaaucaaaacacacagg

SEQ ID NO: 670746 - RNA, 25 nt, Human
ucaucuagaaaccuccccucccuca

SEQ ID NO: 670747 - RNA, 23 nt, Human
uccaaauaagaaggaaucaaaaa

SEQ ID NO: 670748 - RNA, 20 nt, Human
ugaaggacugagauccgagg

SEQ ID NO: 670749 - RNA, 18 nt, Human
ugaaucauaagcauagca

SEQ ID NO: 670750 - RNA, 22 nt, Human
ugaaucauaagcauagcaauuc

SEQ ID NO: 670751 - RNA, 19 nt, Human
ugaaugccuguggcugcca

SEQ ID NO: 670752 - RNA, 20 nt, Human
ugagagggucuggcuuggca

SEQ ID NO: 670753 - RNA, 24 nt, Human
ugagagggucuggcuuggcaucga

SEQ ID NO: 670754 - RNA, 21 nt, Human
ugagagugaggugaguaucaa

SEQ ID NO: 670755 - RNA, 18 nt, Human
uggaaagaaaacaugagc

SEQ ID NO: 670756 - RNA, 19 nt, Human
uggaagaaccaucugggcg

SEQ ID NO: 670757 - RNA, 24 nt, Human
ugggaucucucauugccaaguucu

SEQ ID NO: 670758 - RNA, 19 nt, Human
uggguccacagacacggac

SEQ ID NO: 670759 - RNA, 21 nt, Human
ugugagagggucuggcuuggc

SEQ ID NO: 670760 - RNA, 22 nt, Human
uucaaacuuccccagcucaacc

SEQ ID NO: 670761 - RNA, 24 nt, Human
uuuccugcacugccauuccugcug

SEQ ID NO: 670762 - RNA, 25 nt, Human
caaaagacuccagacuucuuacagg

SEQ ID NO: 670763 - RNA, 24 nt, Human
caaggaggcagugcccaaaagccc

SEQ ID NO: 670764 - RNA, 21 nt, Human
caagguccaccggguccuuca

SEQ ID NO: 670765 - RNA, 19 nt, Human
caccggguccuucaaucuu

SEQ ID NO: 670766 - RNA, 20 nt, Human
cagcagaacucccaaggucc

SEQ ID NO: 670767 - RNA, 22 nt, Human
ccacuaacuucccaaggaggca

SEQ ID NO: 670768 - RNA, 20 nt, Human
ccauccaaggccuuccuucc

SEQ ID NO: 670769 - RNA, 20 nt, Human
cccuagauccagcagaacuc

SEQ ID NO: 670770 - RNA, 25 nt, Human
cgcaugccguacgccacuuccguuu

SEQ ID NO: 670771 - RNA, 20 nt, Human
cguuguacuucgauagcucc

SEQ ID NO: 670772 - RNA, 25 nt, Human
cucccaagguccaccggguccuuca

SEQ ID NO: 670773 - RNA, 20 nt, Human
cuuccugggguuggguaugg

SEQ ID NO: 670774 - RNA, 23 nt, Human
guuguacuucgauagcuccuccu

SEQ ID NO: 670775 - RNA, 25 nt, Human
ucaaagguuuuacugcucauccuga

SEQ ID NO: 670776 - RNA, 18 nt, Human
ucccaaggaggcagugcc

SEQ ID NO: 670777 - RNA, 21 nt, Human
ucuuacagguuucaucucucu

SEQ ID NO: 670778 - RNA, 21 nt, Human
ugaggguccauccaaggccuu

SEQ ID NO: 670779 - RNA, 23 nt, Human
ugcccaaaagcccugugguuuuu

SEQ ID NO: 670780 - RNA, 19 nt, Human
uguggccacuaacuuccca

SEQ ID NO: 670781 - RNA, 22 nt, Human
uuccuuccugggguuggguaug

SEQ ID NO: 670782 - RNA, 22 nt, Human
uuguacuucgauagcuccuccu

SEQ ID NO: 670783 - RNA, 22 nt, Human
aaaaaaaauugaacaaagagac

SEQ ID NO: 670784 - RNA, 21 nt, Human
aaagagacccucuugcgagag

SEQ ID NO: 670785 - RNA, 22 nt, Human
aagggacuuugaggcuuguugg

SEQ ID NO: 670786 - RNA, 20 nt, Human
accucacuucuuuuccuuag

SEQ ID NO: 670787 - RNA, 23 nt, Human
agccuccagggcacgccaaccuu

SEQ ID NO: 670788 - RNA, 20 nt, Human
aggaaggcuggcaucucgcu

SEQ ID NO: 670789 - RNA, 18 nt, Human
aggagauauuuuugggug

SEQ ID NO: 670790 - RNA, 19 nt, Human
agugagagggucacagggg

SEQ ID NO: 670791 - RNA, 23 nt, Human
aguggggacugggugaaacucgg

SEQ ID NO: 670792 - RNA, 22 nt, Human
aucugguuagagcucucuuuca

SEQ ID NO: 670793 - RNA, 25 nt, Human
caacaagcaggcucagugccagccu

SEQ ID NO: 670794 - RNA, 21 nt, Human
caagggacuuugaggcuuguu

SEQ ID NO: 670795 - RNA, 19 nt, Human
cagcagaggaggaagaauu

SEQ ID NO: 670796 - RNA, 24 nt, Human
cagccuccagggcacgccaaccuu

SEQ ID NO: 670797 - RNA, 18 nt, Human
cauaugaggucccauggc

SEQ ID NO: 670798 - RNA, 19 nt, Human
cauaugaggucccauggcu

SEQ ID NO: 670799 - RNA, 23 nt, Human
caugccuuauuagguauugggga

SEQ ID NO: 670800 - RNA, 22 nt, Human
caugucucaggacauuggagga

SEQ ID NO: 670801 - RNA, 24 nt, Human
caugucucaggacauuggaggaga

SEQ ID NO: 670802 - RNA, 23 nt, Human
ccaaccuucucauggugccccaa

SEQ ID NO: 670803 - RNA, 19 nt, Human
ccaaugcacacauaggaag

SEQ ID NO: 670804 - RNA, 24 nt, Human
cccauggcugaggaggcagagggc

SEQ ID NO: 670805 - RNA, 27 nt, Human
ccccaagccccaccccaaugcacacau

SEQ ID NO: 670806 - RNA, 27 nt, Human
ccccaaugcacacauaggaagucucca

SEQ ID NO: 670807 - RNA, 19 nt, Human
cccgggacaggaaggcugg

SEQ ID NO: 670808 - RNA, 18 nt, Human
ccgaagcugccacgcccu

SEQ ID NO: 670809 - RNA, 18 nt, Human
ccgggacaggaaggcugg

SEQ ID NO: 670810 - RNA, 19 nt, Human
ccucuugcgagaggugaga

SEQ ID NO: 670811 - RNA, 19 nt, Human
ccuggaguucaaguuucug

SEQ ID NO: 670812 - RNA, 25 nt, Human
ccuuuuggcuacuaguaaaucccaa

SEQ ID NO: 670813 - RNA, 20 nt, Human
cgcugggcugagagauaagc

SEQ ID NO: 670814 - RNA, 23 nt, Human
cgggagaaaucgggcugccaggc

SEQ ID NO: 670815 - RNA, 22 nt, Human
cuaagcaaaccucacuucuuuu

SEQ ID NO: 670816 - RNA, 21 nt, Human
cuaguaaaucccaaauugcau

SEQ ID NO: 670817 - RNA, 18 nt, Human
cucauggugccccaagcc

SEQ ID NO: 670818 - RNA, 21 nt, Human
cuccagggcacgccaaccuuc

SEQ ID NO: 670819 - RNA, 18 nt, Human
cugccaggcggaguccug

SEQ ID NO: 670820 - RNA, 21 nt, Human
cugccaggcggaguccugcgu

SEQ ID NO: 670821 - RNA, 22 nt, Human
gaaggcuggcaucucgcugggc

SEQ ID NO: 670822 - RNA, 24 nt, Human
gagacaggaccuggggacagagaa

SEQ ID NO: 670823 - RNA, 18 nt, Human
gcagcugcaccguggagu

SEQ ID NO: 670824 - RNA, 21 nt, Human
gccccaagccccaccccaaug

SEQ ID NO: 670825 - RNA, 22 nt, Human
gccccaagccccaccccaaugc

SEQ ID NO: 670826 - RNA, 20 nt, Human
gccccaccccaaugcacaca

SEQ ID NO: 670827 - RNA, 23 nt, Human
ggguaguucaugagaacauuucg

SEQ ID NO: 670828 - RNA, 21 nt, Human
gucauuguauguuauuaaggg

SEQ ID NO: 670829 - RNA, 22 nt, Human
gugccagccucugugucagccu

SEQ ID NO: 670830 - RNA, 21 nt, Human
uaaaaaaaauugaacaaagag

SEQ ID NO: 670831 - RNA, 21 nt, Human
uaagcaaaccucacuucuuuu

SEQ ID NO: 670832 - RNA, 22 nt, Human
uaauaaagugaggucucggggu

SEQ ID NO: 670833 - RNA, 23 nt, Human
uaauaaagugaggucucggggua

SEQ ID NO: 670834 - RNA, 18 nt, Human
uagauuaaaaaaaauuga

SEQ ID NO: 670835 - RNA, 20 nt, Human
uauguuauuaaggguagcau

SEQ ID NO: 670836 - RNA, 18 nt, Human
ucagagcgcuggccugug

SEQ ID NO: 670837 - RNA, 25 nt, Human
uccacuggaauguuccaguguucca

SEQ ID NO: 670838 - RNA, 18 nt, Human
uccgaagcugccacgccc

SEQ ID NO: 670839 - RNA, 23 nt, Human
uccgggagaaaucgggcugccag

SEQ ID NO: 670840 - RNA, 20 nt, Human
uccuggaguucaaguuucug

SEQ ID NO: 670841 - RNA, 21 nt, Human
ugaggucccauggcugaggag

SEQ ID NO: 670842 - RNA, 25 nt, Human
ugccacgcccuaagcaaaccggcgc

SEQ ID NO: 670843 - RNA, 20 nt, Human
ugccaugucccaagccacaa

SEQ ID NO: 670844 - RNA, 21 nt, Human
ugccuuauuagguauugggga

SEQ ID NO: 670845 - RNA, 19 nt, Human
ugcguuuauccgaagcugc

SEQ ID NO: 670846 - RNA, 18 nt, Human
uggaaagaucuuguaaua

SEQ ID NO: 670847 - RNA, 19 nt, Human
uggaauguuccaguguucc

SEQ ID NO: 670848 - RNA, 22 nt, Human
uggggacagagaacgguccucc

SEQ ID NO: 670849 - RNA, 27 nt, Human
uggggacagagaacgguccuccccgag

SEQ ID NO: 670850 - RNA, 21 nt, Human
ugggguaguucaugagaacau

SEQ ID NO: 670851 - RNA, 21 nt, Human
ugugcagagacaggaccuggg

SEQ ID NO: 670852 - RNA, 20 nt, Human
ugugucagccuccagggcac

SEQ ID NO: 670853 - RNA, 24 nt, Human
uucucauggugccccaagccccac

SEQ ID NO: 670854 - RNA, 23 nt, Human
uuggaaguucucacacuaugugg

SEQ ID NO: 670855 - RNA, 20 nt, Human
uuggguauuuggaaagaucu

SEQ ID NO: 670856 - RNA, 22 nt, Human
aggcggaggguguggccagggg

SEQ ID NO: 670857 - RNA, 23 nt, Human
agggacgcggcgguggcugcugc

SEQ ID NO: 670858 - RNA, 19 nt, Human
aggggagcgcgagcgggcg

SEQ ID NO: 670859 - RNA, 22 nt, Human
cuuuacuuuuugucuuagcaga

SEQ ID NO: 670860 - RNA, 19 nt, Human
cuuuuugucuuagcagagg

SEQ ID NO: 670861 - RNA, 20 nt, Human
gagagggacgcggcgguggc

SEQ ID NO: 670862 - RNA, 21 nt, Human
gcccagcagguugucagcucc

SEQ ID NO: 670863 - RNA, 21 nt, Human
gcuggcagggggcuuggucuu

SEQ ID NO: 670864 - RNA, 21 nt, Human
ggaggguguggccaggggagc

SEQ ID NO: 670865 - RNA, 21 nt, Human
ggagguaggagacucggaccc

SEQ ID NO: 670866 - RNA, 21 nt, Human
ggcgguggcugcugcguccag

SEQ ID NO: 670867 - RNA, 22 nt, Human
gggcacggugagcuggcagggg

SEQ ID NO: 670868 - RNA, 19 nt, Human
gggcaggguugggggaggu

SEQ ID NO: 670869 - RNA, 20 nt, Human
ucuuagcagaggagauaacu

SEQ ID NO: 670870 - RNA, 18 nt, Human
ugagcuggcagggggcuu

SEQ ID NO: 670871 - RNA, 19 nt, Human
uggccaggcucuucgaggg

SEQ ID NO: 670872 - RNA, 20 nt, Human
ugucuucccucucuggccag

SEQ ID NO: 670873 - RNA, 21 nt, Human
uugucagcuccuguuucugau

SEQ ID NO: 670874 - RNA, 21 nt, Human
uacaucugccuuuccauccua

SEQ ID NO: 670875 - RNA, 19 nt, Human
aaacagcaaccuaacaaaa

SEQ ID NO: 670876 - RNA, 24 nt, Human
aaagaauucucauauguagaauca

SEQ ID NO: 670877 - RNA, 18 nt, Human
aaaguccuccccagacac

SEQ ID NO: 670878 - RNA, 23 nt, Human
aaaguccuccccagacaccgccu

SEQ ID NO: 670879 - RNA, 22 nt, Human
aaaguuccccuacaaagugcuu

SEQ ID NO: 670880 - RNA, 21 nt, Human
aacaugcagggcccugguggg

SEQ ID NO: 670881 - RNA, 18 nt, Human
aagaaacauaaugaaaug

SEQ ID NO: 670882 - RNA, 21 nt, Human
aaguccuccccagacaccgcc

SEQ ID NO: 670883 - RNA, 21 nt, Human
acaaagagaaacuuugggaaa

SEQ ID NO: 670884 - RNA, 18 nt, Human
acaaaguccuccccagac

SEQ ID NO: 670885 - RNA, 19 nt, Human
acaaaguccuccccagaca

SEQ ID NO: 670886 - RNA, 22 nt, Human
acaaaguccuccccagacaccg

SEQ ID NO: 670887 - RNA, 20 nt, Human
accacagagaacagggaaga

SEQ ID NO: 670888 - RNA, 22 nt, Human
acgcaaaacauccagcucuccu

SEQ ID NO: 670889 - RNA, 24 nt, Human
acucuguuacuuugguucuuaagu

SEQ ID NO: 670890 - RNA, 18 nt, Human
agaaagagagugcagcuu

SEQ ID NO: 670891 - RNA, 23 nt, Human
agaggucuggcugagugaagggc

SEQ ID NO: 670892 - RNA, 24 nt, Human
agagucgcugggggccuggccacc

SEQ ID NO: 670893 - RNA, 22 nt, Human
agcucucagauucucggauagc

SEQ ID NO: 670894 - RNA, 23 nt, Human
aggagcuggucaggaucuccggg

SEQ ID NO: 670895 - RNA, 21 nt, Human
aggaggggaguggggcccagg

SEQ ID NO: 670896 - RNA, 23 nt, Human
agggcuuuauuugaggacagaau

SEQ ID NO: 670897 - RNA, 24 nt, Human
aggugagcuaucuguuguugggga

SEQ ID NO: 670898 - RNA, 21 nt, Human
aggugaggaagagcaguguuu

SEQ ID NO: 670899 - RNA, 19 nt, Human
agguuggcauguucuugaa

SEQ ID NO: 670900 - RNA, 24 nt, Human
agugcaauuccaaauguugagccu

SEQ ID NO: 670901 - RNA, 24 nt, Human
auccuuggaaagccaagcacucaa

SEQ ID NO: 670902 - RNA, 19 nt, Human
augauggcuguguaccucc

SEQ ID NO: 670903 - RNA, 19 nt, Human
auggaaugucccaggcccc

SEQ ID NO: 670904 - RNA, 26 nt, Human
auugcaggccccaaguacaguggguu

SEQ ID NO: 670905 - RNA, 22 nt, Human
auugugcagguggggugcuggu

SEQ ID NO: 670906 - RNA, 20 nt, Human
caaacccauuagcuacucag

SEQ ID NO: 670907 - RNA, 25 nt, Human
caaauguccacccagcccaaaaaau

SEQ ID NO: 670908 - RNA, 20 nt, Human
cacacagccauugcaggccc

SEQ ID NO: 670909 - RNA, 21 nt, Human
caccagaggcagagugucucu

SEQ ID NO: 670910 - RNA, 21 nt, Human
cagaaccgaaacuuucugggg

SEQ ID NO: 670911 - RNA, 22 nt, Human
cagaaccgaaacuuucuggggc

SEQ ID NO: 670912 - RNA, 22 nt, Human
cagaaguuggaaucaccccugc

SEQ ID NO: 670913 - RNA, 23 nt, Human
cagauggaaugucccaggcccca

SEQ ID NO: 670914 - RNA, 23 nt, Human
cagccauugcaggccccaaguac

SEQ ID NO: 670915 - RNA, 27 nt, Human
cagcugaggaguagcucuaaagccaau

SEQ ID NO: 670916 - RNA, 20 nt, Human
caggccccaaguacaguggg

SEQ ID NO: 670917 - RNA, 21 nt, Human
cagggcagaaaaucucuccac

SEQ ID NO: 670918 - RNA, 21 nt, Human
cagggcccugguggggcaggg

SEQ ID NO: 670919 - RNA, 19 nt, Human
cauggucagagccuuggcc

SEQ ID NO: 670920 - RNA, 20 nt, Human
ccaaggacaguuucuuggcc

SEQ ID NO: 670921 - RNA, 18 nt, Human
ccagaaagagagugcagc

SEQ ID NO: 670922 - RNA, 21 nt, Human
ccauccuugguucuaagcauc

SEQ ID NO: 670923 - RNA, 19 nt, Human
cccagacaccgccucugag

SEQ ID NO: 670924 - RNA, 21 nt, Human
ccccaaacccauuagcuacuc

SEQ ID NO: 670925 - RNA, 23 nt, Human
ccccaaguacaguggguuuugcu

SEQ ID NO: 670926 - RNA, 19 nt, Human
ccccacaaaaguccucuuu

SEQ ID NO: 670927 - RNA, 18 nt, Human
ccccuggccaaacuggga

SEQ ID NO: 670928 - RNA, 20 nt, Human
cccucaaaaccagccagacc

SEQ ID NO: 670929 - RNA, 21 nt, Human
ccucaaaaccagccagaccag

SEQ ID NO: 670930 - RNA, 23 nt, Human
ccucaccccuggccaaacuggga

SEQ ID NO: 670931 - RNA, 25 nt, Human
ccugaaauaguuucaccaccuucga

SEQ ID NO: 670932 - RNA, 23 nt, Human
ccugcccgugaaacucuccacaa

SEQ ID NO: 670933 - RNA, 20 nt, Human
ccugucaggaggggaguggg

SEQ ID NO: 670934 - RNA, 23 nt, Human
ccuugcuuaaaaacugacuggaa

SEQ ID NO: 670935 - RNA, 22 nt, Human
ccuuugggugugacaacagcug

SEQ ID NO: 670936 - RNA, 24 nt, Human
ccuuuuaaaaaaaaaaaaaaaaaa

SEQ ID NO: 670937 - RNA, 19 nt, Human
cuccuggaggagugguucu

SEQ ID NO: 670938 - RNA, 24 nt, Human
cucguggguccaccgccgggcaga

SEQ ID NO: 670939 - RNA, 23 nt, Human
cucuggguucucuuuuccuaagg

SEQ ID NO: 670940 - RNA, 24 nt, Human
cugcauaacauacaucaagcagcc

SEQ ID NO: 670941 - RNA, 18 nt, Human
cugccucaaggggggaug

SEQ ID NO: 670942 - RNA, 19 nt, Human
cugccucaaggggggaugu

SEQ ID NO: 670943 - RNA, 18 nt, Human
cuggagcagccuccagcu

SEQ ID NO: 670944 - RNA, 18 nt, Human
cuguuggacuuggccugg

SEQ ID NO: 670945 - RNA, 19 nt, Human
cuuggaccuggaggacaac

SEQ ID NO: 670946 - RNA, 21 nt, Human
cuuggccuggagucccugacc

SEQ ID NO: 670947 - RNA, 22 nt, Human
cuuuaugugacaggugaggaag

SEQ ID NO: 670948 - RNA, 21 nt, Human
cuuugugccaaacgugccucc

SEQ ID NO: 670949 - RNA, 20 nt, Human
gaagugaaguuacugaggug

SEQ ID NO: 670950 - RNA, 19 nt, Human
gagcagugggaagugggca

SEQ ID NO: 670951 - RNA, 20 nt, Human
gagcccuucaacgccucggg

SEQ ID NO: 670952 - RNA, 25 nt, Human
gcacaaaguccuccccaaccggagg

SEQ ID NO: 670953 - RNA, 18 nt, Human
gcaggcagcugguuccau

SEQ ID NO: 670954 - RNA, 22 nt, Human
gcaggcagcugguuccaugaac

SEQ ID NO: 670955 - RNA, 18 nt, Human
gcauguucuugaaggugg

SEQ ID NO: 670956 - RNA, 19 nt, Human
gccaucaaggggcugcccc

SEQ ID NO: 670957 - RNA, 19 nt, Human
gccgaaugcaagaggccca

SEQ ID NO: 670958 - RNA, 22 nt, Human
gccuggguccagaggaaggcuc

SEQ ID NO: 670959 - RNA, 24 nt, Human
gcggaagaggacgggaacgcggug

SEQ ID NO: 670960 - RNA, 22 nt, Human
gcugcagagagcacagcaaacu

SEQ ID NO: 670961 - RNA, 23 nt, Human
ggaagagcaguguuuccugugga

SEQ ID NO: 670962 - RNA, 18 nt, Human
ggaagauuaaauaauucu

SEQ ID NO: 670963 - RNA, 22 nt, Human
ggacaagagcaugacuggagga

SEQ ID NO: 670964 - RNA, 22 nt, Human
ggccaagcggaagaggacggga

SEQ ID NO: 670965 - RNA, 23 nt, Human
ggcccagcucucagauucucgga

SEQ ID NO: 670966 - RNA, 22 nt, Human
gggaagaaaaggaccacagaga

SEQ ID NO: 670967 - RNA, 20 nt, Human
gggcagcccaggggcugagu

SEQ ID NO: 670968 - RNA, 18 nt, Human
gggccaagcggaagagga

SEQ ID NO: 670969 - RNA, 20 nt, Human
gguggugaguggcuucagug

SEQ ID NO: 670970 - RNA, 20 nt, Human
gguuguggcugcuggugugu

SEQ ID NO: 670971 - RNA, 20 nt, Human
gguuuugcucuuggauuauc

SEQ ID NO: 670972 - RNA, 21 nt, Human
gugaagggcuuuauuugagga

SEQ ID NO: 670973 - RNA, 24 nt, Human
gugagguuguggcugcuggugugu

SEQ ID NO: 670974 - RNA, 23 nt, Human
guggugaguggcuucaguggcau

SEQ ID NO: 670975 - RNA, 22 nt, Human
uaacaaaauacaaauguccacc

SEQ ID NO: 670976 - RNA, 18 nt, Human
uaacagugaacaagcuga

SEQ ID NO: 670977 - RNA, 23 nt, Human
uacaaauguccacccagcccaaa

SEQ ID NO: 670978 - RNA, 20 nt, Human
uacuuaauggaaacauugcc

SEQ ID NO: 670979 - RNA, 22 nt, Human
uacuuuauuuaaauccugaggu

SEQ ID NO: 670980 - RNA, 20 nt, Human
ucacaaggguagcuggagga

SEQ ID NO: 670981 - RNA, 24 nt, Human
ucagaauuucggcccucgguggcu

SEQ ID NO: 670982 - RNA, 20 nt, Human
ucaucagcuuggccagaguc

SEQ ID NO: 670983 - RNA, 19 nt, Human
uccacccccauugugcagg

SEQ ID NO: 670984 - RNA, 21 nt, Human
uccccagacaccgccucugag

SEQ ID NO: 670985 - RNA, 18 nt, Human
uccuggguguuuaaaccu

SEQ ID NO: 670986 - RNA, 19 nt, Human
ucgcugggggccuggccac

SEQ ID NO: 670987 - RNA, 22 nt, Human
ucuccaaacccuguggaguuuu

SEQ ID NO: 670988 - RNA, 22 nt, Human
ucuccugccuggguccagagga

SEQ ID NO: 670989 - RNA, 22 nt, Human
ucucuguuggacuuggccugga

SEQ ID NO: 670990 - RNA, 24 nt, Human
ucuuuguugguggugagguugugg

SEQ ID NO: 670991 - RNA, 21 nt, Human
ugaaagguucuauucccuguu

SEQ ID NO: 670992 - RNA, 18 nt, Human
ugaaguuacugaggugcu

SEQ ID NO: 670993 - RNA, 19 nt, Human
ugacaggugaggaagagca

SEQ ID NO: 670994 - RNA, 20 nt, Human
ugacguggcuuuucauuucu

SEQ ID NO: 670995 - RNA, 25 nt, Human
ugacuuuuuaaaaaaaugcuuuaug

SEQ ID NO: 670996 - RNA, 19 nt, Human
ugagcuguggagaggucug

SEQ ID NO: 670997 - RNA, 23 nt, Human
ugaggacaaacaucaggccaaga

SEQ ID NO: 670998 - RNA, 23 nt, Human
ugaggcuuggguauugcucugca

SEQ ID NO: 670999 - RNA, 29 nt, Human
ugcaagaggcccagcuuuucucugggcaa

SEQ ID NO: 671000 - RNA, 21 nt, Human
ugcacgcaaaacauccagcuc

SEQ ID NO: 671001 - RNA, 21 nt, Human
ugcagccaccagaggcagagu

SEQ ID NO: 671002 - RNA, 21 nt, Human
ugccgggcccagcucucagau

SEQ ID NO: 671003 - RNA, 24 nt, Human
ugcugaguucuggagcagccucca

SEQ ID NO: 671004 - RNA, 20 nt, Human
ugcuggugugugguggguuu

SEQ ID NO: 671005 - RNA, 20 nt, Human
ugcuuuaugugacaggugag

SEQ ID NO: 671006 - RNA, 18 nt, Human
uggaaagccaagcacuca

SEQ ID NO: 671007 - RNA, 19 nt, Human
uggaagaaacauaaugaaa

SEQ ID NO: 671008 - RNA, 20 nt, Human
uggaagaaccuggggccuga

SEQ ID NO: 671009 - RNA, 19 nt, Human
uggaagugcucaacucucc

SEQ ID NO: 671010 - RNA, 24 nt, Human
uggagcagcugacuuuuuaaaaaa

SEQ ID NO: 671011 - RNA, 21 nt, Human
uggaggagcuggucaggaucu

SEQ ID NO: 671012 - RNA, 21 nt, Human
uggaguuuuucaguucccgug

SEQ ID NO: 671013 - RNA, 22 nt, Human
uggcuaugaucauuaguaaaca

SEQ ID NO: 671014 - RNA, 19 nt, Human
uggcuggauggauucaaag

SEQ ID NO: 671015 - RNA, 19 nt, Human
ugggaucccaaggacgcuu

SEQ ID NO: 671016 - RNA, 18 nt, Human
ugggcaaaugggcuguug

SEQ ID NO: 671017 - RNA, 23 nt, Human
uggggcagugagggacaagagca

SEQ ID NO: 671018 - RNA, 19 nt, Human
uggggcccagggauccauc

SEQ ID NO: 671019 - RNA, 23 nt, Human
uggugagguuguggcugcuggug

SEQ ID NO: 671020 - RNA, 19 nt, Human
ugguggggcagggcagaaa

SEQ ID NO: 671021 - RNA, 19 nt, Human
uguacacacagccauugca

SEQ ID NO: 671022 - RNA, 23 nt, Human
uguagaaucaugcgcacuuuuaa

SEQ ID NO: 671023 - RNA, 19 nt, Human
ugucccaggccccaaaccc

SEQ ID NO: 671024 - RNA, 19 nt, Human
ugugcagguggggugcugg

SEQ ID NO: 671025 - RNA, 18 nt, Human
uguggagaggucuggcug

SEQ ID NO: 671026 - RNA, 21 nt, Human
uguuggacuuggccuggaguc

SEQ ID NO: 671027 - RNA, 25 nt, Human
uguuugaaagugguucuaauccugg

SEQ ID NO: 671028 - RNA, 24 nt, Human
uuaauggaaacauugccugagccc

SEQ ID NO: 671029 - RNA, 19 nt, Human
uuacuggggcagugaggga

SEQ ID NO: 671030 - RNA, 22 nt, Human
uuacuuuauuuaaauccugagg

SEQ ID NO: 671031 - RNA, 22 nt, Human
uuagaggccccuccaacacugc

SEQ ID NO: 671032 - RNA, 23 nt, Human
uuaggucacaaggguagcuggag

SEQ ID NO: 671033 - RNA, 19 nt, Human
uuaguaaacaugucugcag

SEQ ID NO: 671034 - RNA, 22 nt, Human
uucucaagcccucaaaaccagc

SEQ ID NO: 671035 - RNA, 22 nt, Human
uucuugaagguggugaguggcu

SEQ ID NO: 671036 - RNA, 21 nt, Human
uucuuguugcauauggugcca

SEQ ID NO: 671037 - RNA, 19 nt, Human
uugaggacagaaucagcca

SEQ ID NO: 671038 - RNA, 22 nt, Human
uuggccagagucuccgcaguau

SEQ ID NO: 671039 - RNA, 22 nt, Human
uuggggaaccugucaggagggg

SEQ ID NO: 671040 - RNA, 22 nt, Human
uugucuguaugucuccugccuu

SEQ ID NO: 671041 - RNA, 25 nt, Human
uuuaaaaaaaaaaaaaaaaaagagu

SEQ ID NO: 671042 - RNA, 18 nt, Human
uuuaaaguaccccagucc

SEQ ID NO: 671043 - RNA, 24 nt, Human
uuuguggguaagugaaucugacag

SEQ ID NO: 671044 - RNA, 23 nt, Human
uuuucucugggcaaccucuuugg

SEQ ID NO: 671045 - RNA, 18 nt, Human
accccucugccccgcccc

SEQ ID NO: 671046 - RNA, 22 nt, Human
agacccccaucuccccuaauga

SEQ ID NO: 671047 - RNA, 19 nt, Human
caaggagggggcagcagcc

SEQ ID NO: 671048 - RNA, 25 nt, Human
cagcugcuagucagcugucucuagg

SEQ ID NO: 671049 - RNA, 22 nt, Human
caguccccggugcucacuugcc

SEQ ID NO: 671050 - RNA, 21 nt, Human
ccccgccccuccacauccucc

SEQ ID NO: 671051 - RNA, 23 nt, Human
ccccgccccuccacauccuccac

SEQ ID NO: 671052 - RNA, 18 nt, Human
ccccuccacauccuccac

SEQ ID NO: 671053 - RNA, 19 nt, Human
ccccucugccccgccccuc

SEQ ID NO: 671054 - RNA, 22 nt, Human
ccucaccuccuaccuucccccu

SEQ ID NO: 671055 - RNA, 22 nt, Human
ccuccuaccuucccccuuccca

SEQ ID NO: 671056 - RNA, 25 nt, Human
cgcccugauccucaguccccggugc

SEQ ID NO: 671057 - RNA, 18 nt, Human
cggcuggaccccucugcc

SEQ ID NO: 671058 - RNA, 26 nt, Human
cuaccuucccccuucccagccagaga

SEQ ID NO: 671059 - RNA, 20 nt, Human
cucaccuccuaccuuccccc

SEQ ID NO: 671060 - RNA, 18 nt, Human
cuccccuaaugagccuca

SEQ ID NO: 671061 - RNA, 21 nt, Human
cuccggcuggaccccucugcc

SEQ ID NO: 671062 - RNA, 19 nt, Human
cugccccgccccuccacau

SEQ ID NO: 671063 - RNA, 24 nt, Human
cugccccgccccuccacauccucc

SEQ ID NO: 671064 - RNA, 24 nt, Human
cuggaccccucugccccgccccuc

SEQ ID NO: 671065 - RNA, 21 nt, Human
cuucccagccagagaggauca

SEQ ID NO: 671066 - RNA, 20 nt, Human
cuugacagcugggcagcugc

SEQ ID NO: 671067 - RNA, 19 nt, Human
gagggcaaggagggggcag

SEQ ID NO: 671068 - RNA, 18 nt, Human
gcagcagccaccccgcgc

SEQ ID NO: 671069 - RNA, 18 nt, Human
gggcaaggagggggcagc

SEQ ID NO: 671070 - RNA, 21 nt, Human
ggggacucagccugguccagc

SEQ ID NO: 671071 - RNA, 20 nt, Human
uaaacuccggcuggaccccu

SEQ ID NO: 671072 - RNA, 24 nt, Human
uaggggagacccccaucuccccua

SEQ ID NO: 671073 - RNA, 20 nt, Human
uaggggaugcagggggcagg

SEQ ID NO: 671074 - RNA, 26 nt, Human
uccagaggaacgcaacaauaaauuac

SEQ ID NO: 671075 - RNA, 22 nt, Human
ucuccccuaaugagccucacgg

SEQ ID NO: 671076 - RNA, 23 nt, Human
ugaccuugacagcugggcagcug

SEQ ID NO: 671077 - RNA, 24 nt, Human
ugccccgccccuccacauccucca

SEQ ID NO: 671078 - RNA, 25 nt, Human
ugcucacuugccugaccuugacagc

SEQ ID NO: 671079 - RNA, 21 nt, Human
ugggcagcugcuagucagcug

SEQ ID NO: 671080 - RNA, 19 nt, Human
uguggggacucagccuggu

SEQ ID NO: 671081 - RNA, 22 nt, Human
uugccugaccuugacagcuggg

SEQ ID NO: 671082 - RNA, 24 nt, Human
aaaaaacagcacgugcuccugcac

SEQ ID NO: 671083 - RNA, 20 nt, Human
acugcgucucccucccacuc

SEQ ID NO: 671084 - RNA, 22 nt, Human
augguggucauuguaauaauua

SEQ ID NO: 671085 - RNA, 21 nt, Human
cagcacgugcuccugcacucu

SEQ ID NO: 671086 - RNA, 22 nt, Human
cagcagcaaaacucaaucccaa

SEQ ID NO: 671087 - RNA, 21 nt, Human
cagcgguuucucugaaguuaa

SEQ ID NO: 671088 - RNA, 21 nt, Human
cagcguucuccuccucucggc

SEQ ID NO: 671089 - RNA, 20 nt, Human
ccccucugucucucccuucc

SEQ ID NO: 671090 - RNA, 20 nt, Human
cccuuccuucucggucuguc

SEQ ID NO: 671091 - RNA, 23 nt, Human
cuccugugcgcgcgcccccucug

SEQ ID NO: 671092 - RNA, 25 nt, Human
cucugucuacugcgucucccuccca

SEQ ID NO: 671093 - RNA, 28 nt, Human
cugugcgcgcgcccccucugucucuccc

SEQ ID NO: 671094 - RNA, 19 nt, Human
gaaaugucaugacaaugca

SEQ ID NO: 671095 - RNA, 19 nt, Human
gcacgugcuccugcacucu

SEQ ID NO: 671096 - RNA, 18 nt, Human
gcgcgagcaggaggcagc

SEQ ID NO: 671097 - RNA, 19 nt, Human
ggcucugggcucucggagg

SEQ ID NO: 671098 - RNA, 18 nt, Human
uaaaaaacagcacgugcu

SEQ ID NO: 671099 - RNA, 23 nt, Human
uaaaaagcauuuauccuuccucc

SEQ ID NO: 671100 - RNA, 20 nt, Human
uaacauaaaaagcauuuauc

SEQ ID NO: 671101 - RNA, 26 nt, Human
uagacgcauuuagauaauucacacag

SEQ ID NO: 671102 - RNA, 22 nt, Human
ucccagcggagucaggcuccug

SEQ ID NO: 671103 - RNA, 21 nt, Human
ucccuagugcaaaaugguaga

SEQ ID NO: 671104 - RNA, 19 nt, Human
uccgcuggucucccacagu

SEQ ID NO: 671105 - RNA, 20 nt, Human
ucugucucucccuuccuucu

SEQ ID NO: 671106 - RNA, 25 nt, Human
ucugucucugucuacugcgucuccc

SEQ ID NO: 671107 - RNA, 19 nt, Human
ugcagcucucccaguugga

SEQ ID NO: 671108 - RNA, 22 nt, Human
ugcugcacagcagcaaaacuca

SEQ ID NO: 671109 - RNA, 23 nt, Human
ugcuugugguaggucaguucuag

SEQ ID NO: 671110 - RNA, 19 nt, Human
uggcacggcgcgagcagga

SEQ ID NO: 671111 - RNA, 18 nt, Human
ugguagacgcauuuagau

SEQ ID NO: 671112 - RNA, 21 nt, Human
uguuggaaaugucaugacaau

SEQ ID NO: 671113 - RNA, 19 nt, Human
uuccuucucggucugucuc

SEQ ID NO: 671114 - RNA, 22 nt, Human
uuggcagcggucagcgcguccu

SEQ ID NO: 671115 - RNA, 24 nt, Human
aaacccccaaaucuaccguccccu

SEQ ID NO: 671116 - RNA, 23 nt, Human
agaagaacgaacguggcgccgcc

SEQ ID NO: 671117 - RNA, 22 nt, Human
aggggguggcgugacaggcagg

SEQ ID NO: 671118 - RNA, 22 nt, Human
caaaucuaccguccccucagaa

SEQ ID NO: 671119 - RNA, 20 nt, Human
caccuucccucucugguccu

SEQ ID NO: 671120 - RNA, 25 nt, Human
ccaaagcccgaacacaucccagugg

SEQ ID NO: 671121 - RNA, 21 nt, Human
cccccaaaucuaccguccccu

SEQ ID NO: 671122 - RNA, 24 nt, Human
ccccucagaagaacgaacguggcg

SEQ ID NO: 671123 - RNA, 24 nt, Human
cggccucaagguccaaagcccgaa

SEQ ID NO: 671124 - RNA, 22 nt, Human
cguggcgccgccuccucucggg

SEQ ID NO: 671125 - RNA, 24 nt, Human
cugauagacagcgaagccuucccc

SEQ ID NO: 671126 - RNA, 22 nt, Human
cugcucccaggaaggggguggc

SEQ ID NO: 671127 - RNA, 18 nt, Human
gagaccgugcuccaacuc

SEQ ID NO: 671128 - RNA, 21 nt, Human
gggccuggggcacugcucggc

SEQ ID NO: 671129 - RNA, 24 nt, Human
uagaggaaaacccccaaaucuacc

SEQ ID NO: 671130 - RNA, 22 nt, Human
uaggaugugcuuuccaagagua

SEQ ID NO: 671131 - RNA, 20 nt, Human
uccaacucgggccuggggca

SEQ ID NO: 671132 - RNA, 22 nt, Human
uccacaggauaaucugcaaaga

SEQ ID NO: 671133 - RNA, 18 nt, Human
ucccaggaaggggguggc

SEQ ID NO: 671134 - RNA, 25 nt, Human
ucuccggccucaagguccaaagccc

SEQ ID NO: 671135 - RNA, 21 nt, Human
ugauagacagcgaagccuucc

SEQ ID NO: 671136 - RNA, 23 nt, Human
ugugacuuucaggucaccuuccc

SEQ ID NO: 671137 - RNA, 22 nt, Human
uucagaggaaacggcgcgagaa

SEQ ID NO: 671138 - RNA, 18 nt, Human
aaacaaagaaucaggucu

SEQ ID NO: 671139 - RNA, 18 nt, Human
aaacagaguuaacaugca

SEQ ID NO: 671140 - RNA, 22 nt, Human
aaagaaaaaccuucacaaauaa

SEQ ID NO: 671141 - RNA, 20 nt, Human
aaaggggcucagguuucuug

SEQ ID NO: 671142 - RNA, 18 nt, Human
aaaugucuuccuaugucc

SEQ ID NO: 671143 - RNA, 19 nt, Human
aaccgccccagaaaggaug

SEQ ID NO: 671144 - RNA, 23 nt, Human
aagaaaaaccuucacaaauaacu

SEQ ID NO: 671145 - RNA, 18 nt, Human
aagaaaauggauacagcu

SEQ ID NO: 671146 - RNA, 18 nt, Human
acacaaagucaguagcug

SEQ ID NO: 671147 - RNA, 18 nt, Human
acacguaggcaugggaaa

SEQ ID NO: 671148 - RNA, 20 nt, Human
acacuaccuauuaucauccg

SEQ ID NO: 671149 - RNA, 18 nt, Human
acucaccaugccagggag

SEQ ID NO: 671150 - RNA, 26 nt, Human
acuguguuucuuuuguaggauccuaa

SEQ ID NO: 671151 - RNA, 21 nt, Human
agaaauggagggugagaaaga

SEQ ID NO: 671152 - RNA, 18 nt, Human
agaaggcaccaaagaaga

SEQ ID NO: 671153 - RNA, 23 nt, Human
agaucaaccagcauacuaaaagg

SEQ ID NO: 671154 - RNA, 21 nt, Human
agccagggacuugacccacaa

SEQ ID NO: 671155 - RNA, 23 nt, Human
aggagauggggaggcaugauucu

SEQ ID NO: 671156 - RNA, 23 nt, Human
aggcugaguccucagaguuugga

SEQ ID NO: 671157 - RNA, 21 nt, Human
aggucaccgaagauaagagcu

SEQ ID NO: 671158 - RNA, 21 nt, Human
aggucuauuuauaggcacagc

SEQ ID NO: 671159 - RNA, 18 nt, Human
augaaccuaaaaaaaagg

SEQ ID NO: 671160 - RNA, 19 nt, Human
auuuauagcugauuuccuu

SEQ ID NO: 671161 - RNA, 20 nt, Human
caaggcaaagaaaaaccuuc

SEQ ID NO: 671162 - RNA, 21 nt, Human
cacagaaacagaguuaacaug

SEQ ID NO: 671163 - RNA, 18 nt, Human
caccaugccagggagggc

SEQ ID NO: 671164 - RNA, 18 nt, Human
cacccauugcuaugucuc

SEQ ID NO: 671165 - RNA, 26 nt, Human
cacccuaccauuucagcaaaugucuu

SEQ ID NO: 671166 - RNA, 22 nt, Human
caugcagaggucaccgaagaua

SEQ ID NO: 671167 - RNA, 19 nt, Human
caugggaaacccaaaggcu

SEQ ID NO: 671168 - RNA, 25 nt, Human
cauuccagaaagggcaguuugccau

SEQ ID NO: 671169 - RNA, 21 nt, Human
ccaagaaaaagagaagcucca

SEQ ID NO: 671170 - RNA, 23 nt, Human
ccaagccagggacuugacccaca

SEQ ID NO: 671171 - RNA, 19 nt, Human
ccacacuccugcauugccu

SEQ ID NO: 671172 - RNA, 21 nt, Human
cccagaagccccauaguucac

SEQ ID NO: 671173 - RNA, 21 nt, Human
ccccaagccagggacuugacc

SEQ ID NO: 671174 - RNA, 22 nt, Human
ccccaagccagggacuugaccc

SEQ ID NO: 671175 - RNA, 18 nt, Human
cccuaccauuucagcaaa

SEQ ID NO: 671176 - RNA, 21 nt, Human
cccucucaucuucucucuuuc

SEQ ID NO: 671177 - RNA, 21 nt, Human
ccucagugccgugaggcgaug

SEQ ID NO: 671178 - RNA, 19 nt, Human
ccucucaucuucucucuuu

SEQ ID NO: 671179 - RNA, 23 nt, Human
cguaggcaugggaaacccaaagg

SEQ ID NO: 671180 - RNA, 22 nt, Human
cguugaggacaauggaagaugg

SEQ ID NO: 671181 - RNA, 18 nt, Human
cuaaaaggacacuaccua

SEQ ID NO: 671182 - RNA, 18 nt, Human
cugcauugccuuuaacac

SEQ ID NO: 671183 - RNA, 21 nt, Human
cugcggccugggaagacugug

SEQ ID NO: 671184 - RNA, 22 nt, Human
cuggaagccaacucaccaugcc

SEQ ID NO: 671185 - RNA, 22 nt, Human
cuucaaaacaaggcaaagaaaa

SEQ ID NO: 671186 - RNA, 19 nt, Human
cuugcucuugacccagugu

SEQ ID NO: 671187 - RNA, 18 nt, Human
gaacauuccagaaagggc

SEQ ID NO: 671188 - RNA, 20 nt, Human
gaagcuucuauaaacagagg

SEQ ID NO: 671189 - RNA, 20 nt, Human
gaaggcaccaaagaagaggu

SEQ ID NO: 671190 - RNA, 27 nt, Human
gacaauggaagaugggcucagaagaaa

SEQ ID NO: 671191 - RNA, 18 nt, Human
gacgagggaaacaaagaa

SEQ ID NO: 671192 - RNA, 20 nt, Human
gagaaggcaccaaagaagag

SEQ ID NO: 671193 - RNA, 22 nt, Human
gaggacaauggaagaugggccg

SEQ ID NO: 671194 - RNA, 22 nt, Human
gaggcaugauucucugugggcu

SEQ ID NO: 671195 - RNA, 21 nt, Human
gcaaagaaaaaccuucacaaa

SEQ ID NO: 671196 - RNA, 21 nt, Human
gcaacaucauggucacaaagu

SEQ ID NO: 671197 - RNA, 19 nt, Human
ggaaaauauaaacaacuuc

SEQ ID NO: 671198 - RNA, 23 nt, Human
ggacaucauuguugaagagacag

SEQ ID NO: 671199 - RNA, 18 nt, Human
ggagggcaacuugcaaca

SEQ ID NO: 671200 - RNA, 25 nt, Human
ggcucagaagaaaauggauacagcu

SEQ ID NO: 671201 - RNA, 23 nt, Human
gggaaccagaguccccaaucucc

SEQ ID NO: 671202 - RNA, 23 nt, Human
gggacuuuuauuuccaaaauggc

SEQ ID NO: 671203 - RNA, 19 nt, Human
ggugcuuaauccacacucc

SEQ ID NO: 671204 - RNA, 22 nt, Human
guagcuguuuugcuugcauuga

SEQ ID NO: 671205 - RNA, 23 nt, Human
gugguucuaccacuccuguuucu

SEQ ID NO: 671206 - RNA, 24 nt, Human
guguguucugccgaaagggcgggc

SEQ ID NO: 671207 - RNA, 22 nt, Human
uaacacuaugaaagaucaacca

SEQ ID NO: 671208 - RNA, 21 nt, Human
uaagcccccaacacugcacag

SEQ ID NO: 671209 - RNA, 19 nt, Human
uagcuguuuugcuugcauu

SEQ ID NO: 671210 - RNA, 21 nt, Human
uaggcacagccauugguacug

SEQ ID NO: 671211 - RNA, 19 nt, Human
ucaaaacaaggcaaagaaa

SEQ ID NO: 671212 - RNA, 21 nt, Human
ucaagaguuuccuguucccag

SEQ ID NO: 671213 - RNA, 22 nt, Human
ucauggucacaaaguggccacc

SEQ ID NO: 671214 - RNA, 23 nt, Human
uccauucucaggccaccuucaaa

SEQ ID NO: 671215 - RNA, 22 nt, Human
ucccaagaaaaagagaagcucc

SEQ ID NO: 671216 - RNA, 23 nt, Human
ucccagaagccccauaguucacc

SEQ ID NO: 671217 - RNA, 24 nt, Human
uccccaaucucccugcuacacaaa

SEQ ID NO: 671218 - RNA, 18 nt, Human
ucucaggccaccuucaaa

SEQ ID NO: 671219 - RNA, 18 nt, Human
ucuggcacaggagauggg

SEQ ID NO: 671220 - RNA, 21 nt, Human
ucugucaacgcaaauccacca

SEQ ID NO: 671221 - RNA, 22 nt, Human
ugccagggagggcaacuugcaa

SEQ ID NO: 671222 - RNA, 23 nt, Human
ugccagggagggcaacuugcaac

SEQ ID NO: 671223 - RNA, 19 nt, Human
ugccauuggaaaauauaaa

SEQ ID NO: 671224 - RNA, 19 nt, Human
ugccuuuaacacagaaaca

SEQ ID NO: 671225 - RNA, 21 nt, Human
ugcggccugggaagacuguga

SEQ ID NO: 671226 - RNA, 24 nt, Human
ugcggccugggaagacugugguuc

SEQ ID NO: 671227 - RNA, 23 nt, Human
ugcuacacaaagucaguagcugu

SEQ ID NO: 671228 - RNA, 19 nt, Human
uggaagaugggcucagaag

SEQ ID NO: 671229 - RNA, 18 nt, Human
uggagggaaagucggcug

SEQ ID NO: 671230 - RNA, 23 nt, Human
uggcuggagucagugucucccuu

SEQ ID NO: 671231 - RNA, 27 nt, Human
uggggaggcaugauucucugugggcug

SEQ ID NO: 671232 - RNA, 19 nt, Human
uguccucuacccacagcuc

SEQ ID NO: 671233 - RNA, 24 nt, Human
uuaauccacacuccugcauugccu

SEQ ID NO: 671234 - RNA, 19 nt, Human
uuauagcugauuuccuuuu

SEQ ID NO: 671235 - RNA, 24 nt, Human
uucaaaacaaggcaaagaaaaacc

SEQ ID NO: 671236 - RNA, 18 nt, Human
uuccauagggcacaugcc

SEQ ID NO: 671237 - RNA, 18 nt, Human
uucucucuuucuuggccu

SEQ ID NO: 671238 - RNA, 24 nt, Human
uugacaguuugaaccuccccuucu

SEQ ID NO: 671239 - RNA, 23 nt, Human
uuuauagcugauuuccuuuuuaa

SEQ ID NO: 671240 - RNA, 20 nt, Human
uuucuuggcuggagucagug

SEQ ID NO: 671241 - RNA, 19 nt, Human
uuuguaccacucagcagca

SEQ ID NO: 671242 - RNA, 20 nt, Human
agcuggaagucuccagcuuc

SEQ ID NO: 671243 - RNA, 18 nt, Human
agcuggugcucugugugc

SEQ ID NO: 671244 - RNA, 19 nt, Human
agcuggugcucugugugcc

SEQ ID NO: 671245 - RNA, 21 nt, Human
caacucagcucccauuguacc

SEQ ID NO: 671246 - RNA, 19 nt, Human
ccagcuucucccuccaaca

SEQ ID NO: 671247 - RNA, 19 nt, Human
cuugagugggagcuggagc

SEQ ID NO: 671248 - RNA, 21 nt, Human
gagcuggagcuggaagucucc

SEQ ID NO: 671249 - RNA, 22 nt, Human
uccagcuucucccuccaacaac

SEQ ID NO: 671250 - RNA, 22 nt, Human
ucccuccaacaacucagcuccc

SEQ ID NO: 671251 - RNA, 20 nt, Human
ugagugggagcuggagcugg

SEQ ID NO: 671252 - RNA, 21 nt, Human
aacagacuggggucauacucc

SEQ ID NO: 671253 - RNA, 22 nt, Human
aagauaccaaaggcugucgaaa

SEQ ID NO: 671254 - RNA, 19 nt, Human
aaggcugucgaaaauucac

SEQ ID NO: 671255 - RNA, 21 nt, Human
acacaccauuaacacacaaaa

SEQ ID NO: 671256 - RNA, 22 nt, Human
agagggagagggagcacacacc

SEQ ID NO: 671257 - RNA, 18 nt, Human
gaaagacuaaaggucagg

SEQ ID NO: 671258 - RNA, 24 nt, Human
ggaaaagaguaaauauguccaaac

SEQ ID NO: 671259 - RNA, 21 nt, Human
uaacacacaaaaaaaguaaaa

SEQ ID NO: 671260 - RNA, 21 nt, Human
ucugcaccacagcaccgagga

SEQ ID NO: 671261 - RNA, 19 nt, Human
ugaaagacuaaaggucagg

SEQ ID NO: 671262 - RNA, 18 nt, Human
ugagcuggagaggaacua

SEQ ID NO: 671263 - RNA, 24 nt, Human
uucggguaaaaguccguuauuccu

SEQ ID NO: 671264 - RNA, 24 nt, Human
uuggaagugaaagacuaaagguca

SEQ ID NO: 671265 - RNA, 25 nt, Human
uuggaagugaaagacuaaaggucag

SEQ ID NO: 671266 - RNA, 18 nt, Human
aaaaaaaaacugaaggug

SEQ ID NO: 671267 - RNA, 25 nt, Human
aaaaaaaacugaaggugggagaaaa

SEQ ID NO: 671268 - RNA, 22 nt, Human
aacugcugccccaagggaccuc

SEQ ID NO: 671269 - RNA, 25 nt, Human
aagcaaaaauaacagcuggugaauc

SEQ ID NO: 671270 - RNA, 27 nt, Human
aagcaaaaauaacagcuggugaaucca

SEQ ID NO: 671271 - RNA, 20 nt, Human
aaggugggagaaaaguaaaa

SEQ ID NO: 671272 - RNA, 22 nt, Human
acacugccugagcuaccagccc

SEQ ID NO: 671273 - RNA, 23 nt, Human
acacugccugagcuaccagcccu

SEQ ID NO: 671274 - RNA, 21 nt, Human
accacucucuuacugcagagg

SEQ ID NO: 671275 - RNA, 21 nt, Human
accauccacacccccacaauc

SEQ ID NO: 671276 - RNA, 18 nt, Human
accccaaguuucacucac

SEQ ID NO: 671277 - RNA, 20 nt, Human
acccuggguuucccaaccac

SEQ ID NO: 671278 - RNA, 19 nt, Human
acgcagcagagacgcggcc

SEQ ID NO: 671279 - RNA, 22 nt, Human
acucucuucacccuuugccccc

SEQ ID NO: 671280 - RNA, 25 nt, Human
acuuuuuuuuuuuuuugcuuuuaaa

SEQ ID NO: 671281 - RNA, 24 nt, Human
agaaucucagaucugacaaggccu

SEQ ID NO: 671282 - RNA, 24 nt, Human
agacgcggccuccacaaggucaga

SEQ ID NO: 671283 - RNA, 28 nt, Human
agcaaacuccagccagcagcguucgucc

SEQ ID NO: 671284 - RNA, 22 nt, Human
agcagagacgcggccuccacaa

SEQ ID NO: 671285 - RNA, 20 nt, Human
agccagcagcguucgucccu

SEQ ID NO: 671286 - RNA, 22 nt, Human
agcccuucugcacuggcccucc

SEQ ID NO: 671287 - RNA, 24 nt, Human
aggucugucuauccugcccugguc

SEQ ID NO: 671288 - RNA, 19 nt, Human
aguccuacucugaauucag

SEQ ID NO: 671289 - RNA, 21 nt, Human
agugagcaaaccccuagcccc

SEQ ID NO: 671290 - RNA, 20 nt, Human
aguuugcuuccucuucaguu

SEQ ID NO: 671291 - RNA, 24 nt, Human
auccgcccugcaggcucccuguca

SEQ ID NO: 671292 - RNA, 23 nt, Human
cacacugccugagcuaccagccc

SEQ ID NO: 671293 - RNA, 24 nt, Human
cacccccacaaucugagauuccaa

SEQ ID NO: 671294 - RNA, 20 nt, Human
cacccuuugcccccacccca

SEQ ID NO: 671295 - RNA, 19 nt, Human
cacgcagcagagacgcggc

SEQ ID NO: 671296 - RNA, 20 nt, Human
cagaagccagagucuuucug

SEQ ID NO: 671297 - RNA, 21 nt, Human
cagagaguccucucugcguuu

SEQ ID NO: 671298 - RNA, 19 nt, Human
cagcaaacuccagccagca

SEQ ID NO: 671299 - RNA, 22 nt, Human
cagcagagacgcggccuccaca

SEQ ID NO: 671300 - RNA, 19 nt, Human
cagcagcguucgucccuug

SEQ ID NO: 671301 - RNA, 22 nt, Human
cagccagcagcguucgucccuu

SEQ ID NO: 671302 - RNA, 18 nt, Human
caggaagguggccccagg

SEQ ID NO: 671303 - RNA, 24 nt, Human
cauaaacacaaacacccuaaauag

SEQ ID NO: 671304 - RNA, 24 nt, Human
cauucaccauccacacccccacaa

SEQ ID NO: 671305 - RNA, 18 nt, Human
ccacaccccacggugucc

SEQ ID NO: 671306 - RNA, 23 nt, Human
ccacaccccacggugucccagaa

SEQ ID NO: 671307 - RNA, 19 nt, Human
ccagcaggcagcaccccaa

SEQ ID NO: 671308 - RNA, 21 nt, Human
cccacacucucuucacccuuu

SEQ ID NO: 671309 - RNA, 20 nt, Human
cccacggugucccagaaacu

SEQ ID NO: 671310 - RNA, 20 nt, Human
cccaugaucaccagauccgc

SEQ ID NO: 671311 - RNA, 20 nt, Human
ccccaagggaccucaaggaa

SEQ ID NO: 671312 - RNA, 20 nt, Human
ccccaguuacgaagcaaagc

SEQ ID NO: 671313 - RNA, 19 nt, Human
cccccaaauucugaggcug

SEQ ID NO: 671314 - RNA, 20 nt, Human
cccccaaguggggacuacag

SEQ ID NO: 671315 - RNA, 21 nt, Human
ccccuagcccccaagugggga

SEQ ID NO: 671316 - RNA, 19 nt, Human
cccgcgaacacgcagcaga

SEQ ID NO: 671317 - RNA, 21 nt, Human
cccuauccagacccccuaauc

SEQ ID NO: 671318 - RNA, 20 nt, Human
cccugcacccucguacucgg

SEQ ID NO: 671319 - RNA, 22 nt, Human
cccugcaggcucccugucaccu

SEQ ID NO: 671320 - RNA, 20 nt, Human
ccucguacucggguuucuuc

SEQ ID NO: 671321 - RNA, 24 nt, Human
ccucuggcucccaugaucaccuua

SEQ ID NO: 671322 - RNA, 19 nt, Human
ccugcacuguccccacucc

SEQ ID NO: 671323 - RNA, 19 nt, Human
ccugggucaccaccagaga

SEQ ID NO: 671324 - RNA, 20 nt, Human
ccuggguuucccaaccacuc

SEQ ID NO: 671325 - RNA, 20 nt, Human
ccuucugcacuggcccuccu

SEQ ID NO: 671326 - RNA, 21 nt, Human
cgaagcaaagcgcgggccuac

SEQ ID NO: 671327 - RNA, 20 nt, Human
cgcagcagagacgcggccuc

SEQ ID NO: 671328 - RNA, 23 nt, Human
cgggcgcugugcgcggggaccgc

SEQ ID NO: 671329 - RNA, 22 nt, Human
cuaaagcccacacucucuucac

SEQ ID NO: 671330 - RNA, 27 nt, Human
cuaccagcccuucugcacuggcccucc

SEQ ID NO: 671331 - RNA, 18 nt, Human
cucaaggaauaggaauuc

SEQ ID NO: 671332 - RNA, 22 nt, Human
cucucuucacccuuugccccca

SEQ ID NO: 671333 - RNA, 19 nt, Human
cugagugagcaaaccccua

SEQ ID NO: 671334 - RNA, 18 nt, Human
cugcacccucguacucgg

SEQ ID NO: 671335 - RNA, 23 nt, Human
cugcacuggcccuccugccaaua

SEQ ID NO: 671336 - RNA, 23 nt, Human
cugcacuguccccacucccucug

SEQ ID NO: 671337 - RNA, 22 nt, Human
cugcaggcucccugucaccugu

SEQ ID NO: 671338 - RNA, 20 nt, Human
cuguguaugaaggggggccc

SEQ ID NO: 671339 - RNA, 21 nt, Human
cuucccagcaggcagcacccc

SEQ ID NO: 671340 - RNA, 18 nt, Human
cuucgggaccuacgcguc

SEQ ID NO: 671341 - RNA, 18 nt, Human
cuucugcacuggcccucc

SEQ ID NO: 671342 - RNA, 19 nt, Human
cuuuuaaaaaguggaggug

SEQ ID NO: 671343 - RNA, 21 nt, Human
cuuuuuuuuuuuuuugcuuuu

SEQ ID NO: 671344 - RNA, 20 nt, Human
gacccccuaauccacuugcc

SEQ ID NO: 671345 - RNA, 19 nt, Human
gagcaaaccccuagccccc

SEQ ID NO: 671346 - RNA, 23 nt, Human
gcacuggcccuccugccaauacu

SEQ ID NO: 671347 - RNA, 22 nt, Human
gcagcagagacgcggccuccac

SEQ ID NO: 671348 - RNA, 21 nt, Human
gccacaccccacgguguccca

SEQ ID NO: 671349 - RNA, 25 nt, Human
gccucacacuuuucuccuaaagccc

SEQ ID NO: 671350 - RNA, 19 nt, Human
gcucccugucaccuguggg

SEQ ID NO: 671351 - RNA, 22 nt, Human
ggaagguggccccagguccuag

SEQ ID NO: 671352 - RNA, 21 nt, Human
ggcaggaagguggccccaggu

SEQ ID NO: 671353 - RNA, 24 nt, Human
ggccacaccccacggugucccaga

SEQ ID NO: 671354 - RNA, 25 nt, Human
gggcaggaagguggccccagguccu

SEQ ID NO: 671355 - RNA, 18 nt, Human
ggguuucuuccccauccc

SEQ ID NO: 671356 - RNA, 23 nt, Human
guggagguggaaaaaaaaaaaaa

SEQ ID NO: 671357 - RNA, 23 nt, Human
uaaagcgggcaggaagguggccc

SEQ ID NO: 671358 - RNA, 21 nt, Human
uaaaggggggcauacccaaau

SEQ ID NO: 671359 - RNA, 22 nt, Human
uaagauguccucagagaucccc

SEQ ID NO: 671360 - RNA, 23 nt, Human
uaaugggcccccaaauucugagg

SEQ ID NO: 671361 - RNA, 20 nt, Human
uaggagguggaaugaaagug

SEQ ID NO: 671362 - RNA, 22 nt, Human
uauccugcccuggucuccucca

SEQ ID NO: 671363 - RNA, 23 nt, Human
ucagacucucaggaucuccucag

SEQ ID NO: 671364 - RNA, 20 nt, Human
ucaguucugggguaaagggg

SEQ ID NO: 671365 - RNA, 21 nt, Human
uccaagaaucucagaucugac

SEQ ID NO: 671366 - RNA, 19 nt, Human
uccaagagcagugcccuca

SEQ ID NO: 671367 - RNA, 21 nt, Human
uccaagagcagugcccucacu

SEQ ID NO: 671368 - RNA, 21 nt, Human
uccacuugccuagcagcccca

SEQ ID NO: 671369 - RNA, 23 nt, Human
uccauaaacacaaacacccuaaa

SEQ ID NO: 671370 - RNA, 25 nt, Human
uccauaaacacaaacacccuaaaua

SEQ ID NO: 671371 - RNA, 25 nt, Human
ucccagaaacuggggaggcagugcu

SEQ ID NO: 671372 - RNA, 23 nt, Human
uccccaucccugaggucccuaug

SEQ ID NO: 671373 - RNA, 23 nt, Human
uccuaaagcccacacucucuuca

SEQ ID NO: 671374 - RNA, 22 nt, Human
uccuccaccccaggagaguuuu

SEQ ID NO: 671375 - RNA, 22 nt, Human
uccuucccagcaggcagcaccc

SEQ ID NO: 671376 - RNA, 24 nt, Human
ucucaggaucuccucagaagccag

SEQ ID NO: 671377 - RNA, 22 nt, Human
ucucugaauagucaugcagccu

SEQ ID NO: 671378 - RNA, 21 nt, Human
ugagcaaaccccuagccccca

SEQ ID NO: 671379 - RNA, 18 nt, Human
ugcacuguccccacuccc

SEQ ID NO: 671380 - RNA, 22 nt, Human
ugccucacacuuuucuccuaaa

SEQ ID NO: 671381 - RNA, 22 nt, Human
uggaaaaaaaaaaaaaaacuga

SEQ ID NO: 671382 - RNA, 19 nt, Human
uggagguggaaaaaaaaaa

SEQ ID NO: 671383 - RNA, 22 nt, Human
uggaucguguagucuuuaacug

SEQ ID NO: 671384 - RNA, 19 nt, Human
uggcaaguaguuugcuucc

SEQ ID NO: 671385 - RNA, 18 nt, Human
uggccccagguccuaggu

SEQ ID NO: 671386 - RNA, 24 nt, Human
uggccccagguccuaggugcuccu

SEQ ID NO: 671387 - RNA, 21 nt, Human
uggcccgcgaacacgcagcag

SEQ ID NO: 671388 - RNA, 24 nt, Human
uggcccgcgaacacgcagcagaga

SEQ ID NO: 671389 - RNA, 18 nt, Human
uggcucccaugaucaccu

SEQ ID NO: 671390 - RNA, 19 nt, Human
uggggcccuauccagaccc

SEQ ID NO: 671391 - RNA, 23 nt, Human
ugggguguguaaugggcccccaa

SEQ ID NO: 671392 - RNA, 24 nt, Human
uguaaugggcccccaaauucugag

SEQ ID NO: 671393 - RNA, 24 nt, Human
uguccccacucccucuggcuccca

SEQ ID NO: 671394 - RNA, 19 nt, Human
uucaaagguagagaggacc

SEQ ID NO: 671395 - RNA, 22 nt, Human
uucaccauccacacccccacaa

SEQ ID NO: 671396 - RNA, 21 nt, Human
uugcuuccucuucaguucugg

SEQ ID NO: 671397 - RNA, 24 nt, Human
uuucacucaccaaggccacacccc

SEQ ID NO: 671398 - RNA, 21 nt, Human
uuucuuccccaucccugaggu

SEQ ID NO: 671399 - RNA, 24 nt, Human
uuugcuuuuaaaaaguggaggugg

SEQ ID NO: 671400 - RNA, 24 nt, Human
cagcggacacuccacucgcaagac

SEQ ID NO: 671401 - RNA, 21 nt, Human
cuaugauuuagggcuuuuuuu

SEQ ID NO: 671402 - RNA, 21 nt, Human
aagguccuuugacuucaacuc

SEQ ID NO: 671403 - RNA, 23 nt, Human
acacuagccgacgccugcccucg

SEQ ID NO: 671404 - RNA, 20 nt, Human
acauguuaugaauuguucag

SEQ ID NO: 671405 - RNA, 19 nt, Human
agauaccacaaagcaccac

SEQ ID NO: 671406 - RNA, 22 nt, Human
caccacuuaagucuaaauugcu

SEQ ID NO: 671407 - RNA, 22 nt, Human
cagauaccacaaagcaccacuu

SEQ ID NO: 671408 - RNA, 24 nt, Human
ccuuugacuucaacucuacucauu

SEQ ID NO: 671409 - RNA, 18 nt, Human
cgacucccgacacuagcc

SEQ ID NO: 671410 - RNA, 21 nt, Human
cgccugcccucgugccgaauu

SEQ ID NO: 671411 - RNA, 24 nt, Human
ggcggcgggcgcgacuccucgcgg

SEQ ID NO: 671412 - RNA, 19 nt, Human
uagccagccaccaccagag

SEQ ID NO: 671413 - RNA, 21 nt, Human
ucagauaccacaaagcaccac

SEQ ID NO: 671414 - RNA, 24 nt, Human
ucaguuuucuuuuguucagaaaug

SEQ ID NO: 671415 - RNA, 22 nt, Human
uccuuugacuucaacucuacuc

SEQ ID NO: 671416 - RNA, 20 nt, Human
ucuaccuagaguggaagugu

SEQ ID NO: 671417 - RNA, 20 nt, Human
ugacuucaacucuacucauu

SEQ ID NO: 671418 - RNA, 22 nt, Human
ugggagcuaaacaauacuauuu

SEQ ID NO: 671419 - RNA, 18 nt, Human
ugucaagucauucuucaa

SEQ ID NO: 671420 - RNA, 23 nt, Human
ugucagaaagguccuuugacuuc

SEQ ID NO: 671421 - RNA, 22 nt, Human
uguggaacaaauguuucucugg

SEQ ID NO: 671422 - RNA, 24 nt, Human
uguguuaacuguggaacaaauguu

SEQ ID NO: 671423 - RNA, 19 nt, Human
uguucagaaauggcaaggc

SEQ ID NO: 671424 - RNA, 25 nt, Human
uguucagaaauggcaaggcaauauu

SEQ ID NO: 671425 - RNA, 23 nt, Human
aaaaaaaaaagaaaaaacucaaa

SEQ ID NO: 671426 - RNA, 19 nt, Human
aaaaaacucaaacugagcc

SEQ ID NO: 671427 - RNA, 19 nt, Human
aaaaaggaacuacagaaaa

SEQ ID NO: 671428 - RNA, 23 nt, Human
aaaaggccaagagcagcagaaua

SEQ ID NO: 671429 - RNA, 26 nt, Human
aaaaugaaacaaaaaggaacuacaga

SEQ ID NO: 671430 - RNA, 25 nt, Human
aaacaaaaaggaacuacagaaaacg

SEQ ID NO: 671431 - RNA, 20 nt, Human
aaacauagcucucucucacc

SEQ ID NO: 671432 - RNA, 30 nt, Human
aaagaaaaaacucaaacugagccccaagcc

SEQ ID NO: 671433 - RNA, 20 nt, Human
aaagcaggacauaauugccu

SEQ ID NO: 671434 - RNA, 23 nt, Human
aagaaggcagcuccucacaggcu

SEQ ID NO: 671435 - RNA, 18 nt, Human
aagauggucuccagaggc

SEQ ID NO: 671436 - RNA, 24 nt, Human
aagcagaagggagcaauuggcugg

SEQ ID NO: 671437 - RNA, 19 nt, Human
aagucuacaacugccccaa

SEQ ID NO: 671438 - RNA, 24 nt, Human
acaaaaaaaaaaaaaaaagaaaaa

SEQ ID NO: 671439 - RNA, 18 nt, Human
acaaaaaggaacuacaga

SEQ ID NO: 671440 - RNA, 18 nt, Human
acaccuucauucuggguc

SEQ ID NO: 671441 - RNA, 19 nt, Human
acaggucuucuuuccuaaa

SEQ ID NO: 671442 - RNA, 18 nt, Human
accccaggaccuguaaag

SEQ ID NO: 671443 - RNA, 19 nt, Human
acugcuuccuucuuuucuu

SEQ ID NO: 671444 - RNA, 21 nt, Human
acugcuuccuucuuuucuucc

SEQ ID NO: 671445 - RNA, 24 nt, Human
agaaaugaaacagcaaaaacaaaa

SEQ ID NO: 671446 - RNA, 20 nt, Human
agaagaaaaugaaacaaaaa

SEQ ID NO: 671447 - RNA, 21 nt, Human
agaagaaaaugaaacaaaaag

SEQ ID NO: 671448 - RNA, 23 nt, Human
agaagaaaaugaaacaaaaagga

SEQ ID NO: 671449 - RNA, 23 nt, Human
agaauaccuggcuacagguagcu

SEQ ID NO: 671450 - RNA, 21 nt, Human
agacagaagaaaaugaaacaa

SEQ ID NO: 671451 - RNA, 25 nt, Human
agacagaagaaaaugaaacaaaaag

SEQ ID NO: 671452 - RNA, 21 nt, Human
agaguuccaguugaacaucgc

SEQ ID NO: 671453 - RNA, 22 nt, Human
aggaaaaagccaggucugagga

SEQ ID NO: 671454 - RNA, 24 nt, Human
aggaagaaaauaaugucaccagaa

SEQ ID NO: 671455 - RNA, 19 nt, Human
aggaaguaugagguagagg

SEQ ID NO: 671456 - RNA, 25 nt, Human
aggcucuucccuccccaaggaaagc

SEQ ID NO: 671457 - RNA, 21 nt, Human
agggacugaggaaaaagccag

SEQ ID NO: 671458 - RNA, 18 nt, Human
aggugaccaugagaaugg

SEQ ID NO: 671459 - RNA, 21 nt, Human
agucagaaugcaggaccagua

SEQ ID NO: 671460 - RNA, 20 nt, Human
auauuuugacuuauggugcc

SEQ ID NO: 671461 - RNA, 24 nt, Human
augaaacagcaaaaacaaaaugaa

SEQ ID NO: 671462 - RNA, 21 nt, Human
auggacacuaaauaacacuuc

SEQ ID NO: 671463 - RNA, 21 nt, Human
caaacaggucacacuacccau

SEQ ID NO: 671464 - RNA, 18 nt, Human
caacugccccaacugcac

SEQ ID NO: 671465 - RNA, 19 nt, Human
caacugccccaacugcacu

SEQ ID NO: 671466 - RNA, 19 nt, Human
caccagaaccugcuucuuu

SEQ ID NO: 671467 - RNA, 18 nt, Human
cacuggacgaccccugac

SEQ ID NO: 671468 - RNA, 25 nt, Human
cacuguauaggugaccaugagaauc

SEQ ID NO: 671469 - RNA, 21 nt, Human
cacuugucuuucuuuggguau

SEQ ID NO: 671470 - RNA, 18 nt, Human
cagaaaugaaacagcaaa

SEQ ID NO: 671471 - RNA, 22 nt, Human
cagaaaugaaacagcaaaaaca

SEQ ID NO: 671472 - RNA, 22 nt, Human
cagaaggaucaagaauggacac

SEQ ID NO: 671473 - RNA, 18 nt, Human
cagaagggagcaauuggc

SEQ ID NO: 671474 - RNA, 21 nt, Human
cagcucaaaaacuaccuguac

SEQ ID NO: 671475 - RNA, 18 nt, Human
caggucuucuuuccuaaa

SEQ ID NO: 671476 - RNA, 18 nt, Human
cauucugggucuccugga

SEQ ID NO: 671477 - RNA, 21 nt, Human
ccaccaaaaccaauauuuuga

SEQ ID NO: 671478 - RNA, 21 nt, Human
ccaggccuaucuuccaagguc

SEQ ID NO: 671479 - RNA, 19 nt, Human
ccaggcucacuaaggaccc

SEQ ID NO: 671480 - RNA, 21 nt, Human
ccagugcuccuggguuuguca

SEQ ID NO: 671481 - RNA, 21 nt, Human
cccugguuucuugccugagac

SEQ ID NO: 671482 - RNA, 22 nt, Human
ccgccgccgccgcuuccuccag

SEQ ID NO: 671483 - RNA, 20 nt, Human
ccgccgccgcuuccuccagc

SEQ ID NO: 671484 - RNA, 25 nt, Human
ccucacaggcucuggcugugugugg

SEQ ID NO: 671485 - RNA, 21 nt, Human
ccuugcucuguccaggcucac

SEQ ID NO: 671486 - RNA, 21 nt, Human
cguuaugcuuuugcauagcca

SEQ ID NO: 671487 - RNA, 22 nt, Human
cuaaauaacacuucaugcccaa

SEQ ID NO: 671488 - RNA, 19 nt, Human
cuaacacaagugcuccaca

SEQ ID NO: 671489 - RNA, 24 nt, Human
cuaacgaggugagacagaagaaaa

SEQ ID NO: 671490 - RNA, 25 nt, Human
cucacacacacacaucgaucaucuc

SEQ ID NO: 671491 - RNA, 22 nt, Human
cucacuaaggacccugaacuca

SEQ ID NO: 671492 - RNA, 24 nt, Human
cuccacacgagggaacuacccucc

SEQ ID NO: 671493 - RNA, 20 nt, Human
cuccuugcucuguccaggcu

SEQ ID NO: 671494 - RNA, 23 nt, Human
cugauauacuuaucucagagccu

SEQ ID NO: 671495 - RNA, 20 nt, Human
cugcuuccuucuuuucuucc

SEQ ID NO: 671496 - RNA, 20 nt, Human
cuggaacaagauggucucca

SEQ ID NO: 671497 - RNA, 23 nt, Human
cugggaaaccuaagaauggaauu

SEQ ID NO: 671498 - RNA, 29 nt, Human
cugggucuuggcuuugugagucgguuccg

SEQ ID NO: 671499 - RNA, 21 nt, Human
cugugugcuggacaucaaggc

SEQ ID NO: 671500 - RNA, 26 nt, Human
cugugugcuggacaucaaggcucuuc

SEQ ID NO: 671501 - RNA, 23 nt, Human
cuucaugcccaacugacaccuuc

SEQ ID NO: 671502 - RNA, 24 nt, Human
cuuccaggccuaucuuccaagguc

SEQ ID NO: 671503 - RNA, 22 nt, Human
gaaaaagccaggucugaggaga

SEQ ID NO: 671504 - RNA, 22 nt, Human
gagcuugcaauuggcagccuga

SEQ ID NO: 671505 - RNA, 20 nt, Human
gcaggacauaauugccuaca

SEQ ID NO: 671506 - RNA, 19 nt, Human
gcgugggaaaaggccaaga

SEQ ID NO: 671507 - RNA, 21 nt, Human
gcuggaacaagauggucucca

SEQ ID NO: 671508 - RNA, 21 nt, Human
ggaaggcaacugcuuccuucu

SEQ ID NO: 671509 - RNA, 18 nt, Human
ggcaacugcuuccuucuu

SEQ ID NO: 671510 - RNA, 23 nt, Human
ggcuucuuugaaaaucaaaauga

SEQ ID NO: 671511 - RNA, 20 nt, Human
gggaaacacacuguauaggu

SEQ ID NO: 671512 - RNA, 21 nt, Human
gggaagaaggcagcuccucac

SEQ ID NO: 671513 - RNA, 24 nt, Human
gucagaaugcaggaccaguaucug

SEQ ID NO: 671514 - RNA, 26 nt, Human
gugagacagaagaaaaugaaacaaaa

SEQ ID NO: 671515 - RNA, 23 nt, Human
gugcuccuggguuugucaccuuc

SEQ ID NO: 671516 - RNA, 20 nt, Human
uaacacaagugcuccacacg

SEQ ID NO: 671517 - RNA, 24 nt, Human
uaagacuuuuauuaaugccagaaa

SEQ ID NO: 671518 - RNA, 23 nt, Human
uaaugccagaaaugaaacagcaa

SEQ ID NO: 671519 - RNA, 18 nt, Human
uaccuggcuacagguagc

SEQ ID NO: 671520 - RNA, 21 nt, Human
uacucauuuugugucugcagg

SEQ ID NO: 671521 - RNA, 23 nt, Human
uauggugccuuugcugcugucag

SEQ ID NO: 671522 - RNA, 21 nt, Human
ucaaaacaccuguucagaucc

SEQ ID NO: 671523 - RNA, 20 nt, Human
ucaaaauccucagaggaagu

SEQ ID NO: 671524 - RNA, 28 nt, Human
ucaacagucucuuccaggccuaucuucc

SEQ ID NO: 671525 - RNA, 24 nt, Human
ucacacacacacaucgaucaucuc

SEQ ID NO: 671526 - RNA, 21 nt, Human
ucacacauggcacaagcccgc

SEQ ID NO: 671527 - RNA, 22 nt, Human
ucacccaauuaauccauuuugu

SEQ ID NO: 671528 - RNA, 22 nt, Human
ucacuugacaugcacaucuuuc

SEQ ID NO: 671529 - RNA, 19 nt, Human
ucauagguuuuuuccuggu

SEQ ID NO: 671530 - RNA, 18 nt, Human
ucaucuccaccaaaacca

SEQ ID NO: 671531 - RNA, 24 nt, Human
uccaaggaagaaaauaaugucacc

SEQ ID NO: 671532 - RNA, 20 nt, Human
uccaggcucacuaaggaccc

SEQ ID NO: 671533 - RNA, 21 nt, Human
uccccaaggaaagcuuaacuc

SEQ ID NO: 671534 - RNA, 19 nt, Human
uccugcacuggacgacccc

SEQ ID NO: 671535 - RNA, 21 nt, Human
uccuguugguggcaacacuca

SEQ ID NO: 671536 - RNA, 19 nt, Human
ucucagucagaaugcagga

SEQ ID NO: 671537 - RNA, 21 nt, Human
ucugcagguguuucccacaug

SEQ ID NO: 671538 - RNA, 21 nt, Human
ucuucccuccccaaggaaagc

SEQ ID NO: 671539 - RNA, 20 nt, Human
ugaaaaaagaagacuuuggc

SEQ ID NO: 671540 - RNA, 19 nt, Human
ugaaacaaaaaggaacuac

SEQ ID NO: 671541 - RNA, 23 nt, Human
ugagacagaagaaaaugaaacaa

SEQ ID NO: 671542 - RNA, 18 nt, Human
ugaggaaaaagccagguc

SEQ ID NO: 671543 - RNA, 21 nt, Human
ugccagaaaugaaacagcaaa

SEQ ID NO: 671544 - RNA, 21 nt, Human
ugccccaacugcacugacuau

SEQ ID NO: 671545 - RNA, 24 nt, Human
ugccccugucacuugucuuucuuu

SEQ ID NO: 671546 - RNA, 20 nt, Human
ugcuccuggguuugucaccu

SEQ ID NO: 671547 - RNA, 23 nt, Human
uggaaacccugaaauccuguagc

SEQ ID NO: 671548 - RNA, 18 nt, Human
uggaacaagauggucucc

SEQ ID NO: 671549 - RNA, 19 nt, Human
uggcaacacucacuccaau

SEQ ID NO: 671550 - RNA, 22 nt, Human
uggcaacacucacuccaaucuu

SEQ ID NO: 671551 - RNA, 21 nt, Human
uggcuguggggcuuagggagu

SEQ ID NO: 671552 - RNA, 19 nt, Human
uguggggcuuagggagugg

SEQ ID NO: 671553 - RNA, 23 nt, Human
uuaaugccagaaaugaaacagca

SEQ ID NO: 671554 - RNA, 30 nt, Human
uuaguggacaaaaaaaaaaaaaaaagaaaa

SEQ ID NO: 671555 - RNA, 20 nt, Human
uucucuaagcuggacucugg

SEQ ID NO: 671556 - RNA, 18 nt, Human
uugaagcacaggagagaa

SEQ ID NO: 671557 - RNA, 21 nt, Human
uuguauggucugaaaaaagaa

SEQ ID NO: 671558 - RNA, 18 nt, Human
uuugcugcugucagcuca

SEQ ID NO: 671559 - RNA, 18 nt, Human
uuuuaucaaagcaggaca

SEQ ID NO: 671560 - RNA, 25 nt, Human
aaaggaagggauugcugggguucug

SEQ ID NO: 671561 - RNA, 24 nt, Human
acauuaagaagugccgguccugaa

SEQ ID NO: 671562 - RNA, 24 nt, Human
agaaaccaaaacaaucacuggaug

SEQ ID NO: 671563 - RNA, 22 nt, Human
agagaaaggggaagaaaggagg

SEQ ID NO: 671564 - RNA, 24 nt, Human
agcaggaugggaaaggcgggcaga

SEQ ID NO: 671565 - RNA, 26 nt, Human
agccacaaacauuaagaagugccggu

SEQ ID NO: 671566 - RNA, 24 nt, Human
aggaagggauugcugggguucuga

SEQ ID NO: 671567 - RNA, 19 nt, Human
aggaggaggaggucaagaa

SEQ ID NO: 671568 - RNA, 20 nt, Human
aggcgggcagagaaagggga

SEQ ID NO: 671569 - RNA, 21 nt, Human
agggcugggcugagggaaccc

SEQ ID NO: 671570 - RNA, 24 nt, Human
agucagaaagggaacagaaaccaa

SEQ ID NO: 671571 - RNA, 25 nt, Human
caacuacccccaaaaaagaagguag

SEQ ID NO: 671572 - RNA, 20 nt, Human
cagcaggaugggaaaggcgg

SEQ ID NO: 671573 - RNA, 24 nt, Human
ccacaauuucagucccuuccaacu

SEQ ID NO: 671574 - RNA, 25 nt, Human
ccaccucucucuuuguagaaugaga

SEQ ID NO: 671575 - RNA, 22 nt, Human
cccacaauuucagucccuucca

SEQ ID NO: 671576 - RNA, 23 nt, Human
cccacaauuucagucccuuccaa

SEQ ID NO: 671577 - RNA, 25 nt, Human
cccacaauuucagucccuuccaacu

SEQ ID NO: 671578 - RNA, 19 nt, Human
cccccaaaaaagaagguag

SEQ ID NO: 671579 - RNA, 24 nt, Human
cccccaaaaaagaagguagugaaa

SEQ ID NO: 671580 - RNA, 21 nt, Human
cccccacaauuucagucccuu

SEQ ID NO: 671581 - RNA, 20 nt, Human
ccgggcuggacagggcuggg

SEQ ID NO: 671582 - RNA, 21 nt, Human
ccuccuaccuuccccccacaa

SEQ ID NO: 671583 - RNA, 19 nt, Human
cucuuuguagaaugagacc

SEQ ID NO: 671584 - RNA, 21 nt, Human
cugagggaacccaggggggcc

SEQ ID NO: 671585 - RNA, 20 nt, Human
cuuuguagaaugagaccccc

SEQ ID NO: 671586 - RNA, 18 nt, Human
gaaggaggaggaggucaa

SEQ ID NO: 671587 - RNA, 23 nt, Human
gccaacuccaccauuaccccucc

SEQ ID NO: 671588 - RNA, 19 nt, Human
gccgggacggggggcggcg

SEQ ID NO: 671589 - RNA, 21 nt, Human
gcgcgggcggauucagcggag

SEQ ID NO: 671590 - RNA, 20 nt, Human
ggaaaggcgggcagagaaag

SEQ ID NO: 671591 - RNA, 23 nt, Human
ggaacagaaaccaaaacaaucac

SEQ ID NO: 671592 - RNA, 27 nt, Human
ggaacagaaaccaaaacagcagggacu

SEQ ID NO: 671593 - RNA, 23 nt, Human
gggcugagggaacccaggggggc

SEQ ID NO: 671594 - RNA, 19 nt, Human
ggggcggcgacgacggcgg

SEQ ID NO: 671595 - RNA, 20 nt, Human
gggggcggcgacgacggcgg

SEQ ID NO: 671596 - RNA, 18 nt, Human
gucaagaaaggggggcca

SEQ ID NO: 671597 - RNA, 20 nt, Human
guguuugagcuugaaggagg

SEQ ID NO: 671598 - RNA, 22 nt, Human
uacaagaugccaacuccaccau

SEQ ID NO: 671599 - RNA, 25 nt, Human
uaccccuccuaagagaggcuggaga

SEQ ID NO: 671600 - RNA, 24 nt, Human
uaccuuccccccacaauuucaguc

SEQ ID NO: 671601 - RNA, 19 nt, Human
uagaaugagaccccccucc

SEQ ID NO: 671602 - RNA, 22 nt, Human
ucagaaagggaacagaaaccaa

SEQ ID NO: 671603 - RNA, 18 nt, Human
ucuuuguagaaugagacc

SEQ ID NO: 671604 - RNA, 21 nt, Human
ugaaaggaagggauugcuggg

SEQ ID NO: 671605 - RNA, 22 nt, Human
ugaaaggaagggauugcugggg

SEQ ID NO: 671606 - RNA, 21 nt, Human
ugaaggaggaggaggucaaga

SEQ ID NO: 671607 - RNA, 24 nt, Human
ugaaggaggaggaggucaagaaag

SEQ ID NO: 671608 - RNA, 19 nt, Human
ugagcuugaaggaggagga

SEQ ID NO: 671609 - RNA, 20 nt, Human
ugccuccuaccuucccccca

SEQ ID NO: 671610 - RNA, 21 nt, Human
uggagagaaagccacaaacau

SEQ ID NO: 671611 - RNA, 24 nt, Human
ugggcugagggaacccaggggggc

SEQ ID NO: 671612 - RNA, 18 nt, Human
uguuugagcuugaaggag

SEQ ID NO: 671613 - RNA, 21 nt, Human
uucagcuuggugguuuccucu

SEQ ID NO: 671614 - RNA, 20 nt, Human
uugagcuugaaggaggagga

SEQ ID NO: 671615 - RNA, 26 nt, Human
uuuuuuuuuuuuuuuucagcuugauu

SEQ ID NO: 671616 - RNA, 23 nt, Human
uuuuuuuuuuuuuuuuucagcuu

SEQ ID NO: 671617 - RNA, 26 nt, Human
uuuuuuuuuuuuuuuuuucagcuugg

SEQ ID NO: 671618 - RNA, 24 nt, Human
uuuuuuuuuuuuuuuuuuuuucag

SEQ ID NO: 671619 - RNA, 18 nt, Human
aaaagucaucccuccaaa

SEQ ID NO: 671620 - RNA, 21 nt, Human
aaccaccuucaugccuaaccc

SEQ ID NO: 671621 - RNA, 25 nt, Human
aaccaccuucaugccuaaccccuau

SEQ ID NO: 671622 - RNA, 19 nt, Human
aacugcacaacaauuaaac

SEQ ID NO: 671623 - RNA, 22 nt, Human
aacugcacaacaauuaaacccc

SEQ ID NO: 671624 - RNA, 20 nt, Human
aagggagcacagggaguugc

SEQ ID NO: 671625 - RNA, 20 nt, Human
aaggggcaccaaagagaaag

SEQ ID NO: 671626 - RNA, 24 nt, Human
aagucaucccuccaaaccuuucua

SEQ ID NO: 671627 - RNA, 19 nt, Human
aaguccccuuucccuaccu

SEQ ID NO: 671628 - RNA, 22 nt, Human
aauuccugcuccccacucccac

SEQ ID NO: 671629 - RNA, 22 nt, Human
aauuccugcuccccacucccac

SEQ ID NO: 671630 - RNA, 18 nt, Human
accccuccccuaccccca

SEQ ID NO: 671631 - RNA, 21 nt, Human
acucccaccccacaaaauccc

SEQ ID NO: 671632 - RNA, 25 nt, Human
agaaagaacccuuuucauuagcaga

SEQ ID NO: 671633 - RNA, 24 nt, Human
agccugaagggacagcagcauggg

SEQ ID NO: 671634 - RNA, 18 nt, Human
aggagaugcuaagagugg

SEQ ID NO: 671635 - RNA, 18 nt, Human
aggagaugcuaagagugg

SEQ ID NO: 671636 - RNA, 24 nt, Human
aucaaagccaauccaacagcucug

SEQ ID NO: 671637 - RNA, 26 nt, Human
auuccucuaucaaagccaauccaaca

SEQ ID NO: 671638 - RNA, 19 nt, Human
auugcaaccgggaugggag

SEQ ID NO: 671639 - RNA, 20 nt, Human
caaaaauagaaucucugccc

SEQ ID NO: 671640 - RNA, 23 nt, Human
caacaauuaaaccccaggaauac

SEQ ID NO: 671641 - RNA, 21 nt, Human
caauuccugcuccccacuccc

SEQ ID NO: 671642 - RNA, 21 nt, Human
cacacaccccuccccuacccc

SEQ ID NO: 671643 - RNA, 23 nt, Human
cacacaccccuccccuaccccca

SEQ ID NO: 671644 - RNA, 24 nt, Human
cacacaccccuccccuacccccaa

SEQ ID NO: 671645 - RNA, 18 nt, Human
cacaccccuccccuaccc

SEQ ID NO: 671646 - RNA, 28 nt, Human
caccccacaaaaucccaaaagugaaaau

SEQ ID NO: 671647 - RNA, 18 nt, Human
caccccuccccuaccccc

SEQ ID NO: 671648 - RNA, 21 nt, Human
caccccuccccuacccccaag

SEQ ID NO: 671649 - RNA, 31 nt, Human
cacccucuuuccccaugucgcgcacacacaa

SEQ ID NO: 671650 - RNA, 24 nt, Human
caccucuguccugauacauggaaa

SEQ ID NO: 671651 - RNA, 25 nt, Human
caggugcucccaucugcugggcuuc

SEQ ID NO: 671652 - RNA, 21 nt, Human
cauacuugcccccucccuaca

SEQ ID NO: 671653 - RNA, 23 nt, Human
cauguagcauuccugugcaugug

SEQ ID NO: 671654 - RNA, 21 nt, Human
ccaaaagugaaaauaaaucaa

SEQ ID NO: 671655 - RNA, 18 nt, Human
cccaaagagaagggagca

SEQ ID NO: 671656 - RNA, 22 nt, Human
cccacaaaaucccaaaagugaa

SEQ ID NO: 671657 - RNA, 23 nt, Human
cccaccccacaaaaucccaaaag

SEQ ID NO: 671658 - RNA, 25 nt, Human
cccacucccaccccacaaaauccca

SEQ ID NO: 671659 - RNA, 22 nt, Human
cccagguaugguccacuaccac

SEQ ID NO: 671660 - RNA, 21 nt, Human
ccccaagagaaagaacccuuu

SEQ ID NO: 671661 - RNA, 18 nt, Human
ccccaaguccaggugcuc

SEQ ID NO: 671662 - RNA, 22 nt, Human
ccccaugucgcgcacacacacc

SEQ ID NO: 671663 - RNA, 22 nt, Human
ccccgcgcggggccugccuccu

SEQ ID NO: 671664 - RNA, 21 nt, Human
ccccuauuuuccaaagguaag

SEQ ID NO: 671665 - RNA, 18 nt, Human
ccccuuucccuaccuguc

SEQ ID NO: 671666 - RNA, 25 nt, Human
ccgggggcaacagcgcugggccgag

SEQ ID NO: 671667 - RNA, 18 nt, Human
ccugucuaaauuucuggg

SEQ ID NO: 671668 - RNA, 19 nt, Human
ccugugcaugugagccuga

SEQ ID NO: 671669 - RNA, 22 nt, Human
cgccgcugacccugucccgcuc

SEQ ID NO: 671670 - RNA, 18 nt, Human
cgcgcggggccugccucc

SEQ ID NO: 671671 - RNA, 23 nt, Human
cuaccacaaguccccuuucccua

SEQ ID NO: 671672 - RNA, 24 nt, Human
cuacccccaaguccaggugcuccc

SEQ ID NO: 671673 - RNA, 20 nt, Human
cucccaccccacaaaauccc

SEQ ID NO: 671674 - RNA, 22 nt, Human
cucccugggccgaggaagcagc

SEQ ID NO: 671675 - RNA, 19 nt, Human
cuggccccaacuuguccac

SEQ ID NO: 671676 - RNA, 26 nt, Human
cugucccgcucccucagccgacguca

SEQ ID NO: 671677 - RNA, 22 nt, Human
cugucuugugcaaaugucaaaa

SEQ ID NO: 671678 - RNA, 21 nt, Human
cuuccgagauccccgcgcggg

SEQ ID NO: 671679 - RNA, 20 nt, Human
cuuguccaccuccugaccca

SEQ ID NO: 671680 - RNA, 19 nt, Human
gaaaauacuagaggagaug

SEQ ID NO: 671681 - RNA, 23 nt, Human
gaacuugcagcugacagaacuga

SEQ ID NO: 671682 - RNA, 24 nt, Human
gacugccaucaucucuggccccaa

SEQ ID NO: 671683 - RNA, 20 nt, Human
gagauccccgcgcggggccu

SEQ ID NO: 671684 - RNA, 22 nt, Human
gauaaggggcaccaaagagaaa

SEQ ID NO: 671685 - RNA, 29 nt, Human
ggagggaagcagcuggccauccucccggg

SEQ ID NO: 671686 - RNA, 19 nt, Human
ggagguagaggagagccag

SEQ ID NO: 671687 - RNA, 26 nt, Human
ggccgagugugcaggggggguucggg

SEQ ID NO: 671688 - RNA, 25 nt, Human
gggcggggaucucgggugagccugc

SEQ ID NO: 671689 - RNA, 21 nt, Human
gucaugucugagugcaauucc

SEQ ID NO: 671690 - RNA, 23 nt, Human
gugggagccacccucuuucccca

SEQ ID NO: 671691 - RNA, 24 nt, Human
gugugcucagaauagcugcagaaa

SEQ ID NO: 671692 - RNA, 22 nt, Human
uaaauuucuggguuguugucua

SEQ ID NO: 671693 - RNA, 18 nt, Human
uaagagaucccugucuaa

SEQ ID NO: 671694 - RNA, 24 nt, Human
uacccccaaguccaggugcuccca

SEQ ID NO: 671695 - RNA, 30 nt, Human
uacccccaaguccaggugcucccaucugcu

SEQ ID NO: 671696 - RNA, 23 nt, Human
uagaugucuucaccuucugucuc

SEQ ID NO: 671697 - RNA, 21 nt, Human
uauuuuauuuccuuggccuga

SEQ ID NO: 671698 - RNA, 19 nt, Human
ucaaaaauagaaucucugc

SEQ ID NO: 671699 - RNA, 19 nt, Human
uccacuaccacaagucccc

SEQ ID NO: 671700 - RNA, 22 nt, Human
ucccaccccacaaaaucccaaa

SEQ ID NO: 671701 - RNA, 23 nt, Human
ucccaccccacaaaaucccaaaa

SEQ ID NO: 671702 - RNA, 19 nt, Human
uccccacucccaccccaca

SEQ ID NO: 671703 - RNA, 26 nt, Human
uccccacucccaccccacaaaauccc

SEQ ID NO: 671704 - RNA, 20 nt, Human
uccccagguaugguccacua

SEQ ID NO: 671705 - RNA, 21 nt, Human
ucccccaagagaaagaacccu

SEQ ID NO: 671706 - RNA, 23 nt, Human
uccugacaugcuuucucccuggg

SEQ ID NO: 671707 - RNA, 22 nt, Human
uccugcuccccacucccacccc

SEQ ID NO: 671708 - RNA, 18 nt, Human
uccuucgccgcugacccu

SEQ ID NO: 671709 - RNA, 28 nt, Human
ucgcgcacacacaccccuccccuacccc

SEQ ID NO: 671710 - RNA, 24 nt, Human
ucuacaauuggaaaugccugagac

SEQ ID NO: 671711 - RNA, 23 nt, Human
ucucuggccccaacuuguccacc

SEQ ID NO: 671712 - RNA, 21 nt, Human
ucugucuccuugcggugggag

SEQ ID NO: 671713 - RNA, 21 nt, Human
ugaagggacagcagcauggga

SEQ ID NO: 671714 - RNA, 24 nt, Human
ugaagggacagcagcaugggagca

SEQ ID NO: 671715 - RNA, 19 nt, Human
ugacacacacauuuccccc

SEQ ID NO: 671716 - RNA, 23 nt, Human
ugacacacacauuucccccaaga

SEQ ID NO: 671717 - RNA, 21 nt, Human
ugacccugucccgcucccuca

SEQ ID NO: 671718 - RNA, 25 nt, Human
ugacggugugugugguguaauguuu

SEQ ID NO: 671719 - RNA, 20 nt, Human
ugagccugaagggacagcag

SEQ ID NO: 671720 - RNA, 22 nt, Human
ugauuuacuaaaagucaucccu

SEQ ID NO: 671721 - RNA, 18 nt, Human
ugcaggggggguucgggg

SEQ ID NO: 671722 - RNA, 22 nt, Human
ugcaggggggguucggggcggg

SEQ ID NO: 671723 - RNA, 18 nt, Human
ugcaguggaugauaacca

SEQ ID NO: 671724 - RNA, 18 nt, Human
ugccaucaucucuggccc

SEQ ID NO: 671725 - RNA, 19 nt, Human
ugccaucaucucuggcccc

SEQ ID NO: 671726 - RNA, 23 nt, Human
uggacugccaucaucucuggccc

SEQ ID NO: 671727 - RNA, 18 nt, Human
ugggccgaggaagcagca

SEQ ID NO: 671728 - RNA, 26 nt, Human
ugucaaaaauagaaucucugcccaaa

SEQ ID NO: 671729 - RNA, 22 nt, Human
ugugaugacgguguguguggug

SEQ ID NO: 671730 - RNA, 23 nt, Human
uuccugcuccccacucccacccc

SEQ ID NO: 671731 - RNA, 25 nt, Human
uuuaaugcuauuuaauaacaaaacc

SEQ ID NO: 671732 - RNA, 22 nt, Human
uuuacuaaaagucaucccucca

SEQ ID NO: 671733 - RNA, 23 nt, Human
uuuuuuuuuuuuuuuuuuuaagg

SEQ ID NO: 671734 - RNA, 28 nt, Human
caacaacaacgacggcggcagcggcagg

SEQ ID NO: 671735 - RNA, 19 nt, Human
caccgagcacaacaacaac

SEQ ID NO: 671736 - RNA, 20 nt, Human
cggcggcgggaaggggacgg

SEQ ID NO: 671737 - RNA, 26 nt, Human
cucagcgcaccgagcacaacaacaac

SEQ ID NO: 671738 - RNA, 18 nt, Human
gcggcggcgggaagggga

SEQ ID NO: 671739 - RNA, 21 nt, Human
ggcggcagcggcagcggcagc

SEQ ID NO: 671740 - RNA, 22 nt, Human
ggcggcagcggcagcggcagcc

SEQ ID NO: 671741 - RNA, 19 nt, Human
aaaaacagaaucucugccc

SEQ ID NO: 671742 - RNA, 23 nt, Human
aacagcacugguccaagugugcg

SEQ ID NO: 671743 - RNA, 19 nt, Human
aaccaagaagggaagcagc

SEQ ID NO: 671744 - RNA, 22 nt, Human
aaccaagaagggaagcagcugg

SEQ ID NO: 671745 - RNA, 25 nt, Human
aaccacccucaugccuaaccccuau

SEQ ID NO: 671746 - RNA, 22 nt, Human
aacuuguccaccuccugaccga

SEQ ID NO: 671747 - RNA, 20 nt, Human
aagggagcacagggaguugc

SEQ ID NO: 671748 - RNA, 21 nt, Human
aaugcuauuuaacaacaaaau

SEQ ID NO: 671749 - RNA, 22 nt, Human
aauuccugcuccccacucccac

SEQ ID NO: 671750 - RNA, 22 nt, Human
aauuccugcuccccacucccac

SEQ ID NO: 671751 - RNA, 21 nt, Human
acaaguccccuuucccuaccu

SEQ ID NO: 671752 - RNA, 22 nt, Human
accccuauuuuccaaagauaag

SEQ ID NO: 671753 - RNA, 25 nt, Human
aggaagaacccuuuucauuugcaga

SEQ ID NO: 671754 - RNA, 19 nt, Human
aggagcaccagagagaaag

SEQ ID NO: 671755 - RNA, 19 nt, Human
agggcagaagguggggugg

SEQ ID NO: 671756 - RNA, 19 nt, Human
agguagaggagagccaggu

SEQ ID NO: 671757 - RNA, 24 nt, Human
aucaaagccaauccaacagcucug

SEQ ID NO: 671758 - RNA, 19 nt, Human
caaaaacagaaucucugcc

SEQ ID NO: 671759 - RNA, 27 nt, Human
caacugucaaaaacagaaucucugccc

SEQ ID NO: 671760 - RNA, 23 nt, Human
caagucacacacacaccccuccc

SEQ ID NO: 671761 - RNA, 21 nt, Human
caauuccugcuccccacuccc

SEQ ID NO: 671762 - RNA, 21 nt, Human
cacacaccccuccccuacccc

SEQ ID NO: 671763 - RNA, 23 nt, Human
cacacaccccuccccuaccccua

SEQ ID NO: 671764 - RNA, 18 nt, Human
cacaccccuccccuaccc

SEQ ID NO: 671765 - RNA, 18 nt, Human
caccccuccccuaccccu

SEQ ID NO: 671766 - RNA, 19 nt, Human
caccccuccccuaccccua

SEQ ID NO: 671767 - RNA, 25 nt, Human
caggugcuuccaucugcugggcuuc

SEQ ID NO: 671768 - RNA, 24 nt, Human
caucucuguccugauacauggaaa

SEQ ID NO: 671769 - RNA, 22 nt, Human
caugccuaaccccuauuuucca

SEQ ID NO: 671770 - RNA, 27 nt, Human
cauuccucuaucaaagccaauccaaca

SEQ ID NO: 671771 - RNA, 26 nt, Human
ccacuaccacaaguccccuuucccua

SEQ ID NO: 671772 - RNA, 18 nt, Human
cccaaagagaagggagca

SEQ ID NO: 671773 - RNA, 25 nt, Human
cccacucccaccccacaaaauccua

SEQ ID NO: 671774 - RNA, 23 nt, Human
ccccagguauggcccacuaccac

SEQ ID NO: 671775 - RNA, 19 nt, Human
cccccaagaggaagaaccc

SEQ ID NO: 671776 - RNA, 21 nt, Human
ccccgcgcagggccugccucc

SEQ ID NO: 671777 - RNA, 18 nt, Human
ccccuaaguccaggugcu

SEQ ID NO: 671778 - RNA, 18 nt, Human
ccccuuucccuaccuguc

SEQ ID NO: 671779 - RNA, 20 nt, Human
cccugggccaaggaagcaac

SEQ ID NO: 671780 - RNA, 18 nt, Human
ccucacggugggagccgc

SEQ ID NO: 671781 - RNA, 18 nt, Human
ccugucuaaauuucuggg

SEQ ID NO: 671782 - RNA, 20 nt, Human
ccugugagugugagaaugaa

SEQ ID NO: 671783 - RNA, 20 nt, Human
cgcccucucuuuccccaagu

SEQ ID NO: 671784 - RNA, 18 nt, Human
cgcgcagggccugccucc

SEQ ID NO: 671785 - RNA, 21 nt, Human
cgggagggcagaagguggggu

SEQ ID NO: 671786 - RNA, 19 nt, Human
cugaccccaacuuguccac

SEQ ID NO: 671787 - RNA, 23 nt, Human
cugugagugugagaaugaaggga

SEQ ID NO: 671788 - RNA, 21 nt, Human
gaacugacacacagauuuccc

SEQ ID NO: 671789 - RNA, 23 nt, Human
gaacuugcagcugacagaacuga

SEQ ID NO: 671790 - RNA, 20 nt, Human
gaagguggggugggaggggg

SEQ ID NO: 671791 - RNA, 20 nt, Human
gaccccaacuuguccaccuc

SEQ ID NO: 671792 - RNA, 24 nt, Human
gacugccaucaucucugaccccaa

SEQ ID NO: 671793 - RNA, 20 nt, Human
gaggagcaccagagagaaag

SEQ ID NO: 671794 - RNA, 19 nt, Human
gagugugagaaugaaggga

SEQ ID NO: 671795 - RNA, 22 nt, Human
gaugaggagcaccagagagaaa

SEQ ID NO: 671796 - RNA, 24 nt, Human
gcuggacugccaucaucucugacc

SEQ ID NO: 671797 - RNA, 19 nt, Human
ggagguagaggagagccag

SEQ ID NO: 671798 - RNA, 22 nt, Human
ggcagaagguggggugggaggg

SEQ ID NO: 671799 - RNA, 20 nt, Human
gggugggagggggaccucgg

SEQ ID NO: 671800 - RNA, 23 nt, Human
gggugggagggggaccucgggug

SEQ ID NO: 671801 - RNA, 18 nt, Human
gguagaggagagccaggu

SEQ ID NO: 671802 - RNA, 21 nt, Human
gucaugucugagugcaauucc

SEQ ID NO: 671803 - RNA, 21 nt, Human
guccccuuucccuaccugucu

SEQ ID NO: 671804 - RNA, 18 nt, Human
gucuucaccuucugucuc

SEQ ID NO: 671805 - RNA, 18 nt, Human
gugcuuagaauagcugca

SEQ ID NO: 671806 - RNA, 23 nt, Human
guggggugggagggggaccucgg

SEQ ID NO: 671807 - RNA, 24 nt, Human
gugugcuuagaauagcugcagaaa

SEQ ID NO: 671808 - RNA, 18 nt, Human
guuugugagugagauugc

SEQ ID NO: 671809 - RNA, 19 nt, Human
uaaauuccaagguaggggu

SEQ ID NO: 671810 - RNA, 22 nt, Human
uaaauuucuggguuggugucua

SEQ ID NO: 671811 - RNA, 22 nt, Human
uaaccacccucaugccuaaccc

SEQ ID NO: 671812 - RNA, 18 nt, Human
uaagagaucccugucuaa

SEQ ID NO: 671813 - RNA, 24 nt, Human
uaccccuaaguccaggugcuucca

SEQ ID NO: 671814 - RNA, 23 nt, Human
uagcagcugcaguggauaaccaa

SEQ ID NO: 671815 - RNA, 20 nt, Human
ucaaaaacagaaucucugcu

SEQ ID NO: 671816 - RNA, 26 nt, Human
ucacacacacaccccuccccuacccc

SEQ ID NO: 671817 - RNA, 24 nt, Human
uccaggugcuuccaucugcugggc

SEQ ID NO: 671818 - RNA, 19 nt, Human
uccccacucccaccccaca

SEQ ID NO: 671819 - RNA, 25 nt, Human
uccccacucccaccccacaaaaucc

SEQ ID NO: 671820 - RNA, 20 nt, Human
uccccagguauggcccacua

SEQ ID NO: 671821 - RNA, 21 nt, Human
ucccccaagaggaagaacccu

SEQ ID NO: 671822 - RNA, 19 nt, Human
uccccgcgcagggccugcc

SEQ ID NO: 671823 - RNA, 23 nt, Human
uccugacaugcuuucucccuggg

SEQ ID NO: 671824 - RNA, 25 nt, Human
uccuucgccgcugaccgcuggccac

SEQ ID NO: 671825 - RNA, 24 nt, Human
ucugcaauuggaaaugccugaagc

SEQ ID NO: 671826 - RNA, 21 nt, Human
ugaagcuuauuaaauuccaag

SEQ ID NO: 671827 - RNA, 21 nt, Human
ugaagggacagcagcauggga

SEQ ID NO: 671828 - RNA, 23 nt, Human
ugacacacagauuucccccaaga

SEQ ID NO: 671829 - RNA, 21 nt, Human
ugccaucaucucugaccccaa

SEQ ID NO: 671830 - RNA, 24 nt, Human
uggacugccaucaucucugacccu

SEQ ID NO: 671831 - RNA, 19 nt, Human
ugggagaaaagaagugugg

SEQ ID NO: 671832 - RNA, 24 nt, Human
ugggaugggagaaaagaagugugg

SEQ ID NO: 671833 - RNA, 18 nt, Human
ugggccaaggaagcaaca

SEQ ID NO: 671834 - RNA, 18 nt, Human
uggggugggagggggacc

SEQ ID NO: 671835 - RNA, 23 nt, Human
uggggugggagggggaccucggg

SEQ ID NO: 671836 - RNA, 25 nt, Human
uggggugggagggggaccucgggug

SEQ ID NO: 671837 - RNA, 18 nt, Human
ugggucucuuuucguccc

SEQ ID NO: 671838 - RNA, 26 nt, Human
ugucaaaaacagaaucucugcccaaa

SEQ ID NO: 671839 - RNA, 19 nt, Human
uuagaauagcugcagaaau

SEQ ID NO: 671840 - RNA, 19 nt, Human
uucaccuucugucuccuca

SEQ ID NO: 671841 - RNA, 23 nt, Human
uuccugcuccccacucccacccc

SEQ ID NO: 671842 - RNA, 20 nt, Human
uuggaaaugccugaagcuua

SEQ ID NO: 671843 - RNA, 21 nt, Human
aaaaaaacacaaaacaaaagg

SEQ ID NO: 671844 - RNA, 26 nt, Human
aaaaaaacacaaaacaaaagggagca

SEQ ID NO: 671845 - RNA, 21 nt, Human
aaaaacacaaaacaaaaggga

SEQ ID NO: 671846 - RNA, 26 nt, Human
aaaaacacaaaacaaaagggagcagu

SEQ ID NO: 671847 - RNA, 22 nt, Human
aaacaaaagggagcagucuugg

SEQ ID NO: 671848 - RNA, 24 nt, Human
aaaccugcccccacuuauuuuucc

SEQ ID NO: 671849 - RNA, 22 nt, Human
aagagcacuuguugggagaccc

SEQ ID NO: 671850 - RNA, 21 nt, Human
aagcguguguacacaugagca

SEQ ID NO: 671851 - RNA, 21 nt, Human
acaugugacugaacaugaaga

SEQ ID NO: 671852 - RNA, 21 nt, Human
acccaaaucagcccagaacuc

SEQ ID NO: 671853 - RNA, 20 nt, Human
accccugcuggacaggaacu

SEQ ID NO: 671854 - RNA, 21 nt, Human
acgcaggagaggggaggaugc

SEQ ID NO: 671855 - RNA, 20 nt, Human
agaaaaaggucuguuuccca

SEQ ID NO: 671856 - RNA, 19 nt, Human
agaccccugcuggacagga

SEQ ID NO: 671857 - RNA, 24 nt, Human
agagcacuuguugggagaccccug

SEQ ID NO: 671858 - RNA, 21 nt, Human
agaggagcugcagggguugcc

SEQ ID NO: 671859 - RNA, 21 nt, Human
agaggagcugcagggguugcc

SEQ ID NO: 671860 - RNA, 18 nt, Human
agaggguguugcauggga

SEQ ID NO: 671861 - RNA, 22 nt, Human
agcacuuguugggagaccccug

SEQ ID NO: 671862 - RNA, 19 nt, Human
agcucccaaaggaagcaaa

SEQ ID NO: 671863 - RNA, 21 nt, Human
aggcagaggagcugcaggggu

SEQ ID NO: 671864 - RNA, 23 nt, Human
aggcagaggagcugcagggguug

SEQ ID NO: 671865 - RNA, 18 nt, Human
aggcuccagccuggccag

SEQ ID NO: 671866 - RNA, 21 nt, Human
agggacaccaccucccacccc

SEQ ID NO: 671867 - RNA, 23 nt, Human
agggggagccacaugugagaaag

SEQ ID NO: 671868 - RNA, 25 nt, Human
caacuauccacuggaagcagcucuc

SEQ ID NO: 671869 - RNA, 18 nt, Human
caagagacaccacagugu

SEQ ID NO: 671870 - RNA, 19 nt, Human
cacagugugaaagggacac

SEQ ID NO: 671871 - RNA, 21 nt, Human
caccccauagguccaucuguc

SEQ ID NO: 671872 - RNA, 23 nt, Human
caccucccaccccauagguccau

SEQ ID NO: 671873 - RNA, 19 nt, Human
caccuuucuccuccucccg

SEQ ID NO: 671874 - RNA, 20 nt, Human
caccuuucuccuccucccgu

SEQ ID NO: 671875 - RNA, 18 nt, Human
cagagcacaaaggcagag

SEQ ID NO: 671876 - RNA, 26 nt, Human
caggguaggguacauauggcucuguc

SEQ ID NO: 671877 - RNA, 21 nt, Human
caugagcauguucagugggca

SEQ ID NO: 671878 - RNA, 19 nt, Human
caugauuuaagggaagaaa

SEQ ID NO: 671879 - RNA, 22 nt, Human
cauguauuuacaagagaugaga

SEQ ID NO: 671880 - RNA, 19 nt, Human
ccaaaucagcccagaacuc

SEQ ID NO: 671881 - RNA, 19 nt, Human
ccaccuuucuccuccuccc

SEQ ID NO: 671882 - RNA, 21 nt, Human
ccaugagaggggccggggucc

SEQ ID NO: 671883 - RNA, 23 nt, Human
cccaaaccccaccccugucucuu

SEQ ID NO: 671884 - RNA, 20 nt, Human
cccaaaucagcccagaacuc

SEQ ID NO: 671885 - RNA, 22 nt, Human
cccaccaaacaugaauugggga

SEQ ID NO: 671886 - RNA, 19 nt, Human
ccccaaaccccaccccugu

SEQ ID NO: 671887 - RNA, 21 nt, Human
ccccaggcccggccgcuccuc

SEQ ID NO: 671888 - RNA, 20 nt, Human
ccccccucccuucuccucca

SEQ ID NO: 671889 - RNA, 20 nt, Human
ccccgcuccccccucccuuc

SEQ ID NO: 671890 - RNA, 18 nt, Human
ccccgggccucaaggccc

SEQ ID NO: 671891 - RNA, 20 nt, Human
ccccucaaaaaaacacaaaa

SEQ ID NO: 671892 - RNA, 21 nt, Human
ccccucaaaaaaacacaaaac

SEQ ID NO: 671893 - RNA, 19 nt, Human
ccccucccuucuccuccac

SEQ ID NO: 671894 - RNA, 18 nt, Human
ccccugcuggacaggaac

SEQ ID NO: 671895 - RNA, 19 nt, Human
cccggcuccccggcucucc

SEQ ID NO: 671896 - RNA, 24 nt, Human
cccggggcggcggcagccacggga

SEQ ID NO: 671897 - RNA, 23 nt, Human
cccuacuggccuguccucccuca

SEQ ID NO: 671898 - RNA, 24 nt, Human
cccucccuucuccuccaccuuucc

SEQ ID NO: 671899 - RNA, 22 nt, Human
cccuccucucucgcuuccccca

SEQ ID NO: 671900 - RNA, 23 nt, Human
cccugcccuuccccucucccuuu

SEQ ID NO: 671901 - RNA, 21 nt, Human
cccuuccccucucccuuuccc

SEQ ID NO: 671902 - RNA, 21 nt, Human
ccgcuccuccccgcucccccc

SEQ ID NO: 671903 - RNA, 23 nt, Human
ccucccgucccuccuccccucga

SEQ ID NO: 671904 - RNA, 24 nt, Human
ccucccgucccuccuccccucgaa

SEQ ID NO: 671905 - RNA, 23 nt, Human
ccuccucucucgcuucccccaaa

SEQ ID NO: 671906 - RNA, 21 nt, Human
ccucgaauccaggcuccagcc

SEQ ID NO: 671907 - RNA, 21 nt, Human
cgaaaagaaugagcucccaaa

SEQ ID NO: 671908 - RNA, 25 nt, Human
cgcuccccccucccuucuccuccaa

SEQ ID NO: 671909 - RNA, 18 nt, Human
cggcggcagccacgggag

SEQ ID NO: 671910 - RNA, 18 nt, Human
cggcuccccggcucuccc

SEQ ID NO: 671911 - RNA, 20 nt, Human
cguguguacacaugagcaug

SEQ ID NO: 671912 - RNA, 22 nt, Human
cuacccaaacacgcucaagggc

SEQ ID NO: 671913 - RNA, 21 nt, Human
cucaagggcagacccaugacc

SEQ ID NO: 671914 - RNA, 22 nt, Human
cuccaaaccugcccccacuuau

SEQ ID NO: 671915 - RNA, 21 nt, Human
cuccccgggccucaaggcccc

SEQ ID NO: 671916 - RNA, 21 nt, Human
cuccccuccucucucgcuucc

SEQ ID NO: 671917 - RNA, 18 nt, Human
cuccccucgaauccaggc

SEQ ID NO: 671918 - RNA, 19 nt, Human
cuccuccccgcuccccccu

SEQ ID NO: 671919 - RNA, 19 nt, Human
cucgaauccaggcuccagc

SEQ ID NO: 671920 - RNA, 24 nt, Human
cucgcuucccccaaaccccacccc

SEQ ID NO: 671921 - RNA, 18 nt, Human
cugaguccccugcccuuc

SEQ ID NO: 671922 - RNA, 20 nt, Human
cugugacaaggagagggugu

SEQ ID NO: 671923 - RNA, 19 nt, Human
cuucccagcuggggauggg

SEQ ID NO: 671924 - RNA, 20 nt, Human
cuuccuacggcccccgcggc

SEQ ID NO: 671925 - RNA, 22 nt, Human
cuuggcgaaaagaaugagcucc

SEQ ID NO: 671926 - RNA, 20 nt, Human
gaaaagaaugagcucccaaa

SEQ ID NO: 671927 - RNA, 21 nt, Human
gaaagggacaccaccucccac

SEQ ID NO: 671928 - RNA, 19 nt, Human
gaaucugagcagaaaugga

SEQ ID NO: 671929 - RNA, 21 nt, Human
gaaugcaauggagaugggggg

SEQ ID NO: 671930 - RNA, 20 nt, Human
gagagacccaaaucagccca

SEQ ID NO: 671931 - RNA, 21 nt, Human
gagagcacaugugacugaaca

SEQ ID NO: 671932 - RNA, 20 nt, Human
gagcacaugugacugaacau

SEQ ID NO: 671933 - RNA, 20 nt, Human
gagcagaaauggagauucug

SEQ ID NO: 671934 - RNA, 20 nt, Human
gauuuuguggggaggagggg

SEQ ID NO: 671935 - RNA, 21 nt, Human
gcagugagcagcuucaagcca

SEQ ID NO: 671936 - RNA, 18 nt, Human
gccccaggcccggccgcu

SEQ ID NO: 671937 - RNA, 24 nt, Human
gccccggagaagcagggaagguug

SEQ ID NO: 671938 - RNA, 20 nt, Human
gcucccaaaggaagcaaaau

SEQ ID NO: 671939 - RNA, 22 nt, Human
gcuccccccucccuucuccucc

SEQ ID NO: 671940 - RNA, 24 nt, Human
gcuccccccucccuucuccuccac

SEQ ID NO: 671941 - RNA, 21 nt, Human
gcuuccugaguccccugcccu

SEQ ID NO: 671942 - RNA, 22 nt, Human
ggacaggaacagagcacaaagg

SEQ ID NO: 671943 - RNA, 20 nt, Human
ggcagaggagcugcaggggu

SEQ ID NO: 671944 - RNA, 18 nt, Human
ggcuccagccuggccagg

SEQ ID NO: 671945 - RNA, 21 nt, Human
gggaaucugagcagaaaugga

SEQ ID NO: 671946 - RNA, 18 nt, Human
gggacacuuuuccugggg

SEQ ID NO: 671947 - RNA, 18 nt, Human
gggcgagggccccggaga

SEQ ID NO: 671948 - RNA, 21 nt, Human
ggggaggagggggcgagggcc

SEQ ID NO: 671949 - RNA, 23 nt, Human
gggggcagggguagcuguugggg

SEQ ID NO: 671950 - RNA, 24 nt, Human
ggggggcagggguagcuguugggg

SEQ ID NO: 671951 - RNA, 18 nt, Human
gggguagcuguuggggag

SEQ ID NO: 671952 - RNA, 19 nt, Human
guacaugaaugcaauggag

SEQ ID NO: 671953 - RNA, 20 nt, Human
guacauggaggguacacagg

SEQ ID NO: 671954 - RNA, 22 nt, Human
gugaggcugcugaggaggcagc

SEQ ID NO: 671955 - RNA, 23 nt, Human
gugauacaaaauuacaugaagca

SEQ ID NO: 671956 - RNA, 19 nt, Human
guguguacacaugagcaug

SEQ ID NO: 671957 - RNA, 21 nt, Human
uaagagggugccggggaggcg

SEQ ID NO: 671958 - RNA, 21 nt, Human
uacccaaacacgcucaagggc

SEQ ID NO: 671959 - RNA, 21 nt, Human
uacuggccuguccucccucac

SEQ ID NO: 671960 - RNA, 21 nt, Human
uaggaaagacaugacucagca

SEQ ID NO: 671961 - RNA, 23 nt, Human
uaugagagacccaaaucagccca

SEQ ID NO: 671962 - RNA, 28 nt, Human
ucaaaaaaacacaaaacaaaagggagca

SEQ ID NO: 671963 - RNA, 18 nt, Human
ucaagccagguacgaacu

SEQ ID NO: 671964 - RNA, 19 nt, Human
ucaagccagguacgaacua

SEQ ID NO: 671965 - RNA, 19 nt, Human
ucacagggggacauguauu

SEQ ID NO: 671966 - RNA, 21 nt, Human
uccacuggaagcagcucucca

SEQ ID NO: 671967 - RNA, 20 nt, Human
ucccagagguaugagagacc

SEQ ID NO: 671968 - RNA, 24 nt, Human
ucccagagguaugagagacccaaa

SEQ ID NO: 671969 - RNA, 18 nt, Human
ucccagcuggggaugggg

SEQ ID NO: 671970 - RNA, 18 nt, Human
ucccccaaaccccacccc

SEQ ID NO: 671971 - RNA, 24 nt, Human
uccccgcuccccccucccuucucc

SEQ ID NO: 671972 - RNA, 20 nt, Human
uccccggggcggcggcagcc

SEQ ID NO: 671973 - RNA, 18 nt, Human
uccccugcccuuccccuc

SEQ ID NO: 671974 - RNA, 20 nt, Human
ucccuccuccccucgaaucc

SEQ ID NO: 671975 - RNA, 24 nt, Human
ucccugauuuuguggggaggaggg

SEQ ID NO: 671976 - RNA, 18 nt, Human
uccuccccgcuccccccu

SEQ ID NO: 671977 - RNA, 19 nt, Human
uccucccgucccuccuccc

SEQ ID NO: 671978 - RNA, 19 nt, Human
uccucucucgcuuccccca

SEQ ID NO: 671979 - RNA, 20 nt, Human
ucucccuuucccucccccua

SEQ ID NO: 671980 - RNA, 22 nt, Human
ucucccuuucccucccccuacu

SEQ ID NO: 671981 - RNA, 18 nt, Human
ucuccuccaccuuucucc

SEQ ID NO: 671982 - RNA, 20 nt, Human
ugacucagcaugcuagacaa

SEQ ID NO: 671983 - RNA, 21 nt, Human
ugagaaaguauagaagggcaa

SEQ ID NO: 671984 - RNA, 21 nt, Human
ugagagacccaaaucagccca

SEQ ID NO: 671985 - RNA, 18 nt, Human
ugagcagcuucaagccag

SEQ ID NO: 671986 - RNA, 21 nt, Human
ugaggcugcugaggaggcagc

SEQ ID NO: 671987 - RNA, 25 nt, Human
ugcacagagcagaggcaaggagcau

SEQ ID NO: 671988 - RNA, 25 nt, Human
uggaaagagauuaugacaguggaga

SEQ ID NO: 671989 - RNA, 23 nt, Human
uggaaagagcacuuguugggaga

SEQ ID NO: 671990 - RNA, 18 nt, Human
uggagaaaaggagaggcc

SEQ ID NO: 671991 - RNA, 21 nt, Human
uggagauggggggaaucugag

SEQ ID NO: 671992 - RNA, 19 nt, Human
uggcgaaaagaaugagcuc

SEQ ID NO: 671993 - RNA, 23 nt, Human
uggcgaaaagaaugagcucccaa

SEQ ID NO: 671994 - RNA, 21 nt, Human
ugggaagagaaagaugcagug

SEQ ID NO: 671995 - RNA, 22 nt, Human
ugggagaagaugauugugagug

SEQ ID NO: 671996 - RNA, 19 nt, Human
uggggaggagggggcgagg

SEQ ID NO: 671997 - RNA, 23 nt, Human
uggggaggagggggcgagggccc

SEQ ID NO: 671998 - RNA, 19 nt, Human
uguggauggccccaccaaa

SEQ ID NO: 671999 - RNA, 26 nt, Human
uguggauggccccaccaaacaugaau

SEQ ID NO: 672000 - RNA, 18 nt, Human
uguggggaggagggggcg

SEQ ID NO: 672001 - RNA, 21 nt, Human
uguugggagaccccugcugga

SEQ ID NO: 672002 - RNA, 20 nt, Human
uuccugaguccccugcccuu

SEQ ID NO: 672003 - RNA, 22 nt, Human
uuccugaguccccugcccuucc

SEQ ID NO: 672004 - RNA, 18 nt, Human
uuucuccuccucccgucc

SEQ ID NO: 672005 - RNA, 19 nt, Human
aagcgcuucagcugcacag

SEQ ID NO: 672006 - RNA, 23 nt, Human
aggagguggugcggggacccgag

SEQ ID NO: 672007 - RNA, 20 nt, Human
aggcagcaggagguggugcg

SEQ ID NO: 672008 - RNA, 23 nt, Human
aggcagcaggagguggugcgggg

SEQ ID NO: 672009 - RNA, 19 nt, Human
agggcgcuauuuuccgaaa

SEQ ID NO: 672010 - RNA, 18 nt, Human
aguaauaaauauaaaaga

SEQ ID NO: 672011 - RNA, 21 nt, Human
auaaggcaaaaauaaacaaaa

SEQ ID NO: 672012 - RNA, 21 nt, Human
cccgaggcgccucguacccgg

SEQ ID NO: 672013 - RNA, 24 nt, Human
cccgcuacacacaaagcgcuucag

SEQ ID NO: 672014 - RNA, 21 nt, Human
cgaggcgccucguacccggcc

SEQ ID NO: 672015 - RNA, 21 nt, Human
cgggaaggcagcaggaggugg

SEQ ID NO: 672016 - RNA, 23 nt, Human
cuggaaaagcuucgggagcggcg

SEQ ID NO: 672017 - RNA, 21 nt, Human
uaucaaaacaauacugucagu

SEQ ID NO: 672018 - RNA, 25 nt, Human
ucaguaauaaauauaaaagacaaaa

SEQ ID NO: 672019 - RNA, 24 nt, Human
ucauucauucaauauuuauuuauu

SEQ ID NO: 672020 - RNA, 24 nt, Human
ucuguaucaaaacaauaccggggc

SEQ ID NO: 672021 - RNA, 24 nt, Human
uucgggagcggcgacgggaaggca

SEQ ID NO: 672022 - RNA, 22 nt, Human
acucacucagccccuuggcauc

SEQ ID NO: 672023 - RNA, 22 nt, Human
aguaacugcuugaguaacuaca

SEQ ID NO: 672024 - RNA, 23 nt, Human
caaaaauacccaaacuauggcug

SEQ ID NO: 672025 - RNA, 19 nt, Human
caccccucccgccuugcuu

SEQ ID NO: 672026 - RNA, 25 nt, Human
cagcucaggcccuggcgcucuccgg

SEQ ID NO: 672027 - RNA, 23 nt, Human
cagcuccggccaccccucccgcc

SEQ ID NO: 672028 - RNA, 27 nt, Human
ccaaaaauacccaaacuauggcugcac

SEQ ID NO: 672029 - RNA, 26 nt, Human
cccccagaacauguaguugaacucac

SEQ ID NO: 672030 - RNA, 20 nt, Human
ccccuuggcaucaguuucug

SEQ ID NO: 672031 - RNA, 18 nt, Human
ccgcccgggcuccuccuc

SEQ ID NO: 672032 - RNA, 21 nt, Human
ccucgcccgcccgggcuccuc

SEQ ID NO: 672033 - RNA, 25 nt, Human
ccucgcccgcccgggcuccuccucc

SEQ ID NO: 672034 - RNA, 21 nt, Human
cggcagcucaggcccuggcgc

SEQ ID NO: 672035 - RNA, 20 nt, Human
cggccgccccucgcccgccc

SEQ ID NO: 672036 - RNA, 23 nt, Human
cggccgccccucgcccgcccggg

SEQ ID NO: 672037 - RNA, 18 nt, Human
gccaccccucccgccuug

SEQ ID NO: 672038 - RNA, 18 nt, Human
gcccagggagagagcgcg

SEQ ID NO: 672039 - RNA, 21 nt, Human
gcccccagaacauguaguuga

SEQ ID NO: 672040 - RNA, 21 nt, Human
ggcaucaguuucuguaauccu

SEQ ID NO: 672041 - RNA, 19 nt, Human
gggcccccagaacauguag

SEQ ID NO: 672042 - RNA, 19 nt, Human
uaaauaacuuuucauguca

SEQ ID NO: 672043 - RNA, 24 nt, Human
uaaauaacuuuucaugucauaaaa

SEQ ID NO: 672044 - RNA, 21 nt, Human
uauaaaccaaaaauacccaaa

SEQ ID NO: 672045 - RNA, 21 nt, Human
ucugcacucacucacaggcgc

SEQ ID NO: 672046 - RNA, 22 nt, Human
ucuguuucaacacagcuuccuu

SEQ ID NO: 672047 - RNA, 24 nt, Human
ugagggcauauaaaccaaaaauac

SEQ ID NO: 672048 - RNA, 21 nt, Human
ugccagccgccgcagcuccgg

SEQ ID NO: 672049 - RNA, 25 nt, Human
uuauucauaccaguuuauuguaggu

SEQ ID NO: 672050 - RNA, 22 nt, Human
uucaaaaaauuuauagcauaaa

SEQ ID NO: 672051 - RNA, 18 nt, Human
uugaacucacucagcccc

SEQ ID NO: 672052 - RNA, 24 nt, Human
uuggcaucaguuucuguaauccuu

SEQ ID NO: 672053 - RNA, 18 nt, Human
aacacugugauugcccuu

SEQ ID NO: 672054 - RNA, 23 nt, Human
aacacugugauugcccuucacau

SEQ ID NO: 672055 - RNA, 25 nt, Human
aacuucaaugaagaauuuuccaaca

SEQ ID NO: 672056 - RNA, 19 nt, Human
auaggagcagccugcaaca

SEQ ID NO: 672057 - RNA, 20 nt, Human
auuucagcaugucuucuuuu

SEQ ID NO: 672058 - RNA, 22 nt, Human
cagcaugucuucuuuuaacacu

SEQ ID NO: 672059 - RNA, 23 nt, Human
caguagaggaaaaagaguccgga

SEQ ID NO: 672060 - RNA, 22 nt, Human
cugugauugcccuucacaugcc

SEQ ID NO: 672061 - RNA, 20 nt, Human
gauugcccuucacaugccac

SEQ ID NO: 672062 - RNA, 20 nt, Human
gcuguaaagcuuuauuggga

SEQ ID NO: 672063 - RNA, 21 nt, Human
ugauaggaacuaaacggucuc

SEQ ID NO: 672064 - RNA, 18 nt, Human
ugccacagaugauaggaa

SEQ ID NO: 672065 - RNA, 18 nt, Human
ugccacagaugauaggaa

SEQ ID NO: 672066 - RNA, 25 nt, Human
acacagcacugccucacagcucccu

SEQ ID NO: 672067 - RNA, 25 nt, Human
caaauuuccaacauaggagcagccu

SEQ ID NO: 672068 - RNA, 23 nt, Human
caguagaggaaaaagaguccgga

SEQ ID NO: 672069 - RNA, 19 nt, Human
cggcaggaaccacacagca

SEQ ID NO: 672070 - RNA, 22 nt, Human
cugccucacagcucccuggcgu

SEQ ID NO: 672071 - RNA, 20 nt, Human
gcuguaaagcuuuauuggga

SEQ ID NO: 672072 - RNA, 28 nt, Human
uuuuaaugaacaaauuuccaacauagga

SEQ ID NO: 672073 - RNA, 25 nt, Human
caaauuuccaacauaggagcagccu

SEQ ID NO: 672074 - RNA, 23 nt, Human
caguagaggaaaaagaguccgga

SEQ ID NO: 672075 - RNA, 19 nt, Human
cggcaggaaccacacagca

SEQ ID NO: 672076 - RNA, 20 nt, Human
gcuguaaagcuuuauuggga

SEQ ID NO: 672077 - RNA, 28 nt, Human
uuuuaaugaacaaauuuccaacauagga

SEQ ID NO: 672078 - RNA, 18 nt, Human
uuuuuuuuuuuuucuuug

SEQ ID NO: 672079 - RNA, 18 nt, Human
agugaacaugcacacuga

SEQ ID NO: 672080 - RNA, 21 nt, Human
augcaguccucccuccccucc

SEQ ID NO: 672081 - RNA, 18 nt, Human
cacagcuccccagcgguc

SEQ ID NO: 672082 - RNA, 21 nt, Human
cacagcuccccagcggucacc

SEQ ID NO: 672083 - RNA, 23 nt, Human
cccaccccaucccgcgucaugca

SEQ ID NO: 672084 - RNA, 18 nt, Human
cccgccucgccccacccc

SEQ ID NO: 672085 - RNA, 23 nt, Human
cucacagcuccccagcggucacc

SEQ ID NO: 672086 - RNA, 24 nt, Human
cucgccccaccccaucccgcguca

SEQ ID NO: 672087 - RNA, 23 nt, Human
cucucacagcuccccagcgguca

SEQ ID NO: 672088 - RNA, 20 nt, Human
uaggagagaaagaguccaga

SEQ ID NO: 672089 - RNA, 19 nt, Human
ugcccagugaacaugcaca

SEQ ID NO: 672090 - RNA, 21 nt, Human
ugccugcguugugugcugcag

SEQ ID NO: 672091 - RNA, 18 nt, Human
ugggaggacuggccugcg

SEQ ID NO: 672092 - RNA, 19 nt, Human
cgggcgcaggggcuuccgc

SEQ ID NO: 672093 - RNA, 22 nt, Human
uuguacauccuucaccaccaug

SEQ ID NO: 672094 - RNA, 21 nt, Human
aaauggcaucuugcugccccc

SEQ ID NO: 672095 - RNA, 21 nt, Human
aacauggcugcucuuccaccu

SEQ ID NO: 672096 - RNA, 18 nt, Human
aaucgcuugaaccuggga

SEQ ID NO: 672097 - RNA, 24 nt, Human
aaucgcuugaaccugggaggcaga

SEQ ID NO: 672098 - RNA, 24 nt, Human
aaugaguggaggguggaggaggga

SEQ ID NO: 672099 - RNA, 24 nt, Human
acagagcaagacuccguuucaaaa

SEQ ID NO: 672100 - RNA, 23 nt, Human
acuccagccugggggacagagca

SEQ ID NO: 672101 - RNA, 18 nt, Human
acucuggaggcugaggca

SEQ ID NO: 672102 - RNA, 18 nt, Human
acugcacuccagccuggg

SEQ ID NO: 672103 - RNA, 24 nt, Human
acugcacuccagccugggggacag

SEQ ID NO: 672104 - RNA, 19 nt, Human
agagagaaaugaacagucu

SEQ ID NO: 672105 - RNA, 18 nt, Human
agagguugcagugagccg

SEQ ID NO: 672106 - RNA, 23 nt, Human
agagguugcagugagccgagauc

SEQ ID NO: 672107 - RNA, 24 nt, Human
agagguugcagugagccgagauca

SEQ ID NO: 672108 - RNA, 19 nt, Human
agcacuuugggaggcagag

SEQ ID NO: 672109 - RNA, 20 nt, Human
agcccagcgaagagggggcu

SEQ ID NO: 672110 - RNA, 24 nt, Human
agccugggggacagagcaagacuc

SEQ ID NO: 672111 - RNA, 20 nt, Human
aggagggaagcacugcuggg

SEQ ID NO: 672112 - RNA, 21 nt, Human
aggcagagguugcagugagcc

SEQ ID NO: 672113 - RNA, 24 nt, Human
aggcagagguugcagugagccgag

SEQ ID NO: 672114 - RNA, 22 nt, Human
aggcaggagaaucgcuugaacc

SEQ ID NO: 672115 - RNA, 24 nt, Human
aggcaggagaaucgcuugaaccug

SEQ ID NO: 672116 - RNA, 24 nt, Human
aggccuaguggcucacgccuguaa

SEQ ID NO: 672117 - RNA, 20 nt, Human
aggcugaggcaggagaaucg

SEQ ID NO: 672118 - RNA, 24 nt, Human
aggcugaggcaggagaaucgcuug

SEQ ID NO: 672119 - RNA, 22 nt, Human
agucauguggaucaccugaggu

SEQ ID NO: 672120 - RNA, 22 nt, Human
aguggaggguggaggagggaag

SEQ ID NO: 672121 - RNA, 21 nt, Human
aguggcucacgccuguaaugg

SEQ ID NO: 672122 - RNA, 24 nt, Human
aguggcucacgccuguaauggcag

SEQ ID NO: 672123 - RNA, 24 nt, Human
aucaugccacugcacuccagccug

SEQ ID NO: 672124 - RNA, 21 nt, Human
caacaaacaugucagagagaa

SEQ ID NO: 672125 - RNA, 21 nt, Human
caagacuccguuucaaaaaaa

SEQ ID NO: 672126 - RNA, 24 nt, Human
cacgccuguaauggcagcacuuug

SEQ ID NO: 672127 - RNA, 18 nt, Human
cacugcacuccagccugg

SEQ ID NO: 672128 - RNA, 19 nt, Human
cacugcacuccagccuggg

SEQ ID NO: 672129 - RNA, 22 nt, Human
cacugcacuccagccuggggga

SEQ ID NO: 672130 - RNA, 24 nt, Human
cacugcacuccagccugggggaca

SEQ ID NO: 672131 - RNA, 25 nt, Human
cacugcacuccagccugggggacag

SEQ ID NO: 672132 - RNA, 18 nt, Human
cacuuugggaggcagagu

SEQ ID NO: 672133 - RNA, 22 nt, Human
cagagagauggagccagggcca

SEQ ID NO: 672134 - RNA, 19 nt, Human
cagauuuuugccucuguca

SEQ ID NO: 672135 - RNA, 18 nt, Human
cagcacuuugggaggcag

SEQ ID NO: 672136 - RNA, 18 nt, Human
cagggccaggaagagggg

SEQ ID NO: 672137 - RNA, 23 nt, Human
cagggccaggaagaggggcagag

SEQ ID NO: 672138 - RNA, 24 nt, Human
cauguggaucaccugaggugagga

SEQ ID NO: 672139 - RNA, 22 nt, Human
cauuccaacucaccacgcccca

SEQ ID NO: 672140 - RNA, 20 nt, Human
ccaacucaccacgccccaaa

SEQ ID NO: 672141 - RNA, 22 nt, Human
ccacgccccaaacuuccugugg

SEQ ID NO: 672142 - RNA, 22 nt, Human
ccacucaucacaugugcccuuc

SEQ ID NO: 672143 - RNA, 19 nt, Human
ccacugcacuccagccugg

SEQ ID NO: 672144 - RNA, 20 nt, Human
ccacugcacuccagccuggg

SEQ ID NO: 672145 - RNA, 20 nt, Human
ccacugcacuccagccuggg

SEQ ID NO: 672146 - RNA, 22 nt, Human
ccacugcacuccagccuggggg

SEQ ID NO: 672147 - RNA, 24 nt, Human
ccacugcacuccagccugggggac

SEQ ID NO: 672148 - RNA, 21 nt, Human
ccaggaagaggggcagagaca

SEQ ID NO: 672149 - RNA, 20 nt, Human
ccccaggccugcucacaguc

SEQ ID NO: 672150 - RNA, 25 nt, Human
ccugggaggcagagguugcagugag

SEQ ID NO: 672151 - RNA, 22 nt, Human
ccugggggacagagcaagacuc

SEQ ID NO: 672152 - RNA, 22 nt, Human
cgccccaaacuuccuguggcuc

SEQ ID NO: 672153 - RNA, 23 nt, Human
cgccuguaauggcagcacuuugg

SEQ ID NO: 672154 - RNA, 22 nt, Human
cguaucauuccaacucaccacg

SEQ ID NO: 672155 - RNA, 21 nt, Human
cguaucuguaauccuagcuac

SEQ ID NO: 672156 - RNA, 24 nt, Human
cucacgccuguaauggcagcacuu

SEQ ID NO: 672157 - RNA, 18 nt, Human
cucacuccaucuuuugcc

SEQ ID NO: 672158 - RNA, 22 nt, Human
cucugucagcgucaggccacaa

SEQ ID NO: 672159 - RNA, 24 nt, Human
cugcugggagcccagcgaagaggg

SEQ ID NO: 672160 - RNA, 19 nt, Human
cugguuggagaucgggggg

SEQ ID NO: 672161 - RNA, 18 nt, Human
cuguaauccuagcuacuc

SEQ ID NO: 672162 - RNA, 20 nt, Human
cuguaauccuagcuacucug

SEQ ID NO: 672163 - RNA, 21 nt, Human
cuucaaacauggcugcucuuc

SEQ ID NO: 672164 - RNA, 22 nt, Human
gaaagaacaaaaugaguggagg

SEQ ID NO: 672165 - RNA, 24 nt, Human
gacagagcaagacuccguuucaaa

SEQ ID NO: 672166 - RNA, 23 nt, Human
gagaaucgcuugaaccugggagg

SEQ ID NO: 672167 - RNA, 23 nt, Human
gagaucaugccacugcacuccag

SEQ ID NO: 672168 - RNA, 26 nt, Human
gagccagggccaggaagaggggcaga

SEQ ID NO: 672169 - RNA, 23 nt, Human
gagucauguggaucaccugaggu

SEQ ID NO: 672170 - RNA, 23 nt, Human
gaucaccugaggugaggaguuca

SEQ ID NO: 672171 - RNA, 24 nt, Human
gaucaccugaggugaggaguucaa

SEQ ID NO: 672172 - RNA, 24 nt, Human
gcacuccagccugggggacagagc

SEQ ID NO: 672173 - RNA, 23 nt, Human
gccccaaacuuccuguggcucac

SEQ ID NO: 672174 - RNA, 20 nt, Human
gccgagaucaugccacugca

SEQ ID NO: 672175 - RNA, 22 nt, Human
gcucacuccaucuuuugccccu

SEQ ID NO: 672176 - RNA, 18 nt, Human
ggagcagcaaggccucgu

SEQ ID NO: 672177 - RNA, 23 nt, Human
ggagcccagcgaagagggggcuu

SEQ ID NO: 672178 - RNA, 23 nt, Human
ggcaggaaaggggaaggggaggu

SEQ ID NO: 672179 - RNA, 23 nt, Human
gggcaggaaaggggaaggggagg

SEQ ID NO: 672180 - RNA, 18 nt, Human
ggggaaggggaggucagg

SEQ ID NO: 672181 - RNA, 18 nt, Human
ggggcaggaaaggggaag

SEQ ID NO: 672182 - RNA, 24 nt, Human
guugcagugagccgagaucaugcc

SEQ ID NO: 672183 - RNA, 21 nt, Human
uagcagauuuuugccucuguc

SEQ ID NO: 672184 - RNA, 24 nt, Human
uaucuguaauccuagcuacucugg

SEQ ID NO: 672185 - RNA, 19 nt, Human
ucacagucuugguugaguc

SEQ ID NO: 672186 - RNA, 23 nt, Human
ucaugccacugcacuccagccug

SEQ ID NO: 672187 - RNA, 23 nt, Human
ucccuucugggagaugcagaaau

SEQ ID NO: 672188 - RNA, 18 nt, Human
ucgcuugaaccugggagg

SEQ ID NO: 672189 - RNA, 18 nt, Human
ucugcccccugaguuagc

SEQ ID NO: 672190 - RNA, 23 nt, Human
ucuguaauccuagcuacucugga

SEQ ID NO: 672191 - RNA, 24 nt, Human
ugaaccugggaggcagagguugca

SEQ ID NO: 672192 - RNA, 19 nt, Human
ugaaucccugucucuaaaa

SEQ ID NO: 672193 - RNA, 18 nt, Human
ugacagagagauggagcc

SEQ ID NO: 672194 - RNA, 22 nt, Human
ugagccgagaucaugccacugc

SEQ ID NO: 672195 - RNA, 20 nt, Human
ugaggcaggagaaucgcuug

SEQ ID NO: 672196 - RNA, 24 nt, Human
ugaggcaggagaaucgcuugaacc

SEQ ID NO: 672197 - RNA, 25 nt, Human
ugaggcaggagaaucgcuugaaccu

SEQ ID NO: 672198 - RNA, 22 nt, Human
ugaggugaggaguucaagacca

SEQ ID NO: 672199 - RNA, 19 nt, Human
ugaguggaggguggaggag

SEQ ID NO: 672200 - RNA, 24 nt, Human
uggaucaccugaggugaggaguuc

SEQ ID NO: 672201 - RNA, 21 nt, Human
uggcacagggaagggugaggu

SEQ ID NO: 672202 - RNA, 24 nt, Human
uggcucacgccuguaauggcagca

SEQ ID NO: 672203 - RNA, 21 nt, Human
uggcucacuccaucuuuugcc

SEQ ID NO: 672204 - RNA, 18 nt, Human
ugggagcccagcgaagag

SEQ ID NO: 672205 - RNA, 24 nt, Human
ugggaggcagagguugcagugagc

SEQ ID NO: 672206 - RNA, 21 nt, Human
ugggaggcagagucaugugga

SEQ ID NO: 672207 - RNA, 24 nt, Human
ugggaggcagagucauguggauca

SEQ ID NO: 672208 - RNA, 19 nt, Human
uggggcaggaaaggggaag

SEQ ID NO: 672209 - RNA, 22 nt, Human
ugguggcacguaucuguaaucc

SEQ ID NO: 672210 - RNA, 18 nt, Human
uuagccggguaugguggc

SEQ ID NO: 672211 - RNA, 27 nt, Human
uucaaaaaaaaaaaaguuggggggaaa

SEQ ID NO: 672212 - RNA, 24 nt, Human
uuccaacucaccacgccccaaacu

SEQ ID NO: 672213 - RNA, 24 nt, Human
uugaaccugggaggcagagguugc

SEQ ID NO: 672214 - RNA, 18 nt, Human
uugcagugagccgagauc

SEQ ID NO: 672215 - RNA, 20 nt, Human
uugcagugagccgagaucau

SEQ ID NO: 672216 - RNA, 21 nt, Human
uugcagugagccgagaucaug

SEQ ID NO: 672217 - RNA, 23 nt, Human
uugguugagucugcccccugagu

SEQ ID NO: 672218 - RNA, 18 nt, Human
uuuuuuuuuuuuuuuuug

SEQ ID NO: 672219 - RNA, 19 nt, Human
aaaaggcagggugagcagu

SEQ ID NO: 672220 - RNA, 22 nt, Human
aaccagcugggaaggagagggu

SEQ ID NO: 672221 - RNA, 23 nt, Human
aagguucagcccacgaucgggag

SEQ ID NO: 672222 - RNA, 18 nt, Human
accaaccagcugggaagg

SEQ ID NO: 672223 - RNA, 22 nt, Human
acucaagcccauugaaaagaaa

SEQ ID NO: 672224 - RNA, 22 nt, Human
agaaagggcucucaugggggca

SEQ ID NO: 672225 - RNA, 18 nt, Human
aggcguaccccaaaguuc

SEQ ID NO: 672226 - RNA, 25 nt, Human
caaccaaacaaaaaucccaacccaa

SEQ ID NO: 672227 - RNA, 23 nt, Human
caagcccauugaaaagaaagggc

SEQ ID NO: 672228 - RNA, 24 nt, Human
cacuuggaaaagacagguuguggg

SEQ ID NO: 672229 - RNA, 22 nt, Human
cagaaaaguauagggagccuca

SEQ ID NO: 672230 - RNA, 20 nt, Human
cagccccuggcuggacuccu

SEQ ID NO: 672231 - RNA, 21 nt, Human
caggacccauacuccuggagg

SEQ ID NO: 672232 - RNA, 28 nt, Human
ccaaacaaaaaucccaacccaagaacuc

SEQ ID NO: 672233 - RNA, 22 nt, Human
ccaaccaaacaaaaaucccaac

SEQ ID NO: 672234 - RNA, 18 nt, Human
cccaccccuggaccagcc

SEQ ID NO: 672235 - RNA, 21 nt, Human
cccacgaucgggagcgggggc

SEQ ID NO: 672236 - RNA, 20 nt, Human
ccccagaaaaaggcagggug

SEQ ID NO: 672237 - RNA, 25 nt, Human
cccccagaaaaaggcagggugagca

SEQ ID NO: 672238 - RNA, 21 nt, Human
ccccuggaccagccagggccu

SEQ ID NO: 672239 - RNA, 19 nt, Human
cccugcgcgccgagugccg

SEQ ID NO: 672240 - RNA, 25 nt, Human
cccuucacaggcacucaugggggau

SEQ ID NO: 672241 - RNA, 25 nt, Human
ccgguggcuugccucucagggcgac

SEQ ID NO: 672242 - RNA, 24 nt, Human
ccugcggcucugguagcagggcca

SEQ ID NO: 672243 - RNA, 23 nt, Human
cucagcccccagaaaaaggcagg

SEQ ID NO: 672244 - RNA, 19 nt, Human
cucuggacccuugucucga

SEQ ID NO: 672245 - RNA, 20 nt, Human
cugggagacugggagcagcu

SEQ ID NO: 672246 - RNA, 23 nt, Human
cugguagcagggccaguguuccc

SEQ ID NO: 672247 - RNA, 21 nt, Human
gaaaagaaagggcucucaugg

SEQ ID NO: 672248 - RNA, 18 nt, Human
gaaggagaggguggccca

SEQ ID NO: 672249 - RNA, 18 nt, Human
gagcagccuuucccuagg

SEQ ID NO: 672250 - RNA, 20 nt, Human
gagggugcccggggcccugc

SEQ ID NO: 672251 - RNA, 20 nt, Human
gaucagguggcagcguccgc

SEQ ID NO: 672252 - RNA, 18 nt, Human
gcaggacauggaggcagc

SEQ ID NO: 672253 - RNA, 18 nt, Human
gccccuggcuggacuccu

SEQ ID NO: 672254 - RNA, 19 nt, Human
ggaaggagaggguggccca

SEQ ID NO: 672255 - RNA, 22 nt, Human
ggacucccuucacaggcacucu

SEQ ID NO: 672256 - RNA, 20 nt, Human
ggagaggguggcccagcgcu

SEQ ID NO: 672257 - RNA, 20 nt, Human
ggcagggugagcaguucugg

SEQ ID NO: 672258 - RNA, 20 nt, Human
gggagcagcuuaggucugug

SEQ ID NO: 672259 - RNA, 20 nt, Human
ggggaggguagaaccuggaa

SEQ ID NO: 672260 - RNA, 20 nt, Human
ggggauccugcggcucuggu

SEQ ID NO: 672261 - RNA, 19 nt, Human
uacccaccccuggaccagc

SEQ ID NO: 672262 - RNA, 24 nt, Human
uagcagggccaguguucccgagaa

SEQ ID NO: 672263 - RNA, 22 nt, Human
ucagcgccuggaugggaucagg

SEQ ID NO: 672264 - RNA, 19 nt, Human
ucuguggggaggguagaac

SEQ ID NO: 672265 - RNA, 20 nt, Human
ugaaaagaaagggcucucau

SEQ ID NO: 672266 - RNA, 22 nt, Human
ugcccggggcccugcgcgccga

SEQ ID NO: 672267 - RNA, 21 nt, Human
ugcggcucugguagcagggcc

SEQ ID NO: 672268 - RNA, 19 nt, Human
uggaaaagacagguugugg

SEQ ID NO: 672269 - RNA, 18 nt, Human
uggacuccugggagggca

SEQ ID NO: 672270 - RNA, 22 nt, Human
uggauccagccuaucagcgccg

SEQ ID NO: 672271 - RNA, 20 nt, Human
uggcccagcgcuggauccag

SEQ ID NO: 672272 - RNA, 21 nt, Human
uggcuggacuccugggagggc

SEQ ID NO: 672273 - RNA, 22 nt, Human
ugggagcagcuuaggucugugg

SEQ ID NO: 672274 - RNA, 19 nt, Human
ugggaucagguggcagcgu

SEQ ID NO: 672275 - RNA, 22 nt, Human
ugguucugggagacugggagca

SEQ ID NO: 672276 - RNA, 21 nt, Human
ugucucgaaauccgcacgggg

SEQ ID NO: 672277 - RNA, 22 nt, Human
uucugggagacugggagcagcu

SEQ ID NO: 672278 - RNA, 18 nt, Human
aaaagcagcucuuuucca

SEQ ID NO: 672279 - RNA, 20 nt, Human
aaacauuuuagagcaacucc

SEQ ID NO: 672280 - RNA, 20 nt, Human
aaaguaaaaugccuaagucc

SEQ ID NO: 672281 - RNA, 20 nt, Human
aaaugccuaaguccaaaaua

SEQ ID NO: 672282 - RNA, 21 nt, Human
aagaggcugcuuuagcuaaug

SEQ ID NO: 672283 - RNA, 19 nt, Human
agaaaacaauucaacaguu

SEQ ID NO: 672284 - RNA, 24 nt, Human
agcagcucuuuuccaaacauuuua

SEQ ID NO: 672285 - RNA, 19 nt, Human
aguuguuuacaucuccugu

SEQ ID NO: 672286 - RNA, 19 nt, Human
auuaaaucaagacaacugc

SEQ ID NO: 672287 - RNA, 23 nt, Human
caaaagcagcucuuuuccaaaca

SEQ ID NO: 672288 - RNA, 24 nt, Human
caaaagcagcucuuuuccaaacau

SEQ ID NO: 672289 - RNA, 22 nt, Human
caaaauaucacuucaaaaugga

SEQ ID NO: 672290 - RNA, 21 nt, Human
caauaaauuucaggauauaga

SEQ ID NO: 672291 - RNA, 21 nt, Human
ccgcugccgggcgcuugcagg

SEQ ID NO: 672292 - RNA, 19 nt, Human
ccuaaguccaaaauaucac

SEQ ID NO: 672293 - RNA, 23 nt, Human
cuaaaguaaaaugccuaaguccu

SEQ ID NO: 672294 - RNA, 23 nt, Human
cuccuuauuucagaaucugaaga

SEQ ID NO: 672295 - RNA, 20 nt, Human
cugaagaccacaugauuugu

SEQ ID NO: 672296 - RNA, 21 nt, Human
cugaagaccacaugauuuguu

SEQ ID NO: 672297 - RNA, 25 nt, Human
cuuccaaucuaaaguaaaaugccua

SEQ ID NO: 672298 - RNA, 23 nt, Human
gagaauuauagaaaaauuacagc

SEQ ID NO: 672299 - RNA, 22 nt, Human
gauccuuuuuuccuaccauugc

SEQ ID NO: 672300 - RNA, 24 nt, Human
gcgcagcuucggaggaagggaacc

SEQ ID NO: 672301 - RNA, 23 nt, Human
guuuacaucuccuguaggugauu

SEQ ID NO: 672302 - RNA, 18 nt, Human
uaaaguaaccucgcgggc

SEQ ID NO: 672303 - RNA, 19 nt, Human
uaacuuugugccaauuggu

SEQ ID NO: 672304 - RNA, 23 nt, Human
uaaguccaaaauaucacuucaaa

SEQ ID NO: 672305 - RNA, 21 nt, Human
uaggugauuuuccuauaacuu

SEQ ID NO: 672306 - RNA, 19 nt, Human
uauuguaaaucacauaaug

SEQ ID NO: 672307 - RNA, 23 nt, Human
ucagaaucugaagaccacaugau

SEQ ID NO: 672308 - RNA, 18 nt, Human
uccaggguguaagaaaac

SEQ ID NO: 672309 - RNA, 22 nt, Human
ugcugcuguuccaggagcgcag

SEQ ID NO: 672310 - RNA, 20 nt, Human
uguugugcauuuuuuauugg

SEQ ID NO: 672311 - RNA, 26 nt, Human
uucauaaugcaaaagcagcucuuuuc

SEQ ID NO: 672312 - RNA, 18 nt, Human
uuccaggguguaagaaaa

SEQ ID NO: 672313 - RNA, 19 nt, Human
uugaauauaaaaagccaca

SEQ ID NO: 672314 - RNA, 19 nt, Human
uuuuuuuuuuuuuugcuuu

SEQ ID NO: 672315 - RNA, 18 nt, Human
uuuuuuuuuuuuuuuuug

SEQ ID NO: 672316 - RNA, 23 nt, Human
uuuuuuuuuuuuuuuuuugcuuu

SEQ ID NO: 672317 - RNA, 23 nt, Human
aaaaggauucuuuauuauguaga

SEQ ID NO: 672318 - RNA, 24 nt, Human
aacccaggcuuuccuaaagcccca

SEQ ID NO: 672319 - RNA, 25 nt, Human
aagcaagaaauuccuuaacagcagc

SEQ ID NO: 672320 - RNA, 23 nt, Human
acagggaacugucaucuucucca

SEQ ID NO: 672321 - RNA, 18 nt, Human
acccguggacacucacuu

SEQ ID NO: 672322 - RNA, 18 nt, Human
agccccaaacuccacacc

SEQ ID NO: 672323 - RNA, 22 nt, Human
caaacuccacaccggaggcaac

SEQ ID NO: 672324 - RNA, 19 nt, Human
caacgccugaugaagcaac

SEQ ID NO: 672325 - RNA, 24 nt, Human
cauacucacuucuucacccgugga

SEQ ID NO: 672326 - RNA, 20 nt, Human
ccaaacuccacaccggaggc

SEQ ID NO: 672327 - RNA, 24 nt, Human
ccaauucuagaguuaaaaugauac

SEQ ID NO: 672328 - RNA, 21 nt, Human
ccacagccccaguccgacccg

SEQ ID NO: 672329 - RNA, 24 nt, Human
ccacccaacccaggcuuuccuaaa

SEQ ID NO: 672330 - RNA, 21 nt, Human
cccguggacacucagagcucc

SEQ ID NO: 672331 - RNA, 23 nt, Human
cccguggacacucagagcucccg

SEQ ID NO: 672332 - RNA, 23 nt, Human
ccuaaagccccaaacuccacacc

SEQ ID NO: 672333 - RNA, 18 nt, Human
ccucuauaagcaagaaau

SEQ ID NO: 672334 - RNA, 23 nt, Human
cucaaacaucaccuuaaugucca

SEQ ID NO: 672335 - RNA, 23 nt, Human
gauucaguuuuuuaaaaugaucu

SEQ ID NO: 672336 - RNA, 22 nt, Human
gccacagccccaguccgacccg

SEQ ID NO: 672337 - RNA, 19 nt, Human
uaaaaagaggcauaaauag

SEQ ID NO: 672338 - RNA, 21 nt, Human
uaaagccccaaacuccacacc

SEQ ID NO: 672339 - RNA, 22 nt, Human
uaacagcagcucaaacaucacc

SEQ ID NO: 672340 - RNA, 27 nt, Human
uaacagcagcucaaacaucaccuuaau

SEQ ID NO: 672341 - RNA, 22 nt, Human
uaagcaagaaauuccuuaacag

SEQ ID NO: 672342 - RNA, 19 nt, Human
uaauuuuauaauuaacugc

SEQ ID NO: 672343 - RNA, 23 nt, Human
ucacccguggacacucagagcug

SEQ ID NO: 672344 - RNA, 23 nt, Human
ucacuucuucacccguggacacu

SEQ ID NO: 672345 - RNA, 23 nt, Human
ucacuucuucacccguggacacu

SEQ ID NO: 672346 - RNA, 20 nt, Human
uccgggaggacagggaacug

SEQ ID NO: 672347 - RNA, 23 nt, Human
uccuaaagccccaaacuccacac

SEQ ID NO: 672348 - RNA, 19 nt, Human
ucuccgggaggacagggaa

SEQ ID NO: 672349 - RNA, 20 nt, Human
uuccuggguuuuauccuucu

SEQ ID NO: 672350 - RNA, 23 nt, Human
uuuaaaaugaucuacuuacaaca

SEQ ID NO: 672351 - RNA, 23 nt, Human
aaaauacaucuagaagaucucaa

SEQ ID NO: 672352 - RNA, 23 nt, Human
aacugugguagcaacacauaacc

SEQ ID NO: 672353 - RNA, 21 nt, Human
aagcaaauuguucucugagau

SEQ ID NO: 672354 - RNA, 21 nt, Human
accuugggcagucccgaaagc

SEQ ID NO: 672355 - RNA, 18 nt, Human
agacgcccccagcagccg

SEQ ID NO: 672356 - RNA, 25 nt, Human
agaguccuggcuccacagucuccuu

SEQ ID NO: 672357 - RNA, 22 nt, Human
agcaaauuguucucugagauuu

SEQ ID NO: 672358 - RNA, 22 nt, Human
agucauagugguagaaccagcc

SEQ ID NO: 672359 - RNA, 21 nt, Human
aucuuuuuugcuaaugagagu

SEQ ID NO: 672360 - RNA, 23 nt, Human
augauauaaacauguuuuaaagu

SEQ ID NO: 672361 - RNA, 25 nt, Human
auucauauugacuuaaucagguuga

SEQ ID NO: 672362 - RNA, 23 nt, Human
cacaaauggcaaaaugauugccu

SEQ ID NO: 672363 - RNA, 19 nt, Human
caccaggcccucucucuug

SEQ ID NO: 672364 - RNA, 21 nt, Human
caccaggcccucucucuuguu

SEQ ID NO: 672365 - RNA, 23 nt, Human
cacccaugcagauaucuucguac

SEQ ID NO: 672366 - RNA, 21 nt, Human
caccgggcacaccacugccga

SEQ ID NO: 672367 - RNA, 21 nt, Human
cagccacccuucguggcacuc

SEQ ID NO: 672368 - RNA, 21 nt, Human
cagccgggcucgcaccaggcc

SEQ ID NO: 672369 - RNA, 23 nt, Human
cagcuuaguaaagcaaauuguuc

SEQ ID NO: 672370 - RNA, 22 nt, Human
ccccagcagccgggcucgcacc

SEQ ID NO: 672371 - RNA, 19 nt, Human
cccccagcagccgggcucg

SEQ ID NO: 672372 - RNA, 23 nt, Human
cccgaaagcucauuggccaagcg

SEQ ID NO: 672373 - RNA, 19 nt, Human
ccucgccgcagacgccccc

SEQ ID NO: 672374 - RNA, 27 nt, Human
ccucugcagcagcggcuccagccaccc

SEQ ID NO: 672375 - RNA, 23 nt, Human
cgaucacaucaaucaccgggcac

SEQ ID NO: 672376 - RNA, 22 nt, Human
cgccgcagacgcccccagcagc

SEQ ID NO: 672377 - RNA, 24 nt, Human
cucuucaaagcaaugcagccuagu

SEQ ID NO: 672378 - RNA, 19 nt, Human
cucuuuggcugacaugaac

SEQ ID NO: 672379 - RNA, 19 nt, Human
cugcagcagcggcuccagc

SEQ ID NO: 672380 - RNA, 20 nt, Human
gaguccuggcuccacagucu

SEQ ID NO: 672381 - RNA, 20 nt, Human
gaucauucacaaaucagaaa

SEQ ID NO: 672382 - RNA, 18 nt, Human
gcagcagcacaaacucua

SEQ ID NO: 672383 - RNA, 24 nt, Human
gccgcagacgcccccagcagccgg

SEQ ID NO: 672384 - RNA, 22 nt, Human
uaaaaggcacgacuguaaaaua

SEQ ID NO: 672385 - RNA, 23 nt, Human
uaaauaccaaaauaaaaucuuua

SEQ ID NO: 672386 - RNA, 24 nt, Human
uaaauccaacacaacuuucacaaa

SEQ ID NO: 672387 - RNA, 20 nt, Human
uagcaacacauaaccaaaag

SEQ ID NO: 672388 - RNA, 24 nt, Human
uagcaggauauccggggaugucuc

SEQ ID NO: 672389 - RNA, 22 nt, Human
uauccggggaugucucaaggac

SEQ ID NO: 672390 - RNA, 19 nt, Human
ucaaaauaaguacaaagcu

SEQ ID NO: 672391 - RNA, 20 nt, Human
ucaaucaccgggcacaccac

SEQ ID NO: 672392 - RNA, 22 nt, Human
ucacagcaguugcagcagcaca

SEQ ID NO: 672393 - RNA, 20 nt, Human
ucacuguagucaucuacaag

SEQ ID NO: 672394 - RNA, 18 nt, Human
uccuggcuccacagucuc

SEQ ID NO: 672395 - RNA, 25 nt, Human
ucuaucacuguagucaucuacaagg

SEQ ID NO: 672396 - RNA, 19 nt, Human
ucucaaguugacucagcuu

SEQ ID NO: 672397 - RNA, 21 nt, Human
ucucugagauuucagcuuugg

SEQ ID NO: 672398 - RNA, 20 nt, Human
ucuucuagcaggauauccgg

SEQ ID NO: 672399 - RNA, 23 nt, Human
ugaaaaaggaauuucauauagaa

SEQ ID NO: 672400 - RNA, 19 nt, Human
ugaccugaauaaaucaaua

SEQ ID NO: 672401 - RNA, 18 nt, Human
ugagguauuaucaguuaa

SEQ ID NO: 672402 - RNA, 18 nt, Human
ugcuuagcuaagucuuug

SEQ ID NO: 672403 - RNA, 18 nt, Human
uguaaaauauacaucuug

SEQ ID NO: 672404 - RNA, 20 nt, Human
uguuagaaguucgcucucaa

SEQ ID NO: 672405 - RNA, 22 nt, Human
uuaaccccgcagcugagguauu

SEQ ID NO: 672406 - RNA, 23 nt, Human
uuaaugaacaaacuugaaaaagg

SEQ ID NO: 672407 - RNA, 19 nt, Human
uuccacccaugcagauauc

SEQ ID NO: 672408 - RNA, 22 nt, Human
uugggcagucccgaaagcucau

SEQ ID NO: 672409 - RNA, 25 nt, Human
uugguggguucuggucacugcuuag

SEQ ID NO: 672410 - RNA, 23 nt, Human
uuuuuuuuuuuuuuuuuuguucu

SEQ ID NO: 672411 - RNA, 27 nt, Human
uuuuuuuuuuuuuuuuuuuuuuugggg

SEQ ID NO: 672412 - RNA, 22 nt, Human
acuuuaggaaauauuguuuugg

SEQ ID NO: 672413 - RNA, 19 nt, Human
ccaugagccccucuagcuc

SEQ ID NO: 672414 - RNA, 19 nt, Human
ccucuagcuccaucauccu

SEQ ID NO: 672415 - RNA, 20 nt, Human
cuucccaugagccccucuag

SEQ ID NO: 672416 - RNA, 18 nt, Human
gggucugccuuuugcucu

SEQ ID NO: 672417 - RNA, 24 nt, Human
uaauagauugcuuccuuaagcgau

SEQ ID NO: 672418 - RNA, 24 nt, Human
uuccuggaaauguguuuacuuugg

SEQ ID NO: 672419 - RNA, 19 nt, Human
aaagugcuaggauuacagg

SEQ ID NO: 672420 - RNA, 24 nt, Human
aaagugcuaggauuacagguguga

SEQ ID NO: 672421 - RNA, 24 nt, Human
aaagugcuaggauuucaggcauga

SEQ ID NO: 672422 - RNA, 18 nt, Human
aacuccugggcucaagcc

SEQ ID NO: 672423 - RNA, 25 nt, Human
aagcaauccucccaccucagccuuc

SEQ ID NO: 672424 - RNA, 19 nt, Human
aaguagcugggacugcagg

SEQ ID NO: 672425 - RNA, 20 nt, Human
aaguagcugggacugcaggu

SEQ ID NO: 672426 - RNA, 26 nt, Human
aagugcuaggauuacaggugugagcc

SEQ ID NO: 672427 - RNA, 21 nt, Human
acaaucaaggcucacuguagc

SEQ ID NO: 672428 - RNA, 22 nt, Human
acccucccccagcugccuuccc

SEQ ID NO: 672429 - RNA, 24 nt, Human
accuguugcccaggcuggagugca

SEQ ID NO: 672430 - RNA, 24 nt, Human
acuauguugcucaggccggucuug

SEQ ID NO: 672431 - RNA, 18 nt, Human
acugugcccagccugaag

SEQ ID NO: 672432 - RNA, 22 nt, Human
agagaugggauccucacuaugu

SEQ ID NO: 672433 - RNA, 23 nt, Human
aggaaagaaaaugggcccaaugu

SEQ ID NO: 672434 - RNA, 24 nt, Human
aggugauccaccugccuuggccuc

SEQ ID NO: 672435 - RNA, 23 nt, Human
agguucccagacaucagcaaucc

SEQ ID NO: 672436 - RNA, 22 nt, Human
aguagagauggaguuucaccau

SEQ ID NO: 672437 - RNA, 20 nt, Human
agugauucuccugccucagc

SEQ ID NO: 672438 - RNA, 24 nt, Human
agugauucuccugccucagccucc

SEQ ID NO: 672439 - RNA, 19 nt, Human
auggaguuucaccauguag

SEQ ID NO: 672440 - RNA, 24 nt, Human
auuuuuguacuuuuaguagagaug

SEQ ID NO: 672441 - RNA, 26 nt, Human
caaacuucugaccucaggugauccaa

SEQ ID NO: 672442 - RNA, 24 nt, Human
caaagugcuaggauuacaggugug

SEQ ID NO: 672443 - RNA, 24 nt, Human
caaagugcuaggauuucaggcaug

SEQ ID NO: 672444 - RNA, 27 nt, Human
caagcaauccucccaccucagccuucu

SEQ ID NO: 672445 - RNA, 22 nt, Human
cacaaucaaggcucacuguagc

SEQ ID NO: 672446 - RNA, 21 nt, Human
caccauguaguccaggcuggu

SEQ ID NO: 672447 - RNA, 24 nt, Human
caccauguaguccaggcugguuuc

SEQ ID NO: 672448 - RNA, 24 nt, Human
cacccaguggguuuagaaauccau

SEQ ID NO: 672449 - RNA, 20 nt, Human
caccucagccuucugaguag

SEQ ID NO: 672450 - RNA, 23 nt, Human
caccugccuuggccucccaaagu

SEQ ID NO: 672451 - RNA, 24 nt, Human
caccugccuuggccucccaaagug

SEQ ID NO: 672452 - RNA, 24 nt, Human
cacuauguugcucaggccggucuu

SEQ ID NO: 672453 - RNA, 21 nt, Human
cacugcaaccucugccuccug

SEQ ID NO: 672454 - RNA, 23 nt, Human
cacugcaaccucugccuccuggg

SEQ ID NO: 672455 - RNA, 19 nt, Human
cacugugcccagccagaau

SEQ ID NO: 672456 - RNA, 23 nt, Human
cagagucuuaccuguugcccagg

SEQ ID NO: 672457 - RNA, 21 nt, Human
cagcugccuucccuacuuugg

SEQ ID NO: 672458 - RNA, 25 nt, Human
caggaaaacgcuaggcuaaauagug

SEQ ID NO: 672459 - RNA, 22 nt, Human
caggcaugagccacugugccca

SEQ ID NO: 672460 - RNA, 21 nt, Human
caugcccagcuaauuuuugua

SEQ ID NO: 672461 - RNA, 20 nt, Human
ccaaagugcuaggauuacag

SEQ ID NO: 672462 - RNA, 21 nt, Human
ccaaagugcuaggauuacagg

SEQ ID NO: 672463 - RNA, 24 nt, Human
ccaaagugcuaggauuacaggugu

SEQ ID NO: 672464 - RNA, 24 nt, Human
ccaaagugcuaggauuucaggcau

SEQ ID NO: 672465 - RNA, 19 nt, Human
ccacugugcccagccugaa

SEQ ID NO: 672466 - RNA, 19 nt, Human
ccacugugcccagccugaa

SEQ ID NO: 672467 - RNA, 24 nt, Human
ccagacaucagcaauccuguuucc

SEQ ID NO: 672468 - RNA, 18 nt, Human
ccagagaagcuggugauc

SEQ ID NO: 672469 - RNA, 22 nt, Human
ccagccagaauauaucauuuca

SEQ ID NO: 672470 - RNA, 23 nt, Human
cccaaguagcugggacugcaggu

SEQ ID NO: 672471 - RNA, 24 nt, Human
cccaaguagcugggacugcaggug

SEQ ID NO: 672472 - RNA, 24 nt, Human
cccaccucagccuucugaguagcu

SEQ ID NO: 672473 - RNA, 19 nt, Human
cccaggcuggagugcagug

SEQ ID NO: 672474 - RNA, 23 nt, Human
cccucccccagcugccuucccua

SEQ ID NO: 672475 - RNA, 18 nt, Human
cccugaacccucccccag

SEQ ID NO: 672476 - RNA, 24 nt, Human
ccucccaccucagccuucugagua

SEQ ID NO: 672477 - RNA, 24 nt, Human
ccuccuggguucgagugauucucc

SEQ ID NO: 672478 - RNA, 22 nt, Human
ccucugccuccuggguucgagu

SEQ ID NO: 672479 - RNA, 23 nt, Human
ccugccucagccucccaaguagc

SEQ ID NO: 672480 - RNA, 24 nt, Human
ccugccucagccucccaaguagcu

SEQ ID NO: 672481 - RNA, 24 nt, Human
ccugccuuggccucccaaagugcu

SEQ ID NO: 672482 - RNA, 24 nt, Human
ccuguugcccaggcuggagugcag

SEQ ID NO: 672483 - RNA, 19 nt, Human
cgacuacaggcauaagcca

SEQ ID NO: 672484 - RNA, 27 nt, Human
cgagugauucuccugccucagccuccc

SEQ ID NO: 672485 - RNA, 24 nt, Human
cgcucuuguugcucaggcuggggu

SEQ ID NO: 672486 - RNA, 24 nt, Human
cguagagaugggauccucacuaug

SEQ ID NO: 672487 - RNA, 24 nt, Human
cucaagccauucucccacauuguc

SEQ ID NO: 672488 - RNA, 24 nt, Human
cucacugcaaccucugccuccugg

SEQ ID NO: 672489 - RNA, 23 nt, Human
cucacuguagcuucaaccuccgg

SEQ ID NO: 672490 - RNA, 24 nt, Human
cucagccucccaaguagcugggac

SEQ ID NO: 672491 - RNA, 24 nt, Human
cucaggugauccaccugccuuggc

SEQ ID NO: 672492 - RNA, 25 nt, Human
cuccugccucagccucccaaguagc

SEQ ID NO: 672493 - RNA, 25 nt, Human
cuccugggcucaagccauucuccca

SEQ ID NO: 672494 - RNA, 21 nt, Human
cuccuggguucgagugauucu

SEQ ID NO: 672495 - RNA, 20 nt, Human
cugaccucaggugauccacc

SEQ ID NO: 672496 - RNA, 22 nt, Human
cugaccucaggugauccaccug

SEQ ID NO: 672497 - RNA, 23 nt, Human
cugcaaccucugccuccuggguu

SEQ ID NO: 672498 - RNA, 24 nt, Human
cugcaaccucugccuccuggguuc

SEQ ID NO: 672499 - RNA, 24 nt, Human
cuuaccuguugcccaggcuggagu

SEQ ID NO: 672500 - RNA, 24 nt, Human
cuuguugcucaggcuggggugcaa

SEQ ID NO: 672501 - RNA, 24 nt, Human
cuuuuaguagagauggaguuucac

SEQ ID NO: 672502 - RNA, 19 nt, Human
cuuuuuuuuuugccggggg

SEQ ID NO: 672503 - RNA, 18 nt, Human
gaacaagcaauccuccca

SEQ ID NO: 672504 - RNA, 23 nt, Human
gaacccucccccagcugccuucc

SEQ ID NO: 672505 - RNA, 24 nt, Human
gaccucaggugauccaccugccuu

SEQ ID NO: 672506 - RNA, 18 nt, Human
gacuacaggcauaagcca

SEQ ID NO: 672507 - RNA, 24 nt, Human
gacuacaggcauaagccaccauac

SEQ ID NO: 672508 - RNA, 18 nt, Human
gauuacaggugugagcca

SEQ ID NO: 672509 - RNA, 19 nt, Human
gauuacaggugugagccac

SEQ ID NO: 672510 - RNA, 21 nt, Human
gauuacaggugugagccacug

SEQ ID NO: 672511 - RNA, 21 nt, Human
gauuucaggcaugagccacug

SEQ ID NO: 672512 - RNA, 24 nt, Human
gauuucaggcaugagccacugugc

SEQ ID NO: 672513 - RNA, 22 nt, Human
gcaaccucugccuccuggguuc

SEQ ID NO: 672514 - RNA, 19 nt, Human
gcccaggcuggagugcagu

SEQ ID NO: 672515 - RNA, 24 nt, Human
gcccugaacccucccccagcugcc

SEQ ID NO: 672516 - RNA, 21 nt, Human
gcucacugcaaccucugccuc

SEQ ID NO: 672517 - RNA, 19 nt, Human
gcuggagugcagugacaca

SEQ ID NO: 672518 - RNA, 22 nt, Human
gcuugugggggcucucucuggg

SEQ ID NO: 672519 - RNA, 24 nt, Human
ggacugcaggugcgugccaucaug

SEQ ID NO: 672520 - RNA, 23 nt, Human
ggauccucacuauguugcucagg

SEQ ID NO: 672521 - RNA, 22 nt, Human
ggauuacaggugugagccacug

SEQ ID NO: 672522 - RNA, 22 nt, Human
ggauuucaggcaugagccacug

SEQ ID NO: 672523 - RNA, 18 nt, Human
ggccggucuugaacuccu

SEQ ID NO: 672524 - RNA, 24 nt, Human
ggcugguuucaaacuucugaccuc

SEQ ID NO: 672525 - RNA, 24 nt, Human
gggaacaagcaauccucccaccuc

SEQ ID NO: 672526 - RNA, 24 nt, Human
gggauccucacuauguugcucagg

SEQ ID NO: 672527 - RNA, 19 nt, Human
gguuucaaacuucugaccu

SEQ ID NO: 672528 - RNA, 21 nt, Human
guaguccaggcugguuucaaa

SEQ ID NO: 672529 - RNA, 24 nt, Human
gucuuaccuguugcccaggcugga

SEQ ID NO: 672530 - RNA, 24 nt, Human
gugauccaccugccuuggccuccc

SEQ ID NO: 672531 - RNA, 24 nt, Human
gugauucuccugccucagccuccc

SEQ ID NO: 672532 - RNA, 23 nt, Human
gugcaauggugcugucuuggcuc

SEQ ID NO: 672533 - RNA, 21 nt, Human
gugcgugccaucaugcccagc

SEQ ID NO: 672534 - RNA, 18 nt, Human
gugcugucuuggcucacu

SEQ ID NO: 672535 - RNA, 20 nt, Human
guuuuuuuuuugagacagag

SEQ ID NO: 672536 - RNA, 24 nt, Human
uaauuuuuguacuuuuaguagaga

SEQ ID NO: 672537 - RNA, 24 nt, Human
uacaggcauaagccaccauaccca

SEQ ID NO: 672538 - RNA, 23 nt, Human
uacaggugugagccacugugccc

SEQ ID NO: 672539 - RNA, 24 nt, Human
uacaggugugagccacugugccca

SEQ ID NO: 672540 - RNA, 23 nt, Human
uaccuguugcccaggcuggagug

SEQ ID NO: 672541 - RNA, 22 nt, Human
uagagauggaguuucaccaugu

SEQ ID NO: 672542 - RNA, 21 nt, Human
uaggauuacaggugugagcca

SEQ ID NO: 672543 - RNA, 22 nt, Human
uaggauuacaggugugagccac

SEQ ID NO: 672544 - RNA, 22 nt, Human
uaggauuacaggugugagccac

SEQ ID NO: 672545 - RNA, 22 nt, Human
uaggauuacaggugugagccac

SEQ ID NO: 672546 - RNA, 24 nt, Human
uaggauuacaggugugagccacug

SEQ ID NO: 672547 - RNA, 22 nt, Human
uaggauuucaggcaugagccac

SEQ ID NO: 672548 - RNA, 24 nt, Human
uaggauuucaggcaugagccacug

SEQ ID NO: 672549 - RNA, 26 nt, Human
uaggauuucaggcaugagccacugug

SEQ ID NO: 672550 - RNA, 24 nt, Human
uaguagagauggaguuucaccaug

SEQ ID NO: 672551 - RNA, 25 nt, Human
uaguagagauggaguuucaccaugu

SEQ ID NO: 672552 - RNA, 24 nt, Human
uauguugcucaggccggucuugaa

SEQ ID NO: 672553 - RNA, 24 nt, Human
ucacugcaaccucugccuccuggg

SEQ ID NO: 672554 - RNA, 25 nt, Human
ucacugcaaccucugccuccugggu

SEQ ID NO: 672555 - RNA, 26 nt, Human
ucacugcaaccucugccuccuggguu

SEQ ID NO: 672556 - RNA, 20 nt, Human
ucagccucccaaguagcugg

SEQ ID NO: 672557 - RNA, 21 nt, Human
ucaggcaugagccacugugcc

SEQ ID NO: 672558 - RNA, 24 nt, Human
ucaggccggucuugaacuccuggg

SEQ ID NO: 672559 - RNA, 21 nt, Human
ucaggugauccaccugccuug

SEQ ID NO: 672560 - RNA, 23 nt, Human
ucccaaagugcuaggauuacagg

SEQ ID NO: 672561 - RNA, 24 nt, Human
ucccaaagugcuaggauuucaggc

SEQ ID NO: 672562 - RNA, 24 nt, Human
ucccaaguagcugggacugcaggu

SEQ ID NO: 672563 - RNA, 18 nt, Human
ucccccagcugccuuccc

SEQ ID NO: 672564 - RNA, 21 nt, Human
uccugggcucaagccauucuc

SEQ ID NO: 672565 - RNA, 22 nt, Human
uccugggcucaagccauucucc

SEQ ID NO: 672566 - RNA, 21 nt, Human
uccuggguucgagugauucuc

SEQ ID NO: 672567 - RNA, 24 nt, Human
uccuggguucgagugauucuccug

SEQ ID NO: 672568 - RNA, 22 nt, Human
ucgcucuuguugcucaggcugg

SEQ ID NO: 672569 - RNA, 22 nt, Human
ucgcucuuguugcucaggcugg

SEQ ID NO: 672570 - RNA, 23 nt, Human
ucugaguagcugcgacuacaggc

SEQ ID NO: 672571 - RNA, 24 nt, Human
ucugaguagcugcgacuacaggca

SEQ ID NO: 672572 - RNA, 21 nt, Human
ucuuaccuguugcccaggcug

SEQ ID NO: 672573 - RNA, 22 nt, Human
ucuuaccuguugcccaggcugg

SEQ ID NO: 672574 - RNA, 23 nt, Human
ucuuaccuguugcccaggcugga

SEQ ID NO: 672575 - RNA, 19 nt, Human
ucuugaacuccugggcuca

SEQ ID NO: 672576 - RNA, 23 nt, Human
ucuugaacuccugggcucaagcc

SEQ ID NO: 672577 - RNA, 18 nt, Human
ucuuguugcucaggcugg

SEQ ID NO: 672578 - RNA, 18 nt, Human
ugaaggaaagaaaauggg

SEQ ID NO: 672579 - RNA, 20 nt, Human
ugaaggaaagaaaaugggcc

SEQ ID NO: 672580 - RNA, 20 nt, Human
ugacacaaucaaggcucacu

SEQ ID NO: 672581 - RNA, 24 nt, Human
ugaccucaggugauccaccugccu

SEQ ID NO: 672582 - RNA, 19 nt, Human
ugagacagagucuuaccug

SEQ ID NO: 672583 - RNA, 21 nt, Human
ugagacagagucuuaccuguu

SEQ ID NO: 672584 - RNA, 20 nt, Human
ugauucuccugccucagccu

SEQ ID NO: 672585 - RNA, 18 nt, Human
ugcccaggcuggagugca

SEQ ID NO: 672586 - RNA, 21 nt, Human
ugcccaggcuggagugcagug

SEQ ID NO: 672587 - RNA, 24 nt, Human
ugcccaggcuggagugcagugaca

SEQ ID NO: 672588 - RNA, 21 nt, Human
ugcccugaacccucccccagc

SEQ ID NO: 672589 - RNA, 24 nt, Human
ugccucagccucccaaguagcugg

SEQ ID NO: 672590 - RNA, 23 nt, Human
ugccuuggccucccaaagugcua

SEQ ID NO: 672591 - RNA, 24 nt, Human
ugcgacuacaggcauaagccacca

SEQ ID NO: 672592 - RNA, 19 nt, Human
ugcgugccaucaugcccag

SEQ ID NO: 672593 - RNA, 24 nt, Human
ugcuaggauuacaggugugagcca

SEQ ID NO: 672594 - RNA, 24 nt, Human
ugcucaggccggucuugaacuccu

SEQ ID NO: 672595 - RNA, 20 nt, Human
ugcucaggcuggggugcaau

SEQ ID NO: 672596 - RNA, 24 nt, Human
ugcucaggcuggggugcaauggug

SEQ ID NO: 672597 - RNA, 24 nt, Human
uggagugcagugacacaaucaagg

SEQ ID NO: 672598 - RNA, 24 nt, Human
uggaguuucaccauguaguccagg

SEQ ID NO: 672599 - RNA, 21 nt, Human
ugggacugcaggugcgugcca

SEQ ID NO: 672600 - RNA, 21 nt, Human
ugggggcucucucuggggaug

SEQ ID NO: 672601 - RNA, 28 nt, Human
uggggugcaauggugcuguccuagcacg

SEQ ID NO: 672602 - RNA, 24 nt, Human
uggggugcaauggugcugucuugg

SEQ ID NO: 672603 - RNA, 21 nt, Human
ugugaaggaaagaaaaugggc

SEQ ID NO: 672604 - RNA, 19 nt, Human
ugugcccagccugaaguac

SEQ ID NO: 672605 - RNA, 24 nt, Human
uuaccuguugcccaggcuggagug

SEQ ID NO: 672606 - RNA, 18 nt, Human
uuaguagagauggaguuu

SEQ ID NO: 672607 - RNA, 24 nt, Human
uuaguagagauggaguuucaccau

SEQ ID NO: 672608 - RNA, 18 nt, Human
uuccugaggagcuugugg

SEQ ID NO: 672609 - RNA, 18 nt, Human
uucgagugauucuccugc

SEQ ID NO: 672610 - RNA, 23 nt, Human
uucgagugauucuccugccucag

SEQ ID NO: 672611 - RNA, 24 nt, Human
uucgagugauucuccugccucagc

SEQ ID NO: 672612 - RNA, 24 nt, Human
uucgcucuuguugcucaggcuggg

SEQ ID NO: 672613 - RNA, 24 nt, Human
uugcccaggcuggagugcagugac

SEQ ID NO: 672614 - RNA, 23 nt, Human
uugcucaggcuggggugcaaugg

SEQ ID NO: 672615 - RNA, 24 nt, Human
uugcucaggcuggggugcaauggu

SEQ ID NO: 672616 - RNA, 18 nt, Human
uuggccucccaaagugcu

SEQ ID NO: 672617 - RNA, 22 nt, Human
uuucaccauguaguccaggcug

SEQ ID NO: 672618 - RNA, 24 nt, Human
uuucgcucuuguugcucaggcugg

SEQ ID NO: 672619 - RNA, 21 nt, Human
uuucuagaacaggaaaacgcu

SEQ ID NO: 672620 - RNA, 20 nt, Human
uuuuuguacuuuuaguagag

SEQ ID NO: 672621 - RNA, 18 nt, Human
uuuuuugagacagagucu

SEQ ID NO: 672622 - RNA, 22 nt, Human
uuuuuuuuuugagacagagucu

SEQ ID NO: 672623 - RNA, 18 nt, Human
uuuuuuuuuuuuuuccug

SEQ ID NO: 672624 - RNA, 24 nt, Human
aaacagacauacacaugcuuucuu

SEQ ID NO: 672625 - RNA, 20 nt, Human
aaagaagcugggaguguuaa

SEQ ID NO: 672626 - RNA, 24 nt, Human
agaaucagaaccagccuagcuuuu

SEQ ID NO: 672627 - RNA, 20 nt, Human
caccugaagucgccauaaac

SEQ ID NO: 672628 - RNA, 20 nt, Human
cauaaacagacauacacaug

SEQ ID NO: 672629 - RNA, 20 nt, Human
ccagccuagcuuuuguggga

SEQ ID NO: 672630 - RNA, 23 nt, Human
cugaagucgccauaaacagacau

SEQ ID NO: 672631 - RNA, 23 nt, Human
cuggagcagguuaagaaucagaa

SEQ ID NO: 672632 - RNA, 21 nt, Human
gaugacccagauccagcacca

SEQ ID NO: 672633 - RNA, 20 nt, Human
gcaagaauugaugacccaga

SEQ ID NO: 672634 - RNA, 24 nt, Human
uagaagccauuccacuugcaagaa

SEQ ID NO: 672635 - RNA, 20 nt, Human
uugagaaagaagcugggagu

SEQ ID NO: 672636 - RNA, 19 nt, Human
cccgccgagccucgcccca

SEQ ID NO: 672637 - RNA, 21 nt, Human
ccgagccucgccccaagcgcg

SEQ ID NO: 672638 - RNA, 18 nt, Human
ccgccgagccucgcccca

SEQ ID NO: 672639 - RNA, 18 nt, Human
ccgcgcccgccgagccuc

SEQ ID NO: 672640 - RNA, 19 nt, Human
ccgcgcccgccgagccucg

SEQ ID NO: 672641 - RNA, 28 nt, Human
ccgcgcccgccgagccucgccccaagcg

SEQ ID NO: 672642 - RNA, 20 nt, Human
cgagccucgccccaagcgcg

SEQ ID NO: 672643 - RNA, 18 nt, Human
aaaaaaaaaagguuuaga

SEQ ID NO: 672644 - RNA, 26 nt, Human
aaaaaaagguuuagaaaaaaaaucaa

SEQ ID NO: 672645 - RNA, 23 nt, Human
aaacaugaauaaugccaaaccca

SEQ ID NO: 672646 - RNA, 19 nt, Human
aaacccaaaaccugcacga

SEQ ID NO: 672647 - RNA, 22 nt, Human
aagcaaaauaagauuuguccau

SEQ ID NO: 672648 - RNA, 23 nt, Human
aaugccaaacccaaaaccugcac

SEQ ID NO: 672649 - RNA, 24 nt, Human
acacacacacacacaaacacauua

SEQ ID NO: 672650 - RNA, 25 nt, Human
acacacacacacacacacacaaaca

SEQ ID NO: 672651 - RNA, 23 nt, Human
acacacacacacacacacacaca

SEQ ID NO: 672652 - RNA, 23 nt, Human
acacacacacacacacacacaca

SEQ ID NO: 672653 - RNA, 23 nt, Human
acacacacacacacacacacaca

SEQ ID NO: 672654 - RNA, 23 nt, Human
acacacacacacacacacacaca

SEQ ID NO: 672655 - RNA, 23 nt, Human
acacacacacacacacacacaca

SEQ ID NO: 672656 - RNA, 23 nt, Human
acacacacacacacacacacaca

SEQ ID NO: 672657 - RNA, 24 nt, Human
acacacacacacacacacacacaa

SEQ ID NO: 672658 - RNA, 23 nt, Human
accugggggaccuucugcuggca

SEQ ID NO: 672659 - RNA, 22 nt, Human
acucugaggagggcccaaaggc

SEQ ID NO: 672660 - RNA, 26 nt, Human
agaaaaaaaaucaacagacugaagga

SEQ ID NO: 672661 - RNA, 23 nt, Human
agaaacaugaauaaugccaaacc

SEQ ID NO: 672662 - RNA, 20 nt, Human
agagcagagcccaaugaacc

SEQ ID NO: 672663 - RNA, 20 nt, Human
agauggugucucaucuccuu

SEQ ID NO: 672664 - RNA, 18 nt, Human
agauuuguccauguuaua

SEQ ID NO: 672665 - RNA, 20 nt, Human
agggagcucuguccacagcu

SEQ ID NO: 672666 - RNA, 21 nt, Human
agggaggagagcagagcccaa

SEQ ID NO: 672667 - RNA, 20 nt, Human
agucacagaaucacacaucu

SEQ ID NO: 672668 - RNA, 22 nt, Human
agugagguuuguacccaggcau

SEQ ID NO: 672669 - RNA, 19 nt, Human
auauauauauauauauaua

SEQ ID NO: 672670 - RNA, 19 nt, Human
auauauauauauauauaua

SEQ ID NO: 672671 - RNA, 19 nt, Human
auauauauauauauauaua

SEQ ID NO: 672672 - RNA, 19 nt, Human
auauauauauauauauaua

SEQ ID NO: 672673 - RNA, 19 nt, Human
auauauauauauauauaua

SEQ ID NO: 672674 - RNA, 19 nt, Human
auauauauauauauauaua

SEQ ID NO: 672675 - RNA, 19 nt, Human
auauauauauauauauaua

SEQ ID NO: 672676 - RNA, 19 nt, Human
auauauauauauauauaua

SEQ ID NO: 672677 - RNA, 19 nt, Human
auauauauauauauauaua

SEQ ID NO: 672678 - RNA, 19 nt, Human
auauauauauauauauaua

SEQ ID NO: 672679 - RNA, 19 nt, Human
auauauauauauauauaua

SEQ ID NO: 672680 - RNA, 19 nt, Human
auauauauauauauauaua

SEQ ID NO: 672681 - RNA, 19 nt, Human
auauauauauauauauaua

SEQ ID NO: 672682 - RNA, 19 nt, Human
auauauauauauauauaua

SEQ ID NO: 672683 - RNA, 19 nt, Human
auauauauauauauauaua

SEQ ID NO: 672684 - RNA, 19 nt, Human
auauauauauauauauaua

SEQ ID NO: 672685 - RNA, 19 nt, Human
auauauauauauauauaua

SEQ ID NO: 672686 - RNA, 19 nt, Human
auauauauauauauauaua

SEQ ID NO: 672687 - RNA, 19 nt, Human
auauauauauauauauaua

SEQ ID NO: 672688 - RNA, 19 nt, Human
auauauauauauauauaua

SEQ ID NO: 672689 - RNA, 19 nt, Human
auauauauauauauauaua

SEQ ID NO: 672690 - RNA, 19 nt, Human
auauauauauauauauaua

SEQ ID NO: 672691 - RNA, 19 nt, Human
auauauauauauauauaua

SEQ ID NO: 672692 - RNA, 19 nt, Human
auauauauauauauauaua

SEQ ID NO: 672693 - RNA, 19 nt, Human
auauauauauauauauaua

SEQ ID NO: 672694 - RNA, 19 nt, Human
auauauauauauauauaua

SEQ ID NO: 672695 - RNA, 19 nt, Human
auauauauauauauauaua

SEQ ID NO: 672696 - RNA, 19 nt, Human
auauauauauauauauaua

SEQ ID NO: 672697 - RNA, 19 nt, Human
auauauauauauauauaua

SEQ ID NO: 672698 - RNA, 19 nt, Human
auauauauauauauauaua

SEQ ID NO: 672699 - RNA, 19 nt, Human
auauauauauauauauaua

SEQ ID NO: 672700 - RNA, 19 nt, Human
auauauauauauauauaua

SEQ ID NO: 672701 - RNA, 19 nt, Human
auauauauauauauauaua

SEQ ID NO: 672702 - RNA, 19 nt, Human
auauauauauauauauaua

SEQ ID NO: 672703 - RNA, 19 nt, Human
auauauauauauauauaua

SEQ ID NO: 672704 - RNA, 26 nt, Human
auauauauauauauauauguauauua

SEQ ID NO: 672705 - RNA, 23 nt, Human
caaccuguugugcaaaaacacua

SEQ ID NO: 672706 - RNA, 27 nt, Human
caagucacagaaucacacaucuggcca

SEQ ID NO: 672707 - RNA, 20 nt, Human
cacaaacacauuaagcaaaa

SEQ ID NO: 672708 - RNA, 24 nt, Human
cacacacacacacaaacacauuaa

SEQ ID NO: 672709 - RNA, 25 nt, Human
cacacacacacacacaaacacauua

SEQ ID NO: 672710 - RNA, 18 nt, Human
cacacacacacacacaca

SEQ ID NO: 672711 - RNA, 20 nt, Human
cacacacacacacacacaca

SEQ ID NO: 672712 - RNA, 20 nt, Human
cacacacacacacacacaca

SEQ ID NO: 672713 - RNA, 20 nt, Human
cacacacacacacacacaca

SEQ ID NO: 672714 - RNA, 20 nt, Human
cacacacacacacacacaca

SEQ ID NO: 672715 - RNA, 20 nt, Human
cacacacacacacacacaca

SEQ ID NO: 672716 - RNA, 20 nt, Human
cacacacacacacacacaca

SEQ ID NO: 672717 - RNA, 20 nt, Human
cacacacacacacacacaca

SEQ ID NO: 672718 - RNA, 20 nt, Human
cacacacacacacacacaca

SEQ ID NO: 672719 - RNA, 20 nt, Human
cacacacacacacacacaca

SEQ ID NO: 672720 - RNA, 20 nt, Human
cacacacacacacacacaca

SEQ ID NO: 672721 - RNA, 22 nt, Human
cacacacacacacacacacaca

SEQ ID NO: 672722 - RNA, 22 nt, Human
cacacacacacacacacacaca

SEQ ID NO: 672723 - RNA, 22 nt, Human
cacacacacacacacacacaca

SEQ ID NO: 672724 - RNA, 22 nt, Human
cacacacacacacacacacaca

SEQ ID NO: 672725 - RNA, 22 nt, Human
cacacacacacacacacacaca

SEQ ID NO: 672726 - RNA, 26 nt, Human
cacacacacacacacacacacacaca

SEQ ID NO: 672727 - RNA, 26 nt, Human
cacacacacacacacacacacacaca

SEQ ID NO: 672728 - RNA, 26 nt, Human
cacacacacacacacacacacacaca

SEQ ID NO: 672729 - RNA, 26 nt, Human
cacacacacacacacacacacacaca

SEQ ID NO: 672730 - RNA, 19 nt, Human
cacagucaagucacccacc

SEQ ID NO: 672731 - RNA, 25 nt, Human
cauacacacacacacacacacacac

SEQ ID NO: 672732 - RNA, 23 nt, Human
caugcgucuauggaucugacuua

SEQ ID NO: 672733 - RNA, 19 nt, Human
ccaaacccaaaaccugcac

SEQ ID NO: 672734 - RNA, 24 nt, Human
ccauaacucaagaaugagucucaa

SEQ ID NO: 672735 - RNA, 18 nt, Human
cccaucugggagggacag

SEQ ID NO: 672736 - RNA, 22 nt, Human
cccgaccugccgucuccuccuc

SEQ ID NO: 672737 - RNA, 19 nt, Human
cccgccgcucgccgucccg

SEQ ID NO: 672738 - RNA, 20 nt, Human
ccgcccgccgcucgccgucc

SEQ ID NO: 672739 - RNA, 18 nt, Human
ccgccgcccgccgcucgc

SEQ ID NO: 672740 - RNA, 20 nt, Human
ccgccgcccgccgcucgccg

SEQ ID NO: 672741 - RNA, 20 nt, Human
cgaccugccgucuccuccuc

SEQ ID NO: 672742 - RNA, 19 nt, Human
cgcccgccgcucgccgucc

SEQ ID NO: 672743 - RNA, 19 nt, Human
cuauauauauauauauaua

SEQ ID NO: 672744 - RNA, 19 nt, Human
cuuuuugcagcugcuguuc

SEQ ID NO: 672745 - RNA, 18 nt, Human
gaacuuacagcccaucug

SEQ ID NO: 672746 - RNA, 20 nt, Human
gaauaaugccaaacccaaaa

SEQ ID NO: 672747 - RNA, 20 nt, Human
gaccugccgucuccuccucc

SEQ ID NO: 672748 - RNA, 18 nt, Human
gagcagagcccaaugaac

SEQ ID NO: 672749 - RNA, 21 nt, Human
gcaaaauaagauuuguccaug

SEQ ID NO: 672750 - RNA, 19 nt, Human
gcccggaggauggagaccu

SEQ ID NO: 672751 - RNA, 18 nt, Human
ggagcucuguccacagcu

SEQ ID NO: 672752 - RNA, 19 nt, Human
ggcagggaggagagcagag

SEQ ID NO: 672753 - RNA, 19 nt, Human
ggcauugaagcagaaaaga

SEQ ID NO: 672754 - RNA, 19 nt, Human
gucacagaaucacacaucu

SEQ ID NO: 672755 - RNA, 19 nt, Human
gucuccuccuccgccgccc

SEQ ID NO: 672756 - RNA, 25 nt, Human
uaaauugugcagaucagcaguccua

SEQ ID NO: 672757 - RNA, 25 nt, Human
uacacacacacacacacacacacac

SEQ ID NO: 672758 - RNA, 26 nt, Human
uacauacacacacacacacacacaca

SEQ ID NO: 672759 - RNA, 24 nt, Human
uaccugggggaccuucugcuggca

SEQ ID NO: 672760 - RNA, 20 nt, Human
uagaaaaaaaaucaacagac

SEQ ID NO: 672761 - RNA, 26 nt, Human
uagaaaaaaaaucaacagacugaagg

SEQ ID NO: 672762 - RNA, 26 nt, Human
uauauacauacacacacacacacaca

SEQ ID NO: 672763 - RNA, 25 nt, Human
uauauacauacacacacacacacag

SEQ ID NO: 672764 - RNA, 19 nt, Human
uauauauauauauauauau

SEQ ID NO: 672765 - RNA, 19 nt, Human
uauauauauauauauauau

SEQ ID NO: 672766 - RNA, 19 nt, Human
uauauauauauauauauau

SEQ ID NO: 672767 - RNA, 19 nt, Human
uauauauauauauauauau

SEQ ID NO: 672768 - RNA, 19 nt, Human
uauauauauauauauauau

SEQ ID NO: 672769 - RNA, 19 nt, Human
uauauauauauauauauau

SEQ ID NO: 672770 - RNA, 19 nt, Human
uauauauauauauauauau

SEQ ID NO: 672771 - RNA, 19 nt, Human
uauauauauauauauauau

SEQ ID NO: 672772 - RNA, 19 nt, Human
uauauauauauauauauau

SEQ ID NO: 672773 - RNA, 19 nt, Human
uauauauauauauauauau

SEQ ID NO: 672774 - RNA, 19 nt, Human
uauauauauauauauauau

SEQ ID NO: 672775 - RNA, 19 nt, Human
uauauauauauauauauau

SEQ ID NO: 672776 - RNA, 19 nt, Human
uauauauauauauauauau

SEQ ID NO: 672777 - RNA, 19 nt, Human
uauauauauauauauauau

SEQ ID NO: 672778 - RNA, 19 nt, Human
uauauauauauauauauau

SEQ ID NO: 672779 - RNA, 19 nt, Human
uauauauauauauauauau

SEQ ID NO: 672780 - RNA, 19 nt, Human
uauauauauauauauauau

SEQ ID NO: 672781 - RNA, 19 nt, Human
uauauauauauauauauau

SEQ ID NO: 672782 - RNA, 19 nt, Human
uauauauauauauauauau

SEQ ID NO: 672783 - RNA, 24 nt, Human
uauauauauauauauauauaugua

SEQ ID NO: 672784 - RNA, 19 nt, Human
uauuuauauauauauauau

SEQ ID NO: 672785 - RNA, 21 nt, Human
ucaacagacugaaggaucccc

SEQ ID NO: 672786 - RNA, 26 nt, Human
ucacacaucuggccaaagaaggcaac

SEQ ID NO: 672787 - RNA, 19 nt, Human
ucagaaacaugaauaaugc

SEQ ID NO: 672788 - RNA, 24 nt, Human
ucaguacaucugcuagcucuuuuu

SEQ ID NO: 672789 - RNA, 24 nt, Human
uccagagcgucggcugagcuagca

SEQ ID NO: 672790 - RNA, 18 nt, Human
uccgccgcccgccgcucg

SEQ ID NO: 672791 - RNA, 22 nt, Human
uccuccgccgcccgccgcucgc

SEQ ID NO: 672792 - RNA, 21 nt, Human
ugaagugagaacuuacagccc

SEQ ID NO: 672793 - RNA, 19 nt, Human
ugaggagggcccaaaggcc

SEQ ID NO: 672794 - RNA, 18 nt, Human
ugagguguugacguacac

SEQ ID NO: 672795 - RNA, 21 nt, Human
ugagguguugacguacacggg

SEQ ID NO: 672796 - RNA, 20 nt, Human
ugaucccuugccccaccccc

SEQ ID NO: 672797 - RNA, 18 nt, Human
uggcagcuaaugcuaaaa

SEQ ID NO: 672798 - RNA, 19 nt, Human
uguaaacucagccuuuagg

SEQ ID NO: 672799 - RNA, 24 nt, Human
uguccacagcucccguaauggcag

SEQ ID NO: 672800 - RNA, 22 nt, Human
uguuuucucaucaucacuucca

SEQ ID NO: 672801 - RNA, 19 nt, Human
uucuccaugucuaccuggg

SEQ ID NO: 672802 - RNA, 19 nt, Human
uucugaaggugucgggagg

SEQ ID NO: 672803 - RNA, 23 nt, Human
uugccugcuucacaagcucugga

SEQ ID NO: 672804 - RNA, 19 nt, Human
uuggcagcuaaugcuaaaa

SEQ ID NO: 672805 - RNA, 21 nt, Human
uuuauauauauauauauacau

SEQ ID NO: 672806 - RNA, 22 nt, Human
uuugaagucauuuggcagcuaa

SEQ ID NO: 672807 - RNA, 20 nt, Human
uuuuuuuuuuuuuaaaggug

SEQ ID NO: 672808 - RNA, 22 nt, Human
uuuuuuuuuuuuuuuuuaaagg

SEQ ID NO: 672809 - RNA, 21 nt, Human
gcccuuuuuugcuucccuccu

SEQ ID NO: 672810 - RNA, 21 nt, Human
uuuuuugcuucccuccuaccc

SEQ ID NO: 672811 - RNA, 18 nt, Human
aaggaaaaggagaaggga

SEQ ID NO: 672812 - RNA, 20 nt, Human
aggcagagggggcucccuga

SEQ ID NO: 672813 - RNA, 22 nt, Human
aggcagagggggcucccugaug

SEQ ID NO: 672814 - RNA, 18 nt, Human
agggauggggucugggga

SEQ ID NO: 672815 - RNA, 18 nt, Human
cacugugggcaggaacac

SEQ ID NO: 672816 - RNA, 18 nt, Human
cccggccuccucuaaggc

SEQ ID NO: 672817 - RNA, 25 nt, Human
gagccgggccgggccgccgcaggga

SEQ ID NO: 672818 - RNA, 24 nt, Human
gcagaaggguuaaggccacaaagg

SEQ ID NO: 672819 - RNA, 24 nt, Human
ggauggggucuggggacagcugag

SEQ ID NO: 672820 - RNA, 19 nt, Human
ucccaugaggucugguacu

SEQ ID NO: 672821 - RNA, 18 nt, Human
ugucagaggcucugcugg

SEQ ID NO: 672822 - RNA, 23 nt, Human
ugucagaggcucugcugggccac

SEQ ID NO: 672823 - RNA, 18 nt, Human
uuuuuuuuuuuuuuuuug

SEQ ID NO: 672824 - RNA, 20 nt, Human
uuuuuuuuuuuuuuuuugcu

SEQ ID NO: 672825 - RNA, 22 nt, Human
uuuuuuuuuuuuuuuuugcugg

SEQ ID NO: 672826 - RNA, 23 nt, Human
uuuuuuuuuuuuuuuuuugcugg

SEQ ID NO: 672827 - RNA, 22 nt, Human
aaaaaaaacuccacauugucaa

SEQ ID NO: 672828 - RNA, 23 nt, Human
aaaaagaaacaaaagaaagcuca

SEQ ID NO: 672829 - RNA, 26 nt, Human
aaagaaacaaaagaaagcucaauuua

SEQ ID NO: 672830 - RNA, 18 nt, Human
aacacacuuuaaaaaaug

SEQ ID NO: 672831 - RNA, 26 nt, Human
aaccacuuuuuaaaaaaaaacuccac

SEQ ID NO: 672832 - RNA, 26 nt, Human
aauuuaugaacacuuuacaaauccuu

SEQ ID NO: 672833 - RNA, 20 nt, Human
acgauucacugacaaaugaa

SEQ ID NO: 672834 - RNA, 24 nt, Human
acuuuaaaaaaugucaaagauauu

SEQ ID NO: 672835 - RNA, 25 nt, Human
agaaacaaaagaaagcuccgguacc

SEQ ID NO: 672836 - RNA, 24 nt, Human
agauacgaucaaaccaaaaaauua

SEQ ID NO: 672837 - RNA, 22 nt, Human
auaaacauaacaaauuguauuu

SEQ ID NO: 672838 - RNA, 23 nt, Human
caaaccacuuuuuaaaaaaaaac

SEQ ID NO: 672839 - RNA, 23 nt, Human
caaggaagcucccugucggcacc

SEQ ID NO: 672840 - RNA, 19 nt, Human
cuuaaaacaaauauuugga

SEQ ID NO: 672841 - RNA, 22 nt, Human
uaaaaaaaaacuccacauuguc

SEQ ID NO: 672842 - RNA, 21 nt, Human
uccacauugucaaaauuuuuc

SEQ ID NO: 672843 - RNA, 18 nt, Human
aaagaagccgccuugggg

SEQ ID NO: 672844 - RNA, 18 nt, Human
aacaugauggacacaucu

SEQ ID NO: 672845 - RNA, 21 nt, Human
aauaagugauucuaaugcugc

SEQ ID NO: 672846 - RNA, 18 nt, Human
aauguaccuggggaaauc

SEQ ID NO: 672847 - RNA, 22 nt, Human
acagcaaagaagccgccuuggg

SEQ ID NO: 672848 - RNA, 19 nt, Human
acuggccucuccagccacg

SEQ ID NO: 672849 - RNA, 26 nt, Human
agcacuucccucccacaguugguccc

SEQ ID NO: 672850 - RNA, 24 nt, Human
agccagacagaugcgccagccaaa

SEQ ID NO: 672851 - RNA, 18 nt, Human
agcuuaaaugagcuggug

SEQ ID NO: 672852 - RNA, 23 nt, Human
agcuucguccccuucauuuucca

SEQ ID NO: 672853 - RNA, 21 nt, Human
aggaaagaaauaaauaaguga

SEQ ID NO: 672854 - RNA, 23 nt, Human
aggaaagaaauaaauaagugaag

SEQ ID NO: 672855 - RNA, 22 nt, Human
aggcugggacgccgguucccau

SEQ ID NO: 672856 - RNA, 20 nt, Human
aggggaggagccgcggggcc

SEQ ID NO: 672857 - RNA, 21 nt, Human
agggguacagaauugaucaug

SEQ ID NO: 672858 - RNA, 18 nt, Human
augaugcaggagcagccc

SEQ ID NO: 672859 - RNA, 22 nt, Human
auggacacaucuagagcuucgu

SEQ ID NO: 672860 - RNA, 20 nt, Human
cacaucccacacaaagacuc

SEQ ID NO: 672861 - RNA, 21 nt, Human
caccgggucccccaggauugg

SEQ ID NO: 672862 - RNA, 18 nt, Human
cagaguccuccggauugc

SEQ ID NO: 672863 - RNA, 23 nt, Human
cagcccaccaggcaccgccccgg

SEQ ID NO: 672864 - RNA, 21 nt, Human
cagcgcccgcgcccaggugcc

SEQ ID NO: 672865 - RNA, 21 nt, Human
caucagcugcccagaguccuc

SEQ ID NO: 672866 - RNA, 18 nt, Human
ccacacaaagacuccuac

SEQ ID NO: 672867 - RNA, 19 nt, Human
ccagaguccuccggauugc

SEQ ID NO: 672868 - RNA, 20 nt, Human
ccagcccaccaggcaccgcc

SEQ ID NO: 672869 - RNA, 21 nt, Human
ccagcccgugggaaggugacc

SEQ ID NO: 672870 - RNA, 22 nt, Human
ccaugaccucgauggcgccaag

SEQ ID NO: 672871 - RNA, 25 nt, Human
ccccaugaccucgauggcgccaagg

SEQ ID NO: 672872 - RNA, 23 nt, Human
cccccgggaccucggcccggccc

SEQ ID NO: 672873 - RNA, 18 nt, Human
cccgcagagaggggagga

SEQ ID NO: 672874 - RNA, 21 nt, Human
cccucaacccccauuuacugg

SEQ ID NO: 672875 - RNA, 24 nt, Human
cccugggcgccgggaugacccgag

SEQ ID NO: 672876 - RNA, 18 nt, Human
ccgagcccucggauacua

SEQ ID NO: 672877 - RNA, 19 nt, Human
ccgcauggagaacaugaug

SEQ ID NO: 672878 - RNA, 20 nt, Human
ccgcgcccaggugccagccc

SEQ ID NO: 672879 - RNA, 24 nt, Human
ccggauugcagcaguccgucucuu

SEQ ID NO: 672880 - RNA, 22 nt, Human
ccggccccugggccacggcacc

SEQ ID NO: 672881 - RNA, 19 nt, Human
ccuccggauugcagcaguc

SEQ ID NO: 672882 - RNA, 22 nt, Human
ccuucauuuuccacaucccaca

SEQ ID NO: 672883 - RNA, 23 nt, Human
cgccaggucccgccggccggcuc

SEQ ID NO: 672884 - RNA, 21 nt, Human
cgccccgggacgggcccgcaa

SEQ ID NO: 672885 - RNA, 22 nt, Human
cggcgacagcaaagaagccgcc

SEQ ID NO: 672886 - RNA, 21 nt, Human
cgggcccgcaaggcaccgccc

SEQ ID NO: 672887 - RNA, 22 nt, Human
cggggccagcccaccaggcacc

SEQ ID NO: 672888 - RNA, 18 nt, Human
cucggcccggccccuggg

SEQ ID NO: 672889 - RNA, 18 nt, Human
cucggcccggccccuggg

SEQ ID NO: 672890 - RNA, 24 nt, Human
cucggcccggccccugggccacgg

SEQ ID NO: 672891 - RNA, 21 nt, Human
cuggguccccaugaccucgau

SEQ ID NO: 672892 - RNA, 24 nt, Human
cugguguuucaguggagccgggga

SEQ ID NO: 672893 - RNA, 20 nt, Human
cuuaucugcuccgaggcugg

SEQ ID NO: 672894 - RNA, 24 nt, Human
gaguccuccggauugcagcagucc

SEQ ID NO: 672895 - RNA, 21 nt, Human
gaugcaggagcagcccccgga

SEQ ID NO: 672896 - RNA, 28 nt, Human
gcaccgggucccccaggauugggcgcca

SEQ ID NO: 672897 - RNA, 22 nt, Human
gcagguaccucaagcccaugcc

SEQ ID NO: 672898 - RNA, 20 nt, Human
gcauggagaacaugauggac

SEQ ID NO: 672899 - RNA, 22 nt, Human
gcugccuaggucacccucaacc

SEQ ID NO: 672900 - RNA, 21 nt, Human
ggagacguuguuagcuugaaa

SEQ ID NO: 672901 - RNA, 20 nt, Human
ggagccggggagcucuugcu

SEQ ID NO: 672902 - RNA, 21 nt, Human
ggcggcgacagcaaagaagcc

SEQ ID NO: 672903 - RNA, 20 nt, Human
ggcugggcuguuagcacuuc

SEQ ID NO: 672904 - RNA, 18 nt, Human
gggaggcaccugguagcc

SEQ ID NO: 672905 - RNA, 21 nt, Human
gggcgccaggucccgccggcc

SEQ ID NO: 672906 - RNA, 18 nt, Human
gucggcugucuucgggac

SEQ ID NO: 672907 - RNA, 23 nt, Human
uacagaauugaucaugucgauga

SEQ ID NO: 672908 - RNA, 23 nt, Human
uaggaaaccaucagcugcccaga

SEQ ID NO: 672909 - RNA, 22 nt, Human
uaucauguugcuuagggagacg

SEQ ID NO: 672910 - RNA, 19 nt, Human
uccaccacccaguccauuc

SEQ ID NO: 672911 - RNA, 18 nt, Human
uccagacagaagggcuca

SEQ ID NO: 672912 - RNA, 25 nt, Human
uccagacagaagggcucauuccaca

SEQ ID NO: 672913 - RNA, 18 nt, Human
uccccuucauuuuccaca

SEQ ID NO: 672914 - RNA, 18 nt, Human
ucccgccggccggcuccg

SEQ ID NO: 672915 - RNA, 22 nt, Human
uccgucucuuuugggggucggc

SEQ ID NO: 672916 - RNA, 19 nt, Human
uccuggguccccaugaccu

SEQ ID NO: 672917 - RNA, 25 nt, Human
ucugucuuagggguacagaauugau

SEQ ID NO: 672918 - RNA, 19 nt, Human
ugagccagacagaugcgcc

SEQ ID NO: 672919 - RNA, 24 nt, Human
ugagccagacagaugcgccagcca

SEQ ID NO: 672920 - RNA, 25 nt, Human
ugagccagacagaugcgccagccaa

SEQ ID NO: 672921 - RNA, 20 nt, Human
ugauuguccugauggcucag

SEQ ID NO: 672922 - RNA, 18 nt, Human
uggaaggguuggaugaug

SEQ ID NO: 672923 - RNA, 23 nt, Human
uggauccuggguccccaugaccu

SEQ ID NO: 672924 - RNA, 18 nt, Human
uggcucaggguugcagga

SEQ ID NO: 672925 - RNA, 20 nt, Human
ugggcccgcagagaggggag

SEQ ID NO: 672926 - RNA, 26 nt, Human
uggguggagagaagggaagggguaug

SEQ ID NO: 672927 - RNA, 20 nt, Human
uguacccaugugucugucac

SEQ ID NO: 672928 - RNA, 22 nt, Human
uguuagcacuucccucccacag

SEQ ID NO: 672929 - RNA, 19 nt, Human
uucagaggggaaggaggaa

SEQ ID NO: 672930 - RNA, 18 nt, Human
uuccaggguuaagcugcc

SEQ ID NO: 672931 - RNA, 22 nt, Human
uucccuggauccugggucccca

SEQ ID NO: 672932 - RNA, 21 nt, Human
uuuccacaucccacacaaaga

SEQ ID NO: 672933 - RNA, 19 nt, Human
uuuggaaggguuggaugau

SEQ ID NO: 672934 - RNA, 24 nt, Human
aaggcgccacagggggccaucagg

SEQ ID NO: 672935 - RNA, 21 nt, Human
agacugagcccccgaccuggc

SEQ ID NO: 672936 - RNA, 22 nt, Human
agcccccgaccuggcccagccu

SEQ ID NO: 672937 - RNA, 24 nt, Human
agcuggcgcaggccggcaggggag

SEQ ID NO: 672938 - RNA, 23 nt, Human
aggcuagcccaguccaggagugu

SEQ ID NO: 672939 - RNA, 21 nt, Human
cacaggcuagcccagcacacu

SEQ ID NO: 672940 - RNA, 24 nt, Human
caccagggaggacagcugcuggca

SEQ ID NO: 672941 - RNA, 19 nt, Human
cacuagcuugggggugggc

SEQ ID NO: 672942 - RNA, 20 nt, Human
cagagcaucuuacgggcggc

SEQ ID NO: 672943 - RNA, 22 nt, Human
cagccucagaccccucagcagc

SEQ ID NO: 672944 - RNA, 30 nt, Human
cagccuggcuugggucgagcucugucacaa

SEQ ID NO: 672945 - RNA, 20 nt, Human
cagcugcuggcagggacuaa

SEQ ID NO: 672946 - RNA, 21 nt, Human
cagggggccaucagguccagc

SEQ ID NO: 672947 - RNA, 22 nt, Human
cagugggcuggccaggccaccu

SEQ ID NO: 672948 - RNA, 20 nt, Human
cccccgaccuggcccagccu

SEQ ID NO: 672949 - RNA, 18 nt, Human
cccucggccgacuuuccc

SEQ ID NO: 672950 - RNA, 21 nt, Human
cccucggccgacuuucccagg

SEQ ID NO: 672951 - RNA, 18 nt, Human
cccugaaacgcgggcagg

SEQ ID NO: 672952 - RNA, 23 nt, Human
ccucagcagcuuugggcccucgg

SEQ ID NO: 672953 - RNA, 20 nt, Human
ccucccagacugagcccccg

SEQ ID NO: 672954 - RNA, 21 nt, Human
ccuggcccguccccaauccag

SEQ ID NO: 672955 - RNA, 24 nt, Human
cggcaggggagggucugcucugac

SEQ ID NO: 672956 - RNA, 18 nt, Human
cggccgacuuucccaggc

SEQ ID NO: 672957 - RNA, 19 nt, Human
cuggcccagccuggcccgu

SEQ ID NO: 672958 - RNA, 25 nt, Human
gagccgggccagguuguccgaggaa

SEQ ID NO: 672959 - RNA, 22 nt, Human
gcacuagcuugggggugggcac

SEQ ID NO: 672960 - RNA, 24 nt, Human
gcagucccgaggggucacaggcua

SEQ ID NO: 672961 - RNA, 19 nt, Human
ggccaggcagacaacagcc

SEQ ID NO: 672962 - RNA, 21 nt, Human
gguccagcuggcgcaggccgg

SEQ ID NO: 672963 - RNA, 19 nt, Human
ucacaggcuagcccagcac

SEQ ID NO: 672964 - RNA, 23 nt, Human
ucacaggcuagcccagcacacug

SEQ ID NO: 672965 - RNA, 18 nt, Human
ucagaccccucagcagcu

SEQ ID NO: 672966 - RNA, 22 nt, Human
ucagaccccucagcagcuuugg

SEQ ID NO: 672967 - RNA, 20 nt, Human
uccacacaccagagccgggc

SEQ ID NO: 672968 - RNA, 22 nt, Human
uccagcugccaccaccugcacc

SEQ ID NO: 672969 - RNA, 18 nt, Human
ucccagggcagccuggcc

SEQ ID NO: 672970 - RNA, 21 nt, Human
ucccuccagcugccaccaccu

SEQ ID NO: 672971 - RNA, 21 nt, Human
ucuauggaccgaggcccugaa

SEQ ID NO: 672972 - RNA, 23 nt, Human
ucuauggaccgaggcccugaaac

SEQ ID NO: 672973 - RNA, 19 nt, Human
ucuccagucuccacacacc

SEQ ID NO: 672974 - RNA, 23 nt, Human
ucuugaucucuccagucuccaca

SEQ ID NO: 672975 - RNA, 18 nt, Human
ugaccugggugcugcaug

SEQ ID NO: 672976 - RNA, 21 nt, Human
ugagcccccgaccuggcccag

SEQ ID NO: 672977 - RNA, 24 nt, Human
ugagcccccgaccuggcccagccu

SEQ ID NO: 672978 - RNA, 22 nt, Human
ugcaugggucccuccagcugcc

SEQ ID NO: 672979 - RNA, 24 nt, Human
uggccaggccaccugcaccaggga

SEQ ID NO: 672980 - RNA, 20 nt, Human
uggccaugguggugguguuc

SEQ ID NO: 672981 - RNA, 18 nt, Human
uggcccagccuggcccgu

SEQ ID NO: 672982 - RNA, 19 nt, Human
uggcuugggucgagcucug

SEQ ID NO: 672983 - RNA, 25 nt, Human
uggcuugggucgagcucugucacaa

SEQ ID NO: 672984 - RNA, 22 nt, Human
ugggcccucggccgacuuuccc

SEQ ID NO: 672985 - RNA, 21 nt, Human
ugguggccgccauacucucuc

SEQ ID NO: 672986 - RNA, 18 nt, Human
ugguggugguguucucua

SEQ ID NO: 672987 - RNA, 19 nt, Human
uuguccgaggaagcuggag

SEQ ID NO: 672988 - RNA, 21 nt, Human
uuuuuuuuuuuuuuuucccga

SEQ ID NO: 672989 - RNA, 26 nt, Human
uuuuuuuuuuuuuuuuuuugguuuuu

SEQ ID NO: 672990 - RNA, 28 nt, Human
uuuuuuuuuuuuuuuuuuuuuuuggggg

SEQ ID NO: 672991 - RNA, 24 nt, Human
aacaaaaaugcaugcaucaugauu

SEQ ID NO: 672992 - RNA, 23 nt, Human
aguccuuuuccuccucucuuuuc

SEQ ID NO: 672993 - RNA, 18 nt, Human
ccagguguuguuccccag

SEQ ID NO: 672994 - RNA, 25 nt, Human
cgaguccuuuuccuccucucuuuuc

SEQ ID NO: 672995 - RNA, 25 nt, Human
cuccucuuuuuuucucucacgguaa

SEQ ID NO: 672996 - RNA, 19 nt, Human
cucucuuuucuuccgaguu

SEQ ID NO: 672997 - RNA, 18 nt, Human
cugcacugcuuucuccuc

SEQ ID NO: 672998 - RNA, 32 nt, Human
gcugcacugcuuucuccucuuuuuuucucccc

SEQ ID NO: 672999 - RNA, 21 nt, Human
ggacaggcaaauuuugcuccu

SEQ ID NO: 673000 - RNA, 21 nt, Human
ggggagagggagcuggacagg

SEQ ID NO: 673001 - RNA, 19 nt, Human
uccaaugugaaagucgagu

SEQ ID NO: 673002 - RNA, 23 nt, Human
uccccagaucagagagccuuagc

SEQ ID NO: 673003 - RNA, 21 nt, Human
uggcaguuguuugacacucug

SEQ ID NO: 673004 - RNA, 21 nt, Human
uggggagagggagcuggacag

SEQ ID NO: 673005 - RNA, 22 nt, Human
uuccuccucucuuuucuuccga

SEQ ID NO: 673006 - RNA, 22 nt, Human
uucuccucuuuuuuucucucaa

SEQ ID NO: 673007 - RNA, 20 nt, Human
uuggcugcacugcuuucucc

SEQ ID NO: 673008 - RNA, 18 nt, Human
uuuccuccucucuuuucu

SEQ ID NO: 673009 - RNA, 21 nt, Human
uuucuuccgaguuuggcugca

SEQ ID NO: 673010 - RNA, 22 nt, Human
uuuuccuccucucuuuucuucc

SEQ ID NO: 673011 - RNA, 21 nt, Human
aaaaaacacccagaaccucau

SEQ ID NO: 673012 - RNA, 21 nt, Human
aaaaccuccaucucaccuucc

SEQ ID NO: 673013 - RNA, 18 nt, Human
aacacccagaaccucaug

SEQ ID NO: 673014 - RNA, 22 nt, Human
aacugaaugcugcaacaaccac

SEQ ID NO: 673015 - RNA, 19 nt, Human
aagaaccccagaccgagcc

SEQ ID NO: 673016 - RNA, 24 nt, Human
aagccccuccacgcccauggugcc

SEQ ID NO: 673017 - RNA, 20 nt, Human
aagcuacugccaggacagga

SEQ ID NO: 673018 - RNA, 20 nt, Human
aagggggccaccuccggcuc

SEQ ID NO: 673019 - RNA, 20 nt, Human
aaucucucucucucucucac

SEQ ID NO: 673020 - RNA, 21 nt, Human
acaaacaugcuuguaccaaau

SEQ ID NO: 673021 - RNA, 18 nt, Human
acaaagauucacacagac

SEQ ID NO: 673022 - RNA, 24 nt, Human
acaaagggcagcuuccagccaaca

SEQ ID NO: 673023 - RNA, 23 nt, Human
acacacagguaucuacaacuacc

SEQ ID NO: 673024 - RNA, 26 nt, Human
acacucacacgaacacagaggaaaac

SEQ ID NO: 673025 - RNA, 22 nt, Human
acagaacaaagggcagcuucca

SEQ ID NO: 673026 - RNA, 19 nt, Human
acagaacaggaggguggag

SEQ ID NO: 673027 - RNA, 18 nt, Human
acagacugccacaaaaac

SEQ ID NO: 673028 - RNA, 24 nt, Human
acagaggagagaggugcgucugga

SEQ ID NO: 673029 - RNA, 24 nt, Human
acagccagcgaggaacugaggccu

SEQ ID NO: 673030 - RNA, 20 nt, Human
accaaauaggagaaaaaaga

SEQ ID NO: 673031 - RNA, 18 nt, Human
acccaauaagaccaaaac

SEQ ID NO: 673032 - RNA, 26 nt, Human
acccuguggggucacacgaguguggu

SEQ ID NO: 673033 - RNA, 18 nt, Human
acgggccccacaccccac

SEQ ID NO: 673034 - RNA, 22 nt, Human
acgggccgggugggcuugggug

SEQ ID NO: 673035 - RNA, 23 nt, Human
agaaaaaagaaaaaaauaucuga

SEQ ID NO: 673036 - RNA, 18 nt, Human
agacacaaugccagcucu

SEQ ID NO: 673037 - RNA, 24 nt, Human
agacucucucaaaaaacacccaga

SEQ ID NO: 673038 - RNA, 28 nt, Human
agacugccacaaaaacauaucaccccag

SEQ ID NO: 673039 - RNA, 18 nt, Human
agagagcaggggaggaag

SEQ ID NO: 673040 - RNA, 20 nt, Human
agaggaggaggccgaggagg

SEQ ID NO: 673041 - RNA, 22 nt, Human
agaggaggaggccgaggagggu

SEQ ID NO: 673042 - RNA, 18 nt, Human
agaugcccucucucccca

SEQ ID NO: 673043 - RNA, 21 nt, Human
agaugcccucucuccccaggg

SEQ ID NO: 673044 - RNA, 19 nt, Human
agcaggggaggaagaaaag

SEQ ID NO: 673045 - RNA, 19 nt, Human
agccugggcccgcuggucc

SEQ ID NO: 673046 - RNA, 21 nt, Human
agcggaggggggggcgguggc

SEQ ID NO: 673047 - RNA, 19 nt, Human
agcugcaagaaccccagac

SEQ ID NO: 673048 - RNA, 21 nt, Human
aggaagacuaugucuagagcg

SEQ ID NO: 673049 - RNA, 21 nt, Human
aggaaggaugagagaagagga

SEQ ID NO: 673050 - RNA, 21 nt, Human
aggaaggaugagagaagagga

SEQ ID NO: 673051 - RNA, 23 nt, Human
aggaaggaugagagaagaggagg

SEQ ID NO: 673052 - RNA, 18 nt, Human
aggaggaggccgaggagg

SEQ ID NO: 673053 - RNA, 18 nt, Human
aggagugggcacagauca

SEQ ID NO: 673054 - RNA, 23 nt, Human
aggcagcgggggucagugggggu

SEQ ID NO: 673055 - RNA, 24 nt, Human
aggcaggaugggccagcagccagg

SEQ ID NO: 673056 - RNA, 22 nt, Human
aggccgaggagggugucggugu

SEQ ID NO: 673057 - RNA, 18 nt, Human
aggcuacacagaccccac

SEQ ID NO: 673058 - RNA, 21 nt, Human
aggggggggcgguggccucgg

SEQ ID NO: 673059 - RNA, 21 nt, Human
aggugggagaggccuggaggu

SEQ ID NO: 673060 - RNA, 23 nt, Human
aguagcugacugauacagauuug

SEQ ID NO: 673061 - RNA, 24 nt, Human
agucacccauccgcgcaccccagg

SEQ ID NO: 673062 - RNA, 18 nt, Human
aucccaaguagaggaccc

SEQ ID NO: 673063 - RNA, 21 nt, Human
auccgcgcaccccagguugca

SEQ ID NO: 673064 - RNA, 20 nt, Human
auggaaacggggaaacgcag

SEQ ID NO: 673065 - RNA, 24 nt, Human
auuuucaacuccccccucccccag

SEQ ID NO: 673066 - RNA, 22 nt, Human
caaaaaacacccagaaccucag

SEQ ID NO: 673067 - RNA, 25 nt, Human
caaauacaccauuccauagccacuu

SEQ ID NO: 673068 - RNA, 20 nt, Human
caacacacacgcacgugugc

SEQ ID NO: 673069 - RNA, 26 nt, Human
caacagcaaggaacugaaugcugcaa

SEQ ID NO: 673070 - RNA, 18 nt, Human
caacagccagcgaggaac

SEQ ID NO: 673071 - RNA, 26 nt, Human
caacuacccaccucucuguauacccc

SEQ ID NO: 673072 - RNA, 21 nt, Human
caaucaggacaaacauauuua

SEQ ID NO: 673073 - RNA, 23 nt, Human
cacaaaaacauaucaccccagac

SEQ ID NO: 673074 - RNA, 22 nt, Human
cacacacagacugccacaaaaa

SEQ ID NO: 673075 - RNA, 24 nt, Human
cacacagacaccucacacauaucc

SEQ ID NO: 673076 - RNA, 21 nt, Human
caccccagacagacacacaca

SEQ ID NO: 673077 - RNA, 23 nt, Human
caccccagacagacacacacagg

SEQ ID NO: 673078 - RNA, 22 nt, Human
cacguugcuuccucacacccaa

SEQ ID NO: 673079 - RNA, 20 nt, Human
cacugcugcaggcccugugg

SEQ ID NO: 673080 - RNA, 19 nt, Human
cagaacaaagggcagcuuc

SEQ ID NO: 673081 - RNA, 22 nt, Human
cagaacaaagggcagcuuccag

SEQ ID NO: 673082 - RNA, 24 nt, Human
cagaaucuaugagauaauaagcau

SEQ ID NO: 673083 - RNA, 18 nt, Human
cagacacacacagguaua

SEQ ID NO: 673084 - RNA, 22 nt, Human
cagacacacacagguauacacg

SEQ ID NO: 673085 - RNA, 26 nt, Human
cagacaccucacacauauccagucuu

SEQ ID NO: 673086 - RNA, 18 nt, Human
cagcaccagggaugccca

SEQ ID NO: 673087 - RNA, 18 nt, Human
cagccaggacaggcucgg

SEQ ID NO: 673088 - RNA, 20 nt, Human
cagccuccugagaucccaag

SEQ ID NO: 673089 - RNA, 19 nt, Human
cagcgaggaacugaggccu

SEQ ID NO: 673090 - RNA, 18 nt, Human
cagcggggcaguugugcu

SEQ ID NO: 673091 - RNA, 18 nt, Human
caggacaagggggccacc

SEQ ID NO: 673092 - RNA, 21 nt, Human
cauacaggcacaaagauucac

SEQ ID NO: 673093 - RNA, 21 nt, Human
cauaucacccacuccccaaaa

SEQ ID NO: 673094 - RNA, 20 nt, Human
caucccacgggccccacacc

SEQ ID NO: 673095 - RNA, 21 nt, Human
ccacgcccauggugccucucc

SEQ ID NO: 673096 - RNA, 18 nt, Human
ccagcagccaggacaggc

SEQ ID NO: 673097 - RNA, 23 nt, Human
ccaggacaggagaggaggcaaca

SEQ ID NO: 673098 - RNA, 22 nt, Human
ccauaucacccacuccccaaaa

SEQ ID NO: 673099 - RNA, 21 nt, Human
ccaucccacgggccccacacc

SEQ ID NO: 673100 - RNA, 23 nt, Human
ccaucccacgggccccacacccc

SEQ ID NO: 673101 - RNA, 27 nt, Human
cccacagaaucuaugagauaauaagca

SEQ ID NO: 673102 - RNA, 22 nt, Human
cccacgaugggggagugggggc

SEQ ID NO: 673103 - RNA, 21 nt, Human
cccacuccccaaaauauaguc

SEQ ID NO: 673104 - RNA, 18 nt, Human
cccacugugaagacagag

SEQ ID NO: 673105 - RNA, 19 nt, Human
cccagacagacacacacag

SEQ ID NO: 673106 - RNA, 24 nt, Human
cccagcaccagggaugcccaggca

SEQ ID NO: 673107 - RNA, 18 nt, Human
cccagccccacucucucc

SEQ ID NO: 673108 - RNA, 23 nt, Human
cccagcccugccucggggugggc

SEQ ID NO: 673109 - RNA, 18 nt, Human
cccagggaaagagaugga

SEQ ID NO: 673110 - RNA, 21 nt, Human
ccccagaccgagccugggccc

SEQ ID NO: 673111 - RNA, 23 nt, Human
ccccagaccgagccugggcccgc

SEQ ID NO: 673112 - RNA, 19 nt, Human
ccccagcaccagggaugcc

SEQ ID NO: 673113 - RNA, 22 nt, Human
cccccucccccagaaggucaca

SEQ ID NO: 673114 - RNA, 20 nt, Human
cccggguacccccuccugag

SEQ ID NO: 673115 - RNA, 25 nt, Human
cccucaaucaggacaaaccgggguc

SEQ ID NO: 673116 - RNA, 24 nt, Human
cccugagaaagggccgcagacccc

SEQ ID NO: 673117 - RNA, 25 nt, Human
cccugcucucuggggcacagguggu

SEQ ID NO: 673118 - RNA, 19 nt, Human
ccgcggccgcugcuccugc

SEQ ID NO: 673119 - RNA, 19 nt, Human
ccgggggugggauucgggg

SEQ ID NO: 673120 - RNA, 18 nt, Human
cgaaggcuacacagaccc

SEQ ID NO: 673121 - RNA, 21 nt, Human
cgaggaacugaggccuucagu

SEQ ID NO: 673122 - RNA, 27 nt, Human
cgcacacacacacguugcuuccucaca

SEQ ID NO: 673123 - RNA, 18 nt, Human
cggcgccgcggccgcugc

SEQ ID NO: 673124 - RNA, 18 nt, Human
cggcgccgcggccgcugc

SEQ ID NO: 673125 - RNA, 19 nt, Human
cggcgccgcggccgcugcu

SEQ ID NO: 673126 - RNA, 22 nt, Human
cggggccgggagggcuggugcc

SEQ ID NO: 673127 - RNA, 27 nt, Human
cgugcgcacacacacacguugcuuccu

SEQ ID NO: 673128 - RNA, 21 nt, Human
cuacagagacacaugugugca

SEQ ID NO: 673129 - RNA, 20 nt, Human
cucaaucaggacaaacauau

SEQ ID NO: 673130 - RNA, 23 nt, Human
cuccacgcccauggugccucucc

SEQ ID NO: 673131 - RNA, 23 nt, Human
cuccaggacgccaccuucccggg

SEQ ID NO: 673132 - RNA, 18 nt, Human
cuccugagcaccccaggu

SEQ ID NO: 673133 - RNA, 21 nt, Human
cuccugagcaccccagguccc

SEQ ID NO: 673134 - RNA, 23 nt, Human
cuccugagcaccccaggucccca

SEQ ID NO: 673135 - RNA, 24 nt, Human
cucucucucucucacugcacaaaa

SEQ ID NO: 673136 - RNA, 18 nt, Human
cugcuccugcccgcuccg

SEQ ID NO: 673137 - RNA, 18 nt, Human
cugcuggugggcccuggg

SEQ ID NO: 673138 - RNA, 19 nt, Human
gaagccccuccacgcccau

SEQ ID NO: 673139 - RNA, 26 nt, Human
gaagccccuccacgcccauggugccu

SEQ ID NO: 673140 - RNA, 22 nt, Human
gacccagccaaccugcacccag

SEQ ID NO: 673141 - RNA, 19 nt, Human
gacccagcucugcucagac

SEQ ID NO: 673142 - RNA, 20 nt, Human
gagaagaggaggaggccgag

SEQ ID NO: 673143 - RNA, 20 nt, Human
gagcaggggaggaagaaaag

SEQ ID NO: 673144 - RNA, 27 nt, Human
gaggagggugucgguguugggggaggg

SEQ ID NO: 673145 - RNA, 20 nt, Human
gaggcccaucccacgggccc

SEQ ID NO: 673146 - RNA, 18 nt, Human
gcaccuucagaacccaga

SEQ ID NO: 673147 - RNA, 18 nt, Human
gcacugcugcaggcccug

SEQ ID NO: 673148 - RNA, 18 nt, Human
gcaggggcagcggagggg

SEQ ID NO: 673149 - RNA, 19 nt, Human
gcaggggcagcggaggggg

SEQ ID NO: 673150 - RNA, 24 nt, Human
gcccucggauccugcuggugcugg

SEQ ID NO: 673151 - RNA, 20 nt, Human
gcccugggccagcccaaguu

SEQ ID NO: 673152 - RNA, 24 nt, Human
gcgguggccucgguuuccccagcc

SEQ ID NO: 673153 - RNA, 22 nt, Human
gcgugcgcacacacacacguug

SEQ ID NO: 673154 - RNA, 22 nt, Human
gcuuccucacacccaauaagac

SEQ ID NO: 673155 - RNA, 18 nt, Human
ggaggggggggcgguggc

SEQ ID NO: 673156 - RNA, 24 nt, Human
ggaggguacagacagaacaggagg

SEQ ID NO: 673157 - RNA, 22 nt, Human
ggcagcggaggggggggcggug

SEQ ID NO: 673158 - RNA, 19 nt, Human
ggcaggaugggccagcagc

SEQ ID NO: 673159 - RNA, 18 nt, Human
ggccggggccgggagggc

SEQ ID NO: 673160 - RNA, 18 nt, Human
ggccugaggugggagagg

SEQ ID NO: 673161 - RNA, 21 nt, Human
ggcgugcgcacacacacacgg

SEQ ID NO: 673162 - RNA, 20 nt, Human
ggcucggguccccuccuauu

SEQ ID NO: 673163 - RNA, 19 nt, Human
gggcacugcugcaggcccu

SEQ ID NO: 673164 - RNA, 19 nt, Human
gggcagcggaggggggggc

SEQ ID NO: 673165 - RNA, 24 nt, Human
gggcagcggaggggggggcggugg

SEQ ID NO: 673166 - RNA, 19 nt, Human
gggcagggccugagguggg

SEQ ID NO: 673167 - RNA, 20 nt, Human
gggcagggccugagguggga

SEQ ID NO: 673168 - RNA, 26 nt, Human
gggcaggggcagcggaggggggggcg

SEQ ID NO: 673169 - RNA, 20 nt, Human
gggcggcgugcaggcgggcg

SEQ ID NO: 673170 - RNA, 18 nt, Human
ggggagagggggcagggg

SEQ ID NO: 673171 - RNA, 19 nt, Human
ggggaggaagugggugggg

SEQ ID NO: 673172 - RNA, 22 nt, Human
ggggcuggcaggggcacugcug

SEQ ID NO: 673173 - RNA, 18 nt, Human
gguggagagagagcaggg

SEQ ID NO: 673174 - RNA, 20 nt, Human
gguggagagagagcagggga

SEQ ID NO: 673175 - RNA, 21 nt, Human
ggugggcuuggguguauguua

SEQ ID NO: 673176 - RNA, 20 nt, Human
ggugguggggaggaaguggg

SEQ ID NO: 673177 - RNA, 23 nt, Human
ggugguggggaggaagugggugg

SEQ ID NO: 673178 - RNA, 19 nt, Human
gugcuggcucccaucggcu

SEQ ID NO: 673179 - RNA, 18 nt, Human
guggauguggcugguccc

SEQ ID NO: 673180 - RNA, 21 nt, Human
gugguggggaggaagugggug

SEQ ID NO: 673181 - RNA, 24 nt, Human
guguuguuucugguugcuacauuu

SEQ ID NO: 673182 - RNA, 18 nt, Human
guugcuacauuugugguc

SEQ ID NO: 673183 - RNA, 22 nt, Human
uaaacauuuguugaguaaacac

SEQ ID NO: 673184 - RNA, 26 nt, Human
uacaacuacccaccucucuguauacc

SEQ ID NO: 673185 - RNA, 21 nt, Human
uacacgcagaugcacuuagau

SEQ ID NO: 673186 - RNA, 22 nt, Human
uacagagacacaugugugcaau

SEQ ID NO: 673187 - RNA, 25 nt, Human
uacccccuccugagcaccccagguc

SEQ ID NO: 673188 - RNA, 20 nt, Human
uacccuacaccacuauuaca

SEQ ID NO: 673189 - RNA, 21 nt, Human
uacccuacaccacuauuacac

SEQ ID NO: 673190 - RNA, 25 nt, Human
uaccucuggccggggccccggguac

SEQ ID NO: 673191 - RNA, 23 nt, Human
uagaguggaacacagaucguguc

SEQ ID NO: 673192 - RNA, 22 nt, Human
ucaacuccccccucccccagaa

SEQ ID NO: 673193 - RNA, 19 nt, Human
ucacacccaauaagaccaa

SEQ ID NO: 673194 - RNA, 23 nt, Human
ucacagcaagcauggccuggcac

SEQ ID NO: 673195 - RNA, 18 nt, Human
ucaccccagacagacaca

SEQ ID NO: 673196 - RNA, 18 nt, Human
ucacucagacucucucaa

SEQ ID NO: 673197 - RNA, 23 nt, Human
ucagacacgagcaaucuguuacc

SEQ ID NO: 673198 - RNA, 23 nt, Human
ucccaucggcuguccccccacgg

SEQ ID NO: 673199 - RNA, 24 nt, Human
uccccaaaauauagucaugcucau

SEQ ID NO: 673200 - RNA, 23 nt, Human
uccccagggucgggcagggccug

SEQ ID NO: 673201 - RNA, 20 nt, Human
uccccccucccccagaaggu

SEQ ID NO: 673202 - RNA, 20 nt, Human
uccccgcggcgggugggcgg

SEQ ID NO: 673203 - RNA, 21 nt, Human
ucccgggcaggcccugcucuc

SEQ ID NO: 673204 - RNA, 21 nt, Human
ucccucucucugagugugucc

SEQ ID NO: 673205 - RNA, 27 nt, Human
ucccugagaaagggccgcagaccccug

SEQ ID NO: 673206 - RNA, 20 nt, Human
ucccugcggcgccgcggccg

SEQ ID NO: 673207 - RNA, 26 nt, Human
ucccugcggcgccgcggccgcugcuc

SEQ ID NO: 673208 - RNA, 19 nt, Human
uccggcaccuucagaaccc

SEQ ID NO: 673209 - RNA, 25 nt, Human
ucucucaaaaaacacccagaaccuc

SEQ ID NO: 673210 - RNA, 22 nt, Human
ucucucucucucacugcacaaa

SEQ ID NO: 673211 - RNA, 20 nt, Human
ucugucuugguggaagaggc

SEQ ID NO: 673212 - RNA, 19 nt, Human
ucuugccagcuccccaucc

SEQ ID NO: 673213 - RNA, 21 nt, Human
ugagagaagaggaggaggccg

SEQ ID NO: 673214 - RNA, 25 nt, Human
ugagagaagaggaggaggccgagga

SEQ ID NO: 673215 - RNA, 18 nt, Human
ugagcaccccaggucccc

SEQ ID NO: 673216 - RNA, 23 nt, Human
ugaggugggagaggccuggaggu

SEQ ID NO: 673217 - RNA, 22 nt, Human
ugcaagaaccccagaccgagcc

SEQ ID NO: 673218 - RNA, 18 nt, Human
ugccucggggugggcagg

SEQ ID NO: 673219 - RNA, 19 nt, Human
ugccugguggccugaggcc

SEQ ID NO: 673220 - RNA, 20 nt, Human
ugcggggggagagggggcag

SEQ ID NO: 673221 - RNA, 18 nt, Human
ugcugcaggcccuguggu

SEQ ID NO: 673222 - RNA, 23 nt, Human
uggaaccggaggagugggcacag

SEQ ID NO: 673223 - RNA, 19 nt, Human
uggaagaggcgggucccgg

SEQ ID NO: 673224 - RNA, 21 nt, Human
uggagagagagcaggggagga

SEQ ID NO: 673225 - RNA, 22 nt, Human
uggccugaggcccaucccacgg

SEQ ID NO: 673226 - RNA, 23 nt, Human
uggccuggcacaguccccagcac

SEQ ID NO: 673227 - RNA, 21 nt, Human
ugggcaggggcagcggagggg

SEQ ID NO: 673228 - RNA, 25 nt, Human
ugggcaggggcagcggagggggggg

SEQ ID NO: 673229 - RNA, 22 nt, Human
ugggggagugggggcacccaca

SEQ ID NO: 673230 - RNA, 20 nt, Human
ugggggcacccacaugcggg

SEQ ID NO: 673231 - RNA, 20 nt, Human
uggggucacacgaguguggu

SEQ ID NO: 673232 - RNA, 23 nt, Human
uggugccagcugcaagaacccca

SEQ ID NO: 673233 - RNA, 22 nt, Human
ugguggccugaggcccauccca

SEQ ID NO: 673234 - RNA, 20 nt, Human
ugugaagacagaggagagag

SEQ ID NO: 673235 - RNA, 23 nt, Human
uguggagagacccacaugguaca

SEQ ID NO: 673236 - RNA, 19 nt, Human
uguggcuggucccgggggu

SEQ ID NO: 673237 - RNA, 22 nt, Human
uguugaguaaacacucacacga

SEQ ID NO: 673238 - RNA, 22 nt, Human
uucacacagacaccucacacau

SEQ ID NO: 673239 - RNA, 25 nt, Human
uuccguguauguuggacacaacccu

SEQ ID NO: 673240 - RNA, 21 nt, Human
uugaguaaacacucacacgaa

SEQ ID NO: 673241 - RNA, 26 nt, Human
uugccagcuccccauccuguuuuccc

SEQ ID NO: 673242 - RNA, 19 nt, Human
uuguuucugguugcuacau

SEQ ID NO: 673243 - RNA, 31 nt, Human
aaacacucaaaacauuuuccauuggaaacag

SEQ ID NO: 673244 - RNA, 22 nt, Human
aaaguccguuuacugcagggaa

SEQ ID NO: 673245 - RNA, 18 nt, Human
aagcugcaacguacaugg

SEQ ID NO: 673246 - RNA, 20 nt, Human
acuauucaagaaauucucca

SEQ ID NO: 673247 - RNA, 26 nt, Human
aggaagaggcgaaggaggagggaccc

SEQ ID NO: 673248 - RNA, 25 nt, Human
aggcgaaggaggaggcggaggaaga

SEQ ID NO: 673249 - RNA, 18 nt, Human
augcagaugugaauggaa

SEQ ID NO: 673250 - RNA, 20 nt, Human
auuugggagcauaauugcuc

SEQ ID NO: 673251 - RNA, 18 nt, Human
cagggaaucauuucacaa

SEQ ID NO: 673252 - RNA, 18 nt, Human
ccaaaccggguuuagaga

SEQ ID NO: 673253 - RNA, 21 nt, Human
cccggaucaccuugucaggag

SEQ ID NO: 673254 - RNA, 21 nt, Human
cgcccugggguugggauuagg

SEQ ID NO: 673255 - RNA, 23 nt, Human
cuggaguggcggcggcggaagcc

SEQ ID NO: 673256 - RNA, 24 nt, Human
gaaaaguccguuuacugcagggaa

SEQ ID NO: 673257 - RNA, 20 nt, Human
gagaaaacggaaauaaauaa

SEQ ID NO: 673258 - RNA, 24 nt, Human
gaggaagaggcgagggcgcgagag

SEQ ID NO: 673259 - RNA, 21 nt, Human
gaggcaggaagaggcgaagga

SEQ ID NO: 673260 - RNA, 21 nt, Human
gcccggaucaccuugucagga

SEQ ID NO: 673261 - RNA, 20 nt, Human
ggaaauaaauaagaaaacgc

SEQ ID NO: 673262 - RNA, 19 nt, Human
ggaggaagaggcgagggcg

SEQ ID NO: 673263 - RNA, 20 nt, Human
gggaggaggcaggaagaggc

SEQ ID NO: 673264 - RNA, 21 nt, Human
gggguugggauuaggcuggag

SEQ ID NO: 673265 - RNA, 18 nt, Human
gguugggauuaggcugga

SEQ ID NO: 673266 - RNA, 23 nt, Human
guuuagagaacaaaacuauucaa

SEQ ID NO: 673267 - RNA, 20 nt, Human
uaaacugaacaauaaacacu

SEQ ID NO: 673268 - RNA, 19 nt, Human
uaagaaaacgcuucgcccu

SEQ ID NO: 673269 - RNA, 21 nt, Human
ucuccacguauuuagguucau

SEQ ID NO: 673270 - RNA, 22 nt, Human
uguaaucaugcagaugugaaug

SEQ ID NO: 673271 - RNA, 20 nt, Human
uguaguggcgagaaaacgga

SEQ ID NO: 673272 - RNA, 23 nt, Human
uuuuuuauuguuaagcugcaacu

SEQ ID NO: 673273 - RNA, 18 nt, Human
accuccuuugacccugug

SEQ ID NO: 673274 - RNA, 23 nt, Human
agcccucagcacaggucacgucc

SEQ ID NO: 673275 - RNA, 21 nt, Human
aucgaaaaccuccuuugaccc

SEQ ID NO: 673276 - RNA, 23 nt, Human
caguaggcggaccuuggcucuuc

SEQ ID NO: 673277 - RNA, 22 nt, Human
uaggcggaccuuggcucuucuc

SEQ ID NO: 673278 - RNA, 21 nt, Human
uggcaguaggcggaccuuggc

SEQ ID NO: 673279 - RNA, 22 nt, Human
uggucugggcugaucgaaaacc

SEQ ID NO: 673280 - RNA, 18 nt, Human
aagcaggagggcagcugg

SEQ ID NO: 673281 - RNA, 21 nt, Human
acgcgccagggccgcuggagu

SEQ ID NO: 673282 - RNA, 19 nt, Human
agacggugaggcaggagcu

SEQ ID NO: 673283 - RNA, 22 nt, Human
agcaaggcagacggugaggcag

SEQ ID NO: 673284 - RNA, 23 nt, Human
agcuuggaggucagggcccacag

SEQ ID NO: 673285 - RNA, 19 nt, Human
aggcagacggugaggcagg

SEQ ID NO: 673286 - RNA, 22 nt, Human
aggcagacggugaggcaggagc

SEQ ID NO: 673287 - RNA, 19 nt, Human
aggcaggagcuuggagguc

SEQ ID NO: 673288 - RNA, 22 nt, Human
aggcaggagcuuggaggucagg

SEQ ID NO: 673289 - RNA, 22 nt, Human
cagcagccccuccacaggggug

SEQ ID NO: 673290 - RNA, 19 nt, Human
cagccacucaucacagccc

SEQ ID NO: 673291 - RNA, 18 nt, Human
caggcccgaagcaggagg

SEQ ID NO: 673292 - RNA, 22 nt, Human
caggcccgaagcaggagggcag

SEQ ID NO: 673293 - RNA, 19 nt, Human
ccacagcagccccuccaca

SEQ ID NO: 673294 - RNA, 19 nt, Human
ccagcuccggcccggggca

SEQ ID NO: 673295 - RNA, 23 nt, Human
ccauggcggugaugauuugggaa

SEQ ID NO: 673296 - RNA, 19 nt, Human
cccauggcggugaugauuu

SEQ ID NO: 673297 - RNA, 24 nt, Human
cccgucugcaaaucagcaugagaa

SEQ ID NO: 673298 - RNA, 21 nt, Human
cccucggcccaggcccgaagc

SEQ ID NO: 673299 - RNA, 18 nt, Human
cccuuuggggcugggccc

SEQ ID NO: 673300 - RNA, 19 nt, Human
ccgcuggagugcccagcuc

SEQ ID NO: 673301 - RNA, 19 nt, Human
ccgucugcaaaucagcaug

SEQ ID NO: 673302 - RNA, 20 nt, Human
cggcccggggcagcugcccg

SEQ ID NO: 673303 - RNA, 23 nt, Human
cggccuggcucccaccgggggcu

SEQ ID NO: 673304 - RNA, 18 nt, Human
cggggcagcugcccgagg

SEQ ID NO: 673305 - RNA, 25 nt, Human
gaacauggccuacacaaggcccucg

SEQ ID NO: 673306 - RNA, 21 nt, Human
gagcaaggcagacggugaggc

SEQ ID NO: 673307 - RNA, 19 nt, Human
gaggucagggcccacagca

SEQ ID NO: 673308 - RNA, 26 nt, Human
gcagccccuccacaggggugcccuuc

SEQ ID NO: 673309 - RNA, 19 nt, Human
gcagcugggagcaccaggg

SEQ ID NO: 673310 - RNA, 23 nt, Human
ggccauucacugcccuuuggggc

SEQ ID NO: 673311 - RNA, 20 nt, Human
gggccgcuggagugcccagc

SEQ ID NO: 673312 - RNA, 19 nt, Human
uccacaggggugccccguc

SEQ ID NO: 673313 - RNA, 20 nt, Human
ugaggcaggagcuuggaggu

SEQ ID NO: 673314 - RNA, 22 nt, Human
ugaggcaggagcuuggagguca

SEQ ID NO: 673315 - RNA, 22 nt, Human
ugcccagcuccggcccggggca

SEQ ID NO: 673316 - RNA, 19 nt, Human
ugcccucucccacugcuug

SEQ ID NO: 673317 - RNA, 21 nt, Human
ugggagcaccagggcaccggg

SEQ ID NO: 673318 - RNA, 18 nt, Human
uucacugcccuuuggggc

SEQ ID NO: 673319 - RNA, 19 nt, Human
uuucagagaaggccauuca

SEQ ID NO: 673320 - RNA, 19 nt, Human
aggggcuggggugcacaua

SEQ ID NO: 673321 - RNA, 22 nt, Human
ccaggagauuguuuucuagggc

SEQ ID NO: 673322 - RNA, 23 nt, Human
cuccccucagaaaugcuugagaa

SEQ ID NO: 673323 - RNA, 21 nt, Human
gaaauucuuucagcccuuccc

SEQ ID NO: 673324 - RNA, 23 nt, Human
gauaaggucaggccagccaaggu

SEQ ID NO: 673325 - RNA, 24 nt, Human
ggagaagcagacagcagcgucgac

SEQ ID NO: 673326 - RNA, 24 nt, Human
uccccauuuuugaggggcuggggu

SEQ ID NO: 673327 - RNA, 27 nt, Human
ucugugguuauguuuuaaaaauuauuu

SEQ ID NO: 673328 - RNA, 24 nt, Human
ugaggggcuggggugcacauagug

SEQ ID NO: 673329 - RNA, 19 nt, Human
uggggugcacauagugaaa

SEQ ID NO: 673330 - RNA, 21 nt, Human
aaaaacuaacaaagcucaacu

SEQ ID NO: 673331 - RNA, 19 nt, Human
aaaaauuuuuuuuuucuuu

SEQ ID NO: 673332 - RNA, 23 nt, Human
aaacuccugguuucaagcagucu

SEQ ID NO: 673333 - RNA, 24 nt, Human
aaagugcugggauuaaagguguga

SEQ ID NO: 673334 - RNA, 24 nt, Human
aagcagucuuccugccuuggcuuc

SEQ ID NO: 673335 - RNA, 25 nt, Human
aagcagucuuccugccuuggcuucc

SEQ ID NO: 673336 - RNA, 18 nt, Human
aagugcugggauuaaagg

SEQ ID NO: 673337 - RNA, 19 nt, Human
aagugcugggauuaaaggu

SEQ ID NO: 673338 - RNA, 26 nt, Human
aagugcugggauuaaaggugugagcc

SEQ ID NO: 673339 - RNA, 21 nt, Human
acacaugaaaaacuaacaaag

SEQ ID NO: 673340 - RNA, 18 nt, Human
acagcucacugcagccuc

SEQ ID NO: 673341 - RNA, 18 nt, Human
acugcagccucaaccucc

SEQ ID NO: 673342 - RNA, 19 nt, Human
acuggagugcaguggcgca

SEQ ID NO: 673343 - RNA, 19 nt, Human
acuucuucaccaguuaggc

SEQ ID NO: 673344 - RNA, 22 nt, Human
agccucaaccuccugaggcuca

SEQ ID NO: 673345 - RNA, 21 nt, Human
aggcuggucucaaacuccugg

SEQ ID NO: 673346 - RNA, 21 nt, Human
aggugugagccacugcaccca

SEQ ID NO: 673347 - RNA, 19 nt, Human
aguagcugggacuacaggc

SEQ ID NO: 673348 - RNA, 23 nt, Human
aguagcugggacuacaggcaugu

SEQ ID NO: 673349 - RNA, 21 nt, Human
agugcaguggcgcagucacag

SEQ ID NO: 673350 - RNA, 25 nt, Human
auguacaacauuccauuauuccagu

SEQ ID NO: 673351 - RNA, 24 nt, Human
caaagugcugggauuaaaggugug

SEQ ID NO: 673352 - RNA, 23 nt, Human
caaccuccugaggcucagaugau

SEQ ID NO: 673353 - RNA, 22 nt, Human
caagcagucuuccugccuuggc

SEQ ID NO: 673354 - RNA, 27 nt, Human
caagcagucuuccugccuuggcuuccc

SEQ ID NO: 673355 - RNA, 19 nt, Human
cacaguguuucuuggccag

SEQ ID NO: 673356 - RNA, 22 nt, Human
cagccucaaccuccugaggcuc

SEQ ID NO: 673357 - RNA, 24 nt, Human
cagccucaaccuccugaggcucag

SEQ ID NO: 673358 - RNA, 19 nt, Human
cagcuucuuagaaaaaaau

SEQ ID NO: 673359 - RNA, 19 nt, Human
caggaacuacaucuggaua

SEQ ID NO: 673360 - RNA, 20 nt, Human
caguggcgcagucacagcuc

SEQ ID NO: 673361 - RNA, 21 nt, Human
ccaaagugcugggauuaaagg

SEQ ID NO: 673362 - RNA, 24 nt, Human
ccaaagugcugggauuaaaggugu

SEQ ID NO: 673363 - RNA, 21 nt, Human
cccacaguguuucuuggccag

SEQ ID NO: 673364 - RNA, 22 nt, Human
cccagacuggagugcaguggcg

SEQ ID NO: 673365 - RNA, 18 nt, Human
ccugguuucaagcagucu

SEQ ID NO: 673366 - RNA, 23 nt, Human
ccugguuucaagcagucuuccug

SEQ ID NO: 673367 - RNA, 21 nt, Human
cucagccucuggaguagcugg

SEQ ID NO: 673368 - RNA, 24 nt, Human
cucagccucuggaguagcugggac

SEQ ID NO: 673369 - RNA, 24 nt, Human
cucuucuuagaauuuaauuuuaaa

SEQ ID NO: 673370 - RNA, 23 nt, Human
cugcagccucaaccuccugaggc

SEQ ID NO: 673371 - RNA, 24 nt, Human
cuggaguagcugggacuacaggca

SEQ ID NO: 673372 - RNA, 22 nt, Human
cuugcucuguugucccagacug

SEQ ID NO: 673373 - RNA, 23 nt, Human
cuugcuuuguugcucaggcuggu

SEQ ID NO: 673374 - RNA, 23 nt, Human
cuuuuuuuuuuuaagacaggguc

SEQ ID NO: 673375 - RNA, 24 nt, Human
cuuuuuuuuuuuaagacagggucu

SEQ ID NO: 673376 - RNA, 24 nt, Human
gacuacaggcaugugccaccaugc

SEQ ID NO: 673377 - RNA, 25 nt, Human
gaguagcugggacuacaggcaugug

SEQ ID NO: 673378 - RNA, 24 nt, Human
gagugcaguggcgcagucacagcu

SEQ ID NO: 673379 - RNA, 18 nt, Human
gauuaaaggugugagcca

SEQ ID NO: 673380 - RNA, 22 nt, Human
gauuaaaggugugagccacugc

SEQ ID NO: 673381 - RNA, 23 nt, Human
gauuaaaggugugagccacugca

SEQ ID NO: 673382 - RNA, 22 nt, Human
gccuuggcuucccaaagugcug

SEQ ID NO: 673383 - RNA, 24 nt, Human
gccuuggcuucccaaagugcuggg

SEQ ID NO: 673384 - RNA, 23 nt, Human
gcucaggcuggucucaaacuccu

SEQ ID NO: 673385 - RNA, 24 nt, Human
gcucuguugucccagacuggagug

SEQ ID NO: 673386 - RNA, 24 nt, Human
ggacuacaggcaugugccaccaug

SEQ ID NO: 673387 - RNA, 19 nt, Human
ggcuggucucaaacuccug

SEQ ID NO: 673388 - RNA, 24 nt, Human
gucuugcuuuguugcucaggcugg

SEQ ID NO: 673389 - RNA, 24 nt, Human
gugagccacugcacccagccucuu

SEQ ID NO: 673390 - RNA, 23 nt, Human
guggcgcagucacagcucacugc

SEQ ID NO: 673391 - RNA, 21 nt, Human
gugggcauuuaacccucaaau

SEQ ID NO: 673392 - RNA, 21 nt, Human
uaagacagggucuugcucugu

SEQ ID NO: 673393 - RNA, 22 nt, Human
uaagacagggucuugcucuguu

SEQ ID NO: 673394 - RNA, 24 nt, Human
uacaggcaugugccaccaugccca

SEQ ID NO: 673395 - RNA, 23 nt, Human
uacuucuucaccaguuaggccuu

SEQ ID NO: 673396 - RNA, 24 nt, Human
uagaccuuuggcauuuuuuaacuc

SEQ ID NO: 673397 - RNA, 19 nt, Human
uauagagauggggucuugc

SEQ ID NO: 673398 - RNA, 19 nt, Human
ucacugcagccucaaccuc

SEQ ID NO: 673399 - RNA, 22 nt, Human
ucacugcagccucaaccuccug

SEQ ID NO: 673400 - RNA, 18 nt, Human
ucagccucuggaguagcu

SEQ ID NO: 673401 - RNA, 23 nt, Human
ucccaaagugcugggauuaaagg

SEQ ID NO: 673402 - RNA, 19 nt, Human
ucccagacuggagugcagu

SEQ ID NO: 673403 - RNA, 24 nt, Human
ucucaaacuccugguuucaagcag

SEQ ID NO: 673404 - RNA, 24 nt, Human
ucuggaguagcugggacuacaggc

SEQ ID NO: 673405 - RNA, 23 nt, Human
ucuugcucuguugucccagacug

SEQ ID NO: 673406 - RNA, 25 nt, Human
ucuugcucuguugucccagacugga

SEQ ID NO: 673407 - RNA, 23 nt, Human
ucuugcuuuguugcucaggcugg

SEQ ID NO: 673408 - RNA, 24 nt, Human
ucuugcuuuguugcucaggcuggu

SEQ ID NO: 673409 - RNA, 25 nt, Human
ugaaaaacuaacaaagcucaacuuu

SEQ ID NO: 673410 - RNA, 19 nt, Human
ugaaagcauuuauuauauc

SEQ ID NO: 673411 - RNA, 19 nt, Human
ugccuuggcuucccaaagu

SEQ ID NO: 673412 - RNA, 24 nt, Human
uggagugcaguggcgcagucacag

SEQ ID NO: 673413 - RNA, 28 nt, Human
uggagugcaguggcgcaguccuagcacg

SEQ ID NO: 673414 - RNA, 24 nt, Human
uggcgcagucacagcucacugcag

SEQ ID NO: 673415 - RNA, 21 nt, Human
ugggacuacaggcaugugcca

SEQ ID NO: 673416 - RNA, 22 nt, Human
ugggacuacaggcaugugccac

SEQ ID NO: 673417 - RNA, 24 nt, Human
ugggacuacaggcaugugccacca

SEQ ID NO: 673418 - RNA, 19 nt, Human
ugggauuaaaggugugagc

SEQ ID NO: 673419 - RNA, 22 nt, Human
ugggauuaaaggugugagccac

SEQ ID NO: 673420 - RNA, 22 nt, Human
ugggauuaaaggugugagccac

SEQ ID NO: 673421 - RNA, 24 nt, Human
ugggauuaaaggugugagccacug

SEQ ID NO: 673422 - RNA, 19 nt, Human
uguugcucaggcuggucuc

SEQ ID NO: 673423 - RNA, 20 nt, Human
uguugcucaggcuggucuca

SEQ ID NO: 673424 - RNA, 22 nt, Human
uguugcucaggcuggucucaaa

SEQ ID NO: 673425 - RNA, 22 nt, Human
uuaacucuauuucaggaacuac

SEQ ID NO: 673426 - RNA, 19 nt, Human
uuauagagauggggucuug

SEQ ID NO: 673427 - RNA, 24 nt, Human
uuauagagauggggucuugcuuug

SEQ ID NO: 673428 - RNA, 20 nt, Human
uucaagcagucuuccugccu

SEQ ID NO: 673429 - RNA, 21 nt, Human
uuucuuggccaguucuucuag

SEQ ID NO: 673430 - RNA, 21 nt, Human
uuuggcauuuuuuaacucuau

SEQ ID NO: 673431 - RNA, 24 nt, Human
uuuguugcucaggcuggucucaaa

SEQ ID NO: 673432 - RNA, 18 nt, Human
uuuuuauagagauggggu

SEQ ID NO: 673433 - RNA, 19 nt, Human
uuuuuauagagaugggguc

SEQ ID NO: 673434 - RNA, 24 nt, Human
uuuuuuuuuuaagacagggucuug

SEQ ID NO: 673435 - RNA, 33 nt, Human
uuuuuuuuuucuuuuuuuuuuuaagacaggggg

SEQ ID NO: 673436 - RNA, 27 nt, Human
aaacccaacacauggaccaaaucagaa

SEQ ID NO: 673437 - RNA, 25 nt, Human
aaacucaagguaggaagaggaugau

SEQ ID NO: 673438 - RNA, 20 nt, Human
aagggggggauauugaagga

SEQ ID NO: 673439 - RNA, 21 nt, Human
acaccaagccccaggccuggc

SEQ ID NO: 673440 - RNA, 26 nt, Human
acagagacaccgacagucagacacca

SEQ ID NO: 673441 - RNA, 26 nt, Human
agacaccgacagucagacaccaagcc

SEQ ID NO: 673442 - RNA, 18 nt, Human
agcacagagacaccgaca

SEQ ID NO: 673443 - RNA, 24 nt, Human
aggaagaggaugauggcugcugcc

SEQ ID NO: 673444 - RNA, 19 nt, Human
aggaggcuccggcgcggcg

SEQ ID NO: 673445 - RNA, 24 nt, Human
aggcaggaaagaaggaggcuccgg

SEQ ID NO: 673446 - RNA, 20 nt, Human
agggaaggggaggugagggg

SEQ ID NO: 673447 - RNA, 20 nt, Human
agguaggaagaggaugaugg

SEQ ID NO: 673448 - RNA, 21 nt, Human
aguacagggacagccccggga

SEQ ID NO: 673449 - RNA, 21 nt, Human
agucccaccucacaggguaga

SEQ ID NO: 673450 - RNA, 23 nt, Human
augagcggcagugacaccaagac

SEQ ID NO: 673451 - RNA, 21 nt, Human
caaacccaacacauggaccaa

SEQ ID NO: 673452 - RNA, 18 nt, Human
caagccccaggccuggcc

SEQ ID NO: 673453 - RNA, 20 nt, Human
cacaguuccaucuugagacc

SEQ ID NO: 673454 - RNA, 23 nt, Human
cacauggaccaaaucagaaggac

SEQ ID NO: 673455 - RNA, 18 nt, Human
caccguguaguacaggga

SEQ ID NO: 673456 - RNA, 19 nt, Human
caccucagauccuaaccag

SEQ ID NO: 673457 - RNA, 22 nt, Human
caccucagauccuaaccagucu

SEQ ID NO: 673458 - RNA, 19 nt, Human
cagacaccaagccccaggc

SEQ ID NO: 673459 - RNA, 21 nt, Human
cagagacaccgacagucagac

SEQ ID NO: 673460 - RNA, 18 nt, Human
cagaggcaggaaagaagg

SEQ ID NO: 673461 - RNA, 19 nt, Human
cagcacagagacaccgaca

SEQ ID NO: 673462 - RNA, 20 nt, Human
cagcccggaaucagaggcag

SEQ ID NO: 673463 - RNA, 21 nt, Human
cagggaccucccauggggucu

SEQ ID NO: 673464 - RNA, 18 nt, Human
cagucagacaccaagccc

SEQ ID NO: 673465 - RNA, 23 nt, Human
ccaaacccaacacauggaccaaa

SEQ ID NO: 673466 - RNA, 20 nt, Human
ccaccuccagauccgccccu

SEQ ID NO: 673467 - RNA, 22 nt, Human
ccacugcagccugguuuuuggg

SEQ ID NO: 673468 - RNA, 19 nt, Human
ccuugagucacagcauugg

SEQ ID NO: 673469 - RNA, 20 nt, Human
cgaaacauccugggacucac

SEQ ID NO: 673470 - RNA, 20 nt, Human
cgacagucagacaccaagcc

SEQ ID NO: 673471 - RNA, 22 nt, Human
cucacaggguagaaaaacucaa

SEQ ID NO: 673472 - RNA, 20 nt, Human
cugcagccugguuuuugggu

SEQ ID NO: 673473 - RNA, 20 nt, Human
gacugggguggguggcaugg

SEQ ID NO: 673474 - RNA, 18 nt, Human
gacuuccccgcucucccc

SEQ ID NO: 673475 - RNA, 19 nt, Human
gcaacgucuacuucuaaac

SEQ ID NO: 673476 - RNA, 20 nt, Human
gccaaacccaacacauggac

SEQ ID NO: 673477 - RNA, 23 nt, Human
gccccgggagugacaggaagggg

SEQ ID NO: 673478 - RNA, 21 nt, Human
gcugccuucagagauuucuac

SEQ ID NO: 673479 - RNA, 22 nt, Human
ggaagggggggauauugaagga

SEQ ID NO: 673480 - RNA, 20 nt, Human
ggcaacgucuacuucuaaac

SEQ ID NO: 673481 - RNA, 21 nt, Human
ggcccucugaguccccagcac

SEQ ID NO: 673482 - RNA, 19 nt, Human
gggaaggggaggugagggg

SEQ ID NO: 673483 - RNA, 18 nt, Human
ggggggauauugaaggag

SEQ ID NO: 673484 - RNA, 19 nt, Human
guccaggagaagcgugaag

SEQ ID NO: 673485 - RNA, 18 nt, Human
guguuuucuguuuuuugu

SEQ ID NO: 673486 - RNA, 21 nt, Human
guuuuuucucucucucucucg

SEQ ID NO: 673487 - RNA, 20 nt, Human
uagaggaguugagucuugau

SEQ ID NO: 673488 - RNA, 19 nt, Human
ucagauccuaaccagucuc

SEQ ID NO: 673489 - RNA, 19 nt, Human
uccaggagaagcgugaagc

SEQ ID NO: 673490 - RNA, 22 nt, Human
ucccagaaucugggcccuggug

SEQ ID NO: 673491 - RNA, 25 nt, Human
uccccagcaccucccagaaucuggg

SEQ ID NO: 673492 - RNA, 20 nt, Human
uccccgcucuccccggcucc

SEQ ID NO: 673493 - RNA, 21 nt, Human
ucccugggcaagagggaaggg

SEQ ID NO: 673494 - RNA, 21 nt, Human
uccggcgcggcggcucucucu

SEQ ID NO: 673495 - RNA, 23 nt, Human
uccuguggaagaguucccuggag

SEQ ID NO: 673496 - RNA, 20 nt, Human
ucucgcuuccucucucucuu

SEQ ID NO: 673497 - RNA, 19 nt, Human
ucucucucucgcuuccucu

SEQ ID NO: 673498 - RNA, 19 nt, Human
ugaaggagauggcuuggac

SEQ ID NO: 673499 - RNA, 19 nt, Human
ugacaggaagggggggaua

SEQ ID NO: 673500 - RNA, 21 nt, Human
ugagagggugugcucauggua

SEQ ID NO: 673501 - RNA, 24 nt, Human
ugaguccccagcaccucccagaau

SEQ ID NO: 673502 - RNA, 19 nt, Human
ugcagccugguuuuugggu

SEQ ID NO: 673503 - RNA, 20 nt, Human
uggacgaaacauccugggac

SEQ ID NO: 673504 - RNA, 22 nt, Human
uggacgaaacauccugggacuc

SEQ ID NO: 673505 - RNA, 22 nt, Human
uggcaacgucuacuucuaaacu

SEQ ID NO: 673506 - RNA, 21 nt, Human
uggcucaagcuaguccauguc

SEQ ID NO: 673507 - RNA, 18 nt, Human
uggcuuggacagaggcua

SEQ ID NO: 673508 - RNA, 23 nt, Human
ugggcaagagggaaggggaggug

SEQ ID NO: 673509 - RNA, 21 nt, Human
ugggcuggacugaccuucuga

SEQ ID NO: 673510 - RNA, 20 nt, Human
ugggguggguggcauggaug

SEQ ID NO: 673511 - RNA, 19 nt, Human
uggguggcauggaugcaga

SEQ ID NO: 673512 - RNA, 24 nt, Human
uggguggcauggaugcagagacuu

SEQ ID NO: 673513 - RNA, 21 nt, Human
uguccuguggaagaguucccu

SEQ ID NO: 673514 - RNA, 20 nt, Human
uuacucagaacgaagggcgg

SEQ ID NO: 673515 - RNA, 22 nt, Human
uucagagauuucuacuaaggcc

SEQ ID NO: 673516 - RNA, 22 nt, Human
uuccccgcucuccccggcucca

SEQ ID NO: 673517 - RNA, 19 nt, Human
uuucuacuaaggccaaacc

SEQ ID NO: 673518 - RNA, 20 nt, Human
uuugggugccacugccuugg

SEQ ID NO: 673519 - RNA, 18 nt, Human
uuuguccaccuccagauc

SEQ ID NO: 673520 - RNA, 19 nt, Human
aagauaccccaccacaaca

SEQ ID NO: 673521 - RNA, 21 nt, Human
aaggaaccuuaguccuuaaac

SEQ ID NO: 673522 - RNA, 21 nt, Human
aaggcacaaauagagccugag

SEQ ID NO: 673523 - RNA, 21 nt, Human
aauaucacuucaacagguagc

SEQ ID NO: 673524 - RNA, 21 nt, Human
aauggccuaccauuuuuagau

SEQ ID NO: 673525 - RNA, 20 nt, Human
agacuuagagcacucuggug

SEQ ID NO: 673526 - RNA, 20 nt, Human
agauacucaaaaguugcucc

SEQ ID NO: 673527 - RNA, 18 nt, Human
agcacucuggugguccca

SEQ ID NO: 673528 - RNA, 19 nt, Human
aguccuauguuuugcuaau

SEQ ID NO: 673529 - RNA, 21 nt, Human
augaauaucacuucaacaggu

SEQ ID NO: 673530 - RNA, 29 nt, Human
augauuauaggaaaaaggcugaagauacc

SEQ ID NO: 673531 - RNA, 19 nt, Human
caacacacucucuaaaugc

SEQ ID NO: 673532 - RNA, 23 nt, Human
caacucaagagaugcugcuauga

SEQ ID NO: 673533 - RNA, 22 nt, Human
caagaagcacugaaagauggca

SEQ ID NO: 673534 - RNA, 21 nt, Human
caagagaugcugcuaugaaau

SEQ ID NO: 673535 - RNA, 21 nt, Human
caagaggagugcuguguagca

SEQ ID NO: 673536 - RNA, 23 nt, Human
caccauggaucugaagcaaacaa

SEQ ID NO: 673537 - RNA, 18 nt, Human
ccugggaaccaagaagca

SEQ ID NO: 673538 - RNA, 24 nt, Human
cgagucaaagucccaggagacugg

SEQ ID NO: 673539 - RNA, 21 nt, Human
cucaagagaugcugcuaugaa

SEQ ID NO: 673540 - RNA, 19 nt, Human
cucacugcuggagucuugg

SEQ ID NO: 673541 - RNA, 19 nt, Human
cucauauauauuuauuccc

SEQ ID NO: 673542 - RNA, 20 nt, Human
cugaagauaccccaccacaa

SEQ ID NO: 673543 - RNA, 18 nt, Human
cugugacacacuuccucc

SEQ ID NO: 673544 - RNA, 21 nt, Human
cuucaacagguagcuauucgu

SEQ ID NO: 673545 - RNA, 23 nt, Human
gaagauaccccaccacaacaaag

SEQ ID NO: 673546 - RNA, 22 nt, Human
gacaaaaggcucucuggaucug

SEQ ID NO: 673547 - RNA, 19 nt, Human
gccaauuaucagcucccug

SEQ ID NO: 673548 - RNA, 23 nt, Human
guucacugugacacacuuccucc

SEQ ID NO: 673549 - RNA, 20 nt, Human
uaaaaaaauaccagagaggu

SEQ ID NO: 673550 - RNA, 22 nt, Human
uaaaaugugugcaguucagaau

SEQ ID NO: 673551 - RNA, 26 nt, Human
uaaagauacucaaaaguugcucccca

SEQ ID NO: 673552 - RNA, 26 nt, Human
uaaccaagcuaaggcacaaauagagc

SEQ ID NO: 673553 - RNA, 19 nt, Human
uaacugaagauaccccacc

SEQ ID NO: 673554 - RNA, 21 nt, Human
uacacaaaggaagcgugcaau

SEQ ID NO: 673555 - RNA, 20 nt, Human
uacaugguauuaacaccaug

SEQ ID NO: 673556 - RNA, 19 nt, Human
uagcuaaacaaaaucauuc

SEQ ID NO: 673557 - RNA, 20 nt, Human
uagcuaaacaaaaucauuca

SEQ ID NO: 673558 - RNA, 20 nt, Human
ucaauauucacuggagacuu

SEQ ID NO: 673559 - RNA, 23 nt, Human
ucaauauucacuggagacuuaga

SEQ ID NO: 673560 - RNA, 18 nt, Human
ucagcaggagcgcgccga

SEQ ID NO: 673561 - RNA, 22 nt, Human
uccaugauuauaggaaaaaggc

SEQ ID NO: 673562 - RNA, 26 nt, Human
ucuccggcgacccucagcaggagcug

SEQ ID NO: 673563 - RNA, 21 nt, Human
ugcuaugaaauguccuuagag

SEQ ID NO: 673564 - RNA, 24 nt, Human
ugcugcuaugaaauguccuuagag

SEQ ID NO: 673565 - RNA, 20 nt, Human
uggagucuuggaagaugcuc

SEQ ID NO: 673566 - RNA, 21 nt, Human
uggaucugaagcaaacaaugc

SEQ ID NO: 673567 - RNA, 18 nt, Human
ugucagauacauuuccac

SEQ ID NO: 673568 - RNA, 23 nt, Human
uguucacugugacacacuuccuc

SEQ ID NO: 673569 - RNA, 22 nt, Human
uuccuccacacugaugcaggca

SEQ ID NO: 673570 - RNA, 19 nt, Human
uuuuuuuuuggggaucaag

SEQ ID NO: 673571 - RNA, 20 nt, Human
uuuuuuuuuuuuuggggauc

SEQ ID NO: 673572 - RNA, 23 nt, Human
uuuuuuuuuuuuuuuuuggggau

SEQ ID NO: 673573 - RNA, 25 nt, Human
aaacaccugucagaugcuaaaaaua

SEQ ID NO: 673574 - RNA, 21 nt, Human
aagcagcaacucaagagccca

SEQ ID NO: 673575 - RNA, 27 nt, Human
acacuaccgucaccaaaguuuauaagc

SEQ ID NO: 673576 - RNA, 22 nt, Human
accacuuuuuuguaaacaccug

SEQ ID NO: 673577 - RNA, 18 nt, Human
aggcgggcggggaggggg

SEQ ID NO: 673578 - RNA, 21 nt, Human
agggcugaggcgcugaaggug

SEQ ID NO: 673579 - RNA, 21 nt, Human
agggggcugcuguggccugau

SEQ ID NO: 673580 - RNA, 21 nt, Human
auagccgaguggaacaacgcc

SEQ ID NO: 673581 - RNA, 22 nt, Human
caaaugucuacacggcaauuca

SEQ ID NO: 673582 - RNA, 19 nt, Human
caccaaaguuuauaagcaa

SEQ ID NO: 673583 - RNA, 18 nt, Human
caccgggaaggcgggcgg

SEQ ID NO: 673584 - RNA, 19 nt, Human
cagcggucgccucgccucg

SEQ ID NO: 673585 - RNA, 21 nt, Human
ccaggugagguccacucugcc

SEQ ID NO: 673586 - RNA, 19 nt, Human
ccgccccgccccggcuccc

SEQ ID NO: 673587 - RNA, 22 nt, Human
ccgggccccugaaggucaccgg

SEQ ID NO: 673588 - RNA, 20 nt, Human
ccuucgcugggccgccgccc

SEQ ID NO: 673589 - RNA, 21 nt, Human
ccuucgcugggccgccgcccc

SEQ ID NO: 673590 - RNA, 21 nt, Human
cgccucgccucgugccgaauu

SEQ ID NO: 673591 - RNA, 20 nt, Human
cuaccuccgucaaauaacaa

SEQ ID NO: 673592 - RNA, 21 nt, Human
cugcagcaccucuaacagucc

SEQ ID NO: 673593 - RNA, 20 nt, Human
gcgcccgccacccgggcccc

SEQ ID NO: 673594 - RNA, 22 nt, Human
gcgggcggggagggggcggggc

SEQ ID NO: 673595 - RNA, 19 nt, Human
gcggggccagaccgcccgc

SEQ ID NO: 673596 - RNA, 20 nt, Human
ggccgccgccccgccccggc

SEQ ID NO: 673597 - RNA, 25 nt, Human
ggcgcugaaggugaguuuccaggug

SEQ ID NO: 673598 - RNA, 20 nt, Human
ggcggggagggggcggggcc

SEQ ID NO: 673599 - RNA, 21 nt, Human
ggcggggagggggcggggcca

SEQ ID NO: 673600 - RNA, 20 nt, Human
gggcggggagggggcggggc

SEQ ID NO: 673601 - RNA, 22 nt, Human
gggcggggagggggcggggcca

SEQ ID NO: 673602 - RNA, 19 nt, Human
uaacucuggguugaaaccu

SEQ ID NO: 673603 - RNA, 24 nt, Human
uaccgucaccaaaguuuauaagca

SEQ ID NO: 673604 - RNA, 18 nt, Human
uagccgaguggaacaacg

SEQ ID NO: 673605 - RNA, 20 nt, Human
ugcuaaaaauacggccuuac

SEQ ID NO: 673606 - RNA, 24 nt, Human
ugcuguggccugauagccgagugg

SEQ ID NO: 673607 - RNA, 22 nt, Human
uuuguaaacaccugucagaugc

SEQ ID NO: 673608 - RNA, 24 nt, Human
uuuuuuuuuuuaggaaaagggacu

SEQ ID NO: 673609 - RNA, 18 nt, Human
aacauacacaaucuacag

SEQ ID NO: 673610 - RNA, 22 nt, Human
aacauacacaaucuacaguaua

SEQ ID NO: 673611 - RNA, 20 nt, Human
accacgauuauccuguuuuc

SEQ ID NO: 673612 - RNA, 19 nt, Human
agcgagcgcccuaagauuu

SEQ ID NO: 673613 - RNA, 22 nt, Human
agcggucacagccguccggagc

SEQ ID NO: 673614 - RNA, 21 nt, Human
aggcagcucugcugggcgugg

SEQ ID NO: 673615 - RNA, 19 nt, Human
aggggacccggcugcgcgc

SEQ ID NO: 673616 - RNA, 22 nt, Human
cacauaacauacacaaucuaca

SEQ ID NO: 673617 - RNA, 20 nt, Human
cacugcgcgcccggcccggc

SEQ ID NO: 673618 - RNA, 20 nt, Human
cauuuacaccacgauuaucc

SEQ ID NO: 673619 - RNA, 22 nt, Human
ccacacucagcaugacuaucuc

SEQ ID NO: 673620 - RNA, 25 nt, Human
ccacugcgcgcccggcccggcugcu

SEQ ID NO: 673621 - RNA, 20 nt, Human
cccagugauguugcccauga

SEQ ID NO: 673622 - RNA, 22 nt, Human
cccccggccagcggucacagcc

SEQ ID NO: 673623 - RNA, 25 nt, Human
cccggcugccgugugcgugcgcccg

SEQ ID NO: 673624 - RNA, 18 nt, Human
ccgagaaggcagcucugc

SEQ ID NO: 673625 - RNA, 23 nt, Human
cgagcccccggccagcggucaca

SEQ ID NO: 673626 - RNA, 25 nt, Human
cgccccggaccucuggggcugcagc

SEQ ID NO: 673627 - RNA, 21 nt, Human
cggcccgagcccccggccagc

SEQ ID NO: 673628 - RNA, 25 nt, Human
cggcccgagcccccggccagcgggg

SEQ ID NO: 673629 - RNA, 21 nt, Human
cggcggcccgagcccccggcc

SEQ ID NO: 673630 - RNA, 22 nt, Human
cgggcagcagggcgcuggauac

SEQ ID NO: 673631 - RNA, 18 nt, Human
cguggcuucuuuccaccc

SEQ ID NO: 673632 - RNA, 22 nt, Human
cgugugcgugcgcccgugugug

SEQ ID NO: 673633 - RNA, 26 nt, Human
cuccgagaaggcagcucugcugggcg

SEQ ID NO: 673634 - RNA, 21 nt, Human
cugcgcccucgaggggacccg

SEQ ID NO: 673635 - RNA, 20 nt, Human
cugguugcagaaggcuccga

SEQ ID NO: 673636 - RNA, 20 nt, Human
gaaagacccccuaaugaugc

SEQ ID NO: 673637 - RNA, 22 nt, Human
gaccucuggggcugcagcugac

SEQ ID NO: 673638 - RNA, 22 nt, Human
gaggggcggggcggggcggccc

SEQ ID NO: 673639 - RNA, 21 nt, Human
gcaccacaaguccugguugca

SEQ ID NO: 673640 - RNA, 18 nt, Human
gcgcggggagagcccggg

SEQ ID NO: 673641 - RNA, 19 nt, Human
gcucugugucugcagcugc

SEQ ID NO: 673642 - RNA, 18 nt, Human
gcugcagcugacaggguc

SEQ ID NO: 673643 - RNA, 20 nt, Human
ggaauggugucaacgcccuc

SEQ ID NO: 673644 - RNA, 18 nt, Human
ggcaaagggccgaagucc

SEQ ID NO: 673645 - RNA, 20 nt, Human
ggccccagugauguugccca

SEQ ID NO: 673646 - RNA, 20 nt, Human
gggagagcccgggcagcagg

SEQ ID NO: 673647 - RNA, 22 nt, Human
gggccgaaguccaggaggagga

SEQ ID NO: 673648 - RNA, 20 nt, Human
guuuaaacaacccacacuca

SEQ ID NO: 673649 - RNA, 19 nt, Human
uacaguauagaaaguauaa

SEQ ID NO: 673650 - RNA, 22 nt, Human
uagcaaugaaagacccccuaau

SEQ ID NO: 673651 - RNA, 18 nt, Human
uauuaagaaaaagaaacc

SEQ ID NO: 673652 - RNA, 20 nt, Human
uccgagaaggcagcucugcu

SEQ ID NO: 673653 - RNA, 20 nt, Human
uccgcgcggggcgaggggcu

SEQ ID NO: 673654 - RNA, 19 nt, Human
uccugguugcagaaggcuc

SEQ ID NO: 673655 - RNA, 27 nt, Human
ucuucuugcucaguuaugagaugauga

SEQ ID NO: 673656 - RNA, 19 nt, Human
ugaugcacuggcggacagc

SEQ ID NO: 673657 - RNA, 18 nt, Human
uggcgcaccggaggcugc

SEQ ID NO: 673658 - RNA, 18 nt, Human
ugugcgugcgcccgugug

SEQ ID NO: 673659 - RNA, 18 nt, Human
ugugucugcagcugcacc

SEQ ID NO: 673660 - RNA, 19 nt, Human
ugugucugcagcugcacca

SEQ ID NO: 673661 - RNA, 21 nt, Human
uguuuuguuuucaagccuuca

SEQ ID NO: 673662 - RNA, 24 nt, Human
uuauuagcuuuccauaaaaacaca

SEQ ID NO: 673663 - RNA, 23 nt, Human
uuuauuagcuuuccauaaaaaca

SEQ ID NO: 673664 - RNA, 18 nt, Human
agggucugugggggaggc

SEQ ID NO: 673665 - RNA, 25 nt, Human
augccccugcuuccccuuuccccaa

SEQ ID NO: 673666 - RNA, 21 nt, Human
cacugcugcucuuuuuguucc

SEQ ID NO: 673667 - RNA, 20 nt, Human
cccaaaccccucacccucaa

SEQ ID NO: 673668 - RNA, 22 nt, Human
cccaaaccccucacccucaauu

SEQ ID NO: 673669 - RNA, 23 nt, Human
cccaaaccccucacccucaauuc

SEQ ID NO: 673670 - RNA, 18 nt, Human
ccccaaaccccucacccu

SEQ ID NO: 673671 - RNA, 23 nt, Human
ccccaaaccccucacccucaauu

SEQ ID NO: 673672 - RNA, 24 nt, Human
ccccucacccucaauucccaccug

SEQ ID NO: 673673 - RNA, 19 nt, Human
ccccugcuuccccuuuccc

SEQ ID NO: 673674 - RNA, 27 nt, Human
ccccugcuuccccuuuccccaaacccc

SEQ ID NO: 673675 - RNA, 21 nt, Human
cccucaauucccaccugccuc

SEQ ID NO: 673676 - RNA, 18 nt, Human
cccucuguuguauugcac

SEQ ID NO: 673677 - RNA, 19 nt, Human
cccugcuuccccuuucccc

SEQ ID NO: 673678 - RNA, 20 nt, Human
ccuucucacugcugcucuuu

SEQ ID NO: 673679 - RNA, 19 nt, Human
cggugugauguucgcggga

SEQ ID NO: 673680 - RNA, 23 nt, Human
cucaguguuuugucucugccucg

SEQ ID NO: 673681 - RNA, 23 nt, Human
cuucaaacacuccccacccugac

SEQ ID NO: 673682 - RNA, 23 nt, Human
cuucucacugcugcucuuuuugu

SEQ ID NO: 673683 - RNA, 25 nt, Human
cuuuccccaaaccccucacccucaa

SEQ ID NO: 673684 - RNA, 21 nt, Human
gaagaguggagggagcucuag

SEQ ID NO: 673685 - RNA, 19 nt, Human
ggagggagguacugggggg

SEQ ID NO: 673686 - RNA, 21 nt, Human
ggaggggagggagguacuggg

SEQ ID NO: 673687 - RNA, 25 nt, Human
gggaagaguggagggagccgguacc

SEQ ID NO: 673688 - RNA, 21 nt, Human
gggaugggggcagggcuaggg

SEQ ID NO: 673689 - RNA, 22 nt, Human
gggaugggggcagggcuagggg

SEQ ID NO: 673690 - RNA, 23 nt, Human
gggcagggcuaggggucuugggg

SEQ ID NO: 673691 - RNA, 27 nt, Human
ggggaggggagggagguacuggggggc

SEQ ID NO: 673692 - RNA, 27 nt, Human
ggggaggggagggagguacuggggggc

SEQ ID NO: 673693 - RNA, 23 nt, Human
ggggaugggggcagggcuagggg

SEQ ID NO: 673694 - RNA, 23 nt, Human
guguuuugucucugccucgucug

SEQ ID NO: 673695 - RNA, 19 nt, Human
uccccaaaccccucacccu

SEQ ID NO: 673696 - RNA, 22 nt, Human
ucugcaaacuucaaacacuccc

SEQ ID NO: 673697 - RNA, 19 nt, Human
ucugccucgucugucucuu

SEQ ID NO: 673698 - RNA, 22 nt, Human
ucugccucucucuuugccuucu

SEQ ID NO: 673699 - RNA, 21 nt, Human
ucugucucuucugccucucuc

SEQ ID NO: 673700 - RNA, 21 nt, Human
ugccucgucugucucuucugc

SEQ ID NO: 673701 - RNA, 20 nt, Human
ugcugcucuuuuuguuccuc

SEQ ID NO: 673702 - RNA, 18 nt, Human
ugucucuaucacugucuc

SEQ ID NO: 673703 - RNA, 22 nt, Human
uguuuugucucugccucgucug

SEQ ID NO: 673704 - RNA, 23 nt, Human
uucaaacacuccccacccugacu

SEQ ID NO: 673705 - RNA, 21 nt, Human
uugccuucucacugcugcucu

SEQ ID NO: 673706 - RNA, 22 nt, Human
aaagaggagaauuuuuaugaua

SEQ ID NO: 673707 - RNA, 19 nt, Human
augacuuuuuguggacagu

SEQ ID NO: 673708 - RNA, 20 nt, Human
gccauguugaagcccagcuu

SEQ ID NO: 673709 - RNA, 18 nt, Human
uuuuuuuuuuuuuuuuug

SEQ ID NO: 673710 - RNA, 18 nt, Human
ucaguuaaaaaacuccuc

SEQ ID NO: 673711 - RNA, 25 nt, Human
uuuacauuuaaaacauuuuaugagg

SEQ ID NO: 673712 - RNA, 23 nt, Human
uuuuuuuuuuuuuuuacauuuaa

SEQ ID NO: 673713 - RNA, 19 nt, Human
aaacgacacacaccuuuac

SEQ ID NO: 673714 - RNA, 21 nt, Human
aagcagaaaagugaacacaau

SEQ ID NO: 673715 - RNA, 23 nt, Human
accacgugacccagcacgagcca

SEQ ID NO: 673716 - RNA, 24 nt, Human
acccuaccagccccuaaagaugac

SEQ ID NO: 673717 - RNA, 21 nt, Human
agaagagaggagggagugaag

SEQ ID NO: 673718 - RNA, 19 nt, Human
agacccaggaggucucagg

SEQ ID NO: 673719 - RNA, 21 nt, Human
agcacgagccaccgcccgccc

SEQ ID NO: 673720 - RNA, 22 nt, Human
caaauccuaaucucccaauccc

SEQ ID NO: 673721 - RNA, 19 nt, Human
caacaggaggagcgcuugg

SEQ ID NO: 673722 - RNA, 24 nt, Human
caauugccaggguguggaaccagc

SEQ ID NO: 673723 - RNA, 18 nt, Human
caccgcccgccccaaaau

SEQ ID NO: 673724 - RNA, 18 nt, Human
caccuuuaucuggacucc

SEQ ID NO: 673725 - RNA, 25 nt, Human
cacgagccaccgcccgccccaaaau

SEQ ID NO: 673726 - RNA, 23 nt, Human
cacgugacccagcacgagccacc

SEQ ID NO: 673727 - RNA, 20 nt, Human
cacucgggguccgaccauuc

SEQ ID NO: 673728 - RNA, 18 nt, Human
cagaguucugugagguag

SEQ ID NO: 673729 - RNA, 21 nt, Human
cagccccuaaagaugacuccu

SEQ ID NO: 673730 - RNA, 21 nt, Human
cagcccuuggauaaccacccu

SEQ ID NO: 673731 - RNA, 19 nt, Human
caggaggagcgcuugggca

SEQ ID NO: 673732 - RNA, 20 nt, Human
caguggacaaacauuuggcc

SEQ ID NO: 673733 - RNA, 24 nt, Human
ccauggggcccagaguuccuggcu

SEQ ID NO: 673734 - RNA, 26 nt, Human
cccuuggauaaccacccuaccagccc

SEQ ID NO: 673735 - RNA, 22 nt, Human
ccgcccgccccaaaaugaaauc

SEQ ID NO: 673736 - RNA, 19 nt, Human
ccggucuucaggaaauggc

SEQ ID NO: 673737 - RNA, 19 nt, Human
ccuaaagaugacuccaucc

SEQ ID NO: 673738 - RNA, 26 nt, Human
ccugaacuuaaaggaacuacagaaag

SEQ ID NO: 673739 - RNA, 21 nt, Human
ccugcuggcgaccccccacca

SEQ ID NO: 673740 - RNA, 20 nt, Human
ccugucguacuuggcccagc

SEQ ID NO: 673741 - RNA, 22 nt, Human
cgaaacgacacacaccuuuacu

SEQ ID NO: 673742 - RNA, 23 nt, Human
cgaccacgugacccagcacgagc

SEQ ID NO: 673743 - RNA, 23 nt, Human
cgagccaccgcccgccccaaaau

SEQ ID NO: 673744 - RNA, 21 nt, Human
cgaggggacagcgaaucugcu

SEQ ID NO: 673745 - RNA, 23 nt, Human
cgcgacugagacgaaacgacaca

SEQ ID NO: 673746 - RNA, 23 nt, Human
cuacagaaagggacagaaacugc

SEQ ID NO: 673747 - RNA, 21 nt, Human
cuaccagccccuaaagaugac

SEQ ID NO: 673748 - RNA, 20 nt, Human
cuccagagaggagaucagcu

SEQ ID NO: 673749 - RNA, 19 nt, Human
cucccuccugguggccccg

SEQ ID NO: 673750 - RNA, 26 nt, Human
cuuggcccagcuccacuggauucagc

SEQ ID NO: 673751 - RNA, 19 nt, Human
gacccagcacgagccaccg

SEQ ID NO: 673752 - RNA, 21 nt, Human
gaggucucaggaguccagacu

SEQ ID NO: 673753 - RNA, 19 nt, Human
gaguaucuucaggguggcu

SEQ ID NO: 673754 - RNA, 24 nt, Human
gauaaccacccuaccagccccuaa

SEQ ID NO: 673755 - RNA, 19 nt, Human
gcacuggggugagcgucca

SEQ ID NO: 673756 - RNA, 20 nt, Human
gcagaaaagugaacacaaua

SEQ ID NO: 673757 - RNA, 19 nt, Human
gccagaccucuuuccguca

SEQ ID NO: 673758 - RNA, 27 nt, Human
gccuccaacgaggggacagccgguuuc

SEQ ID NO: 673759 - RNA, 20 nt, Human
gcuccagagaggagaucagc

SEQ ID NO: 673760 - RNA, 20 nt, Human
ggaggccugggauacagugc

SEQ ID NO: 673761 - RNA, 22 nt, Human
ggccgugcagccccuacaccuu

SEQ ID NO: 673762 - RNA, 24 nt, Human
gggacagaaacugcuuucuuuuua

SEQ ID NO: 673763 - RNA, 19 nt, Human
ggggcccagaguuccuggc

SEQ ID NO: 673764 - RNA, 20 nt, Human
gucguacuuggcccagcucc

SEQ ID NO: 673765 - RNA, 23 nt, Human
uaaacaaugcgcuggaagguuac

SEQ ID NO: 673766 - RNA, 22 nt, Human
uaccagccccuaaagaugacuc

SEQ ID NO: 673767 - RNA, 18 nt, Human
uagaauuccuagaguugc

SEQ ID NO: 673768 - RNA, 21 nt, Human
ucaagcagaaaagugaacaca

SEQ ID NO: 673769 - RNA, 22 nt, Human
uccauggggcccagaguuccug

SEQ ID NO: 673770 - RNA, 19 nt, Human
ucccgggguaacugguucu

SEQ ID NO: 673771 - RNA, 19 nt, Human
ugcaguccacagcaaccac

SEQ ID NO: 673772 - RNA, 20 nt, Human
ugccaggguguggaaccagc

SEQ ID NO: 673773 - RNA, 19 nt, Human
uggagagaagagaggaggg

SEQ ID NO: 673774 - RNA, 21 nt, Human
uggcagcaggcccauauuucu

SEQ ID NO: 673775 - RNA, 18 nt, Human
uggcuggacuuugcagcc

SEQ ID NO: 673776 - RNA, 23 nt, Human
ugggaggccugggauacagugcc

SEQ ID NO: 673777 - RNA, 22 nt, Human
uggggccggggagagggaaccu

SEQ ID NO: 673778 - RNA, 20 nt, Human
uggggugagcguccagagcu

SEQ ID NO: 673779 - RNA, 18 nt, Human
ugugaacggccacgcugc

SEQ ID NO: 673780 - RNA, 19 nt, Human
uuccaaugggaucuuagaa

SEQ ID NO: 673781 - RNA, 21 nt, Human
uuccuggcucgggaacauugg

SEQ ID NO: 673782 - RNA, 24 nt, Human
uugcagccucuuuaauaacuuccc

SEQ ID NO: 673783 - RNA, 20 nt, Human
uugccaggguguggaaccag

SEQ ID NO: 673784 - RNA, 25 nt, Human
uuugcagccucuuuaauaacuuccc

SEQ ID NO: 673785 - RNA, 19 nt, Human
uuuuuaaacaaugcgcugg

SEQ ID NO: 673786 - RNA, 21 nt, Human
aaagacguacuugcuacccuc

SEQ ID NO: 673787 - RNA, 24 nt, Human
aagaucaccuaaaggcucaagcuu

SEQ ID NO: 673788 - RNA, 21 nt, Human
aagugcuuuucaagcuguacc

SEQ ID NO: 673789 - RNA, 22 nt, Human
aauucagauggcugaauuugga

SEQ ID NO: 673790 - RNA, 18 nt, Human
acacacauacacacauau

SEQ ID NO: 673791 - RNA, 19 nt, Human
acacacauacacacauaua

SEQ ID NO: 673792 - RNA, 20 nt, Human
accccacucacuuucccuuu

SEQ ID NO: 673793 - RNA, 18 nt, Human
accccgcccgcuccagcc

SEQ ID NO: 673794 - RNA, 23 nt, Human
accucacucagccuaugcccaac

SEQ ID NO: 673795 - RNA, 19 nt, Human
agagaaucaagcccuaaag

SEQ ID NO: 673796 - RNA, 23 nt, Human
agagcaaagauguauuucuguac

SEQ ID NO: 673797 - RNA, 24 nt, Human
aggccaccucacucagccuaugcc

SEQ ID NO: 673798 - RNA, 21 nt, Human
aguaauaauggaucagcacaa

SEQ ID NO: 673799 - RNA, 24 nt, Human
auucaguguguuccacaaccucag

SEQ ID NO: 673800 - RNA, 22 nt, Human
caagcccuaaaguaauaaugga

SEQ ID NO: 673801 - RNA, 22 nt, Human
cacaaccucagccucuuccaca

SEQ ID NO: 673802 - RNA, 22 nt, Human
cacauacacacauauauauuuc

SEQ ID NO: 673803 - RNA, 20 nt, Human
cacgcacacagagccacacc

SEQ ID NO: 673804 - RNA, 19 nt, Human
cagcugguuaauguuuuug

SEQ ID NO: 673805 - RNA, 22 nt, Human
cauucaggccaccucacucagc

SEQ ID NO: 673806 - RNA, 23 nt, Human
ccacaccuaccccgcccgcucca

SEQ ID NO: 673807 - RNA, 20 nt, Human
ccccaagagaaucaagcccu

SEQ ID NO: 673808 - RNA, 18 nt, Human
cccccgcaacugacuucc

SEQ ID NO: 673809 - RNA, 21 nt, Human
cgcuccagccuuuuacgguuu

SEQ ID NO: 673810 - RNA, 23 nt, Human
cucauuaggcccuuuguuucuac

SEQ ID NO: 673811 - RNA, 22 nt, Human
cuccccaagagaaucaagcccu

SEQ ID NO: 673812 - RNA, 25 nt, Human
cugaagcuuagccaagucacucccc

SEQ ID NO: 673813 - RNA, 23 nt, Human
cugugccuguacuucacaguccu

SEQ ID NO: 673814 - RNA, 21 nt, Human
cuuagccaagucacuccccaa

SEQ ID NO: 673815 - RNA, 21 nt, Human
gcgccgggucgacgcggccgc

SEQ ID NO: 673816 - RNA, 18 nt, Human
ggggagaagaagugggag

SEQ ID NO: 673817 - RNA, 21 nt, Human
ggugucauucaggccaccuca

SEQ ID NO: 673818 - RNA, 28 nt, Human
gucacgcacacagagccacaccuacccc

SEQ ID NO: 673819 - RNA, 32 nt, Human
gugugugcauauauauacacacauacacacag

SEQ ID NO: 673820 - RNA, 23 nt, Human
guguuccacaaccucagccucuu

SEQ ID NO: 673821 - RNA, 25 nt, Human
guuaacuuuuuaagcauaaaaugug

SEQ ID NO: 673822 - RNA, 26 nt, Human
uacacacauacacacauauauauuuc

SEQ ID NO: 673823 - RNA, 22 nt, Human
uaccauaguuuaaagaucaccu

SEQ ID NO: 673824 - RNA, 18 nt, Human
uaccccgcccgcuccagc

SEQ ID NO: 673825 - RNA, 24 nt, Human
uaccccgcccgcuccagccuuuua

SEQ ID NO: 673826 - RNA, 25 nt, Human
uagaucauuaagacaaagacguacu

SEQ ID NO: 673827 - RNA, 22 nt, Human
uauacacacauacacacauaua

SEQ ID NO: 673828 - RNA, 25 nt, Human
uauauacacacauacacacauauag

SEQ ID NO: 673829 - RNA, 25 nt, Human
uauauacacacauacacacauauau

SEQ ID NO: 673830 - RNA, 19 nt, Human
uauauauacacacauacac

SEQ ID NO: 673831 - RNA, 20 nt, Human
uaucugugugugugugcaua

SEQ ID NO: 673832 - RNA, 24 nt, Human
uaucugugugugugugcauauaua

SEQ ID NO: 673833 - RNA, 19 nt, Human
ucacaguuucguaucaugu

SEQ ID NO: 673834 - RNA, 19 nt, Human
ucacuuucccuuuccuuau

SEQ ID NO: 673835 - RNA, 21 nt, Human
ucagugccacagggaaaagaa

SEQ ID NO: 673836 - RNA, 22 nt, Human
uccacaaccucagccucuucca

SEQ ID NO: 673837 - RNA, 22 nt, Human
uccacuagcaaauuuaaacaaa

SEQ ID NO: 673838 - RNA, 23 nt, Human
ucccugcagucgggcugugccug

SEQ ID NO: 673839 - RNA, 25 nt, Human
uccgugaccacaguuuacaccugaa

SEQ ID NO: 673840 - RNA, 27 nt, Human
uccgugaccacaguuuacaccugaagc

SEQ ID NO: 673841 - RNA, 18 nt, Human
ucuacaccagccuuagau

SEQ ID NO: 673842 - RNA, 19 nt, Human
ucuggccagaugcgguggg

SEQ ID NO: 673843 - RNA, 18 nt, Human
ugaaaggagagggaagag

SEQ ID NO: 673844 - RNA, 18 nt, Human
ugaaaggagagggaagag

SEQ ID NO: 673845 - RNA, 27 nt, Human
ugaagcuuagccaagucacuccccaag

SEQ ID NO: 673846 - RNA, 25 nt, Human
ugcccaaccccacucacuuucccuu

SEQ ID NO: 673847 - RNA, 22 nt, Human
ugggggaggggagaagaagugg

SEQ ID NO: 673848 - RNA, 21 nt, Human
uguacuucacaguccucuaag

SEQ ID NO: 673849 - RNA, 19 nt, Human
uguccuguauaaauuuguu

SEQ ID NO: 673850 - RNA, 18 nt, Human
ugugugugcauauauaua

SEQ ID NO: 673851 - RNA, 24 nt, Human
ugugugugcauauauauacacaac

SEQ ID NO: 673852 - RNA, 18 nt, Human
ugugugugugugcauaua

SEQ ID NO: 673853 - RNA, 22 nt, Human
ugugugugugugcauauauaua

SEQ ID NO: 673854 - RNA, 21 nt, Human
uucacauucacuggaagcauu

SEQ ID NO: 673855 - RNA, 21 nt, Human
uugaacccugggcagcugguu

SEQ ID NO: 673856 - RNA, 22 nt, Human
uugguucucauuaggcccuuug

SEQ ID NO: 673857 - RNA, 21 nt, Human
aaaagacuacagauacaagga

SEQ ID NO: 673858 - RNA, 24 nt, Human
aaacaaaacagaaacaaauuucaa

SEQ ID NO: 673859 - RNA, 27 nt, Human
aaacaaauuucaaaauaaaucacaucu

SEQ ID NO: 673860 - RNA, 24 nt, Human
aaagaacaagauaaaauaugucau

SEQ ID NO: 673861 - RNA, 27 nt, Human
aauagacaacaagucugagaaacuaag

SEQ ID NO: 673862 - RNA, 20 nt, Human
agacaacaagucugagaaac

SEQ ID NO: 673863 - RNA, 22 nt, Human
agacacggcccgcgaggccagg

SEQ ID NO: 673864 - RNA, 20 nt, Human
augcacuacuguaauauuuc

SEQ ID NO: 673865 - RNA, 20 nt, Human
auugucuucucagauugaag

SEQ ID NO: 673866 - RNA, 23 nt, Human
caaacccuucccuaacuguccaa

SEQ ID NO: 673867 - RNA, 22 nt, Human
caaagcagcuugaauuuaaagu

SEQ ID NO: 673868 - RNA, 24 nt, Human
caaaguaguaggauacccaacaug

SEQ ID NO: 673869 - RNA, 19 nt, Human
caaauuacugggaaaaugu

SEQ ID NO: 673870 - RNA, 18 nt, Human
caacauguacacauccca

SEQ ID NO: 673871 - RNA, 20 nt, Human
cacggcccgcgaggccaggg

SEQ ID NO: 673872 - RNA, 22 nt, Human
cacuuuuaggagaugaaaacac

SEQ ID NO: 673873 - RNA, 20 nt, Human
caucuucucuuaaaacuugg

SEQ ID NO: 673874 - RNA, 18 nt, Human
cauguacacaucccaucu

SEQ ID NO: 673875 - RNA, 26 nt, Human
ccaauauagauuccauuauucaaagu

SEQ ID NO: 673876 - RNA, 20 nt, Human
cccgcgaggccaggggcgag

SEQ ID NO: 673877 - RNA, 25 nt, Human
ccuacagauaauagacaacaagucu

SEQ ID NO: 673878 - RNA, 20 nt, Human
cugcgggcucgggggccggg

SEQ ID NO: 673879 - RNA, 22 nt, Human
cuguaauauuucgcuuccuaaa

SEQ ID NO: 673880 - RNA, 25 nt, Human
gaaaauguaagagguaaccgguacc

SEQ ID NO: 673881 - RNA, 18 nt, Human
gagcuucggugggcaauc

SEQ ID NO: 673882 - RNA, 25 nt, Human
gauaauagacaacaagucugagaaa

SEQ ID NO: 673883 - RNA, 19 nt, Human
gccaggggcgaguggcugg

SEQ ID NO: 673884 - RNA, 19 nt, Human
gcgaggccaggggcgagug

SEQ ID NO: 673885 - RNA, 19 nt, Human
gcuucggugggcaaucugc

SEQ ID NO: 673886 - RNA, 20 nt, Human
ggauacccaacauguacaca

SEQ ID NO: 673887 - RNA, 21 nt, Human
guacacaucccaucuucaaau

SEQ ID NO: 673888 - RNA, 20 nt, Human
uaaaaacaaaacagaaacaa

SEQ ID NO: 673889 - RNA, 26 nt, Human
uaaaaacaaaacagaaacaaauuuca

SEQ ID NO: 673890 - RNA, 24 nt, Human
uaagagguaacuucacaaaaauca

SEQ ID NO: 673891 - RNA, 19 nt, Human
uacacugccacuggcuuua

SEQ ID NO: 673892 - RNA, 23 nt, Human
uagauuccauuauucaaaguccu

SEQ ID NO: 673893 - RNA, 25 nt, Human
uauuucgcuuccuaaauuucuucca

SEQ ID NO: 673894 - RNA, 18 nt, Human
ucacauauugaguggaau

SEQ ID NO: 673895 - RNA, 19 nt, Human
uccauuauucaaaguccuc

SEQ ID NO: 673896 - RNA, 22 nt, Human
ucugcgggcucgggggccgggg

SEQ ID NO: 673897 - RNA, 22 nt, Human
ugaaaacacaaaguaguaggau

SEQ ID NO: 673898 - RNA, 21 nt, Human
ugagaaacuaaggcuaaccag

SEQ ID NO: 673899 - RNA, 21 nt, Human
ugccacuggcuuuagauacuc

SEQ ID NO: 673900 - RNA, 19 nt, Human
uggcgggaucgggggugca

SEQ ID NO: 673901 - RNA, 23 nt, Human
uuaaaacuuggcaaacccuuccc

SEQ ID NO: 673902 - RNA, 23 nt, Human
uuaaagaacaagauaaaauaugu

SEQ ID NO: 673903 - RNA, 24 nt, Human
uuaaagaacaagauaaaauauguc

SEQ ID NO: 673904 - RNA, 23 nt, Human
uuagaaacauauugucuucucag

SEQ ID NO: 673905 - RNA, 25 nt, Human
uucaaaguccuccacaaauuacugg

SEQ ID NO: 673906 - RNA, 23 nt, Human
uucaaggggugauauuuuaaauc

SEQ ID NO: 673907 - RNA, 21 nt, Human
uucacaaaaaucacauauuga

SEQ ID NO: 673908 - RNA, 25 nt, Human
uucagcagucauuuaaaaaauaaaa

SEQ ID NO: 673909 - RNA, 23 nt, Human
uuuaaaaacaaaacagaaacaaa

SEQ ID NO: 673910 - RNA, 21 nt, Human
aaaaaaaaaaaaaaaggcaaa

SEQ ID NO: 673911 - RNA, 26 nt, Human
aaaaaaaaaaaaaaaggcaaauuaua

SEQ ID NO: 673912 - RNA, 23 nt, Human
aaaauccucccuucccucugcua

SEQ ID NO: 673913 - RNA, 21 nt, Human
aaacgaauuuauucuaaacau

SEQ ID NO: 673914 - RNA, 22 nt, Human
aaacuccaaaugagagcuggca

SEQ ID NO: 673915 - RNA, 24 nt, Human
aaacuucccccccgcccccccacc

SEQ ID NO: 673916 - RNA, 19 nt, Human
aaacuucugagagcugcug

SEQ ID NO: 673917 - RNA, 21 nt, Human
aaagagcccacuuagaagugc

SEQ ID NO: 673918 - RNA, 25 nt, Human
aaagagcuuagccaucuucuagacc

SEQ ID NO: 673919 - RNA, 23 nt, Human
aacaguguaauacgaauacaaua

SEQ ID NO: 673920 - RNA, 19 nt, Human
aagacaaggauggaaaagc

SEQ ID NO: 673921 - RNA, 19 nt, Human
aagcaaaucuugacugcac

SEQ ID NO: 673922 - RNA, 18 nt, Human
aagcaggcugaaauuuua

SEQ ID NO: 673923 - RNA, 21 nt, Human
aagcaguuuuaaaaaaaaauu

SEQ ID NO: 673924 - RNA, 21 nt, Human
aagcauggaauaugggaaaga

SEQ ID NO: 673925 - RNA, 21 nt, Human
aaucaguuguacagaaacuaa

SEQ ID NO: 673926 - RNA, 18 nt, Human
aaugcaggucauguguau

SEQ ID NO: 673927 - RNA, 26 nt, Human
acaaagagcaaauucaaaacaccaca

SEQ ID NO: 673928 - RNA, 18 nt, Human
accaggcccuugcauuuu

SEQ ID NO: 673929 - RNA, 20 nt, Human
acccacaggacugucugaga

SEQ ID NO: 673930 - RNA, 20 nt, Human
acccuauaaauguucaggac

SEQ ID NO: 673931 - RNA, 19 nt, Human
accucagcaagcaguuggu

SEQ ID NO: 673932 - RNA, 19 nt, Human
accuguuugugguucucgg

SEQ ID NO: 673933 - RNA, 23 nt, Human
acgaauccaaagacccacaggac

SEQ ID NO: 673934 - RNA, 20 nt, Human
acuucagaaagaugcagaga

SEQ ID NO: 673935 - RNA, 20 nt, Human
agaaauccucuaaccagucc

SEQ ID NO: 673936 - RNA, 24 nt, Human
agaaguuagguagacacccugaug

SEQ ID NO: 673937 - RNA, 21 nt, Human
agacaaggauggaaaagcaaa

SEQ ID NO: 673938 - RNA, 22 nt, Human
agaugcugucucugucaucagg

SEQ ID NO: 673939 - RNA, 19 nt, Human
agcaagguugugauuuugc

SEQ ID NO: 673940 - RNA, 20 nt, Human
agcaguaucucaagcucagu

SEQ ID NO: 673941 - RNA, 19 nt, Human
agcccacuuagaagugccc

SEQ ID NO: 673942 - RNA, 24 nt, Human
aggaccaccuaaccacggcuggag

SEQ ID NO: 673943 - RNA, 21 nt, Human
aguccagggcauaggaaaaag

SEQ ID NO: 673944 - RNA, 23 nt, Human
auagacauucccguagcucaaag

SEQ ID NO: 673945 - RNA, 23 nt, Human
augcugucucugucaucaggugu

SEQ ID NO: 673946 - RNA, 21 nt, Human
caaaaugcaucaucaggcaca

SEQ ID NO: 673947 - RNA, 22 nt, Human
caaaguucucccaaaccuucuc

SEQ ID NO: 673948 - RNA, 30 nt, Human
caaaguucucccaaaccuucucuccacauu

SEQ ID NO: 673949 - RNA, 20 nt, Human
caaaucaguuguacagaaac

SEQ ID NO: 673950 - RNA, 24 nt, Human
caagcaguuggugaguguuugcaa

SEQ ID NO: 673951 - RNA, 19 nt, Human
caccaccuggugccgaagg

SEQ ID NO: 673952 - RNA, 23 nt, Human
cacugcuauaaagaugucaaaaa

SEQ ID NO: 673953 - RNA, 20 nt, Human
cagccuucuccaucucaagg

SEQ ID NO: 673954 - RNA, 21 nt, Human
ccaaaacacuaguaauuacca

SEQ ID NO: 673955 - RNA, 21 nt, Human
ccagccuucuccaucucaaga

SEQ ID NO: 673956 - RNA, 23 nt, Human
cccaccacuguccaccagugaac

SEQ ID NO: 673957 - RNA, 19 nt, Human
ccccccgcccccccaccag

SEQ ID NO: 673958 - RNA, 25 nt, Human
ccccccgcccccccaccaguuuuaa

SEQ ID NO: 673959 - RNA, 18 nt, Human
ccccuaggaccaccuaac

SEQ ID NO: 673960 - RNA, 19 nt, Human
ccccuaggaccaccuaacc

SEQ ID NO: 673961 - RNA, 19 nt, Human
cccguagcucaaagugcug

SEQ ID NO: 673962 - RNA, 19 nt, Human
ccucucugguggcugacau

SEQ ID NO: 673963 - RNA, 21 nt, Human
ccuucuauaaaacccuauaaa

SEQ ID NO: 673964 - RNA, 19 nt, Human
ccuucugccuucuuguccc

SEQ ID NO: 673965 - RNA, 24 nt, Human
ccuugcauuuuagcaaggugacaa

SEQ ID NO: 673966 - RNA, 25 nt, Human
cgaauacaauaaauagacuaugcaa

SEQ ID NO: 673967 - RNA, 20 nt, Human
cuaagcagggcuaguuugcu

SEQ ID NO: 673968 - RNA, 23 nt, Human
cucuccuucugccuucuuguccc

SEQ ID NO: 673969 - RNA, 19 nt, Human
cucugaagucacuguacaa

SEQ ID NO: 673970 - RNA, 22 nt, Human
cugcuaccccuaggaccaccua

SEQ ID NO: 673971 - RNA, 23 nt, Human
cugcugccuggcaaaccucugga

SEQ ID NO: 673972 - RNA, 19 nt, Human
cuggcaaaccucuggagac

SEQ ID NO: 673973 - RNA, 20 nt, Human
cuguuuuguucaugugaagg

SEQ ID NO: 673974 - RNA, 21 nt, Human
cuugacauuguucaucugccc

SEQ ID NO: 673975 - RNA, 21 nt, Human
gaaaaugaauggaccaggccc

SEQ ID NO: 673976 - RNA, 19 nt, Human
gaaaccucucccccucucu

SEQ ID NO: 673977 - RNA, 20 nt, Human
gaaagagcuuucuguugagu

SEQ ID NO: 673978 - RNA, 18 nt, Human
gaacaagcaucauuuucu

SEQ ID NO: 673979 - RNA, 21 nt, Human
gaacgguuacuaacaaaggca

SEQ ID NO: 673980 - RNA, 19 nt, Human
gaauacaauaaauagacua

SEQ ID NO: 673981 - RNA, 18 nt, Human
gaaugaggcguugaugag

SEQ ID NO: 673982 - RNA, 24 nt, Human
gacaguuguuaaacuucagaaaga

SEQ ID NO: 673983 - RNA, 20 nt, Human
gagcacugaccuuauccaca

SEQ ID NO: 673984 - RNA, 22 nt, Human
gcaaaacuggcccacucgcuaa

SEQ ID NO: 673985 - RNA, 21 nt, Human
gcaaaucuugacugcacaaaa

SEQ ID NO: 673986 - RNA, 20 nt, Human
gcugcaguccucacuaacuc

SEQ ID NO: 673987 - RNA, 21 nt, Human
gcuggaaugcugacgaaucca

SEQ ID NO: 673988 - RNA, 22 nt, Human
ggaaaacuaccaaguguagucc

SEQ ID NO: 673989 - RNA, 18 nt, Human
ggagaaaccucucccccu

SEQ ID NO: 673990 - RNA, 22 nt, Human
ggcuggaggaagaggugaacaa

SEQ ID NO: 673991 - RNA, 23 nt, Human
ggcuuuggaggguuugcucagcc

SEQ ID NO: 673992 - RNA, 24 nt, Human
guuuuugcccaguuucugaaaagc

SEQ ID NO: 673993 - RNA, 25 nt, Human
uaaaaacuucccccccgccccccca

SEQ ID NO: 673994 - RNA, 21 nt, Human
uaaaaggcaagauuucuugcu

SEQ ID NO: 673995 - RNA, 22 nt, Human
uaaacauaauuaaggaaacuag

SEQ ID NO: 673996 - RNA, 20 nt, Human
uaaaugguggaaaacuacca

SEQ ID NO: 673997 - RNA, 19 nt, Human
uaacaaaaagagcccacuu

SEQ ID NO: 673998 - RNA, 23 nt, Human
uaagaagcaggcugaaauuuuaa

SEQ ID NO: 673999 - RNA, 23 nt, Human
uaaggacauguuuuugaaacauu

SEQ ID NO: 674000 - RNA, 19 nt, Human
uaauuccagaucuaagauu

SEQ ID NO: 674001 - RNA, 20 nt, Human
uacacagaggcagaaagcau

SEQ ID NO: 674002 - RNA, 22 nt, Human
uacaguaauacauuugcaucua

SEQ ID NO: 674003 - RNA, 25 nt, Human
uacauauauauuauauauauacaca

SEQ ID NO: 674004 - RNA, 22 nt, Human
uagaaaggcucccugcuuuggg

SEQ ID NO: 674005 - RNA, 18 nt, Human
uagcucaaagugcugcag

SEQ ID NO: 674006 - RNA, 20 nt, Human
uagcuucaucuggcuuggug

SEQ ID NO: 674007 - RNA, 20 nt, Human
uauacauauauauuauauaa

SEQ ID NO: 674008 - RNA, 24 nt, Human
ucacaggaaagcaacgugcuuggc

SEQ ID NO: 674009 - RNA, 18 nt, Human
ucagaagacaaggaugga

SEQ ID NO: 674010 - RNA, 19 nt, Human
ucagcaagcaguuggugag

SEQ ID NO: 674011 - RNA, 21 nt, Human
ucaguaaugaggaugaaugag

SEQ ID NO: 674012 - RNA, 21 nt, Human
ucaguaaugaggaugaaugag

SEQ ID NO: 674013 - RNA, 19 nt, Human
ucaguuccggaucugcggu

SEQ ID NO: 674014 - RNA, 25 nt, Human
ucaugugaagguugaaagaaauccu

SEQ ID NO: 674015 - RNA, 18 nt, Human
uccaaagacccacaggac

SEQ ID NO: 674016 - RNA, 18 nt, Human
uccagggauaagaaguca

SEQ ID NO: 674017 - RNA, 19 nt, Human
uccagggauaagaagucau

SEQ ID NO: 674018 - RNA, 20 nt, Human
uccagggauaagaagucauc

SEQ ID NO: 674019 - RNA, 18 nt, Human
ucccguagcucaaagugc

SEQ ID NO: 674020 - RNA, 19 nt, Human
ucccuagacacaaguggcu

SEQ ID NO: 674021 - RNA, 21 nt, Human
uccggaucugcggugucugug

SEQ ID NO: 674022 - RNA, 19 nt, Human
uccuguguuggaccacugc

SEQ ID NO: 674023 - RNA, 18 nt, Human
ucucacggcucugguguc

SEQ ID NO: 674024 - RNA, 24 nt, Human
ucucauauugaaaacuggacugga

SEQ ID NO: 674025 - RNA, 22 nt, Human
ucuccccagccaguuuacaccc

SEQ ID NO: 674026 - RNA, 19 nt, Human
ucucugaauggaccagccc

SEQ ID NO: 674027 - RNA, 26 nt, Human
ugaaaaaaaaaaaaaaaaaggcaaaa

SEQ ID NO: 674028 - RNA, 20 nt, Human
ugaaaauacaagauaaggua

SEQ ID NO: 674029 - RNA, 24 nt, Human
ugaaacacagaaacaaugucagga

SEQ ID NO: 674030 - RNA, 22 nt, Human
ugaauggaccagcccuggagga

SEQ ID NO: 674031 - RNA, 20 nt, Human
ugacaaagagcaaauucaaa

SEQ ID NO: 674032 - RNA, 24 nt, Human
ugacaauaucacagcagcccuaau

SEQ ID NO: 674033 - RNA, 22 nt, Human
ugagaacacgugcuugugcugu

SEQ ID NO: 674034 - RNA, 22 nt, Human
ugaucauaagaaaccagccuuc

SEQ ID NO: 674035 - RNA, 24 nt, Human
ugcagagugagcgaagauuuuaug

SEQ ID NO: 674036 - RNA, 20 nt, Human
ugcugcagauacaggggagg

SEQ ID NO: 674037 - RNA, 18 nt, Human
ugcuggcuagaacagacu

SEQ ID NO: 674038 - RNA, 18 nt, Human
uggcacaucucauauuga

SEQ ID NO: 674039 - RNA, 21 nt, Human
uggcccacucgcuaagaagca

SEQ ID NO: 674040 - RNA, 24 nt, Human
uggcugacaucacuuccugaacac

SEQ ID NO: 674041 - RNA, 18 nt, Human
ugggaaagaaaacacugu

SEQ ID NO: 674042 - RNA, 23 nt, Human
ugguaaaaaugggaauaauaaga

SEQ ID NO: 674043 - RNA, 21 nt, Human
uggugcaaagugaugcacacc

SEQ ID NO: 674044 - RNA, 21 nt, Human
uguacagaaacuaauuucacc

SEQ ID NO: 674045 - RNA, 19 nt, Human
ugucuugucuugaugcugg

SEQ ID NO: 674046 - RNA, 18 nt, Human
uguuuuugcccaguuucu

SEQ ID NO: 674047 - RNA, 23 nt, Human
uuaauggcaauucugguaacuca

SEQ ID NO: 674048 - RNA, 18 nt, Human
uuauuuugacccauaggc

SEQ ID NO: 674049 - RNA, 19 nt, Human
uucaucuggcuuggugggc

SEQ ID NO: 674050 - RNA, 21 nt, Human
uucuaagcagggcuaguuugc

SEQ ID NO: 674051 - RNA, 21 nt, Human
uucucccaaaccuucucucca

SEQ ID NO: 674052 - RNA, 24 nt, Human
uuugccaaaacacuaguaauuacc

SEQ ID NO: 674053 - RNA, 24 nt, Human
uuugcuggaaugcugacgaaucca

SEQ ID NO: 674054 - RNA, 22 nt, Human
uuuggaaacuucugagagcugc

SEQ ID NO: 674055 - RNA, 19 nt, Human
uuuuuaauagcaagguugu

SEQ ID NO: 674056 - RNA, 22 nt, Human
aaggggccaguaggccacagag

SEQ ID NO: 674057 - RNA, 19 nt, Human
aaugguggguaaugcccag

SEQ ID NO: 674058 - RNA, 24 nt, Human
accccaccuugugggagaccccag

SEQ ID NO: 674059 - RNA, 22 nt, Human
acccucuccugaccccaccuug

SEQ ID NO: 674060 - RNA, 23 nt, Human
accugcucuaggggaucuggguc

SEQ ID NO: 674061 - RNA, 22 nt, Human
agcauauggggaacaggaaaga

SEQ ID NO: 674062 - RNA, 20 nt, Human
agcggagugaaagcaccagg

SEQ ID NO: 674063 - RNA, 19 nt, Human
agcugcaggaaaccagggg

SEQ ID NO: 674064 - RNA, 25 nt, Human
aggcaggguggaguagcuggcugug

SEQ ID NO: 674065 - RNA, 21 nt, Human
aggccacagaggcggcccacg

SEQ ID NO: 674066 - RNA, 19 nt, Human
caggaaagacucugccagc

SEQ ID NO: 674067 - RNA, 22 nt, Human
cagggagacgggggcuuuacag

SEQ ID NO: 674068 - RNA, 20 nt, Human
caguaggccacagaggcggc

SEQ ID NO: 674069 - RNA, 22 nt, Human
cagucaggccccagccuacauc

SEQ ID NO: 674070 - RNA, 19 nt, Human
ccacgcaggcaggguggag

SEQ ID NO: 674071 - RNA, 20 nt, Human
ccagggggaagauggccaca

SEQ ID NO: 674072 - RNA, 20 nt, Human
ccuccugacagggagacggg

SEQ ID NO: 674073 - RNA, 23 nt, Human
ccuccugacagggagacgggggc

SEQ ID NO: 674074 - RNA, 20 nt, Human
ccugacagggagacgggggc

SEQ ID NO: 674075 - RNA, 20 nt, Human
cggcuugggggguaagccag

SEQ ID NO: 674076 - RNA, 24 nt, Human
cuaggggaucugggucuccagaga

SEQ ID NO: 674077 - RNA, 22 nt, Human
gaaagacucugccagcaugguc

SEQ ID NO: 674078 - RNA, 21 nt, Human
gaaagcaccagggccggcuug

SEQ ID NO: 674079 - RNA, 21 nt, Human
gagaggucucagcuacaaaag

SEQ ID NO: 674080 - RNA, 20 nt, Human
gauucuggauggucucugac

SEQ ID NO: 674081 - RNA, 24 nt, Human
gcagggcacaggguggggccccuc

SEQ ID NO: 674082 - RNA, 21 nt, Human
gccaaugccaggcagggcaca

SEQ ID NO: 674083 - RNA, 21 nt, Human
ggaucugggucuccagagagg

SEQ ID NO: 674084 - RNA, 25 nt, Human
uacaaagggcagcggagugaaagca

SEQ ID NO: 674085 - RNA, 24 nt, Human
ucagcuacaaaagugacccucucc

SEQ ID NO: 674086 - RNA, 21 nt, Human
ucaggccccagccuacauccc

SEQ ID NO: 674087 - RNA, 22 nt, Human
ucucaaggucugugaauaaagg

SEQ ID NO: 674088 - RNA, 23 nt, Human
ucugggauucuggauggucggua

SEQ ID NO: 674089 - RNA, 21 nt, Human
ucugggauucuggauggucuc

SEQ ID NO: 674090 - RNA, 24 nt, Human
ucugggauucuggauggucucuga

SEQ ID NO: 674091 - RNA, 22 nt, Human
ugaaagcaccagggccggcuug

SEQ ID NO: 674092 - RNA, 23 nt, Human
ugacagggagacgggggcuuuac

SEQ ID NO: 674093 - RNA, 20 nt, Human
ugcaggaaaccagggggaag

SEQ ID NO: 674094 - RNA, 22 nt, Human
uggcuacaaugguggguaaugc

SEQ ID NO: 674095 - RNA, 18 nt, Human
uggguaaugcccaguugg

SEQ ID NO: 674096 - RNA, 21 nt, Human
uugggaggaugcaguguuaga

SEQ ID NO: 674097 - RNA, 20 nt, Human
uuuacagucaggccccagcc

SEQ ID NO: 674098 - RNA, 21 nt, Human
aaauaaaaaagugacauucuu

SEQ ID NO: 674099 - RNA, 31 nt, Human
aaaucuuaucaguuaaauaaaaaagugacaa

SEQ ID NO: 674100 - RNA, 20 nt, Human
aagagaaaguucuuggcauu

SEQ ID NO: 674101 - RNA, 21 nt, Human
aaguaucauugguacuuaaaa

SEQ ID NO: 674102 - RNA, 23 nt, Human
aaucaugaucagucacaaucuua

SEQ ID NO: 674103 - RNA, 18 nt, Human
acaaaauaaacaaaugcc

SEQ ID NO: 674104 - RNA, 20 nt, Human
acauagcaagaaaugaaagu

SEQ ID NO: 674105 - RNA, 25 nt, Human
accacacaaacugcuugaaauacaa

SEQ ID NO: 674106 - RNA, 20 nt, Human
acugcaguucuuuggguguc

SEQ ID NO: 674107 - RNA, 23 nt, Human
auguuagaaauauccaaugugcc

SEQ ID NO: 674108 - RNA, 23 nt, Human
auuauauagaaacaccacacaaa

SEQ ID NO: 674109 - RNA, 18 nt, Human
auuguuucaaugaguuca

SEQ ID NO: 674110 - RNA, 20 nt, Human
caaaaggagcaaugauagca

SEQ ID NO: 674111 - RNA, 19 nt, Human
caaaauaaacaaaugccua

SEQ ID NO: 674112 - RNA, 20 nt, Human
caaaauaaacaaaugccuac

SEQ ID NO: 674113 - RNA, 22 nt, Human
cagcagugcuccaucuucaaau

SEQ ID NO: 674114 - RNA, 24 nt, Human
cauagcaagaaaugaaaguaaauc

SEQ ID NO: 674115 - RNA, 20 nt, Human
cauauacauagcaagaaaug

SEQ ID NO: 674116 - RNA, 23 nt, Human
cauauacauagcaagaaaugaaa

SEQ ID NO: 674117 - RNA, 19 nt, Human
cauuacccaaccacauauc

SEQ ID NO: 674118 - RNA, 21 nt, Human
ccccucauuccccuaaauugu

SEQ ID NO: 674119 - RNA, 24 nt, Human
ccccucauuccccuaaauuguuuc

SEQ ID NO: 674120 - RNA, 20 nt, Human
ccccuuuugccccucauucc

SEQ ID NO: 674121 - RNA, 23 nt, Human
ccugaaugucgaugacucaaucu

SEQ ID NO: 674122 - RNA, 24 nt, Human
gaaugaagauuguuaccuuucuua

SEQ ID NO: 674123 - RNA, 21 nt, Human
ggagacaucuguauuuuucuu

SEQ ID NO: 674124 - RNA, 25 nt, Human
gguuuacuuaucaaaguaaaaaaua

SEQ ID NO: 674125 - RNA, 22 nt, Human
guuaggaagcuuuuaaccagaa

SEQ ID NO: 674126 - RNA, 23 nt, Human
guucuuggcauuuuaagaaaagu

SEQ ID NO: 674127 - RNA, 20 nt, Human
uaaacaaaugccuacuuuau

SEQ ID NO: 674128 - RNA, 19 nt, Human
uaaagucuuucugaaauau

SEQ ID NO: 674129 - RNA, 24 nt, Human
uagcaagaaaugaaaguaaaucaa

SEQ ID NO: 674130 - RNA, 25 nt, Human
uagcaagaaaugaaaguaaaucaaa

SEQ ID NO: 674131 - RNA, 21 nt, Human
uauauagaaacaccacacaaa

SEQ ID NO: 674132 - RNA, 19 nt, Human
uaucaaaguaaaaaauaac

SEQ ID NO: 674133 - RNA, 20 nt, Human
uauccaaugugccaccaaca

SEQ ID NO: 674134 - RNA, 25 nt, Human
uauuaaaaaguccucaggucuggag

SEQ ID NO: 674135 - RNA, 20 nt, Human
uauugcuggugguugggucu

SEQ ID NO: 674136 - RNA, 18 nt, Human
uccuaaggcuuaagaacu

SEQ ID NO: 674137 - RNA, 22 nt, Human
ucgaguggcaacuguucucucc

SEQ ID NO: 674138 - RNA, 19 nt, Human
ucucccauggucuguuacc

SEQ ID NO: 674139 - RNA, 20 nt, Human
ucuccuaaggcuuaagaacu

SEQ ID NO: 674140 - RNA, 21 nt, Human
ucuucaaauaaaacaagccuu

SEQ ID NO: 674141 - RNA, 21 nt, Human
ucuuugggugucuacucaauc

SEQ ID NO: 674142 - RNA, 22 nt, Human
ucuuugggugucuacucaaucu

SEQ ID NO: 674143 - RNA, 22 nt, Human
ugcauuacccaaccacauaucu

SEQ ID NO: 674144 - RNA, 24 nt, Human
ugcuucggagugcauaaugucagg

SEQ ID NO: 674145 - RNA, 20 nt, Human
uggguaaagucuuucugaaa

SEQ ID NO: 674146 - RNA, 20 nt, Human
ugggugucuacucaaucucu

SEQ ID NO: 674147 - RNA, 23 nt, Human
uggucuguuacccguuaggaagc

SEQ ID NO: 674148 - RNA, 27 nt, Human
uguuagaaauauccaaugugccaccaa

SEQ ID NO: 674149 - RNA, 22 nt, Human
uucuuuaucaagccuucuuaaa

SEQ ID NO: 674150 - RNA, 24 nt, Human
uuguauaacuacauuugcauuacc

SEQ ID NO: 674151 - RNA, 23 nt, Human
uuuuuuuuuuuuuugacaaugga

SEQ ID NO: 674152 - RNA, 25 nt, Human
uuuuuuuuuuuuuuuuugacaaugg

SEQ ID NO: 674153 - RNA, 26 nt, Human
aaaaaaaaagcccaaaucagagcagu

SEQ ID NO: 674154 - RNA, 20 nt, Human
aaaaaaacagagacacgggg

SEQ ID NO: 674155 - RNA, 20 nt, Human
aaaaaaacagagacacgggg

SEQ ID NO: 674156 - RNA, 24 nt, Human
aaaaagcccaaaucagagcagugg

SEQ ID NO: 674157 - RNA, 24 nt, Human
aaaaagcccaaaucagagcagugg

SEQ ID NO: 674158 - RNA, 20 nt, Human
aaaacaggccaaaugacaug

SEQ ID NO: 674159 - RNA, 21 nt, Human
aaaaccuccaaccugaggcag

SEQ ID NO: 674160 - RNA, 23 nt, Human
aaaaccuccaaccugaggcaggg

SEQ ID NO: 674161 - RNA, 22 nt, Human
aaaagaucagacuguaaaaaua

SEQ ID NO: 674162 - RNA, 22 nt, Human
aaaagcuacacagaggccgggu

SEQ ID NO: 674163 - RNA, 22 nt, Human
aaaagcuacacagaggccgggu

SEQ ID NO: 674164 - RNA, 24 nt, Human
aaaaugcugggacuacaggcguga

SEQ ID NO: 674165 - RNA, 24 nt, Human
aaaaugcugggacuacaggcguga

SEQ ID NO: 674166 - RNA, 23 nt, Human
aaacaugauaucccaggaccaac

SEQ ID NO: 674167 - RNA, 20 nt, Human
aaaccuccaaccugaggcag

SEQ ID NO: 674168 - RNA, 20 nt, Human
aaaccuccaaccugaggcag

SEQ ID NO: 674169 - RNA, 26 nt, Human
aaagagcagucacggagguaggucac

SEQ ID NO: 674170 - RNA, 24 nt, Human
aaaggcugacaaggcacagagugg

SEQ ID NO: 674171 - RNA, 24 nt, Human
aaaggcugacaaggcacagagugg

SEQ ID NO: 674172 - RNA, 20 nt, Human
aacaaauauccaccucuccu

SEQ ID NO: 674173 - RNA, 20 nt, Human
aacauggugaaauccugucu

SEQ ID NO: 674174 - RNA, 20 nt, Human
aacauggugaaauccugucu

SEQ ID NO: 674175 - RNA, 21 nt, Human
aacauggugaaauccugucuc

SEQ ID NO: 674176 - RNA, 21 nt, Human
aacauggugaaauccugucuc

SEQ ID NO: 674177 - RNA, 21 nt, Human
aaccaggucccuuuuaagguc

SEQ ID NO: 674178 - RNA, 21 nt, Human
aaccaggucccuuuuaagguc

SEQ ID NO: 674179 - RNA, 23 nt, Human
aaccaucacacuuaagagacaga

SEQ ID NO: 674180 - RNA, 25 nt, Human
aagcagcagcaucugagauaucaca

SEQ ID NO: 674181 - RNA, 18 nt, Human
aagcaggaaucagggacc

SEQ ID NO: 674182 - RNA, 23 nt, Human
aagcaggaaucagggacccaaua

SEQ ID NO: 674183 - RNA, 23 nt, Human
aagcaggaaucagggacccaaua

SEQ ID NO: 674184 - RNA, 23 nt, Human
aagccacacagaauacaagcaag

SEQ ID NO: 674185 - RNA, 19 nt, Human
aagccauucagaauuuuuc

SEQ ID NO: 674186 - RNA, 19 nt, Human
aagccauucagaauuuuuc

SEQ ID NO: 674187 - RNA, 24 nt, Human
aagcggucaucccacucagccucc

SEQ ID NO: 674188 - RNA, 24 nt, Human
aagcggucaucccacucagccucc

SEQ ID NO: 674189 - RNA, 21 nt, Human
aagcuccuucaggguggugcc

SEQ ID NO: 674190 - RNA, 21 nt, Human
aagcuccuucaggguggugcc

SEQ ID NO: 674191 - RNA, 25 nt, Human
aaggcaggcggaucaccugagguca

SEQ ID NO: 674192 - RNA, 19 nt, Human
aaguaacugagacugaagc

SEQ ID NO: 674193 - RNA, 23 nt, Human
aauauccaccucuccuguccagc

SEQ ID NO: 674194 - RNA, 23 nt, Human
aauauccaccucuccuguccagc

SEQ ID NO: 674195 - RNA, 20 nt, Human
acaaaaaaaagccacacaga

SEQ ID NO: 674196 - RNA, 20 nt, Human
acaaaaaaaagccacacaga

SEQ ID NO: 674197 - RNA, 24 nt, Human
acaaaaaaaagccacacagaauac

SEQ ID NO: 674198 - RNA, 24 nt, Human
acaaaaaaaagccacacagaauac

SEQ ID NO: 674199 - RNA, 23 nt, Human
acacacacacacacacacacaca

SEQ ID NO: 674200 - RNA, 23 nt, Human
acacacacacacacacacacaca

SEQ ID NO: 674201 - RNA, 23 nt, Human
acacacacacacacacacacaca

SEQ ID NO: 674202 - RNA, 23 nt, Human
acacacacacacacacacacaca

SEQ ID NO: 674203 - RNA, 23 nt, Human
acacacacacacacacacacaca

SEQ ID NO: 674204 - RNA, 23 nt, Human
acacacacacacacacacacaca

SEQ ID NO: 674205 - RNA, 23 nt, Human
acacacacacacacacacacaca

SEQ ID NO: 674206 - RNA, 23 nt, Human
acacacacacacacacacacaca

SEQ ID NO: 674207 - RNA, 23 nt, Human
acacacacacacacacacacaca

SEQ ID NO: 674208 - RNA, 23 nt, Human
acacacacacacacacacacaca

SEQ ID NO: 674209 - RNA, 23 nt, Human
acacacacacacacacacacaca

SEQ ID NO: 674210 - RNA, 23 nt, Human
acacacacacacacacacacaca

SEQ ID NO: 674211 - RNA, 23 nt, Human
acacacacacacacacacacaca

SEQ ID NO: 674212 - RNA, 23 nt, Human
acacacacacacacacacacaca

SEQ ID NO: 674213 - RNA, 23 nt, Human
acacacacacacacacacacaca

SEQ ID NO: 674214 - RNA, 23 nt, Human
acacacacacacacacacacaca

SEQ ID NO: 674215 - RNA, 23 nt, Human
acacacacacacacacacacaca

SEQ ID NO: 674216 - RNA, 23 nt, Human
acacacacacacacacacacaca

SEQ ID NO: 674217 - RNA, 23 nt, Human
acacacacacacacacacacaca

SEQ ID NO: 674218 - RNA, 23 nt, Human
acacacacacacacacacacaca

SEQ ID NO: 674219 - RNA, 23 nt, Human
acacacacacacacacacacaca

SEQ ID NO: 674220 - RNA, 23 nt, Human
acacacacacacacacacacaca

SEQ ID NO: 674221 - RNA, 23 nt, Human
acacacacacacacacacacaca

SEQ ID NO: 674222 - RNA, 23 nt, Human
acacacacacacacacacacaca

SEQ ID NO: 674223 - RNA, 23 nt, Human
acacacacacacacacacacaca

SEQ ID NO: 674224 - RNA, 23 nt, Human
acacacacacacacacacacaca

SEQ ID NO: 674225 - RNA, 23 nt, Human
acacuccacaaaguacacuugcu

SEQ ID NO: 674226 - RNA, 23 nt, Human
acacuccacaaaguacacuugcu

SEQ ID NO: 674227 - RNA, 25 nt, Human
acacugccgauaucccaagcccugu

SEQ ID NO: 674228 - RNA, 25 nt, Human
acacugccgauaucccaagcccugu

SEQ ID NO: 674229 - RNA, 18 nt, Human
acagagccuauaaaagcu

SEQ ID NO: 674230 - RNA, 23 nt, Human
acagagugagauauggccucaaa

SEQ ID NO: 674231 - RNA, 23 nt, Human
acagagugagauauggccucaaa

SEQ ID NO: 674232 - RNA, 24 nt, Human
acagagugagauauggccucaaaa

SEQ ID NO: 674233 - RNA, 24 nt, Human
acagagugagauauggccucaaaa

SEQ ID NO: 674234 - RNA, 24 nt, Human
acaguggugaaggacaugauuggu

SEQ ID NO: 674235 - RNA, 24 nt, Human
acaguggugaaggacaugauuggu

SEQ ID NO: 674236 - RNA, 19 nt, Human
accaccgcacuccagccug

SEQ ID NO: 674237 - RNA, 19 nt, Human
accaucacacuuaagagac

SEQ ID NO: 674238 - RNA, 19 nt, Human
accaucacacuuaagagac

SEQ ID NO: 674239 - RNA, 22 nt, Human
acccucuccccgaacacacaca

SEQ ID NO: 674240 - RNA, 22 nt, Human
acccucuccccgaacacacaca

SEQ ID NO: 674241 - RNA, 18 nt, Human
accgcacuccagccugag

SEQ ID NO: 674242 - RNA, 18 nt, Human
accgcacuccagccugag

SEQ ID NO: 674243 - RNA, 24 nt, Human
accgcacuccagccugagugacag

SEQ ID NO: 674244 - RNA, 24 nt, Human
accgcacuccagccugagugacag

SEQ ID NO: 674245 - RNA, 24 nt, Human
accugaggucaggaguucgagacc

SEQ ID NO: 674246 - RNA, 24 nt, Human
accugaggucaggaguucgagacc

SEQ ID NO: 674247 - RNA, 20 nt, Human
acggagcuggcuguggugag

SEQ ID NO: 674248 - RNA, 21 nt, Human
acuacucugcggauacagacg

SEQ ID NO: 674249 - RNA, 21 nt, Human
acuacucugcggauacagacg

SEQ ID NO: 674250 - RNA, 24 nt, Human
acuccagccugagugacagaguga

SEQ ID NO: 674251 - RNA, 24 nt, Human
acuccagccugagugacagaguga

SEQ ID NO: 674252 - RNA, 25 nt, Human
acuccuugggugaggaggucauuug

SEQ ID NO: 674253 - RNA, 24 nt, Human
acuugaaauccugggcucaagcgg

SEQ ID NO: 674254 - RNA, 23 nt, Human
agaagacaguucccuuuaggccu

SEQ ID NO: 674255 - RNA, 23 nt, Human
agaagacaguucccuuuaggccu

SEQ ID NO: 674256 - RNA, 20 nt, Human
agacacggucucacuaugua

SEQ ID NO: 674257 - RNA, 20 nt, Human
agacacggucucacuaugua

SEQ ID NO: 674258 - RNA, 19 nt, Human
agacagccaggucugggaa

SEQ ID NO: 674259 - RNA, 18 nt, Human
agagaugaugaugaugag

SEQ ID NO: 674260 - RNA, 18 nt, Human
agagaugaugaugaugag

SEQ ID NO: 674261 - RNA, 24 nt, Human
agaggaaaaagagcagucacggag

SEQ ID NO: 674262 - RNA, 24 nt, Human
agaggaaaaagagcagucacggag

SEQ ID NO: 674263 - RNA, 24 nt, Human
agaggccgggugcgguggcucacg

SEQ ID NO: 674264 - RNA, 19 nt, Human
agaggcugagauuauacca

SEQ ID NO: 674265 - RNA, 21 nt, Human
agauaaccccugacagacuga

SEQ ID NO: 674266 - RNA, 19 nt, Human
agcaaaaguaacgccagcc

SEQ ID NO: 674267 - RNA, 19 nt, Human
agcaaaaguaacgccagcc

SEQ ID NO: 674268 - RNA, 22 nt, Human
agccacacagaauacaagcaag

SEQ ID NO: 674269 - RNA, 19 nt, Human
agccugccuccucuccucc

SEQ ID NO: 674270 - RNA, 24 nt, Human
agccuggccaacauggugaaaucc

SEQ ID NO: 674271 - RNA, 24 nt, Human
agccuggccaacauggugaaaucc

SEQ ID NO: 674272 - RNA, 18 nt, Human
agcguccuggcgcucucc

SEQ ID NO: 674273 - RNA, 20 nt, Human
agcuggucaacaacuagcuu

SEQ ID NO: 674274 - RNA, 20 nt, Human
agcuggucaacaacuagcuu

SEQ ID NO: 674275 - RNA, 18 nt, Human
aggaaaaagagcagucac

SEQ ID NO: 674276 - RNA, 20 nt, Human
aggaagccauucagaauuuu

SEQ ID NO: 674277 - RNA, 20 nt, Human
aggaagccauucagaauuuu

SEQ ID NO: 674278 - RNA, 20 nt, Human
aggacagcagccugccuccu

SEQ ID NO: 674279 - RNA, 18 nt, Human
aggcaggcggaucaccug

SEQ ID NO: 674280 - RNA, 18 nt, Human
aggcaggcggaucaccug

SEQ ID NO: 674281 - RNA, 26 nt, Human
aggcaggcggaucaccugaggucagg

SEQ ID NO: 674282 - RNA, 26 nt, Human
aggcaggcggaucaccugaggucagg

SEQ ID NO: 674283 - RNA, 18 nt, Human
aggcccuggucuuggcag

SEQ ID NO: 674284 - RNA, 18 nt, Human
aggcccuggucuuggcag

SEQ ID NO: 674285 - RNA, 22 nt, Human
aggccgggugcgguggcucacg

SEQ ID NO: 674286 - RNA, 23 nt, Human
agggccuccuggucgggcggggc

SEQ ID NO: 674287 - RNA, 20 nt, Human
aguaccugguggcacuuccu

SEQ ID NO: 674288 - RNA, 21 nt, Human
agucccagcuacucgagaggc

SEQ ID NO: 674289 - RNA, 21 nt, Human
agucccagcuacucgagaggc

SEQ ID NO: 674290 - RNA, 19 nt, Human
aucacacuuaagagacaga

SEQ ID NO: 674291 - RNA, 21 nt, Human
aucaccugaggucaggaguuc

SEQ ID NO: 674292 - RNA, 24 nt, Human
aucaccugaggucaggaguucgag

SEQ ID NO: 674293 - RNA, 18 nt, Human
auccaccucuccugucca

SEQ ID NO: 674294 - RNA, 20 nt, Human
augaaaauggagacaagguc

SEQ ID NO: 674295 - RNA, 20 nt, Human
augaaaauggagacaagguc

SEQ ID NO: 674296 - RNA, 20 nt, Human
augaggauccugagaagggc

SEQ ID NO: 674297 - RNA, 20 nt, Human
augaggauccugagaagggc

SEQ ID NO: 674298 - RNA, 23 nt, Human
augggucaacaggacccccgaag

SEQ ID NO: 674299 - RNA, 23 nt, Human
augggucaacaggacccccgaag

SEQ ID NO: 674300 - RNA, 24 nt, Human
auuauaccaccgcacuccagccug

SEQ ID NO: 674301 - RNA, 24 nt, Human
caaaaaacaaaaaaaagccacaca

SEQ ID NO: 674302 - RNA, 24 nt, Human
caaaaaacaaaaaaaagccacaca

SEQ ID NO: 674303 - RNA, 24 nt, Human
caaaaugcugggacuacaggcgug

SEQ ID NO: 674304 - RNA, 24 nt, Human
caacauggugaaauccugucucua

SEQ ID NO: 674305 - RNA, 24 nt, Human
caacauggugaaauccugucucua

SEQ ID NO: 674306 - RNA, 24 nt, Human
caaggcaggcggaucaccugaggu

SEQ ID NO: 674307 - RNA, 24 nt, Human
caaggcaggcggaucaccugaggu

SEQ ID NO: 674308 - RNA, 26 nt, Human
caaggcaggcggaucaccugagguca

SEQ ID NO: 674309 - RNA, 18 nt, Human
caaguuccuagcacacag

SEQ ID NO: 674310 - RNA, 18 nt, Human
caaguuccuagcacacag

SEQ ID NO: 674311 - RNA, 22 nt, Human
cacacaagaagcauugucuaau

SEQ ID NO: 674312 - RNA, 20 nt, Human
cacacacacacacacacaca

SEQ ID NO: 674313 - RNA, 20 nt, Human
cacacacacacacacacaca

SEQ ID NO: 674314 - RNA, 20 nt, Human
cacacacacacacacacaca

SEQ ID NO: 674315 - RNA, 20 nt, Human
cacacacacacacacacaca

SEQ ID NO: 674316 - RNA, 20 nt, Human
cacacacacacacacacaca

SEQ ID NO: 674317 - RNA, 20 nt, Human
cacacacacacacacacaca

SEQ ID NO: 674318 - RNA, 20 nt, Human
cacacacacacacacacaca

SEQ ID NO: 674319 - RNA, 20 nt, Human
cacacacacacacacacaca

SEQ ID NO: 674320 - RNA, 20 nt, Human
cacacacacacacacacaca

SEQ ID NO: 674321 - RNA, 20 nt, Human
cacacacacacacacacaca

SEQ ID NO: 674322 - RNA, 20 nt, Human
cacacacacacacacacaca

SEQ ID NO: 674323 - RNA, 20 nt, Human
cacacacacacacacacaca

SEQ ID NO: 674324 - RNA, 20 nt, Human
cacacacacacacacacaca

SEQ ID NO: 674325 - RNA, 20 nt, Human
cacacacacacacacacaca

SEQ ID NO: 674326 - RNA, 20 nt, Human
cacacacacacacacacaca

SEQ ID NO: 674327 - RNA, 20 nt, Human
cacacacacacacacacaca

SEQ ID NO: 674328 - RNA, 20 nt, Human
cacacacacacacacacaca

SEQ ID NO: 674329 - RNA, 20 nt, Human
cacacacacacacacacaca

SEQ ID NO: 674330 - RNA, 20 nt, Human
cacacacacacacacacaca

SEQ ID NO: 674331 - RNA, 20 nt, Human
cacacacacacacacacaca

SEQ ID NO: 674332 - RNA, 20 nt, Human
cacacacacacacacacaca

SEQ ID NO: 674333 - RNA, 20 nt, Human
cacacacacacacacacaca

SEQ ID NO: 674334 - RNA, 20 nt, Human
cacacacacacacacacaca

SEQ ID NO: 674335 - RNA, 20 nt, Human
cacacacacacacacacaca

SEQ ID NO: 674336 - RNA, 20 nt, Human
cacacacacacacacacaca

SEQ ID NO: 674337 - RNA, 20 nt, Human
cacacacacacacacacaca

SEQ ID NO: 674338 - RNA, 20 nt, Human
cacacacacacacacacaca

SEQ ID NO: 674339 - RNA, 20 nt, Human
cacacacacacacacacaca

SEQ ID NO: 674340 - RNA, 20 nt, Human
cacacacacacacacacaca

SEQ ID NO: 674341 - RNA, 20 nt, Human
cacacacacacacacacaca

SEQ ID NO: 674342 - RNA, 20 nt, Human
cacacacacacacacacaca

SEQ ID NO: 674343 - RNA, 20 nt, Human
cacacacacacacacacaca

SEQ ID NO: 674344 - RNA, 20 nt, Human
cacacacacacacacacaca

SEQ ID NO: 674345 - RNA, 20 nt, Human
cacacacacacacacacaca

SEQ ID NO: 674346 - RNA, 20 nt, Human
cacacacacacacacacaca

SEQ ID NO: 674347 - RNA, 20 nt, Human
cacacacacacacacacaca

SEQ ID NO: 674348 - RNA, 20 nt, Human
cacacacacacacacacaca

SEQ ID NO: 674349 - RNA, 20 nt, Human
cacacacacacacacacaca

SEQ ID NO: 674350 - RNA, 20 nt, Human
cacacacacacacacacaca

SEQ ID NO: 674351 - RNA, 20 nt, Human
cacacacacacacacacaca

SEQ ID NO: 674352 - RNA, 20 nt, Human
cacacacacacacacacaca

SEQ ID NO: 674353 - RNA, 20 nt, Human
cacacacacacacacacaca

SEQ ID NO: 674354 - RNA, 20 nt, Human
cacacacacacacacacaca

SEQ ID NO: 674355 - RNA, 20 nt, Human
cacacacacacacacacaca

SEQ ID NO: 674356 - RNA, 20 nt, Human
cacacacacacacacacaca

SEQ ID NO: 674357 - RNA, 20 nt, Human
cacacacacacacacacaca

SEQ ID NO: 674358 - RNA, 20 nt, Human
cacacacacacacacacaca

SEQ ID NO: 674359 - RNA, 20 nt, Human
cacacacacacacacacaca

SEQ ID NO: 674360 - RNA, 22 nt, Human
cacacacacacacacacacaca

SEQ ID NO: 674361 - RNA, 22 nt, Human
cacacacacacacacacacaca

SEQ ID NO: 674362 - RNA, 22 nt, Human
cacacacacacacacacacaca

SEQ ID NO: 674363 - RNA, 22 nt, Human
cacacacacacacacacacaca

SEQ ID NO: 674364 - RNA, 22 nt, Human
cacacacacacacacacacaca

SEQ ID NO: 674365 - RNA, 22 nt, Human
cacacacacacacacacacaca

SEQ ID NO: 674366 - RNA, 22 nt, Human
cacacacacacacacacacaca

SEQ ID NO: 674367 - RNA, 22 nt, Human
cacacacacacacacacacaca

SEQ ID NO: 674368 - RNA, 22 nt, Human
cacacacacacacacacacaca

SEQ ID NO: 674369 - RNA, 22 nt, Human
cacacacacacacacacacaca

SEQ ID NO: 674370 - RNA, 22 nt, Human
cacacacacacacacacacaca

SEQ ID NO: 674371 - RNA, 22 nt, Human
cacacacacacacacacacaca

SEQ ID NO: 674372 - RNA, 22 nt, Human
cacacacacacacacacacaca

SEQ ID NO: 674373 - RNA, 22 nt, Human
cacacacacacacacacacaca

SEQ ID NO: 674374 - RNA, 22 nt, Human
cacacacacacacacacacaca

SEQ ID NO: 674375 - RNA, 22 nt, Human
cacacacacacacacacacaca

SEQ ID NO: 674376 - RNA, 22 nt, Human
cacacacacacacacacacaca

SEQ ID NO: 674377 - RNA, 22 nt, Human
cacacacacacacacacacaca

SEQ ID NO: 674378 - RNA, 22 nt, Human
cacacacacacacacacacaca

SEQ ID NO: 674379 - RNA, 22 nt, Human
cacacacacacacacacacaca

SEQ ID NO: 674380 - RNA, 25 nt, Human
cacacacacacacagagcaucugca

SEQ ID NO: 674381 - RNA, 21 nt, Human
cacacacagagcaucugcaga

SEQ ID NO: 674382 - RNA, 21 nt, Human
cacacacagagcaucugcaga

SEQ ID NO: 674383 - RNA, 23 nt, Human
cacacacagagcaucugcagaau

SEQ ID NO: 674384 - RNA, 23 nt, Human
cacacacagagcaucugcagaau

SEQ ID NO: 674385 - RNA, 20 nt, Human
cacacagaauacaagcaaga

SEQ ID NO: 674386 - RNA, 20 nt, Human
cacacagaauacaagcaaga

SEQ ID NO: 674387 - RNA, 24 nt, Human
cacagaauacaagcaagaggacau

SEQ ID NO: 674388 - RNA, 24 nt, Human
cacagaauacaagcaagaggacau

SEQ ID NO: 674389 - RNA, 24 nt, Human
cacagccacuugaaacaugauauc

SEQ ID NO: 674390 - RNA, 26 nt, Human
caccaccgccuggcagcgugcuggag

SEQ ID NO: 674391 - RNA, 23 nt, Human
cacccucuccccgaacacacaca

SEQ ID NO: 674392 - RNA, 24 nt, Human
cacccucuccccgaacacacacac

SEQ ID NO: 674393 - RNA, 24 nt, Human
caccgcacuccagccugagugaca

SEQ ID NO: 674394 - RNA, 24 nt, Human
caccgcacuccagccugagugaca

SEQ ID NO: 674395 - RNA, 19 nt, Human
caccucuccuguccagcuu

SEQ ID NO: 674396 - RNA, 19 nt, Human
caccucuccuguccagcuu

SEQ ID NO: 674397 - RNA, 23 nt, Human
caccugaggucaggaguucgaga

SEQ ID NO: 674398 - RNA, 23 nt, Human
caccugaggucaggaguucgaga

SEQ ID NO: 674399 - RNA, 19 nt, Human
caccuucuucuucuugucc

SEQ ID NO: 674400 - RNA, 27 nt, Human
cacgaaaugggucaacaggacccccga

SEQ ID NO: 674401 - RNA, 27 nt, Human
cacgaaaugggucaacaggacccccga

SEQ ID NO: 674402 - RNA, 24 nt, Human
cacgccuguaaucccagcacucug

SEQ ID NO: 674403 - RNA, 24 nt, Human
cacgccuguaaucccagcacucug

SEQ ID NO: 674404 - RNA, 21 nt, Human
cacuauauguagaagucaaaa

SEQ ID NO: 674405 - RNA, 21 nt, Human
cacuauauguagaagucaaaa

SEQ ID NO: 674406 - RNA, 22 nt, Human
cacuauguagcccaggcuggac

SEQ ID NO: 674407 - RNA, 23 nt, Human
cacucagccucccaaaaugcugg

SEQ ID NO: 674408 - RNA, 23 nt, Human
cacucagccucccaaaaugcugg

SEQ ID NO: 674409 - RNA, 22 nt, Human
cacuccagccugagugacagag

SEQ ID NO: 674410 - RNA, 22 nt, Human
cacuccagccugagugacagag

SEQ ID NO: 674411 - RNA, 22 nt, Human
cacuccagccugagugacagag

SEQ ID NO: 674412 - RNA, 22 nt, Human
cacuccagccugagugacagag

SEQ ID NO: 674413 - RNA, 24 nt, Human
cacuccagccugagugacagagug

SEQ ID NO: 674414 - RNA, 24 nt, Human
cacuccagccugagugacagagug

SEQ ID NO: 674415 - RNA, 25 nt, Human
cacucuguuuccaaaggugacccuu

SEQ ID NO: 674416 - RNA, 18 nt, Human
cagaaacaugacuguagc

SEQ ID NO: 674417 - RNA, 18 nt, Human
cagaaacaugacuguagc

SEQ ID NO: 674418 - RNA, 19 nt, Human
cagaacacacacaagaagc

SEQ ID NO: 674419 - RNA, 19 nt, Human
cagaacacacacaagaagc

SEQ ID NO: 674420 - RNA, 19 nt, Human
cagagccuauaaaagcuac

SEQ ID NO: 674421 - RNA, 19 nt, Human
cagagccuauaaaagcuac

SEQ ID NO: 674422 - RNA, 22 nt, Human
cagauaaccccugacagacuga

SEQ ID NO: 674423 - RNA, 24 nt, Human
cagcacucugggaggccaaggcag

SEQ ID NO: 674424 - RNA, 24 nt, Human
cagcacucugggaggccaaggcag

SEQ ID NO: 674425 - RNA, 25 nt, Human
cagcacucugggaggccaaggcagg

SEQ ID NO: 674426 - RNA, 25 nt, Human
cagcacucugggaggccaaggcagg

SEQ ID NO: 674427 - RNA, 22 nt, Human
cagcagccugggagcaaccaag

SEQ ID NO: 674428 - RNA, 22 nt, Human
cagcagccugggagcaaccaag

SEQ ID NO: 674429 - RNA, 21 nt, Human
cagccugccuccucuccuccu

SEQ ID NO: 674430 - RNA, 20 nt, Human
cagcuaagcuucuacaucuu

SEQ ID NO: 674431 - RNA, 18 nt, Human
cagcugcuguagcguccu

SEQ ID NO: 674432 - RNA, 20 nt, Human
cagcuggcaagggcuggcug

SEQ ID NO: 674433 - RNA, 20 nt, Human
cagcuggcaagggcuggcug

SEQ ID NO: 674434 - RNA, 21 nt, Human
cagcuugagagaggucuacaa

SEQ ID NO: 674435 - RNA, 21 nt, Human
cagcuugagagaggucuacaa

SEQ ID NO: 674436 - RNA, 21 nt, Human
caggaaucagggacccaauaa

SEQ ID NO: 674437 - RNA, 21 nt, Human
caggaaucagggacccaauaa

SEQ ID NO: 674438 - RNA, 21 nt, Human
caggacagcagccugccuccu

SEQ ID NO: 674439 - RNA, 21 nt, Human
caggacagcagccugccuccu

SEQ ID NO: 674440 - RNA, 24 nt, Human
caggcggaucaccugaggucagga

SEQ ID NO: 674441 - RNA, 24 nt, Human
caggucuucaugcagccugcugga

SEQ ID NO: 674442 - RNA, 23 nt, Human
cagguucucucuucucugaggca

SEQ ID NO: 674443 - RNA, 23 nt, Human
cagguucucucuucucugaggca

SEQ ID NO: 674444 - RNA, 22 nt, Human
caguaacagagccuauaaaagc

SEQ ID NO: 674445 - RNA, 22 nt, Human
caguaacagagccuauaaaagc

SEQ ID NO: 674446 - RNA, 22 nt, Human
caucaucgucaucagugguguc

SEQ ID NO: 674447 - RNA, 26 nt, Human
caucccacucagccucccaaaaugcu

SEQ ID NO: 674448 - RNA, 26 nt, Human
caucccacucagccucccaaaaugcu

SEQ ID NO: 674449 - RNA, 24 nt, Human
caucuuagacugugacgucagcug

SEQ ID NO: 674450 - RNA, 24 nt, Human
caucuuagacugugacgucagcug

SEQ ID NO: 674451 - RNA, 20 nt, Human
ccaaaaugcugggacuacag

SEQ ID NO: 674452 - RNA, 24 nt, Human
ccaaaaugcugggacuacaggcgu

SEQ ID NO: 674453 - RNA, 24 nt, Human
ccaaaaugcugggacuacaggcgu

SEQ ID NO: 674454 - RNA, 21 nt, Human
ccaacccauggaccugaggcc

SEQ ID NO: 674455 - RNA, 21 nt, Human
ccaacccauggaccugaggcc

SEQ ID NO: 674456 - RNA, 19 nt, Human
ccacacagaauacaagcaa

SEQ ID NO: 674457 - RNA, 19 nt, Human
ccacacagaauacaagcaa

SEQ ID NO: 674458 - RNA, 24 nt, Human
ccacccucuccccgaacacacaca

SEQ ID NO: 674459 - RNA, 24 nt, Human
ccacccucuccccgaacacacaca

SEQ ID NO: 674460 - RNA, 20 nt, Human
ccaccgcacuccagccugag

SEQ ID NO: 674461 - RNA, 20 nt, Human
ccaccgcacuccagccugag

SEQ ID NO: 674462 - RNA, 20 nt, Human
ccaccgcacuccagccugag

SEQ ID NO: 674463 - RNA, 20 nt, Human
ccaccgcacuccagccugag

SEQ ID NO: 674464 - RNA, 24 nt, Human
ccaccgcacuccagccugagugac

SEQ ID NO: 674465 - RNA, 24 nt, Human
ccaccgcacuccagccugagugac

SEQ ID NO: 674466 - RNA, 18 nt, Human
ccacugccucuucagcug

SEQ ID NO: 674467 - RNA, 21 nt, Human
ccagaaaccaugccuguaaca

SEQ ID NO: 674468 - RNA, 23 nt, Human
ccagacuggcugcccaacccaug

SEQ ID NO: 674469 - RNA, 23 nt, Human
ccagacuggcugcccaacccaug

SEQ ID NO: 674470 - RNA, 21 nt, Human
ccaggcuggacuugaaauccu

SEQ ID NO: 674471 - RNA, 21 nt, Human
ccaggcuggacuugaaauccu

SEQ ID NO: 674472 - RNA, 18 nt, Human
ccaucugcgcagguccau

SEQ ID NO: 674473 - RNA, 19 nt, Human
cccaaaaaaaaaaaagccc

SEQ ID NO: 674474 - RNA, 19 nt, Human
cccaaaaaaaaaaaagccc

SEQ ID NO: 674475 - RNA, 23 nt, Human
cccaaaaugcugggacuacaggc

SEQ ID NO: 674476 - RNA, 24 nt, Human
cccaaaaugcugggacuacaggcg

SEQ ID NO: 674477 - RNA, 19 nt, Human
cccaaaucagagcaguggc

SEQ ID NO: 674478 - RNA, 22 nt, Human
cccaaguagauacucucugccc

SEQ ID NO: 674479 - RNA, 22 nt, Human
cccacacugccgauaucccaag

SEQ ID NO: 674480 - RNA, 22 nt, Human
cccacacugccgauaucccaag

SEQ ID NO: 674481 - RNA, 18 nt, Human
cccaggaacucuguccag

SEQ ID NO: 674482 - RNA, 18 nt, Human
cccaggaacucuguccag

SEQ ID NO: 674483 - RNA, 20 nt, Human
ccccgaagaguucaagauac

SEQ ID NO: 674484 - RNA, 20 nt, Human
ccccgaagaguucaagauac

SEQ ID NO: 674485 - RNA, 20 nt, Human
cccugugcuaccacccucuc

SEQ ID NO: 674486 - RNA, 20 nt, Human
cccugugcuaccacccucuc

SEQ ID NO: 674487 - RNA, 26 nt, Human
ccuauccuguccaacaccuaagcaua

SEQ ID NO: 674488 - RNA, 20 nt, Human
ccucaaaaaacaaaaaaaag

SEQ ID NO: 674489 - RNA, 20 nt, Human
ccucaaaaaacaaaaaaaag

SEQ ID NO: 674490 - RNA, 23 nt, Human
ccucaaaaaacaaaaaaaagccc

SEQ ID NO: 674491 - RNA, 25 nt, Human
ccuccaccgcacugacccucuugga

SEQ ID NO: 674492 - RNA, 25 nt, Human
ccuccuaccccuauccuguccaaca

SEQ ID NO: 674493 - RNA, 26 nt, Human
ccuccuaccccuauccuguccaacac

SEQ ID NO: 674494 - RNA, 21 nt, Human
ccuccucuccuccuaccccua

SEQ ID NO: 674495 - RNA, 21 nt, Human
ccuccucuccuccuaccccua

SEQ ID NO: 674496 - RNA, 22 nt, Human
ccugaggucaggaguucgagac

SEQ ID NO: 674497 - RNA, 21 nt, Human
ccugcagcaccuucacauggc

SEQ ID NO: 674498 - RNA, 22 nt, Human
ccuggccaacauggugaaaucc

SEQ ID NO: 674499 - RNA, 22 nt, Human
ccuggccaacauggugaaaucc

SEQ ID NO: 674500 - RNA, 24 nt, Human
ccuggccaacauggugaaauccug

SEQ ID NO: 674501 - RNA, 21 nt, Human
ccugggagcugcuuuccccuc

SEQ ID NO: 674502 - RNA, 21 nt, Human
ccugggagcugcuuuccccuc

SEQ ID NO: 674503 - RNA, 22 nt, Human
ccugggcucaagcggucauccc

SEQ ID NO: 674504 - RNA, 22 nt, Human
ccugggcucaagcggucauccc

SEQ ID NO: 674505 - RNA, 22 nt, Human
ccuggucgggcggggccugccc

SEQ ID NO: 674506 - RNA, 20 nt, Human
ccuguagucccagcuacucg

SEQ ID NO: 674507 - RNA, 22 nt, Human
ccuguagucccagcuacucgag

SEQ ID NO: 674508 - RNA, 22 nt, Human
ccuguagucccagcuacucgag

SEQ ID NO: 674509 - RNA, 22 nt, Human
ccugucucuacuaaaaauacaa

SEQ ID NO: 674510 - RNA, 22 nt, Human
ccugucucuacuaaaaauacaa

SEQ ID NO: 674511 - RNA, 18 nt, Human
ccuugguugaaugucagc

SEQ ID NO: 674512 - RNA, 20 nt, Human
cgaaaugggucaacaggacc

SEQ ID NO: 674513 - RNA, 20 nt, Human
cgaaaugggucaacaggacc

SEQ ID NO: 674514 - RNA, 20 nt, Human
cgaagcaggaaucagggacc

SEQ ID NO: 674515 - RNA, 20 nt, Human
cgaagcaggaaucagggacc

SEQ ID NO: 674516 - RNA, 24 nt, Human
cgagaccagccuggccaacauggu

SEQ ID NO: 674517 - RNA, 24 nt, Human
cgagaccagccuggccaacauggu

SEQ ID NO: 674518 - RNA, 21 nt, Human
cgcacuuccuccaccgcacug

SEQ ID NO: 674519 - RNA, 23 nt, Human
cgccuguaaucccagcacucugg

SEQ ID NO: 674520 - RNA, 23 nt, Human
cgccuguaaucccagcacucugg

SEQ ID NO: 674521 - RNA, 24 nt, Human
cgccuguaaucccagcacucuggg

SEQ ID NO: 674522 - RNA, 24 nt, Human
cgccuguaaucccagcacucuggg

SEQ ID NO: 674523 - RNA, 22 nt, Human
cgccuguagucccagcuacucg

SEQ ID NO: 674524 - RNA, 22 nt, Human
cgccuguagucccagcuacucg

SEQ ID NO: 674525 - RNA, 23 nt, Human
cgccuguagucccagcuacucga

SEQ ID NO: 674526 - RNA, 23 nt, Human
cgccuguagucccagcuacucga

SEQ ID NO: 674527 - RNA, 24 nt, Human
cggaucaccugaggucaggaguuc

SEQ ID NO: 674528 - RNA, 24 nt, Human
cggaucaccugaggucaggaguuc

SEQ ID NO: 674529 - RNA, 27 nt, Human
cggaucaccugaggucaggaguucgag

SEQ ID NO: 674530 - RNA, 27 nt, Human
cggaucaccugaggucaggaguucgag

SEQ ID NO: 674531 - RNA, 20 nt, Human
cggccgcgggcgccacugcc

SEQ ID NO: 674532 - RNA, 21 nt, Human
cuaaguaacugagacugaagc

SEQ ID NO: 674533 - RNA, 22 nt, Human
cuaccacccucuccccgaacac

SEQ ID NO: 674534 - RNA, 22 nt, Human
cuaccacccucuccccgaacac

SEQ ID NO: 674535 - RNA, 23 nt, Human
cuauguagcccaggcuggacuug

SEQ ID NO: 674536 - RNA, 23 nt, Human
cuauguagcccaggcuggacuug

SEQ ID NO: 674537 - RNA, 21 nt, Human
cucaaaaaacaaaaaaaagcc

SEQ ID NO: 674538 - RNA, 21 nt, Human
cucaaaaaacaaaaaaaagcc

SEQ ID NO: 674539 - RNA, 25 nt, Human
cucacagcaauucugaccagaaacc

SEQ ID NO: 674540 - RNA, 23 nt, Human
cucacgccuguaaucccagcacu

SEQ ID NO: 674541 - RNA, 23 nt, Human
cucacgccuguaaucccagcacu

SEQ ID NO: 674542 - RNA, 24 nt, Human
cucacgccuguaaucccagcacuc

SEQ ID NO: 674543 - RNA, 24 nt, Human
cucacgccuguaaucccagcacuc

SEQ ID NO: 674544 - RNA, 20 nt, Human
cucacgccuguagucccagc

SEQ ID NO: 674545 - RNA, 20 nt, Human
cucacgccuguagucccagc

SEQ ID NO: 674546 - RNA, 23 nt, Human
cucacgccuguagucccagcuac

SEQ ID NO: 674547 - RNA, 24 nt, Human
cucacgccuguagucccagcuacu

SEQ ID NO: 674548 - RNA, 19 nt, Human
cucagaucuucagguucuc

SEQ ID NO: 674549 - RNA, 28 nt, Human
cugaagguccucggggugguugcucuuu

SEQ ID NO: 674550 - RNA, 24 nt, Human
cugcagcaccuucacauggcuucg

SEQ ID NO: 674551 - RNA, 24 nt, Human
cuggccaacauggugaaauccugu

SEQ ID NO: 674552 - RNA, 24 nt, Human
cuggccaacauggugaaauccugu

SEQ ID NO: 674553 - RNA, 19 nt, Human
cugucuccucaaaagcaag

SEQ ID NO: 674554 - RNA, 18 nt, Human
cuucaugaaguuuccuuu

SEQ ID NO: 674555 - RNA, 18 nt, Human
cuucaugaaguuuccuuu

SEQ ID NO: 674556 - RNA, 19 nt, Human
cuugaaauccugggcucaa

SEQ ID NO: 674557 - RNA, 19 nt, Human
cuuuauguauaagucucau

SEQ ID NO: 674558 - RNA, 19 nt, Human
cuuuauguauaagucucau

SEQ ID NO: 674559 - RNA, 23 nt, Human
gaaaaagagcagucacggaggua

SEQ ID NO: 674560 - RNA, 23 nt, Human
gaaaaagagcagucacggaggua

SEQ ID NO: 674561 - RNA, 21 nt, Human
gaaaacaggccaaaugacaug

SEQ ID NO: 674562 - RNA, 23 nt, Human
gaaacaugauaucccaggaccaa

SEQ ID NO: 674563 - RNA, 24 nt, Human
gaaaggggcaggacucuggguucc

SEQ ID NO: 674564 - RNA, 18 nt, Human
gaaauccugggcucaagc

SEQ ID NO: 674565 - RNA, 23 nt, Human
gaagcuccuucaggguggugccu

SEQ ID NO: 674566 - RNA, 19 nt, Human
gaaggaagaggaugaggau

SEQ ID NO: 674567 - RNA, 19 nt, Human
gaaggaagaggaugaggau

SEQ ID NO: 674568 - RNA, 18 nt, Human
gacuacaggcgugagcca

SEQ ID NO: 674569 - RNA, 18 nt, Human
gacuacaggcgugagcca

SEQ ID NO: 674570 - RNA, 21 nt, Human
gacuacaggcgugagccacug

SEQ ID NO: 674571 - RNA, 21 nt, Human
gacuacaggcgugagccacug

SEQ ID NO: 674572 - RNA, 24 nt, Human
gacuacaggcgugagccacugugc

SEQ ID NO: 674573 - RNA, 24 nt, Human
gacuacaggcgugagccacugugc

SEQ ID NO: 674574 - RNA, 22 nt, Human
gacuacgcaacaguaacagagc

SEQ ID NO: 674575 - RNA, 20 nt, Human
gaggaggucauuugccugga

SEQ ID NO: 674576 - RNA, 21 nt, Human
gaucaccugaggucaggaguu

SEQ ID NO: 674577 - RNA, 24 nt, Human
gaucaccugaggucaggaguucga

SEQ ID NO: 674578 - RNA, 24 nt, Human
gaucaccugaggucaggaguucga

SEQ ID NO: 674579 - RNA, 23 nt, Human
gcacuccagccugagugacagag

SEQ ID NO: 674580 - RNA, 24 nt, Human
gcacuccagccugagugacagagu

SEQ ID NO: 674581 - RNA, 22 nt, Human
gcagccugccuccucuccuccu

SEQ ID NO: 674582 - RNA, 19 nt, Human
gcagcgugcuggaggaggg

SEQ ID NO: 674583 - RNA, 20 nt, Human
gccaacauggugaaauccug

SEQ ID NO: 674584 - RNA, 20 nt, Human
gccaacauggugaaauccug

SEQ ID NO: 674585 - RNA, 24 nt, Human
gccaacauggugaaauccugucuc

SEQ ID NO: 674586 - RNA, 24 nt, Human
gccaacauggugaaauccugucuc

SEQ ID NO: 674587 - RNA, 21 nt, Human
gcggaucaccugaggucagga

SEQ ID NO: 674588 - RNA, 20 nt, Human
gcgguggcucacgccuguaa

SEQ ID NO: 674589 - RNA, 23 nt, Human
gcugacaugcagaaacaugacug

SEQ ID NO: 674590 - RNA, 23 nt, Human
gcugacaugcagaaacaugacug

SEQ ID NO: 674591 - RNA, 24 nt, Human
gcuggcucacgccuguagucccag

SEQ ID NO: 674592 - RNA, 24 nt, Human
gcuggcucacgccuguagucccag

SEQ ID NO: 674593 - RNA, 23 nt, Human
gcuguggugaagcaggcccuggu

SEQ ID NO: 674594 - RNA, 23 nt, Human
gcuguggugaagcaggcccuggu

SEQ ID NO: 674595 - RNA, 21 nt, Human
ggaaaggggcaggacucuggg

SEQ ID NO: 674596 - RNA, 21 nt, Human
ggaaaggggcaggacucuggg

SEQ ID NO: 674597 - RNA, 24 nt, Human
ggaagccauucagaauuuuucacc

SEQ ID NO: 674598 - RNA, 24 nt, Human
ggaagccauucagaauuuuucacc

SEQ ID NO: 674599 - RNA, 18 nt, Human
ggacccaauaagucucag

SEQ ID NO: 674600 - RNA, 18 nt, Human
ggacccaauaagucucag

SEQ ID NO: 674601 - RNA, 20 nt, Human
ggacuacaggcgugagccac

SEQ ID NO: 674602 - RNA, 20 nt, Human
ggacuacaggcgugagccac

SEQ ID NO: 674603 - RNA, 24 nt, Human
ggacuacaggcgugagccacugug

SEQ ID NO: 674604 - RNA, 21 nt, Human
ggacuucaaagcccuccgccu

SEQ ID NO: 674605 - RNA, 26 nt, Human
ggagaaagccugucuuuccucggaag

SEQ ID NO: 674606 - RNA, 18 nt, Human
ggagucugucuccucaaa

SEQ ID NO: 674607 - RNA, 18 nt, Human
ggagucugucuccucaaa

SEQ ID NO: 674608 - RNA, 22 nt, Human
ggaucaccugaggucaggaguu

SEQ ID NO: 674609 - RNA, 23 nt, Human
ggaucaccugaggucaggaguuc

SEQ ID NO: 674610 - RNA, 23 nt, Human
ggaucaccugaggucaggaguuc

SEQ ID NO: 674611 - RNA, 19 nt, Human
ggauugucaagcagcagca

SEQ ID NO: 674612 - RNA, 24 nt, Human
ggcagcgugcuggaggagggauuc

SEQ ID NO: 674613 - RNA, 22 nt, Human
ggcgugcuggcucacgccugua

SEQ ID NO: 674614 - RNA, 19 nt, Human
gggcggggccugcccuggc

SEQ ID NO: 674615 - RNA, 24 nt, Human
gggcgugcuggcucacgccuguag

SEQ ID NO: 674616 - RNA, 28 nt, Human
ggggagaaagccugucuuuccucggaag

SEQ ID NO: 674617 - RNA, 28 nt, Human
ggggagaaagccugucuuuccucggaag

SEQ ID NO: 674618 - RNA, 24 nt, Human
gggugcgguggcucacgccuguaa

SEQ ID NO: 674619 - RNA, 23 nt, Human
gguggcucacgccuguaauccca

SEQ ID NO: 674620 - RNA, 23 nt, Human
gguggcucacgccuguaauccca

SEQ ID NO: 674621 - RNA, 24 nt, Human
gguggcucacgccuguaaucccag

SEQ ID NO: 674622 - RNA, 24 nt, Human
gguggcucacgccuguaaucccag

SEQ ID NO: 674623 - RNA, 19 nt, Human
guccauuguccaccuccaa

SEQ ID NO: 674624 - RNA, 23 nt, Human
guggcucacgccuguaaucccag

SEQ ID NO: 674625 - RNA, 21 nt, Human
uaagucagagguugacaccca

SEQ ID NO: 674626 - RNA, 18 nt, Human
uacaggcgugagccacug

SEQ ID NO: 674627 - RNA, 19 nt, Human
uacaggcgugagccacugu

SEQ ID NO: 674628 - RNA, 20 nt, Human
uagaaaacaggccaaaugac

SEQ ID NO: 674629 - RNA, 20 nt, Human
uagaaaacaggccaaaugac

SEQ ID NO: 674630 - RNA, 26 nt, Human
uagaaaacaggccaaaugacaugcaa

SEQ ID NO: 674631 - RNA, 26 nt, Human
uagaaaacaggccaaaugacaugcaa

SEQ ID NO: 674632 - RNA, 18 nt, Human
uaggacucuuggcacucc

SEQ ID NO: 674633 - RNA, 18 nt, Human
uaggacucuuggcacucc

SEQ ID NO: 674634 - RNA, 23 nt, Human
uaggucacgaaaugggucaacag

SEQ ID NO: 674635 - RNA, 21 nt, Human
uaucccaagcccugugcuacc

SEQ ID NO: 674636 - RNA, 21 nt, Human
uaucccaagcccugugcuacc

SEQ ID NO: 674637 - RNA, 19 nt, Human
uaucccaggaccaaccugg

SEQ ID NO: 674638 - RNA, 18 nt, Human
uauguagcccaggcugga

SEQ ID NO: 674639 - RNA, 18 nt, Human
uauguagcccaggcugga

SEQ ID NO: 674640 - RNA, 24 nt, Human
uauguagcccaggcuggacuugaa

SEQ ID NO: 674641 - RNA, 24 nt, Human
uauguagcccaggcuggacuugaa

SEQ ID NO: 674642 - RNA, 21 nt, Human
uauuguggcuguggugaagca

SEQ ID NO: 674643 - RNA, 21 nt, Human
uauuguggcuguggugaagca

SEQ ID NO: 674644 - RNA, 19 nt, Human
uauuuagucaccaccucaa

SEQ ID NO: 674645 - RNA, 22 nt, Human
ucaacaaauauccaccucuccu

SEQ ID NO: 674646 - RNA, 20 nt, Human
ucaccugaggucaggaguuc

SEQ ID NO: 674647 - RNA, 20 nt, Human
ucagaauugggacagaggca

SEQ ID NO: 674648 - RNA, 21 nt, Human
ucagagcaguggcaauguaag

SEQ ID NO: 674649 - RNA, 21 nt, Human
ucagagcaguggcaauguaag

SEQ ID NO: 674650 - RNA, 18 nt, Human
ucagccucccaaaaugcu

SEQ ID NO: 674651 - RNA, 18 nt, Human
ucagccucccaaaaugcu

SEQ ID NO: 674652 - RNA, 19 nt, Human
ucaggccaagcaggacuug

SEQ ID NO: 674653 - RNA, 19 nt, Human
ucaggccaagcaggacuug

SEQ ID NO: 674654 - RNA, 22 nt, Human
uccagccccgacgcugcggccg

SEQ ID NO: 674655 - RNA, 24 nt, Human
uccagccccgacgcugcggccgcg

SEQ ID NO: 674656 - RNA, 23 nt, Human
uccagccugagugacagagugag

SEQ ID NO: 674657 - RNA, 23 nt, Human
uccagccugagugacagagugag

SEQ ID NO: 674658 - RNA, 24 nt, Human
uccagccugagugacagagugaga

SEQ ID NO: 674659 - RNA, 24 nt, Human
uccagccugagugacagagugaga

SEQ ID NO: 674660 - RNA, 23 nt, Human
ucccaaaaaaaaaaaagcccaaa

SEQ ID NO: 674661 - RNA, 23 nt, Human
ucccaaaaaaaaaaaagcccaaa

SEQ ID NO: 674662 - RNA, 24 nt, Human
ucccaaaaugcugggacuacaggc

SEQ ID NO: 674663 - RNA, 24 nt, Human
ucccaaaaugcugggacuacaggc

SEQ ID NO: 674664 - RNA, 20 nt, Human
ucccacccaucaggccaagc

SEQ ID NO: 674665 - RNA, 20 nt, Human
ucccacccaucaggccaagc

SEQ ID NO: 674666 - RNA, 19 nt, Human
ucccccaagugugguccuc

SEQ ID NO: 674667 - RNA, 19 nt, Human
ucccccaagugugguccuc

SEQ ID NO: 674668 - RNA, 20 nt, Human
ucccugggucuuggccaccu

SEQ ID NO: 674669 - RNA, 22 nt, Human
ucccugggucuuggccaccuuc

SEQ ID NO: 674670 - RNA, 20 nt, Human
uccucggggugguugcucuu

SEQ ID NO: 674671 - RNA, 20 nt, Human
uccuugggugaggaggucau

SEQ ID NO: 674672 - RNA, 21 nt, Human
uccuugggugaggaggucauu

SEQ ID NO: 674673 - RNA, 24 nt, Human
ucucacuauguagcccaggcugga

SEQ ID NO: 674674 - RNA, 24 nt, Human
ucucacuauguagcccaggcugga

SEQ ID NO: 674675 - RNA, 21 nt, Human
ucucauugacuuuggcacagc

SEQ ID NO: 674676 - RNA, 19 nt, Human
ucucuaaaugcaacuggcu

SEQ ID NO: 674677 - RNA, 19 nt, Human
ucucuaaaugcaacuggcu

SEQ ID NO: 674678 - RNA, 21 nt, Human
ucucuacuaaaaauacaaaaa

SEQ ID NO: 674679 - RNA, 23 nt, Human
ucucuacuaaaaauacaaaaauu

SEQ ID NO: 674680 - RNA, 21 nt, Human
ucugaaagacucuggagacag

SEQ ID NO: 674681 - RNA, 23 nt, Human
ucuggcgacagcaaggagguggc

SEQ ID NO: 674682 - RNA, 23 nt, Human
ucuggcgacagcaaggagguggc

SEQ ID NO: 674683 - RNA, 23 nt, Human
ugaaaggcuguccaccuugguug

SEQ ID NO: 674684 - RNA, 18 nt, Human
ugaagagguaggagcugg

SEQ ID NO: 674685 - RNA, 18 nt, Human
ugaagagguaggagcugg

SEQ ID NO: 674686 - RNA, 20 nt, Human
ugaagcaacaguggaaccuc

SEQ ID NO: 674687 - RNA, 20 nt, Human
ugaagcaacaguggaaccuc

SEQ ID NO: 674688 - RNA, 18 nt, Human
ugaaggaagaggaugagg

SEQ ID NO: 674689 - RNA, 18 nt, Human
ugaaggaagaggaugagg

SEQ ID NO: 674690 - RNA, 19 nt, Human
ugacaugcagaaacaugac

SEQ ID NO: 674691 - RNA, 19 nt, Human
ugacaugcagaaacaugac

SEQ ID NO: 674692 - RNA, 23 nt, Human
ugacuagacagcaaaaguaacgc

SEQ ID NO: 674693 - RNA, 23 nt, Human
ugacuagacagcaaaaguaacgc

SEQ ID NO: 674694 - RNA, 18 nt, Human
ugagagaggucuacaacc

SEQ ID NO: 674695 - RNA, 18 nt, Human
ugagagaggucuacaacc

SEQ ID NO: 674696 - RNA, 18 nt, Human
ugagauaucacagcugga

SEQ ID NO: 674697 - RNA, 23 nt, Human
ugagcuggucacucuguuuccaa

SEQ ID NO: 674698 - RNA, 23 nt, Human
ugaggauggagaugaggauccug

SEQ ID NO: 674699 - RNA, 23 nt, Human
ugaggauggagaugaggauccug

SEQ ID NO: 674700 - RNA, 23 nt, Human
ugauggguaccucuucaagacua

SEQ ID NO: 674701 - RNA, 23 nt, Human
ugauggguaccucuucaagacua

SEQ ID NO: 674702 - RNA, 18 nt, Human
ugcagaauaagucagagg

SEQ ID NO: 674703 - RNA, 18 nt, Human
ugcagaauaagucagagg

SEQ ID NO: 674704 - RNA, 19 nt, Human
ugcagccugaagguccucg

SEQ ID NO: 674705 - RNA, 20 nt, Human
ugcuggauucugaaagacuc

SEQ ID NO: 674706 - RNA, 24 nt, Human
ugcuggcucacgccuguaguccca

SEQ ID NO: 674707 - RNA, 24 nt, Human
ugcuggcucacgccuguaguccca

SEQ ID NO: 674708 - RNA, 24 nt, Human
ugcugggacuacaggcgugagcca

SEQ ID NO: 674709 - RNA, 24 nt, Human
ugcugggacuacaggcgugagcca

SEQ ID NO: 674710 - RNA, 18 nt, Human
uggaaaaccaucacacuu

SEQ ID NO: 674711 - RNA, 18 nt, Human
uggaaaaccaucacacuu

SEQ ID NO: 674712 - RNA, 20 nt, Human
uggaaaggggcaggacucug

SEQ ID NO: 674713 - RNA, 20 nt, Human
uggaaaggggcaggacucug

SEQ ID NO: 674714 - RNA, 22 nt, Human
uggaaaggggcaggacucuggg

SEQ ID NO: 674715 - RNA, 22 nt, Human
uggaaaggggcaggacucuggg

SEQ ID NO: 674716 - RNA, 18 nt, Human
uggaaccuccagauacag

SEQ ID NO: 674717 - RNA, 20 nt, Human
uggaaccuccagauacagau

SEQ ID NO: 674718 - RNA, 18 nt, Human
uggaacgaacgauacaug

SEQ ID NO: 674719 - RNA, 18 nt, Human
uggaacgaacgauacaug

SEQ ID NO: 674720 - RNA, 21 nt, Human
uggacuugaaauccugggccg

SEQ ID NO: 674721 - RNA, 21 nt, Human
uggacuugaaauccugggccg

SEQ ID NO: 674722 - RNA, 20 nt, Human
uggcaagaaccagagcuguu

SEQ ID NO: 674723 - RNA, 20 nt, Human
uggcaagaaccagagcuguu

SEQ ID NO: 674724 - RNA, 19 nt, Human
uggcacagccacuugaaac

SEQ ID NO: 674725 - RNA, 24 nt, Human
uggcagauuuccacuauauguaga

SEQ ID NO: 674726 - RNA, 24 nt, Human
uggcagauuuccacuauauguaga

SEQ ID NO: 674727 - RNA, 24 nt, Human
uggccaacauggugaaauccuguc

SEQ ID NO: 674728 - RNA, 24 nt, Human
uggccaacauggugaaauccuguc

SEQ ID NO: 674729 - RNA, 22 nt, Human
uggccucaaaaaacaaaaaaaa

SEQ ID NO: 674730 - RNA, 22 nt, Human
uggccucaaaaaacaaaaaaaa

SEQ ID NO: 674731 - RNA, 22 nt, Human
uggcucacgccuguaaucccag

SEQ ID NO: 674732 - RNA, 24 nt, Human
uggcucacgccuguaaucccagca

SEQ ID NO: 674733 - RNA, 24 nt, Human
uggcucacgccuguaaucccagca

SEQ ID NO: 674734 - RNA, 21 nt, Human
uggcucacgccuguaguccca

SEQ ID NO: 674735 - RNA, 21 nt, Human
uggcucacgccuguaguccca

SEQ ID NO: 674736 - RNA, 22 nt, Human
uggcucacgccuguagucccag

SEQ ID NO: 674737 - RNA, 22 nt, Human
uggcucacgccuguagucccag

SEQ ID NO: 674738 - RNA, 18 nt, Human
uggcucaggguagcuggu

SEQ ID NO: 674739 - RNA, 18 nt, Human
uggcucaggguagcuggu

SEQ ID NO: 674740 - RNA, 21 nt, Human
ugggacuacaggcgugagcca

SEQ ID NO: 674741 - RNA, 21 nt, Human
ugggacuacaggcgugagcca

SEQ ID NO: 674742 - RNA, 22 nt, Human
ugggacuacaggcgugagccac

SEQ ID NO: 674743 - RNA, 22 nt, Human
ugggacuacaggcgugagccac

SEQ ID NO: 674744 - RNA, 22 nt, Human
ugggacuacaggcgugagccac

SEQ ID NO: 674745 - RNA, 22 nt, Human
ugggacuacaggcgugagccac

SEQ ID NO: 674746 - RNA, 22 nt, Human
ugggacuacaggcgugagccac

SEQ ID NO: 674747 - RNA, 22 nt, Human
ugggacuacaggcgugagccac

SEQ ID NO: 674748 - RNA, 24 nt, Human
ugggacuacaggcgugagccacug

SEQ ID NO: 674749 - RNA, 24 nt, Human
ugggacuacaggcgugagccacug

SEQ ID NO: 674750 - RNA, 25 nt, Human
ugggacuacaggcgugagccacugu

SEQ ID NO: 674751 - RNA, 25 nt, Human
ugggacuacaggcgugagccacugu

SEQ ID NO: 674752 - RNA, 24 nt, Human
ugggaggccaaggcaggcggauca

SEQ ID NO: 674753 - RNA, 24 nt, Human
ugggaggccaaggcaggcggauca

SEQ ID NO: 674754 - RNA, 19 nt, Human
uggugaagcaggcccuggu

SEQ ID NO: 674755 - RNA, 19 nt, Human
uggugaagcaggcccuggu

SEQ ID NO: 674756 - RNA, 23 nt, Human
uggugugucacaaagagcuccaa

SEQ ID NO: 674757 - RNA, 23 nt, Human
uggugugucacaaagagcuccaa

SEQ ID NO: 674758 - RNA, 24 nt, Human
ugugaaggaagaggaugaggaugg

SEQ ID NO: 674759 - RNA, 24 nt, Human
ugugaaggaagaggaugaggaugg

SEQ ID NO: 674760 - RNA, 22 nt, Human
uguggugagaggagguccagcc

SEQ ID NO: 674761 - RNA, 21 nt, Human
uguuaagugaaugaagaggua

SEQ ID NO: 674762 - RNA, 21 nt, Human
uguuaagugaaugaagaggua

SEQ ID NO: 674763 - RNA, 18 nt, Human
uuacucaacacuccacaa

SEQ ID NO: 674764 - RNA, 18 nt, Human
uuacucaacacuccacaa

SEQ ID NO: 674765 - RNA, 18 nt, Human
uuagcugggcgugcuggc

SEQ ID NO: 674766 - RNA, 18 nt, Human
uuagcugggcgugcuggc

SEQ ID NO: 674767 - RNA, 24 nt, Human
uuagcugggcgugcuggcucacgc

SEQ ID NO: 674768 - RNA, 24 nt, Human
uuagcugggcgugcuggcucacgc

SEQ ID NO: 674769 - RNA, 24 nt, Human
uuaguccugacuagacagcaaaag

SEQ ID NO: 674770 - RNA, 24 nt, Human
uuaguccugacuagacagcaaaag

SEQ ID NO: 674771 - RNA, 26 nt, Human
uucaaagcccuccgccuagccaucuc

SEQ ID NO: 674772 - RNA, 26 nt, Human
uucaaagcccuccgccuagccaucuc

SEQ ID NO: 674773 - RNA, 23 nt, Human
uucaaaggcugacaaggcacaga

SEQ ID NO: 674774 - RNA, 20 nt, Human
uucaaagguagaaacccacc

SEQ ID NO: 674775 - RNA, 20 nt, Human
uucaaagguagaaacccacc

SEQ ID NO: 674776 - RNA, 23 nt, Human
uucaaagguagaaacccacccag

SEQ ID NO: 674777 - RNA, 23 nt, Human
uucaaagguagaaacccacccag

SEQ ID NO: 674778 - RNA, 18 nt, Human
uucaaguaagagcaugua

SEQ ID NO: 674779 - RNA, 18 nt, Human
uucaaguaagagcaugua

SEQ ID NO: 674780 - RNA, 21 nt, Human
uucagagggcacggagcuggc

SEQ ID NO: 674781 - RNA, 18 nt, Human
uuccugucugcagaaggg

SEQ ID NO: 674782 - RNA, 21 nt, Human
uugcagccugaagguccucgg

SEQ ID NO: 674783 - RNA, 21 nt, Human
uugcaguuucaaagguagaaa

SEQ ID NO: 674784 - RNA, 21 nt, Human
uugcaguuucaaagguagaaa

SEQ ID NO: 674785 - RNA, 21 nt, Human
uuuaugaguuuuuacauuugc

SEQ ID NO: 674786 - RNA, 21 nt, Human
uuuaugaguuuuuacauuugc

SEQ ID NO: 674787 - RNA, 24 nt, Human
uuucaggacagcagccugccuccu

SEQ ID NO: 674788 - RNA, 24 nt, Human
uuucaggacagcagccugccuccu

SEQ ID NO: 674789 - RNA, 18 nt, Human
aagaaucugugacuuccu

SEQ ID NO: 674790 - RNA, 19 nt, Human
aagcucugcgggcgggcgg

SEQ ID NO: 674791 - RNA, 20 nt, Human
agaaggcuuuuccaugaaaa

SEQ ID NO: 674792 - RNA, 20 nt, Human
caaaagcucugcgggcgggc

SEQ ID NO: 674793 - RNA, 22 nt, Human
ccgccgccuuucaaaagcucug

SEQ ID NO: 674794 - RNA, 18 nt, Human
ccucccgccgccuuucaa

SEQ ID NO: 674795 - RNA, 23 nt, Human
ccucccgccgccuuucaaaagcu

SEQ ID NO: 674796 - RNA, 27 nt, Human
gaaucagagccaggcacauuauagaaa

SEQ ID NO: 674797 - RNA, 24 nt, Human
uagaaaagaaucugugacuuccua

SEQ ID NO: 674798 - RNA, 22 nt, Human
uagcaaguuauucuaacaguuu

SEQ ID NO: 674799 - RNA, 22 nt, Human
uauaagaaggcuuuuccaugaa

SEQ ID NO: 674800 - RNA, 20 nt, Human
ucgccgccucccgccgccuu

SEQ ID NO: 674801 - RNA, 22 nt, Human
ugcgggcgggcgggggcugcgg

SEQ ID NO: 674802 - RNA, 22 nt, Human
ugcucuguuaacaaauugaaga

SEQ ID NO: 674803 - RNA, 21 nt, Human
uuuguauuucaguaaauuuau

SEQ ID NO: 674804 - RNA, 19 nt, Human
uuuuuuguauuucaguaaa

SEQ ID NO: 674805 - RNA, 20 nt, Human
agccuuguccuccuggagca

SEQ ID NO: 674806 - RNA, 18 nt, Human
aguaucuugucccuggau

SEQ ID NO: 674807 - RNA, 19 nt, Human
gaguaucuugucccuggau

SEQ ID NO: 674808 - RNA, 21 nt, Human
ucagccuuguccuccuggagc

SEQ ID NO: 674809 - RNA, 22 nt, Human
uggauugcuugucagccuuguc

SEQ ID NO: 674810 - RNA, 22 nt, Human
ugucagccuuguccuccuggag

SEQ ID NO: 674811 - RNA, 26 nt, Human
uuccugguccuggugaguaucuuguc

SEQ ID NO: 674812 - RNA, 23 nt, Human
aauuggacagauggacaaaaaca

SEQ ID NO: 674813 - RNA, 24 nt, Human
acagagaugggcggacagacagac

SEQ ID NO: 674814 - RNA, 18 nt, Human
acaggacucauggugggg

SEQ ID NO: 674815 - RNA, 18 nt, Human
agccucucaucugcccag

SEQ ID NO: 674816 - RNA, 19 nt, Human
aggaccaccaggggcucug

SEQ ID NO: 674817 - RNA, 21 nt, Human
cacaggacucaugguggggcc

SEQ ID NO: 674818 - RNA, 21 nt, Human
cagacagacaggucugaacaa

SEQ ID NO: 674819 - RNA, 22 nt, Human
cagcccaggaggagaggggcgg

SEQ ID NO: 674820 - RNA, 18 nt, Human
cagcuggacuccccugcc

SEQ ID NO: 674821 - RNA, 19 nt, Human
cagcuggacuccccugcca

SEQ ID NO: 674822 - RNA, 22 nt, Human
ccaccucuuccacucucagcug

SEQ ID NO: 674823 - RNA, 24 nt, Human
cggacagacagacaggucugaaca

SEQ ID NO: 674824 - RNA, 19 nt, Human
cucucagcuggacuccccu

SEQ ID NO: 674825 - RNA, 18 nt, Human
cuggacuccccugccagg

SEQ ID NO: 674826 - RNA, 23 nt, Human
gacaaagaggacaguaagagaaa

SEQ ID NO: 674827 - RNA, 19 nt, Human
gacucaugguggggccaga

SEQ ID NO: 674828 - RNA, 19 nt, Human
gaggggcggcuggugggca

SEQ ID NO: 674829 - RNA, 28 nt, Human
gccaccucuuccacucucagcuggacuc

SEQ ID NO: 674830 - RNA, 19 nt, Human
gcccaggaggagaggggcg

SEQ ID NO: 674831 - RNA, 25 nt, Human
gccugcggagggauagaggggccgg

SEQ ID NO: 674832 - RNA, 18 nt, Human
gcggcuggugggcagacg

SEQ ID NO: 674833 - RNA, 19 nt, Human
ggacaaaaacagguggggg

SEQ ID NO: 674834 - RNA, 21 nt, Human
ggacacaggacucaugguggg

SEQ ID NO: 674835 - RNA, 18 nt, Human
ggagggacggaugggugg

SEQ ID NO: 674836 - RNA, 20 nt, Human
ggcucugggaaaggggguua

SEQ ID NO: 674837 - RNA, 23 nt, Human
ggcuggugggcagacggagggac

SEQ ID NO: 674838 - RNA, 20 nt, Human
ggggccagacuucagcucug

SEQ ID NO: 674839 - RNA, 22 nt, Human
ggugggggcugaagacagacac

SEQ ID NO: 674840 - RNA, 26 nt, Human
uaagagaaagauggucagauagacaa

SEQ ID NO: 674841 - RNA, 19 nt, Human
ucagcuggacuccccugcc

SEQ ID NO: 674842 - RNA, 18 nt, Human
ucccccagccauguccgg

SEQ ID NO: 674843 - RNA, 24 nt, Human
ucugcagcccaggaggagaggggc

SEQ ID NO: 674844 - RNA, 21 nt, Human
ugaauggacagauggcuggca

SEQ ID NO: 674845 - RNA, 21 nt, Human
ugcggagggauagaggggccg

SEQ ID NO: 674846 - RNA, 22 nt, Human
uggacaaaaacaggugggggcu

SEQ ID NO: 674847 - RNA, 19 nt, Human
uggcagcuguggcgagcug

SEQ ID NO: 674848 - RNA, 22 nt, Human
aacccucuggcacccacaaccu

SEQ ID NO: 674849 - RNA, 18 nt, Human
aaggccccugacuguggc

SEQ ID NO: 674850 - RNA, 19 nt, Human
accaccugccgagacccca

SEQ ID NO: 674851 - RNA, 18 nt, Human
agggaggccaccuggagc

SEQ ID NO: 674852 - RNA, 19 nt, Human
agggggcacaggucucaga

SEQ ID NO: 674853 - RNA, 21 nt, Human
aggguggggagggggcacagg

SEQ ID NO: 674854 - RNA, 23 nt, Human
aggguggggagggggcacagguc

SEQ ID NO: 674855 - RNA, 18 nt, Human
aguauuuuguuccuggau

SEQ ID NO: 674856 - RNA, 18 nt, Human
caacccucuggcacccac

SEQ ID NO: 674857 - RNA, 22 nt, Human
cacccacaaccuuccguggcuc

SEQ ID NO: 674858 - RNA, 21 nt, Human
caccugccgagaccccagagc

SEQ ID NO: 674859 - RNA, 23 nt, Human
caggacccaaggcaggcccagga

SEQ ID NO: 674860 - RNA, 23 nt, Human
ccaggacccaaggcaggcccagg

SEQ ID NO: 674861 - RNA, 22 nt, Human
cccaaaguccucuuccucgucc

SEQ ID NO: 674862 - RNA, 24 nt, Human
cccaggacccaaggcaggcccagg

SEQ ID NO: 674863 - RNA, 22 nt, Human
ccccaggacccaaggcaggccc

SEQ ID NO: 674864 - RNA, 19 nt, Human
cucugaccacaacccucug

SEQ ID NO: 674865 - RNA, 19 nt, Human
cuggcacccacaaccuucc

SEQ ID NO: 674866 - RNA, 22 nt, Human
gacuguggcucugaccacaacc

SEQ ID NO: 674867 - RNA, 20 nt, Human
gagaccccagagcuggccua

SEQ ID NO: 674868 - RNA, 18 nt, Human
gaggguggggagggggca

SEQ ID NO: 674869 - RNA, 21 nt, Human
gaggguggggagggggcacag

SEQ ID NO: 674870 - RNA, 19 nt, Human
gaguauuuuguuccuggau

SEQ ID NO: 674871 - RNA, 22 nt, Human
gcccaggaccuugcaugaccag

SEQ ID NO: 674872 - RNA, 22 nt, Human
ggaccaccugccgagaccccag

SEQ ID NO: 674873 - RNA, 23 nt, Human
ggacccaaggcaggcccaggacc

SEQ ID NO: 674874 - RNA, 18 nt, Human
ggagaagccuguccccca

SEQ ID NO: 674875 - RNA, 20 nt, Human
ggaggccaccuggagccugg

SEQ ID NO: 674876 - RNA, 19 nt, Human
ggagggaggguggggaggg

SEQ ID NO: 674877 - RNA, 21 nt, Human
ggagguggggagggagggugg

SEQ ID NO: 674878 - RNA, 26 nt, Human
ggagguggggagggaggguggggagg

SEQ ID NO: 674879 - RNA, 28 nt, Human
ggagguggggagggaggguggggagggg

SEQ ID NO: 674880 - RNA, 21 nt, Human
ggugaguauuuuguuccugga

SEQ ID NO: 674881 - RNA, 19 nt, Human
guggcucugaccacaaccc

SEQ ID NO: 674882 - RNA, 21 nt, Human
ucagccuuguccgccuggagc

SEQ ID NO: 674883 - RNA, 23 nt, Human
ucagccuuguccgccuggagcaa

SEQ ID NO: 674884 - RNA, 20 nt, Human
ucccccaaaguccucuuccu

SEQ ID NO: 674885 - RNA, 24 nt, Human
ucgcggaccaccugccgagacccc

SEQ ID NO: 674886 - RNA, 19 nt, Human
ugaccacaacccucuggca

SEQ ID NO: 674887 - RNA, 21 nt, Human
ugccgagaccccagagcuggc

SEQ ID NO: 674888 - RNA, 22 nt, Human
uggauugcuugucagccuuguc

SEQ ID NO: 674889 - RNA, 22 nt, Human
uggggagggaggguggggaggg

SEQ ID NO: 674890 - RNA, 21 nt, Human
aaaaaaacaaaagacugcagg

SEQ ID NO: 674891 - RNA, 22 nt, Human
aaaaaaaggcagaccugaggca

SEQ ID NO: 674892 - RNA, 19 nt, Human
aaaaaaauaugcaaacaca

SEQ ID NO: 674893 - RNA, 18 nt, Human
aaaaaaggcagaccugag

SEQ ID NO: 674894 - RNA, 20 nt, Human
aaaaucacucaaacaugaga

SEQ ID NO: 674895 - RNA, 23 nt, Human
aaacugcuuucauaauuuccagu

SEQ ID NO: 674896 - RNA, 18 nt, Human
acaugagaauugaaaaug

SEQ ID NO: 674897 - RNA, 23 nt, Human
acuccaaaaaaauaugcaaacaa

SEQ ID NO: 674898 - RNA, 23 nt, Human
agaagccagaagcugagucacuu

SEQ ID NO: 674899 - RNA, 19 nt, Human
agaggauuacugcauuuau

SEQ ID NO: 674900 - RNA, 27 nt, Human
agcaacagcaggagaaugccgguaccc

SEQ ID NO: 674901 - RNA, 22 nt, Human
agccagaagcugagucacuuca

SEQ ID NO: 674902 - RNA, 19 nt, Human
aggcaaugcgagaaaccaa

SEQ ID NO: 674903 - RNA, 22 nt, Human
aguguaagagaaguaaaagucu

SEQ ID NO: 674904 - RNA, 21 nt, Human
auaugcaaaaauaaaaaaaca

SEQ ID NO: 674905 - RNA, 23 nt, Human
auuacaauauucugcacuccaaa

SEQ ID NO: 674906 - RNA, 24 nt, Human
caaaaguaaaacacacauauauaa

SEQ ID NO: 674907 - RNA, 23 nt, Human
cagaugaauguaacaaugaccac

SEQ ID NO: 674908 - RNA, 23 nt, Human
ccaaagcuccaaaucacuuauga

SEQ ID NO: 674909 - RNA, 21 nt, Human
ccggaacauuuaaauaugaug

SEQ ID NO: 674910 - RNA, 22 nt, Human
ccuagcgucggccucaaagagc

SEQ ID NO: 674911 - RNA, 21 nt, Human
ccucaaagagcacaguucucc

SEQ ID NO: 674912 - RNA, 22 nt, Human
cuaccgagcagaucugaaaugc

SEQ ID NO: 674913 - RNA, 21 nt, Human
cuugagaauaguuuuaaaguu

SEQ ID NO: 674914 - RNA, 20 nt, Human
cuuuaguuuucacauucacc

SEQ ID NO: 674915 - RNA, 21 nt, Human
gcauaucugccccauuaaaca

SEQ ID NO: 674916 - RNA, 19 nt, Human
gccccuagcgucggccuca

SEQ ID NO: 674917 - RNA, 23 nt, Human
ggaaaaagcaacauauuucaugc

SEQ ID NO: 674918 - RNA, 19 nt, Human
ggagaaaaacugcuuucau

SEQ ID NO: 674919 - RNA, 18 nt, Human
ggggaaacuaaugaagca

SEQ ID NO: 674920 - RNA, 21 nt, Human
uaaaaaaacaaaagacugcag

SEQ ID NO: 674921 - RNA, 22 nt, Human
uaauuacaauauucugcacucc

SEQ ID NO: 674922 - RNA, 20 nt, Human
uaauuccaucaaggauucuc

SEQ ID NO: 674923 - RNA, 22 nt, Human
uacccagauguuucuuacuggc

SEQ ID NO: 674924 - RNA, 24 nt, Human
uagaaaaaagacuuacauucucau

SEQ ID NO: 674925 - RNA, 23 nt, Human
uagugcuuagucugagaggcaau

SEQ ID NO: 674926 - RNA, 23 nt, Human
uaugacauuaauuacaauauucu

SEQ ID NO: 674927 - RNA, 24 nt, Human
uauuuucucuugagaauaguuuua

SEQ ID NO: 674928 - RNA, 20 nt, Human
ucaugaguauacuguuugua

SEQ ID NO: 674929 - RNA, 23 nt, Human
ucauuucuuucuguugccuccag

SEQ ID NO: 674930 - RNA, 25 nt, Human
uccaguguaagccacaaagaagcuu

SEQ ID NO: 674931 - RNA, 24 nt, Human
uccuucucucuggucccuuuacca

SEQ ID NO: 674932 - RNA, 18 nt, Human
ucuaaacuucaacgaaag

SEQ ID NO: 674933 - RNA, 20 nt, Human
ucucuggucccuuuaccaaa

SEQ ID NO: 674934 - RNA, 18 nt, Human
ugaagcauuuuccucauu

SEQ ID NO: 674935 - RNA, 18 nt, Human
ugaauguaacaaugacca

SEQ ID NO: 674936 - RNA, 23 nt, Human
ugacaagagcaagcuguauucaa

SEQ ID NO: 674937 - RNA, 21 nt, Human
ugcaaacacagguuugcuaaa

SEQ ID NO: 674938 - RNA, 20 nt, Human
ugcuuugcuuuuuagugcuu

SEQ ID NO: 674939 - RNA, 22 nt, Human
uggaaaaagcaacauauuucau

SEQ ID NO: 674940 - RNA, 19 nt, Human
ugugccuguuucaggauga

SEQ ID NO: 674941 - RNA, 22 nt, Human
uuacaaaugucucaagaaagua

SEQ ID NO: 674942 - RNA, 24 nt, Human
uucaccaaaacauuuuaaaaucac

SEQ ID NO: 674943 - RNA, 24 nt, Human
uuccaguguaagccacaagguacc

SEQ ID NO: 674944 - RNA, 23 nt, Human
uuggaaagagagcacugagaagc

SEQ ID NO: 674945 - RNA, 22 nt, Human
uuucaggaugaacaguuuuguu

SEQ ID NO: 674946 - RNA, 20 nt, Human
uuuuccucauuacacuuuug

SEQ ID NO: 674947 - RNA, 21 nt, Human
aagccaccacagaugucccag

SEQ ID NO: 674948 - RNA, 22 nt, Human
aaguucacagccacaucuucaa

SEQ ID NO: 674949 - RNA, 18 nt, Human
acaaaagccaccacagau

SEQ ID NO: 674950 - RNA, 18 nt, Human
acugcucuucaauguucc

SEQ ID NO: 674951 - RNA, 19 nt, Human
agccaccacagauguccca

SEQ ID NO: 674952 - RNA, 22 nt, Human
auuccugacacuuauacaguuu

SEQ ID NO: 674953 - RNA, 25 nt, Human
caaaagccaccacagaugucccagg

SEQ ID NO: 674954 - RNA, 23 nt, Human
cagguuccugaagguuucccaca

SEQ ID NO: 674955 - RNA, 23 nt, Human
ccauucuuuuuguuuuguuccua

SEQ ID NO: 674956 - RNA, 24 nt, Human
cccguagccaggguaggucccagc

SEQ ID NO: 674957 - RNA, 19 nt, Human
cugaagguuucccacauca

SEQ ID NO: 674958 - RNA, 22 nt, Human
cuggcugaaaccuucuccgcca

SEQ ID NO: 674959 - RNA, 21 nt, Human
gcagauaacugaaggguuucc

SEQ ID NO: 674960 - RNA, 19 nt, Human
ggcugugcggugucccggg

SEQ ID NO: 674961 - RNA, 20 nt, Human
uaacugaaggguuucccaca

SEQ ID NO: 674962 - RNA, 18 nt, Human
ucacagagucucucuacc

SEQ ID NO: 674963 - RNA, 21 nt, Human
uccccugguuuuuguacugcu

SEQ ID NO: 674964 - RNA, 19 nt, Human
ucccggguccucccaacuc

SEQ ID NO: 674965 - RNA, 19 nt, Human
uccugacacuuauacaguu

SEQ ID NO: 674966 - RNA, 21 nt, Human
ucugugaaggauccagcaaag

SEQ ID NO: 674967 - RNA, 21 nt, Human
ugauuucugagauuucucccc

SEQ ID NO: 674968 - RNA, 22 nt, Human
uguacugcucuucaauguucca

SEQ ID NO: 674969 - RNA, 18 nt, Human
ugugaaggauccagcaaa

SEQ ID NO: 674970 - RNA, 27 nt, Human
uguuccauucuuuuuguuuuguuccua

SEQ ID NO: 674971 - RNA, 22 nt, Human
uguuuuguuccuauaguggcca

SEQ ID NO: 674972 - RNA, 20 nt, Human
uuccacauacacugcuuucc

SEQ ID NO: 674973 - RNA, 21 nt, Human
uucccacauuucuuacauuua

SEQ ID NO: 674974 - RNA, 27 nt, Human
uuguuuuguuccuauaguggccagguu

SEQ ID NO: 674975 - RNA, 24 nt, Human
uuucuuguucagacugagauuugc

SEQ ID NO: 674976 - RNA, 22 nt, Human
aagcggaggcagauccuccugg

SEQ ID NO: 674977 - RNA, 23 nt, Human
aagguguuugacuucaggcagga

SEQ ID NO: 674978 - RNA, 19 nt, Human
aaucaugguuuccauucug

SEQ ID NO: 674979 - RNA, 22 nt, Human
aaucaugguuuccauucuguga

SEQ ID NO: 674980 - RNA, 21 nt, Human
acuagggcgagcggugaccug

SEQ ID NO: 674981 - RNA, 24 nt, Human
caccgcccggccggccccuugggc

SEQ ID NO: 674982 - RNA, 24 nt, Human
caccguccugcggagccggggccg

SEQ ID NO: 674983 - RNA, 22 nt, Human
cccagccccgcaggcuccgcga

SEQ ID NO: 674984 - RNA, 22 nt, Human
ccccuuggcuaugauuucccug

SEQ ID NO: 674985 - RNA, 21 nt, Human
cccgcgcccgcuugggugccg

SEQ ID NO: 674986 - RNA, 23 nt, Human
cccggagcccagauccgucuccc

SEQ ID NO: 674987 - RNA, 18 nt, Human
ccgccccuucgccuccgc

SEQ ID NO: 674988 - RNA, 20 nt, Human
ccgucgucaccgcccggccg

SEQ ID NO: 674989 - RNA, 21 nt, Human
ccuccgccgucgucaccgccc

SEQ ID NO: 674990 - RNA, 19 nt, Human
ccucugccccaccgcuccc

SEQ ID NO: 674991 - RNA, 24 nt, Human
ccuggggcuccgcagccucugccc

SEQ ID NO: 674992 - RNA, 22 nt, Human
ccuuauacugauagauuucccc

SEQ ID NO: 674993 - RNA, 22 nt, Human
ccuucgccuccgccgucgucac

SEQ ID NO: 674994 - RNA, 21 nt, Human
cgagcggugaccuggggacgc

SEQ ID NO: 674995 - RNA, 20 nt, Human
cgccuccgccgucgucaccg

SEQ ID NO: 674996 - RNA, 21 nt, Human
cgccuccgccgucgucaccgc

SEQ ID NO: 674997 - RNA, 22 nt, Human
cggccccuugggccccagcgcc

SEQ ID NO: 674998 - RNA, 20 nt, Human
cggcgcccagccccgcaggc

SEQ ID NO: 674999 - RNA, 24 nt, Human
cgggacaaauccagacggggcguc

SEQ ID NO: 675000 - RNA, 19 nt, Human
cgucccucccggagcccag

SEQ ID NO: 675001 - RNA, 21 nt, Human
cucccggagcccagauccguc

SEQ ID NO: 675002 - RNA, 25 nt, Human
cuccgcagccucugccccaccgcuc

SEQ ID NO: 675003 - RNA, 21 nt, Human
cuccuggggcuccgcagccuc

SEQ ID NO: 675004 - RNA, 23 nt, Human
cugcugcucuuggaaaaaucugg

SEQ ID NO: 675005 - RNA, 19 nt, Human
cuggcccgcacagccccgc

SEQ ID NO: 675006 - RNA, 18 nt, Human
gagcccagauccgucucc

SEQ ID NO: 675007 - RNA, 19 nt, Human
gaggggcccgggccgggcc

SEQ ID NO: 675008 - RNA, 20 nt, Human
gaggggcccgggccgggccu

SEQ ID NO: 675009 - RNA, 21 nt, Human
gaggucccuuccuguccaccu

SEQ ID NO: 675010 - RNA, 18 nt, Human
gcccgggucccgccgccc

SEQ ID NO: 675011 - RNA, 21 nt, Human
gccggccccuugggccccagc

SEQ ID NO: 675012 - RNA, 23 nt, Human
gccucugccccaccgcucccgac

SEQ ID NO: 675013 - RNA, 25 nt, Human
ggagccggggccgggccgucgagga

SEQ ID NO: 675014 - RNA, 19 nt, Human
ggcccgcacagccccgcgc

SEQ ID NO: 675015 - RNA, 20 nt, Human
ggcucuucggcgcccagccc

SEQ ID NO: 675016 - RNA, 23 nt, Human
gggcccgggccgggccuacggga

SEQ ID NO: 675017 - RNA, 20 nt, Human
gggcccgggucccgccgccc

SEQ ID NO: 675018 - RNA, 18 nt, Human
gggccgggccuacgggac

SEQ ID NO: 675019 - RNA, 18 nt, Human
gggggucgugcucgggga

SEQ ID NO: 675020 - RNA, 24 nt, Human
uaauauuuauaaauuuuuacuugu

SEQ ID NO: 675021 - RNA, 22 nt, Human
ucccuuccuguccaccucacca

SEQ ID NO: 675022 - RNA, 22 nt, Human
uccgcagccucugccccaccgc

SEQ ID NO: 675023 - RNA, 22 nt, Human
uccgccuggcccgcacagcccc

SEQ ID NO: 675024 - RNA, 18 nt, Human
ucuauagucuaguauugu

SEQ ID NO: 675025 - RNA, 21 nt, Human
ucucgcccaccggaggccaaa

SEQ ID NO: 675026 - RNA, 21 nt, Human
ucucugauauaaaaugagguc

SEQ ID NO: 675027 - RNA, 18 nt, Human
ucugcuccagaggggccc

SEQ ID NO: 675028 - RNA, 22 nt, Human
ugagucuucagauuaugagucc

SEQ ID NO: 675029 - RNA, 21 nt, Human
ugccccaccgcucccgacagg

SEQ ID NO: 675030 - RNA, 22 nt, Human
ugccggcccggcucuucggcgc

SEQ ID NO: 675031 - RNA, 19 nt, Human
uggaaaaaucuggaggacu

SEQ ID NO: 675032 - RNA, 25 nt, Human
uguccaccucaccaaggccguucug

SEQ ID NO: 675033 - RNA, 22 nt, Human
uguggucuuguuauaaucaugg

SEQ ID NO: 675034 - RNA, 22 nt, Human
uucugcuccagaggggcccggg

SEQ ID NO: 675035 - RNA, 21 nt, Human
aaaaagugcccagaaaucaaa

SEQ ID NO: 675036 - RNA, 21 nt, Human
aaagagaaaaaaaagaacgau

SEQ ID NO: 675037 - RNA, 19 nt, Human
aagguguccaaaaacagau

SEQ ID NO: 675038 - RNA, 21 nt, Human
acuacaucagcaauguuaaaa

SEQ ID NO: 675039 - RNA, 18 nt, Human
agaaaaaaaagaacgaug

SEQ ID NO: 675040 - RNA, 21 nt, Human
caauguuaaaaagugcccaga

SEQ ID NO: 675041 - RNA, 23 nt, Human
cuuacuuuuaaaaaccuuuugaa

SEQ ID NO: 675042 - RNA, 23 nt, Human
cuuuuuaaaaaagagaaaaaaaa

SEQ ID NO: 675043 - RNA, 18 nt, Human
uacacaugaaauuaaacc

SEQ ID NO: 675044 - RNA, 25 nt, Human
uacuccuuaaaacuuacuuuuaaaa

SEQ ID NO: 675045 - RNA, 21 nt, Human
uccauacacaugaaauuaaac

SEQ ID NO: 675046 - RNA, 23 nt, Human
uccauacacaugaaauuaaacca

SEQ ID NO: 675047 - RNA, 19 nt, Human
uccuaguuuacauuaagau

SEQ ID NO: 675048 - RNA, 20 nt, Human
ugaaaaaaaacuacaaagcu

SEQ ID NO: 675049 - RNA, 21 nt, Human
ugaaaaaaaacuacaaagcua

SEQ ID NO: 675050 - RNA, 24 nt, Human
ugaaaaacaaagcauggguauuaa

SEQ ID NO: 675051 - RNA, 20 nt, Human
ugugaaaaacaaagcauggg

SEQ ID NO: 675052 - RNA, 23 nt, Human
agggcuggguucuggaguugggc

SEQ ID NO: 675053 - RNA, 21 nt, Human
cgggcuggggcugugcugggc

SEQ ID NO: 675054 - RNA, 19 nt, Human
cuagagaagggcuggguuc

SEQ ID NO: 675055 - RNA, 21 nt, Human
cucaaugcugggcuuggucuc

SEQ ID NO: 675056 - RNA, 22 nt, Human
cuccgggcuggggcugugcugg

SEQ ID NO: 675057 - RNA, 23 nt, Human
cuggagcagggccggggcagggg

SEQ ID NO: 675058 - RNA, 18 nt, Human
cugggcccccccagggca

SEQ ID NO: 675059 - RNA, 21 nt, Human
gcgggagaaguucggccaccc

SEQ ID NO: 675060 - RNA, 21 nt, Human
gcugggcuccgggcuggggcu

SEQ ID NO: 675061 - RNA, 21 nt, Human
gcugugcugggcccccccagg

SEQ ID NO: 675062 - RNA, 19 nt, Human
ggauuggguucuagagagg

SEQ ID NO: 675063 - RNA, 19 nt, Human
ggcagggggcugggcuccg

SEQ ID NO: 675064 - RNA, 18 nt, Human
ggccggggcagggggcug

SEQ ID NO: 675065 - RNA, 22 nt, Human
ggccggggcagggggcugggcu

SEQ ID NO: 675066 - RNA, 21 nt, Human
gggcuggguucuggagcaggg

SEQ ID NO: 675067 - RNA, 22 nt, Human
gggggcugggcuccgggcuggg

SEQ ID NO: 675068 - RNA, 18 nt, Human
gugcugggcccccccagg

SEQ ID NO: 675069 - RNA, 24 nt, Human
uagaacagagcuuauucucaaugc

SEQ ID NO: 675070 - RNA, 21 nt, Human
uagagaggaacuuguccuccg

SEQ ID NO: 675071 - RNA, 20 nt, Human
ucugggcuggguucuggagc

SEQ ID NO: 675072 - RNA, 23 nt, Human
uggagcagggccggggcaggggg

SEQ ID NO: 675073 - RNA, 25 nt, Human
uggagcagggccggggcagggggcu

SEQ ID NO: 675074 - RNA, 23 nt, Human
ugggcucuagcacauagcuuggc

SEQ ID NO: 675075 - RNA, 21 nt, Human
uuauucucaaugcugggcuug

SEQ ID NO: 675076 - RNA, 19 nt, Human
uucuggaguugggcugggg

SEQ ID NO: 675077 - RNA, 21 nt, Human
uucuggaguugggcuggggcu

SEQ ID NO: 675078 - RNA, 18 nt, Human
aaaaaaaacagacuuucc

SEQ ID NO: 675079 - RNA, 20 nt, Human
aagaaaaaaaaaaaacagag

SEQ ID NO: 675080 - RNA, 20 nt, Human
aagaagcgggauggggagag

SEQ ID NO: 675081 - RNA, 22 nt, Human
aagcuccugcccccccaaccuc

SEQ ID NO: 675082 - RNA, 23 nt, Human
aagggcacuugugccaguggcuc

SEQ ID NO: 675083 - RNA, 18 nt, Human
aaguucauagagaagggg

SEQ ID NO: 675084 - RNA, 20 nt, Human
acagaggggaggugcaugga

SEQ ID NO: 675085 - RNA, 18 nt, Human
accuggcugcccagggag

SEQ ID NO: 675086 - RNA, 26 nt, Human
agaaaaaaaaaaaacagacuuuccag

SEQ ID NO: 675087 - RNA, 18 nt, Human
agccccaggcucaggugc

SEQ ID NO: 675088 - RNA, 22 nt, Human
agggcagggacauccauggaga

SEQ ID NO: 675089 - RNA, 21 nt, Human
aggggugggcaccagggcacc

SEQ ID NO: 675090 - RNA, 23 nt, Human
agggguggggaagaagaaagaaa

SEQ ID NO: 675091 - RNA, 24 nt, Human
aggugcauggaaugugggggacag

SEQ ID NO: 675092 - RNA, 18 nt, Human
agugagguccuagggugc

SEQ ID NO: 675093 - RNA, 26 nt, Human
caaaacuccagauggaccaggccucc

SEQ ID NO: 675094 - RNA, 20 nt, Human
caccgucugccucuccagcc

SEQ ID NO: 675095 - RNA, 22 nt, Human
cacgcaggcacgcgggggcacu

SEQ ID NO: 675096 - RNA, 23 nt, Human
cagccagguucccaggccuccag

SEQ ID NO: 675097 - RNA, 18 nt, Human
cagggcaccuggcugccc

SEQ ID NO: 675098 - RNA, 18 nt, Human
cauauggcauuaaaggga

SEQ ID NO: 675099 - RNA, 23 nt, Human
cccaggcucaggugcucaguccu

SEQ ID NO: 675100 - RNA, 23 nt, Human
cccaggcugcagccagguuccca

SEQ ID NO: 675101 - RNA, 19 nt, Human
cccagggaagaagcgggau

SEQ ID NO: 675102 - RNA, 23 nt, Human
cccaugcuggucccacugcucug

SEQ ID NO: 675103 - RNA, 18 nt, Human
ccccaaccuccccauccu

SEQ ID NO: 675104 - RNA, 22 nt, Human
ccccaguagggcugaacuggcu

SEQ ID NO: 675105 - RNA, 22 nt, Human
ccccaugcuggucccacugcuc

SEQ ID NO: 675106 - RNA, 21 nt, Human
ccccucaccccucaaaacucc

SEQ ID NO: 675107 - RNA, 19 nt, Human
cccggacagucccuggcuc

SEQ ID NO: 675108 - RNA, 22 nt, Human
cccucaaaacuccagauggacc

SEQ ID NO: 675109 - RNA, 19 nt, Human
cccucaccccucaaaacuc

SEQ ID NO: 675110 - RNA, 23 nt, Human
ccucaaaacuccagauggaccag

SEQ ID NO: 675111 - RNA, 21 nt, Human
ccucaccccucaaaacuccag

SEQ ID NO: 675112 - RNA, 22 nt, Human
ccucaccccucaaaacuccaga

SEQ ID NO: 675113 - RNA, 23 nt, Human
ccucaccccucaaaacuccagaa

SEQ ID NO: 675114 - RNA, 22 nt, Human
ccuccggaaagcacugccgccc

SEQ ID NO: 675115 - RNA, 24 nt, Human
ccuccggaaagcacugccgcccac

SEQ ID NO: 675116 - RNA, 21 nt, Human
ccuuaggggcucgacaggggu

SEQ ID NO: 675117 - RNA, 23 nt, Human
ccuuaggggcucgacaggggugg

SEQ ID NO: 675118 - RNA, 25 nt, Human
cgacaggggugggcaccagggcacc

SEQ ID NO: 675119 - RNA, 21 nt, Human
cggaaagcacugccgcccaca

SEQ ID NO: 675120 - RNA, 19 nt, Human
cggggaccccggggagcca

SEQ ID NO: 675121 - RNA, 18 nt, Human
cuggcaggaccaaaacug

SEQ ID NO: 675122 - RNA, 24 nt, Human
gaagcuccugcccccccaaccucc

SEQ ID NO: 675123 - RNA, 23 nt, Human
gagagcagcaaggggcugguggc

SEQ ID NO: 675124 - RNA, 19 nt, Human
gagccagccccaggcucag

SEQ ID NO: 675125 - RNA, 20 nt, Human
gaggugcauggaaugugggg

SEQ ID NO: 675126 - RNA, 22 nt, Human
gagugaauccuugcaggccccu

SEQ ID NO: 675127 - RNA, 22 nt, Human
gcagcacuaagggcacuugugc

SEQ ID NO: 675128 - RNA, 21 nt, Human
gccucuccagccuucccaggc

SEQ ID NO: 675129 - RNA, 23 nt, Human
gcgagaguggggagggaucaggg

SEQ ID NO: 675130 - RNA, 19 nt, Human
gcucaggugcucaguccuc

SEQ ID NO: 675131 - RNA, 19 nt, Human
gcuccugcccccccaaccu

SEQ ID NO: 675132 - RNA, 18 nt, Human
ggaagaagaaagaaaaaa

SEQ ID NO: 675133 - RNA, 19 nt, Human
ggagagcagcaaggggcug

SEQ ID NO: 675134 - RNA, 20 nt, Human
ggagaugcuauauacagagg

SEQ ID NO: 675135 - RNA, 24 nt, Human
ggagcagggaggagaugggaggga

SEQ ID NO: 675136 - RNA, 23 nt, Human
ggcgagaguggggagggaucagg

SEQ ID NO: 675137 - RNA, 19 nt, Human
gggaagaagaaagaaaaaa

SEQ ID NO: 675138 - RNA, 21 nt, Human
gggagggaucagggaggcagc

SEQ ID NO: 675139 - RNA, 18 nt, Human
gggauggggagagagcug

SEQ ID NO: 675140 - RNA, 20 nt, Human
gggauggggagagagcuggg

SEQ ID NO: 675141 - RNA, 24 nt, Human
gggauggggagagagcuggugggu

SEQ ID NO: 675142 - RNA, 22 nt, Human
ggggaggugcauggaauguggg

SEQ ID NO: 675143 - RNA, 20 nt, Human
gggugcuggccuugcagagg

SEQ ID NO: 675144 - RNA, 19 nt, Human
guccccucaccccucaaaa

SEQ ID NO: 675145 - RNA, 21 nt, Human
gugcucaguccuccacccugg

SEQ ID NO: 675146 - RNA, 18 nt, Human
guggggaagaagaaagaa

SEQ ID NO: 675147 - RNA, 24 nt, Human
guggggagggaucagggaggcagc

SEQ ID NO: 675148 - RNA, 20 nt, Human
uaggaggggggagaugcuau

SEQ ID NO: 675149 - RNA, 18 nt, Human
ucagcccccaguagggcu

SEQ ID NO: 675150 - RNA, 19 nt, Human
ucagggaggcagcuggcag

SEQ ID NO: 675151 - RNA, 20 nt, Human
ucccaccgucugccucucca

SEQ ID NO: 675152 - RNA, 23 nt, Human
uccccaugcuggucccacugcuc

SEQ ID NO: 675153 - RNA, 24 nt, Human
uccugcccccccaaccuccccauc

SEQ ID NO: 675154 - RNA, 18 nt, Human
ucuccagccuucccaggc

SEQ ID NO: 675155 - RNA, 21 nt, Human
ugaacuggcucaugggggugg

SEQ ID NO: 675156 - RNA, 19 nt, Human
ugaggguguggggagagag

SEQ ID NO: 675157 - RNA, 20 nt, Human
ugaggguguggggagagagg

SEQ ID NO: 675158 - RNA, 22 nt, Human
ugccaguggcucuguuggggug

SEQ ID NO: 675159 - RNA, 19 nt, Human
uggaaugugggggacagaa

SEQ ID NO: 675160 - RNA, 21 nt, Human
uggaaugugggggacagaagc

SEQ ID NO: 675161 - RNA, 19 nt, Human
uggaccaggccuccggaaa

SEQ ID NO: 675162 - RNA, 18 nt, Human
uggcagcacuaagggcac

SEQ ID NO: 675163 - RNA, 21 nt, Human
uggcagcacuaagggcacuug

SEQ ID NO: 675164 - RNA, 18 nt, Human
uggcucuguugggguggg

SEQ ID NO: 675165 - RNA, 21 nt, Human
uggcugcccagggaguguggc

SEQ ID NO: 675166 - RNA, 21 nt, Human
uggggagagagcugguggguc

SEQ ID NO: 675167 - RNA, 22 nt, Human
uggggagagagcuggugggucc

SEQ ID NO: 675168 - RNA, 23 nt, Human
uggggagagagcugguggguccc

SEQ ID NO: 675169 - RNA, 18 nt, Human
uggggagggaucagggag

SEQ ID NO: 675170 - RNA, 21 nt, Human
uggggagggaucagggaggca

SEQ ID NO: 675171 - RNA, 21 nt, Human
ugggugcuggccuugcagagg

SEQ ID NO: 675172 - RNA, 25 nt, Human
uugcaggccccugcucacuaggagg

SEQ ID NO: 675173 - RNA, 24 nt, Human
uugugccaguggcucuguuggggu

SEQ ID NO: 675174 - RNA, 23 nt, Human
uuuaaguucauagagaaggggcg

SEQ ID NO: 675175 - RNA, 23 nt, Human
aaaaagaaaaaagagaaaaccgg

SEQ ID NO: 675176 - RNA, 23 nt, Human
aaaaagaacgacguuacugaagg

SEQ ID NO: 675177 - RNA, 18 nt, Human
aaaagcauccacacacgg

SEQ ID NO: 675178 - RNA, 21 nt, Human
aaacaggcgaguuuugcucuu

SEQ ID NO: 675179 - RNA, 23 nt, Human
aaacauuccaaggaaaacacugc

SEQ ID NO: 675180 - RNA, 18 nt, Human
aaaguugaugucuaauuu

SEQ ID NO: 675181 - RNA, 22 nt, Human
aaaugcuguguuugaucuuugg

SEQ ID NO: 675182 - RNA, 18 nt, Human
aacaaguggaagagucuu

SEQ ID NO: 675183 - RNA, 23 nt, Human
aaccaauucauuguuuccuccca

SEQ ID NO: 675184 - RNA, 21 nt, Human
aacgauuuuacaacacuuaaa

SEQ ID NO: 675185 - RNA, 20 nt, Human
aacuuguuuggaguuuugga

SEQ ID NO: 675186 - RNA, 20 nt, Human
aagaaguccuuaaagaugau

SEQ ID NO: 675187 - RNA, 23 nt, Human
aagcuguggccacccuaggccca

SEQ ID NO: 675188 - RNA, 21 nt, Human
aaggggcuuuugaguaacuaa

SEQ ID NO: 675189 - RNA, 23 nt, Human
aaugacgcugauuuuuucuuuuu

SEQ ID NO: 675190 - RNA, 21 nt, Human
aauuggacuuuauaaagccua

SEQ ID NO: 675191 - RNA, 23 nt, Human
acaccagaucucagaugaggcca

SEQ ID NO: 675192 - RNA, 23 nt, Human
acacugcuucaccuccugcagac

SEQ ID NO: 675193 - RNA, 22 nt, Human
acccaaaaaacacgaccucagu

SEQ ID NO: 675194 - RNA, 20 nt, Human
acgauuuuacaacacuuaaa

SEQ ID NO: 675195 - RNA, 21 nt, Human
agaacaagaaggggcuuuuga

SEQ ID NO: 675196 - RNA, 19 nt, Human
agagcuuugggguagcagg

SEQ ID NO: 675197 - RNA, 22 nt, Human
agaggcugcuccaggugugucc

SEQ ID NO: 675198 - RNA, 24 nt, Human
agaggcugcuccagguguguccgg

SEQ ID NO: 675199 - RNA, 26 nt, Human
agcaaaggcggcgguggcggcggcga

SEQ ID NO: 675200 - RNA, 18 nt, Human
agcauccacacacgguga

SEQ ID NO: 675201 - RNA, 21 nt, Human
aggcugcuccauggugcugga

SEQ ID NO: 675202 - RNA, 20 nt, Human
agggcacaauaauuacagga

SEQ ID NO: 675203 - RNA, 21 nt, Human
agggcccuggggugggggcug

SEQ ID NO: 675204 - RNA, 22 nt, Human
agggcugugggacaaacaagug

SEQ ID NO: 675205 - RNA, 26 nt, Human
aggguggcauauggggaggaagggau

SEQ ID NO: 675206 - RNA, 18 nt, Human
aguaacuaaaaaacaauc

SEQ ID NO: 675207 - RNA, 19 nt, Human
auaaagugcaccucugccc

SEQ ID NO: 675208 - RNA, 21 nt, Human
augaagccugcagaaaaggcu

SEQ ID NO: 675209 - RNA, 22 nt, Human
augacgcugauuuuuucuuuuu

SEQ ID NO: 675210 - RNA, 24 nt, Human
augagauguccuguggugggucaa

SEQ ID NO: 675211 - RNA, 18 nt, Human
auuuuaaacaccauucac

SEQ ID NO: 675212 - RNA, 22 nt, Human
caaauaggcacaaaauaaggca

SEQ ID NO: 675213 - RNA, 23 nt, Human
caaauaggcacaaaauaaggcug

SEQ ID NO: 675214 - RNA, 24 nt, Human
caacaggcguggagcugggggcua

SEQ ID NO: 675215 - RNA, 21 nt, Human
caacauuaaauaacagaacau

SEQ ID NO: 675216 - RNA, 22 nt, Human
caaccgaacaucagaaacuaaa

SEQ ID NO: 675217 - RNA, 20 nt, Human
caccacguccauucugcgca

SEQ ID NO: 675218 - RNA, 22 nt, Human
caccagaucucagaugaggcca

SEQ ID NO: 675219 - RNA, 20 nt, Human
cacugcacagcuuacagggc

SEQ ID NO: 675220 - RNA, 21 nt, Human
cagagaagcaagcugacuuuu

SEQ ID NO: 675221 - RNA, 18 nt, Human
cagcaggggcagggguug

SEQ ID NO: 675222 - RNA, 20 nt, Human
cagcuguuuccuucuguuca

SEQ ID NO: 675223 - RNA, 20 nt, Human
caggacaaggaaagaaagaa

SEQ ID NO: 675224 - RNA, 21 nt, Human
caggacaaggaaagaaagaaa

SEQ ID NO: 675225 - RNA, 22 nt, Human
caggguaaaacacugagaagaa

SEQ ID NO: 675226 - RNA, 23 nt, Human
cagguccucaaacauuccaagga

SEQ ID NO: 675227 - RNA, 22 nt, Human
caguuguugacaacacaaccga

SEQ ID NO: 675228 - RNA, 22 nt, Human
caucccgggagcauccaacagc

SEQ ID NO: 675229 - RNA, 20 nt, Human
cauugaggacaaaaacaggc

SEQ ID NO: 675230 - RNA, 22 nt, Human
ccaauggccacgucauuccacc

SEQ ID NO: 675231 - RNA, 20 nt, Human
ccacacacacagaauggcug

SEQ ID NO: 675232 - RNA, 21 nt, Human
cccagaagccucuacagaagc

SEQ ID NO: 675233 - RNA, 19 nt, Human
cccgggagcauccaacagc

SEQ ID NO: 675234 - RNA, 18 nt, Human
cccugcugccguguaccu

SEQ ID NO: 675235 - RNA, 19 nt, Human
ccgugggcuaaccgagcac

SEQ ID NO: 675236 - RNA, 18 nt, Human
ccuggcucccuucacuca

SEQ ID NO: 675237 - RNA, 21 nt, Human
cgaagaaaacuggaaaccuau

SEQ ID NO: 675238 - RNA, 23 nt, Human
cgccugaacuuaaggugggaggc

SEQ ID NO: 675239 - RNA, 23 nt, Human
cgggggacagcaaaggcggcggu

SEQ ID NO: 675240 - RNA, 21 nt, Human
cuacagaagcccguccucccu

SEQ ID NO: 675241 - RNA, 18 nt, Human
cucaguuuuccuaugcag

SEQ ID NO: 675242 - RNA, 21 nt, Human
cugaacuuaaggugggaggcc

SEQ ID NO: 675243 - RNA, 21 nt, Human
cugaauuugaaauuggacuuu

SEQ ID NO: 675244 - RNA, 18 nt, Human
cuugaaaaaucaaagcug

SEQ ID NO: 675245 - RNA, 20 nt, Human
cuuggaggcccugaaugcuc

SEQ ID NO: 675246 - RNA, 18 nt, Human
cuuuuccacauggcaaca

SEQ ID NO: 675247 - RNA, 24 nt, Human
gaaaaagaacgacguuacugaagg

SEQ ID NO: 675248 - RNA, 18 nt, Human
gaaaaauacaccaauagu

SEQ ID NO: 675249 - RNA, 21 nt, Human
gacaagaaaacaucaagagau

SEQ ID NO: 675250 - RNA, 18 nt, Human
gacaaggaaagaaagaaa

SEQ ID NO: 675251 - RNA, 22 nt, Human
gagauguccuguggugggucaa

SEQ ID NO: 675252 - RNA, 20 nt, Human
gaugacaagaaaacaucaag

SEQ ID NO: 675253 - RNA, 24 nt, Human
gcacaaauuccaaaacgauuuuac

SEQ ID NO: 675254 - RNA, 19 nt, Human
gccaaggaaaugcgcgggg

SEQ ID NO: 675255 - RNA, 22 nt, Human
gcggcgguggcggcggcgcuuc

SEQ ID NO: 675256 - RNA, 18 nt, Human
gcugcaguaagcaggaac

SEQ ID NO: 675257 - RNA, 21 nt, Human
gcugcuccauggugcuggaug

SEQ ID NO: 675258 - RNA, 18 nt, Human
gcuguuuccuucuguuca

SEQ ID NO: 675259 - RNA, 21 nt, Human
ggacagcaggggcagggguuu

SEQ ID NO: 675260 - RNA, 20 nt, Human
ggagacguggacccuuuucc

SEQ ID NO: 675261 - RNA, 19 nt, Human
ggagauaccccaaacuuag

SEQ ID NO: 675262 - RNA, 18 nt, Human
ggcaucuggcauuuuaaa

SEQ ID NO: 675263 - RNA, 22 nt, Human
ggccagggcuggaauauuuggc

SEQ ID NO: 675264 - RNA, 18 nt, Human
ggcggcgguggcggcggc

SEQ ID NO: 675265 - RNA, 20 nt, Human
ggcggcgguggcggcggcgc

SEQ ID NO: 675266 - RNA, 20 nt, Human
gggcccuggggugggggcug

SEQ ID NO: 675267 - RNA, 30 nt, Human
ggggacagcaaaggcggcgguggcggcggg

SEQ ID NO: 675268 - RNA, 21 nt, Human
gggggacagcaaaggcggcgg

SEQ ID NO: 675269 - RNA, 22 nt, Human
gggggacagcaaaggcggcggu

SEQ ID NO: 675270 - RNA, 21 nt, Human
ggggugggggcugugagcugg

SEQ ID NO: 675271 - RNA, 20 nt, Human
gggugggggcugugagcugg

SEQ ID NO: 675272 - RNA, 21 nt, Human
gggugggggcugugagcuggc

SEQ ID NO: 675273 - RNA, 20 nt, Human
ggugggggcugugagcuggc

SEQ ID NO: 675274 - RNA, 19 nt, Human
gucaaugcuuuaucucauu

SEQ ID NO: 675275 - RNA, 22 nt, Human
gugaaaggagcuuagagguaca

SEQ ID NO: 675276 - RNA, 23 nt, Human
gugaagcaaaaugcgacaaaagc

SEQ ID NO: 675277 - RNA, 22 nt, Human
gugcaaaagguggcuggaacaa

SEQ ID NO: 675278 - RNA, 19 nt, Human
guggagcuccuacccugaa

SEQ ID NO: 675279 - RNA, 19 nt, Human
guggcacuuagggcugugg

SEQ ID NO: 675280 - RNA, 20 nt, Human
guuuuaagggauggaaaagu

SEQ ID NO: 675281 - RNA, 18 nt, Human
uaaaaaacaaucugagca

SEQ ID NO: 675282 - RNA, 25 nt, Human
uaaaaagcggcaaaguccuuucucu

SEQ ID NO: 675283 - RNA, 22 nt, Human
uaaagcaagcaccgucggggug

SEQ ID NO: 675284 - RNA, 18 nt, Human
uaaagugcaccucugccc

SEQ ID NO: 675285 - RNA, 21 nt, Human
uaacaacauuaaauaacagaa

SEQ ID NO: 675286 - RNA, 19 nt, Human
uaacaggguaaaacacuga

SEQ ID NO: 675287 - RNA, 21 nt, Human
uaacaggguaaaacacugaga

SEQ ID NO: 675288 - RNA, 19 nt, Human
uaacauaucacgaagaaaa

SEQ ID NO: 675289 - RNA, 23 nt, Human
uaacuaaaaaacaaucugagcau

SEQ ID NO: 675290 - RNA, 18 nt, Human
uaacucagaugacugcga

SEQ ID NO: 675291 - RNA, 20 nt, Human
uaagcuggguguggugugag

SEQ ID NO: 675292 - RNA, 22 nt, Human
uaaugagugacagggaucaaac

SEQ ID NO: 675293 - RNA, 19 nt, Human
uacaacacagugucaggga

SEQ ID NO: 675294 - RNA, 20 nt, Human
uacaacacagugucagggag

SEQ ID NO: 675295 - RNA, 21 nt, Human
uacaacacuuaaagggcacaa

SEQ ID NO: 675296 - RNA, 18 nt, Human
uacaugaaaugcuguguu

SEQ ID NO: 675297 - RNA, 19 nt, Human
uacuuugauucuugugucu

SEQ ID NO: 675298 - RNA, 23 nt, Human
uagaaagcaccaaucugugaaaa

SEQ ID NO: 675299 - RNA, 23 nt, Human
uagagguacagcuguuuccuucu

SEQ ID NO: 675300 - RNA, 24 nt, Human
uagagguacagcuguuuccuucug

SEQ ID NO: 675301 - RNA, 24 nt, Human
uagugauaccuaaauggguggcac

SEQ ID NO: 675302 - RNA, 19 nt, Human
uaugguuaaaaacaggagc

SEQ ID NO: 675303 - RNA, 18 nt, Human
uauugcacgaugcuuggc

SEQ ID NO: 675304 - RNA, 21 nt, Human
ucagagcuuugggguagcagg

SEQ ID NO: 675305 - RNA, 23 nt, Human
ucagagcuuugggguagcaggca

SEQ ID NO: 675306 - RNA, 19 nt, Human
ucagaggcugcuccaggug

SEQ ID NO: 675307 - RNA, 30 nt, Human
ucagcacuuuguaaaaaaaaaaagaaaaaa

SEQ ID NO: 675308 - RNA, 22 nt, Human
ucagcuuugggggaaggguggc

SEQ ID NO: 675309 - RNA, 24 nt, Human
ucaguggugucagcuuugaacaug

SEQ ID NO: 675310 - RNA, 24 nt, Human
uccacauggcaacaggcguggagc

SEQ ID NO: 675311 - RNA, 23 nt, Human
ucccugggacagcaggggcaggg

SEQ ID NO: 675312 - RNA, 23 nt, Human
uccucacaugcaggcugcuccau

SEQ ID NO: 675313 - RNA, 19 nt, Human
uccuuaaagaugaugaaaa

SEQ ID NO: 675314 - RNA, 21 nt, Human
ucuacagaagcccguccuccc

SEQ ID NO: 675315 - RNA, 25 nt, Human
ucugaccaaauuccccaccagugcc

SEQ ID NO: 675316 - RNA, 23 nt, Human
ucugcaacugaaucacuugagaa

SEQ ID NO: 675317 - RNA, 20 nt, Human
ucuggcauuuuaaacaccau

SEQ ID NO: 675318 - RNA, 28 nt, Human
ucuuucagagcuuuggggucggaaaucc

SEQ ID NO: 675319 - RNA, 27 nt, Human
ugaaaaagaacgacguuacugaaggua

SEQ ID NO: 675320 - RNA, 21 nt, Human
ugaaaaauacaccaauaguag

SEQ ID NO: 675321 - RNA, 19 nt, Human
ugaaaaaucaaagcugugg

SEQ ID NO: 675322 - RNA, 21 nt, Human
ugaaugcuccuuccauuccuc

SEQ ID NO: 675323 - RNA, 23 nt, Human
ugaccaaauuccccaccagugcc

SEQ ID NO: 675324 - RNA, 18 nt, Human
ugacugcgauacgauaca

SEQ ID NO: 675325 - RNA, 18 nt, Human
ugagaauacagggugaaa

SEQ ID NO: 675326 - RNA, 24 nt, Human
ugaguaacuaaaaaacaaucugag

SEQ ID NO: 675327 - RNA, 24 nt, Human
ugauuacaugaaaugcuguguuug

SEQ ID NO: 675328 - RNA, 21 nt, Human
ugcaaaagguggcuggaacaa

SEQ ID NO: 675329 - RNA, 18 nt, Human
ugccaagguuuaagucca

SEQ ID NO: 675330 - RNA, 25 nt, Human
ugccaagguuuaaguccacaagcaa

SEQ ID NO: 675331 - RNA, 19 nt, Human
ugcgcggggcacauacaga

SEQ ID NO: 675332 - RNA, 18 nt, Human
ugcguggagcuccuaccc

SEQ ID NO: 675333 - RNA, 22 nt, Human
ugcguggagcuccuacccugaa

SEQ ID NO: 675334 - RNA, 18 nt, Human
ugcuaaucugccuggcac

SEQ ID NO: 675335 - RNA, 21 nt, Human
ugcuuggagauaccccaaacu

SEQ ID NO: 675336 - RNA, 18 nt, Human
uggacuuuauaaagccua

SEQ ID NO: 675337 - RNA, 20 nt, Human
uggcaccaccccauuuuaga

SEQ ID NO: 675338 - RNA, 22 nt, Human
uggcagggaacaaaugacgcug

SEQ ID NO: 675339 - RNA, 19 nt, Human
uggcuggaacaaauguuca

SEQ ID NO: 675340 - RNA, 20 nt, Human
uggcuggaacaaauguucag

SEQ ID NO: 675341 - RNA, 19 nt, Human
uggcuucaugagauguccu

SEQ ID NO: 675342 - RNA, 21 nt, Human
uggcuucaugagauguccugu

SEQ ID NO: 675343 - RNA, 21 nt, Human
uggggaggaagggaucauuga

SEQ ID NO: 675344 - RNA, 18 nt, Human
uggggugggggcugugag

SEQ ID NO: 675345 - RNA, 21 nt, Human
uggggugggggcugugagcug

SEQ ID NO: 675346 - RNA, 23 nt, Human
uggggugggggcugugagcuggc

SEQ ID NO: 675347 - RNA, 18 nt, Human
uggguggugaugugcgug

SEQ ID NO: 675348 - RNA, 23 nt, Human
uggguggugaugugcguggagcu

SEQ ID NO: 675349 - RNA, 23 nt, Human
uggguuaaauaguugaaaauugg

SEQ ID NO: 675350 - RNA, 18 nt, Human
uguccggggaagccaggc

SEQ ID NO: 675351 - RNA, 21 nt, Human
ugucucuugaaaaaucaaagc

SEQ ID NO: 675352 - RNA, 20 nt, Human
ugugagaaagcuguaagugg

SEQ ID NO: 675353 - RNA, 20 nt, Human
uguuucuuuuuguagaaauc

SEQ ID NO: 675354 - RNA, 24 nt, Human
uuaaagaugaugaaaaaugugaag

SEQ ID NO: 675355 - RNA, 27 nt, Human
uuaaagggcacaauaauuacaggaaua

SEQ ID NO: 675356 - RNA, 24 nt, Human
uuaacauaucacgaagaaaacugg

SEQ ID NO: 675357 - RNA, 21 nt, Human
uucaagaugacaagaaaacau

SEQ ID NO: 675358 - RNA, 24 nt, Human
uucagaacaagaaggggcuuuuga

SEQ ID NO: 675359 - RNA, 21 nt, Human
uuccauggacauucuauaagc

SEQ ID NO: 675360 - RNA, 22 nt, Human
uuccauggacauucuauaagcc

SEQ ID NO: 675361 - RNA, 19 nt, Human
uuccccaccagugccaagg

SEQ ID NO: 675362 - RNA, 24 nt, Human
uuccuaugcagcauuuucuuuucu

SEQ ID NO: 675363 - RNA, 27 nt, Human
uuccucacaugcaggcugcuccauggu

SEQ ID NO: 675364 - RNA, 20 nt, Human
uucuugugucuucuucacau

SEQ ID NO: 675365 - RNA, 22 nt, Human
uuguuuccucccaagagagacu

SEQ ID NO: 675366 - RNA, 20 nt, Human
uuuaagggauggaaaaguuu

SEQ ID NO: 675367 - RNA, 22 nt, Human
uuugcauuccaaggcagaugac

SEQ ID NO: 675368 - RNA, 20 nt, Human
uuuggccuuucucuccuuug

SEQ ID NO: 675369 - RNA, 23 nt, Human
uuuuaaacaccauucaccacguc

SEQ ID NO: 675370 - RNA, 21 nt, Human
uuuuggagacguggacccuuu

SEQ ID NO: 675371 - RNA, 23 nt, Human
aaaaaagcuguggccgaagccga

SEQ ID NO: 675372 - RNA, 21 nt, Human
aaaaaauacccaccaccccac

SEQ ID NO: 675373 - RNA, 24 nt, Human
aaaaaauacccaccaccccacucc

SEQ ID NO: 675374 - RNA, 22 nt, Human
aaaaagcuguggccgaagccga

SEQ ID NO: 675375 - RNA, 27 nt, Human
aaaaagcuguggccgaagccgaaaccc

SEQ ID NO: 675376 - RNA, 19 nt, Human
aaaaccccaaaccccaaac

SEQ ID NO: 675377 - RNA, 21 nt, Human
aaaaccccaaaccccaaacag

SEQ ID NO: 675378 - RNA, 21 nt, Human
aaaauacccaccaccccacuc

SEQ ID NO: 675379 - RNA, 24 nt, Human
aaaauacccaccaccccacuccca

SEQ ID NO: 675380 - RNA, 21 nt, Human
aaacaaaaagcaacaaucugg

SEQ ID NO: 675381 - RNA, 22 nt, Human
aaagaacauacccagccucaac

SEQ ID NO: 675382 - RNA, 19 nt, Human
aaagauaaaagcagaggga

SEQ ID NO: 675383 - RNA, 18 nt, Human
aaauacccaccaccccac

SEQ ID NO: 675384 - RNA, 23 nt, Human
aaaugcagagaucugaacaagcu

SEQ ID NO: 675385 - RNA, 21 nt, Human
aacccaacccuuacccauccc

SEQ ID NO: 675386 - RNA, 21 nt, Human
aacuuguuauugccucagaac

SEQ ID NO: 675387 - RNA, 19 nt, Human
aagcaacggcacacagcca

SEQ ID NO: 675388 - RNA, 24 nt, Human
aagcaucaacaaaaaauacccacc

SEQ ID NO: 675389 - RNA, 21 nt, Human
acaaaaaauacccaccacccc

SEQ ID NO: 675390 - RNA, 19 nt, Human
acagagcccuuuccaggua

SEQ ID NO: 675391 - RNA, 20 nt, Human
acauacaagaaaacaucaag

SEQ ID NO: 675392 - RNA, 20 nt, Human
acccaacccuuacccauccc

SEQ ID NO: 675393 - RNA, 24 nt, Human
acccaccaccccacucccaccaga

SEQ ID NO: 675394 - RNA, 25 nt, Human
accccacucccaccagaaaacccaa

SEQ ID NO: 675395 - RNA, 21 nt, Human
acugaaguacuaaaagcacug

SEQ ID NO: 675396 - RNA, 21 nt, Human
agagcuucuccaugaacauua

SEQ ID NO: 675397 - RNA, 21 nt, Human
agauaaaagcagagggagaag

SEQ ID NO: 675398 - RNA, 22 nt, Human
agcacaugcuguuuucacagca

SEQ ID NO: 675399 - RNA, 20 nt, Human
auuuauaaaaugcagagauc

SEQ ID NO: 675400 - RNA, 23 nt, Human
caaaaaauacccaccaccccacu

SEQ ID NO: 675401 - RNA, 25 nt, Human
caaaaaauacccaccaccccacucc

SEQ ID NO: 675402 - RNA, 20 nt, Human
caaaccccaaacagaguaga

SEQ ID NO: 675403 - RNA, 18 nt, Human
caaccacuuaaaauacag

SEQ ID NO: 675404 - RNA, 21 nt, Human
caagaguugguuccgcaagag

SEQ ID NO: 675405 - RNA, 21 nt, Human
caagcaaugaccuaaaaaugc

SEQ ID NO: 675406 - RNA, 24 nt, Human
cacagccauaauauagagaacaga

SEQ ID NO: 675407 - RNA, 24 nt, Human
caccagaaaacccaacccuuaccc

SEQ ID NO: 675408 - RNA, 18 nt, Human
caccccacucccaccaga

SEQ ID NO: 675409 - RNA, 23 nt, Human
caccccacucccaccagaaaacc

SEQ ID NO: 675410 - RNA, 18 nt, Human
caccccugcccggccugc

SEQ ID NO: 675411 - RNA, 23 nt, Human
cagcagcacaugcuguuuucaca

SEQ ID NO: 675412 - RNA, 22 nt, Human
caucaacaaaaaauacccacca

SEQ ID NO: 675413 - RNA, 22 nt, Human
ccaccaccccacucccaccaga

SEQ ID NO: 675414 - RNA, 24 nt, Human
ccaccagaaaacccaacccuuacc

SEQ ID NO: 675415 - RNA, 19 nt, Human
ccaccccacucccaccaga

SEQ ID NO: 675416 - RNA, 23 nt, Human
cccaacccuuacccauccccggc

SEQ ID NO: 675417 - RNA, 26 nt, Human
cccaccaccccacucccaccagaaaa

SEQ ID NO: 675418 - RNA, 21 nt, Human
cccaccagaaaacccaacccu

SEQ ID NO: 675419 - RNA, 22 nt, Human
cccacucccaccagaaaaccca

SEQ ID NO: 675420 - RNA, 22 nt, Human
cccacucccaccagaaaaccca

SEQ ID NO: 675421 - RNA, 22 nt, Human
cccaggcugcagcaaccaagaa

SEQ ID NO: 675422 - RNA, 22 nt, Human
ccgaaacccggcccagcgcccu

SEQ ID NO: 675423 - RNA, 23 nt, Human
ccgaaacccggcccagcgcccug

SEQ ID NO: 675424 - RNA, 20 nt, Human
ccgaagccgaaacccggccc

SEQ ID NO: 675425 - RNA, 23 nt, Human
ccgaagccgaaacccggcccagc

SEQ ID NO: 675426 - RNA, 18 nt, Human
ccgccgccuccgcgaucg

SEQ ID NO: 675427 - RNA, 22 nt, Human
ccucucggccuggccgccgccu

SEQ ID NO: 675428 - RNA, 19 nt, Human
ccugcacuaaagcaucaac

SEQ ID NO: 675429 - RNA, 24 nt, Human
ccugcacuaaagcaucaacaaaaa

SEQ ID NO: 675430 - RNA, 26 nt, Human
cggcaaaaauuaccugguacaagcaa

SEQ ID NO: 675431 - RNA, 22 nt, Human
cucagucacgccgcgccucucu

SEQ ID NO: 675432 - RNA, 21 nt, Human
cucaguugcccaagacugucu

SEQ ID NO: 675433 - RNA, 21 nt, Human
cuccaugaacauccacccagg

SEQ ID NO: 675434 - RNA, 19 nt, Human
cucccaccagaaaacccaa

SEQ ID NO: 675435 - RNA, 18 nt, Human
cugcacuaaagcaucaac

SEQ ID NO: 675436 - RNA, 20 nt, Human
cugcccggccugccucucgg

SEQ ID NO: 675437 - RNA, 22 nt, Human
gaaaaaaugaugcuccuguccc

SEQ ID NO: 675438 - RNA, 22 nt, Human
gaaagaacucucaauaguuuag

SEQ ID NO: 675439 - RNA, 19 nt, Human
gaaggaaaaaacauuugug

SEQ ID NO: 675440 - RNA, 18 nt, Human
gacaccccugcccggccu

SEQ ID NO: 675441 - RNA, 23 nt, Human
gcaaugaccuaaaaaugcuuucu

SEQ ID NO: 675442 - RNA, 19 nt, Human
gccauaauauagagaacag

SEQ ID NO: 675443 - RNA, 19 nt, Human
ggaaagcucauuuucaaaa

SEQ ID NO: 675444 - RNA, 21 nt, Human
ggcugcagcaaccaagaagga

SEQ ID NO: 675445 - RNA, 23 nt, Human
guaaaaccccaaaccccaaacag

SEQ ID NO: 675446 - RNA, 25 nt, Human
guaaaaccccaaaccccaaacagag

SEQ ID NO: 675447 - RNA, 20 nt, Human
guugcccaagacugucugaa

SEQ ID NO: 675448 - RNA, 20 nt, Human
uaaaaccccaaaccccaaac

SEQ ID NO: 675449 - RNA, 23 nt, Human
uaaaaccccaaaccccaaacaga

SEQ ID NO: 675450 - RNA, 19 nt, Human
uaaaagcagagggagaagc

SEQ ID NO: 675451 - RNA, 21 nt, Human
uaaaagcagagggagaagcaa

SEQ ID NO: 675452 - RNA, 22 nt, Human
uaaagcaucaacaaaaaauacc

SEQ ID NO: 675453 - RNA, 18 nt, Human
uaacuuggagaaaaaccc

SEQ ID NO: 675454 - RNA, 19 nt, Human
uaauauagagaacagagcu

SEQ ID NO: 675455 - RNA, 23 nt, Human
uacaagcaaugaccuaaaaaugc

SEQ ID NO: 675456 - RNA, 19 nt, Human
uacccaccaccccacuccc

SEQ ID NO: 675457 - RNA, 25 nt, Human
uaccugguacaagcaaugaccuaaa

SEQ ID NO: 675458 - RNA, 20 nt, Human
uacuacauuauguucugggu

SEQ ID NO: 675459 - RNA, 18 nt, Human
uagaugaugaaauaagga

SEQ ID NO: 675460 - RNA, 19 nt, Human
uagauguccauagguaguu

SEQ ID NO: 675461 - RNA, 18 nt, Human
uaucagcaucucccaccu

SEQ ID NO: 675462 - RNA, 27 nt, Human
uaucagguaaggaaaaaaugaugcucc

SEQ ID NO: 675463 - RNA, 24 nt, Human
ucaacaaaaaauacccaccacccc

SEQ ID NO: 675464 - RNA, 22 nt, Human
ucagcaucucccaccuaaaaac

SEQ ID NO: 675465 - RNA, 21 nt, Human
ucauuauuugcagaaucuugg

SEQ ID NO: 675466 - RNA, 24 nt, Human
ucgcagcgguuuuacugccccgga

SEQ ID NO: 675467 - RNA, 21 nt, Human
ucuguaaaaccccaaacccca

SEQ ID NO: 675468 - RNA, 23 nt, Human
ucuguaaaaccccaaaccccaaa

SEQ ID NO: 675469 - RNA, 21 nt, Human
ucuuugaaagaacauacccag

SEQ ID NO: 675470 - RNA, 24 nt, Human
ucuuugaaagaacauacccagccu

SEQ ID NO: 675471 - RNA, 19 nt, Human
ugaaacagagcccuuucca

SEQ ID NO: 675472 - RNA, 22 nt, Human
ugaaacagagcccuuuccaggu

SEQ ID NO: 675473 - RNA, 18 nt, Human
ugagaaaaaaagcugugg

SEQ ID NO: 675474 - RNA, 23 nt, Human
ugcauuuguuacucaagaaaaua

SEQ ID NO: 675475 - RNA, 26 nt, Human
ugccccggaugccucuaggacgcagc

SEQ ID NO: 675476 - RNA, 19 nt, Human
ugccucagaacaggccugc

SEQ ID NO: 675477 - RNA, 24 nt, Human
uguaaaacaaggccacuacuauaa

SEQ ID NO: 675478 - RNA, 25 nt, Human
uuacauauuucuguauuaacuugga

SEQ ID NO: 675479 - RNA, 25 nt, Human
uucacacagaccaaugaucuuaccu

SEQ ID NO: 675480 - RNA, 19 nt, Human
uucaugcauuuguuacuca

SEQ ID NO: 675481 - RNA, 24 nt, Human
uucuguauuaacuuggagaaaaac

SEQ ID NO: 675482 - RNA, 25 nt, Human
uucuugaaacagagcccuuuccagg

SEQ ID NO: 675483 - RNA, 20 nt, Human
uuucacacagaccaaugauc

SEQ ID NO: 675484 - RNA, 23 nt, Human
uuucacagcaacuuguuauugcc

SEQ ID NO: 675485 - RNA, 21 nt, Human
uuuguaaaacaaggccacuac

SEQ ID NO: 675486 - RNA, 22 nt, Human
uuuguauuauaauuuuuaaaau

SEQ ID NO: 675487 - RNA, 18 nt, Human
uuuuuuuuuuuuuuuuug

SEQ ID NO: 675488 - RNA, 21 nt, Human
agaaaccaguacaaauuucga

SEQ ID NO: 675489 - RNA, 19 nt, Human
ugcagaaaccaguacaaau

SEQ ID NO: 675490 - RNA, 24 nt, Human
uugaagacaauaguguuaauuucu

SEQ ID NO: 675491 - RNA, 22 nt, Human
uuuuuuuuuuuuuaaaggcuua

SEQ ID NO: 675492 - RNA, 25 nt, Human
uuuuuuuuuuuuuuuuuuuuaaagg

SEQ ID NO: 675493 - RNA, 22 nt, Human
aaagaaauaaaauuauagacca

SEQ ID NO: 675494 - RNA, 21 nt, Human
aaauccuggaaguuuuaaacu

SEQ ID NO: 675495 - RNA, 19 nt, Human
aagugucggcagagcuggg

SEQ ID NO: 675496 - RNA, 24 nt, Human
acuuuguguugacuucaaaggcua

SEQ ID NO: 675497 - RNA, 24 nt, Human
auccuggaaguuuuaaacuuugug

SEQ ID NO: 675498 - RNA, 19 nt, Human
auuaauuuuauugacugau

SEQ ID NO: 675499 - RNA, 26 nt, Human
caaaaccgggccucccgugccgccgg

SEQ ID NO: 675500 - RNA, 18 nt, Human
caaauuucacccauaggc

SEQ ID NO: 675501 - RNA, 21 nt, Human
caagaaaaacugcauaguuua

SEQ ID NO: 675502 - RNA, 19 nt, Human
ccccccgccgccgccucuc

SEQ ID NO: 675503 - RNA, 22 nt, Human
cccccgccgccgccucucccgc

SEQ ID NO: 675504 - RNA, 23 nt, Human
cccccgccgccgccucucccgcg

SEQ ID NO: 675505 - RNA, 19 nt, Human
ccgccgccgccucucccgc

SEQ ID NO: 675506 - RNA, 19 nt, Human
ccgccggcucggcccuccu

SEQ ID NO: 675507 - RNA, 23 nt, Human
ccuccccccgccgccgccucucc

SEQ ID NO: 675508 - RNA, 21 nt, Human
ccuccuccccccgccgccgcc

SEQ ID NO: 675509 - RNA, 18 nt, Human
cgccgccgccucucccgc

SEQ ID NO: 675510 - RNA, 21 nt, Human
cgccgccgccucucccgcggc

SEQ ID NO: 675511 - RNA, 18 nt, Human
cggcccuccucucccucc

SEQ ID NO: 675512 - RNA, 18 nt, Human
cuccucucccuccucccc

SEQ ID NO: 675513 - RNA, 20 nt, Human
cucucccgcggcuccccggg

SEQ ID NO: 675514 - RNA, 21 nt, Human
cucucccgcggcuccccgggc

SEQ ID NO: 675515 - RNA, 19 nt, Human
gcggaccgcggaggugagc

SEQ ID NO: 675516 - RNA, 24 nt, Human
ggcccuccucucccuccucccccc

SEQ ID NO: 675517 - RNA, 25 nt, Human
ggucaagugucggcagagcuggggg

SEQ ID NO: 675518 - RNA, 22 nt, Human
guggucgcggucggcccgcagg

SEQ ID NO: 675519 - RNA, 24 nt, Human
uaaauauauacaacuuugcaaaau

SEQ ID NO: 675520 - RNA, 20 nt, Human
uaacucgggcagagaagcgg

SEQ ID NO: 675521 - RNA, 24 nt, Human
ucaaaaccgggccucccgugccgc

SEQ ID NO: 675522 - RNA, 24 nt, Human
uccccgggcggccgcacugggcgu

SEQ ID NO: 675523 - RNA, 23 nt, Human
uccucucccuccuccccccgccg

SEQ ID NO: 675524 - RNA, 23 nt, Human
ucugggucaagugucggcagagc

SEQ ID NO: 675525 - RNA, 22 nt, Human
ugaaaaacuaaagugauaagaa

SEQ ID NO: 675526 - RNA, 23 nt, Human
ugaaaaacuaaagugauaagaag

SEQ ID NO: 675527 - RNA, 20 nt, Human
ugcacagcauuaaauauaua

SEQ ID NO: 675528 - RNA, 18 nt, Human
uuugcaaaauccuggaag

SEQ ID NO: 675529 - RNA, 20 nt, Human
uuuuuuuuuuuuuuagugga

SEQ ID NO: 675530 - RNA, 23 nt, Human
uaaaauguuuacaucuugggacu

SEQ ID NO: 675531 - RNA, 21 nt, Human
uaugcuuucauuauguaaaau

SEQ ID NO: 675532 - RNA, 25 nt, Human
aaaaacguacuuuauagaaaaccaa

SEQ ID NO: 675533 - RNA, 18 nt, Human
aaaauacugcuacccugc

SEQ ID NO: 675534 - RNA, 19 nt, Human
aaauauagguccuuccucc

SEQ ID NO: 675535 - RNA, 24 nt, Human
aaugcacauauugcacacauaugg

SEQ ID NO: 675536 - RNA, 23 nt, Human
aaugcagagacagaaacaaagaa

SEQ ID NO: 675537 - RNA, 20 nt, Human
acaaguaccuaaugaagaag

SEQ ID NO: 675538 - RNA, 19 nt, Human
acaaugcagagacagaaac

SEQ ID NO: 675539 - RNA, 22 nt, Human
acacaacaauuccccuacacau

SEQ ID NO: 675540 - RNA, 21 nt, Human
accuaaugaagaagguuauga

SEQ ID NO: 675541 - RNA, 24 nt, Human
acuuugaaaguguuaauguugaag

SEQ ID NO: 675542 - RNA, 19 nt, Human
aggcaaaaaauaaauuccu

SEQ ID NO: 675543 - RNA, 24 nt, Human
augaggcaaaaaauaaauuccuuu

SEQ ID NO: 675544 - RNA, 19 nt, Human
auuuuaagcagguguuacu

SEQ ID NO: 675545 - RNA, 24 nt, Human
caaugcagagacagaaacaaagaa

SEQ ID NO: 675546 - RNA, 21 nt, Human
cacaacaauuccccuacacau

SEQ ID NO: 675547 - RNA, 25 nt, Human
cacaacaauuccccuacacauuuga

SEQ ID NO: 675548 - RNA, 24 nt, Human
cuuuacacaacaauuccccuacac

SEQ ID NO: 675549 - RNA, 19 nt, Human
gcacuaucugcuucugugc

SEQ ID NO: 675550 - RNA, 26 nt, Human
uaaaaacguacuuuauagaaaaccaa

SEQ ID NO: 675551 - RNA, 19 nt, Human
uaaaaugaaagaaugcaca

SEQ ID NO: 675552 - RNA, 19 nt, Human
uaaugaagaagguuaugaa

SEQ ID NO: 675553 - RNA, 23 nt, Human
uagaaaaccaagugcaaaacuaa

SEQ ID NO: 675554 - RNA, 24 nt, Human
uauagaaaaccaagugcaaaacua

SEQ ID NO: 675555 - RNA, 22 nt, Human
uauagguccuuccuccagacuu

SEQ ID NO: 675556 - RNA, 23 nt, Human
ucaauucucuacagacucucucc

SEQ ID NO: 675557 - RNA, 24 nt, Human
uccuccagacuuucuggaagaaau

SEQ ID NO: 675558 - RNA, 21 nt, Human
ucuacagacucucucccauuc

SEQ ID NO: 675559 - RNA, 21 nt, Human
ucuuuuauauuuccagcuguu

SEQ ID NO: 675560 - RNA, 23 nt, Human
ugagacaguauuuuugagggcug

SEQ ID NO: 675561 - RNA, 23 nt, Human
ugcaaaacuaaaaugaaagaaug

SEQ ID NO: 675562 - RNA, 23 nt, Human
ugcaaagggagaauuuuaagcag

SEQ ID NO: 675563 - RNA, 22 nt, Human
ugcagagacagaaacaaagaag

SEQ ID NO: 675564 - RNA, 24 nt, Human
uggacugaugaggcaaaaaauaaa

SEQ ID NO: 675565 - RNA, 23 nt, Human
uucaggguguggacuauaaaaug

SEQ ID NO: 675566 - RNA, 21 nt, Human
uucucuacagacucucuccca

SEQ ID NO: 675567 - RNA, 19 nt, Human
uuuggcacuaucugcuucu

SEQ ID NO: 675568 - RNA, 21 nt, Human
accagguaccaacaucacagc

SEQ ID NO: 675569 - RNA, 20 nt, Human
acccgugaccuagagaugaa

SEQ ID NO: 675570 - RNA, 27 nt, Human
accgcaacgacaccgccaagcggccca

SEQ ID NO: 675571 - RNA, 23 nt, Human
agggagcagcugcccaaauguuu

SEQ ID NO: 675572 - RNA, 22 nt, Human
caacgacaccgccaagcggccc

SEQ ID NO: 675573 - RNA, 18 nt, Human
caacuucaaacagcugaa

SEQ ID NO: 675574 - RNA, 25 nt, Human
cagcagauggcaaaaggagcuuucc

SEQ ID NO: 675575 - RNA, 20 nt, Human
ccagaacccccgaaccccuc

SEQ ID NO: 675576 - RNA, 22 nt, Human
ccagguaccaacaucacagcug

SEQ ID NO: 675577 - RNA, 21 nt, Human
cccagaacccccgaaccccuc

SEQ ID NO: 675578 - RNA, 25 nt, Human
cccagaacccccgaaccccucacgc

SEQ ID NO: 675579 - RNA, 26 nt, Human
cccagaacccccgaaccccucacgcg

SEQ ID NO: 675580 - RNA, 21 nt, Human
cccccgaaccccucacgcgga

SEQ ID NO: 675581 - RNA, 22 nt, Human
cccccgaaccccucacgcggac

SEQ ID NO: 675582 - RNA, 22 nt, Human
ccgccaagcggcccacugaccc

SEQ ID NO: 675583 - RNA, 26 nt, Human
cgaguagaggcaaggacgaagcucau

SEQ ID NO: 675584 - RNA, 20 nt, Human
cuagccaaccaggaauaaau

SEQ ID NO: 675585 - RNA, 18 nt, Human
cuuucauucgaugggaug

SEQ ID NO: 675586 - RNA, 21 nt, Human
gaccacagccugccaagggag

SEQ ID NO: 675587 - RNA, 23 nt, Human
gcuuuccagaacuuuggccuggu

SEQ ID NO: 675588 - RNA, 22 nt, Human
ucaaacagcugaaauuuguuuc

SEQ ID NO: 675589 - RNA, 21 nt, Human
ugauuuauucccuauuuccuu

SEQ ID NO: 675590 - RNA, 19 nt, Human
ugccaagggagcagcugcc

SEQ ID NO: 675591 - RNA, 20 nt, Human
ugccaagggagcagcugccg

SEQ ID NO: 675592 - RNA, 18 nt, Human
ugcccagaacccccgaac

SEQ ID NO: 675593 - RNA, 23 nt, Human
uuaaagaaaaaccucaaaguuca

SEQ ID NO: 675594 - RNA, 19 nt, Human
uuucauagcuguuggucac

SEQ ID NO: 675595 - RNA, 21 nt, Human
uuuggccuggucugcaccagg

SEQ ID NO: 675596 - RNA, 24 nt, Human
aaacaccuggaucaauuguaaaca

SEQ ID NO: 675597 - RNA, 20 nt, Human
aacauaggguggaggccagc

SEQ ID NO: 675598 - RNA, 26 nt, Human
agucuccacuuaaaaugcugaaugac

SEQ ID NO: 675599 - RNA, 19 nt, Human
augcagaugucugaaaucu

SEQ ID NO: 675600 - RNA, 23 nt, Human
caaaaacugcugaauaggaguuc

SEQ ID NO: 675601 - RNA, 24 nt, Human
caaaacacagcaagacauuuucua

SEQ ID NO: 675602 - RNA, 19 nt, Human
caaaacacaggacacagua

SEQ ID NO: 675603 - RNA, 19 nt, Human
cacaauuuauccacuacuu

SEQ ID NO: 675604 - RNA, 20 nt, Human
caccauagaacauaaaaagg

SEQ ID NO: 675605 - RNA, 21 nt, Human
caccauagaacauaaaaagga

SEQ ID NO: 675606 - RNA, 22 nt, Human
caggacacaguacuaaucuguc

SEQ ID NO: 675607 - RNA, 23 nt, Human
cauuacugcuuuccacaaaaacu

SEQ ID NO: 675608 - RNA, 26 nt, Human
ccacaccauagaacauaaaaaggaca

SEQ ID NO: 675609 - RNA, 23 nt, Human
ccacuacugccccuaugcuuuga

SEQ ID NO: 675610 - RNA, 19 nt, Human
cuuuccacaaaaacugcug

SEQ ID NO: 675611 - RNA, 18 nt, Human
gacacaguacuaaucugu

SEQ ID NO: 675612 - RNA, 20 nt, Human
gguaacggugagcuacuccc

SEQ ID NO: 675613 - RNA, 19 nt, Human
gguuugggagaugaagcau

SEQ ID NO: 675614 - RNA, 23 nt, Human
guagcacauuucuucuaaauaaa

SEQ ID NO: 675615 - RNA, 20 nt, Human
gugguggugguguucagaaa

SEQ ID NO: 675616 - RNA, 20 nt, Human
uaaauaaaaacugcaaugca

SEQ ID NO: 675617 - RNA, 22 nt, Human
uaaauuuaaagcaguuauauua

SEQ ID NO: 675618 - RNA, 18 nt, Human
uaagagauacuuuaugau

SEQ ID NO: 675619 - RNA, 22 nt, Human
uacagaaguuagaaacaaacac

SEQ ID NO: 675620 - RNA, 23 nt, Human
ugaaaucuuguuccgaauccaug

SEQ ID NO: 675621 - RNA, 19 nt, Human
ugccacaccauagaacaua

SEQ ID NO: 675622 - RNA, 23 nt, Human
ugccccuaugcuuugaccagucu

SEQ ID NO: 675623 - RNA, 25 nt, Human
uggaacaaaacacaggacacaguac

SEQ ID NO: 675624 - RNA, 21 nt, Human
uggaacauaggguggaggcca

SEQ ID NO: 675625 - RNA, 20 nt, Human
uggaggccagcucccccuuu

SEQ ID NO: 675626 - RNA, 20 nt, Human
uguuugguuugggagaugaa

SEQ ID NO: 675627 - RNA, 24 nt, Human
uuaaagcaguuauauuaacuaguc

SEQ ID NO: 675628 - RNA, 20 nt, Human
uuggugguggugguguucag

SEQ ID NO: 675629 - RNA, 26 nt, Human
uuggugguggugguguucagaaaguu

SEQ ID NO: 675630 - RNA, 18 nt, Human
uuuugcaagcauuacugc

SEQ ID NO: 675631 - RNA, 20 nt, Human
aacuugaaucaaaaccagca

SEQ ID NO: 675632 - RNA, 20 nt, Human
aucaacgagagggacuggag

SEQ ID NO: 675633 - RNA, 23 nt, Human
caaauaucaacgagagggacugg

SEQ ID NO: 675634 - RNA, 21 nt, Human
ccagcagguaauagcacccuu

SEQ ID NO: 675635 - RNA, 22 nt, Human
ccccuucugaccaaacaagccc

SEQ ID NO: 675636 - RNA, 18 nt, Human
cccuuggguaucugaggc

SEQ ID NO: 675637 - RNA, 19 nt, Human
cgccccccuucugaccaaa

SEQ ID NO: 675638 - RNA, 20 nt, Human
gcuaaggggcagcuucucug

SEQ ID NO: 675639 - RNA, 19 nt, Human
uaggaaagaugucauacuu

SEQ ID NO: 675640 - RNA, 27 nt, Human
ucaaaaccagcagguaauagcaccccc

SEQ ID NO: 675641 - RNA, 24 nt, Human
ugaccaaacaagcccucgaaucag

SEQ ID NO: 675642 - RNA, 23 nt, Human
uggcuaaggggcagcuucucuga

SEQ ID NO: 675643 - RNA, 21 nt, Human
uuacuuaauccccugcugucu

SEQ ID NO: 675644 - RNA, 22 nt, Human
aacugcagaaacucugccccca

SEQ ID NO: 675645 - RNA, 18 nt, Human
acccacugaaucauaauc

SEQ ID NO: 675646 - RNA, 20 nt, Human
accccaaagccucuguucuu

SEQ ID NO: 675647 - RNA, 25 nt, Human
agaaacucugcccccaacccacuga

SEQ ID NO: 675648 - RNA, 20 nt, Human
agagggaaauagugugcagu

SEQ ID NO: 675649 - RNA, 20 nt, Human
aggcagccguauugucagcc

SEQ ID NO: 675650 - RNA, 18 nt, Human
auggaacugcagaaacuc

SEQ ID NO: 675651 - RNA, 20 nt, Human
auggaacugcagaaacucug

SEQ ID NO: 675652 - RNA, 22 nt, Human
auggaacugcagaaacucugcc

SEQ ID NO: 675653 - RNA, 22 nt, Human
caaaagggagccaugccagaug

SEQ ID NO: 675654 - RNA, 24 nt, Human
cacugggcuaggaccccaaagccu

SEQ ID NO: 675655 - RNA, 18 nt, Human
cagcaccugcaccugggg

SEQ ID NO: 675656 - RNA, 18 nt, Human
cagccccugccccugggg

SEQ ID NO: 675657 - RNA, 18 nt, Human
ccccagaugaucugcaag

SEQ ID NO: 675658 - RNA, 19 nt, Human
cccccaacccacugaauca

SEQ ID NO: 675659 - RNA, 22 nt, Human
gcagggcacaggaaggacaaaa

SEQ ID NO: 675660 - RNA, 22 nt, Human
ggcacaggaaggacaaaaggga

SEQ ID NO: 675661 - RNA, 21 nt, Human
uaaggcagccguauugucagc

SEQ ID NO: 675662 - RNA, 18 nt, Human
ucccacuuagccgacccc

SEQ ID NO: 675663 - RNA, 18 nt, Human
uccuaaccuggcaugaag

SEQ ID NO: 675664 - RNA, 22 nt, Human
ugggcuaggaccccaaagccuc

SEQ ID NO: 675665 - RNA, 19 nt, Human
acccgggggcugggaggcc

SEQ ID NO: 675666 - RNA, 22 nt, Human
agcgaggcuucagcacccagga

SEQ ID NO: 675667 - RNA, 19 nt, Human
agcugccgggggggcacca

SEQ ID NO: 675668 - RNA, 24 nt, Human
agguggugggggacagacaggagc

SEQ ID NO: 675669 - RNA, 22 nt, Human
caacaaacaauugggcucccaa

SEQ ID NO: 675670 - RNA, 19 nt, Human
cagaagcugagggccaggu

SEQ ID NO: 675671 - RNA, 22 nt, Human
ccagguggugggggacagacag

SEQ ID NO: 675672 - RNA, 18 nt, Human
ccgggagcugccgggggg

SEQ ID NO: 675673 - RNA, 19 nt, Human
cggcgggcugggcuggggc

SEQ ID NO: 675674 - RNA, 18 nt, Human
cucccugcaugacaggcc

SEQ ID NO: 675675 - RNA, 19 nt, Human
ggcuggggcugcccgggca

SEQ ID NO: 675676 - RNA, 20 nt, Human
gggcagugccgggagcugcc

SEQ ID NO: 675677 - RNA, 18 nt, Human
gggcugggcuggggcugc

SEQ ID NO: 675678 - RNA, 20 nt, Human
ggggcugcccgggcaguagg

SEQ ID NO: 675679 - RNA, 24 nt, Human
uagcaccauccuugcucccggcgg

SEQ ID NO: 675680 - RNA, 21 nt, Human
uccuugcucccggcgggcugg

SEQ ID NO: 675681 - RNA, 19 nt, Human
ucucagaagcugagggcca

SEQ ID NO: 675682 - RNA, 18 nt, Human
ugaaggggccggaguugg

SEQ ID NO: 675683 - RNA, 18 nt, Human
ugacaggccaggucccca

SEQ ID NO: 675684 - RNA, 24 nt, Human
ugccgggggggcaccacaacuguc

SEQ ID NO: 675685 - RNA, 25 nt, Human
ugccgggggggcaccacaacugucc

SEQ ID NO: 675686 - RNA, 21 nt, Human
uggggcugcccgggcaguagg

SEQ ID NO: 675687 - RNA, 20 nt, Human
uugcucccggcgggcugggc

SEQ ID NO: 675688 - RNA, 21 nt, Human
aacauuaaaaaagcauggcag

SEQ ID NO: 675689 - RNA, 23 nt, Human
aagaacaucagggaaagaccaac

SEQ ID NO: 675690 - RNA, 20 nt, Human
aagaauggcacgcaggguuu

SEQ ID NO: 675691 - RNA, 23 nt, Human
aagcuagaaaagguuuuccacag

SEQ ID NO: 675692 - RNA, 24 nt, Human
aaugcuaaaggaugccagaaagaa

SEQ ID NO: 675693 - RNA, 21 nt, Human
acaaaguaauaaacagugcuc

SEQ ID NO: 675694 - RNA, 22 nt, Human
acacaccugccagagcaggccc

SEQ ID NO: 675695 - RNA, 19 nt, Human
acucaugugauuaaaacag

SEQ ID NO: 675696 - RNA, 20 nt, Human
acucccauccccaauacaca

SEQ ID NO: 675697 - RNA, 21 nt, Human
acuuuccucuucugugagauu

SEQ ID NO: 675698 - RNA, 24 nt, Human
aggcuguuuccaguucuuggccuu

SEQ ID NO: 675699 - RNA, 23 nt, Human
aguucuuggccuuuaaacaacuc

SEQ ID NO: 675700 - RNA, 22 nt, Human
augagcccagagcacauacaaa

SEQ ID NO: 675701 - RNA, 19 nt, Human
caacugcugcagcucauga

SEQ ID NO: 675702 - RNA, 22 nt, Human
caccagaacaaaugaaacacac

SEQ ID NO: 675703 - RNA, 21 nt, Human
caucaagaaaggguacaacug

SEQ ID NO: 675704 - RNA, 18 nt, Human
caucagggaaagaccaac

SEQ ID NO: 675705 - RNA, 19 nt, Human
cauuuuaucugaauucugg

SEQ ID NO: 675706 - RNA, 21 nt, Human
ccagaaagaacaucagggaaa

SEQ ID NO: 675707 - RNA, 19 nt, Human
ccagaacaaaugaaacaca

SEQ ID NO: 675708 - RNA, 20 nt, Human
ccagaacaaaugaaacacac

SEQ ID NO: 675709 - RNA, 19 nt, Human
ccugcacacaccugccaga

SEQ ID NO: 675710 - RNA, 24 nt, Human
cgauaugcauacuaaugaccuaca

SEQ ID NO: 675711 - RNA, 18 nt, Human
cucccuguucucggcugc

SEQ ID NO: 675712 - RNA, 18 nt, Human
cugcacacaccugccaga

SEQ ID NO: 675713 - RNA, 19 nt, Human
gagcacauacaaauccuaa

SEQ ID NO: 675714 - RNA, 19 nt, Human
gagcccagagcacauacaa

SEQ ID NO: 675715 - RNA, 21 nt, Human
guaauagcagaacauaagcac

SEQ ID NO: 675716 - RNA, 22 nt, Human
uaaauuagaaacacaaauaaau

SEQ ID NO: 675717 - RNA, 27 nt, Human
uaagcuagaaaagguuuuccacaucca

SEQ ID NO: 675718 - RNA, 19 nt, Human
uacaaaguaauaaacagug

SEQ ID NO: 675719 - RNA, 19 nt, Human
uagaagaauggcacgcagg

SEQ ID NO: 675720 - RNA, 20 nt, Human
ucaucaagaaaggguacaac

SEQ ID NO: 675721 - RNA, 19 nt, Human
ucccuuaacuuuuuacaaa

SEQ ID NO: 675722 - RNA, 20 nt, Human
ucugaauucuggaaugaaua

SEQ ID NO: 675723 - RNA, 21 nt, Human
ugaagagcucacugugguuag

SEQ ID NO: 675724 - RNA, 24 nt, Human
ugaauauacaugcugcaauaacau

SEQ ID NO: 675725 - RNA, 20 nt, Human
ugccugguagaagaauggca

SEQ ID NO: 675726 - RNA, 20 nt, Human
uggaaugaauauacaugcug

SEQ ID NO: 675727 - RNA, 18 nt, Human
uggcaccagaacaaauga

SEQ ID NO: 675728 - RNA, 21 nt, Human
uggcaccagaacaaaugaaac

SEQ ID NO: 675729 - RNA, 18 nt, Human
uggccuuuaaacaacucu

SEQ ID NO: 675730 - RNA, 19 nt, Human
ugggagccuuucauuccuc

SEQ ID NO: 675731 - RNA, 22 nt, Human
uuaaaaauaaaaaugcuaaagg

SEQ ID NO: 675732 - RNA, 22 nt, Human
uuggccuuuaaacaacucuaaa

SEQ ID NO: 675733 - RNA, 23 nt, Human
aaaaaacccuaggacuugacuca

SEQ ID NO: 675734 - RNA, 22 nt, Human
aaaacaaaaccaaaaaacccua

SEQ ID NO: 675735 - RNA, 18 nt, Human
aaacaaaaccaaaaaacc

SEQ ID NO: 675736 - RNA, 20 nt, Human
aaacaaaaccaaaaaacccu

SEQ ID NO: 675737 - RNA, 24 nt, Human
aaagugcugggauuacaggcguga

SEQ ID NO: 675738 - RNA, 24 nt, Human
aacaaaaccaaaaaacccuaggac

SEQ ID NO: 675739 - RNA, 19 nt, Human
aagugcugggauuacaggc

SEQ ID NO: 675740 - RNA, 19 nt, Human
aagugcugggauuacaggc

SEQ ID NO: 675741 - RNA, 26 nt, Human
aagugcugggauuacaggcgugagcc

SEQ ID NO: 675742 - RNA, 21 nt, Human
acaaaacaaaaccaaaaaacc

SEQ ID NO: 675743 - RNA, 23 nt, Human
acaaaacaaaaccaaaaaacccu

SEQ ID NO: 675744 - RNA, 18 nt, Human
accauguuggccaggcug

SEQ ID NO: 675745 - RNA, 25 nt, Human
acccgccucagccucccaaagugcu

SEQ ID NO: 675746 - RNA, 22 nt, Human
agacuuaaaaaacgagggcugg

SEQ ID NO: 675747 - RNA, 24 nt, Human
agcgauucuccugccucagccucc

SEQ ID NO: 675748 - RNA, 18 nt, Human
aggacccugggcugcucu

SEQ ID NO: 675749 - RNA, 24 nt, Human
aggugauccacccgccucagccuc

SEQ ID NO: 675750 - RNA, 23 nt, Human
aguagcuggaacuacaggcgugc

SEQ ID NO: 675751 - RNA, 21 nt, Human
agugcaauggugcgaucucag

SEQ ID NO: 675752 - RNA, 18 nt, Human
agugcugggauuacaggc

SEQ ID NO: 675753 - RNA, 18 nt, Human
augggguuucaccauguu

SEQ ID NO: 675754 - RNA, 22 nt, Human
augggguuucaccauguuggcc

SEQ ID NO: 675755 - RNA, 24 nt, Human
augggguuucaccauguuggccag

SEQ ID NO: 675756 - RNA, 21 nt, Human
caaaacaaaaccaaaaaaccc

SEQ ID NO: 675757 - RNA, 24 nt, Human
caaagugcugggauuacaggcgug

SEQ ID NO: 675758 - RNA, 23 nt, Human
caaccuccaccucccggguucaa

SEQ ID NO: 675759 - RNA, 22 nt, Human
caagcgauucuccugccucagc

SEQ ID NO: 675760 - RNA, 21 nt, Human
caccauguuggccaggcuggu

SEQ ID NO: 675761 - RNA, 24 nt, Human
caccauguuggccaggcuggucuc

SEQ ID NO: 675762 - RNA, 27 nt, Human
caccauguuggccaggcuggucucaaa

SEQ ID NO: 675763 - RNA, 23 nt, Human
caccauucccccagagcuguguu

SEQ ID NO: 675764 - RNA, 23 nt, Human
cacccgccucagccucccaaagu

SEQ ID NO: 675765 - RNA, 21 nt, Human
cacugcaaccuccaccucccg

SEQ ID NO: 675766 - RNA, 23 nt, Human
cacugcaaccuccaccucccggg

SEQ ID NO: 675767 - RNA, 19 nt, Human
cagccuccugaguagcugg

SEQ ID NO: 675768 - RNA, 24 nt, Human
cauguuggccaggcuggucucaaa

SEQ ID NO: 675769 - RNA, 22 nt, Human
ccaaagugcugggauuacaggc

SEQ ID NO: 675770 - RNA, 22 nt, Human
ccaaagugcugggauuacaggc

SEQ ID NO: 675771 - RNA, 24 nt, Human
ccaaagugcugggauuacaggcgu

SEQ ID NO: 675772 - RNA, 26 nt, Human
ccacccgccucagccucccaaagugc

SEQ ID NO: 675773 - RNA, 24 nt, Human
ccaccucccggguucaagcgauuc

SEQ ID NO: 675774 - RNA, 22 nt, Human
ccccccggccgccgccgucagc

SEQ ID NO: 675775 - RNA, 22 nt, Human
cccgaccucaggugauccaccc

SEQ ID NO: 675776 - RNA, 23 nt, Human
cccgaccucaggugauccacccg

SEQ ID NO: 675777 - RNA, 20 nt, Human
cccggguucaagcgauucuc

SEQ ID NO: 675778 - RNA, 23 nt, Human
cccggguucaagcgauucuccug

SEQ ID NO: 675779 - RNA, 18 nt, Human
ccgcccgccgcaggcucc

SEQ ID NO: 675780 - RNA, 24 nt, Human
ccgccucagccucccaaagugcug

SEQ ID NO: 675781 - RNA, 24 nt, Human
ccucccggguucaagcgauucucc

SEQ ID NO: 675782 - RNA, 23 nt, Human
ccugccucagccuccugaguagc

SEQ ID NO: 675783 - RNA, 24 nt, Human
ccugccucagccuccugaguagcu

SEQ ID NO: 675784 - RNA, 24 nt, Human
cgaccucaggugauccacccgccu

SEQ ID NO: 675785 - RNA, 22 nt, Human
cgagguggaugacaccauuccc

SEQ ID NO: 675786 - RNA, 30 nt, Human
cgaugggguuucaccauguuggccaggcuu

SEQ ID NO: 675787 - RNA, 24 nt, Human
cgcucuuguugcccaggcuggagu

SEQ ID NO: 675788 - RNA, 24 nt, Human
cucacugcaaccuccaccucccgg

SEQ ID NO: 675789 - RNA, 23 nt, Human
cucguuggcaacaaaacaaaacc

SEQ ID NO: 675790 - RNA, 24 nt, Human
cucuggcaggacccugggcugcuc

SEQ ID NO: 675791 - RNA, 23 nt, Human
cugcaaccuccaccucccggguu

SEQ ID NO: 675792 - RNA, 24 nt, Human
cugcaaccuccaccucccggguuc

SEQ ID NO: 675793 - RNA, 24 nt, Human
cuuguugcccaggcuggagugcaa

SEQ ID NO: 675794 - RNA, 23 nt, Human
gaccucaggugauccacccgccu

SEQ ID NO: 675795 - RNA, 24 nt, Human
gaccucaggugauccacccgccuc

SEQ ID NO: 675796 - RNA, 18 nt, Human
gauuacaggcgugagcca

SEQ ID NO: 675797 - RNA, 19 nt, Human
gauuacaggcgugagccac

SEQ ID NO: 675798 - RNA, 24 nt, Human
gauuacaggcgugagccacggugc

SEQ ID NO: 675799 - RNA, 23 nt, Human
gccaggggcaguucaccgacuug

SEQ ID NO: 675800 - RNA, 23 nt, Human
gcccagcuaauuuuuuauauuuu

SEQ ID NO: 675801 - RNA, 19 nt, Human
gcccaggcuggagugcaau

SEQ ID NO: 675802 - RNA, 21 nt, Human
gcccgcggugaugccccagcc

SEQ ID NO: 675803 - RNA, 23 nt, Human
gccucagccucccaaagugcugg

SEQ ID NO: 675804 - RNA, 24 nt, Human
gcgauucuccugccucagccuccu

SEQ ID NO: 675805 - RNA, 20 nt, Human
gcgggcgucgacaccgcccc

SEQ ID NO: 675806 - RNA, 24 nt, Human
gcucuuguugcccaggcuggagug

SEQ ID NO: 675807 - RNA, 18 nt, Human
gcugcucugggggacaca

SEQ ID NO: 675808 - RNA, 23 nt, Human
gcuggucucaaacucccgaccuc

SEQ ID NO: 675809 - RNA, 23 nt, Human
ggcaacaaaacaaaaccaaaaaa

SEQ ID NO: 675810 - RNA, 19 nt, Human
gggggacacaggccagggg

SEQ ID NO: 675811 - RNA, 22 nt, Human
gggguuucaccauguuggccag

SEQ ID NO: 675812 - RNA, 18 nt, Human
ggguuucaccauguuggc

SEQ ID NO: 675813 - RNA, 21 nt, Human
ggucgaggcccgcggugaugc

SEQ ID NO: 675814 - RNA, 24 nt, Human
gugauccacccgccucagccuccc

SEQ ID NO: 675815 - RNA, 21 nt, Human
uaaagcgagguggaugacacc

SEQ ID NO: 675816 - RNA, 22 nt, Human
uaauuuuuuauauuuuuaguag

SEQ ID NO: 675817 - RNA, 24 nt, Human
uacaggcgugagccacggugccca

SEQ ID NO: 675818 - RNA, 24 nt, Human
uaguagcgaugggguuucaccaug

SEQ ID NO: 675819 - RNA, 23 nt, Human
ucacugcaaccuccaccucccgg

SEQ ID NO: 675820 - RNA, 24 nt, Human
ucacugcaaccuccaccucccggg

SEQ ID NO: 675821 - RNA, 25 nt, Human
ucacugcaaccuccaccucccgggu

SEQ ID NO: 675822 - RNA, 27 nt, Human
ucacugcaaccuccaccucccggguuc

SEQ ID NO: 675823 - RNA, 23 nt, Human
ucagccuccugaguagcuggaac

SEQ ID NO: 675824 - RNA, 21 nt, Human
uccacccgccucagccuccca

SEQ ID NO: 675825 - RNA, 24 nt, Human
ucccaaagugcugggauuacaggc

SEQ ID NO: 675826 - RNA, 22 nt, Human
ucccccagagcuguguuccucg

SEQ ID NO: 675827 - RNA, 21 nt, Human
ucccggguucaagcgauucuc

SEQ ID NO: 675828 - RNA, 24 nt, Human
ucccggguucaagcgauucuccug

SEQ ID NO: 675829 - RNA, 24 nt, Human
uccugaguagcuggaacuacaggc

SEQ ID NO: 675830 - RNA, 21 nt, Human
ucgcucuuguugcccaggcug

SEQ ID NO: 675831 - RNA, 22 nt, Human
ucgcucuuguugcccaggcugg

SEQ ID NO: 675832 - RNA, 23 nt, Human
ucgcucuuguugcccaggcugga

SEQ ID NO: 675833 - RNA, 24 nt, Human
ucuccugccucagccuccugagua

SEQ ID NO: 675834 - RNA, 18 nt, Human
ucuggcaggacccugggc

SEQ ID NO: 675835 - RNA, 22 nt, Human
ucuuguugcccaggcuggagug

SEQ ID NO: 675836 - RNA, 21 nt, Human
ugaaaugaagguauaaaguca

SEQ ID NO: 675837 - RNA, 23 nt, Human
ugagacagaguuucgcucuuguu

SEQ ID NO: 675838 - RNA, 23 nt, Human
ugcaauggugcgaucucagcucc

SEQ ID NO: 675839 - RNA, 18 nt, Human
ugcccaggcuggagugca

SEQ ID NO: 675840 - RNA, 21 nt, Human
ugcccaggcuggagugcaaug

SEQ ID NO: 675841 - RNA, 24 nt, Human
ugcccaggcuggagugcaauggug

SEQ ID NO: 675842 - RNA, 21 nt, Human
ugccccagccggcgccgcggg

SEQ ID NO: 675843 - RNA, 24 nt, Human
ugccucagccuccugaguagcugg

SEQ ID NO: 675844 - RNA, 24 nt, Human
ugcugggauuacaggcgugagcca

SEQ ID NO: 675845 - RNA, 21 nt, Human
uggaacuacaggcgugcgcca

SEQ ID NO: 675846 - RNA, 24 nt, Human
uggaacuacaggcgugcgccacca

SEQ ID NO: 675847 - RNA, 23 nt, Human
uggagugcaauggugcgaucuca

SEQ ID NO: 675848 - RNA, 24 nt, Human
uggagugcaauggugcgaucucag

SEQ ID NO: 675849 - RNA, 18 nt, Human
uggcaacaaaacaaaacc

SEQ ID NO: 675850 - RNA, 21 nt, Human
uggcaacaaaacaaaaccaaa

SEQ ID NO: 675851 - RNA, 22 nt, Human
uggcaggacccugggcugcucu

SEQ ID NO: 675852 - RNA, 21 nt, Human
uggccaggcuggucucaaacu

SEQ ID NO: 675853 - RNA, 18 nt, Human
ugggauuacaggcgugag

SEQ ID NO: 675854 - RNA, 19 nt, Human
ugggauuacaggcgugagc

SEQ ID NO: 675855 - RNA, 21 nt, Human
ugggauuacaggcgugagcca

SEQ ID NO: 675856 - RNA, 22 nt, Human
ugggauuacaggcgugagccac

SEQ ID NO: 675857 - RNA, 22 nt, Human
ugggauuacaggcgugagccac

SEQ ID NO: 675858 - RNA, 23 nt, Human
ugggauuacaggcgugagccacg

SEQ ID NO: 675859 - RNA, 24 nt, Human
ugggauuacaggcgugagccacgg

SEQ ID NO: 675860 - RNA, 26 nt, Human
ugggauuacaggcgugagccacggug

SEQ ID NO: 675861 - RNA, 27 nt, Human
ugggauuacaggcgugagccacggugc

SEQ ID NO: 675862 - RNA, 18 nt, Human
ugggggacacaggccagg

SEQ ID NO: 675863 - RNA, 24 nt, Human
ugggguuucaccauguuggccagg

SEQ ID NO: 675864 - RNA, 19 nt, Human
uggucucaaacucccgacc

SEQ ID NO: 675865 - RNA, 24 nt, Human
uggugcgaucucagcucacugcaa

SEQ ID NO: 675866 - RNA, 20 nt, Human
uguugcccaggcuggagugc

SEQ ID NO: 675867 - RNA, 31 nt, Human
uuagaauagaccaaaaaaaaaaaaaaaaaaa

SEQ ID NO: 675868 - RNA, 18 nt, Human
uuaguagcgaugggguuu

SEQ ID NO: 675869 - RNA, 24 nt, Human
uuaguagcgaugggguuucaccau

SEQ ID NO: 675870 - RNA, 21 nt, Human
uucaagcgauucuccugccuc

SEQ ID NO: 675871 - RNA, 23 nt, Human
uucaagcgauucuccugccucag

SEQ ID NO: 675872 - RNA, 24 nt, Human
uucaagcgauucuccugccucagc

SEQ ID NO: 675873 - RNA, 24 nt, Human
uucgcucuuguugcccaggcugga

SEQ ID NO: 675874 - RNA, 18 nt, Human
uugccuguuucuccaugu

SEQ ID NO: 675875 - RNA, 24 nt, Human
uuggcaacaaaacaaaaccaaaaa

SEQ ID NO: 675876 - RNA, 24 nt, Human
uuucaccauguuggccaggcuggu

SEQ ID NO: 675877 - RNA, 24 nt, Human
uuucgcucuuguugcccaggcugg

SEQ ID NO: 675878 - RNA, 24 nt, Human
uuuuuaguagcgaugggguuucac

SEQ ID NO: 675879 - RNA, 21 nt, Human
aaaaauuauggaucacauggc

SEQ ID NO: 675880 - RNA, 19 nt, Human
aaagaaguaaguugagauu

SEQ ID NO: 675881 - RNA, 23 nt, Human
aagcagauuuccuuuccaaaagc

SEQ ID NO: 675882 - RNA, 23 nt, Human
aagcugucuacugggaucuucag

SEQ ID NO: 675883 - RNA, 22 nt, Human
aaucaugguuguaucaucuuua

SEQ ID NO: 675884 - RNA, 18 nt, Human
accuaagcaaaaacagcu

SEQ ID NO: 675885 - RNA, 21 nt, Human
auuuccuuuccaaaagcagac

SEQ ID NO: 675886 - RNA, 21 nt, Human
cagaauaauuaaguucacaaa

SEQ ID NO: 675887 - RNA, 18 nt, Human
cagaccuuuuaaucacag

SEQ ID NO: 675888 - RNA, 18 nt, Human
cauuaggcaaaagggaga

SEQ ID NO: 675889 - RNA, 23 nt, Human
ccaaaagcagacgccucuccugu

SEQ ID NO: 675890 - RNA, 22 nt, Human
ccaaacacacaaaauaugggcc

SEQ ID NO: 675891 - RNA, 23 nt, Human
ccuaagcaaaaacagcuuaugga

SEQ ID NO: 675892 - RNA, 24 nt, Human
cugucuacugggaucuucagcugc

SEQ ID NO: 675893 - RNA, 20 nt, Human
gaaaaaugucuaaggauuua

SEQ ID NO: 675894 - RNA, 23 nt, Human
gugguuuucucuuccauuuuuuu

SEQ ID NO: 675895 - RNA, 24 nt, Human
uaagcaaaaacagcuuauggaauc

SEQ ID NO: 675896 - RNA, 21 nt, Human
uagugguuuucucuuccauuu

SEQ ID NO: 675897 - RNA, 18 nt, Human
ucauuaggcaaaagggag

SEQ ID NO: 675898 - RNA, 21 nt, Human
uccaaaagcagacgccucucc

SEQ ID NO: 675899 - RNA, 21 nt, Human
uccaaauacaaauaaaggcca

SEQ ID NO: 675900 - RNA, 23 nt, Human
ucuacugggaucuucagcugcca

SEQ ID NO: 675901 - RNA, 21 nt, Human
ucuccuguuacaguugcaaau

SEQ ID NO: 675902 - RNA, 20 nt, Human
ucugauuuugcaauacaaaa

SEQ ID NO: 675903 - RNA, 23 nt, Human
uucagaccuuuuaaucacagauc

SEQ ID NO: 675904 - RNA, 22 nt, Human
uuccaggucuaucugauuuugc

SEQ ID NO: 675905 - RNA, 23 nt, Human
uucucuuccauuuuuuuuaaaaa

SEQ ID NO: 675906 - RNA, 20 nt, Human
uuuaaaaaccucauugaucc

SEQ ID NO: 675907 - RNA, 20 nt, Human
uuuuuuuuuuuuuuuugcca

SEQ ID NO: 675908 - RNA, 18 nt, Human
uuuuuuuuuuuuuuuuug

SEQ ID NO: 675909 - RNA, 23 nt, Human
uuuuuuuuuuuuuuuuugccauu

SEQ ID NO: 675910 - RNA, 19 nt, Human
aagcuagucucugcagaug

SEQ ID NO: 675911 - RNA, 18 nt, Human
acaccaccuccagaaauu

SEQ ID NO: 675912 - RNA, 20 nt, Human
agccugaaaagcuagucucu

SEQ ID NO: 675913 - RNA, 19 nt, Human
aggauaccuuagccugaaa

SEQ ID NO: 675914 - RNA, 24 nt, Human
caaauuauacgcccagaccugccc

SEQ ID NO: 675915 - RNA, 21 nt, Human
cacccuucugggagaugaaaa

SEQ ID NO: 675916 - RNA, 26 nt, Human
cccaacacugucuuauguucaggauu

SEQ ID NO: 675917 - RNA, 20 nt, Human
cgggaagaaacgaugagcaa

SEQ ID NO: 675918 - RNA, 21 nt, Human
cuccuuuacugcugauuacaa

SEQ ID NO: 675919 - RNA, 19 nt, Human
cuuuucauccaccauccac

SEQ ID NO: 675920 - RNA, 21 nt, Human
gaaacgaugagcaacacccuu

SEQ ID NO: 675921 - RNA, 18 nt, Human
gcugauuacaauuuauua

SEQ ID NO: 675922 - RNA, 19 nt, Human
uacgcccagaccugcccaa

SEQ ID NO: 675923 - RNA, 21 nt, Human
uccaccauccacuccucaaau

SEQ ID NO: 675924 - RNA, 19 nt, Human
ugauacaccaccuccagaa

SEQ ID NO: 675925 - RNA, 18 nt, Human
ugcccaacacugucuuau

SEQ ID NO: 675926 - RNA, 19 nt, Human
uucauccaccauccacucc

SEQ ID NO: 675927 - RNA, 21 nt, Human
uugauacaccaccuccagaaa

SEQ ID NO: 675928 - RNA, 19 nt, Human
aaaaagaauucuauagugg

SEQ ID NO: 675929 - RNA, 21 nt, Human
aaaacucucaaagcaugucac

SEQ ID NO: 675930 - RNA, 22 nt, Human
aaacauucaaauguuaauguua

SEQ ID NO: 675931 - RNA, 25 nt, Human
aaagcaccuggaacacaggaggcac

SEQ ID NO: 675932 - RNA, 21 nt, Human
aaauaggguacuugucacaga

SEQ ID NO: 675933 - RNA, 20 nt, Human
aauacauacauguuuuaaau

SEQ ID NO: 675934 - RNA, 24 nt, Human
aauuuuauuuccaugaucuauuua

SEQ ID NO: 675935 - RNA, 23 nt, Human
acaaagacuguugaaaagcaccc

SEQ ID NO: 675936 - RNA, 21 nt, Human
agacaaacauucaaauguuaa

SEQ ID NO: 675937 - RNA, 24 nt, Human
agacaaacauucaaauguuaaugu

SEQ ID NO: 675938 - RNA, 23 nt, Human
agacaagcuacucaagcacucuu

SEQ ID NO: 675939 - RNA, 18 nt, Human
agauguggcauaauaacc

SEQ ID NO: 675940 - RNA, 21 nt, Human
caaaacucucaaagcauguca

SEQ ID NO: 675941 - RNA, 23 nt, Human
caaacauucaaauguuaauguua

SEQ ID NO: 675942 - RNA, 19 nt, Human
caaagcaccuggaacacag

SEQ ID NO: 675943 - RNA, 25 nt, Human
caaagcaccuggaacacaggaggca

SEQ ID NO: 675944 - RNA, 25 nt, Human
cacagacaaacauucaaauguuaau

SEQ ID NO: 675945 - RNA, 20 nt, Human
caugucaacaugugacaaaa

SEQ ID NO: 675946 - RNA, 18 nt, Human
uacaaguucacaguacau

SEQ ID NO: 675947 - RNA, 21 nt, Human
uagcaguacagaaauucuggu

SEQ ID NO: 675948 - RNA, 19 nt, Human
uauaaaaugagaauacuaa

SEQ ID NO: 675949 - RNA, 24 nt, Human
uaugcauuuucauggagauguggc

SEQ ID NO: 675950 - RNA, 18 nt, Human
ucacacgacaaauagggu

SEQ ID NO: 675951 - RNA, 28 nt, Human
ucauggagauguggcauaauaacccaca

SEQ ID NO: 675952 - RNA, 24 nt, Human
ucuauaguggaaaguucuugaggc

SEQ ID NO: 675953 - RNA, 18 nt, Human
ugacaaaacucucaaagc

SEQ ID NO: 675954 - RNA, 19 nt, Human
ugagagcaagaaugcaucc

SEQ ID NO: 675955 - RNA, 22 nt, Human
ugagagcaagaaugcauccaag

SEQ ID NO: 675956 - RNA, 24 nt, Human
ugagagcaagaaugcauccaagug

SEQ ID NO: 675957 - RNA, 20 nt, Human
uggaaaguucuugaggcaau

SEQ ID NO: 675958 - RNA, 21 nt, Human
uggaacacaggaggcacucuu

SEQ ID NO: 675959 - RNA, 24 nt, Human
uggcauaauaacccacaauaucaa

SEQ ID NO: 675960 - RNA, 21 nt, Human
ugucacacgacaaauagggua

SEQ ID NO: 675961 - RNA, 20 nt, Human
ugugacaaaacucucaaagc

SEQ ID NO: 675962 - RNA, 20 nt, Human
aaaaaaggguccuaugugga

SEQ ID NO: 675963 - RNA, 24 nt, Human
aaauuccaaaucaaaacauaacuc

SEQ ID NO: 675964 - RNA, 24 nt, Human
acaaauaauuaaaauuccaaauca

SEQ ID NO: 675965 - RNA, 18 nt, Human
accgccaccgccgccgcc

SEQ ID NO: 675966 - RNA, 22 nt, Human
caaugauaaaaauaaacaaaua

SEQ ID NO: 675967 - RNA, 24 nt, Human
ccgccaccgccgccgccaggccgg

SEQ ID NO: 675968 - RNA, 19 nt, Human
cgccacggcagcuaccgcc

SEQ ID NO: 675969 - RNA, 19 nt, Human
cggcagcuaccgccaccgc

SEQ ID NO: 675970 - RNA, 22 nt, Human
cggccagggcgggcaggcgacg

SEQ ID NO: 675971 - RNA, 20 nt, Human
cgucuccgucgggcgggcgg

SEQ ID NO: 675972 - RNA, 22 nt, Human
cuaccgccaccgccgccgccag

SEQ ID NO: 675973 - RNA, 20 nt, Human
gaagucagauagcugggacu

SEQ ID NO: 675974 - RNA, 22 nt, Human
gagcggccagggcgggcaggcg

SEQ ID NO: 675975 - RNA, 18 nt, Human
gaggccgccacggcagcu

SEQ ID NO: 675976 - RNA, 20 nt, Human
gccacggcagcuaccgccac

SEQ ID NO: 675977 - RNA, 20 nt, Human
gcuaccgccaccgccgccgc

SEQ ID NO: 675978 - RNA, 22 nt, Human
uaacuccuggcccugagauccc

SEQ ID NO: 675979 - RNA, 23 nt, Human
uaauuaaaauuccaaaucaaaac

SEQ ID NO: 675980 - RNA, 20 nt, Human
uaccgccaccgccgccgccc

SEQ ID NO: 675981 - RNA, 18 nt, Human
ucaaaacauaacuccugg

SEQ ID NO: 675982 - RNA, 22 nt, Human
ugaagucagauagcugggacgu

SEQ ID NO: 675983 - RNA, 21 nt, Human
ugaagucagauagcugggacu

SEQ ID NO: 675984 - RNA, 23 nt, Human
ugggacugcgucuccgucgggcg

SEQ ID NO: 675985 - RNA, 24 nt, Human
uuuuaaaaaaggguccuaugugga

SEQ ID NO: 675986 - RNA, 23 nt, Human
uuuuuuuuuuuuaaaaaaggguc

SEQ ID NO: 675987 - RNA, 26 nt, Human
uuuuuuuuuuuuuuuuuaaaaaaggg

SEQ ID NO: 675988 - RNA, 18 nt, Human
aaaaacacccucaguaca

SEQ ID NO: 675989 - RNA, 22 nt, Human
aaaaacgagcggcaacagaagg

SEQ ID NO: 675990 - RNA, 20 nt, Human
aaaacaaacaagacacagcc

SEQ ID NO: 675991 - RNA, 19 nt, Human
aaaaccaaaccaaaggcag

SEQ ID NO: 675992 - RNA, 21 nt, Human
aaaagaaaggaaaugaaccca

SEQ ID NO: 675993 - RNA, 21 nt, Human
aaacaaaaauguaacagagaa

SEQ ID NO: 675994 - RNA, 22 nt, Human
aaacaaaaauguaacagagaaa

SEQ ID NO: 675995 - RNA, 25 nt, Human
aaacaaaaauguaacagagaaaaca

SEQ ID NO: 675996 - RNA, 21 nt, Human
aaacaaacaagacacagccuc

SEQ ID NO: 675997 - RNA, 22 nt, Human
aaagcacagagccacucccucc

SEQ ID NO: 675998 - RNA, 24 nt, Human
aaaugaacccacaacccacuggaa

SEQ ID NO: 675999 - RNA, 21 nt, Human
aaaugcuauaaaucugacucu

SEQ ID NO: 676000 - RNA, 20 nt, Human
aacagagaaaacaaacaaga

SEQ ID NO: 676001 - RNA, 25 nt, Human
aaccaaaccaaaggcagccaugaaa

SEQ ID NO: 676002 - RNA, 22 nt, Human
aacugaguuucaggugcagaaa

SEQ ID NO: 676003 - RNA, 22 nt, Human
aagcaaaacucaaacauggccc

SEQ ID NO: 676004 - RNA, 18 nt, Human
aagcaaaacucaaacauu

SEQ ID NO: 676005 - RNA, 24 nt, Human
aagcaacagauggaaaaagggacc

SEQ ID NO: 676006 - RNA, 25 nt, Human
aagccagccccaaucccugaacuga

SEQ ID NO: 676007 - RNA, 20 nt, Human
aagcugaagggcccacaugg

SEQ ID NO: 676008 - RNA, 21 nt, Human
acaaaaacgagcggcaacaga

SEQ ID NO: 676009 - RNA, 18 nt, Human
acaaagcaaaacucaaac

SEQ ID NO: 676010 - RNA, 26 nt, Human
acaaagcaaaacucaaacauggcccu

SEQ ID NO: 676011 - RNA, 23 nt, Human
acaaccuuccccacccacugcag

SEQ ID NO: 676012 - RNA, 21 nt, Human
acagguucugagcuggugggu

SEQ ID NO: 676013 - RNA, 22 nt, Human
acauacaaagcaaaacucaaac

SEQ ID NO: 676014 - RNA, 25 nt, Human
acauagcacucacaaaggcaucucu

SEQ ID NO: 676015 - RNA, 18 nt, Human
acaucacgccgaaaccag

SEQ ID NO: 676016 - RNA, 26 nt, Human
acauggcccuucccuagggcgccucu

SEQ ID NO: 676017 - RNA, 24 nt, Human
acccaaagagcuaacucgggaagc

SEQ ID NO: 676018 - RNA, 21 nt, Human
accugagcaccggcugggggc

SEQ ID NO: 676019 - RNA, 25 nt, Human
acuccaggcucugguuccgagggcg

SEQ ID NO: 676020 - RNA, 24 nt, Human
acuugcaaaacaacauacaaagca

SEQ ID NO: 676021 - RNA, 22 nt, Human
agaaaacugugggaagaaacca

SEQ ID NO: 676022 - RNA, 21 nt, Human
agaaagcacuccaagaagucc

SEQ ID NO: 676023 - RNA, 23 nt, Human
agaacucaacuagaguggaaaug

SEQ ID NO: 676024 - RNA, 24 nt, Human
agacaugggggccucgugaccugc

SEQ ID NO: 676025 - RNA, 23 nt, Human
agagcaggaggacaggaggggcc

SEQ ID NO: 676026 - RNA, 21 nt, Human
agauacuugcaaaacaacaua

SEQ ID NO: 676027 - RNA, 19 nt, Human
agcagcccacccggggcag

SEQ ID NO: 676028 - RNA, 24 nt, Human
agccacagacagcccuuccagaca

SEQ ID NO: 676029 - RNA, 18 nt, Human
agcuaacucgggaagccu

SEQ ID NO: 676030 - RNA, 21 nt, Human
agcuggugggugggggccgca

SEQ ID NO: 676031 - RNA, 23 nt, Human
aggagccgggggcggugcugaca

SEQ ID NO: 676032 - RNA, 21 nt, Human
aggagcguccaggggaaucug

SEQ ID NO: 676033 - RNA, 18 nt, Human
aggaggacaggaggggcc

SEQ ID NO: 676034 - RNA, 19 nt, Human
aggaggacaggaggggccu

SEQ ID NO: 676035 - RNA, 23 nt, Human
aggcacucaccauuauuuugguu

SEQ ID NO: 676036 - RNA, 31 nt, Human
aggcacucaccauuauuuugguugaaaaugg

SEQ ID NO: 676037 - RNA, 23 nt, Human
aggcagccaugaaaacccguguu

SEQ ID NO: 676038 - RNA, 19 nt, Human
aggcaggcacccaucagga

SEQ ID NO: 676039 - RNA, 21 nt, Human
aggcucccccuagcccccgcc

SEQ ID NO: 676040 - RNA, 22 nt, Human
aggcucccccuagcccccgccc

SEQ ID NO: 676041 - RNA, 21 nt, Human
aggcucccggcuugccaguuc

SEQ ID NO: 676042 - RNA, 19 nt, Human
agggccuugggaagcacug

SEQ ID NO: 676043 - RNA, 18 nt, Human
aggggccacccaaagagc

SEQ ID NO: 676044 - RNA, 23 nt, Human
aggucucaggacagccacagaca

SEQ ID NO: 676045 - RNA, 22 nt, Human
aguccaaggccaggucucagga

SEQ ID NO: 676046 - RNA, 18 nt, Human
auagcacucacaaaggca

SEQ ID NO: 676047 - RNA, 22 nt, Human
auccacacaacauagcacucac

SEQ ID NO: 676048 - RNA, 21 nt, Human
auccagagguuucacacuugg

SEQ ID NO: 676049 - RNA, 22 nt, Human
auccagagguuucacacuuggg

SEQ ID NO: 676050 - RNA, 26 nt, Human
auucugaagcugguuguggcuuauuu

SEQ ID NO: 676051 - RNA, 23 nt, Human
caaacaaaaauguaacagagaaa

SEQ ID NO: 676052 - RNA, 21 nt, Human
caaagggaagcagcuggaagg

SEQ ID NO: 676053 - RNA, 19 nt, Human
caacagauggaaaaauaua

SEQ ID NO: 676054 - RNA, 22 nt, Human
caacauagcacucacaaaggca

SEQ ID NO: 676055 - RNA, 20 nt, Human
caccaagggccagcccaggg

SEQ ID NO: 676056 - RNA, 22 nt, Human
cacccaucaggaucugcacccc

SEQ ID NO: 676057 - RNA, 26 nt, Human
cacccggucaagugcacucacagggg

SEQ ID NO: 676058 - RNA, 22 nt, Human
cacucccuccacguggggcuca

SEQ ID NO: 676059 - RNA, 18 nt, Human
cacugcagugugguuccc

SEQ ID NO: 676060 - RNA, 20 nt, Human
cacuggacggacagccagcc

SEQ ID NO: 676061 - RNA, 19 nt, Human
cagccaugaaaacccgugu

SEQ ID NO: 676062 - RNA, 24 nt, Human
cagcccaggggcugcaugggggcc

SEQ ID NO: 676063 - RNA, 24 nt, Human
cagccccaaucccugaacugaguu

SEQ ID NO: 676064 - RNA, 23 nt, Human
caggacccucgcauugcggggcc

SEQ ID NO: 676065 - RNA, 24 nt, Human
caggacccuggccuggaggggccu

SEQ ID NO: 676066 - RNA, 20 nt, Human
caggaccuggaggagccggg

SEQ ID NO: 676067 - RNA, 23 nt, Human
caggacugaagcccuagggacac

SEQ ID NO: 676068 - RNA, 25 nt, Human
caggcacccaucaggaucugcaccc

SEQ ID NO: 676069 - RNA, 18 nt, Human
caggcucccccuagcccc

SEQ ID NO: 676070 - RNA, 22 nt, Human
cagggaacccugcccccgagga

SEQ ID NO: 676071 - RNA, 19 nt, Human
caggggccucgcccuccug

SEQ ID NO: 676072 - RNA, 21 nt, Human
caggugcagaaagcacuccaa

SEQ ID NO: 676073 - RNA, 20 nt, Human
cauugcggggccucagacgg

SEQ ID NO: 676074 - RNA, 19 nt, Human
ccaaaccaaaggcagccau

SEQ ID NO: 676075 - RNA, 20 nt, Human
ccaagaaaaaagggggagga

SEQ ID NO: 676076 - RNA, 19 nt, Human
ccaagcugaagggcccaca

SEQ ID NO: 676077 - RNA, 21 nt, Human
ccagacugcuaccuccugaca

SEQ ID NO: 676078 - RNA, 18 nt, Human
ccagcccugcggccucug

SEQ ID NO: 676079 - RNA, 19 nt, Human
ccagcccugcggccucuga

SEQ ID NO: 676080 - RNA, 24 nt, Human
ccagcccuguccgucccaggggcc

SEQ ID NO: 676081 - RNA, 19 nt, Human
ccagggcccuuccccacgc

SEQ ID NO: 676082 - RNA, 18 nt, Human
ccaggggccucgcccucc

SEQ ID NO: 676083 - RNA, 19 nt, Human
ccagguugcucucgcuguu

SEQ ID NO: 676084 - RNA, 19 nt, Human
cccacgcuggggcuuggag

SEQ ID NO: 676085 - RNA, 22 nt, Human
cccaggacugaagcccuaggga

SEQ ID NO: 676086 - RNA, 24 nt, Human
ccccacgcuggggcuuggagcccc

SEQ ID NO: 676087 - RNA, 20 nt, Human
ccccaggacccuggccugga

SEQ ID NO: 676088 - RNA, 20 nt, Human
ccccaggacugaagcccuag

SEQ ID NO: 676089 - RNA, 30 nt, Human
ccccaggacugaagcccuagggacacaccu

SEQ ID NO: 676090 - RNA, 24 nt, Human
ccccagggaccuggcugggugcag

SEQ ID NO: 676091 - RNA, 21 nt, Human
cccccgaggagccagcaggac

SEQ ID NO: 676092 - RNA, 18 nt, Human
ccccgaggagccagcagg

SEQ ID NO: 676093 - RNA, 20 nt, Human
ccccugggaggggccggcuc

SEQ ID NO: 676094 - RNA, 20 nt, Human
cccggcuugccaguucuucc

SEQ ID NO: 676095 - RNA, 18 nt, Human
cccuggccuggaggggcc

SEQ ID NO: 676096 - RNA, 19 nt, Human
ccgggacaugcccuguugg

SEQ ID NO: 676097 - RNA, 20 nt, Human
ccgggugcauguucccaacu

SEQ ID NO: 676098 - RNA, 22 nt, Human
ccuaugccucaguagcuaaggg

SEQ ID NO: 676099 - RNA, 25 nt, Human
ccucugagcaggcacagagaaguuc

SEQ ID NO: 676100 - RNA, 24 nt, Human
ccugacaaaaacgagcggcaacag

SEQ ID NO: 676101 - RNA, 20 nt, Human
ccugccccaggacccuggcc

SEQ ID NO: 676102 - RNA, 23 nt, Human
ccugcggccucugcccgcucccu

SEQ ID NO: 676103 - RNA, 22 nt, Human
ccuggaggggccucagccuggu

SEQ ID NO: 676104 - RNA, 22 nt, Human
ccuggccuggaggggccucagc

SEQ ID NO: 676105 - RNA, 19 nt, Human
ccuucggcagcugcccuga

SEQ ID NO: 676106 - RNA, 21 nt, Human
ccuugagucccagacugcuac

SEQ ID NO: 676107 - RNA, 18 nt, Human
cggaaggggacgcccagg

SEQ ID NO: 676108 - RNA, 21 nt, Human
cgggggaggcaggcacccauc

SEQ ID NO: 676109 - RNA, 24 nt, Human
cuaagcaauucacuuaaaaacacc

SEQ ID NO: 676110 - RNA, 19 nt, Human
cucagagcaggaggacagg

SEQ ID NO: 676111 - RNA, 24 nt, Human
cuccacauccacacaacauagcac

SEQ ID NO: 676112 - RNA, 21 nt, Human
cucccccuagcccccgcccac

SEQ ID NO: 676113 - RNA, 19 nt, Human
cucccuaugccucaguagc

SEQ ID NO: 676114 - RNA, 21 nt, Human
cuccgggugcauguucccaac

SEQ ID NO: 676115 - RNA, 23 nt, Human
cucugggcuccaccuucggcagc

SEQ ID NO: 676116 - RNA, 24 nt, Human
cugaacucaaagccagccccaauc

SEQ ID NO: 676117 - RNA, 20 nt, Human
cugacaaaaacgagcggcaa

SEQ ID NO: 676118 - RNA, 24 nt, Human
cugacaaaaacgagcggcaacaga

SEQ ID NO: 676119 - RNA, 27 nt, Human
cugccccaggacugaagcccuagggac

SEQ ID NO: 676120 - RNA, 18 nt, Human
cugcccgcucccugcugc

SEQ ID NO: 676121 - RNA, 23 nt, Human
cugcugcacccaggcucccccua

SEQ ID NO: 676122 - RNA, 21 nt, Human
cuggcugggugcagacauggg

SEQ ID NO: 676123 - RNA, 21 nt, Human
cugggugcagacaugggggcc

SEQ ID NO: 676124 - RNA, 24 nt, Human
cuggugggugggggccgcagggga

SEQ ID NO: 676125 - RNA, 18 nt, Human
cuguccccuucucucuuc

SEQ ID NO: 676126 - RNA, 19 nt, Human
cuuccucugucucugcugc

SEQ ID NO: 676127 - RNA, 18 nt, Human
cuucucagaaaaccaaac

SEQ ID NO: 676128 - RNA, 18 nt, Human
gaaaggaaaugaacccac

SEQ ID NO: 676129 - RNA, 22 nt, Human
gaagaaaccaaauccauagggg

SEQ ID NO: 676130 - RNA, 20 nt, Human
gaagguugcgggucccaggg

SEQ ID NO: 676131 - RNA, 19 nt, Human
gaauuccaagcaacuuccc

SEQ ID NO: 676132 - RNA, 21 nt, Human
gaccacgugacccaccugccc

SEQ ID NO: 676133 - RNA, 19 nt, Human
gacgcacucgugacuuuga

SEQ ID NO: 676134 - RNA, 20 nt, Human
gaggagaacggggcgccagc

SEQ ID NO: 676135 - RNA, 20 nt, Human
gaggcaggcacccaucagga

SEQ ID NO: 676136 - RNA, 23 nt, Human
gaggggccucagccuggucuucc

SEQ ID NO: 676137 - RNA, 20 nt, Human
gcaacagaagggcuacucca

SEQ ID NO: 676138 - RNA, 23 nt, Human
gcacccaggcucccccuagcccc

SEQ ID NO: 676139 - RNA, 21 nt, Human
gcacucaccauuauuuugguu

SEQ ID NO: 676140 - RNA, 19 nt, Human
gcagcgucaguccuccagg

SEQ ID NO: 676141 - RNA, 21 nt, Human
gcaggaggccugggcuggcug

SEQ ID NO: 676142 - RNA, 19 nt, Human
gcaggggcagaaaaggucc

SEQ ID NO: 676143 - RNA, 18 nt, Human
gcccaggaccuccgcacc

SEQ ID NO: 676144 - RNA, 19 nt, Human
gcgcagagguggggucugg

SEQ ID NO: 676145 - RNA, 19 nt, Human
gcucagagcaggaggacag

SEQ ID NO: 676146 - RNA, 18 nt, Human
ggacaggaggggccugga

SEQ ID NO: 676147 - RNA, 23 nt, Human
ggacaggcugcccaggaccuccg

SEQ ID NO: 676148 - RNA, 21 nt, Human
ggaggaaacgugggaccugaa

SEQ ID NO: 676149 - RNA, 18 nt, Human
ggaggcaggcacccauca

SEQ ID NO: 676150 - RNA, 19 nt, Human
ggaggccugggcuggcugc

SEQ ID NO: 676151 - RNA, 20 nt, Human
ggcgccagccacacuaaacc

SEQ ID NO: 676152 - RNA, 21 nt, Human
ggcucugggcuccaccuucgg

SEQ ID NO: 676153 - RNA, 21 nt, Human
gggaagccuaggcacucacca

SEQ ID NO: 676154 - RNA, 18 nt, Human
gggccgggggccagggag

SEQ ID NO: 676155 - RNA, 22 nt, Human
gggcucucccuuggacagagac

SEQ ID NO: 676156 - RNA, 22 nt, Human
ggggcaggggcagaaaaggucc

SEQ ID NO: 676157 - RNA, 20 nt, Human
gggggaggaaacgugggacc

SEQ ID NO: 676158 - RNA, 18 nt, Human
ggugcagacaugggggcc

SEQ ID NO: 676159 - RNA, 24 nt, Human
gguggggucugggccgcucacugg

SEQ ID NO: 676160 - RNA, 22 nt, Human
guccccuucucucuucucguga

SEQ ID NO: 676161 - RNA, 18 nt, Human
gugacaacagcaaacaaa

SEQ ID NO: 676162 - RNA, 19 nt, Human
gugcauguucccaacugga

SEQ ID NO: 676163 - RNA, 22 nt, Human
guugaaaaugcuauaaaucuga

SEQ ID NO: 676164 - RNA, 18 nt, Human
uaagcaacagauggaaaa

SEQ ID NO: 676165 - RNA, 24 nt, Human
uaagcaauucacuuaaaaacaccc

SEQ ID NO: 676166 - RNA, 24 nt, Human
uaagcgcacuccacccguuuuucc

SEQ ID NO: 676167 - RNA, 24 nt, Human
uagaaagcacagagccacucccuu

SEQ ID NO: 676168 - RNA, 18 nt, Human
ucaaagccagccccaauc

SEQ ID NO: 676169 - RNA, 25 nt, Human
ucacuuaaaaacacccucaguacau

SEQ ID NO: 676170 - RNA, 18 nt, Human
ucagagcaggaggacagg

SEQ ID NO: 676171 - RNA, 20 nt, Human
ucagagcaggaggacaggag

SEQ ID NO: 676172 - RNA, 19 nt, Human
ucaggaucugcaccccaag

SEQ ID NO: 676173 - RNA, 23 nt, Human
uccacauccacacaacauagcac

SEQ ID NO: 676174 - RNA, 23 nt, Human
uccagggaacccugcccccgagg

SEQ ID NO: 676175 - RNA, 23 nt, Human
ucccaacuggaggagaacggggc

SEQ ID NO: 676176 - RNA, 22 nt, Human
ucccagggucacaggcagccgu

SEQ ID NO: 676177 - RNA, 22 nt, Human
ucccagggucacaggcagcugu

SEQ ID NO: 676178 - RNA, 22 nt, Human
ucccccuagcccccgcccaccu

SEQ ID NO: 676179 - RNA, 21 nt, Human
ucccgggacaugcccuguugg

SEQ ID NO: 676180 - RNA, 21 nt, Human
ucccugagaugccugccccag

SEQ ID NO: 676181 - RNA, 24 nt, Human
ucccuggacgcaggcucccggcuu

SEQ ID NO: 676182 - RNA, 18 nt, Human
uccgggugcauguuccca

SEQ ID NO: 676183 - RNA, 21 nt, Human
uccguggccaagcagcccaag

SEQ ID NO: 676184 - RNA, 22 nt, Human
uccucugucucugcugcaccca

SEQ ID NO: 676185 - RNA, 20 nt, Human
uccugaacacccaggggcuc

SEQ ID NO: 676186 - RNA, 24 nt, Human
ucucaggacagccacagacagccc

SEQ ID NO: 676187 - RNA, 22 nt, Human
ucucccuaugccucaguagcua

SEQ ID NO: 676188 - RNA, 21 nt, Human
ucucugaguacuggcuggccc

SEQ ID NO: 676189 - RNA, 24 nt, Human
ucugaagcugguuguggcuuauuu

SEQ ID NO: 676190 - RNA, 19 nt, Human
ucuguacgugguugagaag

SEQ ID NO: 676191 - RNA, 23 nt, Human
ucuguccccuucucucuucucgu

SEQ ID NO: 676192 - RNA, 19 nt, Human
ucuguugacgagggcuguc

SEQ ID NO: 676193 - RNA, 23 nt, Human
ucuucucagaaaaccaaaccaaa

SEQ ID NO: 676194 - RNA, 19 nt, Human
ucuuugguucugcagaccu

SEQ ID NO: 676195 - RNA, 19 nt, Human
ugaacccacaacccacugg

SEQ ID NO: 676196 - RNA, 18 nt, Human
ugaagaccgguuuuccag

SEQ ID NO: 676197 - RNA, 19 nt, Human
ugaagugggacacaggacc

SEQ ID NO: 676198 - RNA, 21 nt, Human
ugacaaaaacgagcggcaaca

SEQ ID NO: 676199 - RNA, 23 nt, Human
ugacaaaaacgagcggcaacaga

SEQ ID NO: 676200 - RNA, 18 nt, Human
ugacaacagcaaacaaaa

SEQ ID NO: 676201 - RNA, 20 nt, Human
ugacaacagcaaacaaaaau

SEQ ID NO: 676202 - RNA, 18 nt, Human
ugacugugacaacagcaa

SEQ ID NO: 676203 - RNA, 25 nt, Human
ugagcaggcacagagaaguucucac

SEQ ID NO: 676204 - RNA, 18 nt, Human
ugagcugguggguggggg

SEQ ID NO: 676205 - RNA, 19 nt, Human
ugagcuggugggugggggc

SEQ ID NO: 676206 - RNA, 23 nt, Human
ugagcuggugggugggggccgca

SEQ ID NO: 676207 - RNA, 24 nt, Human
ugagcuggugggugggggccgcag

SEQ ID NO: 676208 - RNA, 19 nt, Human
ugagggcagccaggacagg

SEQ ID NO: 676209 - RNA, 20 nt, Human
ugcaaaacaacauacaaagc

SEQ ID NO: 676210 - RNA, 22 nt, Human
ugcaaaacaacauacaaagcaa

SEQ ID NO: 676211 - RNA, 19 nt, Human
ugccccaggacugaagccc

SEQ ID NO: 676212 - RNA, 22 nt, Human
uggaaguucuguugacgagggc

SEQ ID NO: 676213 - RNA, 21 nt, Human
uggaauuccaagcaacuuccc

SEQ ID NO: 676214 - RNA, 26 nt, Human
uggaggagaacggggcgccagccaca

SEQ ID NO: 676215 - RNA, 18 nt, Human
uggccugaacucaaagcc

SEQ ID NO: 676216 - RNA, 25 nt, Human
uggccuggaggggccucagccuggu

SEQ ID NO: 676217 - RNA, 19 nt, Human
uggcugggugcagacaugg

SEQ ID NO: 676218 - RNA, 21 nt, Human
uggcugggugcagacaugggg

SEQ ID NO: 676219 - RNA, 18 nt, Human
uggcuuauuuuuguaugg

SEQ ID NO: 676220 - RNA, 25 nt, Human
ugggaagaaaccaaauccauaggaa

SEQ ID NO: 676221 - RNA, 21 nt, Human
ugggaagcacugggaaugggc

SEQ ID NO: 676222 - RNA, 18 nt, Human
ugggaggggccggcucag

SEQ ID NO: 676223 - RNA, 19 nt, Human
ugggaggggccggcucagg

SEQ ID NO: 676224 - RNA, 23 nt, Human
ugggagguccagggaacccugcc

SEQ ID NO: 676225 - RNA, 19 nt, Human
ugggggcgggggaggcagg

SEQ ID NO: 676226 - RNA, 23 nt, Human
uggugggugggggccgcagggcu

SEQ ID NO: 676227 - RNA, 22 nt, Human
uguucuguccccuucucucuuc

SEQ ID NO: 676228 - RNA, 20 nt, Human
uguuuuggcgauuccucucu

SEQ ID NO: 676229 - RNA, 21 nt, Human
uucccuggacgcaggcucccg

SEQ ID NO: 676230 - RNA, 22 nt, Human
uuccucugucucugcugcaccc

SEQ ID NO: 676231 - RNA, 23 nt, Human
uuccucugucucugcugcaccca

SEQ ID NO: 676232 - RNA, 20 nt, Human
uuggacagagaccaccaagg

SEQ ID NO: 676233 - RNA, 19 nt, Human
aaaaaagacaguaaauacg

SEQ ID NO: 676234 - RNA, 24 nt, Human
aaaacaaacaccuacucuagcacu

SEQ ID NO: 676235 - RNA, 21 nt, Human
aaaagauacaggaaaccaaag

SEQ ID NO: 676236 - RNA, 20 nt, Human
aaaauguccuacugauccuc

SEQ ID NO: 676237 - RNA, 25 nt, Human
aaacauacuugaaaagaacaaugca

SEQ ID NO: 676238 - RNA, 23 nt, Human
aaacugcuaauauccaguauuug

SEQ ID NO: 676239 - RNA, 19 nt, Human
aacaggugaaacaaaaccu

SEQ ID NO: 676240 - RNA, 20 nt, Human
aacaggugaaacaaaaccuc

SEQ ID NO: 676241 - RNA, 23 nt, Human
aacaggugaaacaaaaccucauu

SEQ ID NO: 676242 - RNA, 18 nt, Human
aacccaccaauuucuaag

SEQ ID NO: 676243 - RNA, 21 nt, Human
aagaauggccacggcggccgc

SEQ ID NO: 676244 - RNA, 20 nt, Human
aagaguaccaucaucuaacc

SEQ ID NO: 676245 - RNA, 20 nt, Human
aagcaauaaaauacaauuuc

SEQ ID NO: 676246 - RNA, 23 nt, Human
aauaucuauucaucacuagucca

SEQ ID NO: 676247 - RNA, 24 nt, Human
aauggcagaaaaaaagacaguaaa

SEQ ID NO: 676248 - RNA, 21 nt, Human
aauggcauaauaaaaaacaaa

SEQ ID NO: 676249 - RNA, 18 nt, Human
acaaaacuaaccacaagu

SEQ ID NO: 676250 - RNA, 22 nt, Human
acaagagugcaaaaagucccug

SEQ ID NO: 676251 - RNA, 24 nt, Human
accacagcuuaaggaguuguguca

SEQ ID NO: 676252 - RNA, 21 nt, Human
accaugcuuaacaaaagacug

SEQ ID NO: 676253 - RNA, 20 nt, Human
accucauuuccuucauucaa

SEQ ID NO: 676254 - RNA, 21 nt, Human
acgaaacauacuugaaaagaa

SEQ ID NO: 676255 - RNA, 24 nt, Human
acucagacauuuuggaauuucagc

SEQ ID NO: 676256 - RNA, 20 nt, Human
acugcacuaggcauuuagua

SEQ ID NO: 676257 - RNA, 23 nt, Human
acuugauuaaaaagauacaggaa

SEQ ID NO: 676258 - RNA, 25 nt, Human
agaaaaaaagacaguaaauacgaaa

SEQ ID NO: 676259 - RNA, 25 nt, Human
agaaauacaaaauaagauuugucca

SEQ ID NO: 676260 - RNA, 21 nt, Human
agacaagcucaaaaaagcaac

SEQ ID NO: 676261 - RNA, 24 nt, Human
aggaaaaaaguugcugcuaaaaag

SEQ ID NO: 676262 - RNA, 19 nt, Human
aggagauaaaaaaggaggg

SEQ ID NO: 676263 - RNA, 20 nt, Human
aggauauaagaugugauugc

SEQ ID NO: 676264 - RNA, 19 nt, Human
auacaguuuauggcuacau

SEQ ID NO: 676265 - RNA, 19 nt, Human
auacuuuagaaacacagaa

SEQ ID NO: 676266 - RNA, 21 nt, Human
augaucucaaacaauauucaa

SEQ ID NO: 676267 - RNA, 21 nt, Human
caaaaauuucaaaacuaacac

SEQ ID NO: 676268 - RNA, 19 nt, Human
caaaacaggugaaacaaaa

SEQ ID NO: 676269 - RNA, 21 nt, Human
caaaacaggugaaacaaaacc

SEQ ID NO: 676270 - RNA, 21 nt, Human
caaaacucagacauuuuggaa

SEQ ID NO: 676271 - RNA, 18 nt, Human
caaaaggaggcaacuguu

SEQ ID NO: 676272 - RNA, 20 nt, Human
caacccaccaauuucuaaga

SEQ ID NO: 676273 - RNA, 19 nt, Human
caaguaugccaaauaucag

SEQ ID NO: 676274 - RNA, 22 nt, Human
caaguaugccaaauaucagaau

SEQ ID NO: 676275 - RNA, 27 nt, Human
cacaaaacuaaccacaaguauacccaa

SEQ ID NO: 676276 - RNA, 23 nt, Human
cacagaaaccucaaaaauaaaau

SEQ ID NO: 676277 - RNA, 22 nt, Human
cacaguauuaacacauuuaaaa

SEQ ID NO: 676278 - RNA, 19 nt, Human
cacauccucacaaaaguug

SEQ ID NO: 676279 - RNA, 19 nt, Human
cacggcggccgccucccuu

SEQ ID NO: 676280 - RNA, 21 nt, Human
cacuuccucaucuccaacuuu

SEQ ID NO: 676281 - RNA, 28 nt, Human
cagaaagauaacggaauguaaaaacugg

SEQ ID NO: 676282 - RNA, 21 nt, Human
cagauggaauaaaaauguccu

SEQ ID NO: 676283 - RNA, 24 nt, Human
caggaaaaaaguugcugcuaaaaa

SEQ ID NO: 676284 - RNA, 18 nt, Human
caggugaaacaaaaccuc

SEQ ID NO: 676285 - RNA, 20 nt, Human
cagguuaauacauaaauacu

SEQ ID NO: 676286 - RNA, 22 nt, Human
caguaaaaaauuuagcaacaca

SEQ ID NO: 676287 - RNA, 21 nt, Human
caguagcggaacuaagagugc

SEQ ID NO: 676288 - RNA, 27 nt, Human
caucuaaaucagugggaacugcccugg

SEQ ID NO: 676289 - RNA, 23 nt, Human
cauuccuacagaauuauaugcau

SEQ ID NO: 676290 - RNA, 22 nt, Human
ccaaauaucagaauccuacgcu

SEQ ID NO: 676291 - RNA, 19 nt, Human
ccacggcggccgccucccu

SEQ ID NO: 676292 - RNA, 23 nt, Human
ccgccgucagcggccugucgccu

SEQ ID NO: 676293 - RNA, 21 nt, Human
ccugggugaguuuucucuucu

SEQ ID NO: 676294 - RNA, 23 nt, Human
cgaaccauaaguuauagaaauua

SEQ ID NO: 676295 - RNA, 18 nt, Human
cggaacuaagagugcuaa

SEQ ID NO: 676296 - RNA, 22 nt, Human
cuaaauaauacugugauuacca

SEQ ID NO: 676297 - RNA, 21 nt, Human
cuagcagagacugaaaccaca

SEQ ID NO: 676298 - RNA, 18 nt, Human
cucacagaaaccucaaaa

SEQ ID NO: 676299 - RNA, 24 nt, Human
cuccugaaaauaggagauaaaaaa

SEQ ID NO: 676300 - RNA, 22 nt, Human
cucucuggaaauuggaauaaag

SEQ ID NO: 676301 - RNA, 24 nt, Human
cugaaaccacagcuuaaggaguug

SEQ ID NO: 676302 - RNA, 24 nt, Human
cugcaggaaacaaacuguaaguaa

SEQ ID NO: 676303 - RNA, 22 nt, Human
gaaacauacuugaaaagaacaa

SEQ ID NO: 676304 - RNA, 22 nt, Human
ggccgccucccuuccugccccg

SEQ ID NO: 676305 - RNA, 19 nt, Human
ggguuggggggaacagcca

SEQ ID NO: 676306 - RNA, 25 nt, Human
guaaacuuuuagaacuagacaauuu

SEQ ID NO: 676307 - RNA, 23 nt, Human
gugaaacaaaaccucauuuccuu

SEQ ID NO: 676308 - RNA, 24 nt, Human
gugaaacaaaaccucauuuccuuc

SEQ ID NO: 676309 - RNA, 18 nt, Human
guguugggaacagaagau

SEQ ID NO: 676310 - RNA, 19 nt, Human
uaaaaaauacauucuugca

SEQ ID NO: 676311 - RNA, 22 nt, Human
uaaaaaauacauucuugcagca

SEQ ID NO: 676312 - RNA, 24 nt, Human
uaaaaagauacaggaaaccaaaga

SEQ ID NO: 676313 - RNA, 22 nt, Human
uaaaaauaagcaaaacuaaaac

SEQ ID NO: 676314 - RNA, 22 nt, Human
uaaacuccccuaacuggaaauu

SEQ ID NO: 676315 - RNA, 21 nt, Human
uaaagacaguagcggaacuaa

SEQ ID NO: 676316 - RNA, 25 nt, Human
uaaagcuaacaaaucaaaggcacaa

SEQ ID NO: 676317 - RNA, 23 nt, Human
uaaaguguuauuaaccuagauuc

SEQ ID NO: 676318 - RNA, 24 nt, Human
uaagaauggccacggcggccgccu

SEQ ID NO: 676319 - RNA, 19 nt, Human
uaaggaguugugucaguug

SEQ ID NO: 676320 - RNA, 22 nt, Human
uaauugcgucaauaccagaaca

SEQ ID NO: 676321 - RNA, 18 nt, Human
uacaaaguuucauuacua

SEQ ID NO: 676322 - RNA, 24 nt, Human
uacugcaggaaacaaacuguaagu

SEQ ID NO: 676323 - RNA, 25 nt, Human
uacugcugcaaaacaggugaaacaa

SEQ ID NO: 676324 - RNA, 20 nt, Human
uacugugauuaccaguuggu

SEQ ID NO: 676325 - RNA, 18 nt, Human
uagaaacacagaaguuca

SEQ ID NO: 676326 - RNA, 24 nt, Human
uagaugcuaugcagaacuuaugca

SEQ ID NO: 676327 - RNA, 26 nt, Human
uaucauaaaaucuaacucccgaccuu

SEQ ID NO: 676328 - RNA, 25 nt, Human
uaucuauucaucacuaguccacaua

SEQ ID NO: 676329 - RNA, 21 nt, Human
uaugaagaugauuuccucuuu

SEQ ID NO: 676330 - RNA, 20 nt, Human
uaugcagggccaaaaauuuc

SEQ ID NO: 676331 - RNA, 20 nt, Human
uaugccaaauaucagaaucc

SEQ ID NO: 676332 - RNA, 19 nt, Human
uaugccaagaguaccauca

SEQ ID NO: 676333 - RNA, 20 nt, Human
ucaauaccagaacaaaguga

SEQ ID NO: 676334 - RNA, 18 nt, Human
ucacagaaaccucaaaaa

SEQ ID NO: 676335 - RNA, 22 nt, Human
uccagaaauguuugaaacacau

SEQ ID NO: 676336 - RNA, 23 nt, Human
uccagaaauguuugaaacacauc

SEQ ID NO: 676337 - RNA, 18 nt, Human
ucccaggaaaaaaguugc

SEQ ID NO: 676338 - RNA, 18 nt, Human
uccugggugaguuuucuc

SEQ ID NO: 676339 - RNA, 22 nt, Human
uccuucccgccgucagcggccu

SEQ ID NO: 676340 - RNA, 21 nt, Human
ucuagacuugauuaaaaagau

SEQ ID NO: 676341 - RNA, 23 nt, Human
ucuagcacuuccucaucuccaac

SEQ ID NO: 676342 - RNA, 20 nt, Human
ucugauuccaguauggucag

SEQ ID NO: 676343 - RNA, 19 nt, Human
ugaaacacauccucacaaa

SEQ ID NO: 676344 - RNA, 25 nt, Human
ugaacuagcagagacugaagggagc

SEQ ID NO: 676345 - RNA, 19 nt, Human
ugacauuuaggauauaaga

SEQ ID NO: 676346 - RNA, 21 nt, Human
ugagugacugaugaacauagu

SEQ ID NO: 676347 - RNA, 19 nt, Human
ugcaaaacaggugaaacaa

SEQ ID NO: 676348 - RNA, 23 nt, Human
ugcaaagaacauaugaauggaaa

SEQ ID NO: 676349 - RNA, 21 nt, Human
ugcauguuauucuccaauauc

SEQ ID NO: 676350 - RNA, 25 nt, Human
uggaccaucuaaaucagugggaacu

SEQ ID NO: 676351 - RNA, 20 nt, Human
uggcaauaaacuccccuaac

SEQ ID NO: 676352 - RNA, 18 nt, Human
uggcacaaaacuaaccac

SEQ ID NO: 676353 - RNA, 20 nt, Human
ugggagcauugguuuuaagc

SEQ ID NO: 676354 - RNA, 21 nt, Human
ugguuuaguuaacuauucagg

SEQ ID NO: 676355 - RNA, 24 nt, Human
uguccagaaauguuugaaacacau

SEQ ID NO: 676356 - RNA, 30 nt, Human
uuaaaaauaagcaaaacuaaaacaugcaaa

SEQ ID NO: 676357 - RNA, 22 nt, Human
uuaaacuaacuuuaaagcuaac

SEQ ID NO: 676358 - RNA, 23 nt, Human
uuacacuaaauuauucauggcuc

SEQ ID NO: 676359 - RNA, 23 nt, Human
uuggacccuuuaaaaaaguauua

SEQ ID NO: 676360 - RNA, 21 nt, Human
aaagcccugcuaacuccgcuc

SEQ ID NO: 676361 - RNA, 22 nt, Human
aacugagaaaauccuauucaca

SEQ ID NO: 676362 - RNA, 22 nt, Human
agaacuaguggagguaaacuuc

SEQ ID NO: 676363 - RNA, 23 nt, Human
aggccacagcucaccuacgcuga

SEQ ID NO: 676364 - RNA, 21 nt, Human
cccaggauucaaacaaggaaa

SEQ ID NO: 676365 - RNA, 21 nt, Human
ccccacggucgcuggagugcc

SEQ ID NO: 676366 - RNA, 27 nt, Human
ccccugcguacccacuuccugccgccu

SEQ ID NO: 676367 - RNA, 23 nt, Human
cgccuugcgccccugcguaccca

SEQ ID NO: 676368 - RNA, 19 nt, Human
cguagcuauggcugcagca

SEQ ID NO: 676369 - RNA, 21 nt, Human
cugcagcaccucgcaaaaggc

SEQ ID NO: 676370 - RNA, 21 nt, Human
cugccgccucuugcccacuua

SEQ ID NO: 676371 - RNA, 24 nt, Human
cugcguacccacuuccugccgccu

SEQ ID NO: 676372 - RNA, 24 nt, Human
gaccaggccgcggcccugcagcug

SEQ ID NO: 676373 - RNA, 25 nt, Human
uaaaauucucaacagucaaauauua

SEQ ID NO: 676374 - RNA, 18 nt, Human
uacaaagaacuaguggag

SEQ ID NO: 676375 - RNA, 24 nt, Human
uauguaguuauguacucugcuaca

SEQ ID NO: 676376 - RNA, 22 nt, Human
ucgcaaaaggccacagcucacc

SEQ ID NO: 676377 - RNA, 22 nt, Human
uuuuuuuuuuuuuuccacagga

SEQ ID NO: 676378 - RNA, 23 nt, Human
uuuuuuuuuuuuuuuuccacagg

SEQ ID NO: 676379 - RNA, 19 nt, Human
aaaacccaggaguccccag

SEQ ID NO: 676380 - RNA, 18 nt, Human
aagacaaaggucugaagc

SEQ ID NO: 676381 - RNA, 19 nt, Human
aaugagcagaaucuccugc

SEQ ID NO: 676382 - RNA, 21 nt, Human
acuagcucccuucacuccagc

SEQ ID NO: 676383 - RNA, 25 nt, Human
agcagccucaaggggaggggaacgc

SEQ ID NO: 676384 - RNA, 21 nt, Human
agcgaguucccuuuugagggc

SEQ ID NO: 676385 - RNA, 19 nt, Human
aggaucuggucucgaaaau

SEQ ID NO: 676386 - RNA, 19 nt, Human
aucagguugguagaagcca

SEQ ID NO: 676387 - RNA, 20 nt, Human
cacccccugugccuaggggg

SEQ ID NO: 676388 - RNA, 24 nt, Human
caccucaaaagacaaaggucugaa

SEQ ID NO: 676389 - RNA, 21 nt, Human
cacuccagcucugccgcccgc

SEQ ID NO: 676390 - RNA, 20 nt, Human
cagcagccucaaggggagug

SEQ ID NO: 676391 - RNA, 20 nt, Human
caggaguccccaggccaucc

SEQ ID NO: 676392 - RNA, 20 nt, Human
ccacauugcuccccggcaug

SEQ ID NO: 676393 - RNA, 18 nt, Human
ccugcagguaccugacug

SEQ ID NO: 676394 - RNA, 19 nt, Human
ccugcagguaccugacugg

SEQ ID NO: 676395 - RNA, 19 nt, Human
ccugcauuccagggaccug

SEQ ID NO: 676396 - RNA, 21 nt, Human
cgaaaaugguaaagaccaccc

SEQ ID NO: 676397 - RNA, 22 nt, Human
cuaaacacuagcucccuucacu

SEQ ID NO: 676398 - RNA, 19 nt, Human
cuccacauagugcaauacc

SEQ ID NO: 676399 - RNA, 23 nt, Human
cuccccggcaugugacgauccag

SEQ ID NO: 676400 - RNA, 20 nt, Human
cugccgcccgcuacugcaag

SEQ ID NO: 676401 - RNA, 20 nt, Human
gaaaaugguaaagaccaccc

SEQ ID NO: 676402 - RNA, 19 nt, Human
gcuuucucugguccuuucu

SEQ ID NO: 676403 - RNA, 21 nt, Human
gggcaccucaaaagacaaagg

SEQ ID NO: 676404 - RNA, 20 nt, Human
gggcuuccaacauagcacuc

SEQ ID NO: 676405 - RNA, 18 nt, Human
gugacgauccagccuggc

SEQ ID NO: 676406 - RNA, 21 nt, Human
uaagaaagggugacgcuggcg

SEQ ID NO: 676407 - RNA, 22 nt, Human
uagcucccuucacuccagcucc

SEQ ID NO: 676408 - RNA, 20 nt, Human
uaugguguuggaucauaggg

SEQ ID NO: 676409 - RNA, 18 nt, Human
uauuagggagucgggagg

SEQ ID NO: 676410 - RNA, 21 nt, Human
uccccaggccauccacauugc

SEQ ID NO: 676411 - RNA, 24 nt, Human
ucugaagcgaguucccuuuugagg

SEQ ID NO: 676412 - RNA, 20 nt, Human
ugagcagaaucuccugcauu

SEQ ID NO: 676413 - RNA, 20 nt, Human
ugcaauaccucgugugucug

SEQ ID NO: 676414 - RNA, 18 nt, Human
ugccgcaguugaugaugu

SEQ ID NO: 676415 - RNA, 22 nt, Human
ugccuaggggggcaaauuccug

SEQ ID NO: 676416 - RNA, 18 nt, Human
ugccucggggcucccagc

SEQ ID NO: 676417 - RNA, 19 nt, Human
ugccucggggcucccagcc

SEQ ID NO: 676418 - RNA, 26 nt, Human
uggauucucaacgaugcagccguagu

SEQ ID NO: 676419 - RNA, 21 nt, Human
ugggcuuccaacauagcacuc

SEQ ID NO: 676420 - RNA, 20 nt, Human
uggguuucuccacauagugc

SEQ ID NO: 676421 - RNA, 26 nt, Human
ugugacgauccagccuggcuuucucu

SEQ ID NO: 676422 - RNA, 19 nt, Human
uucccuuuugagggccucc

SEQ ID NO: 676423 - RNA, 21 nt, Human
uugggcaccucaaaagacaaa

SEQ ID NO: 676424 - RNA, 19 nt, Human
aaaaaaaaaaaaaacaggc

SEQ ID NO: 676425 - RNA, 23 nt, Human
aaaaaaaaacaggcuguguggca

SEQ ID NO: 676426 - RNA, 23 nt, Human
aacccagagccaggcugggcccu

SEQ ID NO: 676427 - RNA, 22 nt, Human
aaccuccaccuuugaacccaga

SEQ ID NO: 676428 - RNA, 20 nt, Human
aaccuggugaaacccugucu

SEQ ID NO: 676429 - RNA, 21 nt, Human
aaccuggugaaacccugucuc

SEQ ID NO: 676430 - RNA, 19 nt, Human
aagaugggcuuauugcaga

SEQ ID NO: 676431 - RNA, 18 nt, Human
aagcaggagaaucacuug

SEQ ID NO: 676432 - RNA, 24 nt, Human
aagcaggagaaucacuugaacccg

SEQ ID NO: 676433 - RNA, 25 nt, Human
aagcaggagaaucacuugaacccgg

SEQ ID NO: 676434 - RNA, 27 nt, Human
aagcagggagacggaaaggaugcaggg

SEQ ID NO: 676435 - RNA, 26 nt, Human
aagcagggagcagggcgagcagcaag

SEQ ID NO: 676436 - RNA, 25 nt, Human
aaggcagguggaucaccugagguca

SEQ ID NO: 676437 - RNA, 23 nt, Human
aaggcagguuggggaccacaacc

SEQ ID NO: 676438 - RNA, 22 nt, Human
aauacaggacuugggguuuggg

SEQ ID NO: 676439 - RNA, 24 nt, Human
aaucacuugaacccgggaggugga

SEQ ID NO: 676440 - RNA, 21 nt, Human
aaugcaggacucaagccagga

SEQ ID NO: 676441 - RNA, 19 nt, Human
acaaccccugucucuacca

SEQ ID NO: 676442 - RNA, 18 nt, Human
acaccaccacauccaacc

SEQ ID NO: 676443 - RNA, 21 nt, Human
acagagcgagacucgucucaa

SEQ ID NO: 676444 - RNA, 22 nt, Human
acauagccaggcauccaacucc

SEQ ID NO: 676445 - RNA, 21 nt, Human
acauccacauagccaggcauc

SEQ ID NO: 676446 - RNA, 18 nt, Human
accaccacaccguacuug

SEQ ID NO: 676447 - RNA, 21 nt, Human
accagcaccugaugaacaaca

SEQ ID NO: 676448 - RNA, 22 nt, Human
acccagagccaggcugggcccu

SEQ ID NO: 676449 - RNA, 23 nt, Human
accccaaaguccccgucagccuu

SEQ ID NO: 676450 - RNA, 23 nt, Human
accccaucucugcuguguuccag

SEQ ID NO: 676451 - RNA, 24 nt, Human
acccugucucuacuaaaaauacaa

SEQ ID NO: 676452 - RNA, 20 nt, Human
accggacucugcgugaaguu

SEQ ID NO: 676453 - RNA, 18 nt, Human
accuguggcuucuccacg

SEQ ID NO: 676454 - RNA, 18 nt, Human
acgggccagcgccagggg

SEQ ID NO: 676455 - RNA, 22 nt, Human
acggugcacagguccaugccac

SEQ ID NO: 676456 - RNA, 18 nt, Human
acuagaauacaggacuug

SEQ ID NO: 676457 - RNA, 20 nt, Human
acugacccacgcggcagcgc

SEQ ID NO: 676458 - RNA, 25 nt, Human
acugcugaaaagcaggggugcaggg

SEQ ID NO: 676459 - RNA, 21 nt, Human
agaaggcagguuggggaccac

SEQ ID NO: 676460 - RNA, 23 nt, Human
agacuuuuagccaggccccaagc

SEQ ID NO: 676461 - RNA, 19 nt, Human
agagccgccuucuuuuccc

SEQ ID NO: 676462 - RNA, 19 nt, Human
agaggacugggagaaggga

SEQ ID NO: 676463 - RNA, 27 nt, Human
agcagaaggcagguugggaggucgacc

SEQ ID NO: 676464 - RNA, 23 nt, Human
agccaggaaugggaacggauccg

SEQ ID NO: 676465 - RNA, 23 nt, Human
agccccugaccggaagcgcuucu

SEQ ID NO: 676466 - RNA, 20 nt, Human
agccuggccaaccuggugaa

SEQ ID NO: 676467 - RNA, 24 nt, Human
agccuggccaaccuggugaaaccc

SEQ ID NO: 676468 - RNA, 24 nt, Human
agccugggcaacagagcgagacuc

SEQ ID NO: 676469 - RNA, 21 nt, Human
agcugugcuguguugaaagcc

SEQ ID NO: 676470 - RNA, 24 nt, Human
aggaauucgagaccagccuggcca

SEQ ID NO: 676471 - RNA, 19 nt, Human
aggagccuuuccugccugg

SEQ ID NO: 676472 - RNA, 21 nt, Human
aggcagcagcugccucccugg

SEQ ID NO: 676473 - RNA, 18 nt, Human
aggcagguggaucaccug

SEQ ID NO: 676474 - RNA, 22 nt, Human
aggcagguggaucaccugaggu

SEQ ID NO: 676475 - RNA, 26 nt, Human
aggcagguggaucaccugaggucagg

SEQ ID NO: 676476 - RNA, 24 nt, Human
aggcagguguccaacagcuucagc

SEQ ID NO: 676477 - RNA, 24 nt, Human
aggcagguguccaacagcuucagc

SEQ ID NO: 676478 - RNA, 19 nt, Human
agggagugggguuuguggg

SEQ ID NO: 676479 - RNA, 19 nt, Human
agggagugggguuuguggg

SEQ ID NO: 676480 - RNA, 20 nt, Human
agggagugggguuugugggg

SEQ ID NO: 676481 - RNA, 20 nt, Human
agggagugggguuugugggg

SEQ ID NO: 676482 - RNA, 19 nt, Human
agggggggugaucauguac

SEQ ID NO: 676483 - RNA, 21 nt, Human
agguggagguugcagugagcc

SEQ ID NO: 676484 - RNA, 24 nt, Human
agguggagguugcagugagccgag

SEQ ID NO: 676485 - RNA, 22 nt, Human
agguguccaacagcuucagcuu

SEQ ID NO: 676486 - RNA, 22 nt, Human
agguguccaacagcuucagcuu

SEQ ID NO: 676487 - RNA, 20 nt, Human
aguaaaagggggagucugga

SEQ ID NO: 676488 - RNA, 22 nt, Human
aguacuaccuccucagcugccu

SEQ ID NO: 676489 - RNA, 18 nt, Human
auagccaggcauccaacu

SEQ ID NO: 676490 - RNA, 26 nt, Human
auagccaggcauccaacuccagccca

SEQ ID NO: 676491 - RNA, 25 nt, Human
aucacauccucagcuaccucugacu

SEQ ID NO: 676492 - RNA, 18 nt, Human
auccagaagcccuguaac

SEQ ID NO: 676493 - RNA, 23 nt, Human
auccuggaaccuccaccuuugaa

SEQ ID NO: 676494 - RNA, 24 nt, Human
aucgcacuccagccugggcaacag

SEQ ID NO: 676495 - RNA, 24 nt, Human
aucgugccaucgcacuccagccug

SEQ ID NO: 676496 - RNA, 21 nt, Human
augaagggcucccagaccccc

SEQ ID NO: 676497 - RNA, 23 nt, Human
augaugauacgaggcucuggcac

SEQ ID NO: 676498 - RNA, 21 nt, Human
augcagggggggugaucaugu

SEQ ID NO: 676499 - RNA, 24 nt, Human
auuccauacagcccuggcccuggc

SEQ ID NO: 676500 - RNA, 24 nt, Human
auuccauacagcccuggcccuggc

SEQ ID NO: 676501 - RNA, 24 nt, Human
caaccuggugaaacccugucucua

SEQ ID NO: 676502 - RNA, 24 nt, Human
caagagagacuuuuagccaggccc

SEQ ID NO: 676503 - RNA, 24 nt, Human
caaggcagguggaucaccugaggu

SEQ ID NO: 676504 - RNA, 23 nt, Human
caaucccaagagagacuuuuagc

SEQ ID NO: 676505 - RNA, 18 nt, Human
cacaacacagaacgcgac

SEQ ID NO: 676506 - RNA, 23 nt, Human
cacagccgcucaggcugcuucug

SEQ ID NO: 676507 - RNA, 23 nt, Human
caccagggacaguacagagcagc

SEQ ID NO: 676508 - RNA, 20 nt, Human
cacccuucacucuccucccu

SEQ ID NO: 676509 - RNA, 18 nt, Human
caccgugcaccgccggau

SEQ ID NO: 676510 - RNA, 20 nt, Human
caccugaggucaggaauucg

SEQ ID NO: 676511 - RNA, 24 nt, Human
cacgccuguaaucccagcacuuug

SEQ ID NO: 676512 - RNA, 23 nt, Human
cacuccagccugggcaacagagc

SEQ ID NO: 676513 - RNA, 24 nt, Human
cacuccagccugggcaacagagcg

SEQ ID NO: 676514 - RNA, 21 nt, Human
cacuccucauuggcaauccca

SEQ ID NO: 676515 - RNA, 19 nt, Human
cacuccucgagagcugucu

SEQ ID NO: 676516 - RNA, 18 nt, Human
cacuuggugcagcaagau

SEQ ID NO: 676517 - RNA, 18 nt, Human
cagcaccuggcacugcuc

SEQ ID NO: 676518 - RNA, 24 nt, Human
cagcacuuugggaagccaaggcag

SEQ ID NO: 676519 - RNA, 25 nt, Human
cagcacuuugggaagccaaggcagg

SEQ ID NO: 676520 - RNA, 18 nt, Human
cagcccacccuucacucu

SEQ ID NO: 676521 - RNA, 21 nt, Human
cagcccacccuucacucuccu

SEQ ID NO: 676522 - RNA, 21 nt, Human
cagcucuugagcaccacuccu

SEQ ID NO: 676523 - RNA, 19 nt, Human
cagcugccucccuggugag

SEQ ID NO: 676524 - RNA, 19 nt, Human
caggcugcuucugccucag

SEQ ID NO: 676525 - RNA, 23 nt, Human
caggucccaggcucacauugggg

SEQ ID NO: 676526 - RNA, 24 nt, Human
cagguggaucaccugaggucagga

SEQ ID NO: 676527 - RNA, 20 nt, Human
cauacagcccuggcccuggc

SEQ ID NO: 676528 - RNA, 20 nt, Human
cauacagcccuggcccuggc

SEQ ID NO: 676529 - RNA, 19 nt, Human
cauccaaccuccuugccug

SEQ ID NO: 676530 - RNA, 21 nt, Human
cauccagaagcccuguaacuc

SEQ ID NO: 676531 - RNA, 18 nt, Human
caucgcacuccagccugg

SEQ ID NO: 676532 - RNA, 19 nt, Human
caucgcacuccagccuggg

SEQ ID NO: 676533 - RNA, 23 nt, Human
caucgcacuccagccugggcaac

SEQ ID NO: 676534 - RNA, 24 nt, Human
caucgcacuccagccugggcaaca

SEQ ID NO: 676535 - RNA, 18 nt, Human
caucugcuaugcccaccc

SEQ ID NO: 676536 - RNA, 21 nt, Human
caugccacuugaauaugugug

SEQ ID NO: 676537 - RNA, 19 nt, Human
cauggcccuaauugugccu

SEQ ID NO: 676538 - RNA, 23 nt, Human
ccaaccccaaaguccccgucagc

SEQ ID NO: 676539 - RNA, 21 nt, Human
ccacaccaccacauccaaccu

SEQ ID NO: 676540 - RNA, 20 nt, Human
ccacauagccaggcauccaa

SEQ ID NO: 676541 - RNA, 18 nt, Human
ccaccagggacaguacag

SEQ ID NO: 676542 - RNA, 19 nt, Human
ccaccccaucucugcugug

SEQ ID NO: 676543 - RNA, 23 nt, Human
ccacgccaggucccaggcucaca

SEQ ID NO: 676544 - RNA, 22 nt, Human
ccagagcccccagcaccuggca

SEQ ID NO: 676545 - RNA, 22 nt, Human
ccagcaccugaugaacaacaag

SEQ ID NO: 676546 - RNA, 21 nt, Human
ccagccccugaccggaagcgc

SEQ ID NO: 676547 - RNA, 21 nt, Human
ccaggcagcagcugccucccu

SEQ ID NO: 676548 - RNA, 25 nt, Human
ccaggccgggcgcgguggcucacgc

SEQ ID NO: 676549 - RNA, 23 nt, Human
ccaguucucuggaccgaagcagg

SEQ ID NO: 676550 - RNA, 21 nt, Human
ccauacagcccuggcccuggc

SEQ ID NO: 676551 - RNA, 20 nt, Human
ccaucgcacuccagccuggg

SEQ ID NO: 676552 - RNA, 21 nt, Human
ccaucgcacuccagccugggc

SEQ ID NO: 676553 - RNA, 24 nt, Human
ccaucgcacuccagccugggcaac

SEQ ID NO: 676554 - RNA, 18 nt, Human
ccaucugcuaugcccacc

SEQ ID NO: 676555 - RNA, 20 nt, Human
cccaagccuucugacugccc

SEQ ID NO: 676556 - RNA, 21 nt, Human
cccacaaugcaggacucaagc

SEQ ID NO: 676557 - RNA, 21 nt, Human
cccacaccaccacauccaacc

SEQ ID NO: 676558 - RNA, 20 nt, Human
cccacgcggcagcgccagcc

SEQ ID NO: 676559 - RNA, 21 nt, Human
cccagagccaggcugggcccu

SEQ ID NO: 676560 - RNA, 23 nt, Human
cccagccauggcccuaauugugc

SEQ ID NO: 676561 - RNA, 22 nt, Human
cccaggccagagagagcagggc

SEQ ID NO: 676562 - RNA, 23 nt, Human
cccccacacaugaagggcuccca

SEQ ID NO: 676563 - RNA, 19 nt, Human
ccccgcaugaccgccagau

SEQ ID NO: 676564 - RNA, 24 nt, Human
cccggccccgcgcccuucaccaac

SEQ ID NO: 676565 - RNA, 21 nt, Human
cccgggagguggagguugcag

SEQ ID NO: 676566 - RNA, 25 nt, Human
cccucccagcucggccaugcucgcc

SEQ ID NO: 676567 - RNA, 19 nt, Human
cccuggugagugggaacac

SEQ ID NO: 676568 - RNA, 19 nt, Human
ccucacacaccaccacacc

SEQ ID NO: 676569 - RNA, 19 nt, Human
ccucccagcucggccaugc

SEQ ID NO: 676570 - RNA, 18 nt, Human
ccucccugcagcccacca

SEQ ID NO: 676571 - RNA, 20 nt, Human
ccuccuggccauggugccgg

SEQ ID NO: 676572 - RNA, 20 nt, Human
ccucggggaguaaaaggggg

SEQ ID NO: 676573 - RNA, 19 nt, Human
ccucuggcuggggcuuagg

SEQ ID NO: 676574 - RNA, 22 nt, Human
ccucuucaugggacauggagau

SEQ ID NO: 676575 - RNA, 22 nt, Human
ccugaggucaggaauucgagac

SEQ ID NO: 676576 - RNA, 22 nt, Human
ccugcagagcugugagugggcu

SEQ ID NO: 676577 - RNA, 22 nt, Human
ccuggccaaccuggugaaaccc

SEQ ID NO: 676578 - RNA, 24 nt, Human
ccuggccaaccuggugaaacccug

SEQ ID NO: 676579 - RNA, 22 nt, Human
ccugggcaacagagcgagacuc

SEQ ID NO: 676580 - RNA, 18 nt, Human
ccugggucucucagccuc

SEQ ID NO: 676581 - RNA, 22 nt, Human
ccuguaaucccagcacuuuggg

SEQ ID NO: 676582 - RNA, 24 nt, Human
cgagaccagccuggccaaccuggu

SEQ ID NO: 676583 - RNA, 22 nt, Human
cgcacuccagccugggcaacag

SEQ ID NO: 676584 - RNA, 22 nt, Human
cgcacuccagccugggcaacag

SEQ ID NO: 676585 - RNA, 21 nt, Human
cgccaauagacuuguggggca

SEQ ID NO: 676586 - RNA, 18 nt, Human
cgccaggcuuuucgggcu

SEQ ID NO: 676587 - RNA, 23 nt, Human
cgccuguaaucccagcacuuugg

SEQ ID NO: 676588 - RNA, 23 nt, Human
cggcggguucuugccagccgacg

SEQ ID NO: 676589 - RNA, 21 nt, Human
cggcuccuaaauacucccccc

SEQ ID NO: 676590 - RNA, 24 nt, Human
cgggaggcuaaagcaggagaauca

SEQ ID NO: 676591 - RNA, 29 nt, Human
cgggagguggagguugcagugacaacggu

SEQ ID NO: 676592 - RNA, 24 nt, Human
cgggagguggagguugcagugagc

SEQ ID NO: 676593 - RNA, 19 nt, Human
cggggaguaaaagggggag

SEQ ID NO: 676594 - RNA, 23 nt, Human
cgucugcaauuccagcuacucgg

SEQ ID NO: 676595 - RNA, 24 nt, Human
cgucugcaauuccagcuacucggg

SEQ ID NO: 676596 - RNA, 22 nt, Human
cucaagaaaaaaaaaaaaaaaa

SEQ ID NO: 676597 - RNA, 25 nt, Human
cucacacaccaccacaccguacuug

SEQ ID NO: 676598 - RNA, 22 nt, Human
cucacgccuguaaucccagcac

SEQ ID NO: 676599 - RNA, 24 nt, Human
cucacgccuguaaucccagcacuu

SEQ ID NO: 676600 - RNA, 24 nt, Human
cucagccucacagggcauuugggc

SEQ ID NO: 676601 - RNA, 21 nt, Human
cuccauggcauauagcugccc

SEQ ID NO: 676602 - RNA, 23 nt, Human
cuccuauugguucccguuugagg

SEQ ID NO: 676603 - RNA, 23 nt, Human
cucgucucaagaaaaaaaaaaaa

SEQ ID NO: 676604 - RNA, 19 nt, Human
cugacgccggauccagggc

SEQ ID NO: 676605 - RNA, 19 nt, Human
cugacgccggauccagggc

SEQ ID NO: 676606 - RNA, 19 nt, Human
cugacugcccuugcacccu

SEQ ID NO: 676607 - RNA, 20 nt, Human
cugcaauuccagcuacucgg

SEQ ID NO: 676608 - RNA, 21 nt, Human
cugcaauuccagcuacucggg

SEQ ID NO: 676609 - RNA, 20 nt, Human
cugccccaucugcuaugccc

SEQ ID NO: 676610 - RNA, 21 nt, Human
cugccgcgcacucccaacgcc

SEQ ID NO: 676611 - RNA, 21 nt, Human
cugcuguguuccagcccugug

SEQ ID NO: 676612 - RNA, 22 nt, Human
cugcuguguuccagcccugugg

SEQ ID NO: 676613 - RNA, 23 nt, Human
cugcuguguuccagcccuguggc

SEQ ID NO: 676614 - RNA, 24 nt, Human
cuggaaccuccaccuuugaaccca

SEQ ID NO: 676615 - RNA, 24 nt, Human
cuggccaaccuggugaaacccugu

SEQ ID NO: 676616 - RNA, 21 nt, Human
cuggggccuuuggguccugug

SEQ ID NO: 676617 - RNA, 23 nt, Human
cuucacccagugccccccagaca

SEQ ID NO: 676618 - RNA, 24 nt, Human
cuucagagccgccuucuuuucccu

SEQ ID NO: 676619 - RNA, 22 nt, Human
cuucagcuucacccagugcccc

SEQ ID NO: 676620 - RNA, 21 nt, Human
cuugaacccgggagguggagg

SEQ ID NO: 676621 - RNA, 19 nt, Human
cuugagcaccacuccucga

SEQ ID NO: 676622 - RNA, 20 nt, Human
cuugcacccuccccuaccua

SEQ ID NO: 676623 - RNA, 19 nt, Human
gaaacccugucucuacuaa

SEQ ID NO: 676624 - RNA, 21 nt, Human
gaaagcaggaacuagcacacc

SEQ ID NO: 676625 - RNA, 23 nt, Human
gaacacggugcacagguccaugc

SEQ ID NO: 676626 - RNA, 19 nt, Human
gacaaauaaugacaagucc

SEQ ID NO: 676627 - RNA, 19 nt, Human
gacaaauaaugacaagucc

SEQ ID NO: 676628 - RNA, 22 nt, Human
gacauggagauucggauuccca

SEQ ID NO: 676629 - RNA, 18 nt, Human
gaccccccuucccugccc

SEQ ID NO: 676630 - RNA, 19 nt, Human
gaccucugcaucugcccag

SEQ ID NO: 676631 - RNA, 25 nt, Human
gacugcaggaagaggcacaugccag

SEQ ID NO: 676632 - RNA, 24 nt, Human
gacugcccuugcacccuccccuac

SEQ ID NO: 676633 - RNA, 23 nt, Human
gagaaucacuugaacccgggagg

SEQ ID NO: 676634 - RNA, 23 nt, Human
gagaucgugccaucgcacuccag

SEQ ID NO: 676635 - RNA, 18 nt, Human
gagcagaaggcagguugg

SEQ ID NO: 676636 - RNA, 18 nt, Human
gagcagcaagaggguggg

SEQ ID NO: 676637 - RNA, 20 nt, Human
gagcagcgagguccaggaug

SEQ ID NO: 676638 - RNA, 22 nt, Human
gagcagcgagguccaggauggc

SEQ ID NO: 676639 - RNA, 18 nt, Human
gagcucccuuugcccuuc

SEQ ID NO: 676640 - RNA, 19 nt, Human
gaggagccuuuccugccug

SEQ ID NO: 676641 - RNA, 19 nt, Human
gagggggugucccgggcuc

SEQ ID NO: 676642 - RNA, 20 nt, Human
gagggugggggccugggugg

SEQ ID NO: 676643 - RNA, 23 nt, Human
gagguugcagugagccgagaucg

SEQ ID NO: 676644 - RNA, 18 nt, Human
gaucaccugaggucagga

SEQ ID NO: 676645 - RNA, 24 nt, Human
gaucaccugaggucaggaauucga

SEQ ID NO: 676646 - RNA, 18 nt, Human
gaugagcuggcccaagug

SEQ ID NO: 676647 - RNA, 21 nt, Human
gcaaguaagugggccccacag

SEQ ID NO: 676648 - RNA, 24 nt, Human
gcacuccagccugggcaacagagc

SEQ ID NO: 676649 - RNA, 19 nt, Human
gcagcagcugccucccugg

SEQ ID NO: 676650 - RNA, 23 nt, Human
gcauauagcugccccuccuuggc

SEQ ID NO: 676651 - RNA, 24 nt, Human
gccaaccuggugaaacccugucuc

SEQ ID NO: 676652 - RNA, 19 nt, Human
gccacaacacagaacgcga

SEQ ID NO: 676653 - RNA, 21 nt, Human
gccagagcccccagcaccugg

SEQ ID NO: 676654 - RNA, 22 nt, Human
gccaucgcacuccagccugggc

SEQ ID NO: 676655 - RNA, 23 nt, Human
gccccaagccuucugacugcccu

SEQ ID NO: 676656 - RNA, 23 nt, Human
gcccugacgccggauccagggcc

SEQ ID NO: 676657 - RNA, 24 nt, Human
gcccugacgccggauccagggccg

SEQ ID NO: 676658 - RNA, 24 nt, Human
gcccugacgccggauccagggccg

SEQ ID NO: 676659 - RNA, 22 nt, Human
gcccuggcccuggcccuucuug

SEQ ID NO: 676660 - RNA, 22 nt, Human
gcccuggcccuggcccuucuug

SEQ ID NO: 676661 - RNA, 18 nt, Human
gcccuguaacuccauggc

SEQ ID NO: 676662 - RNA, 19 nt, Human
gcgggaaagcaggaacuag

SEQ ID NO: 676663 - RNA, 18 nt, Human
gcuagcgccuccacuugg

SEQ ID NO: 676664 - RNA, 22 nt, Human
gcuccuggcagaucccugcuuc

SEQ ID NO: 676665 - RNA, 22 nt, Human
gcugaaaagcaggggugcaggg

SEQ ID NO: 676666 - RNA, 22 nt, Human
gcuguagaagaacacagccacu

SEQ ID NO: 676667 - RNA, 23 nt, Human
gcuucagcuucacccagugcccc

SEQ ID NO: 676668 - RNA, 23 nt, Human
ggaacagaugcuggcgcaccuga

SEQ ID NO: 676669 - RNA, 20 nt, Human
ggaagaggcacaugccagug

SEQ ID NO: 676670 - RNA, 21 nt, Human
ggacagccagagcccccagca

SEQ ID NO: 676671 - RNA, 19 nt, Human
ggacugggagaagggagcc

SEQ ID NO: 676672 - RNA, 23 nt, Human
ggagacggaaaggaugcaggggg

SEQ ID NO: 676673 - RNA, 20 nt, Human
ggagguugcagugagccgag

SEQ ID NO: 676674 - RNA, 22 nt, Human
ggagguugcagugagccgagau

SEQ ID NO: 676675 - RNA, 24 nt, Human
ggagguugcagugagccgagaucg

SEQ ID NO: 676676 - RNA, 23 nt, Human
ggagguuggguguugguggaugg

SEQ ID NO: 676677 - RNA, 23 nt, Human
ggauacacacaccaucuucgacc

SEQ ID NO: 676678 - RNA, 20 nt, Human
ggcaccggauggcccuugcc

SEQ ID NO: 676679 - RNA, 19 nt, Human
ggccauaauggggaagacc

SEQ ID NO: 676680 - RNA, 20 nt, Human
ggccauggugccgguggaac

SEQ ID NO: 676681 - RNA, 21 nt, Human
ggcccacucccucccaccccc

SEQ ID NO: 676682 - RNA, 23 nt, Human
ggccguagccgcgucccauagcc

SEQ ID NO: 676683 - RNA, 23 nt, Human
gggcacuaggaaguccgcgggaa

SEQ ID NO: 676684 - RNA, 24 nt, Human
gggccugggugggggagcccuggg

SEQ ID NO: 676685 - RNA, 24 nt, Human
gggcgcgguggcucacgccuguaa

SEQ ID NO: 676686 - RNA, 20 nt, Human
gggcugggucgggucaggag

SEQ ID NO: 676687 - RNA, 22 nt, Human
gggcugggucgggucaggagcc

SEQ ID NO: 676688 - RNA, 19 nt, Human
gggugggggagcccugggc

SEQ ID NO: 676689 - RNA, 20 nt, Human
gggugggggccugggugggg

SEQ ID NO: 676690 - RNA, 19 nt, Human
gggugugggcgagaucuuc

SEQ ID NO: 676691 - RNA, 21 nt, Human
gguaccccaggccgggcgcgg

SEQ ID NO: 676692 - RNA, 24 nt, Human
ggucagggaaaucuggggcugggu

SEQ ID NO: 676693 - RNA, 21 nt, Human
ggugcacagguccaugccacu

SEQ ID NO: 676694 - RNA, 23 nt, Human
gguggcucacgccuguaauccca

SEQ ID NO: 676695 - RNA, 24 nt, Human
gguggcucacgccuguaaucccag

SEQ ID NO: 676696 - RNA, 19 nt, Human
ggugugggcgagaucuucc

SEQ ID NO: 676697 - RNA, 20 nt, Human
guacagagcagcucugugca

SEQ ID NO: 676698 - RNA, 18 nt, Human
guagagcucaucauuaac

SEQ ID NO: 676699 - RNA, 21 nt, Human
gucacguucuccaugcguacc

SEQ ID NO: 676700 - RNA, 20 nt, Human
gucagccuuuggcuggcagc

SEQ ID NO: 676701 - RNA, 22 nt, Human
guccaacagcuucagcuucacc

SEQ ID NO: 676702 - RNA, 22 nt, Human
guccaacagcuucagcuucacc

SEQ ID NO: 676703 - RNA, 22 nt, Human
guggauggagggagucccauuu

SEQ ID NO: 676704 - RNA, 23 nt, Human
guggcucacgccuguaaucccag

SEQ ID NO: 676705 - RNA, 25 nt, Human
guguuccagcccuguggccacaagu

SEQ ID NO: 676706 - RNA, 24 nt, Human
guugcagugagccgagaucgugcc

SEQ ID NO: 676707 - RNA, 18 nt, Human
uaaacucuggagcagcga

SEQ ID NO: 676708 - RNA, 24 nt, Human
uaaagcaggagaaucacuugaacc

SEQ ID NO: 676709 - RNA, 24 nt, Human
uaagaacagcaaaguccuaggcug

SEQ ID NO: 676710 - RNA, 20 nt, Human
uaagaggcuccugcucucga

SEQ ID NO: 676711 - RNA, 21 nt, Human
uaccucugacuugacacuacc

SEQ ID NO: 676712 - RNA, 19 nt, Human
uacucgggaggcuaaagca

SEQ ID NO: 676713 - RNA, 24 nt, Human
uagaagaacacagccacuuccaca

SEQ ID NO: 676714 - RNA, 21 nt, Human
uagcacaccuugcagggccug

SEQ ID NO: 676715 - RNA, 26 nt, Human
uauuccauacagcccuggcccuggcc

SEQ ID NO: 676716 - RNA, 20 nt, Human
ucaagccaggaaugggaacg

SEQ ID NO: 676717 - RNA, 19 nt, Human
ucacauccucagcuaccuc

SEQ ID NO: 676718 - RNA, 24 nt, Human
ucacuugaacccgggagguggagg

SEQ ID NO: 676719 - RNA, 21 nt, Human
uccaacuccagcccacccuuc

SEQ ID NO: 676720 - RNA, 19 nt, Human
uccacauagccaggcaucc

SEQ ID NO: 676721 - RNA, 19 nt, Human
uccacaugagaaggcaggu

SEQ ID NO: 676722 - RNA, 19 nt, Human
uccacaugagaaggcaggu

SEQ ID NO: 676723 - RNA, 20 nt, Human
uccagaagcccuguaacucc

SEQ ID NO: 676724 - RNA, 23 nt, Human
uccagccugggcaacagagcgag

SEQ ID NO: 676725 - RNA, 24 nt, Human
uccagccugggcaacagagcgaga

SEQ ID NO: 676726 - RNA, 26 nt, Human
uccaggacucacccucuucugcucua

SEQ ID NO: 676727 - RNA, 20 nt, Human
uccauacagcccuggcccug

SEQ ID NO: 676728 - RNA, 20 nt, Human
uccauacagcccuggcccug

SEQ ID NO: 676729 - RNA, 23 nt, Human
uccauacagcccuggcccuggcc

SEQ ID NO: 676730 - RNA, 23 nt, Human
ucccaacgccgugcccggccccg

SEQ ID NO: 676731 - RNA, 19 nt, Human
ucccaagagagacuuuuag

SEQ ID NO: 676732 - RNA, 24 nt, Human
ucccacaccaccacauccaaccuc

SEQ ID NO: 676733 - RNA, 24 nt, Human
ucccaccaguaucugccaguucuc

SEQ ID NO: 676734 - RNA, 20 nt, Human
ucccugcagagcugugagug

SEQ ID NO: 676735 - RNA, 21 nt, Human
ucccuucggcuucgcuagccc

SEQ ID NO: 676736 - RNA, 22 nt, Human
uccgccgcucguuuuuccucgg

SEQ ID NO: 676737 - RNA, 20 nt, Human
uccggcucggcccucccagc

SEQ ID NO: 676738 - RNA, 25 nt, Human
uccuacacaggcacaacggacaucc

SEQ ID NO: 676739 - RNA, 23 nt, Human
uccucauccccuccccuguugua

SEQ ID NO: 676740 - RNA, 18 nt, Human
uccuggaaccuccaccuu

SEQ ID NO: 676741 - RNA, 20 nt, Human
uccuucagagccgccuucuu

SEQ ID NO: 676742 - RNA, 25 nt, Human
ucucagagaguaggucacgggccag

SEQ ID NO: 676743 - RNA, 20 nt, Human
ucucagccccugagggugga

SEQ ID NO: 676744 - RNA, 25 nt, Human
ucuccaagcgaguuccugaucggcu

SEQ ID NO: 676745 - RNA, 19 nt, Human
ucuccgccgcucguuuuuc

SEQ ID NO: 676746 - RNA, 23 nt, Human
ucucuacuaaaaauacaacaauu

SEQ ID NO: 676747 - RNA, 20 nt, Human
ucugccaguucucuggaccg

SEQ ID NO: 676748 - RNA, 23 nt, Human
ucugcuguguuccagcccugugg

SEQ ID NO: 676749 - RNA, 25 nt, Human
ucuggaccgaagcagggagcagggc

SEQ ID NO: 676750 - RNA, 24 nt, Human
ucuggcacugacucgccaauagac

SEQ ID NO: 676751 - RNA, 18 nt, Human
ucuuagccgcgcucccuu

SEQ ID NO: 676752 - RNA, 19 nt, Human
ugaacccagagccaggcug

SEQ ID NO: 676753 - RNA, 26 nt, Human
ugaacccagagccaggcugggccccu

SEQ ID NO: 676754 - RNA, 19 nt, Human
ugaaggacugauaauauua

SEQ ID NO: 676755 - RNA, 18 nt, Human
ugaagggcucccagaccc

SEQ ID NO: 676756 - RNA, 18 nt, Human
ugaccucugcaucugccc

SEQ ID NO: 676757 - RNA, 18 nt, Human
ugagaaggcaggugucca

SEQ ID NO: 676758 - RNA, 20 nt, Human
ugagaaggcagguguccaaa

SEQ ID NO: 676759 - RNA, 20 nt, Human
ugagaaggcagguguccaaa

SEQ ID NO: 676760 - RNA, 25 nt, Human
ugagaaggcagguguccaacagcuu

SEQ ID NO: 676761 - RNA, 25 nt, Human
ugagaaggcagguguccaacagcuu

SEQ ID NO: 676762 - RNA, 21 nt, Human
ugagaugcauaugaagccagg

SEQ ID NO: 676763 - RNA, 21 nt, Human
ugagcacagccgcucaggcug

SEQ ID NO: 676764 - RNA, 22 nt, Human
ugagccgagaucgugccaucgc

SEQ ID NO: 676765 - RNA, 19 nt, Human
ugagcuggcccaaguggaa

SEQ ID NO: 676766 - RNA, 19 nt, Human
ugagggagugggguuugug

SEQ ID NO: 676767 - RNA, 19 nt, Human
ugagggagugggguuugug

SEQ ID NO: 676768 - RNA, 21 nt, Human
ugagggagugggguuuguggg

SEQ ID NO: 676769 - RNA, 21 nt, Human
ugagggagugggguuuguggg

SEQ ID NO: 676770 - RNA, 22 nt, Human
ugagggagugggguuugugggg

SEQ ID NO: 676771 - RNA, 22 nt, Human
ugagggagugggguuugugggg

SEQ ID NO: 676772 - RNA, 21 nt, Human
ugauaauauuauggggcaggc

SEQ ID NO: 676773 - RNA, 18 nt, Human
ugcaaguaagugggcccc

SEQ ID NO: 676774 - RNA, 22 nt, Human
ugcaaguaagugggccccacag

SEQ ID NO: 676775 - RNA, 19 nt, Human
ugcagggccuggggccuuu

SEQ ID NO: 676776 - RNA, 23 nt, Human
ugccagggccugagcacagccgc

SEQ ID NO: 676777 - RNA, 24 nt, Human
ugccaucgcacuccagccugggca

SEQ ID NO: 676778 - RNA, 23 nt, Human
ugcccaauguccauccagaagcc

SEQ ID NO: 676779 - RNA, 22 nt, Human
ugcccaccccaucucugcugug

SEQ ID NO: 676780 - RNA, 20 nt, Human
ugccccaggccagagagagc

SEQ ID NO: 676781 - RNA, 18 nt, Human
ugccccaucugcuaugcc

SEQ ID NO: 676782 - RNA, 20 nt, Human
ugccugcagcccgccuggcc

SEQ ID NO: 676783 - RNA, 20 nt, Human
ugccugcccaccggacucug

SEQ ID NO: 676784 - RNA, 21 nt, Human
ugcggccugugucagccucac

SEQ ID NO: 676785 - RNA, 22 nt, Human
ugcguacccacugacccacgcg

SEQ ID NO: 676786 - RNA, 22 nt, Human
ugcuccugugccuucauuuccu

SEQ ID NO: 676787 - RNA, 20 nt, Human
uggaccgaagcagggagcag

SEQ ID NO: 676788 - RNA, 23 nt, Human
uggacgggaggcucugcuacagg

SEQ ID NO: 676789 - RNA, 24 nt, Human
uggaucaccugaggucaggaauuc

SEQ ID NO: 676790 - RNA, 27 nt, Human
uggaucaccugaggucaggaauucgag

SEQ ID NO: 676791 - RNA, 19 nt, Human
uggcagcucuccgccgcuc

SEQ ID NO: 676792 - RNA, 24 nt, Human
uggccaaccuggugaaacccuguc

SEQ ID NO: 676793 - RNA, 24 nt, Human
uggcucacgccuguaaucccagca

SEQ ID NO: 676794 - RNA, 19 nt, Human
ugggaacacggugcacagg

SEQ ID NO: 676795 - RNA, 22 nt, Human
ugggaacacggugcacaggucc

SEQ ID NO: 676796 - RNA, 20 nt, Human
ugggaagcagggagacggaa

SEQ ID NO: 676797 - RNA, 24 nt, Human
ugggaagccaaggcagguggauca

SEQ ID NO: 676798 - RNA, 23 nt, Human
uggggaccacaaccccugucucu

SEQ ID NO: 676799 - RNA, 20 nt, Human
uggggcugggucgggucagg

SEQ ID NO: 676800 - RNA, 23 nt, Human
uggggcugggucgggucaggagc

SEQ ID NO: 676801 - RNA, 20 nt, Human
uggggggccaggcacagugc

SEQ ID NO: 676802 - RNA, 18 nt, Human
ugggucgggucaggagcc

SEQ ID NO: 676803 - RNA, 21 nt, Human
ugguaccccaggccgggcgcg

SEQ ID NO: 676804 - RNA, 24 nt, Human
ugguaccccaggccgggcgcggug

SEQ ID NO: 676805 - RNA, 25 nt, Human
ugguccacgccugccgcggcuagcg

SEQ ID NO: 676806 - RNA, 20 nt, Human
uggugagugggaacacggug

SEQ ID NO: 676807 - RNA, 21 nt, Human
ugguggggcaggucagggaaa

SEQ ID NO: 676808 - RNA, 25 nt, Human
uggugguggggagagcaguagguac

SEQ ID NO: 676809 - RNA, 18 nt, Human
uguagaagaacacagcca

SEQ ID NO: 676810 - RNA, 24 nt, Human
uguagaagaacacagccacuucca

SEQ ID NO: 676811 - RNA, 24 nt, Human
uguaucccacaccaccacauccaa

SEQ ID NO: 676812 - RNA, 22 nt, Human
uguugaaagccacaggggccug

SEQ ID NO: 676813 - RNA, 18 nt, Human
uuagccgggcgugguggu

SEQ ID NO: 676814 - RNA, 23 nt, Human
uuagccgggcgugguggugggcg

SEQ ID NO: 676815 - RNA, 24 nt, Human
uuagccgggcgugguggugggcgu

SEQ ID NO: 676816 - RNA, 22 nt, Human
uucacccagugccccccagaca

SEQ ID NO: 676817 - RNA, 24 nt, Human
uuccacagcugugcuguguugaaa

SEQ ID NO: 676818 - RNA, 22 nt, Human
uuccucuuucuguccuggggug

SEQ ID NO: 676819 - RNA, 20 nt, Human
uucuccaugcguacccacug

SEQ ID NO: 676820 - RNA, 24 nt, Human
uucuugagggagugggguuugugg

SEQ ID NO: 676821 - RNA, 24 nt, Human
uucuugagggagugggguuugugg

SEQ ID NO: 676822 - RNA, 22 nt, Human
uugaaagccacaggggccuggg

SEQ ID NO: 676823 - RNA, 24 nt, Human
uugaacccgggagguggagguugc

SEQ ID NO: 676824 - RNA, 23 nt, Human
uugaaggacugauaauauuaugg

SEQ ID NO: 676825 - RNA, 18 nt, Human
uugcacccuccccuaccu

SEQ ID NO: 676826 - RNA, 21 nt, Human
uugcagugagccgagaucgug

SEQ ID NO: 676827 - RNA, 22 nt, Human
uugcagugagccgagaucgugc

SEQ ID NO: 676828 - RNA, 25 nt, Human
uuggugcagcaagaugggcuuauug

SEQ ID NO: 676829 - RNA, 18 nt, Human
uuggugguggggagagca

SEQ ID NO: 676830 - RNA, 22 nt, Human
uuucaccagagggcgggcuugu

SEQ ID NO: 676831 - RNA, 19 nt, Human
uuugaagugacuuugaagg

SEQ ID NO: 676832 - RNA, 22 nt, Human
uuuuuuuuuuuuuuuuucacag

SEQ ID NO: 676833 - RNA, 23 nt, Human
uuuuuuuuuuuuuuuuucacagu

SEQ ID NO: 676834 - RNA, 21 nt, Human
aaaaaacaaaacaaacagaaa

SEQ ID NO: 676835 - RNA, 19 nt, Human
aaaacaaaacaaacagaaa

SEQ ID NO: 676836 - RNA, 21 nt, Human
aaaacaaaacaaacagaaaac

SEQ ID NO: 676837 - RNA, 23 nt, Human
aaacaaacagaaaacaucaaaaa

SEQ ID NO: 676838 - RNA, 25 nt, Human
aaacaucaaaaacacaaaaagauau

SEQ ID NO: 676839 - RNA, 22 nt, Human
aacagcuuucagccacaaacca

SEQ ID NO: 676840 - RNA, 24 nt, Human
aacaucaaaaacacaaaaagauau

SEQ ID NO: 676841 - RNA, 22 nt, Human
aaggccgcagaaaaaguacuaa

SEQ ID NO: 676842 - RNA, 21 nt, Human
acaaaaagauauuaaaacagc

SEQ ID NO: 676843 - RNA, 26 nt, Human
acaaaacaaacagaaaacaucaaaaa

SEQ ID NO: 676844 - RNA, 25 nt, Human
acaaacagaaaacaucaaaaacaca

SEQ ID NO: 676845 - RNA, 25 nt, Human
caaaaacacaaaaagauauuaaaac

SEQ ID NO: 676846 - RNA, 22 nt, Human
cagccacaaaccaaaggccgca

SEQ ID NO: 676847 - RNA, 18 nt, Human
ccacaaaccaaaggccgc

SEQ ID NO: 676848 - RNA, 19 nt, Human
ccacaaaccaaaggccgcg

SEQ ID NO: 676849 - RNA, 22 nt, Human
ccgccgccgccgccucgccgcc

SEQ ID NO: 676850 - RNA, 23 nt, Human
ccgccgccgccgccucgccgccu

SEQ ID NO: 676851 - RNA, 18 nt, Human
ccgccgccgccgccucgg

SEQ ID NO: 676852 - RNA, 21 nt, Human
ccgccucgccgccucuccggc

SEQ ID NO: 676853 - RNA, 24 nt, Human
cgccucgccgccucuccggcccca

SEQ ID NO: 676854 - RNA, 21 nt, Human
cugcuauuuuaaaaaacaaaa

SEQ ID NO: 676855 - RNA, 22 nt, Human
cuugccgccgccgccgccgccu

SEQ ID NO: 676856 - RNA, 18 nt, Human
gccgccgccgccgccgcc

SEQ ID NO: 676857 - RNA, 24 nt, Human
gccgccgccgccgccgccucgccg

SEQ ID NO: 676858 - RNA, 22 nt, Human
uuacagcaaaucuuggcgauga

SEQ ID NO: 676859 - RNA, 20 nt, Human
uucaagaaguuaaacguaga

SEQ ID NO: 676860 - RNA, 18 nt, Human
uugccgccgccgccgccg

SEQ ID NO: 676861 - RNA, 23 nt, Human
uuggcgaugagucacucaacagc

SEQ ID NO: 676862 - RNA, 26 nt, Human
uuucagccacaaaccaaaggccgcag

SEQ ID NO: 676863 - RNA, 21 nt, Human
aaaaggaaauaccaaccucau

SEQ ID NO: 676864 - RNA, 26 nt, Human
aaauaccaaccucaugaagacagcgg

SEQ ID NO: 676865 - RNA, 22 nt, Human
accgugggacgggccucccucu

SEQ ID NO: 676866 - RNA, 23 nt, Human
accugaggcuacgcgaaucgccc

SEQ ID NO: 676867 - RNA, 22 nt, Human
aggcacuccacaaaaggaaaua

SEQ ID NO: 676868 - RNA, 21 nt, Human
auuacaucgcgcagccacgcc

SEQ ID NO: 676869 - RNA, 25 nt, Human
caaccucaugaagacagcggggacu

SEQ ID NO: 676870 - RNA, 23 nt, Human
cacccucuugccggagucgggaa

SEQ ID NO: 676871 - RNA, 21 nt, Human
cagcaggcccaagccaacguc

SEQ ID NO: 676872 - RNA, 21 nt, Human
cagggcucuggcuggcccccc

SEQ ID NO: 676873 - RNA, 24 nt, Human
caucgcgcagccacgcccccagcg

SEQ ID NO: 676874 - RNA, 23 nt, Human
ccacagaccgugggacgggccuc

SEQ ID NO: 676875 - RNA, 22 nt, Human
ccagagaccgauuacaucgcgc

SEQ ID NO: 676876 - RNA, 19 nt, Human
cccagcgugcgcgcggccg

SEQ ID NO: 676877 - RNA, 24 nt, Human
cccgcccuccucgucucccgggaa

SEQ ID NO: 676878 - RNA, 21 nt, Human
ccucccugcccgcccuccucg

SEQ ID NO: 676879 - RNA, 22 nt, Human
ccucccugcccgcccuccucgu

SEQ ID NO: 676880 - RNA, 19 nt, Human
ccucggacggccagggcuc

SEQ ID NO: 676881 - RNA, 19 nt, Human
ccucuugccggagucggga

SEQ ID NO: 676882 - RNA, 18 nt, Human
cgcccgcgaagagggucc

SEQ ID NO: 676883 - RNA, 19 nt, Human
cgccgcgcagcguccagag

SEQ ID NO: 676884 - RNA, 21 nt, Human
cggccgccguguacgacccgg

SEQ ID NO: 676885 - RNA, 19 nt, Human
cucccugcccgcccuccuc

SEQ ID NO: 676886 - RNA, 23 nt, Human
cugcccgcccuccucgucucccg

SEQ ID NO: 676887 - RNA, 24 nt, Human
gccacgcccccagcgugcgcgcgg

SEQ ID NO: 676888 - RNA, 22 nt, Human
ggauccguagccacagaccgug

SEQ ID NO: 676889 - RNA, 24 nt, Human
ggcucuggcuggcccccagaguca

SEQ ID NO: 676890 - RNA, 23 nt, Human
gugggacgggccucccucugagg

SEQ ID NO: 676891 - RNA, 24 nt, Human
ucccugcccgcccuccucgucucc

SEQ ID NO: 676892 - RNA, 23 nt, Human
uccguagccacagaccgugggac

SEQ ID NO: 676893 - RNA, 19 nt, Human
ugacuugcugguccucaga

SEQ ID NO: 676894 - RNA, 22 nt, Human
uggcccccagagucaccguccu

SEQ ID NO: 676895 - RNA, 24 nt, Human
ugggauccguagccacagaccgug

SEQ ID NO: 676896 - RNA, 22 nt, Human
uuacaucgcgcagccacgcccc

SEQ ID NO: 676897 - RNA, 23 nt, Human
uuuuuuuuuuuuuuggcaaugga

SEQ ID NO: 676898 - RNA, 18 nt, Human
uuuuuuuuuuuuuuuuug

SEQ ID NO: 676899 - RNA, 25 nt, Human
uuuuuuuuuuuuuuuuuggcaaugg

SEQ ID NO: 676900 - RNA, 19 nt, Human
aaagcucugccauaaacuu

SEQ ID NO: 676901 - RNA, 18 nt, Human
caccacaaccucuccugc

SEQ ID NO: 676902 - RNA, 21 nt, Human
ccucuccugccgccgccuugc

SEQ ID NO: 676903 - RNA, 21 nt, Human
cuuagagaaacuagcaccaca

SEQ ID NO: 676904 - RNA, 18 nt, Human
ggcuuagagaaacuagca

SEQ ID NO: 676905 - RNA, 26 nt, Human
aaaaugucaagaaccauuuauaugcc

SEQ ID NO: 676906 - RNA, 20 nt, Human
aaaccaguauuuugugcuaa

SEQ ID NO: 676907 - RNA, 23 nt, Human
aaagcuuaaagguuuaagaaauu

SEQ ID NO: 676908 - RNA, 25 nt, Human
aacagaacaaaaagcuuaaagguuu

SEQ ID NO: 676909 - RNA, 27 nt, Human
aaggcgccuuugccuuuuuuccuccag

SEQ ID NO: 676910 - RNA, 24 nt, Human
aagugaucugcccaccuuggccuc

SEQ ID NO: 676911 - RNA, 24 nt, Human
acaaagaaaauacacucugaguac

SEQ ID NO: 676912 - RNA, 18 nt, Human
acauugcauuuccucucu

SEQ ID NO: 676913 - RNA, 22 nt, Human
accauguuggguaggcuggucg

SEQ ID NO: 676914 - RNA, 25 nt, Human
acucugucgccuaggcuggagugca

SEQ ID NO: 676915 - RNA, 19 nt, Human
agaacaaaaagcuuaaagg

SEQ ID NO: 676916 - RNA, 22 nt, Human
agaagagaugggguuucaccau

SEQ ID NO: 676917 - RNA, 22 nt, Human
agcagccaacuccgcggcgcgc

SEQ ID NO: 676918 - RNA, 18 nt, Human
agccggcguggagagcgc

SEQ ID NO: 676919 - RNA, 19 nt, Human
aggaauuuuuauuuuggcu

SEQ ID NO: 676920 - RNA, 22 nt, Human
aggcgccuuugccuuuuuuccu

SEQ ID NO: 676921 - RNA, 25 nt, Human
aggcuggagugcaguggcacaaucu

SEQ ID NO: 676922 - RNA, 21 nt, Human
agguguaagccacucugccca

SEQ ID NO: 676923 - RNA, 23 nt, Human
aguagcugggauuacaggaaugu

SEQ ID NO: 676924 - RNA, 20 nt, Human
agugcaguggcacaaucucg

SEQ ID NO: 676925 - RNA, 24 nt, Human
agugcaguggcacaaucucggcuc

SEQ ID NO: 676926 - RNA, 22 nt, Human
aguggaaucacuuacaucuaga

SEQ ID NO: 676927 - RNA, 22 nt, Human
augggguuucaccauguugggu

SEQ ID NO: 676928 - RNA, 24 nt, Human
augggguuucaccauguuggguag

SEQ ID NO: 676929 - RNA, 21 nt, Human
auucaaggggacuuucuucag

SEQ ID NO: 676930 - RNA, 21 nt, Human
caaaggacugaaagcaagcac

SEQ ID NO: 676931 - RNA, 24 nt, Human
caaauugcugggauuauaggugua

SEQ ID NO: 676932 - RNA, 24 nt, Human
cacacaacaauucaccaagguuaa

SEQ ID NO: 676933 - RNA, 22 nt, Human
caccauguuggguaggcugguc

SEQ ID NO: 676934 - RNA, 22 nt, Human
cacucugucgccuaggcuggag

SEQ ID NO: 676935 - RNA, 21 nt, Human
cacugcaaccucugccucccg

SEQ ID NO: 676936 - RNA, 23 nt, Human
cacugcaaccucugccucccggg

SEQ ID NO: 676937 - RNA, 19 nt, Human
cacuuuuuuuuugguaguu

SEQ ID NO: 676938 - RNA, 20 nt, Human
caggagcuaaugagugaaaa

SEQ ID NO: 676939 - RNA, 22 nt, Human
caggcgaaucuccugccucagc

SEQ ID NO: 676940 - RNA, 23 nt, Human
cauccuuugaagcaaaaccacuu

SEQ ID NO: 676941 - RNA, 24 nt, Human
cauguuggguaggcuggucgcgaa

SEQ ID NO: 676942 - RNA, 20 nt, Human
cauuacaaaacucaaaaaua

SEQ ID NO: 676943 - RNA, 21 nt, Human
cauuacaaaacucaaaaauau

SEQ ID NO: 676944 - RNA, 20 nt, Human
cauucauaacugccaucuac

SEQ ID NO: 676945 - RNA, 21 nt, Human
ccaaauugcugggauuauagg

SEQ ID NO: 676946 - RNA, 24 nt, Human
ccaaauugcugggauuauaggugu

SEQ ID NO: 676947 - RNA, 22 nt, Human
ccagagccgccggccacaccca

SEQ ID NO: 676948 - RNA, 22 nt, Human
ccauuacaaaacucaaaaauau

SEQ ID NO: 676949 - RNA, 23 nt, Human
cccgaguagcugggauuacagga

SEQ ID NO: 676950 - RNA, 23 nt, Human
cccggguucaggcgaaucuccug

SEQ ID NO: 676951 - RNA, 27 nt, Human
ccgagaccagagccgccggccacaccc

SEQ ID NO: 676952 - RNA, 20 nt, Human
ccgccggccacacccagucc

SEQ ID NO: 676953 - RNA, 20 nt, Human
ccgcgucgaccgcgcgcugc

SEQ ID NO: 676954 - RNA, 18 nt, Human
ccucccagcagccaacuc

SEQ ID NO: 676955 - RNA, 19 nt, Human
ccugaccucaagugaucug

SEQ ID NO: 676956 - RNA, 24 nt, Human
ccugaccucaagugaucugcccac

SEQ ID NO: 676957 - RNA, 22 nt, Human
cgccggagccggggcggggacg

SEQ ID NO: 676958 - RNA, 22 nt, Human
cgccggccacacccagucccgc

SEQ ID NO: 676959 - RNA, 19 nt, Human
cgcgccggagccggggcgg

SEQ ID NO: 676960 - RNA, 21 nt, Human
cgcgcgggcccggcggggacg

SEQ ID NO: 676961 - RNA, 22 nt, Human
cggcgcgccggagccggggcgg

SEQ ID NO: 676962 - RNA, 21 nt, Human
cucaaaggacugaaagcaagc

SEQ ID NO: 676963 - RNA, 24 nt, Human
cucaagugaucugcccaccuuggc

SEQ ID NO: 676964 - RNA, 24 nt, Human
cucacucugucgccuaggcuggag

SEQ ID NO: 676965 - RNA, 24 nt, Human
cucacugcaaccucugccucccgg

SEQ ID NO: 676966 - RNA, 24 nt, Human
cucagccucccgaguagcugggau

SEQ ID NO: 676967 - RNA, 20 nt, Human
cucccagcagccaacuccgc

SEQ ID NO: 676968 - RNA, 24 nt, Human
cucugaguacacacaacaauucac

SEQ ID NO: 676969 - RNA, 23 nt, Human
cugcaaccucugccucccggguu

SEQ ID NO: 676970 - RNA, 24 nt, Human
cugcaaccucugccucccggguuc

SEQ ID NO: 676971 - RNA, 21 nt, Human
cugcccagccaaaaaguuaau

SEQ ID NO: 676972 - RNA, 23 nt, Human
cugccucagccucccgaguagcu

SEQ ID NO: 676973 - RNA, 21 nt, Human
cugggauuauagguguaagcc

SEQ ID NO: 676974 - RNA, 22 nt, Human
cugggcgcucagcagccccugg

SEQ ID NO: 676975 - RNA, 25 nt, Human
cuuuacaguugaugcacauauuagc

SEQ ID NO: 676976 - RNA, 19 nt, Human
gaaaacagcuggagggagc

SEQ ID NO: 676977 - RNA, 24 nt, Human
gaaaacagcuggagggagcucagg

SEQ ID NO: 676978 - RNA, 25 nt, Human
gaaaacagcuggagggagcucaggc

SEQ ID NO: 676979 - RNA, 24 nt, Human
gaccucaagugaucugcccaccuu

SEQ ID NO: 676980 - RNA, 20 nt, Human
gagaugggguuucaccaugu

SEQ ID NO: 676981 - RNA, 25 nt, Human
gagaugggguuucaccauguugggu

SEQ ID NO: 676982 - RNA, 23 nt, Human
gaguacacacaacaauucacccc

SEQ ID NO: 676983 - RNA, 25 nt, Human
gaguagcugggauuacaggaaugug

SEQ ID NO: 676984 - RNA, 18 nt, Human
gauuacaggaaugugcca

SEQ ID NO: 676985 - RNA, 18 nt, Human
gauuauagguguaagcca

SEQ ID NO: 676986 - RNA, 20 nt, Human
gauuauagguguaagccacu

SEQ ID NO: 676987 - RNA, 19 nt, Human
gccaaaaaguuaauagaaa

SEQ ID NO: 676988 - RNA, 28 nt, Human
gcccggcuaauguuuguauuuuuagaag

SEQ ID NO: 676989 - RNA, 21 nt, Human
gccuaggcuggagugcagugg

SEQ ID NO: 676990 - RNA, 23 nt, Human
gccuaggcuggagugcaguggca

SEQ ID NO: 676991 - RNA, 20 nt, Human
gccucagccucccgaguagc

SEQ ID NO: 676992 - RNA, 24 nt, Human
gcgaaucuccugccucagccuccc

SEQ ID NO: 676993 - RNA, 19 nt, Human
gcgaggcgcgaggcacgag

SEQ ID NO: 676994 - RNA, 23 nt, Human
gcgcgcgggcccggcggggacgu

SEQ ID NO: 676995 - RNA, 19 nt, Human
gcgcggagccggcguggag

SEQ ID NO: 676996 - RNA, 21 nt, Human
gcgcugccgguguccgcuggg

SEQ ID NO: 676997 - RNA, 18 nt, Human
gcggcgcgccggagccgg

SEQ ID NO: 676998 - RNA, 19 nt, Human
gcuggagugcaguggcaca

SEQ ID NO: 676999 - RNA, 23 nt, Human
gcuggucgcgaacuccugaccuc

SEQ ID NO: 677000 - RNA, 22 nt, Human
ggagccggcguggagagcgcag

SEQ ID NO: 677001 - RNA, 19 nt, Human
ggauuauagguguaagcca

SEQ ID NO: 677002 - RNA, 24 nt, Human
ggcuggucgcgaacuccugaccuc

SEQ ID NO: 677003 - RNA, 18 nt, Human
gggguuucaccauguugg

SEQ ID NO: 677004 - RNA, 22 nt, Human
ggguuucaccauguuggguagg

SEQ ID NO: 677005 - RNA, 22 nt, Human
guagcugggauuacaggaaugu

SEQ ID NO: 677006 - RNA, 23 nt, Human
uaaaauaacccaaccccucaaau

SEQ ID NO: 677007 - RNA, 23 nt, Human
uaagagacacauuauuauaccac

SEQ ID NO: 677008 - RNA, 26 nt, Human
uaagguagaauuuuuucacagcuaua

SEQ ID NO: 677009 - RNA, 22 nt, Human
uaaguggaaucacuuacaucua

SEQ ID NO: 677010 - RNA, 23 nt, Human
uaaguuacacauguucaaaaguu

SEQ ID NO: 677011 - RNA, 24 nt, Human
uaauguuuguauuuuuagaagaga

SEQ ID NO: 677012 - RNA, 23 nt, Human
uacaggaaugugccaccacgccc

SEQ ID NO: 677013 - RNA, 24 nt, Human
uagaagagaugggguuucaccaug

SEQ ID NO: 677014 - RNA, 21 nt, Human
uaguuuacugaaagcuuguuu

SEQ ID NO: 677015 - RNA, 20 nt, Human
uauaauguguacauucuguu

SEQ ID NO: 677016 - RNA, 23 nt, Human
uaugcaaacaugaaauaaaccac

SEQ ID NO: 677017 - RNA, 24 nt, Human
ucacucugucgccuaggcuggagu

SEQ ID NO: 677018 - RNA, 24 nt, Human
ucacugcaaccucugccucccggg

SEQ ID NO: 677019 - RNA, 25 nt, Human
ucacugcaaccucugccucccgggu

SEQ ID NO: 677020 - RNA, 18 nt, Human
ucagaggugccccaccug

SEQ ID NO: 677021 - RNA, 21 nt, Human
ucagcagccccuggagcgcgg

SEQ ID NO: 677022 - RNA, 20 nt, Human
ucagccucccgaguagcugg

SEQ ID NO: 677023 - RNA, 21 nt, Human
ucaggcccgcgucgaccgcgc

SEQ ID NO: 677024 - RNA, 23 nt, Human
ucccaaauugcugggauuauagg

SEQ ID NO: 677025 - RNA, 18 nt, Human
ucccgaguagcugggauu

SEQ ID NO: 677026 - RNA, 24 nt, Human
ucccggguucaggcgaaucuccug

SEQ ID NO: 677027 - RNA, 24 nt, Human
ucgccuaggcuggagugcaguggc

SEQ ID NO: 677028 - RNA, 23 nt, Human
ucucacucugucgccuaggcugg

SEQ ID NO: 677029 - RNA, 24 nt, Human
ucucacucugucgccuaggcugga

SEQ ID NO: 677030 - RNA, 24 nt, Human
ucuccugccucagccucccgagua

SEQ ID NO: 677031 - RNA, 24 nt, Human
ucugucgccuaggcuggagugcag

SEQ ID NO: 677032 - RNA, 19 nt, Human
ugaaaacagcuggagggag

SEQ ID NO: 677033 - RNA, 20 nt, Human
ugaaaaguaacuaaguuaca

SEQ ID NO: 677034 - RNA, 22 nt, Human
ugaagcaaaaccacuuagaaac

SEQ ID NO: 677035 - RNA, 18 nt, Human
ugaccucaagugaucugc

SEQ ID NO: 677036 - RNA, 20 nt, Human
ugagaaacaaugaacucccc

SEQ ID NO: 677037 - RNA, 22 nt, Human
ugagauggagucucacucuguc

SEQ ID NO: 677038 - RNA, 24 nt, Human
ugaguacacacaacaauucaccaa

SEQ ID NO: 677039 - RNA, 24 nt, Human
ugaucugcccaccuuggccuccca

SEQ ID NO: 677040 - RNA, 20 nt, Human
ugcaaaacagaacaaaaagc

SEQ ID NO: 677041 - RNA, 24 nt, Human
ugcaaaacagaacaaaaagcuuaa

SEQ ID NO: 677042 - RNA, 24 nt, Human
ugccucagccucccgaguagcugg

SEQ ID NO: 677043 - RNA, 23 nt, Human
uggagugcaguggcacaaucucg

SEQ ID NO: 677044 - RNA, 24 nt, Human
uggagugcaguggcacaaucucgg

SEQ ID NO: 677045 - RNA, 24 nt, Human
uggcacaaucucggcucacugcaa

SEQ ID NO: 677046 - RNA, 22 nt, Human
ugggaaagauguucagaugcag

SEQ ID NO: 677047 - RNA, 18 nt, Human
ugggauuacaggaaugug

SEQ ID NO: 677048 - RNA, 22 nt, Human
ugggauuacaggaaugugccac

SEQ ID NO: 677049 - RNA, 24 nt, Human
ugggauuacaggaaugugccacca

SEQ ID NO: 677050 - RNA, 18 nt, Human
ugggauuauagguguaag

SEQ ID NO: 677051 - RNA, 19 nt, Human
ugggauuauagguguaagc

SEQ ID NO: 677052 - RNA, 21 nt, Human
ugggauuauagguguaagcca

SEQ ID NO: 677053 - RNA, 22 nt, Human
ugggauuauagguguaagccac

SEQ ID NO: 677054 - RNA, 24 nt, Human
ugggguuucaccauguuggguagg

SEQ ID NO: 677055 - RNA, 24 nt, Human
uggguaggcuggucgcgaacuccu

SEQ ID NO: 677056 - RNA, 24 nt, Human
uguauguccaaaauaucagugaaa

SEQ ID NO: 677057 - RNA, 21 nt, Human
uguccaaaauaucagugaaau

SEQ ID NO: 677058 - RNA, 20 nt, Human
ugucgccuaggcuggagugc

SEQ ID NO: 677059 - RNA, 23 nt, Human
uguuuguauuuuuagaagagaug

SEQ ID NO: 677060 - RNA, 18 nt, Human
uuagaagagaugggguuu

SEQ ID NO: 677061 - RNA, 24 nt, Human
uuagaagagaugggguuucaccau

SEQ ID NO: 677062 - RNA, 20 nt, Human
uuagagguaaaguuugggag

SEQ ID NO: 677063 - RNA, 20 nt, Human
uuauuauucuaauugucaac

SEQ ID NO: 677064 - RNA, 22 nt, Human
uucacaacauaaaaacaaaaau

SEQ ID NO: 677065 - RNA, 20 nt, Human
uuccuccacccccacuuuuu

SEQ ID NO: 677066 - RNA, 20 nt, Human
uucuguuuugguccuauauc

SEQ ID NO: 677067 - RNA, 19 nt, Human
uucuuccauuacaaaacuc

SEQ ID NO: 677068 - RNA, 24 nt, Human
uugaagcaaaaccacuuagaaacc

SEQ ID NO: 677069 - RNA, 21 nt, Human
uuucaccauguuggguaggcu

SEQ ID NO: 677070 - RNA, 26 nt, Human
uuuuccuccacccccacuuuuuuuuu

SEQ ID NO: 677071 - RNA, 22 nt, Human
uuuugaucucagaaggcgccuu

SEQ ID NO: 677072 - RNA, 24 nt, Human
uuuuuagaagagaugggguuucac

SEQ ID NO: 677073 - RNA, 19 nt, Human
aacuacaaagcagagaaac

SEQ ID NO: 677074 - RNA, 22 nt, Human
aagaauacaaaaaucaaaucug

SEQ ID NO: 677075 - RNA, 22 nt, Human
aagcagaaauuuuauuuccaag

SEQ ID NO: 677076 - RNA, 24 nt, Human
aaguacagccacaacuacaaagca

SEQ ID NO: 677077 - RNA, 21 nt, Human
aauaucucuaaaaguuaggga

SEQ ID NO: 677078 - RNA, 20 nt, Human
acaaaaaaaacaagcaguua

SEQ ID NO: 677079 - RNA, 21 nt, Human
acaaagcagagaaacguaaga

SEQ ID NO: 677080 - RNA, 22 nt, Human
acaaagcagagaaacguaagaa

SEQ ID NO: 677081 - RNA, 19 nt, Human
agcaaacuucucucgaguc

SEQ ID NO: 677082 - RNA, 22 nt, Human
agguauagaaaucuuaguaacu

SEQ ID NO: 677083 - RNA, 20 nt, Human
aggugcauuuugguauguuu

SEQ ID NO: 677084 - RNA, 22 nt, Human
aucaaaucugcuucauuuauau

SEQ ID NO: 677085 - RNA, 21 nt, Human
caaagcagagaaacguaagaa

SEQ ID NO: 677086 - RNA, 19 nt, Human
caaauuaaaucaaaggcac

SEQ ID NO: 677087 - RNA, 21 nt, Human
caggccacaggaaagggcuga

SEQ ID NO: 677088 - RNA, 24 nt, Human
caguuguuuaaauaaacaaaacua

SEQ ID NO: 677089 - RNA, 22 nt, Human
ccacaacuacaaagcagagaaa

SEQ ID NO: 677090 - RNA, 25 nt, Human
ccucccagcaauuuguacuuucugg

SEQ ID NO: 677091 - RNA, 23 nt, Human
cuuugugcuugaaggcauuccuc

SEQ ID NO: 677092 - RNA, 20 nt, Human
ggaaaaguguuuucuugaga

SEQ ID NO: 677093 - RNA, 25 nt, Human
gguaagguuuuuguuuaucuuaugu

SEQ ID NO: 677094 - RNA, 20 nt, Human
uaaaaauaaagcaaucuucc

SEQ ID NO: 677095 - RNA, 22 nt, Human
uaaaaauaaagcaaucuuccca

SEQ ID NO: 677096 - RNA, 20 nt, Human
uaaacaaaacuauuuuccuu

SEQ ID NO: 677097 - RNA, 18 nt, Human
uaaauaacuuccaggaac

SEQ ID NO: 677098 - RNA, 19 nt, Human
uaacuuccaggaacaacag

SEQ ID NO: 677099 - RNA, 23 nt, Human
uaacuuccaggaacaacaguuua

SEQ ID NO: 677100 - RNA, 20 nt, Human
uacaaagcagagaaacguaa

SEQ ID NO: 677101 - RNA, 25 nt, Human
uacaaagcagagaaacguaagaaua

SEQ ID NO: 677102 - RNA, 23 nt, Human
uacagccacaacuacaaagcaga

SEQ ID NO: 677103 - RNA, 20 nt, Human
uauaaaaguacuugcacaaa

SEQ ID NO: 677104 - RNA, 24 nt, Human
uaucucuaaaaguuagggaaaagu

SEQ ID NO: 677105 - RNA, 23 nt, Human
uauucuuccucccagcaauuugu

SEQ ID NO: 677106 - RNA, 22 nt, Human
uccuucacccaguuuucucacu

SEQ ID NO: 677107 - RNA, 25 nt, Human
ucuauuccuucacccaguuuucuca

SEQ ID NO: 677108 - RNA, 23 nt, Human
uggaauaaauaacuuccaggaac

SEQ ID NO: 677109 - RNA, 22 nt, Human
uuagggaaaaguguuuucuuga

SEQ ID NO: 677110 - RNA, 18 nt, Human
uuccagguauagaaaucu

SEQ ID NO: 677111 - RNA, 21 nt, Human
uuugcuaagaaucugcuccca

SEQ ID NO: 677112 - RNA, 18 nt, Human
uuuuuuuuuuuuuuuuug

SEQ ID NO: 677113 - RNA, 22 nt, Human
aacuaguucuuccacuuaggau

SEQ ID NO: 677114 - RNA, 19 nt, Human
aagcaucaagcaauauacu

SEQ ID NO: 677115 - RNA, 18 nt, Human
augcucaaguaauguucu

SEQ ID NO: 677116 - RNA, 19 nt, Human
auuguacaucugauacucu

SEQ ID NO: 677117 - RNA, 21 nt, Human
caacccaggaggccugcccgg

SEQ ID NO: 677118 - RNA, 23 nt, Human
caagacaaaacuuuauuugaagc

SEQ ID NO: 677119 - RNA, 19 nt, Human
caaguaauguucuuauuuc

SEQ ID NO: 677120 - RNA, 19 nt, Human
cagcagggaugcuggccac

SEQ ID NO: 677121 - RNA, 19 nt, Human
caggaugugacugcagccc

SEQ ID NO: 677122 - RNA, 19 nt, Human
cccugcaacccaggaggcc

SEQ ID NO: 677123 - RNA, 19 nt, Human
ccgagggcuuggcuuucuc

SEQ ID NO: 677124 - RNA, 19 nt, Human
gcuuggcuuucuccgggac

SEQ ID NO: 677125 - RNA, 18 nt, Human
gcuuuuauacauaacccu

SEQ ID NO: 677126 - RNA, 26 nt, Human
ggaaaacuaaaacaacuaguucuucc

SEQ ID NO: 677127 - RNA, 19 nt, Human
uaaaaaagacugcauagug

SEQ ID NO: 677128 - RNA, 19 nt, Human
uccaagcagcuucccgcug

SEQ ID NO: 677129 - RNA, 23 nt, Human
uccccagcuccccgagggcuugg

SEQ ID NO: 677130 - RNA, 23 nt, Human
uccccagcuccccgagggcuugg

SEQ ID NO: 677131 - RNA, 24 nt, Human
uccccagcuccccgagggcuuggc

SEQ ID NO: 677132 - RNA, 25 nt, Human
uccccgagggcuuggcuuucuccgg

SEQ ID NO: 677133 - RNA, 19 nt, Human
uccuaggaccugagaacuc

SEQ ID NO: 677134 - RNA, 18 nt, Human
ucuccgggacgcuuguca

SEQ ID NO: 677135 - RNA, 21 nt, Human
ugaaggccuggcccgccgccc

SEQ ID NO: 677136 - RNA, 23 nt, Human
ugccccagcuuccuaggaccuga

SEQ ID NO: 677137 - RNA, 19 nt, Human
uggcagcggagccgcugga

SEQ ID NO: 677138 - RNA, 18 nt, Human
uggcccgccgcccacccg

SEQ ID NO: 677139 - RNA, 19 nt, Human
ugggaaaacuaaaacaacu

SEQ ID NO: 677140 - RNA, 24 nt, Human
uuccauaauuguacaucugauacu

SEQ ID NO: 677141 - RNA, 24 nt, Human
uuuauacauaacccuaucuauaug

SEQ ID NO: 677142 - RNA, 21 nt, Human
uuuuauacauaacccuaucua

SEQ ID NO: 677143 - RNA, 19 nt, Human
uuuucucaagucccugcaa

SEQ ID NO: 677144 - RNA, 20 nt, Human
uuuuuuuuuuuuuuucccaa

SEQ ID NO: 677145 - RNA, 22 nt, Human
uuuuuuuuuuuuuuuucccaag

SEQ ID NO: 677146 - RNA, 21 nt, Human
aaaaccuucugccugaaaugg

SEQ ID NO: 677147 - RNA, 20 nt, Human
accugaaggaugaaggaugc

SEQ ID NO: 677148 - RNA, 23 nt, Human
acggggcccugcuguggguggag

SEQ ID NO: 677149 - RNA, 19 nt, Human
agacugagagcaagaaccu

SEQ ID NO: 677150 - RNA, 22 nt, Human
agauaggugagggugggccuug

SEQ ID NO: 677151 - RNA, 23 nt, Human
agccacaagcggcaguagcagcc

SEQ ID NO: 677152 - RNA, 19 nt, Human
agggaugggaugcaaggag

SEQ ID NO: 677153 - RNA, 19 nt, Human
caaagggugccucauaucu

SEQ ID NO: 677154 - RNA, 19 nt, Human
caaauggcuuuacccuccc

SEQ ID NO: 677155 - RNA, 21 nt, Human
ccacccaguagggaguugcag

SEQ ID NO: 677156 - RNA, 22 nt, Human
ccaggagagggaaaagggagga

SEQ ID NO: 677157 - RNA, 20 nt, Human
ccaguagggaguugcagcug

SEQ ID NO: 677158 - RNA, 22 nt, Human
ccccuggggagggccaggccag

SEQ ID NO: 677159 - RNA, 22 nt, Human
ccucacauggucaggcaagggu

SEQ ID NO: 677160 - RNA, 18 nt, Human
ccuggcccaucccucucc

SEQ ID NO: 677161 - RNA, 23 nt, Human
cucacaacaauuacugaccuaag

SEQ ID NO: 677162 - RNA, 20 nt, Human
cucuggggugcuuggggucg

SEQ ID NO: 677163 - RNA, 21 nt, Human
cugaagccacaagcggcagua

SEQ ID NO: 677164 - RNA, 18 nt, Human
gagagggaaaagggagga

SEQ ID NO: 677165 - RNA, 23 nt, Human
gaguugcagcugaaaguaucuga

SEQ ID NO: 677166 - RNA, 22 nt, Human
gaugcuagaaggagcugcucag

SEQ ID NO: 677167 - RNA, 19 nt, Human
gcaaggagccuaaggggcu

SEQ ID NO: 677168 - RNA, 22 nt, Human
gcucacaacaauuacugaccua

SEQ ID NO: 677169 - RNA, 18 nt, Human
ggaggccccuggggaggg

SEQ ID NO: 677170 - RNA, 19 nt, Human
ggaggccccuggggagggc

SEQ ID NO: 677171 - RNA, 24 nt, Human
ggcuuuacccucccaguagcucca

SEQ ID NO: 677172 - RNA, 18 nt, Human
gucuggauggcugguacc

SEQ ID NO: 677173 - RNA, 21 nt, Human
uacugaccuaaggaagggccc

SEQ ID NO: 677174 - RNA, 18 nt, Human
uagaaggagcugcucaga

SEQ ID NO: 677175 - RNA, 19 nt, Human
uagaaggagcugcucagau

SEQ ID NO: 677176 - RNA, 21 nt, Human
ucugccugaaaugggugcccc

SEQ ID NO: 677177 - RNA, 23 nt, Human
ugacggggcccugcugugggugg

SEQ ID NO: 677178 - RNA, 18 nt, Human
ugagagcaagaaccuggc

SEQ ID NO: 677179 - RNA, 21 nt, Human
ugagagcaagaaccuggccca

SEQ ID NO: 677180 - RNA, 22 nt, Human
uggaggguaccaaaaccuucug

SEQ ID NO: 677181 - RNA, 24 nt, Human
uggcuuuacccucccaguagcucc

SEQ ID NO: 677182 - RNA, 18 nt, Human
uguggguggagcaaaggg

SEQ ID NO: 677183 - RNA, 18 nt, Human
uuuuuuuuggggcucugg

SEQ ID NO: 677184 - RNA, 19 nt, Human
uuuuuuuuuuuuggggcuc

SEQ ID NO: 677185 - RNA, 23 nt, Human
uuuuuuuuuuuuuuuuuggggcu

SEQ ID NO: 677186 - RNA, 25 nt, Human
aaaaaaaacaaaagaaaaccauucc

SEQ ID NO: 677187 - RNA, 25 nt, Human
aaaaaaacaaaagaaaaccauucca

SEQ ID NO: 677188 - RNA, 23 nt, Human
aaaacaacaacaacaacaaaaaa

SEQ ID NO: 677189 - RNA, 23 nt, Human
aaaaugaaauugaaugccacgaa

SEQ ID NO: 677190 - RNA, 19 nt, Human
aaacaaaagaaaaccauuc

SEQ ID NO: 677191 - RNA, 20 nt, Human
aaagaaaaccauuccaaucc

SEQ ID NO: 677192 - RNA, 25 nt, Human
aacaacaacaacaaaaaaaaaacaa

SEQ ID NO: 677193 - RNA, 23 nt, Human
aacaacaacaacaacaaaaaaaa

SEQ ID NO: 677194 - RNA, 19 nt, Human
aacauggugaaaccccguc

SEQ ID NO: 677195 - RNA, 20 nt, Human
aacauggugaaaccccgucu

SEQ ID NO: 677196 - RNA, 21 nt, Human
aacauggugaaaccccgucuu

SEQ ID NO: 677197 - RNA, 24 nt, Human
aaucgcuugaacccaggaggugga

SEQ ID NO: 677198 - RNA, 24 nt, Human
aaugcacaccaaugcucagaugac

SEQ ID NO: 677199 - RNA, 23 nt, Human
aaugcucagaugacuugggggca

SEQ ID NO: 677200 - RNA, 27 nt, Human
acaacaaaaaaaaaacaaaagaaaacc

SEQ ID NO: 677201 - RNA, 24 nt, Human
acaacaacaaaaaaaaaacaaaag

SEQ ID NO: 677202 - RNA, 26 nt, Human
acaacaacaacaaaaaaaaaacaaaa

SEQ ID NO: 677203 - RNA, 26 nt, Human
acaacaacaacaacaaaaaaaaaaca

SEQ ID NO: 677204 - RNA, 30 nt, Human
acaacaacaacaacaaaaaaaaaacaaaag

SEQ ID NO: 677205 - RNA, 19 nt, Human
acaagggacauccaccacg

SEQ ID NO: 677206 - RNA, 24 nt, Human
acagagcgagacuccaucucaaaa

SEQ ID NO: 677207 - RNA, 23 nt, Human
accaacauggugaaaccccgucu

SEQ ID NO: 677208 - RNA, 24 nt, Human
accccgucuuuacuaaaaauacaa

SEQ ID NO: 677209 - RNA, 19 nt, Human
acugaaacaagggacaucc

SEQ ID NO: 677210 - RNA, 22 nt, Human
acugcagcccacaauggaacuu

SEQ ID NO: 677211 - RNA, 19 nt, Human
agaaaacagauggaaacau

SEQ ID NO: 677212 - RNA, 22 nt, Human
agcaugcauggucucuacaggg

SEQ ID NO: 677213 - RNA, 24 nt, Human
agccugaccaacauggugaaaccc

SEQ ID NO: 677214 - RNA, 24 nt, Human
agccugggugacagagcgagacuc

SEQ ID NO: 677215 - RNA, 24 nt, Human
agcgcuuugggaggccgaggcggg

SEQ ID NO: 677216 - RNA, 23 nt, Human
agcugggugugguggcgcgugcc

SEQ ID NO: 677217 - RNA, 19 nt, Human
aggaaaggagaugaaaacg

SEQ ID NO: 677218 - RNA, 19 nt, Human
aggagccaaaagaggaggg

SEQ ID NO: 677219 - RNA, 20 nt, Human
aggaguuugagaccagccug

SEQ ID NO: 677220 - RNA, 23 nt, Human
aggcaggagaaucgcuugaaccc

SEQ ID NO: 677221 - RNA, 24 nt, Human
aggcaggagaaucgcuugaaccca

SEQ ID NO: 677222 - RNA, 21 nt, Human
aggccgaggcggguggaucac

SEQ ID NO: 677223 - RNA, 24 nt, Human
aggcggguggaucacgaggucagg

SEQ ID NO: 677224 - RNA, 20 nt, Human
aggcugaggcaggagaaucg

SEQ ID NO: 677225 - RNA, 24 nt, Human
aggcugaggcaggagaaucgcuug

SEQ ID NO: 677226 - RNA, 23 nt, Human
agguccuuauauuacugcagccc

SEQ ID NO: 677227 - RNA, 20 nt, Human
agguggaggucgcagugagc

SEQ ID NO: 677228 - RNA, 24 nt, Human
agguggaggucgcagugagcugag

SEQ ID NO: 677229 - RNA, 20 nt, Human
aguaggagccaaaagaggag

SEQ ID NO: 677230 - RNA, 21 nt, Human
aucacgaggucaggaguuuga

SEQ ID NO: 677231 - RNA, 21 nt, Human
auugcacuccagccuggguga

SEQ ID NO: 677232 - RNA, 24 nt, Human
auugcacuccagccugggugacag

SEQ ID NO: 677233 - RNA, 22 nt, Human
caaaacaacaacaacaacaaaa

SEQ ID NO: 677234 - RNA, 24 nt, Human
caacaaaaaaaaaacaaaagaaaa

SEQ ID NO: 677235 - RNA, 21 nt, Human
caacauggugaaaccccgucu

SEQ ID NO: 677236 - RNA, 24 nt, Human
caacauggugaaaccccgucuuua

SEQ ID NO: 677237 - RNA, 23 nt, Human
caagggacauccaccacggccca

SEQ ID NO: 677238 - RNA, 19 nt, Human
caccacggcccacagccug

SEQ ID NO: 677239 - RNA, 21 nt, Human
caccaugccucacuccugcag

SEQ ID NO: 677240 - RNA, 24 nt, Human
cacgaggucaggaguuugagacca

SEQ ID NO: 677241 - RNA, 24 nt, Human
cacgccuguaaucccagcgcuuug

SEQ ID NO: 677242 - RNA, 24 nt, Human
cacggccgggugugguggcucacg

SEQ ID NO: 677243 - RNA, 22 nt, Human
cacuccagccugggugacagag

SEQ ID NO: 677244 - RNA, 24 nt, Human
cacuccagccugggugacagagcg

SEQ ID NO: 677245 - RNA, 21 nt, Human
cacugaaacaagggacaucca

SEQ ID NO: 677246 - RNA, 21 nt, Human
cagcccacaauggaacuacug

SEQ ID NO: 677247 - RNA, 22 nt, Human
cagcgcuuugggaggccgaggc

SEQ ID NO: 677248 - RNA, 24 nt, Human
cagcgcuuugggaggccgaggcgg

SEQ ID NO: 677249 - RNA, 24 nt, Human
cagcuacucaggaggcugaggcag

SEQ ID NO: 677250 - RNA, 18 nt, Human
cagcugcuuucuccagga

SEQ ID NO: 677251 - RNA, 29 nt, Human
caggagguggaggucgcagugacaacggu

SEQ ID NO: 677252 - RNA, 22 nt, Human
caucucaaaacaacaacaacaa

SEQ ID NO: 677253 - RNA, 23 nt, Human
caucucaaaacaacaacaacaac

SEQ ID NO: 677254 - RNA, 18 nt, Human
caugcauggucucuacag

SEQ ID NO: 677255 - RNA, 19 nt, Human
cauugcacuccagccuggg

SEQ ID NO: 677256 - RNA, 21 nt, Human
cauugcacuccagccugggug

SEQ ID NO: 677257 - RNA, 22 nt, Human
cauugcacuccagccuggguga

SEQ ID NO: 677258 - RNA, 24 nt, Human
cauugcacuccagccugggugaca

SEQ ID NO: 677259 - RNA, 25 nt, Human
cauugcacuccagccugggugacag

SEQ ID NO: 677260 - RNA, 21 nt, Human
ccaauaaugaaaauaacauga

SEQ ID NO: 677261 - RNA, 26 nt, Human
ccacagccugggcgccacggccccag

SEQ ID NO: 677262 - RNA, 19 nt, Human
ccagacuuacuuuuacaug

SEQ ID NO: 677263 - RNA, 22 nt, Human
ccaggaggauaugcuaagaaaa

SEQ ID NO: 677264 - RNA, 18 nt, Human
ccaucucaaaacaacaac

SEQ ID NO: 677265 - RNA, 20 nt, Human
ccauugcacuccagccuggg

SEQ ID NO: 677266 - RNA, 21 nt, Human
ccauugcacuccagccugggu

SEQ ID NO: 677267 - RNA, 21 nt, Human
ccauugcacuccagccugggu

SEQ ID NO: 677268 - RNA, 22 nt, Human
ccauugcacuccagccugggug

SEQ ID NO: 677269 - RNA, 23 nt, Human
ccauugcacuccagccuggguga

SEQ ID NO: 677270 - RNA, 24 nt, Human
ccauugcacuccagccugggugac

SEQ ID NO: 677271 - RNA, 21 nt, Human
cccacaauggaacuacugagu

SEQ ID NO: 677272 - RNA, 21 nt, Human
ccgcacccacaggucugccac

SEQ ID NO: 677273 - RNA, 23 nt, Human
ccuacuaaaaccccagcgggccc

SEQ ID NO: 677274 - RNA, 21 nt, Human
ccuaugaucccagcuacucag

SEQ ID NO: 677275 - RNA, 22 nt, Human
ccuaugaucccagcuacucagg

SEQ ID NO: 677276 - RNA, 23 nt, Human
ccugaccaacauggugaaacccc

SEQ ID NO: 677277 - RNA, 24 nt, Human
ccugaccaacauggugaaaccccg

SEQ ID NO: 677278 - RNA, 22 nt, Human
ccugggugacagagcgagacuc

SEQ ID NO: 677279 - RNA, 19 nt, Human
cgaggccgggagggcggag

SEQ ID NO: 677280 - RNA, 24 nt, Human
cgccuguaaucccagcgcuuuggg

SEQ ID NO: 677281 - RNA, 19 nt, Human
cuaaaaccccagcgggccc

SEQ ID NO: 677282 - RNA, 22 nt, Human
cuacuaaaaccccagcgggccc

SEQ ID NO: 677283 - RNA, 25 nt, Human
cucaaaacaacaacaacaacaaaaa

SEQ ID NO: 677284 - RNA, 20 nt, Human
cucacgccuguaaucccagc

SEQ ID NO: 677285 - RNA, 24 nt, Human
cucacgccuguaaucccagcgcuu

SEQ ID NO: 677286 - RNA, 18 nt, Human
gaaccucugcagcugcuu

SEQ ID NO: 677287 - RNA, 22 nt, Human
gaagagguggcauuuggagagg

SEQ ID NO: 677288 - RNA, 23 nt, Human
gagaaucgcuugaacccaggagg

SEQ ID NO: 677289 - RNA, 18 nt, Human
gagcaggaagagguggca

SEQ ID NO: 677290 - RNA, 21 nt, Human
gagcaggaagagguggcauuu

SEQ ID NO: 677291 - RNA, 23 nt, Human
gaggcggguggaucacgagguca

SEQ ID NO: 677292 - RNA, 23 nt, Human
gaggucacgccauugcacuccag

SEQ ID NO: 677293 - RNA, 23 nt, Human
gaguaggagccaaaagaggaggg

SEQ ID NO: 677294 - RNA, 21 nt, Human
gaucacgaggucaggaguuug

SEQ ID NO: 677295 - RNA, 22 nt, Human
gaucacgaggucaggaguuuga

SEQ ID NO: 677296 - RNA, 24 nt, Human
gaucacgaggucaggaguuugaga

SEQ ID NO: 677297 - RNA, 24 nt, Human
gcacuccagccugggugacagagc

SEQ ID NO: 677298 - RNA, 19 nt, Human
gcagcugcuuucuccagga

SEQ ID NO: 677299 - RNA, 22 nt, Human
gcaggagaaucgcuugaaccca

SEQ ID NO: 677300 - RNA, 19 nt, Human
gccauugcacuccagccug

SEQ ID NO: 677301 - RNA, 24 nt, Human
gccauugcacuccagccuggguga

SEQ ID NO: 677302 - RNA, 23 nt, Human
gcccacagccugggcgccacggc

SEQ ID NO: 677303 - RNA, 23 nt, Human
gcgggggugcccuucgcgccccg

SEQ ID NO: 677304 - RNA, 21 nt, Human
ggagccaaaagaggagggagc

SEQ ID NO: 677305 - RNA, 20 nt, Human
ggaggucgcagugagcugag

SEQ ID NO: 677306 - RNA, 24 nt, Human
ggaggucgcagugagcugagguca

SEQ ID NO: 677307 - RNA, 20 nt, Human
ggaggucgcagugagcuggc

SEQ ID NO: 677308 - RNA, 23 nt, Human
ggaucacgaggucaggaguuuga

SEQ ID NO: 677309 - RNA, 21 nt, Human
ggcauuuggagaggggagacc

SEQ ID NO: 677310 - RNA, 22 nt, Human
gggaaggggcugcccuacuaaa

SEQ ID NO: 677311 - RNA, 21 nt, Human
gggcagggauggguguugguc

SEQ ID NO: 677312 - RNA, 23 nt, Human
gggcgcgugcuggaggcgggggu

SEQ ID NO: 677313 - RNA, 18 nt, Human
gggcggagggcgcgugcu

SEQ ID NO: 677314 - RNA, 21 nt, Human
gggcugcccuacuaaaacccc

SEQ ID NO: 677315 - RNA, 19 nt, Human
gguggaggucgcagugagc

SEQ ID NO: 677316 - RNA, 23 nt, Human
gguggaucacgaggucaggaguu

SEQ ID NO: 677317 - RNA, 24 nt, Human
gguggcucacgccuguaaucccag

SEQ ID NO: 677318 - RNA, 23 nt, Human
ggugugguggcucacgccuguaa

SEQ ID NO: 677319 - RNA, 22 nt, Human
gguuguugucuuuuuacuagga

SEQ ID NO: 677320 - RNA, 24 nt, Human
gucacgccauugcacuccagccug

SEQ ID NO: 677321 - RNA, 20 nt, Human
guggaggucgcagugagcug

SEQ ID NO: 677322 - RNA, 23 nt, Human
guggaucacgaggucaggaguuu

SEQ ID NO: 677323 - RNA, 25 nt, Human
uaaaaccccagcgggcccagugcug

SEQ ID NO: 677324 - RNA, 21 nt, Human
uaaauaaauuauccacugaaa

SEQ ID NO: 677325 - RNA, 22 nt, Human
uaagaaaaccauuccacggccg

SEQ ID NO: 677326 - RNA, 22 nt, Human
uaaguccagacuuacuuuuaca

SEQ ID NO: 677327 - RNA, 25 nt, Human
uaccuuaaugcacaccaaugcucag

SEQ ID NO: 677328 - RNA, 18 nt, Human
uacuaaaaauacaaaaaa

SEQ ID NO: 677329 - RNA, 21 nt, Human
uacugaguaggagccaaaaga

SEQ ID NO: 677330 - RNA, 23 nt, Human
ucaaaacaacaacaacaacaaaa

SEQ ID NO: 677331 - RNA, 24 nt, Human
ucacgaggucaggaguuugagacc

SEQ ID NO: 677332 - RNA, 23 nt, Human
ucacgccauugcacuccagccug

SEQ ID NO: 677333 - RNA, 22 nt, Human
ucacgccuguaaucccagcgcu

SEQ ID NO: 677334 - RNA, 23 nt, Human
uccagccugggugacagagcgag

SEQ ID NO: 677335 - RNA, 24 nt, Human
uccagccugggugacagagcgaga

SEQ ID NO: 677336 - RNA, 20 nt, Human
ucgcagugagcugaggucac

SEQ ID NO: 677337 - RNA, 21 nt, Human
ucgcagugagcugaggucacg

SEQ ID NO: 677338 - RNA, 24 nt, Human
ucgcuugaacccaggagguggagg

SEQ ID NO: 677339 - RNA, 22 nt, Human
ucugcagcugcuuucuccagga

SEQ ID NO: 677340 - RNA, 23 nt, Human
ucugcagcugcuuucuccaggaa

SEQ ID NO: 677341 - RNA, 24 nt, Human
ugaccaacauggugaaaccccguc

SEQ ID NO: 677342 - RNA, 23 nt, Human
ugagaccagccugaccaacaugg

SEQ ID NO: 677343 - RNA, 24 nt, Human
ugagaccagccugaccaacauggu

SEQ ID NO: 677344 - RNA, 22 nt, Human
ugagcugaggucacgccauugc

SEQ ID NO: 677345 - RNA, 20 nt, Human
ugaggcaggagaaucgcuug

SEQ ID NO: 677346 - RNA, 24 nt, Human
ugaggcaggagaaucgcuugaacc

SEQ ID NO: 677347 - RNA, 25 nt, Human
ugaggcaggagaaucgcuugaaccc

SEQ ID NO: 677348 - RNA, 22 nt, Human
ugaguaccuuaaugcacaccaa

SEQ ID NO: 677349 - RNA, 24 nt, Human
ugcacuccagccugggugacagag

SEQ ID NO: 677350 - RNA, 20 nt, Human
ugcccuacuaaaaccccagc

SEQ ID NO: 677351 - RNA, 18 nt, Human
ugccuaugaucccagcua

SEQ ID NO: 677352 - RNA, 24 nt, Human
ugccuaugaucccagcuacucagg

SEQ ID NO: 677353 - RNA, 21 nt, Human
ugcuaagaaaaccauuccacg

SEQ ID NO: 677354 - RNA, 18 nt, Human
ugcuggaggcgggggugc

SEQ ID NO: 677355 - RNA, 18 nt, Human
uggaggucgcagugagcu

SEQ ID NO: 677356 - RNA, 21 nt, Human
uggaucacgaggucaggaguu

SEQ ID NO: 677357 - RNA, 24 nt, Human
uggcgcgugccuaugaucccagcu

SEQ ID NO: 677358 - RNA, 22 nt, Human
uggcucacgccuguaaucccag

SEQ ID NO: 677359 - RNA, 23 nt, Human
uggcucacgccuguaaucccagc

SEQ ID NO: 677360 - RNA, 24 nt, Human
uggcucacgccuguaaucccagcg

SEQ ID NO: 677361 - RNA, 18 nt, Human
uggcugggcagggauggg

SEQ ID NO: 677362 - RNA, 23 nt, Human
ugggaggccgaggcggguggauc

SEQ ID NO: 677363 - RNA, 24 nt, Human
ugggaggccgaggcggguggauca

SEQ ID NO: 677364 - RNA, 18 nt, Human
ugggugugguggcgcgug

SEQ ID NO: 677365 - RNA, 23 nt, Human
uggucaaaaugcucuaauuugau

SEQ ID NO: 677366 - RNA, 24 nt, Human
ugguggcgcgugccuaugauccca

SEQ ID NO: 677367 - RNA, 24 nt, Human
ugguggcucacgccuguaauccca

SEQ ID NO: 677368 - RNA, 19 nt, Human
uguggguuguugucuuuuu

SEQ ID NO: 677369 - RNA, 22 nt, Human
uuaaugcacaccaaugcucaga

SEQ ID NO: 677370 - RNA, 22 nt, Human
uuacagucaaguugacuucggu

SEQ ID NO: 677371 - RNA, 20 nt, Human
uuagcugggugugguggcgc

SEQ ID NO: 677372 - RNA, 20 nt, Human
uuagcugggugugguggcgc

SEQ ID NO: 677373 - RNA, 24 nt, Human
uuagcugggugugguggcgcgugc

SEQ ID NO: 677374 - RNA, 25 nt, Human
uugggaggccgaggcggguggauca

SEQ ID NO: 677375 - RNA, 18 nt, Human
uuuuuuuuuuuuuuugca

SEQ ID NO: 677376 - RNA, 20 nt, Human
uuuuuuuuuuuuuuugcacu

SEQ ID NO: 677377 - RNA, 23 nt, Human
acuaggagagcaggaguagaagu

SEQ ID NO: 677378 - RNA, 20 nt, Human
auuucuuuuuuggggggaac

SEQ ID NO: 677379 - RNA, 20 nt, Human
cuaaagacuuacuauucugu

SEQ ID NO: 677380 - RNA, 21 nt, Human
cuaaagacuuacuauucuguu

SEQ ID NO: 677381 - RNA, 19 nt, Human
gggaacuaggagagcagga

SEQ ID NO: 677382 - RNA, 19 nt, Human
ugaggaggaugaagugugg

SEQ ID NO: 677383 - RNA, 18 nt, Human
uggccuggagagaaacug

SEQ ID NO: 677384 - RNA, 19 nt, Human
uuauggcacuaaagacuua

SEQ ID NO: 677385 - RNA, 19 nt, Human
uuggggggaacuaggagag

SEQ ID NO: 677386 - RNA, 22 nt, Human
uuggggggaacuaggagagcag

SEQ ID NO: 677387 - RNA, 22 nt, Human
acacagcacccucuugacaccu

SEQ ID NO: 677388 - RNA, 23 nt, Human
ccagcaccugcucacaaugggug

SEQ ID NO: 677389 - RNA, 23 nt, Human
ccucgcccagcaccugcucacaa

SEQ ID NO: 677390 - RNA, 20 nt, Human
ccucgguccagggcacccuc

SEQ ID NO: 677391 - RNA, 26 nt, Human
uaggacacagcacccucuugacaccu

SEQ ID NO: 677392 - RNA, 20 nt, Human
aaaagccacucccauagagu

SEQ ID NO: 677393 - RNA, 18 nt, Human
aacaggaauccuaguuuu

SEQ ID NO: 677394 - RNA, 21 nt, Human
aacccacggagcuccauccuu

SEQ ID NO: 677395 - RNA, 18 nt, Human
aagcggccucuggaaggc

SEQ ID NO: 677396 - RNA, 19 nt, Human
aagggccgucucuaccucc

SEQ ID NO: 677397 - RNA, 22 nt, Human
acaccugaaacugccgaggagu

SEQ ID NO: 677398 - RNA, 20 nt, Human
acacuuguacaaaauacugc

SEQ ID NO: 677399 - RNA, 19 nt, Human
acagaaaguuuuauacaag

SEQ ID NO: 677400 - RNA, 18 nt, Human
acaguugaaaaaggaaau

SEQ ID NO: 677401 - RNA, 20 nt, Human
acuagauuuaaaacagcuug

SEQ ID NO: 677402 - RNA, 20 nt, Human
acugccgaggaguggggccc

SEQ ID NO: 677403 - RNA, 20 nt, Human
agagagcagcuccacagaca

SEQ ID NO: 677404 - RNA, 19 nt, Human
agaugcugauggcuucagc

SEQ ID NO: 677405 - RNA, 18 nt, Human
agaugcugcccugacuug

SEQ ID NO: 677406 - RNA, 22 nt, Human
agcacagaaucaagacaaagca

SEQ ID NO: 677407 - RNA, 18 nt, Human
agccuagucagugaagcc

SEQ ID NO: 677408 - RNA, 22 nt, Human
aggaggagccagaggaggaggu

SEQ ID NO: 677409 - RNA, 19 nt, Human
aggcagacugccccaaugu

SEQ ID NO: 677410 - RNA, 21 nt, Human
aggcagagagccugagcuggg

SEQ ID NO: 677411 - RNA, 18 nt, Human
aggugguuugagagacag

SEQ ID NO: 677412 - RNA, 18 nt, Human
aguagaagacaggugguc

SEQ ID NO: 677413 - RNA, 23 nt, Human
agugagaagacaaaggaacagga

SEQ ID NO: 677414 - RNA, 19 nt, Human
auaaagggcuauagauacc

SEQ ID NO: 677415 - RNA, 23 nt, Human
aucagcuacccccugagguucag

SEQ ID NO: 677416 - RNA, 24 nt, Human
auugcaccacagaugaauuugcua

SEQ ID NO: 677417 - RNA, 24 nt, Human
caaagcacacgagaucccacugca

SEQ ID NO: 677418 - RNA, 25 nt, Human
caaagccccgccucccgggccucuc

SEQ ID NO: 677419 - RNA, 19 nt, Human
caacccccaccgcccagcc

SEQ ID NO: 677420 - RNA, 23 nt, Human
caagacaaagcacacgagauccc

SEQ ID NO: 677421 - RNA, 20 nt, Human
cacacgagaucccacugcac

SEQ ID NO: 677422 - RNA, 21 nt, Human
caccaucucaaagggccgucu

SEQ ID NO: 677423 - RNA, 20 nt, Human
caccgcccagccggcgagcc

SEQ ID NO: 677424 - RNA, 21 nt, Human
caccgcccagccggcgagccg

SEQ ID NO: 677425 - RNA, 19 nt, Human
cacucccauagaguuccca

SEQ ID NO: 677426 - RNA, 22 nt, Human
cacugcacuucagagggagcag

SEQ ID NO: 677427 - RNA, 23 nt, Human
cacugcacuucagagggagcagu

SEQ ID NO: 677428 - RNA, 21 nt, Human
cagaaucaagacaaagcacac

SEQ ID NO: 677429 - RNA, 20 nt, Human
cagagagccugagcugggac

SEQ ID NO: 677430 - RNA, 24 nt, Human
cagaugacgagcucucaguagucc

SEQ ID NO: 677431 - RNA, 24 nt, Human
cagggugaaagaauauuuucuuga

SEQ ID NO: 677432 - RNA, 18 nt, Human
caggugcagauggggugc

SEQ ID NO: 677433 - RNA, 19 nt, Human
cagguggucugcaucgccc

SEQ ID NO: 677434 - RNA, 24 nt, Human
cagguggucugcaucgcccagcgg

SEQ ID NO: 677435 - RNA, 21 nt, Human
caucgaggcugggggacagcu

SEQ ID NO: 677436 - RNA, 22 nt, Human
caugcuacaagugcugcagcca

SEQ ID NO: 677437 - RNA, 23 nt, Human
caugugcaugcuacaagugcugc

SEQ ID NO: 677438 - RNA, 21 nt, Human
ccacggaggcagcggacgggc

SEQ ID NO: 677439 - RNA, 19 nt, Human
ccacugcacuucagaggga

SEQ ID NO: 677440 - RNA, 24 nt, Human
ccacugcacuucagagggagcagu

SEQ ID NO: 677441 - RNA, 21 nt, Human
ccacuggagacagcggacugu

SEQ ID NO: 677442 - RNA, 23 nt, Human
ccagcaaagccccgccucccggg

SEQ ID NO: 677443 - RNA, 19 nt, Human
ccauagaguucccauggag

SEQ ID NO: 677444 - RNA, 20 nt, Human
cccacagcuacaccugaaac

SEQ ID NO: 677445 - RNA, 19 nt, Human
cccagcggcagcgcagcac

SEQ ID NO: 677446 - RNA, 20 nt, Human
cccuaaagugaguacagacc

SEQ ID NO: 677447 - RNA, 19 nt, Human
cccuuuccucaguaaacga

SEQ ID NO: 677448 - RNA, 19 nt, Human
ccuacaaaguuucagacag

SEQ ID NO: 677449 - RNA, 22 nt, Human
ccuacaaaguuucagacaucca

SEQ ID NO: 677450 - RNA, 22 nt, Human
ccugcagggaagugggccuuag

SEQ ID NO: 677451 - RNA, 23 nt, Human
ccuggaacaguugaaaaaggaaa

SEQ ID NO: 677452 - RNA, 18 nt, Human
cgagccgagcagcgaccc

SEQ ID NO: 677453 - RNA, 21 nt, Human
cgugugggaccaguucaaugg

SEQ ID NO: 677454 - RNA, 23 nt, Human
cucaguaguccuggugccugugu

SEQ ID NO: 677455 - RNA, 19 nt, Human
cugcaaggaggagccagag

SEQ ID NO: 677456 - RNA, 21 nt, Human
cugccgaggaguggggccugg

SEQ ID NO: 677457 - RNA, 19 nt, Human
cuggaacaguugaaaaagg

SEQ ID NO: 677458 - RNA, 26 nt, Human
cuggacgcucugauuuuaagaacacc

SEQ ID NO: 677459 - RNA, 18 nt, Human
cugggaagccagcaaagc

SEQ ID NO: 677460 - RNA, 22 nt, Human
gaacaggaauccuaguuuuagg

SEQ ID NO: 677461 - RNA, 18 nt, Human
gacuugguucuucaugga

SEQ ID NO: 677462 - RNA, 29 nt, Human
gagagcucaagauccaucgcuccgagggg

SEQ ID NO: 677463 - RNA, 20 nt, Human
gagaucccacugcacuucag

SEQ ID NO: 677464 - RNA, 18 nt, Human
gaggcgccuacaaaguuu

SEQ ID NO: 677465 - RNA, 18 nt, Human
gaguuggcuguuccuggc

SEQ ID NO: 677466 - RNA, 18 nt, Human
gcaaggaggagccagagg

SEQ ID NO: 677467 - RNA, 18 nt, Human
gcagcgcagcacagaauc

SEQ ID NO: 677468 - RNA, 25 nt, Human
gccggcccgcgucaccaacccccac

SEQ ID NO: 677469 - RNA, 18 nt, Human
gccuggggugcguguggg

SEQ ID NO: 677470 - RNA, 20 nt, Human
gcugcagccagcugggcgcc

SEQ ID NO: 677471 - RNA, 21 nt, Human
gcuggagaagccacggaggca

SEQ ID NO: 677472 - RNA, 19 nt, Human
ggaaggcagagagccugag

SEQ ID NO: 677473 - RNA, 18 nt, Human
ggagccagaggaggaggu

SEQ ID NO: 677474 - RNA, 18 nt, Human
ggaggagccagaggagga

SEQ ID NO: 677475 - RNA, 22 nt, Human
ggggugggaugagggagagaga

SEQ ID NO: 677476 - RNA, 20 nt, Human
ggugcagauggggugcuggc

SEQ ID NO: 677477 - RNA, 23 nt, Human
guaaacgaggaauccauaaaaca

SEQ ID NO: 677478 - RNA, 24 nt, Human
guccugccucucucugggaagcca

SEQ ID NO: 677479 - RNA, 23 nt, Human
guuacagugauuaaaaacccacc

SEQ ID NO: 677480 - RNA, 24 nt, Human
uaaaacaaguuuuuguugguuacu

SEQ ID NO: 677481 - RNA, 21 nt, Human
uaaaguggagauacugucaga

SEQ ID NO: 677482 - RNA, 21 nt, Human
uaagugcuaccgugaaguuag

SEQ ID NO: 677483 - RNA, 18 nt, Human
uacaaaauacugcaguua

SEQ ID NO: 677484 - RNA, 19 nt, Human
uacaaaauacugcaguuac

SEQ ID NO: 677485 - RNA, 18 nt, Human
uacauggugacucaggug

SEQ ID NO: 677486 - RNA, 24 nt, Human
uacccaucaaacuugcagaacaga

SEQ ID NO: 677487 - RNA, 20 nt, Human
uacuaccagagucaugugca

SEQ ID NO: 677488 - RNA, 19 nt, Human
uagaagacagguggucugc

SEQ ID NO: 677489 - RNA, 22 nt, Human
uagaagacagguggucugcauc

SEQ ID NO: 677490 - RNA, 26 nt, Human
uagcagcgcuacauggugacucaggu

SEQ ID NO: 677491 - RNA, 22 nt, Human
uaguuuuaggaagaauuuccuc

SEQ ID NO: 677492 - RNA, 20 nt, Human
uauacaagucaaagugcauu

SEQ ID NO: 677493 - RNA, 21 nt, Human
ucaacccacggagcuccaucc

SEQ ID NO: 677494 - RNA, 22 nt, Human
ucaccaacccccaccgcccagc

SEQ ID NO: 677495 - RNA, 23 nt, Human
ucagaaaggugcauuuucucauu

SEQ ID NO: 677496 - RNA, 22 nt, Human
uccaagcuagcugcauucccac

SEQ ID NO: 677497 - RNA, 25 nt, Human
uccacagacaaggcagaccgggguc

SEQ ID NO: 677498 - RNA, 22 nt, Human
uccacagacaaggcagacugcc

SEQ ID NO: 677499 - RNA, 19 nt, Human
ucccacuuaaaugugggcc

SEQ ID NO: 677500 - RNA, 19 nt, Human
ucccauagaguucccaugg

SEQ ID NO: 677501 - RNA, 23 nt, Human
uccucaguaaacgaggaauccau

SEQ ID NO: 677502 - RNA, 21 nt, Human
ucucaaagggccgucucuacc

SEQ ID NO: 677503 - RNA, 19 nt, Human
ucucugggaagccagcaaa

SEQ ID NO: 677504 - RNA, 23 nt, Human
ucucugggaagccagcaaagccc

SEQ ID NO: 677505 - RNA, 18 nt, Human
ucugggaagccagcaaag

SEQ ID NO: 677506 - RNA, 19 nt, Human
ucuguccugccucucucug

SEQ ID NO: 677507 - RNA, 23 nt, Human
ucuguccugccucucucugggaa

SEQ ID NO: 677508 - RNA, 19 nt, Human
ucuuaaguaaaguggagau

SEQ ID NO: 677509 - RNA, 21 nt, Human
ucuuacccaucaaacuugcag

SEQ ID NO: 677510 - RNA, 21 nt, Human
ucuuagagauucuuuccugga

SEQ ID NO: 677511 - RNA, 23 nt, Human
ugaagaacuucagcuauaaaaaa

SEQ ID NO: 677512 - RNA, 18 nt, Human
ugacgagcucucaguagu

SEQ ID NO: 677513 - RNA, 21 nt, Human
ugagaagacaaaggaacagga

SEQ ID NO: 677514 - RNA, 21 nt, Human
ugagggagagagagcagcucc

SEQ ID NO: 677515 - RNA, 24 nt, Human
ugagggagagagagcagcuccaca

SEQ ID NO: 677516 - RNA, 20 nt, Human
ugcaaggaggagccagagga

SEQ ID NO: 677517 - RNA, 21 nt, Human
ugcuacagcaguuuucaagaa

SEQ ID NO: 677518 - RNA, 23 nt, Human
uggaaggagagcucaagauccau

SEQ ID NO: 677519 - RNA, 20 nt, Human
uggcagaggcagguggguuu

SEQ ID NO: 677520 - RNA, 20 nt, Human
uggcuggagcugggauauua

SEQ ID NO: 677521 - RNA, 22 nt, Human
uggcuucagcuguaagugcuac

SEQ ID NO: 677522 - RNA, 18 nt, Human
ugggccaagggcuuaugg

SEQ ID NO: 677523 - RNA, 25 nt, Human
ugggggacagcugcugcccccacug

SEQ ID NO: 677524 - RNA, 18 nt, Human
uggguuuggccugcuggg

SEQ ID NO: 677525 - RNA, 24 nt, Human
uguagugucauuuuaaguauuugg

SEQ ID NO: 677526 - RNA, 20 nt, Human
uguccugccucucucuggga

SEQ ID NO: 677527 - RNA, 23 nt, Human
uuaaaugugggccaagggcuuau

SEQ ID NO: 677528 - RNA, 21 nt, Human
uuagacacuuguacaaaauac

SEQ ID NO: 677529 - RNA, 19 nt, Human
uuccuggaacaguugaaaa

SEQ ID NO: 677530 - RNA, 18 nt, Human
uugaaaaaaggcuaccuc

SEQ ID NO: 677531 - RNA, 23 nt, Human
uuggcccuaagcaugauugagaa

SEQ ID NO: 677532 - RNA, 18 nt, Human
uuuaaucaaaaaguguau

SEQ ID NO: 677533 - RNA, 18 nt, Human
uuucuugagaggaaggga

SEQ ID NO: 677534 - RNA, 21 nt, Human
uuugcuacagcaguuuucaag

SEQ ID NO: 677535 - RNA, 24 nt, Human
uuugcuaguuuucuuaaguaaagu

SEQ ID NO: 677536 - RNA, 18 nt, Human
uuuuuuuuuuuuuuuuug

SEQ ID NO: 677537 - RNA, 25 nt, Human
uuuuuuuuuuuuuuuuugcaucugg

SEQ ID NO: 677538 - RNA, 24 nt, Human
aaauccacugcagauuaggggugg

SEQ ID NO: 677539 - RNA, 20 nt, Human
accccuuguccagcagccuc

SEQ ID NO: 677540 - RNA, 21 nt, Human
acugcccccuggcugauguac

SEQ ID NO: 677541 - RNA, 23 nt, Human
agugcugcgucuuuggcacugcc

SEQ ID NO: 677542 - RNA, 24 nt, Human
auccugcuccugaagccucuccug

SEQ ID NO: 677543 - RNA, 20 nt, Human
cacacucuccagcuccuucc

SEQ ID NO: 677544 - RNA, 19 nt, Human
caccagaaguggcuguguc

SEQ ID NO: 677545 - RNA, 22 nt, Human
cacugaguugacugauuauugc

SEQ ID NO: 677546 - RNA, 21 nt, Human
cagauccuccaggguagcaga

SEQ ID NO: 677547 - RNA, 22 nt, Human
cagaugaugcauggccuucccc

SEQ ID NO: 677548 - RNA, 21 nt, Human
cagccucucauccugcuccug

SEQ ID NO: 677549 - RNA, 22 nt, Human
caucuccuccugguccugggcc

SEQ ID NO: 677550 - RNA, 21 nt, Human
ccagaaguggcugugucaggg

SEQ ID NO: 677551 - RNA, 21 nt, Human
ccagcagccucuccuguuccu

SEQ ID NO: 677552 - RNA, 21 nt, Human
ccagcagccucuccuguuccu

SEQ ID NO: 677553 - RNA, 20 nt, Human
ccccaggugagugguaacca

SEQ ID NO: 677554 - RNA, 18 nt, Human
cccguagauaccuguugc

SEQ ID NO: 677555 - RNA, 21 nt, Human
cccguagauaccuguugcuga

SEQ ID NO: 677556 - RNA, 22 nt, Human
cccguagauaccuguugcugaa

SEQ ID NO: 677557 - RNA, 22 nt, Human
ccuccugucuccuguucaggag

SEQ ID NO: 677558 - RNA, 23 nt, Human
ccucuccagcucccacagagucu

SEQ ID NO: 677559 - RNA, 18 nt, Human
ccugacgauguccuccuc

SEQ ID NO: 677560 - RNA, 23 nt, Human
ccugcagccucuccuccugucuc

SEQ ID NO: 677561 - RNA, 25 nt, Human
ccugcagccucuccuccugucuccu

SEQ ID NO: 677562 - RNA, 23 nt, Human
ccuguuagcuccugcuggaaugc

SEQ ID NO: 677563 - RNA, 20 nt, Human
ccuuguccagcagccucucc

SEQ ID NO: 677564 - RNA, 22 nt, Human
cgucuuuggcacugcccccugg

SEQ ID NO: 677565 - RNA, 27 nt, Human
cuccagcuccuuccuuagggggccgcc

SEQ ID NO: 677566 - RNA, 24 nt, Human
cugaagccucuccuguuccagcag

SEQ ID NO: 677567 - RNA, 19 nt, Human
cugcagccucuccuccugu

SEQ ID NO: 677568 - RNA, 23 nt, Human
cugcagccucuccuccugucucc

SEQ ID NO: 677569 - RNA, 19 nt, Human
gccacagccucucauccug

SEQ ID NO: 677570 - RNA, 21 nt, Human
gcccccuggcugauguacuuu

SEQ ID NO: 677571 - RNA, 22 nt, Human
gccuggagcugucuucccacac

SEQ ID NO: 677572 - RNA, 21 nt, Human
gcuccugaagccucuccuguu

SEQ ID NO: 677573 - RNA, 19 nt, Human
gcuggaaugccagggcucu

SEQ ID NO: 677574 - RNA, 19 nt, Human
ggcucuggggccagggguu

SEQ ID NO: 677575 - RNA, 25 nt, Human
gggggcucuggggccagggguucag

SEQ ID NO: 677576 - RNA, 22 nt, Human
ggucucaucuuguagcugcucc

SEQ ID NO: 677577 - RNA, 23 nt, Human
uagcagaugaugcauggccuucc

SEQ ID NO: 677578 - RNA, 23 nt, Human
uauugcggagcuugagugcaggg

SEQ ID NO: 677579 - RNA, 24 nt, Human
ucaguggugaucuucaucuccucc

SEQ ID NO: 677580 - RNA, 23 nt, Human
uccugcuccugaagccucuccug

SEQ ID NO: 677581 - RNA, 20 nt, Human
ucucaucuuguagcugcucc

SEQ ID NO: 677582 - RNA, 20 nt, Human
ucuccagcucccacagaguc

SEQ ID NO: 677583 - RNA, 24 nt, Human
ucuccugcugccacagccucucau

SEQ ID NO: 677584 - RNA, 18 nt, Human
ugaagcucuaguuucucc

SEQ ID NO: 677585 - RNA, 21 nt, Human
ugagugguaaccaccagaagu

SEQ ID NO: 677586 - RNA, 22 nt, Human
ugaguugacugauuauugcgga

SEQ ID NO: 677587 - RNA, 20 nt, Human
ugcgucuuuggcacugcccu

SEQ ID NO: 677588 - RNA, 21 nt, Human
ugcugcgucuuuggcacugcc

SEQ ID NO: 677589 - RNA, 24 nt, Human
uggagcugucuucccacacucucc

SEQ ID NO: 677590 - RNA, 21 nt, Human
uggcacugcccccuggcugau

SEQ ID NO: 677591 - RNA, 22 nt, Human
uggcugauguacuuucucaugg

SEQ ID NO: 677592 - RNA, 19 nt, Human
uguccagcagccucuccug

SEQ ID NO: 677593 - RNA, 24 nt, Human
uguucaggagacucaacaucugau

SEQ ID NO: 677594 - RNA, 24 nt, Human
uuaggggugguagucagggucccu

SEQ ID NO: 677595 - RNA, 19 nt, Human
uucaguggugaucuucauc

SEQ ID NO: 677596 - RNA, 19 nt, Human
uuccaccucagccuggagc

SEQ ID NO: 677597 - RNA, 19 nt, Human
uuccugcagccucuccucc

SEQ ID NO: 677598 - RNA, 24 nt, Human
uuggcacugcccccuggcugaugu

SEQ ID NO: 677599 - RNA, 22 nt, Human
aaaaaaaaaaaaaaaaacaaag

SEQ ID NO: 677600 - RNA, 23 nt, Human
aaaaaaaaaaaaaaaaacaaaga

SEQ ID NO: 677601 - RNA, 25 nt, Human
aaaaaaaacaaguaaaaagccaaag

SEQ ID NO: 677602 - RNA, 19 nt, Human
aaaaaacaaguaaaaagcc

SEQ ID NO: 677603 - RNA, 19 nt, Human
aaaaaacaaguaaaaagcc

SEQ ID NO: 677604 - RNA, 21 nt, Human
aaaaagccaaagguacagaua

SEQ ID NO: 677605 - RNA, 20 nt, Human
aaagcacugaauuuuccaga

SEQ ID NO: 677606 - RNA, 24 nt, Human
aacaaagcgagacucugucucaaa

SEQ ID NO: 677607 - RNA, 20 nt, Human
aacaaguaacucaaaagcac

SEQ ID NO: 677608 - RNA, 24 nt, Human
aacacgccacauaaugcacuggug

SEQ ID NO: 677609 - RNA, 19 nt, Human
aacauggugaaaccccauu

SEQ ID NO: 677610 - RNA, 21 nt, Human
aacauggugaaaccccauugc

SEQ ID NO: 677611 - RNA, 22 nt, Human
aagacaaacaaggaaguacacg

SEQ ID NO: 677612 - RNA, 20 nt, Human
aagcacugaauuuuccagac

SEQ ID NO: 677613 - RNA, 24 nt, Human
aaucgcaugaaccugggaggcgga

SEQ ID NO: 677614 - RNA, 19 nt, Human
acaaacaaggaaguacacg

SEQ ID NO: 677615 - RNA, 21 nt, Human
acaaagcgagacucugucuca

SEQ ID NO: 677616 - RNA, 24 nt, Human
acaaagcgagacucugucucaaaa

SEQ ID NO: 677617 - RNA, 23 nt, Human
acagcacggacuguguucuggug

SEQ ID NO: 677618 - RNA, 20 nt, Human
accauggaaaaacacaugaa

SEQ ID NO: 677619 - RNA, 19 nt, Human
acccuguuuuguaagcagu

SEQ ID NO: 677620 - RNA, 21 nt, Human
acgacaccagcugagcugacg

SEQ ID NO: 677621 - RNA, 25 nt, Human
acuaaaaauacaaacauuagccugg

SEQ ID NO: 677622 - RNA, 28 nt, Human
acucugucucaaaaaaaaaaaaaaaaaa

SEQ ID NO: 677623 - RNA, 20 nt, Human
acugaaguaacucuggaagg

SEQ ID NO: 677624 - RNA, 18 nt, Human
acugcacuccagccuggg

SEQ ID NO: 677625 - RNA, 23 nt, Human
acugcacuccagccugggcaaca

SEQ ID NO: 677626 - RNA, 18 nt, Human
acugcagccgggggcggu

SEQ ID NO: 677627 - RNA, 24 nt, Human
acuugaggucaggagaucgagacc

SEQ ID NO: 677628 - RNA, 18 nt, Human
agaacagccacaacuuga

SEQ ID NO: 677629 - RNA, 18 nt, Human
agaagccacgaccuacaa

SEQ ID NO: 677630 - RNA, 25 nt, Human
agaguugagggccagcuccuuagcg

SEQ ID NO: 677631 - RNA, 25 nt, Human
agaucacuugaggucaggagaucga

SEQ ID NO: 677632 - RNA, 22 nt, Human
agaugggcagaucacuugaggu

SEQ ID NO: 677633 - RNA, 26 nt, Human
agaugggcagaucacuugaggucagg

SEQ ID NO: 677634 - RNA, 24 nt, Human
agcacuuugggaggcugagauggg

SEQ ID NO: 677635 - RNA, 24 nt, Human
agccugggcaacaaagcgagacuc

SEQ ID NO: 677636 - RNA, 22 nt, Human
agcgacaaagacaaacaaggaa

SEQ ID NO: 677637 - RNA, 20 nt, Human
aggagaguugagggccagcu

SEQ ID NO: 677638 - RNA, 22 nt, Human
aggcaggagaaucgcaugaacc

SEQ ID NO: 677639 - RNA, 24 nt, Human
aggcaggagaaucgcaugaaccug

SEQ ID NO: 677640 - RNA, 24 nt, Human
aggcggagcuugcagugagcggag

SEQ ID NO: 677641 - RNA, 21 nt, Human
aggcugagaugggcagaucac

SEQ ID NO: 677642 - RNA, 20 nt, Human
aggcugaggcaggagaaucg

SEQ ID NO: 677643 - RNA, 20 nt, Human
aggcugaggcaggagaaucg

SEQ ID NO: 677644 - RNA, 21 nt, Human
aggggcuacaagugaaccuug

SEQ ID NO: 677645 - RNA, 24 nt, Human
aguggcgcacgccuguaaucccag

SEQ ID NO: 677646 - RNA, 24 nt, Human
agugugccacugcacuccagccug

SEQ ID NO: 677647 - RNA, 21 nt, Human
auccuggccaacauggugaaa

SEQ ID NO: 677648 - RNA, 18 nt, Human
augaagacaagucggcca

SEQ ID NO: 677649 - RNA, 19 nt, Human
augauacccgugacaacgc

SEQ ID NO: 677650 - RNA, 26 nt, Human
caaaaaaaaaaaaaaaaaaacaaaga

SEQ ID NO: 677651 - RNA, 21 nt, Human
caacauggugaaaccccauug

SEQ ID NO: 677652 - RNA, 21 nt, Human
caaguaaaaagccaaagguac

SEQ ID NO: 677653 - RNA, 18 nt, Human
caaguaacccuucagaca

SEQ ID NO: 677654 - RNA, 25 nt, Human
cacaaaauuuaaggaauucccaagg

SEQ ID NO: 677655 - RNA, 23 nt, Human
cacacagcugcucccaguuacgc

SEQ ID NO: 677656 - RNA, 22 nt, Human
cacacggcguggggaugaacac

SEQ ID NO: 677657 - RNA, 22 nt, Human
cacacgguguggggaugaacac

SEQ ID NO: 677658 - RNA, 23 nt, Human
cacauauaccauggaaaaacaca

SEQ ID NO: 677659 - RNA, 19 nt, Human
caccacagcgucacucaac

SEQ ID NO: 677660 - RNA, 24 nt, Human
cacgccuauaauuccagcacuuug

SEQ ID NO: 677661 - RNA, 18 nt, Human
cacgccuguaaucccagc

SEQ ID NO: 677662 - RNA, 19 nt, Human
cacgccuguaaucccagcu

SEQ ID NO: 677663 - RNA, 18 nt, Human
cacugcacuccagccugg

SEQ ID NO: 677664 - RNA, 19 nt, Human
cacugcacuccagccuggg

SEQ ID NO: 677665 - RNA, 21 nt, Human
cacugcacuccagccugggca

SEQ ID NO: 677666 - RNA, 23 nt, Human
cacugcacuccagccugggcaac

SEQ ID NO: 677667 - RNA, 24 nt, Human
cacugcacuccagccugggcaaca

SEQ ID NO: 677668 - RNA, 21 nt, Human
cacuucugcccacaagaaggg

SEQ ID NO: 677669 - RNA, 19 nt, Human
cagaagccacgaccuacaa

SEQ ID NO: 677670 - RNA, 24 nt, Human
cagcacuuugggaggcugagaugg

SEQ ID NO: 677671 - RNA, 24 nt, Human
cagcuacucgagaggcugaggcag

SEQ ID NO: 677672 - RNA, 19 nt, Human
cagggaagugagaaacugc

SEQ ID NO: 677673 - RNA, 21 nt, Human
caugaaccugggaggcggagc

SEQ ID NO: 677674 - RNA, 18 nt, Human
ccaacugcagccgggggc

SEQ ID NO: 677675 - RNA, 20 nt, Human
ccaccuggaaugaagacaag

SEQ ID NO: 677676 - RNA, 20 nt, Human
ccacugcacuccagccuggg

SEQ ID NO: 677677 - RNA, 20 nt, Human
ccacugcacuccagccuggg

SEQ ID NO: 677678 - RNA, 21 nt, Human
ccacugcacuccagccugggc

SEQ ID NO: 677679 - RNA, 22 nt, Human
ccacugcacuccagccugggca

SEQ ID NO: 677680 - RNA, 23 nt, Human
ccacugcacuccagccugggcaa

SEQ ID NO: 677681 - RNA, 24 nt, Human
ccacugcacuccagccugggcaac

SEQ ID NO: 677682 - RNA, 25 nt, Human
ccagcuaauaucaugauacccguga

SEQ ID NO: 677683 - RNA, 21 nt, Human
ccagcugagcugacgcugagg

SEQ ID NO: 677684 - RNA, 18 nt, Human
cccaagaacagccacaac

SEQ ID NO: 677685 - RNA, 24 nt, Human
cccacaagaacaaaauaauucaaa

SEQ ID NO: 677686 - RNA, 25 nt, Human
cccgugacaacgcccggccccacuc

SEQ ID NO: 677687 - RNA, 18 nt, Human
cccuccccuccuagaauc

SEQ ID NO: 677688 - RNA, 19 nt, Human
cccugcuggacccacccga

SEQ ID NO: 677689 - RNA, 18 nt, Human
ccgagagccuaucaggcu

SEQ ID NO: 677690 - RNA, 19 nt, Human
ccgcagagagcagcaucgg

SEQ ID NO: 677691 - RNA, 21 nt, Human
ccggccccacucgcucuggcc

SEQ ID NO: 677692 - RNA, 22 nt, Human
ccuauaauuccagcacuuuggg

SEQ ID NO: 677693 - RNA, 20 nt, Human
ccucacaucagagggcuccu

SEQ ID NO: 677694 - RNA, 22 nt, Human
ccucgccgagagccuaucaggc

SEQ ID NO: 677695 - RNA, 21 nt, Human
ccucucccugucacccgcaga

SEQ ID NO: 677696 - RNA, 22 nt, Human
ccuggccaacauggugaaaccc

SEQ ID NO: 677697 - RNA, 23 nt, Human
ccuggccaacauggugaaacccc

SEQ ID NO: 677698 - RNA, 24 nt, Human
ccuggccaacauggugaaacccca

SEQ ID NO: 677699 - RNA, 20 nt, Human
ccuguaaucccagcuacucg

SEQ ID NO: 677700 - RNA, 22 nt, Human
ccuguaaucccagcuacucgag

SEQ ID NO: 677701 - RNA, 20 nt, Human
cgaccuacaaguaacccuuc

SEQ ID NO: 677702 - RNA, 24 nt, Human
cgagaccauccuggccaacauggu

SEQ ID NO: 677703 - RNA, 22 nt, Human
cgaggagaguccauuucacauc

SEQ ID NO: 677704 - RNA, 23 nt, Human
cgccuguaaucccagcuacucga

SEQ ID NO: 677705 - RNA, 22 nt, Human
cgguguggggaugaacacgccg

SEQ ID NO: 677706 - RNA, 22 nt, Human
cgucagaaaaacaaguagugac

SEQ ID NO: 677707 - RNA, 18 nt, Human
cucaaaaaaaaaaaaaaa

SEQ ID NO: 677708 - RNA, 18 nt, Human
cucgccgagagccuauca

SEQ ID NO: 677709 - RNA, 19 nt, Human
cucugucucaaaaaaaaaa

SEQ ID NO: 677710 - RNA, 24 nt, Human
cugaggggcuacaagugaaccuug

SEQ ID NO: 677711 - RNA, 23 nt, Human
cuggccaacauggugaaacccca

SEQ ID NO: 677712 - RNA, 20 nt, Human
cugugagagccugagaucac

SEQ ID NO: 677713 - RNA, 24 nt, Human
cuugcagugagcggagagugugcc

SEQ ID NO: 677714 - RNA, 19 nt, Human
gacaaagacaaacaaggaa

SEQ ID NO: 677715 - RNA, 21 nt, Human
gaccuacaaguaacccuucag

SEQ ID NO: 677716 - RNA, 23 nt, Human
gagaaacugcagccggccuggcc

SEQ ID NO: 677717 - RNA, 23 nt, Human
gagaugggcagaucacuugaggu

SEQ ID NO: 677718 - RNA, 18 nt, Human
gaguugagggccagcucc

SEQ ID NO: 677719 - RNA, 18 nt, Human
gaucacuugaggucagga

SEQ ID NO: 677720 - RNA, 24 nt, Human
gaucacuugaggucaggagaucga

SEQ ID NO: 677721 - RNA, 19 nt, Human
gauuugcuggucccucccc

SEQ ID NO: 677722 - RNA, 24 nt, Human
gcaacaaagcgagacucugucuca

SEQ ID NO: 677723 - RNA, 21 nt, Human
gccaacauggugaaaccccau

SEQ ID NO: 677724 - RNA, 22 nt, Human
gccacugcacuccagccugggc

SEQ ID NO: 677725 - RNA, 24 nt, Human
gccacugcacuccagccugggcaa

SEQ ID NO: 677726 - RNA, 18 nt, Human
ggaaaaacacaugaaaac

SEQ ID NO: 677727 - RNA, 24 nt, Human
ggagagugugccacugcacuccag

SEQ ID NO: 677728 - RNA, 18 nt, Human
ggagcuugcagugagcgg

SEQ ID NO: 677729 - RNA, 23 nt, Human
ggcauaguggcgcacgccuguaa

SEQ ID NO: 677730 - RNA, 18 nt, Human
gggaacccugcaccaagg

SEQ ID NO: 677731 - RNA, 19 nt, Human
gggaggggcccuacugugu

SEQ ID NO: 677732 - RNA, 21 nt, Human
gggggcggugguucacgccua

SEQ ID NO: 677733 - RNA, 18 nt, Human
ggugggcagggccccugc

SEQ ID NO: 677734 - RNA, 24 nt, Human
ggugguucacgccuauaauuccag

SEQ ID NO: 677735 - RNA, 24 nt, Human
guaaaaagccaaagguacagauaa

SEQ ID NO: 677736 - RNA, 24 nt, Human
uaaaaaaugaacgugcuuuuuaaa

SEQ ID NO: 677737 - RNA, 23 nt, Human
uaaaaacaaguaacucaaaagca

SEQ ID NO: 677738 - RNA, 20 nt, Human
uaaaaauacaaacauuagcc

SEQ ID NO: 677739 - RNA, 24 nt, Human
uaaaaauacaaacauuagccuggc

SEQ ID NO: 677740 - RNA, 18 nt, Human
uaaggaauucccaagcac

SEQ ID NO: 677741 - RNA, 19 nt, Human
uaaggaauucccaagcaca

SEQ ID NO: 677742 - RNA, 19 nt, Human
uaccauggaaaaacacaug

SEQ ID NO: 677743 - RNA, 24 nt, Human
uaccauggaaaaacacaugaaaac

SEQ ID NO: 677744 - RNA, 20 nt, Human
uacuaaaaauacaaacauua

SEQ ID NO: 677745 - RNA, 24 nt, Human
uaguggcgcacgccuguaauccca

SEQ ID NO: 677746 - RNA, 21 nt, Human
ucaaaaaaaaaaaaaaaaaaa

SEQ ID NO: 677747 - RNA, 23 nt, Human
ucacaaaugacuugaugucaaac

SEQ ID NO: 677748 - RNA, 24 nt, Human
ucacacagcugcucccaguuacgc

SEQ ID NO: 677749 - RNA, 22 nt, Human
ucacgccuauaauuccagcacu

SEQ ID NO: 677750 - RNA, 23 nt, Human
ucacgccuauaauuccagcacuu

SEQ ID NO: 677751 - RNA, 21 nt, Human
ucagaaacacugccugaucca

SEQ ID NO: 677752 - RNA, 22 nt, Human
ucagaaacacugccugauccau

SEQ ID NO: 677753 - RNA, 24 nt, Human
uccagccugggcaacaaagcgaga

SEQ ID NO: 677754 - RNA, 18 nt, Human
ucccuuggagauaaaaaa

SEQ ID NO: 677755 - RNA, 19 nt, Human
ucccuuggagauaaaaaaa

SEQ ID NO: 677756 - RNA, 19 nt, Human
uccucacaucagagggcuc

SEQ ID NO: 677757 - RNA, 23 nt, Human
ucugucucaaaaaaaaaaaaaaa

SEQ ID NO: 677758 - RNA, 21 nt, Human
ugaaaaccaaguuacguuguu

SEQ ID NO: 677759 - RNA, 20 nt, Human
ugaagugcccuagccuguug

SEQ ID NO: 677760 - RNA, 26 nt, Human
ugaauuuuccagacccucuaacacau

SEQ ID NO: 677761 - RNA, 21 nt, Human
ugagaaacugcagccggccug

SEQ ID NO: 677762 - RNA, 24 nt, Human
ugagaugggcagaucacuugaggu

SEQ ID NO: 677763 - RNA, 26 nt, Human
ugagaugggcagaucacuugagguca

SEQ ID NO: 677764 - RNA, 20 nt, Human
ugagcggagagugugccacu

SEQ ID NO: 677765 - RNA, 18 nt, Human
ugagcugacgcugagggg

SEQ ID NO: 677766 - RNA, 24 nt, Human
ugaggcaggagaaucgcaugaacc

SEQ ID NO: 677767 - RNA, 25 nt, Human
ugaggcaggagaaucgcaugaaccu

SEQ ID NO: 677768 - RNA, 28 nt, Human
ugcacaaaauuuaaggaauucccaagca

SEQ ID NO: 677769 - RNA, 24 nt, Human
ugcacugaaguaacucuggaaggu

SEQ ID NO: 677770 - RNA, 19 nt, Human
ugcccacaagaacaaaaua

SEQ ID NO: 677771 - RNA, 23 nt, Human
ugccgcagacccugucacacagc

SEQ ID NO: 677772 - RNA, 22 nt, Human
ugcuacuaaaaauacaaacauu

SEQ ID NO: 677773 - RNA, 18 nt, Human
uggaaaaacacaugaaaa

SEQ ID NO: 677774 - RNA, 21 nt, Human
uggaaaaacacaugaaaacca

SEQ ID NO: 677775 - RNA, 28 nt, Human
uggaacgucagaaaaacaaguagugaca

SEQ ID NO: 677776 - RNA, 21 nt, Human
uggaagguagaagugccggga

SEQ ID NO: 677777 - RNA, 24 nt, Human
uggccaacauggugaaaccccauu

SEQ ID NO: 677778 - RNA, 21 nt, Human
uggcgcacgccuguaauccca

SEQ ID NO: 677779 - RNA, 22 nt, Human
ugggaacccugcaccaaggaga

SEQ ID NO: 677780 - RNA, 26 nt, Human
ugggaacccugcaccaaggagaguug

SEQ ID NO: 677781 - RNA, 29 nt, Human
ugggaggcggagcuugcagugacaacggu

SEQ ID NO: 677782 - RNA, 24 nt, Human
ugggaggcggagcuugcagugagc

SEQ ID NO: 677783 - RNA, 20 nt, Human
ugggaggcugagaugggcag

SEQ ID NO: 677784 - RNA, 24 nt, Human
ugggaggcugagaugggcagauca

SEQ ID NO: 677785 - RNA, 21 nt, Human
ugggauggcuaucaaaaaaaa

SEQ ID NO: 677786 - RNA, 24 nt, Human
ugggcaacaaagcgagacucuguc

SEQ ID NO: 677787 - RNA, 24 nt, Human
ugggcagaucacuugaggucagga

SEQ ID NO: 677788 - RNA, 22 nt, Human
uggugggcagggccccugcugg

SEQ ID NO: 677789 - RNA, 21 nt, Human
ugguucacgccuauaauucca

SEQ ID NO: 677790 - RNA, 22 nt, Human
ugguucacgccuauaauuccag

SEQ ID NO: 677791 - RNA, 24 nt, Human
ugguucacgccuauaauuccagca

SEQ ID NO: 677792 - RNA, 21 nt, Human
ugucagacacggugaccccuu

SEQ ID NO: 677793 - RNA, 21 nt, Human
uuauugcacaaaauuuaagga

SEQ ID NO: 677794 - RNA, 18 nt, Human
uugcagagagugggaacg

SEQ ID NO: 677795 - RNA, 19 nt, Human
uugcagugagcggagagug

SEQ ID NO: 677796 - RNA, 22 nt, Human
uugcagugagcggagagugugc

SEQ ID NO: 677797 - RNA, 25 nt, Human
uugggaggcugagaugggcagauca

SEQ ID NO: 677798 - RNA, 23 nt, Human
uuggucauuccaugugaaaagcu

SEQ ID NO: 677799 - RNA, 22 nt, Human
uugucagacacggugaccccuu

SEQ ID NO: 677800 - RNA, 19 nt, Human
uuuaaggaauucccaagca

SEQ ID NO: 677801 - RNA, 24 nt, Human
uuugucagacacggugaccccuuu

SEQ ID NO: 677802 - RNA, 22 nt, Human
aaaaaaaaaaaaaaaagcugaa

SEQ ID NO: 677803 - RNA, 21 nt, Human
aaaaaaaaaaagcugaacuuc

SEQ ID NO: 677804 - RNA, 21 nt, Human
acaaaccaaaugugauucuca

SEQ ID NO: 677805 - RNA, 20 nt, Human
agaagaaagcagacucgcca

SEQ ID NO: 677806 - RNA, 22 nt, Human
aguuggagagaagaccuguaaa

SEQ ID NO: 677807 - RNA, 19 nt, Human
auugaaaccauccucuugg

SEQ ID NO: 677808 - RNA, 18 nt, Human
caccucuguuuuugcagg

SEQ ID NO: 677809 - RNA, 24 nt, Human
cagcugccccccucccaauucaag

SEQ ID NO: 677810 - RNA, 23 nt, Human
ccacaaaagaucaggguccugca

SEQ ID NO: 677811 - RNA, 18 nt, Human
ccccccucccaauucaag

SEQ ID NO: 677812 - RNA, 23 nt, Human
cccguacgcgacaccuuccaccg

SEQ ID NO: 677813 - RNA, 22 nt, Human
ccgccgcgccccgccagggacu

SEQ ID NO: 677814 - RNA, 20 nt, Human
ccgccugaggcuccagcugc

SEQ ID NO: 677815 - RNA, 24 nt, Human
cgacaccuuccaccgccgcgcccc

SEQ ID NO: 677816 - RNA, 19 nt, Human
cgccugaggcuccagcugc

SEQ ID NO: 677817 - RNA, 21 nt, Human
cgccugaggcuccagcugccc

SEQ ID NO: 677818 - RNA, 18 nt, Human
cguauccaccucuguuuu

SEQ ID NO: 677819 - RNA, 24 nt, Human
cucagggcaguagaagaaagcaga

SEQ ID NO: 677820 - RNA, 21 nt, Human
cugccccccucccaauucaag

SEQ ID NO: 677821 - RNA, 24 nt, Human
gcacuuuccgugaagaguuggaga

SEQ ID NO: 677822 - RNA, 23 nt, Human
ggagagaagaccuguaaauggga

SEQ ID NO: 677823 - RNA, 18 nt, Human
uccaaagaguaacaacuu

SEQ ID NO: 677824 - RNA, 24 nt, Human
ucccugcagcuccaaccuguccuc

SEQ ID NO: 677825 - RNA, 19 nt, Human
uccucaguaucuuuuacag

SEQ ID NO: 677826 - RNA, 22 nt, Human
ucgccagucccugcagcuccaa

SEQ ID NO: 677827 - RNA, 18 nt, Human
ugaagggagugguccaaa

SEQ ID NO: 677828 - RNA, 18 nt, Human
uuccucaguaucuuuuac

SEQ ID NO: 677829 - RNA, 21 nt, Human
aaaaaagaaaaaugcugaagg

SEQ ID NO: 677830 - RNA, 22 nt, Human
aaaaaagaaaaaugcugaagga

SEQ ID NO: 677831 - RNA, 19 nt, Human
aaauaaacuuaaacuauaa

SEQ ID NO: 677832 - RNA, 21 nt, Human
acaaaguaauaaacagugcac

SEQ ID NO: 677833 - RNA, 27 nt, Human
acacagaaaauggaggaaaggggaccc

SEQ ID NO: 677834 - RNA, 18 nt, Human
accgcauauugagcuaua

SEQ ID NO: 677835 - RNA, 21 nt, Human
acuuuccucuucugugagauu

SEQ ID NO: 677836 - RNA, 18 nt, Human
agagcucacugugauuaa

SEQ ID NO: 677837 - RNA, 23 nt, Human
aguucucggccuuuaaacagcuc

SEQ ID NO: 677838 - RNA, 23 nt, Human
augccagagugaacaucagugag

SEQ ID NO: 677839 - RNA, 19 nt, Human
auuuagaaagcucccccaa

SEQ ID NO: 677840 - RNA, 20 nt, Human
cacuuuccucuucugugaga

SEQ ID NO: 677841 - RNA, 26 nt, Human
ccuacaauuaugaaaugaaaaaagaa

SEQ ID NO: 677842 - RNA, 22 nt, Human
ccuccaagucgcucuguggcuc

SEQ ID NO: 677843 - RNA, 19 nt, Human
ccuggcccagcuucuccug

SEQ ID NO: 677844 - RNA, 27 nt, Human
cuacaauuaugaaaugaaaaaagaaaa

SEQ ID NO: 677845 - RNA, 21 nt, Human
cucccaucaccaauacacaga

SEQ ID NO: 677846 - RNA, 18 nt, Human
cugcacauaccugccaga

SEQ ID NO: 677847 - RNA, 22 nt, Human
cuuaaacuauaaauuagaaaca

SEQ ID NO: 677848 - RNA, 18 nt, Human
gagccuauuccaaaccag

SEQ ID NO: 677849 - RNA, 24 nt, Human
gcagugcgcucuuguucucgugcu

SEQ ID NO: 677850 - RNA, 18 nt, Human
ggcccagcuucuccugca

SEQ ID NO: 677851 - RNA, 22 nt, Human
gggagccuauuccaaaccagcg

SEQ ID NO: 677852 - RNA, 22 nt, Human
uaaauuagaaacacaaauaauc

SEQ ID NO: 677853 - RNA, 19 nt, Human
uacaaaguaauaaacagug

SEQ ID NO: 677854 - RNA, 21 nt, Human
uagaaacacaaauaaucauga

SEQ ID NO: 677855 - RNA, 19 nt, Human
uagaaagcucccccaaaag

SEQ ID NO: 677856 - RNA, 18 nt, Human
uagaagagcucacuguga

SEQ ID NO: 677857 - RNA, 21 nt, Human
uagcaaauuuuaucugaauuc

SEQ ID NO: 677858 - RNA, 21 nt, Human
uccaacugcagugcgcucuug

SEQ ID NO: 677859 - RNA, 24 nt, Human
uccaugcugcaauaacauuagaaa

SEQ ID NO: 677860 - RNA, 26 nt, Human
uccugcagcuccuuuacuugcugcuc

SEQ ID NO: 677861 - RNA, 22 nt, Human
ucggccuuuaaacagcucuaaa

SEQ ID NO: 677862 - RNA, 19 nt, Human
ucucgugcuucagcuccuc

SEQ ID NO: 677863 - RNA, 23 nt, Human
ugaaaaaagaaaaaugcugaagg

SEQ ID NO: 677864 - RNA, 28 nt, Human
ugaacucccaccacguaagggcaaacuc

SEQ ID NO: 677865 - RNA, 27 nt, Human
ugcuccaacugcagugcgcucuuguug

SEQ ID NO: 677866 - RNA, 20 nt, Human
uuaagaugagaucaaacauc

SEQ ID NO: 677867 - RNA, 21 nt, Human
uugagcuauagaagagcucac

SEQ ID NO: 677868 - RNA, 20 nt, Human
uuuaaaaauuucuugagcag

SEQ ID NO: 677869 - RNA, 18 nt, Human
uuuccaguucucggccuu

SEQ ID NO: 677870 - RNA, 26 nt, Human
aaacaugagaugaauagaggggaccc

SEQ ID NO: 677871 - RNA, 19 nt, Human
aaauguucaaauucuaagc

SEQ ID NO: 677872 - RNA, 18 nt, Human
aagaaccaacucaaguca

SEQ ID NO: 677873 - RNA, 18 nt, Human
aaggacaucacauaugaa

SEQ ID NO: 677874 - RNA, 24 nt, Human
aaggacaucacauaugaagaaugu

SEQ ID NO: 677875 - RNA, 18 nt, Human
aaggagaacuauguucca

SEQ ID NO: 677876 - RNA, 18 nt, Human
aaguugccuuuucugggu

SEQ ID NO: 677877 - RNA, 22 nt, Human
aaucaguuuugugagucauuua

SEQ ID NO: 677878 - RNA, 22 nt, Human
accuuagugacuaaggacauca

SEQ ID NO: 677879 - RNA, 24 nt, Human
acgacggaacccagaguucucugu

SEQ ID NO: 677880 - RNA, 20 nt, Human
agaaucaggaagccccgcug

SEQ ID NO: 677881 - RNA, 18 nt, Human
agaggacuuagaagagua

SEQ ID NO: 677882 - RNA, 19 nt, Human
agaguucucugucucuccu

SEQ ID NO: 677883 - RNA, 23 nt, Human
agcaucucaaauccuguggaucc

SEQ ID NO: 677884 - RNA, 19 nt, Human
agcgcugagaaucucuuuu

SEQ ID NO: 677885 - RNA, 21 nt, Human
agcuacucgggagucugugug

SEQ ID NO: 677886 - RNA, 21 nt, Human
aggaagccccgcugucgccaa

SEQ ID NO: 677887 - RNA, 19 nt, Human
aggccauugauugauugau

SEQ ID NO: 677888 - RNA, 18 nt, Human
aggcuggaagaggacuua

SEQ ID NO: 677889 - RNA, 23 nt, Human
auaaaaacaaccauuguauuccu

SEQ ID NO: 677890 - RNA, 20 nt, Human
caaaguacccccccaaaagc

SEQ ID NO: 677891 - RNA, 19 nt, Human
caacgugaauugcaaacag

SEQ ID NO: 677892 - RNA, 23 nt, Human
caagcuaaauguguacacuauga

SEQ ID NO: 677893 - RNA, 25 nt, Human
cacacacgaagcaaaguaaauaaag

SEQ ID NO: 677894 - RNA, 23 nt, Human
cacagaucuguccacaacaaacu

SEQ ID NO: 677895 - RNA, 21 nt, Human
caccaugcucugcuccagguc

SEQ ID NO: 677896 - RNA, 19 nt, Human
cagaguucucugucucucc

SEQ ID NO: 677897 - RNA, 18 nt, Human
ccagaguucucugucucu

SEQ ID NO: 677898 - RNA, 23 nt, Human
ccaguuuugguguugaacuucuc

SEQ ID NO: 677899 - RNA, 19 nt, Human
cccacacacgaagcaaagu

SEQ ID NO: 677900 - RNA, 21 nt, Human
cccccccaaaagcuguuuaaa

SEQ ID NO: 677901 - RNA, 24 nt, Human
cccccccaaaagcuguuuaaaaga

SEQ ID NO: 677902 - RNA, 18 nt, Human
ccgccgccgccggccucg

SEQ ID NO: 677903 - RNA, 26 nt, Human
ccgccgccgccggccucgagcuccgg

SEQ ID NO: 677904 - RNA, 20 nt, Human
ccgcuacgaggccgcccggg

SEQ ID NO: 677905 - RNA, 19 nt, Human
ccuguagucccagcuacuc

SEQ ID NO: 677906 - RNA, 21 nt, Human
ccuguagucccagcuacucgg

SEQ ID NO: 677907 - RNA, 22 nt, Human
ccuguagucccagcuacucggg

SEQ ID NO: 677908 - RNA, 22 nt, Human
ccuuuuggccuguuuguuuugu

SEQ ID NO: 677909 - RNA, 23 nt, Human
cgaagcaaaguaaauaaagacca

SEQ ID NO: 677910 - RNA, 19 nt, Human
cuacucgggagucugugug

SEQ ID NO: 677911 - RNA, 22 nt, Human
cucaaaaucagcgcugagaauc

SEQ ID NO: 677912 - RNA, 23 nt, Human
cuccaguaauaaaguaggcacag

SEQ ID NO: 677913 - RNA, 21 nt, Human
cucucccgccgccgccggccu

SEQ ID NO: 677914 - RNA, 18 nt, Human
cucuuuucgaggcuccgg

SEQ ID NO: 677915 - RNA, 18 nt, Human
cugugugaggccaggggu

SEQ ID NO: 677916 - RNA, 24 nt, Human
cuuccaaaguacccccccaaaagc

SEQ ID NO: 677917 - RNA, 24 nt, Human
gaagcaaaguaaauaaagaccaca

SEQ ID NO: 677918 - RNA, 19 nt, Human
gacugugugccuguagucc

SEQ ID NO: 677919 - RNA, 18 nt, Human
gaggcuggaagaggacuu

SEQ ID NO: 677920 - RNA, 22 nt, Human
gccaggggugccagcgcaccag

SEQ ID NO: 677921 - RNA, 18 nt, Human
gccgugcgcccagcgccu

SEQ ID NO: 677922 - RNA, 18 nt, Human
gcuucagugacugugugc

SEQ ID NO: 677923 - RNA, 22 nt, Human
ggaagauguugcuuugcccaca

SEQ ID NO: 677924 - RNA, 19 nt, Human
ggacuuagaagaguaugaa

SEQ ID NO: 677925 - RNA, 23 nt, Human
gugacugugugccuguaguccca

SEQ ID NO: 677926 - RNA, 21 nt, Human
uaaaguaggcacagaucuguc

SEQ ID NO: 677927 - RNA, 25 nt, Human
uaacuucuaggccccauuuuccccu

SEQ ID NO: 677928 - RNA, 22 nt, Human
uaagaaccaacucaagucaaac

SEQ ID NO: 677929 - RNA, 21 nt, Human
uaccaaaaauugugacaccuu

SEQ ID NO: 677930 - RNA, 23 nt, Human
uagacacuuccaaaguacccccc

SEQ ID NO: 677931 - RNA, 18 nt, Human
uagagagccuuacuggga

SEQ ID NO: 677932 - RNA, 22 nt, Human
uaguacauuucacaguuuucag

SEQ ID NO: 677933 - RNA, 22 nt, Human
uaugauaaaaacaaccauugua

SEQ ID NO: 677934 - RNA, 21 nt, Human
ucaaaaaccuaaucugcuucu

SEQ ID NO: 677935 - RNA, 19 nt, Human
ucagcgcugagaaucucuu

SEQ ID NO: 677936 - RNA, 18 nt, Human
ucagugacugugugccug

SEQ ID NO: 677937 - RNA, 20 nt, Human
uccaguaauaaaguaggcac

SEQ ID NO: 677938 - RNA, 22 nt, Human
ucccagcuacucgggagucugu

SEQ ID NO: 677939 - RNA, 21 nt, Human
uccuaucaaccccaaggagga

SEQ ID NO: 677940 - RNA, 20 nt, Human
ucgcucucccgccgccgccg

SEQ ID NO: 677941 - RNA, 25 nt, Human
ucucccgccgccgccggccucgagc

SEQ ID NO: 677942 - RNA, 19 nt, Human
ucucuuuucgaggcuccgg

SEQ ID NO: 677943 - RNA, 24 nt, Human
ugccuguagucccagcuacucggg

SEQ ID NO: 677944 - RNA, 19 nt, Human
ugcucuguaacuucuaggc

SEQ ID NO: 677945 - RNA, 20 nt, Human
uggccuguuuguuuugucaa

SEQ ID NO: 677946 - RNA, 23 nt, Human
uguccacaacaaacuugcccucu

SEQ ID NO: 677947 - RNA, 21 nt, Human
ugugaaauaugugauuccagu

SEQ ID NO: 677948 - RNA, 24 nt, Human
uguuuuucuaaacaguccuaauuu

SEQ ID NO: 677949 - RNA, 22 nt, Human
uuccccucugaaaauaagaggg

SEQ ID NO: 677950 - RNA, 19 nt, Human
uucucacacagaacagcuu

SEQ ID NO: 677951 - RNA, 20 nt, Human
uucucacgaaauaccuacua

SEQ ID NO: 677952 - RNA, 21 nt, Human
uucucugucucuccuucacag

SEQ ID NO: 677953 - RNA, 21 nt, Human
uugcccacacacgaagcaaag

SEQ ID NO: 677954 - RNA, 19 nt, Human
uugccucucaccaugcucu

SEQ ID NO: 677955 - RNA, 23 nt, Human
uugccuuuucugggugggaaagu

SEQ ID NO: 677956 - RNA, 19 nt, Human
uuucacaauaaucaucuuc

SEQ ID NO: 677957 - RNA, 21 nt, Human
uuuuuuuuuuuuuuuuuuaag

SEQ ID NO: 677958 - RNA, 28 nt, Human
aaaaacagaaagaggaaggccgguaccc

SEQ ID NO: 677959 - RNA, 18 nt, Human
aaaaagaaacucaagauu

SEQ ID NO: 677960 - RNA, 20 nt, Human
aaaacagaaagaggaaggcc

SEQ ID NO: 677961 - RNA, 22 nt, Human
aaaaccagaagucaacagaaga

SEQ ID NO: 677962 - RNA, 20 nt, Human
aacaaaaaaaaucucuaaac

SEQ ID NO: 677963 - RNA, 19 nt, Human
aacagguaacagugaggau

SEQ ID NO: 677964 - RNA, 19 nt, Human
aaccaauggugaugauaca

SEQ ID NO: 677965 - RNA, 22 nt, Human
aaguagaccagaaacccaaaac

SEQ ID NO: 677966 - RNA, 20 nt, Human
aagugauaaagaaauaguaa

SEQ ID NO: 677967 - RNA, 18 nt, Human
acacacaucuuuucucuc

SEQ ID NO: 677968 - RNA, 21 nt, Human
accaugauugaagcaagcgag

SEQ ID NO: 677969 - RNA, 21 nt, Human
agaaacccaaaacagguaaca

SEQ ID NO: 677970 - RNA, 19 nt, Human
agaaaggagaaugguucac

SEQ ID NO: 677971 - RNA, 25 nt, Human
agaaauuauaaaaacaguaagauaa

SEQ ID NO: 677972 - RNA, 22 nt, Human
aggagaggagcgccuuccugcc

SEQ ID NO: 677973 - RNA, 19 nt, Human
aggcagaaugcuagaugua

SEQ ID NO: 677974 - RNA, 23 nt, Human
agggacauuuuauauuaaguauu

SEQ ID NO: 677975 - RNA, 21 nt, Human
agguaacagugaggauggaac

SEQ ID NO: 677976 - RNA, 24 nt, Human
agucaugaggaaacaggucagggc

SEQ ID NO: 677977 - RNA, 22 nt, Human
augcuaauuauccuaauuguau

SEQ ID NO: 677978 - RNA, 19 nt, Human
auggaaugcagcccauccc

SEQ ID NO: 677979 - RNA, 23 nt, Human
auggcaacagggaauggaaugcc

SEQ ID NO: 677980 - RNA, 21 nt, Human
caaaaaaaaucucuaaacacc

SEQ ID NO: 677981 - RNA, 19 nt, Human
caaaaaagaaaaagccacc

SEQ ID NO: 677982 - RNA, 21 nt, Human
caaaauacuaagaugggagca

SEQ ID NO: 677983 - RNA, 22 nt, Human
caaaguagaccagaaacccaaa

SEQ ID NO: 677984 - RNA, 19 nt, Human
caaauuacagaaaaccaga

SEQ ID NO: 677985 - RNA, 23 nt, Human
caagcugaggucauccaaaagcu

SEQ ID NO: 677986 - RNA, 23 nt, Human
cacagcucaaaaaaucccaggac

SEQ ID NO: 677987 - RNA, 22 nt, Human
cacaucuuuucucucuccuuca

SEQ ID NO: 677988 - RNA, 25 nt, Human
cacguacaaaaaagaaaaagccacc

SEQ ID NO: 677989 - RNA, 19 nt, Human
cagaaaaagaaacucaaga

SEQ ID NO: 677990 - RNA, 18 nt, Human
cagaagccaauuauagug

SEQ ID NO: 677991 - RNA, 21 nt, Human
cagcagaauccuguacacgua

SEQ ID NO: 677992 - RNA, 19 nt, Human
caggcacuuucaagaucau

SEQ ID NO: 677993 - RNA, 18 nt, Human
caggucagggcgaagcgg

SEQ ID NO: 677994 - RNA, 18 nt, Human
caucucaacugaagucua

SEQ ID NO: 677995 - RNA, 24 nt, Human
ccaugauugaagcaagcgaggggc

SEQ ID NO: 677996 - RNA, 18 nt, Human
ccuccgauccggguuucc

SEQ ID NO: 677997 - RNA, 25 nt, Human
ccuucagcgacaagaggucggaauc

SEQ ID NO: 677998 - RNA, 24 nt, Human
cuaaacaccugaaagccccacuuc

SEQ ID NO: 677999 - RNA, 23 nt, Human
cuccuccccgcgcggccuccgau

SEQ ID NO: 678000 - RNA, 18 nt, Human
cucucguaccagcagaau

SEQ ID NO: 678001 - RNA, 18 nt, Human
gaccgggucgcccuccuc

SEQ ID NO: 678002 - RNA, 20 nt, Human
gagcagggguggccagaaga

SEQ ID NO: 678003 - RNA, 23 nt, Human
gagcagggguggccagaagaagg

SEQ ID NO: 678004 - RNA, 18 nt, Human
gaggauggcaacagggaa

SEQ ID NO: 678005 - RNA, 24 nt, Human
gaggcgccgagccgggccgagagg

SEQ ID NO: 678006 - RNA, 19 nt, Human
ggcacagcucaaaaaaucc

SEQ ID NO: 678007 - RNA, 21 nt, Human
gggcaggagaggagcgccuuc

SEQ ID NO: 678008 - RNA, 23 nt, Human
gggccgggggcagucaugaggaa

SEQ ID NO: 678009 - RNA, 19 nt, Human
gguaacagugaggauggcc

SEQ ID NO: 678010 - RNA, 23 nt, Human
guacaaaaaagaaaaagccaccc

SEQ ID NO: 678011 - RNA, 18 nt, Human
guacacguacaaaaaaga

SEQ ID NO: 678012 - RNA, 21 nt, Human
uacaaaaaagaaaaagccacc

SEQ ID NO: 678013 - RNA, 21 nt, Human
uacaauaaagugauaaagaaa

SEQ ID NO: 678014 - RNA, 18 nt, Human
uaccauaaauggcacagc

SEQ ID NO: 678015 - RNA, 19 nt, Human
uaccuuuggugaguugaag

SEQ ID NO: 678016 - RNA, 23 nt, Human
uaguauacauauuagggaauccc

SEQ ID NO: 678017 - RNA, 25 nt, Human
ucaaaaaaucccaggaccaaucaga

SEQ ID NO: 678018 - RNA, 18 nt, Human
ucaaaguagaccagaaac

SEQ ID NO: 678019 - RNA, 21 nt, Human
ucaaaguagaccagaaaccca

SEQ ID NO: 678020 - RNA, 21 nt, Human
ucaaauaaccaugauugaagc

SEQ ID NO: 678021 - RNA, 23 nt, Human
ucaaauaaccaugauugaagcaa

SEQ ID NO: 678022 - RNA, 26 nt, Human
ucaaauaaccaugauugaagcaagcg

SEQ ID NO: 678023 - RNA, 18 nt, Human
ucccaaacuggcucugug

SEQ ID NO: 678024 - RNA, 21 nt, Human
ucccuuaaaauucaacucuag

SEQ ID NO: 678025 - RNA, 22 nt, Human
ucuaaaaaggggaugcauaggc

SEQ ID NO: 678026 - RNA, 21 nt, Human
ucuaaacaccugaaagcccca

SEQ ID NO: 678027 - RNA, 21 nt, Human
ucucuaaacaccugaaagccc

SEQ ID NO: 678028 - RNA, 26 nt, Human
ugaaagucaaaguagaccagaaaccc

SEQ ID NO: 678029 - RNA, 27 nt, Human
ugcaaugaauguuaacaacaacaaaaa

SEQ ID NO: 678030 - RNA, 24 nt, Human
uggaaugccaauauggcaguaaaa

SEQ ID NO: 678031 - RNA, 20 nt, Human
uggagaaacucaagcugagg

SEQ ID NO: 678032 - RNA, 21 nt, Human
uggcacagcucaaaaaauccc

SEQ ID NO: 678033 - RNA, 21 nt, Human
uggccagaagaagggguaauu

SEQ ID NO: 678034 - RNA, 19 nt, Human
uggccgggcgucggcgggg

SEQ ID NO: 678035 - RNA, 18 nt, Human
ugggaagcaaaauccaag

SEQ ID NO: 678036 - RNA, 18 nt, Human
ugggagcagggguggcca

SEQ ID NO: 678037 - RNA, 18 nt, Human
uguaaaacagaagccaau

SEQ ID NO: 678038 - RNA, 18 nt, Human
uguggacagaaaaagaaa

SEQ ID NO: 678039 - RNA, 18 nt, Human
uuacuucagauaaaaaga

SEQ ID NO: 678040 - RNA, 23 nt, Human
uugcaaugaauguuaacaacaac

SEQ ID NO: 678041 - RNA, 23 nt, Human
uuuacuuguggacagaaaaagaa

SEQ ID NO: 678042 - RNA, 23 nt, Human
uuuuuuuuuuuuuuuuuuucagg

SEQ ID NO: 678043 - RNA, 20 nt, Human
aaacauauacaaaucaauga

SEQ ID NO: 678044 - RNA, 21 nt, Human
agauuuauguuugagcagcuu

SEQ ID NO: 678045 - RNA, 21 nt, Human
aggcaaacaaagaacaccugg

SEQ ID NO: 678046 - RNA, 20 nt, Human
gaacuggaagccagaaaggu

SEQ ID NO: 678047 - RNA, 20 nt, Human
uaaaaaaauugggacguggg

SEQ ID NO: 678048 - RNA, 21 nt, Human
uagcuugaauauaaaagaagc

SEQ ID NO: 678049 - RNA, 23 nt, Human
uagcuugaauauaaaagaagcuc

SEQ ID NO: 678050 - RNA, 27 nt, Human
ucaaugagcuuuccaacaucacauaau

SEQ ID NO: 678051 - RNA, 21 nt, Human
ucuucuuuuucauguuuagcu

SEQ ID NO: 678052 - RNA, 24 nt, Human
ugagcagcuugaaaagaauccguu

SEQ ID NO: 678053 - RNA, 24 nt, Human
uuggcugagcguugucuagaaauu

SEQ ID NO: 678054 - RNA, 25 nt, Human
uuuuucuucuuuuucauguuuagcu

SEQ ID NO: 678055 - RNA, 20 nt, Human
aaaaacagggauaucugcau

SEQ ID NO: 678056 - RNA, 19 nt, Human
aaaucaauuccaguuaacu

SEQ ID NO: 678057 - RNA, 20 nt, Human
aacuuaccaucucuuaaaaa

SEQ ID NO: 678058 - RNA, 18 nt, Human
aagcaacagcagcaguua

SEQ ID NO: 678059 - RNA, 23 nt, Human
aagcaacagcagcaguuacaaaa

SEQ ID NO: 678060 - RNA, 23 nt, Human
aagcgcuuucugacaucucaccc

SEQ ID NO: 678061 - RNA, 19 nt, Human
acagugcgcgcuguagaac

SEQ ID NO: 678062 - RNA, 23 nt, Human
acuuuauaagguguauguagaaa

SEQ ID NO: 678063 - RNA, 23 nt, Human
agaaagcaaacauaggacgugaa

SEQ ID NO: 678064 - RNA, 25 nt, Human
agaaagcaaacauaggacgugaaaa

SEQ ID NO: 678065 - RNA, 26 nt, Human
agaaagcaaacauaggacgugaaaaa

SEQ ID NO: 678066 - RNA, 24 nt, Human
agagugccaccuucugguuuaaaa

SEQ ID NO: 678067 - RNA, 20 nt, Human
agaugcacacccccaggaac

SEQ ID NO: 678068 - RNA, 23 nt, Human
aggauacaacccacguccucguu

SEQ ID NO: 678069 - RNA, 19 nt, Human
aguuaacagugcgcgcugu

SEQ ID NO: 678070 - RNA, 22 nt, Human
auguaacacaagaaaaaaagua

SEQ ID NO: 678071 - RNA, 25 nt, Human
auuucauuuucuuacggaaggagca

SEQ ID NO: 678072 - RNA, 26 nt, Human
auuucauuuucuuacggaaggagcag

SEQ ID NO: 678073 - RNA, 23 nt, Human
caaaguacaagaaauguugcgug

SEQ ID NO: 678074 - RNA, 20 nt, Human
caacagcagcaguuacaaaa

SEQ ID NO: 678075 - RNA, 20 nt, Human
cacacccccaggaacggcag

SEQ ID NO: 678076 - RNA, 23 nt, Human
caucucuuaaaaaugggagaaag

SEQ ID NO: 678077 - RNA, 19 nt, Human
ccaccuucugguuuaaaac

SEQ ID NO: 678078 - RNA, 18 nt, Human
ccaguauagcuauaauac

SEQ ID NO: 678079 - RNA, 20 nt, Human
ccccgccaccaccuuucccg

SEQ ID NO: 678080 - RNA, 21 nt, Human
ccccgccaccaccuuucccga

SEQ ID NO: 678081 - RNA, 19 nt, Human
cccuagcgugugagcccca

SEQ ID NO: 678082 - RNA, 18 nt, Human
ccgaagaugcacaccccc

SEQ ID NO: 678083 - RNA, 21 nt, Human
cgaagaugcacacccccagga

SEQ ID NO: 678084 - RNA, 20 nt, Human
cgccccgccaccaccuuucc

SEQ ID NO: 678085 - RNA, 21 nt, Human
cuuucugacaucucacccuag

SEQ ID NO: 678086 - RNA, 22 nt, Human
gaagaugcacacccccaggaac

SEQ ID NO: 678087 - RNA, 21 nt, Human
gcaacagcagcaguuacaaaa

SEQ ID NO: 678088 - RNA, 21 nt, Human
gcacacccccaggaacggcag

SEQ ID NO: 678089 - RNA, 26 nt, Human
gcacacccccaggaacgggggaacgc

SEQ ID NO: 678090 - RNA, 22 nt, Human
gccaccuucugguuuaaaacug

SEQ ID NO: 678091 - RNA, 19 nt, Human
gccccgccaccaccuuucc

SEQ ID NO: 678092 - RNA, 24 nt, Human
gcuguagaacuuuaacacaagucu

SEQ ID NO: 678093 - RNA, 18 nt, Human
ggcagugcaagccuggca

SEQ ID NO: 678094 - RNA, 21 nt, Human
uacaaaguacaagaaauguug

SEQ ID NO: 678095 - RNA, 20 nt, Human
uacaguuuagugaggugguc

SEQ ID NO: 678096 - RNA, 20 nt, Human
uaguagagaugcgacucacg

SEQ ID NO: 678097 - RNA, 24 nt, Human
uaguagagaugcgacucacggaga

SEQ ID NO: 678098 - RNA, 26 nt, Human
ucaguaaaucaauuccaguuaacuua

SEQ ID NO: 678099 - RNA, 20 nt, Human
ugaagaaaaagacguucagu

SEQ ID NO: 678100 - RNA, 20 nt, Human
ugcaagccuggcagcaagcc

SEQ ID NO: 678101 - RNA, 19 nt, Human
ugcacacccccaggaacgg

SEQ ID NO: 678102 - RNA, 21 nt, Human
ugggagaaagcaaacauagga

SEQ ID NO: 678103 - RNA, 26 nt, Human
uguuuaaaauacaagcgcuuucugac

SEQ ID NO: 678104 - RNA, 21 nt, Human
uuucccgaagaugcacacccc

SEQ ID NO: 678105 - RNA, 26 nt, Human
uuuuuuuuuuauuucaaaaacagggg

SEQ ID NO: 678106 - RNA, 21 nt, Human
uuuuuuuuuuuuuuuuuauuu

SEQ ID NO: 678107 - RNA, 25 nt, Human
aaaauguacuaaaaauaaaugcuug

SEQ ID NO: 678108 - RNA, 19 nt, Human
acagcccagaugaucagca

SEQ ID NO: 678109 - RNA, 18 nt, Human
acuacagcaacugcauug

SEQ ID NO: 678110 - RNA, 19 nt, Human
agccgggcagggcccgccc

SEQ ID NO: 678111 - RNA, 22 nt, Human
agcuuuggcauuagcaauuuua

SEQ ID NO: 678112 - RNA, 18 nt, Human
aggagggacaaagaaccg

SEQ ID NO: 678113 - RNA, 19 nt, Human
aggagggacaaagaaccgg

SEQ ID NO: 678114 - RNA, 22 nt, Human
aucacagcccagaugaucagca

SEQ ID NO: 678115 - RNA, 19 nt, Human
cagcccagaugaucagcaa

SEQ ID NO: 678116 - RNA, 19 nt, Human
ccagcaccuggccgcggac

SEQ ID NO: 678117 - RNA, 21 nt, Human
ccgugccggccacaggcugca

SEQ ID NO: 678118 - RNA, 20 nt, Human
ccuggccgcggaccucggcc

SEQ ID NO: 678119 - RNA, 21 nt, Human
cuccguggaggggcagcggcg

SEQ ID NO: 678120 - RNA, 21 nt, Human
cucgcguugucugcccgugcc

SEQ ID NO: 678121 - RNA, 20 nt, Human
gaucagcaacuccguggagg

SEQ ID NO: 678122 - RNA, 18 nt, Human
gcagcggcgccagcaccu

SEQ ID NO: 678123 - RNA, 18 nt, Human
gcccagaugaucagcaac

SEQ ID NO: 678124 - RNA, 22 nt, Human
ggcagcggcgccagcaccuggc

SEQ ID NO: 678125 - RNA, 21 nt, Human
ggccgggcuccugcaccguca

SEQ ID NO: 678126 - RNA, 23 nt, Human
gggcagcggcgccagcaccuggc

SEQ ID NO: 678127 - RNA, 20 nt, Human
gggcgccgcggccgggcucc

SEQ ID NO: 678128 - RNA, 19 nt, Human
guggaggggcagcggcgcc

SEQ ID NO: 678129 - RNA, 24 nt, Human
uaacuggcuccucuuuggauuuau

SEQ ID NO: 678130 - RNA, 22 nt, Human
uaggagggacaaagaaccgggu

SEQ ID NO: 678131 - RNA, 21 nt, Human
uauuucuuuuaauacaaagcu

SEQ ID NO: 678132 - RNA, 20 nt, Human
ucugcagcaaggcaauccac

SEQ ID NO: 678133 - RNA, 22 nt, Human
uggcaugauugguaaaugaugc

SEQ ID NO: 678134 - RNA, 24 nt, Human
uuucuuuuaauacaaagcuuuggc

SEQ ID NO: 678135 - RNA, 23 nt, Human
uuuuuuuuuuuuuuuuuuauuuu

SEQ ID NO: 678136 - RNA, 23 nt, Human
aacuucauuucuucggugacugu

SEQ ID NO: 678137 - RNA, 24 nt, Human
accucaaaggcagagacaaaagga

SEQ ID NO: 678138 - RNA, 20 nt, Human
acugugaagcugagggcaga

SEQ ID NO: 678139 - RNA, 18 nt, Human
aggcagagacaaaaggac

SEQ ID NO: 678140 - RNA, 20 nt, Human
aggcagggugcggcuguggg

SEQ ID NO: 678141 - RNA, 22 nt, Human
aggcagggugcggcuguggggc

SEQ ID NO: 678142 - RNA, 20 nt, Human
aggggacagucgaggcuuga

SEQ ID NO: 678143 - RNA, 23 nt, Human
caacgccccagaagcccugcaag

SEQ ID NO: 678144 - RNA, 24 nt, Human
caacgccccagaagcccugcaagg

SEQ ID NO: 678145 - RNA, 18 nt, Human
caccgccucggccccugc

SEQ ID NO: 678146 - RNA, 24 nt, Human
cagggugcggcuguggggcaggug

SEQ ID NO: 678147 - RNA, 18 nt, Human
cccaacgccccagaagcc

SEQ ID NO: 678148 - RNA, 23 nt, Human
ccccagaagcccugcaaggaucc

SEQ ID NO: 678149 - RNA, 19 nt, Human
cccccgaggucccaccgcc

SEQ ID NO: 678150 - RNA, 20 nt, Human
cccccgaggucccaccgccu

SEQ ID NO: 678151 - RNA, 24 nt, Human
cccgccaaccucaaaggcagagac

SEQ ID NO: 678152 - RNA, 23 nt, Human
ccucaaaggcagagacaaaagga

SEQ ID NO: 678153 - RNA, 19 nt, Human
ccucuggccuccagcgagg

SEQ ID NO: 678154 - RNA, 25 nt, Human
ccuggguuucccaacgccccagaag

SEQ ID NO: 678155 - RNA, 19 nt, Human
cgccucggccccugccggc

SEQ ID NO: 678156 - RNA, 21 nt, Human
cgccucggccccugccggcuc

SEQ ID NO: 678157 - RNA, 21 nt, Human
cggagagaggagcuggugucc

SEQ ID NO: 678158 - RNA, 20 nt, Human
cggccccugccggcucuggg

SEQ ID NO: 678159 - RNA, 19 nt, Human
cggcgggccuggguuuccc

SEQ ID NO: 678160 - RNA, 21 nt, Human
cuuggccucuggccuccagcc

SEQ ID NO: 678161 - RNA, 26 nt, Human
gccaaccucaaaggcagagacaaaag

SEQ ID NO: 678162 - RNA, 25 nt, Human
gccccagaagcccugcaaggauccu

SEQ ID NO: 678163 - RNA, 22 nt, Human
ggacggugugccccuccuguaa

SEQ ID NO: 678164 - RNA, 21 nt, Human
ggugacugugaagcugagggc

SEQ ID NO: 678165 - RNA, 18 nt, Human
gugcggcuguggggcagg

SEQ ID NO: 678166 - RNA, 24 nt, Human
uaacuucauuucuucggugacugu

SEQ ID NO: 678167 - RNA, 21 nt, Human
ucaaaggcagagacaaaagga

SEQ ID NO: 678168 - RNA, 21 nt, Human
ucccaacgccccagaagcccu

SEQ ID NO: 678169 - RNA, 18 nt, Human
ucccaccgccucggcccc

SEQ ID NO: 678170 - RNA, 22 nt, Human
uccucggccuccccggugacgg

SEQ ID NO: 678171 - RNA, 20 nt, Human
ugacggcggagagaggagcu

SEQ ID NO: 678172 - RNA, 22 nt, Human
ugacggcggagagaggagcugg

SEQ ID NO: 678173 - RNA, 23 nt, Human
ugagggcagagucguggccggcg

SEQ ID NO: 678174 - RNA, 22 nt, Human
uggccggcgggccuggguuucc

SEQ ID NO: 678175 - RNA, 18 nt, Human
uggccucuggccuccagc

SEQ ID NO: 678176 - RNA, 19 nt, Human
uucccaacgccccagaagc

SEQ ID NO: 678177 - RNA, 21 nt, Human
uucccaacgccccagaagccc

SEQ ID NO: 678178 - RNA, 23 nt, Human
aaaaaauucuaaaacaucacuga

SEQ ID NO: 678179 - RNA, 18 nt, Human
aaaaagaugccaucuaca

SEQ ID NO: 678180 - RNA, 22 nt, Human
aaaacaaaaacaaaaaauuaga

SEQ ID NO: 678181 - RNA, 21 nt, Human
aaacaaaaacaaaaaauuaga

SEQ ID NO: 678182 - RNA, 22 nt, Human
aaacaagguggagagaugaccc

SEQ ID NO: 678183 - RNA, 24 nt, Human
aaagugcugggauuacaggcguga

SEQ ID NO: 678184 - RNA, 18 nt, Human
aacacaguccagcccccc

SEQ ID NO: 678185 - RNA, 23 nt, Human
aacacuaucccucucccagccac

SEQ ID NO: 678186 - RNA, 25 nt, Human
aaccaacucccaacugcagaaccca

SEQ ID NO: 678187 - RNA, 23 nt, Human
aaccacaguuuacaaacgucaag

SEQ ID NO: 678188 - RNA, 19 nt, Human
aaccuggagggcggaggcu

SEQ ID NO: 678189 - RNA, 24 nt, Human
aacugcagaacccagaaacaaaug

SEQ ID NO: 678190 - RNA, 19 nt, Human
aagaagaaaaaugauauga

SEQ ID NO: 678191 - RNA, 20 nt, Human
aagaggaagaagagaggagg

SEQ ID NO: 678192 - RNA, 23 nt, Human
aagaggaagaagagaggaggagu

SEQ ID NO: 678193 - RNA, 19 nt, Human
aagccaagagcagugggga

SEQ ID NO: 678194 - RNA, 22 nt, Human
aaggauggguccaacacagucc

SEQ ID NO: 678195 - RNA, 19 nt, Human
aaguagcugggacuacagg

SEQ ID NO: 678196 - RNA, 20 nt, Human
aaguagcugggacuacaggc

SEQ ID NO: 678197 - RNA, 25 nt, Human
aaguagcugggacuacaggcaccug

SEQ ID NO: 678198 - RNA, 19 nt, Human
aagugcugggauuacaggc

SEQ ID NO: 678199 - RNA, 19 nt, Human
aagugcugggauuacaggc

SEQ ID NO: 678200 - RNA, 20 nt, Human
aaucaagcuuaucauuauau

SEQ ID NO: 678201 - RNA, 24 nt, Human
acacugggcaccuggagggaaggc

SEQ ID NO: 678202 - RNA, 25 nt, Human
acacugggcaccuggagggaaggcu

SEQ ID NO: 678203 - RNA, 21 nt, Human
acagauucuuccccaaauuag

SEQ ID NO: 678204 - RNA, 18 nt, Human
acgggguuucaccaucuu

SEQ ID NO: 678205 - RNA, 20 nt, Human
acgggguuucaccaucuugg

SEQ ID NO: 678206 - RNA, 24 nt, Human
acgggguuucaccaucuuggccag

SEQ ID NO: 678207 - RNA, 18 nt, Human
acugcacgccagccuggg

SEQ ID NO: 678208 - RNA, 20 nt, Human
acuguccaaaaacaaaaaca

SEQ ID NO: 678209 - RNA, 18 nt, Human
agaaaaacaagguggaga

SEQ ID NO: 678210 - RNA, 20 nt, Human
agaaaccaacucccaacugc

SEQ ID NO: 678211 - RNA, 25 nt, Human
agaaaccaacucccaacugcagaac

SEQ ID NO: 678212 - RNA, 19 nt, Human
agaaaucaugaugccaaua

SEQ ID NO: 678213 - RNA, 20 nt, Human
agaacccagaaacaaaugcc

SEQ ID NO: 678214 - RNA, 22 nt, Human
agaagaaaaacaagguggagag

SEQ ID NO: 678215 - RNA, 21 nt, Human
agacaaguagaccaauggaga

SEQ ID NO: 678216 - RNA, 21 nt, Human
agacuagaaacaucacauuua

SEQ ID NO: 678217 - RNA, 26 nt, Human
agacuguccaaaaacaaaaacaaagc

SEQ ID NO: 678218 - RNA, 20 nt, Human
agagaggaggaguggggagg

SEQ ID NO: 678219 - RNA, 21 nt, Human
agagaggaggaguggggaggg

SEQ ID NO: 678220 - RNA, 27 nt, Human
agagaggaggaguggggaggggaggga

SEQ ID NO: 678221 - RNA, 20 nt, Human
agaggaagaagagaggagga

SEQ ID NO: 678222 - RNA, 21 nt, Human
agaggaagaagagaggaggag

SEQ ID NO: 678223 - RNA, 19 nt, Human
agagggggaggaggaggga

SEQ ID NO: 678224 - RNA, 21 nt, Human
agcaaguggaaacucacagga

SEQ ID NO: 678225 - RNA, 20 nt, Human
agcacuuugggaggcuaagg

SEQ ID NO: 678226 - RNA, 19 nt, Human
agccccccggcagugucag

SEQ ID NO: 678227 - RNA, 23 nt, Human
agccggguguaguggcacacgcc

SEQ ID NO: 678228 - RNA, 22 nt, Human
aggaagaagcaaauuaucagaa

SEQ ID NO: 678229 - RNA, 21 nt, Human
aggaagagggugguauccuug

SEQ ID NO: 678230 - RNA, 20 nt, Human
aggagggguugcgggcccgu

SEQ ID NO: 678231 - RNA, 22 nt, Human
aggcaugagaaucacuugaacc

SEQ ID NO: 678232 - RNA, 24 nt, Human
aggcaugagaaucacuugaaccug

SEQ ID NO: 678233 - RNA, 21 nt, Human
aggcgggcagaucacuugugg

SEQ ID NO: 678234 - RNA, 26 nt, Human
aggcgggcagaucacuuguggccagg

SEQ ID NO: 678235 - RNA, 23 nt, Human
agggggaggaggagggaaaggaa

SEQ ID NO: 678236 - RNA, 24 nt, Human
agguguaguggcuugcgccuguaa

SEQ ID NO: 678237 - RNA, 21 nt, Human
aguagaccaauggagaaccca

SEQ ID NO: 678238 - RNA, 20 nt, Human
agugcaguggcacgaucucg

SEQ ID NO: 678239 - RNA, 23 nt, Human
agugcaguggcacgaucucggcu

SEQ ID NO: 678240 - RNA, 24 nt, Human
agugcaguggcacgaucucggcuc

SEQ ID NO: 678241 - RNA, 18 nt, Human
agugcugggauuacaggc

SEQ ID NO: 678242 - RNA, 24 nt, Human
aguggcuugcgccuguaaucccag

SEQ ID NO: 678243 - RNA, 22 nt, Human
auagagcaacagccuauccuuu

SEQ ID NO: 678244 - RNA, 23 nt, Human
aucacuuguggccaggaguucaa

SEQ ID NO: 678245 - RNA, 25 nt, Human
aucccucucccagccacccccccaa

SEQ ID NO: 678246 - RNA, 24 nt, Human
auuuacugcaauuuucuuuuucuu

SEQ ID NO: 678247 - RNA, 24 nt, Human
auuuuuguauuuuuaguagagacg

SEQ ID NO: 678248 - RNA, 26 nt, Human
caaaaacaaaaaauuagauagagcaa

SEQ ID NO: 678249 - RNA, 20 nt, Human
caaaguaacugaaagacuua

SEQ ID NO: 678250 - RNA, 24 nt, Human
caaagugcugggauuacaggcgug

SEQ ID NO: 678251 - RNA, 18 nt, Human
caacacaguccagccccc

SEQ ID NO: 678252 - RNA, 24 nt, Human
caacucccaacugcagaacccaga

SEQ ID NO: 678253 - RNA, 22 nt, Human
caagaccaggaguuugagauca

SEQ ID NO: 678254 - RNA, 19 nt, Human
caagugauucuccugccuc

SEQ ID NO: 678255 - RNA, 28 nt, Human
caagugauucuccugccucgguguccca

SEQ ID NO: 678256 - RNA, 22 nt, Human
caauagcaaugacaaaucaaaa

SEQ ID NO: 678257 - RNA, 21 nt, Human
caccaucuuggccagcuguuc

SEQ ID NO: 678258 - RNA, 23 nt, Human
caccaucuuggccagcuguucuc

SEQ ID NO: 678259 - RNA, 22 nt, Human
cacccaccucagccucccaaag

SEQ ID NO: 678260 - RNA, 23 nt, Human
cacccaccucagccucccaaagu

SEQ ID NO: 678261 - RNA, 23 nt, Human
cacccagggcugaggccauccgc

SEQ ID NO: 678262 - RNA, 21 nt, Human
cacccccccaacaguccaggc

SEQ ID NO: 678263 - RNA, 24 nt, Human
caccgcacccagcuaauuuuugua

SEQ ID NO: 678264 - RNA, 24 nt, Human
caccucagccucccaaagugcugg

SEQ ID NO: 678265 - RNA, 23 nt, Human
cacgccagccugggccacagagc

SEQ ID NO: 678266 - RNA, 19 nt, Human
cacgccucuaaucccagcu

SEQ ID NO: 678267 - RNA, 21 nt, Human
cacuaucccucucccagccac

SEQ ID NO: 678268 - RNA, 21 nt, Human
cacugcaaccuccgccucccg

SEQ ID NO: 678269 - RNA, 23 nt, Human
cacugcaaccuccgccucccggg

SEQ ID NO: 678270 - RNA, 20 nt, Human
cacugcacgccagccugggc

SEQ ID NO: 678271 - RNA, 24 nt, Human
cacugcacgccagccugggccaca

SEQ ID NO: 678272 - RNA, 19 nt, Human
cacuuguggccaggaguuc

SEQ ID NO: 678273 - RNA, 19 nt, Human
cagaaaauguuuuaaccac

SEQ ID NO: 678274 - RNA, 21 nt, Human
cagaaaccaacucccaacugc

SEQ ID NO: 678275 - RNA, 24 nt, Human
cagaaaccaacucccaacugcaga

SEQ ID NO: 678276 - RNA, 24 nt, Human
cagaacgcugaggcaugagaauca

SEQ ID NO: 678277 - RNA, 21 nt, Human
cagagaaaaauaccaacucaa

SEQ ID NO: 678278 - RNA, 24 nt, Human
cagaucacuuguggccaggaguuc

SEQ ID NO: 678279 - RNA, 19 nt, Human
cagauucuuccccaaauua

SEQ ID NO: 678280 - RNA, 22 nt, Human
cagcacuuugggaggcuaaggc

SEQ ID NO: 678281 - RNA, 24 nt, Human
cagcacuuugggaggcuaaggcgg

SEQ ID NO: 678282 - RNA, 21 nt, Human
cagccacccccccaacagucc

SEQ ID NO: 678283 - RNA, 18 nt, Human
cagccccccggcaguguc

SEQ ID NO: 678284 - RNA, 19 nt, Human
caggagacagccccggccu

SEQ ID NO: 678285 - RNA, 23 nt, Human
caucuggucagguucuaaguaau

SEQ ID NO: 678286 - RNA, 22 nt, Human
ccaaagugcugggauuacaggc

SEQ ID NO: 678287 - RNA, 22 nt, Human
ccaaagugcugggauuacaggc

SEQ ID NO: 678288 - RNA, 24 nt, Human
ccaaagugcugggauuacaggcgu

SEQ ID NO: 678289 - RNA, 25 nt, Human
ccaagccaggcacagcggggcaagg

SEQ ID NO: 678290 - RNA, 26 nt, Human
ccacccaccucagccucccaaagugc

SEQ ID NO: 678291 - RNA, 22 nt, Human
ccacccccccaacaguccaggc

SEQ ID NO: 678292 - RNA, 20 nt, Human
ccacugcacgccagccuggg

SEQ ID NO: 678293 - RNA, 21 nt, Human
ccacugcacgccagccugggc

SEQ ID NO: 678294 - RNA, 24 nt, Human
ccacugcacgccagccugggccac

SEQ ID NO: 678295 - RNA, 19 nt, Human
ccagagacgggcggggaca

SEQ ID NO: 678296 - RNA, 21 nt, Human
ccagccccccggcagugucag

SEQ ID NO: 678297 - RNA, 23 nt, Human
ccaggccaauauggcaaagcccg

SEQ ID NO: 678298 - RNA, 21 nt, Human
cccaacugcagaacccagaaa

SEQ ID NO: 678299 - RNA, 23 nt, Human
cccaaguagcugggacuacaggc

SEQ ID NO: 678300 - RNA, 24 nt, Human
cccaaguagcugggacuacaggca

SEQ ID NO: 678301 - RNA, 24 nt, Human
cccacugcacgccagccugggcca

SEQ ID NO: 678302 - RNA, 26 nt, Human
cccacugcacgccagccugggccaca

SEQ ID NO: 678303 - RNA, 18 nt, Human
cccagaaacaaaugccac

SEQ ID NO: 678304 - RNA, 21 nt, Human
cccggguucaagugauucucc

SEQ ID NO: 678305 - RNA, 23 nt, Human
cccggguucaagugauucuccug

SEQ ID NO: 678306 - RNA, 24 nt, Human
cccucucccagccacccccccaac

SEQ ID NO: 678307 - RNA, 24 nt, Human
ccgccucccggguucaagugauuc

SEQ ID NO: 678308 - RNA, 22 nt, Human
ccgcugggcuaagucauuauau

SEQ ID NO: 678309 - RNA, 19 nt, Human
ccggcagugucagcgcaca

SEQ ID NO: 678310 - RNA, 23 nt, Human
ccuacacugggcaccuggaggga

SEQ ID NO: 678311 - RNA, 28 nt, Human
ccuacugucaaagccaagaagguuuucc

SEQ ID NO: 678312 - RNA, 21 nt, Human
ccuacugucaaagccaagagc

SEQ ID NO: 678313 - RNA, 24 nt, Human
ccucccggguucaagugauucucc

SEQ ID NO: 678314 - RNA, 24 nt, Human
ccuccgagccacaucuggucaggu

SEQ ID NO: 678315 - RNA, 20 nt, Human
ccugaaaaugcucaugcaug

SEQ ID NO: 678316 - RNA, 23 nt, Human
ccugaaauauucauagaauugca

SEQ ID NO: 678317 - RNA, 21 nt, Human
ccugaccugugauccacccac

SEQ ID NO: 678318 - RNA, 22 nt, Human
cgccagaaaauguuuuaaccac

SEQ ID NO: 678319 - RNA, 25 nt, Human
cgcccuguguccaaguguucucauu

SEQ ID NO: 678320 - RNA, 18 nt, Human
cgccucuaaucccagcua

SEQ ID NO: 678321 - RNA, 20 nt, Human
cgccuguaaucccagcacuu

SEQ ID NO: 678322 - RNA, 23 nt, Human
cgccuguaaucccagcacuuugg

SEQ ID NO: 678323 - RNA, 24 nt, Human
cgccuguaaucccagcacuuuggg

SEQ ID NO: 678324 - RNA, 24 nt, Human
cgcucugucgcccaggcuagagug

SEQ ID NO: 678325 - RNA, 21 nt, Human
cggcccacugcacgccagccu

SEQ ID NO: 678326 - RNA, 24 nt, Human
cgggcagaucacuuguggccagga

SEQ ID NO: 678327 - RNA, 19 nt, Human
cggggacagagagaggagg

SEQ ID NO: 678328 - RNA, 23 nt, Human
cgggguuucaccaucuuggccag

SEQ ID NO: 678329 - RNA, 23 nt, Human
cuaauuuuuguauuuuuaguaga

SEQ ID NO: 678330 - RNA, 25 nt, Human
cuauaccaaaaauuauuaaagcucc

SEQ ID NO: 678331 - RNA, 24 nt, Human
cuaugagugagaacaugcgguguu

SEQ ID NO: 678332 - RNA, 24 nt, Human
cucacugcaaccuccgccucccgg

SEQ ID NO: 678333 - RNA, 20 nt, Human
cucccggguucaagugauuc

SEQ ID NO: 678334 - RNA, 23 nt, Human
cucugucgcccaggcuagagugc

SEQ ID NO: 678335 - RNA, 21 nt, Human
cucugugcaggagacagcccc

SEQ ID NO: 678336 - RNA, 23 nt, Human
cugaaaaugcucaugcaugaaug

SEQ ID NO: 678337 - RNA, 19 nt, Human
cugacccugaaauauucau

SEQ ID NO: 678338 - RNA, 18 nt, Human
cugagacggcccacugca

SEQ ID NO: 678339 - RNA, 23 nt, Human
cugcaaccuccgccucccggguu

SEQ ID NO: 678340 - RNA, 18 nt, Human
cugcaauuuucuuuuucu

SEQ ID NO: 678341 - RNA, 24 nt, Human
cugcacuccaaaguaacugaaaga

SEQ ID NO: 678342 - RNA, 19 nt, Human
cuuacccaaagucccaugc

SEQ ID NO: 678343 - RNA, 23 nt, Human
cuuguggccaggaguucaagacc

SEQ ID NO: 678344 - RNA, 21 nt, Human
gaaaccaaggcuuagagaaug

SEQ ID NO: 678345 - RNA, 23 nt, Human
gaaaggaaggcguggcagugaga

SEQ ID NO: 678346 - RNA, 21 nt, Human
gaacccagaaaccaacuccca

SEQ ID NO: 678347 - RNA, 20 nt, Human
gaagaggaagaagagaggag

SEQ ID NO: 678348 - RNA, 21 nt, Human
gaagaggaagaagagaggagg

SEQ ID NO: 678349 - RNA, 18 nt, Human
gacagcagcgggucugga

SEQ ID NO: 678350 - RNA, 24 nt, Human
gacagcagcgggucuggauucccc

SEQ ID NO: 678351 - RNA, 23 nt, Human
gaccugugauccacccaccucag

SEQ ID NO: 678352 - RNA, 24 nt, Human
gagacgggguuucaccaucuuggc

SEQ ID NO: 678353 - RNA, 23 nt, Human
gagaggaggaguggggaggggag

SEQ ID NO: 678354 - RNA, 25 nt, Human
gagaguuuuuccauaaauggcacaa

SEQ ID NO: 678355 - RNA, 18 nt, Human
gaguggggaggggaggga

SEQ ID NO: 678356 - RNA, 24 nt, Human
gaucacuuguggccaggaguucaa

SEQ ID NO: 678357 - RNA, 19 nt, Human
gauccagcucuccugcucc

SEQ ID NO: 678358 - RNA, 27 nt, Human
gauccagcucuccugcuccacauccac

SEQ ID NO: 678359 - RNA, 18 nt, Human
gauuacaggcgugagcug

SEQ ID NO: 678360 - RNA, 19 nt, Human
gauuacaggcgugagcugu

SEQ ID NO: 678361 - RNA, 24 nt, Human
gauuccuacugucaaagccaagag

SEQ ID NO: 678362 - RNA, 22 nt, Human
gcaaccacaguuuacaaacguc

SEQ ID NO: 678363 - RNA, 22 nt, Human
gcaaccuccgccucccggguuc

SEQ ID NO: 678364 - RNA, 20 nt, Human
gcauccugaggauaaagacu

SEQ ID NO: 678365 - RNA, 23 nt, Human
gccaagccaggcacagcggggca

SEQ ID NO: 678366 - RNA, 24 nt, Human
gccucggugucccaaguagcuggg

SEQ ID NO: 678367 - RNA, 19 nt, Human
gcuagagugcaguggcacg

SEQ ID NO: 678368 - RNA, 24 nt, Human
gcuccguguuuucuuccucucuca

SEQ ID NO: 678369 - RNA, 19 nt, Human
gcugcagugaacugagacg

SEQ ID NO: 678370 - RNA, 22 nt, Human
ggaaaagccaucaucacuugga

SEQ ID NO: 678371 - RNA, 23 nt, Human
ggaggaggagggaaaggaaggcg

SEQ ID NO: 678372 - RNA, 20 nt, Human
ggaggaguggggaggggagg

SEQ ID NO: 678373 - RNA, 21 nt, Human
ggaggaguggggaggggaggg

SEQ ID NO: 678374 - RNA, 23 nt, Human
ggagucucgcucugucgcccagg

SEQ ID NO: 678375 - RNA, 19 nt, Human
ggaguugacaugcugaccc

SEQ ID NO: 678376 - RNA, 19 nt, Human
ggcagguguaguggcuugc

SEQ ID NO: 678377 - RNA, 19 nt, Human
ggcggaggcugcagugaac

SEQ ID NO: 678378 - RNA, 22 nt, Human
ggcggggacagagagaggaggg

SEQ ID NO: 678379 - RNA, 23 nt, Human
gggaagaugaaccaugcuuacug

SEQ ID NO: 678380 - RNA, 19 nt, Human
gggacagagagaggagggg

SEQ ID NO: 678381 - RNA, 20 nt, Human
gggaggaggagggaaaggaa

SEQ ID NO: 678382 - RNA, 22 nt, Human
gggcaccuggagggaaggcucc

SEQ ID NO: 678383 - RNA, 24 nt, Human
gggcggaggcugcagugaacugag

SEQ ID NO: 678384 - RNA, 19 nt, Human
ggggaggaggagggaaagg

SEQ ID NO: 678385 - RNA, 22 nt, Human
ggguucaagugauucuccugcc

SEQ ID NO: 678386 - RNA, 23 nt, Human
ggguucaagugauucuccugccu

SEQ ID NO: 678387 - RNA, 22 nt, Human
ggucaggaaaggacccuaucuc

SEQ ID NO: 678388 - RNA, 24 nt, Human
gugauccacccaccucagccuccc

SEQ ID NO: 678389 - RNA, 21 nt, Human
guggagguuuuagccagugca

SEQ ID NO: 678390 - RNA, 22 nt, Human
guucaagaccaggaguuugaga

SEQ ID NO: 678391 - RNA, 19 nt, Human
uaaaaagaugccaucuaca

SEQ ID NO: 678392 - RNA, 19 nt, Human
uaaaacagaaaaauaaauc

SEQ ID NO: 678393 - RNA, 24 nt, Human
uaacaaaaucagugccaagguuuc

SEQ ID NO: 678394 - RNA, 25 nt, Human
uaacauguauugucugcaggccgcu

SEQ ID NO: 678395 - RNA, 18 nt, Human
uaaccugauuccuacugu

SEQ ID NO: 678396 - RNA, 20 nt, Human
uaaggcgggcagaucacuug

SEQ ID NO: 678397 - RNA, 26 nt, Human
uaaggcgggcagaucacuuguggcca

SEQ ID NO: 678398 - RNA, 24 nt, Human
uaauuuuuguauuuuuaguagaga

SEQ ID NO: 678399 - RNA, 24 nt, Human
uacaggcaccugccaccgcaccca

SEQ ID NO: 678400 - RNA, 21 nt, Human
uacugcaauuuucuuuuucuu

SEQ ID NO: 678401 - RNA, 23 nt, Human
uagaagaaaaacaagguggagag

SEQ ID NO: 678402 - RNA, 23 nt, Human
uagagugcaguggcacgaucucg

SEQ ID NO: 678403 - RNA, 24 nt, Human
uagagugcaguggcacgaucucgg

SEQ ID NO: 678404 - RNA, 22 nt, Human
uagccggguguaguggcacacg

SEQ ID NO: 678405 - RNA, 23 nt, Human
uaguagagacgggguuucaccau

SEQ ID NO: 678406 - RNA, 24 nt, Human
uaguggcuugcgccuguaauccca

SEQ ID NO: 678407 - RNA, 26 nt, Human
uauacuuagcaaacucagacuagaaa

SEQ ID NO: 678408 - RNA, 27 nt, Human
uauacuuagcaaacucagacuagaaac

SEQ ID NO: 678409 - RNA, 20 nt, Human
uauugaugaaacauuagaga

SEQ ID NO: 678410 - RNA, 28 nt, Human
uauuucuccuaacacuaucccucuccca

SEQ ID NO: 678411 - RNA, 19 nt, Human
ucaaacuccugaccuguga

SEQ ID NO: 678412 - RNA, 23 nt, Human
ucaaagcucuucuuuagaaauca

SEQ ID NO: 678413 - RNA, 19 nt, Human
ucaagugauucuccugccu

SEQ ID NO: 678414 - RNA, 23 nt, Human
ucacugcaaccuccgccucccgg

SEQ ID NO: 678415 - RNA, 24 nt, Human
ucacugcaaccuccgccucccggg

SEQ ID NO: 678416 - RNA, 25 nt, Human
ucacugcaaccuccgccucccgggu

SEQ ID NO: 678417 - RNA, 27 nt, Human
ucacugcaaccuccgccucccggguuc

SEQ ID NO: 678418 - RNA, 23 nt, Human
ucacuuguggccaggaguucaag

SEQ ID NO: 678419 - RNA, 21 nt, Human
ucagccaggccaauauggcaa

SEQ ID NO: 678420 - RNA, 19 nt, Human
ucagccucacagaagucgc

SEQ ID NO: 678421 - RNA, 18 nt, Human
ucagccucccaaagugcu

SEQ ID NO: 678422 - RNA, 18 nt, Human
ucagugccaagguuucuu

SEQ ID NO: 678423 - RNA, 23 nt, Human
ucaugaauaccagucacauguua

SEQ ID NO: 678424 - RNA, 26 nt, Human
uccaaaaacaaaaacaaaaaauuaga

SEQ ID NO: 678425 - RNA, 24 nt, Human
uccaccagaggccaagccaggcac

SEQ ID NO: 678426 - RNA, 21 nt, Human
uccacccaccucagccuccca

SEQ ID NO: 678427 - RNA, 24 nt, Human
ucccaaagugcugggauuacaggc

SEQ ID NO: 678428 - RNA, 24 nt, Human
ucccaaguagcugggacuacaggc

SEQ ID NO: 678429 - RNA, 22 nt, Human
ucccagcaggguuuuucaaugg

SEQ ID NO: 678430 - RNA, 21 nt, Human
ucccggguucaagugauucuc

SEQ ID NO: 678431 - RNA, 24 nt, Human
ucccggguucaagugauucuccug

SEQ ID NO: 678432 - RNA, 22 nt, Human
ucccucucccagccaccccccc

SEQ ID NO: 678433 - RNA, 21 nt, Human
uccuugcauccugaggauaaa

SEQ ID NO: 678434 - RNA, 24 nt, Human
uccuugcauccugaggauaaagac

SEQ ID NO: 678435 - RNA, 18 nt, Human
ucgcccaggcuagagugc

SEQ ID NO: 678436 - RNA, 28 nt, Human
ucuccaccagaggccaagccaggcacag

SEQ ID NO: 678437 - RNA, 18 nt, Human
ucucgcucugucgcccag

SEQ ID NO: 678438 - RNA, 19 nt, Human
ucucgcucugucgcccagg

SEQ ID NO: 678439 - RNA, 22 nt, Human
ucucgcucugucgcccaggcua

SEQ ID NO: 678440 - RNA, 24 nt, Human
ucucgcucugucgcccaggcuaga

SEQ ID NO: 678441 - RNA, 26 nt, Human
ucucgcucugucgcccaggcuagagu

SEQ ID NO: 678442 - RNA, 24 nt, Human
ucugucgcccaggcuagagugcag

SEQ ID NO: 678443 - RNA, 22 nt, Human
ucuuuuuuuuugagauggaguc

SEQ ID NO: 678444 - RNA, 18 nt, Human
ugaaagacuuagagcucu

SEQ ID NO: 678445 - RNA, 20 nt, Human
ugaaauauucauagaauugc

SEQ ID NO: 678446 - RNA, 22 nt, Human
ugaccugugauccacccaccuc

SEQ ID NO: 678447 - RNA, 19 nt, Human
ugagacugugacagcagcu

SEQ ID NO: 678448 - RNA, 21 nt, Human
ugagcacagagccuggccacc

SEQ ID NO: 678449 - RNA, 20 nt, Human
ugaggcaugagaaucacuug

SEQ ID NO: 678450 - RNA, 24 nt, Human
ugaggcaugagaaucacuugaacc

SEQ ID NO: 678451 - RNA, 24 nt, Human
ugagugagaacaugcgguguuugg

SEQ ID NO: 678452 - RNA, 24 nt, Human
ugauccacccaccucagccuccca

SEQ ID NO: 678453 - RNA, 25 nt, Human
ugcacgccagccugggccacagagc

SEQ ID NO: 678454 - RNA, 22 nt, Human
ugcaguggcacgaucucggcuc

SEQ ID NO: 678455 - RNA, 21 nt, Human
ugccucggugucccaaguagc

SEQ ID NO: 678456 - RNA, 20 nt, Human
ugcgccuguaaucccagcac

SEQ ID NO: 678457 - RNA, 24 nt, Human
ugcgccuguaaucccagcacuuug

SEQ ID NO: 678458 - RNA, 20 nt, Human
ugcugggauuacaggcguga

SEQ ID NO: 678459 - RNA, 22 nt, Human
uggcacacgccucuaaucccag

SEQ ID NO: 678460 - RNA, 20 nt, Human
uggcauguguuccuuuaucc

SEQ ID NO: 678461 - RNA, 27 nt, Human
uggccaggaguucaagaccaggaguuu

SEQ ID NO: 678462 - RNA, 24 nt, Human
uggcuugcgccuguaaucccagca

SEQ ID NO: 678463 - RNA, 25 nt, Human
ugggaaggcaggcaaccacaguuua

SEQ ID NO: 678464 - RNA, 21 nt, Human
ugggacuacaggcaccugcca

SEQ ID NO: 678465 - RNA, 22 nt, Human
ugggacuacaggcaccugccac

SEQ ID NO: 678466 - RNA, 23 nt, Human
ugggacuacaggcaccugccacc

SEQ ID NO: 678467 - RNA, 24 nt, Human
ugggacuacaggcaccugccaccg

SEQ ID NO: 678468 - RNA, 20 nt, Human
ugggaggcuaaggcgggcag

SEQ ID NO: 678469 - RNA, 24 nt, Human
ugggaggcuaaggcgggcagauca

SEQ ID NO: 678470 - RNA, 19 nt, Human
ugggauuacaggcgugagc

SEQ ID NO: 678471 - RNA, 19 nt, Human
ugggauuacaggcgugagc

SEQ ID NO: 678472 - RNA, 21 nt, Human
ugggauuacaggcgugagcug

SEQ ID NO: 678473 - RNA, 22 nt, Human
ugggauuacaggcgugagcugu

SEQ ID NO: 678474 - RNA, 23 nt, Human
ugggauuacaggcgugagcugua

SEQ ID NO: 678475 - RNA, 21 nt, Human
uguaaagcaaguggaaacuca

SEQ ID NO: 678476 - RNA, 20 nt, Human
uguaagcaggugucuuaccc

SEQ ID NO: 678477 - RNA, 23 nt, Human
uguaagcaggugucuuacccaaa

SEQ ID NO: 678478 - RNA, 21 nt, Human
uguauuuuuaguagagacggg

SEQ ID NO: 678479 - RNA, 20 nt, Human
uguccaaaaacaaaaacaaa

SEQ ID NO: 678480 - RNA, 23 nt, Human
uguccaaaaacaaaaacaaaaaa

SEQ ID NO: 678481 - RNA, 23 nt, Human
uguccccuuacucaguagacacu

SEQ ID NO: 678482 - RNA, 21 nt, Human
ugugagcacagagccuggcca

SEQ ID NO: 678483 - RNA, 24 nt, Human
ugugauccacccaccucagccucc

SEQ ID NO: 678484 - RNA, 24 nt, Human
uuacuagacauaagauaauuaugu

SEQ ID NO: 678485 - RNA, 18 nt, Human
uuaguagagacgggguuu

SEQ ID NO: 678486 - RNA, 22 nt, Human
uuaguagagacgggguuucacc

SEQ ID NO: 678487 - RNA, 24 nt, Human
uuaguagagacgggguuucaccau

SEQ ID NO: 678488 - RNA, 23 nt, Human
uucaagaccaggaguuugagauc

SEQ ID NO: 678489 - RNA, 21 nt, Human
uucaagugauucuccugccuc

SEQ ID NO: 678490 - RNA, 23 nt, Human
uucaagugauucuccugccucgg

SEQ ID NO: 678491 - RNA, 25 nt, Human
uucaagugauucuccugccucggug

SEQ ID NO: 678492 - RNA, 25 nt, Human
uugggaggcuaaggcgggcagauca

SEQ ID NO: 678493 - RNA, 23 nt, Human
uuguauuuuuaguagagacgggg

SEQ ID NO: 678494 - RNA, 20 nt, Human
uuucaccaucuuggccagcu

SEQ ID NO: 678495 - RNA, 23 nt, Human
uuucaccaucuuggccagcuguu

SEQ ID NO: 678496 - RNA, 20 nt, Human
uuucccuccaggaaaagcca

SEQ ID NO: 678497 - RNA, 20 nt, Human
uuucuuuuuuuuugagaugg

SEQ ID NO: 678498 - RNA, 24 nt, Human
uuuuuaguagagacgggguuucac

SEQ ID NO: 678499 - RNA, 20 nt, Human
uuuuuguauuuuuaguagag

SEQ ID NO: 678500 - RNA, 19 nt, Human
aaaaaaucgcaaguagaca

SEQ ID NO: 678501 - RNA, 24 nt, Human
aaaaccagagcccaaaugggcugg

SEQ ID NO: 678502 - RNA, 23 nt, Human
aaacccuccaccuggugccccuc

SEQ ID NO: 678503 - RNA, 24 nt, Human
aaagcaaaagccaugaggcccagg

SEQ ID NO: 678504 - RNA, 23 nt, Human
aacagaaggaggcugugggaggg

SEQ ID NO: 678505 - RNA, 23 nt, Human
aacccuuccuccgccgcccucug

SEQ ID NO: 678506 - RNA, 21 nt, Human
aagcaaaagccaugaggccca

SEQ ID NO: 678507 - RNA, 19 nt, Human
aagcagcccuaacgcugcc

SEQ ID NO: 678508 - RNA, 26 nt, Human
aaggagaagggaggccaggaagcggg

SEQ ID NO: 678509 - RNA, 25 nt, Human
aaguuccccuuaaaccagccaccuc

SEQ ID NO: 678510 - RNA, 23 nt, Human
aaugggcugggcagggccagggc

SEQ ID NO: 678511 - RNA, 20 nt, Human
acacaagaacucagaccauc

SEQ ID NO: 678512 - RNA, 18 nt, Human
acagcccccaccccccaa

SEQ ID NO: 678513 - RNA, 28 nt, Human
accaggacacaagaacucagaccaucug

SEQ ID NO: 678514 - RNA, 22 nt, Human
acuccaaaggucccaagaggag

SEQ ID NO: 678515 - RNA, 19 nt, Human
agaaaaccagagcccaaau

SEQ ID NO: 678516 - RNA, 24 nt, Human
agaagaaaugcucgacaaacagaa

SEQ ID NO: 678517 - RNA, 19 nt, Human
agaaggaggcugugggagg

SEQ ID NO: 678518 - RNA, 22 nt, Human
agcaggacagcccccacccccc

SEQ ID NO: 678519 - RNA, 24 nt, Human
agcuggauuggcaggugagcuggg

SEQ ID NO: 678520 - RNA, 20 nt, Human
aggagaagggaggccaggaa

SEQ ID NO: 678521 - RNA, 24 nt, Human
aggcagagauggaaaguguguggg

SEQ ID NO: 678522 - RNA, 18 nt, Human
agggagugggagcuggag

SEQ ID NO: 678523 - RNA, 21 nt, Human
aggugcugggcacacagguga

SEQ ID NO: 678524 - RNA, 21 nt, Human
caaccaaucaaagcaguuucc

SEQ ID NO: 678525 - RNA, 24 nt, Human
caagaggagucuucccuacuuccc

SEQ ID NO: 678526 - RNA, 20 nt, Human
caagcauacucacuuauucu

SEQ ID NO: 678527 - RNA, 21 nt, Human
caaucaaagcaguuuccccaa

SEQ ID NO: 678528 - RNA, 18 nt, Human
caccagaaaaccagagcc

SEQ ID NO: 678529 - RNA, 24 nt, Human
caccuccccugccuucucccuacu

SEQ ID NO: 678530 - RNA, 21 nt, Human
cagcaggacagccccaccaga

SEQ ID NO: 678531 - RNA, 20 nt, Human
cagcaggaucagcacaggga

SEQ ID NO: 678532 - RNA, 18 nt, Human
cagcccccaccccccaag

SEQ ID NO: 678533 - RNA, 18 nt, Human
cagccuccagacaggucu

SEQ ID NO: 678534 - RNA, 18 nt, Human
cagcgcugugcuuccagg

SEQ ID NO: 678535 - RNA, 19 nt, Human
cagcuucuggccuggccca

SEQ ID NO: 678536 - RNA, 21 nt, Human
caggaacaaccaggaacccca

SEQ ID NO: 678537 - RNA, 21 nt, Human
caggacagcccccacccccca

SEQ ID NO: 678538 - RNA, 18 nt, Human
cagggaaagcaaaagcca

SEQ ID NO: 678539 - RNA, 21 nt, Human
cagggcuuagaaaggagaagg

SEQ ID NO: 678540 - RNA, 21 nt, Human
cauccagaaaagauagcaaua

SEQ ID NO: 678541 - RNA, 23 nt, Human
ccaggccagccauguuccccaca

SEQ ID NO: 678542 - RNA, 22 nt, Human
cccaccucugcccagccucagc

SEQ ID NO: 678543 - RNA, 21 nt, Human
cccagccucagcuggauuggc

SEQ ID NO: 678544 - RNA, 19 nt, Human
cccaugauuggacguggga

SEQ ID NO: 678545 - RNA, 28 nt, Human
cccaugcucagcgcugugcuuccaggag

SEQ ID NO: 678546 - RNA, 20 nt, Human
ccccaaggagcuggcgcucu

SEQ ID NO: 678547 - RNA, 24 nt, Human
ccccaaggcuggcaucgccucccu

SEQ ID NO: 678548 - RNA, 21 nt, Human
cccccaaggcuggcaucgccu

SEQ ID NO: 678549 - RNA, 22 nt, Human
cccgcaccaggugucacagcca

SEQ ID NO: 678550 - RNA, 26 nt, Human
cccgcaccaggugucacagccaggag

SEQ ID NO: 678551 - RNA, 23 nt, Human
cccuaacccuuccuccgccgccc

SEQ ID NO: 678552 - RNA, 24 nt, Human
cccucaaguuccccuuaaaccagc

SEQ ID NO: 678553 - RNA, 21 nt, Human
cccugugucuacgaucaucuc

SEQ ID NO: 678554 - RNA, 22 nt, Human
ccgccgcccucugcugcuggcc

SEQ ID NO: 678555 - RNA, 23 nt, Human
ccgccgcccucugcugcuggccu

SEQ ID NO: 678556 - RNA, 23 nt, Human
ccuaaaccuaaccugucacuggc

SEQ ID NO: 678557 - RNA, 26 nt, Human
ccuacuucccucaaguuccccuuaaa

SEQ ID NO: 678558 - RNA, 21 nt, Human
ccuggcccaacuggagguccc

SEQ ID NO: 678559 - RNA, 23 nt, Human
ccuuccuccgccgcccucugcug

SEQ ID NO: 678560 - RNA, 22 nt, Human
cgccgcccucugcugcuggccu

SEQ ID NO: 678561 - RNA, 21 nt, Human
cuaacccuuccuccgccgccc

SEQ ID NO: 678562 - RNA, 19 nt, Human
cuccgccgcccucugcugc

SEQ ID NO: 678563 - RNA, 19 nt, Human
cucugcccuaaaccuaacc

SEQ ID NO: 678564 - RNA, 21 nt, Human
cugcagccuggucuugaguga

SEQ ID NO: 678565 - RNA, 20 nt, Human
cuggagggacagguacgaua

SEQ ID NO: 678566 - RNA, 24 nt, Human
cuggaggucccugcaauuuucccu

SEQ ID NO: 678567 - RNA, 23 nt, Human
cuggugccccuccaggugcuggg

SEQ ID NO: 678568 - RNA, 22 nt, Human
cuucccucaaguuccccuuaaa

SEQ ID NO: 678569 - RNA, 21 nt, Human
gagaacagggcuuagaaagga

SEQ ID NO: 678570 - RNA, 18 nt, Human
gaggccaggaagcgggag

SEQ ID NO: 678571 - RNA, 24 nt, Human
gagugggagguggccuucccagga

SEQ ID NO: 678572 - RNA, 24 nt, Human
gaugcaggaacaaccaggaacccc

SEQ ID NO: 678573 - RNA, 26 nt, Human
gauuugagaugggccuggagggacag

SEQ ID NO: 678574 - RNA, 26 nt, Human
gcaaacccuccaccuggugccccucc

SEQ ID NO: 678575 - RNA, 19 nt, Human
gcagccuggucuugaguga

SEQ ID NO: 678576 - RNA, 18 nt, Human
gcaggacagccccaccag

SEQ ID NO: 678577 - RNA, 21 nt, Human
gcaggacagcccccacccccc

SEQ ID NO: 678578 - RNA, 20 nt, Human
gccauguuccccacagcuga

SEQ ID NO: 678579 - RNA, 21 nt, Human
gcuacagcagcuucuggccug

SEQ ID NO: 678580 - RNA, 25 nt, Human
gcuggauuggcaggugagcuccuuc

SEQ ID NO: 678581 - RNA, 22 nt, Human
ggaaguggaggcugcagccugg

SEQ ID NO: 678582 - RNA, 22 nt, Human
ggacagcccccaccccccaagg

SEQ ID NO: 678583 - RNA, 22 nt, Human
ggacaggagaacagggcuuaga

SEQ ID NO: 678584 - RNA, 21 nt, Human
ggagggacaggagaacagggc

SEQ ID NO: 678585 - RNA, 19 nt, Human
ggagguggccuucccagga

SEQ ID NO: 678586 - RNA, 21 nt, Human
ggagguggccuucccaggagg

SEQ ID NO: 678587 - RNA, 22 nt, Human
ggccagccauguuccccacagc

SEQ ID NO: 678588 - RNA, 20 nt, Human
ggccaggccaaugcagggcc

SEQ ID NO: 678589 - RNA, 19 nt, Human
ggcugggcagggccagggc

SEQ ID NO: 678590 - RNA, 24 nt, Human
gggaaguggaggcugcagccuggu

SEQ ID NO: 678591 - RNA, 21 nt, Human
gggcagggccagggcugaggu

SEQ ID NO: 678592 - RNA, 23 nt, Human
gggccagggcugagguaucggga

SEQ ID NO: 678593 - RNA, 21 nt, Human
ggugagcuggggcugggcuca

SEQ ID NO: 678594 - RNA, 18 nt, Human
gguggccuucccaggagg

SEQ ID NO: 678595 - RNA, 18 nt, Human
gugccccuccaggugcug

SEQ ID NO: 678596 - RNA, 18 nt, Human
guguuuaacucacugaau

SEQ ID NO: 678597 - RNA, 18 nt, Human
uaaaccagccaccucccc

SEQ ID NO: 678598 - RNA, 24 nt, Human
uaaccugucacuggcagccuccag

SEQ ID NO: 678599 - RNA, 21 nt, Human
uaagugcccacuaggaugggc

SEQ ID NO: 678600 - RNA, 27 nt, Human
uacaaaguccuagacugcucacaaagg

SEQ ID NO: 678601 - RNA, 21 nt, Human
uaccaggccagccauguuccc

SEQ ID NO: 678602 - RNA, 19 nt, Human
uauacauuuuuuaaaaaau

SEQ ID NO: 678603 - RNA, 21 nt, Human
ucagcaggaucagcacaggga

SEQ ID NO: 678604 - RNA, 21 nt, Human
uccaggugcugggcacacagg

SEQ ID NO: 678605 - RNA, 24 nt, Human
uccccacagcugacacuggggaag

SEQ ID NO: 678606 - RNA, 24 nt, Human
uccccugccuucucccuacuuaaa

SEQ ID NO: 678607 - RNA, 24 nt, Human
uccccuuaaaccagccaccucccc

SEQ ID NO: 678608 - RNA, 21 nt, Human
ucccuacuucccucaaguucc

SEQ ID NO: 678609 - RNA, 25 nt, Human
ucucacccaccucugcccagccuca

SEQ ID NO: 678610 - RNA, 20 nt, Human
ugaaccccuaacccuuccuc

SEQ ID NO: 678611 - RNA, 24 nt, Human
ugaauacguggguuugggugggaa

SEQ ID NO: 678612 - RNA, 23 nt, Human
ugagaccagccacugguccauga

SEQ ID NO: 678613 - RNA, 24 nt, Human
ugagagcacucgcucagaagacug

SEQ ID NO: 678614 - RNA, 24 nt, Human
ugagcaggacagcccccacccccc

SEQ ID NO: 678615 - RNA, 22 nt, Human
ugaggcccaggcccugccccaa

SEQ ID NO: 678616 - RNA, 22 nt, Human
ugagggccaggcccgcaccagg

SEQ ID NO: 678617 - RNA, 24 nt, Human
ugcaaacccuccaccuggugccuc

SEQ ID NO: 678618 - RNA, 19 nt, Human
ugcaagcaagcucccuugu

SEQ ID NO: 678619 - RNA, 18 nt, Human
uggaaagggagugggagc

SEQ ID NO: 678620 - RNA, 24 nt, Human
uggagggacaggagaacagggcuu

SEQ ID NO: 678621 - RNA, 21 nt, Human
uggcagccuccagacaggucu

SEQ ID NO: 678622 - RNA, 22 nt, Human
uggcagccuccagacaggucug

SEQ ID NO: 678623 - RNA, 21 nt, Human
uggcaggugagcuccucagcu

SEQ ID NO: 678624 - RNA, 20 nt, Human
ugggcacacaggugagcagg

SEQ ID NO: 678625 - RNA, 23 nt, Human
ugggcacacaggugagcaggaca

SEQ ID NO: 678626 - RNA, 20 nt, Human
ugggugagaccagccacugg

SEQ ID NO: 678627 - RNA, 19 nt, Human
uggguugaggagacaugcc

SEQ ID NO: 678628 - RNA, 19 nt, Human
uggugccccuccaggugcu

SEQ ID NO: 678629 - RNA, 18 nt, Human
ugugcagcaggaguggga

SEQ ID NO: 678630 - RNA, 19 nt, Human
cucccggggcacaguuggg

SEQ ID NO: 678631 - RNA, 18 nt, Human
gagcaggcuccgcaguca

SEQ ID NO: 678632 - RNA, 18 nt, Human
acugaugaucuuccuauu

SEQ ID NO: 678633 - RNA, 25 nt, Human
agccgaaccugccuccggaggcccg

SEQ ID NO: 678634 - RNA, 21 nt, Human
auccaguaguuuuuuugagua

SEQ ID NO: 678635 - RNA, 23 nt, Human
cacugcuucauuuucuguccucu

SEQ ID NO: 678636 - RNA, 26 nt, Human
cagauuuacauaacaguuugcaucca

SEQ ID NO: 678637 - RNA, 23 nt, Human
cagccgaaccugccuccggaggc

SEQ ID NO: 678638 - RNA, 22 nt, Human
caucaguauagccaaauguuaa

SEQ ID NO: 678639 - RNA, 19 nt, Human
ccuuccagccgaaccugcc

SEQ ID NO: 678640 - RNA, 21 nt, Human
cuucauuuucuguccucucca

SEQ ID NO: 678641 - RNA, 19 nt, Human
gcguucgucuccggacugc

SEQ ID NO: 678642 - RNA, 23 nt, Human
gcugaaauacacaugauaaaaca

SEQ ID NO: 678643 - RNA, 22 nt, Human
uaacacaaacaucaguauagcc

SEQ ID NO: 678644 - RNA, 18 nt, Human
uauagccaaauguuaacu

SEQ ID NO: 678645 - RNA, 19 nt, Human
uauagccaaauguuaacuc

SEQ ID NO: 678646 - RNA, 21 nt, Human
uauuuuuuaauauguccugag

SEQ ID NO: 678647 - RNA, 18 nt, Human
ucaaaagacacauucuga

SEQ ID NO: 678648 - RNA, 24 nt, Human
ucucagauuuacauaacaguuugc

SEQ ID NO: 678649 - RNA, 25 nt, Human
ucuccagugggucuuccuucccaag

SEQ ID NO: 678650 - RNA, 24 nt, Human
ugcugaaauacacaugauaaaaca

SEQ ID NO: 678651 - RNA, 22 nt, Human
uuaauaacugguauagcccuuc

SEQ ID NO: 678652 - RNA, 19 nt, Human
uuauuuuguuuuuaaaaua

SEQ ID NO: 678653 - RNA, 22 nt, Human
uuuuaauauguccugaguucuu

SEQ ID NO: 678654 - RNA, 26 nt, Human
cagcgcagucaccgcacugacaggag

SEQ ID NO: 678655 - RNA, 23 nt, Human
cgcagucaccgcacugacaggag

SEQ ID NO: 678656 - RNA, 19 nt, Human
uucccagcgcagucaccgc

SEQ ID NO: 678657 - RNA, 27 nt, Human
aaaaauaaugaaaagaagccgguaccc

SEQ ID NO: 678658 - RNA, 24 nt, Human
aaguaucccgccucuucuugcagu

SEQ ID NO: 678659 - RNA, 18 nt, Human
aagugugcacaucauacc

SEQ ID NO: 678660 - RNA, 20 nt, Human
agaagccuugcuaaguugcu

SEQ ID NO: 678661 - RNA, 19 nt, Human
auaaaaaauaaugaaaaga

SEQ ID NO: 678662 - RNA, 19 nt, Human
aucaaguugccaugaaaaa

SEQ ID NO: 678663 - RNA, 21 nt, Human
caaguugccaugaaaaaccag

SEQ ID NO: 678664 - RNA, 22 nt, Human
caugaaaaaccagggaccucau

SEQ ID NO: 678665 - RNA, 22 nt, Human
ccaagagcaacaguguucuucu

SEQ ID NO: 678666 - RNA, 19 nt, Human
ccaucucuaaaaugacauu

SEQ ID NO: 678667 - RNA, 23 nt, Human
ccaucucuaaaaugacauuuaac

SEQ ID NO: 678668 - RNA, 19 nt, Human
ccaugaaaaaccagggacc

SEQ ID NO: 678669 - RNA, 19 nt, Human
ccguccaccaagagcaacg

SEQ ID NO: 678670 - RNA, 18 nt, Human
ccucugggcccguccacc

SEQ ID NO: 678671 - RNA, 18 nt, Human
ccugcaguauaaucccuc

SEQ ID NO: 678672 - RNA, 25 nt, Human
cugaaaguaucccgccucuucuugc

SEQ ID NO: 678673 - RNA, 18 nt, Human
cugggcccguccaccaag

SEQ ID NO: 678674 - RNA, 21 nt, Human
gcccguccaccaagagcaaca

SEQ ID NO: 678675 - RNA, 24 nt, Human
guaucccgccucuucuugcaguua

SEQ ID NO: 678676 - RNA, 25 nt, Human
uaaccuauaaaaaauucaacuuccu

SEQ ID NO: 678677 - RNA, 20 nt, Human
uaaguugcuuuuaucaguuu

SEQ ID NO: 678678 - RNA, 19 nt, Human
uaaucccucuccccaucuc

SEQ ID NO: 678679 - RNA, 21 nt, Human
uaguagcuucucuccuuacuc

SEQ ID NO: 678680 - RNA, 24 nt, Human
uauaaucccucuccccaucucuaa

SEQ ID NO: 678681 - RNA, 18 nt, Human
uaugcauacaguuacaug

SEQ ID NO: 678682 - RNA, 22 nt, Human
ucaugaguguguauugaagugg

SEQ ID NO: 678683 - RNA, 18 nt, Human
ucuugcaguuaaccuggg

SEQ ID NO: 678684 - RNA, 20 nt, Human
ugccaugaaaaaccagggac

SEQ ID NO: 678685 - RNA, 20 nt, Human
uggaauaaaugaauauauga

SEQ ID NO: 678686 - RNA, 23 nt, Human
uggaauaaaugaauauaugaaua

SEQ ID NO: 678687 - RNA, 24 nt, Human
ugucaccaaaauacucccacccau

SEQ ID NO: 678688 - RNA, 19 nt, Human
ugugcacaucauaccacag

SEQ ID NO: 678689 - RNA, 19 nt, Human
uguuccaucaggaguucau

SEQ ID NO: 678690 - RNA, 21 nt, Human
uucaggaaggagagaaaaaga

SEQ ID NO: 678691 - RNA, 18 nt, Human
uugucucuucccacacuu

SEQ ID NO: 678692 - RNA, 24 nt, Human
uuuucugagucuagcaagugugca

SEQ ID NO: 678693 - RNA, 20 nt, Human
uuuugucucuucccacacuu

SEQ ID NO: 678694 - RNA, 22 nt, Human
aaacacagaaggaggcauucga

SEQ ID NO: 678695 - RNA, 28 nt, Human
aaagaggacacuggauuuuccuuaauag

SEQ ID NO: 678696 - RNA, 23 nt, Human
aacugcccagcucuuguccccac

SEQ ID NO: 678697 - RNA, 19 nt, Human
aagcaucuggcccauauug

SEQ ID NO: 678698 - RNA, 21 nt, Human
aagugcacaugggguacccac

SEQ ID NO: 678699 - RNA, 18 nt, Human
aaugcccacgccgagugg

SEQ ID NO: 678700 - RNA, 19 nt, Human
acaucgccaaccccggcgc

SEQ ID NO: 678701 - RNA, 18 nt, Human
acgcgcgggcgccuggcg

SEQ ID NO: 678702 - RNA, 22 nt, Human
agagugcuccugcucccugcuc

SEQ ID NO: 678703 - RNA, 23 nt, Human
aggaauggaaacacagaaggagg

SEQ ID NO: 678704 - RNA, 21 nt, Human
aggcgcggcugcgccccaugc

SEQ ID NO: 678705 - RNA, 19 nt, Human
agggagggaggcgcggcug

SEQ ID NO: 678706 - RNA, 25 nt, Human
augcccacucccuccuggaucccag

SEQ ID NO: 678707 - RNA, 23 nt, Human
caaccgcggguccuccgccccuc

SEQ ID NO: 678708 - RNA, 19 nt, Human
cacauggccacagcauucc

SEQ ID NO: 678709 - RNA, 18 nt, Human
cagcucuuguccccacag

SEQ ID NO: 678710 - RNA, 20 nt, Human
cauucaaaagcaucuggccc

SEQ ID NO: 678711 - RNA, 18 nt, Human
ccacagagaauaaugugg

SEQ ID NO: 678712 - RNA, 21 nt, Human
cccacucccuccuggauccca

SEQ ID NO: 678713 - RNA, 22 nt, Human
cccaugcccacucccuccugga

SEQ ID NO: 678714 - RNA, 18 nt, Human
cccauggcuuggguggaa

SEQ ID NO: 678715 - RNA, 23 nt, Human
ccccagcagccuggcccugcgcc

SEQ ID NO: 678716 - RNA, 21 nt, Human
cccccuuucuuagccccccuc

SEQ ID NO: 678717 - RNA, 22 nt, Human
ccccgagugcccgacagcgccc

SEQ ID NO: 678718 - RNA, 21 nt, Human
ccccgcgcggagccucuccuc

SEQ ID NO: 678719 - RNA, 20 nt, Human
cccuaucauucaaaagcauc

SEQ ID NO: 678720 - RNA, 18 nt, Human
cccucacuuguggcuccg

SEQ ID NO: 678721 - RNA, 19 nt, Human
ccgcgcgccgcccgccucg

SEQ ID NO: 678722 - RNA, 19 nt, Human
ccgcgcggagccucuccuc

SEQ ID NO: 678723 - RNA, 23 nt, Human
ccgcgcggagccucuccuccucc

SEQ ID NO: 678724 - RNA, 20 nt, Human
ccgcugccuccuucaaccgc

SEQ ID NO: 678725 - RNA, 23 nt, Human
ccggagccacgaggggacccccg

SEQ ID NO: 678726 - RNA, 19 nt, Human
ccuccugccucagcacugg

SEQ ID NO: 678727 - RNA, 23 nt, Human
ccucgggcugacgcacucgaccc

SEQ ID NO: 678728 - RNA, 18 nt, Human
ccuggcccugcgcccggc

SEQ ID NO: 678729 - RNA, 19 nt, Human
ccuggcccugcgcccggcc

SEQ ID NO: 678730 - RNA, 20 nt, Human
cgacaggaauggaaacacag

SEQ ID NO: 678731 - RNA, 19 nt, Human
cgaccccucuccuuagcgg

SEQ ID NO: 678732 - RNA, 20 nt, Human
cgccucggagccccgcgcgg

SEQ ID NO: 678733 - RNA, 22 nt, Human
cgccucggagccccgcgcggag

SEQ ID NO: 678734 - RNA, 18 nt, Human
cgcgcggagccucuccuc

SEQ ID NO: 678735 - RNA, 20 nt, Human
cggcgcccgggaggcgggga

SEQ ID NO: 678736 - RNA, 18 nt, Human
cgggcggggacgaaggag

SEQ ID NO: 678737 - RNA, 25 nt, Human
cguccccagcagccuggcccugcgc

SEQ ID NO: 678738 - RNA, 24 nt, Human
cucaagacccauucaaaacugccc

SEQ ID NO: 678739 - RNA, 23 nt, Human
cucgacaggaauggaaacacaga

SEQ ID NO: 678740 - RNA, 23 nt, Human
cucgaccccucuccuuagcggga

SEQ ID NO: 678741 - RNA, 26 nt, Human
cucuccgcucccgcugccuccuucaa

SEQ ID NO: 678742 - RNA, 21 nt, Human
cucugcauggcugggcgcccc

SEQ ID NO: 678743 - RNA, 24 nt, Human
cugcccagcucuuguccccacaga

SEQ ID NO: 678744 - RNA, 22 nt, Human
cugcgcccggccgccugccaag

SEQ ID NO: 678745 - RNA, 18 nt, Human
cugugagcucugaaaguc

SEQ ID NO: 678746 - RNA, 19 nt, Human
gaggcggggagggagggag

SEQ ID NO: 678747 - RNA, 23 nt, Human
gcccacucgacaggaauggaaac

SEQ ID NO: 678748 - RNA, 19 nt, Human
gcccagcccacucgacagg

SEQ ID NO: 678749 - RNA, 23 nt, Human
gcccagggaagugaggcauccuc

SEQ ID NO: 678750 - RNA, 21 nt, Human
gcccugagcguccccagcagc

SEQ ID NO: 678751 - RNA, 18 nt, Human
gcuagaacacagcuugac

SEQ ID NO: 678752 - RNA, 21 nt, Human
gcuccugugagcucugaaagu

SEQ ID NO: 678753 - RNA, 22 nt, Human
gcuccugugagcucugaaaguc

SEQ ID NO: 678754 - RNA, 18 nt, Human
gcuuggguggaaagcccu

SEQ ID NO: 678755 - RNA, 18 nt, Human
ggaaacacagaaggaggc

SEQ ID NO: 678756 - RNA, 20 nt, Human
ggaauggaaacacagaagga

SEQ ID NO: 678757 - RNA, 18 nt, Human
ggauacauauacucccuc

SEQ ID NO: 678758 - RNA, 23 nt, Human
ggcuucgaggcuggauggcgaug

SEQ ID NO: 678759 - RNA, 18 nt, Human
ggggacccccgagugccc

SEQ ID NO: 678760 - RNA, 21 nt, Human
gugcuggguccugcuucccag

SEQ ID NO: 678761 - RNA, 21 nt, Human
guggacuucacuaaggacaug

SEQ ID NO: 678762 - RNA, 24 nt, Human
uaaugcccacgccgaguggccgga

SEQ ID NO: 678763 - RNA, 26 nt, Human
uacccaccucaagacccauucaaaac

SEQ ID NO: 678764 - RNA, 18 nt, Human
uagagugcuccugcuccc

SEQ ID NO: 678765 - RNA, 22 nt, Human
uagggcaucccucuccaguccc

SEQ ID NO: 678766 - RNA, 20 nt, Human
uccccagcagccuggcccug

SEQ ID NO: 678767 - RNA, 24 nt, Human
uccgcagcgccuuuuugccucugc

SEQ ID NO: 678768 - RNA, 22 nt, Human
uccuccgggugaggagggacgc

SEQ ID NO: 678769 - RNA, 21 nt, Human
ucggucccucggccgcuagaa

SEQ ID NO: 678770 - RNA, 23 nt, Human
ucguccgucccuccuccagggug

SEQ ID NO: 678771 - RNA, 20 nt, Human
ucuccacaucgccaaccccg

SEQ ID NO: 678772 - RNA, 21 nt, Human
ucugcauggcugggcgccccc

SEQ ID NO: 678773 - RNA, 18 nt, Human
ucuggugggaauauggaa

SEQ ID NO: 678774 - RNA, 19 nt, Human
ugcaaggagaucauacaau

SEQ ID NO: 678775 - RNA, 21 nt, Human
ugcccagcucuuguccccaca

SEQ ID NO: 678776 - RNA, 20 nt, Human
ugcgccccaugcccacuccc

SEQ ID NO: 678777 - RNA, 19 nt, Human
uggaaacacagaaggaggc

SEQ ID NO: 678778 - RNA, 21 nt, Human
uggaaagcccugagcgucccc

SEQ ID NO: 678779 - RNA, 20 nt, Human
uggaagccccccguugcuuc

SEQ ID NO: 678780 - RNA, 23 nt, Human
uggccacagcauucccacacucu

SEQ ID NO: 678781 - RNA, 22 nt, Human
uguggcuccgaccuccugccuc

SEQ ID NO: 678782 - RNA, 23 nt, Human
uuagccccccucggucccucggc

SEQ ID NO: 678783 - RNA, 21 nt, Human
uucccacacucuggugggaau

SEQ ID NO: 678784 - RNA, 19 nt, Human
uucccagccccucacuugu

SEQ ID NO: 678785 - RNA, 24 nt, Human
uucccagccccucacuuguggcuc

SEQ ID NO: 678786 - RNA, 18 nt, Human
uucgauggucaaggaggg

SEQ ID NO: 678787 - RNA, 19 nt, Human
agacaaugggauuacagau

SEQ ID NO: 678788 - RNA, 20 nt, Human
agauggaguuggaaaaucca

SEQ ID NO: 678789 - RNA, 22 nt, Human
caaaaaucaucuugauugugac

SEQ ID NO: 678790 - RNA, 19 nt, Human
ggaguuggaaaauccaaua

SEQ ID NO: 678791 - RNA, 24 nt, Human
uggaaaauccaauaauuugcacga

SEQ ID NO: 678792 - RNA, 20 nt, Human
ugggauuacagauggaguug

SEQ ID NO: 678793 - RNA, 20 nt, Human
uucauaaaugcauagacaau

SEQ ID NO: 678794 - RNA, 18 nt, Human
uuugaaguuuucauucau

SEQ ID NO: 678795 - RNA, 24 nt, Human
acaguguugaaaacaauuacauac

SEQ ID NO: 678796 - RNA, 19 nt, Human
agugcuaucagaaaaaaaa

SEQ ID NO: 678797 - RNA, 22 nt, Human
auccgucuguuuuccagaaaaa

SEQ ID NO: 678798 - RNA, 22 nt, Human
caccagaaccccaggcucauua

SEQ ID NO: 678799 - RNA, 24 nt, Human
cagaggccucuuaagauuuuuuuu

SEQ ID NO: 678800 - RNA, 22 nt, Human
cagugaagguguuuugcccagu

SEQ ID NO: 678801 - RNA, 19 nt, Human
caucuuauuuuucccauac

SEQ ID NO: 678802 - RNA, 21 nt, Human
cauuaaaugacguaagucuuu

SEQ ID NO: 678803 - RNA, 21 nt, Human
ccguaugccaugucuccagaa

SEQ ID NO: 678804 - RNA, 25 nt, Human
cucauuguaggcuccaagggguucc

SEQ ID NO: 678805 - RNA, 23 nt, Human
cugaaggcagaggccucuuaaga

SEQ ID NO: 678806 - RNA, 18 nt, Human
cugugccugcuuucaagu

SEQ ID NO: 678807 - RNA, 18 nt, Human
cuuguaacuucugaaggc

SEQ ID NO: 678808 - RNA, 20 nt, Human
cuuugcagugccaugaaaua

SEQ ID NO: 678809 - RNA, 19 nt, Human
gaaguaaaauccgucuguu

SEQ ID NO: 678810 - RNA, 24 nt, Human
gacaguaaagcaugaaauagauac

SEQ ID NO: 678811 - RNA, 23 nt, Human
gauuucuguuauguaauugaaga

SEQ ID NO: 678812 - RNA, 18 nt, Human
gcauguaucuaauauccu

SEQ ID NO: 678813 - RNA, 22 nt, Human
gucuuuguagaaaacauauuua

SEQ ID NO: 678814 - RNA, 18 nt, Human
gugugucuuuuucccagu

SEQ ID NO: 678815 - RNA, 18 nt, Human
guguuuugcccagugagc

SEQ ID NO: 678816 - RNA, 20 nt, Human
uaaaaauguuuugaaagaac

SEQ ID NO: 678817 - RNA, 21 nt, Human
uaauagcagagaaagaauuua

SEQ ID NO: 678818 - RNA, 19 nt, Human
uaauuuuuuauuaauagag

SEQ ID NO: 678819 - RNA, 19 nt, Human
uagagaaagaagaugccug

SEQ ID NO: 678820 - RNA, 24 nt, Human
uagcagagaaagaauuuaguuuug

SEQ ID NO: 678821 - RNA, 21 nt, Human
uagcauguaucuaauauccuc

SEQ ID NO: 678822 - RNA, 24 nt, Human
uagccaguuaauagcagagaaaga

SEQ ID NO: 678823 - RNA, 21 nt, Human
uaugaugagggcacauaucuu

SEQ ID NO: 678824 - RNA, 22 nt, Human
uauucuaacaccagaaccccag

SEQ ID NO: 678825 - RNA, 22 nt, Human
ucaaaucaggaaaaaaaccuga

SEQ ID NO: 678826 - RNA, 23 nt, Human
ucagugaagguguuuugcccagu

SEQ ID NO: 678827 - RNA, 18 nt, Human
uccagaaaaaugugaugu

SEQ ID NO: 678828 - RNA, 20 nt, Human
ucccauucgccaguagauua

SEQ ID NO: 678829 - RNA, 18 nt, Human
ugaaagaacauuugaaaa

SEQ ID NO: 678830 - RNA, 19 nt, Human
ugaaauagauacaaacauu

SEQ ID NO: 678831 - RNA, 23 nt, Human
ugacaacaugcacacguggucuu

SEQ ID NO: 678832 - RNA, 23 nt, Human
ugacuuuuuauugcaaacagcuc

SEQ ID NO: 678833 - RNA, 23 nt, Human
ugccaugaaauacaucaauaagg

SEQ ID NO: 678834 - RNA, 18 nt, Human
ugccaugucuccagaagu

SEQ ID NO: 678835 - RNA, 24 nt, Human
ugccugagugaguugucuuugauu

SEQ ID NO: 678836 - RNA, 18 nt, Human
ugcuagagaugauauuua

SEQ ID NO: 678837 - RNA, 28 nt, Human
ugcuucacucauuuugaaauaccucuca

SEQ ID NO: 678838 - RNA, 23 nt, Human
uggcagugcuagagaugauauuu

SEQ ID NO: 678839 - RNA, 21 nt, Human
uguaacuucugaaggcagagg

SEQ ID NO: 678840 - RNA, 20 nt, Human
uguuguguuuuauuuacuau

SEQ ID NO: 678841 - RNA, 20 nt, Human
uucaaaucaggaaaaaaacc

SEQ ID NO: 678842 - RNA, 23 nt, Human
uucaaaucaggaaaaaaaccuga

SEQ ID NO: 678843 - RNA, 20 nt, Human
uugaauaauuguauguauua

SEQ ID NO: 678844 - RNA, 21 nt, Human
uugcagugccaugaaauacau

SEQ ID NO: 678845 - RNA, 20 nt, Human
uuuuauguguuauuuugcac

SEQ ID NO: 678846 - RNA, 21 nt, Human
uuuuuauugcaaacagcucuc

SEQ ID NO: 678847 - RNA, 22 nt, Human
aaauaagcccagaaccacacaa

SEQ ID NO: 678848 - RNA, 23 nt, Human
acaacacaacaggucgaccagaa

SEQ ID NO: 678849 - RNA, 23 nt, Human
acaaucaugaagaucuuuuuguc

SEQ ID NO: 678850 - RNA, 23 nt, Human
accacaccacugggaagaggaug

SEQ ID NO: 678851 - RNA, 24 nt, Human
acugacucaacaccuccuucucca

SEQ ID NO: 678852 - RNA, 22 nt, Human
agaguccuuccacaagccauau

SEQ ID NO: 678853 - RNA, 22 nt, Human
agcagcagucacccccaaccuc

SEQ ID NO: 678854 - RNA, 23 nt, Human
aguggaaugacaaucaugaagau

SEQ ID NO: 678855 - RNA, 19 nt, Human
caaauaagcccagaaccac

SEQ ID NO: 678856 - RNA, 22 nt, Human
caacugacucaacaccuccuuc

SEQ ID NO: 678857 - RNA, 23 nt, Human
cacauagccaucuccaauccauu

SEQ ID NO: 678858 - RNA, 19 nt, Human
caccuccuucuccaaacua

SEQ ID NO: 678859 - RNA, 21 nt, Human
cagaaauagagaguccuuccc

SEQ ID NO: 678860 - RNA, 18 nt, Human
caugacuggaaagucaag

SEQ ID NO: 678861 - RNA, 19 nt, Human
cauggauccagagaccguu

SEQ ID NO: 678862 - RNA, 21 nt, Human
cauuaucccuccuguucucac

SEQ ID NO: 678863 - RNA, 23 nt, Human
ccacaagccauauucagucgugc

SEQ ID NO: 678864 - RNA, 19 nt, Human
ccacgaguggaaaugaaau

SEQ ID NO: 678865 - RNA, 23 nt, Human
ccagaaccacacaaaacauuuuc

SEQ ID NO: 678866 - RNA, 26 nt, Human
ccccaaccuccuccuuauacaacuga

SEQ ID NO: 678867 - RNA, 22 nt, Human
cccuggcugcugaugcuucuug

SEQ ID NO: 678868 - RNA, 22 nt, Human
ccuggcugcugaugcuucuugu

SEQ ID NO: 678869 - RNA, 21 nt, Human
cucaacaccuccuucuccaaa

SEQ ID NO: 678870 - RNA, 20 nt, Human
cuccaaacuaccccuggcug

SEQ ID NO: 678871 - RNA, 23 nt, Human
cuccucgguggacucuaugauga

SEQ ID NO: 678872 - RNA, 22 nt, Human
cuccuuauacaacugacucaac

SEQ ID NO: 678873 - RNA, 20 nt, Human
cuccuucuccaaacuacccc

SEQ ID NO: 678874 - RNA, 22 nt, Human
cugcauuaaagaauguuaauau

SEQ ID NO: 678875 - RNA, 20 nt, Human
gcauuaaagaauguuaauau

SEQ ID NO: 678876 - RNA, 19 nt, Human
gcccagaaccacacaaaac

SEQ ID NO: 678877 - RNA, 18 nt, Human
uaagacaagauuuucucu

SEQ ID NO: 678878 - RNA, 18 nt, Human
uaagcccagaaccacaca

SEQ ID NO: 678879 - RNA, 21 nt, Human
uaccccuggcugcugaugcuu

SEQ ID NO: 678880 - RNA, 20 nt, Human
uacgauaccauggauccaga

SEQ ID NO: 678881 - RNA, 19 nt, Human
ucaaauaagcccagaacca

SEQ ID NO: 678882 - RNA, 19 nt, Human
ucacccccaaccuccuccu

SEQ ID NO: 678883 - RNA, 22 nt, Human
ucuccaaacuaccccuggcugc

SEQ ID NO: 678884 - RNA, 30 nt, Human
ugaccacaccacugggaagaggauggcacc

SEQ ID NO: 678885 - RNA, 19 nt, Human
ugagagaagagagcacugc

SEQ ID NO: 678886 - RNA, 20 nt, Human
ugauugaccacaccacuggg

SEQ ID NO: 678887 - RNA, 19 nt, Human
ugcuauggcagccuguggu

SEQ ID NO: 678888 - RNA, 23 nt, Human
ugcuauggcagccuguggucaug

SEQ ID NO: 678889 - RNA, 25 nt, Human
ugcugaugcuucuuguaaaugucug

SEQ ID NO: 678890 - RNA, 24 nt, Human
uggaaagucaaggagaugcaaaag

SEQ ID NO: 678891 - RNA, 21 nt, Human
uggauccagagaccguucuga

SEQ ID NO: 678892 - RNA, 23 nt, Human
uguggucugaaauucucacuugu

SEQ ID NO: 678893 - RNA, 19 nt, Human
uuauacaacugacucaaca

SEQ ID NO: 678894 - RNA, 19 nt, Human
uucuaagacaagauuuucu

SEQ ID NO: 678895 - RNA, 23 nt, Human
uucuuugcagcuuuucuucugau

SEQ ID NO: 678896 - RNA, 23 nt, Human
uuuacacauagccaucuccaauc

SEQ ID NO: 678897 - RNA, 19 nt, Human
uuugccaggaccuggagug

SEQ ID NO: 678898 - RNA, 18 nt, Human
aaaaggcaagacaacggc

SEQ ID NO: 678899 - RNA, 21 nt, Human
aaagacacggacccugugccc

SEQ ID NO: 678900 - RNA, 25 nt, Human
acacggacccugugcccgcgccccc

SEQ ID NO: 678901 - RNA, 22 nt, Human
acauggacccccuccaccuccc

SEQ ID NO: 678902 - RNA, 23 nt, Human
acauggacccccuccaccucccc

SEQ ID NO: 678903 - RNA, 25 nt, Human
acccuuuggucugagauguggaggu

SEQ ID NO: 678904 - RNA, 22 nt, Human
acggacccugugcccgcgcccc

SEQ ID NO: 678905 - RNA, 21 nt, Human
auauuuggggggaggaaggga

SEQ ID NO: 678906 - RNA, 21 nt, Human
caaaaaggcaagacaacggcg

SEQ ID NO: 678907 - RNA, 20 nt, Human
caacccccaaaaaggcaaga

SEQ ID NO: 678908 - RNA, 22 nt, Human
caacccccaaaaaggcaagaca

SEQ ID NO: 678909 - RNA, 19 nt, Human
caaccuccguguagacccc

SEQ ID NO: 678910 - RNA, 25 nt, Human
caaccuccguguagaccccaacccc

SEQ ID NO: 678911 - RNA, 22 nt, Human
caagacaacggcguagccaaac

SEQ ID NO: 678912 - RNA, 23 nt, Human
cacaaccuccguguagaccccaa

SEQ ID NO: 678913 - RNA, 21 nt, Human
cacacagcgaaaacagguuuc

SEQ ID NO: 678914 - RNA, 18 nt, Human
caccuccccacauacgcu

SEQ ID NO: 678915 - RNA, 23 nt, Human
cacggacccugugcccgcgcccc

SEQ ID NO: 678916 - RNA, 22 nt, Human
cauggacccccuccaccucccc

SEQ ID NO: 678917 - RNA, 27 nt, Human
ccacacacagcgaaaacaguggaccuc

SEQ ID NO: 678918 - RNA, 19 nt, Human
cccaacccccaaaaaggca

SEQ ID NO: 678919 - RNA, 22 nt, Human
cccaacccccaaaaaggcaaga

SEQ ID NO: 678920 - RNA, 21 nt, Human
ccccaaaaaggcaagacaacg

SEQ ID NO: 678921 - RNA, 23 nt, Human
ccccaacccccaaaaaggcaaga

SEQ ID NO: 678922 - RNA, 23 nt, Human
cccgccacacacagcgaaaacag

SEQ ID NO: 678923 - RNA, 21 nt, Human
ccgcgcccccgccacacacag

SEQ ID NO: 678924 - RNA, 21 nt, Human
ccuccguguagaccccaaccc

SEQ ID NO: 678925 - RNA, 21 nt, Human
cuccguguagaccccaacccc

SEQ ID NO: 678926 - RNA, 22 nt, Human
cugaaugaauauuuauugaaua

SEQ ID NO: 678927 - RNA, 20 nt, Human
cugugcccgcgcccccgccu

SEQ ID NO: 678928 - RNA, 20 nt, Human
gaaccggggucccggggagc

SEQ ID NO: 678929 - RNA, 22 nt, Human
gcccgcgcccccgccacacaca

SEQ ID NO: 678930 - RNA, 22 nt, Human
gccugguccacauggacccccu

SEQ ID NO: 678931 - RNA, 22 nt, Human
gcugggggaggacgacccuuug

SEQ ID NO: 678932 - RNA, 19 nt, Human
ggacagggcugcccaauau

SEQ ID NO: 678933 - RNA, 19 nt, Human
gguggucccgggguaagga

SEQ ID NO: 678934 - RNA, 21 nt, Human
guacacauagcuggaagggag

SEQ ID NO: 678935 - RNA, 21 nt, Human
uaaacacaaccuccguguaga

SEQ ID NO: 678936 - RNA, 26 nt, Human
uaaacacaaccuccguguagacccca

SEQ ID NO: 678937 - RNA, 20 nt, Human
uacacauagcuggaagggag

SEQ ID NO: 678938 - RNA, 26 nt, Human
uagaccccaacccccaaaaaggcaag

SEQ ID NO: 678939 - RNA, 24 nt, Human
ugcugggggaggacgacccuuugg

SEQ ID NO: 678940 - RNA, 20 nt, Human
uggaagaagggcaggaguga

SEQ ID NO: 678941 - RNA, 19 nt, Human
uggaagggagggguggucc

SEQ ID NO: 678942 - RNA, 22 nt, Human
uggacccccuccaccuccccac

SEQ ID NO: 678943 - RNA, 21 nt, Human
uguaaacacaaccuccgugua

SEQ ID NO: 678944 - RNA, 19 nt, Human
uguggaagaagggcaggag

SEQ ID NO: 678945 - RNA, 23 nt, Human
auccgagugguccugagaggcca

SEQ ID NO: 678946 - RNA, 18 nt, Human
ccaccugagugccauccg

SEQ ID NO: 678947 - RNA, 22 nt, Human
ccauggugcccagcuucuccgc

SEQ ID NO: 678948 - RNA, 19 nt, Human
cccagcuucuccgcagcca

SEQ ID NO: 678949 - RNA, 20 nt, Human
ccccgggcccaggccuccca

SEQ ID NO: 678950 - RNA, 21 nt, Human
ccgggcccaggccucccaccc

SEQ ID NO: 678951 - RNA, 22 nt, Human
cguccuguccaccugagugcca

SEQ ID NO: 678952 - RNA, 26 nt, Human
cucugcccagugugguucugucacgg

SEQ ID NO: 678953 - RNA, 23 nt, Human
ggucaggugccaagucucccccu

SEQ ID NO: 678954 - RNA, 18 nt, Human
ucccagcgccuccuuguu

SEQ ID NO: 678955 - RNA, 22 nt, Human
ucugcagcagaccccucugccc

SEQ ID NO: 678956 - RNA, 20 nt, Human
ucuuugugaagaaauaagga

SEQ ID NO: 678957 - RNA, 21 nt, Human
ugccaagucucccccugcccc

SEQ ID NO: 678958 - RNA, 22 nt, Human
ugcccagcuucuccgcagccag

SEQ ID NO: 678959 - RNA, 18 nt, Human
uguuaaggaagacguccc

SEQ ID NO: 678960 - RNA, 25 nt, Human
uguuuuuuuuuuuuuuuugcaaguu

SEQ ID NO: 678961 - RNA, 28 nt, Human
uguuuuuuuuuuuuuuuugcaaguuuga

SEQ ID NO: 678962 - RNA, 23 nt, Human
uugugaagaaauaaggacuucac

SEQ ID NO: 678963 - RNA, 30 nt, Human
uuuuuuuuuuuuuuguuuuguuuuuuuuuu

SEQ ID NO: 678964 - RNA, 22 nt, Human
uuuuuuuuuuuuuuuuuguuuu

SEQ ID NO: 678965 - RNA, 20 nt, Human
uuuuuuuuuuuuuuuuuugg

SEQ ID NO: 678966 - RNA, 23 nt, Human
uuuuuuuuuuuuuuuuuuguuuu

SEQ ID NO: 678967 - RNA, 20 nt, Human
aaacaucuuggugcagauuc

SEQ ID NO: 678968 - RNA, 19 nt, Human
aaaugaaagauaagaaacc

SEQ ID NO: 678969 - RNA, 22 nt, Human
aacaaucaacaauguaccaugc

SEQ ID NO: 678970 - RNA, 22 nt, Human
aacuaaacucaccaacaggcug

SEQ ID NO: 678971 - RNA, 26 nt, Human
aagcagauguagguaggaagcaagau

SEQ ID NO: 678972 - RNA, 18 nt, Human
acaacaaaggcaugcaca

SEQ ID NO: 678973 - RNA, 21 nt, Human
agaaaagaaauauugcaaaga

SEQ ID NO: 678974 - RNA, 24 nt, Human
agaaaagaaauauugcaaagacaa

SEQ ID NO: 678975 - RNA, 23 nt, Human
agaaaauaaauacaaaaaaaugu

SEQ ID NO: 678976 - RNA, 22 nt, Human
agccucuuuaaaagguagcuga

SEQ ID NO: 678977 - RNA, 23 nt, Human
auccuauaucaucuccaaaagga

SEQ ID NO: 678978 - RNA, 22 nt, Human
auguaccucaucuacguucaca

SEQ ID NO: 678979 - RNA, 21 nt, Human
caacaaaggcaugcacaacua

SEQ ID NO: 678980 - RNA, 25 nt, Human
caacuaaacucaccaacaggcugaa

SEQ ID NO: 678981 - RNA, 22 nt, Human
cagaaaagaaauauugcaaaga

SEQ ID NO: 678982 - RNA, 24 nt, Human
caugcacaacuaaacucaccaaca

SEQ ID NO: 678983 - RNA, 23 nt, Human
caugcuuugauuuuagaagaaag

SEQ ID NO: 678984 - RNA, 24 nt, Human
ccaaaucagaaaugucuaaaaacc

SEQ ID NO: 678985 - RNA, 24 nt, Human
ccaaccuucuuauaaaaugaaaga

SEQ ID NO: 678986 - RNA, 20 nt, Human
ccucuuuaaaagguagcuga

SEQ ID NO: 678987 - RNA, 21 nt, Human
cuagucuacucuccuguuccu

SEQ ID NO: 678988 - RNA, 24 nt, Human
cugaccgcgaguucagaaaacaaa

SEQ ID NO: 678989 - RNA, 24 nt, Human
cuguacaggucgugcacccaagag

SEQ ID NO: 678990 - RNA, 20 nt, Human
gaaaugucuaaaaaccaugg

SEQ ID NO: 678991 - RNA, 24 nt, Human
gagauccaacauucacuugaaaua

SEQ ID NO: 678992 - RNA, 19 nt, Human
gcucgcguccucgggcugg

SEQ ID NO: 678993 - RNA, 25 nt, Human
ggacauuucacacugucaagcauca

SEQ ID NO: 678994 - RNA, 18 nt, Human
uaaaagggguuugaaaug

SEQ ID NO: 678995 - RNA, 18 nt, Human
uaaggauguacuugaggc

SEQ ID NO: 678996 - RNA, 22 nt, Human
uaggacaguucccuguucccaa

SEQ ID NO: 678997 - RNA, 20 nt, Human
uagggcugugucugcccagu

SEQ ID NO: 678998 - RNA, 22 nt, Human
uauaacuaggagcaaucaaggc

SEQ ID NO: 678999 - RNA, 19 nt, Human
uauagcucuggcugggcca

SEQ ID NO: 679000 - RNA, 23 nt, Human
uauauacaacaaaggcaugcaca

SEQ ID NO: 679001 - RNA, 18 nt, Human
uauaucaucuccaaaagg

SEQ ID NO: 679002 - RNA, 27 nt, Human
uauuucacauccuauaucaucuccaaa

SEQ ID NO: 679003 - RNA, 22 nt, Human
ucaagacacauuuaaaaaacaa

SEQ ID NO: 679004 - RNA, 20 nt, Human
ucacacugucaagcaucaug

SEQ ID NO: 679005 - RNA, 24 nt, Human
ucacauccuauaucaucuccaaaa

SEQ ID NO: 679006 - RNA, 25 nt, Human
ucagaaaagaaauauugcaaagaca

SEQ ID NO: 679007 - RNA, 25 nt, Human
ucagaaaugucuaaaaaccauggug

SEQ ID NO: 679008 - RNA, 21 nt, Human
ucccaauagcuacuccccuug

SEQ ID NO: 679009 - RNA, 23 nt, Human
ucuauaaucugacuacuggggau

SEQ ID NO: 679010 - RNA, 21 nt, Human
ucugugcacaccugccgcucg

SEQ ID NO: 679011 - RNA, 21 nt, Human
ucuguggccaagguauaaagc

SEQ ID NO: 679012 - RNA, 25 nt, Human
ugacuacuggggaugcggucagggg

SEQ ID NO: 679013 - RNA, 18 nt, Human
ugagacaaaacaaccaug

SEQ ID NO: 679014 - RNA, 28 nt, Human
ugagacaaaacaaccaugauucuacaaa

SEQ ID NO: 679015 - RNA, 25 nt, Human
ugcggaacgagcaaggauuuucuga

SEQ ID NO: 679016 - RNA, 19 nt, Human
uggccaagguauaaagcua

SEQ ID NO: 679017 - RNA, 22 nt, Human
uggcugggaucauuauuucuug

SEQ ID NO: 679018 - RNA, 21 nt, Human
uggggauuugagaagcggcag

SEQ ID NO: 679019 - RNA, 21 nt, Human
uguugccgagaauaaaaugag

SEQ ID NO: 679020 - RNA, 19 nt, Human
uuaaagaacggcaauauga

SEQ ID NO: 679021 - RNA, 18 nt, Human
uucucagucuggcuggga

SEQ ID NO: 679022 - RNA, 18 nt, Human
uugacacaugggucacua

SEQ ID NO: 679023 - RNA, 23 nt, Human
uugauuuuaacauauaaauacaa

SEQ ID NO: 679024 - RNA, 26 nt, Human
uuucacauccuauaucaucuccaaaa

SEQ ID NO: 679025 - RNA, 20 nt, Human
uuuccugacacauggucugg

SEQ ID NO: 679026 - RNA, 18 nt, Human
uuucuugauuucacugag

SEQ ID NO: 679027 - RNA, 22 nt, Human
uuuuugauuuuaacauauaaau

SEQ ID NO: 679028 - RNA, 21 nt, Human
acauggggcuaggaggcugga

SEQ ID NO: 679029 - RNA, 18 nt, Human
accccucccacucccucu

SEQ ID NO: 679030 - RNA, 22 nt, Human
acucugaagaucaugugugaga

SEQ ID NO: 679031 - RNA, 28 nt, Human
agagauacaggcugcugugacgucgccg

SEQ ID NO: 679032 - RNA, 18 nt, Human
aggcucucuuucccugcc

SEQ ID NO: 679033 - RNA, 19 nt, Human
caagcagagcucugugcau

SEQ ID NO: 679034 - RNA, 26 nt, Human
cagaccccucccacucccucuuccca

SEQ ID NO: 679035 - RNA, 19 nt, Human
cagcaguaggaagggcugu

SEQ ID NO: 679036 - RNA, 20 nt, Human
caucugggccaacguugucc

SEQ ID NO: 679037 - RNA, 21 nt, Human
ccacucccucuucccaaccuc

SEQ ID NO: 679038 - RNA, 18 nt, Human
cccacagauggaggcagu

SEQ ID NO: 679039 - RNA, 24 nt, Human
ccguguaccuguuucaagcagagc

SEQ ID NO: 679040 - RNA, 19 nt, Human
ccucccacucccucuuccc

SEQ ID NO: 679041 - RNA, 23 nt, Human
cguguaccuguuucaagcagagc

SEQ ID NO: 679042 - RNA, 19 nt, Human
cuaguugguggugccuuuu

SEQ ID NO: 679043 - RNA, 19 nt, Human
cucccacucccucuuccca

SEQ ID NO: 679044 - RNA, 21 nt, Human
cugcaggaguguguuuccagc

SEQ ID NO: 679045 - RNA, 25 nt, Human
cuuuuaguuuucacaucacaugggg

SEQ ID NO: 679046 - RNA, 23 nt, Human
gaauaggcucucuuucccugccu

SEQ ID NO: 679047 - RNA, 21 nt, Human
gcaucugggucaccacaccca

SEQ ID NO: 679048 - RNA, 22 nt, Human
gccucagguggagacagacccc

SEQ ID NO: 679049 - RNA, 19 nt, Human
ggaggcuggacaguuuccu

SEQ ID NO: 679050 - RNA, 18 nt, Human
ggcuaggaggcuggacag

SEQ ID NO: 679051 - RNA, 21 nt, Human
ggcuguaaggcagcagcugcc

SEQ ID NO: 679052 - RNA, 21 nt, Human
uacaggcugcugugccuccca

SEQ ID NO: 679053 - RNA, 21 nt, Human
uaggaagggcuguaaggcagc

SEQ ID NO: 679054 - RNA, 22 nt, Human
uaggaagggcuguaaggcagca

SEQ ID NO: 679055 - RNA, 20 nt, Human
ucaccacacccaaaguauga

SEQ ID NO: 679056 - RNA, 23 nt, Human
ucccacucccucuucccaaccuc

SEQ ID NO: 679057 - RNA, 18 nt, Human
ucccucuucccaaccucu

SEQ ID NO: 679058 - RNA, 18 nt, Human
ucccugccucagguggag

SEQ ID NO: 679059 - RNA, 26 nt, Human
ucugaagaucaugugugagaauaggc

SEQ ID NO: 679060 - RNA, 19 nt, Human
ugagaauaggcucucuuuc

SEQ ID NO: 679061 - RNA, 23 nt, Human
ugcaucugggucaccacacccaa

SEQ ID NO: 679062 - RNA, 25 nt, Human
uggagacagaccccucccacucccu

SEQ ID NO: 679063 - RNA, 20 nt, Human
ugugccucccaguguuucuu

SEQ ID NO: 679064 - RNA, 19 nt, Human
uuccagcacucugaagauc

SEQ ID NO: 679065 - RNA, 21 nt, Human
uuuucacaucacauggggcua

SEQ ID NO: 679066 - RNA, 21 nt, Human
aagcagaagagaagagguggg

SEQ ID NO: 679067 - RNA, 18 nt, Human
agagaagaggugggcaga

SEQ ID NO: 679068 - RNA, 24 nt, Human
gaagugcaaagccacaaaaagcaa

SEQ ID NO: 679069 - RNA, 20 nt, Human
uagaguuaggauuaucacac

SEQ ID NO: 679070 - RNA, 22 nt, Human
uaguagaguuaggauuaucaca

SEQ ID NO: 679071 - RNA, 19 nt, Human
ucucuagaaauauauuuau

SEQ ID NO: 679072 - RNA, 18 nt, Human
ugcaaagccacaaaaagc

SEQ ID NO: 679073 - RNA, 18 nt, Human
ugcaaagccacaaaaagc

SEQ ID NO: 679074 - RNA, 23 nt, Human
uuaauuuuuuugccagagagggc

SEQ ID NO: 679075 - RNA, 18 nt, Human
aaaaggccuugcacauag

SEQ ID NO: 679076 - RNA, 21 nt, Human
cauugagcuccuggauccagc

SEQ ID NO: 679077 - RNA, 22 nt, Human
cauugagcuccuggauccagcu

SEQ ID NO: 679078 - RNA, 23 nt, Human
cuaaaaaggccuugcacauagca

SEQ ID NO: 679079 - RNA, 18 nt, Human
cucugguuuugggagucc

SEQ ID NO: 679080 - RNA, 19 nt, Human
cuugaggaguuaagauuug

SEQ ID NO: 679081 - RNA, 24 nt, Human
gaagauacacacccacaaugucuc

SEQ ID NO: 679082 - RNA, 23 nt, Human
gauccagcuaugccugaagccag

SEQ ID NO: 679083 - RNA, 22 nt, Human
gguuuugggaguccuugaggag

SEQ ID NO: 679084 - RNA, 23 nt, Human
ucaggcuccuggugucucuggag

SEQ ID NO: 679085 - RNA, 23 nt, Human
ugccugaagccagucuugugaaa

SEQ ID NO: 679086 - RNA, 21 nt, Human
aaacaaaggguaaaaaucagg

SEQ ID NO: 679087 - RNA, 20 nt, Human
aacaggagaaacucagcugg

SEQ ID NO: 679088 - RNA, 18 nt, Human
aagcugcaaucacauuca

SEQ ID NO: 679089 - RNA, 21 nt, Human
aaggacgucggaagccgggga

SEQ ID NO: 679090 - RNA, 23 nt, Human
aagugguccuaauguccuggcug

SEQ ID NO: 679091 - RNA, 19 nt, Human
aauacuuucuacauauugu

SEQ ID NO: 679092 - RNA, 18 nt, Human
agaaauggugcaugcaca

SEQ ID NO: 679093 - RNA, 19 nt, Human
agacaggaagaacucuagg

SEQ ID NO: 679094 - RNA, 24 nt, Human
agcaacagcaucagugguccagaa

SEQ ID NO: 679095 - RNA, 25 nt, Human
aggaaaaugugaacagaugaaacug

SEQ ID NO: 679096 - RNA, 26 nt, Human
aguacagaauguucaaagcugcaauc

SEQ ID NO: 679097 - RNA, 23 nt, Human
agugcccgcuucucccaagcagc

SEQ ID NO: 679098 - RNA, 20 nt, Human
augguaagagaagcaucauc

SEQ ID NO: 679099 - RNA, 24 nt, Human
caaaaacaaacuguguggaaauaa

SEQ ID NO: 679100 - RNA, 20 nt, Human
caaggaaaaugugaacagau

SEQ ID NO: 679101 - RNA, 24 nt, Human
cacccugugcucagaagcaggagu

SEQ ID NO: 679102 - RNA, 20 nt, Human
caccuagggcuucacugccc

SEQ ID NO: 679103 - RNA, 18 nt, Human
cacuauauaugacugagu

SEQ ID NO: 679104 - RNA, 23 nt, Human
cagaagcaggagugguggcugau

SEQ ID NO: 679105 - RNA, 22 nt, Human
cagaauguucaaagcugcaauc

SEQ ID NO: 679106 - RNA, 24 nt, Human
cagcagcagcaagaaugcuuggcu

SEQ ID NO: 679107 - RNA, 23 nt, Human
cagcaucagugguccagaaauca

SEQ ID NO: 679108 - RNA, 22 nt, Human
cagcgcgguccauccugacacu

SEQ ID NO: 679109 - RNA, 26 nt, Human
caggaagaacucuagguagccagagg

SEQ ID NO: 679110 - RNA, 24 nt, Human
caggcgggugggcaggcaggcagc

SEQ ID NO: 679111 - RNA, 20 nt, Human
caguauaccacaugcccaau

SEQ ID NO: 679112 - RNA, 22 nt, Human
caugcuauagaaaaugugaaac

SEQ ID NO: 679113 - RNA, 20 nt, Human
ccacacacaugguccugggc

SEQ ID NO: 679114 - RNA, 21 nt, Human
ccaggaaauaccuccucagca

SEQ ID NO: 679115 - RNA, 22 nt, Human
cccgcuggggucgaaggcccca

SEQ ID NO: 679116 - RNA, 19 nt, Human
ccgcuggggucgaaggccc

SEQ ID NO: 679117 - RNA, 23 nt, Human
ccugaauuaugcaguuaacugag

SEQ ID NO: 679118 - RNA, 19 nt, Human
ccugugcucagaagcagga

SEQ ID NO: 679119 - RNA, 18 nt, Human
cuaaaauagauaaucacc

SEQ ID NO: 679120 - RNA, 19 nt, Human
cucuagguagccagaggug

SEQ ID NO: 679121 - RNA, 20 nt, Human
cuugaggucuuaauggcaac

SEQ ID NO: 679122 - RNA, 20 nt, Human
gacuuauucuucuuagcaac

SEQ ID NO: 679123 - RNA, 19 nt, Human
gagaagcaucaucaaagac

SEQ ID NO: 679124 - RNA, 18 nt, Human
gagggaaggaggcgacgg

SEQ ID NO: 679125 - RNA, 24 nt, Human
gauaaucaccuuauuuguuuucaa

SEQ ID NO: 679126 - RNA, 18 nt, Human
gcgaaaaaaaaggagcau

SEQ ID NO: 679127 - RNA, 18 nt, Human
gcucaagaggagagcacc

SEQ ID NO: 679128 - RNA, 20 nt, Human
gggcugcaagcccaggcggg

SEQ ID NO: 679129 - RNA, 21 nt, Human
gguccagaaaucaacaggaga

SEQ ID NO: 679130 - RNA, 25 nt, Human
gguuacuuucuaaaauacuuucuac

SEQ ID NO: 679131 - RNA, 19 nt, Human
gucaagacaggaagaacuc

SEQ ID NO: 679132 - RNA, 18 nt, Human
guccaaaaugacuucggg

SEQ ID NO: 679133 - RNA, 20 nt, Human
uaaaauagauaaucaccuua

SEQ ID NO: 679134 - RNA, 21 nt, Human
uaaagucccaacugggagcuu

SEQ ID NO: 679135 - RNA, 21 nt, Human
uaagagaagcaucaucaaaga

SEQ ID NO: 679136 - RNA, 21 nt, Human
uaagagugcgaaaaaaaagga

SEQ ID NO: 679137 - RNA, 25 nt, Human
uacaaaaacuaaaugguaagagaag

SEQ ID NO: 679138 - RNA, 19 nt, Human
uagagagacgccuugguuc

SEQ ID NO: 679139 - RNA, 23 nt, Human
uagauuaauaaaaugacagcuga

SEQ ID NO: 679140 - RNA, 22 nt, Human
uagcagcuaauauuagcuaugc

SEQ ID NO: 679141 - RNA, 22 nt, Human
uagcagcugcagggagacuucu

SEQ ID NO: 679142 - RNA, 18 nt, Human
uagcccgcuggggucgaa

SEQ ID NO: 679143 - RNA, 24 nt, Human
ucaacauauacaauauugauguua

SEQ ID NO: 679144 - RNA, 22 nt, Human
ucaacgccaauuuucagucuua

SEQ ID NO: 679145 - RNA, 21 nt, Human
ucagucuuaagagugcgaaaa

SEQ ID NO: 679146 - RNA, 18 nt, Human
ucagugccaggagcaagu

SEQ ID NO: 679147 - RNA, 22 nt, Human
uccacacacaugguccugggca

SEQ ID NO: 679148 - RNA, 23 nt, Human
ucccccgaucuaucgggcuucgc

SEQ ID NO: 679149 - RNA, 21 nt, Human
ucucagcugguaucagggcug

SEQ ID NO: 679150 - RNA, 23 nt, Human
ucucugugucucuuuucaaauaa

SEQ ID NO: 679151 - RNA, 18 nt, Human
ucugguguuuugacuuua

SEQ ID NO: 679152 - RNA, 22 nt, Human
ugacaaaccucaaauaauaugu

SEQ ID NO: 679153 - RNA, 20 nt, Human
ugagauaaagucccaacugg

SEQ ID NO: 679154 - RNA, 22 nt, Human
ugagauaaagucccaacuggga

SEQ ID NO: 679155 - RNA, 18 nt, Human
ugaggcuguuugggccca

SEQ ID NO: 679156 - RNA, 22 nt, Human
ugcccaggcgugcaacaaagca

SEQ ID NO: 679157 - RNA, 18 nt, Human
ugcuauagaaaaugugaa

SEQ ID NO: 679158 - RNA, 20 nt, Human
ugggcaggaacuagcagcug

SEQ ID NO: 679159 - RNA, 18 nt, Human
ugguaaguagucagaaug

SEQ ID NO: 679160 - RNA, 20 nt, Human
uggugcaugcacaaaaggga

SEQ ID NO: 679161 - RNA, 23 nt, Human
uguccugccuugcguuuaggcug

SEQ ID NO: 679162 - RNA, 24 nt, Human
ugucucagggggagggaugccagg

SEQ ID NO: 679163 - RNA, 18 nt, Human
ugucuggaagaaguaaaa

SEQ ID NO: 679164 - RNA, 21 nt, Human
ugugcaugcuauagaaaaugu

SEQ ID NO: 679165 - RNA, 21 nt, Human
uugcugagccaaccauauuau

SEQ ID NO: 679166 - RNA, 23 nt, Human
uuggcugcaaaaucagaagcuga

SEQ ID NO: 679167 - RNA, 23 nt, Human
uugugagauaaagucccaacugg

SEQ ID NO: 679168 - RNA, 19 nt, Human
uuucacacaauuuugcauu

SEQ ID NO: 679169 - RNA, 27 nt, Human
uuuuuuuuuuuuuuuuuuuuucugggg

SEQ ID NO: 679170 - RNA, 18 nt, Human
acccucuacgccaugccu

SEQ ID NO: 679171 - RNA, 22 nt, Human
agacauaaaaauaaaagagcaa

SEQ ID NO: 679172 - RNA, 22 nt, Human
agagccagagccggcagaggga

SEQ ID NO: 679173 - RNA, 19 nt, Human
agggaggagccuggaaugg

SEQ ID NO: 679174 - RNA, 18 nt, Human
aguuuccaaaugagaagg

SEQ ID NO: 679175 - RNA, 21 nt, Human
augaaguuuuaguuuccaaau

SEQ ID NO: 679176 - RNA, 23 nt, Human
caaauauagaggucuuggggacc

SEQ ID NO: 679177 - RNA, 18 nt, Human
cacccucuacgccaugcc

SEQ ID NO: 679178 - RNA, 18 nt, Human
caccucgggcggcaggau

SEQ ID NO: 679179 - RNA, 20 nt, Human
cacugcugagcuggaggccu

SEQ ID NO: 679180 - RNA, 18 nt, Human
cagagccggcagagggag

SEQ ID NO: 679181 - RNA, 23 nt, Human
ccccucugcuuuggugcuugugg

SEQ ID NO: 679182 - RNA, 27 nt, Human
ccucuacgccaugccuuguacuccccg

SEQ ID NO: 679183 - RNA, 23 nt, Human
ccugccccucugcuuuggugcuu

SEQ ID NO: 679184 - RNA, 25 nt, Human
cucuacgccaugccuuguacucccc

SEQ ID NO: 679185 - RNA, 20 nt, Human
cucugcuuuggugcuugugg

SEQ ID NO: 679186 - RNA, 22 nt, Human
cucuggcugcuggguggugugc

SEQ ID NO: 679187 - RNA, 19 nt, Human
cugagcuggaggccugggc

SEQ ID NO: 679188 - RNA, 20 nt, Human
cugccccucugcuuuggugc

SEQ ID NO: 679189 - RNA, 22 nt, Human
cugcuuuggugcuugugguugg

SEQ ID NO: 679190 - RNA, 21 nt, Human
cugguggugcuggggcugcca

SEQ ID NO: 679191 - RNA, 18 nt, Human
gaccauggccacagucac

SEQ ID NO: 679192 - RNA, 24 nt, Human
gagccagagccggcagagggaggg

SEQ ID NO: 679193 - RNA, 24 nt, Human
gagccggcagagggagggaggagc

SEQ ID NO: 679194 - RNA, 25 nt, Human
gagcugggaggguggcuucccgggg

SEQ ID NO: 679195 - RNA, 21 nt, Human
gcugagcuggaggccugggcu

SEQ ID NO: 679196 - RNA, 20 nt, Human
ggcggcaggauggggcuugg

SEQ ID NO: 679197 - RNA, 19 nt, Human
guggugugcugccugcccc

SEQ ID NO: 679198 - RNA, 19 nt, Human
ugagcuggaggccugggcu

SEQ ID NO: 679199 - RNA, 19 nt, Human
ugcucuggcugcugggugg

SEQ ID NO: 679200 - RNA, 18 nt, Human
uggaggccugggcugugg

SEQ ID NO: 679201 - RNA, 22 nt, Human
uggcuucccgggagaccuggug

SEQ ID NO: 679202 - RNA, 19 nt, Human
uggggcuuggcagcuaagg

SEQ ID NO: 679203 - RNA, 20 nt, Human
uggugcaguccucagagcug

SEQ ID NO: 679204 - RNA, 21 nt, Human
uggugcaguccucagagcugg

SEQ ID NO: 679205 - RNA, 23 nt, Human
uuauugaaaaguuuuaagcagga

SEQ ID NO: 679206 - RNA, 24 nt, Human
uucccgggagaccugguggugcug

SEQ ID NO: 679207 - RNA, 23 nt, Human
uuuagacauaaaaauaaaagagc

SEQ ID NO: 679208 - RNA, 18 nt, Human
uuuuugguccugacgauc

SEQ ID NO: 679209 - RNA, 18 nt, Human
uuuuuuuuuuuuuuuuug

SEQ ID NO: 679210 - RNA, 28 nt, Human
uuuuuuuuuuuuuuuuuuuuuuuggggg

SEQ ID NO: 679211 - RNA, 23 nt, Human
acccacagggucgagcccugcag

SEQ ID NO: 679212 - RNA, 21 nt, Human
acccaguggccaggccccuua

SEQ ID NO: 679213 - RNA, 20 nt, Human
aggaagggccacaacuagca

SEQ ID NO: 679214 - RNA, 21 nt, Human
agguccgagguccguggaggu

SEQ ID NO: 679215 - RNA, 23 nt, Human
caccugacugaggcgggaacagg

SEQ ID NO: 679216 - RNA, 23 nt, Human
caggaggggucugggaaauggug

SEQ ID NO: 679217 - RNA, 19 nt, Human
ccacaacuagcagccgccu

SEQ ID NO: 679218 - RNA, 21 nt, Human
ccacugggccugggugccgca

SEQ ID NO: 679219 - RNA, 24 nt, Human
ccaguggccaggccccuuagcugg

SEQ ID NO: 679220 - RNA, 20 nt, Human
ccccagggagggcacacagg

SEQ ID NO: 679221 - RNA, 19 nt, Human
ccuccucagccccagggag

SEQ ID NO: 679222 - RNA, 21 nt, Human
cuagcagccgccugccuccuc

SEQ ID NO: 679223 - RNA, 18 nt, Human
cuccuuccaggaagggcc

SEQ ID NO: 679224 - RNA, 22 nt, Human
cuccuuccaggaagggccacaa

SEQ ID NO: 679225 - RNA, 18 nt, Human
gagcccugcaggccucuc

SEQ ID NO: 679226 - RNA, 21 nt, Human
gagccgccuggagguccgagg

SEQ ID NO: 679227 - RNA, 19 nt, Human
gaggcgggaacaggagggg

SEQ ID NO: 679228 - RNA, 18 nt, Human
gcacacaggcuggguggc

SEQ ID NO: 679229 - RNA, 20 nt, Human
gccgccugccuccucagccc

SEQ ID NO: 679230 - RNA, 20 nt, Human
gggaacaggaggggucuggg

SEQ ID NO: 679231 - RNA, 27 nt, Human
gucugcucuuuaauggacaccgcccac

SEQ ID NO: 679232 - RNA, 19 nt, Human
uaauggacaccgcccacuu

SEQ ID NO: 679233 - RNA, 23 nt, Human
uagcagccgccugccuccucagc

SEQ ID NO: 679234 - RNA, 21 nt, Human
uccgagguccguggagguggg

SEQ ID NO: 679235 - RNA, 19 nt, Human
ucgagcccugcaggccucu

SEQ ID NO: 679236 - RNA, 19 nt, Human
ucugcucccuggggacaga

SEQ ID NO: 679237 - RNA, 24 nt, Human
ugacugaggcgggaacaggagggg

SEQ ID NO: 679238 - RNA, 22 nt, Human
uggagguggggagggggugcag

SEQ ID NO: 679239 - RNA, 20 nt, Human
uggcacccaguggccaggcc

SEQ ID NO: 679240 - RNA, 19 nt, Human
ugggaaauggugccacugg

SEQ ID NO: 679241 - RNA, 20 nt, Human
uggggacagaaacccacagg

SEQ ID NO: 679242 - RNA, 20 nt, Human
aaagacuuccucagcccuca

SEQ ID NO: 679243 - RNA, 27 nt, Human
aaccagaaacaaaaacggaaauaaauu

SEQ ID NO: 679244 - RNA, 23 nt, Human
aaccugcaccagccaaagggcag

SEQ ID NO: 679245 - RNA, 31 nt, Human
aaccugcccacuucucaucuagcucuuccag

SEQ ID NO: 679246 - RNA, 19 nt, Human
aagaccccacggccccgcc

SEQ ID NO: 679247 - RNA, 20 nt, Human
aagcagcaggaguucuugga

SEQ ID NO: 679248 - RNA, 20 nt, Human
aauacccacuucauucuggc

SEQ ID NO: 679249 - RNA, 18 nt, Human
acacggcuccccaccccc

SEQ ID NO: 679250 - RNA, 21 nt, Human
acagggagagacuccucugga

SEQ ID NO: 679251 - RNA, 21 nt, Human
acgacuccucccaucagacgg

SEQ ID NO: 679252 - RNA, 22 nt, Human
acucagcauccaugugucauag

SEQ ID NO: 679253 - RNA, 21 nt, Human
acuggccuuggcauccucagc

SEQ ID NO: 679254 - RNA, 19 nt, Human
agacaaggccaugagcaua

SEQ ID NO: 679255 - RNA, 22 nt, Human
agcacuuuucccacuggcagcc

SEQ ID NO: 679256 - RNA, 22 nt, Human
agcaggaguucuuggaagcgag

SEQ ID NO: 679257 - RNA, 24 nt, Human
agccugaccagcgguccaccaucu

SEQ ID NO: 679258 - RNA, 18 nt, Human
agccuggugcguccgcug

SEQ ID NO: 679259 - RNA, 21 nt, Human
agcugcccaucacgccucacu

SEQ ID NO: 679260 - RNA, 18 nt, Human
agcuggauaccauccaag

SEQ ID NO: 679261 - RNA, 21 nt, Human
agcuuccggcaagacucacag

SEQ ID NO: 679262 - RNA, 24 nt, Human
aggaagcagcaggaguucuuggaa

SEQ ID NO: 679263 - RNA, 20 nt, Human
aggcagcgccuugguccugg

SEQ ID NO: 679264 - RNA, 20 nt, Human
aggcaguaccugcucccagc

SEQ ID NO: 679265 - RNA, 23 nt, Human
aggccgaggcggaggcucugaga

SEQ ID NO: 679266 - RNA, 19 nt, Human
aggcuccucgaacccuacc

SEQ ID NO: 679267 - RNA, 21 nt, Human
agggcuggggcacaucuggca

SEQ ID NO: 679268 - RNA, 21 nt, Human
agggguaccagggccuggagc

SEQ ID NO: 679269 - RNA, 19 nt, Human
aggugcacaguucucgcca

SEQ ID NO: 679270 - RNA, 18 nt, Human
aucacgccucacuucaca

SEQ ID NO: 679271 - RNA, 19 nt, Human
caaagacuuccucagcccu

SEQ ID NO: 679272 - RNA, 23 nt, Human
cacccacacggcuccccaccccc

SEQ ID NO: 679273 - RNA, 23 nt, Human
caccucaaagacuuccucagccc

SEQ ID NO: 679274 - RNA, 19 nt, Human
cacgccucacuucacagcu

SEQ ID NO: 679275 - RNA, 21 nt, Human
cacggccccgcagcagccagg

SEQ ID NO: 679276 - RNA, 21 nt, Human
cacguguccagauugggccca

SEQ ID NO: 679277 - RNA, 25 nt, Human
cacucagcauccaugugucauaguc

SEQ ID NO: 679278 - RNA, 19 nt, Human
cacuccagccucaauggag

SEQ ID NO: 679279 - RNA, 21 nt, Human
cacuucuugguuaguguccca

SEQ ID NO: 679280 - RNA, 18 nt, Human
cagcacaggagggggcug

SEQ ID NO: 679281 - RNA, 23 nt, Human
cagcagccaggcugcccguuuga

SEQ ID NO: 679282 - RNA, 24 nt, Human
cagccaggcugcccguuugagggc

SEQ ID NO: 679283 - RNA, 21 nt, Human
cagcggcacgcacugcccucg

SEQ ID NO: 679284 - RNA, 21 nt, Human
cagcuacccccugguccaccc

SEQ ID NO: 679285 - RNA, 23 nt, Human
cagcuggauaccauccaaguggu

SEQ ID NO: 679286 - RNA, 22 nt, Human
caggauggaggcaguaccugcu

SEQ ID NO: 679287 - RNA, 20 nt, Human
caggccccauauccucucca

SEQ ID NO: 679288 - RNA, 20 nt, Human
caggugaugacucccaggac

SEQ ID NO: 679289 - RNA, 18 nt, Human
caguggcagguagauuuu

SEQ ID NO: 679290 - RNA, 24 nt, Human
cauagagguccacaagcgcauggc

SEQ ID NO: 679291 - RNA, 18 nt, Human
caugucugcuuucuccaa

SEQ ID NO: 679292 - RNA, 24 nt, Human
caugucugcuuucuccaugucccc

SEQ ID NO: 679293 - RNA, 23 nt, Human
ccaagcuccagcaccugcgcaug

SEQ ID NO: 679294 - RNA, 22 nt, Human
ccaaugcgugcaccugugccca

SEQ ID NO: 679295 - RNA, 22 nt, Human
ccaccuacaucugagagccugc

SEQ ID NO: 679296 - RNA, 26 nt, Human
ccacucccgcccgguggccccggaaa

SEQ ID NO: 679297 - RNA, 22 nt, Human
ccacuggggagugcagugggaa

SEQ ID NO: 679298 - RNA, 22 nt, Human
ccagagcuguccagccgcaguc

SEQ ID NO: 679299 - RNA, 20 nt, Human
ccagcgguccaccaucuucu

SEQ ID NO: 679300 - RNA, 20 nt, Human
ccauauccucuccauccacc

SEQ ID NO: 679301 - RNA, 23 nt, Human
ccaucuucugaaugacaauuuuu

SEQ ID NO: 679302 - RNA, 22 nt, Human
ccaugagcauagccagcggcac

SEQ ID NO: 679303 - RNA, 22 nt, Human
cccacacggcuccccaccccca

SEQ ID NO: 679304 - RNA, 23 nt, Human
cccacccccagccucucuagguu

SEQ ID NO: 679305 - RNA, 27 nt, Human
cccacucccgcccgguggccccggaaa

SEQ ID NO: 679306 - RNA, 22 nt, Human
cccacuggcagccccuggcuca

SEQ ID NO: 679307 - RNA, 19 nt, Human
cccaggccaugcuccucgc

SEQ ID NO: 679308 - RNA, 25 nt, Human
ccccacggccccgcagcagccaggg

SEQ ID NO: 679309 - RNA, 21 nt, Human
ccccagcacacacucucuuug

SEQ ID NO: 679310 - RNA, 19 nt, Human
ccccgacgaacacccacac

SEQ ID NO: 679311 - RNA, 22 nt, Human
ccccggaaaaagcagcuucaug

SEQ ID NO: 679312 - RNA, 22 nt, Human
ccccggaaaaagcagcuucaug

SEQ ID NO: 679313 - RNA, 19 nt, Human
cccucgugccauccuccuc

SEQ ID NO: 679314 - RNA, 23 nt, Human
cccugggccaccaccgccugccc

SEQ ID NO: 679315 - RNA, 24 nt, Human
cccugggccaccaccgccugcccc

SEQ ID NO: 679316 - RNA, 18 nt, Human
ccgcggcccgacugugcu

SEQ ID NO: 679317 - RNA, 24 nt, Human
ccuaccccagguucucccuucaaa

SEQ ID NO: 679318 - RNA, 21 nt, Human
ccucaaagacuuccucagccc

SEQ ID NO: 679319 - RNA, 18 nt, Human
ccucagacggggcccgcc

SEQ ID NO: 679320 - RNA, 26 nt, Human
ccucgcccucacugccggugucugaa

SEQ ID NO: 679321 - RNA, 18 nt, Human
ccucgugccauccuccuc

SEQ ID NO: 679322 - RNA, 23 nt, Human
ccucuggaacgccaccugagccu

SEQ ID NO: 679323 - RNA, 18 nt, Human
ccuggagcugggcuccca

SEQ ID NO: 679324 - RNA, 23 nt, Human
ccugugcccagcgcauccagguc

SEQ ID NO: 679325 - RNA, 22 nt, Human
cgagcaggcagcgccuuggucc

SEQ ID NO: 679326 - RNA, 21 nt, Human
cgcagcuuccggcaagacuca

SEQ ID NO: 679327 - RNA, 21 nt, Human
cgcaucaugccaaugcgugca

SEQ ID NO: 679328 - RNA, 25 nt, Human
cgccaggcuccucgaacccuacccc

SEQ ID NO: 679329 - RNA, 21 nt, Human
cgccgggaacgugagcgacga

SEQ ID NO: 679330 - RNA, 24 nt, Human
cgcgcgagagagaggccgaggcgg

SEQ ID NO: 679331 - RNA, 20 nt, Human
cggcaggugguggaccccag

SEQ ID NO: 679332 - RNA, 22 nt, Human
cggcugccaagcuccagcaccu

SEQ ID NO: 679333 - RNA, 19 nt, Human
cgggaaugagguggaggca

SEQ ID NO: 679334 - RNA, 21 nt, Human
cgguggcaguguugcuggucg

SEQ ID NO: 679335 - RNA, 20 nt, Human
cguccggagcucuggcaggg

SEQ ID NO: 679336 - RNA, 21 nt, Human
cucacaggugaaagaaggcgg

SEQ ID NO: 679337 - RNA, 18 nt, Human
cucagaguccaugggccc

SEQ ID NO: 679338 - RNA, 20 nt, Human
cuccagcaccugcgcaugcc

SEQ ID NO: 679339 - RNA, 18 nt, Human
cuccagccucaauggagc

SEQ ID NO: 679340 - RNA, 22 nt, Human
cucgcagcucuuuagaggacua

SEQ ID NO: 679341 - RNA, 20 nt, Human
cucgcagcuuccggcaagac

SEQ ID NO: 679342 - RNA, 18 nt, Human
cucuuccacuuucaccuc

SEQ ID NO: 679343 - RNA, 21 nt, Human
cugaacugggggaaggaggcu

SEQ ID NO: 679344 - RNA, 21 nt, Human
cuggccccugcgucacauccg

SEQ ID NO: 679345 - RNA, 21 nt, Human
cuucaaaggacggcagcucag

SEQ ID NO: 679346 - RNA, 20 nt, Human
cuuccgugcgcccacccuuc

SEQ ID NO: 679347 - RNA, 20 nt, Human
gaacacccacacggcucccc

SEQ ID NO: 679348 - RNA, 23 nt, Human
gaagagggguaccagggccugga

SEQ ID NO: 679349 - RNA, 21 nt, Human
gaccucagacggggcccgccu

SEQ ID NO: 679350 - RNA, 18 nt, Human
gacuaccgcauacaccuc

SEQ ID NO: 679351 - RNA, 19 nt, Human
gacucccaggacaagggaa

SEQ ID NO: 679352 - RNA, 22 nt, Human
gagcauagccagcggcacgcac

SEQ ID NO: 679353 - RNA, 24 nt, Human
gaggcagucgccacucagagucca

SEQ ID NO: 679354 - RNA, 19 nt, Human
gcacaguucucgccaggcu

SEQ ID NO: 679355 - RNA, 24 nt, Human
gcagcaggaguucuuggaagcgag

SEQ ID NO: 679356 - RNA, 23 nt, Human
gcgcaggugaugacucccaggac

SEQ ID NO: 679357 - RNA, 20 nt, Human
gcguccgcugggauuugggg

SEQ ID NO: 679358 - RNA, 18 nt, Human
gcucccacgacuccuccc

SEQ ID NO: 679359 - RNA, 20 nt, Human
gcuccccacccccagccucu

SEQ ID NO: 679360 - RNA, 18 nt, Human
gcugccaagcuccagcac

SEQ ID NO: 679361 - RNA, 24 nt, Human
gcugcuccucccgaggaggugcac

SEQ ID NO: 679362 - RNA, 24 nt, Human
ggaaggaggcugggugccuucuga

SEQ ID NO: 679363 - RNA, 22 nt, Human
ggaggcaugaaauaaucuucag

SEQ ID NO: 679364 - RNA, 21 nt, Human
ggcagggaaggaggcagcccu

SEQ ID NO: 679365 - RNA, 21 nt, Human
ggccaccaccgccugccccgg

SEQ ID NO: 679366 - RNA, 19 nt, Human
gggaauuccaggucuucag

SEQ ID NO: 679367 - RNA, 18 nt, Human
gggcacaucuggcacagc

SEQ ID NO: 679368 - RNA, 22 nt, Human
ggggccgguggcauuggugaug

SEQ ID NO: 679369 - RNA, 23 nt, Human
ggggcugcuccucccgaggaggu

SEQ ID NO: 679370 - RNA, 21 nt, Human
gggguaggggaguaaaaggga

SEQ ID NO: 679371 - RNA, 21 nt, Human
gguguugaagauauaaucuga

SEQ ID NO: 679372 - RNA, 19 nt, Human
guccggagcucuggcaggg

SEQ ID NO: 679373 - RNA, 25 nt, Human
gugcaccugugcccagcgcauccag

SEQ ID NO: 679374 - RNA, 24 nt, Human
gugcugggccuccggacauggagc

SEQ ID NO: 679375 - RNA, 21 nt, Human
guugaagauauaaucugaugg

SEQ ID NO: 679376 - RNA, 22 nt, Human
uaacaugaagaugcagcccccc

SEQ ID NO: 679377 - RNA, 25 nt, Human
uaccagggccuggagcugggcuccc

SEQ ID NO: 679378 - RNA, 19 nt, Human
uagcacaggcuucgcuuug

SEQ ID NO: 679379 - RNA, 18 nt, Human
uagcggcaggugguggac

SEQ ID NO: 679380 - RNA, 19 nt, Human
ucacccacgaugggguggg

SEQ ID NO: 679381 - RNA, 19 nt, Human
ucaggccgaauagcaguca

SEQ ID NO: 679382 - RNA, 20 nt, Human
uccacuuucaccucaaagaa

SEQ ID NO: 679383 - RNA, 18 nt, Human
uccauggggccgguggca

SEQ ID NO: 679384 - RNA, 20 nt, Human
uccauggggccgguggcauu

SEQ ID NO: 679385 - RNA, 22 nt, Human
ucccacuggcagccccuggcuc

SEQ ID NO: 679386 - RNA, 18 nt, Human
ucccggggaggcuccccu

SEQ ID NO: 679387 - RNA, 18 nt, Human
uccgugcgcccacccuuc

SEQ ID NO: 679388 - RNA, 20 nt, Human
uccucagcccucagcuccuu

SEQ ID NO: 679389 - RNA, 20 nt, Human
uccucuggaacgccaccuga

SEQ ID NO: 679390 - RNA, 21 nt, Human
uccucuggaacgccaccuggu

SEQ ID NO: 679391 - RNA, 23 nt, Human
ucgcagcuuccggcaagacucaa

SEQ ID NO: 679392 - RNA, 22 nt, Human
ucgguggcaguguugcuggucg

SEQ ID NO: 679393 - RNA, 21 nt, Human
ucugaacugggggaaggaggc

SEQ ID NO: 679394 - RNA, 22 nt, Human
ucugaacugggggaaggaggcu

SEQ ID NO: 679395 - RNA, 19 nt, Human
ucugccccccgacgaacac

SEQ ID NO: 679396 - RNA, 18 nt, Human
ucuggccucccaggccau

SEQ ID NO: 679397 - RNA, 19 nt, Human
ugaagaugcagccccccag

SEQ ID NO: 679398 - RNA, 20 nt, Human
ugagcgacgacggcugcaga

SEQ ID NO: 679399 - RNA, 21 nt, Human
ugagcgacgacggcugcagac

SEQ ID NO: 679400 - RNA, 18 nt, Human
ugagggcacaggcagaag

SEQ ID NO: 679401 - RNA, 23 nt, Human
ugccagaccucagacggggcccg

SEQ ID NO: 679402 - RNA, 21 nt, Human
ugcccucgugccauccuccuc

SEQ ID NO: 679403 - RNA, 19 nt, Human
ugccuacaugcuccugcgc

SEQ ID NO: 679404 - RNA, 22 nt, Human
ugcugggccuccggacauggag

SEQ ID NO: 679405 - RNA, 21 nt, Human
uggaacugacaauugacacac

SEQ ID NO: 679406 - RNA, 19 nt, Human
uggccccugcgucacaucc

SEQ ID NO: 679407 - RNA, 22 nt, Human
uggccucccaggccaugcuccu

SEQ ID NO: 679408 - RNA, 19 nt, Human
uggccuuggcauccucagc

SEQ ID NO: 679409 - RNA, 24 nt, Human
uggcggaggcaugaaauaaucuuc

SEQ ID NO: 679410 - RNA, 18 nt, Human
uggggucccggaauugca

SEQ ID NO: 679411 - RNA, 23 nt, Human
ugggugccuucugacuccuccag

SEQ ID NO: 679412 - RNA, 22 nt, Human
uguaccacucagcauccaugug

SEQ ID NO: 679413 - RNA, 20 nt, Human
uguccauggggccgguggca

SEQ ID NO: 679414 - RNA, 22 nt, Human
uguggucagccccagccgcagg

SEQ ID NO: 679415 - RNA, 20 nt, Human
uguugaagauauaaucugau

SEQ ID NO: 679416 - RNA, 20 nt, Human
uuccggagucacggcggcgg

SEQ ID NO: 679417 - RNA, 19 nt, Human
uuccucagcccucagcucc

SEQ ID NO: 679418 - RNA, 22 nt, Human
uuccucagcccucagcuccuug

SEQ ID NO: 679419 - RNA, 19 nt, Human
uucuccauguccccuuggg

SEQ ID NO: 679420 - RNA, 19 nt, Human
uuggcuccuuagaaaucag

SEQ ID NO: 679421 - RNA, 19 nt, Human
uuggcuccuuagaaaucag

SEQ ID NO: 679422 - RNA, 20 nt, Human
uuggcuccuuagaaaucaga

SEQ ID NO: 679423 - RNA, 24 nt, Human
uuucccacuggcagccccuggcuc

SEQ ID NO: 679424 - RNA, 18 nt, Human
uuuuuuuuuuuuucucug

SEQ ID NO: 679425 - RNA, 22 nt, Human
uuuuuuuuuuuuuuuucagugg

SEQ ID NO: 679426 - RNA, 23 nt, Human
uuuuuuuuuuuuuuuuuuuucag

SEQ ID NO: 679427 - RNA, 18 nt, Human
agaaugccaccggguuga

SEQ ID NO: 679428 - RNA, 21 nt, Human
agagcugugggccccacuccu

SEQ ID NO: 679429 - RNA, 19 nt, Human
ccacuccucccccagaauc

SEQ ID NO: 679430 - RNA, 18 nt, Human
ccccacuccucccccaga

SEQ ID NO: 679431 - RNA, 18 nt, Human
ccucagcaggggugagcu

SEQ ID NO: 679432 - RNA, 19 nt, Human
ccucccccagaaugccacc

SEQ ID NO: 679433 - RNA, 18 nt, Human
ggggcugagccucagcag

SEQ ID NO: 679434 - RNA, 24 nt, Human
uccgggugcuggagagcugugggc

SEQ ID NO: 679435 - RNA, 24 nt, Human
uuuuuuuuuuuuguuccgacuggg

SEQ ID NO: 679436 - RNA, 19 nt, Human
uuuuuuuuuuuuuuguucc

SEQ ID NO: 679437 - RNA, 21 nt, Human
uuuuuuuuuuuuuuguuccga

SEQ ID NO: 679438 - RNA, 18 nt, Human
uuuuuuuuuuuuuuuuug

SEQ ID NO: 679439 - RNA, 20 nt, Human
uuuuuuuuuuuuuuuuuguu

SEQ ID NO: 679440 - RNA, 22 nt, Human
aaacaucucacccaacacaucc

SEQ ID NO: 679441 - RNA, 19 nt, Human
aacacuccacacacaccag

SEQ ID NO: 679442 - RNA, 23 nt, Human
aacaucucacccaacacauccua

SEQ ID NO: 679443 - RNA, 25 nt, Human
aagcaaaaacaauaacagauucaga

SEQ ID NO: 679444 - RNA, 24 nt, Human
aagcacggcaaugaaccuccaacc

SEQ ID NO: 679445 - RNA, 21 nt, Human
aaguuuuuaggggcuguuuau

SEQ ID NO: 679446 - RNA, 24 nt, Human
aauacuaaccccgccucccccaug

SEQ ID NO: 679447 - RNA, 24 nt, Human
acagaaucuguagaaaaccaaacc

SEQ ID NO: 679448 - RNA, 20 nt, Human
acagucucuuuuuaaaaaac

SEQ ID NO: 679449 - RNA, 21 nt, Human
accagauucagcucgccacca

SEQ ID NO: 679450 - RNA, 21 nt, Human
accccgccucccccaugaaaa

SEQ ID NO: 679451 - RNA, 22 nt, Human
acccugucgccccugguaggcc

SEQ ID NO: 679452 - RNA, 19 nt, Human
accucacgacccugggacu

SEQ ID NO: 679453 - RNA, 18 nt, Human
acgaagugaccagcggcc

SEQ ID NO: 679454 - RNA, 18 nt, Human
acuaaccccgccuccccc

SEQ ID NO: 679455 - RNA, 21 nt, Human
acuccacacacaccagaacag

SEQ ID NO: 679456 - RNA, 23 nt, Human
agaaaccucacgacccugggacu

SEQ ID NO: 679457 - RNA, 18 nt, Human
agaaaggacagggccuug

SEQ ID NO: 679458 - RNA, 18 nt, Human
agaggcgcucucaacauc

SEQ ID NO: 679459 - RNA, 21 nt, Human
agcauagaggcugcugccuca

SEQ ID NO: 679460 - RNA, 21 nt, Human
agcccguagcaccgcagccuc

SEQ ID NO: 679461 - RNA, 24 nt, Human
agccugggaggggagccggaagcu

SEQ ID NO: 679462 - RNA, 21 nt, Human
aggaaaggcaccggaacagaa

SEQ ID NO: 679463 - RNA, 20 nt, Human
aggaagaaaaaguuuuagaa

SEQ ID NO: 679464 - RNA, 24 nt, Human
aggcacaaagaaagacgucuccag

SEQ ID NO: 679465 - RNA, 18 nt, Human
aggcagggaggaugggga

SEQ ID NO: 679466 - RNA, 23 nt, Human
auaaauacuaaccccgccucccc

SEQ ID NO: 679467 - RNA, 19 nt, Human
aucaaggcacaaagaaaga

SEQ ID NO: 679468 - RNA, 22 nt, Human
aucugcaucuguuccuccccaa

SEQ ID NO: 679469 - RNA, 24 nt, Human
augaaaaaagcaauuguuacaaaa

SEQ ID NO: 679470 - RNA, 23 nt, Human
caaaaacaauaacagauucagag

SEQ ID NO: 679471 - RNA, 21 nt, Human
caaaacacucugcaugaaagc

SEQ ID NO: 679472 - RNA, 24 nt, Human
caacacuccacacacaccagaaca

SEQ ID NO: 679473 - RNA, 23 nt, Human
caacaucaaggcacaaagaaaga

SEQ ID NO: 679474 - RNA, 20 nt, Human
cacagcccagcacgugcuuc

SEQ ID NO: 679475 - RNA, 23 nt, Human
cacaugcuacacacacagaucug

SEQ ID NO: 679476 - RNA, 21 nt, Human
caccagaacaggaauagccag

SEQ ID NO: 679477 - RNA, 18 nt, Human
cacgacugacuccuccac

SEQ ID NO: 679478 - RNA, 23 nt, Human
cacgacugacuccuccacggcag

SEQ ID NO: 679479 - RNA, 22 nt, Human
cacuccacacacaccagaacag

SEQ ID NO: 679480 - RNA, 22 nt, Human
cacucugcaugaaagcacggca

SEQ ID NO: 679481 - RNA, 21 nt, Human
cacugucugaggcacagccca

SEQ ID NO: 679482 - RNA, 21 nt, Human
cacuuuuaccaccuaaaagcu

SEQ ID NO: 679483 - RNA, 26 nt, Human
cagaaacuucacagauguaacuucca

SEQ ID NO: 679484 - RNA, 22 nt, Human
cagauucagcucgccaccauuc

SEQ ID NO: 679485 - RNA, 22 nt, Human
cagccacagguugaucugcauc

SEQ ID NO: 679486 - RNA, 19 nt, Human
cagcccucaccacgguuaa

SEQ ID NO: 679487 - RNA, 24 nt, Human
cauucccaaagcccgccgggcgca

SEQ ID NO: 679488 - RNA, 18 nt, Human
ccaggcacuuuuaccacc

SEQ ID NO: 679489 - RNA, 19 nt, Human
ccaggcacuuuuaccaccu

SEQ ID NO: 679490 - RNA, 23 nt, Human
ccaggggccuuccaggcccuucu

SEQ ID NO: 679491 - RNA, 21 nt, Human
cccaaaugaacuuuccagaag

SEQ ID NO: 679492 - RNA, 20 nt, Human
cccacgccucacaguggggc

SEQ ID NO: 679493 - RNA, 21 nt, Human
ccccaacacuccacacacacc

SEQ ID NO: 679494 - RNA, 21 nt, Human
ccccagcaucuaccccaagcu

SEQ ID NO: 679495 - RNA, 24 nt, Human
cccccaugaaaaaagcaauuguua

SEQ ID NO: 679496 - RNA, 25 nt, Human
cccgacguuaaccuccuagacuagc

SEQ ID NO: 679497 - RNA, 21 nt, Human
cccgccucccccaugaaaaaa

SEQ ID NO: 679498 - RNA, 26 nt, Human
ccgcaugcugggggauggcacccucc

SEQ ID NO: 679499 - RNA, 22 nt, Human
ccuagacgggaaaacagccaca

SEQ ID NO: 679500 - RNA, 20 nt, Human
ccuccuagacuagcugaccu

SEQ ID NO: 679501 - RNA, 21 nt, Human
ccuggagcagcuacccggccc

SEQ ID NO: 679502 - RNA, 21 nt, Human
ccuggauaggaaaggcaccgg

SEQ ID NO: 679503 - RNA, 23 nt, Human
cgacaccugcucauuucuccaga

SEQ ID NO: 679504 - RNA, 24 nt, Human
cgaccagauucagcucgccaccau

SEQ ID NO: 679505 - RNA, 18 nt, Human
cgaggcagagucacgggg

SEQ ID NO: 679506 - RNA, 20 nt, Human
cgaguucagccugacgggca

SEQ ID NO: 679507 - RNA, 19 nt, Human
cgcuugcggagagaaaccc

SEQ ID NO: 679508 - RNA, 19 nt, Human
cuaaccccgccucccccau

SEQ ID NO: 679509 - RNA, 18 nt, Human
cuccacacacaccagaac

SEQ ID NO: 679510 - RNA, 21 nt, Human
cuccacggcagccaagcugcc

SEQ ID NO: 679511 - RNA, 19 nt, Human
cugcgcucccggcgccugc

SEQ ID NO: 679512 - RNA, 19 nt, Human
cugggggauggcacccucc

SEQ ID NO: 679513 - RNA, 21 nt, Human
cuguuccuccccaacacucca

SEQ ID NO: 679514 - RNA, 20 nt, Human
cuguuuccucugcacggacc

SEQ ID NO: 679515 - RNA, 23 nt, Human
cuucacaccgcuaagggcuuuau

SEQ ID NO: 679516 - RNA, 19 nt, Human
gaacaggcaccggucaccc

SEQ ID NO: 679517 - RNA, 24 nt, Human
gagaacccuggucacaccugcuga

SEQ ID NO: 679518 - RNA, 18 nt, Human
gagcagcuacccggcccc

SEQ ID NO: 679519 - RNA, 21 nt, Human
gccuacgcauguucaagggaa

SEQ ID NO: 679520 - RNA, 18 nt, Human
gcggagagaaacccuguc

SEQ ID NO: 679521 - RNA, 18 nt, Human
gcugggaagcggaggccc

SEQ ID NO: 679522 - RNA, 23 nt, Human
ggagauaccugugagaaccuaga

SEQ ID NO: 679523 - RNA, 19 nt, Human
ggaggauauuuucagcccu

SEQ ID NO: 679524 - RNA, 19 nt, Human
ggcaagccucugggugccc

SEQ ID NO: 679525 - RNA, 19 nt, Human
gggcugugaugucgguggg

SEQ ID NO: 679526 - RNA, 26 nt, Human
uaaaccccaaaugaacuuuccagaag

SEQ ID NO: 679527 - RNA, 21 nt, Human
uaacaugaaggcaaaacacuc

SEQ ID NO: 679528 - RNA, 20 nt, Human
uaaccuuuucaccagaaacc

SEQ ID NO: 679529 - RNA, 22 nt, Human
uaacuuccaagugcgaccucaa

SEQ ID NO: 679530 - RNA, 20 nt, Human
uaagggcuuuauuucacaga

SEQ ID NO: 679531 - RNA, 20 nt, Human
uagcuucuacgauuuaaccu

SEQ ID NO: 679532 - RNA, 20 nt, Human
uagugcaacauccugcccag

SEQ ID NO: 679533 - RNA, 19 nt, Human
uauuucacagaucauggug

SEQ ID NO: 679534 - RNA, 20 nt, Human
ucaagaaaggacagggccuu

SEQ ID NO: 679535 - RNA, 18 nt, Human
ucacagauguaacuucca

SEQ ID NO: 679536 - RNA, 21 nt, Human
ucaccagaaaccucacgaccc

SEQ ID NO: 679537 - RNA, 27 nt, Human
ucagcauuccuacccgacguuaaccuc

SEQ ID NO: 679538 - RNA, 25 nt, Human
ucauucccaaagcccgccgggcgca

SEQ ID NO: 679539 - RNA, 20 nt, Human
ucauuuccccgcugucgcca

SEQ ID NO: 679540 - RNA, 23 nt, Human
uccagaagcaaaaacaauaacag

SEQ ID NO: 679541 - RNA, 21 nt, Human
uccauuuuuuaaggaagaaaa

SEQ ID NO: 679542 - RNA, 21 nt, Human
ucccaaagcccgccgggcgca

SEQ ID NO: 679543 - RNA, 22 nt, Human
ucucaggccuggcugcguugcu

SEQ ID NO: 679544 - RNA, 20 nt, Human
ucuccagcuucuccaauccc

SEQ ID NO: 679545 - RNA, 21 nt, Human
ucugaaacaucucacccaaca

SEQ ID NO: 679546 - RNA, 20 nt, Human
ucugcagccugggaggggag

SEQ ID NO: 679547 - RNA, 24 nt, Human
ugaaaaaagcaauuguuacaaaaa

SEQ ID NO: 679548 - RNA, 18 nt, Human
ugaaacaucucacccaac

SEQ ID NO: 679549 - RNA, 22 nt, Human
ugaaagcacggcaaugaaccuc

SEQ ID NO: 679550 - RNA, 22 nt, Human
ugacagaaacuucacagaugua

SEQ ID NO: 679551 - RNA, 23 nt, Human
ugagggaggcgagggcuaagccc

SEQ ID NO: 679552 - RNA, 22 nt, Human
ugaucugcaucuguuccucccc

SEQ ID NO: 679553 - RNA, 22 nt, Human
ugcagccugggaggggagccgg

SEQ ID NO: 679554 - RNA, 18 nt, Human
ugccacaggucagagucu

SEQ ID NO: 679555 - RNA, 24 nt, Human
ugcccaguccacgugcuacugcgc

SEQ ID NO: 679556 - RNA, 19 nt, Human
ugcugggggauggcacccu

SEQ ID NO: 679557 - RNA, 21 nt, Human
ugcugggggauggcacccucc

SEQ ID NO: 679558 - RNA, 21 nt, Human
uggcagagaagccgcaugcug

SEQ ID NO: 679559 - RNA, 23 nt, Human
uggcagagaagccgcaugcuggg

SEQ ID NO: 679560 - RNA, 18 nt, Human
uggccgcagcccccagca

SEQ ID NO: 679561 - RNA, 21 nt, Human
ugggaggaagagccaaggaca

SEQ ID NO: 679562 - RNA, 22 nt, Human
ugggaggaagagccaaggacag

SEQ ID NO: 679563 - RNA, 21 nt, Human
ugggaguuucuguuuccucug

SEQ ID NO: 679564 - RNA, 22 nt, Human
uggggaaggcagggaggauggg

SEQ ID NO: 679565 - RNA, 22 nt, Human
uggggaggauauuuucagcccu

SEQ ID NO: 679566 - RNA, 22 nt, Human
ugguaggcccucgccgcacucg

SEQ ID NO: 679567 - RNA, 21 nt, Human
uggucggcccgcccagggcug

SEQ ID NO: 679568 - RNA, 22 nt, Human
uguggucggcccgcccagggcu

SEQ ID NO: 679569 - RNA, 19 nt, Human
uguuaaguaccucugucag

SEQ ID NO: 679570 - RNA, 18 nt, Human
uguuuccucugcacggac

SEQ ID NO: 679571 - RNA, 24 nt, Human
uguuugcucaaaagagaggcgcuc

SEQ ID NO: 679572 - RNA, 18 nt, Human
uucccgacaccugcucau

SEQ ID NO: 679573 - RNA, 18 nt, Human
uucucagguggugccugg

SEQ ID NO: 679574 - RNA, 23 nt, Human
uuuuaaaaaacuguguaaacguu

SEQ ID NO: 679575 - RNA, 19 nt, Human
agagggaugaggacaggag

SEQ ID NO: 679576 - RNA, 23 nt, Human
caggagugcuucaagaaacugaa

SEQ ID NO: 679577 - RNA, 21 nt, Human
ccaucaggccccaccaggaac

SEQ ID NO: 679578 - RNA, 24 nt, Human
cugaagacuuucuguucuuuuuca

SEQ ID NO: 679579 - RNA, 23 nt, Human
uauagauuugaaugugcccaaaa

SEQ ID NO: 679580 - RNA, 18 nt, Human
ucagagggaugaggacag

SEQ ID NO: 679581 - RNA, 19 nt, Human
ucugucuugacugagcuga

SEQ ID NO: 679582 - RNA, 20 nt, Human
ugcccaaaaucucagaggga

SEQ ID NO: 679583 - RNA, 26 nt, Human
ugcuucaaguacgccaggaugucugu

SEQ ID NO: 679584 - RNA, 22 nt, Human
aaacagagcugaggcuccaccc

SEQ ID NO: 679585 - RNA, 18 nt, Human
aaaguugugaucaggugg

SEQ ID NO: 679586 - RNA, 23 nt, Human
aacccccccuccuuuucccucug

SEQ ID NO: 679587 - RNA, 18 nt, Human
aagcuccccaggcaccuc

SEQ ID NO: 679588 - RNA, 23 nt, Human
aaucccuucucacagaaagcaga

SEQ ID NO: 679589 - RNA, 23 nt, Human
aauugcuugaaccgggaggcaga

SEQ ID NO: 679590 - RNA, 19 nt, Human
acacccauucauucagggc

SEQ ID NO: 679591 - RNA, 21 nt, Human
acccaggagcuccauggccac

SEQ ID NO: 679592 - RNA, 20 nt, Human
acccgccccacccagccacc

SEQ ID NO: 679593 - RNA, 23 nt, Human
acccgugcacccgccccacccag

SEQ ID NO: 679594 - RNA, 18 nt, Human
accgcaggcuagcccagg

SEQ ID NO: 679595 - RNA, 20 nt, Human
accuauggguuuggcacaaa

SEQ ID NO: 679596 - RNA, 19 nt, Human
accucacucuuaucaucca

SEQ ID NO: 679597 - RNA, 27 nt, Human
acucauccuuccuccgaggaguccccu

SEQ ID NO: 679598 - RNA, 20 nt, Human
acucuuaucauccaaaagcc

SEQ ID NO: 679599 - RNA, 24 nt, Human
acugcauuccagccugggugacag

SEQ ID NO: 679600 - RNA, 26 nt, Human
acugcauuccagccugggugacagag

SEQ ID NO: 679601 - RNA, 25 nt, Human
agaaagaaacagagcugaggcucca

SEQ ID NO: 679602 - RNA, 24 nt, Human
agaacccuucauucaaaugaagcc

SEQ ID NO: 679603 - RNA, 19 nt, Human
agaaguaaggcucaccugc

SEQ ID NO: 679604 - RNA, 21 nt, Human
agaauugcuugaaccgggagg

SEQ ID NO: 679605 - RNA, 20 nt, Human
agagguuucagugagccaag

SEQ ID NO: 679606 - RNA, 19 nt, Human
agaguagaggaugcuagaa

SEQ ID NO: 679607 - RNA, 21 nt, Human
agcagcugcucacccaggagc

SEQ ID NO: 679608 - RNA, 24 nt, Human
agccugggugacagagcaagacuc

SEQ ID NO: 679609 - RNA, 19 nt, Human
agccuuggggucaggggcc

SEQ ID NO: 679610 - RNA, 18 nt, Human
agcuggaggcuccugaga

SEQ ID NO: 679611 - RNA, 21 nt, Human
aggaagcacaucugggcagag

SEQ ID NO: 679612 - RNA, 24 nt, Human
aggcagagguuucagugagccaag

SEQ ID NO: 679613 - RNA, 22 nt, Human
aggcaggagaauugcuugaacc

SEQ ID NO: 679614 - RNA, 23 nt, Human
aggcaggagaauugcuugaaccg

SEQ ID NO: 679615 - RNA, 18 nt, Human
aggccuggaaucuacacu

SEQ ID NO: 679616 - RNA, 21 nt, Human
aggcugaggcaggagaauugc

SEQ ID NO: 679617 - RNA, 24 nt, Human
aggcugaggcaggagaauugcuug

SEQ ID NO: 679618 - RNA, 18 nt, Human
agggcauacugacuguga

SEQ ID NO: 679619 - RNA, 21 nt, Human
aggugugugcgugugggagcc

SEQ ID NO: 679620 - RNA, 24 nt, Human
aucaugccacugcauuccagccug

SEQ ID NO: 679621 - RNA, 20 nt, Human
auccaaaagccuugccccuu

SEQ ID NO: 679622 - RNA, 22 nt, Human
augccacugcauuccagccugg

SEQ ID NO: 679623 - RNA, 24 nt, Human
caagaucaugccacugcauuccag

SEQ ID NO: 679624 - RNA, 22 nt, Human
caagugcacauguguuuccugc

SEQ ID NO: 679625 - RNA, 19 nt, Human
cacagucucuaaggguaag

SEQ ID NO: 679626 - RNA, 21 nt, Human
cacagucucuaaggguaagga

SEQ ID NO: 679627 - RNA, 23 nt, Human
cacccgccccacccagccaccca

SEQ ID NO: 679628 - RNA, 19 nt, Human
cacugcauuccagccuggg

SEQ ID NO: 679629 - RNA, 22 nt, Human
cacugcauuccagccuggguga

SEQ ID NO: 679630 - RNA, 23 nt, Human
cacugcauuccagccugggugac

SEQ ID NO: 679631 - RNA, 24 nt, Human
cacugcauuccagccugggugaca

SEQ ID NO: 679632 - RNA, 25 nt, Human
cacugcauuccagccugggugacag

SEQ ID NO: 679633 - RNA, 20 nt, Human
cacugccugcugugugacug

SEQ ID NO: 679634 - RNA, 19 nt, Human
cacuuuagcucugaaaaau

SEQ ID NO: 679635 - RNA, 27 nt, Human
cagaacccuucauucaaaugaagccuu

SEQ ID NO: 679636 - RNA, 23 nt, Human
cagaauggugcuuugggaacccc

SEQ ID NO: 679637 - RNA, 21 nt, Human
cagagcaagacuccaucugug

SEQ ID NO: 679638 - RNA, 18 nt, Human
cagagugaaggcucccag

SEQ ID NO: 679639 - RNA, 24 nt, Human
cagagugaaggcucccagggcuca

SEQ ID NO: 679640 - RNA, 24 nt, Human
cagcuacucaggaggcugaggcag

SEQ ID NO: 679641 - RNA, 23 nt, Human
cagcuggcacuggcugagaggug

SEQ ID NO: 679642 - RNA, 20 nt, Human
cagguccagaaagagcugga

SEQ ID NO: 679643 - RNA, 24 nt, Human
caucucggcugaccucgcuggaaa

SEQ ID NO: 679644 - RNA, 22 nt, Human
cauuccagccugggugacagag

SEQ ID NO: 679645 - RNA, 19 nt, Human
ccacagggaugcccaggac

SEQ ID NO: 679646 - RNA, 20 nt, Human
ccacugcauuccagccuggg

SEQ ID NO: 679647 - RNA, 20 nt, Human
ccacugcauuccagccuggg

SEQ ID NO: 679648 - RNA, 20 nt, Human
ccacugcauuccagccuggg

SEQ ID NO: 679649 - RNA, 21 nt, Human
ccacugcauuccagccugggu

SEQ ID NO: 679650 - RNA, 21 nt, Human
ccacugcauuccagccugggu

SEQ ID NO: 679651 - RNA, 24 nt, Human
ccacugcauuccagccugggugac

SEQ ID NO: 679652 - RNA, 23 nt, Human
ccagaaagagcuggaggcuccug

SEQ ID NO: 679653 - RNA, 22 nt, Human
ccaggaagagaaguaaggcuca

SEQ ID NO: 679654 - RNA, 21 nt, Human
ccaggcaccucugaauaccca

SEQ ID NO: 679655 - RNA, 22 nt, Human
ccaggcaccucugaauacccaa

SEQ ID NO: 679656 - RNA, 20 nt, Human
cccagagaaagaaacagagc

SEQ ID NO: 679657 - RNA, 21 nt, Human
cccagagaaagaaacagagcu

SEQ ID NO: 679658 - RNA, 20 nt, Human
cccaggaagagaaguaaggc

SEQ ID NO: 679659 - RNA, 21 nt, Human
cccaggaagagaaguaaggcu

SEQ ID NO: 679660 - RNA, 21 nt, Human
cccagguauacaauccauaga

SEQ ID NO: 679661 - RNA, 18 nt, Human
ccccacccagccacccag

SEQ ID NO: 679662 - RNA, 20 nt, Human
ccccacccagccacccagca

SEQ ID NO: 679663 - RNA, 21 nt, Human
ccccagagagcugagagcggg

SEQ ID NO: 679664 - RNA, 21 nt, Human
cccccuccuuuucccucugcc

SEQ ID NO: 679665 - RNA, 21 nt, Human
cccgccccacccagccaccca

SEQ ID NO: 679666 - RNA, 26 nt, Human
cccgccccacccagccacccagcacg

SEQ ID NO: 679667 - RNA, 22 nt, Human
cccgugcacccgccccacccag

SEQ ID NO: 679668 - RNA, 23 nt, Human
cccuccuuuucccucugccaccc

SEQ ID NO: 679669 - RNA, 22 nt, Human
cccucggccucacccacugcuc

SEQ ID NO: 679670 - RNA, 18 nt, Human
ccucacccacugcucaga

SEQ ID NO: 679671 - RNA, 20 nt, Human
ccucacucuuaucauccaaa

SEQ ID NO: 679672 - RNA, 23 nt, Human
ccugaccgcaggcuagcccagga

SEQ ID NO: 679673 - RNA, 24 nt, Human
ccugaccgcaggcuagcccaggaa

SEQ ID NO: 679674 - RNA, 19 nt, Human
ccugccacugccugcugug

SEQ ID NO: 679675 - RNA, 22 nt, Human
ccugcgcauggcagccaccggg

SEQ ID NO: 679676 - RNA, 19 nt, Human
ccuggaaucuacacuuuua

SEQ ID NO: 679677 - RNA, 22 nt, Human
ccugggugacagagcaagacuc

SEQ ID NO: 679678 - RNA, 19 nt, Human
cgagccacgcgccaagggc

SEQ ID NO: 679679 - RNA, 21 nt, Human
cgcacaccgcaggugugugcg

SEQ ID NO: 679680 - RNA, 18 nt, Human
cuacugccugccacugcc

SEQ ID NO: 679681 - RNA, 18 nt, Human
cuccccagagagcugaga

SEQ ID NO: 679682 - RNA, 21 nt, Human
cuccccaggcaccucugaaua

SEQ ID NO: 679683 - RNA, 21 nt, Human
cucugggcagucccucggccu

SEQ ID NO: 679684 - RNA, 21 nt, Human
cugagucaccggagggccucu

SEQ ID NO: 679685 - RNA, 21 nt, Human
cugcaguuaggauucgagagc

SEQ ID NO: 679686 - RNA, 19 nt, Human
cuggaaaggcagcucucug

SEQ ID NO: 679687 - RNA, 19 nt, Human
cugggcagagugaaggcuc

SEQ ID NO: 679688 - RNA, 23 nt, Human
cugggcccugccccggauacuga

SEQ ID NO: 679689 - RNA, 18 nt, Human
cuucacaggggaccuccc

SEQ ID NO: 679690 - RNA, 21 nt, Human
cuuccacaggaagcacaucug

SEQ ID NO: 679691 - RNA, 18 nt, Human
gaacccucagacucaucc

SEQ ID NO: 679692 - RNA, 19 nt, Human
gaagaugccugggcccugc

SEQ ID NO: 679693 - RNA, 23 nt, Human
gaagcacuuucuguucccaauug

SEQ ID NO: 679694 - RNA, 20 nt, Human
gaccuuggguggucucaggc

SEQ ID NO: 679695 - RNA, 20 nt, Human
gagcagcugcucacccagga

SEQ ID NO: 679696 - RNA, 19 nt, Human
gaggagcccagguauacaa

SEQ ID NO: 679697 - RNA, 26 nt, Human
gaggaugcuagaauagggcaauggga

SEQ ID NO: 679698 - RNA, 18 nt, Human
gagguccuuaucucucac

SEQ ID NO: 679699 - RNA, 21 nt, Human
gcaaaacaaaauagcugccuu

SEQ ID NO: 679700 - RNA, 25 nt, Human
gcagaauggugcuuugggaaccccc

SEQ ID NO: 679701 - RNA, 21 nt, Human
gcaguggggacacuacccaga

SEQ ID NO: 679702 - RNA, 24 nt, Human
gcauuccagccugggugacagagc

SEQ ID NO: 679703 - RNA, 20 nt, Human
gccaagaucaugccacugca

SEQ ID NO: 679704 - RNA, 19 nt, Human
gccacugcauuccagccug

SEQ ID NO: 679705 - RNA, 24 nt, Human
gccacugcauuccagccuggguga

SEQ ID NO: 679706 - RNA, 19 nt, Human
gccggggcccaccaggcug

SEQ ID NO: 679707 - RNA, 22 nt, Human
gcucccgcacagagggcuccau

SEQ ID NO: 679708 - RNA, 20 nt, Human
gcugcaguuaggauucgaga

SEQ ID NO: 679709 - RNA, 21 nt, Human
ggaaacgccugagucaccgga

SEQ ID NO: 679710 - RNA, 22 nt, Human
ggaaagacaggcccuucacagg

SEQ ID NO: 679711 - RNA, 21 nt, Human
ggaacccccccuccuuuuccc

SEQ ID NO: 679712 - RNA, 20 nt, Human
ggacagaaguuguugagggg

SEQ ID NO: 679713 - RNA, 21 nt, Human
ggacgugaaaaacucucagug

SEQ ID NO: 679714 - RNA, 22 nt, Human
ggacguggauguggcuugucac

SEQ ID NO: 679715 - RNA, 26 nt, Human
ggcaguggggacacuacccagagaaa

SEQ ID NO: 679716 - RNA, 26 nt, Human
ggcucagguccagaaagagcuggagg

SEQ ID NO: 679717 - RNA, 18 nt, Human
gggacacuacccagagaa

SEQ ID NO: 679718 - RNA, 21 nt, Human
gggacagaaguuguugagggg

SEQ ID NO: 679719 - RNA, 21 nt, Human
gggcagagugaaggcucccag

SEQ ID NO: 679720 - RNA, 18 nt, Human
ggggaccuccccagagag

SEQ ID NO: 679721 - RNA, 23 nt, Human
gguccagaaagagcuggaggcuc

SEQ ID NO: 679722 - RNA, 18 nt, Human
uaacaagcuccccaggca

SEQ ID NO: 679723 - RNA, 21 nt, Human
uagaaaguugugaucaggugg

SEQ ID NO: 679724 - RNA, 23 nt, Human
uagaaaguugugaucaggugguu

SEQ ID NO: 679725 - RNA, 19 nt, Human
uagacacguccucauccuc

SEQ ID NO: 679726 - RNA, 22 nt, Human
uaucauccaaaagccuugcccc

SEQ ID NO: 679727 - RNA, 22 nt, Human
ucagagcagcugcucacccagg

SEQ ID NO: 679728 - RNA, 23 nt, Human
ucagguccagaaagagcuggagg

SEQ ID NO: 679729 - RNA, 24 nt, Human
ucaguuccaaauaggacgugaaaa

SEQ ID NO: 679730 - RNA, 24 nt, Human
ucauccaaaagccuugccccugac

SEQ ID NO: 679731 - RNA, 27 nt, Human
ucauccaaaagccuugccccugaccgc

SEQ ID NO: 679732 - RNA, 23 nt, Human
ucaugccacugcauuccagccug

SEQ ID NO: 679733 - RNA, 22 nt, Human
uccaaaagccuugccccugacc

SEQ ID NO: 679734 - RNA, 22 nt, Human
uccagaaagagcuggaggcucc

SEQ ID NO: 679735 - RNA, 19 nt, Human
uccagccugggugacagag

SEQ ID NO: 679736 - RNA, 24 nt, Human
uccagccugggugacagagcaaga

SEQ ID NO: 679737 - RNA, 26 nt, Human
uccauggccacagggaugcccaggac

SEQ ID NO: 679738 - RNA, 18 nt, Human
uccccaggcaccucugaa

SEQ ID NO: 679739 - RNA, 28 nt, Human
uccccaggcaccucugaauacccaaccu

SEQ ID NO: 679740 - RNA, 31 nt, Human
uccccaggcaccucugaauacccaaccugcu

SEQ ID NO: 679741 - RNA, 18 nt, Human
uccccuccggggacuaca

SEQ ID NO: 679742 - RNA, 23 nt, Human
ucccucggccucacccacugcuc

SEQ ID NO: 679743 - RNA, 18 nt, Human
ucccucugccacccccaa

SEQ ID NO: 679744 - RNA, 19 nt, Human
ucucaguuucagaccuaug

SEQ ID NO: 679745 - RNA, 25 nt, Human
ucucauugcaaaacaaaauagcugc

SEQ ID NO: 679746 - RNA, 21 nt, Human
ucuguaaucccagcuacucag

SEQ ID NO: 679747 - RNA, 22 nt, Human
ucuguggccaggucaagagggc

SEQ ID NO: 679748 - RNA, 26 nt, Human
ucuugcuguguggcuuugagaaaacc

SEQ ID NO: 679749 - RNA, 26 nt, Human
ucuuugauuccgacagcccaaucacu

SEQ ID NO: 679750 - RNA, 24 nt, Human
ugaggcaggagaauugcuugaacc

SEQ ID NO: 679751 - RNA, 23 nt, Human
ugagguccuuaucucucacuagg

SEQ ID NO: 679752 - RNA, 21 nt, Human
ugcaaaacaaaauagcugccu

SEQ ID NO: 679753 - RNA, 23 nt, Human
ugcaaaacaaaauagcugccuua

SEQ ID NO: 679754 - RNA, 18 nt, Human
ugcacccgccccacccag

SEQ ID NO: 679755 - RNA, 23 nt, Human
ugccaaaucuugcuguguggcuu

SEQ ID NO: 679756 - RNA, 18 nt, Human
ugcccaggacagggacga

SEQ ID NO: 679757 - RNA, 19 nt, Human
ugcccaggacagggacgac

SEQ ID NO: 679758 - RNA, 23 nt, Human
ugccccugaccgcaggcuagccc

SEQ ID NO: 679759 - RNA, 18 nt, Human
ugcugugugacugugagc

SEQ ID NO: 679760 - RNA, 19 nt, Human
ugcuguguggcuuugagaa

SEQ ID NO: 679761 - RNA, 21 nt, Human
uggcacaaaagcgcuuauguu

SEQ ID NO: 679762 - RNA, 24 nt, Human
uggccaggucaagagggcugggga

SEQ ID NO: 679763 - RNA, 22 nt, Human
ugggaagggcuuguuuugaggg

SEQ ID NO: 679764 - RNA, 19 nt, Human
ugggagagacccacccagc

SEQ ID NO: 679765 - RNA, 22 nt, Human
ugggagagacccacccagcugg

SEQ ID NO: 679766 - RNA, 22 nt, Human
ugggagagacccacccagcugg

SEQ ID NO: 679767 - RNA, 22 nt, Human
uggggacacuacccagagaaag

SEQ ID NO: 679768 - RNA, 21 nt, Human
uggggcucugggcagucccuc

SEQ ID NO: 679769 - RNA, 21 nt, Human
ugggggucuccuuccacagga

SEQ ID NO: 679770 - RNA, 24 nt, Human
ugugggagccucuuccugaagccu

SEQ ID NO: 679771 - RNA, 22 nt, Human
uguuccuaaaaccugccugcgc

SEQ ID NO: 679772 - RNA, 18 nt, Human
uuucuguaaucccagcua

SEQ ID NO: 679773 - RNA, 24 nt, Human
uuucuguaaucccagcuacucagg

SEQ ID NO: 679774 - RNA, 23 nt, Human
uuuuuuuuuuagcagcagaaccc

SEQ ID NO: 679775 - RNA, 20 nt, Human
acucugacagagcugggggu

SEQ ID NO: 679776 - RNA, 20 nt, Human
cacugagccccgugugacuc

SEQ ID NO: 679777 - RNA, 23 nt, Human
ccaguuugugcagagcggccgga

SEQ ID NO: 679778 - RNA, 20 nt, Human
ccgugugacucugacagagc

SEQ ID NO: 679779 - RNA, 23 nt, Human
cggccggaggcaguuaggagccc

SEQ ID NO: 679780 - RNA, 19 nt, Human
cugcucggggcuccagcag

SEQ ID NO: 679781 - RNA, 23 nt, Human
cuggggguguccauguccucucu

SEQ ID NO: 679782 - RNA, 23 nt, Human
gaccugggccaucccaguuugug

SEQ ID NO: 679783 - RNA, 24 nt, Human
gcucggggcuccagcagcugggcu

SEQ ID NO: 679784 - RNA, 19 nt, Human
ggccguccacugagccccg

SEQ ID NO: 679785 - RNA, 20 nt, Human
gggcuccagcagcugggcuc

SEQ ID NO: 679786 - RNA, 24 nt, Human
guccauguccucucuggaccucag

SEQ ID NO: 679787 - RNA, 20 nt, Human
ucucuggaccucaguuccug

SEQ ID NO: 679788 - RNA, 21 nt, Human
ucucuggaccucaguuccugu

SEQ ID NO: 679789 - RNA, 19 nt, Human
ugcucggggcuccagcagc

SEQ ID NO: 679790 - RNA, 22 nt, Human
ugugcagagcggccggaggcag

SEQ ID NO: 679791 - RNA, 25 nt, Human
aaaaaauaaaauaaaauaaaaaaga

SEQ ID NO: 679792 - RNA, 24 nt, Human
aaaaauaaaauaaaauaaaaaaga

SEQ ID NO: 679793 - RNA, 18 nt, Human
aagaaggagaaaucccug

SEQ ID NO: 679794 - RNA, 24 nt, Human
acauggaccacacacccacccagc

SEQ ID NO: 679795 - RNA, 18 nt, Human
acccagcauccccaaucc

SEQ ID NO: 679796 - RNA, 18 nt, Human
aggugggugcagccugca

SEQ ID NO: 679797 - RNA, 26 nt, Human
cacacacacacacacacguguugcua

SEQ ID NO: 679798 - RNA, 21 nt, Human
cacacccacccagcaucccca

SEQ ID NO: 679799 - RNA, 23 nt, Human
cacccagcauccccaaucccaaa

SEQ ID NO: 679800 - RNA, 24 nt, Human
ccacacacccacccagcaucccca

SEQ ID NO: 679801 - RNA, 22 nt, Human
ccaggaccaagaagaaggagaa

SEQ ID NO: 679802 - RNA, 20 nt, Human
cccaaucccaaaugcagagu

SEQ ID NO: 679803 - RNA, 21 nt, Human
ccccuucccucaggaucccca

SEQ ID NO: 679804 - RNA, 20 nt, Human
ccucguacucagccugcugc

SEQ ID NO: 679805 - RNA, 19 nt, Human
gaacauggaccacacaccc

SEQ ID NO: 679806 - RNA, 23 nt, Human
gaccaagaagaaggagaaauccc

SEQ ID NO: 679807 - RNA, 21 nt, Human
gaguagccaggcuccagacau

SEQ ID NO: 679808 - RNA, 18 nt, Human
gccugcugcugcugcaac

SEQ ID NO: 679809 - RNA, 18 nt, Human
gcucaugcagagaugaag

SEQ ID NO: 679810 - RNA, 21 nt, Human
gcugcaacucagcugccagcc

SEQ ID NO: 679811 - RNA, 23 nt, Human
gcugcaacucagcugccagccca

SEQ ID NO: 679812 - RNA, 23 nt, Human
ggagccaggaccaagaagaagga

SEQ ID NO: 679813 - RNA, 20 nt, Human
gggaaggagagcucaugcag

SEQ ID NO: 679814 - RNA, 19 nt, Human
gugggcccgucuggccaga

SEQ ID NO: 679815 - RNA, 18 nt, Human
uacacacacacacacaca

SEQ ID NO: 679816 - RNA, 24 nt, Human
uacacacacacacacacacguggg

SEQ ID NO: 679817 - RNA, 24 nt, Human
uacacacacacacacacacguguu

SEQ ID NO: 679818 - RNA, 23 nt, Human
uagccaggcuccagacauaaauu

SEQ ID NO: 679819 - RNA, 18 nt, Human
uaggaaggggaggaggug

SEQ ID NO: 679820 - RNA, 21 nt, Human
uaggaaggggaggaggugggu

SEQ ID NO: 679821 - RNA, 20 nt, Human
uccaccacagcccaagggaa

SEQ ID NO: 679822 - RNA, 22 nt, Human
uccaccacagcccaagggaaua

SEQ ID NO: 679823 - RNA, 18 nt, Human
ucccugguggccucugcc

SEQ ID NO: 679824 - RNA, 22 nt, Human
uccuaggggguaggaaggggag

SEQ ID NO: 679825 - RNA, 19 nt, Human
ucucugggaaggagagcuc

SEQ ID NO: 679826 - RNA, 24 nt, Human
ucucugggaaggagagcucaugca

SEQ ID NO: 679827 - RNA, 18 nt, Human
ucugcccuaagacaggau

SEQ ID NO: 679828 - RNA, 19 nt, Human
ugaacauggaccacacacc

SEQ ID NO: 679829 - RNA, 23 nt, Human
ugauuuuggcuccagcccucauu

SEQ ID NO: 679830 - RNA, 21 nt, Human
uugggagccaggaccaagaag

SEQ ID NO: 679831 - RNA, 21 nt, Human
uuuuuuuugugggugggcccg

SEQ ID NO: 679832 - RNA, 20 nt, Human
uuuuuuuuuuuuuuuguggg

SEQ ID NO: 679833 - RNA, 19 nt, Human
uuuuuuuuuuuuuuuuugu

SEQ ID NO: 679834 - RNA, 22 nt, Human
uuuuuuuuuuuuuuuuuguggg

SEQ ID NO: 679835 - RNA, 27 nt, Human
uuuuuuuuuuuuuuuuuuuuuuugggg

SEQ ID NO: 679836 - RNA, 22 nt, Human
agcuggucuaggccagcagugc

SEQ ID NO: 679837 - RNA, 23 nt, Human
agcuggucuaggccagcagugcc

SEQ ID NO: 679838 - RNA, 22 nt, Human
cagcagugccuccccaccuccc

SEQ ID NO: 679839 - RNA, 19 nt, Human
cagcuuucagcagcugguc

SEQ ID NO: 679840 - RNA, 23 nt, Human
cccuggaggucgccgggccucug

SEQ ID NO: 679841 - RNA, 19 nt, Human
ccucagcacagucuguggu

SEQ ID NO: 679842 - RNA, 27 nt, Human
cgucuuucucuucugaaaguugagcuc

SEQ ID NO: 679843 - RNA, 22 nt, Human
cucagccucaccagcuuucagc

SEQ ID NO: 679844 - RNA, 21 nt, Human
cuccccaccuccccaagggga

SEQ ID NO: 679845 - RNA, 21 nt, Human
cucccuuucuuccucccucca

SEQ ID NO: 679846 - RNA, 23 nt, Human
cucccuuucuuccucccuccaag

SEQ ID NO: 679847 - RNA, 21 nt, Human
cuggaagggagcucgguugac

SEQ ID NO: 679848 - RNA, 21 nt, Human
gaccuggaagggagcucgguu

SEQ ID NO: 679849 - RNA, 23 nt, Human
gcguagcagacugucauagccuu

SEQ ID NO: 679850 - RNA, 22 nt, Human
ggugguggcaagaccucagcac

SEQ ID NO: 679851 - RNA, 24 nt, Human
uagaggacuccccgaaagaggcuu

SEQ ID NO: 679852 - RNA, 20 nt, Human
uccaaguggcucuggggcug

SEQ ID NO: 679853 - RNA, 20 nt, Human
uccccaaggggagggguggu

SEQ ID NO: 679854 - RNA, 21 nt, Human
ugaccuggaagggagcucggu

SEQ ID NO: 679855 - RNA, 23 nt, Human
uggggcgucuuucucuucugaaa

SEQ ID NO: 679856 - RNA, 18 nt, Human
uggguugggguaggggcu

SEQ ID NO: 679857 - RNA, 19 nt, Human
uugcuggggcgucuuucuc

SEQ ID NO: 679858 - RNA, 21 nt, Human
aaagaugaaaagcauugcaga

SEQ ID NO: 679859 - RNA, 20 nt, Human
aagaugaaaagcauugcaga

SEQ ID NO: 679860 - RNA, 23 nt, Human
acagcaauugaguuauuagacgu

SEQ ID NO: 679861 - RNA, 18 nt, Human
accucagcccacuauaca

SEQ ID NO: 679862 - RNA, 20 nt, Human
accuguggucauuuguuggu

SEQ ID NO: 679863 - RNA, 18 nt, Human
agaugucaucuuccaaaa

SEQ ID NO: 679864 - RNA, 21 nt, Human
augguuuuauuugauauugaa

SEQ ID NO: 679865 - RNA, 20 nt, Human
auuauggccacacuggaauc

SEQ ID NO: 679866 - RNA, 20 nt, Human
caccucagcccacuauacac

SEQ ID NO: 679867 - RNA, 21 nt, Human
cagaaaggcuugccguuggua

SEQ ID NO: 679868 - RNA, 24 nt, Human
ccucuuauaccucagcaggaguug

SEQ ID NO: 679869 - RNA, 19 nt, Human
gaauucacaugugcuuuuc

SEQ ID NO: 679870 - RNA, 18 nt, Human
ggagaggaaccuuuggug

SEQ ID NO: 679871 - RNA, 18 nt, Human
uaguaaguucaccugccc

SEQ ID NO: 679872 - RNA, 23 nt, Human
uaguccacugaaaguccagugau

SEQ ID NO: 679873 - RNA, 20 nt, Human
uauacacgaauucacaugug

SEQ ID NO: 679874 - RNA, 22 nt, Human
ugaaaaggcaaggaaagaguug

SEQ ID NO: 679875 - RNA, 19 nt, Human
ugaggagaggaaccuuugg

SEQ ID NO: 679876 - RNA, 18 nt, Human
ugcagaaaggcuugccgu

SEQ ID NO: 679877 - RNA, 19 nt, Human
ugcugugcucucugugcag

SEQ ID NO: 679878 - RNA, 21 nt, Human
uggaaugcagugacaggagcc

SEQ ID NO: 679879 - RNA, 19 nt, Human
ugguagauaguacagcugc

SEQ ID NO: 679880 - RNA, 24 nt, Human
uggugcuguccucagcaugguugg

SEQ ID NO: 679881 - RNA, 23 nt, Human
ugugaguguuucuauuucaugga

SEQ ID NO: 679882 - RNA, 20 nt, Human
uguggggugaggagaggaac

SEQ ID NO: 679883 - RNA, 19 nt, Human
uguggucauuuguuggugg

SEQ ID NO: 679884 - RNA, 22 nt, Human
uucaccugcccgggcggccgcu

SEQ ID NO: 679885 - RNA, 21 nt, Human
uugcagaugucaucuuccaaa

SEQ ID NO: 679886 - RNA, 23 nt, Human
aaaaacaaaacaaaacaaaacaa

SEQ ID NO: 679887 - RNA, 18 nt, Human
aaaauuagcugggcaugg

SEQ ID NO: 679888 - RNA, 18 nt, Human
aaacaaaacaaaacaaaa

SEQ ID NO: 679889 - RNA, 22 nt, Human
aaacaaaacaaaacaaaacaaa

SEQ ID NO: 679890 - RNA, 22 nt, Human
aaacaaaacaaaacaaaacaaa

SEQ ID NO: 679891 - RNA, 22 nt, Human
aaacaaaacaaaacaaaacaaa

SEQ ID NO: 679892 - RNA, 22 nt, Human
aaaccccaucucuacuaaaaaa

SEQ ID NO: 679893 - RNA, 22 nt, Human
aaaccccgucucuacuaaaaaa

SEQ ID NO: 679894 - RNA, 19 nt, Human
aaauuugaugccuuugggc

SEQ ID NO: 679895 - RNA, 19 nt, Human
aacauggugaaaccccguc

SEQ ID NO: 679896 - RNA, 20 nt, Human
aacauggugaaaccccgucu

SEQ ID NO: 679897 - RNA, 21 nt, Human
aacauggugaaaccccgucuc

SEQ ID NO: 679898 - RNA, 19 nt, Human
aaccuggcgaaaccccauc

SEQ ID NO: 679899 - RNA, 20 nt, Human
aaccuggcgaaaccccaucu

SEQ ID NO: 679900 - RNA, 21 nt, Human
aaccuggcgaaaccccaucuc

SEQ ID NO: 679901 - RNA, 21 nt, Human
aacuccccccccaaaaaaccc

SEQ ID NO: 679902 - RNA, 18 nt, Human
aacuuuuccuucaaguua

SEQ ID NO: 679903 - RNA, 22 nt, Human
aaggucuuuaaacagaauucag

SEQ ID NO: 679904 - RNA, 24 nt, Human
aaucacuugaacccaggaggcaga

SEQ ID NO: 679905 - RNA, 21 nt, Human
acaaaacaaaacaaaacaaaa

SEQ ID NO: 679906 - RNA, 21 nt, Human
acaaaacaaaacaaaacaaaa

SEQ ID NO: 679907 - RNA, 21 nt, Human
acaaaacaaaacaaaacaaaa

SEQ ID NO: 679908 - RNA, 23 nt, Human
acaaaacaaaacaaaacaaaacc

SEQ ID NO: 679909 - RNA, 18 nt, Human
acaaaacaaaacaaaacc

SEQ ID NO: 679910 - RNA, 24 nt, Human
acagagcuagaguccaucucaaaa

SEQ ID NO: 679911 - RNA, 19 nt, Human
accacugcacuccagccug

SEQ ID NO: 679912 - RNA, 24 nt, Human
accacugcacuccagccuggguga

SEQ ID NO: 679913 - RNA, 22 nt, Human
accauugcacuccagccugggc

SEQ ID NO: 679914 - RNA, 24 nt, Human
acccaggaggcagagguugcagug

SEQ ID NO: 679915 - RNA, 18 nt, Human
accccaucucuacuaaaa

SEQ ID NO: 679916 - RNA, 25 nt, Human
accccgucucuacuaaaaaauacaa

SEQ ID NO: 679917 - RNA, 25 nt, Human
acuccagccugggcagcaagaguga

SEQ ID NO: 679918 - RNA, 24 nt, Human
acugcacuccagccugggugacag

SEQ ID NO: 679919 - RNA, 26 nt, Human
acugcacuccagccugggugacagag

SEQ ID NO: 679920 - RNA, 27 nt, Human
agaaaaaaaucagguuuguccauggaa

SEQ ID NO: 679921 - RNA, 23 nt, Human
agaaauacaucucccugccuccu

SEQ ID NO: 679922 - RNA, 22 nt, Human
agaacuaagagaaaaaaaucag

SEQ ID NO: 679923 - RNA, 19 nt, Human
agacagguuacacuguccc

SEQ ID NO: 679924 - RNA, 18 nt, Human
agagguugcagugagccg

SEQ ID NO: 679925 - RNA, 23 nt, Human
agagguugcagugagccgagauc

SEQ ID NO: 679926 - RNA, 24 nt, Human
agagguugcagugagccgagauca

SEQ ID NO: 679927 - RNA, 26 nt, Human
agcacucaucucuucaggaccuuugg

SEQ ID NO: 679928 - RNA, 24 nt, Human
agcacuuugggaggccgaggcggg

SEQ ID NO: 679929 - RNA, 24 nt, Human
agcacuuuuggaggaugagguggg

SEQ ID NO: 679930 - RNA, 20 nt, Human
agccauguccuuccacacaa

SEQ ID NO: 679931 - RNA, 23 nt, Human
agccgggcgugguggugggcgcc

SEQ ID NO: 679932 - RNA, 19 nt, Human
agccugggaauauaggcuu

SEQ ID NO: 679933 - RNA, 23 nt, Human
agcugggcaugguggugggcgcc

SEQ ID NO: 679934 - RNA, 21 nt, Human
aggaugaggugggcagaucac

SEQ ID NO: 679935 - RNA, 24 nt, Human
aggcacgguggcucacgccuguaa

SEQ ID NO: 679936 - RNA, 21 nt, Human
aggcagagguugcagugagcc

SEQ ID NO: 679937 - RNA, 24 nt, Human
aggcagagguugcagugagccgag

SEQ ID NO: 679938 - RNA, 18 nt, Human
aggcaggagaauggugag

SEQ ID NO: 679939 - RNA, 24 nt, Human
aggcaggagaauggugagaacccg

SEQ ID NO: 679940 - RNA, 22 nt, Human
aggccaggcgcaguggcucaug

SEQ ID NO: 679941 - RNA, 21 nt, Human
aggccgaggcgggcggaucac

SEQ ID NO: 679942 - RNA, 23 nt, Human
aggccgaggcgggcggaucacga

SEQ ID NO: 679943 - RNA, 24 nt, Human
aggcgcaguggcucaugccuguaa

SEQ ID NO: 679944 - RNA, 24 nt, Human
aggcggagcuugcagugagccgag

SEQ ID NO: 679945 - RNA, 24 nt, Human
aggcgggcggaucacgaggucagg

SEQ ID NO: 679946 - RNA, 19 nt, Human
aggcugaggcaggagaaug

SEQ ID NO: 679947 - RNA, 24 nt, Human
aggcugaggcuggagaaucacuug

SEQ ID NO: 679948 - RNA, 18 nt, Human
aggcuggagaaucacuug

SEQ ID NO: 679949 - RNA, 23 nt, Human
aggcuggagaaucacuugaaccc

SEQ ID NO: 679950 - RNA, 26 nt, Human
agguagaaggugaaacagcugcaagg

SEQ ID NO: 679951 - RNA, 21 nt, Human
aggugggcagaucaccugagg

SEQ ID NO: 679952 - RNA, 22 nt, Human
aggugggcagaucaccugaggg

SEQ ID NO: 679953 - RNA, 23 nt, Human
aguggcucaugccuguaauccca

SEQ ID NO: 679954 - RNA, 24 nt, Human
aguggcucaugccuguaaucccag

SEQ ID NO: 679955 - RNA, 24 nt, Human
aucgcaccacugcacuccagccug

SEQ ID NO: 679956 - RNA, 22 nt, Human
aucucaaaaacaaaacaaaaca

SEQ ID NO: 679957 - RNA, 20 nt, Human
augacccuaucaucaguuuc

SEQ ID NO: 679958 - RNA, 19 nt, Human
augccuguaaucccagcac

SEQ ID NO: 679959 - RNA, 21 nt, Human
auggaagcacacgaauggcag

SEQ ID NO: 679960 - RNA, 24 nt, Human
auugcaccauugcacuccagccug

SEQ ID NO: 679961 - RNA, 21 nt, Human
auugcacuccagccugggcag

SEQ ID NO: 679962 - RNA, 24 nt, Human
auugcacuccagccugggcagcaa

SEQ ID NO: 679963 - RNA, 21 nt, Human
caaaacaaaacaaaacaaaac

SEQ ID NO: 679964 - RNA, 24 nt, Human
caaaacaaaacaaaacaaaacaaa

SEQ ID NO: 679965 - RNA, 24 nt, Human
caaaacaaaacaaaacaaaacaaa

SEQ ID NO: 679966 - RNA, 27 nt, Human
caaaacaaaacaaaacaaaacaaaacc

SEQ ID NO: 679967 - RNA, 22 nt, Human
caaaacaaaacaaaacaaaacc

SEQ ID NO: 679968 - RNA, 23 nt, Human
caaaacaaaacaaaacaaaacca

SEQ ID NO: 679969 - RNA, 25 nt, Human
caaaagacaaguauaugauuaaaga

SEQ ID NO: 679970 - RNA, 25 nt, Human
caaaggggaugaauaauuccaauca

SEQ ID NO: 679971 - RNA, 19 nt, Human
caaauaagcacaccaucca

SEQ ID NO: 679972 - RNA, 22 nt, Human
caacuccccccccaaaaaaccc

SEQ ID NO: 679973 - RNA, 26 nt, Human
caagaugaacaagaugaucacugucc

SEQ ID NO: 679974 - RNA, 21 nt, Human
cacaagaccagccuggccaac

SEQ ID NO: 679975 - RNA, 22 nt, Human
cacacaagaaaggacugaacag

SEQ ID NO: 679976 - RNA, 21 nt, Human
caccacacguguuaaaagcca

SEQ ID NO: 679977 - RNA, 26 nt, Human
caccacugcacuccagccugggugac

SEQ ID NO: 679978 - RNA, 20 nt, Human
caccauugcacuccagccug

SEQ ID NO: 679979 - RNA, 21 nt, Human
caccgcuacaaaauaacccaa

SEQ ID NO: 679980 - RNA, 23 nt, Human
caccgcuacaaaauaacccaaga

SEQ ID NO: 679981 - RNA, 20 nt, Human
caccguuuacuuagcaaggu

SEQ ID NO: 679982 - RNA, 19 nt, Human
caccuccucucuagucaag

SEQ ID NO: 679983 - RNA, 24 nt, Human
cacgccuguaaucccagcacuuug

SEQ ID NO: 679984 - RNA, 23 nt, Human
cacuccagccugggcagcaagag

SEQ ID NO: 679985 - RNA, 24 nt, Human
cacuccagccugggcagcaagagu

SEQ ID NO: 679986 - RNA, 25 nt, Human
cacuccagccugggcagcaagagug

SEQ ID NO: 679987 - RNA, 22 nt, Human
cacuccagccugggugacagag

SEQ ID NO: 679988 - RNA, 23 nt, Human
cacuccagccugggugacagagc

SEQ ID NO: 679989 - RNA, 19 nt, Human
cacugcacuccagccuggg

SEQ ID NO: 679990 - RNA, 19 nt, Human
cacugcacuccagccuggg

SEQ ID NO: 679991 - RNA, 21 nt, Human
cacugcacuccagccugggug

SEQ ID NO: 679992 - RNA, 22 nt, Human
cacugcacuccagccuggguga

SEQ ID NO: 679993 - RNA, 24 nt, Human
cacugcacuccagccugggugaca

SEQ ID NO: 679994 - RNA, 24 nt, Human
cacugcacuccagccugggugaca

SEQ ID NO: 679995 - RNA, 19 nt, Human
cagaaaguuaggacuggaa

SEQ ID NO: 679996 - RNA, 19 nt, Human
cagaagccagaacuuugaa

SEQ ID NO: 679997 - RNA, 18 nt, Human
cagagcaaugggcuggcc

SEQ ID NO: 679998 - RNA, 24 nt, Human
cagaucaccugaggccaggaguuc

SEQ ID NO: 679999 - RNA, 24 nt, Human
cagcacuuugggaggccgaggcgg

SEQ ID NO: 680000 - RNA, 21 nt, Human
cagcacuuuuggaggaugagg

SEQ ID NO: 680001 - RNA, 24 nt, Human
cagcacuuuuggaggaugaggugg

SEQ ID NO: 680002 - RNA, 21 nt, Human
cagcagagacgaagaaagggu

SEQ ID NO: 680003 - RNA, 19 nt, Human
cagccuggccaaccuggcg

SEQ ID NO: 680004 - RNA, 24 nt, Human
cagcuacucgggaggcugaggcag

SEQ ID NO: 680005 - RNA, 19 nt, Human
cauagggcuccaggucucu

SEQ ID NO: 680006 - RNA, 22 nt, Human
caucucaaaaacaaaacaaaac

SEQ ID NO: 680007 - RNA, 25 nt, Human
cauggugucagaacuuuccauaggg

SEQ ID NO: 680008 - RNA, 21 nt, Human
cauguccuuccacacauggug

SEQ ID NO: 680009 - RNA, 19 nt, Human
cauugcacuccagccuggg

SEQ ID NO: 680010 - RNA, 21 nt, Human
cauugcacuccagccugggca

SEQ ID NO: 680011 - RNA, 24 nt, Human
cauugcacuccagccugggcagca

SEQ ID NO: 680012 - RNA, 19 nt, Human
ccaacuccccccccaaaaa

SEQ ID NO: 680013 - RNA, 19 nt, Human
ccacggccucgggggccca

SEQ ID NO: 680014 - RNA, 20 nt, Human
ccacugcacuccagccuggg

SEQ ID NO: 680015 - RNA, 20 nt, Human
ccacugcacuccagccuggg

SEQ ID NO: 680016 - RNA, 21 nt, Human
ccacugcacuccagccugggu

SEQ ID NO: 680017 - RNA, 21 nt, Human
ccacugcacuccagccugggu

SEQ ID NO: 680018 - RNA, 24 nt, Human
ccacugcacuccagccugggugac

SEQ ID NO: 680019 - RNA, 25 nt, Human
ccacugcacuccagccugggugaca

SEQ ID NO: 680020 - RNA, 24 nt, Human
ccagagcaaugggcuggcccagaa

SEQ ID NO: 680021 - RNA, 22 nt, Human
ccaggacagggaauaaaaacaa

SEQ ID NO: 680022 - RNA, 23 nt, Human
ccaggccucccuuuagccucaac

SEQ ID NO: 680023 - RNA, 22 nt, Human
ccagucaccacacguguuaaaa

SEQ ID NO: 680024 - RNA, 20 nt, Human
ccauugcacuccagccuggg

SEQ ID NO: 680025 - RNA, 21 nt, Human
ccauugcacuccagccugggc

SEQ ID NO: 680026 - RNA, 23 nt, Human
ccauugcacuccagccugggcaa

SEQ ID NO: 680027 - RNA, 23 nt, Human
ccauugcacuccagccugggcag

SEQ ID NO: 680028 - RNA, 24 nt, Human
ccauugcacuccagccugggcagc

SEQ ID NO: 680029 - RNA, 25 nt, Human
ccauugcacuccagccugggcagca

SEQ ID NO: 680030 - RNA, 18 nt, Human
cccaagagccugaaugcg

SEQ ID NO: 680031 - RNA, 19 nt, Human
cccaggaccacggccucgg

SEQ ID NO: 680032 - RNA, 23 nt, Human
cccccaaaaaacccuuuuaguuu

SEQ ID NO: 680033 - RNA, 19 nt, Human
ccccgccaacucccccccc

SEQ ID NO: 680034 - RNA, 24 nt, Human
ccccgccaacuccccccccaaaaa

SEQ ID NO: 680035 - RNA, 24 nt, Human
ccguuccaggccucccuuuagccu

SEQ ID NO: 680036 - RNA, 20 nt, Human
ccuaaauucucaaaggugga

SEQ ID NO: 680037 - RNA, 21 nt, Human
ccucaacagcaugagggcucu

SEQ ID NO: 680038 - RNA, 19 nt, Human
ccucaagagcugcaagccu

SEQ ID NO: 680039 - RNA, 21 nt, Human
ccuccuucucucuucuguucc

SEQ ID NO: 680040 - RNA, 24 nt, Human
ccugaggccaggaguucacaagac

SEQ ID NO: 680041 - RNA, 18 nt, Human
ccugccuccuucucucuu

SEQ ID NO: 680042 - RNA, 19 nt, Human
ccugccuccuucucucuuc

SEQ ID NO: 680043 - RNA, 22 nt, Human
ccuggacugcagaguccagaag

SEQ ID NO: 680044 - RNA, 24 nt, Human
ccuggccaaccuggcgaaacccca

SEQ ID NO: 680045 - RNA, 22 nt, Human
ccuggcuaacauggugaaaccc

SEQ ID NO: 680046 - RNA, 23 nt, Human
ccuggcuaacauggugaaacccc

SEQ ID NO: 680047 - RNA, 24 nt, Human
ccuggcuaacauggugaaaccccg

SEQ ID NO: 680048 - RNA, 19 nt, Human
ccuguaaucccagcacuuu

SEQ ID NO: 680049 - RNA, 21 nt, Human
ccuguagucccagcuacucgg

SEQ ID NO: 680050 - RNA, 22 nt, Human
ccuguagucccagcuacucggg

SEQ ID NO: 680051 - RNA, 20 nt, Human
ccuucucucuucuguuccca

SEQ ID NO: 680052 - RNA, 22 nt, Human
ccuucucucuucuguucccacc

SEQ ID NO: 680053 - RNA, 25 nt, Human
ccuuuagccucaacagcaugagggc

SEQ ID NO: 680054 - RNA, 19 nt, Human
cgaaaccccaucucuacua

SEQ ID NO: 680055 - RNA, 24 nt, Human
cgagaccauccuggcuaacauggu

SEQ ID NO: 680056 - RNA, 24 nt, Human
cgaggcgggcggaucacgagguca

SEQ ID NO: 680057 - RNA, 21 nt, Human
cgcaccacugcacuccagccu

SEQ ID NO: 680058 - RNA, 24 nt, Human
cgcccauaaucccagcuacucggg

SEQ ID NO: 680059 - RNA, 23 nt, Human
cgccuguaaucccagcacuuugg

SEQ ID NO: 680060 - RNA, 24 nt, Human
cgccuguaaucccagcacuuuggg

SEQ ID NO: 680061 - RNA, 23 nt, Human
cgccuguagucccagcuacucgg

SEQ ID NO: 680062 - RNA, 24 nt, Human
cgccuguagucccagcuacucggg

SEQ ID NO: 680063 - RNA, 24 nt, Human
cgggaggcugaggcuggagaauca

SEQ ID NO: 680064 - RNA, 22 nt, Human
cguuuacuuagcaaggucucua

SEQ ID NO: 680065 - RNA, 21 nt, Human
cuaaaaaauacaaaaaauuag

SEQ ID NO: 680066 - RNA, 19 nt, Human
cuacuaaaaaauacaaaaa

SEQ ID NO: 680067 - RNA, 22 nt, Human
cucacgccuguaaucccagcac

SEQ ID NO: 680068 - RNA, 24 nt, Human
cucacgccuguaaucccagcacuu

SEQ ID NO: 680069 - RNA, 23 nt, Human
cucaugccuguaaucccagcacu

SEQ ID NO: 680070 - RNA, 24 nt, Human
cucaugccuguaaucccagcacuu

SEQ ID NO: 680071 - RNA, 25 nt, Human
cucccaggaccacggccucgggggc

SEQ ID NO: 680072 - RNA, 21 nt, Human
cuccccgccaacucccccccc

SEQ ID NO: 680073 - RNA, 23 nt, Human
cuccccgccaacuccccccccaa

SEQ ID NO: 680074 - RNA, 20 nt, Human
cucccuuuagccucaacagc

SEQ ID NO: 680075 - RNA, 18 nt, Human
cucuacuaaaaaaaaaaa

SEQ ID NO: 680076 - RNA, 22 nt, Human
cucuacuaaaaaaaaaaaauac

SEQ ID NO: 680077 - RNA, 18 nt, Human
cugccuccuucucucuuc

SEQ ID NO: 680078 - RNA, 24 nt, Human
cuggggcaggcacgguggcucacg

SEQ ID NO: 680079 - RNA, 18 nt, Human
cuucaagaggauggaguc

SEQ ID NO: 680080 - RNA, 18 nt, Human
cuucucaucuuucaaagg

SEQ ID NO: 680081 - RNA, 21 nt, Human
cuugcagugagccgagaucgc

SEQ ID NO: 680082 - RNA, 22 nt, Human
cuuuccagcagugagaacuugg

SEQ ID NO: 680083 - RNA, 23 nt, Human
cuuuuggaggaugaggugggcag

SEQ ID NO: 680084 - RNA, 19 nt, Human
gaaaggguggcuguccuca

SEQ ID NO: 680085 - RNA, 18 nt, Human
gaacauucagccugggaa

SEQ ID NO: 680086 - RNA, 23 nt, Human
gagaaucacuugaacccaggagg

SEQ ID NO: 680087 - RNA, 23 nt, Human
gagaucgcaccacugcacuccag

SEQ ID NO: 680088 - RNA, 18 nt, Human
gagcuugcagugagccga

SEQ ID NO: 680089 - RNA, 23 nt, Human
gagcuugcagugagccgagaucg

SEQ ID NO: 680090 - RNA, 21 nt, Human
gaggcagagguugcagugagc

SEQ ID NO: 680091 - RNA, 18 nt, Human
gaggcugaggcuggagaa

SEQ ID NO: 680092 - RNA, 18 nt, Human
gaggugggcagaucaccu

SEQ ID NO: 680093 - RNA, 21 nt, Human
gagugagacugaauacuuuuc

SEQ ID NO: 680094 - RNA, 18 nt, Human
gaucaccugaggccagga

SEQ ID NO: 680095 - RNA, 24 nt, Human
gaucaccugaggccaggaguucac

SEQ ID NO: 680096 - RNA, 20 nt, Human
gauuagccagccagagcaug

SEQ ID NO: 680097 - RNA, 21 nt, Human
gcaagguagaaggugaaacag

SEQ ID NO: 680098 - RNA, 20 nt, Human
gcaccacugcacuccagccu

SEQ ID NO: 680099 - RNA, 24 nt, Human
gcacuccagccugggugacagagc

SEQ ID NO: 680100 - RNA, 25 nt, Human
gccaacuccccccccaaaaaacccu

SEQ ID NO: 680101 - RNA, 23 nt, Human
gccaccguauuuucagucggcua

SEQ ID NO: 680102 - RNA, 20 nt, Human
gccgagaucgcaccacugca

SEQ ID NO: 680103 - RNA, 24 nt, Human
gcuaacauggugaaaccccgucuc

SEQ ID NO: 680104 - RNA, 21 nt, Human
gcuacucgggaggcugaggcu

SEQ ID NO: 680105 - RNA, 22 nt, Human
gcuggagaaucacuugaaccca

SEQ ID NO: 680106 - RNA, 24 nt, Human
ggagcuugcagugagccgagaucg

SEQ ID NO: 680107 - RNA, 22 nt, Human
ggaggaugaggugggcagauca

SEQ ID NO: 680108 - RNA, 19 nt, Human
ggcagguccucaagagcug

SEQ ID NO: 680109 - RNA, 22 nt, Human
ggcccagaacuugggagucuca

SEQ ID NO: 680110 - RNA, 21 nt, Human
ggcggaucacgaggucaggag

SEQ ID NO: 680111 - RNA, 22 nt, Human
ggcgugguggugggcgccugua

SEQ ID NO: 680112 - RNA, 21 nt, Human
ggcucacgccuguaaucccag

SEQ ID NO: 680113 - RNA, 18 nt, Human
ggcuuuaaaacagcccag

SEQ ID NO: 680114 - RNA, 22 nt, Human
gggcagcaagagugaaacuccg

SEQ ID NO: 680115 - RNA, 20 nt, Human
gggcuggcccagaacuuggg

SEQ ID NO: 680116 - RNA, 24 nt, Human
gggucuugcauucuuuccuuaacc

SEQ ID NO: 680117 - RNA, 23 nt, Human
gguccuuucuccuuuguaaggcu

SEQ ID NO: 680118 - RNA, 23 nt, Human
gguggcucacgccuguaauccca

SEQ ID NO: 680119 - RNA, 24 nt, Human
gguggcucacgccuguaaucccag

SEQ ID NO: 680120 - RNA, 18 nt, Human
gucagucugugaaggggu

SEQ ID NO: 680121 - RNA, 21 nt, Human
gugagauucuucccugaggaa

SEQ ID NO: 680122 - RNA, 23 nt, Human
guggugggcgccuguagucccag

SEQ ID NO: 680123 - RNA, 21 nt, Human
gugucagaacuuuccauaggg

SEQ ID NO: 680124 - RNA, 19 nt, Human
guugcagugagccgagauc

SEQ ID NO: 680125 - RNA, 22 nt, Human
uaacauggugaaaccccgucuc

SEQ ID NO: 680126 - RNA, 24 nt, Human
uaacauggugaaaccccgucucua

SEQ ID NO: 680127 - RNA, 20 nt, Human
uaagacuggaacagacaaga

SEQ ID NO: 680128 - RNA, 24 nt, Human
uaagcaccacuggguaccaucauu

SEQ ID NO: 680129 - RNA, 18 nt, Human
uaauucagaaaaagauga

SEQ ID NO: 680130 - RNA, 21 nt, Human
uacaaaagacaaguauaugau

SEQ ID NO: 680131 - RNA, 22 nt, Human
uagacugcaaauaagcacacca

SEQ ID NO: 680132 - RNA, 22 nt, Human
uagccagccagagcauguccaa

SEQ ID NO: 680133 - RNA, 24 nt, Human
uagccucugaaacagcaaacuuau

SEQ ID NO: 680134 - RNA, 23 nt, Human
uagucaagugagauucuucccug

SEQ ID NO: 680135 - RNA, 19 nt, Human
uauaggcuuucuccuacuc

SEQ ID NO: 680136 - RNA, 26 nt, Human
ucaaaaacaaaacaaaacaaaacaaa

SEQ ID NO: 680137 - RNA, 19 nt, Human
ucaccugaggccaggaguu

SEQ ID NO: 680138 - RNA, 18 nt, Human
ucacgaggucaggagauc

SEQ ID NO: 680139 - RNA, 24 nt, Human
ucacgaggucaggagaucgagacc

SEQ ID NO: 680140 - RNA, 20 nt, Human
ucagaaaaagaugacuugau

SEQ ID NO: 680141 - RNA, 21 nt, Human
ucagcagagacgaagaaaggg

SEQ ID NO: 680142 - RNA, 20 nt, Human
ucagccaacauaaagagugc

SEQ ID NO: 680143 - RNA, 19 nt, Human
ucagcugcagcuacuccag

SEQ ID NO: 680144 - RNA, 20 nt, Human
ucagucggcuagaacaugga

SEQ ID NO: 680145 - RNA, 19 nt, Human
ucaucaguuucagugccau

SEQ ID NO: 680146 - RNA, 18 nt, Human
ucaucucuucagaaaacu

SEQ ID NO: 680147 - RNA, 19 nt, Human
uccacacauggugucagaa

SEQ ID NO: 680148 - RNA, 23 nt, Human
uccagaagccagaacuuugaacu

SEQ ID NO: 680149 - RNA, 24 nt, Human
uccagccugggugacagagcuaga

SEQ ID NO: 680150 - RNA, 22 nt, Human
uccauagggcuccaggucucug

SEQ ID NO: 680151 - RNA, 21 nt, Human
uccaucucaaaaacaaaacaa

SEQ ID NO: 680152 - RNA, 29 nt, Human
uccccccccaaaaaacccuuuuaguuuua

SEQ ID NO: 680153 - RNA, 21 nt, Human
uccuuccacacauggugucag

SEQ ID NO: 680154 - RNA, 20 nt, Human
uccuuucuccuuuguaaggc

SEQ ID NO: 680155 - RNA, 23 nt, Human
ucgcaccacugcacuccagccug

SEQ ID NO: 680156 - RNA, 25 nt, Human
ucgggaggcugaggcuggagaauca

SEQ ID NO: 680157 - RNA, 25 nt, Human
ucucaaguuuucauucucacccacu

SEQ ID NO: 680158 - RNA, 20 nt, Human
ucucuacuaaaaaaaaaaaa

SEQ ID NO: 680159 - RNA, 23 nt, Human
ucucuacuaaaaaauacaaaaaa

SEQ ID NO: 680160 - RNA, 23 nt, Human
ucuuuguuccucgugaaaugggc

SEQ ID NO: 680161 - RNA, 24 nt, Human
ugaaacagcaaacuuauaggcaau

SEQ ID NO: 680162 - RNA, 22 nt, Human
ugaacugugcuucuagcucuuu

SEQ ID NO: 680163 - RNA, 19 nt, Human
ugacaucaacucuucggca

SEQ ID NO: 680164 - RNA, 25 nt, Human
ugagaacccgggaggcggagcuugc

SEQ ID NO: 680165 - RNA, 20 nt, Human
ugagaacuuggaaagguaga

SEQ ID NO: 680166 - RNA, 22 nt, Human
ugagccgagaucgcaccacugc

SEQ ID NO: 680167 - RNA, 24 nt, Human
ugaggcaggagaauggugagaacc

SEQ ID NO: 680168 - RNA, 25 nt, Human
ugaggcaggagaauggugagaaccc

SEQ ID NO: 680169 - RNA, 24 nt, Human
ugaggccaggaguucacaagacca

SEQ ID NO: 680170 - RNA, 20 nt, Human
ugaggcuggagaaucacuug

SEQ ID NO: 680171 - RNA, 24 nt, Human
ugaggcuggagaaucacuugaacc

SEQ ID NO: 680172 - RNA, 19 nt, Human
ugagggcucugagcacuca

SEQ ID NO: 680173 - RNA, 20 nt, Human
ugaggugggcagaucaccug

SEQ ID NO: 680174 - RNA, 26 nt, Human
ugaggugggcagaucaccugaggcca

SEQ ID NO: 680175 - RNA, 19 nt, Human
ugauugucaguauaaacuu

SEQ ID NO: 680176 - RNA, 21 nt, Human
ugcaccauugcacuccagccu

SEQ ID NO: 680177 - RNA, 22 nt, Human
ugcacuccagccugggcagcaa

SEQ ID NO: 680178 - RNA, 25 nt, Human
ugcacuccagccugggcagcaagag

SEQ ID NO: 680179 - RNA, 23 nt, Human
ugccuccuucucucuucuguucc

SEQ ID NO: 680180 - RNA, 18 nt, Human
ugccuguaaucccagcac

SEQ ID NO: 680181 - RNA, 23 nt, Human
ugccuguaaucccagcacuuuug

SEQ ID NO: 680182 - RNA, 24 nt, Human
uggaagcacacgaauggcaggaca

SEQ ID NO: 680183 - RNA, 22 nt, Human
uggcucacgccuguaaucccag

SEQ ID NO: 680184 - RNA, 24 nt, Human
uggcucacgccuguaaucccagca

SEQ ID NO: 680185 - RNA, 22 nt, Human
uggcucaugccuguaaucccag

SEQ ID NO: 680186 - RNA, 24 nt, Human
uggcucaugccuguaaucccagca

SEQ ID NO: 680187 - RNA, 21 nt, Human
uggcucccaggaccacggccu

SEQ ID NO: 680188 - RNA, 20 nt, Human
uggcugaaaucccaucuacu

SEQ ID NO: 680189 - RNA, 18 nt, Human
ugggagaagggagaccug

SEQ ID NO: 680190 - RNA, 21 nt, Human
ugggagaagggagaccuggac

SEQ ID NO: 680191 - RNA, 19 nt, Human
ugggaggccgaggcgggcg

SEQ ID NO: 680192 - RNA, 24 nt, Human
ugggaggccgaggcgggcggauca

SEQ ID NO: 680193 - RNA, 24 nt, Human
ugggcagaucaccugaggccagga

SEQ ID NO: 680194 - RNA, 23 nt, Human
ugggcuagccucugaaacagcaa

SEQ ID NO: 680195 - RNA, 23 nt, Human
ugggcuggcccagaacuugggag

SEQ ID NO: 680196 - RNA, 23 nt, Human
ugggcuuuaaaacagcccagagc

SEQ ID NO: 680197 - RNA, 26 nt, Human
ugguauuuucucuuuuaugaauuguc

SEQ ID NO: 680198 - RNA, 19 nt, Human
uggugagaacccgggaggc

SEQ ID NO: 680199 - RNA, 24 nt, Human
ugguggugggcgccuguaguccca

SEQ ID NO: 680200 - RNA, 21 nt, Human
uguccuucuuccauuuggcag

SEQ ID NO: 680201 - RNA, 23 nt, Human
ugucuguuucaaguaagcaaugu

SEQ ID NO: 680202 - RNA, 21 nt, Human
uuacacugucccuaugugcau

SEQ ID NO: 680203 - RNA, 18 nt, Human
uuagccgggcgugguggu

SEQ ID NO: 680204 - RNA, 24 nt, Human
uuagccgggcgugguggugggcgc

SEQ ID NO: 680205 - RNA, 18 nt, Human
uuagccucaacagcauga

SEQ ID NO: 680206 - RNA, 18 nt, Human
uuagcugggcaugguggu

SEQ ID NO: 680207 - RNA, 24 nt, Human
uuagcugggcaugguggugggcgc

SEQ ID NO: 680208 - RNA, 23 nt, Human
uucaagaggauggagucuucugu

SEQ ID NO: 680209 - RNA, 18 nt, Human
uuccuccccgccaacucc

SEQ ID NO: 680210 - RNA, 22 nt, Human
uugcagugagccgagaucauug

SEQ ID NO: 680211 - RNA, 25 nt, Human
uugcagugagccgagaucauugcac

SEQ ID NO: 680212 - RNA, 19 nt, Human
uugcagugagccgagaucg

SEQ ID NO: 680213 - RNA, 22 nt, Human
uugcagugagccgagaucgcac

SEQ ID NO: 680214 - RNA, 25 nt, Human
uugggaggccgaggcgggcggauca

SEQ ID NO: 680215 - RNA, 19 nt, Human
uugggucuugcauucuuuc

SEQ ID NO: 680216 - RNA, 24 nt, Human
uuuccuucaaguuaugggccacuu

SEQ ID NO: 680217 - RNA, 21 nt, Human
uuuccuucugguauuuucucu

SEQ ID NO: 680218 - RNA, 24 nt, Human
uuuccuucugguauuuucucuuuu

SEQ ID NO: 680219 - RNA, 22 nt, Human
uuugcauuuuugcccuuucuaa

SEQ ID NO: 680220 - RNA, 20 nt, Human
uuuucauucucacccacugc

SEQ ID NO: 680221 - RNA, 21 nt, Human
aaaagaaaaugaaaaacaagg

SEQ ID NO: 680222 - RNA, 28 nt, Human
aaaauauauauauauauauauaaacaug

SEQ ID NO: 680223 - RNA, 22 nt, Human
aaacaaagccugcucuuccucg

SEQ ID NO: 680224 - RNA, 19 nt, Human
aaacaaggccaacaguaug

SEQ ID NO: 680225 - RNA, 23 nt, Human
aaacacauccuccaucucccucu

SEQ ID NO: 680226 - RNA, 19 nt, Human
aaacucacucuuuaucaag

SEQ ID NO: 680227 - RNA, 19 nt, Human
aaacugggcuucccugcag

SEQ ID NO: 680228 - RNA, 22 nt, Human
aaccauccaagaagacauccaa

SEQ ID NO: 680229 - RNA, 18 nt, Human
aaccccaccuccgcccag

SEQ ID NO: 680230 - RNA, 23 nt, Human
aacucccugcccccauggaccuu

SEQ ID NO: 680231 - RNA, 21 nt, Human
aagcagaaccauccaagaaga

SEQ ID NO: 680232 - RNA, 26 nt, Human
aagcaugaaaaaaagauacauucuga

SEQ ID NO: 680233 - RNA, 18 nt, Human
acaaagucauucauacag

SEQ ID NO: 680234 - RNA, 19 nt, Human
acaaggcuauagaagaagc

SEQ ID NO: 680235 - RNA, 28 nt, Human
acacacacaaacacacacacacaggcgc

SEQ ID NO: 680236 - RNA, 25 nt, Human
acacacacacacaaacacacacaca

SEQ ID NO: 680237 - RNA, 27 nt, Human
acacacacacacacacacaaacacaca

SEQ ID NO: 680238 - RNA, 30 nt, Human
acacacacacacacacacaaacacacacaa

SEQ ID NO: 680239 - RNA, 21 nt, Human
acacacacacacaggcgcaca

SEQ ID NO: 680240 - RNA, 19 nt, Human
acacacacacaggcgcaca

SEQ ID NO: 680241 - RNA, 31 nt, Human
acacacacacaggcgcacaaacacauccucu

SEQ ID NO: 680242 - RNA, 21 nt, Human
acacacacaggcgcacaaaca

SEQ ID NO: 680243 - RNA, 23 nt, Human
acaggcgcacaaacacauccucu

SEQ ID NO: 680244 - RNA, 18 nt, Human
acccaaauaaacaugguc

SEQ ID NO: 680245 - RNA, 20 nt, Human
acccaaauaaacauggucuc

SEQ ID NO: 680246 - RNA, 18 nt, Human
accucgcaacucccugcc

SEQ ID NO: 680247 - RNA, 18 nt, Human
agaaaucaauccugggcu

SEQ ID NO: 680248 - RNA, 22 nt, Human
agacaggacaggauagcccuga

SEQ ID NO: 680249 - RNA, 21 nt, Human
agauucccccaguuccacucc

SEQ ID NO: 680250 - RNA, 22 nt, Human
agcaagcugugggacaaggcag

SEQ ID NO: 680251 - RNA, 21 nt, Human
aggaaugggggggcuccuuug

SEQ ID NO: 680252 - RNA, 18 nt, Human
aggccuggaaaucucaga

SEQ ID NO: 680253 - RNA, 18 nt, Human
aggcuuccuccuacccaa

SEQ ID NO: 680254 - RNA, 21 nt, Human
agucugcccuccuucccccaa

SEQ ID NO: 680255 - RNA, 21 nt, Human
aguggcaugugggguuccucg

SEQ ID NO: 680256 - RNA, 19 nt, Human
auauauauauauauauaua

SEQ ID NO: 680257 - RNA, 23 nt, Human
aucaaagcccucaauuaccuccu

SEQ ID NO: 680258 - RNA, 18 nt, Human
aucagaccauucucagca

SEQ ID NO: 680259 - RNA, 20 nt, Human
aucuauggccucacuuccuu

SEQ ID NO: 680260 - RNA, 19 nt, Human
auggggcagcaagcugugg

SEQ ID NO: 680261 - RNA, 22 nt, Human
augugugugugugcgagugugu

SEQ ID NO: 680262 - RNA, 19 nt, Human
caaagcccucaauuaccuc

SEQ ID NO: 680263 - RNA, 23 nt, Human
cacaaacacauccuccaucuccc

SEQ ID NO: 680264 - RNA, 18 nt, Human
cacaacucagauuccccc

SEQ ID NO: 680265 - RNA, 20 nt, Human
cacacaaacacacacacaca

SEQ ID NO: 680266 - RNA, 21 nt, Human
cacacacaaacacacacacac

SEQ ID NO: 680267 - RNA, 22 nt, Human
cacacacacaaacacacacaca

SEQ ID NO: 680268 - RNA, 23 nt, Human
cacacacacaggcgcacaaacac

SEQ ID NO: 680269 - RNA, 21 nt, Human
cacagcaacccagugggccag

SEQ ID NO: 680270 - RNA, 21 nt, Human
cacagcggugacuaacucguc

SEQ ID NO: 680271 - RNA, 23 nt, Human
caccuccucagccccaggcuacc

SEQ ID NO: 680272 - RNA, 19 nt, Human
caccucgcaacucccugcc

SEQ ID NO: 680273 - RNA, 25 nt, Human
caccuggaguacugguccacccacc

SEQ ID NO: 680274 - RNA, 18 nt, Human
cagaaagggcaacugaag

SEQ ID NO: 680275 - RNA, 23 nt, Human
cagaacagccgaucacccuacag

SEQ ID NO: 680276 - RNA, 18 nt, Human
cagaaccauccaagaaga

SEQ ID NO: 680277 - RNA, 23 nt, Human
cagauucccccaguuccacuccu

SEQ ID NO: 680278 - RNA, 22 nt, Human
cagcacagcaacccagugggcc

SEQ ID NO: 680279 - RNA, 20 nt, Human
cagcagagaggggcuccuua

SEQ ID NO: 680280 - RNA, 19 nt, Human
cagcccaaugcgggcucca

SEQ ID NO: 680281 - RNA, 20 nt, Human
cagcgaguggcauguggggu

SEQ ID NO: 680282 - RNA, 24 nt, Human
caugcaacuaaccccaccucgcaa

SEQ ID NO: 680283 - RNA, 21 nt, Human
ccagaagacaggccaucucag

SEQ ID NO: 680284 - RNA, 20 nt, Human
ccagggcaccuccucagccc

SEQ ID NO: 680285 - RNA, 22 nt, Human
ccauggguccaaacccaaggga

SEQ ID NO: 680286 - RNA, 24 nt, Human
cccaagggaauauucuuccucuac

SEQ ID NO: 680287 - RNA, 23 nt, Human
cccauggggcagaggcacacugc

SEQ ID NO: 680288 - RNA, 23 nt, Human
ccccaccucgcaacucccugccc

SEQ ID NO: 680289 - RNA, 22 nt, Human
ccccaggcuacccagaacagcc

SEQ ID NO: 680290 - RNA, 21 nt, Human
ccccauggaccuucuuccaga

SEQ ID NO: 680291 - RNA, 18 nt, Human
ccccuccugcccucagaa

SEQ ID NO: 680292 - RNA, 18 nt, Human
ccuccaucucccucucuu

SEQ ID NO: 680293 - RNA, 22 nt, Human
ccucgucuucccuucuccccca

SEQ ID NO: 680294 - RNA, 22 nt, Human
ccucuaccuggccuuuuguucc

SEQ ID NO: 680295 - RNA, 26 nt, Human
ccugggaccauggguccaaacccaag

SEQ ID NO: 680296 - RNA, 19 nt, Human
ccuuaucuggucgccccuc

SEQ ID NO: 680297 - RNA, 22 nt, Human
ccuuaucuggucgccccuccug

SEQ ID NO: 680298 - RNA, 24 nt, Human
ccuuaucuggucgccccuccugcc

SEQ ID NO: 680299 - RNA, 22 nt, Human
cggugacuaacucgucccgcaa

SEQ ID NO: 680300 - RNA, 23 nt, Human
cuaaugguucuuucccugauucu

SEQ ID NO: 680301 - RNA, 21 nt, Human
cucacacacacacacacacac

SEQ ID NO: 680302 - RNA, 29 nt, Human
cucacacacacacacacacacaaacacac

SEQ ID NO: 680303 - RNA, 24 nt, Human
cucagauucccccaguuccacucc

SEQ ID NO: 680304 - RNA, 21 nt, Human
cuccugcccucagaaaggccc

SEQ ID NO: 680305 - RNA, 20 nt, Human
cuccuugacacucauucuaa

SEQ ID NO: 680306 - RNA, 18 nt, Human
cucucucucucuccgggc

SEQ ID NO: 680307 - RNA, 22 nt, Human
cugcccccauggaccuucuucc

SEQ ID NO: 680308 - RNA, 24 nt, Human
cuuccagaccaaccccaccuccgc

SEQ ID NO: 680309 - RNA, 26 nt, Human
cuuccagaccaaccccaccuccgccc

SEQ ID NO: 680310 - RNA, 19 nt, Human
cuuuguauuucuccaugau

SEQ ID NO: 680311 - RNA, 19 nt, Human
gaaaaugaaaaacaaggcc

SEQ ID NO: 680312 - RNA, 18 nt, Human
gagggugggcaggagggc

SEQ ID NO: 680313 - RNA, 19 nt, Human
gagugugugugguuugugu

SEQ ID NO: 680314 - RNA, 19 nt, Human
gcaaggcaaggcuuccucc

SEQ ID NO: 680315 - RNA, 19 nt, Human
gcuugaagaggacuccagg

SEQ ID NO: 680316 - RNA, 24 nt, Human
ggaaguuuuuuuuuuuccuagaga

SEQ ID NO: 680317 - RNA, 23 nt, Human
ggcaccucccccaacucuuacua

SEQ ID NO: 680318 - RNA, 24 nt, Human
ggcuaguuaucacccucauaaaua

SEQ ID NO: 680319 - RNA, 22 nt, Human
gggcagcaagcugugggacaag

SEQ ID NO: 680320 - RNA, 19 nt, Human
gggcagggcccccaacgug

SEQ ID NO: 680321 - RNA, 21 nt, Human
ggggggcuccuuuggcacuuc

SEQ ID NO: 680322 - RNA, 22 nt, Human
ggggggcuccuuuggcacuuca

SEQ ID NO: 680323 - RNA, 23 nt, Human
gggggggcuccuuuggcacuuca

SEQ ID NO: 680324 - RNA, 19 nt, Human
gucucuguguaugugugug

SEQ ID NO: 680325 - RNA, 25 nt, Human
gugcgagugugugugguuuguguug

SEQ ID NO: 680326 - RNA, 20 nt, Human
gugggugggagggugggcag

SEQ ID NO: 680327 - RNA, 25 nt, Human
uaaaagggacgaggugccaggagca

SEQ ID NO: 680328 - RNA, 20 nt, Human
uacaaggcuauagaagaagc

SEQ ID NO: 680329 - RNA, 22 nt, Human
uacacuuaugcuucucaccuaa

SEQ ID NO: 680330 - RNA, 21 nt, Human
uacauucugagcugacacaga

SEQ ID NO: 680331 - RNA, 22 nt, Human
uagcccugaguccagggcaccu

SEQ ID NO: 680332 - RNA, 23 nt, Human
uaggcuucucugagcaugccugg

SEQ ID NO: 680333 - RNA, 23 nt, Human
uaugugugugugugcgagugugu

SEQ ID NO: 680334 - RNA, 23 nt, Human
uaugugugugugugcgagugugu

SEQ ID NO: 680335 - RNA, 21 nt, Human
ucacacacacacacacacaca

SEQ ID NO: 680336 - RNA, 23 nt, Human
ucacacacacacacacacacaaa

SEQ ID NO: 680337 - RNA, 29 nt, Human
ucacacacacacacacacacaaacacaca

SEQ ID NO: 680338 - RNA, 21 nt, Human
uccaagaagacauccaagcua

SEQ ID NO: 680339 - RNA, 24 nt, Human
uccaagaagacauccaagcuauac

SEQ ID NO: 680340 - RNA, 23 nt, Human
uccaagacaggacaggauagccc

SEQ ID NO: 680341 - RNA, 20 nt, Human
uccagcaauaaauaacauaa

SEQ ID NO: 680342 - RNA, 22 nt, Human
uccaugcaacuaaccccaccuc

SEQ ID NO: 680343 - RNA, 22 nt, Human
uccauucugacgggucuggaga

SEQ ID NO: 680344 - RNA, 18 nt, Human
ucccccaguuccacuccu

SEQ ID NO: 680345 - RNA, 19 nt, Human
ucccugcagcuguaccugc

SEQ ID NO: 680346 - RNA, 22 nt, Human
ucccugcagcuguaccugcaca

SEQ ID NO: 680347 - RNA, 20 nt, Human
uccucagccccaggcuaccc

SEQ ID NO: 680348 - RNA, 19 nt, Human
uccuccaucucccucucuu

SEQ ID NO: 680349 - RNA, 18 nt, Human
uccugcccucagaaaggc

SEQ ID NO: 680350 - RNA, 24 nt, Human
ucgggugggugggagggugggcag

SEQ ID NO: 680351 - RNA, 18 nt, Human
ucuagaaacucuacaagg

SEQ ID NO: 680352 - RNA, 21 nt, Human
ucucacacacacacacacaca

SEQ ID NO: 680353 - RNA, 21 nt, Human
ucucagcaugccccaucaccu

SEQ ID NO: 680354 - RNA, 18 nt, Human
ucucccucucuuuccucc

SEQ ID NO: 680355 - RNA, 27 nt, Human
ucucucacacacacacacacacacaaa

SEQ ID NO: 680356 - RNA, 21 nt, Human
ucucucucucucucucucaca

SEQ ID NO: 680357 - RNA, 21 nt, Human
ucucucucucucucucucuca

SEQ ID NO: 680358 - RNA, 18 nt, Human
ucucuguguaugugugug

SEQ ID NO: 680359 - RNA, 23 nt, Human
ucucuuccccacagugcuuuuag

SEQ ID NO: 680360 - RNA, 24 nt, Human
ucugucauuauuuacacauaugua

SEQ ID NO: 680361 - RNA, 18 nt, Human
ugaaaagaaaaugaaaaa

SEQ ID NO: 680362 - RNA, 21 nt, Human
ugaaaagaaaaugaaaaacaa

SEQ ID NO: 680363 - RNA, 20 nt, Human
ugaagaggacuccaggucug

SEQ ID NO: 680364 - RNA, 21 nt, Human
ugaauaucaaucauuuccccu

SEQ ID NO: 680365 - RNA, 22 nt, Human
ugacacaacucagauuccccca

SEQ ID NO: 680366 - RNA, 25 nt, Human
ugagaacagcucaguaucaaagccc

SEQ ID NO: 680367 - RNA, 24 nt, Human
ugaggaaacagaguuggugugaga

SEQ ID NO: 680368 - RNA, 18 nt, Human
ugaguggggagggccccu

SEQ ID NO: 680369 - RNA, 19 nt, Human
ugaguggggagggccccug

SEQ ID NO: 680370 - RNA, 20 nt, Human
ugccugaguggggagggccc

SEQ ID NO: 680371 - RNA, 23 nt, Human
ugccuggcuccaagguccacaug

SEQ ID NO: 680372 - RNA, 22 nt, Human
uggaagggagaguuugugcugg

SEQ ID NO: 680373 - RNA, 24 nt, Human
uggaccuucuuccagaccaacccc

SEQ ID NO: 680374 - RNA, 20 nt, Human
uggccuuuuguuccaccacc

SEQ ID NO: 680375 - RNA, 18 nt, Human
ugggaaguuuuuuuuuuu

SEQ ID NO: 680376 - RNA, 24 nt, Human
uguacaagaaaaaugaaagagucu

SEQ ID NO: 680377 - RNA, 25 nt, Human
uguacaagaaaaaugaaagagucuc

SEQ ID NO: 680378 - RNA, 22 nt, Human
ugucauuauuuacacauaugua

SEQ ID NO: 680379 - RNA, 24 nt, Human
ugucuuuaggagaggaacugaagu

SEQ ID NO: 680380 - RNA, 23 nt, Human
ugugcuggagccagcccuguuug

SEQ ID NO: 680381 - RNA, 18 nt, Human
uguguaugugugugugug

SEQ ID NO: 680382 - RNA, 23 nt, Human
ugugugcgagugugugugguuug

SEQ ID NO: 680383 - RNA, 20 nt, Human
ugugugugugcgagugugug

SEQ ID NO: 680384 - RNA, 22 nt, Human
ugugugugugugcgagugugug

SEQ ID NO: 680385 - RNA, 21 nt, Human
uuacacuuaugcuucucaccu

SEQ ID NO: 680386 - RNA, 20 nt, Human
uucauacaguuuuuguguuu

SEQ ID NO: 680387 - RNA, 23 nt, Human
uuccagaccaaccccaccuccgc

SEQ ID NO: 680388 - RNA, 21 nt, Human
uucccccaguuccacuccuaa

SEQ ID NO: 680389 - RNA, 24 nt, Human
uugccugacaccacaaagcuucua

SEQ ID NO: 680390 - RNA, 25 nt, Human
uuguguuuuuuuacugacuucgaaa

SEQ ID NO: 680391 - RNA, 24 nt, Human
uuugaaaagaaaaugaaaaacaag

SEQ ID NO: 680392 - RNA, 24 nt, Human
uuuuggggcuacaagcaacuuccc

SEQ ID NO: 680393 - RNA, 18 nt, Human
caccuugccucuggggug

SEQ ID NO: 680394 - RNA, 24 nt, Human
cagggcuccacgucagucacuggg

SEQ ID NO: 680395 - RNA, 21 nt, Human
ccccuuuucccguuuucgccc

SEQ ID NO: 680396 - RNA, 23 nt, Human
cucuacgcgaagcccagggcucc

SEQ ID NO: 680397 - RNA, 19 nt, Human
gacucuacgcgaagcccag

SEQ ID NO: 680398 - RNA, 19 nt, Human
gcccagggcuccacgucag

SEQ ID NO: 680399 - RNA, 22 nt, Human
gggguguugcgcaguccaguca

SEQ ID NO: 680400 - RNA, 18 nt, Human
uccaggucugcagagcau

SEQ ID NO: 680401 - RNA, 18 nt, Human
uccgucccaguggggagg

SEQ ID NO: 680402 - RNA, 18 nt, Human
ucuacgcgaagcccaggg

SEQ ID NO: 680403 - RNA, 23 nt, Human
ugaugcuuggggggcagcugcug

SEQ ID NO: 680404 - RNA, 18 nt, Human
uggccggagggcacaggg

SEQ ID NO: 680405 - RNA, 19 nt, Human
uggggaggggcagggaucc

SEQ ID NO: 680406 - RNA, 20 nt, Human
uggggggcagcugcugcuac

SEQ ID NO: 680407 - RNA, 19 nt, Human
uuccaggucugcagagcau

SEQ ID NO: 680408 - RNA, 22 nt, Human
uuggggggcagcugcugcuacg

SEQ ID NO: 680409 - RNA, 20 nt, Human
uuuuuuuuuuuuuuuuccag

SEQ ID NO: 680410 - RNA, 23 nt, Human
uuuuuuuuuuuuuuuuuuccagg

SEQ ID NO: 680411 - RNA, 23 nt, Human
uuuuuuuuuuuuuuuuuuuucca

SEQ ID NO: 680412 - RNA, 24 nt, Human
uuuuuuuuuuuuuuuuuuuuuccu

SEQ ID NO: 680413 - RNA, 24 nt, Human
aaaacacaauacacuguuucacaa

SEQ ID NO: 680414 - RNA, 18 nt, Human
aaacaaaacaaaacaaaa

SEQ ID NO: 680415 - RNA, 24 nt, Human
aaacacaauacacuguuucacaaa

SEQ ID NO: 680416 - RNA, 23 nt, Human
aaacagguuuucucuucaugcuu

SEQ ID NO: 680417 - RNA, 21 nt, Human
aaagaagccaaauccaccuuc

SEQ ID NO: 680418 - RNA, 19 nt, Human
aaagcaaaacaaaacaaaa

SEQ ID NO: 680419 - RNA, 22 nt, Human
aacacuccuacccuggagaccu

SEQ ID NO: 680420 - RNA, 21 nt, Human
aacccgauauacaaaaaugca

SEQ ID NO: 680421 - RNA, 26 nt, Human
aacuuccagaaugguguuucuaggau

SEQ ID NO: 680422 - RNA, 18 nt, Human
aagaggaaagugcuuggc

SEQ ID NO: 680423 - RNA, 21 nt, Human
aagcaaaacaaaacaaaacaa

SEQ ID NO: 680424 - RNA, 22 nt, Human
aagcaaaacaaaacaaaacaaa

SEQ ID NO: 680425 - RNA, 20 nt, Human
aagcagaggggagguuacuu

SEQ ID NO: 680426 - RNA, 25 nt, Human
aagcagcagcucuugauaggguuug

SEQ ID NO: 680427 - RNA, 21 nt, Human
aagcauacacacucuggggcc

SEQ ID NO: 680428 - RNA, 21 nt, Human
aaggcuucugaucuuuguguu

SEQ ID NO: 680429 - RNA, 20 nt, Human
aauuucugaagaacuggaug

SEQ ID NO: 680430 - RNA, 23 nt, Human
acauccccuccccuuuucacagu

SEQ ID NO: 680431 - RNA, 18 nt, Human
acccacaccaaggaagug

SEQ ID NO: 680432 - RNA, 19 nt, Human
acccccagugggaggugcu

SEQ ID NO: 680433 - RNA, 26 nt, Human
acccuagauaaccucguucuguguua

SEQ ID NO: 680434 - RNA, 20 nt, Human
acccuccugcaggcuccccc

SEQ ID NO: 680435 - RNA, 23 nt, Human
accuccacccccaaccccauaau

SEQ ID NO: 680436 - RNA, 20 nt, Human
agaaacugaagauggaaaag

SEQ ID NO: 680437 - RNA, 22 nt, Human
agaaagugacaccuaagcagag

SEQ ID NO: 680438 - RNA, 22 nt, Human
agaaagugacaccuaagcagag

SEQ ID NO: 680439 - RNA, 23 nt, Human
agaaagugacaccuaagcagagg

SEQ ID NO: 680440 - RNA, 21 nt, Human
agagcccucccacauccauau

SEQ ID NO: 680441 - RNA, 21 nt, Human
agaggaaagugcuuggcacag

SEQ ID NO: 680442 - RNA, 18 nt, Human
agaugaggcuggaggauc

SEQ ID NO: 680443 - RNA, 22 nt, Human
agauuccccuuucuccuccacc

SEQ ID NO: 680444 - RNA, 21 nt, Human
agcaaaacagcccguucacuu

SEQ ID NO: 680445 - RNA, 19 nt, Human
agcaggcaggcgggcgggc

SEQ ID NO: 680446 - RNA, 18 nt, Human
agcauacacacucugggg

SEQ ID NO: 680447 - RNA, 19 nt, Human
agccccugcugcugcuugc

SEQ ID NO: 680448 - RNA, 23 nt, Human
agccggaguuccucgggggcagc

SEQ ID NO: 680449 - RNA, 22 nt, Human
aggagcuggagcggucucuagg

SEQ ID NO: 680450 - RNA, 20 nt, Human
aggcaggcgggcgggccggc

SEQ ID NO: 680451 - RNA, 21 nt, Human
aggcauuucaagcaauguuga

SEQ ID NO: 680452 - RNA, 19 nt, Human
aggccaugcaaguuggagc

SEQ ID NO: 680453 - RNA, 19 nt, Human
aggcggccgggaugagaag

SEQ ID NO: 680454 - RNA, 23 nt, Human
aggcucuaacagacacagcacca

SEQ ID NO: 680455 - RNA, 28 nt, Human
aggucccuccgccuggcauccucugccc

SEQ ID NO: 680456 - RNA, 21 nt, Human
agucuguuacccagaugauaa

SEQ ID NO: 680457 - RNA, 21 nt, Human
auccagaaccuucucaaaaac

SEQ ID NO: 680458 - RNA, 22 nt, Human
aucccgcucccaggucccuccg

SEQ ID NO: 680459 - RNA, 21 nt, Human
auggccuaguguguggugugu

SEQ ID NO: 680460 - RNA, 22 nt, Human
caaaacaaaacaaaacaaaacu

SEQ ID NO: 680461 - RNA, 23 nt, Human
caaaacaaaacaaaacaaaacuu

SEQ ID NO: 680462 - RNA, 22 nt, Human
caaaacaaaacuucucaaacag

SEQ ID NO: 680463 - RNA, 21 nt, Human
caaaacagcccguucacuuca

SEQ ID NO: 680464 - RNA, 21 nt, Human
caaauugcaaaacacuguuca

SEQ ID NO: 680465 - RNA, 22 nt, Human
caacacagaacuguccuuuugu

SEQ ID NO: 680466 - RNA, 23 nt, Human
caacccuagauaaccucguucug

SEQ ID NO: 680467 - RNA, 20 nt, Human
cacaaccuugcuuugccuuu

SEQ ID NO: 680468 - RNA, 19 nt, Human
caccaaggaagugcuuaac

SEQ ID NO: 680469 - RNA, 19 nt, Human
cacccccaaccccauaauc

SEQ ID NO: 680470 - RNA, 21 nt, Human
caccugugucagucacuuggg

SEQ ID NO: 680471 - RNA, 18 nt, Human
cacgcagagcaugguggc

SEQ ID NO: 680472 - RNA, 21 nt, Human
cagagagucaucuccaggcac

SEQ ID NO: 680473 - RNA, 21 nt, Human
cagccggaguuccucgggggc

SEQ ID NO: 680474 - RNA, 20 nt, Human
cagggcucaccuguuuccuc

SEQ ID NO: 680475 - RNA, 19 nt, Human
cagugacagaggagcgacg

SEQ ID NO: 680476 - RNA, 20 nt, Human
ccagaauaccacccucuauc

SEQ ID NO: 680477 - RNA, 21 nt, Human
cccccaaccccauaaucucug

SEQ ID NO: 680478 - RNA, 20 nt, Human
cccccagcgccgacuucauu

SEQ ID NO: 680479 - RNA, 18 nt, Human
ccccuuucuccuccaccu

SEQ ID NO: 680480 - RNA, 25 nt, Human
cccgcagcuggagcgcccguucccu

SEQ ID NO: 680481 - RNA, 19 nt, Human
cccgccccaucugcagggc

SEQ ID NO: 680482 - RNA, 19 nt, Human
cccuccugcaggcuccccc

SEQ ID NO: 680483 - RNA, 22 nt, Human
cccucugcagccgcugccugag

SEQ ID NO: 680484 - RNA, 21 nt, Human
cccugcccgccccaucugcag

SEQ ID NO: 680485 - RNA, 19 nt, Human
cccugcugcugcuugcugc

SEQ ID NO: 680486 - RNA, 22 nt, Human
ccgcucccaggucccuccgccu

SEQ ID NO: 680487 - RNA, 18 nt, Human
ccgcugccugaggucucc

SEQ ID NO: 680488 - RNA, 25 nt, Human
ccuaaacuugauaugcugagaaagu

SEQ ID NO: 680489 - RNA, 22 nt, Human
ccuccaaagauguuugaggagc

SEQ ID NO: 680490 - RNA, 23 nt, Human
ccuccacuguuggccacccuccu

SEQ ID NO: 680491 - RNA, 19 nt, Human
ccucccacauccauaucag

SEQ ID NO: 680492 - RNA, 23 nt, Human
ccucugcugccugucuucuguuu

SEQ ID NO: 680493 - RNA, 23 nt, Human
ccugcaggcucccccagcgccga

SEQ ID NO: 680494 - RNA, 18 nt, Human
ccugcgcccggcucgccc

SEQ ID NO: 680495 - RNA, 20 nt, Human
ccuggggugagaacgugagg

SEQ ID NO: 680496 - RNA, 19 nt, Human
ccugugggcagccaaacuu

SEQ ID NO: 680497 - RNA, 24 nt, Human
ccugugggcagccaaacuuccaga

SEQ ID NO: 680498 - RNA, 23 nt, Human
cgggggcagcagugacagaggag

SEQ ID NO: 680499 - RNA, 24 nt, Human
cguagcgcgccuccggcagucuca

SEQ ID NO: 680500 - RNA, 23 nt, Human
cuaaaaaaaaagagugagggaau

SEQ ID NO: 680501 - RNA, 26 nt, Human
cuaaacagucaggauggagucagaga

SEQ ID NO: 680502 - RNA, 21 nt, Human
cuaaggcucuaacagacacag

SEQ ID NO: 680503 - RNA, 22 nt, Human
cuacuagaugacucuuaucuac

SEQ ID NO: 680504 - RNA, 20 nt, Human
cuagaccucagcuuccccac

SEQ ID NO: 680505 - RNA, 19 nt, Human
cucacaagacagcauuucc

SEQ ID NO: 680506 - RNA, 26 nt, Human
cucaccucuagaccuccacccccaaa

SEQ ID NO: 680507 - RNA, 21 nt, Human
cuccacuguuggccacccucc

SEQ ID NO: 680508 - RNA, 20 nt, Human
cuccugcgcccggcucgccc

SEQ ID NO: 680509 - RNA, 21 nt, Human
cucugcucuuaccugcucccc

SEQ ID NO: 680510 - RNA, 20 nt, Human
cugcacuuuaggcgagggag

SEQ ID NO: 680511 - RNA, 22 nt, Human
cuucacuccacucggugaagcg

SEQ ID NO: 680512 - RNA, 19 nt, Human
cuucuuuaccagaauacca

SEQ ID NO: 680513 - RNA, 19 nt, Human
cuuggcacuugcuccgcuu

SEQ ID NO: 680514 - RNA, 22 nt, Human
gaacggaaaggagguuuccaag

SEQ ID NO: 680515 - RNA, 19 nt, Human
gaccuccacccccaacccc

SEQ ID NO: 680516 - RNA, 21 nt, Human
gaccuccacccccaaccccau

SEQ ID NO: 680517 - RNA, 24 nt, Human
gagauuccccuuucuccuccaccu

SEQ ID NO: 680518 - RNA, 19 nt, Human
gagccucccuccacuccag

SEQ ID NO: 680519 - RNA, 23 nt, Human
gcaaaacaaaacaaaacaaaacu

SEQ ID NO: 680520 - RNA, 20 nt, Human
gcaccuggugaaaagguuaa

SEQ ID NO: 680521 - RNA, 25 nt, Human
gcagagaaagggcuaaaaaccagaa

SEQ ID NO: 680522 - RNA, 20 nt, Human
gcaugugaucaccacugcuc

SEQ ID NO: 680523 - RNA, 22 nt, Human
gcccggcucgccccucugcagc

SEQ ID NO: 680524 - RNA, 24 nt, Human
gcccggcucgccccucugcagccg

SEQ ID NO: 680525 - RNA, 19 nt, Human
gccuuuuucucucuuuucc

SEQ ID NO: 680526 - RNA, 20 nt, Human
ggcacugcguccggccccgc

SEQ ID NO: 680527 - RNA, 21 nt, Human
ggcagggcgaucuggcaugug

SEQ ID NO: 680528 - RNA, 25 nt, Human
ggcccagagcuuuuguucugaaagc

SEQ ID NO: 680529 - RNA, 23 nt, Human
gggaugagaagcagccggaguuc

SEQ ID NO: 680530 - RNA, 20 nt, Human
gggaugggggugaggauguu

SEQ ID NO: 680531 - RNA, 19 nt, Human
gggcagcagugacagagga

SEQ ID NO: 680532 - RNA, 20 nt, Human
gggcagcagugacagaggag

SEQ ID NO: 680533 - RNA, 21 nt, Human
gggcagcagugacagaggagc

SEQ ID NO: 680534 - RNA, 18 nt, Human
gggcauuagaugaggcug

SEQ ID NO: 680535 - RNA, 19 nt, Human
gggcgccucgggcacugcg

SEQ ID NO: 680536 - RNA, 23 nt, Human
ggggaugggguguuucaacacag

SEQ ID NO: 680537 - RNA, 18 nt, Human
gggggcagcagugacaga

SEQ ID NO: 680538 - RNA, 18 nt, Human
ggggugagaacgugaggg

SEQ ID NO: 680539 - RNA, 18 nt, Human
gucccgcgcgcagcuuca

SEQ ID NO: 680540 - RNA, 21 nt, Human
gugacugcugaucugaaaaug

SEQ ID NO: 680541 - RNA, 21 nt, Human
guguagaacauuucacccaca

SEQ ID NO: 680542 - RNA, 24 nt, Human
guucugcuuggcacuugcuccgcu

SEQ ID NO: 680543 - RNA, 21 nt, Human
guuuagguggguaaagaaagg

SEQ ID NO: 680544 - RNA, 25 nt, Human
uaaaaagcaaaacaaaacaaaacaa

SEQ ID NO: 680545 - RNA, 26 nt, Human
uaaaaagcaaaacaaaacaaaacaaa

SEQ ID NO: 680546 - RNA, 24 nt, Human
uaacuugcucuaaggcucuaacag

SEQ ID NO: 680547 - RNA, 18 nt, Human
uaacuuuagagcccuccc

SEQ ID NO: 680548 - RNA, 23 nt, Human
uaagcagaggggagguuacuugu

SEQ ID NO: 680549 - RNA, 22 nt, Human
uacaaaaaugcagacuuacaaa

SEQ ID NO: 680550 - RNA, 26 nt, Human
uacaaaacacaauacacuguuucaca

SEQ ID NO: 680551 - RNA, 24 nt, Human
uaccacauccccuccccuuuucac

SEQ ID NO: 680552 - RNA, 21 nt, Human
uaccugcuccccauucagaau

SEQ ID NO: 680553 - RNA, 18 nt, Human
uagauggauaguuuaggu

SEQ ID NO: 680554 - RNA, 24 nt, Human
uagcagagagucaucuccaggcac

SEQ ID NO: 680555 - RNA, 23 nt, Human
uauaguguucccgggcuggaggu

SEQ ID NO: 680556 - RNA, 18 nt, Human
uaugcaaagugcagggca

SEQ ID NO: 680557 - RNA, 22 nt, Human
uauuaaaaagcaaaacaaaaca

SEQ ID NO: 680558 - RNA, 20 nt, Human
uauuacuguggcaccuggug

SEQ ID NO: 680559 - RNA, 22 nt, Human
ucaccucuagaccuccaccccc

SEQ ID NO: 680560 - RNA, 20 nt, Human
ucagccaauuaaucacuagg

SEQ ID NO: 680561 - RNA, 23 nt, Human
ucagccuuccgggcugcacagag

SEQ ID NO: 680562 - RNA, 21 nt, Human
ucauuagagggaccaaaacca

SEQ ID NO: 680563 - RNA, 21 nt, Human
uccaaaggcaguugcaaccua

SEQ ID NO: 680564 - RNA, 18 nt, Human
ucccaggagcuggagcgg

SEQ ID NO: 680565 - RNA, 21 nt, Human
ucccaggagcuggagcggucu

SEQ ID NO: 680566 - RNA, 25 nt, Human
ucccaggucccuccgccuggcaucc

SEQ ID NO: 680567 - RNA, 23 nt, Human
ucccccagcgccgacuucauuuu

SEQ ID NO: 680568 - RNA, 18 nt, Human
uccccuccccuuuucaca

SEQ ID NO: 680569 - RNA, 21 nt, Human
uccgccuggcauccucugccc

SEQ ID NO: 680570 - RNA, 22 nt, Human
uccuccacuguuggccacccuc

SEQ ID NO: 680571 - RNA, 23 nt, Human
uccuccacuguuggccacccucc

SEQ ID NO: 680572 - RNA, 19 nt, Human
uccuggccaguguuuuggc

SEQ ID NO: 680573 - RNA, 20 nt, Human
ucgccuggauucuuuuccuu

SEQ ID NO: 680574 - RNA, 22 nt, Human
ucucucuucucucgcuacuucc

SEQ ID NO: 680575 - RNA, 18 nt, Human
ucucugagccucccucca

SEQ ID NO: 680576 - RNA, 20 nt, Human
ucucuucucucgcuacuucc

SEQ ID NO: 680577 - RNA, 21 nt, Human
ucugcuuggcacuugcuccgc

SEQ ID NO: 680578 - RNA, 19 nt, Human
ucuguuccagcuccucuga

SEQ ID NO: 680579 - RNA, 23 nt, Human
ugaaagaacagaggcagagcuga

SEQ ID NO: 680580 - RNA, 25 nt, Human
ugaagaacuggauggguuuucuguu

SEQ ID NO: 680581 - RNA, 19 nt, Human
ugaagauggaaaagaccug

SEQ ID NO: 680582 - RNA, 20 nt, Human
ugacccauauuccuuucccu

SEQ ID NO: 680583 - RNA, 22 nt, Human
ugaccucuaacuuuagagcccu

SEQ ID NO: 680584 - RNA, 20 nt, Human
ugagaacgugaggggauggg

SEQ ID NO: 680585 - RNA, 19 nt, Human
ugagacaccuuuccaguga

SEQ ID NO: 680586 - RNA, 21 nt, Human
ugagcaugcuuuaucaugugc

SEQ ID NO: 680587 - RNA, 19 nt, Human
ugagccucaaaggaguuga

SEQ ID NO: 680588 - RNA, 21 nt, Human
ugagcuugagaggagcugcug

SEQ ID NO: 680589 - RNA, 22 nt, Human
ugaggaugggggauugacuuga

SEQ ID NO: 680590 - RNA, 22 nt, Human
ugaguaacaauuuuaucucuug

SEQ ID NO: 680591 - RNA, 21 nt, Human
ugagugggugugaggaugggg

SEQ ID NO: 680592 - RNA, 24 nt, Human
ugcaaaacacuguucaguuacuac

SEQ ID NO: 680593 - RNA, 19 nt, Human
ugccugaggucuccgccuc

SEQ ID NO: 680594 - RNA, 18 nt, Human
uggcacagcuccugaacu

SEQ ID NO: 680595 - RNA, 26 nt, Human
uggcaguaagccugcuguuguccgga

SEQ ID NO: 680596 - RNA, 20 nt, Human
uggcaugugaucaccacugc

SEQ ID NO: 680597 - RNA, 23 nt, Human
uggccagguaguuccuccaaaga

SEQ ID NO: 680598 - RNA, 22 nt, Human
uggcucuugccugguccaauca

SEQ ID NO: 680599 - RNA, 26 nt, Human
uggcuggagcaaaacagcccguucac

SEQ ID NO: 680600 - RNA, 21 nt, Human
uggggguggaacaaugagucc

SEQ ID NO: 680601 - RNA, 18 nt, Human
uggguggggauggcuaag

SEQ ID NO: 680602 - RNA, 25 nt, Human
uguaauguggauugagguacaccug

SEQ ID NO: 680603 - RNA, 23 nt, Human
ugugcuaaaauuauuaaaaagca

SEQ ID NO: 680604 - RNA, 18 nt, Human
uguguagaacauuucacc

SEQ ID NO: 680605 - RNA, 21 nt, Human
uguuucugcuuaccacauccc

SEQ ID NO: 680606 - RNA, 19 nt, Human
uucacaaauugcaaaacac

SEQ ID NO: 680607 - RNA, 18 nt, Human
uucaucuguggaguuggu

SEQ ID NO: 680608 - RNA, 21 nt, Human
uuccugaauggucgaagcuua

SEQ ID NO: 680609 - RNA, 26 nt, Human
uuccuggggucgcguuggagagggcu

SEQ ID NO: 680610 - RNA, 21 nt, Human
uucugggccuggggugagaac

SEQ ID NO: 680611 - RNA, 19 nt, Human
uugcaaacacauuaaaaug

SEQ ID NO: 680612 - RNA, 21 nt, Human
uugcuccgcuuaccacuuuuc

SEQ ID NO: 680613 - RNA, 19 nt, Human
uuguacaagaaaaguggcu

SEQ ID NO: 680614 - RNA, 24 nt, Human
uuguguuuucagggcucaccuguu

SEQ ID NO: 680615 - RNA, 18 nt, Human
uuuaagaagaccuagacc

SEQ ID NO: 680616 - RNA, 23 nt, Human
uuuuuaaugccucugcugccugu

SEQ ID NO: 680617 - RNA, 18 nt, Human
aacaugagccaugagaga

SEQ ID NO: 680618 - RNA, 18 nt, Human
aaguucuccucuuguucu

SEQ ID NO: 680619 - RNA, 18 nt, Human
agggaagugaacaugagc

SEQ ID NO: 680620 - RNA, 23 nt, Human
cacgccugucagcuuucuccucc

SEQ ID NO: 680621 - RNA, 20 nt, Human
cauaacucagccccacaucu

SEQ ID NO: 680622 - RNA, 19 nt, Human
ccaaaaaagaaaccucuuc

SEQ ID NO: 680623 - RNA, 23 nt, Human
ccagcgcuugagaccagaaguuc

SEQ ID NO: 680624 - RNA, 25 nt, Human
ccagucuucauaacucagccccaca

SEQ ID NO: 680625 - RNA, 22 nt, Human
ccugacuguccgcagguuucca

SEQ ID NO: 680626 - RNA, 25 nt, Human
ccugcaaaaccacuggcuguggacc

SEQ ID NO: 680627 - RNA, 25 nt, Human
cggcagccccugcaaaaccacuggc

SEQ ID NO: 680628 - RNA, 20 nt, Human
cucagaauuccugacugucc

SEQ ID NO: 680629 - RNA, 20 nt, Human
cucuguuuuggacuccucca

SEQ ID NO: 680630 - RNA, 18 nt, Human
cugucagcuuucuccucc

SEQ ID NO: 680631 - RNA, 21 nt, Human
gccugucagcuuucuccucca

SEQ ID NO: 680632 - RNA, 21 nt, Human
uaaaagaccccugugcuugca

SEQ ID NO: 680633 - RNA, 26 nt, Human
ucaacuugaaaagggaagugaacaug

SEQ ID NO: 680634 - RNA, 24 nt, Human
ucagcuuucuccuccaguucucuc

SEQ ID NO: 680635 - RNA, 25 nt, Human
ucagcuuucuccuccaguucucuca

SEQ ID NO: 680636 - RNA, 18 nt, Human
ugcaaaaccacuggcugu

SEQ ID NO: 680637 - RNA, 25 nt, Human
agcaugguggggaaaauucaggagg

SEQ ID NO: 680638 - RNA, 24 nt, Human
aggugcgcgcccugagccuugcgc

SEQ ID NO: 680639 - RNA, 19 nt, Human
auggaggcagcggugacag

SEQ ID NO: 680640 - RNA, 23 nt, Human
auuuuguccccauguaccauuua

SEQ ID NO: 680641 - RNA, 18 nt, Human
caagccaauaaagauagc

SEQ ID NO: 680642 - RNA, 19 nt, Human
cauuuuguccccauguacc

SEQ ID NO: 680643 - RNA, 20 nt, Human
ccacuagaagaaaaucugcc

SEQ ID NO: 680644 - RNA, 22 nt, Human
cccaggcagccgcuccucgagg

SEQ ID NO: 680645 - RNA, 26 nt, Human
cccgcggcgguggcgcucgcucucuc

SEQ ID NO: 680646 - RNA, 24 nt, Human
ccuugcgcccccaggcagccgcuc

SEQ ID NO: 680647 - RNA, 21 nt, Human
cgcacugcuucccuagagcaa

SEQ ID NO: 680648 - RNA, 18 nt, Human
cgcgcaggccggcgugcu

SEQ ID NO: 680649 - RNA, 21 nt, Human
cggcgguggcgcucgcucucu

SEQ ID NO: 680650 - RNA, 18 nt, Human
cggcugcggggcccgcgg

SEQ ID NO: 680651 - RNA, 19 nt, Human
cgguugucaugagauagca

SEQ ID NO: 680652 - RNA, 24 nt, Human
cguaaccaggcgacuaugcuugcc

SEQ ID NO: 680653 - RNA, 22 nt, Human
cuagaagaaaaucugccaaaag

SEQ ID NO: 680654 - RNA, 24 nt, Human
cucguagcggccuuggcugcagcu

SEQ ID NO: 680655 - RNA, 19 nt, Human
gaagagacgccuugucagc

SEQ ID NO: 680656 - RNA, 23 nt, Human
gaagagacgccuugucagcccuc

SEQ ID NO: 680657 - RNA, 19 nt, Human
gauagcacuacugaucucg

SEQ ID NO: 680658 - RNA, 20 nt, Human
gcagaacggcugcggggccc

SEQ ID NO: 680659 - RNA, 23 nt, Human
gcgcaggccggcgugcuuuccag

SEQ ID NO: 680660 - RNA, 20 nt, Human
ggcgauggaggcagcgguga

SEQ ID NO: 680661 - RNA, 20 nt, Human
gggccguaaccaggcgacua

SEQ ID NO: 680662 - RNA, 22 nt, Human
ggggaaaauucaggaggguucu

SEQ ID NO: 680663 - RNA, 23 nt, Human
guaaccaggcgacuaugcuugcc

SEQ ID NO: 680664 - RNA, 18 nt, Human
gucaugaucuucuaaacc

SEQ ID NO: 680665 - RNA, 21 nt, Human
uaaaagcccauguuuucuaag

SEQ ID NO: 680666 - RNA, 18 nt, Human
uaaccaggcgacuaugcu

SEQ ID NO: 680667 - RNA, 21 nt, Human
uaccauuuaguuagaugaucc

SEQ ID NO: 680668 - RNA, 20 nt, Human
uagcuacgaacaagcgaugu

SEQ ID NO: 680669 - RNA, 24 nt, Human
uagugucggcgauggaggcagcgg

SEQ ID NO: 680670 - RNA, 20 nt, Human
ucacacgcacugcuucccuu

SEQ ID NO: 680671 - RNA, 22 nt, Human
ugagucgcaaaucaagaaauua

SEQ ID NO: 680672 - RNA, 19 nt, Human
ugcccuuggcaucuucccc

SEQ ID NO: 680673 - RNA, 23 nt, Human
ugcgcccccaggcagccgcuccu

SEQ ID NO: 680674 - RNA, 21 nt, Human
uucuucgucgguugucaugag

SEQ ID NO: 680675 - RNA, 21 nt, Human
uugaagagacgccuugucagc

SEQ ID NO: 680676 - RNA, 23 nt, Human
uugcgcccccaggcagccgcucc

SEQ ID NO: 680677 - RNA, 26 nt, Human
uuuuacaguugcuuauuaacuaugcu

SEQ ID NO: 680678 - RNA, 18 nt, Human
uuuucuaaggccacuaga

SEQ ID NO: 680679 - RNA, 23 nt, Human
aaauagacacacauacauuuccc

SEQ ID NO: 680680 - RNA, 26 nt, Human
aacaaaugacuagagaauaucugcaa

SEQ ID NO: 680681 - RNA, 21 nt, Human
aacauuuuaguucuuaaagcu

SEQ ID NO: 680682 - RNA, 19 nt, Human
aagcuucaacaugagaaau

SEQ ID NO: 680683 - RNA, 22 nt, Human
aaggagcugccuguggcccggg

SEQ ID NO: 680684 - RNA, 20 nt, Human
acauagaaucuucuaaaaca

SEQ ID NO: 680685 - RNA, 21 nt, Human
agaaauguugaccacacacug

SEQ ID NO: 680686 - RNA, 19 nt, Human
agacacacauacauuuccc

SEQ ID NO: 680687 - RNA, 18 nt, Human
agacauaaaauguccaag

SEQ ID NO: 680688 - RNA, 19 nt, Human
agcaggcgguucgagcggc

SEQ ID NO: 680689 - RNA, 24 nt, Human
auaaauaaauagaagacuucuccu

SEQ ID NO: 680690 - RNA, 19 nt, Human
auccagguggccucugcag

SEQ ID NO: 680691 - RNA, 26 nt, Human
auuccucagccucuaucacaguggcu

SEQ ID NO: 680692 - RNA, 24 nt, Human
caaaauagacacacauacauuucc

SEQ ID NO: 680693 - RNA, 22 nt, Human
caauaagcuuccuccuuccuuc

SEQ ID NO: 680694 - RNA, 23 nt, Human
cacuggccauuuucuuggauucc

SEQ ID NO: 680695 - RNA, 22 nt, Human
ccucucugcucuaacacagagg

SEQ ID NO: 680696 - RNA, 18 nt, Human
ccuguggcccgggcucug

SEQ ID NO: 680697 - RNA, 18 nt, Human
ccuucaggaacagccacc

SEQ ID NO: 680698 - RNA, 21 nt, Human
cuaucuucaaauuaaauauga

SEQ ID NO: 680699 - RNA, 20 nt, Human
cucuucuguuccuguaaggg

SEQ ID NO: 680700 - RNA, 19 nt, Human
cucuuuccucuucuguucc

SEQ ID NO: 680701 - RNA, 21 nt, Human
cugcaaaccuucuaucuucaa

SEQ ID NO: 680702 - RNA, 20 nt, Human
cugugaaaucauuucaauaa

SEQ ID NO: 680703 - RNA, 24 nt, Human
cuucuccuaagugaugcucaaaca

SEQ ID NO: 680704 - RNA, 25 nt, Human
gaggagagcuggcaaggagcugccc

SEQ ID NO: 680705 - RNA, 21 nt, Human
gcaaaccuucuaucuucaaau

SEQ ID NO: 680706 - RNA, 22 nt, Human
gcaaaccuucuaucuucaaauu

SEQ ID NO: 680707 - RNA, 21 nt, Human
gcaauccagguggccucugca

SEQ ID NO: 680708 - RNA, 19 nt, Human
gcagggccuccuucaggaa

SEQ ID NO: 680709 - RNA, 24 nt, Human
gcucuaacacagagggaaacacug

SEQ ID NO: 680710 - RNA, 23 nt, Human
gucucucuuuccucuucuguucc

SEQ ID NO: 680711 - RNA, 23 nt, Human
guuacaaaauagacacacauaca

SEQ ID NO: 680712 - RNA, 18 nt, Human
uauuuuauuuuccuguuc

SEQ ID NO: 680713 - RNA, 20 nt, Human
ucaaauuaaauaugaaucag

SEQ ID NO: 680714 - RNA, 22 nt, Human
ucaauaaauaucgaaaccucuc

SEQ ID NO: 680715 - RNA, 19 nt, Human
ucaggaacagccaccaaua

SEQ ID NO: 680716 - RNA, 21 nt, Human
uccuucaggaacagccaccaa

SEQ ID NO: 680717 - RNA, 18 nt, Human
ucugcagcugugucucuc

SEQ ID NO: 680718 - RNA, 25 nt, Human
ugaaucaggauugaacuaacuuggg

SEQ ID NO: 680719 - RNA, 25 nt, Human
ugagaaauguugaccacacacugug

SEQ ID NO: 680720 - RNA, 19 nt, Human
ugcagcugugucucucuuu

SEQ ID NO: 680721 - RNA, 18 nt, Human
ugccuuacaagaaagaca

SEQ ID NO: 680722 - RNA, 19 nt, Human
uggcaaggagcugccugug

SEQ ID NO: 680723 - RNA, 20 nt, Human
uggcaaggagcugccugugg

SEQ ID NO: 680724 - RNA, 18 nt, Human
uuaggcgcaauccaggug

SEQ ID NO: 680725 - RNA, 21 nt, Human
uuucccugccgucacauugau

SEQ ID NO: 680726 - RNA, 18 nt, Human
uuucuuggauuccucagc

SEQ ID NO: 680727 - RNA, 21 nt, Human
aagcaagacauaaaaugucua

SEQ ID NO: 680728 - RNA, 24 nt, Human
aagcaagacauaaaaugucuaagg

SEQ ID NO: 680729 - RNA, 19 nt, Human
aaguagaacccucguaaga

SEQ ID NO: 680730 - RNA, 23 nt, Human
acgcugcagaauggacauuaaac

SEQ ID NO: 680731 - RNA, 20 nt, Human
caagacauaaaaugucuaag

SEQ ID NO: 680732 - RNA, 19 nt, Human
cacaucuuuaaauaacagc

SEQ ID NO: 680733 - RNA, 20 nt, Human
cacauuaaguccuuuccagc

SEQ ID NO: 680734 - RNA, 25 nt, Human
cacauuuaaaacccaucauauucca

SEQ ID NO: 680735 - RNA, 20 nt, Human
cacccuccaguuccccaccc

SEQ ID NO: 680736 - RNA, 21 nt, Human
cacccuccaguuccccacccu

SEQ ID NO: 680737 - RNA, 20 nt, Human
cacccuccaguuccccaccu

SEQ ID NO: 680738 - RNA, 18 nt, Human
cagcagacgcgucgggaa

SEQ ID NO: 680739 - RNA, 21 nt, Human
cauuuaaaacccaucauauuc

SEQ ID NO: 680740 - RNA, 23 nt, Human
cauuucaauccccccacccucca

SEQ ID NO: 680741 - RNA, 22 nt, Human
cccccacccuccaguuccccac

SEQ ID NO: 680742 - RNA, 19 nt, Human
gcugcuguucucuuuuuca

SEQ ID NO: 680743 - RNA, 22 nt, Human
gucauuuguacaaauguaacag

SEQ ID NO: 680744 - RNA, 23 nt, Human
gucauuuguacaaauguaacagu

SEQ ID NO: 680745 - RNA, 23 nt, Human
uaagaaauagucaaacacauuaa

SEQ ID NO: 680746 - RNA, 19 nt, Human
uacaagcaagacauaaaau

SEQ ID NO: 680747 - RNA, 20 nt, Human
uagauguguacauacauucc

SEQ ID NO: 680748 - RNA, 19 nt, Human
ucuaagggaaacuucagca

SEQ ID NO: 680749 - RNA, 20 nt, Human
ugaaacacacucacaucuuu

SEQ ID NO: 680750 - RNA, 24 nt, Human
ugcccuacaagcaagacauaaaau

SEQ ID NO: 680751 - RNA, 20 nt, Human
uggcugacacauuauggucu

SEQ ID NO: 680752 - RNA, 24 nt, Human
ugucauuuaucaagguggcugaca

SEQ ID NO: 680753 - RNA, 22 nt, Human
ugugcgagaagcgggagagcug

SEQ ID NO: 680754 - RNA, 24 nt, Human
uguguacauacauucccuuacccu

SEQ ID NO: 680755 - RNA, 19 nt, Human
uugaauaaauaacaacuga

SEQ ID NO: 680756 - RNA, 18 nt, Human
aggaccaucucuucuggg

SEQ ID NO: 680757 - RNA, 19 nt, Human
agguucgggggggcccugc

SEQ ID NO: 680758 - RNA, 21 nt, Human
auccagggggugcggugucug

SEQ ID NO: 680759 - RNA, 19 nt, Human
caaggacaaaccccugccc

SEQ ID NO: 680760 - RNA, 21 nt, Human
cagggggugcggugucugguc

SEQ ID NO: 680761 - RNA, 23 nt, Human
cagguucgggggggcccugcugg

SEQ ID NO: 680762 - RNA, 20 nt, Human
cauguccacuccaagagcag

SEQ ID NO: 680763 - RNA, 20 nt, Human
ccagggggugcggugucugg

SEQ ID NO: 680764 - RNA, 22 nt, Human
ccagggggugcggugucugguc

SEQ ID NO: 680765 - RNA, 20 nt, Human
ccaggucaucugccugcacc

SEQ ID NO: 680766 - RNA, 22 nt, Human
cggaaccgccagccacccgcca

SEQ ID NO: 680767 - RNA, 18 nt, Human
cggccuguggaggccccu

SEQ ID NO: 680768 - RNA, 24 nt, Human
cucagaccuaacggaaccgccagc

SEQ ID NO: 680769 - RNA, 19 nt, Human
gaggccccuggggguggcu

SEQ ID NO: 680770 - RNA, 22 nt, Human
gccccgaggggcuggccagcuc

SEQ ID NO: 680771 - RNA, 26 nt, Human
gccuguggaggccccuggggguggcu

SEQ ID NO: 680772 - RNA, 21 nt, Human
ggaaccgccagccacccgcca

SEQ ID NO: 680773 - RNA, 18 nt, Human
ggaggccccugggggugg

SEQ ID NO: 680774 - RNA, 19 nt, Human
ucaccaggucaucugccug

SEQ ID NO: 680775 - RNA, 22 nt, Human
ucacccauccgucugaccugga

SEQ ID NO: 680776 - RNA, 22 nt, Human
ucagaccuaacggaaccgccag

SEQ ID NO: 680777 - RNA, 18 nt, Human
uccaagagcaguagcacc

SEQ ID NO: 680778 - RNA, 22 nt, Human
uccacuccaagagcaguagcac

SEQ ID NO: 680779 - RNA, 18 nt, Human
ucgggggggcccugcugg

SEQ ID NO: 680780 - RNA, 18 nt, Human
ucucuucugggcugaaga

SEQ ID NO: 680781 - RNA, 20 nt, Human
ugagcaggguccccucggcu

SEQ ID NO: 680782 - RNA, 21 nt, Human
uggaggccccuggggguggcu

SEQ ID NO: 680783 - RNA, 26 nt, Human
uggcugggccuguguccugagcccuc

SEQ ID NO: 680784 - RNA, 24 nt, Human
ugggcugaagagcaucuucaccag

SEQ ID NO: 680785 - RNA, 20 nt, Human
ugugcagguucgggggggcc

SEQ ID NO: 680786 - RNA, 20 nt, Human
uucagagaggccuccgcucc

SEQ ID NO: 680787 - RNA, 23 nt, Human
aaaacaaaaaaugaaaaaaaccc

SEQ ID NO: 680788 - RNA, 23 nt, Human
aaaacaaaacaaaacaaaacaag

SEQ ID NO: 680789 - RNA, 23 nt, Human
aaaacaaaacaagaaaaacaaaa

SEQ ID NO: 680790 - RNA, 25 nt, Human
aaacaaaacaaaacaaaacaagaaa

SEQ ID NO: 680791 - RNA, 22 nt, Human
aagaaaacuccaaaaccaugca

SEQ ID NO: 680792 - RNA, 25 nt, Human
aagaacaaaacaaaacaaaacaaaa

SEQ ID NO: 680793 - RNA, 23 nt, Human
aagaagaacaaaacaaaacaaaa

SEQ ID NO: 680794 - RNA, 19 nt, Human
aagcacaccaagaagaaca

SEQ ID NO: 680795 - RNA, 20 nt, Human
aagcauggauaucacaaacc

SEQ ID NO: 680796 - RNA, 18 nt, Human
aaguacaugcaaaaaagc

SEQ ID NO: 680797 - RNA, 21 nt, Human
acaaaaaaugaaaaaaacccc

SEQ ID NO: 680798 - RNA, 21 nt, Human
acaaaacaaaacaaaacaaaa

SEQ ID NO: 680799 - RNA, 28 nt, Human
acaaaacaaaacaagaaaaacaaaaaag

SEQ ID NO: 680800 - RNA, 23 nt, Human
acaaaacaagaaaaacaaaaaau

SEQ ID NO: 680801 - RNA, 22 nt, Human
acaagaaaaacaaaaaaugaaa

SEQ ID NO: 680802 - RNA, 20 nt, Human
acaccaagaagaacaaaaca

SEQ ID NO: 680803 - RNA, 19 nt, Human
accaagaagaacaaaacaa

SEQ ID NO: 680804 - RNA, 21 nt, Human
acugaagacugccccaaauac

SEQ ID NO: 680805 - RNA, 23 nt, Human
agaaaaacaaaaaaugaaaaaaa

SEQ ID NO: 680806 - RNA, 22 nt, Human
agaaaacuccaaaaccaugcaa

SEQ ID NO: 680807 - RNA, 23 nt, Human
aucaaguacaugcaaaaaagcuu

SEQ ID NO: 680808 - RNA, 23 nt, Human
aucccacagugucccaaggcagu

SEQ ID NO: 680809 - RNA, 21 nt, Human
caaaaaagcuuucauuucacc

SEQ ID NO: 680810 - RNA, 23 nt, Human
caaaaagcacaccaagaagaaca

SEQ ID NO: 680811 - RNA, 23 nt, Human
caaaaagcacaccaagaagaaca

SEQ ID NO: 680812 - RNA, 21 nt, Human
caaaacaaaacaaaacaaaac

SEQ ID NO: 680813 - RNA, 25 nt, Human
caaaacaaaacaaaacaaaacaaga

SEQ ID NO: 680814 - RNA, 22 nt, Human
caaaacaaaacaagaaaaacaa

SEQ ID NO: 680815 - RNA, 21 nt, Human
cacaaaaaaagcaaagucuga

SEQ ID NO: 680816 - RNA, 27 nt, Human
cacaccaagaagaacaaaacaaaacaa

SEQ ID NO: 680817 - RNA, 19 nt, Human
cacagcacacacaaaaguu

SEQ ID NO: 680818 - RNA, 22 nt, Human
cacagcacacacaaaaguuuau

SEQ ID NO: 680819 - RNA, 21 nt, Human
cacaucaucugcaguauuucc

SEQ ID NO: 680820 - RNA, 19 nt, Human
caccaagaagaacaaaaca

SEQ ID NO: 680821 - RNA, 23 nt, Human
caccaagaagaacaaaacaaaac

SEQ ID NO: 680822 - RNA, 24 nt, Human
caccaagaagaacaaaacaaaaca

SEQ ID NO: 680823 - RNA, 21 nt, Human
cacugcauuccagugucugac

SEQ ID NO: 680824 - RNA, 21 nt, Human
cagcaucagauagaccaucuc

SEQ ID NO: 680825 - RNA, 24 nt, Human
caggaaaauguuaaguucuggucc

SEQ ID NO: 680826 - RNA, 21 nt, Human
caucuagggauggcugccuuc

SEQ ID NO: 680827 - RNA, 21 nt, Human
caugggcugucagcucccaag

SEQ ID NO: 680828 - RNA, 23 nt, Human
ccaaaaagcacaccaagaagaac

SEQ ID NO: 680829 - RNA, 24 nt, Human
ccaaaaagcacaccaagaagaaca

SEQ ID NO: 680830 - RNA, 24 nt, Human
ccaagaagaacaaaacaaaacaaa

SEQ ID NO: 680831 - RNA, 19 nt, Human
ccauccaaaaagcacacca

SEQ ID NO: 680832 - RNA, 25 nt, Human
cccaaauacaaacaaauuccauuuu

SEQ ID NO: 680833 - RNA, 18 nt, Human
cccacagugucccaaggc

SEQ ID NO: 680834 - RNA, 21 nt, Human
cccaugggcugucagcuccca

SEQ ID NO: 680835 - RNA, 24 nt, Human
ccuccaacugauaacuucacauca

SEQ ID NO: 680836 - RNA, 19 nt, Human
cucaggaaaauguuaaguu

SEQ ID NO: 680837 - RNA, 18 nt, Human
cuccauaaucaugcaagu

SEQ ID NO: 680838 - RNA, 18 nt, Human
cuccuccaacugauaacu

SEQ ID NO: 680839 - RNA, 21 nt, Human
cugccacagcacacacaaaag

SEQ ID NO: 680840 - RNA, 24 nt, Human
cugcccagaacagguacucaacaa

SEQ ID NO: 680841 - RNA, 22 nt, Human
cuggaacuacuuugccuuaaug

SEQ ID NO: 680842 - RNA, 19 nt, Human
gaaauguuaaucaaauaug

SEQ ID NO: 680843 - RNA, 22 nt, Human
gaacaaaacaaaacaaaacaaa

SEQ ID NO: 680844 - RNA, 18 nt, Human
gaagaaauagacccauaa

SEQ ID NO: 680845 - RNA, 18 nt, Human
gcacaccaagaagaacaa

SEQ ID NO: 680846 - RNA, 23 nt, Human
gcacaccaagaagaacaaaacaa

SEQ ID NO: 680847 - RNA, 22 nt, Human
gccccaaauacaaacaaauucc

SEQ ID NO: 680848 - RNA, 23 nt, Human
ggaauauauacacuuuagccccc

SEQ ID NO: 680849 - RNA, 18 nt, Human
ggacaagcauaauuuucu

SEQ ID NO: 680850 - RNA, 23 nt, Human
ggacaagcauaauuuucuuccau

SEQ ID NO: 680851 - RNA, 21 nt, Human
guaucuuuccagauaacuucc

SEQ ID NO: 680852 - RNA, 20 nt, Human
gucagagcuuucuucagagg

SEQ ID NO: 680853 - RNA, 22 nt, Human
guggaaggcaguuucuuaggaa

SEQ ID NO: 680854 - RNA, 23 nt, Human
uaaacaguuucuccuugcaguug

SEQ ID NO: 680855 - RNA, 23 nt, Human
uaacuuugugcauauagcguggg

SEQ ID NO: 680856 - RNA, 23 nt, Human
uacaaacaaauuccauuuuaaau

SEQ ID NO: 680857 - RNA, 21 nt, Human
uacuucaagaaaacuccaaaa

SEQ ID NO: 680858 - RNA, 20 nt, Human
uacuuugccuuaaugcccau

SEQ ID NO: 680859 - RNA, 21 nt, Human
uaggaagggaacaaggguucu

SEQ ID NO: 680860 - RNA, 21 nt, Human
uaggagagcuuucacgaccau

SEQ ID NO: 680861 - RNA, 23 nt, Human
uaguuauuuuggguaaaugggag

SEQ ID NO: 680862 - RNA, 20 nt, Human
uauuuuaaaucacuggaacu

SEQ ID NO: 680863 - RNA, 20 nt, Human
ucaagaaaacuccaaaacca

SEQ ID NO: 680864 - RNA, 20 nt, Human
ucaauggagaaaagaaagga

SEQ ID NO: 680865 - RNA, 21 nt, Human
ucacugcauuccagugucuga

SEQ ID NO: 680866 - RNA, 22 nt, Human
ucacugcauuccagugucugau

SEQ ID NO: 680867 - RNA, 18 nt, Human
ucagauagaccaucucca

SEQ ID NO: 680868 - RNA, 25 nt, Human
uccaaaaagcacaccaagaagaaca

SEQ ID NO: 680869 - RNA, 25 nt, Human
uccaaucuguaaaucugguuggcac

SEQ ID NO: 680870 - RNA, 18 nt, Human
ucccaagggcuaagacca

SEQ ID NO: 680871 - RNA, 21 nt, Human
ucccugccacagcacacacaa

SEQ ID NO: 680872 - RNA, 24 nt, Human
ucccugccacagcacacacaaaag

SEQ ID NO: 680873 - RNA, 20 nt, Human
ucucacaaaaaaagcaaagu

SEQ ID NO: 680874 - RNA, 21 nt, Human
ucucacaaaaaaagcaaaguc

SEQ ID NO: 680875 - RNA, 19 nt, Human
ucugguuggcacaaguugg

SEQ ID NO: 680876 - RNA, 24 nt, Human
ugaccuguccuuaguuguacuuca

SEQ ID NO: 680877 - RNA, 21 nt, Human
ugagaaaaguacugacuacau

SEQ ID NO: 680878 - RNA, 23 nt, Human
ugagaagcaaaagaacaguacaa

SEQ ID NO: 680879 - RNA, 18 nt, Human
ugagagucagagcuuucu

SEQ ID NO: 680880 - RNA, 18 nt, Human
ugagcuuccuaguccuca

SEQ ID NO: 680881 - RNA, 19 nt, Human
ugauuuaugauuauuuucu

SEQ ID NO: 680882 - RNA, 20 nt, Human
ugccacagcacacacaaaag

SEQ ID NO: 680883 - RNA, 21 nt, Human
ugcccagaacagguacucaac

SEQ ID NO: 680884 - RNA, 18 nt, Human
uggaagaaauagacccau

SEQ ID NO: 680885 - RNA, 19 nt, Human
uggauaguaguagauagug

SEQ ID NO: 680886 - RNA, 27 nt, Human
ugggaaggauguaaacagucgaccucc

SEQ ID NO: 680887 - RNA, 22 nt, Human
uguaauauacaugaaaccaaca

SEQ ID NO: 680888 - RNA, 19 nt, Human
ugugauauauacaugugug

SEQ ID NO: 680889 - RNA, 18 nt, Human
ugugugauauauacaugu

SEQ ID NO: 680890 - RNA, 19 nt, Human
ugugugauauauacaugug

SEQ ID NO: 680891 - RNA, 23 nt, Human
ugugugauauauacaugugugac

SEQ ID NO: 680892 - RNA, 21 nt, Human
uucacccguauauaaaugguc

SEQ ID NO: 680893 - RNA, 22 nt, Human
uuccugagagucagagcuuucu

SEQ ID NO: 680894 - RNA, 18 nt, Human
uucuuaggaagggaacaa

SEQ ID NO: 680895 - RNA, 27 nt, Human
uugaaucaaguucucucuccucuaauc

SEQ ID NO: 680896 - RNA, 19 nt, Human
uuuacugaagacugcccca

SEQ ID NO: 680897 - RNA, 21 nt, Human
uuucacgaccaugcuauagcu

SEQ ID NO: 680898 - RNA, 19 nt, Human
aaaaagccagggagggaca

SEQ ID NO: 680899 - RNA, 21 nt, Human
aaaccgccaaauugucauuua

SEQ ID NO: 680900 - RNA, 18 nt, Human
aaagcaaaugaggagacu

SEQ ID NO: 680901 - RNA, 22 nt, Human
aaauugucauuuacacuaagcu

SEQ ID NO: 680902 - RNA, 21 nt, Human
aagaugugcaaaugaaaugcu

SEQ ID NO: 680903 - RNA, 24 nt, Human
aaguacagcuuuauccauaaaccc

SEQ ID NO: 680904 - RNA, 18 nt, Human
accagucuggacuguucu

SEQ ID NO: 680905 - RNA, 20 nt, Human
acccaaaacaccaaaaucau

SEQ ID NO: 680906 - RNA, 22 nt, Human
acccuuauuaucuggagccccu

SEQ ID NO: 680907 - RNA, 21 nt, Human
accugucagaaaccugggcaa

SEQ ID NO: 680908 - RNA, 24 nt, Human
acugauuuuuuuccuaucuagagc

SEQ ID NO: 680909 - RNA, 21 nt, Human
acugccacauugugacagaag

SEQ ID NO: 680910 - RNA, 23 nt, Human
agaagacauagucucucuuccag

SEQ ID NO: 680911 - RNA, 19 nt, Human
agaagcaauuaacccaaaa

SEQ ID NO: 680912 - RNA, 20 nt, Human
agaagcaauuaacccaaaac

SEQ ID NO: 680913 - RNA, 18 nt, Human
agagcacucaauucacag

SEQ ID NO: 680914 - RNA, 19 nt, Human
auaucccaaguccaagaaa

SEQ ID NO: 680915 - RNA, 19 nt, Human
aucagagcacucaauucac

SEQ ID NO: 680916 - RNA, 20 nt, Human
cagcugcuccagcagcgaug

SEQ ID NO: 680917 - RNA, 24 nt, Human
caguccacuaugaaacuuuucuua

SEQ ID NO: 680918 - RNA, 23 nt, Human
ccaaaaaaagccagggagggaca

SEQ ID NO: 680919 - RNA, 23 nt, Human
ccaaaacaccaaaaucauuuccc

SEQ ID NO: 680920 - RNA, 20 nt, Human
ccaaaccauaccaguucaaa

SEQ ID NO: 680921 - RNA, 19 nt, Human
ccagcagcgauggugcucg

SEQ ID NO: 680922 - RNA, 20 nt, Human
ccaguucaaaggucugaaac

SEQ ID NO: 680923 - RNA, 21 nt, Human
ccaguucaaaggucugaaacc

SEQ ID NO: 680924 - RNA, 20 nt, Human
cccaaaccaaaaaaagccag

SEQ ID NO: 680925 - RNA, 19 nt, Human
cccugagaacaggaacaag

SEQ ID NO: 680926 - RNA, 24 nt, Human
cccuuaggucuaccccaaaccaaa

SEQ ID NO: 680927 - RNA, 20 nt, Human
ccuagcaguugcugcuaaua

SEQ ID NO: 680928 - RNA, 23 nt, Human
ccugggcaaauuuaauuuuaaga

SEQ ID NO: 680929 - RNA, 25 nt, Human
cuaccccaaaccaaaaaaagccagg

SEQ ID NO: 680930 - RNA, 21 nt, Human
cucaauucacaggcaaaaaaa

SEQ ID NO: 680931 - RNA, 25 nt, Human
cuccagcagcgauggugcucgugcc

SEQ ID NO: 680932 - RNA, 23 nt, Human
cugauuuuuuuccuaucuagagc

SEQ ID NO: 680933 - RNA, 23 nt, Human
cugguggcagucgucacccugag

SEQ ID NO: 680934 - RNA, 22 nt, Human
cuuugcuuuggugaauguuugg

SEQ ID NO: 680935 - RNA, 21 nt, Human
gaacaggaacaaggcaaagaa

SEQ ID NO: 680936 - RNA, 22 nt, Human
gagaacaggaacaaggcaaaga

SEQ ID NO: 680937 - RNA, 22 nt, Human
gagaacaggaacaaggcaaaga

SEQ ID NO: 680938 - RNA, 24 nt, Human
gcgcagggccugaaggcagcugcu

SEQ ID NO: 680939 - RNA, 20 nt, Human
gcuuuauccauaaacccuuc

SEQ ID NO: 680940 - RNA, 21 nt, Human
ggaacuguauaucccaagucc

SEQ ID NO: 680941 - RNA, 22 nt, Human
ggucugaaaccguucuuugcuu

SEQ ID NO: 680942 - RNA, 23 nt, Human
guuuugagacuaacaaacacccu

SEQ ID NO: 680943 - RNA, 21 nt, Human
uaaaaagcaaaugaggagacu

SEQ ID NO: 680944 - RNA, 18 nt, Human
uaaaaccgccaaauuguc

SEQ ID NO: 680945 - RNA, 21 nt, Human
uacgccuuuagcacaaggcuu

SEQ ID NO: 680946 - RNA, 20 nt, Human
uagaagcaauuaacccaaaa

SEQ ID NO: 680947 - RNA, 21 nt, Human
uaggucuaccccaaaccaaaa

SEQ ID NO: 680948 - RNA, 25 nt, Human
uauaaaacaaagaccauauuuuuaa

SEQ ID NO: 680949 - RNA, 22 nt, Human
uaucccaaguccaagaaagaug

SEQ ID NO: 680950 - RNA, 21 nt, Human
ucaauucacaggcaaaaaaaa

SEQ ID NO: 680951 - RNA, 20 nt, Human
ucacccugagaacaggaacu

SEQ ID NO: 680952 - RNA, 19 nt, Human
ucagagcacucaauucaca

SEQ ID NO: 680953 - RNA, 19 nt, Human
uccaagaaagaugugcaaa

SEQ ID NO: 680954 - RNA, 22 nt, Human
ucccaaguccaagaaagaugug

SEQ ID NO: 680955 - RNA, 22 nt, Human
ucucucuuccagguaucaccug

SEQ ID NO: 680956 - RNA, 24 nt, Human
ugaaaugcuucuugcuucacccuu

SEQ ID NO: 680957 - RNA, 19 nt, Human
ugaaggcagcugcuccagc

SEQ ID NO: 680958 - RNA, 24 nt, Human
ugaggagacugauuuuuuuccuau

SEQ ID NO: 680959 - RNA, 18 nt, Human
uggaacuguauaucccaa

SEQ ID NO: 680960 - RNA, 24 nt, Human
uguuucacuccaugagaaguuuua

SEQ ID NO: 680961 - RNA, 26 nt, Human
uuaaagaacacugcugaauaaaaaua

SEQ ID NO: 680962 - RNA, 25 nt, Human
uugguuaaaauaaaucacuguuuca

SEQ ID NO: 680963 - RNA, 25 nt, Human
uuuaaauucaagugaagccauuaau

SEQ ID NO: 680964 - RNA, 24 nt, Human
uuuauccauaaacccuucacacaa

SEQ ID NO: 680965 - RNA, 20 nt, Human
aaacagaauccaucacggca

SEQ ID NO: 680966 - RNA, 19 nt, Human
aaagucagggaggagggga

SEQ ID NO: 680967 - RNA, 19 nt, Human
aacauggugaaaccccguc

SEQ ID NO: 680968 - RNA, 20 nt, Human
aacauggugaaaccccgucu

SEQ ID NO: 680969 - RNA, 21 nt, Human
aacauggugaaaccccgucuc

SEQ ID NO: 680970 - RNA, 23 nt, Human
aagaucgugcuacugcacuccag

SEQ ID NO: 680971 - RNA, 19 nt, Human
aagcaggaagcaagaucag

SEQ ID NO: 680972 - RNA, 21 nt, Human
aagcaggaagcaagaucagag

SEQ ID NO: 680973 - RNA, 25 nt, Human
aagcaggaagcaagaucagagccag

SEQ ID NO: 680974 - RNA, 24 nt, Human
aaucacuuuaacccaggaggcgga

SEQ ID NO: 680975 - RNA, 25 nt, Human
aaugaaccccuuccaggggagccca

SEQ ID NO: 680976 - RNA, 18 nt, Human
acacaggccacaccaggc

SEQ ID NO: 680977 - RNA, 23 nt, Human
acagaccaagacuccgucucaaa

SEQ ID NO: 680978 - RNA, 23 nt, Human
acccacaccuccaauuuggugca

SEQ ID NO: 680979 - RNA, 24 nt, Human
acccaggaggcggagguugcagug

SEQ ID NO: 680980 - RNA, 24 nt, Human
accccgucucuacuaaaaauacaa

SEQ ID NO: 680981 - RNA, 22 nt, Human
acuccgucucaaacaaacaaac

SEQ ID NO: 680982 - RNA, 18 nt, Human
acugcacuccagccuggg

SEQ ID NO: 680983 - RNA, 18 nt, Human
acugcacuccagccuggg

SEQ ID NO: 680984 - RNA, 19 nt, Human
acugcacuccagccugggc

SEQ ID NO: 680985 - RNA, 19 nt, Human
acugcacuccagccugggc

SEQ ID NO: 680986 - RNA, 19 nt, Human
acugcacuccagccugggc

SEQ ID NO: 680987 - RNA, 21 nt, Human
acugcacuccagccugggcga

SEQ ID NO: 680988 - RNA, 22 nt, Human
acugcacuccagccugggcgac

SEQ ID NO: 680989 - RNA, 23 nt, Human
acugcacuccagccugggcgaca

SEQ ID NO: 680990 - RNA, 24 nt, Human
acugcacuccagccugggcgacag

SEQ ID NO: 680991 - RNA, 19 nt, Human
agcacucugggaggccggg

SEQ ID NO: 680992 - RNA, 22 nt, Human
agccuggccaacauggugaaac

SEQ ID NO: 680993 - RNA, 24 nt, Human
agccuggccaacauggugaaaccc

SEQ ID NO: 680994 - RNA, 24 nt, Human
agccugggcgacagaccaagacuc

SEQ ID NO: 680995 - RNA, 19 nt, Human
aggaagacaacgggcagaa

SEQ ID NO: 680996 - RNA, 19 nt, Human
aggaaggaauccgacacac

SEQ ID NO: 680997 - RNA, 18 nt, Human
aggaauccgacacacagg

SEQ ID NO: 680998 - RNA, 24 nt, Human
aggcggagguugcagugagccaag

SEQ ID NO: 680999 - RNA, 24 nt, Human
aucgugcuacugcacuccagccug

SEQ ID NO: 681000 - RNA, 19 nt, Human
caaaaaacuggguucuggg

SEQ ID NO: 681001 - RNA, 19 nt, Human
caaacaaaaaacuggguuc

SEQ ID NO: 681002 - RNA, 24 nt, Human
caacauggugaaaccccgucucua

SEQ ID NO: 681003 - RNA, 22 nt, Human
cacagcaccagccucuaaaguc

SEQ ID NO: 681004 - RNA, 23 nt, Human
caccaggccacacaagucucugg

SEQ ID NO: 681005 - RNA, 23 nt, Human
cacgccuguaaucccaacccagc

SEQ ID NO: 681006 - RNA, 19 nt, Human
cacuguauaucccccgagu

SEQ ID NO: 681007 - RNA, 24 nt, Human
cagaauccaucacggcagcccaca

SEQ ID NO: 681008 - RNA, 22 nt, Human
cagaccaagacuccgucucaaa

SEQ ID NO: 681009 - RNA, 23 nt, Human
cagaccaagacuccgucucaaac

SEQ ID NO: 681010 - RNA, 27 nt, Human
cagaucacuugagaucaagaauuugag

SEQ ID NO: 681011 - RNA, 24 nt, Human
cagcacucugggaggccggggcgg

SEQ ID NO: 681012 - RNA, 23 nt, Human
cagcagccaaaacuggguccuga

SEQ ID NO: 681013 - RNA, 21 nt, Human
cagccucuaaagucagggagg

SEQ ID NO: 681014 - RNA, 19 nt, Human
ccagccucuaaagucaggg

SEQ ID NO: 681015 - RNA, 21 nt, Human
cccacacggagaaauccuggc

SEQ ID NO: 681016 - RNA, 20 nt, Human
cccccgaguccccugcuggg

SEQ ID NO: 681017 - RNA, 23 nt, Human
ccgucucaaacaaacaaacaaaa

SEQ ID NO: 681018 - RNA, 23 nt, Human
ccuggccaacauggugaaacccc

SEQ ID NO: 681019 - RNA, 24 nt, Human
ccuggccaacauggugaaaccccg

SEQ ID NO: 681020 - RNA, 19 nt, Human
ccuguaaucccagcuaccu

SEQ ID NO: 681021 - RNA, 21 nt, Human
ccuguaaucccagcuaccugg

SEQ ID NO: 681022 - RNA, 22 nt, Human
cgacacacaggccacaccaggc

SEQ ID NO: 681023 - RNA, 20 nt, Human
cgccuguaaucccaacccag

SEQ ID NO: 681024 - RNA, 24 nt, Human
cggacagaucacuugagaucaaga

SEQ ID NO: 681025 - RNA, 26 nt, Human
cggggcggacagaucacuugagauca

SEQ ID NO: 681026 - RNA, 25 nt, Human
cgucucaaacaaacaaacaaaaaac

SEQ ID NO: 681027 - RNA, 21 nt, Human
cuacugcacuccagccugggc

SEQ ID NO: 681028 - RNA, 24 nt, Human
cuacugcacuccagccugggcgac

SEQ ID NO: 681029 - RNA, 23 nt, Human
cucaaacaaacaaacaaaaaacc

SEQ ID NO: 681030 - RNA, 19 nt, Human
cucacgccuguaaucccaa

SEQ ID NO: 681031 - RNA, 26 nt, Human
cucacgccuguaaucccaacccagca

SEQ ID NO: 681032 - RNA, 24 nt, Human
cugagccggacgcgguggcucacg

SEQ ID NO: 681033 - RNA, 19 nt, Human
cuggguucuggggacacag

SEQ ID NO: 681034 - RNA, 19 nt, Human
gaaccagcagccaaaacug

SEQ ID NO: 681035 - RNA, 20 nt, Human
gaaccagcagccaaaacugg

SEQ ID NO: 681036 - RNA, 21 nt, Human
gacagaccaagacuccgucuc

SEQ ID NO: 681037 - RNA, 21 nt, Human
gaggcggagguugcagugagc

SEQ ID NO: 681038 - RNA, 23 nt, Human
gagguugcagugagccaagaucg

SEQ ID NO: 681039 - RNA, 24 nt, Human
gaucacuugagaucaagaauuuga

SEQ ID NO: 681040 - RNA, 20 nt, Human
gcagccacuguauauccccc

SEQ ID NO: 681041 - RNA, 18 nt, Human
gcaggaagcaagaucaga

SEQ ID NO: 681042 - RNA, 24 nt, Human
gccaacauggugaaaccccgucuc

SEQ ID NO: 681043 - RNA, 20 nt, Human
gcccugguuaaaccgaguuc

SEQ ID NO: 681044 - RNA, 22 nt, Human
gcuacugcacuccagccugggc

SEQ ID NO: 681045 - RNA, 24 nt, Human
gcuacugcacuccagccugggcga

SEQ ID NO: 681046 - RNA, 20 nt, Human
ggaaggaauccgacacacag

SEQ ID NO: 681047 - RNA, 24 nt, Human
ggacgcgguggcucacgccuguaa

SEQ ID NO: 681048 - RNA, 20 nt, Human
ggagguugcagugagccaag

SEQ ID NO: 681049 - RNA, 23 nt, Human
ggagguugcagugagccaagauc

SEQ ID NO: 681050 - RNA, 24 nt, Human
ggagguugcagugagccaagaucg

SEQ ID NO: 681051 - RNA, 26 nt, Human
ggaucagagccaggccuucuagagaa

SEQ ID NO: 681052 - RNA, 19 nt, Human
gggaguggucuuacagagc

SEQ ID NO: 681053 - RNA, 23 nt, Human
gggugggaguggucuuacagagc

SEQ ID NO: 681054 - RNA, 24 nt, Human
gggugugguggcacaugccuguaa

SEQ ID NO: 681055 - RNA, 24 nt, Human
gguggcacaugccuguaaucccag

SEQ ID NO: 681056 - RNA, 23 nt, Human
gguggcucacgccuguaauccca

SEQ ID NO: 681057 - RNA, 23 nt, Human
gucagggaggaggggagaggguc

SEQ ID NO: 681058 - RNA, 22 nt, Human
guggcucacgccuguaauccca

SEQ ID NO: 681059 - RNA, 20 nt, Human
gugggaguggucuuacagag

SEQ ID NO: 681060 - RNA, 25 nt, Human
gugggaguggucuuacagagcccug

SEQ ID NO: 681061 - RNA, 20 nt, Human
uaaagucagggaggagggga

SEQ ID NO: 681062 - RNA, 22 nt, Human
uacugcacuccagccugggcga

SEQ ID NO: 681063 - RNA, 23 nt, Human
uacugcacuccagccugggcgac

SEQ ID NO: 681064 - RNA, 24 nt, Human
uacugcacuccagccugggcgaca

SEQ ID NO: 681065 - RNA, 19 nt, Human
ucaaaugggucacagcuga

SEQ ID NO: 681066 - RNA, 19 nt, Human
ucaacagaccugaaugaac

SEQ ID NO: 681067 - RNA, 19 nt, Human
ucagagccagugggacgcc

SEQ ID NO: 681068 - RNA, 22 nt, Human
ucaggccucuuccugguccuuu

SEQ ID NO: 681069 - RNA, 18 nt, Human
uccagccugggcgacaga

SEQ ID NO: 681070 - RNA, 23 nt, Human
ucgugcuacugcacuccagccug

SEQ ID NO: 681071 - RNA, 21 nt, Human
ucucuacuaaaaauacaaaaa

SEQ ID NO: 681072 - RNA, 22 nt, Human
ucuuuggugagaggggucacug

SEQ ID NO: 681073 - RNA, 24 nt, Human
ucuuuggugagaggggucacugga

SEQ ID NO: 681074 - RNA, 23 nt, Human
ugagaccagccuggccaacaugg

SEQ ID NO: 681075 - RNA, 24 nt, Human
ugagaccagccuggccaacauggu

SEQ ID NO: 681076 - RNA, 22 nt, Human
ugagccaagaucgugcuacugc

SEQ ID NO: 681077 - RNA, 21 nt, Human
ugagccggacgcgguggcuca

SEQ ID NO: 681078 - RNA, 23 nt, Human
ugccuguaaucccagcuaccugg

SEQ ID NO: 681079 - RNA, 24 nt, Human
ugccuguaaucccagcuaccuggg

SEQ ID NO: 681080 - RNA, 21 nt, Human
uggcacaugccuguaauccca

SEQ ID NO: 681081 - RNA, 24 nt, Human
uggccaacauggugaaaccccguc

SEQ ID NO: 681082 - RNA, 21 nt, Human
uggcucacgccuguaauccca

SEQ ID NO: 681083 - RNA, 27 nt, Human
uggcucacgccuguaaucccaacccag

SEQ ID NO: 681084 - RNA, 24 nt, Human
ugggagacugagcugagagaauca

SEQ ID NO: 681085 - RNA, 20 nt, Human
ugggaggccggggcggacag

SEQ ID NO: 681086 - RNA, 24 nt, Human
ugggaggccggggcggacagauca

SEQ ID NO: 681087 - RNA, 21 nt, Human
uggggacacaggucaaauggg

SEQ ID NO: 681088 - RNA, 19 nt, Human
uggugagaggggucacugg

SEQ ID NO: 681089 - RNA, 24 nt, Human
ugguggcacaugccuguaauccca

SEQ ID NO: 681090 - RNA, 20 nt, Human
uuaacggggugugguggcac

SEQ ID NO: 681091 - RNA, 22 nt, Human
uugcagugagccaagaucgugc

SEQ ID NO: 681092 - RNA, 21 nt, Human
uuggaggaacccacaccucca

SEQ ID NO: 681093 - RNA, 24 nt, Human
uuuaacccaggaggcggagguugc

SEQ ID NO: 681094 - RNA, 18 nt, Human
uuuuuuuuuuuuuuuuug

SEQ ID NO: 681095 - RNA, 20 nt, Human
uuuuuuuuuuuuuuuuuguu

SEQ ID NO: 681096 - RNA, 19 nt, Human
aaaaaaagaaaaauugcaa

SEQ ID NO: 681097 - RNA, 24 nt, Human
aaaaauugcaagggagcauuuaac

SEQ ID NO: 681098 - RNA, 22 nt, Human
aaaaugaaaagugggguaggcg

SEQ ID NO: 681099 - RNA, 26 nt, Human
aaacaaaaaaaagaaaaauugcaagg

SEQ ID NO: 681100 - RNA, 22 nt, Human
aaacaaaaagagaaaggaaaca

SEQ ID NO: 681101 - RNA, 23 nt, Human
aaacaaaaagagaaaggaaacaa

SEQ ID NO: 681102 - RNA, 27 nt, Human
aaacccucauuguucaaaagcaaaaca

SEQ ID NO: 681103 - RNA, 21 nt, Human
aaagugggguaggcggaagug

SEQ ID NO: 681104 - RNA, 23 nt, Human
aacaaacaaacaaaaaaaagaaa

SEQ ID NO: 681105 - RNA, 21 nt, Human
aaccuucucuccuuucuaucu

SEQ ID NO: 681106 - RNA, 23 nt, Human
aacuguuccuucccugaauccua

SEQ ID NO: 681107 - RNA, 22 nt, Human
aagcaccagaggccauagaucc

SEQ ID NO: 681108 - RNA, 20 nt, Human
aagccaaacaaaaagagaaa

SEQ ID NO: 681109 - RNA, 25 nt, Human
aaggaaacaagcacgggucuaccgg

SEQ ID NO: 681110 - RNA, 19 nt, Human
aagugagguacugggaaca

SEQ ID NO: 681111 - RNA, 20 nt, Human
aauaggggagaggggaaaaa

SEQ ID NO: 681112 - RNA, 24 nt, Human
aaucaccccgucucccccuacccc

SEQ ID NO: 681113 - RNA, 23 nt, Human
aauccccaucccacgccucuugc

SEQ ID NO: 681114 - RNA, 19 nt, Human
acaaaaaaaaacccgcugg

SEQ ID NO: 681115 - RNA, 20 nt, Human
acaaaaaaaaacccgcugga

SEQ ID NO: 681116 - RNA, 22 nt, Human
acaaaaaaaaacccgcuggaga

SEQ ID NO: 681117 - RNA, 22 nt, Human
acaaaaaaaagaaaaauugcaa

SEQ ID NO: 681118 - RNA, 30 nt, Human
acaaaacagaauagcuuguuaaaggacagg

SEQ ID NO: 681119 - RNA, 25 nt, Human
acaaacaaaaaaaagaaaaauugca

SEQ ID NO: 681120 - RNA, 21 nt, Human
acagaagaggggcugcgugga

SEQ ID NO: 681121 - RNA, 25 nt, Human
acggggcggaggagcccgcgguagu

SEQ ID NO: 681122 - RNA, 20 nt, Human
agaaaagccguaauaaaaaa

SEQ ID NO: 681123 - RNA, 20 nt, Human
agaaaggaaacaagcacggg

SEQ ID NO: 681124 - RNA, 23 nt, Human
agaacuggaucucguccuggaau

SEQ ID NO: 681125 - RNA, 22 nt, Human
agacaaauguuuaguugcgauc

SEQ ID NO: 681126 - RNA, 22 nt, Human
agagacagaaauacucaaacaa

SEQ ID NO: 681127 - RNA, 22 nt, Human
agaggggaggggacagaagagg

SEQ ID NO: 681128 - RNA, 18 nt, Human
agccagaauccgcgcugc

SEQ ID NO: 681129 - RNA, 19 nt, Human
agccagaauccgcgcugca

SEQ ID NO: 681130 - RNA, 24 nt, Human
agccguaauaaaaaacauuuugcc

SEQ ID NO: 681131 - RNA, 23 nt, Human
agcuccagcgggcucccauccau

SEQ ID NO: 681132 - RNA, 18 nt, Human
agcugcguacccuggccc

SEQ ID NO: 681133 - RNA, 21 nt, Human
aggaaaaagaauuauaaaugu

SEQ ID NO: 681134 - RNA, 21 nt, Human
aggagcccgcgguaguuugug

SEQ ID NO: 681135 - RNA, 21 nt, Human
aggcauaaagcauccaagagu

SEQ ID NO: 681136 - RNA, 18 nt, Human
aggggagaggggaaaaaa

SEQ ID NO: 681137 - RNA, 19 nt, Human
aggggcugcguggagaaag

SEQ ID NO: 681138 - RNA, 25 nt, Human
aggguggggggcguguaaggggggg

SEQ ID NO: 681139 - RNA, 21 nt, Human
auccaucucaccccaaucccc

SEQ ID NO: 681140 - RNA, 23 nt, Human
auguuaaaaaaaaaaaaaaaccc

SEQ ID NO: 681141 - RNA, 19 nt, Human
caaaaagagaaaggaaaca

SEQ ID NO: 681142 - RNA, 22 nt, Human
caaaaagagaaaggaaacaagc

SEQ ID NO: 681143 - RNA, 28 nt, Human
caaaaauuaaacaaacaaacaaaaaaaa

SEQ ID NO: 681144 - RNA, 18 nt, Human
caaaauagaaucaagggc

SEQ ID NO: 681145 - RNA, 24 nt, Human
caaaauagaaucaagggcaaaucu

SEQ ID NO: 681146 - RNA, 24 nt, Human
caaagcaccagaggccauagaucc

SEQ ID NO: 681147 - RNA, 23 nt, Human
caacaaaagauugcaaaagcugg

SEQ ID NO: 681148 - RNA, 19 nt, Human
caagggcaaauccauggcc

SEQ ID NO: 681149 - RNA, 20 nt, Human
cacagcaccaucuucagaau

SEQ ID NO: 681150 - RNA, 19 nt, Human
caccccaauccccauccca

SEQ ID NO: 681151 - RNA, 21 nt, Human
caccccgucucccccuacccc

SEQ ID NO: 681152 - RNA, 23 nt, Human
cacggacccaauugacacaaaac

SEQ ID NO: 681153 - RNA, 24 nt, Human
cagaaauacucaaacaaggaaaaa

SEQ ID NO: 681154 - RNA, 21 nt, Human
cagaauagcuuguuaaaggac

SEQ ID NO: 681155 - RNA, 21 nt, Human
cagaauccgcgcugcaccccc

SEQ ID NO: 681156 - RNA, 21 nt, Human
cagcuccuugaagguuuuccu

SEQ ID NO: 681157 - RNA, 18 nt, Human
cagguaaugcauccugga

SEQ ID NO: 681158 - RNA, 19 nt, Human
cauaaagcauccaagaguc

SEQ ID NO: 681159 - RNA, 22 nt, Human
caugaaaaaggaguuggauuuc

SEQ ID NO: 681160 - RNA, 24 nt, Human
cauuuacauacuagaguccacgug

SEQ ID NO: 681161 - RNA, 21 nt, Human
ccaaaaacaggaccauuucac

SEQ ID NO: 681162 - RNA, 20 nt, Human
ccaaacaaaaagagaaagga

SEQ ID NO: 681163 - RNA, 20 nt, Human
ccaucuucagaauguuaaaa

SEQ ID NO: 681164 - RNA, 19 nt, Human
cccaacgcguuagaagcca

SEQ ID NO: 681165 - RNA, 22 nt, Human
cccauccaucucaccccaaucc

SEQ ID NO: 681166 - RNA, 22 nt, Human
ccccaaaugggcgccgccggau

SEQ ID NO: 681167 - RNA, 21 nt, Human
ccccaauccccaucccacgcc

SEQ ID NO: 681168 - RNA, 21 nt, Human
ccccagagaaaagaggggacc

SEQ ID NO: 681169 - RNA, 21 nt, Human
cccccagagaaaagaggggac

SEQ ID NO: 681170 - RNA, 23 nt, Human
cccccagagaaaagaggggaccg

SEQ ID NO: 681171 - RNA, 18 nt, Human
ccccccagagaaaagagg

SEQ ID NO: 681172 - RNA, 22 nt, Human
cccccggaagaacuccuuuccg

SEQ ID NO: 681173 - RNA, 20 nt, Human
cccccuucagggagcaaagc

SEQ ID NO: 681174 - RNA, 19 nt, Human
cccguaauugaaguacugg

SEQ ID NO: 681175 - RNA, 18 nt, Human
cccgucucccccuacccc

SEQ ID NO: 681176 - RNA, 25 nt, Human
ccgagcccggcucccggggguccuc

SEQ ID NO: 681177 - RNA, 20 nt, Human
ccgcacuuuuaguuacucug

SEQ ID NO: 681178 - RNA, 24 nt, Human
ccgccgcgcggaggucagcacagg

SEQ ID NO: 681179 - RNA, 18 nt, Human
ccgccuugucuccugguu

SEQ ID NO: 681180 - RNA, 23 nt, Human
ccugcgggcgcugcaaggggagc

SEQ ID NO: 681181 - RNA, 22 nt, Human
cgccgcacuuuuaguuacucug

SEQ ID NO: 681182 - RNA, 22 nt, Human
cgccggauaccucgucugcucc

SEQ ID NO: 681183 - RNA, 23 nt, Human
cucagcaaagaggaaugccuguc

SEQ ID NO: 681184 - RNA, 23 nt, Human
cucagucccaacgcguuagaagc

SEQ ID NO: 681185 - RNA, 22 nt, Human
cuccaaaaauuaaacaaacaaa

SEQ ID NO: 681186 - RNA, 25 nt, Human
cuccaaaaauuaaacaaacaaacaa

SEQ ID NO: 681187 - RNA, 21 nt, Human
cucccauccaucucaccccaa

SEQ ID NO: 681188 - RNA, 22 nt, Human
cucccgacgcgacccccaggcc

SEQ ID NO: 681189 - RNA, 23 nt, Human
cucuccuuucuaucuuccauuuu

SEQ ID NO: 681190 - RNA, 24 nt, Human
cugcaggcgccucggugccacuga

SEQ ID NO: 681191 - RNA, 30 nt, Human
cuucagaauguuaaaaaaaaaaaaaaaccc

SEQ ID NO: 681192 - RNA, 19 nt, Human
cuucuugacacagcaccau

SEQ ID NO: 681193 - RNA, 20 nt, Human
cuugcuaaaaucucaggcca

SEQ ID NO: 681194 - RNA, 21 nt, Human
cuuucuucuucccuuuucuuu

SEQ ID NO: 681195 - RNA, 23 nt, Human
cuuuuccuuucuucuucccuuuu

SEQ ID NO: 681196 - RNA, 18 nt, Human
gaaagaguuagaagcccc

SEQ ID NO: 681197 - RNA, 22 nt, Human
gacccccaggccggcuuccgaa

SEQ ID NO: 681198 - RNA, 24 nt, Human
gaccguguauuuaaaaauuaaagg

SEQ ID NO: 681199 - RNA, 21 nt, Human
gagcugcagcgcagggcuccc

SEQ ID NO: 681200 - RNA, 19 nt, Human
gagcugcguacccuggccc

SEQ ID NO: 681201 - RNA, 22 nt, Human
gcaauagaaaagccguaauaaa

SEQ ID NO: 681202 - RNA, 21 nt, Human
gcacacgacaaacaaaaaaaa

SEQ ID NO: 681203 - RNA, 22 nt, Human
gcacacgacaaacaaaaaaaaa

SEQ ID NO: 681204 - RNA, 20 nt, Human
gcugcagcgcagggcucccg

SEQ ID NO: 681205 - RNA, 21 nt, Human
ggaccguguauuuaaaaauua

SEQ ID NO: 681206 - RNA, 21 nt, Human
ggagcugcguacccuggcccu

SEQ ID NO: 681207 - RNA, 22 nt, Human
ggaggggacagaagaggggcug

SEQ ID NO: 681208 - RNA, 22 nt, Human
gggcacagaguugcggcgcggg

SEQ ID NO: 681209 - RNA, 18 nt, Human
gggcgccgccggauaccu

SEQ ID NO: 681210 - RNA, 20 nt, Human
gggcucccgacgcgaccccc

SEQ ID NO: 681211 - RNA, 19 nt, Human
ggggcguguaagggggggg

SEQ ID NO: 681212 - RNA, 20 nt, Human
ggggggcguguaaggggggg

SEQ ID NO: 681213 - RNA, 19 nt, Human
ggggugcgggagagggcag

SEQ ID NO: 681214 - RNA, 20 nt, Human
ggggugcgggagagggcagu

SEQ ID NO: 681215 - RNA, 22 nt, Human
ggguaggcggaaguggcccaag

SEQ ID NO: 681216 - RNA, 19 nt, Human
gguggaaaggguggggggc

SEQ ID NO: 681217 - RNA, 26 nt, Human
gguuggcuuguuuaaaagaaaaaaaa

SEQ ID NO: 681218 - RNA, 21 nt, Human
guguguguguccccggcgugg

SEQ ID NO: 681219 - RNA, 18 nt, Human
guuaaaaaaaaaaaaaaa

SEQ ID NO: 681220 - RNA, 19 nt, Human
uaaaaaauaggggagaggg

SEQ ID NO: 681221 - RNA, 18 nt, Human
uaaaaggaucauucucug

SEQ ID NO: 681222 - RNA, 24 nt, Human
uaaaaggaucauucucuguaaaga

SEQ ID NO: 681223 - RNA, 18 nt, Human
uaaggggggggugcggga

SEQ ID NO: 681224 - RNA, 27 nt, Human
uaauuugcaaucaccccgucucccccu

SEQ ID NO: 681225 - RNA, 20 nt, Human
uaccccaaagcagucggcga

SEQ ID NO: 681226 - RNA, 25 nt, Human
uacugggaacacaaauauuuaugcc

SEQ ID NO: 681227 - RNA, 22 nt, Human
uagaaaagccguaauaaaaaac

SEQ ID NO: 681228 - RNA, 21 nt, Human
uagaagaaaugaguugaagug

SEQ ID NO: 681229 - RNA, 22 nt, Human
uagaagcccccaaaugggcgcc

SEQ ID NO: 681230 - RNA, 18 nt, Human
uagauggcgucugaggcu

SEQ ID NO: 681231 - RNA, 19 nt, Human
uagcuuccuugccacggac

SEQ ID NO: 681232 - RNA, 23 nt, Human
uaggacaaaaacauuaaaccaaa

SEQ ID NO: 681233 - RNA, 19 nt, Human
uaggcggaaguggcccaag

SEQ ID NO: 681234 - RNA, 19 nt, Human
uagggaagacaagcuccag

SEQ ID NO: 681235 - RNA, 20 nt, Human
uaucauacagcaauagaaaa

SEQ ID NO: 681236 - RNA, 23 nt, Human
uaucauacagcaauagaaaagcc

SEQ ID NO: 681237 - RNA, 19 nt, Human
ucagagacagaaauacuca

SEQ ID NO: 681238 - RNA, 19 nt, Human
ucagccaggcaauucgugu

SEQ ID NO: 681239 - RNA, 22 nt, Human
ucagccaggcaauucguguccc

SEQ ID NO: 681240 - RNA, 18 nt, Human
ucccauccaucucacccc

SEQ ID NO: 681241 - RNA, 23 nt, Human
uccccaccaugcaugucaccaac

SEQ ID NO: 681242 - RNA, 18 nt, Human
ucccccggaagaacuccu

SEQ ID NO: 681243 - RNA, 23 nt, Human
ucccugaauccuaacaagaaguu

SEQ ID NO: 681244 - RNA, 18 nt, Human
ucccuuuucuuucccccu

SEQ ID NO: 681245 - RNA, 23 nt, Human
uccuggaaccugcuaagucuccg

SEQ ID NO: 681246 - RNA, 19 nt, Human
ucgcacacgacaaacaaaa

SEQ ID NO: 681247 - RNA, 19 nt, Human
ucgcucacuccuggaaccu

SEQ ID NO: 681248 - RNA, 21 nt, Human
ucgugucccccggaagaacuc

SEQ ID NO: 681249 - RNA, 23 nt, Human
ucucccccuaccccgagaccaaa

SEQ ID NO: 681250 - RNA, 23 nt, Human
ucucuacugaggguuuuuguccc

SEQ ID NO: 681251 - RNA, 22 nt, Human
ucugucaggaucugcaacuauu

SEQ ID NO: 681252 - RNA, 18 nt, Human
ucuugcuugcccccccca

SEQ ID NO: 681253 - RNA, 23 nt, Human
ugaagccgcccuccugggaacgu

SEQ ID NO: 681254 - RNA, 22 nt, Human
ugacacagcaccaucuucagaa

SEQ ID NO: 681255 - RNA, 18 nt, Human
ugaccaggauauuaaaua

SEQ ID NO: 681256 - RNA, 18 nt, Human
ugaggcagagaguuuuga

SEQ ID NO: 681257 - RNA, 25 nt, Human
ugccacggacccaauugacacaaaa

SEQ ID NO: 681258 - RNA, 21 nt, Human
ugcuaaggugcggagcugccg

SEQ ID NO: 681259 - RNA, 26 nt, Human
ugcuacguggucagucagcuccuuga

SEQ ID NO: 681260 - RNA, 23 nt, Human
ugcuaucaucucagcaaagagga

SEQ ID NO: 681261 - RNA, 18 nt, Human
uggaaaggguggggggcg

SEQ ID NO: 681262 - RNA, 21 nt, Human
uggaauaauuugcaaucaccc

SEQ ID NO: 681263 - RNA, 19 nt, Human
uggaugaguacccgggcug

SEQ ID NO: 681264 - RNA, 24 nt, Human
uggcaagggguggucucccaggcu

SEQ ID NO: 681265 - RNA, 23 nt, Human
ugggaacacaaauauuuaugcca

SEQ ID NO: 681266 - RNA, 22 nt, Human
ugggaacgugaggacagggcuc

SEQ ID NO: 681267 - RNA, 22 nt, Human
uguaaagaaaacuaaauagcug

SEQ ID NO: 681268 - RNA, 20 nt, Human
uguaaggggggggugcggga

SEQ ID NO: 681269 - RNA, 23 nt, Human
ugucaccaaccucuccuccucca

SEQ ID NO: 681270 - RNA, 20 nt, Human
ugucccccggaagaacuccu

SEQ ID NO: 681271 - RNA, 24 nt, Human
ugucucuacugaggguuuuugucc

SEQ ID NO: 681272 - RNA, 25 nt, Human
uguuagggaagacaagcuccagcgg

SEQ ID NO: 681273 - RNA, 18 nt, Human
uucacaaaacauauacag

SEQ ID NO: 681274 - RNA, 23 nt, Human
uucccgcuugucucuacugaggg

SEQ ID NO: 681275 - RNA, 26 nt, Human
uugaagguuuuccugcucugaaccaa

SEQ ID NO: 681276 - RNA, 27 nt, Human
uuuauacaugugggacaaccugcuuug

SEQ ID NO: 681277 - RNA, 23 nt, Human
uuuccuuucuucuucccuuuucu

SEQ ID NO: 681278 - RNA, 21 nt, Human
uuuguuuuggagaaaauugac

SEQ ID NO: 681279 - RNA, 24 nt, Human
uuuguuuuggagaaaauugacggc

SEQ ID NO: 681280 - RNA, 22 nt, Human
acuggccacuccugggcagcag

SEQ ID NO: 681281 - RNA, 19 nt, Human
aggccuggggucagcaguc

SEQ ID NO: 681282 - RNA, 22 nt, Human
aggcggccagggagaagucagc

SEQ ID NO: 681283 - RNA, 22 nt, Human
cacuggccacuccugggcagca

SEQ ID NO: 681284 - RNA, 22 nt, Human
ccucagcaggcggccagggaga

SEQ ID NO: 681285 - RNA, 19 nt, Human
cuggccacuccugggcagc

SEQ ID NO: 681286 - RNA, 20 nt, Human
cuggcgauggagagcuccuc

SEQ ID NO: 681287 - RNA, 23 nt, Human
gaaucaccaggccuggggucagc

SEQ ID NO: 681288 - RNA, 18 nt, Human
ggguauggaggaggggcc

SEQ ID NO: 681289 - RNA, 20 nt, Human
ggguauggaggaggggccca

SEQ ID NO: 681290 - RNA, 21 nt, Human
guaucuugaaucccgagcaac

SEQ ID NO: 681291 - RNA, 20 nt, Human
uaucuugaaucccgagcaac

SEQ ID NO: 681292 - RNA, 23 nt, Human
ucaauagcaaggccaaggccaag

SEQ ID NO: 681293 - RNA, 20 nt, Human
ugaaucccgagcaacgccgg

SEQ ID NO: 681294 - RNA, 20 nt, Human
uuuuuuuuuuuuuuucccag

SEQ ID NO: 681295 - RNA, 23 nt, Human
uuuuuuuuuuuuuuuuucccagg

SEQ ID NO: 681296 - RNA, 18 nt, Human
acuucuuucagaacauuu

SEQ ID NO: 681297 - RNA, 18 nt, Human
agcugacuggaaaccugu

SEQ ID NO: 681298 - RNA, 20 nt, Human
agcugacuggaaaccuguga

SEQ ID NO: 681299 - RNA, 24 nt, Human
aggggucuugcuauguugaccagg

SEQ ID NO: 681300 - RNA, 18 nt, Human
aguagcugggacuacagg

SEQ ID NO: 681301 - RNA, 19 nt, Human
aguagcugggacuacaggc

SEQ ID NO: 681302 - RNA, 23 nt, Human
aguuuauuuauuuaaaaaaauag

SEQ ID NO: 681303 - RNA, 20 nt, Human
caagcgauccuccugccuca

SEQ ID NO: 681304 - RNA, 22 nt, Human
caagcgauccuccugccucagc

SEQ ID NO: 681305 - RNA, 27 nt, Human
caagcgauccuccugccucagccuccc

SEQ ID NO: 681306 - RNA, 20 nt, Human
caccagaggcuucaagacca

SEQ ID NO: 681307 - RNA, 19 nt, Human
cagaacauuuguuaucagc

SEQ ID NO: 681308 - RNA, 20 nt, Human
cagcaccagaggcuucaaga

SEQ ID NO: 681309 - RNA, 23 nt, Human
cccgaguagcugggacuacaggc

SEQ ID NO: 681310 - RNA, 24 nt, Human
cccgaguagcugggacuacaggcg

SEQ ID NO: 681311 - RNA, 24 nt, Human
ccuccugccucagccucccgagua

SEQ ID NO: 681312 - RNA, 20 nt, Human
ccuccuguggggacggaggu

SEQ ID NO: 681313 - RNA, 23 nt, Human
ccugccucagccucccgaguagc

SEQ ID NO: 681314 - RNA, 24 nt, Human
cucaagcgauccuccugccucagc

SEQ ID NO: 681315 - RNA, 24 nt, Human
cucagccucccgaguagcugggac

SEQ ID NO: 681316 - RNA, 25 nt, Human
cucuugggcucaagcgauccuccug

SEQ ID NO: 681317 - RNA, 23 nt, Human
cugccucagccucccgaguagcu

SEQ ID NO: 681318 - RNA, 20 nt, Human
cuugggcucaagcgauccuc

SEQ ID NO: 681319 - RNA, 22 nt, Human
gacuacaggcgcacgccacugc

SEQ ID NO: 681320 - RNA, 26 nt, Human
gaguagcugggacuacaggcgcacgc

SEQ ID NO: 681321 - RNA, 21 nt, Human
gcaccagaggcuucaagacca

SEQ ID NO: 681322 - RNA, 24 nt, Human
gcgauccuccugccucagccuccc

SEQ ID NO: 681323 - RNA, 19 nt, Human
ggcucaagcgauccuccug

SEQ ID NO: 681324 - RNA, 20 nt, Human
gggcucaagcgauccuccug

SEQ ID NO: 681325 - RNA, 22 nt, Human
gggcucaagcgauccuccugcc

SEQ ID NO: 681326 - RNA, 22 nt, Human
gggucuugcuauguugaccagg

SEQ ID NO: 681327 - RNA, 23 nt, Human
uagagacaggggucuugcuaugu

SEQ ID NO: 681328 - RNA, 21 nt, Human
uagauaugaacucuugggcuc

SEQ ID NO: 681329 - RNA, 18 nt, Human
uauguugaccaggcuaga

SEQ ID NO: 681330 - RNA, 24 nt, Human
uauguugaccaggcuagauaugaa

SEQ ID NO: 681331 - RNA, 23 nt, Human
ucagccucccgaguagcugggac

SEQ ID NO: 681332 - RNA, 24 nt, Human
ucccgaguagcugggacuacaggc

SEQ ID NO: 681333 - RNA, 23 nt, Human
ucggggcaguaagauacauuuag

SEQ ID NO: 681334 - RNA, 19 nt, Human
ucuugcuauguugaccagg

SEQ ID NO: 681335 - RNA, 22 nt, Human
ucuugggcucaagcgauccucc

SEQ ID NO: 681336 - RNA, 28 nt, Human
ugaaaagcugacuggaaaccugugagaa

SEQ ID NO: 681337 - RNA, 24 nt, Human
ugaccaggcuagauaugaacucuu

SEQ ID NO: 681338 - RNA, 24 nt, Human
ugagaaugggaguuccacccuccu

SEQ ID NO: 681339 - RNA, 24 nt, Human
ugccucagccucccgaguagcugg

SEQ ID NO: 681340 - RNA, 26 nt, Human
uggaaaccugugagaaugggaguucc

SEQ ID NO: 681341 - RNA, 21 nt, Human
ugggacuacaggcgcacgcca

SEQ ID NO: 681342 - RNA, 22 nt, Human
ugggacuacaggcgcacgccac

SEQ ID NO: 681343 - RNA, 22 nt, Human
ugggacuacaggcgcacgccac

SEQ ID NO: 681344 - RNA, 24 nt, Human
ugggacuacaggcgcacgccacug

SEQ ID NO: 681345 - RNA, 18 nt, Human
ugggaguuccacccuccu

SEQ ID NO: 681346 - RNA, 24 nt, Human
ugggcucaagcgauccuccugccu

SEQ ID NO: 681347 - RNA, 18 nt, Human
uuuuuuuuuuuuguuuuc

SEQ ID NO: 681348 - RNA, 23 nt, Human
uuuuuuuuuuuuuuuuguuuuca

SEQ ID NO: 681349 - RNA, 24 nt, Human
uuuuuuuuuuuuuuuuuuuguuuu

SEQ ID NO: 681350 - RNA, 27 nt, Human
uuuuuuuuuuuuuuuuuuuuuuugggg

SEQ ID NO: 681351 - RNA, 18 nt, Human
ccccgcagccagcccgcc

SEQ ID NO: 681352 - RNA, 18 nt, Human
aacaaagggguccccgga

SEQ ID NO: 681353 - RNA, 18 nt, Human
acacgggcagucaagccc

SEQ ID NO: 681354 - RNA, 19 nt, Human
cagucaagcccuuggggac

SEQ ID NO: 681355 - RNA, 18 nt, Human
cccggagagggcuggucc

SEQ ID NO: 681356 - RNA, 19 nt, Human
cccugggagccgcgcagac

SEQ ID NO: 681357 - RNA, 19 nt, Human
ccgcucggcucaggcuccu

SEQ ID NO: 681358 - RNA, 25 nt, Human
ccggcaguucgcggcgaccccucuc

SEQ ID NO: 681359 - RNA, 18 nt, Human
cucuaguguucuaagcuu

SEQ ID NO: 681360 - RNA, 23 nt, Human
gggcagucaagcccuuggggacg

SEQ ID NO: 681361 - RNA, 20 nt, Human
uccucuucacgccgcacccu

SEQ ID NO: 681362 - RNA, 21 nt, Human
ugcccgagucacaacagaagc

SEQ ID NO: 681363 - RNA, 26 nt, Human
uggcgucugggcugggaacaaagggg

SEQ ID NO: 681364 - RNA, 22 nt, Human
ugggaacaaagggguccccgga

SEQ ID NO: 681365 - RNA, 19 nt, Human
ugggcugggaacaaagggg

SEQ ID NO: 681366 - RNA, 23 nt, Human
aaaagcccaccacaggggugagg

SEQ ID NO: 681367 - RNA, 21 nt, Human
aaaccuuacuguggaaacuaa

SEQ ID NO: 681368 - RNA, 18 nt, Human
aagaggagacgggcuggg

SEQ ID NO: 681369 - RNA, 24 nt, Human
acccuguccuucucuucccucccc

SEQ ID NO: 681370 - RNA, 18 nt, Human
acucauuuaccucugccc

SEQ ID NO: 681371 - RNA, 23 nt, Human
agcuguaggaggggcggggccag

SEQ ID NO: 681372 - RNA, 19 nt, Human
aggaggggcggggccaggu

SEQ ID NO: 681373 - RNA, 20 nt, Human
agggaagggaagaggagacg

SEQ ID NO: 681374 - RNA, 23 nt, Human
agggacucauuuaccucugcccu

SEQ ID NO: 681375 - RNA, 19 nt, Human
aggggugaggcuggugagg

SEQ ID NO: 681376 - RNA, 18 nt, Human
aggucugggggaggggag

SEQ ID NO: 681377 - RNA, 26 nt, Human
cacccuguccuucucuucccucccca

SEQ ID NO: 681378 - RNA, 22 nt, Human
cagccagggcaggagcuugaug

SEQ ID NO: 681379 - RNA, 24 nt, Human
caucaggagcucucuccacucccc

SEQ ID NO: 681380 - RNA, 25 nt, Human
ccagccgccgccgcugccgccgccu

SEQ ID NO: 681381 - RNA, 21 nt, Human
cccagccccucuuggggcucc

SEQ ID NO: 681382 - RNA, 19 nt, Human
ccccaacacccuguccuuc

SEQ ID NO: 681383 - RNA, 23 nt, Human
ccccacaaccaguuaaaauccuc

SEQ ID NO: 681384 - RNA, 26 nt, Human
ccccccuucccagccccucuuggggc

SEQ ID NO: 681385 - RNA, 18 nt, Human
cccuguccuucucuuccc

SEQ ID NO: 681386 - RNA, 18 nt, Human
ccgccgccgcugccgccg

SEQ ID NO: 681387 - RNA, 20 nt, Human
ccgccgccucccccgggccc

SEQ ID NO: 681388 - RNA, 21 nt, Human
ccgccgccucccccgggcccu

SEQ ID NO: 681389 - RNA, 24 nt, Human
ccgccgcugccgccgccucccccg

SEQ ID NO: 681390 - RNA, 21 nt, Human
ccgggcccuggccucuuccag

SEQ ID NO: 681391 - RNA, 20 nt, Human
ccuucucuucccuccccaca

SEQ ID NO: 681392 - RNA, 20 nt, Human
cgagcacaggcccaggcugc

SEQ ID NO: 681393 - RNA, 21 nt, Human
cgagcacaggcccaggcugcg

SEQ ID NO: 681394 - RNA, 20 nt, Human
cggggccagguuggacggug

SEQ ID NO: 681395 - RNA, 20 nt, Human
cuccacuccccuggcccucc

SEQ ID NO: 681396 - RNA, 23 nt, Human
cucuccacuccccuggcccucca

SEQ ID NO: 681397 - RNA, 18 nt, Human
cuguccuucucuucccuc

SEQ ID NO: 681398 - RNA, 18 nt, Human
gaagggugcuuggugggg

SEQ ID NO: 681399 - RNA, 21 nt, Human
gagcucucuccacuccccugg

SEQ ID NO: 681400 - RNA, 25 nt, Human
gccccagccgccgccgcugccgccg

SEQ ID NO: 681401 - RNA, 21 nt, Human
gccgccgccucccccgggccc

SEQ ID NO: 681402 - RNA, 18 nt, Human
ggagcucucuccacuccc

SEQ ID NO: 681403 - RNA, 21 nt, Human
ggaggagguggaggucugggg

SEQ ID NO: 681404 - RNA, 25 nt, Human
ggaggucugggggaggggagggggc

SEQ ID NO: 681405 - RNA, 21 nt, Human
ggcagaggacaggaggggagu

SEQ ID NO: 681406 - RNA, 18 nt, Human
ggccccccuucccagccc

SEQ ID NO: 681407 - RNA, 24 nt, Human
gggacacaggaggggagggggucu

SEQ ID NO: 681408 - RNA, 21 nt, Human
gggacuggagguggggacagg

SEQ ID NO: 681409 - RNA, 19 nt, Human
gggcaggagcuugaugggc

SEQ ID NO: 681410 - RNA, 19 nt, Human
gggcccuggccucuuccag

SEQ ID NO: 681411 - RNA, 22 nt, Human
ggggaggggagggggccaaggg

SEQ ID NO: 681412 - RNA, 23 nt, Human
ggggaggggagggggccaagggg

SEQ ID NO: 681413 - RNA, 24 nt, Human
ggggaggggagggggccaaggggg

SEQ ID NO: 681414 - RNA, 25 nt, Human
ggggaggggagggggccaagggggu

SEQ ID NO: 681415 - RNA, 24 nt, Human
ggucuggaggagguggaggucugg

SEQ ID NO: 681416 - RNA, 18 nt, Human
ggugagggagggacugga

SEQ ID NO: 681417 - RNA, 22 nt, Human
uaaaaagcccaccacaggggug

SEQ ID NO: 681418 - RNA, 24 nt, Human
uaccucugcccucuagucuagggg

SEQ ID NO: 681419 - RNA, 24 nt, Human
ucccagauggaaguggaagggugc

SEQ ID NO: 681420 - RNA, 18 nt, Human
uccucauccccccaacac

SEQ ID NO: 681421 - RNA, 18 nt, Human
ucucuucccuccccacaa

SEQ ID NO: 681422 - RNA, 22 nt, Human
ugaggagggaguagaccuuggg

SEQ ID NO: 681423 - RNA, 24 nt, Human
ugaggcuggugagggagggacugg

SEQ ID NO: 681424 - RNA, 19 nt, Human
ugcccgggcugccccagcc

SEQ ID NO: 681425 - RNA, 18 nt, Human
uggaaacuaagacaucaa

SEQ ID NO: 681426 - RNA, 26 nt, Human
uggaggagguggaggucugggggagg

SEQ ID NO: 681427 - RNA, 20 nt, Human
uggccccccuucccagcccc

SEQ ID NO: 681428 - RNA, 19 nt, Human
ugggggaggggagggggcc

SEQ ID NO: 681429 - RNA, 19 nt, Human
ugggggaggggagggggcc

SEQ ID NO: 681430 - RNA, 23 nt, Human
ugggggaggggagggggccaagg

SEQ ID NO: 681431 - RNA, 22 nt, Human
uugaugggcuauggccccccuu

SEQ ID NO: 681432 - RNA, 18 nt, Human
uuggacggugcgaaucga

SEQ ID NO: 681433 - RNA, 21 nt, Human
uuggggcucccagauggaagu

SEQ ID NO: 681434 - RNA, 21 nt, Human
aaagcugacaaaacaugaauu

SEQ ID NO: 681435 - RNA, 23 nt, Human
aacagaucucaacaugagaaagc

SEQ ID NO: 681436 - RNA, 18 nt, Human
acugcggcggcagcagcu

SEQ ID NO: 681437 - RNA, 20 nt, Human
acuguaggcaauuacgucca

SEQ ID NO: 681438 - RNA, 18 nt, Human
agcgacacgaaccuuagc

SEQ ID NO: 681439 - RNA, 18 nt, Human
aggaaggaaacuugaggg

SEQ ID NO: 681440 - RNA, 21 nt, Human
aggcagcuaagcgccgaugcu

SEQ ID NO: 681441 - RNA, 19 nt, Human
caacaugagaaagcugaca

SEQ ID NO: 681442 - RNA, 24 nt, Human
cacacacaaacacugacacacucu

SEQ ID NO: 681443 - RNA, 22 nt, Human
cauaacagaucucaacaugaga

SEQ ID NO: 681444 - RNA, 18 nt, Human
ccuaaaagaaaaugaaaa

SEQ ID NO: 681445 - RNA, 22 nt, Human
cucaacaugagaaagcugacaa

SEQ ID NO: 681446 - RNA, 19 nt, Human
cugcauucgcaacugcggc

SEQ ID NO: 681447 - RNA, 20 nt, Human
cugucaauucuccucacagu

SEQ ID NO: 681448 - RNA, 22 nt, Human
cuuuugcugucaauucuccuca

SEQ ID NO: 681449 - RNA, 19 nt, Human
gagcgggcucaacaggcca

SEQ ID NO: 681450 - RNA, 21 nt, Human
gagcgggcuccaccggcgggg

SEQ ID NO: 681451 - RNA, 21 nt, Human
ggcagugagggagcgggcuca

SEQ ID NO: 681452 - RNA, 21 nt, Human
gggcaguaaauaagaguaggu

SEQ ID NO: 681453 - RNA, 21 nt, Human
uaacacacacacaaacacuga

SEQ ID NO: 681454 - RNA, 18 nt, Human
uagguggugaacuuuugc

SEQ ID NO: 681455 - RNA, 20 nt, Human
uauccuaaaagaaaaugaaa

SEQ ID NO: 681456 - RNA, 20 nt, Human
ucacaguaucuugcagaggc

SEQ ID NO: 681457 - RNA, 19 nt, Human
uccuaaaagaaaaugaaaa

SEQ ID NO: 681458 - RNA, 21 nt, Human
ugacacacucugguuugcgug

SEQ ID NO: 681459 - RNA, 18 nt, Human
ugcuguguggcagugagg

SEQ ID NO: 681460 - RNA, 18 nt, Human
uggaacaaggguggucua

SEQ ID NO: 681461 - RNA, 20 nt, Human
uggaacaaggguggucuaaa

SEQ ID NO: 681462 - RNA, 22 nt, Human
uggaguauuuuauucacauguu

SEQ ID NO: 681463 - RNA, 23 nt, Human
uguggcagugagggagcgggcuc

SEQ ID NO: 681464 - RNA, 20 nt, Human
uuaaggcagcaagagcgaag

SEQ ID NO: 681465 - RNA, 23 nt, Human
uuagcugcaccgcggaggcagcu

SEQ ID NO: 681466 - RNA, 21 nt, Human
uucaucagugacauaacagau

SEQ ID NO: 681467 - RNA, 20 nt, Human
aaaaaaccugaaaacacuca

SEQ ID NO: 681468 - RNA, 25 nt, Human
aaaaaaccugaaaacacucauuugc

SEQ ID NO: 681469 - RNA, 20 nt, Human
aaaacaccaauuaacuguga

SEQ ID NO: 681470 - RNA, 26 nt, Human
aaacacagaagaauuaauaaacccga

SEQ ID NO: 681471 - RNA, 22 nt, Human
aaaccccucucuucuucaauuu

SEQ ID NO: 681472 - RNA, 20 nt, Human
aacacauaggaucccaucuc

SEQ ID NO: 681473 - RNA, 18 nt, Human
aacauuaugaaauguauu

SEQ ID NO: 681474 - RNA, 18 nt, Human
aacauuccaacuucuuaa

SEQ ID NO: 681475 - RNA, 24 nt, Human
aacugagcguauugcgggaacccg

SEQ ID NO: 681476 - RNA, 21 nt, Human
aagauuuuccucgcaccauac

SEQ ID NO: 681477 - RNA, 21 nt, Human
aagcaccucucugggcgauac

SEQ ID NO: 681478 - RNA, 19 nt, Human
aagguccuuuucaagaaaa

SEQ ID NO: 681479 - RNA, 23 nt, Human
aaucaugaucauucuugacagcc

SEQ ID NO: 681480 - RNA, 18 nt, Human
aaucucuauuauggauga

SEQ ID NO: 681481 - RNA, 23 nt, Human
acaguggagagauggggcccaga

SEQ ID NO: 681482 - RNA, 22 nt, Human
acccccccauuugcuuuaagga

SEQ ID NO: 681483 - RNA, 18 nt, Human
acggagccagucacaugc

SEQ ID NO: 681484 - RNA, 24 nt, Human
agaagccuuuaaauagcaaauuag

SEQ ID NO: 681485 - RNA, 22 nt, Human
agagauggggcccagagccacu

SEQ ID NO: 681486 - RNA, 21 nt, Human
agauggugcaucugucaccga

SEQ ID NO: 681487 - RNA, 20 nt, Human
agcgagagguaucgcuucug

SEQ ID NO: 681488 - RNA, 22 nt, Human
aggggcucccuuuggcugugaa

SEQ ID NO: 681489 - RNA, 21 nt, Human
augcagaaucucaggcccagc

SEQ ID NO: 681490 - RNA, 24 nt, Human
auguacauaugcuauacauacauu

SEQ ID NO: 681491 - RNA, 20 nt, Human
auuacaauaaaaagcacauu

SEQ ID NO: 681492 - RNA, 18 nt, Human
caaaaaaaccugaaaaca

SEQ ID NO: 681493 - RNA, 25 nt, Human
caaaaacaaaaaagucagauaauuc

SEQ ID NO: 681494 - RNA, 24 nt, Human
caauaauaaauaagguugggucaa

SEQ ID NO: 681495 - RNA, 24 nt, Human
cacauaggaucccaucucaggagc

SEQ ID NO: 681496 - RNA, 23 nt, Human
caguaaagauggagauauacaca

SEQ ID NO: 681497 - RNA, 27 nt, Human
cauaugcuauacauacauuuauuuaca

SEQ ID NO: 681498 - RNA, 24 nt, Human
cauauguacauaugcuauacauac

SEQ ID NO: 681499 - RNA, 19 nt, Human
caugcacacucucugccac

SEQ ID NO: 681500 - RNA, 19 nt, Human
cauuacauaaaugcauaua

SEQ ID NO: 681501 - RNA, 19 nt, Human
cccaaaagguaaauuaugg

SEQ ID NO: 681502 - RNA, 20 nt, Human
ccuacacauaacaaaauaug

SEQ ID NO: 681503 - RNA, 20 nt, Human
ccucgcaccauaccaaacuc

SEQ ID NO: 681504 - RNA, 21 nt, Human
ccuuuuuuucccuuuuccuug

SEQ ID NO: 681505 - RNA, 22 nt, Human
ccuuuuuuucccuuuuccuugu

SEQ ID NO: 681506 - RNA, 22 nt, Human
ccuuuuuuucccuuuuccuugu

SEQ ID NO: 681507 - RNA, 18 nt, Human
cuagauuaaacuucacug

SEQ ID NO: 681508 - RNA, 19 nt, Human
cucacaaagcauugcccaa

SEQ ID NO: 681509 - RNA, 24 nt, Human
cucacaugcacacucucugccaca

SEQ ID NO: 681510 - RNA, 18 nt, Human
cuccaacauuccaacuuc

SEQ ID NO: 681511 - RNA, 27 nt, Human
cuccuuuuuuucccuuuuccuuguuuu

SEQ ID NO: 681512 - RNA, 23 nt, Human
cucugccacacucgucacuuuag

SEQ ID NO: 681513 - RNA, 25 nt, Human
cucuucguuaucucugccagcuaau

SEQ ID NO: 681514 - RNA, 20 nt, Human
cugcacagcuuacaggacag

SEQ ID NO: 681515 - RNA, 19 nt, Human
cuugaaaacugcuccucag

SEQ ID NO: 681516 - RNA, 21 nt, Human
cuuggaaauucuugcaucucc

SEQ ID NO: 681517 - RNA, 18 nt, Human
cuuggagcagagucugca

SEQ ID NO: 681518 - RNA, 22 nt, Human
gaagagagggagaaucagaaau

SEQ ID NO: 681519 - RNA, 18 nt, Human
gaauagcagaaacaaagc

SEQ ID NO: 681520 - RNA, 24 nt, Human
gauauacacacauauguacauaug

SEQ ID NO: 681521 - RNA, 19 nt, Human
gcacuguguuguuaugcag

SEQ ID NO: 681522 - RNA, 24 nt, Human
gccacuuggaaagaacugugugag

SEQ ID NO: 681523 - RNA, 18 nt, Human
gcuuuuuuauuccucuca

SEQ ID NO: 681524 - RNA, 20 nt, Human
ggacaguggagagauggggc

SEQ ID NO: 681525 - RNA, 18 nt, Human
ggcaacuccucaucuagc

SEQ ID NO: 681526 - RNA, 22 nt, Human
ggcccagagccacuuggaaaga

SEQ ID NO: 681527 - RNA, 19 nt, Human
gggucuguagugaugggca

SEQ ID NO: 681528 - RNA, 24 nt, Human
ggugucuggaguugaauucagugc

SEQ ID NO: 681529 - RNA, 18 nt, Human
guacauaugcuauacaua

SEQ ID NO: 681530 - RNA, 23 nt, Human
guuuagcuagauuaaacuucacu

SEQ ID NO: 681531 - RNA, 22 nt, Human
guuuuuucuccuuuuuuucccu

SEQ ID NO: 681532 - RNA, 22 nt, Human
uaaaaacuugagacaacacagg

SEQ ID NO: 681533 - RNA, 20 nt, Human
uaaaauuauauuaguaggga

SEQ ID NO: 681534 - RNA, 22 nt, Human
uaacaaaauaugaauucccuga

SEQ ID NO: 681535 - RNA, 19 nt, Human
uaagaaaguucuuggaaau

SEQ ID NO: 681536 - RNA, 21 nt, Human
uacauaaaugcauauaaugca

SEQ ID NO: 681537 - RNA, 24 nt, Human
uagcagaaacaaagcguuaacaca

SEQ ID NO: 681538 - RNA, 18 nt, Human
uaguuaaaaacccugucu

SEQ ID NO: 681539 - RNA, 22 nt, Human
uaucacguuuuccaaacacaua

SEQ ID NO: 681540 - RNA, 19 nt, Human
uauuauggaugaccaaaga

SEQ ID NO: 681541 - RNA, 18 nt, Human
ucacaaagcauugcccaa

SEQ ID NO: 681542 - RNA, 23 nt, Human
ucagggcauguucacaccuuggu

SEQ ID NO: 681543 - RNA, 21 nt, Human
uccauuagcaguuggcuaaag

SEQ ID NO: 681544 - RNA, 22 nt, Human
uccauuggcaagauaacaauga

SEQ ID NO: 681545 - RNA, 21 nt, Human
ucccugagacuccuuagaaau

SEQ ID NO: 681546 - RNA, 20 nt, Human
uccucagaaacugacagaug

SEQ ID NO: 681547 - RNA, 21 nt, Human
uccucauauaacugagcguau

SEQ ID NO: 681548 - RNA, 23 nt, Human
uccucgugugccuaucacguuuu

SEQ ID NO: 681549 - RNA, 24 nt, Human
uccucuuucucucgcuuucucaca

SEQ ID NO: 681550 - RNA, 19 nt, Human
ucucgcugacuccgguggu

SEQ ID NO: 681551 - RNA, 21 nt, Human
ucucugccacacucgucacuu

SEQ ID NO: 681552 - RNA, 20 nt, Human
ucucugggcgauacaaagcc

SEQ ID NO: 681553 - RNA, 24 nt, Human
ucugagugugguuuuaggccagca

SEQ ID NO: 681554 - RNA, 19 nt, Human
ucuuucucucuauagcugu

SEQ ID NO: 681555 - RNA, 21 nt, Human
ucuuugguuaggcaucagggc

SEQ ID NO: 681556 - RNA, 25 nt, Human
ucuuugguuaggcaucagggcauca

SEQ ID NO: 681557 - RNA, 19 nt, Human
ugaagaaacacagaagaau

SEQ ID NO: 681558 - RNA, 18 nt, Human
ugaagaaguaaaggcuau

SEQ ID NO: 681559 - RNA, 20 nt, Human
ugacuuggggucuguaguga

SEQ ID NO: 681560 - RNA, 19 nt, Human
ugaugcauauaaaguaauc

SEQ ID NO: 681561 - RNA, 20 nt, Human
ugcaaaaaaaccugaaaaca

SEQ ID NO: 681562 - RNA, 24 nt, Human
ugcacaaaaacaaaaaagucagau

SEQ ID NO: 681563 - RNA, 22 nt, Human
ugcucacaaagcauugcccaaa

SEQ ID NO: 681564 - RNA, 19 nt, Human
ugcuguaccuuucaaacaa

SEQ ID NO: 681565 - RNA, 21 nt, Human
ugcuguaccuuucaaacaaaa

SEQ ID NO: 681566 - RNA, 18 nt, Human
uggcaagauaacaaugaa

SEQ ID NO: 681567 - RNA, 23 nt, Human
uggcuagugaagaaacacagaag

SEQ ID NO: 681568 - RNA, 18 nt, Human
ugggucaaaugcauaggu

SEQ ID NO: 681569 - RNA, 22 nt, Human
ugguaaugacuucucacccccc

SEQ ID NO: 681570 - RNA, 20 nt, Human
ugguauuugacaaacaagcu

SEQ ID NO: 681571 - RNA, 19 nt, Human
ugugaagaaguaaaggcua

SEQ ID NO: 681572 - RNA, 18 nt, Human
uugguuaacucaucuuug

SEQ ID NO: 681573 - RNA, 23 nt, Human
uuguugaugcauauaaaguaauc

SEQ ID NO: 681574 - RNA, 22 nt, Human
uuuacauauauacaguaaagau

SEQ ID NO: 681575 - RNA, 31 nt, Human
uuucaaacaaaaccccucucuucuucaauuu

SEQ ID NO: 681576 - RNA, 18 nt, Human
uuuugccucaauuuuuug

SEQ ID NO: 681577 - RNA, 24 nt, Human
uuuuuucuccuuuuuuucccuuuu

SEQ ID NO: 681578 - RNA, 20 nt, Human
uuuuuuguuuaaaauugucc

SEQ ID NO: 681579 - RNA, 25 nt, Human
aaaaaaaaaaaaacuauuaacaccc

SEQ ID NO: 681580 - RNA, 24 nt, Human
aaaacaaaaccaaaaaaaaaaaaa

SEQ ID NO: 681581 - RNA, 21 nt, Human
aaacaagagggggcaacccca

SEQ ID NO: 681582 - RNA, 24 nt, Human
aaacaagagggggcaaccccaaga

SEQ ID NO: 681583 - RNA, 24 nt, Human
aaacaagauaaaaacaaaaccaaa

SEQ ID NO: 681584 - RNA, 25 nt, Human
aaacaagauaaaaacaaaaccaaaa

SEQ ID NO: 681585 - RNA, 27 nt, Human
aaaucaccgcaagauuggggaaaaaau

SEQ ID NO: 681586 - RNA, 21 nt, Human
aacaagauaaaaacaaaacca

SEQ ID NO: 681587 - RNA, 24 nt, Human
aacaagauaaaaacaaaaccaaaa

SEQ ID NO: 681588 - RNA, 19 nt, Human
acaaaaccaaaaaaaaaaa

SEQ ID NO: 681589 - RNA, 19 nt, Human
accccaagaaaacaagaua

SEQ ID NO: 681590 - RNA, 24 nt, Human
accccaagaaaacaagauaaaaac

SEQ ID NO: 681591 - RNA, 24 nt, Human
accccaagaaaacaagauaaaaac

SEQ ID NO: 681592 - RNA, 26 nt, Human
accucgagaaucgccuuaaaaaaaaa

SEQ ID NO: 681593 - RNA, 23 nt, Human
agaaaacaagauaaaaacaaaac

SEQ ID NO: 681594 - RNA, 20 nt, Human
agagaggaggaggagggggg

SEQ ID NO: 681595 - RNA, 27 nt, Human
agagcggagagaggaggaggagggggg

SEQ ID NO: 681596 - RNA, 19 nt, Human
agaggaggaggaggggggc

SEQ ID NO: 681597 - RNA, 19 nt, Human
agaggaggaggaggggggc

SEQ ID NO: 681598 - RNA, 22 nt, Human
agcggagagaggaggaggaggg

SEQ ID NO: 681599 - RNA, 20 nt, Human
auuuuaaacaaaaucaaucc

SEQ ID NO: 681600 - RNA, 23 nt, Human
caacacaaacaagagggggcaac

SEQ ID NO: 681601 - RNA, 20 nt, Human
caaccccaagaaaacaagau

SEQ ID NO: 681602 - RNA, 26 nt, Human
caagaaaacaagauaaaaacaaaacc

SEQ ID NO: 681603 - RNA, 22 nt, Human
cacacaacacaaacaagagggg

SEQ ID NO: 681604 - RNA, 20 nt, Human
cacacacaacacaaacaaga

SEQ ID NO: 681605 - RNA, 23 nt, Human
caccggucaccgcucccugcgcc

SEQ ID NO: 681606 - RNA, 18 nt, Human
ccaaggagggaaaccacc

SEQ ID NO: 681607 - RNA, 21 nt, Human
ccacacacaacacaaacaaga

SEQ ID NO: 681608 - RNA, 23 nt, Human
cccaccccgcgccaaggagggaa

SEQ ID NO: 681609 - RNA, 18 nt, Human
ccccaccccgcgccaagg

SEQ ID NO: 681610 - RNA, 18 nt, Human
ccgcagcugaaaaccucg

SEQ ID NO: 681611 - RNA, 18 nt, Human
ccgccgcugccgccaccg

SEQ ID NO: 681612 - RNA, 20 nt, Human
ccgcugccgccaccggcugc

SEQ ID NO: 681613 - RNA, 28 nt, Human
ccucccgcagcugaaaaccucgagaauc

SEQ ID NO: 681614 - RNA, 24 nt, Human
ccuuaaaaaaaaaaaaaagccacg

SEQ ID NO: 681615 - RNA, 20 nt, Human
cgccaaggagggaaaccacc

SEQ ID NO: 681616 - RNA, 22 nt, Human
cuccucccgcagcugaaaaccu

SEQ ID NO: 681617 - RNA, 24 nt, Human
cugcagcuccagccguccgguccg

SEQ ID NO: 681618 - RNA, 25 nt, Human
cugccgccaccggcugcagcuccag

SEQ ID NO: 681619 - RNA, 18 nt, Human
cuuaaaaaaaaaaaaaag

SEQ ID NO: 681620 - RNA, 18 nt, Human
gaaggaguaggggagagc

SEQ ID NO: 681621 - RNA, 23 nt, Human
gagcggagagaggaggaggaggg

SEQ ID NO: 681622 - RNA, 23 nt, Human
gauaaaaacaaaaccaaaaaaaa

SEQ ID NO: 681623 - RNA, 21 nt, Human
gcagcuccagccguccggucc

SEQ ID NO: 681624 - RNA, 21 nt, Human
gcccgcuccccaccccgcgcc

SEQ ID NO: 681625 - RNA, 21 nt, Human
gcgccgccgcugccgccaccg

SEQ ID NO: 681626 - RNA, 20 nt, Human
ggaaaaaauuuuaaacaaaa

SEQ ID NO: 681627 - RNA, 19 nt, Human
ggagagcggagagaggagg

SEQ ID NO: 681628 - RNA, 18 nt, Human
ggaggaggggggcacucc

SEQ ID NO: 681629 - RNA, 18 nt, Human
gggcaaccccaagaaaac

SEQ ID NO: 681630 - RNA, 22 nt, Human
gggcaaccccaagaaaacaaga

SEQ ID NO: 681631 - RNA, 22 nt, Human
ggggagagcggagagaggagga

SEQ ID NO: 681632 - RNA, 27 nt, Human
ucaccgcucccugcgccgccgcugccg

SEQ ID NO: 681633 - RNA, 23 nt, Human
uccacacacaacacaaacaagag

SEQ ID NO: 681634 - RNA, 18 nt, Human
ucccugcgccgccgcugc

SEQ ID NO: 681635 - RNA, 18 nt, Human
ugacccaaaucaccgcaa

SEQ ID NO: 681636 - RNA, 22 nt, Human
ugccgccaccggcugcagcucc

SEQ ID NO: 681637 - RNA, 22 nt, Human
uuccacacacaacacaaacaag

SEQ ID NO: 681638 - RNA, 23 nt, Human
uuccacacacaacacaaacaaga

SEQ ID NO: 681639 - RNA, 20 nt, Human
uugcccgcuccccaccccgc

SEQ ID NO: 681640 - RNA, 21 nt, Human
uugcccgcuccccaccccgcg

SEQ ID NO: 681641 - RNA, 20 nt, Human
aaaaagucauauuuuuucua

SEQ ID NO: 681642 - RNA, 24 nt, Human
agguucuuaggaaggcaacaacuu

SEQ ID NO: 681643 - RNA, 21 nt, Human
caaaagcaaugaauaacagaa

SEQ ID NO: 681644 - RNA, 22 nt, Human
caggagguuccuacuucuccga

SEQ ID NO: 681645 - RNA, 21 nt, Human
ccuguggggaaggcgcuuccc

SEQ ID NO: 681646 - RNA, 22 nt, Human
gacagaagccgccacgagcccg

SEQ ID NO: 681647 - RNA, 21 nt, Human
ggcuuaggaggaagaauuugu

SEQ ID NO: 681648 - RNA, 20 nt, Human
guuccuacuucuccgaccac

SEQ ID NO: 681649 - RNA, 24 nt, Human
uaagaggcuacagaguuacaaguu

SEQ ID NO: 681650 - RNA, 24 nt, Human
ucccuccgcggagcggacagaagc

SEQ ID NO: 681651 - RNA, 19 nt, Human
uccuacuucuccgaccacc

SEQ ID NO: 681652 - RNA, 19 nt, Human
ucuacuggaauucucuggu

SEQ ID NO: 681653 - RNA, 18 nt, Human
ucucugguauagcacagu

SEQ ID NO: 681654 - RNA, 24 nt, Human
uguagucauuucugcaauucuaga

SEQ ID NO: 681655 - RNA, 18 nt, Human
uguccuguggggaaggcg

SEQ ID NO: 681656 - RNA, 22 nt, Human
uuaaaaaaaaguuaugguuuuu

SEQ ID NO: 681657 - RNA, 26 nt, Human
uuacaaguuucuuucuacuggaauuc

SEQ ID NO: 681658 - RNA, 22 nt, Human
agaaauuugauaagaaauuuaa

SEQ ID NO: 681659 - RNA, 23 nt, Human
augucuuuuguuuuuccucauga

SEQ ID NO: 681660 - RNA, 19 nt, Human
caagcaauaguauucagcc

SEQ ID NO: 681661 - RNA, 18 nt, Human
ccgcaacaagacacaaca

SEQ ID NO: 681662 - RNA, 18 nt, Human
uaguauauacauacagaa

SEQ ID NO: 681663 - RNA, 23 nt, Human
uauauacauacagaaugccaagc

SEQ ID NO: 681664 - RNA, 18 nt, Human
uauguacaacaggcaaag

SEQ ID NO: 681665 - RNA, 26 nt, Human
ucaaauaucuuccaaaauacaguuuc

SEQ ID NO: 681666 - RNA, 21 nt, Human
uccaaaauacaguuuccuaga

SEQ ID NO: 681667 - RNA, 22 nt, Human
ucuuuuguuuuuccucaugaaa

SEQ ID NO: 681668 - RNA, 23 nt, Human
ucuuuuguuuuuccucaugaaag

SEQ ID NO: 681669 - RNA, 24 nt, Human
aaaaaaaaaaaaaaaagaaaagaa

SEQ ID NO: 681670 - RNA, 22 nt, Human
aaaaaaaucagauaagaaaaua

SEQ ID NO: 681671 - RNA, 24 nt, Human
aaaagaaaauacaguaaaauauua

SEQ ID NO: 681672 - RNA, 21 nt, Human
aaagccacuuaaauacuuuuc

SEQ ID NO: 681673 - RNA, 18 nt, Human
aacauggugaaacccugc

SEQ ID NO: 681674 - RNA, 20 nt, Human
aacauggugaaacccugccu

SEQ ID NO: 681675 - RNA, 21 nt, Human
aacauggugaaacccugccuc

SEQ ID NO: 681676 - RNA, 22 nt, Human
aacgaacuccaacuuuaaauau

SEQ ID NO: 681677 - RNA, 23 nt, Human
aagaaaaaaaucagauaagaaaa

SEQ ID NO: 681678 - RNA, 25 nt, Human
aagaaaagaaaauacaguaaaauau

SEQ ID NO: 681679 - RNA, 23 nt, Human
aauaaggcaagaaaaaaaucaga

SEQ ID NO: 681680 - RNA, 24 nt, Human
aaucgcuugaacccaggaggcaga

SEQ ID NO: 681681 - RNA, 22 nt, Human
aaugaaacaucacuccauacaa

SEQ ID NO: 681682 - RNA, 18 nt, Human
aauuagccaggcauggug

SEQ ID NO: 681683 - RNA, 18 nt, Human
acauauugauccaucuca

SEQ ID NO: 681684 - RNA, 27 nt, Human
accaauuauacuucuguuuucuaucau

SEQ ID NO: 681685 - RNA, 24 nt, Human
acccaggaggcagagguugcagug

SEQ ID NO: 681686 - RNA, 24 nt, Human
acccugccucuacuaaaaauacaa

SEQ ID NO: 681687 - RNA, 25 nt, Human
acuccagccugggguacaagaguga

SEQ ID NO: 681688 - RNA, 22 nt, Human
agaaaagaaaauacaguaaaag

SEQ ID NO: 681689 - RNA, 27 nt, Human
agaaaagaaaauacaguaaaauauuaa

SEQ ID NO: 681690 - RNA, 22 nt, Human
agaaucgcuugaacccaggagg

SEQ ID NO: 681691 - RNA, 25 nt, Human
agacuaacugacacaguucuaaggc

SEQ ID NO: 681692 - RNA, 18 nt, Human
agagguugcagugagccg

SEQ ID NO: 681693 - RNA, 23 nt, Human
agagguugcagugagccgagauc

SEQ ID NO: 681694 - RNA, 24 nt, Human
agagguugcagugagccgagauca

SEQ ID NO: 681695 - RNA, 26 nt, Human
agauaagaaaauacagcacuuuggga

SEQ ID NO: 681696 - RNA, 24 nt, Human
agcacuuugggaggccgaggcggg

SEQ ID NO: 681697 - RNA, 25 nt, Human
agccugggguacaagagugagacuu

SEQ ID NO: 681698 - RNA, 20 nt, Human
aggcaagaaaaaaaucagau

SEQ ID NO: 681699 - RNA, 22 nt, Human
aggcaagaaaaaaaucagauaa

SEQ ID NO: 681700 - RNA, 21 nt, Human
aggcagagguugcagugagcc

SEQ ID NO: 681701 - RNA, 24 nt, Human
aggcagagguugcagugagccgag

SEQ ID NO: 681702 - RNA, 23 nt, Human
aggcaggagaaucgcuugaaccc

SEQ ID NO: 681703 - RNA, 24 nt, Human
aggcaggagaaucgcuugaaccca

SEQ ID NO: 681704 - RNA, 24 nt, Human
aggcaugguggcaggcaccuguaa

SEQ ID NO: 681705 - RNA, 20 nt, Human
aggccgaggcggguggauca

SEQ ID NO: 681706 - RNA, 24 nt, Human
aggcggguggaucaugaggucagg

SEQ ID NO: 681707 - RNA, 20 nt, Human
aggcugaggcaggagaaucg

SEQ ID NO: 681708 - RNA, 24 nt, Human
aggcugaggcaggagaaucgcuug

SEQ ID NO: 681709 - RNA, 20 nt, Human
agggagagugacagagagag

SEQ ID NO: 681710 - RNA, 24 nt, Human
aucacgccauugcacuccagccug

SEQ ID NO: 681711 - RNA, 23 nt, Human
aucauccuaaauccaaaccaaaa

SEQ ID NO: 681712 - RNA, 18 nt, Human
auugcacuccagccuggg

SEQ ID NO: 681713 - RNA, 24 nt, Human
caaaaccaggaccagucucagcug

SEQ ID NO: 681714 - RNA, 19 nt, Human
caaagggaacaaaaccagg

SEQ ID NO: 681715 - RNA, 21 nt, Human
caaagggaacaaaaccaggac

SEQ ID NO: 681716 - RNA, 19 nt, Human
caagaaaaaaaucagauaa

SEQ ID NO: 681717 - RNA, 24 nt, Human
caagaaaaaaaucagauaagaaaa

SEQ ID NO: 681718 - RNA, 22 nt, Human
caccuccccuuacauauugauc

SEQ ID NO: 681719 - RNA, 23 nt, Human
caccuguaaucccagcuacucgg

SEQ ID NO: 681720 - RNA, 24 nt, Human
caccuguaaucccagcuacucggg

SEQ ID NO: 681721 - RNA, 23 nt, Human
cacuccagccugggguacaagag

SEQ ID NO: 681722 - RNA, 24 nt, Human
cacuccagccugggguacaagagu

SEQ ID NO: 681723 - RNA, 25 nt, Human
cacuccagccugggguacaagagug

SEQ ID NO: 681724 - RNA, 18 nt, Human
cagaacccaaaauaaacu

SEQ ID NO: 681725 - RNA, 19 nt, Human
cagauggaugggaaggauu

SEQ ID NO: 681726 - RNA, 18 nt, Human
cagcacccuaccuugcug

SEQ ID NO: 681727 - RNA, 21 nt, Human
cagcacccuaccuugcuggga

SEQ ID NO: 681728 - RNA, 24 nt, Human
cagcacuuugggaggccgaggcgg

SEQ ID NO: 681729 - RNA, 24 nt, Human
cagcuacucgggaggcugaggcag

SEQ ID NO: 681730 - RNA, 23 nt, Human
caguauaaaacagauuuauuguc

SEQ ID NO: 681731 - RNA, 24 nt, Human
cauucagucauuaacacaacccag

SEQ ID NO: 681732 - RNA, 18 nt, Human
cauugcacuccagccugg

SEQ ID NO: 681733 - RNA, 19 nt, Human
cauugcacuccagccuggg

SEQ ID NO: 681734 - RNA, 19 nt, Human
cauugcacuccagccuggg

SEQ ID NO: 681735 - RNA, 19 nt, Human
cauugcacuccagccuggg

SEQ ID NO: 681736 - RNA, 22 nt, Human
cauugcacuccagccuggggua

SEQ ID NO: 681737 - RNA, 24 nt, Human
cauugcacuccagccugggguaca

SEQ ID NO: 681738 - RNA, 22 nt, Human
ccaaaaaaaaaaaaaaaagaaa

SEQ ID NO: 681739 - RNA, 22 nt, Human
ccagguaaaugaaacaucacuc

SEQ ID NO: 681740 - RNA, 20 nt, Human
ccauugcacuccagccuggg

SEQ ID NO: 681741 - RNA, 21 nt, Human
ccauugcacuccagccugggg

SEQ ID NO: 681742 - RNA, 22 nt, Human
ccauugcacuccagccuggggu

SEQ ID NO: 681743 - RNA, 24 nt, Human
ccauugcacuccagccugggguac

SEQ ID NO: 681744 - RNA, 23 nt, Human
cccccaaucagugauuugacugu

SEQ ID NO: 681745 - RNA, 22 nt, Human
cccuugugugaaaguucuuuau

SEQ ID NO: 681746 - RNA, 18 nt, Human
ccucauuaaacaauuuau

SEQ ID NO: 681747 - RNA, 22 nt, Human
ccuggcuaacauggugaaaccc

SEQ ID NO: 681748 - RNA, 22 nt, Human
ccuggcuaacauggugaaaccc

SEQ ID NO: 681749 - RNA, 24 nt, Human
ccuggcuaacauggugaaacccug

SEQ ID NO: 681750 - RNA, 21 nt, Human
ccuguaaucccagcuacucgg

SEQ ID NO: 681751 - RNA, 24 nt, Human
cgagaucacgccauugcacuccag

SEQ ID NO: 681752 - RNA, 24 nt, Human
cgagaucauccuggcuaacauggu

SEQ ID NO: 681753 - RNA, 22 nt, Human
cgaggcggguggaucaugaggu

SEQ ID NO: 681754 - RNA, 24 nt, Human
cgaggcggguggaucaugagguca

SEQ ID NO: 681755 - RNA, 26 nt, Human
cgccauugcacuccagccugggguac

SEQ ID NO: 681756 - RNA, 26 nt, Human
cucaaguauaucucucccccuuccac

SEQ ID NO: 681757 - RNA, 21 nt, Human
cucccccuuccacacacgcuc

SEQ ID NO: 681758 - RNA, 20 nt, Human
cucuacuaaaaauacaaaaa

SEQ ID NO: 681759 - RNA, 23 nt, Human
cuggcuagaacagauaaaaugga

SEQ ID NO: 681760 - RNA, 21 nt, Human
cuguaaucccagcuacucggg

SEQ ID NO: 681761 - RNA, 28 nt, Human
cuguaccaaagggaacaaaaccaggacc

SEQ ID NO: 681762 - RNA, 21 nt, Human
cuucaaagaugagacauuccu

SEQ ID NO: 681763 - RNA, 19 nt, Human
cuuuagcaacgaacuccaa

SEQ ID NO: 681764 - RNA, 18 nt, Human
gaacagauaaaauggaug

SEQ ID NO: 681765 - RNA, 22 nt, Human
gcaggagaaucgcuugaaccca

SEQ ID NO: 681766 - RNA, 22 nt, Human
gcuaacauggugaaacccugcc

SEQ ID NO: 681767 - RNA, 24 nt, Human
gcuaacauggugaaacccugccuc

SEQ ID NO: 681768 - RNA, 20 nt, Human
gcuugucacucuucaacccu

SEQ ID NO: 681769 - RNA, 22 nt, Human
ggaggcagagguugcagugagc

SEQ ID NO: 681770 - RNA, 21 nt, Human
ggcaagcugcuuuggugggca

SEQ ID NO: 681771 - RNA, 19 nt, Human
ggcaccuguaaucccagcu

SEQ ID NO: 681772 - RNA, 21 nt, Human
ggcaggcaccuguaaucccag

SEQ ID NO: 681773 - RNA, 23 nt, Human
ggcggguggaucaugaggucagg

SEQ ID NO: 681774 - RNA, 19 nt, Human
ggcuagaacagauaaaaug

SEQ ID NO: 681775 - RNA, 21 nt, Human
gguggaucaugaggucaggag

SEQ ID NO: 681776 - RNA, 21 nt, Human
gugaaacccugccucuacuaa

SEQ ID NO: 681777 - RNA, 19 nt, Human
guugcagugagccgagauc

SEQ ID NO: 681778 - RNA, 21 nt, Human
uaaaaauacaaaaauuagcca

SEQ ID NO: 681779 - RNA, 18 nt, Human
uaacacaacccagguaaa

SEQ ID NO: 681780 - RNA, 21 nt, Human
uaacauggugaaacccugccu

SEQ ID NO: 681781 - RNA, 22 nt, Human
uaacauggugaaacccugccuc

SEQ ID NO: 681782 - RNA, 24 nt, Human
uaacauggugaaacccugccucua

SEQ ID NO: 681783 - RNA, 22 nt, Human
uaagauauacaauuguuacaga

SEQ ID NO: 681784 - RNA, 20 nt, Human
uaaggcacuguuaccaaugc

SEQ ID NO: 681785 - RNA, 19 nt, Human
uaauaaggcaagaaaaaaa

SEQ ID NO: 681786 - RNA, 27 nt, Human
uacagcacuuugggaggccgaggcggg

SEQ ID NO: 681787 - RNA, 23 nt, Human
uacauaucagaacccaaaauaaa

SEQ ID NO: 681788 - RNA, 18 nt, Human
uaccaaugcuugucacuc

SEQ ID NO: 681789 - RNA, 18 nt, Human
uacugugucugacaaaau

SEQ ID NO: 681790 - RNA, 22 nt, Human
uagagaaaggagaaagaauuag

SEQ ID NO: 681791 - RNA, 21 nt, Human
uagcacugacaagaggucugu

SEQ ID NO: 681792 - RNA, 24 nt, Human
uaugaacuucccucacucauuuca

SEQ ID NO: 681793 - RNA, 23 nt, Human
uaugucuuaauaaggcaagaaaa

SEQ ID NO: 681794 - RNA, 20 nt, Human
uauuguaguaaacagaugga

SEQ ID NO: 681795 - RNA, 22 nt, Human
ucaaauucuaagcaaaauuuca

SEQ ID NO: 681796 - RNA, 23 nt, Human
ucacgccauugcacuccagccug

SEQ ID NO: 681797 - RNA, 23 nt, Human
ucaucuccaaaaaaaaaaaaaaa

SEQ ID NO: 681798 - RNA, 18 nt, Human
ucaugaggucaggagauc

SEQ ID NO: 681799 - RNA, 24 nt, Human
ucaugaggucaggagaucgagauc

SEQ ID NO: 681800 - RNA, 24 nt, Human
uccaaaaaaaaaaaaaaaagaaaa

SEQ ID NO: 681801 - RNA, 26 nt, Human
uccaaaaaaaaaaaaaaaagaaaaga

SEQ ID NO: 681802 - RNA, 24 nt, Human
uccagccugggguacaagagugag

SEQ ID NO: 681803 - RNA, 25 nt, Human
uccagccugggguacaagagugaga

SEQ ID NO: 681804 - RNA, 24 nt, Human
ucgggaggcugaggcaggagaauc

SEQ ID NO: 681805 - RNA, 20 nt, Human
ucuccaaaaaaaaaaaaaaa

SEQ ID NO: 681806 - RNA, 22 nt, Human
ugagccgagaucacgccauugc

SEQ ID NO: 681807 - RNA, 20 nt, Human
ugaggcaggagaaucgcuug

SEQ ID NO: 681808 - RNA, 24 nt, Human
ugaggcaggagaaucgcuugaacc

SEQ ID NO: 681809 - RNA, 25 nt, Human
ugaggcaggagaaucgcuugaaccc

SEQ ID NO: 681810 - RNA, 23 nt, Human
uggcaagcugcuuuggugggcag

SEQ ID NO: 681811 - RNA, 22 nt, Human
uggcaggcaccuguaaucccag

SEQ ID NO: 681812 - RNA, 23 nt, Human
ugggaggccgaggcggguggauc

SEQ ID NO: 681813 - RNA, 24 nt, Human
ugggaggccgaggcggguggauca

SEQ ID NO: 681814 - RNA, 24 nt, Human
ugguggcaggcaccuguaauccca

SEQ ID NO: 681815 - RNA, 26 nt, Human
uuaacacaacccagguaaaugaaaca

SEQ ID NO: 681816 - RNA, 21 nt, Human
uuaaucauaagacucaaguau

SEQ ID NO: 681817 - RNA, 23 nt, Human
uuccaaaucagacuaacugacac

SEQ ID NO: 681818 - RNA, 19 nt, Human
uuccacacacgcucccacc

SEQ ID NO: 681819 - RNA, 20 nt, Human
uuccacacacgcucccaccu

SEQ ID NO: 681820 - RNA, 23 nt, Human
uuccacacacgcucccaccuccc

SEQ ID NO: 681821 - RNA, 18 nt, Human
uugcagugagccgagauc

SEQ ID NO: 681822 - RNA, 20 nt, Human
uugcagugagccgagaucac

SEQ ID NO: 681823 - RNA, 21 nt, Human
uugcagugagccgagaucacg

SEQ ID NO: 681824 - RNA, 25 nt, Human
uugggaggccgaggcggguggauca

SEQ ID NO: 681825 - RNA, 26 nt, Human
aaaaacaguuaagaaacuuuacaagc

SEQ ID NO: 681826 - RNA, 24 nt, Human
aaagcuaauauuuaagaaaaaccc

SEQ ID NO: 681827 - RNA, 18 nt, Human
aaucuguucuuucuccuc

SEQ ID NO: 681828 - RNA, 21 nt, Human
acgcagggcugaggagcgggc

SEQ ID NO: 681829 - RNA, 23 nt, Human
agaaaaacccucuuaauccucca

SEQ ID NO: 681830 - RNA, 21 nt, Human
agcgaccccaggacgcagggc

SEQ ID NO: 681831 - RNA, 23 nt, Human
aggcgugcgggaugcagcagcga

SEQ ID NO: 681832 - RNA, 21 nt, Human
caaaggacaagccgccgcuga

SEQ ID NO: 681833 - RNA, 19 nt, Human
cagcagcgaccccaggacg

SEQ ID NO: 681834 - RNA, 22 nt, Human
cagcagcgaccccaggacgcag

SEQ ID NO: 681835 - RNA, 21 nt, Human
cagcgccuuuugcauagcauc

SEQ ID NO: 681836 - RNA, 19 nt, Human
cagggcugaggagcgggcg

SEQ ID NO: 681837 - RNA, 20 nt, Human
ccaggacgcagggcugagga

SEQ ID NO: 681838 - RNA, 23 nt, Human
ccguuuguucuuugacaauuuca

SEQ ID NO: 681839 - RNA, 25 nt, Human
cuauacaauucuccuuggaucugua

SEQ ID NO: 681840 - RNA, 19 nt, Human
uacagguuuaaaaaauuua

SEQ ID NO: 681841 - RNA, 24 nt, Human
uacagguuuaaaaaauuuaccgag

SEQ ID NO: 681842 - RNA, 22 nt, Human
uaccucagcuccuuagauacgg

SEQ ID NO: 681843 - RNA, 20 nt, Human
uagagaguccucacuuaaaa

SEQ ID NO: 681844 - RNA, 18 nt, Human
uagcaugcuggcuaggag

SEQ ID NO: 681845 - RNA, 18 nt, Human
uccggaacaaaggacaag

SEQ ID NO: 681846 - RNA, 22 nt, Human
ucuguucuuucuccucaaaaaa

SEQ ID NO: 681847 - RNA, 19 nt, Human
ugaaaagaaacgugaucac

SEQ ID NO: 681848 - RNA, 22 nt, Human
ugaaaagaaacgugaucaccug

SEQ ID NO: 681849 - RNA, 18 nt, Human
ugcuggcuaggagucuuc

SEQ ID NO: 681850 - RNA, 21 nt, Human
uguaguugacuguuuuuuucu

SEQ ID NO: 681851 - RNA, 20 nt, Human
uuccuacugugaauaaucug

SEQ ID NO: 681852 - RNA, 19 nt, Human
uuuaagaguuucuguaguu

SEQ ID NO: 681853 - RNA, 20 nt, Human
uuuuaagaguuucuguaguu

SEQ ID NO: 681854 - RNA, 19 nt, Human
aaaaaaacaaacaagggcc

SEQ ID NO: 681855 - RNA, 26 nt, Human
aaaaaaacaaacaagggccgggugcg

SEQ ID NO: 681856 - RNA, 18 nt, Human
aaacaagggccgggugcg

SEQ ID NO: 681857 - RNA, 20 nt, Human
aacaaaucaguccuccagaa

SEQ ID NO: 681858 - RNA, 23 nt, Human
aaccugggcaauguagugagacc

SEQ ID NO: 681859 - RNA, 24 nt, Human
aaccugggcaauguagugagaccu

SEQ ID NO: 681860 - RNA, 22 nt, Human
aagcaaacccaaauguguauua

SEQ ID NO: 681861 - RNA, 21 nt, Human
acaaaaaguaaauaucugcaa

SEQ ID NO: 681862 - RNA, 18 nt, Human
acaaacaagggccgggug

SEQ ID NO: 681863 - RNA, 22 nt, Human
acacuuuaggaggccaaggugg

SEQ ID NO: 681864 - RNA, 25 nt, Human
accuugucucuacuuaaaaaaacaa

SEQ ID NO: 681865 - RNA, 21 nt, Human
agacaaaaaguaaauaucugc

SEQ ID NO: 681866 - RNA, 19 nt, Human
agagguugauaggacugac

SEQ ID NO: 681867 - RNA, 20 nt, Human
aggaguuugagaccaaccug

SEQ ID NO: 681868 - RNA, 24 nt, Human
agucaucccauuaaaaaaaugaaa

SEQ ID NO: 681869 - RNA, 22 nt, Human
caaacaaaucaguccuccagaa

SEQ ID NO: 681870 - RNA, 22 nt, Human
caaacaagggccgggugcggug

SEQ ID NO: 681871 - RNA, 24 nt, Human
cacacuuuaggaggccaagguggg

SEQ ID NO: 681872 - RNA, 24 nt, Human
cacgccuguaaucccagcacuuug

SEQ ID NO: 681873 - RNA, 22 nt, Human
cagcucuaaaagauggggaaaa

SEQ ID NO: 681874 - RNA, 23 nt, Human
cagcucuaaaagauggggaaaau

SEQ ID NO: 681875 - RNA, 18 nt, Human
cccagcaccucagcgccc

SEQ ID NO: 681876 - RNA, 28 nt, Human
ccuaucuuuauuuuuuucagucuuccca

SEQ ID NO: 681877 - RNA, 21 nt, Human
ccuccagaagcacaggaugaa

SEQ ID NO: 681878 - RNA, 18 nt, Human
cgccuguaaucccagcac

SEQ ID NO: 681879 - RNA, 24 nt, Human
cucacgccuguaaucccagcacuu

SEQ ID NO: 681880 - RNA, 26 nt, Human
cucacgccuguaaucccagcacuuug

SEQ ID NO: 681881 - RNA, 18 nt, Human
cucagacuuacuuggagg

SEQ ID NO: 681882 - RNA, 23 nt, Human
cugcuugagcucaggaguuugag

SEQ ID NO: 681883 - RNA, 19 nt, Human
cuucccaacaaagaaucug

SEQ ID NO: 681884 - RNA, 23 nt, Human
cuugagcucaggaguuugagacc

SEQ ID NO: 681885 - RNA, 24 nt, Human
gaccuugucucuacuuaaaaaaac

SEQ ID NO: 681886 - RNA, 22 nt, Human
gauguuagagguugauaggacu

SEQ ID NO: 681887 - RNA, 18 nt, Human
ggccgggugcgguggcuc

SEQ ID NO: 681888 - RNA, 21 nt, Human
ggccgggugcgguggcucacg

SEQ ID NO: 681889 - RNA, 21 nt, Human
ggcucacgccuguaaucccag

SEQ ID NO: 681890 - RNA, 24 nt, Human
gggugcgguggcucacgccuguaa

SEQ ID NO: 681891 - RNA, 23 nt, Human
gguggcucacgccuguaauccca

SEQ ID NO: 681892 - RNA, 24 nt, Human
gguggcucacgccuguaaucccag

SEQ ID NO: 681893 - RNA, 18 nt, Human
gugcgaggauguuagagg

SEQ ID NO: 681894 - RNA, 25 nt, Human
uaaaaaaacaaacaagggccgggug

SEQ ID NO: 681895 - RNA, 22 nt, Human
ucaaacaaaucaguccuccaga

SEQ ID NO: 681896 - RNA, 19 nt, Human
ucagucuucccaacaaaga

SEQ ID NO: 681897 - RNA, 24 nt, Human
ucaucccauuaaaaaaaugaaagc

SEQ ID NO: 681898 - RNA, 23 nt, Human
uccacacuuuaggaggccaaggu

SEQ ID NO: 681899 - RNA, 24 nt, Human
uccacacuuuaggaggccaaggug

SEQ ID NO: 681900 - RNA, 18 nt, Human
ucccagcaccucagcgcc

SEQ ID NO: 681901 - RNA, 22 nt, Human
ucugcaaauaucugaggcuguc

SEQ ID NO: 681902 - RNA, 22 nt, Human
uggcucacgccuguaaucccag

SEQ ID NO: 681903 - RNA, 24 nt, Human
uggcucacgccuguaaucccagca

SEQ ID NO: 681904 - RNA, 18 nt, Human
ugggaagacugcuugagc

SEQ ID NO: 681905 - RNA, 18 nt, Human
uggugcgaggauguuaga

SEQ ID NO: 681906 - RNA, 21 nt, Human
uucaauacagacaccuguccu

SEQ ID NO: 681907 - RNA, 23 nt, Human
uucccaacaaagaaucugcuaua

SEQ ID NO: 681908 - RNA, 18 nt, Human
uuucucagacuuacuugg

SEQ ID NO: 681909 - RNA, 24 nt, Human
uuucucagacuuacuuggagguua

SEQ ID NO: 681910 - RNA, 18 nt, Human
aaaagggagccgcuccgc

SEQ ID NO: 681911 - RNA, 20 nt, Human
acaggcggggcaaacucugg

SEQ ID NO: 681912 - RNA, 19 nt, Human
acagugggaaacgugucag

SEQ ID NO: 681913 - RNA, 21 nt, Human
acucacaaggcugaaaaggga

SEQ ID NO: 681914 - RNA, 22 nt, Human
acucuggagacccagagacaag

SEQ ID NO: 681915 - RNA, 24 nt, Human
agaagagccugggggaugggcagg

SEQ ID NO: 681916 - RNA, 18 nt, Human
agcacccguccccugcug

SEQ ID NO: 681917 - RNA, 21 nt, Human
agccagcccagcuggggccug

SEQ ID NO: 681918 - RNA, 25 nt, Human
agccaggagauccugccgagauggc

SEQ ID NO: 681919 - RNA, 27 nt, Human
agccugggggaugggcaggucggggag

SEQ ID NO: 681920 - RNA, 22 nt, Human
aggcucggcagacccaaggcca

SEQ ID NO: 681921 - RNA, 19 nt, Human
caacgcaccgccaagggcc

SEQ ID NO: 681922 - RNA, 18 nt, Human
caagaagcaccaacuccc

SEQ ID NO: 681923 - RNA, 22 nt, Human
caagaagcaccaacucccagug

SEQ ID NO: 681924 - RNA, 20 nt, Human
cagcggggcacaccgauccc

SEQ ID NO: 681925 - RNA, 25 nt, Human
caggcaggagugguguggcaggcgg

SEQ ID NO: 681926 - RNA, 19 nt, Human
ccacagcccccaugggggg

SEQ ID NO: 681927 - RNA, 21 nt, Human
ccagcccagcuggggccugcc

SEQ ID NO: 681928 - RNA, 30 nt, Human
cuggccaaagcacccguccccugcugcagg

SEQ ID NO: 681929 - RNA, 21 nt, Human
gaggggccacagcccccaugg

SEQ ID NO: 681930 - RNA, 20 nt, Human
gcagacccaaggccagggca

SEQ ID NO: 681931 - RNA, 20 nt, Human
gcccagaagagccuggggga

SEQ ID NO: 681932 - RNA, 22 nt, Human
ggagacccagagacaagaagca

SEQ ID NO: 681933 - RNA, 22 nt, Human
ggcaggcgguggcugggaggga

SEQ ID NO: 681934 - RNA, 21 nt, Human
ggggaugggcaggucggggag

SEQ ID NO: 681935 - RNA, 21 nt, Human
gggggaugggcaggucgggga

SEQ ID NO: 681936 - RNA, 20 nt, Human
ggggggccccucgcagcggg

SEQ ID NO: 681937 - RNA, 21 nt, Human
ggugguucagucccagccagg

SEQ ID NO: 681938 - RNA, 21 nt, Human
gugacucuggccaaagcaccc

SEQ ID NO: 681939 - RNA, 20 nt, Human
gugguguggcaggcgguggc

SEQ ID NO: 681940 - RNA, 19 nt, Human
guugggauguccugccugc

SEQ ID NO: 681941 - RNA, 19 nt, Human
ucagucgcggcgccccggg

SEQ ID NO: 681942 - RNA, 18 nt, Human
ugagggacacggacagcc

SEQ ID NO: 681943 - RNA, 24 nt, Human
ugagggacacggacagccagccca

SEQ ID NO: 681944 - RNA, 22 nt, Human
ugcggaggggccacagccccca

SEQ ID NO: 681945 - RNA, 23 nt, Human
uggcaggcgguggcugggaggga

SEQ ID NO: 681946 - RNA, 24 nt, Human
ugggauguccugccugcggagggg

SEQ ID NO: 681947 - RNA, 23 nt, Human
ugggggaugggcaggucggggag

SEQ ID NO: 681948 - RNA, 19 nt, Human
uggggucugccgagcacca

SEQ ID NO: 681949 - RNA, 23 nt, Human
ugguucagucccagccagggguu

SEQ ID NO: 681950 - RNA, 20 nt, Human
ugucagucugugacucuggc

SEQ ID NO: 681951 - RNA, 18 nt, Human
uucccaaggggaaggccc

SEQ ID NO: 681952 - RNA, 22 nt, Human
aagcaggagcaaguaagaucug

SEQ ID NO: 681953 - RNA, 18 nt, Human
aaucuagagaagauuugg

SEQ ID NO: 681954 - RNA, 24 nt, Human
acccuaaagaggaaguuucagaag

SEQ ID NO: 681955 - RNA, 19 nt, Human
agacaggagccuucaugca

SEQ ID NO: 681956 - RNA, 20 nt, Human
cacuguccagggaaggcccc

SEQ ID NO: 681957 - RNA, 21 nt, Human
cagaagucuguagaaagagug

SEQ ID NO: 681958 - RNA, 21 nt, Human
cagacaggagccuucaugcag

SEQ ID NO: 681959 - RNA, 20 nt, Human
cagggaaggcccccaguucc

SEQ ID NO: 681960 - RNA, 19 nt, Human
caguaccuuuacuuggcuu

SEQ ID NO: 681961 - RNA, 21 nt, Human
ccccaaaauggcugcccccuc

SEQ ID NO: 681962 - RNA, 21 nt, Human
ccccccaaaauggcugccccc

SEQ ID NO: 681963 - RNA, 23 nt, Human
ccccccaaaauggcugcccccuc

SEQ ID NO: 681964 - RNA, 22 nt, Human
cccuaaagaggaaguuucagaa

SEQ ID NO: 681965 - RNA, 22 nt, Human
cuccauacacccauucacaagu

SEQ ID NO: 681966 - RNA, 20 nt, Human
cucugugcauaggggccauu

SEQ ID NO: 681967 - RNA, 20 nt, Human
cugcccccucgccaaagucc

SEQ ID NO: 681968 - RNA, 20 nt, Human
cugcccccucgccaaagucc

SEQ ID NO: 681969 - RNA, 18 nt, Human
cuguagaaagagugggau

SEQ ID NO: 681970 - RNA, 20 nt, Human
gaaacacaugauagcuaugg

SEQ ID NO: 681971 - RNA, 24 nt, Human
gcaugaucacuguccagggaaggc

SEQ ID NO: 681972 - RNA, 18 nt, Human
ggaauagucagacaggag

SEQ ID NO: 681973 - RNA, 19 nt, Human
ggaucuaaggaguccuggg

SEQ ID NO: 681974 - RNA, 18 nt, Human
ggccuggcaugaucacug

SEQ ID NO: 681975 - RNA, 21 nt, Human
uaacagggcaaucacagggaa

SEQ ID NO: 681976 - RNA, 21 nt, Human
uacccuaaagaggaaguuuca

SEQ ID NO: 681977 - RNA, 19 nt, Human
uagaaguauacucucugac

SEQ ID NO: 681978 - RNA, 28 nt, Human
uauaaaggaagauuuuaaaaaacaugac

SEQ ID NO: 681979 - RNA, 20 nt, Human
ucacagggaagaugacuaga

SEQ ID NO: 681980 - RNA, 19 nt, Human
ugaguguuucucaugagcc

SEQ ID NO: 681981 - RNA, 22 nt, Human
ugcagauacccuuuucaguucu

SEQ ID NO: 681982 - RNA, 20 nt, Human
ugcauaggggccauuuguuc

SEQ ID NO: 681983 - RNA, 24 nt, Human
uggcugcccccucgccaaaguccu

SEQ ID NO: 681984 - RNA, 20 nt, Human
ugggaaacacaugauagcua

SEQ ID NO: 681985 - RNA, 23 nt, Human
uggggaggcaggccuaaaggucc

SEQ ID NO: 681986 - RNA, 21 nt, Human
ugugaucacagaagucuguag

SEQ ID NO: 681987 - RNA, 21 nt, Human
uuaaaaaacaugacuguucag

SEQ ID NO: 681988 - RNA, 21 nt, Human
uugauauaaaggaagauuuua

SEQ ID NO: 681989 - RNA, 24 nt, Human
uuuucaguucuccauacacccauu

SEQ ID NO: 681990 - RNA, 20 nt, Human
cagcgccuuccagaagcuac

SEQ ID NO: 681991 - RNA, 22 nt, Human
cagcugccauugcucuguucuc

SEQ ID NO: 681992 - RNA, 24 nt, Human
cugagacagaagacacugguccuc

SEQ ID NO: 681993 - RNA, 24 nt, Human
gaaccgggacagagaaccggaaga

SEQ ID NO: 681994 - RNA, 26 nt, Human
gugcaaccccaggaaccgggacagag

SEQ ID NO: 681995 - RNA, 21 nt, Human
ugucugugcaaccccaggaac

SEQ ID NO: 681996 - RNA, 20 nt, Human
uuuuuuuuuuuuuuguagga

SEQ ID NO: 681997 - RNA, 19 nt, Human
uuuuuuuuuuuuuuuuugu

SEQ ID NO: 681998 - RNA, 22 nt, Human
uuuuuuuuuuuuuuuuuguagg

SEQ ID NO: 681999 - RNA, 27 nt, Human
uuuuuuuuuuuuuuuuuuuuuuugggg

SEQ ID NO: 682000 - RNA, 19 nt, Human
aaccuaacucaacccagca

SEQ ID NO: 682001 - RNA, 22 nt, Human
aacugccuguccagaaaaagga

SEQ ID NO: 682002 - RNA, 23 nt, Human
aaggcaguuccaaaccaaggcaa

SEQ ID NO: 682003 - RNA, 19 nt, Human
acccccuuuucccugccca

SEQ ID NO: 682004 - RNA, 20 nt, Human
agcgccgccgagccaagaag

SEQ ID NO: 682005 - RNA, 22 nt, Human
agcgccgccgagccaagaagga

SEQ ID NO: 682006 - RNA, 21 nt, Human
aggacccccuuuucccugccc

SEQ ID NO: 682007 - RNA, 22 nt, Human
agguggagaccuggcuccagca

SEQ ID NO: 682008 - RNA, 28 nt, Human
caccucccggaccgugccgccacccccu

SEQ ID NO: 682009 - RNA, 20 nt, Human
cacuguguucaaauugcuuc

SEQ ID NO: 682010 - RNA, 20 nt, Human
cagaguucaucaugcccuuc

SEQ ID NO: 682011 - RNA, 28 nt, Human
caggccccgagcgccgccgagccaagaa

SEQ ID NO: 682012 - RNA, 23 nt, Human
cauccuucucuucaggcuggagg

SEQ ID NO: 682013 - RNA, 24 nt, Human
ccaaggcaaggauuaaaaccuaac

SEQ ID NO: 682014 - RNA, 25 nt, Human
ccagugcccuccgcggcgguuuucu

SEQ ID NO: 682015 - RNA, 20 nt, Human
cccccuuuucccugcccagg

SEQ ID NO: 682016 - RNA, 18 nt, Human
ccccgagcgccgccgagc

SEQ ID NO: 682017 - RNA, 23 nt, Human
cccgaaggcaguuccaaaccaag

SEQ ID NO: 682018 - RNA, 20 nt, Human
cccgaggacccccuuuuccc

SEQ ID NO: 682019 - RNA, 25 nt, Human
cccgaggacccccuuuucccugccc

SEQ ID NO: 682020 - RNA, 21 nt, Human
cccuaccagguggccaaggaa

SEQ ID NO: 682021 - RNA, 21 nt, Human
ccgagccaagaaggacccugc

SEQ ID NO: 682022 - RNA, 21 nt, Human
ccgccgagccaagaaggaccc

SEQ ID NO: 682023 - RNA, 18 nt, Human
ccucaggccccgagcgcc

SEQ ID NO: 682024 - RNA, 21 nt, Human
ccucaggccccgagcgccgcc

SEQ ID NO: 682025 - RNA, 23 nt, Human
ccucccggaccgugccgccaccc

SEQ ID NO: 682026 - RNA, 21 nt, Human
ccuuuagucucuggaaaugga

SEQ ID NO: 682027 - RNA, 23 nt, Human
cucaggccccgagcgccgccgag

SEQ ID NO: 682028 - RNA, 22 nt, Human
cucuccacucgugaggguccgg

SEQ ID NO: 682029 - RNA, 30 nt, Human
cucuucaggcuggaggaaguuuucuauggg

SEQ ID NO: 682030 - RNA, 20 nt, Human
gacagcgagcggggagcccc

SEQ ID NO: 682031 - RNA, 19 nt, Human
gacccccuuuucccugccc

SEQ ID NO: 682032 - RNA, 22 nt, Human
ggacccccuuuucccugcccag

SEQ ID NO: 682033 - RNA, 19 nt, Human
ucaucaugcccuuccaucu

SEQ ID NO: 682034 - RNA, 24 nt, Human
uccaaaccaaggcaaggauuaaaa

SEQ ID NO: 682035 - RNA, 24 nt, Human
uccaacucucugaguccagccauu

SEQ ID NO: 682036 - RNA, 22 nt, Human
ucccggaccgugccgccacccc

SEQ ID NO: 682037 - RNA, 18 nt, Human
uccuucucuucaggcugg

SEQ ID NO: 682038 - RNA, 20 nt, Human
ucuucaggcuggaggaaguu

SEQ ID NO: 682039 - RNA, 23 nt, Human
ugaaaagcacuccaacucucuga

SEQ ID NO: 682040 - RNA, 20 nt, Human
ugcagagguggagaccuggc

SEQ ID NO: 682041 - RNA, 22 nt, Human
ugcagagguggagaccuggcuc

SEQ ID NO: 682042 - RNA, 21 nt, Human
ugcgauucagaaaugagcucc

SEQ ID NO: 682043 - RNA, 23 nt, Human
uggagcccgaaggcaguuccaaa

SEQ ID NO: 682044 - RNA, 20 nt, Human
uguccagaaaaaggacagcg

SEQ ID NO: 682045 - RNA, 25 nt, Human
uucucucaggugcagagguggagac

SEQ ID NO: 682046 - RNA, 22 nt, Human
uugguuacaaagcuggggcuaa

SEQ ID NO: 682047 - RNA, 26 nt, Human
aaaaaacuacgaaacaaauauacuga

SEQ ID NO: 682048 - RNA, 23 nt, Human
aaaaaagaaaaaaauuagccggg

SEQ ID NO: 682049 - RNA, 20 nt, Human
aaaaacuacgaaacaaauau

SEQ ID NO: 682050 - RNA, 23 nt, Human
aaaaacuacgaaacaaauauacu

SEQ ID NO: 682051 - RNA, 22 nt, Human
aaacaaauauacugagauccuc

SEQ ID NO: 682052 - RNA, 21 nt, Human
aaacuguuuccagaucccccg

SEQ ID NO: 682053 - RNA, 25 nt, Human
aaagggaaagggaaaaggaaaggga

SEQ ID NO: 682054 - RNA, 19 nt, Human
aaagggaagggaagggaag

SEQ ID NO: 682055 - RNA, 20 nt, Human
aacauggugaaaccuugucu

SEQ ID NO: 682056 - RNA, 21 nt, Human
aacauggugaaaccuugucuc

SEQ ID NO: 682057 - RNA, 22 nt, Human
aacuccagccugggugacagag

SEQ ID NO: 682058 - RNA, 23 nt, Human
aacuccagccugggugacagagc

SEQ ID NO: 682059 - RNA, 23 nt, Human
aagacacacauuaagccaugaca

SEQ ID NO: 682060 - RNA, 23 nt, Human
aagaggcugaggcaggagaauca

SEQ ID NO: 682061 - RNA, 24 nt, Human
aaguaugcaaacauucaaaguucu

SEQ ID NO: 682062 - RNA, 24 nt, Human
aaucacuugaacccgggaggugga

SEQ ID NO: 682063 - RNA, 24 nt, Human
acagagcgagacucugucucaaaa

SEQ ID NO: 682064 - RNA, 22 nt, Human
acauuaagccaugacaaccaca

SEQ ID NO: 682065 - RNA, 22 nt, Human
accacugcacuccagccugggc

SEQ ID NO: 682066 - RNA, 24 nt, Human
accuugucucuacuaaaaauacaa

SEQ ID NO: 682067 - RNA, 23 nt, Human
acuccagccugggugacagagcg

SEQ ID NO: 682068 - RNA, 24 nt, Human
acugaacuccagccugggugacag

SEQ ID NO: 682069 - RNA, 26 nt, Human
acugaacuccagccugggugacagag

SEQ ID NO: 682070 - RNA, 21 nt, Human
acugcacuccagccugggcaa

SEQ ID NO: 682071 - RNA, 24 nt, Human
acugcacuccagccugggcaauag

SEQ ID NO: 682072 - RNA, 19 nt, Human
agacagaggagggaagggu

SEQ ID NO: 682073 - RNA, 19 nt, Human
agaggagggaaggguaggg

SEQ ID NO: 682074 - RNA, 19 nt, Human
agaggagggaaggguaggg

SEQ ID NO: 682075 - RNA, 24 nt, Human
agauggagguugcagugagccaag

SEQ ID NO: 682076 - RNA, 23 nt, Human
agccgggcaugcuggcacaugcc

SEQ ID NO: 682077 - RNA, 23 nt, Human
agccuggcgugguggugugcgcc

SEQ ID NO: 682078 - RNA, 24 nt, Human
agccugggugacagagcgagacuc

SEQ ID NO: 682079 - RNA, 23 nt, Human
agccuggucaacauggugaaacc

SEQ ID NO: 682080 - RNA, 25 nt, Human
agccuggucaacauggugaaaccuu

SEQ ID NO: 682081 - RNA, 18 nt, Human
agcuguguugcuucacua

SEQ ID NO: 682082 - RNA, 25 nt, Human
aggagggaaggguaggggaagggga

SEQ ID NO: 682083 - RNA, 21 nt, Human
aggaguucaagaccagccugg

SEQ ID NO: 682084 - RNA, 18 nt, Human
aggcaggagaagcgcuug

SEQ ID NO: 682085 - RNA, 18 nt, Human
aggcaggagaaucacuug

SEQ ID NO: 682086 - RNA, 24 nt, Human
aggcaggagaaucacuugaacccg

SEQ ID NO: 682087 - RNA, 18 nt, Human
aggccaagguaggcagau

SEQ ID NO: 682088 - RNA, 24 nt, Human
aggcugaggcaggagaagcgcuug

SEQ ID NO: 682089 - RNA, 24 nt, Human
aggcugaggcaggagaaucacuug

SEQ ID NO: 682090 - RNA, 22 nt, Human
agggaaaaggaaagggaaggga

SEQ ID NO: 682091 - RNA, 19 nt, Human
agggaaggguaggggaagg

SEQ ID NO: 682092 - RNA, 26 nt, Human
agguaggcagauuaccugaggucaag

SEQ ID NO: 682093 - RNA, 21 nt, Human
agguggagguugcaguaagcc

SEQ ID NO: 682094 - RNA, 24 nt, Human
agguggagguugcaguaagccgag

SEQ ID NO: 682095 - RNA, 24 nt, Human
aggugugauagcucacgccuguga

SEQ ID NO: 682096 - RNA, 23 nt, Human
auagcucacgccugugaucccag

SEQ ID NO: 682097 - RNA, 20 nt, Human
caacauggugaaaccuuguc

SEQ ID NO: 682098 - RNA, 22 nt, Human
caacauggugaaaccuugucuc

SEQ ID NO: 682099 - RNA, 24 nt, Human
caacauggugaaaccuugucucua

SEQ ID NO: 682100 - RNA, 24 nt, Human
caagaccagccuggucaacauggu

SEQ ID NO: 682101 - RNA, 24 nt, Human
caagguaggcagauuaccugaggu

SEQ ID NO: 682102 - RNA, 26 nt, Human
caagguaggcagauuaccugagguca

SEQ ID NO: 682103 - RNA, 24 nt, Human
cacgccugugaucccagcacuuug

SEQ ID NO: 682104 - RNA, 22 nt, Human
cacuauuugagaaucaaguucu

SEQ ID NO: 682105 - RNA, 24 nt, Human
cacuauuugagaaucaaguucuuu

SEQ ID NO: 682106 - RNA, 24 nt, Human
cacugaacuccagccugggugaca

SEQ ID NO: 682107 - RNA, 19 nt, Human
cacugcacuccagccuggg

SEQ ID NO: 682108 - RNA, 21 nt, Human
cacugcacuccagccugggca

SEQ ID NO: 682109 - RNA, 22 nt, Human
cacugcacuccagccugggcaa

SEQ ID NO: 682110 - RNA, 23 nt, Human
cacugcacuccagccugggcaau

SEQ ID NO: 682111 - RNA, 24 nt, Human
cacugcacuccagccugggcaaua

SEQ ID NO: 682112 - RNA, 26 nt, Human
cacugcacuccagccugggcaauaga

SEQ ID NO: 682113 - RNA, 25 nt, Human
cagaucccccgaggcuccugggucu

SEQ ID NO: 682114 - RNA, 25 nt, Human
cagauuaccugaggucaaggaguuc

SEQ ID NO: 682115 - RNA, 21 nt, Human
cagcacuuugggaggccaagg

SEQ ID NO: 682116 - RNA, 25 nt, Human
cagcacuuugggaggccaagguagg

SEQ ID NO: 682117 - RNA, 20 nt, Human
cagcaucaagggucgaacgg

SEQ ID NO: 682118 - RNA, 24 nt, Human
cagcuacucaagaggcugaggcag

SEQ ID NO: 682119 - RNA, 24 nt, Human
cagcuacucaggaggcugaggcag

SEQ ID NO: 682120 - RNA, 22 nt, Human
caggagaagcgcuugagccccg

SEQ ID NO: 682121 - RNA, 19 nt, Human
caucccaacccggaugccc

SEQ ID NO: 682122 - RNA, 22 nt, Human
cauuuauauaugauacacaaga

SEQ ID NO: 682123 - RNA, 20 nt, Human
ccacugaacuccagccuggg

SEQ ID NO: 682124 - RNA, 20 nt, Human
ccacugaacuccagccuggg

SEQ ID NO: 682125 - RNA, 23 nt, Human
ccacugaacuccagccuggguga

SEQ ID NO: 682126 - RNA, 24 nt, Human
ccacugaacuccagccugggugac

SEQ ID NO: 682127 - RNA, 20 nt, Human
ccacugcacuccagccuggg

SEQ ID NO: 682128 - RNA, 20 nt, Human
ccacugcacuccagccuggg

SEQ ID NO: 682129 - RNA, 20 nt, Human
ccacugcacuccagccuggg

SEQ ID NO: 682130 - RNA, 21 nt, Human
ccacugcacuccagccugggc

SEQ ID NO: 682131 - RNA, 22 nt, Human
ccacugcacuccagccugggca

SEQ ID NO: 682132 - RNA, 23 nt, Human
ccacugcacuccagccugggcaa

SEQ ID NO: 682133 - RNA, 23 nt, Human
ccacugcacuccagccugggcaa

SEQ ID NO: 682134 - RNA, 24 nt, Human
ccacugcacuccagccugggcaau

SEQ ID NO: 682135 - RNA, 18 nt, Human
cccccgaggcuccugggg

SEQ ID NO: 682136 - RNA, 23 nt, Human
ccccgaggcuccugggucuccac

SEQ ID NO: 682137 - RNA, 20 nt, Human
cccggagauggagguugcag

SEQ ID NO: 682138 - RNA, 21 nt, Human
cccgggagguggagguugcag

SEQ ID NO: 682139 - RNA, 21 nt, Human
ccuccuaucuccaucccaacc

SEQ ID NO: 682140 - RNA, 18 nt, Human
ccucucagcuguguugcu

SEQ ID NO: 682141 - RNA, 23 nt, Human
ccucucagcuguguugcuucacu

SEQ ID NO: 682142 - RNA, 23 nt, Human
ccugaggucaaggaguucaagac

SEQ ID NO: 682143 - RNA, 23 nt, Human
ccugggucuccacgcagcuuggg

SEQ ID NO: 682144 - RNA, 22 nt, Human
ccugggugacagagcgagacuc

SEQ ID NO: 682145 - RNA, 21 nt, Human
ccuggucaacauggugaaacc

SEQ ID NO: 682146 - RNA, 24 nt, Human
ccuggucaacauggugaaaccuug

SEQ ID NO: 682147 - RNA, 19 nt, Human
ccuguaaucccagcuacuc

SEQ ID NO: 682148 - RNA, 21 nt, Human
ccuguaaucccagcuacucag

SEQ ID NO: 682149 - RNA, 22 nt, Human
ccuguagucccagcuacucaag

SEQ ID NO: 682150 - RNA, 22 nt, Human
ccugugaucccagcacuuuggg

SEQ ID NO: 682151 - RNA, 23 nt, Human
cgagacucugucucaaaaaaaga

SEQ ID NO: 682152 - RNA, 21 nt, Human
cgcaccacugcacuccagccu

SEQ ID NO: 682153 - RNA, 19 nt, Human
cgccuguagucccagcuac

SEQ ID NO: 682154 - RNA, 22 nt, Human
cgccuguagucccagcuacuca

SEQ ID NO: 682155 - RNA, 23 nt, Human
cgccugugaucccagcacuuugg

SEQ ID NO: 682156 - RNA, 23 nt, Human
cggagauggagguugcagugagc

SEQ ID NO: 682157 - RNA, 29 nt, Human
cgggagguggagguugcaguaacaacggu

SEQ ID NO: 682158 - RNA, 24 nt, Human
cgggagguggagguugcaguaagc

SEQ ID NO: 682159 - RNA, 22 nt, Human
cucacgccugugaucccagcac

SEQ ID NO: 682160 - RNA, 24 nt, Human
cucacgccugugaucccagcacuu

SEQ ID NO: 682161 - RNA, 21 nt, Human
cuccugggucuccacgcagcu

SEQ ID NO: 682162 - RNA, 20 nt, Human
cugaaucuccagggaguccc

SEQ ID NO: 682163 - RNA, 21 nt, Human
cuggcacaugccuguaauccc

SEQ ID NO: 682164 - RNA, 18 nt, Human
cugggucuccacgcagcu

SEQ ID NO: 682165 - RNA, 24 nt, Human
cuggucaacauggugaaaccuugu

SEQ ID NO: 682166 - RNA, 21 nt, Human
cuugaacccgggagguggagg

SEQ ID NO: 682167 - RNA, 19 nt, Human
cuugagccccggagaugga

SEQ ID NO: 682168 - RNA, 18 nt, Human
gaaaaggaaagggaaggg

SEQ ID NO: 682169 - RNA, 23 nt, Human
gaaagggaaagggaaaaggaaag

SEQ ID NO: 682170 - RNA, 24 nt, Human
gaacuccagccugggugacagagc

SEQ ID NO: 682171 - RNA, 24 nt, Human
gacagagcgagacucugucucaaa

SEQ ID NO: 682172 - RNA, 19 nt, Human
gacccgccugcccgaccug

SEQ ID NO: 682173 - RNA, 23 nt, Human
gagaaucacuugaacccgggagg

SEQ ID NO: 682174 - RNA, 23 nt, Human
gagguugcaguaagccgaggucg

SEQ ID NO: 682175 - RNA, 23 nt, Human
gagguugcagugagccaaggucg

SEQ ID NO: 682176 - RNA, 24 nt, Human
gauagcucacgccugugaucccag

SEQ ID NO: 682177 - RNA, 24 nt, Human
gauuaccugaggucaaggaguuca

SEQ ID NO: 682178 - RNA, 25 nt, Human
gauuaccugaggucaaggaguucaa

SEQ ID NO: 682179 - RNA, 18 nt, Human
gcaauagacagaggaggg

SEQ ID NO: 682180 - RNA, 20 nt, Human
gcaccacugcacuccagccu

SEQ ID NO: 682181 - RNA, 23 nt, Human
gcaggagaaucacuugaacccgg

SEQ ID NO: 682182 - RNA, 24 nt, Human
gcuggcacaugccuguaaucccag

SEQ ID NO: 682183 - RNA, 20 nt, Human
ggaaagggaaaaggaaaggg

SEQ ID NO: 682184 - RNA, 19 nt, Human
ggaaagggaagggaaggga

SEQ ID NO: 682185 - RNA, 24 nt, Human
ggagguugcaguaagccgaggucg

SEQ ID NO: 682186 - RNA, 20 nt, Human
ggagguugcagugagccaag

SEQ ID NO: 682187 - RNA, 20 nt, Human
ggagguugcagugagccaag

SEQ ID NO: 682188 - RNA, 24 nt, Human
ggagguugcagugagccaaggucg

SEQ ID NO: 682189 - RNA, 21 nt, Human
ggccaggugugauagcucacg

SEQ ID NO: 682190 - RNA, 22 nt, Human
ggcgugguggugugcgccugua

SEQ ID NO: 682191 - RNA, 24 nt, Human
gggcaugcuggcacaugccuguaa

SEQ ID NO: 682192 - RNA, 24 nt, Human
gggccaggugugauagcucacgcc

SEQ ID NO: 682193 - RNA, 24 nt, Human
gguggugugcgccuguagucccag

SEQ ID NO: 682194 - RNA, 24 nt, Human
gucgcaccacugcacuccagccug

SEQ ID NO: 682195 - RNA, 21 nt, Human
gugaaaccuugucucuacuaa

SEQ ID NO: 682196 - RNA, 24 nt, Human
gugacagagcgagacucugucuca

SEQ ID NO: 682197 - RNA, 18 nt, Human
guggugugcgccuguagu

SEQ ID NO: 682198 - RNA, 20 nt, Human
uaaaaauacaaaaauuagcc

SEQ ID NO: 682199 - RNA, 21 nt, Human
uaaaaauacaaaaauuagccu

SEQ ID NO: 682200 - RNA, 19 nt, Human
uagacagaggagggaaggg

SEQ ID NO: 682201 - RNA, 24 nt, Human
uagcucacgccugugaucccagca

SEQ ID NO: 682202 - RNA, 18 nt, Human
uaggcagauuaccugagg

SEQ ID NO: 682203 - RNA, 24 nt, Human
uauacugagauccuccuaucucca

SEQ ID NO: 682204 - RNA, 18 nt, Human
ucaaggaguucaagacca

SEQ ID NO: 682205 - RNA, 22 nt, Human
ucacgccugugaucccagcacu

SEQ ID NO: 682206 - RNA, 24 nt, Human
ucacuugaacccgggagguggagg

SEQ ID NO: 682207 - RNA, 20 nt, Human
ucagccccauuccagggccu

SEQ ID NO: 682208 - RNA, 23 nt, Human
uccagccugggugacagagcgag

SEQ ID NO: 682209 - RNA, 24 nt, Human
uccagccugggugacagagcgaga

SEQ ID NO: 682210 - RNA, 21 nt, Human
uccauguugaaacacuucugg

SEQ ID NO: 682211 - RNA, 24 nt, Human
uccauguugaaacacuucuggggc

SEQ ID NO: 682212 - RNA, 24 nt, Human
ucccccgaggcuccugggucucca

SEQ ID NO: 682213 - RNA, 23 nt, Human
ucccugcagggaucucacuaccu

SEQ ID NO: 682214 - RNA, 18 nt, Human
ucgcaccacugaacucca

SEQ ID NO: 682215 - RNA, 23 nt, Human
ucgcaccacugaacuccagccug

SEQ ID NO: 682216 - RNA, 23 nt, Human
ucgcaccacugcacuccagccug

SEQ ID NO: 682217 - RNA, 23 nt, Human
ucucuacuaaaaauacaaaaauu

SEQ ID NO: 682218 - RNA, 21 nt, Human
ucugucucaaaaaaagaaaaa

SEQ ID NO: 682219 - RNA, 23 nt, Human
ucugucucaaaaaaagaaaaaaa

SEQ ID NO: 682220 - RNA, 23 nt, Human
ugagccaaggucgcaccacugca

SEQ ID NO: 682221 - RNA, 25 nt, Human
ugaggcaggagaagcgcuugagccc

SEQ ID NO: 682222 - RNA, 20 nt, Human
ugaggcaggagaaucacuug

SEQ ID NO: 682223 - RNA, 24 nt, Human
ugaggcaggagaaucacuugaacc

SEQ ID NO: 682224 - RNA, 25 nt, Human
ugaggcaggagaaucacuugaaccc

SEQ ID NO: 682225 - RNA, 24 nt, Human
ugccuguaaucccagcuacucagg

SEQ ID NO: 682226 - RNA, 24 nt, Human
ugcuggcacaugccuguaauccca

SEQ ID NO: 682227 - RNA, 22 nt, Human
uggaaagacacacauuaagcca

SEQ ID NO: 682228 - RNA, 21 nt, Human
uggcacaugccuguaauccca

SEQ ID NO: 682229 - RNA, 22 nt, Human
uggcacaugccuguaaucccag

SEQ ID NO: 682230 - RNA, 22 nt, Human
ugggaggccaagguaggcagau

SEQ ID NO: 682231 - RNA, 21 nt, Human
ugggcaauagacagaggaggg

SEQ ID NO: 682232 - RNA, 21 nt, Human
ugggugcgacuucccuggauc

SEQ ID NO: 682233 - RNA, 24 nt, Human
ugguggugugcgccuguaguccca

SEQ ID NO: 682234 - RNA, 18 nt, Human
uggugugcgccuguaguc

SEQ ID NO: 682235 - RNA, 21 nt, Human
uggugugcgccuguaguccca

SEQ ID NO: 682236 - RNA, 24 nt, Human
uggugugcgccuguagucccagcu

SEQ ID NO: 682237 - RNA, 24 nt, Human
uuagccuggcgugguggugugcgc

SEQ ID NO: 682238 - RNA, 20 nt, Human
uuccagaucccccgaggcuc

SEQ ID NO: 682239 - RNA, 25 nt, Human
uucccaggcgaaugagaaucccaau

SEQ ID NO: 682240 - RNA, 24 nt, Human
uugaacccgggagguggagguugc

SEQ ID NO: 682241 - RNA, 22 nt, Human
uugcaguaagccgaggucgcac

SEQ ID NO: 682242 - RNA, 22 nt, Human
uugcagugagccaaggucgcac

SEQ ID NO: 682243 - RNA, 25 nt, Human
uuucccaggcgaaugagaaucccaa

SEQ ID NO: 682244 - RNA, 24 nt, Human
aaacagaauaaaaacuaagggccc

SEQ ID NO: 682245 - RNA, 25 nt, Human
aaacagaauaaaaacuaagggccca

SEQ ID NO: 682246 - RNA, 21 nt, Human
aaacccaccagcugucuuugg

SEQ ID NO: 682247 - RNA, 24 nt, Human
aaaggaggagagagagaaaaggga

SEQ ID NO: 682248 - RNA, 18 nt, Human
aaccccccuggaaaaugg

SEQ ID NO: 682249 - RNA, 24 nt, Human
aaccccccuggaaaaugggggugg

SEQ ID NO: 682250 - RNA, 20 nt, Human
aagaagcggggugaugggag

SEQ ID NO: 682251 - RNA, 20 nt, Human
aagaagguggggaggacagu

SEQ ID NO: 682252 - RNA, 27 nt, Human
aagcaggaggaaaggaaaggggacccc

SEQ ID NO: 682253 - RNA, 21 nt, Human
aagccccuccacccggucugg

SEQ ID NO: 682254 - RNA, 19 nt, Human
aagcggggugaugggaggc

SEQ ID NO: 682255 - RNA, 23 nt, Human
acacacacacacacacacacaca

SEQ ID NO: 682256 - RNA, 23 nt, Human
acacacacacacacacacacaca

SEQ ID NO: 682257 - RNA, 23 nt, Human
acacacacacacacacacacaca

SEQ ID NO: 682258 - RNA, 23 nt, Human
acacacacacacacacacacaca

SEQ ID NO: 682259 - RNA, 24 nt, Human
acacacacacacacacacacacaa

SEQ ID NO: 682260 - RNA, 19 nt, Human
acaccaaaucccagaagcc

SEQ ID NO: 682261 - RNA, 18 nt, Human
acagggcccugggggugg

SEQ ID NO: 682262 - RNA, 22 nt, Human
acaugucuccagguuacaacca

SEQ ID NO: 682263 - RNA, 22 nt, Human
accaaaucccagaagccccucc

SEQ ID NO: 682264 - RNA, 24 nt, Human
accacacacacacacacacacaca

SEQ ID NO: 682265 - RNA, 27 nt, Human
acccccacccaccagccuacccuccau

SEQ ID NO: 682266 - RNA, 25 nt, Human
agacagagacauauaauaaacagaa

SEQ ID NO: 682267 - RNA, 18 nt, Human
agacagauacgcaggcag

SEQ ID NO: 682268 - RNA, 23 nt, Human
agagagcuuuuggcaugaccuga

SEQ ID NO: 682269 - RNA, 23 nt, Human
agaggggaccagcaguccgcaag

SEQ ID NO: 682270 - RNA, 22 nt, Human
agagguugacagggcccugggg

SEQ ID NO: 682271 - RNA, 19 nt, Human
agcagcaagauagggaggg

SEQ ID NO: 682272 - RNA, 23 nt, Human
agccacagggguggcgugguggg

SEQ ID NO: 682273 - RNA, 18 nt, Human
aggaagaagguggggagg

SEQ ID NO: 682274 - RNA, 20 nt, Human
aggaagaagguggggaggac

SEQ ID NO: 682275 - RNA, 21 nt, Human
aggaggaaaggaaaggguugg

SEQ ID NO: 682276 - RNA, 21 nt, Human
aggaggaggcaaggcugagga

SEQ ID NO: 682277 - RNA, 22 nt, Human
aggcaaggcugaggaaggaccc

SEQ ID NO: 682278 - RNA, 19 nt, Human
aggccgggaccggcgaguc

SEQ ID NO: 682279 - RNA, 25 nt, Human
aguguccuuucacuaaccccugccu

SEQ ID NO: 682280 - RNA, 22 nt, Human
aucccaucgccauuccccucca

SEQ ID NO: 682281 - RNA, 28 nt, Human
aucgccauuccccuccacaugucuccag

SEQ ID NO: 682282 - RNA, 19 nt, Human
aucuguggcuucagugcag

SEQ ID NO: 682283 - RNA, 18 nt, Human
caaaacaugauccugagc

SEQ ID NO: 682284 - RNA, 23 nt, Human
caaggggaaacccaccagcuguc

SEQ ID NO: 682285 - RNA, 20 nt, Human
cacacacacacacacacaca

SEQ ID NO: 682286 - RNA, 20 nt, Human
cacacacacacacacacaca

SEQ ID NO: 682287 - RNA, 20 nt, Human
cacacacacacacacacaca

SEQ ID NO: 682288 - RNA, 20 nt, Human
cacacacacacacacacaca

SEQ ID NO: 682289 - RNA, 20 nt, Human
cacacacacacacacacaca

SEQ ID NO: 682290 - RNA, 20 nt, Human
cacacacacacacacacaca

SEQ ID NO: 682291 - RNA, 20 nt, Human
cacacacacacacacacaca

SEQ ID NO: 682292 - RNA, 20 nt, Human
cacacacacacacacacaca

SEQ ID NO: 682293 - RNA, 20 nt, Human
cacacacacacacacacaca

SEQ ID NO: 682294 - RNA, 20 nt, Human
cacacacacacacacacaca

SEQ ID NO: 682295 - RNA, 20 nt, Human
cacacacacacacacacaca

SEQ ID NO: 682296 - RNA, 22 nt, Human
cacacacacacacacacacaca

SEQ ID NO: 682297 - RNA, 22 nt, Human
cacacacacacacacacacaca

SEQ ID NO: 682298 - RNA, 22 nt, Human
cacacacacacacacacacaca

SEQ ID NO: 682299 - RNA, 22 nt, Human
cacacacacacacacacacaca

SEQ ID NO: 682300 - RNA, 22 nt, Human
cacacacacacacacacacaca

SEQ ID NO: 682301 - RNA, 22 nt, Human
cacacacacacacacacacaca

SEQ ID NO: 682302 - RNA, 26 nt, Human
cacacacacacacacacacacacaca

SEQ ID NO: 682303 - RNA, 26 nt, Human
cacacacacacacacacacacacaca

SEQ ID NO: 682304 - RNA, 26 nt, Human
cacacacacacacacacacacacaca

SEQ ID NO: 682305 - RNA, 26 nt, Human
cacacacacacacacacacacacaca

SEQ ID NO: 682306 - RNA, 26 nt, Human
cacacacacacacacacacacacaca

SEQ ID NO: 682307 - RNA, 26 nt, Human
cacacacacacacacacacacacaca

SEQ ID NO: 682308 - RNA, 20 nt, Human
caccaaaucccagaagcccc

SEQ ID NO: 682309 - RNA, 21 nt, Human
caccacacacacacacacaca

SEQ ID NO: 682310 - RNA, 23 nt, Human
caccacacacacacacacacaca

SEQ ID NO: 682311 - RNA, 18 nt, Human
cacccaccagccuacccu

SEQ ID NO: 682312 - RNA, 22 nt, Human
cagaaggcuaaaugcucugucc

SEQ ID NO: 682313 - RNA, 18 nt, Human
cagaagucaguccaggug

SEQ ID NO: 682314 - RNA, 18 nt, Human
cagcagacaccaaauccc

SEQ ID NO: 682315 - RNA, 23 nt, Human
cagcagcagacaccaaaucccag

SEQ ID NO: 682316 - RNA, 19 nt, Human
cagccuacccuccaucugu

SEQ ID NO: 682317 - RNA, 20 nt, Human
caggaggugcuacaaaacau

SEQ ID NO: 682318 - RNA, 21 nt, Human
cagucccaccccaggcagggg

SEQ ID NO: 682319 - RNA, 21 nt, Human
ccacacacacacacacacaca

SEQ ID NO: 682320 - RNA, 22 nt, Human
ccaccagccuacccuccaucug

SEQ ID NO: 682321 - RNA, 21 nt, Human
ccacccaccagccuacccucc

SEQ ID NO: 682322 - RNA, 25 nt, Human
ccagaagccccuccacccggucugg

SEQ ID NO: 682323 - RNA, 24 nt, Human
ccagccuacccuccaucuguggcu

SEQ ID NO: 682324 - RNA, 18 nt, Human
cccaacaagaagcggggu

SEQ ID NO: 682325 - RNA, 26 nt, Human
ccccccuggaaaaugggggugggggc

SEQ ID NO: 682326 - RNA, 24 nt, Human
cccccggggagcugggcucggggg

SEQ ID NO: 682327 - RNA, 25 nt, Human
ccccggggagcugggcucgggggcg

SEQ ID NO: 682328 - RNA, 19 nt, Human
ccccugagugccaagagga

SEQ ID NO: 682329 - RNA, 18 nt, Human
ccccuuggguggugaggg

SEQ ID NO: 682330 - RNA, 20 nt, Human
cccugagugccaagaggagc

SEQ ID NO: 682331 - RNA, 21 nt, Human
ccgccgcggcccuggccgccc

SEQ ID NO: 682332 - RNA, 19 nt, Human
ccuagacuggggguuccug

SEQ ID NO: 682333 - RNA, 24 nt, Human
ccucgccguccucgcugcaguccg

SEQ ID NO: 682334 - RNA, 26 nt, Human
ccugcaccacacacacacacacacag

SEQ ID NO: 682335 - RNA, 20 nt, Human
ccuggcucagggaagauggg

SEQ ID NO: 682336 - RNA, 23 nt, Human
ccuggcucagggaagaugggguu

SEQ ID NO: 682337 - RNA, 28 nt, Human
cuaacccuggaaguguccuuucacuaac

SEQ ID NO: 682338 - RNA, 19 nt, Human
cuccacccggucuggcucc

SEQ ID NO: 682339 - RNA, 31 nt, Human
cugcaccacacacacacacacacacacacag

SEQ ID NO: 682340 - RNA, 22 nt, Human
cuggaaaaugggggugggggca

SEQ ID NO: 682341 - RNA, 23 nt, Human
cuggaaggagggaaggagagggg

SEQ ID NO: 682342 - RNA, 21 nt, Human
cuggaaguguccuuucacuaa

SEQ ID NO: 682343 - RNA, 27 nt, Human
cuggagcucaggccuucacuacugugc

SEQ ID NO: 682344 - RNA, 20 nt, Human
cugguggagugguggccaga

SEQ ID NO: 682345 - RNA, 18 nt, Human
cuguagcagccacagggg

SEQ ID NO: 682346 - RNA, 22 nt, Human
cuucugguaaccagugccugag

SEQ ID NO: 682347 - RNA, 25 nt, Human
gaagccccuccacccggucuggcuc

SEQ ID NO: 682348 - RNA, 20 nt, Human
gaaggcuaaaugcucugucc

SEQ ID NO: 682349 - RNA, 19 nt, Human
gaagguggggaggacagug

SEQ ID NO: 682350 - RNA, 21 nt, Human
gacaccaaaucccagaagccc

SEQ ID NO: 682351 - RNA, 21 nt, Human
gaccagcaguccgcaagcagg

SEQ ID NO: 682352 - RNA, 20 nt, Human
gagcagcaagauagggaggg

SEQ ID NO: 682353 - RNA, 22 nt, Human
gagcgggagggcuggguggcgg

SEQ ID NO: 682354 - RNA, 24 nt, Human
gagcuuuuggcaugaccugaaucu

SEQ ID NO: 682355 - RNA, 18 nt, Human
gaggagagagagaaaagg

SEQ ID NO: 682356 - RNA, 21 nt, Human
gaggagcagcaagauagggag

SEQ ID NO: 682357 - RNA, 22 nt, Human
gagggaaggagaggggaccagc

SEQ ID NO: 682358 - RNA, 19 nt, Human
gcacuccugcaccacacac

SEQ ID NO: 682359 - RNA, 21 nt, Human
gcacuccugcaccacacacac

SEQ ID NO: 682360 - RNA, 21 nt, Human
gccccgaggauucucagagac

SEQ ID NO: 682361 - RNA, 23 nt, Human
gccccgaggauucucagagacag

SEQ ID NO: 682362 - RNA, 18 nt, Human
gccgccgcggcccuggcc

SEQ ID NO: 682363 - RNA, 18 nt, Human
gcggagcgacugcgcucc

SEQ ID NO: 682364 - RNA, 19 nt, Human
ggaaacccaccagcugucu

SEQ ID NO: 682365 - RNA, 18 nt, Human
ggaaaggaaaggguuggg

SEQ ID NO: 682366 - RNA, 19 nt, Human
ggaaggagggaaggagagg

SEQ ID NO: 682367 - RNA, 21 nt, Human
ggaggaaaggaaaggguuggg

SEQ ID NO: 682368 - RNA, 18 nt, Human
ggagugguggccagagau

SEQ ID NO: 682369 - RNA, 18 nt, Human
ggcggcuccuuccccucc

SEQ ID NO: 682370 - RNA, 20 nt, Human
ggcgugguggggaagauggg

SEQ ID NO: 682371 - RNA, 23 nt, Human
ggcuguggccugagcgggagggc

SEQ ID NO: 682372 - RNA, 24 nt, Human
ggcuguggccugagcgggagggcu

SEQ ID NO: 682373 - RNA, 18 nt, Human
gggaacaucccuccaccc

SEQ ID NO: 682374 - RNA, 24 nt, Human
gggcaaugcggaggcuccggcugu

SEQ ID NO: 682375 - RNA, 23 nt, Human
gggcagccagggccggcccaggc

SEQ ID NO: 682376 - RNA, 18 nt, Human
ggggagcugggcucgggg

SEQ ID NO: 682377 - RNA, 22 nt, Human
gggggugggggcaaugcggagg

SEQ ID NO: 682378 - RNA, 23 nt, Human
gggggugggggcaaugcggaggc

SEQ ID NO: 682379 - RNA, 23 nt, Human
ggggugggggcaaugcggaggcu

SEQ ID NO: 682380 - RNA, 19 nt, Human
ggugagggugggccagggg

SEQ ID NO: 682381 - RNA, 18 nt, Human
gguggagugguggccaga

SEQ ID NO: 682382 - RNA, 21 nt, Human
gguggagugguggccagagau

SEQ ID NO: 682383 - RNA, 22 nt, Human
gguggugagggugggccagggg

SEQ ID NO: 682384 - RNA, 19 nt, Human
ucagcgaaagcugagggca

SEQ ID NO: 682385 - RNA, 20 nt, Human
ucagugcagaagucagucca

SEQ ID NO: 682386 - RNA, 19 nt, Human
uccagguuacaaccagaga

SEQ ID NO: 682387 - RNA, 20 nt, Human
ucccaucgccauuccccucc

SEQ ID NO: 682388 - RNA, 20 nt, Human
uccccuccugacauccccug

SEQ ID NO: 682389 - RNA, 26 nt, Human
uccuauaaucccaucgccauuccccu

SEQ ID NO: 682390 - RNA, 18 nt, Human
uccuccggaagucuggcu

SEQ ID NO: 682391 - RNA, 21 nt, Human
uccugagcagacccagacccc

SEQ ID NO: 682392 - RNA, 19 nt, Human
uccuguagcagccacaggg

SEQ ID NO: 682393 - RNA, 22 nt, Human
ucugguaaccagugccugaggc

SEQ ID NO: 682394 - RNA, 18 nt, Human
ucugugggcuuaaaggga

SEQ ID NO: 682395 - RNA, 18 nt, Human
ugaggaagaaggugggga

SEQ ID NO: 682396 - RNA, 18 nt, Human
ugaggaaggacccagcca

SEQ ID NO: 682397 - RNA, 23 nt, Human
ugaggaaggacccagccagcugg

SEQ ID NO: 682398 - RNA, 28 nt, Human
ugcaccacacacacacacacacacacag

SEQ ID NO: 682399 - RNA, 26 nt, Human
ugcaccacacacacacacacacacag

SEQ ID NO: 682400 - RNA, 24 nt, Human
ugcuccuguagcagccacaggggu

SEQ ID NO: 682401 - RNA, 20 nt, Human
ugcucugcccaucuggugga

SEQ ID NO: 682402 - RNA, 20 nt, Human
uggaaggagggaaggagagg

SEQ ID NO: 682403 - RNA, 24 nt, Human
uggaaguguccuuucacuaacccc

SEQ ID NO: 682404 - RNA, 21 nt, Human
uggccugagcgggagggcugg

SEQ ID NO: 682405 - RNA, 23 nt, Human
uggcgugguggggaagauggggu

SEQ ID NO: 682406 - RNA, 26 nt, Human
ugggaggcuccaggccgggcagauca

SEQ ID NO: 682407 - RNA, 21 nt, Human
ugggguucuagucucagccug

SEQ ID NO: 682408 - RNA, 21 nt, Human
ugggguucuagucucagccug

SEQ ID NO: 682409 - RNA, 18 nt, Human
uggguucaggcccaugcc

SEQ ID NO: 682410 - RNA, 19 nt, Human
ugguggagugguggccaga

SEQ ID NO: 682411 - RNA, 23 nt, Human
ugguggagugguggccagagaug

SEQ ID NO: 682412 - RNA, 22 nt, Human
uguagcagccacagggguggcg

SEQ ID NO: 682413 - RNA, 20 nt, Human
ugugagugaggaagaaggug

SEQ ID NO: 682414 - RNA, 18 nt, Human
uucuuccagaaggcuaaa

SEQ ID NO: 682415 - RNA, 18 nt, Human
uuuuuuuuuuuuuuuuug

SEQ ID NO: 682416 - RNA, 21 nt, Human
aaaagaccagacugaugggca

SEQ ID NO: 682417 - RNA, 19 nt, Human
aagaguaggaaauauggca

SEQ ID NO: 682418 - RNA, 21 nt, Human
aagugcagagaccacaccagc

SEQ ID NO: 682419 - RNA, 24 nt, Human
acaacaaauagcaccuguggggcc

SEQ ID NO: 682420 - RNA, 21 nt, Human
acaccagcaaaacaugcccag

SEQ ID NO: 682421 - RNA, 18 nt, Human
agagggaagggaacaguc

SEQ ID NO: 682422 - RNA, 21 nt, Human
agcaugaaagccaacaugacc

SEQ ID NO: 682423 - RNA, 21 nt, Human
aggaaaguggggugagagugg

SEQ ID NO: 682424 - RNA, 21 nt, Human
aggccucaggccucagcacag

SEQ ID NO: 682425 - RNA, 20 nt, Human
aggggaugggggagauaggg

SEQ ID NO: 682426 - RNA, 25 nt, Human
agugcagagaccacaccagcaaaac

SEQ ID NO: 682427 - RNA, 20 nt, Human
auguauauauauauauauga

SEQ ID NO: 682428 - RNA, 24 nt, Human
auuucuucagacucugggccgcca

SEQ ID NO: 682429 - RNA, 21 nt, Human
caacaugaccgcagaggaaaa

SEQ ID NO: 682430 - RNA, 23 nt, Human
caagccuuugcuugguagcccca

SEQ ID NO: 682431 - RNA, 21 nt, Human
caauuuauauucaauguuucc

SEQ ID NO: 682432 - RNA, 21 nt, Human
cacagcuucggagcacugccc

SEQ ID NO: 682433 - RNA, 19 nt, Human
caccccucucucccuagcc

SEQ ID NO: 682434 - RNA, 19 nt, Human
cagaaaguuggcagggagc

SEQ ID NO: 682435 - RNA, 22 nt, Human
cagacaggccacaggguugcca

SEQ ID NO: 682436 - RNA, 20 nt, Human
cagcaaaacaugcccagucu

SEQ ID NO: 682437 - RNA, 20 nt, Human
cauauguauauauauauaua

SEQ ID NO: 682438 - RNA, 24 nt, Human
cauauguauauauauauauaugca

SEQ ID NO: 682439 - RNA, 18 nt, Human
ccacaccagcaaaacaug

SEQ ID NO: 682440 - RNA, 22 nt, Human
ccaccagauggccaagagcaga

SEQ ID NO: 682441 - RNA, 24 nt, Human
ccagcaaaacaugcccagucuuag

SEQ ID NO: 682442 - RNA, 22 nt, Human
ccagcacaacaaauagcaccug

SEQ ID NO: 682443 - RNA, 21 nt, Human
ccaggacacuaacaaagggaa

SEQ ID NO: 682444 - RNA, 22 nt, Human
cccacgccugggccagcacaac

SEQ ID NO: 682445 - RNA, 21 nt, Human
ccccucuguuccuuccguucu

SEQ ID NO: 682446 - RNA, 18 nt, Human
ccgcagaggaaaaagacc

SEQ ID NO: 682447 - RNA, 22 nt, Human
ccgccaccaccaccagauggcc

SEQ ID NO: 682448 - RNA, 19 nt, Human
ccucaggccucagcacagg

SEQ ID NO: 682449 - RNA, 23 nt, Human
ccugaagugcagagaccacacca

SEQ ID NO: 682450 - RNA, 24 nt, Human
cucucucucucucucucucgucga

SEQ ID NO: 682451 - RNA, 22 nt, Human
cuucuucuuucccuuuggcccc

SEQ ID NO: 682452 - RNA, 30 nt, Human
cuuuccuggccacaccaaguuuggcaccuu

SEQ ID NO: 682453 - RNA, 19 nt, Human
gaacccaggacacuaacaa

SEQ ID NO: 682454 - RNA, 23 nt, Human
gacagcaccccucucucccuagc

SEQ ID NO: 682455 - RNA, 22 nt, Human
gaccacaccagcaaaacaugcc

SEQ ID NO: 682456 - RNA, 18 nt, Human
gacucugggccgccacca

SEQ ID NO: 682457 - RNA, 20 nt, Human
gauaaagcugaggaagaggc

SEQ ID NO: 682458 - RNA, 21 nt, Human
gcagauaaccuuuuguccaca

SEQ ID NO: 682459 - RNA, 19 nt, Human
gccccacgccugggccagc

SEQ ID NO: 682460 - RNA, 21 nt, Human
gccgccaauggcagggcagca

SEQ ID NO: 682461 - RNA, 25 nt, Human
gccgccaccaccaccagauggccaa

SEQ ID NO: 682462 - RNA, 20 nt, Human
ggaaaaagaccagacugaug

SEQ ID NO: 682463 - RNA, 24 nt, Human
gggaacucagaugccaccagucug

SEQ ID NO: 682464 - RNA, 19 nt, Human
gggcaggaaagugggguga

SEQ ID NO: 682465 - RNA, 22 nt, Human
gggcaugcagcuggccuuuggu

SEQ ID NO: 682466 - RNA, 23 nt, Human
gguagccccacgccugggccagc

SEQ ID NO: 682467 - RNA, 23 nt, Human
guauauauauauauaugcacaga

SEQ ID NO: 682468 - RNA, 24 nt, Human
guccaugggaacccaggacacuaa

SEQ ID NO: 682469 - RNA, 22 nt, Human
uaaauauauauacauauguaua

SEQ ID NO: 682470 - RNA, 21 nt, Human
uacgggggguuguuggcuuug

SEQ ID NO: 682471 - RNA, 18 nt, Human
uauacauauguauauaua

SEQ ID NO: 682472 - RNA, 19 nt, Human
uauacauauguauauauau

SEQ ID NO: 682473 - RNA, 20 nt, Human
uauacauauguauauauaua

SEQ ID NO: 682474 - RNA, 23 nt, Human
uauacauauguauauauauauau

SEQ ID NO: 682475 - RNA, 23 nt, Human
uauagaaaaaggagugcuuuuga

SEQ ID NO: 682476 - RNA, 18 nt, Human
uauauacauauguauaua

SEQ ID NO: 682477 - RNA, 24 nt, Human
uauauauacauauguauauauaua

SEQ ID NO: 682478 - RNA, 19 nt, Human
uauauauauauauaugcac

SEQ ID NO: 682479 - RNA, 28 nt, Human
uauauauguguauuuaaauauauauaca

SEQ ID NO: 682480 - RNA, 19 nt, Human
uauaugccaagccuuugcu

SEQ ID NO: 682481 - RNA, 18 nt, Human
uauguauauauauauaua

SEQ ID NO: 682482 - RNA, 24 nt, Human
uauguguauuuaaauauauauaca

SEQ ID NO: 682483 - RNA, 21 nt, Human
ucaccagcuucaauuuauauu

SEQ ID NO: 682484 - RNA, 24 nt, Human
ucaggccucagcacaggguggcaa

SEQ ID NO: 682485 - RNA, 21 nt, Human
ucccugaguccaugggaaccc

SEQ ID NO: 682486 - RNA, 24 nt, Human
ucccugcaacagagggaagggaac

SEQ ID NO: 682487 - RNA, 19 nt, Human
ucccuuuggccccccgaga

SEQ ID NO: 682488 - RNA, 23 nt, Human
ucuccagaaaguuggcagggagc

SEQ ID NO: 682489 - RNA, 19 nt, Human
ucuguuccuuccguucuuc

SEQ ID NO: 682490 - RNA, 23 nt, Human
ugaccgcagaggaaaaagaccag

SEQ ID NO: 682491 - RNA, 24 nt, Human
ugagccaaccaggugagcacacag

SEQ ID NO: 682492 - RNA, 19 nt, Human
ugaggaagaggccucaggc

SEQ ID NO: 682493 - RNA, 21 nt, Human
ugagggcuacccccuguugug

SEQ ID NO: 682494 - RNA, 18 nt, Human
ugaugggcaugcagcugg

SEQ ID NO: 682495 - RNA, 30 nt, Human
ugcacagagaaaccuuagccaacaaauccc

SEQ ID NO: 682496 - RNA, 24 nt, Human
ugcagagaccacaccagcaaaaca

SEQ ID NO: 682497 - RNA, 25 nt, Human
ugccaagccuuugcuugguagcccc

SEQ ID NO: 682498 - RNA, 18 nt, Human
ugccauuucuucagacuc

SEQ ID NO: 682499 - RNA, 23 nt, Human
ugccauuucuucagacucugggc

SEQ ID NO: 682500 - RNA, 18 nt, Human
ugcccccucuguuccuuc

SEQ ID NO: 682501 - RNA, 25 nt, Human
uggcagacagcaccccucucucccu

SEQ ID NO: 682502 - RNA, 26 nt, Human
uggcagacagcaccccucucucccua

SEQ ID NO: 682503 - RNA, 22 nt, Human
uggcagggcagcauggccagaa

SEQ ID NO: 682504 - RNA, 20 nt, Human
ugggaacccaggacacuaac

SEQ ID NO: 682505 - RNA, 23 nt, Human
ugggaacccaggacacuaacaaa

SEQ ID NO: 682506 - RNA, 25 nt, Human
ugggaacccaggacacuaacaaagg

SEQ ID NO: 682507 - RNA, 22 nt, Human
ugggauggauucaccagcuuca

SEQ ID NO: 682508 - RNA, 23 nt, Human
ugggauggauucaccagcuucaa

SEQ ID NO: 682509 - RNA, 18 nt, Human
uguacaauauauaugugu

SEQ ID NO: 682510 - RNA, 18 nt, Human
uguauauauauauauaug

SEQ ID NO: 682511 - RNA, 22 nt, Human
uguauauauauauauaugcaca

SEQ ID NO: 682512 - RNA, 24 nt, Human
uguguauuuaaauauauauacaua

SEQ ID NO: 682513 - RNA, 24 nt, Human
uguugugaccauuccugaagugca

SEQ ID NO: 682514 - RNA, 20 nt, Human
uucccuuuggccccccgaga

SEQ ID NO: 682515 - RNA, 18 nt, Human
uuccuggccacaccaagu

SEQ ID NO: 682516 - RNA, 18 nt, Human
uucucucucucucucucu

SEQ ID NO: 682517 - RNA, 22 nt, Human
uugaugagccaaccaggugagc

SEQ ID NO: 682518 - RNA, 20 nt, Human
uugaugaguggauccaguca

SEQ ID NO: 682519 - RNA, 19 nt, Human
uugcccccucuguuccuuc

SEQ ID NO: 682520 - RNA, 21 nt, Human
aaaccaccgaauucacaccca

SEQ ID NO: 682521 - RNA, 19 nt, Human
aaagacuuaaaccacagaa

SEQ ID NO: 682522 - RNA, 24 nt, Human
aaagugcugggacuacaggcauga

SEQ ID NO: 682523 - RNA, 18 nt, Human
aaaugagcaacuggcuca

SEQ ID NO: 682524 - RNA, 24 nt, Human
aagcagcuggccucacugcucuuc

SEQ ID NO: 682525 - RNA, 19 nt, Human
aagugcugggacuacaggc

SEQ ID NO: 682526 - RNA, 26 nt, Human
aagugcugggacuacaggcaugagcc

SEQ ID NO: 682527 - RNA, 19 nt, Human
acaggaaaggcgcugcugc

SEQ ID NO: 682528 - RNA, 20 nt, Human
acaggugcaggaaauacgga

SEQ ID NO: 682529 - RNA, 20 nt, Human
acccagaagcaccacaacuc

SEQ ID NO: 682530 - RNA, 18 nt, Human
accccaaccccuuauuag

SEQ ID NO: 682531 - RNA, 22 nt, Human
accccguuaugggcaccccaac

SEQ ID NO: 682532 - RNA, 24 nt, Human
acgcagccaggucggauauugggu

SEQ ID NO: 682533 - RNA, 21 nt, Human
acggcagcccagccagaaaca

SEQ ID NO: 682534 - RNA, 18 nt, Human
acgggguuucacuguguu

SEQ ID NO: 682535 - RNA, 19 nt, Human
acgggguuucacuguguua

SEQ ID NO: 682536 - RNA, 20 nt, Human
acgggguuucacuguguuag

SEQ ID NO: 682537 - RNA, 24 nt, Human
acgggguuucacuguguuagccag

SEQ ID NO: 682538 - RNA, 23 nt, Human
acucaggcuggagugcaguggug

SEQ ID NO: 682539 - RNA, 23 nt, Human
acugagcacagagaaguguucug

SEQ ID NO: 682540 - RNA, 18 nt, Human
acugaggggcgaaggccc

SEQ ID NO: 682541 - RNA, 21 nt, Human
acugcaagcuccgccucccag

SEQ ID NO: 682542 - RNA, 19 nt, Human
acuugacugcaaagacuua

SEQ ID NO: 682543 - RNA, 20 nt, Human
agacaggaaaggcgcugcug

SEQ ID NO: 682544 - RNA, 22 nt, Human
agcaggcggggcccagagaccc

SEQ ID NO: 682545 - RNA, 20 nt, Human
agccccaguguggauccaga

SEQ ID NO: 682546 - RNA, 18 nt, Human
aggcaggcugccagcagc

SEQ ID NO: 682547 - RNA, 18 nt, Human
aggcaugggccuggcuug

SEQ ID NO: 682548 - RNA, 25 nt, Human
aggcuggagugcaguggugugaucu

SEQ ID NO: 682549 - RNA, 19 nt, Human
aguagagacgggguuucac

SEQ ID NO: 682550 - RNA, 18 nt, Human
aguagcugggacuacagg

SEQ ID NO: 682551 - RNA, 20 nt, Human
agugcaguggugcaaucacg

SEQ ID NO: 682552 - RNA, 19 nt, Human
agugcaguggugugaucuc

SEQ ID NO: 682553 - RNA, 20 nt, Human
agugcaguggugugaucucg

SEQ ID NO: 682554 - RNA, 23 nt, Human
agugcaguggugugaucucggcu

SEQ ID NO: 682555 - RNA, 24 nt, Human
agugcaguggugugaucucggcuc

SEQ ID NO: 682556 - RNA, 21 nt, Human
auggagcugaguggaaauucc

SEQ ID NO: 682557 - RNA, 24 nt, Human
caaagugcugggacuacaggcaug

SEQ ID NO: 682558 - RNA, 20 nt, Human
caccccguuaugggcacccc

SEQ ID NO: 682559 - RNA, 22 nt, Human
cacgccauucuccugcuucagc

SEQ ID NO: 682560 - RNA, 23 nt, Human
cacggcagcccagccagaaacac

SEQ ID NO: 682561 - RNA, 20 nt, Human
cacuauacccugcccaugcc

SEQ ID NO: 682562 - RNA, 24 nt, Human
cacucaggcuggagugcaguggug

SEQ ID NO: 682563 - RNA, 22 nt, Human
cacugcagccuugaccucccag

SEQ ID NO: 682564 - RNA, 22 nt, Human
cacuggugccugggcuugcggu

SEQ ID NO: 682565 - RNA, 18 nt, Human
cacuguguuagccaggau

SEQ ID NO: 682566 - RNA, 19 nt, Human
cacuguguuagccaggaug

SEQ ID NO: 682567 - RNA, 24 nt, Human
cacuguguuagccaggauggucuc

SEQ ID NO: 682568 - RNA, 23 nt, Human
cagagacccagaagcaccacaac

SEQ ID NO: 682569 - RNA, 21 nt, Human
cagaggcccagaggcgacccc

SEQ ID NO: 682570 - RNA, 24 nt, Human
cagccccaguguggauccagaggu

SEQ ID NO: 682571 - RNA, 20 nt, Human
cagccucuggaguguccccu

SEQ ID NO: 682572 - RNA, 20 nt, Human
cagccuugaccucccaggcu

SEQ ID NO: 682573 - RNA, 20 nt, Human
cagcugccaucccacugagg

SEQ ID NO: 682574 - RNA, 22 nt, Human
cagcugccugcgccgcucugcc

SEQ ID NO: 682575 - RNA, 19 nt, Human
caggaaaggcgcugcugca

SEQ ID NO: 682576 - RNA, 18 nt, Human
caggaagcagcuggccuc

SEQ ID NO: 682577 - RNA, 19 nt, Human
caggcggggcccagagacc

SEQ ID NO: 682578 - RNA, 25 nt, Human
cagggccaccccguuaugggcaccc

SEQ ID NO: 682579 - RNA, 19 nt, Human
cauccucggccccaccccu

SEQ ID NO: 682580 - RNA, 24 nt, Human
cauucaaaaccaccgaauucacac

SEQ ID NO: 682581 - RNA, 19 nt, Human
ccaaagugcugggacuaca

SEQ ID NO: 682582 - RNA, 24 nt, Human
ccaaagugcugggacuacaggcau

SEQ ID NO: 682583 - RNA, 24 nt, Human
ccacaaggcacuuuaugcauucaa

SEQ ID NO: 682584 - RNA, 22 nt, Human
ccacagccccucuaguuaacuu

SEQ ID NO: 682585 - RNA, 20 nt, Human
ccacugaggggcgaaggccc

SEQ ID NO: 682586 - RNA, 24 nt, Human
cccaaagugcugggacuacaggca

SEQ ID NO: 682587 - RNA, 20 nt, Human
cccagagacccagaagcacc

SEQ ID NO: 682588 - RNA, 23 nt, Human
cccaggcucacaugauccuccca

SEQ ID NO: 682589 - RNA, 20 nt, Human
cccagguucacgccauucuc

SEQ ID NO: 682590 - RNA, 25 nt, Human
cccaugccacggccgccuucugaga

SEQ ID NO: 682591 - RNA, 24 nt, Human
ccccuccacuuucuuucuuagggg

SEQ ID NO: 682592 - RNA, 23 nt, Human
cccgaguagcugggacuacaggu

SEQ ID NO: 682593 - RNA, 24 nt, Human
cccgaguagcugggacuacaggug

SEQ ID NO: 682594 - RNA, 19 nt, Human
cccucagcugccaucccac

SEQ ID NO: 682595 - RNA, 20 nt, Human
cccugcccaugccacggccg

SEQ ID NO: 682596 - RNA, 21 nt, Human
ccgccuucugagaauaacgcu

SEQ ID NO: 682597 - RNA, 28 nt, Human
ccugaccuugugauccaccagccucggc

SEQ ID NO: 682598 - RNA, 19 nt, Human
cgccucccagguucacgcc

SEQ ID NO: 682599 - RNA, 24 nt, Human
cgcucaggcuggagugcaguggug

SEQ ID NO: 682600 - RNA, 24 nt, Human
cgcucugucacucaggcuggagug

SEQ ID NO: 682601 - RNA, 23 nt, Human
cggccgccuucugagaauaacgc

SEQ ID NO: 682602 - RNA, 24 nt, Human
cggcucacugcagccuugaccucc

SEQ ID NO: 682603 - RNA, 24 nt, Human
cgggguuucacuguguuagccagg

SEQ ID NO: 682604 - RNA, 21 nt, Human
cguuaugggcaccccaacccc

SEQ ID NO: 682605 - RNA, 18 nt, Human
cucacaugauccucccac

SEQ ID NO: 682606 - RNA, 22 nt, Human
cucacuauacccugcccaugcc

SEQ ID NO: 682607 - RNA, 18 nt, Human
cuccugaccuugugaucc

SEQ ID NO: 682608 - RNA, 24 nt, Human
cucgcucugucacucaggcuggag

SEQ ID NO: 682609 - RNA, 23 nt, Human
cucggccccaccccuugcgcagc

SEQ ID NO: 682610 - RNA, 22 nt, Human
cucugccuggacuugcauccuc

SEQ ID NO: 682611 - RNA, 24 nt, Human
cugcaagcuccgccucccagguuc

SEQ ID NO: 682612 - RNA, 22 nt, Human
cugcagccuugaccucccaggc

SEQ ID NO: 682613 - RNA, 23 nt, Human
cugcagccuugaccucccaggcu

SEQ ID NO: 682614 - RNA, 27 nt, Human
cugcugagcucauccgagaguccacgc

SEQ ID NO: 682615 - RNA, 23 nt, Human
cugcuucagccucccgaguagcu

SEQ ID NO: 682616 - RNA, 21 nt, Human
cuggggcuccucugcagucag

SEQ ID NO: 682617 - RNA, 18 nt, Human
cugucgcucaggcuggag

SEQ ID NO: 682618 - RNA, 19 nt, Human
cugucgcucaggcuggagu

SEQ ID NO: 682619 - RNA, 18 nt, Human
gacaggaaaggcgcugcu

SEQ ID NO: 682620 - RNA, 19 nt, Human
gaccuugugauccaccagc

SEQ ID NO: 682621 - RNA, 22 nt, Human
gaccuugugauccaccagccuc

SEQ ID NO: 682622 - RNA, 22 nt, Human
gaccuugugauccaccagccuc

SEQ ID NO: 682623 - RNA, 24 nt, Human
gaccuugugauccaccagccucgg

SEQ ID NO: 682624 - RNA, 21 nt, Human
gacuacaggcaugagccaccg

SEQ ID NO: 682625 - RNA, 24 nt, Human
gacuacaggcaugagccaccgugc

SEQ ID NO: 682626 - RNA, 19 nt, Human
gagacacuggugccugggc

SEQ ID NO: 682627 - RNA, 21 nt, Human
gagauggagucuugcucuguc

SEQ ID NO: 682628 - RNA, 18 nt, Human
gagggcaggcgggguagg

SEQ ID NO: 682629 - RNA, 26 nt, Human
gaguagcugggacuacaggugaccgc

SEQ ID NO: 682630 - RNA, 24 nt, Human
gagugcaguggugcaaucacggcu

SEQ ID NO: 682631 - RNA, 22 nt, Human
gcacacgucuccuuccacuccu

SEQ ID NO: 682632 - RNA, 20 nt, Human
gcacagagaaguguucugaa

SEQ ID NO: 682633 - RNA, 19 nt, Human
gccagcagcugagcugucc

SEQ ID NO: 682634 - RNA, 25 nt, Human
gccucccagguucacgccauucucc

SEQ ID NO: 682635 - RNA, 24 nt, Human
gccuggcuaauuuuuuuguauuuu

SEQ ID NO: 682636 - RNA, 19 nt, Human
gccuugaccucccaggcuc

SEQ ID NO: 682637 - RNA, 22 nt, Human
gcucacagcugccugcgccgcu

SEQ ID NO: 682638 - RNA, 20 nt, Human
gcucaggcuggagugcagug

SEQ ID NO: 682639 - RNA, 23 nt, Human
gcucaggcuggagugcaguggug

SEQ ID NO: 682640 - RNA, 24 nt, Human
gcucaggcuggagugcaguggugu

SEQ ID NO: 682641 - RNA, 18 nt, Human
ggaaauacggagggcagg

SEQ ID NO: 682642 - RNA, 21 nt, Human
ggacuacaggcaugagccacc

SEQ ID NO: 682643 - RNA, 24 nt, Human
ggacuacaggcaugagccaccgug

SEQ ID NO: 682644 - RNA, 19 nt, Human
ggagcugaguggaaauucc

SEQ ID NO: 682645 - RNA, 19 nt, Human
ggcccagagacccagaagc

SEQ ID NO: 682646 - RNA, 20 nt, Human
ggcucgguaacugccuggcg

SEQ ID NO: 682647 - RNA, 22 nt, Human
ggcuggagugcaguggugugau

SEQ ID NO: 682648 - RNA, 20 nt, Human
gggcaggcgggguagggggc

SEQ ID NO: 682649 - RNA, 23 nt, Human
gggccaggcaggcugccagcagc

SEQ ID NO: 682650 - RNA, 23 nt, Human
gggguuucacuguguuagccagg

SEQ ID NO: 682651 - RNA, 19 nt, Human
ggucucaaucuccugaccu

SEQ ID NO: 682652 - RNA, 23 nt, Human
guagagacgggguuucacugugu

SEQ ID NO: 682653 - RNA, 24 nt, Human
gugauccaccagccucggccuccc

SEQ ID NO: 682654 - RNA, 21 nt, Human
gugaucucggcucacugcaag

SEQ ID NO: 682655 - RNA, 20 nt, Human
guguccccuccacuuucuuu

SEQ ID NO: 682656 - RNA, 21 nt, Human
uaaaccacagacaggaaaggc

SEQ ID NO: 682657 - RNA, 24 nt, Human
uacaggcaugagccaccgugccca

SEQ ID NO: 682658 - RNA, 22 nt, Human
uacaggugaccgccaccacgcc

SEQ ID NO: 682659 - RNA, 23 nt, Human
uaccgcagggcugcuggacaacg

SEQ ID NO: 682660 - RNA, 20 nt, Human
uaguagagacgggguuucac

SEQ ID NO: 682661 - RNA, 23 nt, Human
uaguagagacgggguuucacugu

SEQ ID NO: 682662 - RNA, 24 nt, Human
uaguagagacgggguuucacugug

SEQ ID NO: 682663 - RNA, 25 nt, Human
uauuagggguguuaaucagcacaaa

SEQ ID NO: 682664 - RNA, 24 nt, Human
ucaaaaccaccgaauucacacccc

SEQ ID NO: 682665 - RNA, 19 nt, Human
ucaaucuccugaccuugug

SEQ ID NO: 682666 - RNA, 20 nt, Human
ucaaucuccugaccuuguga

SEQ ID NO: 682667 - RNA, 24 nt, Human
ucacucaggcuggagugcaguggu

SEQ ID NO: 682668 - RNA, 18 nt, Human
ucacugcaagcuccgccu

SEQ ID NO: 682669 - RNA, 19 nt, Human
ucacugcaagcuccgccuc

SEQ ID NO: 682670 - RNA, 19 nt, Human
ucacugcaagcuccgccuc

SEQ ID NO: 682671 - RNA, 24 nt, Human
ucacugcaagcuccgccucccagg

SEQ ID NO: 682672 - RNA, 19 nt, Human
ucacugcagccuugaccuc

SEQ ID NO: 682673 - RNA, 23 nt, Human
ucacugcagccuugaccucccag

SEQ ID NO: 682674 - RNA, 24 nt, Human
ucacugcagccuugaccucccagg

SEQ ID NO: 682675 - RNA, 24 nt, Human
ucacuguguuagccaggauggucu

SEQ ID NO: 682676 - RNA, 23 nt, Human
ucagccucccgaguagcugggac

SEQ ID NO: 682677 - RNA, 25 nt, Human
uccacuccucacuauacccugccca

SEQ ID NO: 682678 - RNA, 24 nt, Human
ucccaaagugcugggacuacaggc

SEQ ID NO: 682679 - RNA, 19 nt, Human
ucccagguucacgccauuc

SEQ ID NO: 682680 - RNA, 20 nt, Human
ucccagguucacgccauucu

SEQ ID NO: 682681 - RNA, 21 nt, Human
ucccagguucacgccauucuc

SEQ ID NO: 682682 - RNA, 24 nt, Human
ucccagguucacgccauucuccug

SEQ ID NO: 682683 - RNA, 23 nt, Human
ucccgaguagcugggacuacagg

SEQ ID NO: 682684 - RNA, 24 nt, Human
ucccgaguagcugggacuacaggu

SEQ ID NO: 682685 - RNA, 24 nt, Human
ucgcucaggcuggagugcaguggu

SEQ ID NO: 682686 - RNA, 24 nt, Human
ucgcucugucacucaggcuggagu

SEQ ID NO: 682687 - RNA, 18 nt, Human
ucggccucccaaagugcu

SEQ ID NO: 682688 - RNA, 19 nt, Human
ucucgcucugucacucagg

SEQ ID NO: 682689 - RNA, 22 nt, Human
ucucgcucugucacucaggcug

SEQ ID NO: 682690 - RNA, 23 nt, Human
ucucgcucugucacucaggcugg

SEQ ID NO: 682691 - RNA, 24 nt, Human
ucucgcucugucacucaggcugga

SEQ ID NO: 682692 - RNA, 21 nt, Human
ucugcacuucugaccuggggc

SEQ ID NO: 682693 - RNA, 28 nt, Human
ucuggaguguccccuccacuuucuuucu

SEQ ID NO: 682694 - RNA, 24 nt, Human
ucugucacucaggcuggagugcag

SEQ ID NO: 682695 - RNA, 24 nt, Human
ucugucgcucaggcuggagugcag

SEQ ID NO: 682696 - RNA, 20 nt, Human
ucuugcucugucgcucaggc

SEQ ID NO: 682697 - RNA, 22 nt, Human
ucuugcucugucgcucaggcug

SEQ ID NO: 682698 - RNA, 23 nt, Human
ucuugcucugucgcucaggcugg

SEQ ID NO: 682699 - RNA, 24 nt, Human
ucuugcucugucgcucaggcugga

SEQ ID NO: 682700 - RNA, 24 nt, Human
ugacaggugcaggaaauacggagg

SEQ ID NO: 682701 - RNA, 25 nt, Human
ugaccucccaggcucacaugauccu

SEQ ID NO: 682702 - RNA, 19 nt, Human
ugaccuugugauccaccag

SEQ ID NO: 682703 - RNA, 27 nt, Human
ugacugcaaagacuuaaaccacagaca

SEQ ID NO: 682704 - RNA, 22 nt, Human
ugagacagggucucgcucuguc

SEQ ID NO: 682705 - RNA, 22 nt, Human
ugcaguggugcaaucacggcuc

SEQ ID NO: 682706 - RNA, 22 nt, Human
ugcaguggugugaucucggcuc

SEQ ID NO: 682707 - RNA, 19 nt, Human
ugcccaugccacggccgcc

SEQ ID NO: 682708 - RNA, 19 nt, Human
ugcccuggggcuccucugc

SEQ ID NO: 682709 - RNA, 20 nt, Human
ugccugcgccgcucugccug

SEQ ID NO: 682710 - RNA, 19 nt, Human
ugccuggcguagcacaagg

SEQ ID NO: 682711 - RNA, 22 nt, Human
ugccugggcuugcgguaccgca

SEQ ID NO: 682712 - RNA, 24 nt, Human
ugcucugucgcucaggcuggagug

SEQ ID NO: 682713 - RNA, 23 nt, Human
ugcugagaacccuggucugcacu

SEQ ID NO: 682714 - RNA, 24 nt, Human
ugcugagcucauccgagaguccac

SEQ ID NO: 682715 - RNA, 24 nt, Human
ugcuucagccucccgaguagcugg

SEQ ID NO: 682716 - RNA, 23 nt, Human
uggagucuugcucugucgcucag

SEQ ID NO: 682717 - RNA, 21 nt, Human
uggagugcaguggugcaauca

SEQ ID NO: 682718 - RNA, 24 nt, Human
uggagugcaguggugcaaucacgg

SEQ ID NO: 682719 - RNA, 19 nt, Human
uggagugcaguggugugau

SEQ ID NO: 682720 - RNA, 23 nt, Human
uggagugcaguggugugaucucg

SEQ ID NO: 682721 - RNA, 24 nt, Human
uggagugcaguggugugaucucgg

SEQ ID NO: 682722 - RNA, 18 nt, Human
uggcuuggaugcaucagu

SEQ ID NO: 682723 - RNA, 18 nt, Human
ugggacuacaggcaugag

SEQ ID NO: 682724 - RNA, 21 nt, Human
ugggacuacaggcaugagcca

SEQ ID NO: 682725 - RNA, 22 nt, Human
ugggacuacaggcaugagccac

SEQ ID NO: 682726 - RNA, 23 nt, Human
ugggacuacaggcaugagccacc

SEQ ID NO: 682727 - RNA, 24 nt, Human
ugggacuacaggcaugagccaccg

SEQ ID NO: 682728 - RNA, 26 nt, Human
ugggacuacaggcaugagccaccgug

SEQ ID NO: 682729 - RNA, 21 nt, Human
ugggacuacaggugaccgcca

SEQ ID NO: 682730 - RNA, 22 nt, Human
ugggacuacaggugaccgccac

SEQ ID NO: 682731 - RNA, 24 nt, Human
ugggacuacaggugaccgccacca

SEQ ID NO: 682732 - RNA, 24 nt, Human
uggugcaaucacggcucacugcag

SEQ ID NO: 682733 - RNA, 21 nt, Human
uguauuuuuaguagagacggg

SEQ ID NO: 682734 - RNA, 22 nt, Human
uguccacaaggcacuuuaugca

SEQ ID NO: 682735 - RNA, 18 nt, Human
uguccccuccacuuucuu

SEQ ID NO: 682736 - RNA, 24 nt, Human
uguuuguuuuuugagacagggucu

SEQ ID NO: 682737 - RNA, 24 nt, Human
uuaccaggcacacgucuccuucca

SEQ ID NO: 682738 - RNA, 18 nt, Human
uuaguagagacgggguuu

SEQ ID NO: 682739 - RNA, 21 nt, Human
uuaguagagacgggguuucac

SEQ ID NO: 682740 - RNA, 21 nt, Human
uuaguagagacgggguuucac

SEQ ID NO: 682741 - RNA, 24 nt, Human
uuaguagagacgggguuucacugu

SEQ ID NO: 682742 - RNA, 21 nt, Human
uucacuguguuagccaggaug

SEQ ID NO: 682743 - RNA, 24 nt, Human
uucagccucccgaguagcugggac

SEQ ID NO: 682744 - RNA, 22 nt, Human
uucucuuuaaauccccagcaaa

SEQ ID NO: 682745 - RNA, 22 nt, Human
uugagacagggucucgcucugu

SEQ ID NO: 682746 - RNA, 23 nt, Human
uuguauuuuuaguagagacgggg

SEQ ID NO: 682747 - RNA, 25 nt, Human
uugugauccaccagccucggccucc

SEQ ID NO: 682748 - RNA, 21 nt, Human
uuguuuguuuguuuguuuuuu

SEQ ID NO: 682749 - RNA, 19 nt, Human
uuucacuguguuagccagg

SEQ ID NO: 682750 - RNA, 24 nt, Human
uuuuuaguagagacgggguuucac

SEQ ID NO: 682751 - RNA, 21 nt, Human
uuuuuguauuuuuaguagaga

SEQ ID NO: 682752 - RNA, 21 nt, Human
uuuuuuguauuuuuaguagag

SEQ ID NO: 682753 - RNA, 24 nt, Human
uuuuuuguauuuuuaguagagacg

SEQ ID NO: 682754 - RNA, 21 nt, Human
aagcagcagcucccauguccu

SEQ ID NO: 682755 - RNA, 19 nt, Human
aagcuggcacagagccccg

SEQ ID NO: 682756 - RNA, 22 nt, Human
agauucccacaagcagcagcuc

SEQ ID NO: 682757 - RNA, 20 nt, Human
caggcaccagauucccacaa

SEQ ID NO: 682758 - RNA, 21 nt, Human
cccacaagcagcagcucccau

SEQ ID NO: 682759 - RNA, 24 nt, Human
ccgacccuggagugaagaguaagc

SEQ ID NO: 682760 - RNA, 21 nt, Human
gaacaggcaccagauucccac

SEQ ID NO: 682761 - RNA, 24 nt, Human
guggaacaggcaccagauucccac

SEQ ID NO: 682762 - RNA, 22 nt, Human
ugagaaacucuaccccuugucu

SEQ ID NO: 682763 - RNA, 24 nt, Human
uggcacagagccccgacgcuggga

SEQ ID NO: 682764 - RNA, 18 nt, Human
uggcauccgacccuggag

SEQ ID NO: 682765 - RNA, 20 nt, Human
uguccuguagcacguggcau

SEQ ID NO: 682766 - RNA, 22 nt, Human
aaguaauccgcccaccucagcc

SEQ ID NO: 682767 - RNA, 20 nt, Human
aaguagcugggacuacaggc

SEQ ID NO: 682768 - RNA, 22 nt, Human
aaguagcugggacuacaggcau

SEQ ID NO: 682769 - RNA, 24 nt, Human
aaguagcugggacuacaggcaugc

SEQ ID NO: 682770 - RNA, 20 nt, Human
aaguguaagccacugcgacc

SEQ ID NO: 682771 - RNA, 20 nt, Human
acaaaacauucaaaagaaaa

SEQ ID NO: 682772 - RNA, 23 nt, Human
accacacccggcuaauuuuugua

SEQ ID NO: 682773 - RNA, 19 nt, Human
acugcagccugcaucuccu

SEQ ID NO: 682774 - RNA, 21 nt, Human
aggaggguggcggcgggaagc

SEQ ID NO: 682775 - RNA, 19 nt, Human
aggcuggagugcaguggca

SEQ ID NO: 682776 - RNA, 21 nt, Human
agugcaguggcacaaucacag

SEQ ID NO: 682777 - RNA, 25 nt, Human
aucacagcccacugcagccugcauc

SEQ ID NO: 682778 - RNA, 19 nt, Human
auggcagcgaggagggugg

SEQ ID NO: 682779 - RNA, 22 nt, Human
auuccagcccagagaauggcag

SEQ ID NO: 682780 - RNA, 24 nt, Human
cacauuggugcccaggcuggagug

SEQ ID NO: 682781 - RNA, 23 nt, Human
caccucagccucccaaguucuag

SEQ ID NO: 682782 - RNA, 24 nt, Human
cacuucagccucccaaguagcugg

SEQ ID NO: 682783 - RNA, 21 nt, Human
cagcccacugcagccugcauc

SEQ ID NO: 682784 - RNA, 21 nt, Human
cagcccagagaauggcagcga

SEQ ID NO: 682785 - RNA, 20 nt, Human
cagcgaggaggguggcggcg

SEQ ID NO: 682786 - RNA, 23 nt, Human
cauuggugcccaggcuggagugc

SEQ ID NO: 682787 - RNA, 23 nt, Human
cccaaguagcugggacuacaggc

SEQ ID NO: 682788 - RNA, 24 nt, Human
cccaaguagcugggacuacaggca

SEQ ID NO: 682789 - RNA, 23 nt, Human
cccacccucuccagcacugggaa

SEQ ID NO: 682790 - RNA, 20 nt, Human
cccacuucagccucccaagu

SEQ ID NO: 682791 - RNA, 23 nt, Human
ccgcccaccucagccucccaagu

SEQ ID NO: 682792 - RNA, 25 nt, Human
ccgcccaccucagccucccaaguuc

SEQ ID NO: 682793 - RNA, 18 nt, Human
ccucagcccacccucucc

SEQ ID NO: 682794 - RNA, 26 nt, Human
ccucccacuucagccucccaaguagc

SEQ ID NO: 682795 - RNA, 18 nt, Human
ccugggcucaaguaaucc

SEQ ID NO: 682796 - RNA, 24 nt, Human
ccugggcucaaguaauccgcccac

SEQ ID NO: 682797 - RNA, 24 nt, Human
cucaaguaauccgcccaccucagc

SEQ ID NO: 682798 - RNA, 21 nt, Human
cuccugggcucaaguaauccg

SEQ ID NO: 682799 - RNA, 23 nt, Human
gaaaauucuucauuuagagugac

SEQ ID NO: 682800 - RNA, 21 nt, Human
gcacugggaauauauuuaugc

SEQ ID NO: 682801 - RNA, 19 nt, Human
gcccaggcuggagugcagu

SEQ ID NO: 682802 - RNA, 19 nt, Human
gcuggagugcaguggcaca

SEQ ID NO: 682803 - RNA, 19 nt, Human
gcuggucccgaacuccugg

SEQ ID NO: 682804 - RNA, 18 nt, Human
ggaggguggcggcgggaa

SEQ ID NO: 682805 - RNA, 18 nt, Human
ggcaggcugaaggcucau

SEQ ID NO: 682806 - RNA, 24 nt, Human
gggcucaaguaauccgcccaccuc

SEQ ID NO: 682807 - RNA, 22 nt, Human
ggguuacaaguguaagccacug

SEQ ID NO: 682808 - RNA, 24 nt, Human
guaauccgcccaccucagccuccc

SEQ ID NO: 682809 - RNA, 24 nt, Human
gugcccaggcuggagugcaguggc

SEQ ID NO: 682810 - RNA, 24 nt, Human
uaauuuuuguacuuuuuguaggga

SEQ ID NO: 682811 - RNA, 23 nt, Human
uacaggcaugcacuaccacaccc

SEQ ID NO: 682812 - RNA, 22 nt, Human
uaggguuacaaguguaagccac

SEQ ID NO: 682813 - RNA, 24 nt, Human
uaggguuacaaguguaagccacug

SEQ ID NO: 682814 - RNA, 24 nt, Human
uauauuucccaggcuggucccgaa

SEQ ID NO: 682815 - RNA, 22 nt, Human
uauuuuacauacaaaacauuca

SEQ ID NO: 682816 - RNA, 20 nt, Human
ucaaaagaaaauucuucauu

SEQ ID NO: 682817 - RNA, 24 nt, Human
ucacauuggugcccaggcuggagu

SEQ ID NO: 682818 - RNA, 22 nt, Human
ucagcccacccucuccagcacu

SEQ ID NO: 682819 - RNA, 18 nt, Human
ucagccucccaaguagcu

SEQ ID NO: 682820 - RNA, 20 nt, Human
ucagccucccaaguagcugg

SEQ ID NO: 682821 - RNA, 23 nt, Human
ucagccucccaaguagcugggac

SEQ ID NO: 682822 - RNA, 21 nt, Human
ucagccucccaaguucuaggg

SEQ ID NO: 682823 - RNA, 25 nt, Human
ucaggccauccucccacuucagccu

SEQ ID NO: 682824 - RNA, 24 nt, Human
ucccaaguagcugggacuacaggc

SEQ ID NO: 682825 - RNA, 18 nt, Human
ucccgaacuccugggcuc

SEQ ID NO: 682826 - RNA, 23 nt, Human
ucccgaacuccugggcucaagua

SEQ ID NO: 682827 - RNA, 18 nt, Human
ucccucagcccacccucu

SEQ ID NO: 682828 - RNA, 21 nt, Human
uccgcccaccucagccuccca

SEQ ID NO: 682829 - RNA, 20 nt, Human
uccugggcucaaguaauccg

SEQ ID NO: 682830 - RNA, 18 nt, Human
ucgcggccgccgcccucg

SEQ ID NO: 682831 - RNA, 24 nt, Human
ucucacauuggugcccaggcugga

SEQ ID NO: 682832 - RNA, 18 nt, Human
ugcccaggcuggagugca

SEQ ID NO: 682833 - RNA, 21 nt, Human
ugcccaggcuggagugcagug

SEQ ID NO: 682834 - RNA, 22 nt, Human
ugcccaggcuggagugcagugg

SEQ ID NO: 682835 - RNA, 24 nt, Human
ugcccaggcuggagugcaguggca

SEQ ID NO: 682836 - RNA, 18 nt, Human
uggagugcaguggcacaa

SEQ ID NO: 682837 - RNA, 19 nt, Human
uggagugcaguggcacaau

SEQ ID NO: 682838 - RNA, 21 nt, Human
uggagugcaguggcacaauca

SEQ ID NO: 682839 - RNA, 20 nt, Human
uggcacaaucacagcccacu

SEQ ID NO: 682840 - RNA, 23 nt, Human
uggcacaaucacagcccacugca

SEQ ID NO: 682841 - RNA, 18 nt, Human
uggcagcgaggagggugg

SEQ ID NO: 682842 - RNA, 20 nt, Human
uggcggcgggaagcagaggc

SEQ ID NO: 682843 - RNA, 19 nt, Human
ugggacuacaggcaugcac

SEQ ID NO: 682844 - RNA, 24 nt, Human
ugggacuacaggcaugcacuacca

SEQ ID NO: 682845 - RNA, 27 nt, Human
uguuucuuuuuuuuuuuuuuuccaaga

SEQ ID NO: 682846 - RNA, 20 nt, Human
uuacaaguguaagccacugc

SEQ ID NO: 682847 - RNA, 21 nt, Human
uuccagcccagagaauggcag

SEQ ID NO: 682848 - RNA, 23 nt, Human
uucucacauuggugcccaggcug

SEQ ID NO: 682849 - RNA, 24 nt, Human
uuguagggacaggaguuucacuau

SEQ ID NO: 682850 - RNA, 24 nt, Human
uuucuuuuuuuuuuuuuuuccaag

SEQ ID NO: 682851 - RNA, 24 nt, Human
uuuuuguagggacaggaguuucac

SEQ ID NO: 682852 - RNA, 22 nt, Human
uuuuuuuuuuuuuuuuaugcuu

SEQ ID NO: 682853 - RNA, 18 nt, Human
aaaggaagcgggggcaag

SEQ ID NO: 682854 - RNA, 20 nt, Human
agacacauaccucaacuaug

SEQ ID NO: 682855 - RNA, 22 nt, Human
aggcagaaauaggcaagcucac

SEQ ID NO: 682856 - RNA, 20 nt, Human
cgggcacaguggccacaacc

SEQ ID NO: 682857 - RNA, 20 nt, Human
gaaaagagacaauaaaagga

SEQ ID NO: 682858 - RNA, 21 nt, Human
ggccacaaccaccuacgggca

SEQ ID NO: 682859 - RNA, 21 nt, Human
ggccaccgccgccucccuccg

SEQ ID NO: 682860 - RNA, 20 nt, Human
ggccgcccggccuuggccau

SEQ ID NO: 682861 - RNA, 19 nt, Human
uauaacuggauaaguagau

SEQ ID NO: 682862 - RNA, 20 nt, Human
uaugaugaccuaauuuuugg

SEQ ID NO: 682863 - RNA, 19 nt, Human
ugaaaagagacaauaaaag

SEQ ID NO: 682864 - RNA, 21 nt, Human
ugaaaagagacaauaaaagga

SEQ ID NO: 682865 - RNA, 27 nt, Human
uguuccauucuugugaaauacuuuuua

SEQ ID NO: 682866 - RNA, 22 nt, Human
uuuuuuuuuuuugaaaagagac

SEQ ID NO: 682867 - RNA, 18 nt, Human
uuuuuuuuuuuuuuuuug

SEQ ID NO: 682868 - RNA, 23 nt, Human
aaaaagcaggugccucaucuaca

SEQ ID NO: 682869 - RNA, 24 nt, Human
aaaaaggccucucuccauaaaacu

SEQ ID NO: 682870 - RNA, 26 nt, Human
aaaaauagacaaagacuagaugauaa

SEQ ID NO: 682871 - RNA, 22 nt, Human
aaaagcacagaagcacaucaca

SEQ ID NO: 682872 - RNA, 21 nt, Human
aaaauagacaaagacuagaug

SEQ ID NO: 682873 - RNA, 23 nt, Human
aaaaucucuucuguucugguguu

SEQ ID NO: 682874 - RNA, 21 nt, Human
aaaauuacaugcaacaacuga

SEQ ID NO: 682875 - RNA, 25 nt, Human
aaacaaaggcaaaaauuacaugcag

SEQ ID NO: 682876 - RNA, 23 nt, Human
aaacaacugggacacagaaccuc

SEQ ID NO: 682877 - RNA, 25 nt, Human
aaacuaauuaauuggacauauuccc

SEQ ID NO: 682878 - RNA, 19 nt, Human
aaaguucuuucucaaacuu

SEQ ID NO: 682879 - RNA, 20 nt, Human
aacaccugggaaagagcuga

SEQ ID NO: 682880 - RNA, 22 nt, Human
aacagaagggcuaggagaaaug

SEQ ID NO: 682881 - RNA, 23 nt, Human
aagaacagaagggcuaggagaaa

SEQ ID NO: 682882 - RNA, 23 nt, Human
aagcauuuaaacugccaauccua

SEQ ID NO: 682883 - RNA, 22 nt, Human
aaugagagaaaagaaaaagcag

SEQ ID NO: 682884 - RNA, 18 nt, Human
aauuggaggucccacauc

SEQ ID NO: 682885 - RNA, 23 nt, Human
acaaacauuuucucuuucacccu

SEQ ID NO: 682886 - RNA, 21 nt, Human
acagagcacuggcagguccca

SEQ ID NO: 682887 - RNA, 18 nt, Human
acauuguaaugcauaaga

SEQ ID NO: 682888 - RNA, 20 nt, Human
acugggacacagaaccuccg

SEQ ID NO: 682889 - RNA, 24 nt, Human
agaacagaagggcuaggagaaaug

SEQ ID NO: 682890 - RNA, 24 nt, Human
agaagagauuuuuuacuauuauga

SEQ ID NO: 682891 - RNA, 20 nt, Human
agaauauauaagcaugccaa

SEQ ID NO: 682892 - RNA, 31 nt, Human
aggaaaaagugcagagcauuaacuauaaccc

SEQ ID NO: 682893 - RNA, 23 nt, Human
aggcaaaaauuacaugcaacaac

SEQ ID NO: 682894 - RNA, 21 nt, Human
aggcaguagaaggggguuggu

SEQ ID NO: 682895 - RNA, 22 nt, Human
aggcaguagaaggggguuggug

SEQ ID NO: 682896 - RNA, 20 nt, Human
aguaggcaguagaagggggu

SEQ ID NO: 682897 - RNA, 18 nt, Human
auaucugcagauaucuaa

SEQ ID NO: 682898 - RNA, 19 nt, Human
caaaagcacagaagcacau

SEQ ID NO: 682899 - RNA, 19 nt, Human
caaagaaucccuauacgcc

SEQ ID NO: 682900 - RNA, 19 nt, Human
caacaccugggaaagagcu

SEQ ID NO: 682901 - RNA, 22 nt, Human
caacaccugggaaagagcugaa

SEQ ID NO: 682902 - RNA, 18 nt, Human
cacaaacacagggaaaga

SEQ ID NO: 682903 - RNA, 19 nt, Human
cacagggaaagagggcaaa

SEQ ID NO: 682904 - RNA, 18 nt, Human
cacauaccaugaaggcgu

SEQ ID NO: 682905 - RNA, 22 nt, Human
caccauguuaaccagugcuggc

SEQ ID NO: 682906 - RNA, 22 nt, Human
cacccuaacuccuaaacagcuu

SEQ ID NO: 682907 - RNA, 21 nt, Human
caccugggaaagagcugaagc

SEQ ID NO: 682908 - RNA, 22 nt, Human
cagaaagaucauaauucagaag

SEQ ID NO: 682909 - RNA, 19 nt, Human
caucuacagauccuucugg

SEQ ID NO: 682910 - RNA, 26 nt, Human
cauucaaaagcacagaagcacaucac

SEQ ID NO: 682911 - RNA, 21 nt, Human
cccacaauccauucucaucca

SEQ ID NO: 682912 - RNA, 18 nt, Human
cccacauaccaugaaggc

SEQ ID NO: 682913 - RNA, 24 nt, Human
cccaugaugucaauucggacaguu

SEQ ID NO: 682914 - RNA, 22 nt, Human
cccuaacuccuaaacagcuuac

SEQ ID NO: 682915 - RNA, 19 nt, Human
ccuaaacagcuuacugggg

SEQ ID NO: 682916 - RNA, 22 nt, Human
ccuggagcuggagcugaagcug

SEQ ID NO: 682917 - RNA, 26 nt, Human
ccuggagcuggagcugaagcuggagc

SEQ ID NO: 682918 - RNA, 19 nt, Human
cgaccuggagcuggagcug

SEQ ID NO: 682919 - RNA, 18 nt, Human
cggggcugggaauuggag

SEQ ID NO: 682920 - RNA, 18 nt, Human
cuaagcugcggcuggagc

SEQ ID NO: 682921 - RNA, 20 nt, Human
cugaagcuggagcuggaguc

SEQ ID NO: 682922 - RNA, 20 nt, Human
cuggagcccgaccuggagcu

SEQ ID NO: 682923 - RNA, 21 nt, Human
cuggagcugaagcuggagcug

SEQ ID NO: 682924 - RNA, 20 nt, Human
cuuuuaguaagguggacaau

SEQ ID NO: 682925 - RNA, 23 nt, Human
gaaauuggaaaacaacugggaca

SEQ ID NO: 682926 - RNA, 21 nt, Human
gaagcacaucacauacaccag

SEQ ID NO: 682927 - RNA, 23 nt, Human
gaaucccuauacgccaaacagaa

SEQ ID NO: 682928 - RNA, 21 nt, Human
gacaaugagagaaaagaaaaa

SEQ ID NO: 682929 - RNA, 22 nt, Human
gagcugaagccggggcugggaa

SEQ ID NO: 682930 - RNA, 19 nt, Human
gaggggaaaaaaaaguugg

SEQ ID NO: 682931 - RNA, 20 nt, Human
gaggggaaaaaaaaguugga

SEQ ID NO: 682932 - RNA, 25 nt, Human
gagucaacaccugggaaagagcuga

SEQ ID NO: 682933 - RNA, 21 nt, Human
gcuggagucaacaccugggaa

SEQ ID NO: 682934 - RNA, 20 nt, Human
ggaaaaauagacaaagacua

SEQ ID NO: 682935 - RNA, 20 nt, Human
guagaauauauaagcaugcc

SEQ ID NO: 682936 - RNA, 20 nt, Human
gugaaauuggaaaacaacug

SEQ ID NO: 682937 - RNA, 22 nt, Human
guuagguuuaacaguuucuuuu

SEQ ID NO: 682938 - RNA, 23 nt, Human
uaaauaacccacaauccauucuc

SEQ ID NO: 682939 - RNA, 22 nt, Human
uaacccuuuugaccagaaacuu

SEQ ID NO: 682940 - RNA, 21 nt, Human
uaacuauaacccuuuugacca

SEQ ID NO: 682941 - RNA, 21 nt, Human
uaagaaauguauccuucuccc

SEQ ID NO: 682942 - RNA, 21 nt, Human
uacaaugucuaguuugcccuc

SEQ ID NO: 682943 - RNA, 19 nt, Human
uacagaaccccacauacca

SEQ ID NO: 682944 - RNA, 18 nt, Human
uacauggaugaggacuag

SEQ ID NO: 682945 - RNA, 19 nt, Human
uacgccaaacagaagagau

SEQ ID NO: 682946 - RNA, 21 nt, Human
uacuggggcuucugcaagaca

SEQ ID NO: 682947 - RNA, 22 nt, Human
uagauacucucaauagcuuuuc

SEQ ID NO: 682948 - RNA, 18 nt, Human
uagcaccugaaguguggu

SEQ ID NO: 682949 - RNA, 22 nt, Human
uagcaccugaagugugguguca

SEQ ID NO: 682950 - RNA, 21 nt, Human
uaggcaguagaaggggguugg

SEQ ID NO: 682951 - RNA, 21 nt, Human
uauuaugacacaaacacaggg

SEQ ID NO: 682952 - RNA, 25 nt, Human
uauuuuuucaacaaacauuuucucu

SEQ ID NO: 682953 - RNA, 22 nt, Human
ucaaacuucugagaaagaacau

SEQ ID NO: 682954 - RNA, 24 nt, Human
ucaaaggaaaaauagacaaagacu

SEQ ID NO: 682955 - RNA, 24 nt, Human
ucacuuuggaaaguucuuucucaa

SEQ ID NO: 682956 - RNA, 22 nt, Human
uccaggcuuaaacaaaggcaaa

SEQ ID NO: 682957 - RNA, 22 nt, Human
ucccacggucauccacggagcc

SEQ ID NO: 682958 - RNA, 18 nt, Human
ucccuauacgccaaacag

SEQ ID NO: 682959 - RNA, 20 nt, Human
uccgcugccuaagcugcggc

SEQ ID NO: 682960 - RNA, 20 nt, Human
uccgcugccuaagcugcggc

SEQ ID NO: 682961 - RNA, 22 nt, Human
uccgcugccuaagcugcggcug

SEQ ID NO: 682962 - RNA, 18 nt, Human
ucggacaguuagguuuaa

SEQ ID NO: 682963 - RNA, 22 nt, Human
ucugaauuaugaucuuucuguc

SEQ ID NO: 682964 - RNA, 23 nt, Human
ugaauaaauaacccacaauccau

SEQ ID NO: 682965 - RNA, 25 nt, Human
ugaccagaaacuuuaugucuauaac

SEQ ID NO: 682966 - RNA, 23 nt, Human
ugagagaaaagaaaaagcaggug

SEQ ID NO: 682967 - RNA, 21 nt, Human
ugaggacuagucauugggcaa

SEQ ID NO: 682968 - RNA, 22 nt, Human
ugaggggaaaaaaaaguuggag

SEQ ID NO: 682969 - RNA, 26 nt, Human
ugcaagacagaaagaucauaauucag

SEQ ID NO: 682970 - RNA, 21 nt, Human
ugcagaagccccaguaagcug

SEQ ID NO: 682971 - RNA, 19 nt, Human
ugccuaagcugcggcugga

SEQ ID NO: 682972 - RNA, 21 nt, Human
ugccuaagcugcggcuggagc

SEQ ID NO: 682973 - RNA, 24 nt, Human
ugccuaagcugcggcuggagcugg

SEQ ID NO: 682974 - RNA, 20 nt, Human
uggaaaacaacugggacaca

SEQ ID NO: 682975 - RNA, 22 nt, Human
uggagcuggagcugaagcugga

SEQ ID NO: 682976 - RNA, 23 nt, Human
uggagcuggagcugaagcuggag

SEQ ID NO: 682977 - RNA, 18 nt, Human
ugggaaagagcugaagcc

SEQ ID NO: 682978 - RNA, 19 nt, Human
ugggaaagagcugaagccg

SEQ ID NO: 682979 - RNA, 20 nt, Human
ugggaaagagcugaagccgg

SEQ ID NO: 682980 - RNA, 22 nt, Human
ugggaauuggaggucccacauc

SEQ ID NO: 682981 - RNA, 19 nt, Human
uggugggggguggaauugg

SEQ ID NO: 682982 - RNA, 20 nt, Human
uggugggggguggaauuggu

SEQ ID NO: 682983 - RNA, 19 nt, Human
ugucuauaacgaugguuac

SEQ ID NO: 682984 - RNA, 22 nt, Human
uuaaaguaggcaguagaagggg

SEQ ID NO: 682985 - RNA, 28 nt, Human
uuaucugccacauacaaagcaucauucc

SEQ ID NO: 682986 - RNA, 25 nt, Human
uuauuugccauguacaauuuaaugc

SEQ ID NO: 682987 - RNA, 24 nt, Human
uucuuauagucuuagagucaugua

SEQ ID NO: 682988 - RNA, 21 nt, Human
uugaccagaaacuuuaugucu

SEQ ID NO: 682989 - RNA, 20 nt, Human
uugcacauaugcuccaaggu

SEQ ID NO: 682990 - RNA, 18 nt, Human
uuggaggucccacauccc

SEQ ID NO: 682991 - RNA, 18 nt, Human
uuuuuuuuuuuuuuuucg

SEQ ID NO: 682992 - RNA, 25 nt, Human
aaaaagaagcaagugcauccaauaa

SEQ ID NO: 682993 - RNA, 21 nt, Human
aaccagcaugguagaaauaca

SEQ ID NO: 682994 - RNA, 18 nt, Human
aacuugauuccuuaauaa

SEQ ID NO: 682995 - RNA, 18 nt, Human
aagaagcccagaugaaau

SEQ ID NO: 682996 - RNA, 18 nt, Human
aagaagcccagaugaaau

SEQ ID NO: 682997 - RNA, 26 nt, Human
aggaaaaaagaagcaagugcauccaa

SEQ ID NO: 682998 - RNA, 19 nt, Human
agugauacaagugaaaaag

SEQ ID NO: 682999 - RNA, 20 nt, Human
auauuaggaaaaaagaagca

SEQ ID NO: 683000 - RNA, 18 nt, Human
uaaaaccagcaugguaga

SEQ ID NO: 683001 - RNA, 21 nt, Human
uagaauaaaaccagcauggua

SEQ ID NO: 683002 - RNA, 20 nt, Human
ugaaaaagaacuugauuccu

SEQ ID NO: 683003 - RNA, 18 nt, Human
ugacuuacaagugcaaaa

SEQ ID NO: 683004 - RNA, 20 nt, Human
ugcuuuacuuacacccaacc

SEQ ID NO: 683005 - RNA, 18 nt, Human
aagaggagauggguaaug

SEQ ID NO: 683006 - RNA, 21 nt, Human
aauguagacaauucuuugagg

SEQ ID NO: 683007 - RNA, 22 nt, Human
acagaauauuaccccaaccccc

SEQ ID NO: 683008 - RNA, 19 nt, Human
agaauauuaccccaacccc

SEQ ID NO: 683009 - RNA, 18 nt, Human
aggcaaaagaggagaugg

SEQ ID NO: 683010 - RNA, 19 nt, Human
ccagagaaagucccuccuu

SEQ ID NO: 683011 - RNA, 24 nt, Human
ccccccagugggguacagaagcug

SEQ ID NO: 683012 - RNA, 23 nt, Human
ccgaaggcaauugugcuucuuuu

SEQ ID NO: 683013 - RNA, 19 nt, Human
cuuguggaaaaguccaucu

SEQ ID NO: 683014 - RNA, 20 nt, Human
gagccugagacgagcagcag

SEQ ID NO: 683015 - RNA, 27 nt, Human
uaccccaaccccccagugggguacaga

SEQ ID NO: 683016 - RNA, 24 nt, Human
uacgagccugagacgagcagcaga

SEQ ID NO: 683017 - RNA, 18 nt, Human
uauuaccccaacccccca

SEQ ID NO: 683018 - RNA, 19 nt, Human
ucaggaaauuccagagaaa

SEQ ID NO: 683019 - RNA, 18 nt, Human
ugagaucaagaggccagc

SEQ ID NO: 683020 - RNA, 18 nt, Human
uuucuuggucauaucagg

SEQ ID NO: 683021 - RNA, 23 nt, Human
aaacccauuuuaucuccauuuua

SEQ ID NO: 683022 - RNA, 23 nt, Human
aagcuacaccagccaaacccuca

SEQ ID NO: 683023 - RNA, 24 nt, Human
acagugaccccggcucugucuccc

SEQ ID NO: 683024 - RNA, 19 nt, Human
acccagacugucuccaaag

SEQ ID NO: 683025 - RNA, 21 nt, Human
accccggcucugucucccacu

SEQ ID NO: 683026 - RNA, 19 nt, Human
agcuacaccagccaaaccc

SEQ ID NO: 683027 - RNA, 22 nt, Human
aggcucagagacaguaaacagg

SEQ ID NO: 683028 - RNA, 24 nt, Human
auucaucauuuccaaugcucacaa

SEQ ID NO: 683029 - RNA, 22 nt, Human
caagaagauguaggcucagaga

SEQ ID NO: 683030 - RNA, 24 nt, Human
caagcuacaccagccaaacccuca

SEQ ID NO: 683031 - RNA, 25 nt, Human
caagguagaccucauuaaacccauu

SEQ ID NO: 683032 - RNA, 23 nt, Human
cacaguccagacuagagucuucc

SEQ ID NO: 683033 - RNA, 20 nt, Human
cacuccaggcuacgccccca

SEQ ID NO: 683034 - RNA, 18 nt, Human
cacucugcacuugcaccu

SEQ ID NO: 683035 - RNA, 20 nt, Human
cacucugcacuugcaccuua

SEQ ID NO: 683036 - RNA, 22 nt, Human
cacucugcacuugcaccuuacc

SEQ ID NO: 683037 - RNA, 22 nt, Human
caggaugccuuuuccuuccuga

SEQ ID NO: 683038 - RNA, 23 nt, Human
cauauaacaucuagguuugugua

SEQ ID NO: 683039 - RNA, 20 nt, Human
cauucaaaauacacuuuaau

SEQ ID NO: 683040 - RNA, 24 nt, Human
ccagcucacgcccucagcaggccu

SEQ ID NO: 683041 - RNA, 21 nt, Human
ccccaagcugggccacagucc

SEQ ID NO: 683042 - RNA, 22 nt, Human
cccccaagcaccugcggggucc

SEQ ID NO: 683043 - RNA, 18 nt, Human
ccucaagacuccacgcca

SEQ ID NO: 683044 - RNA, 22 nt, Human
ccucacuccaggcuacgccccc

SEQ ID NO: 683045 - RNA, 24 nt, Human
ccuccauaauauugcucuauuaua

SEQ ID NO: 683046 - RNA, 19 nt, Human
ccuuagcagaagugacgcu

SEQ ID NO: 683047 - RNA, 21 nt, Human
cucccacucugcacuugcacc

SEQ ID NO: 683048 - RNA, 18 nt, Human
cugugucauucaaaauac

SEQ ID NO: 683049 - RNA, 19 nt, Human
cuugcaguaaaucacaaua

SEQ ID NO: 683050 - RNA, 20 nt, Human
gaaaccugauacauggcccu

SEQ ID NO: 683051 - RNA, 20 nt, Human
gaacauauacagaaaccuga

SEQ ID NO: 683052 - RNA, 20 nt, Human
gcaaagcuaaguuuggcaag

SEQ ID NO: 683053 - RNA, 22 nt, Human
ggaacauauacagaaaccugaa

SEQ ID NO: 683054 - RNA, 20 nt, Human
ggcccuugauauuggcauug

SEQ ID NO: 683055 - RNA, 23 nt, Human
gggaaaaaaguacacuuuaauau

SEQ ID NO: 683056 - RNA, 23 nt, Human
uaaauaaaaauacauauaacauc

SEQ ID NO: 683057 - RNA, 23 nt, Human
uacacaaugacagaauugccuag

SEQ ID NO: 683058 - RNA, 21 nt, Human
uacagaaaccugauacauggc

SEQ ID NO: 683059 - RNA, 22 nt, Human
uagagagcagaggagugaaugg

SEQ ID NO: 683060 - RNA, 18 nt, Human
uaucacuggcaaagcuaa

SEQ ID NO: 683061 - RNA, 24 nt, Human
uauccccaucguuaagcaaugcau

SEQ ID NO: 683062 - RNA, 21 nt, Human
uaucugugucauucaaaauac

SEQ ID NO: 683063 - RNA, 19 nt, Human
ucaaaacugguguuuauug

SEQ ID NO: 683064 - RNA, 26 nt, Human
ugacagaacugggauuuaaacccaga

SEQ ID NO: 683065 - RNA, 21 nt, Human
ugacgcuggggagggcaccug

SEQ ID NO: 683066 - RNA, 18 nt, Human
ugacuauucuugccuggu

SEQ ID NO: 683067 - RNA, 19 nt, Human
ugaguggguagagagcaga

SEQ ID NO: 683068 - RNA, 22 nt, Human
ugaguggguagagagcagagga

SEQ ID NO: 683069 - RNA, 20 nt, Human
ugccuagugacacauuucua

SEQ ID NO: 683070 - RNA, 24 nt, Human
uggggcaacacgggucccuccuua

SEQ ID NO: 683071 - RNA, 22 nt, Human
uuacacaaugacagaauugccu

SEQ ID NO: 683072 - RNA, 19 nt, Human
uuccugaagaugaucugag

SEQ ID NO: 683073 - RNA, 19 nt, Human
uuccugccgucuuaaggac

SEQ ID NO: 683074 - RNA, 21 nt, Human
uugcagaucaaguaggggaaa

SEQ ID NO: 683075 - RNA, 18 nt, Human
uuuuuuuuuuuuuuuuug

SEQ ID NO: 683076 - RNA, 23 nt, Human
uuuuuuuuuuuuuuuuugucauu

SEQ ID NO: 683077 - RNA, 18 nt, Human
aaaaagaaaaccaaaaac

SEQ ID NO: 683078 - RNA, 19 nt, Human
aaacaacaacaacaacaaa

SEQ ID NO: 683079 - RNA, 22 nt, Human
aaagaaaaacaagaacuuacaa

SEQ ID NO: 683080 - RNA, 18 nt, Human
aaagaagacauacaugug

SEQ ID NO: 683081 - RNA, 23 nt, Human
aaagaauaauguuauggggagag

SEQ ID NO: 683082 - RNA, 21 nt, Human
aaaguuuaagagaaagcauca

SEQ ID NO: 683083 - RNA, 25 nt, Human
aacaaaaagaaaaccaaaaaccuaa

SEQ ID NO: 683084 - RNA, 23 nt, Human
aacaacaacaacaacaaaaagaa

SEQ ID NO: 683085 - RNA, 22 nt, Human
aacaggaagguuuuauuuaggu

SEQ ID NO: 683086 - RNA, 21 nt, Human
aacuuguuuuucucaucccug

SEQ ID NO: 683087 - RNA, 23 nt, Human
aagaaaaacaagaacuuacaaaa

SEQ ID NO: 683088 - RNA, 23 nt, Human
aagaaucaucugaaccugggagg

SEQ ID NO: 683089 - RNA, 21 nt, Human
aagcaaaaacaugaacagaua

SEQ ID NO: 683090 - RNA, 18 nt, Human
aagcagaagaaucaucug

SEQ ID NO: 683091 - RNA, 24 nt, Human
aagcagaagaaucaucugaaccug

SEQ ID NO: 683092 - RNA, 25 nt, Human
aagcagaagaaucaucugaaccugg

SEQ ID NO: 683093 - RNA, 21 nt, Human
aaguaagcaaaaacaugaaca

SEQ ID NO: 683094 - RNA, 25 nt, Human
aaguguugaagauugguuaaaagcu

SEQ ID NO: 683095 - RNA, 24 nt, Human
aaucaucugaaccugggaggugga

SEQ ID NO: 683096 - RNA, 19 nt, Human
aauggucccugugauccca

SEQ ID NO: 683097 - RNA, 19 nt, Human
aauggucccugugauccca

SEQ ID NO: 683098 - RNA, 24 nt, Human
acaaaaagaaaaccaaaaaccuaa

SEQ ID NO: 683099 - RNA, 28 nt, Human
acaacaacaaaaagaaaaccaaaaaccu

SEQ ID NO: 683100 - RNA, 22 nt, Human
acaacaacaacaacaaaaagaa

SEQ ID NO: 683101 - RNA, 28 nt, Human
acaacaacaacaacaaaaagaaaaccaa

SEQ ID NO: 683102 - RNA, 22 nt, Human
acaacaggauuugcaacaugag

SEQ ID NO: 683103 - RNA, 19 nt, Human
acacagcaagacuccaucu

SEQ ID NO: 683104 - RNA, 20 nt, Human
acacagcaagacuccaucuc

SEQ ID NO: 683105 - RNA, 24 nt, Human
acacagcaagacuccaucucagaa

SEQ ID NO: 683106 - RNA, 24 nt, Human
acaugagccuaccuuacuuaaaca

SEQ ID NO: 683107 - RNA, 22 nt, Human
acugaagcagaagaaucaucug

SEQ ID NO: 683108 - RNA, 25 nt, Human
acugcacuccauccuggugacacag

SEQ ID NO: 683109 - RNA, 21 nt, Human
agaaaaacaagaacuuacaaa

SEQ ID NO: 683110 - RNA, 18 nt, Human
agaaaacaacaacaacaa

SEQ ID NO: 683111 - RNA, 23 nt, Human
agaaaacaacaacaacaacaaaa

SEQ ID NO: 683112 - RNA, 25 nt, Human
agaaaacaacaacaacaacaaaaag

SEQ ID NO: 683113 - RNA, 27 nt, Human
agaaaacaacaacaacaacaaaaagaa

SEQ ID NO: 683114 - RNA, 20 nt, Human
agaaugccuauuguucaaaa

SEQ ID NO: 683115 - RNA, 18 nt, Human
agacagguaaucaggucu

SEQ ID NO: 683116 - RNA, 19 nt, Human
agagaauucuauggccaca

SEQ ID NO: 683117 - RNA, 19 nt, Human
agaggaaguagcucuuuuc

SEQ ID NO: 683118 - RNA, 19 nt, Human
agcagaagaaucaucugaa

SEQ ID NO: 683119 - RNA, 25 nt, Human
aggcaggggcaagucggggggaggc

SEQ ID NO: 683120 - RNA, 21 nt, Human
aggcaggggcaagucggguuu

SEQ ID NO: 683121 - RNA, 19 nt, Human
agguggagguugcagugag

SEQ ID NO: 683122 - RNA, 24 nt, Human
agguggagguugcagugagucgag

SEQ ID NO: 683123 - RNA, 19 nt, Human
auaccaucucauccaguca

SEQ ID NO: 683124 - RNA, 24 nt, Human
aucaugccacugcacuccauccug

SEQ ID NO: 683125 - RNA, 24 nt, Human
aucucagaaaacaacaacaacaac

SEQ ID NO: 683126 - RNA, 22 nt, Human
augccacugcacuccauccugg

SEQ ID NO: 683127 - RNA, 20 nt, Human
auuuacuucaagaggaagua

SEQ ID NO: 683128 - RNA, 22 nt, Human
caaaaagaaaaccaaaaaccua

SEQ ID NO: 683129 - RNA, 18 nt, Human
caaaggcugagcccggaa

SEQ ID NO: 683130 - RNA, 23 nt, Human
caacaaaaagaaaaccaaaaacc

SEQ ID NO: 683131 - RNA, 19 nt, Human
caacaacaaaaagaaaacc

SEQ ID NO: 683132 - RNA, 20 nt, Human
caacaacaaaaagaaaacca

SEQ ID NO: 683133 - RNA, 22 nt, Human
caacaacaaaaagaaaacccca

SEQ ID NO: 683134 - RNA, 25 nt, Human
caacaacaacaaaaagaaaaccaaa

SEQ ID NO: 683135 - RNA, 27 nt, Human
caacaacaacaacaaaaagaaaaccaa

SEQ ID NO: 683136 - RNA, 27 nt, Human
caacaacaacaacaaaaagaaaaccaa

SEQ ID NO: 683137 - RNA, 26 nt, Human
caacaggaagguuuuauuuaggucga

SEQ ID NO: 683138 - RNA, 19 nt, Human
cacagugagauaccaucuc

SEQ ID NO: 683139 - RNA, 18 nt, Human
cacaucacaugccuauau

SEQ ID NO: 683140 - RNA, 21 nt, Human
cacugcacuccauccugguga

SEQ ID NO: 683141 - RNA, 22 nt, Human
cacugcacuccauccuggugac

SEQ ID NO: 683142 - RNA, 23 nt, Human
cacugcacuccauccuggugaca

SEQ ID NO: 683143 - RNA, 24 nt, Human
cagaaaacaacaacaacaacaaaa

SEQ ID NO: 683144 - RNA, 19 nt, Human
cagaagcagaacaaaggca

SEQ ID NO: 683145 - RNA, 21 nt, Human
cagcaggacuuuggagugagu

SEQ ID NO: 683146 - RNA, 18 nt, Human
cagcggauuaacauccaa

SEQ ID NO: 683147 - RNA, 24 nt, Human
caggagacugaagcagaagaauca

SEQ ID NO: 683148 - RNA, 20 nt, Human
caguaugaauuaucuuaugu

SEQ ID NO: 683149 - RNA, 18 nt, Human
caucucagaaaacaacaa

SEQ ID NO: 683150 - RNA, 21 nt, Human
caucugaaccugggaggugga

SEQ ID NO: 683151 - RNA, 22 nt, Human
cauuccccccuuugaugcuuuu

SEQ ID NO: 683152 - RNA, 19 nt, Human
ccacugcacuccauccugg

SEQ ID NO: 683153 - RNA, 19 nt, Human
ccacugcacuccauccugg

SEQ ID NO: 683154 - RNA, 20 nt, Human
ccacugcacuccauccuggu

SEQ ID NO: 683155 - RNA, 23 nt, Human
ccacugcacuccauccuggugac

SEQ ID NO: 683156 - RNA, 19 nt, Human
ccagggcucuuuuccuugc

SEQ ID NO: 683157 - RNA, 19 nt, Human
cccggaacaaagacagggc

SEQ ID NO: 683158 - RNA, 21 nt, Human
ccugggagguggagguugcag

SEQ ID NO: 683159 - RNA, 23 nt, Human
ccuggugacacagcaagacucca

SEQ ID NO: 683160 - RNA, 21 nt, Human
ccugugaucccagcuacucag

SEQ ID NO: 683161 - RNA, 23 nt, Human
cggagccccugccuggccuugca

SEQ ID NO: 683162 - RNA, 22 nt, Human
cgggcuagguugcagagaaaag

SEQ ID NO: 683163 - RNA, 19 nt, Human
cuccaaagagaauucuaug

SEQ ID NO: 683164 - RNA, 20 nt, Human
cugaaccugggagguggagg

SEQ ID NO: 683165 - RNA, 24 nt, Human
cugaaccugggagguggagguugc

SEQ ID NO: 683166 - RNA, 19 nt, Human
cugcuccuggagcccuccu

SEQ ID NO: 683167 - RNA, 18 nt, Human
cuguaguucucucacauc

SEQ ID NO: 683168 - RNA, 18 nt, Human
cuuacagaagcagaacaa

SEQ ID NO: 683169 - RNA, 19 nt, Human
cuuguaagguuucucucca

SEQ ID NO: 683170 - RNA, 25 nt, Human
gaacaaagacagggcuugacuuuua

SEQ ID NO: 683171 - RNA, 22 nt, Human
gagaaaaggaaugcuuauaugu

SEQ ID NO: 683172 - RNA, 18 nt, Human
gagaucaugccacugcac

SEQ ID NO: 683173 - RNA, 22 nt, Human
gagguugcagugagucgagauc

SEQ ID NO: 683174 - RNA, 20 nt, Human
gcaagucggguuuuuggcgc

SEQ ID NO: 683175 - RNA, 21 nt, Human
gcagagaaaaaccacagugag

SEQ ID NO: 683176 - RNA, 18 nt, Human
ggagguugcagugagucg

SEQ ID NO: 683177 - RNA, 20 nt, Human
ggagguugcagugagucgag

SEQ ID NO: 683178 - RNA, 23 nt, Human
ggagguugcagugagucgagauc

SEQ ID NO: 683179 - RNA, 24 nt, Human
ggagguugcagugagucgagauca

SEQ ID NO: 683180 - RNA, 22 nt, Human
ggccggagagaucacugggugc

SEQ ID NO: 683181 - RNA, 24 nt, Human
guaguucucucacaucacaugccu

SEQ ID NO: 683182 - RNA, 24 nt, Human
guugcagugagucgagaucaugcc

SEQ ID NO: 683183 - RNA, 23 nt, Human
uaaaaaguaagcaaaaacaugaa

SEQ ID NO: 683184 - RNA, 21 nt, Human
uaagcaaaaacaugaacagau

SEQ ID NO: 683185 - RNA, 22 nt, Human
uacagaagcagaacaaaggcag

SEQ ID NO: 683186 - RNA, 21 nt, Human
uacaugcaucaggcaggggca

SEQ ID NO: 683187 - RNA, 21 nt, Human
uagcuccagcaggacuuugga

SEQ ID NO: 683188 - RNA, 18 nt, Human
ucaauggucccugugauc

SEQ ID NO: 683189 - RNA, 19 nt, Human
ucacugggugcaacaggaa

SEQ ID NO: 683190 - RNA, 19 nt, Human
ucaucugaaccugggaggu

SEQ ID NO: 683191 - RNA, 22 nt, Human
ucaucuuauguuuaguaaaggu

SEQ ID NO: 683192 - RNA, 23 nt, Human
ucaugccacugcacuccauccug

SEQ ID NO: 683193 - RNA, 24 nt, Human
uccauaaaugucaauggucccugu

SEQ ID NO: 683194 - RNA, 24 nt, Human
ucccugugaucccagcuacucagg

SEQ ID NO: 683195 - RNA, 20 nt, Human
ucucuccaguaugaaucauc

SEQ ID NO: 683196 - RNA, 21 nt, Human
ucucuuauguccaauaagggu

SEQ ID NO: 683197 - RNA, 18 nt, Human
ucugaaccugggaggugg

SEQ ID NO: 683198 - RNA, 18 nt, Human
ucugcugugcagugucca

SEQ ID NO: 683199 - RNA, 19 nt, Human
ucuuacagaagcagaacaa

SEQ ID NO: 683200 - RNA, 24 nt, Human
ugaaccugggagguggagguugca

SEQ ID NO: 683201 - RNA, 20 nt, Human
ugaagcagaagaaucaucug

SEQ ID NO: 683202 - RNA, 24 nt, Human
ugaagcagaagaaucaucugaacc

SEQ ID NO: 683203 - RNA, 19 nt, Human
ugacaagcacaugaaaaca

SEQ ID NO: 683204 - RNA, 24 nt, Human
ugagaaagcagucuuacagaagca

SEQ ID NO: 683205 - RNA, 19 nt, Human
ugagagcagaacaaagaau

SEQ ID NO: 683206 - RNA, 20 nt, Human
ugagcccggaacaaagacag

SEQ ID NO: 683207 - RNA, 23 nt, Human
ugagucagacuggucaggaaagg

SEQ ID NO: 683208 - RNA, 22 nt, Human
ugagucgagaucaugccacugc

SEQ ID NO: 683209 - RNA, 24 nt, Human
ugcaucaggcaggggcaagucggg

SEQ ID NO: 683210 - RNA, 22 nt, Human
ugccacauucuucacacuugua

SEQ ID NO: 683211 - RNA, 22 nt, Human
ugccacauucuucacauuugua

SEQ ID NO: 683212 - RNA, 21 nt, Human
ugccacugcacuccauccugg

SEQ ID NO: 683213 - RNA, 19 nt, Human
ugccaugcuacagaaagaa

SEQ ID NO: 683214 - RNA, 24 nt, Human
ugccaugcuacagaaagaaaaaca

SEQ ID NO: 683215 - RNA, 20 nt, Human
ugccuuagagacagcaauac

SEQ ID NO: 683216 - RNA, 23 nt, Human
ugccuuagagacagcaauaccuu

SEQ ID NO: 683217 - RNA, 21 nt, Human
ugcgaggugagaaagcagucu

SEQ ID NO: 683218 - RNA, 20 nt, Human
ugcuacagaaagaaaaacaa

SEQ ID NO: 683219 - RNA, 19 nt, Human
ugcuccuggagcccuccuu

SEQ ID NO: 683220 - RNA, 23 nt, Human
uggagcccuccuucggagccccu

SEQ ID NO: 683221 - RNA, 18 nt, Human
ugggagguggagguugca

SEQ ID NO: 683222 - RNA, 29 nt, Human
ugggagguggagguugcagugacaacggu

SEQ ID NO: 683223 - RNA, 24 nt, Human
ugggagguggagguugcagugagu

SEQ ID NO: 683224 - RNA, 22 nt, Human
ugggugcaacaggaagguuuua

SEQ ID NO: 683225 - RNA, 23 nt, Human
uguaggguuucucuccaguauga

SEQ ID NO: 683226 - RNA, 21 nt, Human
ugugcaguguccaggcauugc

SEQ ID NO: 683227 - RNA, 19 nt, Human
ugugggaaccaggaggccg

SEQ ID NO: 683228 - RNA, 21 nt, Human
uguuauggggagagaauuuca

SEQ ID NO: 683229 - RNA, 20 nt, Human
uuaguaaagguugagaaaug

SEQ ID NO: 683230 - RNA, 22 nt, Human
uucaaaaagucaaugacagaag

SEQ ID NO: 683231 - RNA, 24 nt, Human
uucaaacagggaaacugauaagga

SEQ ID NO: 683232 - RNA, 25 nt, Human
uucacacuuguaagguuucucucca

SEQ ID NO: 683233 - RNA, 19 nt, Human
uuccagggcucuuuuccuu

SEQ ID NO: 683234 - RNA, 22 nt, Human
uucuauggccacauccauaaau

SEQ ID NO: 683235 - RNA, 18 nt, Human
uugcagugagucgagauc

SEQ ID NO: 683236 - RNA, 20 nt, Human
uugcagugagucgagaucau

SEQ ID NO: 683237 - RNA, 21 nt, Human
uugcagugagucgagaucaug

SEQ ID NO: 683238 - RNA, 18 nt, Human
uuguacuguuucucuuca

SEQ ID NO: 683239 - RNA, 21 nt, Human
uuucucaucccugcuccugga

SEQ ID NO: 683240 - RNA, 18 nt, Human
uuuguacuguuucucuuc

SEQ ID NO: 683241 - RNA, 19 nt, Human
uuuguaggguuucucucca

SEQ ID NO: 683242 - RNA, 21 nt, Human
uuuuuauaaguaaaguuuaag

SEQ ID NO: 683243 - RNA, 18 nt, Human
aaaaaaauaaaacagaag

SEQ ID NO: 683244 - RNA, 20 nt, Human
aaaacagaaggaagucaaaa

SEQ ID NO: 683245 - RNA, 24 nt, Human
aaauccugaaaauaaauaugagcu

SEQ ID NO: 683246 - RNA, 20 nt, Human
aagaaaaaaaaagguauggg

SEQ ID NO: 683247 - RNA, 23 nt, Human
aagacaacauuuccauaauaacu

SEQ ID NO: 683248 - RNA, 24 nt, Human
aagcaccaaagcguuucccaagcu

SEQ ID NO: 683249 - RNA, 22 nt, Human
aagccagucuuugaagaacuga

SEQ ID NO: 683250 - RNA, 23 nt, Human
aagguaugggaaaggcugugugu

SEQ ID NO: 683251 - RNA, 21 nt, Human
acaccacagcacaaacucaac

SEQ ID NO: 683252 - RNA, 21 nt, Human
acagcacaaacucaacaugag

SEQ ID NO: 683253 - RNA, 20 nt, Human
accacagcacaaacucaaca

SEQ ID NO: 683254 - RNA, 23 nt, Human
agaaaaaaaaagguaugggaaag

SEQ ID NO: 683255 - RNA, 22 nt, Human
agaaaacuggagaaaagcacca

SEQ ID NO: 683256 - RNA, 21 nt, Human
agaaggaagucaaaagggacc

SEQ ID NO: 683257 - RNA, 20 nt, Human
aggaagucaaaaugaauagu

SEQ ID NO: 683258 - RNA, 18 nt, Human
aggccaggucugauggug

SEQ ID NO: 683259 - RNA, 23 nt, Human
agggaaaaaaauaaaacagaagg

SEQ ID NO: 683260 - RNA, 19 nt, Human
aguaaauagggagccuaag

SEQ ID NO: 683261 - RNA, 24 nt, Human
aguaaauagggagccuaagaaaaa

SEQ ID NO: 683262 - RNA, 23 nt, Human
aguaagaaaaaaaaagguaugga

SEQ ID NO: 683263 - RNA, 19 nt, Human
auaaaagacaacauuucca

SEQ ID NO: 683264 - RNA, 22 nt, Human
auaaaagacaacauuuccauaa

SEQ ID NO: 683265 - RNA, 22 nt, Human
augcuaaagggaaaaaaauaaa

SEQ ID NO: 683266 - RNA, 22 nt, Human
ccagucuuugaagaacugagga

SEQ ID NO: 683267 - RNA, 22 nt, Human
ccucauaaauccugaaaauaaa

SEQ ID NO: 683268 - RNA, 20 nt, Human
cuaaagggaaaaaaauaaaa

SEQ ID NO: 683269 - RNA, 21 nt, Human
cugggcauuagcaaguggacc

SEQ ID NO: 683270 - RNA, 26 nt, Human
gaaaagcaccaaagcguuucccaguc

SEQ ID NO: 683271 - RNA, 19 nt, Human
gaagagaugcucgguggua

SEQ ID NO: 683272 - RNA, 21 nt, Human
gguaccagaaaacuggagaaa

SEQ ID NO: 683273 - RNA, 19 nt, Human
gucuuugaagaacugagga

SEQ ID NO: 683274 - RNA, 19 nt, Human
guggaccaagaggaggaga

SEQ ID NO: 683275 - RNA, 21 nt, Human
uaaaagaaaggacgcauggua

SEQ ID NO: 683276 - RNA, 20 nt, Human
uaacuaaguauaaaagacaa

SEQ ID NO: 683277 - RNA, 22 nt, Human
uaagaaaaaaaaagguauggga

SEQ ID NO: 683278 - RNA, 21 nt, Human
uagguauaccucauuuuagcu

SEQ ID NO: 683279 - RNA, 18 nt, Human
ucaauguuucaggcaaag

SEQ ID NO: 683280 - RNA, 23 nt, Human
uccucauucagguaaaugagauc

SEQ ID NO: 683281 - RNA, 18 nt, Human
ucuucuuggaggccaggu

SEQ ID NO: 683282 - RNA, 19 nt, Human
ugaagagaugcucgguggu

SEQ ID NO: 683283 - RNA, 20 nt, Human
ugacaucuagguauaccuca

SEQ ID NO: 683284 - RNA, 22 nt, Human
uggaaauggagaagaaaacugg

SEQ ID NO: 683285 - RNA, 18 nt, Human
uggaauucuggugacacc

SEQ ID NO: 683286 - RNA, 23 nt, Human
uggagaagaaaacugggcauuag

SEQ ID NO: 683287 - RNA, 21 nt, Human
ugguaccagaaaacuggagaa

SEQ ID NO: 683288 - RNA, 18 nt, Human
ugucaaaagauuuccuac

SEQ ID NO: 683289 - RNA, 28 nt, Human
uucccaagcugauagauauuaauugcau

SEQ ID NO: 683290 - RNA, 18 nt, Human
uugaagaacugaggaguc

SEQ ID NO: 683291 - RNA, 20 nt, Human
aaauccaguuccaugaaggg

SEQ ID NO: 683292 - RNA, 20 nt, Human
agaaauccaaauccaguucc

SEQ ID NO: 683293 - RNA, 22 nt, Human
agagcccagccuccaguguccc

SEQ ID NO: 683294 - RNA, 24 nt, Human
aguagggugcgcucucugccuagc

SEQ ID NO: 683295 - RNA, 23 nt, Human
caauccacaggggaaggagugac

SEQ ID NO: 683296 - RNA, 19 nt, Human
cacccuuuacuccccuccc

SEQ ID NO: 683297 - RNA, 18 nt, Human
cagaaggagucacaggcu

SEQ ID NO: 683298 - RNA, 21 nt, Human
ccacugaacuccaggcccgga

SEQ ID NO: 683299 - RNA, 22 nt, Human
ccacugaacuccaggcccggac

SEQ ID NO: 683300 - RNA, 23 nt, Human
ccaugaaggaagaaaugucuguu

SEQ ID NO: 683301 - RNA, 21 nt, Human
cccucccgcgugagccgagaa

SEQ ID NO: 683302 - RNA, 22 nt, Human
ccuagcagaaggagucacaggc

SEQ ID NO: 683303 - RNA, 21 nt, Human
ccucccgcgugagccgagaau

SEQ ID NO: 683304 - RNA, 22 nt, Human
cuagcagaaggagucacaggcu

SEQ ID NO: 683305 - RNA, 21 nt, Human
cugcacccacugaacuccagg

SEQ ID NO: 683306 - RNA, 19 nt, Human
gagcuuccuccaccaagag

SEQ ID NO: 683307 - RNA, 21 nt, Human
gccccccugucuggccucagc

SEQ ID NO: 683308 - RNA, 20 nt, Human
ggaaagaguagggugcgcuc

SEQ ID NO: 683309 - RNA, 18 nt, Human
gggaaggagugacuggcu

SEQ ID NO: 683310 - RNA, 19 nt, Human
guccguaggcgccccccug

SEQ ID NO: 683311 - RNA, 23 nt, Human
uaggcgccccccugucuggccuc

SEQ ID NO: 683312 - RNA, 25 nt, Human
uauaauaugaagcugccugcuucaa

SEQ ID NO: 683313 - RNA, 21 nt, Human
ucagagcaaacucauucaaag

SEQ ID NO: 683314 - RNA, 23 nt, Human
uccguaggcgccccccugucugg

SEQ ID NO: 683315 - RNA, 19 nt, Human
ugaagcugccugcuucaag

SEQ ID NO: 683316 - RNA, 23 nt, Human
ugaaggaagaaaugucuguuuuu

SEQ ID NO: 683317 - RNA, 23 nt, Human
uggcugagcaacgugucgagaga

SEQ ID NO: 683318 - RNA, 22 nt, Human
ugucgagagagcccagccucca

SEQ ID NO: 683319 - RNA, 20 nt, Human
aaacacaggggacagaagaa

SEQ ID NO: 683320 - RNA, 21 nt, Human
aacacaggggacagaagaaag

SEQ ID NO: 683321 - RNA, 21 nt, Human
aacuucuucuggcuccuucug

SEQ ID NO: 683322 - RNA, 18 nt, Human
aaucuguggucaguccuc

SEQ ID NO: 683323 - RNA, 20 nt, Human
acagaccggcaagccaccgu

SEQ ID NO: 683324 - RNA, 23 nt, Human
acuguuauuuaccccuaaacaac

SEQ ID NO: 683325 - RNA, 19 nt, Human
acuuugagaacgugcugga

SEQ ID NO: 683326 - RNA, 23 nt, Human
agaaaaguaacccuugcauucac

SEQ ID NO: 683327 - RNA, 19 nt, Human
agaaacagaggcucagaga

SEQ ID NO: 683328 - RNA, 21 nt, Human
agaaacagaggcucagagaga

SEQ ID NO: 683329 - RNA, 21 nt, Human
agaagaaaggggggaccuagg

SEQ ID NO: 683330 - RNA, 21 nt, Human
agaagaaaggggggaccuagg

SEQ ID NO: 683331 - RNA, 22 nt, Human
agccaugggaaucgggagcccc

SEQ ID NO: 683332 - RNA, 19 nt, Human
agcucagagagaaacagag

SEQ ID NO: 683333 - RNA, 19 nt, Human
agcuccuuuauuauuauua

SEQ ID NO: 683334 - RNA, 20 nt, Human
aggaaccugggugauggggg

SEQ ID NO: 683335 - RNA, 20 nt, Human
aggcuucccaggcugcccag

SEQ ID NO: 683336 - RNA, 19 nt, Human
aggggacagaagaaagggg

SEQ ID NO: 683337 - RNA, 25 nt, Human
aggggacagaagaaaggggggaccu

SEQ ID NO: 683338 - RNA, 23 nt, Human
agugcuaauguggaaacuuugag

SEQ ID NO: 683339 - RNA, 23 nt, Human
caacgugaaauguuaaguccccu

SEQ ID NO: 683340 - RNA, 19 nt, Human
cagaaucccagaggguccc

SEQ ID NO: 683341 - RNA, 19 nt, Human
cagaaucccagaggguccc

SEQ ID NO: 683342 - RNA, 19 nt, Human
cagagagacagaaccaccu

SEQ ID NO: 683343 - RNA, 19 nt, Human
cagcauaacucaaauaaua

SEQ ID NO: 683344 - RNA, 18 nt, Human
cagcucagagagaaacag

SEQ ID NO: 683345 - RNA, 24 nt, Human
ccaaagguaacccccggggcagau

SEQ ID NO: 683346 - RNA, 22 nt, Human
ccagcccccaaagguaaccccc

SEQ ID NO: 683347 - RNA, 22 nt, Human
ccagggacgguuguguccccuc

SEQ ID NO: 683348 - RNA, 21 nt, Human
ccccuaaacaacagcauaacu

SEQ ID NO: 683349 - RNA, 22 nt, Human
ccccuaaacaacagcauaacuc

SEQ ID NO: 683350 - RNA, 18 nt, Human
cccguccgcacugccuca

SEQ ID NO: 683351 - RNA, 20 nt, Human
cccguccgcacugccucacg

SEQ ID NO: 683352 - RNA, 21 nt, Human
cccguccgcacugccucacgg

SEQ ID NO: 683353 - RNA, 28 nt, Human
ccuaggguuggggacaaaaccggggucc

SEQ ID NO: 683354 - RNA, 22 nt, Human
ccucgugccuagaaacuucuuc

SEQ ID NO: 683355 - RNA, 24 nt, Human
ccucuguaaaaaucccgacuuaaa

SEQ ID NO: 683356 - RNA, 21 nt, Human
cgcugaggucuagagcggagc

SEQ ID NO: 683357 - RNA, 21 nt, Human
cggggcagauccagcagaauc

SEQ ID NO: 683358 - RNA, 24 nt, Human
cuaaacaacagcauaacucaaaua

SEQ ID NO: 683359 - RNA, 21 nt, Human
cucacccccgcacccucuaac

SEQ ID NO: 683360 - RNA, 23 nt, Human
cucccagcguccuuagggagugc

SEQ ID NO: 683361 - RNA, 21 nt, Human
cuccuuuauuauuauuauuau

SEQ ID NO: 683362 - RNA, 24 nt, Human
cugcuggaggcuggaggcggguuu

SEQ ID NO: 683363 - RNA, 21 nt, Human
cuggaggcggguuuugcaagc

SEQ ID NO: 683364 - RNA, 21 nt, Human
cuguggucaguccucaccccc

SEQ ID NO: 683365 - RNA, 18 nt, Human
gacuggggucccagcccc

SEQ ID NO: 683366 - RNA, 23 nt, Human
gagaagcagaaccaaccacugcc

SEQ ID NO: 683367 - RNA, 20 nt, Human
gaggugaugaaccagccccg

SEQ ID NO: 683368 - RNA, 18 nt, Human
gccaccguccucccaggc

SEQ ID NO: 683369 - RNA, 26 nt, Human
gcggagccaggagcuuaauaaaccca

SEQ ID NO: 683370 - RNA, 23 nt, Human
gcugcccaggcuggcagccagaa

SEQ ID NO: 683371 - RNA, 19 nt, Human
gcugcuggaggcuggaggc

SEQ ID NO: 683372 - RNA, 18 nt, Human
gcuggaggcuggaggcgg

SEQ ID NO: 683373 - RNA, 19 nt, Human
gguaaagaaagcaaaacua

SEQ ID NO: 683374 - RNA, 22 nt, Human
ggugaugggggagguccccaga

SEQ ID NO: 683375 - RNA, 26 nt, Human
ggugaugggggagguccccagagaaa

SEQ ID NO: 683376 - RNA, 23 nt, Human
gucaguccucacccccgcacccu

SEQ ID NO: 683377 - RNA, 18 nt, Human
gugaaauguuaagucccc

SEQ ID NO: 683378 - RNA, 24 nt, Human
uaaccaaaccaugcggcaugguuu

SEQ ID NO: 683379 - RNA, 19 nt, Human
uagagcggagccaggagcu

SEQ ID NO: 683380 - RNA, 18 nt, Human
uaggucagaucauaaacu

SEQ ID NO: 683381 - RNA, 21 nt, Human
uaggucagaucauaaacugac

SEQ ID NO: 683382 - RNA, 23 nt, Human
uauccuggaaucagagaagcccu

SEQ ID NO: 683383 - RNA, 19 nt, Human
ucaaauaauaaugacacac

SEQ ID NO: 683384 - RNA, 21 nt, Human
ucaagauagaaaagguaaaga

SEQ ID NO: 683385 - RNA, 23 nt, Human
ucagagagaaacagaggcucaga

SEQ ID NO: 683386 - RNA, 19 nt, Human
ucccagaggguccccgucc

SEQ ID NO: 683387 - RNA, 22 nt, Human
ucccagcccccaaagguaaccc

SEQ ID NO: 683388 - RNA, 21 nt, Human
uccccagagaaaaguaacccu

SEQ ID NO: 683389 - RNA, 21 nt, Human
uccgcggagggaacagcuggg

SEQ ID NO: 683390 - RNA, 22 nt, Human
uccuuagggagugcuaaugugg

SEQ ID NO: 683391 - RNA, 25 nt, Human
uccuuuauuauuauuauuauuauua

SEQ ID NO: 683392 - RNA, 23 nt, Human
ucuaccacuacacuauccaggga

SEQ ID NO: 683393 - RNA, 18 nt, Human
ucuucuggcuccuucugg

SEQ ID NO: 683394 - RNA, 25 nt, Human
ugagaacgugcuggacacaucuggg

SEQ ID NO: 683395 - RNA, 24 nt, Human
ugaggucuagagcggagccaggag

SEQ ID NO: 683396 - RNA, 23 nt, Human
ugccaauugcgcuauccugugga

SEQ ID NO: 683397 - RNA, 20 nt, Human
ugcuggacacaucugggcag

SEQ ID NO: 683398 - RNA, 23 nt, Human
uggaaacuuugagaacgugcugg

SEQ ID NO: 683399 - RNA, 22 nt, Human
uggacacaucugggcagagggc

SEQ ID NO: 683400 - RNA, 20 nt, Human
ugguguggcugggcuagcuu

SEQ ID NO: 683401 - RNA, 23 nt, Human
ugguuccugauggagcugucugg

SEQ ID NO: 683402 - RNA, 23 nt, Human
uuaccccuaaacaacagcauaac

SEQ ID NO: 683403 - RNA, 21 nt, Human
uugcugcuggaggcuggaggc

SEQ ID NO: 683404 - RNA, 24 nt, Human
uuuaccccuaaacaacagcauaac

SEQ ID NO: 683405 - RNA, 19 nt, Human
uuuacuugcacuaaaucug

SEQ ID NO: 683406 - RNA, 25 nt, Human
uuuugcaacuauagaaugugcaaca

SEQ ID NO: 683407 - RNA, 23 nt, Human
aaacagacgaaaaucaauaaacc

SEQ ID NO: 683408 - RNA, 18 nt, Human
aagcugcacugcugccuc

SEQ ID NO: 683409 - RNA, 22 nt, Human
acaguacuggggaagauggaag

SEQ ID NO: 683410 - RNA, 25 nt, Human
agacgaaaaucaauaaaccugagcc

SEQ ID NO: 683411 - RNA, 24 nt, Human
agaggagaggacacuggggagggg

SEQ ID NO: 683412 - RNA, 23 nt, Human
agagugcucccaugccugggcuc

SEQ ID NO: 683413 - RNA, 19 nt, Human
agcccggacccucugaaag

SEQ ID NO: 683414 - RNA, 21 nt, Human
auuggccucggccucacugcc

SEQ ID NO: 683415 - RNA, 20 nt, Human
caauggccugccugagagga

SEQ ID NO: 683416 - RNA, 23 nt, Human
cagcaaacaaggcugugaacaca

SEQ ID NO: 683417 - RNA, 19 nt, Human
cagccaggaugcaagccag

SEQ ID NO: 683418 - RNA, 20 nt, Human
caguccugggccagggugcu

SEQ ID NO: 683419 - RNA, 21 nt, Human
caguccugggccagggugcuc

SEQ ID NO: 683420 - RNA, 19 nt, Human
ccaguggagccagugcaga

SEQ ID NO: 683421 - RNA, 24 nt, Human
ccucugaaagcugcacugcugccu

SEQ ID NO: 683422 - RNA, 22 nt, Human
cugagaggagaggacacugggg

SEQ ID NO: 683423 - RNA, 18 nt, Human
gaacacagccaggaugcc

SEQ ID NO: 683424 - RNA, 24 nt, Human
gacacuggggagggggagaaggcc

SEQ ID NO: 683425 - RNA, 23 nt, Human
gagaggacacuggggagggggaa

SEQ ID NO: 683426 - RNA, 19 nt, Human
gcagucuuuccuggucagu

SEQ ID NO: 683427 - RNA, 18 nt, Human
gccugccugagaggagag

SEQ ID NO: 683428 - RNA, 20 nt, Human
ggagaggacacuggggaggg

SEQ ID NO: 683429 - RNA, 21 nt, Human
gggccagggugcucaggccuc

SEQ ID NO: 683430 - RNA, 18 nt, Human
ggggagggggagaaggcc

SEQ ID NO: 683431 - RNA, 22 nt, Human
uaggguaaacagacgaaaauca

SEQ ID NO: 683432 - RNA, 18 nt, Human
ugcaauggccugccugag

SEQ ID NO: 683433 - RNA, 23 nt, Human
ugcccuggugggugacaucagca

SEQ ID NO: 683434 - RNA, 20 nt, Human
ugccugugccugcccagcca

SEQ ID NO: 683435 - RNA, 22 nt, Human
uggaagcagcaaacaaggcugu

SEQ ID NO: 683436 - RNA, 18 nt, Human
uuuuuuuuuuuuggaggg

SEQ ID NO: 683437 - RNA, 19 nt, Human
uuuuuuuuuuuuuuggagg

SEQ ID NO: 683438 - RNA, 23 nt, Human
uuuuuuuuuuuuuuuuuggaggg

SEQ ID NO: 683439 - RNA, 28 nt, Human
aaagaaaauuaaaaaaaaaaaaaaaaaa

SEQ ID NO: 683440 - RNA, 26 nt, Human
aagaaggaaggaaguguguccucugg

SEQ ID NO: 683441 - RNA, 22 nt, Human
aaugacacugucacaugucccu

SEQ ID NO: 683442 - RNA, 20 nt, Human
acacugcagaacuguaaaac

SEQ ID NO: 683443 - RNA, 23 nt, Human
acuccucagacaccaaagaagga

SEQ ID NO: 683444 - RNA, 20 nt, Human
aggaaaaguauaauacagua

SEQ ID NO: 683445 - RNA, 21 nt, Human
aggaaguguguccucugguua

SEQ ID NO: 683446 - RNA, 21 nt, Human
aggcggccaaggucaccggcg

SEQ ID NO: 683447 - RNA, 19 nt, Human
aggucaccggcgagggggc

SEQ ID NO: 683448 - RNA, 22 nt, Human
aguuauguugggucuuaacuga

SEQ ID NO: 683449 - RNA, 19 nt, Human
auuacacugcagaacugua

SEQ ID NO: 683450 - RNA, 23 nt, Human
caaguuagagcgagccgcgugga

SEQ ID NO: 683451 - RNA, 19 nt, Human
cacacuccucagacaccaa

SEQ ID NO: 683452 - RNA, 21 nt, Human
caccaaagaaggaaggaagug

SEQ ID NO: 683453 - RNA, 19 nt, Human
caugcacguugcccguccu

SEQ ID NO: 683454 - RNA, 22 nt, Human
ccggcgagggggcuggaggggg

SEQ ID NO: 683455 - RNA, 21 nt, Human
ccucuugcagguaaguguggu

SEQ ID NO: 683456 - RNA, 19 nt, Human
cggccaaggucaccggcga

SEQ ID NO: 683457 - RNA, 20 nt, Human
cguggaaucagagcauccga

SEQ ID NO: 683458 - RNA, 19 nt, Human
cugugugugugauccuacu

SEQ ID NO: 683459 - RNA, 19 nt, Human
gaaggaaguguguccucug

SEQ ID NO: 683460 - RNA, 23 nt, Human
gauccuacucuucucacaaacac

SEQ ID NO: 683461 - RNA, 20 nt, Human
gggcuggagggggcgucuuu

SEQ ID NO: 683462 - RNA, 20 nt, Human
gguugaaaggcaaacaacag

SEQ ID NO: 683463 - RNA, 19 nt, Human
gugagccugcacaugcacg

SEQ ID NO: 683464 - RNA, 21 nt, Human
uaacugaccccaacaguucac

SEQ ID NO: 683465 - RNA, 22 nt, Human
uaauacaguaaaucaucuugua

SEQ ID NO: 683466 - RNA, 25 nt, Human
uaucaaaaaauuaaacacaaauucu

SEQ ID NO: 683467 - RNA, 24 nt, Human
ucagacaccaaagaaggaaggaag

SEQ ID NO: 683468 - RNA, 19 nt, Human
ucagaggccugggaguggu

SEQ ID NO: 683469 - RNA, 20 nt, Human
ugauagaguuauguuggguc

SEQ ID NO: 683470 - RNA, 26 nt, Human
ugggucuuaacugaccccaacaguuc

SEQ ID NO: 683471 - RNA, 21 nt, Human
uggugagccugcacaugcacg

SEQ ID NO: 683472 - RNA, 20 nt, Human
uuaaaaaaaaaaaaaaaaaa

SEQ ID NO: 683473 - RNA, 20 nt, Human
aacaacagagaaacgcaaga

SEQ ID NO: 683474 - RNA, 22 nt, Human
cagagaaacgcaagauguaaua

SEQ ID NO: 683475 - RNA, 22 nt, Human
gcucuuaaaagagccuuugggu

SEQ ID NO: 683476 - RNA, 22 nt, Human
caacgcuacugccagaccucaa

SEQ ID NO: 683477 - RNA, 20 nt, Human
cugccacagcugcugagcgc

SEQ ID NO: 683478 - RNA, 20 nt, Human
cuuuaauugcaaacaacuug

SEQ ID NO: 683479 - RNA, 22 nt, Human
ugccacagcugcugagcgccca

SEQ ID NO: 683480 - RNA, 18 nt, Human
ugcugagcgcccaacugc

SEQ ID NO: 683481 - RNA, 18 nt, Human
cagcagaagaacuaacaa

SEQ ID NO: 683482 - RNA, 23 nt, Human
cagcagaagaacuaacaauccac

SEQ ID NO: 683483 - RNA, 22 nt, Human
ccuuugguuucugggacucggg

SEQ ID NO: 683484 - RNA, 20 nt, Human
ggacucgggaucacugacgg

SEQ ID NO: 683485 - RNA, 21 nt, Human
ucguauguguauuccagcacu

SEQ ID NO: 683486 - RNA, 21 nt, Human
uggguggcucugaaaagagcc

SEQ ID NO: 683487 - RNA, 27 nt, Human
ccuuugguuccuuuggggggcuccggc

SEQ ID NO: 683488 - RNA, 26 nt, Human
ugaguugcugcaaacuaauccaggcu

SEQ ID NO: 683489 - RNA, 21 nt, Human
gaaguggcucugaaaagagcc

SEQ ID NO: 683490 - RNA, 22 nt, Human
ugaaguggcucugaaaagagcc

SEQ ID NO: 683491 - RNA, 22 nt, Human
agacugcuuccuuaaaaagcca

SEQ ID NO: 683492 - RNA, 23 nt, Human
ugaaaagagccuuuguuaagacu

SEQ ID NO: 683493 - RNA, 21 nt, Human
uggguggcucugaaaagagcc

SEQ ID NO: 683494 - RNA, 26 nt, Human
aaaaaaauaugaacauaaaagugcua

SEQ ID NO: 683495 - RNA, 18 nt, Human
aaaagcaagagguuuuug

SEQ ID NO: 683496 - RNA, 19 nt, Human
aaacccauacccccauuga

SEQ ID NO: 683497 - RNA, 24 nt, Human
aaacccauacccccauugaacaug

SEQ ID NO: 683498 - RNA, 21 nt, Human
aaagauaucugauauccaaag

SEQ ID NO: 683499 - RNA, 23 nt, Human
aaagucaaaccgauucucaaagu

SEQ ID NO: 683500 - RNA, 19 nt, Human
aaauacuggggacaaaaua

SEQ ID NO: 683501 - RNA, 19 nt, Human
aagaaccccuaaaagcaag

SEQ ID NO: 683502 - RNA, 23 nt, Human
aaugcaacucccaaagacauuac

SEQ ID NO: 683503 - RNA, 21 nt, Human
aauuugccuccuaacagaggu

SEQ ID NO: 683504 - RNA, 27 nt, Human
acaaaaccacagaguaaauagcagaac

SEQ ID NO: 683505 - RNA, 21 nt, Human
acauagaaauaaaaacagcua

SEQ ID NO: 683506 - RNA, 20 nt, Human
acccauacccccauugaaca

SEQ ID NO: 683507 - RNA, 20 nt, Human
acuccagagacggagacaaa

SEQ ID NO: 683508 - RNA, 25 nt, Human
aggaaccaauaaaaauaaagugagc

SEQ ID NO: 683509 - RNA, 18 nt, Human
agguaaacuauuaugccc

SEQ ID NO: 683510 - RNA, 23 nt, Human
aguaaauagcagaacaucucgaa

SEQ ID NO: 683511 - RNA, 18 nt, Human
augaaauaaauaggagug

SEQ ID NO: 683512 - RNA, 25 nt, Human
auuugccuccuaacagaggugugua

SEQ ID NO: 683513 - RNA, 22 nt, Human
caacaucacuuuaaaagcucaa

SEQ ID NO: 683514 - RNA, 20 nt, Human
caacucccaaagacauuacu

SEQ ID NO: 683515 - RNA, 18 nt, Human
caaguacuaacagaagcu

SEQ ID NO: 683516 - RNA, 21 nt, Human
caaguacuaacagaagcugau

SEQ ID NO: 683517 - RNA, 22 nt, Human
caauaaaaauaaagugagcucc

SEQ ID NO: 683518 - RNA, 23 nt, Human
caccucaaaaauggcaacauggg

SEQ ID NO: 683519 - RNA, 23 nt, Human
caggaaagaugaauccaaagaug

SEQ ID NO: 683520 - RNA, 18 nt, Human
cauugcuucaggcuagug

SEQ ID NO: 683521 - RNA, 24 nt, Human
ccacugaccccaagugguaacugu

SEQ ID NO: 683522 - RNA, 21 nt, Human
ccauauaugcauuuuguuccu

SEQ ID NO: 683523 - RNA, 19 nt, Human
cgagagaguggaaaucugg

SEQ ID NO: 683524 - RNA, 21 nt, Human
cgccuacaacuccagagacgg

SEQ ID NO: 683525 - RNA, 22 nt, Human
cgccuacaacuccagagacgga

SEQ ID NO: 683526 - RNA, 25 nt, Human
cgccuacaacuccagagacggagac

SEQ ID NO: 683527 - RNA, 21 nt, Human
cuaggaagaaucucaaguuga

SEQ ID NO: 683528 - RNA, 22 nt, Human
cucauucacagcucuacuccua

SEQ ID NO: 683529 - RNA, 21 nt, Human
cuccagagacggagacaaacc

SEQ ID NO: 683530 - RNA, 19 nt, Human
cucccaaagacauuacugg

SEQ ID NO: 683531 - RNA, 18 nt, Human
cuuuguacagagccuggc

SEQ ID NO: 683532 - RNA, 20 nt, Human
ggagugucaauuaagggcag

SEQ ID NO: 683533 - RNA, 20 nt, Human
guaaacuauuaugcccauuu

SEQ ID NO: 683534 - RNA, 20 nt, Human
uaaaaaaaaaauaugaacau

SEQ ID NO: 683535 - RNA, 19 nt, Human
uaaaugaacaaucucaauc

SEQ ID NO: 683536 - RNA, 26 nt, Human
uaacguauguauuuguuccuuguccc

SEQ ID NO: 683537 - RNA, 21 nt, Human
uaagagaguucaaacagguua

SEQ ID NO: 683538 - RNA, 21 nt, Human
uacaaguacuaacagaagcug

SEQ ID NO: 683539 - RNA, 24 nt, Human
uacauagaaauaaaaacagcuacu

SEQ ID NO: 683540 - RNA, 22 nt, Human
uacauugaauuguggauguccu

SEQ ID NO: 683541 - RNA, 20 nt, Human
uacuggaaugaggucauugc

SEQ ID NO: 683542 - RNA, 19 nt, Human
uagaaauaaaaacagcuac

SEQ ID NO: 683543 - RNA, 20 nt, Human
uagaaugcuguuuaccuguu

SEQ ID NO: 683544 - RNA, 22 nt, Human
uagacucaaaugucaaaaccau

SEQ ID NO: 683545 - RNA, 24 nt, Human
uauauacauauauuuuuggggaag

SEQ ID NO: 683546 - RNA, 19 nt, Human
ucaaaaauggcaacauggg

SEQ ID NO: 683547 - RNA, 21 nt, Human
ucaauucuccccaaacucuau

SEQ ID NO: 683548 - RNA, 22 nt, Human
ucacaaaagucgaaggauugcu

SEQ ID NO: 683549 - RNA, 20 nt, Human
ucacacacauuaauucacuc

SEQ ID NO: 683550 - RNA, 20 nt, Human
uccacacacagcagagaggu

SEQ ID NO: 683551 - RNA, 19 nt, Human
ucccaaagacauuacugga

SEQ ID NO: 683552 - RNA, 24 nt, Human
uccccaaacucuaugagguaaacu

SEQ ID NO: 683553 - RNA, 26 nt, Human
ucgccuacaacuccagagacggagac

SEQ ID NO: 683554 - RNA, 18 nt, Human
ugaaagcaaagucaaacc

SEQ ID NO: 683555 - RNA, 23 nt, Human
ugaaagcacagcagcuacuaggc

SEQ ID NO: 683556 - RNA, 22 nt, Human
uggaaugaggucauugcuucag

SEQ ID NO: 683557 - RNA, 19 nt, Human
ugggaaucuuaguguccuc

SEQ ID NO: 683558 - RNA, 24 nt, Human
uggguaagaaccccuaaaagcaag

SEQ ID NO: 683559 - RNA, 21 nt, Human
uuaauguuuaccuauaauuua

SEQ ID NO: 683560 - RNA, 22 nt, Human
uuaauucacucaauucucccca

SEQ ID NO: 683561 - RNA, 18 nt, Human
uucacucaauucucccca

SEQ ID NO: 683562 - RNA, 21 nt, Human
uuccuggucugaaauguguuu

SEQ ID NO: 683563 - RNA, 23 nt, Human
uugcugaggaugaaauaaauagg

SEQ ID NO: 683564 - RNA, 23 nt, Human
uugguccuaucuuuccuuacaug

SEQ ID NO: 683565 - RNA, 23 nt, Human
aaucaccaaaaccagcggccuaa

SEQ ID NO: 683566 - RNA, 23 nt, Human
agaaaacaaacaaaaucaagaaa

SEQ ID NO: 683567 - RNA, 21 nt, Human
caaaaaucaccaaaaccagcg

SEQ ID NO: 683568 - RNA, 19 nt, Human
caaaaccagcggccuaagc

SEQ ID NO: 683569 - RNA, 19 nt, Human
ccaaaaccagcggccuaag

SEQ ID NO: 683570 - RNA, 23 nt, Human
cgagaaaacaaacaaaaucaaga

SEQ ID NO: 683571 - RNA, 21 nt, Human
cucacgagaaaacaaacaaaa

SEQ ID NO: 683572 - RNA, 24 nt, Human
cucacgagaaaacaaacaaaauca

SEQ ID NO: 683573 - RNA, 19 nt, Human
gagaaaacaaacaaaauca

SEQ ID NO: 683574 - RNA, 20 nt, Human
gagaaaacaaacaaaaucaa

SEQ ID NO: 683575 - RNA, 22 nt, Human
gcucugaaaagagccuuugggu

SEQ ID NO: 683576 - RNA, 22 nt, Human
ucagacaaaaaucaccaaaacc

SEQ ID NO: 683577 - RNA, 21 nt, Human
aaaacagcagugcaugaagcg

SEQ ID NO: 683578 - RNA, 24 nt, Human
agaaaaacagcagugcaugaagcg

SEQ ID NO: 683579 - RNA, 22 nt, Human
ugacagaaaaacagcagugcau

SEQ ID NO: 683580 - RNA, 22 nt, Human
cugaaaagagccuuuugucuug

SEQ ID NO: 683581 - RNA, 20 nt, Human
cuuguaaguuuacauuuuua

SEQ ID NO: 683582 - RNA, 21 nt, Human
gaccuguggccuaagucagaa

SEQ ID NO: 683583 - RNA, 19 nt, Human
ugaaaagagccuuuugucu

SEQ ID NO: 683584 - RNA, 21 nt, Human
uggguggcucugaaaagagcc

SEQ ID NO: 683585 - RNA, 22 nt, Human
ugagcugccacaaacuaguaca

SEQ ID NO: 683586 - RNA, 21 nt, Human
uggguggcccugaaaagagcc

SEQ ID NO: 683587 - RNA, 21 nt, Human
aaaugaaaggggucccaccuc

SEQ ID NO: 683588 - RNA, 18 nt, Human
aacggggcuuccuggcuu

SEQ ID NO: 683589 - RNA, 22 nt, Human
aagaacauuagaguaaaaagaa

SEQ ID NO: 683590 - RNA, 22 nt, Human
aagacgcuguucuccccacugc

SEQ ID NO: 683591 - RNA, 26 nt, Human
aagcaccacaacacacgcuuacaaac

SEQ ID NO: 683592 - RNA, 18 nt, Human
aaggugucucggccugag

SEQ ID NO: 683593 - RNA, 23 nt, Human
aaugccaacuaucagugcuaaca

SEQ ID NO: 683594 - RNA, 18 nt, Human
agacaaaaaguaaccaaa

SEQ ID NO: 683595 - RNA, 30 nt, Human
agacaaaaaguaaccaaaaauuaggucugg

SEQ ID NO: 683596 - RNA, 24 nt, Human
agcaaaaguucacuuucggaccca

SEQ ID NO: 683597 - RNA, 25 nt, Human
agcggcggcucgguggcggcggcgg

SEQ ID NO: 683598 - RNA, 22 nt, Human
aggggauuuuuuuuuucuuuua

SEQ ID NO: 683599 - RNA, 23 nt, Human
agugagcacagcggcggcucggu

SEQ ID NO: 683600 - RNA, 19 nt, Human
auaaaacuauaaaaucucc

SEQ ID NO: 683601 - RNA, 23 nt, Human
auaaaacuauaaaaucuccuagg

SEQ ID NO: 683602 - RNA, 20 nt, Human
auaagacaaaaaguaaccaa

SEQ ID NO: 683603 - RNA, 22 nt, Human
auaagacaaaaaguaaccaaaa

SEQ ID NO: 683604 - RNA, 19 nt, Human
augagcaaaacugaaaaug

SEQ ID NO: 683605 - RNA, 22 nt, Human
caaauauaauuaaggacaacag

SEQ ID NO: 683606 - RNA, 23 nt, Human
caccgguuccccugggguccuuc

SEQ ID NO: 683607 - RNA, 27 nt, Human
cagugcuaacauaaaaacauuuuagaa

SEQ ID NO: 683608 - RNA, 27 nt, Human
caguuaauccuccucaccccgaagucu

SEQ ID NO: 683609 - RNA, 24 nt, Human
caucaauaagacaaaaaguaacca

SEQ ID NO: 683610 - RNA, 18 nt, Human
ccaaaagaacauuagagu

SEQ ID NO: 683611 - RNA, 18 nt, Human
cccaguaggagugaaggg

SEQ ID NO: 683612 - RNA, 21 nt, Human
ccccgaagucuggaaccugcc

SEQ ID NO: 683613 - RNA, 22 nt, Human
ccuagaugagcaaaacugaaaa

SEQ ID NO: 683614 - RNA, 23 nt, Human
ccucaccccgaagucuggaaccu

SEQ ID NO: 683615 - RNA, 21 nt, Human
ccucuucgcuucccgcccgcg

SEQ ID NO: 683616 - RNA, 24 nt, Human
ccuggccgcucgcgccuuuucucu

SEQ ID NO: 683617 - RNA, 22 nt, Human
cggcucgguggcggcggcggca

SEQ ID NO: 683618 - RNA, 19 nt, Human
cgguggcggcggcggcagc

SEQ ID NO: 683619 - RNA, 22 nt, Human
cuccccacugcugugcgucaau

SEQ ID NO: 683620 - RNA, 22 nt, Human
cucgguggcggcggcggcagcu

SEQ ID NO: 683621 - RNA, 24 nt, Human
cuugcacauggaagcgguuagcua

SEQ ID NO: 683622 - RNA, 22 nt, Human
gagcacaccgguuccccugggg

SEQ ID NO: 683623 - RNA, 23 nt, Human
gagcacagcggcggcucgguggc

SEQ ID NO: 683624 - RNA, 20 nt, Human
gccugagcccuccuggccgc

SEQ ID NO: 683625 - RNA, 26 nt, Human
gcggcggcucgguggcggcggcggca

SEQ ID NO: 683626 - RNA, 27 nt, Human
gcggcggcucgguggcggcggcggcaa

SEQ ID NO: 683627 - RNA, 18 nt, Human
gcggcucgguggcggcgg

SEQ ID NO: 683628 - RNA, 20 nt, Human
ggcccuggaggcggaucagu

SEQ ID NO: 683629 - RNA, 20 nt, Human
ggcccuggaggcggaucagu

SEQ ID NO: 683630 - RNA, 22 nt, Human
guaaaaagaacgccacuggagg

SEQ ID NO: 683631 - RNA, 20 nt, Human
guggcggcggcggcagcugc

SEQ ID NO: 683632 - RNA, 21 nt, Human
guggcggcggcggcagcugca

SEQ ID NO: 683633 - RNA, 21 nt, Human
uaaaaagaacgccacuggagg

SEQ ID NO: 683634 - RNA, 22 nt, Human
uaaaacuauaaaaucuccuagg

SEQ ID NO: 683635 - RNA, 22 nt, Human
uaaaagacgcuguucuccccac

SEQ ID NO: 683636 - RNA, 25 nt, Human
uaaaagacgcuguucuccccacugc

SEQ ID NO: 683637 - RNA, 20 nt, Human
uaaaaucuccuagguuacac

SEQ ID NO: 683638 - RNA, 18 nt, Human
uaaacuggaaaccaaagc

SEQ ID NO: 683639 - RNA, 23 nt, Human
uaaacuggaaaccaaagccuuaa

SEQ ID NO: 683640 - RNA, 21 nt, Human
uaacaacaguaaugccaacua

SEQ ID NO: 683641 - RNA, 23 nt, Human
uaagucagacacggucuggaaca

SEQ ID NO: 683642 - RNA, 22 nt, Human
uagaaggucaaaaacaauuaaa

SEQ ID NO: 683643 - RNA, 18 nt, Human
uagaguaaaaagaacgcc

SEQ ID NO: 683644 - RNA, 22 nt, Human
uagaugagcaaaacugaaaaug

SEQ ID NO: 683645 - RNA, 23 nt, Human
ucaaauccaucaauaagacaaaa

SEQ ID NO: 683646 - RNA, 23 nt, Human
ucacacaaauuccaaauugcaaa

SEQ ID NO: 683647 - RNA, 22 nt, Human
ucagacacggucuggaacacag

SEQ ID NO: 683648 - RNA, 19 nt, Human
ucaguuaauccuccucacc

SEQ ID NO: 683649 - RNA, 23 nt, Human
ucccaguaggagugaaggggauu

SEQ ID NO: 683650 - RNA, 18 nt, Human
uccccugggguccuucag

SEQ ID NO: 683651 - RNA, 23 nt, Human
ucggccugagcccuccuggccgc

SEQ ID NO: 683652 - RNA, 25 nt, Human
ucuccuagguuacacuaagucagac

SEQ ID NO: 683653 - RNA, 21 nt, Human
ugaaaaugaaaggggucccac

SEQ ID NO: 683654 - RNA, 23 nt, Human
ugaaaaugaaaggggucccaccu

SEQ ID NO: 683655 - RNA, 18 nt, Human
ugagcaaaacugaaaaug

SEQ ID NO: 683656 - RNA, 24 nt, Human
ugagcaaaacugaaaaugaaaggg

SEQ ID NO: 683657 - RNA, 24 nt, Human
ugcuuugccuuauuaaaucuuuca

SEQ ID NO: 683658 - RNA, 23 nt, Human
uggcggcggcggcagcugcaagg

SEQ ID NO: 683659 - RNA, 21 nt, Human
ugggguccuucaguuaauccu

SEQ ID NO: 683660 - RNA, 22 nt, Human
uuaacaacaguaaugccaacua

SEQ ID NO: 683661 - RNA, 20 nt, Human
uucaguuaauccuccucacc

SEQ ID NO: 683662 - RNA, 24 nt, Human
uucuccccacugcugugcgucaau

SEQ ID NO: 683663 - RNA, 19 nt, Human
uuuuuuuuuuuuuuaacgg

SEQ ID NO: 683664 - RNA, 22 nt, Human
uuuuuuuuuuuuuuuuuaacgg

SEQ ID NO: 683665 - RNA, 23 nt, Human
aaaaaaaagccugaaucaaaacc

SEQ ID NO: 683666 - RNA, 24 nt, Human
aaaaaaguucuuuuaacaacagga

SEQ ID NO: 683667 - RNA, 19 nt, Human
aaaaagccugaaucaaaac

SEQ ID NO: 683668 - RNA, 18 nt, Human
aaaagcaaaaccccacuc

SEQ ID NO: 683669 - RNA, 23 nt, Human
aaaaugaaaccaaaaaaaagccu

SEQ ID NO: 683670 - RNA, 21 nt, Human
aaagaaaccccucgcggagac

SEQ ID NO: 683671 - RNA, 20 nt, Human
aaagagaaaagcaccaguga

SEQ ID NO: 683672 - RNA, 21 nt, Human
aaagagaaaagcaccagugag

SEQ ID NO: 683673 - RNA, 25 nt, Human
aaaugaaaccaaaaaaaagccugaa

SEQ ID NO: 683674 - RNA, 26 nt, Human
aacaaaaugaaaccaaaaaaaagccu

SEQ ID NO: 683675 - RNA, 18 nt, Human
aacaggaggaaaacacau

SEQ ID NO: 683676 - RNA, 18 nt, Human
acaaaagagaaaagcacc

SEQ ID NO: 683677 - RNA, 24 nt, Human
accaaaaaaaagccugaaucaaaa

SEQ ID NO: 683678 - RNA, 23 nt, Human
acggaacacgcacaccaacagag

SEQ ID NO: 683679 - RNA, 19 nt, Human
agagaaaagcaccagugag

SEQ ID NO: 683680 - RNA, 23 nt, Human
agauauuauagggaugggggcgg

SEQ ID NO: 683681 - RNA, 20 nt, Human
aggagagugugaagggcaga

SEQ ID NO: 683682 - RNA, 23 nt, Human
aggaggaaaacacauggaaagaa

SEQ ID NO: 683683 - RNA, 18 nt, Human
agggaugggggcgggggg

SEQ ID NO: 683684 - RNA, 18 nt, Human
agggaugggggcgggggg

SEQ ID NO: 683685 - RNA, 23 nt, Human
agucaaugcuauaaaucuaaaac

SEQ ID NO: 683686 - RNA, 22 nt, Human
caaaaaaaagccugaaucaaaa

SEQ ID NO: 683687 - RNA, 23 nt, Human
caaaaaaaagccugaaucaaaac

SEQ ID NO: 683688 - RNA, 23 nt, Human
caaaaugaaaccaaaaaaaagcc

SEQ ID NO: 683689 - RNA, 19 nt, Human
caacaggaggaaaacacau

SEQ ID NO: 683690 - RNA, 21 nt, Human
caacaggaggaaaacacaugg

SEQ ID NO: 683691 - RNA, 21 nt, Human
cacaccaacagagcccaggcc

SEQ ID NO: 683692 - RNA, 20 nt, Human
cacccuccacuccccugcca

SEQ ID NO: 683693 - RNA, 18 nt, Human
cacgcacaccaacagagc

SEQ ID NO: 683694 - RNA, 26 nt, Human
cacgcacaccaacagagcccaggcca

SEQ ID NO: 683695 - RNA, 22 nt, Human
cacuaaaacaaaagagaaaagc

SEQ ID NO: 683696 - RNA, 24 nt, Human
cagagcccaggccacuuuuugccc

SEQ ID NO: 683697 - RNA, 27 nt, Human
caucaccccuccucucuccuuuuaaaa

SEQ ID NO: 683698 - RNA, 20 nt, Human
cccacgcggcgccggugccg

SEQ ID NO: 683699 - RNA, 20 nt, Human
cccggcacuaacacaaugcu

SEQ ID NO: 683700 - RNA, 27 nt, Human
cccuccucucuccuuuuaaaaagcaaa

SEQ ID NO: 683701 - RNA, 26 nt, Human
ccgcaggaauuuuuuuuuuuuuuuuu

SEQ ID NO: 683702 - RNA, 26 nt, Human
ccuccucucuccuuuuaaaaagcaaa

SEQ ID NO: 683703 - RNA, 24 nt, Human
ccucucuccuuuuaaaaagcaaaa

SEQ ID NO: 683704 - RNA, 19 nt, Human
ccugcccggccacccucca

SEQ ID NO: 683705 - RNA, 25 nt, Human
cggcacuaacacaaugcuggugcug

SEQ ID NO: 683706 - RNA, 18 nt, Human
cggccacccuccacuccc

SEQ ID NO: 683707 - RNA, 31 nt, Human
cggccacccuccacuccccugccaucacccc

SEQ ID NO: 683708 - RNA, 21 nt, Human
cuaaaacaaaagagaaaagca

SEQ ID NO: 683709 - RNA, 22 nt, Human
cucccggcacuaacacaaugcu

SEQ ID NO: 683710 - RNA, 18 nt, Human
cucucagcuugcugacac

SEQ ID NO: 683711 - RNA, 28 nt, Human
gaaaacacauggaaagaaaccgguaccc

SEQ ID NO: 683712 - RNA, 22 nt, Human
gaacacgcacaccaacagagcc

SEQ ID NO: 683713 - RNA, 21 nt, Human
gagagugugaagggcagaggg

SEQ ID NO: 683714 - RNA, 23 nt, Human
gcccggugcccucugcgcgcccc

SEQ ID NO: 683715 - RNA, 22 nt, Human
gccgccugcucccggcgcccgg

SEQ ID NO: 683716 - RNA, 18 nt, Human
gcggccucgugccaagcu

SEQ ID NO: 683717 - RNA, 19 nt, Human
ggaaagaaaccccucgcgg

SEQ ID NO: 683718 - RNA, 19 nt, Human
gggaugggggcggggggca

SEQ ID NO: 683719 - RNA, 20 nt, Human
gggcaggacucuuugccuuu

SEQ ID NO: 683720 - RNA, 18 nt, Human
ggugcugcgccgccugcu

SEQ ID NO: 683721 - RNA, 24 nt, Human
uaaaaaaacaaaaugaaaccaaaa

SEQ ID NO: 683722 - RNA, 23 nt, Human
uaaaaagcaaaaccccacucuug

SEQ ID NO: 683723 - RNA, 22 nt, Human
uaaaacaaaagagaaaagcacc

SEQ ID NO: 683724 - RNA, 25 nt, Human
ucaccccuccucucuccuuuuaaaa

SEQ ID NO: 683725 - RNA, 23 nt, Human
uccacgggcgcagguuuggccca

SEQ ID NO: 683726 - RNA, 21 nt, Human
uccuuucauuuucuuuuucuu

SEQ ID NO: 683727 - RNA, 22 nt, Human
uggaaagaaaccccucgcggag

SEQ ID NO: 683728 - RNA, 23 nt, Human
uggaaagaaaccccucgcggaga

SEQ ID NO: 683729 - RNA, 24 nt, Human
uggugcugcgccgccugcucccgg

SEQ ID NO: 683730 - RNA, 23 nt, Human
uguguaaaagucaaugcuauaaa

SEQ ID NO: 683731 - RNA, 21 nt, Human
ugugugaauguguguaaaagu

SEQ ID NO: 683732 - RNA, 19 nt, Human
uuaaaaagcaaaaccccac

SEQ ID NO: 683733 - RNA, 19 nt, Human
uugcuucaguuucccucuc

SEQ ID NO: 683734 - RNA, 22 nt, Human
uuuuuuuuuuuuuuuuuccuuu

SEQ ID NO: 683735 - RNA, 23 nt, Human
uuuuuuuuuuuuuuuuuuccuuu

SEQ ID NO: 683736 - RNA, 23 nt, Human
aaauagaauuacaaaaaggcaaa

SEQ ID NO: 683737 - RNA, 23 nt, Human
aagcaaggcagagaaaaggcuaa

SEQ ID NO: 683738 - RNA, 20 nt, Human
acuuauccaccagaguggaa

SEQ ID NO: 683739 - RNA, 21 nt, Human
auacaguccacuggaaucacc

SEQ ID NO: 683740 - RNA, 19 nt, Human
caaggcagagaaaaggcua

SEQ ID NO: 683741 - RNA, 19 nt, Human
caccagaguggaaauaaug

SEQ ID NO: 683742 - RNA, 24 nt, Human
cacuggaaucaccaacacuggaca

SEQ ID NO: 683743 - RNA, 21 nt, Human
gcagagaaaaggcuaaucgga

SEQ ID NO: 683744 - RNA, 18 nt, Human
uacuauaacuucugcauc

SEQ ID NO: 683745 - RNA, 21 nt, Human
uccaccagaguggaaauaaug

SEQ ID NO: 683746 - RNA, 21 nt, Human
ugagaucccaccaccuacucc

SEQ ID NO: 683747 - RNA, 20 nt, Human
uggaaucaccaacacuggac

SEQ ID NO: 683748 - RNA, 23 nt, Human
uguacaaaaccaaauguuuguua

SEQ ID NO: 683749 - RNA, 28 nt, Human
uuaaaaacagucaacucaaucaaaaccc

SEQ ID NO: 683750 - RNA, 22 nt, Human
aaaaaaaaaaaaaaaagcuaag

SEQ ID NO: 683751 - RNA, 23 nt, Human
aaaaauacauaucuuuggcaggc

SEQ ID NO: 683752 - RNA, 20 nt, Human
aaaaggucaaacauaaauag

SEQ ID NO: 683753 - RNA, 18 nt, Human
aaaauuagcugggcaugg

SEQ ID NO: 683754 - RNA, 18 nt, Human
aaacacacgggagaaacc

SEQ ID NO: 683755 - RNA, 18 nt, Human
aaaugucaaaggucuacu

SEQ ID NO: 683756 - RNA, 20 nt, Human
aacauggugaaaccccacgu

SEQ ID NO: 683757 - RNA, 21 nt, Human
aacauggugaaaccccacguc

SEQ ID NO: 683758 - RNA, 21 nt, Human
aacauggugaaaccccacguc

SEQ ID NO: 683759 - RNA, 22 nt, Human
aacauggugaaaccccacgucu

SEQ ID NO: 683760 - RNA, 22 nt, Human
aaccuagccaaucaacacacaa

SEQ ID NO: 683761 - RNA, 20 nt, Human
aagaaucugagccaaacugg

SEQ ID NO: 683762 - RNA, 18 nt, Human
aagacagaggcuuaaagc

SEQ ID NO: 683763 - RNA, 23 nt, Human
aagaugaauagagcuaauuguca

SEQ ID NO: 683764 - RNA, 22 nt, Human
aagcuuuugugaaacuaugccc

SEQ ID NO: 683765 - RNA, 21 nt, Human
aagguacuuuuaucaaacuuc

SEQ ID NO: 683766 - RNA, 19 nt, Human
aaggucccaaagaacagga

SEQ ID NO: 683767 - RNA, 20 nt, Human
aaggugcucucuuccaagcu

SEQ ID NO: 683768 - RNA, 24 nt, Human
aauuuuuuaaaauuuuaaaagguu

SEQ ID NO: 683769 - RNA, 23 nt, Human
acaaaacccgaaaaaugaacacu

SEQ ID NO: 683770 - RNA, 19 nt, Human
acaaacagggccauggugc

SEQ ID NO: 683771 - RNA, 21 nt, Human
acagcacccaaggcaaaaugc

SEQ ID NO: 683772 - RNA, 22 nt, Human
acagccagggacuggccaacaa

SEQ ID NO: 683773 - RNA, 20 nt, Human
acaugguauuccugacucua

SEQ ID NO: 683774 - RNA, 20 nt, Human
accaacacugcagcaacaca

SEQ ID NO: 683775 - RNA, 19 nt, Human
acccagguagauaggacuc

SEQ ID NO: 683776 - RNA, 21 nt, Human
acucccagguucucacucuuu

SEQ ID NO: 683777 - RNA, 24 nt, Human
acugaaaaacaaacagggccaugg

SEQ ID NO: 683778 - RNA, 22 nt, Human
agacgggcggaucgccugaggu

SEQ ID NO: 683779 - RNA, 26 nt, Human
agacgggcggaucgccugaggucagg

SEQ ID NO: 683780 - RNA, 21 nt, Human
agcaauagcaccuugggccuu

SEQ ID NO: 683781 - RNA, 18 nt, Human
agcaccaggaacugugcu

SEQ ID NO: 683782 - RNA, 24 nt, Human
agcacuuuggaaggcuuagacggg

SEQ ID NO: 683783 - RNA, 21 nt, Human
agcucacuggaaggauucacu

SEQ ID NO: 683784 - RNA, 23 nt, Human
agcugggcaugguggcgugcgcc

SEQ ID NO: 683785 - RNA, 18 nt, Human
aggagggccuguuuugua

SEQ ID NO: 683786 - RNA, 20 nt, Human
aggaguuugagaccagucug

SEQ ID NO: 683787 - RNA, 24 nt, Human
aggcaggagaaucgcuggaacccg

SEQ ID NO: 683788 - RNA, 22 nt, Human
aggcaucagguaaggccaagcu

SEQ ID NO: 683789 - RNA, 20 nt, Human
aggcugaggcaggagaaucg

SEQ ID NO: 683790 - RNA, 23 nt, Human
aggcugaggcaggagaaucgcug

SEQ ID NO: 683791 - RNA, 18 nt, Human
agggaggguugcagugag

SEQ ID NO: 683792 - RNA, 23 nt, Human
agggaggguugcagugagccaag

SEQ ID NO: 683793 - RNA, 19 nt, Human
aggguugcagugagccaag

SEQ ID NO: 683794 - RNA, 25 nt, Human
aguagaaucuuguuccacuaaauca

SEQ ID NO: 683795 - RNA, 22 nt, Human
agucuggccaacauggugaaac

SEQ ID NO: 683796 - RNA, 24 nt, Human
agucuggccaacauggugaaaccc

SEQ ID NO: 683797 - RNA, 20 nt, Human
aucaacaggaaacagggcca

SEQ ID NO: 683798 - RNA, 20 nt, Human
aucacccccuccuggaaccu

SEQ ID NO: 683799 - RNA, 20 nt, Human
aucagguaaggccaagcuuc

SEQ ID NO: 683800 - RNA, 25 nt, Human
aucgcacuccagucugggugacaag

SEQ ID NO: 683801 - RNA, 24 nt, Human
aucgugccaucgcacuccagucug

SEQ ID NO: 683802 - RNA, 19 nt, Human
augaacacuaacuauaacc

SEQ ID NO: 683803 - RNA, 18 nt, Human
augcaggaauaaaggacu

SEQ ID NO: 683804 - RNA, 19 nt, Human
auggccccucuaucuucaa

SEQ ID NO: 683805 - RNA, 20 nt, Human
auugucaggcacuccuauuu

SEQ ID NO: 683806 - RNA, 23 nt, Human
caaaauucugccuaucacccccu

SEQ ID NO: 683807 - RNA, 18 nt, Human
caaagaucugaacccagg

SEQ ID NO: 683808 - RNA, 21 nt, Human
caaagcccaacucuccacugc

SEQ ID NO: 683809 - RNA, 24 nt, Human
caacauggugaaaccccacgucua

SEQ ID NO: 683810 - RNA, 19 nt, Human
caagcucacuggaaggauu

SEQ ID NO: 683811 - RNA, 21 nt, Human
caaggcaaaaugcugucuccc

SEQ ID NO: 683812 - RNA, 20 nt, Human
cacaacugucaccacaugaa

SEQ ID NO: 683813 - RNA, 18 nt, Human
cacacaucccaguagaau

SEQ ID NO: 683814 - RNA, 28 nt, Human
cacauaauguaacacauucauaggcaua

SEQ ID NO: 683815 - RNA, 19 nt, Human
caccauaucaacaggaaac

SEQ ID NO: 683816 - RNA, 22 nt, Human
caccauaucaacaggaaacagg

SEQ ID NO: 683817 - RNA, 24 nt, Human
caccauaucaacaggaaacagggc

SEQ ID NO: 683818 - RNA, 23 nt, Human
cacgucuacuaaaaauacaaaaa

SEQ ID NO: 683819 - RNA, 18 nt, Human
cacuccagucugggugac

SEQ ID NO: 683820 - RNA, 20 nt, Human
cacuccagucugggugacaa

SEQ ID NO: 683821 - RNA, 21 nt, Human
cacuccagucugggugacaag

SEQ ID NO: 683822 - RNA, 18 nt, Human
cacuuuggaaggcuuaga

SEQ ID NO: 683823 - RNA, 22 nt, Human
cagcacccaaggcaaaaugcug

SEQ ID NO: 683824 - RNA, 22 nt, Human
cagcaccgaccgccgccgccgg

SEQ ID NO: 683825 - RNA, 20 nt, Human
cagcacuuuggaaggcuuag

SEQ ID NO: 683826 - RNA, 24 nt, Human
cagcacuuuggaaggcuuagacgg

SEQ ID NO: 683827 - RNA, 24 nt, Human
cagcuacuugggaggcugaggcag

SEQ ID NO: 683828 - RNA, 26 nt, Human
caggaaacagggccaugccaccaggg

SEQ ID NO: 683829 - RNA, 18 nt, Human
caggaaacaugcaggaau

SEQ ID NO: 683830 - RNA, 23 nt, Human
cagggccaugccaccagggagga

SEQ ID NO: 683831 - RNA, 20 nt, Human
cauaggcauaacacugggca

SEQ ID NO: 683832 - RNA, 19 nt, Human
caucgcacuccagucuggg

SEQ ID NO: 683833 - RNA, 23 nt, Human
caucgcacuccagucugggugac

SEQ ID NO: 683834 - RNA, 24 nt, Human
caucgcacuccagucugggugaca

SEQ ID NO: 683835 - RNA, 25 nt, Human
caucgcacuccagucugggugacaa

SEQ ID NO: 683836 - RNA, 19 nt, Human
caugcaggaauaaaggacu

SEQ ID NO: 683837 - RNA, 24 nt, Human
cauucagaaaauuacucaugcaag

SEQ ID NO: 683838 - RNA, 23 nt, Human
ccaacacugcagcaacacaguuu

SEQ ID NO: 683839 - RNA, 18 nt, Human
ccaagcaguuauagcagc

SEQ ID NO: 683840 - RNA, 20 nt, Human
ccaagcuucucaucugugcc

SEQ ID NO: 683841 - RNA, 26 nt, Human
ccacugcucucuacuugucggugggc

SEQ ID NO: 683842 - RNA, 22 nt, Human
ccagggacuggccaacaaagau

SEQ ID NO: 683843 - RNA, 20 nt, Human
ccaucgcacuccagucuggg

SEQ ID NO: 683844 - RNA, 21 nt, Human
ccaucgcacuccagucugggu

SEQ ID NO: 683845 - RNA, 21 nt, Human
ccaucgcacuccagucugggu

SEQ ID NO: 683846 - RNA, 23 nt, Human
ccaucgcacuccagucuggguga

SEQ ID NO: 683847 - RNA, 24 nt, Human
ccaucgcacuccagucugggugac

SEQ ID NO: 683848 - RNA, 19 nt, Human
cccgccucgcgcugcugug

SEQ ID NO: 683849 - RNA, 21 nt, Human
cccgcgccgccgccgccgcuc

SEQ ID NO: 683850 - RNA, 19 nt, Human
cccuccuggaaccucucuu

SEQ ID NO: 683851 - RNA, 22 nt, Human
ccgccgccgcucucgcagcacc

SEQ ID NO: 683852 - RNA, 24 nt, Human
ccgccuccgcucggccgcgcgccc

SEQ ID NO: 683853 - RNA, 18 nt, Human
ccgcgccgccgccgccgc

SEQ ID NO: 683854 - RNA, 19 nt, Human
ccgcgccgccgccgccgcu

SEQ ID NO: 683855 - RNA, 21 nt, Human
ccgcgccgccgccgccgcucu

SEQ ID NO: 683856 - RNA, 21 nt, Human
ccgcgccgccgccgccgcucu

SEQ ID NO: 683857 - RNA, 25 nt, Human
ccgcugccgacccgcgccgccgccg

SEQ ID NO: 683858 - RNA, 20 nt, Human
ccgugcccgccucgcgcugc

SEQ ID NO: 683859 - RNA, 18 nt, Human
ccucccgcugccgacccg

SEQ ID NO: 683860 - RNA, 22 nt, Human
ccucccgcugccgacccgcgcc

SEQ ID NO: 683861 - RNA, 21 nt, Human
ccucgcgcugcuguggccaau

SEQ ID NO: 683862 - RNA, 22 nt, Human
ccugaggucaggaguuugagac

SEQ ID NO: 683863 - RNA, 24 nt, Human
ccugccaguaaucccagcacuuug

SEQ ID NO: 683864 - RNA, 18 nt, Human
ccuguaaucccagcuacu

SEQ ID NO: 683865 - RNA, 21 nt, Human
ccuguaaucccagcuacuugg

SEQ ID NO: 683866 - RNA, 23 nt, Human
cgcacuccagucugggugacaag

SEQ ID NO: 683867 - RNA, 23 nt, Human
cgccugaggucaggaguuugaga

SEQ ID NO: 683868 - RNA, 21 nt, Human
cgccuguaaucccagcuacuu

SEQ ID NO: 683869 - RNA, 24 nt, Human
cgccuguaaucccagcuacuuggg

SEQ ID NO: 683870 - RNA, 24 nt, Human
cggaucgccugaggucaggaguuu

SEQ ID NO: 683871 - RNA, 19 nt, Human
cgggagggaggguugcagu

SEQ ID NO: 683872 - RNA, 23 nt, Human
cgggagggaggguugcagugagc

SEQ ID NO: 683873 - RNA, 24 nt, Human
cgggcggaucgccugaggucagga

SEQ ID NO: 683874 - RNA, 21 nt, Human
cuaaagccaacaaauuaccac

SEQ ID NO: 683875 - RNA, 20 nt, Human
cuagccaaucaacacacaag

SEQ ID NO: 683876 - RNA, 19 nt, Human
cucagggauaacaauacau

SEQ ID NO: 683877 - RNA, 20 nt, Human
cugagaagcaaauguccuug

SEQ ID NO: 683878 - RNA, 23 nt, Human
cuggccaacauggugaaacccca

SEQ ID NO: 683879 - RNA, 22 nt, Human
cugggugacaagaaugagacuc

SEQ ID NO: 683880 - RNA, 20 nt, Human
cuguccucugccaagugucc

SEQ ID NO: 683881 - RNA, 24 nt, Human
cugugccucaaggugcucucuucc

SEQ ID NO: 683882 - RNA, 18 nt, Human
cuucuaagugacuggucu

SEQ ID NO: 683883 - RNA, 23 nt, Human
cuugaaagaauuacaaagcccaa

SEQ ID NO: 683884 - RNA, 24 nt, Human
cuuuuaucaugucuacaguaauug

SEQ ID NO: 683885 - RNA, 23 nt, Human
gaaaggccuauuuuuacugggga

SEQ ID NO: 683886 - RNA, 18 nt, Human
gagaagcaaauguccuug

SEQ ID NO: 683887 - RNA, 23 nt, Human
gagaaucgcuggaacccgggagg

SEQ ID NO: 683888 - RNA, 24 nt, Human
gaggguugcagugagccaagaucg

SEQ ID NO: 683889 - RNA, 24 nt, Human
gaucgccugaggucaggaguuuga

SEQ ID NO: 683890 - RNA, 18 nt, Human
gccaacauggugaaaccc

SEQ ID NO: 683891 - RNA, 19 nt, Human
gccaucgcacuccagucug

SEQ ID NO: 683892 - RNA, 23 nt, Human
gccgacccgcgccgccgccgccg

SEQ ID NO: 683893 - RNA, 19 nt, Human
gccgccgccgccgcucucg

SEQ ID NO: 683894 - RNA, 25 nt, Human
gccuaucacccccuccuggaaccuc

SEQ ID NO: 683895 - RNA, 24 nt, Human
gccugaggucaggaguuugagacc

SEQ ID NO: 683896 - RNA, 23 nt, Human
gccuguaaucccagcuacuuggg

SEQ ID NO: 683897 - RNA, 21 nt, Human
ggagaaucgcuggaacccggg

SEQ ID NO: 683898 - RNA, 22 nt, Human
ggaucgccugaggucaggaguu

SEQ ID NO: 683899 - RNA, 23 nt, Human
ggcaugguggcgugcgccuguaa

SEQ ID NO: 683900 - RNA, 20 nt, Human
ggccauggugcuuucaggug

SEQ ID NO: 683901 - RNA, 21 nt, Human
ggcgugcgccuguaaucccag

SEQ ID NO: 683902 - RNA, 19 nt, Human
ggucaggaguuugagacca

SEQ ID NO: 683903 - RNA, 24 nt, Human
gguggcgugcgccuguaaucccag

SEQ ID NO: 683904 - RNA, 21 nt, Human
gguuccugccaguaaucccag

SEQ ID NO: 683905 - RNA, 23 nt, Human
gugguuccugccaguaaucccag

SEQ ID NO: 683906 - RNA, 24 nt, Human
gugguuccugccaguaaucccagc

SEQ ID NO: 683907 - RNA, 20 nt, Human
uaaaaauuccacauaucccc

SEQ ID NO: 683908 - RNA, 19 nt, Human
uaaaacacacgggagaaac

SEQ ID NO: 683909 - RNA, 21 nt, Human
uaaagccaacaaauuaccaca

SEQ ID NO: 683910 - RNA, 23 nt, Human
uaaagccaacaaauuaccacaaa

SEQ ID NO: 683911 - RNA, 19 nt, Human
uaaggccaagcuucucauc

SEQ ID NO: 683912 - RNA, 21 nt, Human
uacaaugacggggaggaagag

SEQ ID NO: 683913 - RNA, 20 nt, Human
uacagaguuuacaaauaagc

SEQ ID NO: 683914 - RNA, 18 nt, Human
uagcuccuaaaggucccu

SEQ ID NO: 683915 - RNA, 21 nt, Human
uaggaaugggaugaucuucaa

SEQ ID NO: 683916 - RNA, 19 nt, Human
uagggugcuuacagcuagg

SEQ ID NO: 683917 - RNA, 21 nt, Human
uauaaaacacacgggagaaac

SEQ ID NO: 683918 - RNA, 21 nt, Human
uaugaaacaaaacccgaaaaa

SEQ ID NO: 683919 - RNA, 24 nt, Human
uaugaaacaaaacccgaaaaauga

SEQ ID NO: 683920 - RNA, 22 nt, Human
ucaaagcugcucugaagcagau

SEQ ID NO: 683921 - RNA, 23 nt, Human
ucaaaggucuacuucucaacauu

SEQ ID NO: 683922 - RNA, 18 nt, Human
ucaccaggcuaaaaucaa

SEQ ID NO: 683923 - RNA, 20 nt, Human
ucacucaaaauauaaauuaa

SEQ ID NO: 683924 - RNA, 18 nt, Human
ucagcucagcacacaucc

SEQ ID NO: 683925 - RNA, 19 nt, Human
ucagggauaacaauacaua

SEQ ID NO: 683926 - RNA, 18 nt, Human
ucagguuaccccacucag

SEQ ID NO: 683927 - RNA, 21 nt, Human
ucauggggcccuuguaucacu

SEQ ID NO: 683928 - RNA, 23 nt, Human
ucauguauccauuucaaaggccu

SEQ ID NO: 683929 - RNA, 24 nt, Human
uccaaaaggucaaacauaaauaga

SEQ ID NO: 683930 - RNA, 22 nt, Human
ucccaaagaacaggaaacaugc

SEQ ID NO: 683931 - RNA, 18 nt, Human
ucccaguuuuuauguucu

SEQ ID NO: 683932 - RNA, 19 nt, Human
ucccugaagaaucugagcc

SEQ ID NO: 683933 - RNA, 23 nt, Human
uccugccaguaaucccagcacuu

SEQ ID NO: 683934 - RNA, 24 nt, Human
ucgcagcaccgaccgccgccgccg

SEQ ID NO: 683935 - RNA, 19 nt, Human
ucgccugaggucaggaguu

SEQ ID NO: 683936 - RNA, 21 nt, Human
ucgcgcugcuguggccaaugc

SEQ ID NO: 683937 - RNA, 19 nt, Human
ucuagggugcuuacagcua

SEQ ID NO: 683938 - RNA, 23 nt, Human
ucuggccaacauggugaaacccc

SEQ ID NO: 683939 - RNA, 24 nt, Human
ucuggccaacauggugaaacccca

SEQ ID NO: 683940 - RNA, 18 nt, Human
ugaaaaacaaacagggcc

SEQ ID NO: 683941 - RNA, 19 nt, Human
ugaaaaacaaacagggcca

SEQ ID NO: 683942 - RNA, 20 nt, Human
ugaaacaaaacccgaaaaau

SEQ ID NO: 683943 - RNA, 24 nt, Human
ugaaacaaaacccgaaaaaugaac

SEQ ID NO: 683944 - RNA, 25 nt, Human
ugaaacaaaacccgaaaaaugaaca

SEQ ID NO: 683945 - RNA, 21 nt, Human
ugaacacuaacuauaacccuu

SEQ ID NO: 683946 - RNA, 22 nt, Human
ugaagacagaggcuuaaagcag

SEQ ID NO: 683947 - RNA, 18 nt, Human
ugaagagcaggugggagc

SEQ ID NO: 683948 - RNA, 19 nt, Human
ugaagcagaucaagaaucu

SEQ ID NO: 683949 - RNA, 23 nt, Human
ugacggggaggaagaggguuggu

SEQ ID NO: 683950 - RNA, 23 nt, Human
ugacugaaaaacaaacagggcca

SEQ ID NO: 683951 - RNA, 23 nt, Human
ugagaccagucuggccaacaugg

SEQ ID NO: 683952 - RNA, 24 nt, Human
ugagaccagucuggccaacauggu

SEQ ID NO: 683953 - RNA, 22 nt, Human
ugagauauacauuuuucugaaa

SEQ ID NO: 683954 - RNA, 23 nt, Human
ugagccaaacuggaagaaaccag

SEQ ID NO: 683955 - RNA, 22 nt, Human
ugagccaagaucgugccaucgc

SEQ ID NO: 683956 - RNA, 19 nt, Human
ugaggcaggagaaucgcug

SEQ ID NO: 683957 - RNA, 24 nt, Human
ugaggcaggagaaucgcuggaacc

SEQ ID NO: 683958 - RNA, 25 nt, Human
ugaggcaggagaaucgcuggaaccc

SEQ ID NO: 683959 - RNA, 18 nt, Human
ugaggucaggaguuugag

SEQ ID NO: 683960 - RNA, 27 nt, Human
ugcagcagucuucuaagugacuggggu

SEQ ID NO: 683961 - RNA, 24 nt, Human
ugccaucgcacuccagucugggug

SEQ ID NO: 683962 - RNA, 22 nt, Human
ugcccgcuugucuugcugguuc

SEQ ID NO: 683963 - RNA, 22 nt, Human
ugccgacccgcgccgccgccgc

SEQ ID NO: 683964 - RNA, 24 nt, Human
ugcgccuguaaucccagcuacuug

SEQ ID NO: 683965 - RNA, 19 nt, Human
uggaaaggccuauuuuuac

SEQ ID NO: 683966 - RNA, 19 nt, Human
uggaagaaaccagccucau

SEQ ID NO: 683967 - RNA, 21 nt, Human
uggaaggauucacuuccuucu

SEQ ID NO: 683968 - RNA, 23 nt, Human
uggaaggcuuagacgggcggauc

SEQ ID NO: 683969 - RNA, 22 nt, Human
uggaccaacacugcagcaacac

SEQ ID NO: 683970 - RNA, 18 nt, Human
uggccaacauggugaaac

SEQ ID NO: 683971 - RNA, 21 nt, Human
uggccauggagcucauggggc

SEQ ID NO: 683972 - RNA, 21 nt, Human
uggcgugcgccuguaauccca

SEQ ID NO: 683973 - RNA, 22 nt, Human
uggcgugcgccuguaaucccag

SEQ ID NO: 683974 - RNA, 24 nt, Human
uggcgugcgccuguaaucccagcu

SEQ ID NO: 683975 - RNA, 19 nt, Human
ugggaggcugaggcaggag

SEQ ID NO: 683976 - RNA, 23 nt, Human
ugggaggcugaggcaggagaauc

SEQ ID NO: 683977 - RNA, 24 nt, Human
ugguggcgugcgccuguaauccca

SEQ ID NO: 683978 - RNA, 24 nt, Human
uggugguuccugccaguaauccca

SEQ ID NO: 683979 - RNA, 22 nt, Human
ugguuccugccaguaaucccag

SEQ ID NO: 683980 - RNA, 24 nt, Human
ugguuccugccaguaaucccagca

SEQ ID NO: 683981 - RNA, 19 nt, Human
ugguuggcugggccuggug

SEQ ID NO: 683982 - RNA, 20 nt, Human
uguaauuacacuggguuccc

SEQ ID NO: 683983 - RNA, 23 nt, Human
uguacagauguggccauggagcu

SEQ ID NO: 683984 - RNA, 23 nt, Human
ugucuuaacugggcuucccuggc

SEQ ID NO: 683985 - RNA, 20 nt, Human
uguggccaaugcccgcuugu

SEQ ID NO: 683986 - RNA, 21 nt, Human
uguggccaaugcccgcuuguc

SEQ ID NO: 683987 - RNA, 20 nt, Human
uguucucacugaaccucugg

SEQ ID NO: 683988 - RNA, 27 nt, Human
uuaaggaaaaaaaaaaaaaaaagcuug

SEQ ID NO: 683989 - RNA, 26 nt, Human
uuagacgggcggaucgccugagguca

SEQ ID NO: 683990 - RNA, 19 nt, Human
uuagcugggcaugguggcg

SEQ ID NO: 683991 - RNA, 22 nt, Human
uuagcugggcaugguggcgugc

SEQ ID NO: 683992 - RNA, 23 nt, Human
uuaguuuucuaggugcauaauuu

SEQ ID NO: 683993 - RNA, 21 nt, Human
uucacauauuaccagcaauua

SEQ ID NO: 683994 - RNA, 18 nt, Human
uuccaagcucacuggaag

SEQ ID NO: 683995 - RNA, 20 nt, Human
uucucggcgccgacuccgcc

SEQ ID NO: 683996 - RNA, 18 nt, Human
uugaagcuuuugugaaac

SEQ ID NO: 683997 - RNA, 24 nt, Human
uugaguuuacccugcccauguucu

SEQ ID NO: 683998 - RNA, 22 nt, Human
uugcagugagccaagaucgugc

SEQ ID NO: 683999 - RNA, 22 nt, Human
uugcucucucgagaccaguucc

SEQ ID NO: 684000 - RNA, 24 nt, Human
uugggaggcugaggcaggagaauc

SEQ ID NO: 684001 - RNA, 21 nt, Human
uuuuguguaaucauuaaccag

SEQ ID NO: 684002 - RNA, 24 nt, Human
uuuuuuuuuuuuuuuuuuaauuuu

SEQ ID NO: 684003 - RNA, 26 nt, Human
ucugaaaagagccuuugaguuuuaaa

SEQ ID NO: 684004 - RNA, 22 nt, Human
uugaguggcucugaaaagagcc

SEQ ID NO: 684005 - RNA, 23 nt, Human
aaaaaguaacaugaagugcaaac

SEQ ID NO: 684006 - RNA, 21 nt, Human
aggaugaguuggauuugggug

SEQ ID NO: 684007 - RNA, 22 nt, Human
caaaaaguaacaugaagugcaa

SEQ ID NO: 684008 - RNA, 20 nt, Human
caacucauuuauugaaaaca

SEQ ID NO: 684009 - RNA, 21 nt, Human
cagugugcagcaaaccaggau

SEQ ID NO: 684010 - RNA, 21 nt, Human
ccauggcaaguaaugaauucc

SEQ ID NO: 684011 - RNA, 18 nt, Human
ccccucgguaaccuucuu

SEQ ID NO: 684012 - RNA, 21 nt, Human
ccuuuaguuccuuccccucgg

SEQ ID NO: 684013 - RNA, 20 nt, Human
cuuuuuuuuucagacguccu

SEQ ID NO: 684014 - RNA, 23 nt, Human
gaaccagugugcagcaaaccagg

SEQ ID NO: 684015 - RNA, 20 nt, Human
gccaucuucucauucagacu

SEQ ID NO: 684016 - RNA, 21 nt, Human
guccugccaucuucucauuca

SEQ ID NO: 684017 - RNA, 18 nt, Human
uaacaugaagugcaaaca

SEQ ID NO: 684018 - RNA, 21 nt, Human
uaauaguuagaacacuguugc

SEQ ID NO: 684019 - RNA, 21 nt, Human
uacaacucauuuauugaaaac

SEQ ID NO: 684020 - RNA, 24 nt, Human
uauguuuauaaacucaaaaaguaa

SEQ ID NO: 684021 - RNA, 25 nt, Human
uauguuuauaaacucaaaaaguaac

SEQ ID NO: 684022 - RNA, 21 nt, Human
ugaauucccaguaacuagguc

SEQ ID NO: 684023 - RNA, 18 nt, Human
uuaugcauucauuucucc

SEQ ID NO: 684024 - RNA, 24 nt, Human
uucaggcagaugagacuuccuaag

SEQ ID NO: 684025 - RNA, 21 nt, Human
uucucauucagacuuuucuua

SEQ ID NO: 684026 - RNA, 26 nt, Human
uugaaugaaaugauuacaacucauuu

SEQ ID NO: 684027 - RNA, 20 nt, Human
aacaauaguggcaaaaccaa

SEQ ID NO: 684028 - RNA, 22 nt, Human
gcucugaaaagagccuuugggu

SEQ ID NO: 684029 - RNA, 21 nt, Human
ugaguggcucugaaaagagcc

SEQ ID NO: 684030 - RNA, 22 nt, Human
cuuuggggugugggccgagacu

SEQ ID NO: 684031 - RNA, 20 nt, Human
gaguggcucugaaaagagcc

SEQ ID NO: 684032 - RNA, 20 nt, Human
ugaaaagagccuuuggggug

SEQ ID NO: 684033 - RNA, 22 nt, Human
gcucugaaaagagccuuugggu

SEQ ID NO: 684034 - RNA, 20 nt, Human
ccuuuggguuuacuaaggca

SEQ ID NO: 684035 - RNA, 22 nt, Human
gcucugaaaagagccuuugggu

SEQ ID NO: 684036 - RNA, 18 nt, Human
uaaggcaguugcagggac

SEQ ID NO: 684037 - RNA, 21 nt, Human
ugaguggcucugaaaagagcc

SEQ ID NO: 684038 - RNA, 22 nt, Human
gcucugaaaagagccuuugggu

SEQ ID NO: 684039 - RNA, 24 nt, Human
aggagagugaaagagcacucaaau

SEQ ID NO: 684040 - RNA, 21 nt, Human
ugaguggcucugaaaagagcc

SEQ ID NO: 684041 - RNA, 21 nt, Human
aaaagcaaauccaaugacgca

SEQ ID NO: 684042 - RNA, 21 nt, Human
aaaagggugggauggaaaaau

SEQ ID NO: 684043 - RNA, 21 nt, Human
aaacaagaaaacagacgaacc

SEQ ID NO: 684044 - RNA, 23 nt, Human
aaacaagaaaacagacgaaccaa

SEQ ID NO: 684045 - RNA, 22 nt, Human
aaacagacccaaggagccacca

SEQ ID NO: 684046 - RNA, 22 nt, Human
aaacagacgaaccaauuucaga

SEQ ID NO: 684047 - RNA, 23 nt, Human
aaacagcugaaucacucaucaaa

SEQ ID NO: 684048 - RNA, 20 nt, Human
aacaagaaaacagacgaacc

SEQ ID NO: 684049 - RNA, 22 nt, Human
aacacggcccccucccagcugu

SEQ ID NO: 684050 - RNA, 20 nt, Human
aacagccuaauugagaaccg

SEQ ID NO: 684051 - RNA, 20 nt, Human
aagcaaauccaaugacgcac

SEQ ID NO: 684052 - RNA, 22 nt, Human
aagcagcacaaugaguaaagac

SEQ ID NO: 684053 - RNA, 19 nt, Human
aagcagccggcgacucgag

SEQ ID NO: 684054 - RNA, 27 nt, Human
aaugaaacagacccaaggagccaccag

SEQ ID NO: 684055 - RNA, 21 nt, Human
acagacccaaggagccaccag

SEQ ID NO: 684056 - RNA, 22 nt, Human
acagacccaaggagccaccagg

SEQ ID NO: 684057 - RNA, 19 nt, Human
accagggcgcguguggggc

SEQ ID NO: 684058 - RNA, 25 nt, Human
accccugccaucagcuccaaaagcc

SEQ ID NO: 684059 - RNA, 19 nt, Human
agaaaagcaaaugaggugg

SEQ ID NO: 684060 - RNA, 22 nt, Human
agaaaagcaaaugaggugguaa

SEQ ID NO: 684061 - RNA, 19 nt, Human
agaacggcugguauccaca

SEQ ID NO: 684062 - RNA, 22 nt, Human
agacacaguacaaacgcggcuu

SEQ ID NO: 684063 - RNA, 23 nt, Human
agcacccuucauccauccacgga

SEQ ID NO: 684064 - RNA, 20 nt, Human
agccuuuggagucaagcagc

SEQ ID NO: 684065 - RNA, 22 nt, Human
agccuuuggagucaagcagccg

SEQ ID NO: 684066 - RNA, 24 nt, Human
agccuuuggagucaagcagccgac

SEQ ID NO: 684067 - RNA, 21 nt, Human
aggucucugagaggugacuuu

SEQ ID NO: 684068 - RNA, 23 nt, Human
auaaacaagaaaacagacgaacc

SEQ ID NO: 684069 - RNA, 21 nt, Human
caaaagcccuuagccaaaaac

SEQ ID NO: 684070 - RNA, 22 nt, Human
caaaagcccuuagccaaaaaca

SEQ ID NO: 684071 - RNA, 20 nt, Human
caagaaaacagacgaaccaa

SEQ ID NO: 684072 - RNA, 21 nt, Human
cagaaagaguaaauauucugc

SEQ ID NO: 684073 - RNA, 23 nt, Human
cagaccauuaaaugcagaaauua

SEQ ID NO: 684074 - RNA, 18 nt, Human
cagccuaauugagaaccg

SEQ ID NO: 684075 - RNA, 21 nt, Human
cauacagagcugucacgcagu

SEQ ID NO: 684076 - RNA, 21 nt, Human
cauggccuccagaaaagcaaa

SEQ ID NO: 684077 - RNA, 27 nt, Human
ccaaaaacagcugaaucacucaucaaa

SEQ ID NO: 684078 - RNA, 24 nt, Human
ccacaaaauaaaacuaaaaugcaa

SEQ ID NO: 684079 - RNA, 20 nt, Human
ccagaaaagcaaaugaggug

SEQ ID NO: 684080 - RNA, 24 nt, Human
ccuauauugcauggccuccagaaa

SEQ ID NO: 684081 - RNA, 22 nt, Human
cgagcgagcgagcgccaggucc

SEQ ID NO: 684082 - RNA, 21 nt, Human
cggcagaacuggugaccggac

SEQ ID NO: 684083 - RNA, 20 nt, Human
cguaugccauuucccaugac

SEQ ID NO: 684084 - RNA, 21 nt, Human
cguguggggcgggaguggggg

SEQ ID NO: 684085 - RNA, 25 nt, Human
cuacguaugccauuucccaugaccu

SEQ ID NO: 684086 - RNA, 24 nt, Human
cuagagcucauuuggauucaucaa

SEQ ID NO: 684087 - RNA, 19 nt, Human
cucgcagugaccuggggcc

SEQ ID NO: 684088 - RNA, 18 nt, Human
gaaacugaaaucuacaaa

SEQ ID NO: 684089 - RNA, 21 nt, Human
gaaccaauuucagacagcugc

SEQ ID NO: 684090 - RNA, 22 nt, Human
gaagaugcacgggaaaaccaca

SEQ ID NO: 684091 - RNA, 18 nt, Human
gagaaggaaaaggcucuu

SEQ ID NO: 684092 - RNA, 23 nt, Human
gagaaggaaaaggcucuuuccag

SEQ ID NO: 684093 - RNA, 21 nt, Human
gcagcacaaugaguaaagaca

SEQ ID NO: 684094 - RNA, 20 nt, Human
gccuccagaaaagcaaauga

SEQ ID NO: 684095 - RNA, 24 nt, Human
ggaaaugaacagcacccuucaucc

SEQ ID NO: 684096 - RNA, 18 nt, Human
ggcgggagugggggcggg

SEQ ID NO: 684097 - RNA, 20 nt, Human
gggcgcguguggggcgggag

SEQ ID NO: 684098 - RNA, 19 nt, Human
ggggcgggagugggggcgg

SEQ ID NO: 684099 - RNA, 19 nt, Human
guaugccauuucccaugac

SEQ ID NO: 684100 - RNA, 21 nt, Human
gugaccggacacaaaagcugc

SEQ ID NO: 684101 - RNA, 21 nt, Human
guguggggcgggagugggggc

SEQ ID NO: 684102 - RNA, 22 nt, Human
uaaaagcuccucuccuuuaaga

SEQ ID NO: 684103 - RNA, 20 nt, Human
uaaaaugagacaggcaagua

SEQ ID NO: 684104 - RNA, 18 nt, Human
uaccauaaacaagaaaac

SEQ ID NO: 684105 - RNA, 21 nt, Human
uagauucaaaagcaaauccaa

SEQ ID NO: 684106 - RNA, 25 nt, Human
uagauucaaaagcaaauccaaugac

SEQ ID NO: 684107 - RNA, 28 nt, Human
uauacacauuugaaaacacacauguagu

SEQ ID NO: 684108 - RNA, 24 nt, Human
uauucugcaccuccacaaaauaaa

SEQ ID NO: 684109 - RNA, 24 nt, Human
ucacugugccuucacauacaucua

SEQ ID NO: 684110 - RNA, 19 nt, Human
uccucggcagaaucaaggg

SEQ ID NO: 684111 - RNA, 26 nt, Human
ucuagauucaaaagcaaauccaauga

SEQ ID NO: 684112 - RNA, 21 nt, Human
ugaaaacacacauguaggaga

SEQ ID NO: 684113 - RNA, 22 nt, Human
ugaaaacacacauguaggagac

SEQ ID NO: 684114 - RNA, 21 nt, Human
ugaaaagaaacuaagggaaua

SEQ ID NO: 684115 - RNA, 22 nt, Human
ugaaaucuacaaauuagaaaaa

SEQ ID NO: 684116 - RNA, 19 nt, Human
ugaauauucuugucgccca

SEQ ID NO: 684117 - RNA, 26 nt, Human
ugaccggacacaaaagcugcugccaa

SEQ ID NO: 684118 - RNA, 23 nt, Human
ugagaaccgacuccugggaaggc

SEQ ID NO: 684119 - RNA, 19 nt, Human
ugagaagcauaagggugga

SEQ ID NO: 684120 - RNA, 21 nt, Human
ugaggggagaguaagaaaagg

SEQ ID NO: 684121 - RNA, 20 nt, Human
ugaggugacuaaggauacau

SEQ ID NO: 684122 - RNA, 19 nt, Human
ugccaucagcuccaaaagc

SEQ ID NO: 684123 - RNA, 20 nt, Human
ugggggcggguaaagaggcg

SEQ ID NO: 684124 - RNA, 21 nt, Human
uggguggcucugaaaagagcc

SEQ ID NO: 684125 - RNA, 20 nt, Human
uguccuggaguucucuuaaa

SEQ ID NO: 684126 - RNA, 22 nt, Human
uguccuggaguucucuuaaaug

SEQ ID NO: 684127 - RNA, 24 nt, Human
uuaaaugacagccgaacucagcca

SEQ ID NO: 684128 - RNA, 26 nt, Human
uuagccaaaaacagcugaaucacuca

SEQ ID NO: 684129 - RNA, 23 nt, Human
uucaaagucucaaagugaacgac

SEQ ID NO: 684130 - RNA, 26 nt, Human
uuguagcaaaaaaaaucuuaacacgg

SEQ ID NO: 684131 - RNA, 22 nt, Human
uuuaugaaaagaaacuaaggga

SEQ ID NO: 684132 - RNA, 19 nt, Human
uuucacugugccuucacau

SEQ ID NO: 684133 - RNA, 19 nt, Human
aaagcgccaacgaaaagga

SEQ ID NO: 684134 - RNA, 21 nt, Human
auaaagcgccaacgaaaagga

SEQ ID NO: 684135 - RNA, 26 nt, Human
auaaagcgccaacgaaaaggaaaaac

SEQ ID NO: 684136 - RNA, 20 nt, Human
caacgaaaaggaaaaacagc

SEQ ID NO: 684137 - RNA, 19 nt, Human
acugaaguaaggaccaggc

SEQ ID NO: 684138 - RNA, 19 nt, Human
cccagcgaugacuucgggu

SEQ ID NO: 684139 - RNA, 21 nt, Human
cggaaggaaaagaccugagcg

SEQ ID NO: 684140 - RNA, 21 nt, Human
cucuguagauucacugaagga

SEQ ID NO: 684141 - RNA, 20 nt, Human
uagccagccuuuccuccuuu

SEQ ID NO: 684142 - RNA, 27 nt, Human
ucacugaaggacugaggaaagggcaac

SEQ ID NO: 684143 - RNA, 21 nt, Human
ugaaguaaggaccaggcugag

SEQ ID NO: 684144 - RNA, 20 nt, Human
ugaggaaagggcaaccagua

SEQ ID NO: 684145 - RNA, 20 nt, Human
ugaggaaauaggcucuguag

SEQ ID NO: 684146 - RNA, 23 nt, Human
aaaaaauccaaaugcuggcauug

SEQ ID NO: 684147 - RNA, 21 nt, Human
aaaaauaucuaacguucagaa

SEQ ID NO: 684148 - RNA, 24 nt, Human
aagacagacaacauuaaaaacaug

SEQ ID NO: 684149 - RNA, 20 nt, Human
aaguauagugaauggaugga

SEQ ID NO: 684150 - RNA, 20 nt, Human
aaugaaaauggaaaaacugc

SEQ ID NO: 684151 - RNA, 18 nt, Human
agaagacagacaacauua

SEQ ID NO: 684152 - RNA, 24 nt, Human
agaagacagacaacauuaaaaaca

SEQ ID NO: 684153 - RNA, 25 nt, Human
aggaacagcacagaagacagacaac

SEQ ID NO: 684154 - RNA, 22 nt, Human
auggaaaaaaaauaucuaacgu

SEQ ID NO: 684155 - RNA, 20 nt, Human
auguaggacaacucaguuag

SEQ ID NO: 684156 - RNA, 24 nt, Human
cacacacaaaugaaaauggaaaaa

SEQ ID NO: 684157 - RNA, 20 nt, Human
cagcacagaagacagacaac

SEQ ID NO: 684158 - RNA, 21 nt, Human
ccuuacuuaccccccuucucc

SEQ ID NO: 684159 - RNA, 23 nt, Human
ccuucggcuggagcucggcgagc

SEQ ID NO: 684160 - RNA, 20 nt, Human
cguucagaacuaccaauaac

SEQ ID NO: 684161 - RNA, 19 nt, Human
cugaaacauuuuaacuugc

SEQ ID NO: 684162 - RNA, 18 nt, Human
gagaccuccuuacuuacc

SEQ ID NO: 684163 - RNA, 20 nt, Human
gcggcggcggcugcgaacac

SEQ ID NO: 684164 - RNA, 22 nt, Human
uaaaaaaauccaaaugcuggca

SEQ ID NO: 684165 - RNA, 18 nt, Human
uaaaaaugcuacaaacac

SEQ ID NO: 684166 - RNA, 21 nt, Human
uaaaaaugcuacaaacaccau

SEQ ID NO: 684167 - RNA, 21 nt, Human
uaauagcaaacuuacaggaac

SEQ ID NO: 684168 - RNA, 26 nt, Human
uagcaaacuuacaggaacagcacaga

SEQ ID NO: 684169 - RNA, 22 nt, Human
uaugauaaaaaugcuacaaaca

SEQ ID NO: 684170 - RNA, 23 nt, Human
uccgcauuuauauuaaaaauuca

SEQ ID NO: 684171 - RNA, 22 nt, Human
ucggcgagcgagaggcggcgcu

SEQ ID NO: 684172 - RNA, 26 nt, Human
ugaaaauggaaaaacugccaauaccu

SEQ ID NO: 684173 - RNA, 26 nt, Human
uucacacacaaaugaaaauggaaaaa

SEQ ID NO: 684174 - RNA, 22 nt, Human
uuuacuuguuuuaaaaaaaucc

SEQ ID NO: 684175 - RNA, 27 nt, Human
aaaagagccuuuggguuuugguuaauu

SEQ ID NO: 684176 - RNA, 22 nt, Human
gcucugaaaagagccuuugggu

SEQ ID NO: 684177 - RNA, 20 nt, Human
uggguuuugguuagcacaca

SEQ ID NO: 684178 - RNA, 18 nt, Human
aaguuggcgcacacccuc

SEQ ID NO: 684179 - RNA, 21 nt, Human
uuuaaguuggcgcacacccuc

SEQ ID NO: 684180 - RNA, 18 nt, Human
aaacccaagauagagcag

SEQ ID NO: 684181 - RNA, 22 nt, Human
aaacccaagauagagcagggga

SEQ ID NO: 684182 - RNA, 25 nt, Human
agccuuuggaagcuuggaagcaauu

SEQ ID NO: 684183 - RNA, 24 nt, Human
gaaaagagccuuuggaagcuugga

SEQ ID NO: 684184 - RNA, 23 nt, Human
gcaauuaagaaacccaagauaga

SEQ ID NO: 684185 - RNA, 19 nt, Human
uuggaagcuuggaagcaau

SEQ ID NO: 684186 - RNA, 18 nt, Human
acugugggauagaagguu

SEQ ID NO: 684187 - RNA, 19 nt, Human
agaagggagggaagacacg

SEQ ID NO: 684188 - RNA, 21 nt, Human
agagccagggcacgcugggca

SEQ ID NO: 684189 - RNA, 22 nt, Human
aggagcgaagcgggcaaggggc

SEQ ID NO: 684190 - RNA, 18 nt, Human
agggagggaagacacggg

SEQ ID NO: 684191 - RNA, 19 nt, Human
agggcacgcugggcaggug

SEQ ID NO: 684192 - RNA, 25 nt, Human
caaggccagcccggccgccaccccu

SEQ ID NO: 684193 - RNA, 21 nt, Human
cacagagcugccggucaaagg

SEQ ID NO: 684194 - RNA, 21 nt, Human
caccuccucuuccgcagggcc

SEQ ID NO: 684195 - RNA, 18 nt, Human
cacgcggccacgcgccgc

SEQ ID NO: 684196 - RNA, 23 nt, Human
cacgcugggcagguggcggggcc

SEQ ID NO: 684197 - RNA, 18 nt, Human
cagggcacgcugggcagg

SEQ ID NO: 684198 - RNA, 20 nt, Human
ccacccgccccaggccucag

SEQ ID NO: 684199 - RNA, 20 nt, Human
ccagcccggccgccacccgc

SEQ ID NO: 684200 - RNA, 19 nt, Human
cccugggccgcaccuccuc

SEQ ID NO: 684201 - RNA, 18 nt, Human
ccgagaagggagggaaga

SEQ ID NO: 684202 - RNA, 20 nt, Human
ccgagaagggagggaagaca

SEQ ID NO: 684203 - RNA, 21 nt, Human
ccgcaccuccucuuccgcagg

SEQ ID NO: 684204 - RNA, 19 nt, Human
ccgccacccgccccaggcc

SEQ ID NO: 684205 - RNA, 20 nt, Human
ccggccgccacccgccccag

SEQ ID NO: 684206 - RNA, 18 nt, Human
cgagggcuccccugcgcc

SEQ ID NO: 684207 - RNA, 25 nt, Human
cgcaccuccucuuccgcagggcccg

SEQ ID NO: 684208 - RNA, 19 nt, Human
cgcaggccgcuccuccggg

SEQ ID NO: 684209 - RNA, 20 nt, Human
cggccgccacccgccccagg

SEQ ID NO: 684210 - RNA, 24 nt, Human
cggccggggcggcgcugagggccg

SEQ ID NO: 684211 - RNA, 25 nt, Human
cggccggggcggcgcugagggccgg

SEQ ID NO: 684212 - RNA, 18 nt, Human
cgggacacggccggggcg

SEQ ID NO: 684213 - RNA, 18 nt, Human
cgggcaaggggcacaggc

SEQ ID NO: 684214 - RNA, 18 nt, Human
cugcgcccugggccgcac

SEQ ID NO: 684215 - RNA, 21 nt, Human
gagaagggagggaagacacgg

SEQ ID NO: 684216 - RNA, 21 nt, Human
gcaucuauccaccaauacaca

SEQ ID NO: 684217 - RNA, 23 nt, Human
gccggggcggcgcugagggccgg

SEQ ID NO: 684218 - RNA, 22 nt, Human
ggagagccagggcacgcugggc

SEQ ID NO: 684219 - RNA, 22 nt, Human
ggccggggcggcgcugagggcc

SEQ ID NO: 684220 - RNA, 19 nt, Human
gguggcggggccgagaagg

SEQ ID NO: 684221 - RNA, 20 nt, Human
uacacagagcugccggucaa

SEQ ID NO: 684222 - RNA, 27 nt, Human
ucuggggccugacugugggauagaagg

SEQ ID NO: 684223 - RNA, 22 nt, Human
ucuuccgcagggcccgucacuc

SEQ ID NO: 684224 - RNA, 22 nt, Human
uggagagccagggcacgcuggg

SEQ ID NO: 684225 - RNA, 18 nt, Human
ugggcagguggcggggcc

SEQ ID NO: 684226 - RNA, 22 nt, Human
acuuuaugguccaguaaggcca

SEQ ID NO: 684227 - RNA, 25 nt, Human
caaaacacuggggcuaucuucugug

SEQ ID NO: 684228 - RNA, 25 nt, Human
caaaacacuggggcuaucuucugug

SEQ ID NO: 684229 - RNA, 22 nt, Human
cagcaagccuugcugcaagucu

SEQ ID NO: 684230 - RNA, 22 nt, Human
cagcaagccuugcugcaagucu

SEQ ID NO: 684231 - RNA, 18 nt, Human
cagucugaucucagaauc

SEQ ID NO: 684232 - RNA, 18 nt, Human
cagucugaucucagaauc

SEQ ID NO: 684233 - RNA, 23 nt, Human
cauaggccucuuuggccgaauuc

SEQ ID NO: 684234 - RNA, 21 nt, Human
cucagaaucacauucaaaacc

SEQ ID NO: 684235 - RNA, 21 nt, Human
cucagaaucacauucaaaacc

SEQ ID NO: 684236 - RNA, 18 nt, Human
cuccaagguuguguagcu

SEQ ID NO: 684237 - RNA, 18 nt, Human
cugcaagucuucagagaa

SEQ ID NO: 684238 - RNA, 22 nt, Human
gccaggauuccagcucagucag

SEQ ID NO: 684239 - RNA, 22 nt, Human
gccaggauuccagcucagucag

SEQ ID NO: 684240 - RNA, 21 nt, Human
ggccgcuuuuuuuuuuuuuuu

SEQ ID NO: 684241 - RNA, 18 nt, Human
gggaaaguaaggaugacc

SEQ ID NO: 684242 - RNA, 23 nt, Human
uaugguccaguaaggccagaauu

SEQ ID NO: 684243 - RNA, 24 nt, Human
ucagaaucacauucaaaaccacuc

SEQ ID NO: 684244 - RNA, 24 nt, Human
ucagaaucacauucaaaaccacuc

SEQ ID NO: 684245 - RNA, 24 nt, Human
ugagggaaaguaaggaugacugcu

SEQ ID NO: 684246 - RNA, 24 nt, Human
ugagggaaaguaaggaugacugcu

SEQ ID NO: 684247 - RNA, 19 nt, Human
ugguaagauauaaagccag

SEQ ID NO: 684248 - RNA, 19 nt, Human
ugguaagauauaaagccag

SEQ ID NO: 684249 - RNA, 21 nt, Human
ugguaagauauaaagccagga

SEQ ID NO: 684250 - RNA, 21 nt, Human
ugguaagauauaaagccagga

SEQ ID NO: 684251 - RNA, 22 nt, Human
uugguagcacaaaaaauccugu

SEQ ID NO: 684252 - RNA, 21 nt, Human
uuuuuuuuuuuuuuuaucuuu

SEQ ID NO: 684253 - RNA, 19 nt, Human
aaaccccagcuccgccccc

SEQ ID NO: 684254 - RNA, 21 nt, Human
aaccacacgguggcuuccgag

SEQ ID NO: 684255 - RNA, 24 nt, Human
aaccccagcuccgcccccauccac

SEQ ID NO: 684256 - RNA, 30 nt, Human
aacugcaccaaaccccagcuccgcccccaa

SEQ ID NO: 684257 - RNA, 21 nt, Human
aagccaccuguggucccagcc

SEQ ID NO: 684258 - RNA, 25 nt, Human
acacgguggcuuccgagagacccca

SEQ ID NO: 684259 - RNA, 21 nt, Human
accaaaccccagcuccgcccc

SEQ ID NO: 684260 - RNA, 22 nt, Human
accaacaaggccacugugacuu

SEQ ID NO: 684261 - RNA, 18 nt, Human
agagagaagccaccugug

SEQ ID NO: 684262 - RNA, 22 nt, Human
agccaccuguggucccagcccc

SEQ ID NO: 684263 - RNA, 18 nt, Human
aggagagggcagggcagg

SEQ ID NO: 684264 - RNA, 24 nt, Human
agggacaggagcaggcaagagaga

SEQ ID NO: 684265 - RNA, 27 nt, Human
caaaauaaacgugccugugaaagaacc

SEQ ID NO: 684266 - RNA, 18 nt, Human
caaaccccagcuccgccc

SEQ ID NO: 684267 - RNA, 24 nt, Human
cacagcccugugggcaccaacaag

SEQ ID NO: 684268 - RNA, 23 nt, Human
caccaaaccccagcuccgccccc

SEQ ID NO: 684269 - RNA, 21 nt, Human
cagaaugguuucuggaguccc

SEQ ID NO: 684270 - RNA, 19 nt, Human
cagcgaccccaggacggcg

SEQ ID NO: 684271 - RNA, 18 nt, Human
cagguggccacaccuggu

SEQ ID NO: 684272 - RNA, 22 nt, Human
ccacgugacaggcccggccguc

SEQ ID NO: 684273 - RNA, 20 nt, Human
cccauccacggcucccagaa

SEQ ID NO: 684274 - RNA, 21 nt, Human
cccauccacggcucccagaau

SEQ ID NO: 684275 - RNA, 23 nt, Human
ccccagguggccacaccuggugu

SEQ ID NO: 684276 - RNA, 18 nt, Human
cccccaacaggaaaaggc

SEQ ID NO: 684277 - RNA, 21 nt, Human
cccccuccccagcugucaggc

SEQ ID NO: 684278 - RNA, 21 nt, Human
cccugugggcaccaacaaggc

SEQ ID NO: 684279 - RNA, 19 nt, Human
ccuccauccacacagcccu

SEQ ID NO: 684280 - RNA, 21 nt, Human
cggcagcgaccccaggacggc

SEQ ID NO: 684281 - RNA, 18 nt, Human
cgucgaaguccaggcgcu

SEQ ID NO: 684282 - RNA, 24 nt, Human
cguggugcaggggacgugcuggag

SEQ ID NO: 684283 - RNA, 19 nt, Human
cuccugcguccccgugaug

SEQ ID NO: 684284 - RNA, 22 nt, Human
cugcguccccgugaugaccugg

SEQ ID NO: 684285 - RNA, 23 nt, Human
cugcguccccgugaugaccuggg

SEQ ID NO: 684286 - RNA, 18 nt, Human
cugcuguacugcacccug

SEQ ID NO: 684287 - RNA, 23 nt, Human
cugcuguacugcacccuggaaac

SEQ ID NO: 684288 - RNA, 21 nt, Human
cuguacugcacccuggaaacu

SEQ ID NO: 684289 - RNA, 25 nt, Human
gacagcacagggcacaguccugugc

SEQ ID NO: 684290 - RNA, 19 nt, Human
gagggcagggcagggccug

SEQ ID NO: 684291 - RNA, 24 nt, Human
gcacccuggaaacugcaccaaacc

SEQ ID NO: 684292 - RNA, 25 nt, Human
gcagggacagcuuccuccauccaca

SEQ ID NO: 684293 - RNA, 26 nt, Human
gcccacgugacaggcccggccgucac

SEQ ID NO: 684294 - RNA, 20 nt, Human
gcucucggcagcgaccccag

SEQ ID NO: 684295 - RNA, 22 nt, Human
ggcagggcagggccugccuccu

SEQ ID NO: 684296 - RNA, 22 nt, Human
ggccacccccuccccagcuguc

SEQ ID NO: 684297 - RNA, 19 nt, Human
ggccgggagcccgaggggg

SEQ ID NO: 684298 - RNA, 22 nt, Human
ggcugggggucucagcgcugca

SEQ ID NO: 684299 - RNA, 21 nt, Human
gggacaggagcaggcaagaga

SEQ ID NO: 684300 - RNA, 21 nt, Human
gggcagggccugccuccugcg

SEQ ID NO: 684301 - RNA, 21 nt, Human
gggcgggcugggggucucagc

SEQ ID NO: 684302 - RNA, 19 nt, Human
ggggaugcacugggcaggg

SEQ ID NO: 684303 - RNA, 18 nt, Human
ggggccccggccgggagc

SEQ ID NO: 684304 - RNA, 23 nt, Human
gucacuggcgggcccucccccca

SEQ ID NO: 684305 - RNA, 19 nt, Human
guggugcaggggacgugcu

SEQ ID NO: 684306 - RNA, 26 nt, Human
uaaaaacuuuuuauuucagcaaaaua

SEQ ID NO: 684307 - RNA, 20 nt, Human
uaccugagccccagguggcc

SEQ ID NO: 684308 - RNA, 22 nt, Human
ucacacgacagcaguguucccc

SEQ ID NO: 684309 - RNA, 21 nt, Human
ucacuggcgggcccucccccc

SEQ ID NO: 684310 - RNA, 18 nt, Human
uccccagcugucaggccc

SEQ ID NO: 684311 - RNA, 18 nt, Human
ucccugcaacagaccugu

SEQ ID NO: 684312 - RNA, 22 nt, Human
ucugggaggaggcgcccgcugg

SEQ ID NO: 684313 - RNA, 23 nt, Human
ugccguggugcaggggacgugcu

SEQ ID NO: 684314 - RNA, 19 nt, Human
uggaaacugcaccaaaccc

SEQ ID NO: 684315 - RNA, 19 nt, Human
uggccacaccugguguucu

SEQ ID NO: 684316 - RNA, 18 nt, Human
uggcuuccgagagacccc

SEQ ID NO: 684317 - RNA, 19 nt, Human
ugggaggaggcgcccgcug

SEQ ID NO: 684318 - RNA, 22 nt, Human
ugggaggaggcgcccgcuggug

SEQ ID NO: 684319 - RNA, 22 nt, Human
ugggggucucagcgcugcagcu

SEQ ID NO: 684320 - RNA, 23 nt, Human
ugucgccggccacccccucccca

SEQ ID NO: 684321 - RNA, 20 nt, Human
ugugaaagaaccacacggug

SEQ ID NO: 684322 - RNA, 21 nt, Human
ugugaaagaaccacacggugg

SEQ ID NO: 684323 - RNA, 25 nt, Human
ugugggcaccaacaaggcuggagac

SEQ ID NO: 684324 - RNA, 19 nt, Human
agaagggcaggaggguggg

SEQ ID NO: 684325 - RNA, 19 nt, Human
agagaagauggggagcugc

SEQ ID NO: 684326 - RNA, 18 nt, Human
agaguuguuuggcaggga

SEQ ID NO: 684327 - RNA, 21 nt, Human
agaguuguuuggcagggaugg

SEQ ID NO: 684328 - RNA, 22 nt, Human
agaguuguuuggcagggauggc

SEQ ID NO: 684329 - RNA, 19 nt, Human
aggcagugggcugagucug

SEQ ID NO: 684330 - RNA, 24 nt, Human
aggcagugggcugagucugccaga

SEQ ID NO: 684331 - RNA, 19 nt, Human
cacucgagggugcuuggca

SEQ ID NO: 684332 - RNA, 24 nt, Human
cacucgagggugcuuggcacaccu

SEQ ID NO: 684333 - RNA, 20 nt, Human
ccgcccaggggcauggcauc

SEQ ID NO: 684334 - RNA, 24 nt, Human
cuugguguggaagugcugcacuga

SEQ ID NO: 684335 - RNA, 20 nt, Human
gagaagauggggagcugcug

SEQ ID NO: 684336 - RNA, 20 nt, Human
ggcaggagcggggccggggg

SEQ ID NO: 684337 - RNA, 20 nt, Human
ggccuucuugguguggaagu

SEQ ID NO: 684338 - RNA, 22 nt, Human
gggacagaggaaugggcaggag

SEQ ID NO: 684339 - RNA, 18 nt, Human
gggagcugcugcccgccc

SEQ ID NO: 684340 - RNA, 20 nt, Human
gggagcugcugcccgcccag

SEQ ID NO: 684341 - RNA, 27 nt, Human
gggcaggagggugggugacaacaaugu

SEQ ID NO: 684342 - RNA, 19 nt, Human
ugagaagggcaggagggug

SEQ ID NO: 684343 - RNA, 19 nt, Human
uggcaaggcagugggcuga

SEQ ID NO: 684344 - RNA, 20 nt, Human
aaaauaauaacucugaaagc

SEQ ID NO: 684345 - RNA, 19 nt, Human
aaagaagaaggcccugcug

SEQ ID NO: 684346 - RNA, 18 nt, Human
aagaagccaggucuaaau

SEQ ID NO: 684347 - RNA, 20 nt, Human
aaggcccuuuuucuugggga

SEQ ID NO: 684348 - RNA, 22 nt, Human
acucugaaagcagauggagaau

SEQ ID NO: 684349 - RNA, 18 nt, Human
acuuuguucagaagaaag

SEQ ID NO: 684350 - RNA, 23 nt, Human
agaaagaagccaggucuaaauga

SEQ ID NO: 684351 - RNA, 19 nt, Human
agacaggcuucagauggcu

SEQ ID NO: 684352 - RNA, 18 nt, Human
agaggggaaaaggaaagg

SEQ ID NO: 684353 - RNA, 19 nt, Human
cagaagaagccuggugaua

SEQ ID NO: 684354 - RNA, 21 nt, Human
caucagaguggggaggugaac

SEQ ID NO: 684355 - RNA, 19 nt, Human
ccaccagcccaucccagau

SEQ ID NO: 684356 - RNA, 18 nt, Human
cccaucccagaucuuccu

SEQ ID NO: 684357 - RNA, 25 nt, Human
cccgggccagggcagcccaggcugu

SEQ ID NO: 684358 - RNA, 21 nt, Human
cccugcuguugugagccaugc

SEQ ID NO: 684359 - RNA, 21 nt, Human
cccuggaggcucuggaggugu

SEQ ID NO: 684360 - RNA, 20 nt, Human
ccuuuaggggggaaaaaugu

SEQ ID NO: 684361 - RNA, 23 nt, Human
ccuuuaggggggaaaaaugucag

SEQ ID NO: 684362 - RNA, 19 nt, Human
cucccggugucagggugcc

SEQ ID NO: 684363 - RNA, 21 nt, Human
cugcagaggcaaaccuaccgg

SEQ ID NO: 684364 - RNA, 22 nt, Human
cuuugauuucggcaagcuggaa

SEQ ID NO: 684365 - RNA, 25 nt, Human
cuuugauuucggcaagcuggaaugg

SEQ ID NO: 684366 - RNA, 21 nt, Human
cuuugcaguuuaaggacuugu

SEQ ID NO: 684367 - RNA, 22 nt, Human
cuuuucaaaguuuauuuuuggc

SEQ ID NO: 684368 - RNA, 20 nt, Human
gaggcucuggagguguccau

SEQ ID NO: 684369 - RNA, 26 nt, Human
gaggggaaaaggaaagggagggugag

SEQ ID NO: 684370 - RNA, 27 nt, Human
gagugggcucugagguccagaagacca

SEQ ID NO: 684371 - RNA, 24 nt, Human
gagugggggugggggagcuucauu

SEQ ID NO: 684372 - RNA, 22 nt, Human
gcagaagcaguggaggcuggaa

SEQ ID NO: 684373 - RNA, 18 nt, Human
gcaguuuaaggacuugug

SEQ ID NO: 684374 - RNA, 24 nt, Human
gccacccugauuccugagaggcca

SEQ ID NO: 684375 - RNA, 20 nt, Human
gccagggcagcccaggcugu

SEQ ID NO: 684376 - RNA, 18 nt, Human
gcccaggcuggguggcag

SEQ ID NO: 684377 - RNA, 20 nt, Human
gcggggggcagaagcagugg

SEQ ID NO: 684378 - RNA, 18 nt, Human
ggccgggagugggggugg

SEQ ID NO: 684379 - RNA, 20 nt, Human
gggagugggggugggggagc

SEQ ID NO: 684380 - RNA, 18 nt, Human
gggcagaagcaguggagg

SEQ ID NO: 684381 - RNA, 23 nt, Human
gggcugaggaauaaagaugugau

SEQ ID NO: 684382 - RNA, 23 nt, Human
gggcuuucucugaagucacagcc

SEQ ID NO: 684383 - RNA, 21 nt, Human
ggggaaaaggaaagggagggu

SEQ ID NO: 684384 - RNA, 19 nt, Human
gucuacugugugguccccu

SEQ ID NO: 684385 - RNA, 20 nt, Human
gugaacccagaugccacuga

SEQ ID NO: 684386 - RNA, 23 nt, Human
uaccuagacguggauggcugauu

SEQ ID NO: 684387 - RNA, 23 nt, Human
uagaagguacaauuggguaagga

SEQ ID NO: 684388 - RNA, 20 nt, Human
uaugccuuuaggggggaaaa

SEQ ID NO: 684389 - RNA, 19 nt, Human
ucagggugccaaggagagu

SEQ ID NO: 684390 - RNA, 23 nt, Human
ucgcuggauaugacagucugcau

SEQ ID NO: 684391 - RNA, 21 nt, Human
ucuaaaugagagauuggcuuu

SEQ ID NO: 684392 - RNA, 19 nt, Human
ucucugcuuagaguaggga

SEQ ID NO: 684393 - RNA, 19 nt, Human
ucugcacgucaaaaagaag

SEQ ID NO: 684394 - RNA, 19 nt, Human
ucugggaaggcccaggcug

SEQ ID NO: 684395 - RNA, 23 nt, Human
ucugugaacacugauuuucuaga

SEQ ID NO: 684396 - RNA, 23 nt, Human
ucuuggggaggguagaagagggg

SEQ ID NO: 684397 - RNA, 22 nt, Human
ugagagauuggcuuugcuuucu

SEQ ID NO: 684398 - RNA, 19 nt, Human
ugagaggccagagaggaag

SEQ ID NO: 684399 - RNA, 18 nt, Human
ugaggaauaaagauguga

SEQ ID NO: 684400 - RNA, 20 nt, Human
ugaggaauaaagaugugaug

SEQ ID NO: 684401 - RNA, 25 nt, Human
ugccaaggagagugggcucugaggu

SEQ ID NO: 684402 - RNA, 20 nt, Human
ugggaaggcccaggcugggu

SEQ ID NO: 684403 - RNA, 22 nt, Human
ugggaaggcccaggcugggugg

SEQ ID NO: 684404 - RNA, 23 nt, Human
ugggaaggcccaggcuggguggc

SEQ ID NO: 684405 - RNA, 18 nt, Human
uggggaggguagaagagg

SEQ ID NO: 684406 - RNA, 19 nt, Human
uggggaggguagaagaggg

SEQ ID NO: 684407 - RNA, 20 nt, Human
ugggggugggggagcuucau

SEQ ID NO: 684408 - RNA, 19 nt, Human
ugugaaacgcagcucaaac

SEQ ID NO: 684409 - RNA, 22 nt, Human
ugugauggugguucccgcugau

SEQ ID NO: 684410 - RNA, 22 nt, Human
uuccuuggguuaccaagggagg

SEQ ID NO: 684411 - RNA, 18 nt, Human
uugcaggaugccuguggu

SEQ ID NO: 684412 - RNA, 19 nt, Human
aaaacucagcugugacugc

SEQ ID NO: 684413 - RNA, 28 nt, Human
aaaccagaacucaaaauauuccaggaga

SEQ ID NO: 684414 - RNA, 18 nt, Human
aacagcucagcccaaaaa

SEQ ID NO: 684415 - RNA, 21 nt, Human
aagccaccuuagacagugugg

SEQ ID NO: 684416 - RNA, 21 nt, Human
acacacagaaaccacgaggua

SEQ ID NO: 684417 - RNA, 24 nt, Human
acaccccagcuucuagcagcucua

SEQ ID NO: 684418 - RNA, 21 nt, Human
acagcucagcccaaaaaagug

SEQ ID NO: 684419 - RNA, 18 nt, Human
acucaaaauauuccagga

SEQ ID NO: 684420 - RNA, 20 nt, Human
agaacuggagccaggacuaa

SEQ ID NO: 684421 - RNA, 21 nt, Human
agcuggaaaagucuccccaca

SEQ ID NO: 684422 - RNA, 18 nt, Human
agugcagcuccgcggugc

SEQ ID NO: 684423 - RNA, 24 nt, Human
caaagugggaaaaagcacagaucc

SEQ ID NO: 684424 - RNA, 24 nt, Human
caaccuccuuucccuccaugcuuc

SEQ ID NO: 684425 - RNA, 20 nt, Human
caauaaaaacacagucacca

SEQ ID NO: 684426 - RNA, 23 nt, Human
cacacacacagaaaccacgaggu

SEQ ID NO: 684427 - RNA, 18 nt, Human
cacagcccccgggaaucu

SEQ ID NO: 684428 - RNA, 21 nt, Human
caccccagcuucuagcagcuc

SEQ ID NO: 684429 - RNA, 20 nt, Human
cacgggaaaagcaacaucua

SEQ ID NO: 684430 - RNA, 20 nt, Human
cacugcgggcccgggagggc

SEQ ID NO: 684431 - RNA, 22 nt, Human
cacuuggguuccaguucaaagc

SEQ ID NO: 684432 - RNA, 22 nt, Human
cauaugaacugugugacaacag

SEQ ID NO: 684433 - RNA, 21 nt, Human
caucuucuugggaaauggccu

SEQ ID NO: 684434 - RNA, 21 nt, Human
ccagcacaguguguguucccg

SEQ ID NO: 684435 - RNA, 21 nt, Human
ccagcuggaaaagucucccca

SEQ ID NO: 684436 - RNA, 24 nt, Human
cccaaccccaaacuuucaccaaaa

SEQ ID NO: 684437 - RNA, 23 nt, Human
ccccacaggugugcagugcagcu

SEQ ID NO: 684438 - RNA, 19 nt, Human
cccccgggaaucuacugcu

SEQ ID NO: 684439 - RNA, 20 nt, Human
ccuaaaaaccacccaaacac

SEQ ID NO: 684440 - RNA, 23 nt, Human
ccuaaaaaccacccaaacacuag

SEQ ID NO: 684441 - RNA, 18 nt, Human
ccucuaacagcucagccc

SEQ ID NO: 684442 - RNA, 24 nt, Human
ccucugagguguacccccaacccu

SEQ ID NO: 684443 - RNA, 19 nt, Human
cgcuaaaggcacagccccc

SEQ ID NO: 684444 - RNA, 21 nt, Human
cugagguguacccccaacccc

SEQ ID NO: 684445 - RNA, 21 nt, Human
gaaccucugagguguaccccc

SEQ ID NO: 684446 - RNA, 21 nt, Human
gagccaggacuaagugagaaa

SEQ ID NO: 684447 - RNA, 20 nt, Human
gagccucuggagaagccccu

SEQ ID NO: 684448 - RNA, 21 nt, Human
gagucuauuuuacaaccuccu

SEQ ID NO: 684449 - RNA, 18 nt, Human
gauccugggaccaagguu

SEQ ID NO: 684450 - RNA, 21 nt, Human
gcaauaaagaggaacucuaga

SEQ ID NO: 684451 - RNA, 21 nt, Human
gcggaagaaaaggaugcggua

SEQ ID NO: 684452 - RNA, 22 nt, Human
gcucuauguguuuccucuaacg

SEQ ID NO: 684453 - RNA, 21 nt, Human
gggaaaagcaacaucuauugu

SEQ ID NO: 684454 - RNA, 21 nt, Human
ggggagagcaacaccccagcu

SEQ ID NO: 684455 - RNA, 24 nt, Human
ggguccagcucuguucaggguggg

SEQ ID NO: 684456 - RNA, 19 nt, Human
gguauuugcuuuugccaug

SEQ ID NO: 684457 - RNA, 26 nt, Human
gugugugcacacacacagaaaccacg

SEQ ID NO: 684458 - RNA, 23 nt, Human
uaacgcuaaaggcacagcccccg

SEQ ID NO: 684459 - RNA, 18 nt, Human
uaagugaaaaccagaacu

SEQ ID NO: 684460 - RNA, 23 nt, Human
uacugcuuccuaagagucuccau

SEQ ID NO: 684461 - RNA, 22 nt, Human
ucagcccaaaaaagugcaacaa

SEQ ID NO: 684462 - RNA, 22 nt, Human
uccagcucuguucaggguggga

SEQ ID NO: 684463 - RNA, 23 nt, Human
uccgaaaacucagcugugacugc

SEQ ID NO: 684464 - RNA, 24 nt, Human
uccuucaauaaaaacacagucacc

SEQ ID NO: 684465 - RNA, 19 nt, Human
ucuaacagcucagcccaaa

SEQ ID NO: 684466 - RNA, 18 nt, Human
ucuaugagaaagcgggga

SEQ ID NO: 684467 - RNA, 18 nt, Human
ucuccgaaaacucagcug

SEQ ID NO: 684468 - RNA, 23 nt, Human
ucucgagccucuggagaagcccc

SEQ ID NO: 684469 - RNA, 21 nt, Human
ucuuccuaaaaaccacccaaa

SEQ ID NO: 684470 - RNA, 21 nt, Human
ugagaaaaacugcuuauaagu

SEQ ID NO: 684471 - RNA, 22 nt, Human
ugagaaaaacugcuuauaagug

SEQ ID NO: 684472 - RNA, 23 nt, Human
ugagaaagcggggagagcaacac

SEQ ID NO: 684473 - RNA, 24 nt, Human
ugagaaagcggggagagcaacacc

SEQ ID NO: 684474 - RNA, 18 nt, Human
ugccgaacucugacucua

SEQ ID NO: 684475 - RNA, 22 nt, Human
ugcucaagccgagggcagaggc

SEQ ID NO: 684476 - RNA, 21 nt, Human
ugggaaaaagcacagauccug

SEQ ID NO: 684477 - RNA, 21 nt, Human
ugggaaauggccugcucucga

SEQ ID NO: 684478 - RNA, 23 nt, Human
ugugcacacacacagaaaccacg

SEQ ID NO: 684479 - RNA, 21 nt, Human
ugugugugugcacacacacag

SEQ ID NO: 684480 - RNA, 22 nt, Human
uucaccaaaagcaauaaagagg

SEQ ID NO: 684481 - RNA, 24 nt, Human
uuccuaaaaaccacccaaacacua

SEQ ID NO: 684482 - RNA, 24 nt, Human
uuugccaugaucccuuuccauuug

SEQ ID NO: 684483 - RNA, 21 nt, Human
caagaaggggcgcguccgacg

SEQ ID NO: 684484 - RNA, 25 nt, Human
cacuauuauuuuaagaaucagucaa

SEQ ID NO: 684485 - RNA, 20 nt, Human
uagcccccccgcccacgcuc

SEQ ID NO: 684486 - RNA, 21 nt, Human
ucaaaucaguccggucucuuc

SEQ ID NO: 684487 - RNA, 19 nt, Human
uccaagaaggggcgcgucc

SEQ ID NO: 684488 - RNA, 23 nt, Human
ucuucauacugccaacaugucca

SEQ ID NO: 684489 - RNA, 23 nt, Human
ugcaccaccugaccgugacgucg

SEQ ID NO: 684490 - RNA, 19 nt, Human
uuuuuuuuuuuuuuuuuaa

SEQ ID NO: 684491 - RNA, 23 nt, Human
aaaaauaaaaguuucugagucug

SEQ ID NO: 684492 - RNA, 24 nt, Human
aaccaaacaacccuggccugcgcu

SEQ ID NO: 684493 - RNA, 19 nt, Human
aacccggagguguggccca

SEQ ID NO: 684494 - RNA, 19 nt, Human
aaggacuuuccuuggggga

SEQ ID NO: 684495 - RNA, 21 nt, Human
acccggagguguggcccacga

SEQ ID NO: 684496 - RNA, 24 nt, Human
accgcagaacugagccgccccaga

SEQ ID NO: 684497 - RNA, 23 nt, Human
aguuucugagucugauaauucca

SEQ ID NO: 684498 - RNA, 20 nt, Human
caaaaccaaacaacccuggc

SEQ ID NO: 684499 - RNA, 20 nt, Human
caaagugccccugggccuuc

SEQ ID NO: 684500 - RNA, 25 nt, Human
caccucaaaaccaaacaacccuggc

SEQ ID NO: 684501 - RNA, 23 nt, Human
cagaaaaaaaaaauaaaaguuuc

SEQ ID NO: 684502 - RNA, 18 nt, Human
cagcacaccucaaaacca

SEQ ID NO: 684503 - RNA, 22 nt, Human
cagcacaccucaaaaccaaaca

SEQ ID NO: 684504 - RNA, 21 nt, Human
caucccagcacaccucaaaac

SEQ ID NO: 684505 - RNA, 22 nt, Human
caucccagcacaccucaaaacc

SEQ ID NO: 684506 - RNA, 24 nt, Human
ccaaagugccccugggccuucgca

SEQ ID NO: 684507 - RNA, 18 nt, Human
cccaucuguguuugggac

SEQ ID NO: 684508 - RNA, 19 nt, Human
cccucauaaacucgcacuu

SEQ ID NO: 684509 - RNA, 23 nt, Human
cgcacuuugauuagaaaagugca

SEQ ID NO: 684510 - RNA, 22 nt, Human
cucccuggcaccgcagaacuga

SEQ ID NO: 684511 - RNA, 23 nt, Human
cugcuccacucccuggcaccgca

SEQ ID NO: 684512 - RNA, 20 nt, Human
gaaaguagagcuuuacccuc

SEQ ID NO: 684513 - RNA, 22 nt, Human
gagccgccccagacugcccugg

SEQ ID NO: 684514 - RNA, 24 nt, Human
gcucauuuaccuuccacuuccagg

SEQ ID NO: 684515 - RNA, 25 nt, Human
ggguauugggcucagguaucuuucu

SEQ ID NO: 684516 - RNA, 23 nt, Human
gggugccuuucaucccagcacac

SEQ ID NO: 684517 - RNA, 19 nt, Human
guuugcuuccucccuuccc

SEQ ID NO: 684518 - RNA, 24 nt, Human
uaauuccaaggguaucuuuuagaa

SEQ ID NO: 684519 - RNA, 24 nt, Human
ucaauaugacaguuugcuuccucc

SEQ ID NO: 684520 - RNA, 21 nt, Human
ucauugugcaacuuguguuuc

SEQ ID NO: 684521 - RNA, 22 nt, Human
ucccaaagugccccugggccuu

SEQ ID NO: 684522 - RNA, 21 nt, Human
ugagaagucuggugagacagu

SEQ ID NO: 684523 - RNA, 21 nt, Human
ugagaagucuggugagacagu

SEQ ID NO: 684524 - RNA, 18 nt, Human
ugccccugggccuucgca

SEQ ID NO: 684525 - RNA, 23 nt, Human
ugcucauuuaccuuccacuucca

SEQ ID NO: 684526 - RNA, 22 nt, Human
ugcuccacucccuggcaccgca

SEQ ID NO: 684527 - RNA, 20 nt, Human
uggcccacgacaucaggcgg

SEQ ID NO: 684528 - RNA, 18 nt, Human
ugggccuucgcacacugu

SEQ ID NO: 684529 - RNA, 23 nt, Human
uggugucugugcaaggacuuucc

SEQ ID NO: 684530 - RNA, 22 nt, Human
uguuuccucuuggucaauccca

SEQ ID NO: 684531 - RNA, 25 nt, Human
uuagaacucacucacuggugucugu

SEQ ID NO: 684532 - RNA, 23 nt, Human
uuuccuugggggaaaauagauuu

SEQ ID NO: 684533 - RNA, 19 nt, Human
uuuuuuuuuuuuuuuugcu

SEQ ID NO: 684534 - RNA, 21 nt, Human
uuuuuuuuuuuuuuuugcuag

SEQ ID NO: 684535 - RNA, 19 nt, Human
aacuugauccagugagcga

SEQ ID NO: 684536 - RNA, 20 nt, Human
acagugggaagaauuuuggc

SEQ ID NO: 684537 - RNA, 23 nt, Human
augacagugggaagaauuuuggc

SEQ ID NO: 684538 - RNA, 22 nt, Human
cagcaggaugugucuagaaauc

SEQ ID NO: 684539 - RNA, 19 nt, Human
caguggaacaacuugaucu

SEQ ID NO: 684540 - RNA, 18 nt, Human
cauuagguuacccaggga

SEQ ID NO: 684541 - RNA, 24 nt, Human
ccaaucguugauucaaucucccca

SEQ ID NO: 684542 - RNA, 20 nt, Human
ccccauaaaccuggucgcaa

SEQ ID NO: 684543 - RNA, 19 nt, Human
ccugucuuugagaccaauc

SEQ ID NO: 684544 - RNA, 24 nt, Human
cgaccagucgcugcugcuguggug

SEQ ID NO: 684545 - RNA, 21 nt, Human
cuccccauaaaccuggucgca

SEQ ID NO: 684546 - RNA, 21 nt, Human
cuguguggccucagauuuucc

SEQ ID NO: 684547 - RNA, 23 nt, Human
cuguguggccucagauuuucccu

SEQ ID NO: 684548 - RNA, 20 nt, Human
cuugcucugccuggguugaa

SEQ ID NO: 684549 - RNA, 21 nt, Human
gauugugugcugcuagccagu

SEQ ID NO: 684550 - RNA, 20 nt, Human
ggcgcacagucggcuggggg

SEQ ID NO: 684551 - RNA, 19 nt, Human
uacaucacagcaggaugug

SEQ ID NO: 684552 - RNA, 23 nt, Human
uagcacauucucuugcaucagca

SEQ ID NO: 684553 - RNA, 19 nt, Human
uauuagacaccaguggaac

SEQ ID NO: 684554 - RNA, 25 nt, Human
ucccuugcaauuuguguugccuucu

SEQ ID NO: 684555 - RNA, 23 nt, Human
ucucucuuuuaucacucuggguu

SEQ ID NO: 684556 - RNA, 19 nt, Human
ucuugcucugccuggguug

SEQ ID NO: 684557 - RNA, 21 nt, Human
ucuugcucugccuggguugaa

SEQ ID NO: 684558 - RNA, 21 nt, Human
ucuuugagaccaaucguugau

SEQ ID NO: 684559 - RNA, 22 nt, Human
ugaacagacucuucucagcacc

SEQ ID NO: 684560 - RNA, 19 nt, Human
ugccacgcacucucugcag

SEQ ID NO: 684561 - RNA, 24 nt, Human
uggggguaaggauugccacgcacu

SEQ ID NO: 684562 - RNA, 24 nt, Human
ugugcaaauacacaaauauacaca

SEQ ID NO: 684563 - RNA, 21 nt, Human
uguugccuucuuuggagacug

SEQ ID NO: 684564 - RNA, 23 nt, Human
uuggcugugaacagacucuucuc

SEQ ID NO: 684565 - RNA, 20 nt, Human
aaucuuaaaacucagcccug

SEQ ID NO: 684566 - RNA, 23 nt, Human
agacauacuggccacuggaaaca

SEQ ID NO: 684567 - RNA, 21 nt, Human
aggaaaggagagaaaaucuua

SEQ ID NO: 684568 - RNA, 22 nt, Human
aggcaggaaauacaaaagggac

SEQ ID NO: 684569 - RNA, 19 nt, Human
caaagcaaugaaagacaua

SEQ ID NO: 684570 - RNA, 22 nt, Human
gcaaagcaaugaaagacauacu

SEQ ID NO: 684571 - RNA, 21 nt, Human
gcccugggcuaggagggcgcc

SEQ ID NO: 684572 - RNA, 23 nt, Human
gggccgggucaacagugggcugc

SEQ ID NO: 684573 - RNA, 23 nt, Human
guuucuucuuacuuugggggugg

SEQ ID NO: 684574 - RNA, 20 nt, Human
uaggagggcgccacacagca

SEQ ID NO: 684575 - RNA, 24 nt, Human
ugccacagagggcgauggggugac

SEQ ID NO: 684576 - RNA, 21 nt, Human
uggccaggaacuccuagagca

SEQ ID NO: 684577 - RNA, 19 nt, Human
ugguaacagugggugcaaa

SEQ ID NO: 684578 - RNA, 19 nt, Human
uugaggaaccaaaggagaa

SEQ ID NO: 684579 - RNA, 26 nt, Human
aaacaaaaaggaaggaaaagggaccc

SEQ ID NO: 684580 - RNA, 23 nt, Human
aagagccagauagggaaauggag

SEQ ID NO: 684581 - RNA, 26 nt, Human
aauaaaauaaaaccaccacgauucga

SEQ ID NO: 684582 - RNA, 21 nt, Human
agaaaagagagagacagagaa

SEQ ID NO: 684583 - RNA, 21 nt, Human
agaaaaggguuggggauggca

SEQ ID NO: 684584 - RNA, 18 nt, Human
agagacagagaaagagag

SEQ ID NO: 684585 - RNA, 22 nt, Human
aggaaaagaaggaagaaaagag

SEQ ID NO: 684586 - RNA, 21 nt, Human
aggaagaaaagagagagacag

SEQ ID NO: 684587 - RNA, 23 nt, Human
aggaaggaaaagaaggaagaaaa

SEQ ID NO: 684588 - RNA, 25 nt, Human
aggaaggaaaagaaggaagaaaaga

SEQ ID NO: 684589 - RNA, 24 nt, Human
aggcaagaaaagaauugauuccuu

SEQ ID NO: 684590 - RNA, 25 nt, Human
aggcaagaaaagaauugauuccuua

SEQ ID NO: 684591 - RNA, 23 nt, Human
agggacaagagagaaagagccag

SEQ ID NO: 684592 - RNA, 22 nt, Human
augcgccccagagacugccggg

SEQ ID NO: 684593 - RNA, 20 nt, Human
augguagguaguuuaaauac

SEQ ID NO: 684594 - RNA, 21 nt, Human
caccacgauucgaagaacaaa

SEQ ID NO: 684595 - RNA, 23 nt, Human
caccagucgccggagcccagagc

SEQ ID NO: 684596 - RNA, 20 nt, Human
cagagccuggcguucgccgc

SEQ ID NO: 684597 - RNA, 24 nt, Human
caggaugaacaaacaccugagcac

SEQ ID NO: 684598 - RNA, 19 nt, Human
caugcgccccagagacugc

SEQ ID NO: 684599 - RNA, 22 nt, Human
ccaccacgauucgaagaacaaa

SEQ ID NO: 684600 - RNA, 23 nt, Human
ccaccacgauucgaagaacaaag

SEQ ID NO: 684601 - RNA, 23 nt, Human
ccagagccuggcguucgccgcuu

SEQ ID NO: 684602 - RNA, 25 nt, Human
ccccagagacugccgggggccaccu

SEQ ID NO: 684603 - RNA, 22 nt, Human
ccucgguugggcugggggugga

SEQ ID NO: 684604 - RNA, 20 nt, Human
ccugugggcucuggagccaa

SEQ ID NO: 684605 - RNA, 18 nt, Human
ccuguuuaacccuucugc

SEQ ID NO: 684606 - RNA, 22 nt, Human
cgaggucgccgaagcccaaaga

SEQ ID NO: 684607 - RNA, 19 nt, Human
cuccaaaaggguggaagag

SEQ ID NO: 684608 - RNA, 19 nt, Human
cucccggggcuucaggagu

SEQ ID NO: 684609 - RNA, 25 nt, Human
cuucuugcauguugccgccaagggc

SEQ ID NO: 684610 - RNA, 21 nt, Human
gaagaaaagagagagacagag

SEQ ID NO: 684611 - RNA, 20 nt, Human
gaagggaggggggcugugag

SEQ ID NO: 684612 - RNA, 21 nt, Human
gaagggaggggggcugugagu

SEQ ID NO: 684613 - RNA, 25 nt, Human
gagagagacagagaaagagagaaag

SEQ ID NO: 684614 - RNA, 22 nt, Human
gaggucgccgaagcccaaagac

SEQ ID NO: 684615 - RNA, 19 nt, Human
gccgaagcccaaagaccug

SEQ ID NO: 684616 - RNA, 18 nt, Human
gccggagcccagagccug

SEQ ID NO: 684617 - RNA, 21 nt, Human
gccuggcguucgccgcugccu

SEQ ID NO: 684618 - RNA, 18 nt, Human
gcgauccaaguguguggu

SEQ ID NO: 684619 - RNA, 19 nt, Human
gcgcagcccacugucuucu

SEQ ID NO: 684620 - RNA, 24 nt, Human
gcgcucagcagaagcuccgcggga

SEQ ID NO: 684621 - RNA, 21 nt, Human
ggagcccagagccuggcguuc

SEQ ID NO: 684622 - RNA, 21 nt, Human
ggaugaacaaacaccugagca

SEQ ID NO: 684623 - RNA, 20 nt, Human
ggcucuggagccacuacugg

SEQ ID NO: 684624 - RNA, 23 nt, Human
gggguggauauauauauauuucu

SEQ ID NO: 684625 - RNA, 18 nt, Human
gguucucuuucucaggca

SEQ ID NO: 684626 - RNA, 25 nt, Human
uacauaaaaacuuuccaacacaggg

SEQ ID NO: 684627 - RNA, 23 nt, Human
uacuggccugcgccgccagcccu

SEQ ID NO: 684628 - RNA, 33 nt, Human
uacuggccugcgccgccagcccuauuaacgccg

SEQ ID NO: 684629 - RNA, 19 nt, Human
uacugggcgccggcuuugg

SEQ ID NO: 684630 - RNA, 21 nt, Human
uacugggcgccggcuuuggga

SEQ ID NO: 684631 - RNA, 27 nt, Human
uagaaacaaaaaggaaggaaaagaagg

SEQ ID NO: 684632 - RNA, 24 nt, Human
uagacacugcuuuggcgaagggag

SEQ ID NO: 684633 - RNA, 22 nt, Human
uagagaagacggcgucggggcg

SEQ ID NO: 684634 - RNA, 18 nt, Human
ucgccgaagcccaaagac

SEQ ID NO: 684635 - RNA, 21 nt, Human
ucucuuucucaggcaagaaaa

SEQ ID NO: 684636 - RNA, 19 nt, Human
ugaacaaacaccugagcac

SEQ ID NO: 684637 - RNA, 20 nt, Human
ugaacaaacaccugagcaca

SEQ ID NO: 684638 - RNA, 21 nt, Human
ugaacaaacaccugagcacaa

SEQ ID NO: 684639 - RNA, 22 nt, Human
ugaacaaacaccugagcacaac

SEQ ID NO: 684640 - RNA, 23 nt, Human
ugagcccuuggguucgacagucc

SEQ ID NO: 684641 - RNA, 23 nt, Human
ugauuucagaaaauguuuuauua

SEQ ID NO: 684642 - RNA, 23 nt, Human
ugcagcgacaaaaagaaaaauaa

SEQ ID NO: 684643 - RNA, 21 nt, Human
ugcauuuuaauuagagaagac

SEQ ID NO: 684644 - RNA, 24 nt, Human
ugccggcgcucagcagaagcuccg

SEQ ID NO: 684645 - RNA, 21 nt, Human
ugcgccccagagacugccggg

SEQ ID NO: 684646 - RNA, 22 nt, Human
ugcguagcaccagucgccggag

SEQ ID NO: 684647 - RNA, 26 nt, Human
uggccagguccucggcgcgggccucg

SEQ ID NO: 684648 - RNA, 21 nt, Human
uggccuggccagguccucggc

SEQ ID NO: 684649 - RNA, 18 nt, Human
uggcuggccuggccaggu

SEQ ID NO: 684650 - RNA, 19 nt, Human
ugguagguaguuuaaauac

SEQ ID NO: 684651 - RNA, 22 nt, Human
uuagauagaaacaaaaaggaag

SEQ ID NO: 684652 - RNA, 22 nt, Human
uucaucuuccugcgucugguuc

SEQ ID NO: 684653 - RNA, 20 nt, Human
uuccucuccucccggggcuu

SEQ ID NO: 684654 - RNA, 23 nt, Human
uucuuaccgguuucugccgcggg

SEQ ID NO: 684655 - RNA, 19 nt, Human
uuuggcgaagggagggggg

SEQ ID NO: 684656 - RNA, 19 nt, Human
aacgcucggcguccucccc

SEQ ID NO: 684657 - RNA, 19 nt, Human
acgggaguguccucuucgg

SEQ ID NO: 684658 - RNA, 21 nt, Human
agcccccgggcgcccgggccc

SEQ ID NO: 684659 - RNA, 20 nt, Human
caccccccagcccccgggcg

SEQ ID NO: 684660 - RNA, 22 nt, Human
cacgcgccccaucgugcgcgca

SEQ ID NO: 684661 - RNA, 20 nt, Human
cacuuuuuuuuuggaggggg

SEQ ID NO: 684662 - RNA, 20 nt, Human
cagagcggagcgcggacggc

SEQ ID NO: 684663 - RNA, 23 nt, Human
cagcggcagccgcagagggggcu

SEQ ID NO: 684664 - RNA, 24 nt, Human
ccccagcccccgggcgcccgggcc

SEQ ID NO: 684665 - RNA, 19 nt, Human
cccccgggcgcccgggccc

SEQ ID NO: 684666 - RNA, 22 nt, Human
cccccgggcgcccgggcccgcc

SEQ ID NO: 684667 - RNA, 21 nt, Human
ccccgccgcgcccucggcccg

SEQ ID NO: 684668 - RNA, 22 nt, Human
ccccgggcgcccgggcccgccc

SEQ ID NO: 684669 - RNA, 19 nt, Human
ccccucgcccucgcgguug

SEQ ID NO: 684670 - RNA, 18 nt, Human
cccgcagaaguccgcaga

SEQ ID NO: 684671 - RNA, 18 nt, Human
cccgccgcgcccucggcc

SEQ ID NO: 684672 - RNA, 22 nt, Human
cccucggcccgggccccugccu

SEQ ID NO: 684673 - RNA, 18 nt, Human
cccugccucaacgcucgg

SEQ ID NO: 684674 - RNA, 25 nt, Human
cccugcucacucgcgcucuccuccu

SEQ ID NO: 684675 - RNA, 22 nt, Human
ccgcccggcagcggcagccgca

SEQ ID NO: 684676 - RNA, 25 nt, Human
ccgccgcgcccucggcccgggcccc

SEQ ID NO: 684677 - RNA, 20 nt, Human
ccuccacgcgccccaucgug

SEQ ID NO: 684678 - RNA, 23 nt, Human
ccuccgcgccccuccacgcgccc

SEQ ID NO: 684679 - RNA, 20 nt, Human
ccucgcgguugucaccgccc

SEQ ID NO: 684680 - RNA, 18 nt, Human
cgcagccccgccgcgccc

SEQ ID NO: 684681 - RNA, 19 nt, Human
cggcagcggcagccgcaga

SEQ ID NO: 684682 - RNA, 22 nt, Human
cggcccgggccccugccucaac

SEQ ID NO: 684683 - RNA, 20 nt, Human
cggcguccucccccaccccc

SEQ ID NO: 684684 - RNA, 21 nt, Human
cggcguccucccccacccccc

SEQ ID NO: 684685 - RNA, 21 nt, Human
cgggcgcccgggcccgcccgg

SEQ ID NO: 684686 - RNA, 22 nt, Human
cucaaagggggucaaagagagg

SEQ ID NO: 684687 - RNA, 24 nt, Human
cucggcccgggccccugccucaac

SEQ ID NO: 684688 - RNA, 18 nt, Human
gcccuccgcgccccucca

SEQ ID NO: 684689 - RNA, 21 nt, Human
gccugcacacgggaguguccu

SEQ ID NO: 684690 - RNA, 20 nt, Human
gcgcagccccgccgcgcccu

SEQ ID NO: 684691 - RNA, 23 nt, Human
gcggagcgcggacggcuuuuccg

SEQ ID NO: 684692 - RNA, 21 nt, Human
gcucacucgcgcucuccuccu

SEQ ID NO: 684693 - RNA, 20 nt, Human
ggcccgcccggcagcggcag

SEQ ID NO: 684694 - RNA, 20 nt, Human
uaaaauauggaaugcuuuuc

SEQ ID NO: 684695 - RNA, 18 nt, Human
ucagagcggagcgcggac

SEQ ID NO: 684696 - RNA, 19 nt, Human
ucccccaccccccagcccc

SEQ ID NO: 684697 - RNA, 18 nt, Human
uccgcagagccucuagcu

SEQ ID NO: 684698 - RNA, 26 nt, Human
ucgugcgcgcagccccgccgcgcccu

SEQ ID NO: 684699 - RNA, 20 nt, Human
ucuccuccuccuccuucucc

SEQ ID NO: 684700 - RNA, 20 nt, Human
ugcaaggaguccucagagcg

SEQ ID NO: 684701 - RNA, 20 nt, Human
ugcucacucgcgcucuccuc

SEQ ID NO: 684702 - RNA, 21 nt, Human
uggaaugcuuuucuucaaaua

SEQ ID NO: 684703 - RNA, 22 nt, Human
uggccccugcucacucgcgcuc

SEQ ID NO: 684704 - RNA, 22 nt, Human
ugguaggcuccuucucccacgu

SEQ ID NO: 684705 - RNA, 24 nt, Human
ugguaggcuccuucucccacgucu

SEQ ID NO: 684706 - RNA, 21 nt, Human
aaaccugaaaaaaucugagua

SEQ ID NO: 684707 - RNA, 22 nt, Human
aaguggggagaaugguauaaug

SEQ ID NO: 684708 - RNA, 22 nt, Human
acaggucccuacugccccacca

SEQ ID NO: 684709 - RNA, 24 nt, Human
acccucaacaggauaaccugaagc

SEQ ID NO: 684710 - RNA, 19 nt, Human
agaaguggggagaauggua

SEQ ID NO: 684711 - RNA, 18 nt, Human
agacuuuggagagaagcu

SEQ ID NO: 684712 - RNA, 20 nt, Human
agagaagaagggagccccga

SEQ ID NO: 684713 - RNA, 21 nt, Human
agagaagaagggagccccgag

SEQ ID NO: 684714 - RNA, 22 nt, Human
agagaagcucagcaaccucgaa

SEQ ID NO: 684715 - RNA, 18 nt, Human
aggaagugguuguugcca

SEQ ID NO: 684716 - RNA, 24 nt, Human
aggaagugguuguugccaguguuu

SEQ ID NO: 684717 - RNA, 18 nt, Human
aggaucccuuuacccugc

SEQ ID NO: 684718 - RNA, 24 nt, Human
agugggccuuuaaaaaaaguuaga

SEQ ID NO: 684719 - RNA, 22 nt, Human
caaaugcccguguuaaaguucu

SEQ ID NO: 684720 - RNA, 30 nt, Human
caauuaucaacauguggccaguuuuucauu

SEQ ID NO: 684721 - RNA, 21 nt, Human
cacauccucacaauaagauug

SEQ ID NO: 684722 - RNA, 19 nt, Human
caccccacaccagcccugc

SEQ ID NO: 684723 - RNA, 18 nt, Human
cacucuucccacccaccc

SEQ ID NO: 684724 - RNA, 24 nt, Human
cagccaguccccucggcagagccu

SEQ ID NO: 684725 - RNA, 19 nt, Human
cagugggccuuuaaaaaaa

SEQ ID NO: 684726 - RNA, 21 nt, Human
ccacccucaacaggauaaccu

SEQ ID NO: 684727 - RNA, 21 nt, Human
ccaguguuugggaaaggcuaa

SEQ ID NO: 684728 - RNA, 18 nt, Human
ccccacaccagcccugcc

SEQ ID NO: 684729 - RNA, 23 nt, Human
ccucucacaggucccuacugccc

SEQ ID NO: 684730 - RNA, 21 nt, Human
ccuuuacccugcccuccccca

SEQ ID NO: 684731 - RNA, 18 nt, Human
cuagaaaaaccugaaaaa

SEQ ID NO: 684732 - RNA, 19 nt, Human
cugcaccccacaccagccc

SEQ ID NO: 684733 - RNA, 27 nt, Human
cugcaccccacaccagcccugccagag

SEQ ID NO: 684734 - RNA, 24 nt, Human
gagaaaaacuucagagauaagugu

SEQ ID NO: 684735 - RNA, 22 nt, Human
gagaaugacacuuugcauugag

SEQ ID NO: 684736 - RNA, 23 nt, Human
gaggagcuagaaaaaccugaaaa

SEQ ID NO: 684737 - RNA, 24 nt, Human
gcaaauaggggcugguaggguggu

SEQ ID NO: 684738 - RNA, 19 nt, Human
gcagaccucuagggcagca

SEQ ID NO: 684739 - RNA, 21 nt, Human
gcagugggccuuuaaaaaaag

SEQ ID NO: 684740 - RNA, 21 nt, Human
gcugcaccccacaccagcccu

SEQ ID NO: 684741 - RNA, 21 nt, Human
ggaggagcuagaaaaaccuga

SEQ ID NO: 684742 - RNA, 22 nt, Human
ggaggagcuagaaaaaccugaa

SEQ ID NO: 684743 - RNA, 18 nt, Human
ggaucccuuuacccugcc

SEQ ID NO: 684744 - RNA, 22 nt, Human
gggagaaugguauaaugaaugu

SEQ ID NO: 684745 - RNA, 20 nt, Human
gggcagcaggagccugggcg

SEQ ID NO: 684746 - RNA, 21 nt, Human
gugauuggaguccugguggga

SEQ ID NO: 684747 - RNA, 26 nt, Human
uacccugcccucccccauaacccagc

SEQ ID NO: 684748 - RNA, 23 nt, Human
uaccugcuguucugagugggauc

SEQ ID NO: 684749 - RNA, 22 nt, Human
uagaaaaaccugaaaaaaucug

SEQ ID NO: 684750 - RNA, 23 nt, Human
uagaaaaaccugaaaaaaucuga

SEQ ID NO: 684751 - RNA, 21 nt, Human
uagaacacauucaagaaagug

SEQ ID NO: 684752 - RNA, 22 nt, Human
uaggggccacugauaauagaaa

SEQ ID NO: 684753 - RNA, 21 nt, Human
uauaaugaauguccacguacc

SEQ ID NO: 684754 - RNA, 21 nt, Human
uaugaaauggaaucaucaucu

SEQ ID NO: 684755 - RNA, 19 nt, Human
ucacucuucccacccaccc

SEQ ID NO: 684756 - RNA, 20 nt, Human
ucagaacacugaacaaguca

SEQ ID NO: 684757 - RNA, 19 nt, Human
ucaggaccucucagaaauc

SEQ ID NO: 684758 - RNA, 23 nt, Human
ucaucccaccaccgcugucucgg

SEQ ID NO: 684759 - RNA, 20 nt, Human
ucaucccuucuucuucuucc

SEQ ID NO: 684760 - RNA, 18 nt, Human
ucccuucuucuucuuccc

SEQ ID NO: 684761 - RNA, 18 nt, Human
ucucacaggucccuacug

SEQ ID NO: 684762 - RNA, 25 nt, Human
ugaaaauaaagcagugggccuuuaa

SEQ ID NO: 684763 - RNA, 24 nt, Human
ugaaauggaaucaucaucucugcc

SEQ ID NO: 684764 - RNA, 19 nt, Human
ugcaaacaaauacagaagu

SEQ ID NO: 684765 - RNA, 21 nt, Human
ugcccucccccauaacccagc

SEQ ID NO: 684766 - RNA, 18 nt, Human
ugggaaaggcuaaaguua

SEQ ID NO: 684767 - RNA, 19 nt, Human
ugggaggucccaacggugc

SEQ ID NO: 684768 - RNA, 18 nt, Human
ugggggaaguacauuggg

SEQ ID NO: 684769 - RNA, 19 nt, Human
uguuaaaguucuccauugg

SEQ ID NO: 684770 - RNA, 26 nt, Human
uuaaggaucccuuuacccugcccucc

SEQ ID NO: 684771 - RNA, 21 nt, Human
uucaagaaagugacauacgga

SEQ ID NO: 684772 - RNA, 24 nt, Human
uuccaugaaacucuguguuugggg

SEQ ID NO: 684773 - RNA, 21 nt, Human
uugcagaccucuagggcagca

SEQ ID NO: 684774 - RNA, 26 nt, Human
uuggugugggguuuccaugaaacucu

SEQ ID NO: 684775 - RNA, 19 nt, Human
uuuaaggaucccuuuaccc

SEQ ID NO: 684776 - RNA, 22 nt, Human
aaaauagcacuuggccucagca

SEQ ID NO: 684777 - RNA, 19 nt, Human
aaacaaaaaaccuagcagc

SEQ ID NO: 684778 - RNA, 22 nt, Human
aaacaaaaaaccuagcagcaca

SEQ ID NO: 684779 - RNA, 25 nt, Human
aacaaaaauaaagugcagcacccau

SEQ ID NO: 684780 - RNA, 22 nt, Human
acaaaaauaaagugcagcaccc

SEQ ID NO: 684781 - RNA, 21 nt, Human
acaaaacaaaaaaccuagcag

SEQ ID NO: 684782 - RNA, 19 nt, Human
acaaaacaaaacaaaaaac

SEQ ID NO: 684783 - RNA, 22 nt, Human
acaaaacaaaacaaaaaaccua

SEQ ID NO: 684784 - RNA, 23 nt, Human
acccauaaaagugucaagaaaau

SEQ ID NO: 684785 - RNA, 21 nt, Human
agaacaaaacaaaacaaaaaa

SEQ ID NO: 684786 - RNA, 27 nt, Human
agcacccauaaaagugucaagaaaaua

SEQ ID NO: 684787 - RNA, 20 nt, Human
agcagaugccucccagaauc

SEQ ID NO: 684788 - RNA, 19 nt, Human
augccucccagaaucaacc

SEQ ID NO: 684789 - RNA, 23 nt, Human
auuucaguacucuuucccuccca

SEQ ID NO: 684790 - RNA, 24 nt, Human
caaaaaccaaacaaaaauaaagug

SEQ ID NO: 684791 - RNA, 21 nt, Human
caacugccacugccaacagac

SEQ ID NO: 684792 - RNA, 19 nt, Human
cagcacccauaaaaguguc

SEQ ID NO: 684793 - RNA, 26 nt, Human
cagcacccauaaaagugucaagaaaa

SEQ ID NO: 684794 - RNA, 20 nt, Human
caucaaaaaccaaacaaaaa

SEQ ID NO: 684795 - RNA, 21 nt, Human
ccaaacaaaaauaaagugcag

SEQ ID NO: 684796 - RNA, 25 nt, Human
ccaaacaaaaauaaagugcagcacc

SEQ ID NO: 684797 - RNA, 20 nt, Human
ccacugccaacagacuuggc

SEQ ID NO: 684798 - RNA, 21 nt, Human
cccauaaaagugucaagaaaa

SEQ ID NO: 684799 - RNA, 19 nt, Human
cgcccuuggcccuacaacu

SEQ ID NO: 684800 - RNA, 21 nt, Human
cugccacugccaacagacuug

SEQ ID NO: 684801 - RNA, 20 nt, Human
cugcgccgagccagaagccc

SEQ ID NO: 684802 - RNA, 21 nt, Human
cuuggccucagcagucuuaac

SEQ ID NO: 684803 - RNA, 19 nt, Human
gaacaaaacaaaacaaaaa

SEQ ID NO: 684804 - RNA, 22 nt, Human
gcacuuggccucagcagucuua

SEQ ID NO: 684805 - RNA, 23 nt, Human
uacaaccgcccuuggcccuacaa

SEQ ID NO: 684806 - RNA, 20 nt, Human
uagcagcacauuaaaaaaaa

SEQ ID NO: 684807 - RNA, 23 nt, Human
uauccauauaaaaagagacugua

SEQ ID NO: 684808 - RNA, 20 nt, Human
uaugguaccacucuucucuu

SEQ ID NO: 684809 - RNA, 18 nt, Human
ucagaacaaaacaaaaca

SEQ ID NO: 684810 - RNA, 25 nt, Human
ucagaacaaaacaaaacaaaaaacc

SEQ ID NO: 684811 - RNA, 22 nt, Human
uccaaaauugagaacaauaaga

SEQ ID NO: 684812 - RNA, 24 nt, Human
ucccucccaucaaaaaccaaacaa

SEQ ID NO: 684813 - RNA, 23 nt, Human
uccugcaacauaugguaccacuc

SEQ ID NO: 684814 - RNA, 23 nt, Human
ugagaacaauaagauuaaaggca

SEQ ID NO: 684815 - RNA, 19 nt, Human
uggcgugaauggaaccugc

SEQ ID NO: 684816 - RNA, 21 nt, Human
uguaaacauugcauuugugca

SEQ ID NO: 684817 - RNA, 18 nt, Human
uguagaauaggacaugua

SEQ ID NO: 684818 - RNA, 19 nt, Human
uguagcagaugccucccag

SEQ ID NO: 684819 - RNA, 27 nt, Human
uuaaaaaaaauuuacaaaacauuucag

SEQ ID NO: 684820 - RNA, 23 nt, Human
uucagaacaaaacaaaacaaaaa

SEQ ID NO: 684821 - RNA, 19 nt, Human
uuggccucagcagucuuaa

SEQ ID NO: 684822 - RNA, 18 nt, Human
uuuuuuuuuuuuuuuuug

SEQ ID NO: 684823 - RNA, 19 nt, Human
uuuuuuuuuuuuuuuuugu

SEQ ID NO: 684824 - RNA, 22 nt, Human
acacaagagaaacaaagucaaa

SEQ ID NO: 684825 - RNA, 20 nt, Human
acagcaaaucucaauaagca

SEQ ID NO: 684826 - RNA, 20 nt, Human
accacuacacaagagaaaca

SEQ ID NO: 684827 - RNA, 22 nt, Human
caaaagaauuauauauuaaugc

SEQ ID NO: 684828 - RNA, 20 nt, Human
caagagaaacaaagucaaaa

SEQ ID NO: 684829 - RNA, 20 nt, Human
cacuacacaagagaaacaaa

SEQ ID NO: 684830 - RNA, 20 nt, Human
cauacuuuguacaauuugcu

SEQ ID NO: 684831 - RNA, 22 nt, Human
ccacuacacaagagaaacaaag

SEQ ID NO: 684832 - RNA, 25 nt, Human
cuuccacuauaguccucuauaacaa

SEQ ID NO: 684833 - RNA, 18 nt, Human
gcggggcggggccggggc

SEQ ID NO: 684834 - RNA, 21 nt, Human
uauaacaaaacauccuacaua

SEQ ID NO: 684835 - RNA, 24 nt, Human
uauauuaaugcaaagaguaaacac

SEQ ID NO: 684836 - RNA, 23 nt, Human
uccacuauaguccucuauaacaa

SEQ ID NO: 684837 - RNA, 20 nt, Human
ugcaaagaguaaacacagaa

SEQ ID NO: 684838 - RNA, 18 nt, Human
uuaaauauuugauaugaa

SEQ ID NO: 684839 - RNA, 20 nt, Human
aaacaagaagaggguacugg

SEQ ID NO: 684840 - RNA, 26 nt, Human
aaagcaaugugaggucacuggggccc

SEQ ID NO: 684841 - RNA, 19 nt, Human
aacaugguaaaaccccguc

SEQ ID NO: 684842 - RNA, 20 nt, Human
aacaugguaaaaccccgucu

SEQ ID NO: 684843 - RNA, 21 nt, Human
aacaugguaaaaccccgucuc

SEQ ID NO: 684844 - RNA, 29 nt, Human
aacccagagagaaugacgucccccgaggg

SEQ ID NO: 684845 - RNA, 22 nt, Human
aagaggacagaggcuuccagga

SEQ ID NO: 684846 - RNA, 21 nt, Human
aagcagaaaugacaacuaaau

SEQ ID NO: 684847 - RNA, 25 nt, Human
aagcagaaaugacaacuaaaugccg

SEQ ID NO: 684848 - RNA, 20 nt, Human
aagcagaauaauaacuaaaa

SEQ ID NO: 684849 - RNA, 20 nt, Human
aaggcaaaauguacuauucu

SEQ ID NO: 684850 - RNA, 23 nt, Human
acagacccaaggacacuguggca

SEQ ID NO: 684851 - RNA, 18 nt, Human
acccaaugggauaagaug

SEQ ID NO: 684852 - RNA, 22 nt, Human
acuaugaagggcacaagaucac

SEQ ID NO: 684853 - RNA, 21 nt, Human
agaaaaaagacauuuaaaaaa

SEQ ID NO: 684854 - RNA, 22 nt, Human
agaaaacccaaagugagaaaca

SEQ ID NO: 684855 - RNA, 23 nt, Human
agaaccaacaagaggacagaggc

SEQ ID NO: 684856 - RNA, 19 nt, Human
agaggacagaggcuuccag

SEQ ID NO: 684857 - RNA, 24 nt, Human
agcacuuugggaggccgaggcggg

SEQ ID NO: 684858 - RNA, 30 nt, Human
agcagaaaaaagacauuuaaaaaaccuagg

SEQ ID NO: 684859 - RNA, 23 nt, Human
agccagaggcaagacaaaaaccc

SEQ ID NO: 684860 - RNA, 24 nt, Human
agccagaggcaagacaaaaaccca

SEQ ID NO: 684861 - RNA, 20 nt, Human
aggacagacaaggggaaagg

SEQ ID NO: 684862 - RNA, 21 nt, Human
aggcagacagaaccaacaagg

SEQ ID NO: 684863 - RNA, 21 nt, Human
aggccgaggcggguggaucac

SEQ ID NO: 684864 - RNA, 19 nt, Human
aggcggguggaucaccagg

SEQ ID NO: 684865 - RNA, 21 nt, Human
aggggccccacauuuucauuu

SEQ ID NO: 684866 - RNA, 21 nt, Human
aggggccccaccuuucguuuu

SEQ ID NO: 684867 - RNA, 21 nt, Human
agggggauagagaagcagagu

SEQ ID NO: 684868 - RNA, 25 nt, Human
auggaauaaugaucaaauaaaacca

SEQ ID NO: 684869 - RNA, 23 nt, Human
caaaucaauaccacauaccuccu

SEQ ID NO: 684870 - RNA, 24 nt, Human
caacaagaggacagaggcuuccag

SEQ ID NO: 684871 - RNA, 24 nt, Human
cacaccuguaaucccagcacuuug

SEQ ID NO: 684872 - RNA, 24 nt, Human
cacagccgagcagucacacaggcc

SEQ ID NO: 684873 - RNA, 21 nt, Human
caccugaaccaaguaauaagg

SEQ ID NO: 684874 - RNA, 22 nt, Human
caccugaaccaaguaauaaggc

SEQ ID NO: 684875 - RNA, 19 nt, Human
caccuguaaucccagcacu

SEQ ID NO: 684876 - RNA, 24 nt, Human
caccuguaaucccagcacuuuggg

SEQ ID NO: 684877 - RNA, 22 nt, Human
cagaaaaaagacauuuaaaaaa

SEQ ID NO: 684878 - RNA, 26 nt, Human
cagaaaaaagacauuuaaaaaaccua

SEQ ID NO: 684879 - RNA, 24 nt, Human
cagcacuuugggaggccgaggcgg

SEQ ID NO: 684880 - RNA, 20 nt, Human
caugaaauaaagcaauguga

SEQ ID NO: 684881 - RNA, 20 nt, Human
cauuuaaaaaaccuagugaa

SEQ ID NO: 684882 - RNA, 20 nt, Human
cauuuucauuuuacacuggg

SEQ ID NO: 684883 - RNA, 25 nt, Human
cccacagccgagcagucacacaggc

SEQ ID NO: 684884 - RNA, 19 nt, Human
ccugcauuaucccggagca

SEQ ID NO: 684885 - RNA, 23 nt, Human
ccuggccccagggagaggcugga

SEQ ID NO: 684886 - RNA, 23 nt, Human
ccuggcuaacaugguaaaacccc

SEQ ID NO: 684887 - RNA, 24 nt, Human
ccuggcuaacaugguaaaaccccg

SEQ ID NO: 684888 - RNA, 24 nt, Human
cgagaccauccuggcuaacauggu

SEQ ID NO: 684889 - RNA, 18 nt, Human
cggguggaucaccagggc

SEQ ID NO: 684890 - RNA, 19 nt, Human
cggguggaucaccagggca

SEQ ID NO: 684891 - RNA, 22 nt, Human
cguguggaauccugcauuaucc

SEQ ID NO: 684892 - RNA, 18 nt, Human
cugcuggcuucuuucccu

SEQ ID NO: 684893 - RNA, 19 nt, Human
cugggcgcgguaguucaca

SEQ ID NO: 684894 - RNA, 20 nt, Human
gaaccaacaagaggacagag

SEQ ID NO: 684895 - RNA, 22 nt, Human
gacagacaaggggaaagagguu

SEQ ID NO: 684896 - RNA, 24 nt, Human
gagaaccuuuacagacccaaggac

SEQ ID NO: 684897 - RNA, 27 nt, Human
gagcagaaaaaagacauuuaaaaaacc

SEQ ID NO: 684898 - RNA, 23 nt, Human
gaggcggguggaucaccagggca

SEQ ID NO: 684899 - RNA, 19 nt, Human
gaucaaauaaaaccagagg

SEQ ID NO: 684900 - RNA, 20 nt, Human
gcaaaauguacuauucuacc

SEQ ID NO: 684901 - RNA, 21 nt, Human
gcggguggaucaccagggcag

SEQ ID NO: 684902 - RNA, 24 nt, Human
gcuaacaugguaaaaccccgucuc

SEQ ID NO: 684903 - RNA, 20 nt, Human
gcucuaugucaccaccuuga

SEQ ID NO: 684904 - RNA, 20 nt, Human
gcuggggcgaguggggcggc

SEQ ID NO: 684905 - RNA, 18 nt, Human
ggaaaggguagcucugcu

SEQ ID NO: 684906 - RNA, 20 nt, Human
ggaggcuccgcagccggcgc

SEQ ID NO: 684907 - RNA, 23 nt, Human
ggcgcgguaguucacaccuguaa

SEQ ID NO: 684908 - RNA, 22 nt, Human
gggaagggcuccaaagcccagg

SEQ ID NO: 684909 - RNA, 23 nt, Human
gggaggcuccgcagccggcgccc

SEQ ID NO: 684910 - RNA, 18 nt, Human
gggauagagaagcagagu

SEQ ID NO: 684911 - RNA, 24 nt, Human
gguaguucacaccuguaaucccag

SEQ ID NO: 684912 - RNA, 24 nt, Human
uaaagcagaauaauaacuaaaaac

SEQ ID NO: 684913 - RNA, 24 nt, Human
uaacaugguaaaaccccgucucua

SEQ ID NO: 684914 - RNA, 27 nt, Human
uacaaaacaguagacuaguacucuuga

SEQ ID NO: 684915 - RNA, 19 nt, Human
uacauacacauagugaagu

SEQ ID NO: 684916 - RNA, 19 nt, Human
uacugguugaaagaaaggu

SEQ ID NO: 684917 - RNA, 18 nt, Human
uagccagaggcaagacaa

SEQ ID NO: 684918 - RNA, 24 nt, Human
uaguucacaccuguaaucccagca

SEQ ID NO: 684919 - RNA, 26 nt, Human
uauggaauaaugaucaaauaaaacca

SEQ ID NO: 684920 - RNA, 23 nt, Human
ucacaccuguaaucccagcacuu

SEQ ID NO: 684921 - RNA, 24 nt, Human
ucaccagggcaggagaucgagacc

SEQ ID NO: 684922 - RNA, 25 nt, Human
uccaaagcccaggucagucuagacc

SEQ ID NO: 684923 - RNA, 21 nt, Human
uccaggaagcugcugaggagg

SEQ ID NO: 684924 - RNA, 23 nt, Human
uccaggaagcugcugaggaggug

SEQ ID NO: 684925 - RNA, 21 nt, Human
ucgcgacucugagggaggcuc

SEQ ID NO: 684926 - RNA, 24 nt, Human
ucuccaaauagaguuaaagcagaa

SEQ ID NO: 684927 - RNA, 18 nt, Human
ucugaucuacauacacau

SEQ ID NO: 684928 - RNA, 21 nt, Human
ucugcuggcuucuuucccugc

SEQ ID NO: 684929 - RNA, 24 nt, Human
ugaaaaaaagacuaaaauuuuucu

SEQ ID NO: 684930 - RNA, 28 nt, Human
ugaacaaggggccccacauuguaaugac

SEQ ID NO: 684931 - RNA, 19 nt, Human
ugagaaacauucuacaaaa

SEQ ID NO: 684932 - RNA, 18 nt, Human
ugagaaccuuuacagacc

SEQ ID NO: 684933 - RNA, 18 nt, Human
ugagaaccuuuacagacc

SEQ ID NO: 684934 - RNA, 20 nt, Human
ugagaggcagacagaaccaa

SEQ ID NO: 684935 - RNA, 23 nt, Human
ugcacaauaugauacugcacucc

SEQ ID NO: 684936 - RNA, 20 nt, Human
ugcguccggccucgcgacuc

SEQ ID NO: 684937 - RNA, 24 nt, Human
ugcuaccacgguggcagaaggggg

SEQ ID NO: 684938 - RNA, 23 nt, Human
ugggaggccgaggcggguggauc

SEQ ID NO: 684939 - RNA, 24 nt, Human
ugggaggccgaggcggguggauca

SEQ ID NO: 684940 - RNA, 21 nt, Human
ugggcagcaguggcaagaaaa

SEQ ID NO: 684941 - RNA, 21 nt, Human
ugugaaugagccagaggacag

SEQ ID NO: 684942 - RNA, 18 nt, Human
ugugagaggcagacagaa

SEQ ID NO: 684943 - RNA, 19 nt, Human
uuacacugggccucucaaa

SEQ ID NO: 684944 - RNA, 24 nt, Human
uucagaggggccccaccuuucguu

SEQ ID NO: 684945 - RNA, 25 nt, Human
uugggaggccgaggcggguggauca

SEQ ID NO: 684946 - RNA, 21 nt, Human
uuucauuuuacacugggccuc

SEQ ID NO: 684947 - RNA, 21 nt, Human
uuugaccuaaacaagaagagg

SEQ ID NO: 684948 - RNA, 22 nt, Human
uuugaccuaaacaagaagaggg

SEQ ID NO: 684949 - RNA, 21 nt, Human
uuuuuuuuuuuuuugauuugg

SEQ ID NO: 684950 - RNA, 26 nt, Human
uuuuuuuuuuuuuuuuugauuugggg

SEQ ID NO: 684951 - RNA, 24 nt, Human
aaccacuucuaaaacagccuccau

SEQ ID NO: 684952 - RNA, 24 nt, Human
aagauuaucaagcauacagcccca

SEQ ID NO: 684953 - RNA, 26 nt, Human
aagguacuugucacccuuccuggcua

SEQ ID NO: 684954 - RNA, 19 nt, Human
acccaggaagaauggagga

SEQ ID NO: 684955 - RNA, 24 nt, Human
acccaggaagaauggaggaggcag

SEQ ID NO: 684956 - RNA, 22 nt, Human
agcaauggaugggcuagagaga

SEQ ID NO: 684957 - RNA, 18 nt, Human
agcccaggaguccucagg

SEQ ID NO: 684958 - RNA, 25 nt, Human
agccuugcucacagcaacaaucuca

SEQ ID NO: 684959 - RNA, 18 nt, Human
agcugcucacacuagccc

SEQ ID NO: 684960 - RNA, 19 nt, Human
aggaagaauggaggaggcc

SEQ ID NO: 684961 - RNA, 24 nt, Human
aggcagaagguacuugucacccuu

SEQ ID NO: 684962 - RNA, 21 nt, Human
agucacgaaggcugagguggg

SEQ ID NO: 684963 - RNA, 21 nt, Human
caagauuaucaagcauacagc

SEQ ID NO: 684964 - RNA, 21 nt, Human
cacauccagccaucugcaccc

SEQ ID NO: 684965 - RNA, 21 nt, Human
caccaggaaggguggagggca

SEQ ID NO: 684966 - RNA, 23 nt, Human
cacuaccucuugacaacguuccg

SEQ ID NO: 684967 - RNA, 19 nt, Human
ccaaccacuucuaaaacag

SEQ ID NO: 684968 - RNA, 21 nt, Human
ccaucugcacccaugcagaau

SEQ ID NO: 684969 - RNA, 21 nt, Human
cuacaguucugcacccaggaa

SEQ ID NO: 684970 - RNA, 20 nt, Human
cugaaagcagccauugcccc

SEQ ID NO: 684971 - RNA, 19 nt, Human
cugagccugaggugacucu

SEQ ID NO: 684972 - RNA, 20 nt, Human
cugaucucaaugguucagaa

SEQ ID NO: 684973 - RNA, 23 nt, Human
cugguuucugaucucaaugguuc

SEQ ID NO: 684974 - RNA, 19 nt, Human
cuucggcacuuccgggagg

SEQ ID NO: 684975 - RNA, 18 nt, Human
gacaggaacaaaaggccu

SEQ ID NO: 684976 - RNA, 24 nt, Human
gagccuugcucacagcaacaaucu

SEQ ID NO: 684977 - RNA, 20 nt, Human
gaggcagaagguacuuguca

SEQ ID NO: 684978 - RNA, 20 nt, Human
gcacuuccgggaggagccgg

SEQ ID NO: 684979 - RNA, 23 nt, Human
gcacuuccgggaggagccggaaa

SEQ ID NO: 684980 - RNA, 21 nt, Human
gcugcucacacuagcccagga

SEQ ID NO: 684981 - RNA, 20 nt, Human
ggaagaauggaggaggcaga

SEQ ID NO: 684982 - RNA, 21 nt, Human
ggaaggguggagggcacugca

SEQ ID NO: 684983 - RNA, 21 nt, Human
guuguugugaaguccaucacu

SEQ ID NO: 684984 - RNA, 20 nt, Human
uagaaggcuaaguaucuggu

SEQ ID NO: 684985 - RNA, 19 nt, Human
uagagcaugucucuuucac

SEQ ID NO: 684986 - RNA, 21 nt, Human
uagucacgaaggcugaggugg

SEQ ID NO: 684987 - RNA, 18 nt, Human
uauggaauagagcaguga

SEQ ID NO: 684988 - RNA, 24 nt, Human
ucaacauggguacugccaugcccu

SEQ ID NO: 684989 - RNA, 23 nt, Human
ucacuagucacgaaggcugaggu

SEQ ID NO: 684990 - RNA, 23 nt, Human
ucagggucuucuacaguucugca

SEQ ID NO: 684991 - RNA, 24 nt, Human
uccauggcacgguauggaauagag

SEQ ID NO: 684992 - RNA, 21 nt, Human
uccguagcuacaguagaaggc

SEQ ID NO: 684993 - RNA, 20 nt, Human
ucuacuguaagcaauggauu

SEQ ID NO: 684994 - RNA, 18 nt, Human
ucuccaaaaucucaaaau

SEQ ID NO: 684995 - RNA, 19 nt, Human
ucucccagagccuugcuca

SEQ ID NO: 684996 - RNA, 23 nt, Human
ucugcagcuagagcaugucucuu

SEQ ID NO: 684997 - RNA, 24 nt, Human
ucuggcacaggaaauggucuccaa

SEQ ID NO: 684998 - RNA, 22 nt, Human
uggaggaggcagaagguacuug

SEQ ID NO: 684999 - RNA, 21 nt, Human
uggcacgguauggaauagagc

SEQ ID NO: 685000 - RNA, 18 nt, Human
uucuacaguucugcaccc

SEQ ID NO: 685001 - RNA, 26 nt, Human
uuuuuuuuuuuuuuuuuuacacuuaa

SEQ ID NO: 685002 - RNA, 20 nt, Human
aacugcuuugagauucccac

SEQ ID NO: 685003 - RNA, 21 nt, Human
agaaaauagaaaaccuuuaau

SEQ ID NO: 685004 - RNA, 18 nt, Human
agagguucuuuuuucugc

SEQ ID NO: 685005 - RNA, 22 nt, Human
caccugcauacagacuuugcaa

SEQ ID NO: 685006 - RNA, 19 nt, Human
cuuuaauaauaaagaaagg

SEQ ID NO: 685007 - RNA, 18 nt, Human
gaaaauagaaaaccuuua

SEQ ID NO: 685008 - RNA, 20 nt, Human
uaauaaagaaagguuaaaca

SEQ ID NO: 685009 - RNA, 22 nt, Human
uggaauuuaagacaggcacacc

SEQ ID NO: 685010 - RNA, 19 nt, Human
uuaaugaagagguucuuuu

SEQ ID NO: 685011 - RNA, 20 nt, Human
aaacucucaaagagcaccac

SEQ ID NO: 685012 - RNA, 22 nt, Human
acucucaaagagcaccacuggg

SEQ ID NO: 685013 - RNA, 19 nt, Human
agcguucagauccaggcuc

SEQ ID NO: 685014 - RNA, 21 nt, Human
cagcguucagauccaggcucu

SEQ ID NO: 685015 - RNA, 19 nt, Human
ccagaugaaacugaaacag

SEQ ID NO: 685016 - RNA, 24 nt, Human
uaaaaagaacauacaauuauaaag

SEQ ID NO: 685017 - RNA, 19 nt, Human
uaaacucucaaagagcacc

SEQ ID NO: 685018 - RNA, 21 nt, Human
uaaacucucaaagagcaccac

SEQ ID NO: 685019 - RNA, 21 nt, Human
ucagcguucagauccaggcuc

SEQ ID NO: 685020 - RNA, 23 nt, Human
ugaaacugaaacagaaaaauugu

SEQ ID NO: 685021 - RNA, 18 nt, Human
ugagagaaaacugcaaug

SEQ ID NO: 685022 - RNA, 23 nt, Human
ugcaaugaucagaaggauugagc

SEQ ID NO: 685023 - RNA, 21 nt, Human
ugccagaugaaacugaaacag

SEQ ID NO: 685024 - RNA, 19 nt, Human
aagggcauauguuccacuu

SEQ ID NO: 685025 - RNA, 19 nt, Human
cacugugcagagcagaggc

SEQ ID NO: 685026 - RNA, 23 nt, Human
cgccucggccuccugggaugugg

SEQ ID NO: 685027 - RNA, 18 nt, Human
ggcaagccgccucggccu

SEQ ID NO: 685028 - RNA, 18 nt, Human
gggcaagccgccucggcc

SEQ ID NO: 685029 - RNA, 22 nt, Human
ggucagaaggcucagggccugc

SEQ ID NO: 685030 - RNA, 20 nt, Human
ucagggccugcccggcuucu

SEQ ID NO: 685031 - RNA, 20 nt, Human
uggcagaggaugugagguca

SEQ ID NO: 685032 - RNA, 23 nt, Human
uggcagaggaugugaggucagaa

SEQ ID NO: 685033 - RNA, 20 nt, Human
ugugguguggcagaggaugu

SEQ ID NO: 685034 - RNA, 18 nt, Human
uugucccugcucauccac

SEQ ID NO: 685035 - RNA, 23 nt, Human
uuugucccugcucauccacacca

SEQ ID NO: 685036 - RNA, 21 nt, Human
uuuuuuuuuuuucaaagguug

SEQ ID NO: 685037 - RNA, 21 nt, Human
uuuuuuuuuuuuuuucaaagg

SEQ ID NO: 685038 - RNA, 19 nt, Human
aaagcaagauggaacccaa

SEQ ID NO: 685039 - RNA, 21 nt, Human
aacaccaaaaauagaagacca

SEQ ID NO: 685040 - RNA, 22 nt, Human
aaucacaagagcaacagagaaa

SEQ ID NO: 685041 - RNA, 18 nt, Human
acaagagaaaggcacaaa

SEQ ID NO: 685042 - RNA, 24 nt, Human
acacaaaggucggagccaggacag

SEQ ID NO: 685043 - RNA, 26 nt, Human
acaccaaaaauagaagaccagagaau

SEQ ID NO: 685044 - RNA, 19 nt, Human
accacauguggggaagggu

SEQ ID NO: 685045 - RNA, 28 nt, Human
accacgcuuagaagacacaacacaaccu

SEQ ID NO: 685046 - RNA, 18 nt, Human
accugcaaacguaaaaag

SEQ ID NO: 685047 - RNA, 21 nt, Human
acugcccacugcccacugccc

SEQ ID NO: 685048 - RNA, 19 nt, Human
acugcugggguucgcuggc

SEQ ID NO: 685049 - RNA, 21 nt, Human
agaagcaaacuuuggcagggg

SEQ ID NO: 685050 - RNA, 19 nt, Human
agaaggauggugacaaauc

SEQ ID NO: 685051 - RNA, 19 nt, Human
agagagaaauuagagggaa

SEQ ID NO: 685052 - RNA, 24 nt, Human
aguguacagagaugacaagagaaa

SEQ ID NO: 685053 - RNA, 23 nt, Human
aucccauccaggcaaccucacug

SEQ ID NO: 685054 - RNA, 22 nt, Human
aucccuaggguacggauuccua

SEQ ID NO: 685055 - RNA, 18 nt, Human
caaacccagaaccaccac

SEQ ID NO: 685056 - RNA, 24 nt, Human
caaaucccaaaaaggaaauggagg

SEQ ID NO: 685057 - RNA, 24 nt, Human
caacaccaaaaauagaagaccaga

SEQ ID NO: 685058 - RNA, 19 nt, Human
caacagagaaaugacagac

SEQ ID NO: 685059 - RNA, 19 nt, Human
caaccucacugaggccgaa

SEQ ID NO: 685060 - RNA, 24 nt, Human
caaccucacugaggccgaaacaac

SEQ ID NO: 685061 - RNA, 18 nt, Human
caagagaaaggcacaaau

SEQ ID NO: 685062 - RNA, 26 nt, Human
caagagcaacagagaaauuggagacc

SEQ ID NO: 685063 - RNA, 19 nt, Human
cacaaccucauggggcgag

SEQ ID NO: 685064 - RNA, 26 nt, Human
caccccuucauucuucucuccaucuc

SEQ ID NO: 685065 - RNA, 18 nt, Human
cacugaggccgaaacaac

SEQ ID NO: 685066 - RNA, 23 nt, Human
cagaacuccuugggucagugcug

SEQ ID NO: 685067 - RNA, 20 nt, Human
caggacaguccugaggggga

SEQ ID NO: 685068 - RNA, 24 nt, Human
cagugcugagagaccugcacucaa

SEQ ID NO: 685069 - RNA, 21 nt, Human
cauguuggaggagaccaaguu

SEQ ID NO: 685070 - RNA, 24 nt, Human
ccaaagugaauggacccccugcca

SEQ ID NO: 685071 - RNA, 25 nt, Human
ccaagacacugcccacugcccacua

SEQ ID NO: 685072 - RNA, 20 nt, Human
ccaauccacacacacucaca

SEQ ID NO: 685073 - RNA, 23 nt, Human
ccacaggugaacucaaaucaaac

SEQ ID NO: 685074 - RNA, 22 nt, Human
ccaggacaguccugagggggau

SEQ ID NO: 685075 - RNA, 24 nt, Human
cccaaaaaggaaauggaggaggag

SEQ ID NO: 685076 - RNA, 25 nt, Human
ccccugccaauccacacacacucac

SEQ ID NO: 685077 - RNA, 20 nt, Human
ccugccccuccauagaacac

SEQ ID NO: 685078 - RNA, 21 nt, Human
cuacugcugggguucgcuggc

SEQ ID NO: 685079 - RNA, 18 nt, Human
cucacugaggccgaaaca

SEQ ID NO: 685080 - RNA, 22 nt, Human
cucccccaacccacagugaaua

SEQ ID NO: 685081 - RNA, 22 nt, Human
cucuccaucucauucagaucaa

SEQ ID NO: 685082 - RNA, 18 nt, Human
cugccaauccacacacac

SEQ ID NO: 685083 - RNA, 25 nt, Human
cuucucuccaucucauucagaucaa

SEQ ID NO: 685084 - RNA, 28 nt, Human
gagaauagaaggauggugaccgguaccc

SEQ ID NO: 685085 - RNA, 22 nt, Human
gaggacaugaggagagaaccag

SEQ ID NO: 685086 - RNA, 24 nt, Human
gaggaggaguucguggaagggcag

SEQ ID NO: 685087 - RNA, 24 nt, Human
gaucccuaggguacggauuccuac

SEQ ID NO: 685088 - RNA, 19 nt, Human
gcaaccucacugaggccga

SEQ ID NO: 685089 - RNA, 20 nt, Human
gcaagcacuaguaccacgcu

SEQ ID NO: 685090 - RNA, 21 nt, Human
gcagagaacaugcuuuauuga

SEQ ID NO: 685091 - RNA, 19 nt, Human
gccaaucacaagagcaacg

SEQ ID NO: 685092 - RNA, 22 nt, Human
gccaccuuuucccugccccucc

SEQ ID NO: 685093 - RNA, 19 nt, Human
gcuuuauugaggaguagau

SEQ ID NO: 685094 - RNA, 22 nt, Human
ggcgagaggacaugaggagaga

SEQ ID NO: 685095 - RNA, 26 nt, Human
ggggauggccuucccaaaggauacug

SEQ ID NO: 685096 - RNA, 27 nt, Human
ggggauggccuucccaaaggauacugu

SEQ ID NO: 685097 - RNA, 18 nt, Human
ggguucgcuggcucggaa

SEQ ID NO: 685098 - RNA, 25 nt, Human
gguccuggugguggcagccauauuu

SEQ ID NO: 685099 - RNA, 27 nt, Human
ggugaccagguggcaagcacuaguacc

SEQ ID NO: 685100 - RNA, 21 nt, Human
uaaaauuagcucccccaaccc

SEQ ID NO: 685101 - RNA, 21 nt, Human
uaaagcaagauggaacccaaa

SEQ ID NO: 685102 - RNA, 20 nt, Human
uagaagacacaacacaaccu

SEQ ID NO: 685103 - RNA, 22 nt, Human
uagaagagcacauucuaccaca

SEQ ID NO: 685104 - RNA, 19 nt, Human
uagcccaauacagaucaaa

SEQ ID NO: 685105 - RNA, 21 nt, Human
uagcccaauacagaucaaaaa

SEQ ID NO: 685106 - RNA, 21 nt, Human
ucaaaucaaacccagaaccac

SEQ ID NO: 685107 - RNA, 22 nt, Human
ucacaagagcaacagagaaaug

SEQ ID NO: 685108 - RNA, 22 nt, Human
ucagaaccagcgucugcagugu

SEQ ID NO: 685109 - RNA, 18 nt, Human
uccauagaacacacauau

SEQ ID NO: 685110 - RNA, 23 nt, Human
ucccaaaggauacuguacuugcc

SEQ ID NO: 685111 - RNA, 19 nt, Human
ucugcaguguacacaaagg

SEQ ID NO: 685112 - RNA, 21 nt, Human
ucuguaaaaggccuuuauccc

SEQ ID NO: 685113 - RNA, 18 nt, Human
ugaaaagagaagcaaacu

SEQ ID NO: 685114 - RNA, 18 nt, Human
ugaauggacccccugcca

SEQ ID NO: 685115 - RNA, 21 nt, Human
ugacaaaucccaaaaaggaaa

SEQ ID NO: 685116 - RNA, 21 nt, Human
ugaggcaaaaaguaguauccc

SEQ ID NO: 685117 - RNA, 23 nt, Human
ugcccacugcccacaggugaacu

SEQ ID NO: 685118 - RNA, 24 nt, Human
ugcccacugcccacaggugaacuc

SEQ ID NO: 685119 - RNA, 19 nt, Human
uggaaagguccugguggug

SEQ ID NO: 685120 - RNA, 24 nt, Human
uggaacccaaagugaauggacccc

SEQ ID NO: 685121 - RNA, 20 nt, Human
uggcaccugcaaacguaaaa

SEQ ID NO: 685122 - RNA, 24 nt, Human
ugggaaacucuucaaaaguauuug

SEQ ID NO: 685123 - RNA, 19 nt, Human
ugggaguaaagagagaagg

SEQ ID NO: 685124 - RNA, 24 nt, Human
ugggcuagagagaaauuagaggga

SEQ ID NO: 685125 - RNA, 22 nt, Human
uggugacaaaucccaaaaagga

SEQ ID NO: 685126 - RNA, 18 nt, Human
uuaaagcaagauggaacc

SEQ ID NO: 685127 - RNA, 19 nt, Human
uuaaagcaagauggaaccc

SEQ ID NO: 685128 - RNA, 20 nt, Human
uucuaccacauguggggaag

SEQ ID NO: 685129 - RNA, 22 nt, Human
uuugagcagagaacaugcuuua

SEQ ID NO: 685130 - RNA, 25 nt, Human
uuuuuuuuuuugagcagagaacaug

SEQ ID NO: 685131 - RNA, 27 nt, Human
uuuuuuuuuuuuuuuuuuuuuuugggg

SEQ ID NO: 685132 - RNA, 24 nt, Human
aaaagcagcuguauugccaaugua

SEQ ID NO: 685133 - RNA, 19 nt, Human
aaauguugauaguuuuagc

SEQ ID NO: 685134 - RNA, 18 nt, Human
accuuggccugggcuagg

SEQ ID NO: 685135 - RNA, 18 nt, Human
acgacaacaccaccagca

SEQ ID NO: 685136 - RNA, 20 nt, Human
agcaacuuuuuuuuccauuu

SEQ ID NO: 685137 - RNA, 23 nt, Human
agcagcucucguacccccucucc

SEQ ID NO: 685138 - RNA, 19 nt, Human
aggcugggacaccaacacc

SEQ ID NO: 685139 - RNA, 20 nt, Human
agguggcucuuaggcuggga

SEQ ID NO: 685140 - RNA, 22 nt, Human
auaauaacggauggcugcugcc

SEQ ID NO: 685141 - RNA, 22 nt, Human
aucuucuuaagucuuuccauca

SEQ ID NO: 685142 - RNA, 21 nt, Human
auggcugaggagauacagaac

SEQ ID NO: 685143 - RNA, 19 nt, Human
caaauccucacucauauua

SEQ ID NO: 685144 - RNA, 21 nt, Human
caccaacaccagccaccugcc

SEQ ID NO: 685145 - RNA, 21 nt, Human
caccagcagcucucguacccc

SEQ ID NO: 685146 - RNA, 20 nt, Human
cagcagcucucguacccccu

SEQ ID NO: 685147 - RNA, 20 nt, Human
cagcagcucucguacccccu

SEQ ID NO: 685148 - RNA, 22 nt, Human
ccaccagcagcucucguacccc

SEQ ID NO: 685149 - RNA, 23 nt, Human
ccauaaagaaagauuaugaugac

SEQ ID NO: 685150 - RNA, 20 nt, Human
cccaaugcuauuaacuaacu

SEQ ID NO: 685151 - RNA, 21 nt, Human
ccccgcgcggguuacugcucc

SEQ ID NO: 685152 - RNA, 22 nt, Human
cccgcgcggguuacugcucccg

SEQ ID NO: 685153 - RNA, 24 nt, Human
cccgcgcggguuacugcucccgcg

SEQ ID NO: 685154 - RNA, 19 nt, Human
ccgcggcagcucuuacucc

SEQ ID NO: 685155 - RNA, 22 nt, Human
cgacaacaccaccagcagcucu

SEQ ID NO: 685156 - RNA, 23 nt, Human
cgacaacaccaccagcagcucuc

SEQ ID NO: 685157 - RNA, 19 nt, Human
cggccacgacaacaccacc

SEQ ID NO: 685158 - RNA, 22 nt, Human
cucccagcuucugcuucauuuc

SEQ ID NO: 685159 - RNA, 27 nt, Human
cuccucaaccgaaacuuuccuacuuac

SEQ ID NO: 685160 - RNA, 25 nt, Human
cucguacccccucuccgaccgacgu

SEQ ID NO: 685161 - RNA, 18 nt, Human
cuucuccucucuuucuac

SEQ ID NO: 685162 - RNA, 25 nt, Human
gacucaaugcuaucaguaucuuaug

SEQ ID NO: 685163 - RNA, 24 nt, Human
gcaaagucugcccccaccauaaag

SEQ ID NO: 685164 - RNA, 20 nt, Human
gcacagaugcugagccaugu

SEQ ID NO: 685165 - RNA, 19 nt, Human
gcugagccauguggugguu

SEQ ID NO: 685166 - RNA, 18 nt, Human
ggaaauaauaacggaugg

SEQ ID NO: 685167 - RNA, 18 nt, Human
guacccccucuccgaccg

SEQ ID NO: 685168 - RNA, 24 nt, Human
uaagugcaaagucugcccccaguu

SEQ ID NO: 685169 - RNA, 20 nt, Human
uacagcugugauuccuaacc

SEQ ID NO: 685170 - RNA, 25 nt, Human
uaggcugggacaccaacaccagcca

SEQ ID NO: 685171 - RNA, 27 nt, Human
uaugaugacaaaauauauuuaagauac

SEQ ID NO: 685172 - RNA, 20 nt, Human
ucccgcggcagcucuuacuc

SEQ ID NO: 685173 - RNA, 21 nt, Human
ucguacccccucuccgaccga

SEQ ID NO: 685174 - RNA, 23 nt, Human
ucuacuguacuuuagcaccacag

SEQ ID NO: 685175 - RNA, 24 nt, Human
ucuacuguacuuuagcaccacagg

SEQ ID NO: 685176 - RNA, 24 nt, Human
ucuccgaccgacgucggccucccc

SEQ ID NO: 685177 - RNA, 19 nt, Human
ugaaaagccaugauuguag

SEQ ID NO: 685178 - RNA, 21 nt, Human
ugaggacaaauggugagaccu

SEQ ID NO: 685179 - RNA, 21 nt, Human
ugccccauguucugguagccu

SEQ ID NO: 685180 - RNA, 18 nt, Human
uguggugguuacuagagg

SEQ ID NO: 685181 - RNA, 25 nt, Human
uucuccucucuuucuacuguacuuu

SEQ ID NO: 685182 - RNA, 22 nt, Human
uugcacugcaguaagugcaaag

SEQ ID NO: 685183 - RNA, 24 nt, Human
uuggcacagaugcugagccaugug

SEQ ID NO: 685184 - RNA, 18 nt, Human
uuuuacagcugugauucc

SEQ ID NO: 685185 - RNA, 19 nt, Human
uuuucagagauaagcaacu

SEQ ID NO: 685186 - RNA, 24 nt, Human
uuuuuuuuuuuuuuuuuuuuucag

SEQ ID NO: 685187 - RNA, 24 nt, Human
aaaacacaaaagcaaaaaauacaa

SEQ ID NO: 685188 - RNA, 28 nt, Human
aaaauaaggcaaauuccaaaacacaaaa

SEQ ID NO: 685189 - RNA, 22 nt, Human
aacacaaaagcaaaaaauacaa

SEQ ID NO: 685190 - RNA, 23 nt, Human
aacacaaaagcaaaaaauacaaa

SEQ ID NO: 685191 - RNA, 20 nt, Human
aagcaaaaaauacaaaacuu

SEQ ID NO: 685192 - RNA, 26 nt, Human
aaggcaaauuccaaaacacaaaagca

SEQ ID NO: 685193 - RNA, 24 nt, Human
acacaaaagcaaaaaauacaaaac

SEQ ID NO: 685194 - RNA, 20 nt, Human
acuguagagagcuuuaaagu

SEQ ID NO: 685195 - RNA, 19 nt, Human
aguucauauuuugggggga

SEQ ID NO: 685196 - RNA, 18 nt, Human
caaaacacaaaagcaaaa

SEQ ID NO: 685197 - RNA, 20 nt, Human
caaaacacaaaagcaaaaaa

SEQ ID NO: 685198 - RNA, 23 nt, Human
caaaacacaaaagcaaaaaauac

SEQ ID NO: 685199 - RNA, 22 nt, Human
cagagggacuuacgacaugaca

SEQ ID NO: 685200 - RNA, 22 nt, Human
cagaguuuuauuaccauuaauu

SEQ ID NO: 685201 - RNA, 21 nt, Human
cagccucugaacaucgcaucc

SEQ ID NO: 685202 - RNA, 26 nt, Human
cauccaagaaaaauaaggcaaauucc

SEQ ID NO: 685203 - RNA, 18 nt, Human
cauggaaauacaugcugc

SEQ ID NO: 685204 - RNA, 18 nt, Human
ccaaaacacaaaagcaaa

SEQ ID NO: 685205 - RNA, 23 nt, Human
ccucugaacaucgcauccaagaa

SEQ ID NO: 685206 - RNA, 19 nt, Human
cgcugcucaaacacauagc

SEQ ID NO: 685207 - RNA, 18 nt, Human
cguugcacucacuaagca

SEQ ID NO: 685208 - RNA, 18 nt, Human
cucaaagacucuucgcug

SEQ ID NO: 685209 - RNA, 22 nt, Human
cugcucaaacacauagcugugu

SEQ ID NO: 685210 - RNA, 25 nt, Human
uacgacaugacaucucuuaaaggaa

SEQ ID NO: 685211 - RNA, 22 nt, Human
ucaaagacucuucgcugcucaa

SEQ ID NO: 685212 - RNA, 24 nt, Human
uccaaaacacaaaagcaaaaaaua

SEQ ID NO: 685213 - RNA, 18 nt, Human
uccagugcaaucccaggc

SEQ ID NO: 685214 - RNA, 19 nt, Human
ugcacugaaauuaucacuc

SEQ ID NO: 685215 - RNA, 23 nt, Human
ugcagcugggcguucaccuuguu

SEQ ID NO: 685216 - RNA, 23 nt, Human
uuaaaguauacagagggacuuac

SEQ ID NO: 685217 - RNA, 18 nt, Human
uucaccuuguucugagca

SEQ ID NO: 685218 - RNA, 23 nt, Human
uucauauuuuggggggacuguag

SEQ ID NO: 685219 - RNA, 18 nt, Human
uuuuuuuuuuuuuuuuug

SEQ ID NO: 685220 - RNA, 18 nt, Human
agccuggagaaccccuau

SEQ ID NO: 685221 - RNA, 22 nt, Human
auugcacauuguuccuuugacu

SEQ ID NO: 685222 - RNA, 19 nt, Human
caccgcgcgacggcaaugc

SEQ ID NO: 685223 - RNA, 19 nt, Human
cagccccuuaacuccuucc

SEQ ID NO: 685224 - RNA, 25 nt, Human
ccaaaacacuccgcuuagauacuga

SEQ ID NO: 685225 - RNA, 21 nt, Human
cccgcaggccucugcgccgag

SEQ ID NO: 685226 - RNA, 18 nt, Human
cgacggcaaugccucaga

SEQ ID NO: 685227 - RNA, 19 nt, Human
cucugcgccgagcgccugc

SEQ ID NO: 685228 - RNA, 19 nt, Human
cuugaaacagagguuagcu

SEQ ID NO: 685229 - RNA, 20 nt, Human
gcuuuaauuuuucucucuca

SEQ ID NO: 685230 - RNA, 23 nt, Human
uaaauccauuuauuaacguuuca

SEQ ID NO: 685231 - RNA, 18 nt, Human
uaacuccuuccaaaacac

SEQ ID NO: 685232 - RNA, 19 nt, Human
uaaggcgccaacugcagcc

SEQ ID NO: 685233 - RNA, 22 nt, Human
uauccagaaacgugguagaaau

SEQ ID NO: 685234 - RNA, 22 nt, Human
uauuucacuguauccagaaacg

SEQ ID NO: 685235 - RNA, 23 nt, Human
ucaucuaaaaacauaucaauugc

SEQ ID NO: 685236 - RNA, 18 nt, Human
ugcgccgagcgccugcgc

SEQ ID NO: 685237 - RNA, 24 nt, Human
uugaaacagagguuagcuauuuca

SEQ ID NO: 685238 - RNA, 18 nt, Human
aaaaaccuaauucuaaac

SEQ ID NO: 685239 - RNA, 27 nt, Human
aaaaauaaaaucugacaaugaagaaaa

SEQ ID NO: 685240 - RNA, 23 nt, Human
aaaaauauagaaagacaaaaagc

SEQ ID NO: 685241 - RNA, 19 nt, Human
aaacaaaguuuuacugaga

SEQ ID NO: 685242 - RNA, 24 nt, Human
aaauuagcacaaaaauggaaaaaa

SEQ ID NO: 685243 - RNA, 23 nt, Human
aacaagaaacucugcuauaacaa

SEQ ID NO: 685244 - RNA, 25 nt, Human
aauuagcacaaaaauggaaaaaaag

SEQ ID NO: 685245 - RNA, 19 nt, Human
accaugaaccuggaaaaag

SEQ ID NO: 685246 - RNA, 21 nt, Human
acccuuuuucacaaagucagg

SEQ ID NO: 685247 - RNA, 21 nt, Human
acuacuaauuuuacguacauu

SEQ ID NO: 685248 - RNA, 19 nt, Human
agaauucauugacuacuaa

SEQ ID NO: 685249 - RNA, 22 nt, Human
agacaaaaagcccauauccuau

SEQ ID NO: 685250 - RNA, 20 nt, Human
agcacaaaaauggaaaaaaa

SEQ ID NO: 685251 - RNA, 18 nt, Human
aggaaauauaaagucaaa

SEQ ID NO: 685252 - RNA, 23 nt, Human
aggagagcucaggaaauauaaag

SEQ ID NO: 685253 - RNA, 22 nt, Human
aguaaaaaauaaaaucugacaa

SEQ ID NO: 685254 - RNA, 18 nt, Human
agucauucuguaguggag

SEQ ID NO: 685255 - RNA, 24 nt, Human
aguuucuauuuuaaaagagguggc

SEQ ID NO: 685256 - RNA, 20 nt, Human
auaaagucaaaaauauacaa

SEQ ID NO: 685257 - RNA, 20 nt, Human
aucuuuguuguuauuauaau

SEQ ID NO: 685258 - RNA, 24 nt, Human
auguauauuuccauuuaaaguuuc

SEQ ID NO: 685259 - RNA, 25 nt, Human
caagugcuuucacccaccccuaaau

SEQ ID NO: 685260 - RNA, 24 nt, Human
cacccuuuuucacaaagucaggag

SEQ ID NO: 685261 - RNA, 18 nt, Human
caccuuauccuugcuacu

SEQ ID NO: 685262 - RNA, 21 nt, Human
cacggcagugggaaaaugaaa

SEQ ID NO: 685263 - RNA, 25 nt, Human
cagaaaaagcuuaauuacaugaaua

SEQ ID NO: 685264 - RNA, 20 nt, Human
ccaccacugaacauuucaga

SEQ ID NO: 685265 - RNA, 23 nt, Human
ccagaagacuauauuuguuuuaa

SEQ ID NO: 685266 - RNA, 22 nt, Human
cccauauccuauuacccagagg

SEQ ID NO: 685267 - RNA, 20 nt, Human
ccccuaaauucuguuuuggg

SEQ ID NO: 685268 - RNA, 25 nt, Human
ccccuaaauucuguuuugggcccuc

SEQ ID NO: 685269 - RNA, 18 nt, Human
cggcagugggaaaaugaa

SEQ ID NO: 685270 - RNA, 18 nt, Human
cuaaaacauuuccagaag

SEQ ID NO: 685271 - RNA, 23 nt, Human
cucaaacuguaacaguacagacu

SEQ ID NO: 685272 - RNA, 22 nt, Human
cuggcccgcuggugugagagcu

SEQ ID NO: 685273 - RNA, 24 nt, Human
cuguuccucuaaaaaucagaaaaa

SEQ ID NO: 685274 - RNA, 25 nt, Human
cuucuggucuuguauauuuuucacu

SEQ ID NO: 685275 - RNA, 21 nt, Human
cuuucuguuccucuaaaaauc

SEQ ID NO: 685276 - RNA, 22 nt, Human
cuuucuguuccucuaaaaauca

SEQ ID NO: 685277 - RNA, 19 nt, Human
gaaaaagaaaaucaaaagg

SEQ ID NO: 685278 - RNA, 26 nt, Human
gaaaaagcuaaagcacaagugcuuuc

SEQ ID NO: 685279 - RNA, 22 nt, Human
gaaccuggaaaaagaaaaucaa

SEQ ID NO: 685280 - RNA, 25 nt, Human
gacauaaauuuuuuuccuaaaauuu

SEQ ID NO: 685281 - RNA, 25 nt, Human
gcuaaagcacaagugcuuucaccca

SEQ ID NO: 685282 - RNA, 27 nt, Human
gcuacugaaaaaccuaauucuaaacaa

SEQ ID NO: 685283 - RNA, 22 nt, Human
ggauauuugacaguaaaaaaua

SEQ ID NO: 685284 - RNA, 18 nt, Human
guaauauuuuagguuacu

SEQ ID NO: 685285 - RNA, 23 nt, Human
uaaaaacauaaaauugaaaaugc

SEQ ID NO: 685286 - RNA, 20 nt, Human
uaaaaacugacaacuguuag

SEQ ID NO: 685287 - RNA, 18 nt, Human
uaacuggcccgcuggugu

SEQ ID NO: 685288 - RNA, 23 nt, Human
uaagugugguuaucuccaauagu

SEQ ID NO: 685289 - RNA, 21 nt, Human
uagaaagacaaaaagcccaua

SEQ ID NO: 685290 - RNA, 18 nt, Human
uauacaaaucuuuguugu

SEQ ID NO: 685291 - RNA, 25 nt, Human
uauagaaagacaaaaagcccauauc

SEQ ID NO: 685292 - RNA, 24 nt, Human
uauuuaucuucaaaguucagaacu

SEQ ID NO: 685293 - RNA, 18 nt, Human
ucacaaagucaggagagc

SEQ ID NO: 685294 - RNA, 19 nt, Human
ucacaaagucaggagagcu

SEQ ID NO: 685295 - RNA, 20 nt, Human
ucacaaagucaggagagcuc

SEQ ID NO: 685296 - RNA, 23 nt, Human
uccaugaaugaaauuaccaagga

SEQ ID NO: 685297 - RNA, 23 nt, Human
ucuccaauaguaaacaaguucau

SEQ ID NO: 685298 - RNA, 19 nt, Human
ucuggucuuguauauuuuu

SEQ ID NO: 685299 - RNA, 19 nt, Human
ucuucuuuauaccuuauug

SEQ ID NO: 685300 - RNA, 23 nt, Human
ugaaaaaccuaauucuaaacaaa

SEQ ID NO: 685301 - RNA, 20 nt, Human
ugaaaaagcuaaagcacaag

SEQ ID NO: 685302 - RNA, 22 nt, Human
ugaaaaagcuaaagcacaagug

SEQ ID NO: 685303 - RNA, 19 nt, Human
ugaaccuggaaaaagaaaa

SEQ ID NO: 685304 - RNA, 21 nt, Human
ugaaccuggaaaaagaaaauc

SEQ ID NO: 685305 - RNA, 18 nt, Human
ugaagaaaauuacaaaaa

SEQ ID NO: 685306 - RNA, 21 nt, Human
uggaaaaagaaaaucaaaagg

SEQ ID NO: 685307 - RNA, 24 nt, Human
uggaaaaagaaaaucaaaaggaau

SEQ ID NO: 685308 - RNA, 23 nt, Human
uggaauaaauuagcacaaaaaug

SEQ ID NO: 685309 - RNA, 20 nt, Human
uggaguuuucuaggaaaaau

SEQ ID NO: 685310 - RNA, 21 nt, Human
uggcuuaaaaacauaaaauug

SEQ ID NO: 685311 - RNA, 22 nt, Human
uuagcacaaaaauggaaaaaaa

SEQ ID NO: 685312 - RNA, 20 nt, Human
uucaagagauggcuuaaaaa

SEQ ID NO: 685313 - RNA, 18 nt, Human
uucacuuucuuucuguuc

SEQ ID NO: 685314 - RNA, 28 nt, Human
uucuuuauuaagugugguuaucuccaau

SEQ ID NO: 685315 - RNA, 18 nt, Human
uuuccaugaaugaaauua

SEQ ID NO: 685316 - RNA, 25 nt, Human
uuucuguuccucuaaaaaucagaaa

SEQ ID NO: 685317 - RNA, 18 nt, Human
uuuuccaugaaugaaauu

SEQ ID NO: 685318 - RNA, 18 nt, Human
aaugaauggccuaacuac

SEQ ID NO: 685319 - RNA, 21 nt, Human
aaugcacauuaaaugaauggc

SEQ ID NO: 685320 - RNA, 23 nt, Human
caccgaccacuccggcucagaac

SEQ ID NO: 685321 - RNA, 24 nt, Human
ccagcggcacggcacguccuucuc

SEQ ID NO: 685322 - RNA, 18 nt, Human
cggcucagaacccagcgg

SEQ ID NO: 685323 - RNA, 23 nt, Human
cuacuggaacuuuaguaguucua

SEQ ID NO: 685324 - RNA, 19 nt, Human
gguccauagagcauuagaa

SEQ ID NO: 685325 - RNA, 19 nt, Human
uaaauaaacagaaaagugc

SEQ ID NO: 685326 - RNA, 18 nt, Human
ugaauacagcaaaauucu

SEQ ID NO: 685327 - RNA, 19 nt, Human
agcagggcuguggccacgg

SEQ ID NO: 685328 - RNA, 22 nt, Human
agcagucagaugcagggacgcc

SEQ ID NO: 685329 - RNA, 22 nt, Human
cacagucugcgcuccucgggac

SEQ ID NO: 685330 - RNA, 19 nt, Human
caggaggggacaugaagcg

SEQ ID NO: 685331 - RNA, 18 nt, Human
caggauggggaaggggug

SEQ ID NO: 685332 - RNA, 18 nt, Human
cccggugcagaagcacca

SEQ ID NO: 685333 - RNA, 18 nt, Human
ccucagucugguucuucu

SEQ ID NO: 685334 - RNA, 22 nt, Human
cgcccggugcagaagcaccagg

SEQ ID NO: 685335 - RNA, 19 nt, Human
gagcaggauggggaagggg

SEQ ID NO: 685336 - RNA, 21 nt, Human
gcagucagaugcagggacgcc

SEQ ID NO: 685337 - RNA, 21 nt, Human
ggacacagucugcgcuccucg

SEQ ID NO: 685338 - RNA, 18 nt, Human
ggacaugaagcggagcag

SEQ ID NO: 685339 - RNA, 19 nt, Human
ggggaagggguguaaggaa

SEQ ID NO: 685340 - RNA, 19 nt, Human
ggggaagggguguaaggaa

SEQ ID NO: 685341 - RNA, 22 nt, Human
gucugguucuucuuccagcagu

SEQ ID NO: 685342 - RNA, 20 nt, Human
ucagggacacagucugcgcu

SEQ ID NO: 685343 - RNA, 24 nt, Human
ucuuuuccucagucugguucuucu

SEQ ID NO: 685344 - RNA, 18 nt, Human
ugcugcuggagcagggcg

SEQ ID NO: 685345 - RNA, 19 nt, Human
ugggaacaauaacaugaga

SEQ ID NO: 685346 - RNA, 18 nt, Human
uggggccaggauaacugg

SEQ ID NO: 685347 - RNA, 22 nt, Human
uggggcuguugaaaagccucuu

SEQ ID NO: 685348 - RNA, 18 nt, Human
uuuuuuuuuuuuuuuuug

SEQ ID NO: 685349 - RNA, 20 nt, Human
uuuuuuuuuuuuuuuuugcu

SEQ ID NO: 685350 - RNA, 23 nt, Human
uuuuuuuuuuuuuuuuuugcugg

SEQ ID NO: 685351 - RNA, 25 nt, Human
uuuuuuuuuuuuuuuuuuugcuggg

SEQ ID NO: 685352 - RNA, 20 nt, Human
aaauaggagcaaagugagga

SEQ ID NO: 685353 - RNA, 22 nt, Human
aaccuaaggcaaaaguacaagg

SEQ ID NO: 685354 - RNA, 19 nt, Human
aagaucccaagacacacag

SEQ ID NO: 685355 - RNA, 21 nt, Human
aagaucccaagacacacagcc

SEQ ID NO: 685356 - RNA, 23 nt, Human
aaggaaaaauaucccccucccca

SEQ ID NO: 685357 - RNA, 22 nt, Human
accacaucucuuccuaaaccag

SEQ ID NO: 685358 - RNA, 18 nt, Human
agaaagcuaaagaauuac

SEQ ID NO: 685359 - RNA, 23 nt, Human
agaaauaggagcaaagugagaga

SEQ ID NO: 685360 - RNA, 23 nt, Human
agacagaaguggagaaaggggac

SEQ ID NO: 685361 - RNA, 21 nt, Human
agacuagauauuggggaaagg

SEQ ID NO: 685362 - RNA, 21 nt, Human
agagauguacaaauacaccag

SEQ ID NO: 685363 - RNA, 20 nt, Human
agaugaggguaggaguaggg

SEQ ID NO: 685364 - RNA, 21 nt, Human
agcccucagcccuaaugacuu

SEQ ID NO: 685365 - RNA, 21 nt, Human
aggcaggagauguagaguugg

SEQ ID NO: 685366 - RNA, 23 nt, Human
aucuacuccucuccucccugcaa

SEQ ID NO: 685367 - RNA, 20 nt, Human
caaagcuucaugugcucucc

SEQ ID NO: 685368 - RNA, 23 nt, Human
caacaugaagacuauugucccuu

SEQ ID NO: 685369 - RNA, 27 nt, Human
caagacacacagccuaguaccuaagaa

SEQ ID NO: 685370 - RNA, 22 nt, Human
caagauaugggccuccccugcc

SEQ ID NO: 685371 - RNA, 24 nt, Human
caaggaggggaaauacuggguccu

SEQ ID NO: 685372 - RNA, 20 nt, Human
caauacacaguagauacuca

SEQ ID NO: 685373 - RNA, 22 nt, Human
cacaacacucuuacuuucaaag

SEQ ID NO: 685374 - RNA, 18 nt, Human
cacaauguagccacgaga

SEQ ID NO: 685375 - RNA, 20 nt, Human
cacaauguagccacgagaac

SEQ ID NO: 685376 - RNA, 21 nt, Human
cacagccuaguaccuaagaau

SEQ ID NO: 685377 - RNA, 23 nt, Human
cacagccuaguaccuaagaauuu

SEQ ID NO: 685378 - RNA, 23 nt, Human
cacauacacacuguggcaaugua

SEQ ID NO: 685379 - RNA, 25 nt, Human
cacucuuacuuucaaagagcagagg

SEQ ID NO: 685380 - RNA, 21 nt, Human
cacugucaauuucacgucccg

SEQ ID NO: 685381 - RNA, 18 nt, Human
cacuguuuagcaccugaa

SEQ ID NO: 685382 - RNA, 18 nt, Human
cagaaagaaauaggagca

SEQ ID NO: 685383 - RNA, 21 nt, Human
cagaaagaaauaggagcaaag

SEQ ID NO: 685384 - RNA, 22 nt, Human
cagaggaacauuuuauauagug

SEQ ID NO: 685385 - RNA, 27 nt, Human
cagaggaacauuuuauauagugaacac

SEQ ID NO: 685386 - RNA, 23 nt, Human
cagaguaaugguucugaacaaaa

SEQ ID NO: 685387 - RNA, 22 nt, Human
cagcuccuuaggcuccaggccu

SEQ ID NO: 685388 - RNA, 18 nt, Human
caucaggacaucaaugac

SEQ ID NO: 685389 - RNA, 18 nt, Human
ccagaaaucccaagagca

SEQ ID NO: 685390 - RNA, 23 nt, Human
ccagcagcuauccugagcugagg

SEQ ID NO: 685391 - RNA, 19 nt, Human
cccaagagcagaaagaaau

SEQ ID NO: 685392 - RNA, 19 nt, Human
cccaagagcagaaagaaau

SEQ ID NO: 685393 - RNA, 23 nt, Human
ccccugccccucagacccuacag

SEQ ID NO: 685394 - RNA, 20 nt, Human
cccucagacccuacagcucc

SEQ ID NO: 685395 - RNA, 21 nt, Human
cccuuaucuucgagugaccuu

SEQ ID NO: 685396 - RNA, 22 nt, Human
ccugaaccacaucucuuccuaa

SEQ ID NO: 685397 - RNA, 24 nt, Human
ccuuuucuuuugggaggaaaggcc

SEQ ID NO: 685398 - RNA, 24 nt, Human
ccuuuugcccuucccuuagcucca

SEQ ID NO: 685399 - RNA, 20 nt, Human
cuccccugccccucagaccc

SEQ ID NO: 685400 - RNA, 19 nt, Human
cugagccuuuugcccuucc

SEQ ID NO: 685401 - RNA, 20 nt, Human
cuuaccaggaaaccuggcuu

SEQ ID NO: 685402 - RNA, 21 nt, Human
gaaaggccaccugcacaaucc

SEQ ID NO: 685403 - RNA, 22 nt, Human
gaaccacaucucuuccuaaacc

SEQ ID NO: 685404 - RNA, 22 nt, Human
gaauuacagccaugccucccaa

SEQ ID NO: 685405 - RNA, 22 nt, Human
gagagauguacaaauacaccag

SEQ ID NO: 685406 - RNA, 18 nt, Human
gaggaaaggccaccugca

SEQ ID NO: 685407 - RNA, 21 nt, Human
gcccccauccccaucccuuau

SEQ ID NO: 685408 - RNA, 20 nt, Human
ggaaagcuguggggcuuggg

SEQ ID NO: 685409 - RNA, 21 nt, Human
guggagaaagcuaaagaauua

SEQ ID NO: 685410 - RNA, 21 nt, Human
uaaaccagaaaucccaagagc

SEQ ID NO: 685411 - RNA, 21 nt, Human
uacaauagacacaauguagcc

SEQ ID NO: 685412 - RNA, 20 nt, Human
uacagccgagcccucagccc

SEQ ID NO: 685413 - RNA, 21 nt, Human
uacagccgagcccucagcccu

SEQ ID NO: 685414 - RNA, 21 nt, Human
uaccugaaacaagauaugggc

SEQ ID NO: 685415 - RNA, 19 nt, Human
uagcaccugaaccacaucu

SEQ ID NO: 685416 - RNA, 22 nt, Human
uaggagacuucgugggguuggg

SEQ ID NO: 685417 - RNA, 22 nt, Human
uaucugagccuuuugcccuucc

SEQ ID NO: 685418 - RNA, 24 nt, Human
uaugaaaaggagggcuuguccaag

SEQ ID NO: 685419 - RNA, 21 nt, Human
ucacugucaauuucacguccc

SEQ ID NO: 685420 - RNA, 26 nt, Human
ucagacccuacagcuccuuaggcucc

SEQ ID NO: 685421 - RNA, 19 nt, Human
ucagauccaagagagcaag

SEQ ID NO: 685422 - RNA, 21 nt, Human
uccaagcuaccucugggccuu

SEQ ID NO: 685423 - RNA, 21 nt, Human
uccccagccagguacugagac

SEQ ID NO: 685424 - RNA, 29 nt, Human
ucccuuagcuccaaacaagggcagggguu

SEQ ID NO: 685425 - RNA, 18 nt, Human
ugagugggagagaaggga

SEQ ID NO: 685426 - RNA, 21 nt, Human
uggaaggaaagucccacccac

SEQ ID NO: 685427 - RNA, 23 nt, Human
ugggggcacucucagccuaagga

SEQ ID NO: 685428 - RNA, 19 nt, Human
ugucagccugggggcacuc

SEQ ID NO: 685429 - RNA, 18 nt, Human
uguggggcuuggggagcc

SEQ ID NO: 685430 - RNA, 19 nt, Human
uguggggcuuggggagccu

SEQ ID NO: 685431 - RNA, 22 nt, Human
uuacucaaaucuaaaucuacuc

SEQ ID NO: 685432 - RNA, 24 nt, Human
uucauugaucuuaagaucccaaga

SEQ ID NO: 685433 - RNA, 25 nt, Human
uuccuaaaccagaaaucccaagagc

SEQ ID NO: 685434 - RNA, 22 nt, Human
uugaucuuaagaucccaagaca

SEQ ID NO: 685435 - RNA, 23 nt, Human
uugaucuuaagaucccaagacac

SEQ ID NO: 685436 - RNA, 20 nt, Human
uuuguauuauccaauacaca

SEQ ID NO: 685437 - RNA, 23 nt, Human
uuuuuuuuuuuuuuuuuuaaaug

SEQ ID NO: 685438 - RNA, 21 nt, Human
aucuuucuacacaagugcugg

SEQ ID NO: 685439 - RNA, 20 nt, Human
cccgagacccuggagcugga

SEQ ID NO: 685440 - RNA, 22 nt, Human
ccucggcacaaagcugaagccc

SEQ ID NO: 685441 - RNA, 21 nt, Human
cgagacccuggagcuggaagg

SEQ ID NO: 685442 - RNA, 18 nt, Human
ggagacaggagcgggaac

SEQ ID NO: 685443 - RNA, 22 nt, Human
ggagcuggaaggaucaaaagug

SEQ ID NO: 685444 - RNA, 18 nt, Human
ggcacaaagcugaagccc

SEQ ID NO: 685445 - RNA, 22 nt, Human
ugccucggcacaaagcugaagc

SEQ ID NO: 685446 - RNA, 23 nt, Human
uuccaggagacaggagcgggaac

SEQ ID NO: 685447 - RNA, 22 nt, Human
aaaaacaaaacaaaacuguaua

SEQ ID NO: 685448 - RNA, 23 nt, Human
aaaaaggcagaaaacauauuuac

SEQ ID NO: 685449 - RNA, 21 nt, Human
aaaaccuacccccacaaccac

SEQ ID NO: 685450 - RNA, 25 nt, Human
aaacaaaaacaaaacaaaacuguau

SEQ ID NO: 685451 - RNA, 22 nt, Human
aaacacauccuaaagcuacaca

SEQ ID NO: 685452 - RNA, 24 nt, Human
aaagaauuauaggcugggcgaggu

SEQ ID NO: 685453 - RNA, 24 nt, Human
aaauaaaauucuccacaucacgga

SEQ ID NO: 685454 - RNA, 18 nt, Human
aaauagcccaauaaaagg

SEQ ID NO: 685455 - RNA, 23 nt, Human
aacacuuagggaaaaaaggcaga

SEQ ID NO: 685456 - RNA, 20 nt, Human
aacauggcaaaaccccgucu

SEQ ID NO: 685457 - RNA, 21 nt, Human
aacauggcaaaaccccgucuc

SEQ ID NO: 685458 - RNA, 21 nt, Human
aacuggugcuaggcuauccau

SEQ ID NO: 685459 - RNA, 20 nt, Human
aagaaaaaaacgaaguggaa

SEQ ID NO: 685460 - RNA, 21 nt, Human
aagaaaaaaacgaaguggaac

SEQ ID NO: 685461 - RNA, 22 nt, Human
aagaagaaaaaaacgaagugga

SEQ ID NO: 685462 - RNA, 23 nt, Human
aagagcaagacuccgucucaaaa

SEQ ID NO: 685463 - RNA, 19 nt, Human
aaggggaccaggaggcagg

SEQ ID NO: 685464 - RNA, 24 nt, Human
aaucgcuugaauccaggaggcaga

SEQ ID NO: 685465 - RNA, 18 nt, Human
aaugcacuccagccuggg

SEQ ID NO: 685466 - RNA, 25 nt, Human
acacucaccauacacguuauauuuc

SEQ ID NO: 685467 - RNA, 23 nt, Human
acagcaauaugcucccuggguuc

SEQ ID NO: 685468 - RNA, 24 nt, Human
accccgucucuacuaaaaguacaa

SEQ ID NO: 685469 - RNA, 18 nt, Human
accuacccccacaaccac

SEQ ID NO: 685470 - RNA, 19 nt, Human
accuacccccacaaccacc

SEQ ID NO: 685471 - RNA, 19 nt, Human
acuaaaauaaaaggcuuua

SEQ ID NO: 685472 - RNA, 22 nt, Human
acuacguguuuagcagcagagc

SEQ ID NO: 685473 - RNA, 19 nt, Human
agaaacucacacaugugcc

SEQ ID NO: 685474 - RNA, 18 nt, Human
agaacauauaaagauguc

SEQ ID NO: 685475 - RNA, 24 nt, Human
agagauugcacugagccaagauug

SEQ ID NO: 685476 - RNA, 21 nt, Human
agaucaagaagaaaugccugu

SEQ ID NO: 685477 - RNA, 18 nt, Human
agcaagacuccgucucaa

SEQ ID NO: 685478 - RNA, 21 nt, Human
agcacuuuaggaggccgaggc

SEQ ID NO: 685479 - RNA, 25 nt, Human
agccugggcgacaagagcaagacuc

SEQ ID NO: 685480 - RNA, 26 nt, Human
aggcagaaaacauauuuuuccuuagg

SEQ ID NO: 685481 - RNA, 24 nt, Human
aggcagagauugcacugagccaag

SEQ ID NO: 685482 - RNA, 23 nt, Human
aggcaggagaaucgcuugaaucc

SEQ ID NO: 685483 - RNA, 21 nt, Human
aggccgaggcgggcagauuac

SEQ ID NO: 685484 - RNA, 20 nt, Human
aggcugaggcaggagaaucg

SEQ ID NO: 685485 - RNA, 24 nt, Human
aggcugaggcaggagaaucgcuug

SEQ ID NO: 685486 - RNA, 20 nt, Human
agggagguaaggggaccagg

SEQ ID NO: 685487 - RNA, 22 nt, Human
agggauugguaaacaaaaacaa

SEQ ID NO: 685488 - RNA, 18 nt, Human
agguaaggggaccaggag

SEQ ID NO: 685489 - RNA, 24 nt, Human
aguaaccuaucacauuccuccaua

SEQ ID NO: 685490 - RNA, 26 nt, Human
auaguccuugauugcuccauuuguuu

SEQ ID NO: 685491 - RNA, 19 nt, Human
augccuguaauccuagcac

SEQ ID NO: 685492 - RNA, 19 nt, Human
auguccugcucuuauguuc

SEQ ID NO: 685493 - RNA, 24 nt, Human
auuaccuaaagucaggaguuugag

SEQ ID NO: 685494 - RNA, 21 nt, Human
auugcuccauuuguuucuggc

SEQ ID NO: 685495 - RNA, 24 nt, Human
auugugccaaugcacuccagccug

SEQ ID NO: 685496 - RNA, 20 nt, Human
auuuaaaaaacacacaaugc

SEQ ID NO: 685497 - RNA, 18 nt, Human
caaaacaaaacuguauaa

SEQ ID NO: 685498 - RNA, 22 nt, Human
caaaacaaaacuguauaaaaug

SEQ ID NO: 685499 - RNA, 23 nt, Human
caaaacaaaugcuccuuuguuua

SEQ ID NO: 685500 - RNA, 23 nt, Human
caaaacagcauugaccuuaauau

SEQ ID NO: 685501 - RNA, 23 nt, Human
caaaauaacacaacauuaaaaaa

SEQ ID NO: 685502 - RNA, 22 nt, Human
caaacaucacacucuauggcaa

SEQ ID NO: 685503 - RNA, 20 nt, Human
caaaugcaaaucccaauuca

SEQ ID NO: 685504 - RNA, 24 nt, Human
caacauggcaaaaccccgucucua

SEQ ID NO: 685505 - RNA, 19 nt, Human
caagaaacaucugcauaca

SEQ ID NO: 685506 - RNA, 19 nt, Human
caaugcacuccagccuggg

SEQ ID NO: 685507 - RNA, 22 nt, Human
caaugcacuccagccugggcga

SEQ ID NO: 685508 - RNA, 23 nt, Human
caaugcacuccagccugggcgac

SEQ ID NO: 685509 - RNA, 24 nt, Human
caaugcacuccagccugggcgaca

SEQ ID NO: 685510 - RNA, 22 nt, Human
cacagggggugaagguggaggg

SEQ ID NO: 685511 - RNA, 22 nt, Human
cacagugagaaauauauuucac

SEQ ID NO: 685512 - RNA, 18 nt, Human
caccaaagcaacuuacuu

SEQ ID NO: 685513 - RNA, 21 nt, Human
caccuguaaucccagcuacuc

SEQ ID NO: 685514 - RNA, 24 nt, Human
caccuguaaucccagcuacucagg

SEQ ID NO: 685515 - RNA, 19 nt, Human
cacguaacaccgcuuauau

SEQ ID NO: 685516 - RNA, 18 nt, Human
cacguuauauuuccccau

SEQ ID NO: 685517 - RNA, 22 nt, Human
cacuauacacaaauguagcucu

SEQ ID NO: 685518 - RNA, 24 nt, Human
cacuccagccugggcgacaagagc

SEQ ID NO: 685519 - RNA, 24 nt, Human
cagauuaccuaaagucaggaguuu

SEQ ID NO: 685520 - RNA, 24 nt, Human
cagcuacucaggaggcugaggcag

SEQ ID NO: 685521 - RNA, 25 nt, Human
caggucaagaaacaucugcauacaa

SEQ ID NO: 685522 - RNA, 23 nt, Human
cauacccuuuucccuauaccuaa

SEQ ID NO: 685523 - RNA, 20 nt, Human
cauauuccacugaugaaaca

SEQ ID NO: 685524 - RNA, 21 nt, Human
caucacggacuaaaaccauuu

SEQ ID NO: 685525 - RNA, 23 nt, Human
caugccuguaauccuagcacuuu

SEQ ID NO: 685526 - RNA, 20 nt, Human
cauuacuaguaagcaacagg

SEQ ID NO: 685527 - RNA, 21 nt, Human
ccaaugcacuccagccugggc

SEQ ID NO: 685528 - RNA, 22 nt, Human
ccaaugcacuccagccugggcg

SEQ ID NO: 685529 - RNA, 23 nt, Human
ccaaugcacuccagccugggcga

SEQ ID NO: 685530 - RNA, 24 nt, Human
ccaaugcacuccagccugggcgac

SEQ ID NO: 685531 - RNA, 21 nt, Human
ccacugaugaaacaaaugcaa

SEQ ID NO: 685532 - RNA, 25 nt, Human
ccagacaguccgauucccaaacagg

SEQ ID NO: 685533 - RNA, 18 nt, Human
ccauaccucacaucauac

SEQ ID NO: 685534 - RNA, 18 nt, Human
cccacaaccaccaugcug

SEQ ID NO: 685535 - RNA, 19 nt, Human
ccgauucccaaacaggcau

SEQ ID NO: 685536 - RNA, 18 nt, Human
ccuaaagcuacacacauu

SEQ ID NO: 685537 - RNA, 22 nt, Human
ccuaaagucaggaguuugagac

SEQ ID NO: 685538 - RNA, 23 nt, Human
ccuaaagucaggaguuugagacc

SEQ ID NO: 685539 - RNA, 22 nt, Human
ccucacaucauacacaaaagca

SEQ ID NO: 685540 - RNA, 21 nt, Human
ccucugagaaaagcgggggga

SEQ ID NO: 685541 - RNA, 23 nt, Human
ccuggccaacauggcaaaacccc

SEQ ID NO: 685542 - RNA, 24 nt, Human
ccuggccaacauggcaaaaccccg

SEQ ID NO: 685543 - RNA, 23 nt, Human
ccugggcgacaagagcaagacuc

SEQ ID NO: 685544 - RNA, 21 nt, Human
ccuguaaucccagcuacucag

SEQ ID NO: 685545 - RNA, 21 nt, Human
cgacccgcuaacgccggugcc

SEQ ID NO: 685546 - RNA, 18 nt, Human
cgauucccaaacaggcau

SEQ ID NO: 685547 - RNA, 19 nt, Human
cgcuugaauccaggaggca

SEQ ID NO: 685548 - RNA, 23 nt, Human
cggcaggugccggcgcacacucc

SEQ ID NO: 685549 - RNA, 24 nt, Human
cgggcagauuaccuaaagucagga

SEQ ID NO: 685550 - RNA, 23 nt, Human
cgggucggcgacccgcuaacgcc

SEQ ID NO: 685551 - RNA, 18 nt, Human
cuagaggacuaucuuuug

SEQ ID NO: 685552 - RNA, 21 nt, Human
cuagauagauagagcagacca

SEQ ID NO: 685553 - RNA, 21 nt, Human
cucacuauagacucuuuuaaa

SEQ ID NO: 685554 - RNA, 18 nt, Human
cucagacccuugucccgg

SEQ ID NO: 685555 - RNA, 19 nt, Human
cucaugauccugauuuugu

SEQ ID NO: 685556 - RNA, 24 nt, Human
cucaugccuguaauccuagcacuu

SEQ ID NO: 685557 - RNA, 19 nt, Human
cuguaacugcuucuuuuca

SEQ ID NO: 685558 - RNA, 21 nt, Human
cuguaaucccagcuacucagg

SEQ ID NO: 685559 - RNA, 24 nt, Human
gaaauucucucaugacccacgauu

SEQ ID NO: 685560 - RNA, 21 nt, Human
gacccgcuaacgccggugccu

SEQ ID NO: 685561 - RNA, 23 nt, Human
gacgugguggcgggcaccuguaa

SEQ ID NO: 685562 - RNA, 23 nt, Human
gagaaucgcuugaauccaggagg

SEQ ID NO: 685563 - RNA, 22 nt, Human
gaggaggagaaagcugagucag

SEQ ID NO: 685564 - RNA, 25 nt, Human
gaggcgggcagauuaccuaaaguca

SEQ ID NO: 685565 - RNA, 26 nt, Human
gaucauagucaaguuuuccaauucgg

SEQ ID NO: 685566 - RNA, 24 nt, Human
gauuaccuaaagucaggaguuuga

SEQ ID NO: 685567 - RNA, 23 nt, Human
gauugguaaacaaaaacaaaaca

SEQ ID NO: 685568 - RNA, 20 nt, Human
gcaaaaaagacuaaaauaaa

SEQ ID NO: 685569 - RNA, 23 nt, Human
gcacacucaccauacacguuaau

SEQ ID NO: 685570 - RNA, 25 nt, Human
gcagaaaacauauuuacaauuuuag

SEQ ID NO: 685571 - RNA, 18 nt, Human
gcagauacuuaacauuac

SEQ ID NO: 685572 - RNA, 21 nt, Human
gccaacauggcaaaaccccgu

SEQ ID NO: 685573 - RNA, 22 nt, Human
gccaaugcacuccagccugggc

SEQ ID NO: 685574 - RNA, 18 nt, Human
gcgcagugucgcggacgc

SEQ ID NO: 685575 - RNA, 20 nt, Human
gcgggcaccuguaaucccag

SEQ ID NO: 685576 - RNA, 23 nt, Human
ggaaaaaaacucuuaacagcaaa

SEQ ID NO: 685577 - RNA, 19 nt, Human
ggaccaggaggcaggaagg

SEQ ID NO: 685578 - RNA, 19 nt, Human
ggcaccuguaaucccagcu

SEQ ID NO: 685579 - RNA, 19 nt, Human
ggccucugauguuucauau

SEQ ID NO: 685580 - RNA, 19 nt, Human
gggcaugaggaggagaaag

SEQ ID NO: 685581 - RNA, 24 nt, Human
gggcgagguggcucaugccuguaa

SEQ ID NO: 685582 - RNA, 19 nt, Human
gggucucagacccuugucc

SEQ ID NO: 685583 - RNA, 24 nt, Human
gguggcgggcaccuguaaucccag

SEQ ID NO: 685584 - RNA, 21 nt, Human
gguggcucaugccuguaaucc

SEQ ID NO: 685585 - RNA, 24 nt, Human
gguggcucaugccuguaauccuag

SEQ ID NO: 685586 - RNA, 21 nt, Human
guccccgaugacgugcuucag

SEQ ID NO: 685587 - RNA, 18 nt, Human
gucucagacccuuguccc

SEQ ID NO: 685588 - RNA, 22 nt, Human
gugaagaucaaaacuuugaaca

SEQ ID NO: 685589 - RNA, 21 nt, Human
guucguucucccuucccccaa

SEQ ID NO: 685590 - RNA, 22 nt, Human
uaaaaccuacccccacaaccac

SEQ ID NO: 685591 - RNA, 20 nt, Human
uaaaaugagugaaucagguc

SEQ ID NO: 685592 - RNA, 19 nt, Human
uaaaaugcagaucaagaag

SEQ ID NO: 685593 - RNA, 22 nt, Human
uaaacaaaaacaaaacaaaacu

SEQ ID NO: 685594 - RNA, 24 nt, Human
uaaauguccagacauuaaggaaug

SEQ ID NO: 685595 - RNA, 21 nt, Human
uaacuacaguagcaagaagaa

SEQ ID NO: 685596 - RNA, 23 nt, Human
uaacugcuucuuuucaauaauau

SEQ ID NO: 685597 - RNA, 19 nt, Human
uaacugguggugacugcug

SEQ ID NO: 685598 - RNA, 23 nt, Human
uaagcaagcuaggacugaagggg

SEQ ID NO: 685599 - RNA, 19 nt, Human
uacaaaucaauagaaauag

SEQ ID NO: 685600 - RNA, 20 nt, Human
uacacguaauggaggaacac

SEQ ID NO: 685601 - RNA, 23 nt, Human
uaccuaaagucaggaguuugaga

SEQ ID NO: 685602 - RNA, 21 nt, Human
uacuuaacauuacuaguaagc

SEQ ID NO: 685603 - RNA, 20 nt, Human
uagaacauauaaagaugucu

SEQ ID NO: 685604 - RNA, 24 nt, Human
uagcacuuuaggaggccgaggcgg

SEQ ID NO: 685605 - RNA, 18 nt, Human
uagccggacgugguggcg

SEQ ID NO: 685606 - RNA, 22 nt, Human
uaggaggccgaggcgggcagau

SEQ ID NO: 685607 - RNA, 25 nt, Human
uauaaaugaugaaaaacuggugcua

SEQ ID NO: 685608 - RNA, 27 nt, Human
uauacccgaagacguacuggaggcgcu

SEQ ID NO: 685609 - RNA, 20 nt, Human
uauguauauauacauguaua

SEQ ID NO: 685610 - RNA, 19 nt, Human
ucaaaaaggagugagagca

SEQ ID NO: 685611 - RNA, 25 nt, Human
ucaaaaauacaguauuuauuguaau

SEQ ID NO: 685612 - RNA, 18 nt, Human
ucacaucauacacaaaag

SEQ ID NO: 685613 - RNA, 21 nt, Human
uccagaccaaggagaauaaaa

SEQ ID NO: 685614 - RNA, 19 nt, Human
uccagccugggcgacaaga

SEQ ID NO: 685615 - RNA, 18 nt, Human
uccuugauugcuccauuu

SEQ ID NO: 685616 - RNA, 18 nt, Human
ucggcauccuccuccaca

SEQ ID NO: 685617 - RNA, 23 nt, Human
ucguucucccuucccccaauccu

SEQ ID NO: 685618 - RNA, 18 nt, Human
ucucaaaaagaaaaaaag

SEQ ID NO: 685619 - RNA, 21 nt, Human
ucucuaagcaagcuaggacug

SEQ ID NO: 685620 - RNA, 21 nt, Human
ucucuacuaaaaguacaaaaa

SEQ ID NO: 685621 - RNA, 24 nt, Human
ugaaaaugugggagaagguauuug

SEQ ID NO: 685622 - RNA, 19 nt, Human
ugaaacaacuucuacaaaa

SEQ ID NO: 685623 - RNA, 22 nt, Human
ugaccuuaauauguagcaaaaa

SEQ ID NO: 685624 - RNA, 23 nt, Human
ugagaaaagcggggggaauuuug

SEQ ID NO: 685625 - RNA, 21 nt, Human
ugagaccacccuggccaacau

SEQ ID NO: 685626 - RNA, 21 nt, Human
ugagauucagagagcuuaaaa

SEQ ID NO: 685627 - RNA, 22 nt, Human
ugagccaagauugugccaaugc

SEQ ID NO: 685628 - RNA, 20 nt, Human
ugaggcaggagaaucgcuug

SEQ ID NO: 685629 - RNA, 24 nt, Human
ugaggcaggagaaucgcuugaauc

SEQ ID NO: 685630 - RNA, 25 nt, Human
ugaggcaggagaaucgcuugaaucc

SEQ ID NO: 685631 - RNA, 22 nt, Human
ugagugucauaaaucagugugg

SEQ ID NO: 685632 - RNA, 19 nt, Human
ugauguggccucugauguu

SEQ ID NO: 685633 - RNA, 23 nt, Human
ugcagcaccucccccuaaaacaa

SEQ ID NO: 685634 - RNA, 26 nt, Human
ugcauacaaacuaaggaaccuaugua

SEQ ID NO: 685635 - RNA, 28 nt, Human
ugccagacagccccaagacccauacccu

SEQ ID NO: 685636 - RNA, 23 nt, Human
ugccggcgcacacuccgguaggc

SEQ ID NO: 685637 - RNA, 19 nt, Human
ugccuggaggcgcgcgcag

SEQ ID NO: 685638 - RNA, 22 nt, Human
ugccuguaauccuagcacuuua

SEQ ID NO: 685639 - RNA, 24 nt, Human
ugccuguaauccuagcacuuuagg

SEQ ID NO: 685640 - RNA, 22 nt, Human
uggcgggcaccuguaaucccag

SEQ ID NO: 685641 - RNA, 19 nt, Human
uggcucaugccuguaaucc

SEQ ID NO: 685642 - RNA, 24 nt, Human
uggcucaugccuguaauccuagca

SEQ ID NO: 685643 - RNA, 21 nt, Human
ugggagaagguauuugcacua

SEQ ID NO: 685644 - RNA, 19 nt, Human
uggggagggugagaaggaa

SEQ ID NO: 685645 - RNA, 21 nt, Human
ugguaaacaaaaacaaaacaa

SEQ ID NO: 685646 - RNA, 24 nt, Human
ugguggcgggcaccuguaauccca

SEQ ID NO: 685647 - RNA, 18 nt, Human
ugugaagaucaaaacuuu

SEQ ID NO: 685648 - RNA, 22 nt, Human
uuaaaaaacacacaaugcuuaa

SEQ ID NO: 685649 - RNA, 22 nt, Human
uuauaccaaaaagaguaaaauc

SEQ ID NO: 685650 - RNA, 24 nt, Human
uugaagcguuuacagcaauaugcu

SEQ ID NO: 685651 - RNA, 22 nt, Human
uugcacugagccaagauugugc

SEQ ID NO: 685652 - RNA, 22 nt, Human
uugccagacagccccaagaccc

SEQ ID NO: 685653 - RNA, 23 nt, Human
uuuaaaaaacacacaaugcuuaa

SEQ ID NO: 685654 - RNA, 21 nt, Human
uuuauaggggaaaaaaacucu

SEQ ID NO: 685655 - RNA, 24 nt, Human
uuucacacuguaccagaauggcug

SEQ ID NO: 685656 - RNA, 24 nt, Human
uuuuuuuuuuuuuuuuuuaauuuu

SEQ ID NO: 685657 - RNA, 23 nt, Human
aaaauuaaagugugucucaaaac

SEQ ID NO: 685658 - RNA, 20 nt, Human
acucaauacaaauuugcccc

SEQ ID NO: 685659 - RNA, 23 nt, Human
caaguuaacauaaaauuaaagug

SEQ ID NO: 685660 - RNA, 21 nt, Human
ugcuugcaauacuauuucaca

SEQ ID NO: 685661 - RNA, 18 nt, Human
ugucucaaaaccagacag

SEQ ID NO: 685662 - RNA, 25 nt, Human
agaggcagcgcucuccgaggagucu

SEQ ID NO: 685663 - RNA, 21 nt, Human
agcccgccaacccagaggcag

SEQ ID NO: 685664 - RNA, 22 nt, Human
cagcgcucuccgaggagucuuc

SEQ ID NO: 685665 - RNA, 20 nt, Human
ccaacccagaggcagcgcuc

SEQ ID NO: 685666 - RNA, 19 nt, Human
cccgcgagacugccguaag

SEQ ID NO: 685667 - RNA, 19 nt, Human
ccugccagcccgccaaccc

SEQ ID NO: 685668 - RNA, 18 nt, Human
gcuacagccugccagccc

SEQ ID NO: 685669 - RNA, 24 nt, Human
uaaagcaaauaacuggacauaauc

SEQ ID NO: 685670 - RNA, 18 nt, Human
ucuucuaugacagcccca

SEQ ID NO: 685671 - RNA, 23 nt, Human
uggacauaaucuuaaaggauucc

SEQ ID NO: 685672 - RNA, 21 nt, Human
uuaaagcaaauaacuggacau

SEQ ID NO: 685673 - RNA, 21 nt, Human
uuaccgcucgaacguucaaau

SEQ ID NO: 685674 - RNA, 22 nt, Human
uuugacaaggguaacuucuucu

SEQ ID NO: 685675 - RNA, 23 nt, Human
uuuuucucugauuuugacaaggg

SEQ ID NO: 685676 - RNA, 18 nt, Human
uuuuuuuuuuuuucucug

SEQ ID NO: 685677 - RNA, 25 nt, Human
uuuuuuuuuuuuuuuucucugauuu

SEQ ID NO: 685678 - RNA, 26 nt, Human
uuuuuuuuuuuuuuuucucugauuuu

SEQ ID NO: 685679 - RNA, 18 nt, Human
accuccaaugaacagcug

SEQ ID NO: 685680 - RNA, 21 nt, Human
agauuccugcccgaacagcuu

SEQ ID NO: 685681 - RNA, 25 nt, Human
augaaaccugugcaccauccaguga

SEQ ID NO: 685682 - RNA, 25 nt, Human
ccauccagugacaccuccaaugaac

SEQ ID NO: 685683 - RNA, 20 nt, Human
ccuccaaugaacagcugggu

SEQ ID NO: 685684 - RNA, 24 nt, Human
ccucccacagcuguugcagccaac

SEQ ID NO: 685685 - RNA, 20 nt, Human
cgaacagcuuacgccaccau

SEQ ID NO: 685686 - RNA, 24 nt, Human
cugcugaagguccagauuccugcc

SEQ ID NO: 685687 - RNA, 24 nt, Human
gccaacuuuccaaccuucuggaau

SEQ ID NO: 685688 - RNA, 18 nt, Human
ucccacagcuguugcagc

SEQ ID NO: 685689 - RNA, 19 nt, Human
ucccacagcuguugcagcc

SEQ ID NO: 685690 - RNA, 20 nt, Human
uccuucuccacucguugcca

SEQ ID NO: 685691 - RNA, 30 nt, Human
uucuccacucguugccagucaacuuugauu

SEQ ID NO: 685692 - RNA, 19 nt, Human
aaaaaaaugaaacaaaaac

SEQ ID NO: 685693 - RNA, 22 nt, Human
aaaaaggcacauucuccuaacc

SEQ ID NO: 685694 - RNA, 18 nt, Human
aaaacaaaaacaaaaaca

SEQ ID NO: 685695 - RNA, 23 nt, Human
aaaaggucuuucuucauaaauua

SEQ ID NO: 685696 - RNA, 23 nt, Human
aaacagaaaagcuaacaaucuga

SEQ ID NO: 685697 - RNA, 23 nt, Human
aaagaaauaaaacagaaaagcua

SEQ ID NO: 685698 - RNA, 19 nt, Human
aacacauuucucuuaugac

SEQ ID NO: 685699 - RNA, 20 nt, Human
aaccggacaaauaaguuacc

SEQ ID NO: 685700 - RNA, 24 nt, Human
aaggcacauucuccuaaccgcaaa

SEQ ID NO: 685701 - RNA, 18 nt, Human
aauaccacaacuuuaaaa

SEQ ID NO: 685702 - RNA, 18 nt, Human
acaaaaacaaaaacaaaa

SEQ ID NO: 685703 - RNA, 21 nt, Human
aggauuuggucuguggaaaca

SEQ ID NO: 685704 - RNA, 18 nt, Human
agggagcauagaaccaau

SEQ ID NO: 685705 - RNA, 22 nt, Human
agggugcugcguucagucugga

SEQ ID NO: 685706 - RNA, 24 nt, Human
agucauuuuuauuuuucaaauuua

SEQ ID NO: 685707 - RNA, 23 nt, Human
auaaaacagaaaagcuaacaauc

SEQ ID NO: 685708 - RNA, 24 nt, Human
caaaaauaaagagcacagaagaug

SEQ ID NO: 685709 - RNA, 22 nt, Human
caaagcaguaauauuccaggga

SEQ ID NO: 685710 - RNA, 19 nt, Human
caaguccuaggaaagaaaa

SEQ ID NO: 685711 - RNA, 22 nt, Human
cagcacaaaagaaaauagacuc

SEQ ID NO: 685712 - RNA, 22 nt, Human
cagggagggccagcaaccuguc

SEQ ID NO: 685713 - RNA, 24 nt, Human
cauaauucucauucuaaagcacua

SEQ ID NO: 685714 - RNA, 18 nt, Human
ccagacgaguauggcacu

SEQ ID NO: 685715 - RNA, 20 nt, Human
ccagcacaaaagaaaauaga

SEQ ID NO: 685716 - RNA, 21 nt, Human
cccagcacaaaagaaaauaga

SEQ ID NO: 685717 - RNA, 18 nt, Human
ccggcaaaaauaaagagc

SEQ ID NO: 685718 - RNA, 20 nt, Human
ccuaaccgcaaacugguccg

SEQ ID NO: 685719 - RNA, 25 nt, Human
cuaaccgcaaacugguccggcaaaa

SEQ ID NO: 685720 - RNA, 20 nt, Human
cuagguacacagagggugcu

SEQ ID NO: 685721 - RNA, 25 nt, Human
cucaaaagaaauaaaacagaaaagc

SEQ ID NO: 685722 - RNA, 20 nt, Human
cuccuaaccgcaaacugguc

SEQ ID NO: 685723 - RNA, 21 nt, Human
cugaccagacaaguacacagu

SEQ ID NO: 685724 - RNA, 27 nt, Human
cuuagcccuagcuccugagccgguucc

SEQ ID NO: 685725 - RNA, 24 nt, Human
gaaacaaaaacaaaaacaaaaaca

SEQ ID NO: 685726 - RNA, 23 nt, Human
gaaccaauaauaccacaacuuua

SEQ ID NO: 685727 - RNA, 21 nt, Human
gacaaguacacaguuuuggaa

SEQ ID NO: 685728 - RNA, 20 nt, Human
gcacaaaagaaaauagacuc

SEQ ID NO: 685729 - RNA, 24 nt, Human
gcagauuuccccuccccucuaacc

SEQ ID NO: 685730 - RNA, 23 nt, Human
ggaaggacaaaacgguuucgcga

SEQ ID NO: 685731 - RNA, 20 nt, Human
ggcaaaaauaaagagcacag

SEQ ID NO: 685732 - RNA, 21 nt, Human
ggcaaaaauaaagagcacaga

SEQ ID NO: 685733 - RNA, 28 nt, Human
uaaaaaaaugaaacaaaaacaaaaacaa

SEQ ID NO: 685734 - RNA, 24 nt, Human
uaacaaucugaucaaauguacagu

SEQ ID NO: 685735 - RNA, 24 nt, Human
uaacuaaugcaaaaauaucaagua

SEQ ID NO: 685736 - RNA, 23 nt, Human
uacaaaaggucuuucuucauaaa

SEQ ID NO: 685737 - RNA, 18 nt, Human
uacacuucucagagcagc

SEQ ID NO: 685738 - RNA, 26 nt, Human
uaccacaacuuuaaaaaaaugaaaca

SEQ ID NO: 685739 - RNA, 20 nt, Human
uauaaaggaaggacaaaacg

SEQ ID NO: 685740 - RNA, 27 nt, Human
uauaaaggaaggacaaaacgguuucgc

SEQ ID NO: 685741 - RNA, 26 nt, Human
ucaaauguacaguucaaaaaugucuu

SEQ ID NO: 685742 - RNA, 25 nt, Human
ucacaaagcaguaauauuccaggga

SEQ ID NO: 685743 - RNA, 18 nt, Human
ucccaaaucuuacccaga

SEQ ID NO: 685744 - RNA, 19 nt, Human
ucccaaaucuuacccagac

SEQ ID NO: 685745 - RNA, 24 nt, Human
uccggcaaaaauaaagagcacaga

SEQ ID NO: 685746 - RNA, 22 nt, Human
ucuaucaucaaauacaagcauu

SEQ ID NO: 685747 - RNA, 24 nt, Human
ucuuaugacuauguaauuuucacu

SEQ ID NO: 685748 - RNA, 18 nt, Human
ucuugaaccggacaaaua

SEQ ID NO: 685749 - RNA, 20 nt, Human
ugaaacaaaaacaaaaacaa

SEQ ID NO: 685750 - RNA, 24 nt, Human
ugaaacaaaaacaaaaacaaaaac

SEQ ID NO: 685751 - RNA, 29 nt, Human
ugaaacaaaaacaaaaacaaaaacacauu

SEQ ID NO: 685752 - RNA, 23 nt, Human
ugaaacuaugaaaugucacugac

SEQ ID NO: 685753 - RNA, 20 nt, Human
ugaaccggacaaauaaguua

SEQ ID NO: 685754 - RNA, 27 nt, Human
ugaagauaaauccuuacuuuuagcuuu

SEQ ID NO: 685755 - RNA, 21 nt, Human
ugagacaaguuggagcuacug

SEQ ID NO: 685756 - RNA, 22 nt, Human
ugagguagauaacugaucaacu

SEQ ID NO: 685757 - RNA, 24 nt, Human
uggaagacaacuuaauuuaccauu

SEQ ID NO: 685758 - RNA, 24 nt, Human
uguggaaacagggagggccagcaa

SEQ ID NO: 685759 - RNA, 22 nt, Human
uguggcacuaguaaaacaaaaa

SEQ ID NO: 685760 - RNA, 18 nt, Human
uuccccuccccucuaacc

SEQ ID NO: 685761 - RNA, 24 nt, Human
uucuccuaaccgcaaacugguccg

SEQ ID NO: 685762 - RNA, 24 nt, Human
uuucgcgauugguaauggccgucg

SEQ ID NO: 685763 - RNA, 23 nt, Human
uuuuauguacagagguuauguuu

SEQ ID NO: 685764 - RNA, 20 nt, Human
uuuuucaaauuuaccuaaua

SEQ ID NO: 685765 - RNA, 23 nt, Human
aggaugacaucaccucuucugcu

SEQ ID NO: 685766 - RNA, 23 nt, Human
agucuguuuccagagagaaugaa

SEQ ID NO: 685767 - RNA, 19 nt, Human
auacuuuccuuuuucccuu

SEQ ID NO: 685768 - RNA, 21 nt, Human
aucaguuaccccucacuguag

SEQ ID NO: 685769 - RNA, 18 nt, Human
augcacaaaaaugacauu

SEQ ID NO: 685770 - RNA, 23 nt, Human
caccccaguucacuuuggguuuc

SEQ ID NO: 685771 - RNA, 19 nt, Human
caccucuucugcucccaaa

SEQ ID NO: 685772 - RNA, 23 nt, Human
caccugaucaguuaccccucacu

SEQ ID NO: 685773 - RNA, 24 nt, Human
cauaacaaacacaucccaugguca

SEQ ID NO: 685774 - RNA, 26 nt, Human
cccacugaauccaguuucccaacacu

SEQ ID NO: 685775 - RNA, 18 nt, Human
ccucacuguaggaugcac

SEQ ID NO: 685776 - RNA, 26 nt, Human
ccucacuguaggaugcacaaaaauug

SEQ ID NO: 685777 - RNA, 18 nt, Human
gaauccaguuucccaaca

SEQ ID NO: 685778 - RNA, 23 nt, Human
ggucagaugaacuacccaguuuc

SEQ ID NO: 685779 - RNA, 22 nt, Human
uaacaaacacaucccaugguca

SEQ ID NO: 685780 - RNA, 25 nt, Human
uaacaaacacaucccauggucagau

SEQ ID NO: 685781 - RNA, 24 nt, Human
uacuuuccuuuuucccuuccccca

SEQ ID NO: 685782 - RNA, 20 nt, Human
uauaaaguauacagagcauu

SEQ ID NO: 685783 - RNA, 22 nt, Human
uauagaaagaucuguaaaaaaa

SEQ ID NO: 685784 - RNA, 22 nt, Human
ucccauggucagaugaacuacc

SEQ ID NO: 685785 - RNA, 18 nt, Human
uggaagaaaugcaaagca

SEQ ID NO: 685786 - RNA, 21 nt, Human
uguuauagacaccugaucagu

SEQ ID NO: 685787 - RNA, 24 nt, Human
uucaaacagcuuuacuuucauaga

SEQ ID NO: 685788 - RNA, 22 nt, Human
uuucccaggaugacaucaccuc

SEQ ID NO: 685789 - RNA, 24 nt, Human
uuuccuuuuucccuucccccaccc

SEQ ID NO: 685790 - RNA, 26 nt, Human
uuugguccaaagaaaccugagucugu

SEQ ID NO: 685791 - RNA, 20 nt, Human
aagcccgcccagcacucucc

SEQ ID NO: 685792 - RNA, 18 nt, Human
aaugucccaaccugauga

SEQ ID NO: 685793 - RNA, 25 nt, Human
acagaacaaugggaaagaggaccgg

SEQ ID NO: 685794 - RNA, 18 nt, Human
agagaaaccaaacuggga

SEQ ID NO: 685795 - RNA, 19 nt, Human
cacuagacagugcccuccc

SEQ ID NO: 685796 - RNA, 24 nt, Human
cagcacucucccuuucugcccucc

SEQ ID NO: 685797 - RNA, 20 nt, Human
cagcguaaaggagaaguggg

SEQ ID NO: 685798 - RNA, 25 nt, Human
ccagcacucucccuuucugcccucc

SEQ ID NO: 685799 - RNA, 18 nt, Human
ccccacuuaucccccucc

SEQ ID NO: 685800 - RNA, 20 nt, Human
ccccacuuaucccccuccuc

SEQ ID NO: 685801 - RNA, 24 nt, Human
ccccacuuaucccccuccucgcga

SEQ ID NO: 685802 - RNA, 20 nt, Human
cccgcccagcacucucccuu

SEQ ID NO: 685803 - RNA, 21 nt, Human
ccucccggaagcggauuccca

SEQ ID NO: 685804 - RNA, 20 nt, Human
ccuugagacaauaaggugga

SEQ ID NO: 685805 - RNA, 21 nt, Human
cucccggaagcggauucccag

SEQ ID NO: 685806 - RNA, 23 nt, Human
cucccuuucugcccucccucacc

SEQ ID NO: 685807 - RNA, 23 nt, Human
cuccgacuaagcccgcccagcac

SEQ ID NO: 685808 - RNA, 23 nt, Human
cugacaccagacuucuccccacu

SEQ ID NO: 685809 - RNA, 23 nt, Human
cugugcacuagacagugcccucc

SEQ ID NO: 685810 - RNA, 23 nt, Human
cuuaucccccuccucgcgaugca

SEQ ID NO: 685811 - RNA, 19 nt, Human
gaaagaggacugggagagg

SEQ ID NO: 685812 - RNA, 21 nt, Human
gagaaguggggcagcugcagg

SEQ ID NO: 685813 - RNA, 23 nt, Human
gagcaacagaacaaugggaaaga

SEQ ID NO: 685814 - RNA, 23 nt, Human
gagcugagccuauucacagugcc

SEQ ID NO: 685815 - RNA, 24 nt, Human
gcaacagaacaaugggaaagagga

SEQ ID NO: 685816 - RNA, 21 nt, Human
ggaaagaggacugggagagga

SEQ ID NO: 685817 - RNA, 22 nt, Human
gggaaagaggacugggagagga

SEQ ID NO: 685818 - RNA, 24 nt, Human
gguggagcaacagaacaaugggaa

SEQ ID NO: 685819 - RNA, 20 nt, Human
uacggccuugagacaauaag

SEQ ID NO: 685820 - RNA, 18 nt, Human
uaggaggcgaaggccagg

SEQ ID NO: 685821 - RNA, 19 nt, Human
ucacagugccuaaccugga

SEQ ID NO: 685822 - RNA, 20 nt, Human
ucccaaccugaugagauuac

SEQ ID NO: 685823 - RNA, 27 nt, Human
ucccaguccucaaucuccgacuaagcc

SEQ ID NO: 685824 - RNA, 18 nt, Human
uccucgcgaugcagaggu

SEQ ID NO: 685825 - RNA, 22 nt, Human
ucucccuuucugcccucccuca

SEQ ID NO: 685826 - RNA, 18 nt, Human
ucuccgacuaagcccgcc

SEQ ID NO: 685827 - RNA, 19 nt, Human
ugacaccagacuucucccc

SEQ ID NO: 685828 - RNA, 26 nt, Human
ugagacaauaagguggagcaacagaa

SEQ ID NO: 685829 - RNA, 24 nt, Human
uggagcaacagaacaaugggaaag

SEQ ID NO: 685830 - RNA, 19 nt, Human
ugggagaggaaucuaagaa

SEQ ID NO: 685831 - RNA, 22 nt, Human
aauagcuucaguaaaaaaacca

SEQ ID NO: 685832 - RNA, 22 nt, Human
acaaaucuucauaaccaguuac

SEQ ID NO: 685833 - RNA, 21 nt, Human
cuggaaauacagccagagaau

SEQ ID NO: 685834 - RNA, 21 nt, Human
ugacaaaucuucauaaccagu

SEQ ID NO: 685835 - RNA, 24 nt, Human
uuuggaucuauaauucagcaaaua

SEQ ID NO: 685836 - RNA, 21 nt, Human
aaacaaacaaacaacaacaac

SEQ ID NO: 685837 - RNA, 22 nt, Human
aaacaacaacaacaaaaaaccc

SEQ ID NO: 685838 - RNA, 20 nt, Human
aaacaggcagugcaugagca

SEQ ID NO: 685839 - RNA, 24 nt, Human
aaacuggucucuauucgugacaca

SEQ ID NO: 685840 - RNA, 23 nt, Human
aaacuggucucuauucuaucuca

SEQ ID NO: 685841 - RNA, 20 nt, Human
aacaaacaaacaacaacaac

SEQ ID NO: 685842 - RNA, 25 nt, Human
aacaaacaaacaacaacaacaaaaa

SEQ ID NO: 685843 - RNA, 25 nt, Human
aacaaacaaacaacaacaacaaaaa

SEQ ID NO: 685844 - RNA, 20 nt, Human
aacaacaaaaaacccugucu

SEQ ID NO: 685845 - RNA, 21 nt, Human
aacaacaaaaaacccugucuc

SEQ ID NO: 685846 - RNA, 22 nt, Human
aacaacaacaacaaaaaacccu

SEQ ID NO: 685847 - RNA, 19 nt, Human
acaacaacaacaaaaaacc

SEQ ID NO: 685848 - RNA, 18 nt, Human
acuaaguguucauauaaa

SEQ ID NO: 685849 - RNA, 19 nt, Human
aggcagugcaugagcacug

SEQ ID NO: 685850 - RNA, 19 nt, Human
aucagguuuaaaaaauacu

SEQ ID NO: 685851 - RNA, 24 nt, Human
auuacaucguccugaacgaggacc

SEQ ID NO: 685852 - RNA, 19 nt, Human
caacaaaaaacccugucuc

SEQ ID NO: 685853 - RNA, 24 nt, Human
caacaaaaaacccugucucuacac

SEQ ID NO: 685854 - RNA, 25 nt, Human
caacaaaaaacccugucucuacacc

SEQ ID NO: 685855 - RNA, 24 nt, Human
caacaacaaaaaacccugucucua

SEQ ID NO: 685856 - RNA, 25 nt, Human
caacaacaaaaaacccugucucuac

SEQ ID NO: 685857 - RNA, 23 nt, Human
caacaacaacaaaaaacccuguc

SEQ ID NO: 685858 - RNA, 21 nt, Human
cacggaccgcccgggucuccc

SEQ ID NO: 685859 - RNA, 22 nt, Human
cacucaggcacaacuuuuccag

SEQ ID NO: 685860 - RNA, 18 nt, Human
caggagccguuacccggu

SEQ ID NO: 685861 - RNA, 27 nt, Human
caggagccguuacccggucgaccuggu

SEQ ID NO: 685862 - RNA, 20 nt, Human
cccgggucuccccgagucuc

SEQ ID NO: 685863 - RNA, 18 nt, Human
ccguacuggcuccugguu

SEQ ID NO: 685864 - RNA, 21 nt, Human
ccuccauucccagggcaagcu

SEQ ID NO: 685865 - RNA, 22 nt, Human
cgggagaggcccaggagccguu

SEQ ID NO: 685866 - RNA, 24 nt, Human
cggggccagggucucacacccauc

SEQ ID NO: 685867 - RNA, 19 nt, Human
cucacucucuggcaacaag

SEQ ID NO: 685868 - RNA, 18 nt, Human
cuccccgagucucugggu

SEQ ID NO: 685869 - RNA, 23 nt, Human
cucucuggcaacaagcucccugg

SEQ ID NO: 685870 - RNA, 19 nt, Human
cuggcaacaagcucccugg

SEQ ID NO: 685871 - RNA, 21 nt, Human
gagacccuugacccgggagag

SEQ ID NO: 685872 - RNA, 25 nt, Human
gagggcggggcucggugggcggggc

SEQ ID NO: 685873 - RNA, 18 nt, Human
gcggggcuggccgcgggg

SEQ ID NO: 685874 - RNA, 22 nt, Human
uaaaaaacaaacaaacaacaac

SEQ ID NO: 685875 - RNA, 21 nt, Human
uaaaaaauacuaaguguucau

SEQ ID NO: 685876 - RNA, 20 nt, Human
uaaaauacuacaagcgggag

SEQ ID NO: 685877 - RNA, 20 nt, Human
uacaucguccugaacgagga

SEQ ID NO: 685878 - RNA, 22 nt, Human
uauggaaugaagguaaauuuaa

SEQ ID NO: 685879 - RNA, 18 nt, Human
ucaagggaccaaagucac

SEQ ID NO: 685880 - RNA, 20 nt, Human
uccagauuuaaaaaacaaac

SEQ ID NO: 685881 - RNA, 19 nt, Human
ucccagggcaagcucacuc

SEQ ID NO: 685882 - RNA, 22 nt, Human
ucccagggcaagcucacucucu

SEQ ID NO: 685883 - RNA, 19 nt, Human
ucuacagagccuugcaggg

SEQ ID NO: 685884 - RNA, 25 nt, Human
ucucuggcaacaagcucccuggggu

SEQ ID NO: 685885 - RNA, 23 nt, Human
ugcaugagcacuggugaggggca

SEQ ID NO: 685886 - RNA, 20 nt, Human
uggcaacaagcucccugggg

SEQ ID NO: 685887 - RNA, 19 nt, Human
uggccgauuagauuccuga

SEQ ID NO: 685888 - RNA, 24 nt, Human
uggccgcgggggcggggccagggu

SEQ ID NO: 685889 - RNA, 20 nt, Human
uguauuaggagauguccugg

SEQ ID NO: 685890 - RNA, 24 nt, Human
ugucaagggaccaaagucacauuu

SEQ ID NO: 685891 - RNA, 23 nt, Human
uuaggagcuuugugauuccuguu

SEQ ID NO: 685892 - RNA, 21 nt, Human
uuccagauuuaaaaaacaaac

SEQ ID NO: 685893 - RNA, 23 nt, Human
uuccagauuuaaaaaacaaacaa

SEQ ID NO: 685894 - RNA, 20 nt, Human
uugguccuggcgagggcggg

SEQ ID NO: 685895 - RNA, 21 nt, Human
uuuaauacaucaaucuacaga

SEQ ID NO: 685896 - RNA, 25 nt, Human
uuuuccagauuuaaaaaacaaacaa

SEQ ID NO: 685897 - RNA, 23 nt, Human
acccaggcuggaguguaguggug

SEQ ID NO: 685898 - RNA, 24 nt, Human
agagcugggauuacaggccugagc

SEQ ID NO: 685899 - RNA, 18 nt, Human
auagcucacugcagccuc

SEQ ID NO: 685900 - RNA, 19 nt, Human
auuuuauuuauuuauuucu

SEQ ID NO: 685901 - RNA, 24 nt, Human
cacccaggcuggaguguaguggug

SEQ ID NO: 685902 - RNA, 27 nt, Human
cagagcugggauuacaggccugagcca

SEQ ID NO: 685903 - RNA, 24 nt, Human
cagccucgaacuccugggcucaag

SEQ ID NO: 685904 - RNA, 20 nt, Human
caggcucucuccuccgccuc

SEQ ID NO: 685905 - RNA, 22 nt, Human
cccuggcacaucuggagguaga

SEQ ID NO: 685906 - RNA, 18 nt, Human
cccuggguuccugggcug

SEQ ID NO: 685907 - RNA, 22 nt, Human
ccucgaacuccugggcucaagc

SEQ ID NO: 685908 - RNA, 23 nt, Human
ccucgaacuccugggcucaagcu

SEQ ID NO: 685909 - RNA, 20 nt, Human
ccugggcucaagcuauccuu

SEQ ID NO: 685910 - RNA, 25 nt, Human
cgaacuccugggcucaagcuauccu

SEQ ID NO: 685911 - RNA, 24 nt, Human
cgagggcccuuccagcucugccgc

SEQ ID NO: 685912 - RNA, 21 nt, Human
cgccuggccaaaauccaaguu

SEQ ID NO: 685913 - RNA, 21 nt, Human
cucacugcagccucgaacucc

SEQ ID NO: 685914 - RNA, 24 nt, Human
cucacugcagccucgaacuccugg

SEQ ID NO: 685915 - RNA, 23 nt, Human
cucuugcugucacccaggcugga

SEQ ID NO: 685916 - RNA, 24 nt, Human
cucuugcugucacccaggcuggag

SEQ ID NO: 685917 - RNA, 23 nt, Human
cugcagccucgaacuccugggcu

SEQ ID NO: 685918 - RNA, 18 nt, Human
cugucacccaggcuggag

SEQ ID NO: 685919 - RNA, 21 nt, Human
cuuuucggacaaaccuucuga

SEQ ID NO: 685920 - RNA, 19 nt, Human
gaucauagcucacugcagc

SEQ ID NO: 685921 - RNA, 18 nt, Human
gauuacaggccugagcca

SEQ ID NO: 685922 - RNA, 22 nt, Human
gauuacaggccugagccaccgc

SEQ ID NO: 685923 - RNA, 24 nt, Human
gcugucacccaggcuggaguguag

SEQ ID NO: 685924 - RNA, 24 nt, Human
gcuuccagagcugggauuacaggc

SEQ ID NO: 685925 - RNA, 23 nt, Human
guucucugcagcuugaccucgca

SEQ ID NO: 685926 - RNA, 22 nt, Human
uacaggccugagccaccgcgcc

SEQ ID NO: 685927 - RNA, 24 nt, Human
uagcucacugcagccucgaacucc

SEQ ID NO: 685928 - RNA, 24 nt, Human
ucacccaggcuggaguguaguggu

SEQ ID NO: 685929 - RNA, 24 nt, Human
ucacugcagccucgaacuccuggg

SEQ ID NO: 685930 - RNA, 21 nt, Human
uccagagcugggauuacaggc

SEQ ID NO: 685931 - RNA, 20 nt, Human
uccugggcucaagcuauccu

SEQ ID NO: 685932 - RNA, 23 nt, Human
ucucuugcugucacccaggcugg

SEQ ID NO: 685933 - RNA, 24 nt, Human
ucucuugcugucacccaggcugga

SEQ ID NO: 685934 - RNA, 18 nt, Human
ucugaagucccuggguuc

SEQ ID NO: 685935 - RNA, 26 nt, Human
ucugcagcuugaccucgcaggcucuc

SEQ ID NO: 685936 - RNA, 21 nt, Human
ucuugcugucacccaggcugg

SEQ ID NO: 685937 - RNA, 21 nt, Human
ucuugcugucacccaggcugg

SEQ ID NO: 685938 - RNA, 22 nt, Human
ucuugcugucacccaggcugga

SEQ ID NO: 685939 - RNA, 23 nt, Human
ucuugcugucacccaggcuggag

SEQ ID NO: 685940 - RNA, 24 nt, Human
ucuugcugucacccaggcuggagu

SEQ ID NO: 685941 - RNA, 18 nt, Human
ugaagucccuggguuccu

SEQ ID NO: 685942 - RNA, 22 nt, Human
ugagacaagaucucuugcuguc

SEQ ID NO: 685943 - RNA, 20 nt, Human
uggaguguaguggugagauc

SEQ ID NO: 685944 - RNA, 18 nt, Human
ugggauuacaggccugag

SEQ ID NO: 685945 - RNA, 19 nt, Human
ugggauuacaggccugagc

SEQ ID NO: 685946 - RNA, 21 nt, Human
ugggauuacaggccugagcca

SEQ ID NO: 685947 - RNA, 22 nt, Human
ugggauuacaggccugagccac

SEQ ID NO: 685948 - RNA, 23 nt, Human
ugggauuacaggccugagccacc

SEQ ID NO: 685949 - RNA, 24 nt, Human
ugggauuacaggccugagccaccg

SEQ ID NO: 685950 - RNA, 24 nt, Human
uggugagaucauagcucacugcag

SEQ ID NO: 685951 - RNA, 25 nt, Human
uuuuuuuuuuuuuuuuuuuauuuuu

SEQ ID NO: 685952 - RNA, 22 nt, Human
aaaagccuuccugggugugucc

SEQ ID NO: 685953 - RNA, 21 nt, Human
aaacagaaugcaggagaggcc

SEQ ID NO: 685954 - RNA, 25 nt, Human
aaacauccacagugcccuuggccaa

SEQ ID NO: 685955 - RNA, 19 nt, Human
aaacuggcuugacuucaaa

SEQ ID NO: 685956 - RNA, 28 nt, Human
aaccaccuuucuaaaccucugcccaccc

SEQ ID NO: 685957 - RNA, 19 nt, Human
aagagguaagaauacggca

SEQ ID NO: 685958 - RNA, 23 nt, Human
aagcaacacggcccuucacagcc

SEQ ID NO: 685959 - RNA, 26 nt, Human
aagccccaucgaggaaggggugagaa

SEQ ID NO: 685960 - RNA, 18 nt, Human
aagcuccucucagguggc

SEQ ID NO: 685961 - RNA, 18 nt, Human
aagggugggguggcagga

SEQ ID NO: 685962 - RNA, 18 nt, Human
aagggugggguggcagga

SEQ ID NO: 685963 - RNA, 19 nt, Human
aagugcacucaagggagca

SEQ ID NO: 685964 - RNA, 22 nt, Human
aagugcacucaagggagcacag

SEQ ID NO: 685965 - RNA, 18 nt, Human
acaaugagcugccgccuc

SEQ ID NO: 685966 - RNA, 20 nt, Human
acagcgccuggcucccgugc

SEQ ID NO: 685967 - RNA, 23 nt, Human
acccacugaaagcaacacggccc

SEQ ID NO: 685968 - RNA, 19 nt, Human
acucccgccuguccaugcc

SEQ ID NO: 685969 - RNA, 20 nt, Human
agagaagaaacaggcuuaca

SEQ ID NO: 685970 - RNA, 24 nt, Human
agaggaagggugggguggcaggag

SEQ ID NO: 685971 - RNA, 26 nt, Human
agcccuggccaggcgcugacgccucc

SEQ ID NO: 685972 - RNA, 20 nt, Human
agcugccgccucgccaaggc

SEQ ID NO: 685973 - RNA, 19 nt, Human
aggaagccuuuucacaguc

SEQ ID NO: 685974 - RNA, 18 nt, Human
aggaagggugggguggca

SEQ ID NO: 685975 - RNA, 21 nt, Human
aggacuggggcagcccuggcc

SEQ ID NO: 685976 - RNA, 18 nt, Human
aggagcccucccaggagc

SEQ ID NO: 685977 - RNA, 22 nt, Human
auccacagugcccuuggccaau

SEQ ID NO: 685978 - RNA, 23 nt, Human
caaaacauccacagugcccuugg

SEQ ID NO: 685979 - RNA, 18 nt, Human
caaacagaagcuccucuc

SEQ ID NO: 685980 - RNA, 18 nt, Human
caagaguaccaggugcca

SEQ ID NO: 685981 - RNA, 21 nt, Human
caagggagcacagcuccacca

SEQ ID NO: 685982 - RNA, 24 nt, Human
cacacagaggaagggugggguggc

SEQ ID NO: 685983 - RNA, 23 nt, Human
cacagcccuuccgcuccagugga

SEQ ID NO: 685984 - RNA, 18 nt, Human
caccaaaggacuggggca

SEQ ID NO: 685985 - RNA, 23 nt, Human
cacccacugaaagcaacacggcc

SEQ ID NO: 685986 - RNA, 21 nt, Human
caccccagcccuucuggaaac

SEQ ID NO: 685987 - RNA, 22 nt, Human
caggaggugauucaucuccccc

SEQ ID NO: 685988 - RNA, 23 nt, Human
caugugagcugaagcauuugccu

SEQ ID NO: 685989 - RNA, 21 nt, Human
ccaaccaucuuacgacgcuuu

SEQ ID NO: 685990 - RNA, 25 nt, Human
ccacugggcaguggucacugggcuu

SEQ ID NO: 685991 - RNA, 22 nt, Human
ccaggucccacaagaguaccag

SEQ ID NO: 685992 - RNA, 23 nt, Human
ccaguggagaaucgccaaagauc

SEQ ID NO: 685993 - RNA, 19 nt, Human
ccaucacccgagaacuggc

SEQ ID NO: 685994 - RNA, 22 nt, Human
ccccaggucccacaagaguacc

SEQ ID NO: 685995 - RNA, 22 nt, Human
cccgccuguccaugcccagagg

SEQ ID NO: 685996 - RNA, 25 nt, Human
cccuucacagccuggcuuccuucuu

SEQ ID NO: 685997 - RNA, 20 nt, Human
ccucccaggagcagggcuug

SEQ ID NO: 685998 - RNA, 19 nt, Human
ccuggccaggcgcugacgc

SEQ ID NO: 685999 - RNA, 19 nt, Human
ccuguugucaacccugagg

SEQ ID NO: 686000 - RNA, 22 nt, Human
ccuuccgcuccaguggagaauc

SEQ ID NO: 686001 - RNA, 22 nt, Human
ccuuccuggguguguccaaaaa

SEQ ID NO: 686002 - RNA, 20 nt, Human
cggcagaccccagguggugc

SEQ ID NO: 686003 - RNA, 21 nt, Human
cggggggagcccaguggccac

SEQ ID NO: 686004 - RNA, 22 nt, Human
cggggggagcccaguggccacu

SEQ ID NO: 686005 - RNA, 22 nt, Human
cucaagggagcacagcuccacc

SEQ ID NO: 686006 - RNA, 19 nt, Human
cucaccccagcccuucugg

SEQ ID NO: 686007 - RNA, 19 nt, Human
cucaccccagcccuucugg

SEQ ID NO: 686008 - RNA, 23 nt, Human
cucugcacaggucaggaucucac

SEQ ID NO: 686009 - RNA, 18 nt, Human
cugcucagcuccugcugg

SEQ ID NO: 686010 - RNA, 24 nt, Human
cuucuugggucaccccucugaaca

SEQ ID NO: 686011 - RNA, 18 nt, Human
gaagaaacaggcuuacag

SEQ ID NO: 686012 - RNA, 21 nt, Human
gagcugccgccucgccaaggc

SEQ ID NO: 686013 - RNA, 24 nt, Human
gaguaggucccaguccugaaauau

SEQ ID NO: 686014 - RNA, 18 nt, Human
gcagauggggcauacgug

SEQ ID NO: 686015 - RNA, 22 nt, Human
gccaaagaucaugaaggguaaa

SEQ ID NO: 686016 - RNA, 22 nt, Human
gccaugcugccucccacaaaac

SEQ ID NO: 686017 - RNA, 21 nt, Human
gcccacccacugaaagcaaca

SEQ ID NO: 686018 - RNA, 24 nt, Human
gcccgaguguguguguacggggag

SEQ ID NO: 686019 - RNA, 18 nt, Human
gcucuucuccccagagcu

SEQ ID NO: 686020 - RNA, 19 nt, Human
ggcauacguggggcucggg

SEQ ID NO: 686021 - RNA, 24 nt, Human
ggggcauacguggggcucggggac

SEQ ID NO: 686022 - RNA, 23 nt, Human
gugcugcccaggggcugcugugg

SEQ ID NO: 686023 - RNA, 22 nt, Human
gugcugccuguccuuccaucug

SEQ ID NO: 686024 - RNA, 20 nt, Human
guggacagacccuguccaca

SEQ ID NO: 686025 - RNA, 19 nt, Human
guggcaucuggggaguagg

SEQ ID NO: 686026 - RNA, 22 nt, Human
uaaauagucuccucugaacccc

SEQ ID NO: 686027 - RNA, 19 nt, Human
uaagaauacggcacuuuua

SEQ ID NO: 686028 - RNA, 18 nt, Human
uacguggggcucggggac

SEQ ID NO: 686029 - RNA, 24 nt, Human
uacugcccuuuccacggugccaug

SEQ ID NO: 686030 - RNA, 20 nt, Human
ucaaguccuaggguggcccc

SEQ ID NO: 686031 - RNA, 18 nt, Human
ucaccgggcaccaaagga

SEQ ID NO: 686032 - RNA, 24 nt, Human
ucaccgggcaccaaaggacugggg

SEQ ID NO: 686033 - RNA, 18 nt, Human
ucaucucccccgcugcuc

SEQ ID NO: 686034 - RNA, 24 nt, Human
uccacagcgccuggcucccgugcu

SEQ ID NO: 686035 - RNA, 20 nt, Human
uccacagugcccuuggccaa

SEQ ID NO: 686036 - RNA, 21 nt, Human
uccacagugcccuuggccaau

SEQ ID NO: 686037 - RNA, 20 nt, Human
uccacggugccaugcugccu

SEQ ID NO: 686038 - RNA, 23 nt, Human
uccacggugccaugcugccuccc

SEQ ID NO: 686039 - RNA, 24 nt, Human
uccccagagcuuuaaagccccauc

SEQ ID NO: 686040 - RNA, 19 nt, Human
ucccccgcugcucagcucc

SEQ ID NO: 686041 - RNA, 21 nt, Human
ucccccgcugcucagcuccug

SEQ ID NO: 686042 - RNA, 23 nt, Human
uccuuauauuccccaggucccac

SEQ ID NO: 686043 - RNA, 20 nt, Human
ucgccaaagaucaugaaggg

SEQ ID NO: 686044 - RNA, 22 nt, Human
ugaaagcaacacggcccuucac

SEQ ID NO: 686045 - RNA, 19 nt, Human
ugacgccuccccacucucu

SEQ ID NO: 686046 - RNA, 20 nt, Human
ugacuucuugggucaccccu

SEQ ID NO: 686047 - RNA, 18 nt, Human
ugagaugccaagagguaa

SEQ ID NO: 686048 - RNA, 20 nt, Human
ugaguggggagcagcucuuc

SEQ ID NO: 686049 - RNA, 19 nt, Human
ugcccagaggcauacacgg

SEQ ID NO: 686050 - RNA, 23 nt, Human
ugcuggcugcgcucaccgggcac

SEQ ID NO: 686051 - RNA, 22 nt, Human
uggcucccgugcugccuguccu

SEQ ID NO: 686052 - RNA, 19 nt, Human
uggggcagcccuggccagg

SEQ ID NO: 686053 - RNA, 24 nt, Human
ugggguggcaggagcccucccagg

SEQ ID NO: 686054 - RNA, 21 nt, Human
uggguuuugggaucaaggcgg

SEQ ID NO: 686055 - RNA, 27 nt, Human
uggugcugcccaggggcugcugugggg

SEQ ID NO: 686056 - RNA, 26 nt, Human
ugugagcugaagcauuugccugcaaa

SEQ ID NO: 686057 - RNA, 24 nt, Human
ggaggggggaugggggagggacgg

SEQ ID NO: 686058 - RNA, 18 nt, Human
gggaggggguggggaggg

SEQ ID NO: 686059 - RNA, 20 nt, Human
ggggaggggguggggagggg

SEQ ID NO: 686060 - RNA, 24 nt, Human
ggggaggggguggggaggggggau

SEQ ID NO: 686061 - RNA, 18 nt, Human
ggggaugggggagggacg

SEQ ID NO: 686062 - RNA, 21 nt, Human
ggggguggggaggggggaugg

SEQ ID NO: 686063 - RNA, 27 nt, Human
ggggguggggaggggggaugggggagg

SEQ ID NO: 686064 - RNA, 27 nt, Human
ggguggggaggggggaugggggaggga

SEQ ID NO: 686065 - RNA, 19 nt, Human
uacaaacguagcuguauug

SEQ ID NO: 686066 - RNA, 18 nt, Human
uagcuguauuggggaggg

SEQ ID NO: 686067 - RNA, 23 nt, Human
uagcuguauuggggagggggugg

SEQ ID NO: 686068 - RNA, 19 nt, Human
uggaugcccagguacagga

SEQ ID NO: 686069 - RNA, 21 nt, Human
uggggaggggggaugggggag

SEQ ID NO: 686070 - RNA, 23 nt, Human
uggggaggggggaugggggaggg

SEQ ID NO: 686071 - RNA, 18 nt, Human
uggggaggggguggggag

SEQ ID NO: 686072 - RNA, 25 nt, Human
uguacaaacguagcuguauugggga

SEQ ID NO: 686073 - RNA, 23 nt, Human
aacccaggacugaagccacagcc

SEQ ID NO: 686074 - RNA, 21 nt, Human
agaggagggagcuugggccag

SEQ ID NO: 686075 - RNA, 18 nt, Human
agagggagaggagggagc

SEQ ID NO: 686076 - RNA, 26 nt, Human
agagggagaggagggagcuugggccg

SEQ ID NO: 686077 - RNA, 18 nt, Human
agccacagccuuucacca

SEQ ID NO: 686078 - RNA, 24 nt, Human
aggcagaaacccaggacugaagcc

SEQ ID NO: 686079 - RNA, 25 nt, Human
aggcagaaacccaggacugaagcca

SEQ ID NO: 686080 - RNA, 22 nt, Human
agggagaggagggagcuugggc

SEQ ID NO: 686081 - RNA, 18 nt, Human
aggggcauccuaggcucu

SEQ ID NO: 686082 - RNA, 24 nt, Human
cagaucccccgagccggagccucc

SEQ ID NO: 686083 - RNA, 19 nt, Human
cagcccucagcccacuccc

SEQ ID NO: 686084 - RNA, 19 nt, Human
cagccucaaacuuccugaa

SEQ ID NO: 686085 - RNA, 19 nt, Human
cagccuuucaccacaucca

SEQ ID NO: 686086 - RNA, 20 nt, Human
caggagccgcugcagcagag

SEQ ID NO: 686087 - RNA, 24 nt, Human
caggagccgcugcagcagaggggc

SEQ ID NO: 686088 - RNA, 22 nt, Human
cccgagccggagccuccagggc

SEQ ID NO: 686089 - RNA, 18 nt, Human
ccucagcccacucccuuc

SEQ ID NO: 686090 - RNA, 20 nt, Human
cgagccggagccuccagggc

SEQ ID NO: 686091 - RNA, 19 nt, Human
cucagcccacucccuucag

SEQ ID NO: 686092 - RNA, 18 nt, Human
cucaggagccgcugcagc

SEQ ID NO: 686093 - RNA, 23 nt, Human
gagcucaggagccgcugcagcag

SEQ ID NO: 686094 - RNA, 19 nt, Human
ggagcuugggccagcccuc

SEQ ID NO: 686095 - RNA, 19 nt, Human
gguaggggcagaucccccg

SEQ ID NO: 686096 - RNA, 24 nt, Human
uaggcucuacagagggagaggagg

SEQ ID NO: 686097 - RNA, 22 nt, Human
ucagcccacucccuucagggug

SEQ ID NO: 686098 - RNA, 25 nt, Human
ucagcccacucccuucagggugccu

SEQ ID NO: 686099 - RNA, 19 nt, Human
ucaggagccgcugcagcag

SEQ ID NO: 686100 - RNA, 19 nt, Human
ucccccgagccggagccuc

SEQ ID NO: 686101 - RNA, 20 nt, Human
ucccccgagccggagccucc

SEQ ID NO: 686102 - RNA, 19 nt, Human
ucucagccucaaacuuccu

SEQ ID NO: 686103 - RNA, 18 nt, Human
uucaccacauccagcugu

SEQ ID NO: 686104 - RNA, 21 nt, Human
uugcacccaggucuuuucggg

SEQ ID NO: 686105 - RNA, 25 nt, Human
aaaaaaagauccacaaguaauuuua

SEQ ID NO: 686106 - RNA, 18 nt, Human
aaggauaguuuuacucag

SEQ ID NO: 686107 - RNA, 18 nt, Human
acucagguauccuuguca

SEQ ID NO: 686108 - RNA, 20 nt, Human
aggcuagaaggggcucccga

SEQ ID NO: 686109 - RNA, 19 nt, Human
aggcugcagcaaugacacc

SEQ ID NO: 686110 - RNA, 28 nt, Human
caaagagcaauagauuaaaaaaaaaaaa

SEQ ID NO: 686111 - RNA, 20 nt, Human
caagcuccucuccgccugcc

SEQ ID NO: 686112 - RNA, 19 nt, Human
caaguaauuuuagcuucac

SEQ ID NO: 686113 - RNA, 24 nt, Human
caccaggaggagaaagcuacgucc

SEQ ID NO: 686114 - RNA, 20 nt, Human
ccggagucuucugccgggca

SEQ ID NO: 686115 - RNA, 22 nt, Human
cuccggagucuucugccgggca

SEQ ID NO: 686116 - RNA, 19 nt, Human
gcagcaaugacaccaggag

SEQ ID NO: 686117 - RNA, 22 nt, Human
gcagcugaggaacuagggaccc

SEQ ID NO: 686118 - RNA, 21 nt, Human
ggaagauaggcagcugaggaa

SEQ ID NO: 686119 - RNA, 21 nt, Human
ggcucccgagcagaaaaugac

SEQ ID NO: 686120 - RNA, 21 nt, Human
gugauuugcggugggaaaggc

SEQ ID NO: 686121 - RNA, 20 nt, Human
uaauaaaauuucuguuccca

SEQ ID NO: 686122 - RNA, 24 nt, Human
uacugagccaaugccuccggaguc

SEQ ID NO: 686123 - RNA, 22 nt, Human
uagcuucacaucauaggauaau

SEQ ID NO: 686124 - RNA, 19 nt, Human
uccaaagagcaauagauua

SEQ ID NO: 686125 - RNA, 25 nt, Human
ucccgagcagaaaaugacgugaaaa

SEQ ID NO: 686126 - RNA, 18 nt, Human
ucuucugccgggcaacuu

SEQ ID NO: 686127 - RNA, 20 nt, Human
ugcgguggcuuugcugucuu

SEQ ID NO: 686128 - RNA, 18 nt, Human
ugggaaaggcugcgcgga

SEQ ID NO: 686129 - RNA, 21 nt, Human
uuucuguucccagugauuuua

SEQ ID NO: 686130 - RNA, 23 nt, Human
uuuuuuuuuuuuuuuuucauuuu

SEQ ID NO: 686131 - RNA, 22 nt, Human
accugggucccgccccgcgccc

SEQ ID NO: 686132 - RNA, 20 nt, Human
agccggaggccugggaccug

SEQ ID NO: 686133 - RNA, 18 nt, Human
cacagaaccuaggcaggc

SEQ ID NO: 686134 - RNA, 26 nt, Human
caccuucggccgggagcagccggagg

SEQ ID NO: 686135 - RNA, 19 nt, Human
cagcgggcgcggaagccuc

SEQ ID NO: 686136 - RNA, 20 nt, Human
cccuggguucccaaacgccc

SEQ ID NO: 686137 - RNA, 20 nt, Human
ccgccccgcgcccugcuccc

SEQ ID NO: 686138 - RNA, 22 nt, Human
ccugccacugccuguccccacc

SEQ ID NO: 686139 - RNA, 23 nt, Human
ccugccacugccuguccccaccu

SEQ ID NO: 686140 - RNA, 24 nt, Human
ccuguccccaccuucggccgggag

SEQ ID NO: 686141 - RNA, 24 nt, Human
cgaggaaccagcgggcgcggaagc

SEQ ID NO: 686142 - RNA, 24 nt, Human
cgccccggagcgaggaaccagcgg

SEQ ID NO: 686143 - RNA, 22 nt, Human
cgggagcagccggaggccuggg

SEQ ID NO: 686144 - RNA, 21 nt, Human
cucccggucgcuaucgcgagc

SEQ ID NO: 686145 - RNA, 19 nt, Human
gcaccggccugggcgggag

SEQ ID NO: 686146 - RNA, 24 nt, Human
gcaccggccugggcgggagcgcac

SEQ ID NO: 686147 - RNA, 19 nt, Human
gccccgcgcccugcucccg

SEQ ID NO: 686148 - RNA, 18 nt, Human
gccuggggcgcaggcggg

SEQ ID NO: 686149 - RNA, 22 nt, Human
gcgggcaccggccugggcggga

SEQ ID NO: 686150 - RNA, 19 nt, Human
ggagcagccggaggccugg

SEQ ID NO: 686151 - RNA, 18 nt, Human
ggcugcagucgaaggggg

SEQ ID NO: 686152 - RNA, 19 nt, Human
gggcaccggccugggcggg

SEQ ID NO: 686153 - RNA, 18 nt, Human
ucccaaacgcccucgcua

SEQ ID NO: 686154 - RNA, 18 nt, Human
uccccgcgccuggcuucc

SEQ ID NO: 686155 - RNA, 23 nt, Human
ucccgccccgcgcccugcucccg

SEQ ID NO: 686156 - RNA, 18 nt, Human
ucgcgagcuccgccccgg

SEQ ID NO: 686157 - RNA, 20 nt, Human
ugccuggggcgcaggcgggc

SEQ ID NO: 686158 - RNA, 21 nt, Human
uggcuuccggcuuccucgccu

SEQ ID NO: 686159 - RNA, 19 nt, Human
uggggcgcaggcgggcggc

SEQ ID NO: 686160 - RNA, 22 nt, Human
uguaaaugcucccaccuuggcc

SEQ ID NO: 686161 - RNA, 25 nt, Human
aaccaggcccaccuggagaccuagc

SEQ ID NO: 686162 - RNA, 18 nt, Human
aacugccugccucccugg

SEQ ID NO: 686163 - RNA, 21 nt, Human
accuagccuguccucuccaau

SEQ ID NO: 686164 - RNA, 19 nt, Human
agaaaacaaaaagcacuaa

SEQ ID NO: 686165 - RNA, 22 nt, Human
agaaaacaaaaagcacuaaggg

SEQ ID NO: 686166 - RNA, 25 nt, Human
agcccuucuggcuuccagcagggaa

SEQ ID NO: 686167 - RNA, 21 nt, Human
agggagggaggcccaguuagg

SEQ ID NO: 686168 - RNA, 21 nt, Human
caaaaccagaacaccccaagc

SEQ ID NO: 686169 - RNA, 24 nt, Human
caaaaccagaacaccccaagccca

SEQ ID NO: 686170 - RNA, 19 nt, Human
caagcccagggcccucgcu

SEQ ID NO: 686171 - RNA, 24 nt, Human
cacauccaggcccaggguucccac

SEQ ID NO: 686172 - RNA, 27 nt, Human
cacccauagaggccucaagcccuucug

SEQ ID NO: 686173 - RNA, 26 nt, Human
cagaacaccccaagcccagggcccuc

SEQ ID NO: 686174 - RNA, 19 nt, Human
ccaagcccagggcccucgc

SEQ ID NO: 686175 - RNA, 19 nt, Human
ccaaggggagggagggagg

SEQ ID NO: 686176 - RNA, 20 nt, Human
ccauagaggccucaagcccu

SEQ ID NO: 686177 - RNA, 18 nt, Human
cccaccugcugccuggga

SEQ ID NO: 686178 - RNA, 20 nt, Human
cccauagaggccucaagccc

SEQ ID NO: 686179 - RNA, 21 nt, Human
cccggggccggcccucccaaa

SEQ ID NO: 686180 - RNA, 21 nt, Human
cccugggacacaggcucugcc

SEQ ID NO: 686181 - RNA, 20 nt, Human
ccuccugggccauccacacc

SEQ ID NO: 686182 - RNA, 25 nt, Human
ccuguaccccuuccugaccgccccu

SEQ ID NO: 686183 - RNA, 23 nt, Human
cguucucaaaaccagaacacccc

SEQ ID NO: 686184 - RNA, 29 nt, Human
cuccagcaccuccugggccauccacaccc

SEQ ID NO: 686185 - RNA, 22 nt, Human
cucccuggaccuaugggcuggu

SEQ ID NO: 686186 - RNA, 23 nt, Human
gccagggauggcccugccccucc

SEQ ID NO: 686187 - RNA, 20 nt, Human
gccugggaccuagccugucc

SEQ ID NO: 686188 - RNA, 19 nt, Human
gcuccagcaccuccugggc

SEQ ID NO: 686189 - RNA, 22 nt, Human
ggacacaggcucugccuucugc

SEQ ID NO: 686190 - RNA, 23 nt, Human
ggagggagggaggcccaguuagg

SEQ ID NO: 686191 - RNA, 19 nt, Human
gggaacccaccuguacccc

SEQ ID NO: 686192 - RNA, 24 nt, Human
ggguucccaccugcugccugggaa

SEQ ID NO: 686193 - RNA, 20 nt, Human
uagaggccucaagcccuucu

SEQ ID NO: 686194 - RNA, 21 nt, Human
uagccuguccucuccaauucu

SEQ ID NO: 686195 - RNA, 19 nt, Human
uaggcagggccacgugaca

SEQ ID NO: 686196 - RNA, 20 nt, Human
ucaaaaccagaacaccccaa

SEQ ID NO: 686197 - RNA, 21 nt, Human
ucacuccgaccugggucugcc

SEQ ID NO: 686198 - RNA, 18 nt, Human
ucccaccugcugccuggg

SEQ ID NO: 686199 - RNA, 21 nt, Human
ucccaugaccaaggggaggga

SEQ ID NO: 686200 - RNA, 18 nt, Human
ucccccugggacacaggc

SEQ ID NO: 686201 - RNA, 21 nt, Human
ucccuggaccuaugggcuggu

SEQ ID NO: 686202 - RNA, 23 nt, Human
ucuggcuuccagcagggaaaagu

SEQ ID NO: 686203 - RNA, 21 nt, Human
ugacuucgugugggucccccu

SEQ ID NO: 686204 - RNA, 24 nt, Human
ugccugggaaccaggcccaccugg

SEQ ID NO: 686205 - RNA, 21 nt, Human
ugggccauccacaccagugcc

SEQ ID NO: 686206 - RNA, 18 nt, Human
uucucaaaaccagaacac

SEQ ID NO: 686207 - RNA, 20 nt, Human
uuuuuuuuuuuugcaggucc

SEQ ID NO: 686208 - RNA, 18 nt, Human
uuuuuuuuuuuuuuuuug

SEQ ID NO: 686209 - RNA, 21 nt, Human
uuuuuuuuuuuuuuuuugcag

SEQ ID NO: 686210 - RNA, 22 nt, Human
uuuuuuuuuuuuuuuuugcagg

SEQ ID NO: 686211 - RNA, 23 nt, Human
uuuuuuuuuuuuuuuuugcaggu

SEQ ID NO: 686212 - RNA, 23 nt, Human
aaaaagucauuuuaauaugaagg

SEQ ID NO: 686213 - RNA, 20 nt, Human
aaaacaagagaucaccuuca

SEQ ID NO: 686214 - RNA, 21 nt, Human
aaacaagagaucaccuucaag

SEQ ID NO: 686215 - RNA, 22 nt, Human
aaacaagagaucaccuucaagg

SEQ ID NO: 686216 - RNA, 22 nt, Human
aaagacuaucaaauucaaacaa

SEQ ID NO: 686217 - RNA, 22 nt, Human
aacagcaggaaccugacaaaga

SEQ ID NO: 686218 - RNA, 21 nt, Human
aaguggcuccagccggugccc

SEQ ID NO: 686219 - RNA, 19 nt, Human
acaaaacaagagaucaccu

SEQ ID NO: 686220 - RNA, 22 nt, Human
acaaaauaaaaguaaaaugagc

SEQ ID NO: 686221 - RNA, 18 nt, Human
agacaauaaaucaauuca

SEQ ID NO: 686222 - RNA, 20 nt, Human
agcaaaauguaaacaacacg

SEQ ID NO: 686223 - RNA, 23 nt, Human
aggaagagacuuauaacagaagg

SEQ ID NO: 686224 - RNA, 23 nt, Human
aggcaagaagggaaacauacaaa

SEQ ID NO: 686225 - RNA, 21 nt, Human
aguaaagcacuauccucagau

SEQ ID NO: 686226 - RNA, 26 nt, Human
auagagugcccuuuaaaaacagaaag

SEQ ID NO: 686227 - RNA, 20 nt, Human
aucugcuucauuugcucuuu

SEQ ID NO: 686228 - RNA, 22 nt, Human
auuuaaagccuauuaacugcuc

SEQ ID NO: 686229 - RNA, 24 nt, Human
auuugcucuuuuuugauagacagu

SEQ ID NO: 686230 - RNA, 27 nt, Human
caaaacaacugacaaaaagucauuuua

SEQ ID NO: 686231 - RNA, 20 nt, Human
caaaacaagagaucaccuuc

SEQ ID NO: 686232 - RNA, 22 nt, Human
caaaagggaauaugaaggaaau

SEQ ID NO: 686233 - RNA, 25 nt, Human
caaacaauauauuuacaacacaaaa

SEQ ID NO: 686234 - RNA, 28 nt, Human
caaccuacacaauaaccuaggacuacug

SEQ ID NO: 686235 - RNA, 22 nt, Human
cacaauaaccuaggacuacugg

SEQ ID NO: 686236 - RNA, 20 nt, Human
caggcugcuaggguuuuguu

SEQ ID NO: 686237 - RNA, 21 nt, Human
cauuacuucucacuaacauuu

SEQ ID NO: 686238 - RNA, 22 nt, Human
cauuauggaauuauacuuaaga

SEQ ID NO: 686239 - RNA, 23 nt, Human
ccagaacauuucuacuuaacuaa

SEQ ID NO: 686240 - RNA, 18 nt, Human
ccuacauuccucaguaca

SEQ ID NO: 686241 - RNA, 21 nt, Human
ccugcaaguggcuccagccgg

SEQ ID NO: 686242 - RNA, 21 nt, Human
ccuuuaacaguguucaagacu

SEQ ID NO: 686243 - RNA, 23 nt, Human
cuagauguugcaaaaaaucaaaa

SEQ ID NO: 686244 - RNA, 20 nt, Human
cuauauagauauauacauaa

SEQ ID NO: 686245 - RNA, 20 nt, Human
cuccuaucugugucugugcc

SEQ ID NO: 686246 - RNA, 18 nt, Human
cugagccaagagcugcuc

SEQ ID NO: 686247 - RNA, 22 nt, Human
cugugucugugccucucuuccc

SEQ ID NO: 686248 - RNA, 20 nt, Human
gacuacuggcauggugacca

SEQ ID NO: 686249 - RNA, 20 nt, Human
gauacaccuucuuuucaaac

SEQ ID NO: 686250 - RNA, 23 nt, Human
gcaaaacaacugacaaaaaguca

SEQ ID NO: 686251 - RNA, 22 nt, Human
ggaaaacuuuuaaacuuucuaa

SEQ ID NO: 686252 - RNA, 25 nt, Human
ggagaacagcaggaaccugacaaag

SEQ ID NO: 686253 - RNA, 21 nt, Human
ggcaagaagggaaacauacaa

SEQ ID NO: 686254 - RNA, 18 nt, Human
gggagacuauccagcagu

SEQ ID NO: 686255 - RNA, 24 nt, Human
gugccaauaacauacaguugaaca

SEQ ID NO: 686256 - RNA, 20 nt, Human
guugcaaaaacccucagucc

SEQ ID NO: 686257 - RNA, 20 nt, Human
uaaaaaaagagagaggaagg

SEQ ID NO: 686258 - RNA, 21 nt, Human
uaaagccuauuaacugcucag

SEQ ID NO: 686259 - RNA, 20 nt, Human
uaaaugucacagcaaaaugu

SEQ ID NO: 686260 - RNA, 21 nt, Human
uaacagaaggcaagaagggaa

SEQ ID NO: 686261 - RNA, 19 nt, Human
uacaacacaaaacaagaga

SEQ ID NO: 686262 - RNA, 21 nt, Human
uacacaaaauaaaaguaaaau

SEQ ID NO: 686263 - RNA, 19 nt, Human
uacauuauguacagugaug

SEQ ID NO: 686264 - RNA, 21 nt, Human
uagaaguaauugguguagcag

SEQ ID NO: 686265 - RNA, 23 nt, Human
uaggacuacuggcauggugacca

SEQ ID NO: 686266 - RNA, 20 nt, Human
uaggauacuacaccuugaaa

SEQ ID NO: 686267 - RNA, 23 nt, Human
uauaacagaaggcaagaagggaa

SEQ ID NO: 686268 - RNA, 21 nt, Human
uauaacagguauuuccuuacc

SEQ ID NO: 686269 - RNA, 26 nt, Human
uauccagcagucacugaucucaacac

SEQ ID NO: 686270 - RNA, 23 nt, Human
uauccauuuaccaaaccugcaau

SEQ ID NO: 686271 - RNA, 22 nt, Human
uaugaaggaauauacuaaccaa

SEQ ID NO: 686272 - RNA, 23 nt, Human
uaugaaggaauauacuaaccaaa

SEQ ID NO: 686273 - RNA, 19 nt, Human
uauguaucauaauuuuagu

SEQ ID NO: 686274 - RNA, 19 nt, Human
ucacuuuucuguaggagaa

SEQ ID NO: 686275 - RNA, 20 nt, Human
ucagaaggacuuucauuaug

SEQ ID NO: 686276 - RNA, 22 nt, Human
ucagccacauguuccuccccaa

SEQ ID NO: 686277 - RNA, 19 nt, Human
ucauccuguuacuguguuu

SEQ ID NO: 686278 - RNA, 19 nt, Human
uccaccaacuguacugaug

SEQ ID NO: 686279 - RNA, 21 nt, Human
uccguaacaauuucccuacuu

SEQ ID NO: 686280 - RNA, 23 nt, Human
uccuguucacccucacagaauca

SEQ ID NO: 686281 - RNA, 18 nt, Human
ucgaaugcuucauugauc

SEQ ID NO: 686282 - RNA, 21 nt, Human
ucuauauauuuaaaaccaccu

SEQ ID NO: 686283 - RNA, 27 nt, Human
ucuggcuuagaguucuucaggcugcua

SEQ ID NO: 686284 - RNA, 22 nt, Human
ugaaaaaagacuuugaagaaaa

SEQ ID NO: 686285 - RNA, 23 nt, Human
ugaaucacuuggacuuccuguuu

SEQ ID NO: 686286 - RNA, 22 nt, Human
ugagacauaaucuaauauuuaa

SEQ ID NO: 686287 - RNA, 19 nt, Human
ugcaaaaaaucaaaaacua

SEQ ID NO: 686288 - RNA, 21 nt, Human
ugcaaguggcuccagccggug

SEQ ID NO: 686289 - RNA, 19 nt, Human
ugguguagcaggcuuuggg

SEQ ID NO: 686290 - RNA, 23 nt, Human
uguuauuugccagaauguuacgg

SEQ ID NO: 686291 - RNA, 20 nt, Human
uguucacccucacagaauca

SEQ ID NO: 686292 - RNA, 23 nt, Human
uucauagagugcccuuuaaaaac

SEQ ID NO: 686293 - RNA, 18 nt, Human
uucuucaggcugcuaggg

SEQ ID NO: 686294 - RNA, 19 nt, Human
uugcaaaaacccucagucc

SEQ ID NO: 686295 - RNA, 18 nt, Human
uugcaaccuacacaauaa

SEQ ID NO: 686296 - RNA, 21 nt, Human
uugcaaccuacacaauaaccu

SEQ ID NO: 686297 - RNA, 23 nt, Human
uugcaucugcuucauuugcucuu

SEQ ID NO: 686298 - RNA, 19 nt, Human
uuuccacaaggcauuuccu

SEQ ID NO: 686299 - RNA, 19 nt, Human
uuucuaacuucuaguuaug

SEQ ID NO: 686300 - RNA, 20 nt, Human
uuucuaauuguuauuugcca

SEQ ID NO: 686301 - RNA, 25 nt, Human
uuucuuagacaauaaaucaauucau

SEQ ID NO: 686302 - RNA, 23 nt, Human
uuugauagacagugucaucaaau

SEQ ID NO: 686303 - RNA, 21 nt, Human
aaacaacauugccacauuucc

SEQ ID NO: 686304 - RNA, 23 nt, Human
aaaucaagcucuacaacagcuga

SEQ ID NO: 686305 - RNA, 22 nt, Human
aagcuucugccuuucuucuucu

SEQ ID NO: 686306 - RNA, 23 nt, Human
aaucaccugacacugacaucuaa

SEQ ID NO: 686307 - RNA, 18 nt, Human
acucuuaaggcuggaaug

SEQ ID NO: 686308 - RNA, 27 nt, Human
auccucauccuuuggucuuucccccag

SEQ ID NO: 686309 - RNA, 22 nt, Human
caaaccccuuuggaucuccagu

SEQ ID NO: 686310 - RNA, 22 nt, Human
caacauugccacauuucccaaa

SEQ ID NO: 686311 - RNA, 23 nt, Human
caauccagcugugauuaacauuu

SEQ ID NO: 686312 - RNA, 22 nt, Human
ccccagagguuuuuuccuccgg

SEQ ID NO: 686313 - RNA, 22 nt, Human
ccuuccaaaucaagcucuacaa

SEQ ID NO: 686314 - RNA, 21 nt, Human
ccuuuuccucuucaguagaga

SEQ ID NO: 686315 - RNA, 22 nt, Human
cuaaaucaccugacacugacau

SEQ ID NO: 686316 - RNA, 24 nt, Human
cuggugccuuccaaaucaagcucu

SEQ ID NO: 686317 - RNA, 19 nt, Human
cuucuucuuuuucuuuuuc

SEQ ID NO: 686318 - RNA, 18 nt, Human
cuuucuucuucuuuuucu

SEQ ID NO: 686319 - RNA, 18 nt, Human
cuuucuucuucuuuuucu

SEQ ID NO: 686320 - RNA, 20 nt, Human
gcuaccauaauaaaagugaa

SEQ ID NO: 686321 - RNA, 21 nt, Human
ggaagcuucugccuuucuucu

SEQ ID NO: 686322 - RNA, 24 nt, Human
ggaagcuucugccuuucuucuucu

SEQ ID NO: 686323 - RNA, 22 nt, Human
uaaaucaccugacacugacauc

SEQ ID NO: 686324 - RNA, 23 nt, Human
uaccauaauaaaagugaaucucc

SEQ ID NO: 686325 - RNA, 24 nt, Human
uauccuuuuccucuucaguagaga

SEQ ID NO: 686326 - RNA, 23 nt, Human
uccaaaucaagcucuacaacagc

SEQ ID NO: 686327 - RNA, 21 nt, Human
ucucccaagaacagcucaagu

SEQ ID NO: 686328 - RNA, 19 nt, Human
ucuucuucuuuuucuuuuu

SEQ ID NO: 686329 - RNA, 19 nt, Human
ucuucuuuuucuuuuucuu

SEQ ID NO: 686330 - RNA, 24 nt, Human
ucuuuuucuucucuuccacaacuc

SEQ ID NO: 686331 - RNA, 21 nt, Human
ucuuuuucuuuuucuucucuu

SEQ ID NO: 686332 - RNA, 19 nt, Human
ugauuaacauuuuugggaa

SEQ ID NO: 686333 - RNA, 21 nt, Human
ugccacauuucccaaauacuc

SEQ ID NO: 686334 - RNA, 18 nt, Human
ugcugcuuguucuuuugu

SEQ ID NO: 686335 - RNA, 26 nt, Human
ugcuuguucuuuuguuucaaauucca

SEQ ID NO: 686336 - RNA, 22 nt, Human
uggaaugggcuuauuuuucacu

SEQ ID NO: 686337 - RNA, 20 nt, Human
ugugcguucauccucauccu

SEQ ID NO: 686338 - RNA, 24 nt, Human
uuauuuacaaguuaaggaacaaag

SEQ ID NO: 686339 - RNA, 22 nt, Human
uucuuuuucuucucuuccacaa

SEQ ID NO: 686340 - RNA, 22 nt, Human
uuucuuauguuuccuuuuuguu

SEQ ID NO: 686341 - RNA, 24 nt, Human
uuuuucuuuuucuucucuuccccu

SEQ ID NO: 686342 - RNA, 19 nt, Human
aagcacugaauacucuacc

SEQ ID NO: 686343 - RNA, 26 nt, Human
agaaaccacacaaagauuugguauca

SEQ ID NO: 686344 - RNA, 21 nt, Human
aggggcuauugauggaggcag

SEQ ID NO: 686345 - RNA, 23 nt, Human
auguaagcggggaguggcagggg

SEQ ID NO: 686346 - RNA, 20 nt, Human
cagauacagaaaccacacaa

SEQ ID NO: 686347 - RNA, 20 nt, Human
caggucacugauuguagugg

SEQ ID NO: 686348 - RNA, 18 nt, Human
uacagauacagaaaccac

SEQ ID NO: 686349 - RNA, 20 nt, Human
uauaaagagagucaauauca

SEQ ID NO: 686350 - RNA, 18 nt, Human
uaucaagaaaucacgagg

SEQ ID NO: 686351 - RNA, 19 nt, Human
uaucaagaaaucacgaggu

SEQ ID NO: 686352 - RNA, 20 nt, Human
uauuuaagaaaaggaggguc

SEQ ID NO: 686353 - RNA, 24 nt, Human
uauuuuauuuaagaaaaggagggu

SEQ ID NO: 686354 - RNA, 25 nt, Human
ucaccacguccaccugcguguccua

SEQ ID NO: 686355 - RNA, 19 nt, Human
ucaggaaagucuuagguua

SEQ ID NO: 686356 - RNA, 22 nt, Human
ugacacauaaauguaagcgggg

SEQ ID NO: 686357 - RNA, 23 nt, Human
ugccauaugagcugaaucuugga

SEQ ID NO: 686358 - RNA, 18 nt, Human
uggcaggggcuauugaug

SEQ ID NO: 686359 - RNA, 23 nt, Human
uggguagguauaaagagagucaa

SEQ ID NO: 686360 - RNA, 26 nt, Human
uggguguaaauuaggcaaauuaggac

SEQ ID NO: 686361 - RNA, 20 nt, Human
uuggaaaaaaugugggugua

SEQ ID NO: 686362 - RNA, 19 nt, Human
caggcagagaaacaacaca

SEQ ID NO: 686363 - RNA, 20 nt, Human
cagucaccggggccgcccua

SEQ ID NO: 686364 - RNA, 19 nt, Human
ccaggcagagaaacaacac

SEQ ID NO: 686365 - RNA, 18 nt, Human
cccuacucagacucccuc

SEQ ID NO: 686366 - RNA, 18 nt, Human
cgacaaaaguauaagagu

SEQ ID NO: 686367 - RNA, 24 nt, Human
gaagggaagauuguucagcuuggg

SEQ ID NO: 686368 - RNA, 22 nt, Human
uaagaguaaauuagguaaauga

SEQ ID NO: 686369 - RNA, 20 nt, Human
uaggacuauugauggaggca

SEQ ID NO: 686370 - RNA, 23 nt, Human
uaucaagagagucaauaucagga

SEQ ID NO: 686371 - RNA, 20 nt, Human
ucaagaacagaugccauaug

SEQ ID NO: 686372 - RNA, 19 nt, Human
ucaggaaagucuuggguua

SEQ ID NO: 686373 - RNA, 20 nt, Human
ucauaacucuaaguauuugg

SEQ ID NO: 686374 - RNA, 25 nt, Human
ugacaaauaaaugcaagaaggguuc

SEQ ID NO: 686375 - RNA, 19 nt, Human
ugucgacaaaaguauaaga

SEQ ID NO: 686376 - RNA, 22 nt, Human
aaacucagaagguccucccgug

SEQ ID NO: 686377 - RNA, 22 nt, Human
aaaggugggaggggcggcuguu

SEQ ID NO: 686378 - RNA, 22 nt, Human
aaccacauaguagcacagugaa

SEQ ID NO: 686379 - RNA, 19 nt, Human
aagaaccacauauggaaua

SEQ ID NO: 686380 - RNA, 18 nt, Human
aagccgcucggccuucug

SEQ ID NO: 686381 - RNA, 26 nt, Human
acaaaauccuuuuuaggcagggggaa

SEQ ID NO: 686382 - RNA, 18 nt, Human
agaaaugcaauucuccag

SEQ ID NO: 686383 - RNA, 23 nt, Human
agaauuuaaaccaaacuacaagc

SEQ ID NO: 686384 - RNA, 19 nt, Human
agccaggagcccaacaggu

SEQ ID NO: 686385 - RNA, 23 nt, Human
agccaggagcccaacagguaaac

SEQ ID NO: 686386 - RNA, 22 nt, Human
agggauagagaaagcggaggaa

SEQ ID NO: 686387 - RNA, 19 nt, Human
caagccacgaagcacaaaa

SEQ ID NO: 686388 - RNA, 23 nt, Human
caagcgguucuugcccggaccca

SEQ ID NO: 686389 - RNA, 24 nt, Human
caccaagcugucaucucccaccug

SEQ ID NO: 686390 - RNA, 22 nt, Human
cagcaaggcuuccugcugaucu

SEQ ID NO: 686391 - RNA, 23 nt, Human
cagccugacagagguuucaccaa

SEQ ID NO: 686392 - RNA, 26 nt, Human
ccaauuacagucucaugguuuuccuu

SEQ ID NO: 686393 - RNA, 22 nt, Human
ccaccugacacagugcuuggca

SEQ ID NO: 686394 - RNA, 23 nt, Human
ccagggauagagaaagcggagga

SEQ ID NO: 686395 - RNA, 18 nt, Human
cccccgcgcugggcaggg

SEQ ID NO: 686396 - RNA, 23 nt, Human
cccgugcagaauuuaaaccaaac

SEQ ID NO: 686397 - RNA, 19 nt, Human
ccggagcagccgagagcgg

SEQ ID NO: 686398 - RNA, 18 nt, Human
cgcuaagccgcucggccu

SEQ ID NO: 686399 - RNA, 21 nt, Human
cuaguccacaguuuacugguc

SEQ ID NO: 686400 - RNA, 21 nt, Human
cucagcccaucugccucuagg

SEQ ID NO: 686401 - RNA, 22 nt, Human
cucccaccugacacagugcuug

SEQ ID NO: 686402 - RNA, 20 nt, Human
gaagggaggcccgggagaaa

SEQ ID NO: 686403 - RNA, 21 nt, Human
gagaaagcggaggaagacagc

SEQ ID NO: 686404 - RNA, 19 nt, Human
gaggcccgggagaaagaga

SEQ ID NO: 686405 - RNA, 19 nt, Human
gcagccaggagcccaacag

SEQ ID NO: 686406 - RNA, 22 nt, Human
gcccgggagaaagagagacuca

SEQ ID NO: 686407 - RNA, 18 nt, Human
gccucuagggguggccag

SEQ ID NO: 686408 - RNA, 19 nt, Human
ggaaacagaagggaggccc

SEQ ID NO: 686409 - RNA, 18 nt, Human
ggagucccucuaauucac

SEQ ID NO: 686410 - RNA, 18 nt, Human
ggcagggacaggucgagg

SEQ ID NO: 686411 - RNA, 21 nt, Human
guggcgguugcgcccccgcgc

SEQ ID NO: 686412 - RNA, 19 nt, Human
uaaacucagaagguccucc

SEQ ID NO: 686413 - RNA, 18 nt, Human
uaagaaccacauauggaa

SEQ ID NO: 686414 - RNA, 19 nt, Human
uacuaguccacaguuuacu

SEQ ID NO: 686415 - RNA, 18 nt, Human
uccgaugauuucuuccag

SEQ ID NO: 686416 - RNA, 25 nt, Human
ugcagaauuuaaaccaaacuacaag

SEQ ID NO: 686417 - RNA, 19 nt, Human
ugcccggacccacgccgga

SEQ ID NO: 686418 - RNA, 22 nt, Human
ugcccggacccacgccggaaac

SEQ ID NO: 686419 - RNA, 20 nt, Human
ugccuggacaagccacgaag

SEQ ID NO: 686420 - RNA, 20 nt, Human
uggucagguggccccaacag

SEQ ID NO: 686421 - RNA, 19 nt, Human
uuauucgugcagccggagg

SEQ ID NO: 686422 - RNA, 18 nt, Human
uuuaucucagcccaucug

SEQ ID NO: 686423 - RNA, 22 nt, Human
uuuccugcuccccugcagccca

SEQ ID NO: 686424 - RNA, 20 nt, Human
cugcuagacaggacagcggg

SEQ ID NO: 686425 - RNA, 25 nt, Human
cuuaugaccuuuuuuccaguuuccu

SEQ ID NO: 686426 - RNA, 25 nt, Human
ggaccgaauuucuguaaaccgugca

SEQ ID NO: 686427 - RNA, 19 nt, Human
uuuuuuuuuuuuacugaga

SEQ ID NO: 686428 - RNA, 23 nt, Human
uuuuuuuuuuuuuuuuuuacuga

SEQ ID NO: 686429 - RNA, 19 nt, Human
aaaaugcagcauuagaagg

SEQ ID NO: 686430 - RNA, 21 nt, Human
aaaggccucuacuugcaacug

SEQ ID NO: 686431 - RNA, 22 nt, Human
aaaugcagaagauugaacagcc

SEQ ID NO: 686432 - RNA, 23 nt, Human
aagcacugcggugcccgccccuc

SEQ ID NO: 686433 - RNA, 18 nt, Human
aaggaccuggccaguucc

SEQ ID NO: 686434 - RNA, 19 nt, Human
aaucauagucugauacgcc

SEQ ID NO: 686435 - RNA, 23 nt, Human
acaaaaaccagacaguauuucca

SEQ ID NO: 686436 - RNA, 19 nt, Human
acaaggacguggagaacaa

SEQ ID NO: 686437 - RNA, 20 nt, Human
accacucacaaaugcagaag

SEQ ID NO: 686438 - RNA, 18 nt, Human
agucugauacgccuuugu

SEQ ID NO: 686439 - RNA, 25 nt, Human
augacugaaccacucacaaaugcag

SEQ ID NO: 686440 - RNA, 20 nt, Human
augauuuggaaggugaacac

SEQ ID NO: 686441 - RNA, 22 nt, Human
augcagcauuagaaggugcuua

SEQ ID NO: 686442 - RNA, 20 nt, Human
caaacaucuacaaacaaaaa

SEQ ID NO: 686443 - RNA, 19 nt, Human
caagaauaagucaugcuau

SEQ ID NO: 686444 - RNA, 18 nt, Human
caagagggcuuuguggca

SEQ ID NO: 686445 - RNA, 20 nt, Human
cacugcggugcccgccccuc

SEQ ID NO: 686446 - RNA, 19 nt, Human
caugaucaaggaccuggcc

SEQ ID NO: 686447 - RNA, 19 nt, Human
ccaacgccuaacuaucgag

SEQ ID NO: 686448 - RNA, 26 nt, Human
ccaacgccuaacuaucgagacuugga

SEQ ID NO: 686449 - RNA, 21 nt, Human
ccagggaggcaauugcucucc

SEQ ID NO: 686450 - RNA, 21 nt, Human
cccgccccuccauugagugca

SEQ ID NO: 686451 - RNA, 18 nt, Human
cccuuccucuuuuuuuuc

SEQ ID NO: 686452 - RNA, 21 nt, Human
ccucaugauuuggaaggugaa

SEQ ID NO: 686453 - RNA, 21 nt, Human
cgcaguccccuuccucuuuuu

SEQ ID NO: 686454 - RNA, 24 nt, Human
cggugcccgccccuccauugagug

SEQ ID NO: 686455 - RNA, 21 nt, Human
cucuggucucucuucccucca

SEQ ID NO: 686456 - RNA, 20 nt, Human
cuggccucuaaacucucugg

SEQ ID NO: 686457 - RNA, 18 nt, Human
cuucccagauucccagug

SEQ ID NO: 686458 - RNA, 26 nt, Human
cuuggccaucauguguuuaagauggu

SEQ ID NO: 686459 - RNA, 21 nt, Human
gacaaacaucuacaaacaaaa

SEQ ID NO: 686460 - RNA, 26 nt, Human
gacagcauuaagcacugcggugcccc

SEQ ID NO: 686461 - RNA, 18 nt, Human
gagcaggauaugucuggu

SEQ ID NO: 686462 - RNA, 23 nt, Human
gauguuuuuaacaacaacaaaaa

SEQ ID NO: 686463 - RNA, 19 nt, Human
gcaguccccuuccucuuuu

SEQ ID NO: 686464 - RNA, 20 nt, Human
gccccagggaggcaauugcu

SEQ ID NO: 686465 - RNA, 18 nt, Human
gcccgccccuccauugag

SEQ ID NO: 686466 - RNA, 18 nt, Human
gccucccucaagucucuc

SEQ ID NO: 686467 - RNA, 18 nt, Human
ggaaaaccucaugacuga

SEQ ID NO: 686468 - RNA, 18 nt, Human
guccccuuccucuuuuuu

SEQ ID NO: 686469 - RNA, 18 nt, Human
uaaaaacaucuuuuggaa

SEQ ID NO: 686470 - RNA, 24 nt, Human
uaagaacacucaggggggaaaaaa

SEQ ID NO: 686471 - RNA, 21 nt, Human
uacaaacaaaaacaugaauac

SEQ ID NO: 686472 - RNA, 24 nt, Human
uacaaacaaaaacaugaauacaug

SEQ ID NO: 686473 - RNA, 21 nt, Human
uauuaagagucagaaaggccu

SEQ ID NO: 686474 - RNA, 25 nt, Human
ucaaaacaagaauaagucaugcuau

SEQ ID NO: 686475 - RNA, 26 nt, Human
ucagacaaacaucuacaaacaaaaac

SEQ ID NO: 686476 - RNA, 21 nt, Human
ucagucgcagcgccucccuca

SEQ ID NO: 686477 - RNA, 20 nt, Human
uccagcucccugaauuucug

SEQ ID NO: 686478 - RNA, 19 nt, Human
uccaugaucaaggaccugg

SEQ ID NO: 686479 - RNA, 24 nt, Human
ucccagauucccagugccaggcuc

SEQ ID NO: 686480 - RNA, 19 nt, Human
ucccucuccagcucccuga

SEQ ID NO: 686481 - RNA, 23 nt, Human
ucccugaauuucugaaaguuguc

SEQ ID NO: 686482 - RNA, 19 nt, Human
ucuccagcucccugaauuu

SEQ ID NO: 686483 - RNA, 21 nt, Human
ugaacagccccagggaggcaa

SEQ ID NO: 686484 - RNA, 21 nt, Human
ugacugaaccacucacaaaug

SEQ ID NO: 686485 - RNA, 21 nt, Human
uguaaaucuuugcugcaaaua

SEQ ID NO: 686486 - RNA, 23 nt, Human
uguagcugucucucaguauugaa

SEQ ID NO: 686487 - RNA, 24 nt, Human
uguggcacuuggccaucauguguu

SEQ ID NO: 686488 - RNA, 18 nt, Human
uuagagagcaggauaugu

SEQ ID NO: 686489 - RNA, 20 nt, Human
uuccaugaucaaggaccugg

SEQ ID NO: 686490 - RNA, 22 nt, Human
uugcaaauaaacuaugcuuccc

SEQ ID NO: 686491 - RNA, 19 nt, Human
uuuggaaaaccucaugacu

SEQ ID NO: 686492 - RNA, 23 nt, Human
aaaaacgcaguacucaucuacag

SEQ ID NO: 686493 - RNA, 19 nt, Human
aagaaaaacgcaguacuca

SEQ ID NO: 686494 - RNA, 24 nt, Human
aagcccauaugauuuucagggggu

SEQ ID NO: 686495 - RNA, 24 nt, Human
aaguagcugggaucacaggugcgu

SEQ ID NO: 686496 - RNA, 25 nt, Human
aaguagcugggaucacaggugcgug

SEQ ID NO: 686497 - RNA, 21 nt, Human
aauuuuacuccucuggcauca

SEQ ID NO: 686498 - RNA, 25 nt, Human
acucuguugcccaggcuggagugca

SEQ ID NO: 686499 - RNA, 20 nt, Human
agagggaaagaaaguggagc

SEQ ID NO: 686500 - RNA, 23 nt, Human
agccucaaccuccuaaguagcug

SEQ ID NO: 686501 - RNA, 25 nt, Human
aggcuggagugcaguggcaugaucu

SEQ ID NO: 686502 - RNA, 18 nt, Human
agugcaguggcaugaucu

SEQ ID NO: 686503 - RNA, 19 nt, Human
agugcaguggcaugaucuu

SEQ ID NO: 686504 - RNA, 21 nt, Human
agugcaguggcaugaucuuag

SEQ ID NO: 686505 - RNA, 18 nt, Human
aucaauuaucuaggauca

SEQ ID NO: 686506 - RNA, 21 nt, Human
aucuugaucaaaauucaagua

SEQ ID NO: 686507 - RNA, 23 nt, Human
caaagagguccagacuggaacag

SEQ ID NO: 686508 - RNA, 24 nt, Human
caagugauccucccagccucaacc

SEQ ID NO: 686509 - RNA, 24 nt, Human
cacucuguugcccaggcuggagug

SEQ ID NO: 686510 - RNA, 25 nt, Human
cagacuccugggcucaagugauccu

SEQ ID NO: 686511 - RNA, 18 nt, Human
cagcccaccaaaacggag

SEQ ID NO: 686512 - RNA, 24 nt, Human
cagccucaaccuccuaaguagcug

SEQ ID NO: 686513 - RNA, 25 nt, Human
cagccucaaccuccuaaguagcugg

SEQ ID NO: 686514 - RNA, 19 nt, Human
cagcuccaaagagguccag

SEQ ID NO: 686515 - RNA, 21 nt, Human
cagggggucuacagaugggcc

SEQ ID NO: 686516 - RNA, 24 nt, Human
cagggucucacucuguugcccagg

SEQ ID NO: 686517 - RNA, 26 nt, Human
caguggauuucaucuccaaccagccc

SEQ ID NO: 686518 - RNA, 20 nt, Human
ccaaaacggagagggaaaga

SEQ ID NO: 686519 - RNA, 22 nt, Human
ccagccucaaccuccuaaguag

SEQ ID NO: 686520 - RNA, 19 nt, Human
ccagcuucuaucuagaaau

SEQ ID NO: 686521 - RNA, 22 nt, Human
cccaccaaaacggagagggaaa

SEQ ID NO: 686522 - RNA, 24 nt, Human
cccagccucaaccuccuaaguagc

SEQ ID NO: 686523 - RNA, 19 nt, Human
ccuaaguagcugggaucac

SEQ ID NO: 686524 - RNA, 20 nt, Human
ccucccagccucaaccuccu

SEQ ID NO: 686525 - RNA, 21 nt, Human
ccucccagccucaaccuccua

SEQ ID NO: 686526 - RNA, 26 nt, Human
ccucccagccucaaccuccuaaguag

SEQ ID NO: 686527 - RNA, 22 nt, Human
ccugggcucaagugauccuccc

SEQ ID NO: 686528 - RNA, 25 nt, Human
cucaagugauccucccagccucaac

SEQ ID NO: 686529 - RNA, 24 nt, Human
cucacucuguugcccaggcuggag

SEQ ID NO: 686530 - RNA, 27 nt, Human
cuccagaagcugaagagaguccauaaa

SEQ ID NO: 686531 - RNA, 23 nt, Human
cuccugggcucaagugauccucc

SEQ ID NO: 686532 - RNA, 24 nt, Human
cuggagugcaguggcaugaucuua

SEQ ID NO: 686533 - RNA, 23 nt, Human
gaaaaacgcaguacucaucuaca

SEQ ID NO: 686534 - RNA, 24 nt, Human
gaucacuaaagccucagacuccug

SEQ ID NO: 686535 - RNA, 23 nt, Human
gauuucaucuccaaccagcccac

SEQ ID NO: 686536 - RNA, 24 nt, Human
gcccaggcuggagugcaguggcau

SEQ ID NO: 686537 - RNA, 20 nt, Human
gccucaaccuccuaaguagc

SEQ ID NO: 686538 - RNA, 18 nt, Human
gcuuuagguaccaucagc

SEQ ID NO: 686539 - RNA, 23 nt, Human
gggcucaagugauccucccagcc

SEQ ID NO: 686540 - RNA, 24 nt, Human
gugcuggacuucccuccucagucg

SEQ ID NO: 686541 - RNA, 23 nt, Human
uaaaagaaaaacgcaguacucau

SEQ ID NO: 686542 - RNA, 22 nt, Human
uagaaacagggucucacucugu

SEQ ID NO: 686543 - RNA, 23 nt, Human
uagaucacuaaagccucagacuc

SEQ ID NO: 686544 - RNA, 19 nt, Human
uagugaggucuccagaagc

SEQ ID NO: 686545 - RNA, 21 nt, Human
uaucuugaucaaaauucaagu

SEQ ID NO: 686546 - RNA, 23 nt, Human
ucaaguaccaggcuuuagguacc

SEQ ID NO: 686547 - RNA, 24 nt, Human
ucacucuguugcccaggcuggagu

SEQ ID NO: 686548 - RNA, 21 nt, Human
uccagacuggaacagcgaaac

SEQ ID NO: 686549 - RNA, 23 nt, Human
uccaggauuuacagcuccaaaga

SEQ ID NO: 686550 - RNA, 24 nt, Human
ucccagccucaaccuccuaaguag

SEQ ID NO: 686551 - RNA, 24 nt, Human
uccuaaguagcugggaucacaggu

SEQ ID NO: 686552 - RNA, 24 nt, Human
uccucuggcaucacaugaauccag

SEQ ID NO: 686553 - RNA, 21 nt, Human
uccugggcucaagugauccuc

SEQ ID NO: 686554 - RNA, 24 nt, Human
uccugggcucaagugauccuccca

SEQ ID NO: 686555 - RNA, 22 nt, Human
ucucacucuguugcccaggcug

SEQ ID NO: 686556 - RNA, 23 nt, Human
ucucacucuguugcccaggcugg

SEQ ID NO: 686557 - RNA, 24 nt, Human
ucucacucuguugcccaggcugga

SEQ ID NO: 686558 - RNA, 26 nt, Human
ucucacucuguugcccaggcuggagu

SEQ ID NO: 686559 - RNA, 25 nt, Human
ucuccagaagcugaagagaguccau

SEQ ID NO: 686560 - RNA, 22 nt, Human
ucucuugaaauuuuacuccucu

SEQ ID NO: 686561 - RNA, 18 nt, Human
ucuguugcccaggcugga

SEQ ID NO: 686562 - RNA, 24 nt, Human
ucuguugcccaggcuggagugcag

SEQ ID NO: 686563 - RNA, 18 nt, Human
ugcccaggcuggagugca

SEQ ID NO: 686564 - RNA, 21 nt, Human
ugcccaggcuggagugcagug

SEQ ID NO: 686565 - RNA, 22 nt, Human
ugcccaggcuggagugcagugg

SEQ ID NO: 686566 - RNA, 24 nt, Human
ugcccaggcuggagugcaguggca

SEQ ID NO: 686567 - RNA, 18 nt, Human
ugcgugacacuaugcgug

SEQ ID NO: 686568 - RNA, 19 nt, Human
uggagugcaguggcaugau

SEQ ID NO: 686569 - RNA, 24 nt, Human
uggagugcaguggcaugaucuuag

SEQ ID NO: 686570 - RNA, 21 nt, Human
ugggaucacaggugcgugaca

SEQ ID NO: 686571 - RNA, 22 nt, Human
ugggaucacaggugcgugacac

SEQ ID NO: 686572 - RNA, 24 nt, Human
ugggaucacaggugcgugacacua

SEQ ID NO: 686573 - RNA, 19 nt, Human
ugggcucaagugauccucc

SEQ ID NO: 686574 - RNA, 24 nt, Human
uugcccaggcuggagugcaguggc

SEQ ID NO: 686575 - RNA, 18 nt, Human
uuucaucuccaaccagcc

SEQ ID NO: 686576 - RNA, 19 nt, Human
uuuuuuuuuagaaacaggg

SEQ ID NO: 686577 - RNA, 24 nt, Human
uuuuuuuuuagaaacagggucuca

SEQ ID NO: 686578 - RNA, 18 nt, Human
uuuuuuuuuuuuuuuuug

SEQ ID NO: 686579 - RNA, 19 nt, Human
caccuugggaaaagacccc

SEQ ID NO: 686580 - RNA, 22 nt, Human
caccuugggaaaagaccccaag

SEQ ID NO: 686581 - RNA, 24 nt, Human
cauguacaauaaauaauucauaua

SEQ ID NO: 686582 - RNA, 19 nt, Human
gagcccgcuucuacaucca

SEQ ID NO: 686583 - RNA, 23 nt, Human
gcccgcuucuacauccaccccgc

SEQ ID NO: 686584 - RNA, 18 nt, Human
ggagagugggacgccgga

SEQ ID NO: 686585 - RNA, 22 nt, Human
ugggaaaagaccccaaguuagc

SEQ ID NO: 686586 - RNA, 20 nt, Human
uuuuuuuuuuuuuuuugcug

SEQ ID NO: 686587 - RNA, 18 nt, Human
uuuuuuuuuuuuuuuuug

SEQ ID NO: 686588 - RNA, 20 nt, Human
uuuuuuuuuuuuuuuuugcu

SEQ ID NO: 686589 - RNA, 23 nt, Human
uccaauagaaaaacauaguuacu

SEQ ID NO: 686590 - RNA, 18 nt, Human
ugucuccaauagaaaaac

SEQ ID NO: 686591 - RNA, 22 nt, Human
uuacgauguucauuuugucucc

SEQ ID NO: 686592 - RNA, 23 nt, Human
aaaaaaaaaguuuggauuacagu

SEQ ID NO: 686593 - RNA, 18 nt, Human
aaacaagagguucuaaac

SEQ ID NO: 686594 - RNA, 18 nt, Human
aaacaagagguucuaaac

SEQ ID NO: 686595 - RNA, 25 nt, Human
aaacacuuagcacuucagaaauuaa

SEQ ID NO: 686596 - RNA, 19 nt, Human
aaacagaaaacccacaaga

SEQ ID NO: 686597 - RNA, 20 nt, Human
aaacagaaaacccacaagac

SEQ ID NO: 686598 - RNA, 19 nt, Human
aaacagauaacagugcaua

SEQ ID NO: 686599 - RNA, 19 nt, Human
aaacagaugccaugacucc

SEQ ID NO: 686600 - RNA, 18 nt, Human
aaaccuuuuagcccaagg

SEQ ID NO: 686601 - RNA, 21 nt, Human
aacagaaaacccacaagacua

SEQ ID NO: 686602 - RNA, 21 nt, Human
aagccaauaguacaaaacuga

SEQ ID NO: 686603 - RNA, 20 nt, Human
aaggcgccggcuaucuacaa

SEQ ID NO: 686604 - RNA, 20 nt, Human
aagguccuuucccccccuuu

SEQ ID NO: 686605 - RNA, 20 nt, Human
aaucaagcgcuaugauguca

SEQ ID NO: 686606 - RNA, 22 nt, Human
acaaggaaaucugugucaaaac

SEQ ID NO: 686607 - RNA, 19 nt, Human
acucacccuacacccuucc

SEQ ID NO: 686608 - RNA, 23 nt, Human
agacauuuaacaauguagguaua

SEQ ID NO: 686609 - RNA, 18 nt, Human
aggcggcggcggcggagg

SEQ ID NO: 686610 - RNA, 18 nt, Human
augacacacaucauaggc

SEQ ID NO: 686611 - RNA, 26 nt, Human
caaacagaaaacccacaagacuaaua

SEQ ID NO: 686612 - RNA, 20 nt, Human
caagacuaauagagaaccaa

SEQ ID NO: 686613 - RNA, 21 nt, Human
cacaagacuaauagagaacca

SEQ ID NO: 686614 - RNA, 19 nt, Human
cacuauuguaggccagacu

SEQ ID NO: 686615 - RNA, 19 nt, Human
cacugguggaaagcaaaau

SEQ ID NO: 686616 - RNA, 24 nt, Human
cacuucagaaauuaaaaauggccu

SEQ ID NO: 686617 - RNA, 19 nt, Human
cagaaaacccacaagacua

SEQ ID NO: 686618 - RNA, 23 nt, Human
cagcagcuuugagcagcagcaag

SEQ ID NO: 686619 - RNA, 19 nt, Human
cauuuuacaaggaaaucug

SEQ ID NO: 686620 - RNA, 18 nt, Human
cccagaaauguuagaaau

SEQ ID NO: 686621 - RNA, 19 nt, Human
cccuacuuauauaaucugu

SEQ ID NO: 686622 - RNA, 23 nt, Human
cuacucacccuacacccuuccua

SEQ ID NO: 686623 - RNA, 20 nt, Human
cucaaaauaaaaaaauaaga

SEQ ID NO: 686624 - RNA, 23 nt, Human
cucacccuacacccuuccuaaaa

SEQ ID NO: 686625 - RNA, 19 nt, Human
gagcagcagcaaggcggcg

SEQ ID NO: 686626 - RNA, 23 nt, Human
gagccugcuugauucaaagccaa

SEQ ID NO: 686627 - RNA, 22 nt, Human
gcacugguggaaagcaaaauug

SEQ ID NO: 686628 - RNA, 19 nt, Human
gcgaugggaagaggaaggc

SEQ ID NO: 686629 - RNA, 21 nt, Human
ggaaggcgccggcuaucuaca

SEQ ID NO: 686630 - RNA, 20 nt, Human
ggcacaacucauauugugcu

SEQ ID NO: 686631 - RNA, 20 nt, Human
ggcccgggagccaaucgcgg

SEQ ID NO: 686632 - RNA, 21 nt, Human
gguaaauaggcaaucaucucu

SEQ ID NO: 686633 - RNA, 23 nt, Human
gucagagagcccagaaauguuag

SEQ ID NO: 686634 - RNA, 28 nt, Human
guccuuucccccccuuuguuaauuucuu

SEQ ID NO: 686635 - RNA, 19 nt, Human
uaacaauguagguauaucc

SEQ ID NO: 686636 - RNA, 21 nt, Human
uaagguccuuucccccccuuu

SEQ ID NO: 686637 - RNA, 18 nt, Human
uaaguuucaucacgacug

SEQ ID NO: 686638 - RNA, 23 nt, Human
uaaucuguauacguuuucuaggg

SEQ ID NO: 686639 - RNA, 22 nt, Human
uacaaucagaacgugggcugac

SEQ ID NO: 686640 - RNA, 26 nt, Human
uacacccuuccuaaaaucucgaggac

SEQ ID NO: 686641 - RNA, 26 nt, Human
uaccauaacaacauuguacaaauuua

SEQ ID NO: 686642 - RNA, 20 nt, Human
uagaaggagacaccgguggc

SEQ ID NO: 686643 - RNA, 18 nt, Human
uagcccaaggggcggcag

SEQ ID NO: 686644 - RNA, 21 nt, Human
uauaguuucuguauugaaaua

SEQ ID NO: 686645 - RNA, 21 nt, Human
ucacccuacacccuuccuaaa

SEQ ID NO: 686646 - RNA, 21 nt, Human
ucauggucuuugauuuuuucu

SEQ ID NO: 686647 - RNA, 19 nt, Human
ucgcacugguggaaagcaa

SEQ ID NO: 686648 - RNA, 19 nt, Human
ugacagcacacuauugaau

SEQ ID NO: 686649 - RNA, 22 nt, Human
ugccgugucugauuucacauca

SEQ ID NO: 686650 - RNA, 20 nt, Human
ugcuguagagccccccccuu

SEQ ID NO: 686651 - RNA, 22 nt, Human
uggcagccggcgcagaggcgga

SEQ ID NO: 686652 - RNA, 21 nt, Human
uguagaaggagacaccggugg

SEQ ID NO: 686653 - RNA, 21 nt, Human
ugugugagaugugauuuuaug

SEQ ID NO: 686654 - RNA, 24 nt, Human
uuaaaaugacacacaucauaggcu

SEQ ID NO: 686655 - RNA, 24 nt, Human
uuaaacaaguuaccucuaucaaau

SEQ ID NO: 686656 - RNA, 24 nt, Human
uuaauaguggcacucaaaauaaaa

SEQ ID NO: 686657 - RNA, 22 nt, Human
uuaauuuugguaaacuaggcac

SEQ ID NO: 686658 - RNA, 23 nt, Human
uuaauuuugguaaacuaggcaca

SEQ ID NO: 686659 - RNA, 24 nt, Human
uuauauaaucuguauacguuuucu

SEQ ID NO: 686660 - RNA, 23 nt, Human
uucaaacagaaaacccacaagac

SEQ ID NO: 686661 - RNA, 20 nt, Human
uuccagaauccgaugcggug

SEQ ID NO: 686662 - RNA, 19 nt, Human
uucuaagcagaaagaaauu

SEQ ID NO: 686663 - RNA, 20 nt, Human
uuuacauuuacaaucacaug

SEQ ID NO: 686664 - RNA, 25 nt, Human
uuuagacauuuaacaauguagguau

SEQ ID NO: 686665 - RNA, 21 nt, Human
uuucaaacagaaaacccacaa

SEQ ID NO: 686666 - RNA, 25 nt, Human
uuucacaucaacaagucacuggaaa

SEQ ID NO: 686667 - RNA, 21 nt, Human
uuuuuuuuuuuuuuucacagg

SEQ ID NO: 686668 - RNA, 23 nt, Human
uuuuuuuuuuuuuuuuucacagg

SEQ ID NO: 686669 - RNA, 23 nt, Human
aaaagagucaacuaaagccugaa

SEQ ID NO: 686670 - RNA, 21 nt, Human
aaccaauuauccaguccuccc

SEQ ID NO: 686671 - RNA, 23 nt, Human
acacacacacacacacacacaca

SEQ ID NO: 686672 - RNA, 23 nt, Human
acacacacacacacacacacaca

SEQ ID NO: 686673 - RNA, 23 nt, Human
acacacacacacacacacacaca

SEQ ID NO: 686674 - RNA, 25 nt, Human
acacacacacacacacacacauucu

SEQ ID NO: 686675 - RNA, 25 nt, Human
acacacacacacacacacacauucu

SEQ ID NO: 686676 - RNA, 27 nt, Human
acacacacacacacauucuagcauggu

SEQ ID NO: 686677 - RNA, 18 nt, Human
accaauuauccaguccuc

SEQ ID NO: 686678 - RNA, 21 nt, Human
accaauuauccaguccucccc

SEQ ID NO: 686679 - RNA, 19 nt, Human
agaaaacuauauacuccac

SEQ ID NO: 686680 - RNA, 23 nt, Human
auacaaaaguaaacuacauucau

SEQ ID NO: 686681 - RNA, 21 nt, Human
caagcagccuagaugcuuccc

SEQ ID NO: 686682 - RNA, 20 nt, Human
cacacacacacacacacaca

SEQ ID NO: 686683 - RNA, 20 nt, Human
cacacacacacacacacaca

SEQ ID NO: 686684 - RNA, 20 nt, Human
cacacacacacacacacaca

SEQ ID NO: 686685 - RNA, 20 nt, Human
cacacacacacacacacaca

SEQ ID NO: 686686 - RNA, 20 nt, Human
cacacacacacacacacaca

SEQ ID NO: 686687 - RNA, 22 nt, Human
cacacacacacacacacacaca

SEQ ID NO: 686688 - RNA, 26 nt, Human
cacacacacacacacacacacacaca

SEQ ID NO: 686689 - RNA, 26 nt, Human
cacacacacacacacacacacacaca

SEQ ID NO: 686690 - RNA, 25 nt, Human
cauacacacacacacacacacacac

SEQ ID NO: 686691 - RNA, 18 nt, Human
ccaaauagccauugugau

SEQ ID NO: 686692 - RNA, 24 nt, Human
cccaccacuauccucuccccgacc

SEQ ID NO: 686693 - RNA, 31 nt, Human
ccccgaccuauacauacauacacacacacag

SEQ ID NO: 686694 - RNA, 22 nt, Human
cccgaccuauacauacauacac

SEQ ID NO: 686695 - RNA, 23 nt, Human
ccuuccugcuauuuuggucugac

SEQ ID NO: 686696 - RNA, 24 nt, Human
cuccaaaauaucuuuuaaggagaa

SEQ ID NO: 686697 - RNA, 21 nt, Human
cuuagucacuuaucugcucuu

SEQ ID NO: 686698 - RNA, 19 nt, Human
cuucuugaugagggucagg

SEQ ID NO: 686699 - RNA, 19 nt, Human
cuugcugcaauaccuuccu

SEQ ID NO: 686700 - RNA, 24 nt, Human
gaaaaucaaaauucaaauacaaaa

SEQ ID NO: 686701 - RNA, 29 nt, Human
gaccuauacauacauacacacacacacac

SEQ ID NO: 686702 - RNA, 19 nt, Human
gcauguuucagaagaaugg

SEQ ID NO: 686703 - RNA, 20 nt, Human
uacacacacacacacacaca

SEQ ID NO: 686704 - RNA, 25 nt, Human
uacacacacacacacacacacacac

SEQ ID NO: 686705 - RNA, 26 nt, Human
uacauacacacacacacacacacaca

SEQ ID NO: 686706 - RNA, 26 nt, Human
uacauacauacacacacacacacaca

SEQ ID NO: 686707 - RNA, 20 nt, Human
uauauacuccacaaaaugua

SEQ ID NO: 686708 - RNA, 24 nt, Human
uauccaguccuccccgcuuccuua

SEQ ID NO: 686709 - RNA, 27 nt, Human
uauguuacuuucuugacauauuucaga

SEQ ID NO: 686710 - RNA, 18 nt, Human
uauuuuggucugacuucc

SEQ ID NO: 686711 - RNA, 23 nt, Human
ucacuccaaaauaucuuuuaagg

SEQ ID NO: 686712 - RNA, 23 nt, Human
ucaggcacaacuuuuugcgggga

SEQ ID NO: 686713 - RNA, 18 nt, Human
ucagguucagacacaugu

SEQ ID NO: 686714 - RNA, 20 nt, Human
uccaaaauaucuuuuaagga

SEQ ID NO: 686715 - RNA, 22 nt, Human
ucccaccacuauccucuccccg

SEQ ID NO: 686716 - RNA, 25 nt, Human
ucuacaaauagaaaaaauaauauua

SEQ ID NO: 686717 - RNA, 20 nt, Human
ucucaaacuccagguuccaa

SEQ ID NO: 686718 - RNA, 24 nt, Human
ucuccaaauagccauugugauguu

SEQ ID NO: 686719 - RNA, 18 nt, Human
ucugccucuucgauuucc

SEQ ID NO: 686720 - RNA, 23 nt, Human
ugagggucaggugucugauggug

SEQ ID NO: 686721 - RNA, 21 nt, Human
uggcauguuucagaagaaugg

SEQ ID NO: 686722 - RNA, 27 nt, Human
uguucccaccacuauccucuccccgac

SEQ ID NO: 686723 - RNA, 20 nt, Human
uucaucacuccaaaauaucu

SEQ ID NO: 686724 - RNA, 22 nt, Human
uuccucaggcacaacuuuuugc

SEQ ID NO: 686725 - RNA, 18 nt, Human
uuguacugcuauuucuug

SEQ ID NO: 686726 - RNA, 19 nt, Human
uuuccuguucucugcugcu

SEQ ID NO: 686727 - RNA, 20 nt, Human
uuuccuguucucugcugcuu

SEQ ID NO: 686728 - RNA, 19 nt, Human
uuuguuguuucuuucugcc

SEQ ID NO: 686729 - RNA, 19 nt, Human
aaaaggaaacaccccucac

SEQ ID NO: 686730 - RNA, 24 nt, Human
aaaauucuuccagccucugcccau

SEQ ID NO: 686731 - RNA, 18 nt, Human
aaacaccccucacuggcu

SEQ ID NO: 686732 - RNA, 22 nt, Human
aaacaccccucacuggcucaag

SEQ ID NO: 686733 - RNA, 19 nt, Human
aaccuggcgccugcuccua

SEQ ID NO: 686734 - RNA, 20 nt, Human
aacucagcucucccagcuga

SEQ ID NO: 686735 - RNA, 26 nt, Human
aagcaggcagucauccuugagccaaa

SEQ ID NO: 686736 - RNA, 22 nt, Human
aaggccucaguuuccccaacua

SEQ ID NO: 686737 - RNA, 20 nt, Human
aauauaggcuccccaaaggg

SEQ ID NO: 686738 - RNA, 24 nt, Human
acaacagcgaggagucaagagccc

SEQ ID NO: 686739 - RNA, 23 nt, Human
acagagcaggcauccuaaaggag

SEQ ID NO: 686740 - RNA, 22 nt, Human
acagcagcacucuaauuugggc

SEQ ID NO: 686741 - RNA, 23 nt, Human
acaucaccagcacucaccaaccu

SEQ ID NO: 686742 - RNA, 19 nt, Human
acccccuucgcccucccca

SEQ ID NO: 686743 - RNA, 21 nt, Human
accggaauacaugggcugcca

SEQ ID NO: 686744 - RNA, 24 nt, Human
accucaagccagcaguucucaaac

SEQ ID NO: 686745 - RNA, 18 nt, Human
accuucucuugcucucca

SEQ ID NO: 686746 - RNA, 18 nt, Human
acgggccagcccugcugg

SEQ ID NO: 686747 - RNA, 23 nt, Human
acuggcugcccuggccugggccu

SEQ ID NO: 686748 - RNA, 25 nt, Human
agaaagacagaaagggcaauacugg

SEQ ID NO: 686749 - RNA, 19 nt, Human
agaaucgaagguggauagg

SEQ ID NO: 686750 - RNA, 19 nt, Human
agagccaaagggcacaagg

SEQ ID NO: 686751 - RNA, 21 nt, Human
agaguccaugcagcuggggcu

SEQ ID NO: 686752 - RNA, 19 nt, Human
agaguggccccuggaccca

SEQ ID NO: 686753 - RNA, 20 nt, Human
agcaagggaggggauagggc

SEQ ID NO: 686754 - RNA, 18 nt, Human
agcacugauggggccuug

SEQ ID NO: 686755 - RNA, 25 nt, Human
agccaagagcuccaggaaaccuggc

SEQ ID NO: 686756 - RNA, 23 nt, Human
agccaggacucuggcugggggcu

SEQ ID NO: 686757 - RNA, 19 nt, Human
agccaggacuggcugaggu

SEQ ID NO: 686758 - RNA, 21 nt, Human
agccauagugcagggcaacac

SEQ ID NO: 686759 - RNA, 20 nt, Human
aggaagccaggggcagcuca

SEQ ID NO: 686760 - RNA, 20 nt, Human
aggagcaagggaggggauag

SEQ ID NO: 686761 - RNA, 23 nt, Human
agggggcuuguccagggcagaag

SEQ ID NO: 686762 - RNA, 26 nt, Human
agggguucucaccucaagccagcagu

SEQ ID NO: 686763 - RNA, 18 nt, Human
agucccagcucuauucua

SEQ ID NO: 686764 - RNA, 23 nt, Human
auacaugggcugccaggucagau

SEQ ID NO: 686765 - RNA, 19 nt, Human
auagcccaggguccaggug

SEQ ID NO: 686766 - RNA, 22 nt, Human
augccacaaugugccaagccag

SEQ ID NO: 686767 - RNA, 21 nt, Human
augggccugaggccaggaggg

SEQ ID NO: 686768 - RNA, 22 nt, Human
caacacagagcaacugcccuca

SEQ ID NO: 686769 - RNA, 18 nt, Human
caacugcccucagccacu

SEQ ID NO: 686770 - RNA, 23 nt, Human
caagaccucaggggcuugcacag

SEQ ID NO: 686771 - RNA, 22 nt, Human
caagagccaaagggcacaagga

SEQ ID NO: 686772 - RNA, 20 nt, Human
cacagaccagagcuggggug

SEQ ID NO: 686773 - RNA, 24 nt, Human
cacaucaccagcacucaccaaccu

SEQ ID NO: 686774 - RNA, 18 nt, Human
caccagcacucaccaacc

SEQ ID NO: 686775 - RNA, 19 nt, Human
cacccagguuccuucugga

SEQ ID NO: 686776 - RNA, 22 nt, Human
cacccccuucgcccuccccacc

SEQ ID NO: 686777 - RNA, 21 nt, Human
cacuggguccuuccucccugu

SEQ ID NO: 686778 - RNA, 20 nt, Human
cagaagagccagcuucucau

SEQ ID NO: 686779 - RNA, 25 nt, Human
cagaggaugcugccuauuggaccau

SEQ ID NO: 686780 - RNA, 20 nt, Human
cagaguccaugcagcugggg

SEQ ID NO: 686781 - RNA, 20 nt, Human
cagcacucaccaaccuagag

SEQ ID NO: 686782 - RNA, 18 nt, Human
cagcugccccgacagugu

SEQ ID NO: 686783 - RNA, 23 nt, Human
cagcugccccgacagugucacuc

SEQ ID NO: 686784 - RNA, 23 nt, Human
cagggcaguggaggacuaaucaa

SEQ ID NO: 686785 - RNA, 26 nt, Human
caucagaccauacugccaggcccugg

SEQ ID NO: 686786 - RNA, 19 nt, Human
caucagcuccauguccucc

SEQ ID NO: 686787 - RNA, 19 nt, Human
caucgagaguacugcacaa

SEQ ID NO: 686788 - RNA, 18 nt, Human
caucugggcucaacgucc

SEQ ID NO: 686789 - RNA, 24 nt, Human
caugcagcuggggcugggcacagg

SEQ ID NO: 686790 - RNA, 20 nt, Human
cauggagaaacccacugaca

SEQ ID NO: 686791 - RNA, 24 nt, Human
cauggagaaacccacugacaacug

SEQ ID NO: 686792 - RNA, 23 nt, Human
cauuuuggggggucacuguucag

SEQ ID NO: 686793 - RNA, 20 nt, Human
ccacacugcacccccacacc

SEQ ID NO: 686794 - RNA, 19 nt, Human
ccacucugaugugauggag

SEQ ID NO: 686795 - RNA, 19 nt, Human
ccagacccuccccuccaga

SEQ ID NO: 686796 - RNA, 24 nt, Human
ccagagcagggguagaguugcuuu

SEQ ID NO: 686797 - RNA, 22 nt, Human
ccagcaauauaggcuccccaaa

SEQ ID NO: 686798 - RNA, 18 nt, Human
ccagcucuauucuagaaa

SEQ ID NO: 686799 - RNA, 20 nt, Human
ccaggacucuggcugggggc

SEQ ID NO: 686800 - RNA, 24 nt, Human
ccauaagaaccugggcucuggaaa

SEQ ID NO: 686801 - RNA, 25 nt, Human
ccauaucccccgauacccccacagc

SEQ ID NO: 686802 - RNA, 23 nt, Human
cccacagcaauuucaccaacaca

SEQ ID NO: 686803 - RNA, 20 nt, Human
ccccacaccacuaccaagca

SEQ ID NO: 686804 - RNA, 22 nt, Human
ccccacagcaauuucaccaaca

SEQ ID NO: 686805 - RNA, 23 nt, Human
cccccacaccacuaccaagcagg

SEQ ID NO: 686806 - RNA, 20 nt, Human
cccccagggcuuuucccaca

SEQ ID NO: 686807 - RNA, 19 nt, Human
ccucauggcuucccauccc

SEQ ID NO: 686808 - RNA, 19 nt, Human
ccuccagacccuccccucc

SEQ ID NO: 686809 - RNA, 18 nt, Human
ccuuagaagccaaggcug

SEQ ID NO: 686810 - RNA, 18 nt, Human
ccuugagccaaaacgcag

SEQ ID NO: 686811 - RNA, 22 nt, Human
cgagaguacugcacaaaggcug

SEQ ID NO: 686812 - RNA, 24 nt, Human
cgaggagucaagagcccaagacug

SEQ ID NO: 686813 - RNA, 21 nt, Human
cucaauacuuuacuggccaua

SEQ ID NO: 686814 - RNA, 18 nt, Human
cucacucuccccagcccc

SEQ ID NO: 686815 - RNA, 18 nt, Human
cucacucuccccagcccc

SEQ ID NO: 686816 - RNA, 19 nt, Human
cucauggcuucccaucccu

SEQ ID NO: 686817 - RNA, 22 nt, Human
cuccacacugcacccccacacc

SEQ ID NO: 686818 - RNA, 18 nt, Human
cuccagaaagcaggcagu

SEQ ID NO: 686819 - RNA, 21 nt, Human
cuccagcaauugcaucacucu

SEQ ID NO: 686820 - RNA, 21 nt, Human
cucccauucugccugcaagug

SEQ ID NO: 686821 - RNA, 19 nt, Human
cucccugugucugcccucc

SEQ ID NO: 686822 - RNA, 21 nt, Human
cuccuacacuccugucuaugc

SEQ ID NO: 686823 - RNA, 22 nt, Human
cugaagacagcaagagccaaag

SEQ ID NO: 686824 - RNA, 21 nt, Human
cugaaggaggcugcacgggca

SEQ ID NO: 686825 - RNA, 18 nt, Human
cugaaggcaugguacaga

SEQ ID NO: 686826 - RNA, 24 nt, Human
cugcacccccacaccacuaccaag

SEQ ID NO: 686827 - RNA, 20 nt, Human
cugcuccuacugccgccaag

SEQ ID NO: 686828 - RNA, 21 nt, Human
cugcuggcuccaucucuagac

SEQ ID NO: 686829 - RNA, 18 nt, Human
cuggcugaaggaggcugc

SEQ ID NO: 686830 - RNA, 21 nt, Human
cuggcugcccuggccugggcc

SEQ ID NO: 686831 - RNA, 19 nt, Human
cugggccucaaggcacugg

SEQ ID NO: 686832 - RNA, 23 nt, Human
cugggcucaacguccagggccca

SEQ ID NO: 686833 - RNA, 18 nt, Human
cuuccagccucugcccau

SEQ ID NO: 686834 - RNA, 20 nt, Human
cuugagccaaaacgcagaug

SEQ ID NO: 686835 - RNA, 25 nt, Human
cuuguggccccagcugccccgacag

SEQ ID NO: 686836 - RNA, 18 nt, Human
cuuuaugaugucagcugc

SEQ ID NO: 686837 - RNA, 21 nt, Human
gaaagguucuccagagugcuu

SEQ ID NO: 686838 - RNA, 20 nt, Human
gaaaugccauaagaaccugg

SEQ ID NO: 686839 - RNA, 21 nt, Human
gaacucagcucucccagcugc

SEQ ID NO: 686840 - RNA, 22 nt, Human
gaagaaaaaaaagagaaaagaa

SEQ ID NO: 686841 - RNA, 20 nt, Human
gaagacagcaagagccaaag

SEQ ID NO: 686842 - RNA, 20 nt, Human
gaagaggcugucugcauucc

SEQ ID NO: 686843 - RNA, 23 nt, Human
gacccuccccuccagaaagcaac

SEQ ID NO: 686844 - RNA, 18 nt, Human
gacucacgugccuuccuc

SEQ ID NO: 686845 - RNA, 18 nt, Human
gagaaagacagaaagggc

SEQ ID NO: 686846 - RNA, 19 nt, Human
gagaauccacuaagaagga

SEQ ID NO: 686847 - RNA, 25 nt, Human
gagcccuuuuguucugaugacagcc

SEQ ID NO: 686848 - RNA, 23 nt, Human
gagucugcacagaccagagcugg

SEQ ID NO: 686849 - RNA, 19 nt, Human
gauacuccuuccaucucaa

SEQ ID NO: 686850 - RNA, 18 nt, Human
gcaaagggaaggugugug

SEQ ID NO: 686851 - RNA, 18 nt, Human
gcaggacacuggggcacu

SEQ ID NO: 686852 - RNA, 24 nt, Human
gccaaaacgcagaugagcuuccug

SEQ ID NO: 686853 - RNA, 19 nt, Human
gccacaaugugccaagcca

SEQ ID NO: 686854 - RNA, 19 nt, Human
gccagcagagguaugggcu

SEQ ID NO: 686855 - RNA, 18 nt, Human
gcccaaggucacauccug

SEQ ID NO: 686856 - RNA, 19 nt, Human
gcccuccccacccagguuc

SEQ ID NO: 686857 - RNA, 20 nt, Human
gcccuggacucagaagagcc

SEQ ID NO: 686858 - RNA, 18 nt, Human
gcccuugugauuauacuc

SEQ ID NO: 686859 - RNA, 22 nt, Human
gcuaccagccugcuggcuccau

SEQ ID NO: 686860 - RNA, 18 nt, Human
gcugaagcccagggcagu

SEQ ID NO: 686861 - RNA, 20 nt, Human
gcugguggugguggggaggc

SEQ ID NO: 686862 - RNA, 25 nt, Human
ggacucuggcugggggcuggcugaa

SEQ ID NO: 686863 - RNA, 20 nt, Human
ggagaucaggucacuguccu

SEQ ID NO: 686864 - RNA, 19 nt, Human
ggagcagccaauagcccag

SEQ ID NO: 686865 - RNA, 19 nt, Human
ggagcugcagugugaccuc

SEQ ID NO: 686866 - RNA, 18 nt, Human
ggauagggcaggugggcc

SEQ ID NO: 686867 - RNA, 18 nt, Human
ggccucaguuuccccaac

SEQ ID NO: 686868 - RNA, 19 nt, Human
ggcugggggcuggcugaag

SEQ ID NO: 686869 - RNA, 24 nt, Human
ggcugggggcuggcugaagccaag

SEQ ID NO: 686870 - RNA, 21 nt, Human
ggcuuguccagggcagaaggu

SEQ ID NO: 686871 - RNA, 19 nt, Human
gggaaaugccauaagaacc

SEQ ID NO: 686872 - RNA, 20 nt, Human
gggcaaggauugggagcagc

SEQ ID NO: 686873 - RNA, 21 nt, Human
gggcacuggguccuuccuccc

SEQ ID NO: 686874 - RNA, 22 nt, Human
gggcaggugggccuggcuuucc

SEQ ID NO: 686875 - RNA, 20 nt, Human
gggccauagugaggagaggc

SEQ ID NO: 686876 - RNA, 26 nt, Human
gggcccccagggcuuuucccacaguu

SEQ ID NO: 686877 - RNA, 18 nt, Human
gggccugaggccaggagg

SEQ ID NO: 686878 - RNA, 24 nt, Human
ggggcuggcugaagccaagagcuc

SEQ ID NO: 686879 - RNA, 18 nt, Human
ggggcugggcacagggca

SEQ ID NO: 686880 - RNA, 19 nt, Human
ggucacauccuggugaggg

SEQ ID NO: 686881 - RNA, 23 nt, Human
guccuccagccauagugcagggc

SEQ ID NO: 686882 - RNA, 19 nt, Human
gugaggggcagauucuggg

SEQ ID NO: 686883 - RNA, 21 nt, Human
guggauagggaaagacaugcu

SEQ ID NO: 686884 - RNA, 18 nt, Human
guggugguggggaggcug

SEQ ID NO: 686885 - RNA, 23 nt, Human
uaaaauaaaaaagcauuaagucc

SEQ ID NO: 686886 - RNA, 20 nt, Human
uaacuuacugucuccacuug

SEQ ID NO: 686887 - RNA, 19 nt, Human
uaaggcagcuguaugagac

SEQ ID NO: 686888 - RNA, 21 nt, Human
uacccccacagcaauuucacc

SEQ ID NO: 686889 - RNA, 23 nt, Human
uaccugggaguaagggggucagg

SEQ ID NO: 686890 - RNA, 20 nt, Human
uacugcacaaaggcugaagc

SEQ ID NO: 686891 - RNA, 19 nt, Human
uagaaaaugcauguaccau

SEQ ID NO: 686892 - RNA, 24 nt, Human
uaggugauuaagacacugccauuu

SEQ ID NO: 686893 - RNA, 19 nt, Human
ucacucuccaacacugcac

SEQ ID NO: 686894 - RNA, 19 nt, Human
ucacucugaccucugcuuc

SEQ ID NO: 686895 - RNA, 18 nt, Human
ucacugucaugugaccuc

SEQ ID NO: 686896 - RNA, 19 nt, Human
ucagagcacugauggggcc

SEQ ID NO: 686897 - RNA, 23 nt, Human
ucagaguccaugcagcuggggcu

SEQ ID NO: 686898 - RNA, 21 nt, Human
ucagccuuagaagccaaggcu

SEQ ID NO: 686899 - RNA, 22 nt, Human
ucagggcagcuacccugagaug

SEQ ID NO: 686900 - RNA, 23 nt, Human
uccacacugcacccccacaccac

SEQ ID NO: 686901 - RNA, 22 nt, Human
uccagggcagaaggucaugagg

SEQ ID NO: 686902 - RNA, 21 nt, Human
uccugcuuguggccccagcug

SEQ ID NO: 686903 - RNA, 22 nt, Human
uccuggugaggggcagauucug

SEQ ID NO: 686904 - RNA, 18 nt, Human
ucgaagguggauagggaa

SEQ ID NO: 686905 - RNA, 20 nt, Human
ucgagucucuggcuuuggcc

SEQ ID NO: 686906 - RNA, 19 nt, Human
ucuagaaaaugcauguacc

SEQ ID NO: 686907 - RNA, 21 nt, Human
ucuccagagugcuuccagguu

SEQ ID NO: 686908 - RNA, 19 nt, Human
ucuccugguguggcuguug

SEQ ID NO: 686909 - RNA, 18 nt, Human
ucucucaauacuuuacug

SEQ ID NO: 686910 - RNA, 22 nt, Human
ucugcauuccucggcucauggc

SEQ ID NO: 686911 - RNA, 19 nt, Human
ucugcccaaggucacaucc

SEQ ID NO: 686912 - RNA, 23 nt, Human
ucugggcucaacguccagggccc

SEQ ID NO: 686913 - RNA, 19 nt, Human
ugaacguggaugugcgacc

SEQ ID NO: 686914 - RNA, 22 nt, Human
ugaacuuggguaugccagaucc

SEQ ID NO: 686915 - RNA, 23 nt, Human
ugaagacagcaagagccaaaggg

SEQ ID NO: 686916 - RNA, 22 nt, Human
ugaaggaggcugcacgggcagu

SEQ ID NO: 686917 - RNA, 18 nt, Human
ugaggacucacgugccuu

SEQ ID NO: 686918 - RNA, 21 nt, Human
ugaggagaggcugaggggaga

SEQ ID NO: 686919 - RNA, 21 nt, Human
ugaggggagauguaggcugcc

SEQ ID NO: 686920 - RNA, 19 nt, Human
ugaggggagauguaggcuu

SEQ ID NO: 686921 - RNA, 24 nt, Human
ugaggugaagucaucugcccaagg

SEQ ID NO: 686922 - RNA, 22 nt, Human
ugagucugcacagaccagagcu

SEQ ID NO: 686923 - RNA, 24 nt, Human
ugccaagccaggcacauuccaugg

SEQ ID NO: 686924 - RNA, 22 nt, Human
ugccagauccacagggggcccc

SEQ ID NO: 686925 - RNA, 20 nt, Human
ugccaggcuaccagccugcu

SEQ ID NO: 686926 - RNA, 18 nt, Human
ugccuuguaucccugccu

SEQ ID NO: 686927 - RNA, 19 nt, Human
ugcuaugugaagguaauau

SEQ ID NO: 686928 - RNA, 22 nt, Human
ugcugguggugguggggaggcu

SEQ ID NO: 686929 - RNA, 18 nt, Human
ugcuuguggccccagcug

SEQ ID NO: 686930 - RNA, 21 nt, Human
ugcuuguggccccagcugccc

SEQ ID NO: 686931 - RNA, 24 nt, Human
ugcuuguggccccagcugccccga

SEQ ID NO: 686932 - RNA, 22 nt, Human
uggaaagugccauccaccuccc

SEQ ID NO: 686933 - RNA, 18 nt, Human
uggcagggggcaguuagu

SEQ ID NO: 686934 - RNA, 20 nt, Human
uggcagggggcaguuagugg

SEQ ID NO: 686935 - RNA, 20 nt, Human
uggccccuggacccagcugg

SEQ ID NO: 686936 - RNA, 20 nt, Human
uggccucaggagcaagggag

SEQ ID NO: 686937 - RNA, 19 nt, Human
uggcggcacugacaaggca

SEQ ID NO: 686938 - RNA, 23 nt, Human
ugggagcagccaauagcccaggg

SEQ ID NO: 686939 - RNA, 21 nt, Human
ugggcucaacguccagggccc

SEQ ID NO: 686940 - RNA, 20 nt, Human
uggggaggcuguucgagucu

SEQ ID NO: 686941 - RNA, 19 nt, Human
ugggguggaggccacaacc

SEQ ID NO: 686942 - RNA, 25 nt, Human
uggguaugccagauccacagggggc

SEQ ID NO: 686943 - RNA, 21 nt, Human
uggguggagauggagagguca

SEQ ID NO: 686944 - RNA, 20 nt, Human
uggugaggggcagauucugg

SEQ ID NO: 686945 - RNA, 24 nt, Human
ugguguggcuccaacaucugggcu

SEQ ID NO: 686946 - RNA, 19 nt, Human
uguaacaaauuaucacaca

SEQ ID NO: 686947 - RNA, 24 nt, Human
ugugcucgagccaggcuuggccag

SEQ ID NO: 686948 - RNA, 21 nt, Human
uguucgagucucuggcuuugg

SEQ ID NO: 686949 - RNA, 19 nt, Human
uguuggagcuugaagaagu

SEQ ID NO: 686950 - RNA, 21 nt, Human
uuaggucaccauuuguuaguc

SEQ ID NO: 686951 - RNA, 19 nt, Human
uuccuccacacugcacccc

SEQ ID NO: 686952 - RNA, 19 nt, Human
uucucuugcucuccaugcc

SEQ ID NO: 686953 - RNA, 22 nt, Human
uucucuugcucuccaugccugg

SEQ ID NO: 686954 - RNA, 23 nt, Human
uucuuccagccucugcccauuuc

SEQ ID NO: 686955 - RNA, 23 nt, Human
uugcaauuccaaagccacuucaa

SEQ ID NO: 686956 - RNA, 25 nt, Human
aaaaauauggagggaaaaaccugac

SEQ ID NO: 686957 - RNA, 20 nt, Human
aacuuaucaaaagugaccaa

SEQ ID NO: 686958 - RNA, 21 nt, Human
acaggcaauucaaauuaaaac

SEQ ID NO: 686959 - RNA, 22 nt, Human
agugaccaaaaauauggaggga

SEQ ID NO: 686960 - RNA, 21 nt, Human
caaaauaaauauaugaauauu

SEQ ID NO: 686961 - RNA, 25 nt, Human
caaucacagaaaaauaaaaacaucu

SEQ ID NO: 686962 - RNA, 24 nt, Human
cauuuagaguaacuaaauguggcc

SEQ ID NO: 686963 - RNA, 19 nt, Human
ccaaaaauauggagggaaa

SEQ ID NO: 686964 - RNA, 19 nt, Human
cccaacuaaaaaugcacca

SEQ ID NO: 686965 - RNA, 23 nt, Human
gaaaaauaaaaacaucuaauuuc

SEQ ID NO: 686966 - RNA, 21 nt, Human
gagcuggcgggguggggcgcg

SEQ ID NO: 686967 - RNA, 18 nt, Human
gggguggggcgcggcucc

SEQ ID NO: 686968 - RNA, 19 nt, Human
uaccauaaaaguauaucaa

SEQ ID NO: 686969 - RNA, 18 nt, Human
uccgcagaggcggaauuc

SEQ ID NO: 686970 - RNA, 19 nt, Human
ugagagcacuucguuuuug

SEQ ID NO: 686971 - RNA, 19 nt, Human
ugagggagagaagggaggg

SEQ ID NO: 686972 - RNA, 19 nt, Human
ugagggagagaagggaggg

SEQ ID NO: 686973 - RNA, 19 nt, Human
ugagggagagaagggaggg

SEQ ID NO: 686974 - RNA, 22 nt, Human
ugagggagagaagggaggguga

SEQ ID NO: 686975 - RNA, 19 nt, Human
ugcauaaggaacccugaac

SEQ ID NO: 686976 - RNA, 27 nt, Human
uuauugagggagagaagggagggugag

SEQ ID NO: 686977 - RNA, 20 nt, Human
uucguuuuuguuguuuuugu

SEQ ID NO: 686978 - RNA, 24 nt, Human
aaaaacaaaaagaaaaagcaaaaa

SEQ ID NO: 686979 - RNA, 18 nt, Human
aaaaacaccucccauaca

SEQ ID NO: 686980 - RNA, 18 nt, Human
aaaaagcaaaaaucuaca

SEQ ID NO: 686981 - RNA, 23 nt, Human
aaaacaaaaagaaaaagcaaaaa

SEQ ID NO: 686982 - RNA, 22 nt, Human
aaaacaccaaauuuauugcaua

SEQ ID NO: 686983 - RNA, 24 nt, Human
aaaauaaagaagaaacgaaaggaa

SEQ ID NO: 686984 - RNA, 19 nt, Human
aaacaaaaacaaaaacacc

SEQ ID NO: 686985 - RNA, 18 nt, Human
aaacaaaaacaccuccca

SEQ ID NO: 686986 - RNA, 24 nt, Human
aaacaccucccauacaagggccaa

SEQ ID NO: 686987 - RNA, 24 nt, Human
aacaaaaagaaaaagcaaaaaucu

SEQ ID NO: 686988 - RNA, 22 nt, Human
aacacauucacaagugcaagga

SEQ ID NO: 686989 - RNA, 23 nt, Human
aacguccuuaaaucuuagcaauu

SEQ ID NO: 686990 - RNA, 20 nt, Human
aagaagaaacgaaaggaaaa

SEQ ID NO: 686991 - RNA, 21 nt, Human
aagaagaaacgaaaggaaaau

SEQ ID NO: 686992 - RNA, 23 nt, Human
aagaagaaacgaaaggaaaauca

SEQ ID NO: 686993 - RNA, 20 nt, Human
aagcaaaaaucuacaauccg

SEQ ID NO: 686994 - RNA, 22 nt, Human
agcaauuagggaagaggaaaaa

SEQ ID NO: 686995 - RNA, 21 nt, Human
agcagagugcaacacauucac

SEQ ID NO: 686996 - RNA, 18 nt, Human
aggaaggagaaaauggua

SEQ ID NO: 686997 - RNA, 24 nt, Human
aggaaggagaaaaugguagaggac

SEQ ID NO: 686998 - RNA, 21 nt, Human
agggaagaggaaaaaaaaucu

SEQ ID NO: 686999 - RNA, 22 nt, Human
auacaagggccaauuuuucacc

SEQ ID NO: 687000 - RNA, 21 nt, Human
auccccaaccucuaauuuuuc

SEQ ID NO: 687001 - RNA, 24 nt, Human
caaaaacaaaaacaccucccauac

SEQ ID NO: 687002 - RNA, 25 nt, Human
caaaaacaaaaacaccucccauaca

SEQ ID NO: 687003 - RNA, 27 nt, Human
caaaaacaccucccauacaagggccaa

SEQ ID NO: 687004 - RNA, 25 nt, Human
caaccaggcucaguauuuaaaaguc

SEQ ID NO: 687005 - RNA, 24 nt, Human
caagaacuuuuuaaaagcaagaua

SEQ ID NO: 687006 - RNA, 21 nt, Human
caaucccagaaacacaucaac

SEQ ID NO: 687007 - RNA, 24 nt, Human
cacacauagaaaauaaacauuuca

SEQ ID NO: 687008 - RNA, 21 nt, Human
caguccuuuccuccuuugggu

SEQ ID NO: 687009 - RNA, 25 nt, Human
ccagaaacacaucaaccaggcucag

SEQ ID NO: 687010 - RNA, 24 nt, Human
cccacuguaaacaaacauuucgaa

SEQ ID NO: 687011 - RNA, 24 nt, Human
ccccuaaaaucccacuguaaacaa

SEQ ID NO: 687012 - RNA, 22 nt, Human
cuguauauauauuuuuaauccu

SEQ ID NO: 687013 - RNA, 24 nt, Human
gaaaaggagaaaauaagggaaggg

SEQ ID NO: 687014 - RNA, 21 nt, Human
gaaaauaagggaagggaggaa

SEQ ID NO: 687015 - RNA, 19 nt, Human
gaaauaggcacagccaugg

SEQ ID NO: 687016 - RNA, 22 nt, Human
gaaccgcagcuugggacuccga

SEQ ID NO: 687017 - RNA, 22 nt, Human
gacaaggaagcacugugagaaa

SEQ ID NO: 687018 - RNA, 20 nt, Human
gcagcagccgaaccgcagcu

SEQ ID NO: 687019 - RNA, 19 nt, Human
gcuauacaaucccagaaac

SEQ ID NO: 687020 - RNA, 22 nt, Human
gcucccauaaauucuuaggagu

SEQ ID NO: 687021 - RNA, 18 nt, Human
ggaagggaggaaggagaa

SEQ ID NO: 687022 - RNA, 23 nt, Human
ggaaugagaaguuaagagaagga

SEQ ID NO: 687023 - RNA, 22 nt, Human
ggacacaggguacgaaaaggag

SEQ ID NO: 687024 - RNA, 18 nt, Human
ggagaggagaggaaggga

SEQ ID NO: 687025 - RNA, 21 nt, Human
gggacaaggaugagcaagaaa

SEQ ID NO: 687026 - RNA, 23 nt, Human
gggacaaggaugagcaagaaaaa

SEQ ID NO: 687027 - RNA, 24 nt, Human
gggaggacacaggguacgaaaagg

SEQ ID NO: 687028 - RNA, 21 nt, Human
guucucggcagcagccgaacc

SEQ ID NO: 687029 - RNA, 22 nt, Human
uaaaaacaaaaagaaaaagcaa

SEQ ID NO: 687030 - RNA, 23 nt, Human
uaaaaggucuaggaaauaggcac

SEQ ID NO: 687031 - RNA, 23 nt, Human
uaaaauaaagaagaaacgaaagg

SEQ ID NO: 687032 - RNA, 20 nt, Human
uaaacaaacauuucgaaugu

SEQ ID NO: 687033 - RNA, 22 nt, Human
uaacagagaaugggauaaaaua

SEQ ID NO: 687034 - RNA, 18 nt, Human
uaaggugauagaaaaagg

SEQ ID NO: 687035 - RNA, 23 nt, Human
uaaguuuuaaaaacaaaaagaaa

SEQ ID NO: 687036 - RNA, 22 nt, Human
uaaugcaacuugcuccaaaagc

SEQ ID NO: 687037 - RNA, 18 nt, Human
uagaaggagaggagagga

SEQ ID NO: 687038 - RNA, 21 nt, Human
uagaggaaugagaaguuaaga

SEQ ID NO: 687039 - RNA, 24 nt, Human
ucagcugcaacgaaugcuaagcug

SEQ ID NO: 687040 - RNA, 25 nt, Human
ucauaauaaagaacguccuuaaauc

SEQ ID NO: 687041 - RNA, 21 nt, Human
ucccagaaacacaucaaccag

SEQ ID NO: 687042 - RNA, 21 nt, Human
ucccucaagaacuuuuuaaaa

SEQ ID NO: 687043 - RNA, 18 nt, Human
uccuuuggguuaaaggag

SEQ ID NO: 687044 - RNA, 24 nt, Human
ugagaaaacaucagggcugagaga

SEQ ID NO: 687045 - RNA, 19 nt, Human
ugagagagacauuugggaa

SEQ ID NO: 687046 - RNA, 22 nt, Human
ugagcaagaaaaaauuaggcuc

SEQ ID NO: 687047 - RNA, 24 nt, Human
ugccaaaauaauggacccagacuc

SEQ ID NO: 687048 - RNA, 21 nt, Human
ugcgcagauaaaaaaggacag

SEQ ID NO: 687049 - RNA, 20 nt, Human
ugcuaagcugcucugcacau

SEQ ID NO: 687050 - RNA, 19 nt, Human
ugcuauacaaucccagaaa

SEQ ID NO: 687051 - RNA, 19 nt, Human
ugugauaaaguuucauaau

SEQ ID NO: 687052 - RNA, 23 nt, Human
uuaaccuuauugucaaagggacc

SEQ ID NO: 687053 - RNA, 23 nt, Human
uuacauggauucuuuaaucaugu

SEQ ID NO: 687054 - RNA, 23 nt, Human
uucacaagugcaaggaauacugg

SEQ ID NO: 687055 - RNA, 28 nt, Human
uucauauaacuguauauauauuuuuaau

SEQ ID NO: 687056 - RNA, 21 nt, Human
uugcaguucucggcagcagcc

SEQ ID NO: 687057 - RNA, 22 nt, Human
uugcuauucccucaagaacuuu

SEQ ID NO: 687058 - RNA, 19 nt, Human
uuuagcaauuggaauaagu

SEQ ID NO: 687059 - RNA, 21 nt, Human
uuucauaauaaagaacguccu

SEQ ID NO: 687060 - RNA, 22 nt, Human
uuuucaccccauccccaaccuc

SEQ ID NO: 687061 - RNA, 21 nt, Human
aaacauuccaacaggaaucaa

SEQ ID NO: 687062 - RNA, 22 nt, Human
aacacacaugcagacacacaca

SEQ ID NO: 687063 - RNA, 27 nt, Human
aaccacuucugcaucuaugacuucuau

SEQ ID NO: 687064 - RNA, 20 nt, Human
aagcauagacaugcaacacc

SEQ ID NO: 687065 - RNA, 18 nt, Human
aagcauaucaucauccac

SEQ ID NO: 687066 - RNA, 20 nt, Human
acacaugcagacacacacau

SEQ ID NO: 687067 - RNA, 24 nt, Human
acagugcuuauuaaacuacauaga

SEQ ID NO: 687068 - RNA, 18 nt, Human
acaugagaagccuugggc

SEQ ID NO: 687069 - RNA, 23 nt, Human
auaagucuuuccuagaaaagucc

SEQ ID NO: 687070 - RNA, 24 nt, Human
auucauaguaaaacuuuauugaac

SEQ ID NO: 687071 - RNA, 21 nt, Human
caacaggaaucaaaucguacc

SEQ ID NO: 687072 - RNA, 19 nt, Human
cagcuacagcacaaacacc

SEQ ID NO: 687073 - RNA, 22 nt, Human
caguccauuccugucaaagccu

SEQ ID NO: 687074 - RNA, 20 nt, Human
cauagacaugcaacaccuaa

SEQ ID NO: 687075 - RNA, 23 nt, Human
cauuccaacaggaaucaaaucgu

SEQ ID NO: 687076 - RNA, 22 nt, Human
ccagcagaaccacuucugcauc

SEQ ID NO: 687077 - RNA, 18 nt, Human
ccugucaaagccuccaac

SEQ ID NO: 687078 - RNA, 23 nt, Human
ccugucaaagccuccaacagccg

SEQ ID NO: 687079 - RNA, 23 nt, Human
cuaaaacaugucuagcaauuuca

SEQ ID NO: 687080 - RNA, 23 nt, Human
gcaaaguuccccuuaguuuaaag

SEQ ID NO: 687081 - RNA, 19 nt, Human
gcuggagucaggugaucca

SEQ ID NO: 687082 - RNA, 23 nt, Human
uaaagcucuucagaauaaagaca

SEQ ID NO: 687083 - RNA, 20 nt, Human
uaaggccuucuacguacagu

SEQ ID NO: 687084 - RNA, 22 nt, Human
uaagucuuuccuagaaaagucc

SEQ ID NO: 687085 - RNA, 20 nt, Human
uauguacaaacacacaugca

SEQ ID NO: 687086 - RNA, 26 nt, Human
uauguacaaacacacaugcagacaca

SEQ ID NO: 687087 - RNA, 26 nt, Human
uccuaggugccaggcaggcggcgucu

SEQ ID NO: 687088 - RNA, 24 nt, Human
uguacaaacacacaugcagacaca

SEQ ID NO: 687089 - RNA, 22 nt, Human
ugucggggcuccgcuccggggg

SEQ ID NO: 687090 - RNA, 21 nt, Human
uucagaauaaagacaugagaa

SEQ ID NO: 687091 - RNA, 18 nt, Human
uuucagggucauucauag

SEQ ID NO: 687092 - RNA, 18 nt, Human
uuuuuuuuuuucaggguc

SEQ ID NO: 687093 - RNA, 24 nt, Human
uuuuuuuuuuuuuuuuuuucaggg

SEQ ID NO: 687094 - RNA, 23 nt, Human
aaacugaaucucuguacccauga

SEQ ID NO: 687095 - RNA, 24 nt, Human
aaagugcugggauuacaggcguga

SEQ ID NO: 687096 - RNA, 23 nt, Human
aacaaaacaaacauuaccgcaaa

SEQ ID NO: 687097 - RNA, 23 nt, Human
aacuccccauucuucccaccccc

SEQ ID NO: 687098 - RNA, 26 nt, Human
aagcaccaacuccccauucuucccac

SEQ ID NO: 687099 - RNA, 22 nt, Human
aaggaacaagaaacaaaacaaa

SEQ ID NO: 687100 - RNA, 19 nt, Human
aagugcugggauuacaggc

SEQ ID NO: 687101 - RNA, 19 nt, Human
aagugcugggauuacaggc

SEQ ID NO: 687102 - RNA, 26 nt, Human
aagugcugggauuacaggcgugagcc

SEQ ID NO: 687103 - RNA, 23 nt, Human
acaaacauuaccgcaaaugaaac

SEQ ID NO: 687104 - RNA, 19 nt, Human
acccaugaagcaccaacuc

SEQ ID NO: 687105 - RNA, 20 nt, Human
acugcaagcuccaccuccca

SEQ ID NO: 687106 - RNA, 21 nt, Human
agagaagccccugggcaccuu

SEQ ID NO: 687107 - RNA, 19 nt, Human
agagaugggguuucaccgu

SEQ ID NO: 687108 - RNA, 24 nt, Human
agauggucucgaucuccugaccuc

SEQ ID NO: 687109 - RNA, 21 nt, Human
agccaccgcgcccggcccauc

SEQ ID NO: 687110 - RNA, 22 nt, Human
agcgguggcagcucuggaauug

SEQ ID NO: 687111 - RNA, 19 nt, Human
agugcaguggcgugaucuc

SEQ ID NO: 687112 - RNA, 20 nt, Human
agugcaguggcgugaucucg

SEQ ID NO: 687113 - RNA, 23 nt, Human
agugcaguggcgugaucucggcu

SEQ ID NO: 687114 - RNA, 24 nt, Human
agugcaguggcgugaucucggcuc

SEQ ID NO: 687115 - RNA, 18 nt, Human
agugcugggauuacaggc

SEQ ID NO: 687116 - RNA, 24 nt, Human
auaguagagaugggguuucaccgu

SEQ ID NO: 687117 - RNA, 23 nt, Human
augcacauucacauugcggugua

SEQ ID NO: 687118 - RNA, 18 nt, Human
augggguuucaccguguu

SEQ ID NO: 687119 - RNA, 19 nt, Human
augggguuucaccguguua

SEQ ID NO: 687120 - RNA, 20 nt, Human
augggguuucaccguguuag

SEQ ID NO: 687121 - RNA, 24 nt, Human
caaagugcugggauuacaggcgug

SEQ ID NO: 687122 - RNA, 18 nt, Human
caacuccccauucuuccc

SEQ ID NO: 687123 - RNA, 21 nt, Human
caacuccccauucuucccacc

SEQ ID NO: 687124 - RNA, 22 nt, Human
caacuccccauucuucccaccc

SEQ ID NO: 687125 - RNA, 18 nt, Human
caccccccagccccugcc

SEQ ID NO: 687126 - RNA, 24 nt, Human
caccguguuagccaagauggucuc

SEQ ID NO: 687127 - RNA, 20 nt, Human
cacugcaagcuccaccuccc

SEQ ID NO: 687128 - RNA, 19 nt, Human
caugcacauucacauugcg

SEQ ID NO: 687129 - RNA, 22 nt, Human
caugccauucuccugccucagc

SEQ ID NO: 687130 - RNA, 22 nt, Human
ccaaagugcugggauuacaggc

SEQ ID NO: 687131 - RNA, 22 nt, Human
ccaaagugcugggauuacaggc

SEQ ID NO: 687132 - RNA, 24 nt, Human
ccaaagugcugggauuacaggcgu

SEQ ID NO: 687133 - RNA, 19 nt, Human
ccaacuccccauucuuccc

SEQ ID NO: 687134 - RNA, 19 nt, Human
ccaucagcagcauccaucu

SEQ ID NO: 687135 - RNA, 19 nt, Human
ccauugacucaagcacagg

SEQ ID NO: 687136 - RNA, 22 nt, Human
cccagccuggagugcaguggcg

SEQ ID NO: 687137 - RNA, 20 nt, Human
cccagguucaugccauucuc

SEQ ID NO: 687138 - RNA, 19 nt, Human
ccccagccccugccaacca

SEQ ID NO: 687139 - RNA, 22 nt, Human
ccccauucuucccaccccccag

SEQ ID NO: 687140 - RNA, 23 nt, Human
ccccauucuucccaccccccagc

SEQ ID NO: 687141 - RNA, 20 nt, Human
cccccacgcccggcuaauuu

SEQ ID NO: 687142 - RNA, 21 nt, Human
ccccugggcaccuugccccag

SEQ ID NO: 687143 - RNA, 24 nt, Human
ccucccagguucaugccauucucc

SEQ ID NO: 687144 - RNA, 23 nt, Human
ccugccucagccucccgaguagc

SEQ ID NO: 687145 - RNA, 24 nt, Human
cgaaggaacaagaaacaaaacaaa

SEQ ID NO: 687146 - RNA, 24 nt, Human
cgccucggccucccaaagugcugg

SEQ ID NO: 687147 - RNA, 24 nt, Human
cgcucugucgcccagccuggagug

SEQ ID NO: 687148 - RNA, 24 nt, Human
cucacugcaagcuccaccucccag

SEQ ID NO: 687149 - RNA, 24 nt, Human
cucagccucccgaguagcugggac

SEQ ID NO: 687150 - RNA, 24 nt, Human
cucccgaguagcugggaccacagg

SEQ ID NO: 687151 - RNA, 24 nt, Human
cuccugaccucgugaucugcccgc

SEQ ID NO: 687152 - RNA, 24 nt, Human
cugcaagcuccaccucccagguuc

SEQ ID NO: 687153 - RNA, 23 nt, Human
cugccucagccucccgaguagcu

SEQ ID NO: 687154 - RNA, 25 nt, Human
gaaacaaaacaaacauuaccgcaaa

SEQ ID NO: 687155 - RNA, 22 nt, Human
gaccucgugaucugcccgccuc

SEQ ID NO: 687156 - RNA, 24 nt, Human
gaccucgugaucugcccgccucgg

SEQ ID NO: 687157 - RNA, 24 nt, Human
gagaugggguuucaccguguuagc

SEQ ID NO: 687158 - RNA, 18 nt, Human
gauuacaggcgugagcca

SEQ ID NO: 687159 - RNA, 20 nt, Human
gauuacaggcgugagccacc

SEQ ID NO: 687160 - RNA, 22 nt, Human
gauuacaggcgugagccaccgc

SEQ ID NO: 687161 - RNA, 18 nt, Human
gcaagcuccaccucccag

SEQ ID NO: 687162 - RNA, 22 nt, Human
gcaagcuccaccucccagguuc

SEQ ID NO: 687163 - RNA, 19 nt, Human
ggagagaagccccugggca

SEQ ID NO: 687164 - RNA, 21 nt, Human
gggaagcgguggcagcucugg

SEQ ID NO: 687165 - RNA, 19 nt, Human
gggaaugagaacuucugga

SEQ ID NO: 687166 - RNA, 18 nt, Human
gggguuucaccguguuag

SEQ ID NO: 687167 - RNA, 21 nt, Human
gugaucucggcucacugcaag

SEQ ID NO: 687168 - RNA, 24 nt, Human
gugaucugcccgccucggccuccc

SEQ ID NO: 687169 - RNA, 24 nt, Human
uaauuuuuuguauuuauaguagag

SEQ ID NO: 687170 - RNA, 25 nt, Human
uaauuuuuuguauuuauaguagaga

SEQ ID NO: 687171 - RNA, 23 nt, Human
uacaggcgugagccaccgcgccc

SEQ ID NO: 687172 - RNA, 20 nt, Human
uacccuggagcugcugaagc

SEQ ID NO: 687173 - RNA, 21 nt, Human
uaguagagaugggguuucacc

SEQ ID NO: 687174 - RNA, 21 nt, Human
uaguagagaugggguuucacc

SEQ ID NO: 687175 - RNA, 24 nt, Human
uaguagagaugggguuucaccgug

SEQ ID NO: 687176 - RNA, 26 nt, Human
uaguagagaugggguuucaccguguu

SEQ ID NO: 687177 - RNA, 24 nt, Human
ucaccguguuagccaagauggucu

SEQ ID NO: 687178 - RNA, 19 nt, Human
ucacugcaagcuccaccuc

SEQ ID NO: 687179 - RNA, 24 nt, Human
ucacugcaagcuccaccucccagg

SEQ ID NO: 687180 - RNA, 23 nt, Human
ucagccucccgaguagcugggac

SEQ ID NO: 687181 - RNA, 18 nt, Human
ucaugccauucuccugcc

SEQ ID NO: 687182 - RNA, 24 nt, Human
ucccaaagugcugggauuacaggc

SEQ ID NO: 687183 - RNA, 23 nt, Human
ucccagauagguacgaaggaaca

SEQ ID NO: 687184 - RNA, 20 nt, Human
ucccagguucaugccauucu

SEQ ID NO: 687185 - RNA, 21 nt, Human
ucccagguucaugccauucuc

SEQ ID NO: 687186 - RNA, 24 nt, Human
ucccagguucaugccauucuccug

SEQ ID NO: 687187 - RNA, 23 nt, Human
ucccgaguagcugggaccacagg

SEQ ID NO: 687188 - RNA, 24 nt, Human
ucgcccagccuggagugcaguggc

SEQ ID NO: 687189 - RNA, 18 nt, Human
ucggccucccaaagugcu

SEQ ID NO: 687190 - RNA, 24 nt, Human
ucuccugccucagccucccgagua

SEQ ID NO: 687191 - RNA, 24 nt, Human
ucucgcucugucgcccagccugga

SEQ ID NO: 687192 - RNA, 24 nt, Human
ucugucgcccagccuggagugcag

SEQ ID NO: 687193 - RNA, 22 nt, Human
ugagacggagucucgcucuguc

SEQ ID NO: 687194 - RNA, 22 nt, Human
ugcaguggcgugaucucggcuc

SEQ ID NO: 687195 - RNA, 24 nt, Human
ugccucagccucccgaguagcugg

SEQ ID NO: 687196 - RNA, 24 nt, Human
ugcugggauuacaggcgugagcca

SEQ ID NO: 687197 - RNA, 19 nt, Human
uggagugcaguggcgugau

SEQ ID NO: 687198 - RNA, 23 nt, Human
uggagugcaguggcgugaucucg

SEQ ID NO: 687199 - RNA, 24 nt, Human
uggagugcaguggcgugaucucgg

SEQ ID NO: 687200 - RNA, 20 nt, Human
uggcgugaucucggcucacu

SEQ ID NO: 687201 - RNA, 18 nt, Human
ugggaccacaggugcccg

SEQ ID NO: 687202 - RNA, 18 nt, Human
ugggauuacaggcgugag

SEQ ID NO: 687203 - RNA, 19 nt, Human
ugggauuacaggcgugagc

SEQ ID NO: 687204 - RNA, 21 nt, Human
ugggauuacaggcgugagcca

SEQ ID NO: 687205 - RNA, 22 nt, Human
ugggauuacaggcgugagccac

SEQ ID NO: 687206 - RNA, 23 nt, Human
ugggauuacaggcgugagccacc

SEQ ID NO: 687207 - RNA, 24 nt, Human
ugggauuacaggcgugagccaccg

SEQ ID NO: 687208 - RNA, 21 nt, Human
uggggucucaacuguuacgug

SEQ ID NO: 687209 - RNA, 19 nt, Human
ugggguuucaccguguuag

SEQ ID NO: 687210 - RNA, 20 nt, Human
uucacauugcgguguagcca

SEQ ID NO: 687211 - RNA, 19 nt, Human
uucaugccauucuccugcc

SEQ ID NO: 687212 - RNA, 18 nt, Human
uucccagauagguacgaa

SEQ ID NO: 687213 - RNA, 24 nt, Human
uuuauaguagagaugggguuucac

SEQ ID NO: 687214 - RNA, 19 nt, Human
uuucaccguguuagccaag

SEQ ID NO: 687215 - RNA, 21 nt, Human
uuuuuguauuuauaguagaga

SEQ ID NO: 687216 - RNA, 24 nt, Human
uuuuuuguauuuauaguagagaug

SEQ ID NO: 687217 - RNA, 25 nt, Human
uuuuuuuuuuuugagacggagucuc

SEQ ID NO: 687218 - RNA, 22 nt, Human
uuuuuuuuuuuuuugagacgga

SEQ ID NO: 687219 - RNA, 18 nt, Human
uuuuuuuuuuuuuuuuug

SEQ ID NO: 687220 - RNA, 18 nt, Human
aaaauucuuccuccugcc

SEQ ID NO: 687221 - RNA, 18 nt, Human
aaacaagauguacagagc

SEQ ID NO: 687222 - RNA, 22 nt, Human
aagcuuuuguuuagcccaggga

SEQ ID NO: 687223 - RNA, 18 nt, Human
acccacuccagagcugca

SEQ ID NO: 687224 - RNA, 25 nt, Human
acuccaaaauucuuuauuuaguaaa

SEQ ID NO: 687225 - RNA, 23 nt, Human
agcagcggggacggggagcggcg

SEQ ID NO: 687226 - RNA, 18 nt, Human
aggagggagggaagaccu

SEQ ID NO: 687227 - RNA, 22 nt, Human
aggcugggugggugaaccuggg

SEQ ID NO: 687228 - RNA, 18 nt, Human
agggagggaagaccuggg

SEQ ID NO: 687229 - RNA, 19 nt, Human
aucagaggagggagggaag

SEQ ID NO: 687230 - RNA, 23 nt, Human
auuccugccaccucugcccccag

SEQ ID NO: 687231 - RNA, 27 nt, Human
caaaauucuuuauuuaguaaaauuguc

SEQ ID NO: 687232 - RNA, 21 nt, Human
caaggguaacuaacuccaaaa

SEQ ID NO: 687233 - RNA, 28 nt, Human
caccucugcccccagagcccgcacaggg

SEQ ID NO: 687234 - RNA, 18 nt, Human
cagaggagggagggaaga

SEQ ID NO: 687235 - RNA, 22 nt, Human
cagcagcagcccagccguccgc

SEQ ID NO: 687236 - RNA, 21 nt, Human
cagcucugggcagugcagcug

SEQ ID NO: 687237 - RNA, 22 nt, Human
cagcugagugcaccugccucuc

SEQ ID NO: 687238 - RNA, 22 nt, Human
ccagcaccauuccugccaccuc

SEQ ID NO: 687239 - RNA, 23 nt, Human
cccagccguccgcgcuccccucg

SEQ ID NO: 687240 - RNA, 22 nt, Human
ccccgcaggacucuggcuggca

SEQ ID NO: 687241 - RNA, 23 nt, Human
cccgcaggacucuggcuggcauu

SEQ ID NO: 687242 - RNA, 20 nt, Human
cccuaaaaguuucuuaagaa

SEQ ID NO: 687243 - RNA, 21 nt, Human
cccuaccccaccacaucugaa

SEQ ID NO: 687244 - RNA, 18 nt, Human
cccugggaggagggagga

SEQ ID NO: 687245 - RNA, 23 nt, Human
ccgcccagcagcagcccagccgu

SEQ ID NO: 687246 - RNA, 22 nt, Human
ccgcuccgccggggacgcggca

SEQ ID NO: 687247 - RNA, 21 nt, Human
ccgcugccccgcggccgccca

SEQ ID NO: 687248 - RNA, 24 nt, Human
ccugcccguagcucccucccucca

SEQ ID NO: 687249 - RNA, 19 nt, Human
ccugggaggagggaggaga

SEQ ID NO: 687250 - RNA, 20 nt, Human
cuccagagcugcaggguccc

SEQ ID NO: 687251 - RNA, 21 nt, Human
cucccucccuccacccacucc

SEQ ID NO: 687252 - RNA, 26 nt, Human
cugcccguagcucccucccuccaccc

SEQ ID NO: 687253 - RNA, 27 nt, Human
cugggaggagggaggagauccagggag

SEQ ID NO: 687254 - RNA, 20 nt, Human
gaaacggggcuggggccuga

SEQ ID NO: 687255 - RNA, 21 nt, Human
gaaccugggagagcgcuggca

SEQ ID NO: 687256 - RNA, 23 nt, Human
gaggagggaggagauccagggag

SEQ ID NO: 687257 - RNA, 24 nt, Human
gaggagggagggaagaccugggag

SEQ ID NO: 687258 - RNA, 20 nt, Human
gcaggggcuaggagcagcgg

SEQ ID NO: 687259 - RNA, 23 nt, Human
gcaggggcuaggagcagcgggga

SEQ ID NO: 687260 - RNA, 25 nt, Human
gcucuacaaaauucuuccuccugcc

SEQ ID NO: 687261 - RNA, 19 nt, Human
ggagcggcggggaccggag

SEQ ID NO: 687262 - RNA, 21 nt, Human
ggagggaagaccugggagacu

SEQ ID NO: 687263 - RNA, 20 nt, Human
ggcuggugaaggcugggugg

SEQ ID NO: 687264 - RNA, 24 nt, Human
gggaagaccugggagacuuccagg

SEQ ID NO: 687265 - RNA, 28 nt, Human
gggcagugcagcugagugccgggccccc

SEQ ID NO: 687266 - RNA, 21 nt, Human
gggcugguuaccaggggcugc

SEQ ID NO: 687267 - RNA, 20 nt, Human
guagcucccucccuccaccc

SEQ ID NO: 687268 - RNA, 20 nt, Human
gugcagcugagugcaccugc

SEQ ID NO: 687269 - RNA, 21 nt, Human
uaccccaccacaucugaaccc

SEQ ID NO: 687270 - RNA, 19 nt, Human
uagcucccucccuccaccc

SEQ ID NO: 687271 - RNA, 18 nt, Human
ucccuccacccacuccag

SEQ ID NO: 687272 - RNA, 19 nt, Human
ucccucccuccacccacuc

SEQ ID NO: 687273 - RNA, 19 nt, Human
ucccucccuccacccacuc

SEQ ID NO: 687274 - RNA, 19 nt, Human
uccgcugccccgcggccgc

SEQ ID NO: 687275 - RNA, 23 nt, Human
ugaaguggcaaguucaagcuuuu

SEQ ID NO: 687276 - RNA, 23 nt, Human
ugacugggcugguuaccaggggc

SEQ ID NO: 687277 - RNA, 22 nt, Human
ugccccgcggccgcccagcagc

SEQ ID NO: 687278 - RNA, 19 nt, Human
ugcccguagcucccucccu

SEQ ID NO: 687279 - RNA, 22 nt, Human
ugccggcgcccuccgcugcccc

SEQ ID NO: 687280 - RNA, 23 nt, Human
uggaacacuagugcccagcacca

SEQ ID NO: 687281 - RNA, 21 nt, Human
uggaauacacaaacucaagug

SEQ ID NO: 687282 - RNA, 21 nt, Human
ugggagacuuccagggcccua

SEQ ID NO: 687283 - RNA, 21 nt, Human
ugggcugguuaccaggggcug

SEQ ID NO: 687284 - RNA, 22 nt, Human
ugggugaaccugggagagcgcu

SEQ ID NO: 687285 - RNA, 18 nt, Human
ugguuaccaggggcugcc

SEQ ID NO: 687286 - RNA, 19 nt, Human
uguuuagcccagggcugcc

SEQ ID NO: 687287 - RNA, 18 nt, Human
uuccagggcccuacccca

SEQ ID NO: 687288 - RNA, 23 nt, Human
uuguuuagcccagggcugccugg

SEQ ID NO: 687289 - RNA, 18 nt, Human
uuuuuuuuuuuucaaggg

SEQ ID NO: 687290 - RNA, 23 nt, Human
uuuuuuuuuuuuuuuuuucaagg

SEQ ID NO: 687291 - RNA, 18 nt, Human
aaaaguaaaccaacaaac

SEQ ID NO: 687292 - RNA, 19 nt, Human
aaacagaccaaaaauacua

SEQ ID NO: 687293 - RNA, 18 nt, Human
aaggagaaaaacagacca

SEQ ID NO: 687294 - RNA, 28 nt, Human
acaaacagaaucauguuaaccgaggucc

SEQ ID NO: 687295 - RNA, 21 nt, Human
acaguacaaaccuaucacaaa

SEQ ID NO: 687296 - RNA, 18 nt, Human
acaugacaugaugaaaaa

SEQ ID NO: 687297 - RNA, 19 nt, Human
accacaguuccaugcacca

SEQ ID NO: 687298 - RNA, 22 nt, Human
accuucaguuuccuuuccacca

SEQ ID NO: 687299 - RNA, 18 nt, Human
accuuggcaaccacaguu

SEQ ID NO: 687300 - RNA, 21 nt, Human
agaaaaacagaccaaaaauac

SEQ ID NO: 687301 - RNA, 23 nt, Human
aggcaaaaacggaaucauucugg

SEQ ID NO: 687302 - RNA, 23 nt, Human
auauaguuccccuccccccaaaa

SEQ ID NO: 687303 - RNA, 20 nt, Human
caaacccaguucaguggagg

SEQ ID NO: 687304 - RNA, 20 nt, Human
caaggagaaaaacagaccaa

SEQ ID NO: 687305 - RNA, 18 nt, Human
caccaaaaggaaaacuca

SEQ ID NO: 687306 - RNA, 25 nt, Human
caccaacacuccaaaugagaccuaa

SEQ ID NO: 687307 - RNA, 21 nt, Human
cagcggcucucuccuaacuaa

SEQ ID NO: 687308 - RNA, 22 nt, Human
caucaguacaacagaggucaaa

SEQ ID NO: 687309 - RNA, 21 nt, Human
ccaaaugagaccuaaccuauc

SEQ ID NO: 687310 - RNA, 21 nt, Human
ccaguccuggcagauaccagc

SEQ ID NO: 687311 - RNA, 25 nt, Human
cuaauacaugacaugaugaaaaaaa

SEQ ID NO: 687312 - RNA, 21 nt, Human
cuacucaauugaccacucgcc

SEQ ID NO: 687313 - RNA, 18 nt, Human
cuuuccaccaacacucca

SEQ ID NO: 687314 - RNA, 23 nt, Human
gaugaaaaaaacauuaaaaaaga

SEQ ID NO: 687315 - RNA, 26 nt, Human
gauucagggccaccaacaguuuguac

SEQ ID NO: 687316 - RNA, 18 nt, Human
gcaggaaagcccuuuuaa

SEQ ID NO: 687317 - RNA, 23 nt, Human
gcagucccaggaaaauuagguua

SEQ ID NO: 687318 - RNA, 19 nt, Human
ggagaaaaacagaccaaaa

SEQ ID NO: 687319 - RNA, 21 nt, Human
uaaaauucaauauaguucccc

SEQ ID NO: 687320 - RNA, 24 nt, Human
uaaauaccuuggcaaccacaguuc

SEQ ID NO: 687321 - RNA, 18 nt, Human
uaaggugauguuggcaac

SEQ ID NO: 687322 - RNA, 18 nt, Human
uaauucuaaaaacagacc

SEQ ID NO: 687323 - RNA, 19 nt, Human
uacaaggagaaaaacagac

SEQ ID NO: 687324 - RNA, 22 nt, Human
uacaugacaugaugaaaaaaac

SEQ ID NO: 687325 - RNA, 24 nt, Human
uacuaaauguuaagauuccccaaa

SEQ ID NO: 687326 - RNA, 27 nt, Human
uagcccaaaucaaauuaaauaaaucaa

SEQ ID NO: 687327 - RNA, 19 nt, Human
uaguuccccuccccccaaa

SEQ ID NO: 687328 - RNA, 22 nt, Human
uauacaaggagaaaaacagacc

SEQ ID NO: 687329 - RNA, 18 nt, Human
uccaccaacacuccaaau

SEQ ID NO: 687330 - RNA, 24 nt, Human
uccaccaacacuccaaaugagacc

SEQ ID NO: 687331 - RNA, 25 nt, Human
ugaaaaaaacauuaaaaaagauaaa

SEQ ID NO: 687332 - RNA, 19 nt, Human
ugacgacuuuaaggugaug

SEQ ID NO: 687333 - RNA, 21 nt, Human
ugauuugucaacgcuuugcuc

SEQ ID NO: 687334 - RNA, 23 nt, Human
ugcucagaaauauaaaauucaau

SEQ ID NO: 687335 - RNA, 18 nt, Human
uggaggucguuuaacuac

SEQ ID NO: 687336 - RNA, 20 nt, Human
uggucagauggauucagggc

SEQ ID NO: 687337 - RNA, 24 nt, Human
uguuaagauuccccaaauuuugag

SEQ ID NO: 687338 - RNA, 21 nt, Human
uuccccuccccccaaaagaau

SEQ ID NO: 687339 - RNA, 19 nt, Human
uuuaaauaccuuggcaacc

SEQ ID NO: 687340 - RNA, 19 nt, Human
aaaacaaaaccacaacccc

SEQ ID NO: 687341 - RNA, 18 nt, Human
aaaccaaacuccuacaaa

SEQ ID NO: 687342 - RNA, 23 nt, Human
aaacuaagauaaaacuagaucuu

SEQ ID NO: 687343 - RNA, 22 nt, Human
aaacugaauaaauuaaaccaaa

SEQ ID NO: 687344 - RNA, 22 nt, Human
aaagcagcaccauauuuugagc

SEQ ID NO: 687345 - RNA, 24 nt, Human
aaaucgaaaaaaacaaaaccacaa

SEQ ID NO: 687346 - RNA, 26 nt, Human
aaaucgaaaaaaacaaaaccacaacc

SEQ ID NO: 687347 - RNA, 26 nt, Human
aagcagcaccauauuuugagccaucc

SEQ ID NO: 687348 - RNA, 20 nt, Human
acaaaguaaugcaaaaaaga

SEQ ID NO: 687349 - RNA, 19 nt, Human
acacgacucucucacucuc

SEQ ID NO: 687350 - RNA, 24 nt, Human
acgaaaucgaaaaaaacaaaacca

SEQ ID NO: 687351 - RNA, 23 nt, Human
agagaaaaaaaagagaauaccac

SEQ ID NO: 687352 - RNA, 23 nt, Human
aggagaaaaugaagaggagggac

SEQ ID NO: 687353 - RNA, 19 nt, Human
agggagagaaaaaaaagag

SEQ ID NO: 687354 - RNA, 21 nt, Human
caaaaaagacuagguacagua

SEQ ID NO: 687355 - RNA, 18 nt, Human
cacugcuggaugguacgg

SEQ ID NO: 687356 - RNA, 25 nt, Human
caucauuaggagaaaaugaagagga

SEQ ID NO: 687357 - RNA, 23 nt, Human
ccacaaccccauuacauagcacu

SEQ ID NO: 687358 - RNA, 20 nt, Human
ccaguaaaaccuguugguuu

SEQ ID NO: 687359 - RNA, 21 nt, Human
cccauugcauacauucaucuu

SEQ ID NO: 687360 - RNA, 18 nt, Human
cccuuuccuuucuuaacc

SEQ ID NO: 687361 - RNA, 20 nt, Human
ccuguugguuucagcagaau

SEQ ID NO: 687362 - RNA, 23 nt, Human
ccuucagggugcagagguuuuaa

SEQ ID NO: 687363 - RNA, 27 nt, Human
ccuugugcaauguuauauauccagaag

SEQ ID NO: 687364 - RNA, 23 nt, Human
cgaaaaaaacaaaaccacaaccc

SEQ ID NO: 687365 - RNA, 27 nt, Human
cgaaaaaaacaaaaccacaaccccauu

SEQ ID NO: 687366 - RNA, 22 nt, Human
cgaaaucgaaaaaaacaaaacc

SEQ ID NO: 687367 - RNA, 18 nt, Human
cuccuacaaacuggagag

SEQ ID NO: 687368 - RNA, 18 nt, Human
gaccgcgcggggcacagc

SEQ ID NO: 687369 - RNA, 18 nt, Human
gagaaaaaaaagagaaua

SEQ ID NO: 687370 - RNA, 18 nt, Human
ggaucugucggcaucugu

SEQ ID NO: 687371 - RNA, 21 nt, Human
guaaaaccuguugguuucagc

SEQ ID NO: 687372 - RNA, 21 nt, Human
uaaacaaaaacucucacgugc

SEQ ID NO: 687373 - RNA, 22 nt, Human
uaaacaaaaacucucacgugcu

SEQ ID NO: 687374 - RNA, 25 nt, Human
uaaacaaaaacucucacgugcuuga

SEQ ID NO: 687375 - RNA, 21 nt, Human
uaacuucucccaaagggugac

SEQ ID NO: 687376 - RNA, 28 nt, Human
uaagauaaaacuagaucuuucaacuugg

SEQ ID NO: 687377 - RNA, 25 nt, Human
uacaaagaaggcaaacuaagauaaa

SEQ ID NO: 687378 - RNA, 21 nt, Human
uagaaaaagguuacaaaguaa

SEQ ID NO: 687379 - RNA, 21 nt, Human
uagcacuaguuuaggcauggg

SEQ ID NO: 687380 - RNA, 23 nt, Human
uauauaaauguaagguuuauaua

SEQ ID NO: 687381 - RNA, 23 nt, Human
uaucuuuuaaacaaaaacucuca

SEQ ID NO: 687382 - RNA, 22 nt, Human
uauguacaucccauugcauaca

SEQ ID NO: 687383 - RNA, 21 nt, Human
ucaggcacuuacgaaacacga

SEQ ID NO: 687384 - RNA, 23 nt, Human
uccacacaguagagaaaugaagu

SEQ ID NO: 687385 - RNA, 21 nt, Human
uccagaagaaaacuuccuaag

SEQ ID NO: 687386 - RNA, 19 nt, Human
ucccuuuccuuucuuaacc

SEQ ID NO: 687387 - RNA, 21 nt, Human
uccuuucuuaaccuauccucc

SEQ ID NO: 687388 - RNA, 19 nt, Human
ucucauaauguuuauugcu

SEQ ID NO: 687389 - RNA, 18 nt, Human
ucucccaaagggugacaa

SEQ ID NO: 687390 - RNA, 20 nt, Human
ucucuuaucuuuuaaacaaa

SEQ ID NO: 687391 - RNA, 18 nt, Human
ucugucccuuuccuuucu

SEQ ID NO: 687392 - RNA, 19 nt, Human
ucugucccuuuccuuucuu

SEQ ID NO: 687393 - RNA, 19 nt, Human
ugacaagaauagauguugc

SEQ ID NO: 687394 - RNA, 20 nt, Human
ugcagccuauugcaagacuu

SEQ ID NO: 687395 - RNA, 23 nt, Human
ugcauagaaaaagguuacaaagu

SEQ ID NO: 687396 - RNA, 19 nt, Human
ugccugggggccugcaggc

SEQ ID NO: 687397 - RNA, 23 nt, Human
ugggaucaaaugcaaucacuaac

SEQ ID NO: 687398 - RNA, 22 nt, Human
ugucauuaaacgaaaucgaaaa

SEQ ID NO: 687399 - RNA, 23 nt, Human
uuaccgagcugccuugaaccaaa

SEQ ID NO: 687400 - RNA, 21 nt, Human
uucaaaacaaauauuuaaaag

SEQ ID NO: 687401 - RNA, 19 nt, Human
aagggcccuuuuccccaag

SEQ ID NO: 687402 - RNA, 22 nt, Human
aaggggcagacaggguucccaa

SEQ ID NO: 687403 - RNA, 19 nt, Human
aaugaaagcaaguucaacc

SEQ ID NO: 687404 - RNA, 19 nt, Human
acagaguuuugcugcugcc

SEQ ID NO: 687405 - RNA, 20 nt, Human
acagcuccaggagagcuggg

SEQ ID NO: 687406 - RNA, 21 nt, Human
acgaagcaaagcagaaaaggc

SEQ ID NO: 687407 - RNA, 21 nt, Human
agaaacacaagaugcaagucc

SEQ ID NO: 687408 - RNA, 22 nt, Human
agaccagaacagcuccaggaga

SEQ ID NO: 687409 - RNA, 23 nt, Human
agaccucuuuguagccccugcuc

SEQ ID NO: 687410 - RNA, 19 nt, Human
agagcuguccaaggccugg

SEQ ID NO: 687411 - RNA, 24 nt, Human
agaggaggaggaggaggaggaguu

SEQ ID NO: 687412 - RNA, 20 nt, Human
agauggguuggaggaggagg

SEQ ID NO: 687413 - RNA, 24 nt, Human
agccccugcucaguuacuaucucc

SEQ ID NO: 687414 - RNA, 24 nt, Human
agcgaggcagacacuauguuccag

SEQ ID NO: 687415 - RNA, 18 nt, Human
aggagcagcaggagagga

SEQ ID NO: 687416 - RNA, 23 nt, Human
aggagcagcaggagaggaggagg

SEQ ID NO: 687417 - RNA, 23 nt, Human
aggaggaggaggaggaggaguug

SEQ ID NO: 687418 - RNA, 23 nt, Human
aggcagcacagacgucuggugcu

SEQ ID NO: 687419 - RNA, 21 nt, Human
aggcagugcccuuuuuugggc

SEQ ID NO: 687420 - RNA, 24 nt, Human
aggcuccgcuguucugcugggaac

SEQ ID NO: 687421 - RNA, 30 nt, Human
agggaggaggugggagaaucuucccagggg

SEQ ID NO: 687422 - RNA, 21 nt, Human
auccuuucucuugccccuccu

SEQ ID NO: 687423 - RNA, 23 nt, Human
aucuccucccucuuauccacuuc

SEQ ID NO: 687424 - RNA, 22 nt, Human
caaguccuugaccacagaauca

SEQ ID NO: 687425 - RNA, 23 nt, Human
cacaauaucccagggacaaugaa

SEQ ID NO: 687426 - RNA, 24 nt, Human
caccuuuccuuccacaauauccca

SEQ ID NO: 687427 - RNA, 23 nt, Human
cacgaagcaaagcagaaaaggca

SEQ ID NO: 687428 - RNA, 23 nt, Human
cacuauguuccagccucuuggcg

SEQ ID NO: 687429 - RNA, 23 nt, Human
cacugaccugguaucccaggagc

SEQ ID NO: 687430 - RNA, 21 nt, Human
cacugcaugaccuugaagggc

SEQ ID NO: 687431 - RNA, 23 nt, Human
cacugugcacccaauggggaggg

SEQ ID NO: 687432 - RNA, 18 nt, Human
cagaacagcuccaggaga

SEQ ID NO: 687433 - RNA, 23 nt, Human
cagccugccuuggguccuggugc

SEQ ID NO: 687434 - RNA, 22 nt, Human
caggaucucaggcgcucgaccc

SEQ ID NO: 687435 - RNA, 23 nt, Human
cagucuccccucugccucccucc

SEQ ID NO: 687436 - RNA, 23 nt, Human
ccacagucuccccucugccuccc

SEQ ID NO: 687437 - RNA, 23 nt, Human
ccagccugacaguccuuggcugu

SEQ ID NO: 687438 - RNA, 18 nt, Human
cccaagagguuccucucu

SEQ ID NO: 687439 - RNA, 28 nt, Human
cccacugcaugaccuugaaagguuuucc

SEQ ID NO: 687440 - RNA, 23 nt, Human
ccccaagguuucugcaaacucac

SEQ ID NO: 687441 - RNA, 21 nt, Human
ccccucugcacugugcaccca

SEQ ID NO: 687442 - RNA, 18 nt, Human
ccucucugcgcaccauca

SEQ ID NO: 687443 - RNA, 19 nt, Human
ccuguccccaauccuggga

SEQ ID NO: 687444 - RNA, 18 nt, Human
ccuguccugagugggccc

SEQ ID NO: 687445 - RNA, 21 nt, Human
ccuucuguuaccuccucuguc

SEQ ID NO: 687446 - RNA, 22 nt, Human
cggccccucugcacugugcacc

SEQ ID NO: 687447 - RNA, 22 nt, Human
cggggaaugaaauggcuucuga

SEQ ID NO: 687448 - RNA, 20 nt, Human
cuaaaaugauccccccucuc

SEQ ID NO: 687449 - RNA, 22 nt, Human
cuccccucugccucccuccgga

SEQ ID NO: 687450 - RNA, 25 nt, Human
cucuugccccuccuugcaguuauuu

SEQ ID NO: 687451 - RNA, 25 nt, Human
cuggugcccugcagguuaaagcuuu

SEQ ID NO: 687452 - RNA, 23 nt, Human
cuugcuacugcacaucucagaug

SEQ ID NO: 687453 - RNA, 21 nt, Human
gaaacuggccuuugccuucug

SEQ ID NO: 687454 - RNA, 19 nt, Human
gagaaggagagauggguug

SEQ ID NO: 687455 - RNA, 20 nt, Human
gagaaggagagauggguugg

SEQ ID NO: 687456 - RNA, 24 nt, Human
gagcaggcucugcugggcccccag

SEQ ID NO: 687457 - RNA, 21 nt, Human
gaggaggugggagaaucuucc

SEQ ID NO: 687458 - RNA, 19 nt, Human
gcagccucuggggagggug

SEQ ID NO: 687459 - RNA, 19 nt, Human
gcagccucuggggagggug

SEQ ID NO: 687460 - RNA, 18 nt, Human
gccugccuuggguccugg

SEQ ID NO: 687461 - RNA, 18 nt, Human
gccuuggguccuggugcc

SEQ ID NO: 687462 - RNA, 23 nt, Human
ggaaauguguuucccacagcccc

SEQ ID NO: 687463 - RNA, 22 nt, Human
ggagacaccaggaaggcuuggg

SEQ ID NO: 687464 - RNA, 19 nt, Human
ggaggaggaggaggaguug

SEQ ID NO: 687465 - RNA, 18 nt, Human
ggaggaggagggggccuc

SEQ ID NO: 687466 - RNA, 18 nt, Human
ggaggagggugggagcag

SEQ ID NO: 687467 - RNA, 19 nt, Human
ggaguccugggggaagugc

SEQ ID NO: 687468 - RNA, 20 nt, Human
ggaguccugggggaagugcc

SEQ ID NO: 687469 - RNA, 22 nt, Human
ggaugcaaaccaggcagcacag

SEQ ID NO: 687470 - RNA, 19 nt, Human
gggcaccuggagucacuug

SEQ ID NO: 687471 - RNA, 21 nt, Human
gggcaggagaggggucugggc

SEQ ID NO: 687472 - RNA, 19 nt, Human
gggcgggguggugaagggg

SEQ ID NO: 687473 - RNA, 21 nt, Human
ggggcgggguggugaaggggc

SEQ ID NO: 687474 - RNA, 21 nt, Human
ggguuggaggaggagggggcc

SEQ ID NO: 687475 - RNA, 24 nt, Human
ggugugcagagggcaggagagggg

SEQ ID NO: 687476 - RNA, 23 nt, Human
gucugucuuuucaaaagagcuuu

SEQ ID NO: 687477 - RNA, 21 nt, Human
gugcagagggcaggagagggg

SEQ ID NO: 687478 - RNA, 21 nt, Human
guuaccuccucugucccuguc

SEQ ID NO: 687479 - RNA, 19 nt, Human
uaccaggccagcugugugc

SEQ ID NO: 687480 - RNA, 22 nt, Human
uagaaacacaagaugcaagucc

SEQ ID NO: 687481 - RNA, 23 nt, Human
uaggaguccugggggaagugcca

SEQ ID NO: 687482 - RNA, 18 nt, Human
uaucuaaccaguguggaa

SEQ ID NO: 687483 - RNA, 19 nt, Human
ucaaagggaggagguggga

SEQ ID NO: 687484 - RNA, 22 nt, Human
ucagugagagggugggugucug

SEQ ID NO: 687485 - RNA, 23 nt, Human
ucagugagagggugggugucugc

SEQ ID NO: 687486 - RNA, 23 nt, Human
ucagugugaugguguggcccaag

SEQ ID NO: 687487 - RNA, 20 nt, Human
uccuugaccacagaaucaga

SEQ ID NO: 687488 - RNA, 18 nt, Human
uccuuggcuguuccagca

SEQ ID NO: 687489 - RNA, 22 nt, Human
uccuuggggcgggguggugaag

SEQ ID NO: 687490 - RNA, 24 nt, Human
ucuaccacagucuccccucugccu

SEQ ID NO: 687491 - RNA, 20 nt, Human
ucuccaggccuuggcugugg

SEQ ID NO: 687492 - RNA, 26 nt, Human
ucucuccuugaggagucugucuuuuc

SEQ ID NO: 687493 - RNA, 27 nt, Human
ucugagaccagaacagcuccaggagag

SEQ ID NO: 687494 - RNA, 18 nt, Human
ucugagcagagccagcuc

SEQ ID NO: 687495 - RNA, 22 nt, Human
ucugcugggcccccagucucca

SEQ ID NO: 687496 - RNA, 19 nt, Human
ucugucccuguccccaauc

SEQ ID NO: 687497 - RNA, 20 nt, Human
ucuguuaccuccucuguccc

SEQ ID NO: 687498 - RNA, 24 nt, Human
ucuguucaggugagaaauggaacc

SEQ ID NO: 687499 - RNA, 19 nt, Human
ucuugccccuccuugcagu

SEQ ID NO: 687500 - RNA, 20 nt, Human
ugaccugguaucccaggagc

SEQ ID NO: 687501 - RNA, 24 nt, Human
ugagaaauggaaccaagccucuga

SEQ ID NO: 687502 - RNA, 24 nt, Human
ugagaaggagagauggguuggagg

SEQ ID NO: 687503 - RNA, 22 nt, Human
ugagcagagccagcucugugga

SEQ ID NO: 687504 - RNA, 19 nt, Human
ugaggacacccugucacag

SEQ ID NO: 687505 - RNA, 22 nt, Human
ugccugcugcuggugugcagag

SEQ ID NO: 687506 - RNA, 23 nt, Human
ugcugaaucccaagagguuccuc

SEQ ID NO: 687507 - RNA, 21 nt, Human
ugcugggaggagggugggagc

SEQ ID NO: 687508 - RNA, 22 nt, Human
uggaaccaagccucugagacca

SEQ ID NO: 687509 - RNA, 19 nt, Human
uggaggaggagggggccuc

SEQ ID NO: 687510 - RNA, 25 nt, Human
uggaggaggagggggccucugaugg

SEQ ID NO: 687511 - RNA, 22 nt, Human
uggccuaggguggagccgggga

SEQ ID NO: 687512 - RNA, 19 nt, Human
uggcugugguggagaaagg

SEQ ID NO: 687513 - RNA, 22 nt, Human
ugggaaggggcagacaggguuc

SEQ ID NO: 687514 - RNA, 23 nt, Human
ugggaaggggcagacaggguucc

SEQ ID NO: 687515 - RNA, 24 nt, Human
ugggaggagggugggagcaggcuc

SEQ ID NO: 687516 - RNA, 21 nt, Human
ugggauaacagugagaaggag

SEQ ID NO: 687517 - RNA, 18 nt, Human
ugggcccccagucuccag

SEQ ID NO: 687518 - RNA, 21 nt, Human
ugggcuccugguaaaagaacc

SEQ ID NO: 687519 - RNA, 19 nt, Human
uggguccuggugcccugca

SEQ ID NO: 687520 - RNA, 21 nt, Human
uggguuggaggaggagggggc

SEQ ID NO: 687521 - RNA, 23 nt, Human
ugguuccaucaaagggaggaggu

SEQ ID NO: 687522 - RNA, 18 nt, Human
uguaagacgugggggcug

SEQ ID NO: 687523 - RNA, 20 nt, Human
uguccagccugacaguccuu

SEQ ID NO: 687524 - RNA, 18 nt, Human
ugucugggagagcugucc

SEQ ID NO: 687525 - RNA, 20 nt, Human
ugugaugguguggcccaagg

SEQ ID NO: 687526 - RNA, 19 nt, Human
uuucagucuguggagucuc

SEQ ID NO: 687527 - RNA, 18 nt, Human
uuucccacagccccacua

SEQ ID NO: 687528 - RNA, 22 nt, Human
uuuguagccccugcucaguuac

SEQ ID NO: 687529 - RNA, 22 nt, Human
uuuuuuuuuuuuuuuuuuccag

SEQ ID NO: 687530 - RNA, 19 nt, Human
caguacuugaaaaaugaaa

SEQ ID NO: 687531 - RNA, 22 nt, Human
gcuuugaaucucgugccgaauu

SEQ ID NO: 687532 - RNA, 20 nt, Human
uaaaacaguacuugaaaaau

SEQ ID NO: 687533 - RNA, 20 nt, Human
uggugguguugcuuugaauc

SEQ ID NO: 687534 - RNA, 24 nt, Human
uucagugguggugguguugcuuuu

SEQ ID NO: 687535 - RNA, 24 nt, Human
aaacacggcucgcgcccagcaucg

SEQ ID NO: 687536 - RNA, 21 nt, Human
aagaacugcuuuacacccuuc

SEQ ID NO: 687537 - RNA, 20 nt, Human
aagaugagccucagccaccu

SEQ ID NO: 687538 - RNA, 20 nt, Human
accucaggugcccaggcagc

SEQ ID NO: 687539 - RNA, 18 nt, Human
agaacgugcagaagccuc

SEQ ID NO: 687540 - RNA, 20 nt, Human
agagugccgagacccugcua

SEQ ID NO: 687541 - RNA, 22 nt, Human
agcggggggggacagcaggggu

SEQ ID NO: 687542 - RNA, 23 nt, Human
agcggggggggacagcaggggug

SEQ ID NO: 687543 - RNA, 22 nt, Human
agcgggggggggacagcggggg

SEQ ID NO: 687544 - RNA, 23 nt, Human
agcgggggggggacagcgggggu

SEQ ID NO: 687545 - RNA, 23 nt, Human
agcuggagaggcagagaaggaag

SEQ ID NO: 687546 - RNA, 24 nt, Human
aggcggugaugagaggcucugagc

SEQ ID NO: 687547 - RNA, 22 nt, Human
aggcguuucauucuucuucucg

SEQ ID NO: 687548 - RNA, 20 nt, Human
agggacagcggggggacaac

SEQ ID NO: 687549 - RNA, 20 nt, Human
agguggacagcaagggggac

SEQ ID NO: 687550 - RNA, 21 nt, Human
auacaggcguuucauucuucu

SEQ ID NO: 687551 - RNA, 22 nt, Human
caaagaugagccucagccaccu

SEQ ID NO: 687552 - RNA, 18 nt, Human
caacaggggggacagcgg

SEQ ID NO: 687553 - RNA, 19 nt, Human
cacguuuuccaccaugugc

SEQ ID NO: 687554 - RNA, 23 nt, Human
cacucuggcugcucggucgggag

SEQ ID NO: 687555 - RNA, 18 nt, Human
cacugcucccucccagcu

SEQ ID NO: 687556 - RNA, 22 nt, Human
cacugcucccucccagcuccca

SEQ ID NO: 687557 - RNA, 24 nt, Human
cacugcucccucccagcucccacc

SEQ ID NO: 687558 - RNA, 26 nt, Human
cacugugugacucggccacgcuggcu

SEQ ID NO: 687559 - RNA, 18 nt, Human
cagcaagggggacagcgg

SEQ ID NO: 687560 - RNA, 21 nt, Human
cagcaucgccccaccgugcag

SEQ ID NO: 687561 - RNA, 18 nt, Human
cagcggggcggccuggcc

SEQ ID NO: 687562 - RNA, 23 nt, Human
cagcucccacugcagcccugcuu

SEQ ID NO: 687563 - RNA, 22 nt, Human
cagggcacuuccccggucuuga

SEQ ID NO: 687564 - RNA, 20 nt, Human
caucuucccauggaagaucc

SEQ ID NO: 687565 - RNA, 22 nt, Human
ccacgacggggagcaaagggga

SEQ ID NO: 687566 - RNA, 19 nt, Human
ccaguuaacaacauauccc

SEQ ID NO: 687567 - RNA, 23 nt, Human
cccaccgugcagugagcggcccu

SEQ ID NO: 687568 - RNA, 21 nt, Human
cccagauguauugagucagaa

SEQ ID NO: 687569 - RNA, 23 nt, Human
cccuuuguccuuucagcaugcca

SEQ ID NO: 687570 - RNA, 20 nt, Human
ccucaaagaugagccucagc

SEQ ID NO: 687571 - RNA, 19 nt, Human
ccucagccaccucaggugc

SEQ ID NO: 687572 - RNA, 22 nt, Human
ccuccgucccuuuguccuuuca

SEQ ID NO: 687573 - RNA, 23 nt, Human
ccugcguccucuucacccaggag

SEQ ID NO: 687574 - RNA, 22 nt, Human
ccuggcgggcaucgacaggccc

SEQ ID NO: 687575 - RNA, 21 nt, Human
cgcccacauucagucuggacc

SEQ ID NO: 687576 - RNA, 18 nt, Human
cgcccagcaucgccccac

SEQ ID NO: 687577 - RNA, 23 nt, Human
cgucaggggagaccuggggcggc

SEQ ID NO: 687578 - RNA, 19 nt, Human
cguucugugucagaguuuc

SEQ ID NO: 687579 - RNA, 23 nt, Human
cucaaagaugagccucagccacc

SEQ ID NO: 687580 - RNA, 22 nt, Human
cucagaugaccaagugacuggg

SEQ ID NO: 687581 - RNA, 23 nt, Human
cucgugauaauugagcuuccaga

SEQ ID NO: 687582 - RNA, 21 nt, Human
cugacaccaaauuccacaggu

SEQ ID NO: 687583 - RNA, 18 nt, Human
cugcagcccugcuugcug

SEQ ID NO: 687584 - RNA, 21 nt, Human
cugcugaacuggcaccugugu

SEQ ID NO: 687585 - RNA, 20 nt, Human
cugcugggccccauggaugu

SEQ ID NO: 687586 - RNA, 22 nt, Human
cuguguccacguugggcguucu

SEQ ID NO: 687587 - RNA, 23 nt, Human
cuugcugugggggacccuucccg

SEQ ID NO: 687588 - RNA, 19 nt, Human
gacagcggggcggccuggc

SEQ ID NO: 687589 - RNA, 24 nt, Human
gacagcggggggggacagcagggg

SEQ ID NO: 687590 - RNA, 20 nt, Human
gacaggcugguggcuggggc

SEQ ID NO: 687591 - RNA, 20 nt, Human
gacggggagcaaaggggaug

SEQ ID NO: 687592 - RNA, 24 nt, Human
gacuuucuguuucuuaaauacuuu

SEQ ID NO: 687593 - RNA, 18 nt, Human
gagagaaauguuugcagu

SEQ ID NO: 687594 - RNA, 26 nt, Human
gagccgaggcacaggcagcaugaaaa

SEQ ID NO: 687595 - RNA, 23 nt, Human
gaggcacaggcagcaugaaaaca

SEQ ID NO: 687596 - RNA, 18 nt, Human
gagggauaguggggacag

SEQ ID NO: 687597 - RNA, 18 nt, Human
gcagcaugaaaacagucc

SEQ ID NO: 687598 - RNA, 20 nt, Human
gccuccgucccuuuguccuu

SEQ ID NO: 687599 - RNA, 21 nt, Human
gcggccccggggagaggccca

SEQ ID NO: 687600 - RNA, 19 nt, Human
gcucagaugaccaagugac

SEQ ID NO: 687601 - RNA, 20 nt, Human
gcuuucggggucacucuggc

SEQ ID NO: 687602 - RNA, 18 nt, Human
ggacaacaggggggacag

SEQ ID NO: 687603 - RNA, 23 nt, Human
ggacagcggggggacaacagggg

SEQ ID NO: 687604 - RNA, 21 nt, Human
ggacaggcugguggcuggggc

SEQ ID NO: 687605 - RNA, 20 nt, Human
ggcaucgacaggcccgggcc

SEQ ID NO: 687606 - RNA, 22 nt, Human
ggcgccuuucaccgaagccggg

SEQ ID NO: 687607 - RNA, 21 nt, Human
gggacagcggggcggccuggc

SEQ ID NO: 687608 - RNA, 20 nt, Human
gggacagcggggggggacag

SEQ ID NO: 687609 - RNA, 21 nt, Human
gggacagcgggggggggacag

SEQ ID NO: 687610 - RNA, 22 nt, Human
gggacagcgggggggggacagc

SEQ ID NO: 687611 - RNA, 22 nt, Human
ggggacagcggggggggacagc

SEQ ID NO: 687612 - RNA, 23 nt, Human
ggggacagcgggggugugacagc

SEQ ID NO: 687613 - RNA, 18 nt, Human
ggggcagagcugcggggg

SEQ ID NO: 687614 - RNA, 24 nt, Human
gggggacagcagggguggacagag

SEQ ID NO: 687615 - RNA, 19 nt, Human
ggugugacagcggggggga

SEQ ID NO: 687616 - RNA, 18 nt, Human
guaaaaugccuccguccc

SEQ ID NO: 687617 - RNA, 23 nt, Human
uaaaauguuucccaaacauauga

SEQ ID NO: 687618 - RNA, 19 nt, Human
uaaccaggauauacaggcg

SEQ ID NO: 687619 - RNA, 20 nt, Human
uaaccaggauauacaggcgu

SEQ ID NO: 687620 - RNA, 22 nt, Human
uaacggguguuucuuucagaaa

SEQ ID NO: 687621 - RNA, 18 nt, Human
uaaguugucaccggccca

SEQ ID NO: 687622 - RNA, 20 nt, Human
uauuauguacauuuacaugu

SEQ ID NO: 687623 - RNA, 22 nt, Human
ucacaucuucccauggaagauc

SEQ ID NO: 687624 - RNA, 20 nt, Human
ucagugcgcgucaccagcug

SEQ ID NO: 687625 - RNA, 21 nt, Human
uccccggucuugacggucacu

SEQ ID NO: 687626 - RNA, 18 nt, Human
ucccugggggcgcgacuu

SEQ ID NO: 687627 - RNA, 28 nt, Human
ucgcgcccagcaucgccccaccgugcag

SEQ ID NO: 687628 - RNA, 20 nt, Human
ucugugucagaguuuccugg

SEQ ID NO: 687629 - RNA, 20 nt, Human
ugacaccaaauuccacaggu

SEQ ID NO: 687630 - RNA, 20 nt, Human
ugacucggccacgcuggcag

SEQ ID NO: 687631 - RNA, 19 nt, Human
ugagccgaggcacaggcag

SEQ ID NO: 687632 - RNA, 19 nt, Human
ugagccucagccaccucag

SEQ ID NO: 687633 - RNA, 18 nt, Human
ugagggcaggcacugugu

SEQ ID NO: 687634 - RNA, 20 nt, Human
ugcagcccugcuugcuggag

SEQ ID NO: 687635 - RNA, 18 nt, Human
ugccuccgucccuuuguc

SEQ ID NO: 687636 - RNA, 21 nt, Human
ugcgaccugcguccucuucac

SEQ ID NO: 687637 - RNA, 22 nt, Human
ugcugggccccauggauguccu

SEQ ID NO: 687638 - RNA, 25 nt, Human
ugcuuugcucccaaaguucucuaaa

SEQ ID NO: 687639 - RNA, 18 nt, Human
uggcaggugcacugcucc

SEQ ID NO: 687640 - RNA, 20 nt, Human
uggcugcagugucacggggg

SEQ ID NO: 687641 - RNA, 21 nt, Human
uggcugcagugucacgggggc

SEQ ID NO: 687642 - RNA, 21 nt, Human
ugggcguucugugucagaguu

SEQ ID NO: 687643 - RNA, 20 nt, Human
uggggacaggcugguggcug

SEQ ID NO: 687644 - RNA, 22 nt, Human
ugggugugggcgucaggggaga

SEQ ID NO: 687645 - RNA, 24 nt, Human
ugggugugggcgucaggggagacc

SEQ ID NO: 687646 - RNA, 18 nt, Human
uggucaccacagggcacu

SEQ ID NO: 687647 - RNA, 21 nt, Human
ugguggcuggggccggacaca

SEQ ID NO: 687648 - RNA, 24 nt, Human
ugguucugucacaucuucccaugg

SEQ ID NO: 687649 - RNA, 24 nt, Human
ugucagaguuuccuggcuucccug

SEQ ID NO: 687650 - RNA, 21 nt, Human
ugugacagcgggggggacagc

SEQ ID NO: 687651 - RNA, 22 nt, Human
uuuuaugaaucguguauguucu

SEQ ID NO: 687652 - RNA, 19 nt, Human
aacauaaagagccauauuu

SEQ ID NO: 687653 - RNA, 19 nt, Human
aaccagugccugcuguccc

SEQ ID NO: 687654 - RNA, 25 nt, Human
acuuucugcuuucucuuucccaucu

SEQ ID NO: 687655 - RNA, 21 nt, Human
caaaccccaaaguuacugaga

SEQ ID NO: 687656 - RNA, 21 nt, Human
caacauaaagagccauauuua

SEQ ID NO: 687657 - RNA, 18 nt, Human
cacaggaagagaggggag

SEQ ID NO: 687658 - RNA, 21 nt, Human
caccuccucugcacaccgcuc

SEQ ID NO: 687659 - RNA, 24 nt, Human
cacggacggacucaacggcgacca

SEQ ID NO: 687660 - RNA, 25 nt, Human
cacugauacugcauugccuguuuug

SEQ ID NO: 687661 - RNA, 27 nt, Human
cagcccguugaccacaucuccagcugc

SEQ ID NO: 687662 - RNA, 20 nt, Human
cagcccucucccugcagucc

SEQ ID NO: 687663 - RNA, 19 nt, Human
cagcuccccggggacuccu

SEQ ID NO: 687664 - RNA, 23 nt, Human
ccacaucuccagcugccucggcc

SEQ ID NO: 687665 - RNA, 19 nt, Human
ccccaugaaucuccuccuc

SEQ ID NO: 687666 - RNA, 20 nt, Human
ccccggggacuccucgcagg

SEQ ID NO: 687667 - RNA, 24 nt, Human
cccgcugugucccgccuuuccucc

SEQ ID NO: 687668 - RNA, 21 nt, Human
ccucccuucccgcuguguccc

SEQ ID NO: 687669 - RNA, 20 nt, Human
ccugcagucccagcaccaag

SEQ ID NO: 687670 - RNA, 19 nt, Human
ccuuuccuccuggcgguug

SEQ ID NO: 687671 - RNA, 19 nt, Human
cgcugugccuaaccagugc

SEQ ID NO: 687672 - RNA, 19 nt, Human
cuaaauacuuaccugugca

SEQ ID NO: 687673 - RNA, 23 nt, Human
cucacagcccucucccugcaguc

SEQ ID NO: 687674 - RNA, 22 nt, Human
cuccagcugccucggccccagc

SEQ ID NO: 687675 - RNA, 23 nt, Human
cucccugcagucccagcaccaag

SEQ ID NO: 687676 - RNA, 22 nt, Human
cugcacaccgcucccuguuccc

SEQ ID NO: 687677 - RNA, 21 nt, Human
cuggaucaagcucugugggca

SEQ ID NO: 687678 - RNA, 21 nt, Human
cuguccccaugaaucuccucc

SEQ ID NO: 687679 - RNA, 19 nt, Human
cuuccucacagcccucucc

SEQ ID NO: 687680 - RNA, 21 nt, Human
cuucuggaucaagcucugugg

SEQ ID NO: 687681 - RNA, 25 nt, Human
gagcuacaacacuuacaaaccccaa

SEQ ID NO: 687682 - RNA, 22 nt, Human
gcauugccuguuuugucucuua

SEQ ID NO: 687683 - RNA, 19 nt, Human
gccuaaccagugccugcug

SEQ ID NO: 687684 - RNA, 20 nt, Human
gcuacaacacuuacaaaccc

SEQ ID NO: 687685 - RNA, 21 nt, Human
gggcauagcaggucauuuaaa

SEQ ID NO: 687686 - RNA, 21 nt, Human
gugaggugggggucaccacag

SEQ ID NO: 687687 - RNA, 26 nt, Human
uaaaaucaguuaaaaauaacaugugu

SEQ ID NO: 687688 - RNA, 26 nt, Human
uaaagagcacauucuugagauuguuc

SEQ ID NO: 687689 - RNA, 24 nt, Human
uaaccagugccugcuguccccaug

SEQ ID NO: 687690 - RNA, 22 nt, Human
uaaccgacacuaugagcuacaa

SEQ ID NO: 687691 - RNA, 25 nt, Human
uaaccgacacuaugagcuacaacac

SEQ ID NO: 687692 - RNA, 19 nt, Human
uccacagcuggugccaaga

SEQ ID NO: 687693 - RNA, 18 nt, Human
ucccgccuuuccuccugg

SEQ ID NO: 687694 - RNA, 19 nt, Human
ucccuguucccugcugggu

SEQ ID NO: 687695 - RNA, 19 nt, Human
ucugcuaggauccaacuca

SEQ ID NO: 687696 - RNA, 19 nt, Human
ugaccacaucuccagcugc

SEQ ID NO: 687697 - RNA, 23 nt, Human
ugcauugccuguuuugucucuua

SEQ ID NO: 687698 - RNA, 18 nt, Human
ugucccgccuuuccuccu

SEQ ID NO: 687699 - RNA, 23 nt, Human
ugugccuaaccagugccugcugu

SEQ ID NO: 687700 - RNA, 19 nt, Human
uguuuugucucuuaauuga

SEQ ID NO: 687701 - RNA, 25 nt, Human
uucaaaucaacaucggccagccugc

SEQ ID NO: 687702 - RNA, 20 nt, Human
uucccgggcaggccaccucc

SEQ ID NO: 687703 - RNA, 21 nt, Human
uugaccacaucuccagcugcc

SEQ ID NO: 687704 - RNA, 19 nt, Human
uuguaagugaggugggggu

SEQ ID NO: 687705 - RNA, 22 nt, Human
uuuuuguaagugaggugggggu

SEQ ID NO: 687706 - RNA, 20 nt, Human
aaaaagacaaaaaacauagc

SEQ ID NO: 687707 - RNA, 20 nt, Human
aaaacauaguaaaaagacaa

SEQ ID NO: 687708 - RNA, 22 nt, Human
aaaaugaaccacccuuaaagaa

SEQ ID NO: 687709 - RNA, 30 nt, Human
aaacauaguaaaaagacaaaaaacauagcc

SEQ ID NO: 687710 - RNA, 25 nt, Human
aacaagaaacugaagaaacauucac

SEQ ID NO: 687711 - RNA, 19 nt, Human
aacugccuuuuauuuccca

SEQ ID NO: 687712 - RNA, 20 nt, Human
aaggucagagaaaaugaacc

SEQ ID NO: 687713 - RNA, 18 nt, Human
agaaacugaagaaacauu

SEQ ID NO: 687714 - RNA, 20 nt, Human
aggaggaaaggguuuaaaaa

SEQ ID NO: 687715 - RNA, 27 nt, Human
aggaggaaaggguuuaaaaauuagaga

SEQ ID NO: 687716 - RNA, 22 nt, Human
agugaaauuaagaaaaaagucc

SEQ ID NO: 687717 - RNA, 20 nt, Human
aguuuuuucuuuuucuuuuc

SEQ ID NO: 687718 - RNA, 21 nt, Human
auuuuucaccuaaacuaccua

SEQ ID NO: 687719 - RNA, 24 nt, Human
caaccaaagccaaaauaaaaggga

SEQ ID NO: 687720 - RNA, 26 nt, Human
caagaacagaacauuucuuaggacuc

SEQ ID NO: 687721 - RNA, 21 nt, Human
cacaaccaaagccaaaauaaa

SEQ ID NO: 687722 - RNA, 21 nt, Human
cacaacucaaguguucuccaa

SEQ ID NO: 687723 - RNA, 22 nt, Human
ccaaaaccuucacaacucaagu

SEQ ID NO: 687724 - RNA, 28 nt, Human
ccacccuuaaagacacaaccuugggaaa

SEQ ID NO: 687725 - RNA, 28 nt, Human
cccaaaaccuucacaacucaaguguucu

SEQ ID NO: 687726 - RNA, 22 nt, Human
ccugacacucgggggccucggc

SEQ ID NO: 687727 - RNA, 24 nt, Human
cgaaaaacauaguaaaaagacaaa

SEQ ID NO: 687728 - RNA, 19 nt, Human
cggcagaugagccccggcu

SEQ ID NO: 687729 - RNA, 23 nt, Human
cggcgaacucuccucagcgcggc

SEQ ID NO: 687730 - RNA, 28 nt, Human
cgggcggcgacggcggcgaacucuccuc

SEQ ID NO: 687731 - RNA, 19 nt, Human
cucaaguguucuccaagug

SEQ ID NO: 687732 - RNA, 23 nt, Human
cuuccaaaaugcauuucuguaaa

SEQ ID NO: 687733 - RNA, 20 nt, Human
gaaaaacauaguaaaaagac

SEQ ID NO: 687734 - RNA, 24 nt, Human
gaaaggguuuaaaaauuagagaaa

SEQ ID NO: 687735 - RNA, 20 nt, Human
gaaaucacaaccaaagccaa

SEQ ID NO: 687736 - RNA, 22 nt, Human
gaggaaaggguuuaaaaauuag

SEQ ID NO: 687737 - RNA, 25 nt, Human
gaguuuuuaccacuguucucagcuu

SEQ ID NO: 687738 - RNA, 18 nt, Human
gcaaugcccuuuccucau

SEQ ID NO: 687739 - RNA, 19 nt, Human
gcggcagaugagccccggc

SEQ ID NO: 687740 - RNA, 18 nt, Human
gcggcggcggcagaugag

SEQ ID NO: 687741 - RNA, 22 nt, Human
ggggccucggcggacgcagcgg

SEQ ID NO: 687742 - RNA, 24 nt, Human
guuuuacaguauuuuucucuucca

SEQ ID NO: 687743 - RNA, 22 nt, Human
uaaaaagacaaaaaacauagca

SEQ ID NO: 687744 - RNA, 18 nt, Human
uaagaaaaaaguccuaau

SEQ ID NO: 687745 - RNA, 22 nt, Human
uaagaaaaaaguccuaauucuc

SEQ ID NO: 687746 - RNA, 23 nt, Human
uaguaaaaagacaaaaaacauag

SEQ ID NO: 687747 - RNA, 21 nt, Human
uaugcagaugcaaccguugcu

SEQ ID NO: 687748 - RNA, 19 nt, Human
uccaaaaugcauuucugua

SEQ ID NO: 687749 - RNA, 18 nt, Human
ucuccaagugcaaauguc

SEQ ID NO: 687750 - RNA, 22 nt, Human
ucuccucagcgcggcggcggcg

SEQ ID NO: 687751 - RNA, 22 nt, Human
ucuguaaacgaguuuuuaccac

SEQ ID NO: 687752 - RNA, 24 nt, Human
ugaaaucacaaccaaagccaaaau

SEQ ID NO: 687753 - RNA, 22 nt, Human
ugcacuuacggacuuaaaaauc

SEQ ID NO: 687754 - RNA, 20 nt, Human
ugggguggaugcccaaaacc

SEQ ID NO: 687755 - RNA, 19 nt, Human
uguuauauucuccuagaca

SEQ ID NO: 687756 - RNA, 19 nt, Human
uuaguuuuuucuuuuucuu

SEQ ID NO: 687757 - RNA, 24 nt, Human
uuccaguuaaguccuaugucuuuu

SEQ ID NO: 687758 - RNA, 22 nt, Human
uucucagcuuugaaaucaaauu

SEQ ID NO: 687759 - RNA, 18 nt, Human
uuuuuuuuuuuuuuuuug

SEQ ID NO: 687760 - RNA, 28 nt, Human
aaaaaacucgacucauaaaaauacuagc

SEQ ID NO: 687761 - RNA, 19 nt, Human
aagaaaaaacaguuuagaa

SEQ ID NO: 687762 - RNA, 20 nt, Human
acuccugggagaagaugcuc

SEQ ID NO: 687763 - RNA, 24 nt, Human
agaagaugcucagcagaguggccu

SEQ ID NO: 687764 - RNA, 19 nt, Human
agcaaacacacagcauagg

SEQ ID NO: 687765 - RNA, 23 nt, Human
aggcggcacagacacuaggcacu

SEQ ID NO: 687766 - RNA, 23 nt, Human
augaauuuuauacugaaacagaa

SEQ ID NO: 687767 - RNA, 21 nt, Human
caauggaacuaauacuuucaa

SEQ ID NO: 687768 - RNA, 23 nt, Human
caauggaacuaauacuuucaaau

SEQ ID NO: 687769 - RNA, 22 nt, Human
caauugcuuccgaaguaugaug

SEQ ID NO: 687770 - RNA, 25 nt, Human
cagcagaguggccugcgauugacug

SEQ ID NO: 687771 - RNA, 21 nt, Human
cccauaucaucuauucaacau

SEQ ID NO: 687772 - RNA, 22 nt, Human
ccuaaagaaaaaacaguuuaga

SEQ ID NO: 687773 - RNA, 18 nt, Human
ccucccagcuucucuucc

SEQ ID NO: 687774 - RNA, 24 nt, Human
ccucugguaauaacuuucaauugc

SEQ ID NO: 687775 - RNA, 20 nt, Human
cggcacagacacuaggcacu

SEQ ID NO: 687776 - RNA, 20 nt, Human
cguaaagauugaauauagca

SEQ ID NO: 687777 - RNA, 20 nt, Human
cucugcuucagcuuccucag

SEQ ID NO: 687778 - RNA, 20 nt, Human
cugaacuuacucgaguguuu

SEQ ID NO: 687779 - RNA, 23 nt, Human
cuuuuccucccagcuucucuucc

SEQ ID NO: 687780 - RNA, 19 nt, Human
gccagguccaggagcacug

SEQ ID NO: 687781 - RNA, 21 nt, Human
gugugugugugugugugugag

SEQ ID NO: 687782 - RNA, 20 nt, Human
gugugugugugugugugugu

SEQ ID NO: 687783 - RNA, 19 nt, Human
guguucaaauaacauuauu

SEQ ID NO: 687784 - RNA, 20 nt, Human
guuucugguacuccugggag

SEQ ID NO: 687785 - RNA, 18 nt, Human
uaaaaguacacaaaagug

SEQ ID NO: 687786 - RNA, 20 nt, Human
uaaaaguacacaaaagugaa

SEQ ID NO: 687787 - RNA, 22 nt, Human
uaaaauaaacaaauccuugaca

SEQ ID NO: 687788 - RNA, 22 nt, Human
uaauauucaacuucccgaaaga

SEQ ID NO: 687789 - RNA, 23 nt, Human
uaaugcaccccacucagaguuaa

SEQ ID NO: 687790 - RNA, 22 nt, Human
uaauguaaaauaaacaaauccu

SEQ ID NO: 687791 - RNA, 23 nt, Human
uacacaaaagugaauaaauuaaa

SEQ ID NO: 687792 - RNA, 23 nt, Human
uagaacaugccaggaaaccugcu

SEQ ID NO: 687793 - RNA, 24 nt, Human
uaggcaggcugccaucaaggucuu

SEQ ID NO: 687794 - RNA, 19 nt, Human
uaugucagcauggcagggu

SEQ ID NO: 687795 - RNA, 22 nt, Human
uaugucagcauggcaggguggc

SEQ ID NO: 687796 - RNA, 21 nt, Human
ucaagcaauguauauaaguua

SEQ ID NO: 687797 - RNA, 20 nt, Human
ucauuggccagguccaggag

SEQ ID NO: 687798 - RNA, 19 nt, Human
uccacacauguugggacca

SEQ ID NO: 687799 - RNA, 18 nt, Human
uccaccucauuggccagg

SEQ ID NO: 687800 - RNA, 24 nt, Human
ucucuuuuccucccagcuucucuu

SEQ ID NO: 687801 - RNA, 21 nt, Human
ucuuuuccucccagcuucucu

SEQ ID NO: 687802 - RNA, 20 nt, Human
ugccucucucuuuugauuua

SEQ ID NO: 687803 - RNA, 23 nt, Human
ugcuccagguuuauuucuggcac

SEQ ID NO: 687804 - RNA, 21 nt, Human
ugcuucagcuuccucaggcuc

SEQ ID NO: 687805 - RNA, 18 nt, Human
uggcuuuggacuuugugg

SEQ ID NO: 687806 - RNA, 19 nt, Human
ugggagaagaugcucagca

SEQ ID NO: 687807 - RNA, 24 nt, Human
ugguagaaaauaaacaaaguauaa

SEQ ID NO: 687808 - RNA, 18 nt, Human
uguguguguguguaucca

SEQ ID NO: 687809 - RNA, 18 nt, Human
uguguguguguguguauc

SEQ ID NO: 687810 - RNA, 18 nt, Human
ugugugugugugugugug

SEQ ID NO: 687811 - RNA, 18 nt, Human
ugugugugugugugugug

SEQ ID NO: 687812 - RNA, 21 nt, Human
ugugugugugugugugugugu

SEQ ID NO: 687813 - RNA, 23 nt, Human
uguguguguguguguguguguaa

SEQ ID NO: 687814 - RNA, 22 nt, Human
uuaaaaauaaacucuccucaau

SEQ ID NO: 687815 - RNA, 22 nt, Human
uuauuccuaaagaaaaaacagu

SEQ ID NO: 687816 - RNA, 22 nt, Human
uucagcuuccucaggcucugcc

SEQ ID NO: 687817 - RNA, 19 nt, Human
uuccucaggcucugccugg

SEQ ID NO: 687818 - RNA, 23 nt, Human
uuguauaaagugugugugugugu

SEQ ID NO: 687819 - RNA, 31 nt, Human
uuguauaaagugugugugugugugugugugg

SEQ ID NO: 687820 - RNA, 24 nt, Human
uuuguuuaauguaaaauaaacaaa

SEQ ID NO: 687821 - RNA, 19 nt, Human
uuuuucaccacuccauuca

SEQ ID NO: 687822 - RNA, 25 nt, Human
uuuuuuuuuuuuuuuuuuuauuuuu

SEQ ID NO: 687823 - RNA, 24 nt, Human
aaacacaguugaguacauccaugc

SEQ ID NO: 687824 - RNA, 19 nt, Human
aacaagucaaauaaaagca

SEQ ID NO: 687825 - RNA, 20 nt, Human
aagagccccgagcaaagcuc

SEQ ID NO: 687826 - RNA, 22 nt, Human
aagcuccaaucaagagccccga

SEQ ID NO: 687827 - RNA, 18 nt, Human
aaggaaggcggagcucag

SEQ ID NO: 687828 - RNA, 27 nt, Human
aaugcacaaacagaaauuuauauuaaa

SEQ ID NO: 687829 - RNA, 19 nt, Human
acaagucaaauaaaagcac

SEQ ID NO: 687830 - RNA, 23 nt, Human
acaagucaaauaaaagcacugcu

SEQ ID NO: 687831 - RNA, 20 nt, Human
agaaaagaaagcucucucau

SEQ ID NO: 687832 - RNA, 20 nt, Human
agccccgagcaaagcucguu

SEQ ID NO: 687833 - RNA, 25 nt, Human
agcuccaaucaagagccccgagcaa

SEQ ID NO: 687834 - RNA, 18 nt, Human
aggcggagcucaggagug

SEQ ID NO: 687835 - RNA, 21 nt, Human
caaaacaaaggaaggcggagc

SEQ ID NO: 687836 - RNA, 20 nt, Human
cacugcuuucuuuuccuuag

SEQ ID NO: 687837 - RNA, 18 nt, Human
ccucagaaaagaaagcuc

SEQ ID NO: 687838 - RNA, 22 nt, Human
cguuucauaacaucauuaagau

SEQ ID NO: 687839 - RNA, 23 nt, Human
cuucccaaguacaggcguaaaua

SEQ ID NO: 687840 - RNA, 21 nt, Human
gggaacgcgggaagggaagac

SEQ ID NO: 687841 - RNA, 21 nt, Human
uaaaaaaaaguccccagcuuc

SEQ ID NO: 687842 - RNA, 18 nt, Human
uaaaaaguuaagugaaaa

SEQ ID NO: 687843 - RNA, 24 nt, Human
uaaaauucagaguauuaaacacag

SEQ ID NO: 687844 - RNA, 19 nt, Human
uaaccucagaaaagaaagc

SEQ ID NO: 687845 - RNA, 22 nt, Human
uaacuagguggggguauuccug

SEQ ID NO: 687846 - RNA, 19 nt, Human
uacaggcguaaauaugaug

SEQ ID NO: 687847 - RNA, 23 nt, Human
uacauccaugcauacaugacaua

SEQ ID NO: 687848 - RNA, 18 nt, Human
uauccugcugagugaaga

SEQ ID NO: 687849 - RNA, 19 nt, Human
uauuaccaaaauaagagua

SEQ ID NO: 687850 - RNA, 20 nt, Human
ucaaaacaaaggaaggcgga

SEQ ID NO: 687851 - RNA, 20 nt, Human
ugaguacauccaugcauaca

SEQ ID NO: 687852 - RNA, 24 nt, Human
ugcauacaugacauaccgucauca

SEQ ID NO: 687853 - RNA, 25 nt, Human
ugcauacaugacauaccgucaucac

SEQ ID NO: 687854 - RNA, 21 nt, Human
uggaacaagucaaauaaaagc

SEQ ID NO: 687855 - RNA, 18 nt, Human
ugucagaaaugcacaaac

SEQ ID NO: 687856 - RNA, 23 nt, Human
ugugaagguagauagcauugcug

SEQ ID NO: 687857 - RNA, 22 nt, Human
aaaacuagacuaaaauaccuug

SEQ ID NO: 687858 - RNA, 22 nt, Human
aaauaaaugugauaccagaaaa

SEQ ID NO: 687859 - RNA, 24 nt, Human
augcuuggcuugggcucagaggcc

SEQ ID NO: 687860 - RNA, 18 nt, Human
auuucaccugggugcagg

SEQ ID NO: 687861 - RNA, 21 nt, Human
ccuacaugcaaaacagcugug

SEQ ID NO: 687862 - RNA, 19 nt, Human
ccugggugcaggugggcug

SEQ ID NO: 687863 - RNA, 22 nt, Human
cgaagggugauggauuaucauu

SEQ ID NO: 687864 - RNA, 19 nt, Human
cucaaggguggggagaauu

SEQ ID NO: 687865 - RNA, 18 nt, Human
cucacuguaaccuccugg

SEQ ID NO: 687866 - RNA, 18 nt, Human
cucacuguaaccuccugg

SEQ ID NO: 687867 - RNA, 19 nt, Human
cuccuacaugcaaaacagc

SEQ ID NO: 687868 - RNA, 19 nt, Human
cuugugcagaacauauuag

SEQ ID NO: 687869 - RNA, 22 nt, Human
gaaaaugguuacaacucuuugc

SEQ ID NO: 687870 - RNA, 21 nt, Human
ggaugcgaugcuuggcuuggg

SEQ ID NO: 687871 - RNA, 23 nt, Human
ggcccuuuucccuagcaaucuua

SEQ ID NO: 687872 - RNA, 23 nt, Human
gggcaggguggaucucacaaagu

SEQ ID NO: 687873 - RNA, 21 nt, Human
guauauuccacaucaccauca

SEQ ID NO: 687874 - RNA, 23 nt, Human
gugaaguuaagagcaauguuuug

SEQ ID NO: 687875 - RNA, 23 nt, Human
uaaauuggaauccuuaacaucca

SEQ ID NO: 687876 - RNA, 21 nt, Human
uaaccuuuccacuaaggugac

SEQ ID NO: 687877 - RNA, 22 nt, Human
uaaccuuuccacuaaggugacu

SEQ ID NO: 687878 - RNA, 24 nt, Human
uaagagcaauguuuugugggcagg

SEQ ID NO: 687879 - RNA, 23 nt, Human
uacgugcaaaucacaggggaugc

SEQ ID NO: 687880 - RNA, 21 nt, Human
uagugggucagugaaugaugu

SEQ ID NO: 687881 - RNA, 18 nt, Human
ucacaaugguggaauguc

SEQ ID NO: 687882 - RNA, 20 nt, Human
ucacaggggaugcgaugcuu

SEQ ID NO: 687883 - RNA, 19 nt, Human
ucaguuaaggcuauuuuua

SEQ ID NO: 687884 - RNA, 18 nt, Human
ucaguugaucagauuggg

SEQ ID NO: 687885 - RNA, 23 nt, Human
ucaucccaaaucgaguugguuac

SEQ ID NO: 687886 - RNA, 21 nt, Human
uccacaucaccaucacaaucu

SEQ ID NO: 687887 - RNA, 18 nt, Human
uccauuuucucugcuaug

SEQ ID NO: 687888 - RNA, 23 nt, Human
ucuccuacaugcaaaacagcugu

SEQ ID NO: 687889 - RNA, 22 nt, Human
ucuuaaggguggggaagauuac

SEQ ID NO: 687890 - RNA, 23 nt, Human
ucuucaguuacuuuaggccaucu

SEQ ID NO: 687891 - RNA, 20 nt, Human
ucuugguuuccaggcucugg

SEQ ID NO: 687892 - RNA, 22 nt, Human
ugaagaaaggggagaugaaguc

SEQ ID NO: 687893 - RNA, 20 nt, Human
uggaaugucaucaguuaagg

SEQ ID NO: 687894 - RNA, 21 nt, Human
ugggcugaguccgaaaagaga

SEQ ID NO: 687895 - RNA, 22 nt, Human
uguuuuguccauuuucucugcu

SEQ ID NO: 687896 - RNA, 18 nt, Human
uuacccugauacaaccgu

SEQ ID NO: 687897 - RNA, 20 nt, Human
uuagucuuuggugcccuaag

SEQ ID NO: 687898 - RNA, 24 nt, Human
uucaccugggugcaggugggcucc

SEQ ID NO: 687899 - RNA, 19 nt, Human
uuccaggcucugguuuucu

SEQ ID NO: 687900 - RNA, 23 nt, Human
uugccuggaauuguggugaagaa

SEQ ID NO: 687901 - RNA, 20 nt, Human
uuuaaccuuuccacuaaggu

SEQ ID NO: 687902 - RNA, 19 nt, Human
aaaauuacaaucaaagggg

SEQ ID NO: 687903 - RNA, 21 nt, Human
aagcuucugagccaggagaag

SEQ ID NO: 687904 - RNA, 21 nt, Human
aggagaaggaaguucacaggu

SEQ ID NO: 687905 - RNA, 19 nt, Human
aggcaggggcgggggucac

SEQ ID NO: 687906 - RNA, 24 nt, Human
aggcaggggcgggggucacaaggu

SEQ ID NO: 687907 - RNA, 19 nt, Human
agggagauagggguggggc

SEQ ID NO: 687908 - RNA, 22 nt, Human
auggcaggcaggggcggggguc

SEQ ID NO: 687909 - RNA, 24 nt, Human
caugcaggucacaggggauaugau

SEQ ID NO: 687910 - RNA, 20 nt, Human
ccaggagaaggaaguucaca

SEQ ID NO: 687911 - RNA, 23 nt, Human
cccuucuauauagaaguaacuug

SEQ ID NO: 687912 - RNA, 19 nt, Human
cggggucggcuggcagcug

SEQ ID NO: 687913 - RNA, 21 nt, Human
cggggucggcuggcagcuggg

SEQ ID NO: 687914 - RNA, 21 nt, Human
gaagggagauagggguggggc

SEQ ID NO: 687915 - RNA, 18 nt, Human
gauucuucacuugcuuca

SEQ ID NO: 687916 - RNA, 23 nt, Human
gcgcgguuggcgggagugcgggg

SEQ ID NO: 687917 - RNA, 20 nt, Human
ggagugcggguucggggucg

SEQ ID NO: 687918 - RNA, 20 nt, Human
ggcaggaaccggcccuuuuc

SEQ ID NO: 687919 - RNA, 20 nt, Human
gggagacuccagcucugggc

SEQ ID NO: 687920 - RNA, 20 nt, Human
gggccguuuuauaggauuug

SEQ ID NO: 687921 - RNA, 21 nt, Human
gggcgggggucacaaggugcu

SEQ ID NO: 687922 - RNA, 24 nt, Human
gggguuguucuauggcaggcaggg

SEQ ID NO: 687923 - RNA, 23 nt, Human
gguggggccguuuuauaggauuu

SEQ ID NO: 687924 - RNA, 22 nt, Human
uacaugcaggucacaggggaua

SEQ ID NO: 687925 - RNA, 18 nt, Human
ucacaaugguggaauguc

SEQ ID NO: 687926 - RNA, 22 nt, Human
ucuauggcaggcaggggcgggg

SEQ ID NO: 687927 - RNA, 24 nt, Human
ucuauggcaggcaggggcgggggu

SEQ ID NO: 687928 - RNA, 27 nt, Human
uggaaugucaucaguuaaggcaggaaa

SEQ ID NO: 687929 - RNA, 23 nt, Human
uggcuuugcuugggcucagaggu

SEQ ID NO: 687930 - RNA, 24 nt, Human
uggcuuugcuugggcucagagguc

SEQ ID NO: 687931 - RNA, 19 nt, Human
uguauacaugcaggucaca

SEQ ID NO: 687932 - RNA, 26 nt, Human
uuaaggcaggaaccggcccuuuucac

SEQ ID NO: 687933 - RNA, 22 nt, Human
uugcgugacaauaaagcuuuuu

SEQ ID NO: 687934 - RNA, 21 nt, Human
uugugauucuucacuugcuuc

SEQ ID NO: 687935 - RNA, 18 nt, Human
aaaauauaccuuaaaagc

SEQ ID NO: 687936 - RNA, 19 nt, Human
acuccgaaacuaaagcagc

SEQ ID NO: 687937 - RNA, 21 nt, Human
aggcagcaggcuggauuuggc

SEQ ID NO: 687938 - RNA, 25 nt, Human
aggcagcaggcuggauuuggccggc

SEQ ID NO: 687939 - RNA, 18 nt, Human
caaacacuccgaaacuaa

SEQ ID NO: 687940 - RNA, 26 nt, Human
cccaugcuacaaaauauaccuuaaaa

SEQ ID NO: 687941 - RNA, 27 nt, Human
cccaugcuacaaaauauaccuuaaaag

SEQ ID NO: 687942 - RNA, 19 nt, Human
ccccgucgccaaacacucc

SEQ ID NO: 687943 - RNA, 20 nt, Human
ccgaaacuaaagcagcagag

SEQ ID NO: 687944 - RNA, 19 nt, Human
cgccaaacacuccgaaacu

SEQ ID NO: 687945 - RNA, 21 nt, Human
cgcugccccgucgccaaacac

SEQ ID NO: 687946 - RNA, 24 nt, Human
gcagcagagcgagaaucucccgga

SEQ ID NO: 687947 - RNA, 19 nt, Human
uaaagcagcagagcgagaa

SEQ ID NO: 687948 - RNA, 21 nt, Human
uguagauugccaacccaugcu

SEQ ID NO: 687949 - RNA, 27 nt, Human
aaaagaaacagaaauaucgguaaaaag

SEQ ID NO: 687950 - RNA, 24 nt, Human
aaaagaccuaaagcucucaaaaua

SEQ ID NO: 687951 - RNA, 22 nt, Human
aaaugccacauucucccugaaa

SEQ ID NO: 687952 - RNA, 26 nt, Human
aaaugccaggguuacagguguaagcc

SEQ ID NO: 687953 - RNA, 19 nt, Human
aacacaaacaaaagauaaa

SEQ ID NO: 687954 - RNA, 21 nt, Human
aacgguuaaaagaaacagaaa

SEQ ID NO: 687955 - RNA, 21 nt, Human
aagaaacaaacuaaacaacua

SEQ ID NO: 687956 - RNA, 18 nt, Human
aaggacaccgccuguaac

SEQ ID NO: 687957 - RNA, 20 nt, Human
aaguaugcugaaggcacugu

SEQ ID NO: 687958 - RNA, 22 nt, Human
acaacuaaaauguucucauccc

SEQ ID NO: 687959 - RNA, 18 nt, Human
acagguguaagccaccgu

SEQ ID NO: 687960 - RNA, 24 nt, Human
accauguugcccuggcuggucucg

SEQ ID NO: 687961 - RNA, 20 nt, Human
accucucuuaaaaggcuagg

SEQ ID NO: 687962 - RNA, 26 nt, Human
agaaacagaaauaucgguaaaaagga

SEQ ID NO: 687963 - RNA, 22 nt, Human
agaaagauucaaaaguuugcua

SEQ ID NO: 687964 - RNA, 24 nt, Human
agacugcuuccuuucaaucaugaa

SEQ ID NO: 687965 - RNA, 22 nt, Human
agagauggagucucgcucuguu

SEQ ID NO: 687966 - RNA, 22 nt, Human
agcgguggcggcucugacuccg

SEQ ID NO: 687967 - RNA, 24 nt, Human
agcucacuccagccggcuccccug

SEQ ID NO: 687968 - RNA, 20 nt, Human
aggaggccagagccggccug

SEQ ID NO: 687969 - RNA, 24 nt, Human
aggcaaucugcccaccuuggccuc

SEQ ID NO: 687970 - RNA, 19 nt, Human
aggcauuuaacauuuggga

SEQ ID NO: 687971 - RNA, 23 nt, Human
agguguaagccaccgugccuggc

SEQ ID NO: 687972 - RNA, 22 nt, Human
aguagagaugggguuucaccau

SEQ ID NO: 687973 - RNA, 18 nt, Human
aguagcugggacuacagg

SEQ ID NO: 687974 - RNA, 19 nt, Human
aguagcugggacuacaggc

SEQ ID NO: 687975 - RNA, 24 nt, Human
aguucaguggcacaaucucggcuc

SEQ ID NO: 687976 - RNA, 21 nt, Human
auagcaauaaaagaaagauuc

SEQ ID NO: 687977 - RNA, 19 nt, Human
augggguuucaccauguug

SEQ ID NO: 687978 - RNA, 25 nt, Human
augggguuucaccauguugcccugg

SEQ ID NO: 687979 - RNA, 22 nt, Human
auugaaacuauuuucacauuug

SEQ ID NO: 687980 - RNA, 18 nt, Human
auuugccuacuuuuccuu

SEQ ID NO: 687981 - RNA, 24 nt, Human
auuuuaguagagaugggguuucac

SEQ ID NO: 687982 - RNA, 25 nt, Human
caaaaagcuguauuccuacaacuaa

SEQ ID NO: 687983 - RNA, 24 nt, Human
caaaaugccaggguuacaggugua

SEQ ID NO: 687984 - RNA, 22 nt, Human
caaaaugucccuaaguuauugu

SEQ ID NO: 687985 - RNA, 22 nt, Human
caagcaauucuccugccucagc

SEQ ID NO: 687986 - RNA, 22 nt, Human
cacacaguuuaggguguccacc

SEQ ID NO: 687987 - RNA, 24 nt, Human
caccauguugcccuggcuggucuc

SEQ ID NO: 687988 - RNA, 27 nt, Human
caccauguugcccuggcuggucucgaa

SEQ ID NO: 687989 - RNA, 21 nt, Human
caccgugccuggccaagacug

SEQ ID NO: 687990 - RNA, 23 nt, Human
cacugcaacuuccgccucucggg

SEQ ID NO: 687991 - RNA, 23 nt, Human
cacuucucccucuguugcucuuu

SEQ ID NO: 687992 - RNA, 22 nt, Human
cacuugguugaaaaacuuugca

SEQ ID NO: 687993 - RNA, 20 nt, Human
cagaucccaaaauuuaaagg

SEQ ID NO: 687994 - RNA, 23 nt, Human
cagcccagacgccgcaguggcgg

SEQ ID NO: 687995 - RNA, 20 nt, Human
cagccuccugaguagcuggg

SEQ ID NO: 687996 - RNA, 22 nt, Human
caggaguggaauuguaucuguc

SEQ ID NO: 687997 - RNA, 22 nt, Human
caggguuacagguguaagccac

SEQ ID NO: 687998 - RNA, 19 nt, Human
cagucggcauucagagucu

SEQ ID NO: 687999 - RNA, 20 nt, Human
caguggcacaaucucggcuc

SEQ ID NO: 688000 - RNA, 24 nt, Human
cauguugcccuggcuggucucgaa

SEQ ID NO: 688001 - RNA, 25 nt, Human
ccaaaaagaccuaaagcucucaaaa

SEQ ID NO: 688002 - RNA, 24 nt, Human
ccaaaaugccaggguuacaggugu

SEQ ID NO: 688003 - RNA, 24 nt, Human
ccaaagcauacuuucaaaauuucu

SEQ ID NO: 688004 - RNA, 23 nt, Human
ccaagcccagcuaacuuuuugua

SEQ ID NO: 688005 - RNA, 26 nt, Human
cccaaaaggaaauuuuuaaacaccau

SEQ ID NO: 688006 - RNA, 25 nt, Human
cccccguagucgcuccaagccccuu

SEQ ID NO: 688007 - RNA, 19 nt, Human
ccccggaaaguuagcgagc

SEQ ID NO: 688008 - RNA, 20 nt, Human
ccccgguggccugacgacgg

SEQ ID NO: 688009 - RNA, 23 nt, Human
ccccugcgagggggccuuccccc

SEQ ID NO: 688010 - RNA, 19 nt, Human
ccccugcgcguccucccgc

SEQ ID NO: 688011 - RNA, 18 nt, Human
cccgcgccgcgccgcugc

SEQ ID NO: 688012 - RNA, 20 nt, Human
cccgcgccgcgccgcugccg

SEQ ID NO: 688013 - RNA, 19 nt, Human
cccguagucgcuccaagcc

SEQ ID NO: 688014 - RNA, 22 nt, Human
cccucuguugcucuuuuucauc

SEQ ID NO: 688015 - RNA, 26 nt, Human
ccgccccugcgcguccucccgccucc

SEQ ID NO: 688016 - RNA, 19 nt, Human
ccgccgagcccgcgccgcg

SEQ ID NO: 688017 - RNA, 24 nt, Human
ccgcugccgccuagcucgccgccc

SEQ ID NO: 688018 - RNA, 20 nt, Human
ccggcagcggccgcauuuuc

SEQ ID NO: 688019 - RNA, 21 nt, Human
ccggcuccccugcgagggggc

SEQ ID NO: 688020 - RNA, 23 nt, Human
ccuaaaauuaugcuucuguuguu

SEQ ID NO: 688021 - RNA, 19 nt, Human
ccuaaaguuucuuuuaaaa

SEQ ID NO: 688022 - RNA, 25 nt, Human
ccuacaacuaauaaaaaaguaugcu

SEQ ID NO: 688023 - RNA, 23 nt, Human
ccucaaaugccacauucucccug

SEQ ID NO: 688024 - RNA, 21 nt, Human
ccucccgccucccuccggcuc

SEQ ID NO: 688025 - RNA, 19 nt, Human
ccucgaacucuuggcuagc

SEQ ID NO: 688026 - RNA, 24 nt, Human
ccucucggguucaagcaauucucc

SEQ ID NO: 688027 - RNA, 19 nt, Human
ccucucuuuccccucuucc

SEQ ID NO: 688028 - RNA, 19 nt, Human
ccucucuuuccccucuucc

SEQ ID NO: 688029 - RNA, 26 nt, Human
ccugacgacggcggcggccgccccuu

SEQ ID NO: 688030 - RNA, 23 nt, Human
ccugaguagcugggacuacaggc

SEQ ID NO: 688031 - RNA, 24 nt, Human
ccugaguagcugggacuacaggcg

SEQ ID NO: 688032 - RNA, 24 nt, Human
ccugccucagccuccugaguagcu

SEQ ID NO: 688033 - RNA, 24 nt, Human
ccuguaacuauaaauucuagcacu

SEQ ID NO: 688034 - RNA, 19 nt, Human
cgagccuccggcagcggcc

SEQ ID NO: 688035 - RNA, 18 nt, Human
cgcccugcgcugucuggg

SEQ ID NO: 688036 - RNA, 18 nt, Human
cgccgcgccgcugccgcc

SEQ ID NO: 688037 - RNA, 22 nt, Human
cgcgacccgggcucggccgcgc

SEQ ID NO: 688038 - RNA, 22 nt, Human
cgcgcgaucccucgcgcccugc

SEQ ID NO: 688039 - RNA, 24 nt, Human
cgcucuguugcccaggcuggagug

SEQ ID NO: 688040 - RNA, 21 nt, Human
cggguucaagcaauucuccug

SEQ ID NO: 688041 - RNA, 24 nt, Human
cuaguuaaaguaguuaaaauuuca

SEQ ID NO: 688042 - RNA, 24 nt, Human
cucacugcaacuuccgccucucgg

SEQ ID NO: 688043 - RNA, 24 nt, Human
cucagccuccugaguagcugggac

SEQ ID NO: 688044 - RNA, 24 nt, Human
cucaggcaaucugcccaccuuggc

SEQ ID NO: 688045 - RNA, 21 nt, Human
cucaucccaaaaagaccuaaa

SEQ ID NO: 688046 - RNA, 20 nt, Human
cucccugaaaccuuacugaa

SEQ ID NO: 688047 - RNA, 20 nt, Human
cuccuccuccuccuccucuu

SEQ ID NO: 688048 - RNA, 24 nt, Human
cucgcucuguugcccaggcuggag

SEQ ID NO: 688049 - RNA, 21 nt, Human
cucucuuuccccucuuccacu

SEQ ID NO: 688050 - RNA, 25 nt, Human
cugaaacacuucucccucuguugcu

SEQ ID NO: 688051 - RNA, 26 nt, Human
cugccucucuuuccccucuuccacuc

SEQ ID NO: 688052 - RNA, 22 nt, Human
cugcggcagcgguggcggcucu

SEQ ID NO: 688053 - RNA, 22 nt, Human
cugucuggaguagacaagagga

SEQ ID NO: 688054 - RNA, 20 nt, Human
cuuauaauccucacuucagu

SEQ ID NO: 688055 - RNA, 24 nt, Human
cuuucaucuaagccacacacuaua

SEQ ID NO: 688056 - RNA, 19 nt, Human
cuuuccccucuuccacucc

SEQ ID NO: 688057 - RNA, 19 nt, Human
gaaaaugcauauuuuuagu

SEQ ID NO: 688058 - RNA, 20 nt, Human
gaacucuuggcuagcggccc

SEQ ID NO: 688059 - RNA, 18 nt, Human
gagaugggguuucaccau

SEQ ID NO: 688060 - RNA, 23 nt, Human
gagaugggguuucaccauguugc

SEQ ID NO: 688061 - RNA, 22 nt, Human
gagccuccggcagcggccgcau

SEQ ID NO: 688062 - RNA, 24 nt, Human
gagcucaggcaaucugcccaccuu

SEQ ID NO: 688063 - RNA, 19 nt, Human
gaggaagggcugugaggug

SEQ ID NO: 688064 - RNA, 25 nt, Human
gaguagcugggacuacaggcgcaca

SEQ ID NO: 688065 - RNA, 22 nt, Human
gaucccaaaauuuaaagguuuu

SEQ ID NO: 688066 - RNA, 22 nt, Human
gaugggguuucaccauguugcc

SEQ ID NO: 688067 - RNA, 18 nt, Human
gcacaccgccaagcccag

SEQ ID NO: 688068 - RNA, 19 nt, Human
gcacaccgccaagcccagc

SEQ ID NO: 688069 - RNA, 20 nt, Human
gcccaggcuggagugcaggu

SEQ ID NO: 688070 - RNA, 21 nt, Human
gccccgaugcugggagcggcg

SEQ ID NO: 688071 - RNA, 20 nt, Human
gccucagccuccugaguagc

SEQ ID NO: 688072 - RNA, 19 nt, Human
gcgccgcgccgcugccgcc

SEQ ID NO: 688073 - RNA, 21 nt, Human
gcgguggcggcucugacuccg

SEQ ID NO: 688074 - RNA, 19 nt, Human
gcguccucccgccucccuc

SEQ ID NO: 688075 - RNA, 25 nt, Human
gcucuguugcccaggcuggagugca

SEQ ID NO: 688076 - RNA, 18 nt, Human
gcugggugcagggaacug

SEQ ID NO: 688077 - RNA, 21 nt, Human
gcugugaggugcugggugcag

SEQ ID NO: 688078 - RNA, 23 nt, Human
ggagucucgcucuguugcccagg

SEQ ID NO: 688079 - RNA, 20 nt, Human
gggguuucaccauguugccc

SEQ ID NO: 688080 - RNA, 22 nt, Human
ggguuacagguguaagccaccg

SEQ ID NO: 688081 - RNA, 24 nt, Human
ggguuacagguguaagccaccgug

SEQ ID NO: 688082 - RNA, 22 nt, Human
ggguucaagcaauucuccugcc

SEQ ID NO: 688083 - RNA, 18 nt, Human
gguuacagguguaagcca

SEQ ID NO: 688084 - RNA, 24 nt, Human
gguuacagguguaagccaccgugc

SEQ ID NO: 688085 - RNA, 23 nt, Human
guagagaugggguuucaccaugu

SEQ ID NO: 688086 - RNA, 21 nt, Human
guauguguguauguaugugua

SEQ ID NO: 688087 - RNA, 18 nt, Human
gucugaggaagagagucc

SEQ ID NO: 688088 - RNA, 23 nt, Human
uaacuuuuuguauuuuaguagag

SEQ ID NO: 688089 - RNA, 24 nt, Human
uaacuuuuuguauuuuaguagaga

SEQ ID NO: 688090 - RNA, 22 nt, Human
uaauaaaaaaguaugcugaagg

SEQ ID NO: 688091 - RNA, 23 nt, Human
uacaaaugcuuuauggaauaacu

SEQ ID NO: 688092 - RNA, 18 nt, Human
uacaauccugaaacacuc

SEQ ID NO: 688093 - RNA, 21 nt, Human
uacaauccugaaacacuucuc

SEQ ID NO: 688094 - RNA, 18 nt, Human
uacagaucuccuuagucu

SEQ ID NO: 688095 - RNA, 22 nt, Human
uacagguguaagccaccgugcc

SEQ ID NO: 688096 - RNA, 22 nt, Human
uagagaugggguuucaccaugu

SEQ ID NO: 688097 - RNA, 24 nt, Human
uaguagagaugggguuucaccaug

SEQ ID NO: 688098 - RNA, 26 nt, Human
uaguagagaugggguuucaccauguu

SEQ ID NO: 688099 - RNA, 20 nt, Human
uauguguguauguaugugua

SEQ ID NO: 688100 - RNA, 24 nt, Human
uauuaaauagagcuauuuuacuaa

SEQ ID NO: 688101 - RNA, 25 nt, Human
uauuauguggguuuguuuccuaaag

SEQ ID NO: 688102 - RNA, 22 nt, Human
uauuuauuuagagauggagucu

SEQ ID NO: 688103 - RNA, 24 nt, Human
uauuuuacuaaggcauuauguuuu

SEQ ID NO: 688104 - RNA, 21 nt, Human
ucacauauuaaaccauguaga

SEQ ID NO: 688105 - RNA, 21 nt, Human
ucacauccggaucgggaaggc

SEQ ID NO: 688106 - RNA, 23 nt, Human
ucacugcaacuuccgccucucgg

SEQ ID NO: 688107 - RNA, 24 nt, Human
ucacugcaacuuccgccucucggg

SEQ ID NO: 688108 - RNA, 25 nt, Human
ucacugcaacuuccgccucucgggu

SEQ ID NO: 688109 - RNA, 23 nt, Human
ucagccuccugaguagcugggac

SEQ ID NO: 688110 - RNA, 21 nt, Human
ucagguuaaaaaccucucuua

SEQ ID NO: 688111 - RNA, 21 nt, Human
ucauucuuuacagaucuccuu

SEQ ID NO: 688112 - RNA, 20 nt, Human
uccaagccccuuccuccucc

SEQ ID NO: 688113 - RNA, 22 nt, Human
uccaagccccuuccuccuccuc

SEQ ID NO: 688114 - RNA, 22 nt, Human
uccacauuuaaaaggacaccgc

SEQ ID NO: 688115 - RNA, 23 nt, Human
ucccaaaaugccaggguuacagg

SEQ ID NO: 688116 - RNA, 20 nt, Human
uccccucuuccacuccuaca

SEQ ID NO: 688117 - RNA, 25 nt, Human
uccgcauccccccguagucgcucca

SEQ ID NO: 688118 - RNA, 19 nt, Human
uccgccucucggguucaag

SEQ ID NO: 688119 - RNA, 24 nt, Human
uccgccucucggguucaagcaauu

SEQ ID NO: 688120 - RNA, 24 nt, Human
uccugaguagcugggacuacaggc

SEQ ID NO: 688121 - RNA, 19 nt, Human
uccuuuuucuguuuuccuu

SEQ ID NO: 688122 - RNA, 24 nt, Human
ucgcucuguugcccaggcuggagu

SEQ ID NO: 688123 - RNA, 18 nt, Human
ucucaucccaaaaagacc

SEQ ID NO: 688124 - RNA, 24 nt, Human
ucuccugccucagccuccugagua

SEQ ID NO: 688125 - RNA, 23 nt, Human
ucucgaacuccugagcucaggca

SEQ ID NO: 688126 - RNA, 19 nt, Human
ucucgcucuguugcccagg

SEQ ID NO: 688127 - RNA, 23 nt, Human
ucucgcucuguugcccaggcugg

SEQ ID NO: 688128 - RNA, 24 nt, Human
ucucgcucuguugcccaggcugga

SEQ ID NO: 688129 - RNA, 26 nt, Human
ucucgcucuguugcccaggcuggagu

SEQ ID NO: 688130 - RNA, 27 nt, Human
ucucgcucuguugcccaggcuggagug

SEQ ID NO: 688131 - RNA, 24 nt, Human
ucucggguucaagcaauucuccug

SEQ ID NO: 688132 - RNA, 23 nt, Human
ucugacuccgcgcacuccgcccc

SEQ ID NO: 688133 - RNA, 21 nt, Human
ucugcccaccuuggccuccca

SEQ ID NO: 688134 - RNA, 24 nt, Human
ucugcccaccuuggccucccaaaa

SEQ ID NO: 688135 - RNA, 23 nt, Human
ucugccucucuuuccccucuucc

SEQ ID NO: 688136 - RNA, 21 nt, Human
ucugggucaggaggccagagc

SEQ ID NO: 688137 - RNA, 24 nt, Human
ucuguugcccaggcuggagugcag

SEQ ID NO: 688138 - RNA, 25 nt, Human
ucuguugcccaggcuggagugcagg

SEQ ID NO: 688139 - RNA, 18 nt, Human
ugaaaagaaugguuucca

SEQ ID NO: 688140 - RNA, 19 nt, Human
ugaaucacucauucuaaga

SEQ ID NO: 688141 - RNA, 20 nt, Human
ugacugcuucuccgcauccc

SEQ ID NO: 688142 - RNA, 21 nt, Human
ugacugcuucuccgcaucccc

SEQ ID NO: 688143 - RNA, 21 nt, Human
ugagaacgguuaaaagaaaca

SEQ ID NO: 688144 - RNA, 21 nt, Human
ugaggaagagaguccacacag

SEQ ID NO: 688145 - RNA, 18 nt, Human
ugcccaggcuggagugca

SEQ ID NO: 688146 - RNA, 19 nt, Human
ugcccaggcuggagugcag

SEQ ID NO: 688147 - RNA, 24 nt, Human
ugcccuggcuggucucgaacuccu

SEQ ID NO: 688148 - RNA, 24 nt, Human
ugccucagccuccugaguagcugg

SEQ ID NO: 688149 - RNA, 23 nt, Human
ugcgagggggccuucccccucuc

SEQ ID NO: 688150 - RNA, 27 nt, Human
ugcggcagcgguggcggcucugacucc

SEQ ID NO: 688151 - RNA, 24 nt, Human
ugcugggagcggcgcgacccgggc

SEQ ID NO: 688152 - RNA, 22 nt, Human
uggaauaacugucuggaguaga

SEQ ID NO: 688153 - RNA, 23 nt, Human
uggaguagacaagaggaaaagua

SEQ ID NO: 688154 - RNA, 24 nt, Human
uggagucucgcucuguugcccagg

SEQ ID NO: 688155 - RNA, 19 nt, Human
uggaguucaguggcacaau

SEQ ID NO: 688156 - RNA, 24 nt, Human
uggaguucaguggcacaaucucgg

SEQ ID NO: 688157 - RNA, 24 nt, Human
uggcacaaucucggcucacugcaa

SEQ ID NO: 688158 - RNA, 21 nt, Human
ugggacuacaggcgcacaccg

SEQ ID NO: 688159 - RNA, 24 nt, Human
ugggacuacaggcgcacaccgcca

SEQ ID NO: 688160 - RNA, 18 nt, Human
ugggguuucaccauguug

SEQ ID NO: 688161 - RNA, 18 nt, Human
uguauguguguauguaug

SEQ ID NO: 688162 - RNA, 19 nt, Human
ugugcuuuucuucccccca

SEQ ID NO: 688163 - RNA, 21 nt, Human
uguguaagaaaaugcauauuu

SEQ ID NO: 688164 - RNA, 18 nt, Human
uguguguauguaugugua

SEQ ID NO: 688165 - RNA, 24 nt, Human
uguguguauguauguguaaauagc

SEQ ID NO: 688166 - RNA, 24 nt, Human
uguugcucuuuuucaucacauccc

SEQ ID NO: 688167 - RNA, 21 nt, Human
uuaacacaaacaaaagauaaa

SEQ ID NO: 688168 - RNA, 19 nt, Human
uuacagguguaagccaccg

SEQ ID NO: 688169 - RNA, 18 nt, Human
uuaguagagaugggguuu

SEQ ID NO: 688170 - RNA, 22 nt, Human
uuaguagagaugggguuucacc

SEQ ID NO: 688171 - RNA, 24 nt, Human
uuaguagagaugggguuucaccau

SEQ ID NO: 688172 - RNA, 19 nt, Human
uuauuuauuuauuuauuua

SEQ ID NO: 688173 - RNA, 19 nt, Human
uuauuuauuuauuuauuua

SEQ ID NO: 688174 - RNA, 19 nt, Human
uuauuuauuuauuuauuua

SEQ ID NO: 688175 - RNA, 19 nt, Human
uuauuuauuuauuuauuua

SEQ ID NO: 688176 - RNA, 19 nt, Human
uuauuuauuuauuuauuua

SEQ ID NO: 688177 - RNA, 24 nt, Human
uuauuuauuuauuuauuuauuuag

SEQ ID NO: 688178 - RNA, 25 nt, Human
uuauuuauuuauuuauuuauuuauu

SEQ ID NO: 688179 - RNA, 25 nt, Human
uuauuuauuuauuuauuuauuuauu

SEQ ID NO: 688180 - RNA, 25 nt, Human
uuauuuauuuauuuauuuauuuauu

SEQ ID NO: 688181 - RNA, 25 nt, Human
uuauuuauuuauuuauuuauuuauu

SEQ ID NO: 688182 - RNA, 21 nt, Human
uucaagcaauucuccugccuc

SEQ ID NO: 688183 - RNA, 24 nt, Human
uucaagcaauucuccugccucagc

SEQ ID NO: 688184 - RNA, 21 nt, Human
uuccauguuguuucaugagaa

SEQ ID NO: 688185 - RNA, 27 nt, Human
uuccauguuguuucaugagaaucuuac

SEQ ID NO: 688186 - RNA, 25 nt, Human
uuccccccaaaaggaaauuuuuaaa

SEQ ID NO: 688187 - RNA, 25 nt, Human
uuccccucuuccacuccuacaaucc

SEQ ID NO: 688188 - RNA, 23 nt, Human
uuccuaaaauuaugcuucuguug

SEQ ID NO: 688189 - RNA, 20 nt, Human
uuccuacaacuaauaaaaaa

SEQ ID NO: 688190 - RNA, 23 nt, Human
uugcccaggcuggagugcagguu

SEQ ID NO: 688191 - RNA, 24 nt, Human
uugguuaaaguaaaaaggcuuuca

SEQ ID NO: 688192 - RNA, 25 nt, Human
uuguuuauuuauuuauuuauuuauu

SEQ ID NO: 688193 - RNA, 22 nt, Human
uuuauuuauuuauuuauuuauu

SEQ ID NO: 688194 - RNA, 26 nt, Human
uuuuuaaacacucuccaguuuuaaca

SEQ ID NO: 688195 - RNA, 20 nt, Human
uuuuuguauuuuaguagaga

SEQ ID NO: 688196 - RNA, 21 nt, Human
uuuuuguauuuuaguagagau

SEQ ID NO: 688197 - RNA, 21 nt, Human
aaaacaugaucccucuuccag

SEQ ID NO: 688198 - RNA, 20 nt, Human
aaacaaaacagcuauaaccc

SEQ ID NO: 688199 - RNA, 25 nt, Human
aaacaagaguaccgacggccccggc

SEQ ID NO: 688200 - RNA, 21 nt, Human
aaacagcuauaaccccauccc

SEQ ID NO: 688201 - RNA, 24 nt, Human
aacaaaacagcuauaaccccaucc

SEQ ID NO: 688202 - RNA, 21 nt, Human
aacaaguaccucuaaacaaag

SEQ ID NO: 688203 - RNA, 22 nt, Human
aacagcuauaaccccaucccuc

SEQ ID NO: 688204 - RNA, 23 nt, Human
aacgggguucugggaaauaggag

SEQ ID NO: 688205 - RNA, 21 nt, Human
aagagguagcaaaaggucaga

SEQ ID NO: 688206 - RNA, 21 nt, Human
aagaguaccgacggccccggc

SEQ ID NO: 688207 - RNA, 24 nt, Human
aagccaaauguuguguuaaucccg

SEQ ID NO: 688208 - RNA, 21 nt, Human
aagcucccucacccccaaaag

SEQ ID NO: 688209 - RNA, 20 nt, Human
aaggccuggcaccuuuggcu

SEQ ID NO: 688210 - RNA, 21 nt, Human
aaggccuggcaccuuuggcuu

SEQ ID NO: 688211 - RNA, 26 nt, Human
aauacugacggauuuugacuccgaga

SEQ ID NO: 688212 - RNA, 27 nt, Human
acacacacauacgcacauacacacaca

SEQ ID NO: 688213 - RNA, 19 nt, Human
acagaaaaggcucgauaca

SEQ ID NO: 688214 - RNA, 21 nt, Human
acagacacaagcacacgugca

SEQ ID NO: 688215 - RNA, 19 nt, Human
acaggcugagguguauggc

SEQ ID NO: 688216 - RNA, 23 nt, Human
acccagucagccccuuccgcugc

SEQ ID NO: 688217 - RNA, 23 nt, Human
acccaguuuccuugugaggcucu

SEQ ID NO: 688218 - RNA, 19 nt, Human
acggauuuugggagugggu

SEQ ID NO: 688219 - RNA, 22 nt, Human
acgggguucugggaaauaggag

SEQ ID NO: 688220 - RNA, 22 nt, Human
agaaaguuaaaguggggugacu

SEQ ID NO: 688221 - RNA, 22 nt, Human
agacacggccagcggggugagg

SEQ ID NO: 688222 - RNA, 19 nt, Human
agacugcacacuucugaau

SEQ ID NO: 688223 - RNA, 22 nt, Human
agagagaaaaaaaaauggugaa

SEQ ID NO: 688224 - RNA, 21 nt, Human
agcagcagccagcggcggggg

SEQ ID NO: 688225 - RNA, 18 nt, Human
agccagcggcgggggggg

SEQ ID NO: 688226 - RNA, 20 nt, Human
agccuccccccaccccccgg

SEQ ID NO: 688227 - RNA, 22 nt, Human
agcucccucacccccaaaagac

SEQ ID NO: 688228 - RNA, 20 nt, Human
agcuggucaggaccagcaug

SEQ ID NO: 688229 - RNA, 24 nt, Human
aggaaucaccuacuuucacgaguc

SEQ ID NO: 688230 - RNA, 22 nt, Human
aguaggaauaacagcaacacag

SEQ ID NO: 688231 - RNA, 21 nt, Human
agugacagcggcgguggccag

SEQ ID NO: 688232 - RNA, 20 nt, Human
agugaugggugggguagaga

SEQ ID NO: 688233 - RNA, 22 nt, Human
auaaaacaaaacaugaucccuc

SEQ ID NO: 688234 - RNA, 22 nt, Human
augcagccuccugcucccugag

SEQ ID NO: 688235 - RNA, 23 nt, Human
augcauacggcacacaccacaca

SEQ ID NO: 688236 - RNA, 20 nt, Human
auggaggauaggaguggcag

SEQ ID NO: 688237 - RNA, 20 nt, Human
caaaacagcuauaaccccau

SEQ ID NO: 688238 - RNA, 20 nt, Human
caaaagacgccgcucaccac

SEQ ID NO: 688239 - RNA, 27 nt, Human
caacucagaaggguuuccagcagcagg

SEQ ID NO: 688240 - RNA, 19 nt, Human
caacucaggauggccgcag

SEQ ID NO: 688241 - RNA, 20 nt, Human
caagaguaccgacggccccg

SEQ ID NO: 688242 - RNA, 22 nt, Human
caaggugagguagggggagggg

SEQ ID NO: 688243 - RNA, 21 nt, Human
caaugugacaagugacagcgg

SEQ ID NO: 688244 - RNA, 22 nt, Human
cacaaaugaaaacaagaguacc

SEQ ID NO: 688245 - RNA, 21 nt, Human
cacacacaaaugaaaacaaga

SEQ ID NO: 688246 - RNA, 25 nt, Human
cacacacacacacucgcacacaccu

SEQ ID NO: 688247 - RNA, 18 nt, Human
cacacacagacacggcca

SEQ ID NO: 688248 - RNA, 19 nt, Human
cacaccccucaccuauacc

SEQ ID NO: 688249 - RNA, 19 nt, Human
cacagagguuugugugccc

SEQ ID NO: 688250 - RNA, 19 nt, Human
caccucacagaugcggcug

SEQ ID NO: 688251 - RNA, 20 nt, Human
cagagccgggggacgcgcag

SEQ ID NO: 688252 - RNA, 22 nt, Human
cagcaccuguucccugcagaac

SEQ ID NO: 688253 - RNA, 21 nt, Human
cagcagcaggggaggguuccc

SEQ ID NO: 688254 - RNA, 24 nt, Human
cagcagcaggggaggguucccugg

SEQ ID NO: 688255 - RNA, 20 nt, Human
cagcagccagcggcgggggg

SEQ ID NO: 688256 - RNA, 18 nt, Human
cagcagggggacccaagc

SEQ ID NO: 688257 - RNA, 20 nt, Human
cagcccagccccacagcuuc

SEQ ID NO: 688258 - RNA, 20 nt, Human
cagcgagacccacgugaccc

SEQ ID NO: 688259 - RNA, 20 nt, Human
caggaaaagcacucuccccu

SEQ ID NO: 688260 - RNA, 18 nt, Human
caggaccagcaugguccg

SEQ ID NO: 688261 - RNA, 24 nt, Human
cagggcucagggaccagggaagcc

SEQ ID NO: 688262 - RNA, 23 nt, Human
caguccucugucucccaccagga

SEQ ID NO: 688263 - RNA, 18 nt, Human
caguuaggucccucccca

SEQ ID NO: 688264 - RNA, 23 nt, Human
caucaacccauccccaaggguca

SEQ ID NO: 688265 - RNA, 24 nt, Human
cauugagucuagccuccccccacc

SEQ ID NO: 688266 - RNA, 19 nt, Human
ccaaaagacgccgcucacc

SEQ ID NO: 688267 - RNA, 19 nt, Human
ccaaaggcucaaagggaaa

SEQ ID NO: 688268 - RNA, 22 nt, Human
ccacagagguuugugugcccgg

SEQ ID NO: 688269 - RNA, 23 nt, Human
ccacccgcucacucgccccaagu

SEQ ID NO: 688270 - RNA, 19 nt, Human
ccacccggagccuccacuu

SEQ ID NO: 688271 - RNA, 18 nt, Human
ccacugccagucaccaac

SEQ ID NO: 688272 - RNA, 23 nt, Human
ccagcccggcucggcuccccgcc

SEQ ID NO: 688273 - RNA, 21 nt, Human
ccagcggcggggggggcuccu

SEQ ID NO: 688274 - RNA, 22 nt, Human
ccagucccugaaguucugcaaa

SEQ ID NO: 688275 - RNA, 23 nt, Human
ccagugccuggcuccaggcuggg

SEQ ID NO: 688276 - RNA, 20 nt, Human
cccaaaagacgccgcucacc

SEQ ID NO: 688277 - RNA, 23 nt, Human
cccaagcucccucacccccaaaa

SEQ ID NO: 688278 - RNA, 24 nt, Human
cccaagcucccucacccccaaaag

SEQ ID NO: 688279 - RNA, 18 nt, Human
cccaccgcucaugcccac

SEQ ID NO: 688280 - RNA, 22 nt, Human
cccagcgagacccacgugaccc

SEQ ID NO: 688281 - RNA, 19 nt, Human
ccccaacgggguucuggga

SEQ ID NO: 688282 - RNA, 22 nt, Human
ccccaccccccggaaccccaga

SEQ ID NO: 688283 - RNA, 23 nt, Human
ccccaccccccggaaccccagaa

SEQ ID NO: 688284 - RNA, 20 nt, Human
ccccagcccucacuccuggc

SEQ ID NO: 688285 - RNA, 18 nt, Human
ccccagggcuacccuucu

SEQ ID NO: 688286 - RNA, 19 nt, Human
ccccaucccuccccccucc

SEQ ID NO: 688287 - RNA, 21 nt, Human
cccccaaaagacgccgcucac

SEQ ID NO: 688288 - RNA, 22 nt, Human
cccccaaaagacgccgcucacc

SEQ ID NO: 688289 - RNA, 21 nt, Human
cccccagccccagggcuaccc

SEQ ID NO: 688290 - RNA, 23 nt, Human
cccccagccccagggcuacccuu

SEQ ID NO: 688291 - RNA, 23 nt, Human
cccccggaaccccagaccuucca

SEQ ID NO: 688292 - RNA, 24 nt, Human
cccccggaaccccagaccuuccag

SEQ ID NO: 688293 - RNA, 20 nt, Human
ccccguccgccugccgccag

SEQ ID NO: 688294 - RNA, 18 nt, Human
ccccugaggcagccgagg

SEQ ID NO: 688295 - RNA, 18 nt, Human
ccccuggcuucccuccuc

SEQ ID NO: 688296 - RNA, 21 nt, Human
ccccuggcuucccuccucucg

SEQ ID NO: 688297 - RNA, 21 nt, Human
ccccuuccgcugccuggggug

SEQ ID NO: 688298 - RNA, 18 nt, Human
cccgccccgccccacaaa

SEQ ID NO: 688299 - RNA, 21 nt, Human
cccgccccgccccacaaaccc

SEQ ID NO: 688300 - RNA, 21 nt, Human
cccggcucgcgccgcacgcgc

SEQ ID NO: 688301 - RNA, 24 nt, Human
cccggcucgcgccgcacgcgcccg

SEQ ID NO: 688302 - RNA, 23 nt, Human
cccggcucggcuccccgccuagc

SEQ ID NO: 688303 - RNA, 22 nt, Human
cccugcagcgccagagccgggg

SEQ ID NO: 688304 - RNA, 18 nt, Human
cccuggacuggccuuaca

SEQ ID NO: 688305 - RNA, 19 nt, Human
cccuggcuucccuccucuc

SEQ ID NO: 688306 - RNA, 20 nt, Human
cccugucagcacccagugcc

SEQ ID NO: 688307 - RNA, 21 nt, Human
ccgcacgcgcccgccccgucc

SEQ ID NO: 688308 - RNA, 18 nt, Human
ccgccccgccccacaaac

SEQ ID NO: 688309 - RNA, 21 nt, Human
ccgcucaugcccacccccaau

SEQ ID NO: 688310 - RNA, 21 nt, Human
ccggagccuccacuggaccca

SEQ ID NO: 688311 - RNA, 23 nt, Human
ccggccggccggcccuaccagcg

SEQ ID NO: 688312 - RNA, 23 nt, Human
ccuccccccaccccccggaaccc

SEQ ID NO: 688313 - RNA, 18 nt, Human
ccugaaguucugcaaagg

SEQ ID NO: 688314 - RNA, 25 nt, Human
ccuggaggagcccuugcuggggcuu

SEQ ID NO: 688315 - RNA, 18 nt, Human
ccuggccccacggggccc

SEQ ID NO: 688316 - RNA, 19 nt, Human
ccuggcuccaggcuggggg

SEQ ID NO: 688317 - RNA, 21 nt, Human
ccuggggugggguuagggggc

SEQ ID NO: 688318 - RNA, 24 nt, Human
ccugggucccccccggggugggag

SEQ ID NO: 688319 - RNA, 18 nt, Human
ccuuacagcugcugaggu

SEQ ID NO: 688320 - RNA, 21 nt, Human
ccuuacagcugcugaggucug

SEQ ID NO: 688321 - RNA, 19 nt, Human
ccuugcuggggcucggucc

SEQ ID NO: 688322 - RNA, 19 nt, Human
cgccgacaccccugcagcg

SEQ ID NO: 688323 - RNA, 18 nt, Human
cggcccuaccagcggccc

SEQ ID NO: 688324 - RNA, 18 nt, Human
cggcggcgcuccgcccgc

SEQ ID NO: 688325 - RNA, 21 nt, Human
cggggagcaagguggcagagg

SEQ ID NO: 688326 - RNA, 22 nt, Human
cguccgccugccgccagcccgg

SEQ ID NO: 688327 - RNA, 19 nt, Human
cucaaagggaaaacccaca

SEQ ID NO: 688328 - RNA, 22 nt, Human
cucacccccaaaagacgccgcu

SEQ ID NO: 688329 - RNA, 24 nt, Human
cucacuccuggcgucugauucaca

SEQ ID NO: 688330 - RNA, 19 nt, Human
cucccagucccugaaguuc

SEQ ID NO: 688331 - RNA, 23 nt, Human
cucccccagccccagggcuaccc

SEQ ID NO: 688332 - RNA, 20 nt, Human
cuccccccuucugggaaggg

SEQ ID NO: 688333 - RNA, 20 nt, Human
cuccuuccauggguucccgg

SEQ ID NO: 688334 - RNA, 20 nt, Human
cucgcaucaacccaucccca

SEQ ID NO: 688335 - RNA, 19 nt, Human
cugcucccagucccugaag

SEQ ID NO: 688336 - RNA, 18 nt, Human
cugcucccgacaccaccc

SEQ ID NO: 688337 - RNA, 19 nt, Human
cugcucccgacaccacccu

SEQ ID NO: 688338 - RNA, 19 nt, Human
cugcucccugagcccugcc

SEQ ID NO: 688339 - RNA, 24 nt, Human
cugcuggcuccugcacacgacuuc

SEQ ID NO: 688340 - RNA, 20 nt, Human
cuggcaccuuuggcuuuugu

SEQ ID NO: 688341 - RNA, 22 nt, Human
cugggugugggcagugggggcc

SEQ ID NO: 688342 - RNA, 19 nt, Human
cuucagcuggcugaagaca

SEQ ID NO: 688343 - RNA, 21 nt, Human
cuugcuggaaccugagaccca

SEQ ID NO: 688344 - RNA, 20 nt, Human
cuuggccuccaauaacccag

SEQ ID NO: 688345 - RNA, 20 nt, Human
cuuguccucagcgcccggcc

SEQ ID NO: 688346 - RNA, 20 nt, Human
gaagcuagugaugggugggg

SEQ ID NO: 688347 - RNA, 18 nt, Human
gaaguccaugggucuccu

SEQ ID NO: 688348 - RNA, 20 nt, Human
gacaccacccuggccguggc

SEQ ID NO: 688349 - RNA, 22 nt, Human
gacccucgcaucaacccauccc

SEQ ID NO: 688350 - RNA, 18 nt, Human
gagacaguggccgggggc

SEQ ID NO: 688351 - RNA, 19 nt, Human
gagcagcagccagcggcgg

SEQ ID NO: 688352 - RNA, 20 nt, Human
gagcagcagccagcggcggg

SEQ ID NO: 688353 - RNA, 19 nt, Human
gagcugcaaagaccugcca

SEQ ID NO: 688354 - RNA, 19 nt, Human
gagcugggggccugggugg

SEQ ID NO: 688355 - RNA, 23 nt, Human
gaggaccuuggucccuuuagggg

SEQ ID NO: 688356 - RNA, 21 nt, Human
gagguccagugaauacugacg

SEQ ID NO: 688357 - RNA, 24 nt, Human
gagguuugugugcccggggugcca

SEQ ID NO: 688358 - RNA, 22 nt, Human
gagucuagccuccccccacccc

SEQ ID NO: 688359 - RNA, 21 nt, Human
gcagcaggggaggguucccug

SEQ ID NO: 688360 - RNA, 21 nt, Human
gcaggagugccagcggccccu

SEQ ID NO: 688361 - RNA, 18 nt, Human
gccccgccccacaaaccc

SEQ ID NO: 688362 - RNA, 22 nt, Human
gccccguccgccugccgccagc

SEQ ID NO: 688363 - RNA, 18 nt, Human
gccugcucccgacaccac

SEQ ID NO: 688364 - RNA, 19 nt, Human
gccugcucccgacaccacc

SEQ ID NO: 688365 - RNA, 20 nt, Human
gcuggcuccugcacacgacu

SEQ ID NO: 688366 - RNA, 23 nt, Human
gcugggaccccuggcuucccucc

SEQ ID NO: 688367 - RNA, 19 nt, Human
gcuggggccucacaccccu

SEQ ID NO: 688368 - RNA, 21 nt, Human
ggaggagcccuugcuggggcu

SEQ ID NO: 688369 - RNA, 20 nt, Human
ggaguggcaggaugagggcu

SEQ ID NO: 688370 - RNA, 23 nt, Human
ggcagggggucagccugcccagc

SEQ ID NO: 688371 - RNA, 18 nt, Human
ggccaaaggcucaaaggg

SEQ ID NO: 688372 - RNA, 19 nt, Human
ggcgagaggugggccccga

SEQ ID NO: 688373 - RNA, 19 nt, Human
ggcuucuggggccuggaga

SEQ ID NO: 688374 - RNA, 19 nt, Human
gggagugggugggcggccc

SEQ ID NO: 688375 - RNA, 24 nt, Human
gggcagggggucagccugcccagc

SEQ ID NO: 688376 - RNA, 24 nt, Human
gggcucuuuagauguagagaggua

SEQ ID NO: 688377 - RNA, 19 nt, Human
ggggagcugggggccuggg

SEQ ID NO: 688378 - RNA, 19 nt, Human
gggugggagcccuggggau

SEQ ID NO: 688379 - RNA, 20 nt, Human
gggugggguuagggggcccc

SEQ ID NO: 688380 - RNA, 18 nt, Human
gguaggggaugacucugu

SEQ ID NO: 688381 - RNA, 21 nt, Human
gguuuccagcagcaggggagg

SEQ ID NO: 688382 - RNA, 21 nt, Human
gucauguggcuuaagugcuga

SEQ ID NO: 688383 - RNA, 18 nt, Human
gucccuccccccuucugg

SEQ ID NO: 688384 - RNA, 24 nt, Human
gucucuagagggguggggguaggg

SEQ ID NO: 688385 - RNA, 19 nt, Human
gucuugccccugcugcugc

SEQ ID NO: 688386 - RNA, 19 nt, Human
uaaaggcugccagcccagc

SEQ ID NO: 688387 - RNA, 22 nt, Human
uaacagcaacacaggcccagag

SEQ ID NO: 688388 - RNA, 24 nt, Human
uaacaguuucuuaucgcuguacau

SEQ ID NO: 688389 - RNA, 26 nt, Human
uagcaaggugagguagggggaggggg

SEQ ID NO: 688390 - RNA, 19 nt, Human
uagccuccccccacccccc

SEQ ID NO: 688391 - RNA, 18 nt, Human
uaggcgguggggucaccc

SEQ ID NO: 688392 - RNA, 26 nt, Human
uaucugcuauuuucugauuccuguuu

SEQ ID NO: 688393 - RNA, 20 nt, Human
uauguaaacaaugagauaaa

SEQ ID NO: 688394 - RNA, 24 nt, Human
uauugucuguuuugguuuaaaaaa

SEQ ID NO: 688395 - RNA, 21 nt, Human
ucagcgcccggcucgcgccgc

SEQ ID NO: 688396 - RNA, 25 nt, Human
uccacacacacacacucgcacacac

SEQ ID NO: 688397 - RNA, 18 nt, Human
uccaugggucuccucccc

SEQ ID NO: 688398 - RNA, 19 nt, Human
uccaugggucuccuccccc

SEQ ID NO: 688399 - RNA, 18 nt, Human
ucccagcgccagugaaca

SEQ ID NO: 688400 - RNA, 27 nt, Human
uccccaagggucacgggcagagcagca

SEQ ID NO: 688401 - RNA, 22 nt, Human
uccccccaccccccggaacccc

SEQ ID NO: 688402 - RNA, 24 nt, Human
uccccccaccccccggaaccccag

SEQ ID NO: 688403 - RNA, 20 nt, Human
uccccccuccccuucgaggu

SEQ ID NO: 688404 - RNA, 19 nt, Human
uccccggggggcccugugg

SEQ ID NO: 688405 - RNA, 19 nt, Human
ucccgccccgccccacaaa

SEQ ID NO: 688406 - RNA, 22 nt, Human
ucccugaacucaggcucuguuu

SEQ ID NO: 688407 - RNA, 24 nt, Human
ucccugaaguucugcaaaggaauc

SEQ ID NO: 688408 - RNA, 18 nt, Human
ucccugccccagugaggu

SEQ ID NO: 688409 - RNA, 21 nt, Human
ucccuggacuggccuuacagc

SEQ ID NO: 688410 - RNA, 22 nt, Human
ucccuggacuggccuuacagcu

SEQ ID NO: 688411 - RNA, 21 nt, Human
uccgcugccuggggugggguu

SEQ ID NO: 688412 - RNA, 22 nt, Human
uccugagcgcguggccuuccug

SEQ ID NO: 688413 - RNA, 20 nt, Human
uccugcacacgacuuccuag

SEQ ID NO: 688414 - RNA, 21 nt, Human
ucuacccaagcucccucaccc

SEQ ID NO: 688415 - RNA, 21 nt, Human
ucuccacacacacacacucgc

SEQ ID NO: 688416 - RNA, 21 nt, Human
ucuccuuccauggguucccgg

SEQ ID NO: 688417 - RNA, 23 nt, Human
ucugaccuugagagcccacuuca

SEQ ID NO: 688418 - RNA, 24 nt, Human
ucugauucacagguucaguaacau

SEQ ID NO: 688419 - RNA, 21 nt, Human
ucuucagacccaggcucagcc

SEQ ID NO: 688420 - RNA, 18 nt, Human
ugaacagugccacccugg

SEQ ID NO: 688421 - RNA, 19 nt, Human
ugagagcccuugucugcuc

SEQ ID NO: 688422 - RNA, 22 nt, Human
ugaugggugggguagagaggcu

SEQ ID NO: 688423 - RNA, 21 nt, Human
ugauucacagguucaguaaca

SEQ ID NO: 688424 - RNA, 19 nt, Human
ugcaauccuggaggagccc

SEQ ID NO: 688425 - RNA, 22 nt, Human
ugcacacacacagacacggcca

SEQ ID NO: 688426 - RNA, 18 nt, Human
ugccagggcugagagccc

SEQ ID NO: 688427 - RNA, 19 nt, Human
ugccagggcugagagcccu

SEQ ID NO: 688428 - RNA, 19 nt, Human
ugcccacccccaccccggc

SEQ ID NO: 688429 - RNA, 23 nt, Human
ugccugagguggggaaaguuggu

SEQ ID NO: 688430 - RNA, 23 nt, Human
ugccuggggugggguuagggggc

SEQ ID NO: 688431 - RNA, 21 nt, Human
uggaaccugagacccaggguc

SEQ ID NO: 688432 - RNA, 21 nt, Human
uggagggugggagcccugggg

SEQ ID NO: 688433 - RNA, 21 nt, Human
uggagggugggagcccugggg

SEQ ID NO: 688434 - RNA, 20 nt, Human
uggcagagggcgcccgcggg

SEQ ID NO: 688435 - RNA, 18 nt, Human
uggccagcgucccacugc

SEQ ID NO: 688436 - RNA, 23 nt, Human
uggcccccgcggggagcuggggg

SEQ ID NO: 688437 - RNA, 22 nt, Human
uggccguggccagcgucccacu

SEQ ID NO: 688438 - RNA, 22 nt, Human
uggccuccaauaacccaguuuc

SEQ ID NO: 688439 - RNA, 20 nt, Human
uggcgcgccgacaccccugc

SEQ ID NO: 688440 - RNA, 18 nt, Human
uggcuccaggcuggggcc

SEQ ID NO: 688441 - RNA, 18 nt, Human
uggggacccaccagaguc

SEQ ID NO: 688442 - RNA, 20 nt, Human
uggggagguagacgggcugg

SEQ ID NO: 688443 - RNA, 25 nt, Human
uggggagguagacgggcugggaccc

SEQ ID NO: 688444 - RNA, 18 nt, Human
uggggugggguuaggggg

SEQ ID NO: 688445 - RNA, 19 nt, Human
uggggugggguuagggggc

SEQ ID NO: 688446 - RNA, 22 nt, Human
ugggucuccuccccccaggucc

SEQ ID NO: 688447 - RNA, 24 nt, Human
uggguucccggggagcaagguggc

SEQ ID NO: 688448 - RNA, 22 nt, Human
ugguccggccagagggccuugg

SEQ ID NO: 688449 - RNA, 21 nt, Human
ugucagcacccagugccuggc

SEQ ID NO: 688450 - RNA, 20 nt, Human
ugugggcagugggggccaga

SEQ ID NO: 688451 - RNA, 22 nt, Human
ugugucauguggcuuaagugcu

SEQ ID NO: 688452 - RNA, 22 nt, Human
uguuaagaguguuugcaccguc

SEQ ID NO: 688453 - RNA, 24 nt, Human
uguuuauccucucuuuccuacaug

SEQ ID NO: 688454 - RNA, 22 nt, Human
uguuugcaccgucuauguuggu

SEQ ID NO: 688455 - RNA, 19 nt, Human
uuaacaucuccacacacac

SEQ ID NO: 688456 - RNA, 20 nt, Human
uuaaucccgccccgccccac

SEQ ID NO: 688457 - RNA, 23 nt, Human
uucuccaagccgccugcaacaaa

SEQ ID NO: 688458 - RNA, 20 nt, Human
uucucuuaauaaaaaacaag

SEQ ID NO: 688459 - RNA, 21 nt, Human
uucugggaagggcauaaaaca

SEQ ID NO: 688460 - RNA, 22 nt, Human
uugcuggaaccugagacccagg

SEQ ID NO: 688461 - RNA, 24 nt, Human
uuggcgcccugcuggcuccugcac

SEQ ID NO: 688462 - RNA, 18 nt, Human
uugugugcccggggugcc

SEQ ID NO: 688463 - RNA, 24 nt, Human
uuucacaggcugagguguauggcu

SEQ ID NO: 688464 - RNA, 23 nt, Human
uuugcaccgucuauguugguaag

SEQ ID NO: 688465 - RNA, 21 nt, Human
uuuuuggcuugagugggaccc

SEQ ID NO: 688466 - RNA, 23 nt, Human
aaaaaaaaaaaaaaagaaaagaa

SEQ ID NO: 688467 - RNA, 23 nt, Human
aaaaaaagaaaagaaaaccagag

SEQ ID NO: 688468 - RNA, 22 nt, Human
aaaaaagaaaagaaaaccagag

SEQ ID NO: 688469 - RNA, 22 nt, Human
aaacaaacacacagaggcuugc

SEQ ID NO: 688470 - RNA, 20 nt, Human
aaacaccccuccccaaaaaa

SEQ ID NO: 688471 - RNA, 25 nt, Human
aaacaccugacuccugggccauggc

SEQ ID NO: 688472 - RNA, 22 nt, Human
aacgcacucaggcaugcacaca

SEQ ID NO: 688473 - RNA, 22 nt, Human
aagaaaaccagagaccuuccaa

SEQ ID NO: 688474 - RNA, 22 nt, Human
aagcucagcaggaauaaaggau

SEQ ID NO: 688475 - RNA, 18 nt, Human
aagcugcagcccugagag

SEQ ID NO: 688476 - RNA, 22 nt, Human
aagcugcagcccugagaggggu

SEQ ID NO: 688477 - RNA, 20 nt, Human
aagguccuuuuauguauggc

SEQ ID NO: 688478 - RNA, 19 nt, Human
aaucacagcugcccaccug

SEQ ID NO: 688479 - RNA, 18 nt, Human
acacacacacacacacac

SEQ ID NO: 688480 - RNA, 29 nt, Human
acacacacacacacacacacggacacaca

SEQ ID NO: 688481 - RNA, 27 nt, Human
acacacacacacacacacggacacaca

SEQ ID NO: 688482 - RNA, 23 nt, Human
acacacacacacacgcacgcaca

SEQ ID NO: 688483 - RNA, 24 nt, Human
acacacacacacacgcacgcacag

SEQ ID NO: 688484 - RNA, 26 nt, Human
acacacacacacacggacacacacaa

SEQ ID NO: 688485 - RNA, 27 nt, Human
acacacacacacacggacacacacaca

SEQ ID NO: 688486 - RNA, 23 nt, Human
acacacacgcacgcacacacaca

SEQ ID NO: 688487 - RNA, 33 nt, Human
acacacacggacacacacacacacacgcacggu

SEQ ID NO: 688488 - RNA, 24 nt, Human
acacacagacacacacaaacaaac

SEQ ID NO: 688489 - RNA, 31 nt, Human
acacacggacacacacacacacacgcacgca

SEQ ID NO: 688490 - RNA, 19 nt, Human
acacagacaugaugacaac

SEQ ID NO: 688491 - RNA, 23 nt, Human
acacgcacgcacacacacacaca

SEQ ID NO: 688492 - RNA, 18 nt, Human
acacugcaucagagaacc

SEQ ID NO: 688493 - RNA, 21 nt, Human
accccuagaaccuagagaagc

SEQ ID NO: 688494 - RNA, 20 nt, Human
accccuccccaaaaaacgca

SEQ ID NO: 688495 - RNA, 19 nt, Human
acgcacacacacacacaca

SEQ ID NO: 688496 - RNA, 24 nt, Human
acgcacacacacacacacacccag

SEQ ID NO: 688497 - RNA, 21 nt, Human
acgcacacacagacacacaca

SEQ ID NO: 688498 - RNA, 21 nt, Human
agaaaagaaaaccagagaccu

SEQ ID NO: 688499 - RNA, 22 nt, Human
agaggugaggagacacagggcc

SEQ ID NO: 688500 - RNA, 18 nt, Human
agaugcuggaaguaaacc

SEQ ID NO: 688501 - RNA, 21 nt, Human
agaugcuggaaguaaaccuuu

SEQ ID NO: 688502 - RNA, 24 nt, Human
agcaggaauaaaggauauggccug

SEQ ID NO: 688503 - RNA, 21 nt, Human
aggaauaaaggauauggccug

SEQ ID NO: 688504 - RNA, 21 nt, Human
aggagcagaggugaggagaca

SEQ ID NO: 688505 - RNA, 24 nt, Human
aggcagacugaccuaauggucaga

SEQ ID NO: 688506 - RNA, 24 nt, Human
agugacagccugacccagaaggaa

SEQ ID NO: 688507 - RNA, 23 nt, Human
auacauacaugcgugugcaugca

SEQ ID NO: 688508 - RNA, 21 nt, Human
augcacacacauccacacgca

SEQ ID NO: 688509 - RNA, 23 nt, Human
augcaggacuuuaggcggggggc

SEQ ID NO: 688510 - RNA, 23 nt, Human
auuagagucccgguagccauucc

SEQ ID NO: 688511 - RNA, 20 nt, Human
caaaaaaaaaaaaaaagaaa

SEQ ID NO: 688512 - RNA, 21 nt, Human
caaaagcugggacuccacaca

SEQ ID NO: 688513 - RNA, 22 nt, Human
caaaagcugggacuccacacac

SEQ ID NO: 688514 - RNA, 21 nt, Human
caaacacacagaggcuugcac

SEQ ID NO: 688515 - RNA, 21 nt, Human
cacacacaaacaaacacacag

SEQ ID NO: 688516 - RNA, 22 nt, Human
cacacacaaacaaacacacaga

SEQ ID NO: 688517 - RNA, 18 nt, Human
cacacacacacacacaca

SEQ ID NO: 688518 - RNA, 24 nt, Human
cacacacacacacacacccagagg

SEQ ID NO: 688519 - RNA, 28 nt, Human
cacacacacacacgcacgcacacacaca

SEQ ID NO: 688520 - RNA, 26 nt, Human
cacacacacacacggacacacacaca

SEQ ID NO: 688521 - RNA, 24 nt, Human
cacacacacgcacgcacacacaca

SEQ ID NO: 688522 - RNA, 28 nt, Human
cacacacacgcacgcacacacacacaca

SEQ ID NO: 688523 - RNA, 21 nt, Human
cacacacauccacacgcaucc

SEQ ID NO: 688524 - RNA, 19 nt, Human
cacacagacacacacaaac

SEQ ID NO: 688525 - RNA, 25 nt, Human
cacacagacacacacaaacaaacac

SEQ ID NO: 688526 - RNA, 20 nt, Human
cacacugcaucagagaaccc

SEQ ID NO: 688527 - RNA, 27 nt, Human
caccacacugcccaaucccagggaccc

SEQ ID NO: 688528 - RNA, 21 nt, Human
cagaaaaggaaauucgacuuc

SEQ ID NO: 688529 - RNA, 30 nt, Human
cagggaacagauacauacaugcguguggug

SEQ ID NO: 688530 - RNA, 19 nt, Human
caucauagggccuggaggc

SEQ ID NO: 688531 - RNA, 27 nt, Human
caugcacacacauccacacgcauccuc

SEQ ID NO: 688532 - RNA, 24 nt, Human
ccaaacaccugacuccugggccau

SEQ ID NO: 688533 - RNA, 20 nt, Human
ccacacugcccaaucccagg

SEQ ID NO: 688534 - RNA, 22 nt, Human
ccacacugcccaaucccaggga

SEQ ID NO: 688535 - RNA, 18 nt, Human
ccacagcuaggagaacuc

SEQ ID NO: 688536 - RNA, 19 nt, Human
ccagaaggaacagggaaca

SEQ ID NO: 688537 - RNA, 30 nt, Human
ccaguguggacacacacacacacacacacg

SEQ ID NO: 688538 - RNA, 18 nt, Human
ccaguuagccucgggcag

SEQ ID NO: 688539 - RNA, 21 nt, Human
cccuccccaaaaaacgcacuc

SEQ ID NO: 688540 - RNA, 19 nt, Human
ccuaucuaauccucucuca

SEQ ID NO: 688541 - RNA, 19 nt, Human
ccugacccagaaggaacag

SEQ ID NO: 688542 - RNA, 24 nt, Human
ccugacuccugggccauggcaaga

SEQ ID NO: 688543 - RNA, 19 nt, Human
cgacuuccaugcuccacca

SEQ ID NO: 688544 - RNA, 18 nt, Human
cgcuuggagucuccuguc

SEQ ID NO: 688545 - RNA, 21 nt, Human
cuauguguuugcccgugcccu

SEQ ID NO: 688546 - RNA, 19 nt, Human
cucaaaggcaagccucccc

SEQ ID NO: 688547 - RNA, 19 nt, Human
cugcccaccuguaagcugc

SEQ ID NO: 688548 - RNA, 18 nt, Human
cuggcccugcagcccaga

SEQ ID NO: 688549 - RNA, 21 nt, Human
cuggggcacaagaggcaaggg

SEQ ID NO: 688550 - RNA, 19 nt, Human
cugucaggaggcagacuga

SEQ ID NO: 688551 - RNA, 26 nt, Human
cuucaaguugugcaaucacagcugcc

SEQ ID NO: 688552 - RNA, 19 nt, Human
cuugagcuuguaggcccag

SEQ ID NO: 688553 - RNA, 20 nt, Human
cuuucaccccauuagagucc

SEQ ID NO: 688554 - RNA, 26 nt, Human
gacacacacacacacacacacggaca

SEQ ID NO: 688555 - RNA, 18 nt, Human
gacccagaaggaacaggg

SEQ ID NO: 688556 - RNA, 23 nt, Human
gagccagagcucagaugcuggaa

SEQ ID NO: 688557 - RNA, 19 nt, Human
gagggguucccaggaguag

SEQ ID NO: 688558 - RNA, 18 nt, Human
gauggcccuucaaguugu

SEQ ID NO: 688559 - RNA, 21 nt, Human
gcaagccuauguguuugcccg

SEQ ID NO: 688560 - RNA, 23 nt, Human
gcacacacagacacacacaaaca

SEQ ID NO: 688561 - RNA, 19 nt, Human
gcaccccuagaaccuagag

SEQ ID NO: 688562 - RNA, 24 nt, Human
gcacgcacacacacacacacaccc

SEQ ID NO: 688563 - RNA, 18 nt, Human
gcccugagagggguuccc

SEQ ID NO: 688564 - RNA, 18 nt, Human
gcuccaaacaccugacuc

SEQ ID NO: 688565 - RNA, 21 nt, Human
ggaggcucuagccaguuagcc

SEQ ID NO: 688566 - RNA, 21 nt, Human
ggauauggccugggcagggag

SEQ ID NO: 688567 - RNA, 19 nt, Human
ggcaggcugcagugagacc

SEQ ID NO: 688568 - RNA, 24 nt, Human
ggcaugcacacacauccacacgca

SEQ ID NO: 688569 - RNA, 30 nt, Human
gggaacagauacauacaugcgugugcaugg

SEQ ID NO: 688570 - RNA, 23 nt, Human
gggcagagagagaaggugcuggg

SEQ ID NO: 688571 - RNA, 20 nt, Human
ggugagagccagagcucaga

SEQ ID NO: 688572 - RNA, 27 nt, Human
gugcaugcacacacacgcacacauucc

SEQ ID NO: 688573 - RNA, 20 nt, Human
guggagugccaacugcccug

SEQ ID NO: 688574 - RNA, 23 nt, Human
gugugcaugcacacacacgcaca

SEQ ID NO: 688575 - RNA, 26 nt, Human
uaaaaauaaacaccccuccccaaaaa

SEQ ID NO: 688576 - RNA, 23 nt, Human
uaaaauccaaguguaaaagcuua

SEQ ID NO: 688577 - RNA, 23 nt, Human
uaaacaccccuccccaaaaaacg

SEQ ID NO: 688578 - RNA, 24 nt, Human
uaaacaccccuccccaaaaaacgc

SEQ ID NO: 688579 - RNA, 21 nt, Human
uacacacagacaugaugacaa

SEQ ID NO: 688580 - RNA, 31 nt, Human
uacaugcgugugcaugcacacacacgcacag

SEQ ID NO: 688581 - RNA, 23 nt, Human
uaccgccuagagcuugacuacgc

SEQ ID NO: 688582 - RNA, 24 nt, Human
uacuaaaaauaaacaccccucccc

SEQ ID NO: 688583 - RNA, 23 nt, Human
uaugauggcuaaaauccaagugu

SEQ ID NO: 688584 - RNA, 20 nt, Human
ucagacuagcucuggcccug

SEQ ID NO: 688585 - RNA, 18 nt, Human
uccaaauaggaguggagu

SEQ ID NO: 688586 - RNA, 21 nt, Human
uccgaaguugacagacuaaca

SEQ ID NO: 688587 - RNA, 18 nt, Human
ucuggcagaggagcuggc

SEQ ID NO: 688588 - RNA, 21 nt, Human
ucuggcccugcagcccagaug

SEQ ID NO: 688589 - RNA, 27 nt, Human
ucuucccuuccagagagaaggugauga

SEQ ID NO: 688590 - RNA, 25 nt, Human
ugaaagagcuacacuugagaaggua

SEQ ID NO: 688591 - RNA, 19 nt, Human
ugaaugagcugccugggcu

SEQ ID NO: 688592 - RNA, 21 nt, Human
ugaaugagcugccugggcuug

SEQ ID NO: 688593 - RNA, 21 nt, Human
ugacccagaaggaacagggaa

SEQ ID NO: 688594 - RNA, 20 nt, Human
ugcaggagauagggcugaga

SEQ ID NO: 688595 - RNA, 23 nt, Human
ugccaacugcccugccucgcucc

SEQ ID NO: 688596 - RNA, 18 nt, Human
ugcccugccucgcuccaa

SEQ ID NO: 688597 - RNA, 22 nt, Human
uggcaaaaaaaaaaaaaaagaa

SEQ ID NO: 688598 - RNA, 23 nt, Human
uggcaagaguccaguccauuaag

SEQ ID NO: 688599 - RNA, 25 nt, Human
uggcaagaguccaguccauuaagug

SEQ ID NO: 688600 - RNA, 25 nt, Human
uggcuaaaauccaaguguaaaagcu

SEQ ID NO: 688601 - RNA, 24 nt, Human
ugucaggaggcagacugaccuaau

SEQ ID NO: 688602 - RNA, 21 nt, Human
uuagagucccgguagccauuc

SEQ ID NO: 688603 - RNA, 23 nt, Human
uuggagucuccuguccucaucaa

SEQ ID NO: 688604 - RNA, 22 nt, Human
uuggcaaaaaaaaaaaaaaaga

SEQ ID NO: 688605 - RNA, 21 nt, Human
acagcaccucggucuccuggc

SEQ ID NO: 688606 - RNA, 18 nt, Human
agaaagaaagcugggggg

SEQ ID NO: 688607 - RNA, 19 nt, Human
agagggaggagggaggggu

SEQ ID NO: 688608 - RNA, 21 nt, Human
agagggaggagggagggguca

SEQ ID NO: 688609 - RNA, 24 nt, Human
aggugggcgcugacgccgcgggcg

SEQ ID NO: 688610 - RNA, 19 nt, Human
caccaucuguagaaagaaa

SEQ ID NO: 688611 - RNA, 20 nt, Human
cagagcgagcagugccuucc

SEQ ID NO: 688612 - RNA, 21 nt, Human
cagagcgagcagugccuuccc

SEQ ID NO: 688613 - RNA, 21 nt, Human
cagcacaauucccuccauuga

SEQ ID NO: 688614 - RNA, 24 nt, Human
cagucuagucccuccccuuucccu

SEQ ID NO: 688615 - RNA, 21 nt, Human
cauagaugguggcagacagcu

SEQ ID NO: 688616 - RNA, 22 nt, Human
ccaucgcccaggcccccguugg

SEQ ID NO: 688617 - RNA, 19 nt, Human
cccccguuggcugaagggc

SEQ ID NO: 688618 - RNA, 20 nt, Human
ccugugcaugugccugugug

SEQ ID NO: 688619 - RNA, 19 nt, Human
ccuguguggcuggagaagu

SEQ ID NO: 688620 - RNA, 21 nt, Human
ccuugcgcagcuccguggucg

SEQ ID NO: 688621 - RNA, 21 nt, Human
cuccccuuucccuagcccagc

SEQ ID NO: 688622 - RNA, 21 nt, Human
cuccguggucgaccaucgccc

SEQ ID NO: 688623 - RNA, 22 nt, Human
cuccuggcugcgccggcugcgg

SEQ ID NO: 688624 - RNA, 22 nt, Human
cugagggguccuggcuucucuc

SEQ ID NO: 688625 - RNA, 21 nt, Human
gacagcugagggguccuggcu

SEQ ID NO: 688626 - RNA, 21 nt, Human
gaggagggaggggucagaccc

SEQ ID NO: 688627 - RNA, 19 nt, Human
gauagaggccuuguccagg

SEQ ID NO: 688628 - RNA, 19 nt, Human
gcacaauucccuccauuga

SEQ ID NO: 688629 - RNA, 22 nt, Human
gcgaagggcagcgugugagcca

SEQ ID NO: 688630 - RNA, 19 nt, Human
gcgccggcugcgggccgca

SEQ ID NO: 688631 - RNA, 20 nt, Human
ggaggccuuuuccuguggga

SEQ ID NO: 688632 - RNA, 18 nt, Human
gggcgaagggcagcgugu

SEQ ID NO: 688633 - RNA, 19 nt, Human
gggggguaagggaggcaca

SEQ ID NO: 688634 - RNA, 21 nt, Human
gggguaaauggggcuaagaag

SEQ ID NO: 688635 - RNA, 21 nt, Human
ggugaggucuuuaugguguau

SEQ ID NO: 688636 - RNA, 19 nt, Human
gugcagccaggacccgggu

SEQ ID NO: 688637 - RNA, 19 nt, Human
gugcaggaggggaugcggu

SEQ ID NO: 688638 - RNA, 18 nt, Human
uagaggccuuguccaggu

SEQ ID NO: 688639 - RNA, 21 nt, Human
uagaugguggcagacagcuga

SEQ ID NO: 688640 - RNA, 23 nt, Human
uccacaaacgggguaaauggggc

SEQ ID NO: 688641 - RNA, 19 nt, Human
uccagagggaggagggagg

SEQ ID NO: 688642 - RNA, 22 nt, Human
ucuguagaaagaaagcuggggg

SEQ ID NO: 688643 - RNA, 19 nt, Human
ucuuuaugguguauagagg

SEQ ID NO: 688644 - RNA, 22 nt, Human
ugccuguguggcuggagaaguc

SEQ ID NO: 688645 - RNA, 19 nt, Human
uggcaauaugcagacagca

SEQ ID NO: 688646 - RNA, 19 nt, Human
uggugaguuucagagccag

SEQ ID NO: 688647 - RNA, 19 nt, Human
ugguggcagacagcugagg

SEQ ID NO: 688648 - RNA, 20 nt, Human
ugugcaugugccuguguggc

SEQ ID NO: 688649 - RNA, 19 nt, Human
uuccuugcgcagcuccgug

SEQ ID NO: 688650 - RNA, 23 nt, Human
uuuaugguguauagagguuggug

SEQ ID NO: 688651 - RNA, 19 nt, Human
aaagugcuaggauuacagg

SEQ ID NO: 688652 - RNA, 24 nt, Human
aaagugcuaggauuacaggcauga

SEQ ID NO: 688653 - RNA, 25 nt, Human
aagcaauucucccgccucagccucc

SEQ ID NO: 688654 - RNA, 26 nt, Human
aagugcuaggauuacaggcaugagcc

SEQ ID NO: 688655 - RNA, 23 nt, Human
acaucuaagagaugucagagcca

SEQ ID NO: 688656 - RNA, 24 nt, Human
accagcgcagaagcuucccgccac

SEQ ID NO: 688657 - RNA, 22 nt, Human
acucccaacagcccacccacac

SEQ ID NO: 688658 - RNA, 21 nt, Human
acugaacacuccauccucacu

SEQ ID NO: 688659 - RNA, 23 nt, Human
acuuuaaaauguaaaaugagaaa

SEQ ID NO: 688660 - RNA, 24 nt, Human
acuuuuguauuuuuaguagagaug

SEQ ID NO: 688661 - RNA, 18 nt, Human
agaagcuucccgccacaa

SEQ ID NO: 688662 - RNA, 24 nt, Human
agccaccgcaaccggccuaaacag

SEQ ID NO: 688663 - RNA, 18 nt, Human
aggacccuacuccucugc

SEQ ID NO: 688664 - RNA, 22 nt, Human
aggccucugccaccacacccag

SEQ ID NO: 688665 - RNA, 24 nt, Human
aggugauccacccaccucagccuc

SEQ ID NO: 688666 - RNA, 22 nt, Human
aguagagaugggguuucgccau

SEQ ID NO: 688667 - RNA, 26 nt, Human
auccucacucccaacagcccacccac

SEQ ID NO: 688668 - RNA, 22 nt, Human
augggguuucgccauguuggcg

SEQ ID NO: 688669 - RNA, 23 nt, Human
augggguuucgccauguuggcga

SEQ ID NO: 688670 - RNA, 24 nt, Human
augggguuucgccauguuggcgag

SEQ ID NO: 688671 - RNA, 21 nt, Human
auucucccgccucagccuccc

SEQ ID NO: 688672 - RNA, 24 nt, Human
caaagugcuaggauuacaggcaug

SEQ ID NO: 688673 - RNA, 21 nt, Human
caagacuaaaggaaccccaga

SEQ ID NO: 688674 - RNA, 19 nt, Human
caaugagcauccaguuaga

SEQ ID NO: 688675 - RNA, 25 nt, Human
cacaaccucuucaacugcuauccaa

SEQ ID NO: 688676 - RNA, 22 nt, Human
cacaauguccauaacuugagca

SEQ ID NO: 688677 - RNA, 24 nt, Human
caccaaauaauugagcauaagaca

SEQ ID NO: 688678 - RNA, 22 nt, Human
caccagaccccgggguaagggc

SEQ ID NO: 688679 - RNA, 22 nt, Human
cacccaccucagccucccaaag

SEQ ID NO: 688680 - RNA, 23 nt, Human
cacccaccucagccucccaaagu

SEQ ID NO: 688681 - RNA, 24 nt, Human
caccucagccucccaaagugcuag

SEQ ID NO: 688682 - RNA, 21 nt, Human
caccugugcauuaaacaggcu

SEQ ID NO: 688683 - RNA, 23 nt, Human
cacucccaacagcccacccacac

SEQ ID NO: 688684 - RNA, 19 nt, Human
cacugaacacuccauccuc

SEQ ID NO: 688685 - RNA, 22 nt, Human
cacugcaaccuccguccccggg

SEQ ID NO: 688686 - RNA, 23 nt, Human
cagaccccgggguaagggcgaga

SEQ ID NO: 688687 - RNA, 22 nt, Human
cagccucccaaggaacugggau

SEQ ID NO: 688688 - RNA, 20 nt, Human
caucccaccacccccuucag

SEQ ID NO: 688689 - RNA, 19 nt, Human
ccaaagugcuaggauuaca

SEQ ID NO: 688690 - RNA, 24 nt, Human
ccaaagugcuaggauuacaggcau

SEQ ID NO: 688691 - RNA, 22 nt, Human
ccaauacacacuauguuggagg

SEQ ID NO: 688692 - RNA, 21 nt, Human
ccacaaaacucaccggagaca

SEQ ID NO: 688693 - RNA, 26 nt, Human
ccacccaccucagccucccaaagugc

SEQ ID NO: 688694 - RNA, 18 nt, Human
ccagaccccgggguaagg

SEQ ID NO: 688695 - RNA, 22 nt, Human
ccauguuggcgaggcuggucuc

SEQ ID NO: 688696 - RNA, 23 nt, Human
ccauguuggcgaggcuggucucg

SEQ ID NO: 688697 - RNA, 23 nt, Human
ccccagacagauguuuaggaagu

SEQ ID NO: 688698 - RNA, 19 nt, Human
ccccggguucaagcaauuc

SEQ ID NO: 688699 - RNA, 21 nt, Human
ccccggguucaagcaauucuc

SEQ ID NO: 688700 - RNA, 24 nt, Human
ccugaccucaggugauccacccac

SEQ ID NO: 688701 - RNA, 24 nt, Human
cgccauguuggcgaggcuggucuc

SEQ ID NO: 688702 - RNA, 26 nt, Human
cgggguaagggcgagaucaaccuauc

SEQ ID NO: 688703 - RNA, 24 nt, Human
cucacucccaacagcccacccaca

SEQ ID NO: 688704 - RNA, 18 nt, Human
cucauagccauaagcaau

SEQ ID NO: 688705 - RNA, 18 nt, Human
cuccauccucacucccaa

SEQ ID NO: 688706 - RNA, 20 nt, Human
cuccgggggaacagccggga

SEQ ID NO: 688707 - RNA, 21 nt, Human
cugaaguugggaccggggucc

SEQ ID NO: 688708 - RNA, 22 nt, Human
cugcaaccuccguccccggguu

SEQ ID NO: 688709 - RNA, 21 nt, Human
cuucccgccacaaaacucacc

SEQ ID NO: 688710 - RNA, 20 nt, Human
cuuuuguauuuuuaguagag

SEQ ID NO: 688711 - RNA, 24 nt, Human
cuuuuuuuuuuugagauggagucu

SEQ ID NO: 688712 - RNA, 24 nt, Human
gaaagcacagcauacaccagaccc

SEQ ID NO: 688713 - RNA, 24 nt, Human
gaccucaggugauccacccaccuc

SEQ ID NO: 688714 - RNA, 20 nt, Human
gagaugggguuucgccaugu

SEQ ID NO: 688715 - RNA, 24 nt, Human
gagaugggguuucgccauguuggc

SEQ ID NO: 688716 - RNA, 18 nt, Human
gauuacaggcaugagcca

SEQ ID NO: 688717 - RNA, 20 nt, Human
gauuacaggcaugagccacc

SEQ ID NO: 688718 - RNA, 23 nt, Human
gauuacaggcaugagccaccgca

SEQ ID NO: 688719 - RNA, 21 nt, Human
gcaaccuccguccccggguuc

SEQ ID NO: 688720 - RNA, 19 nt, Human
gcacagcauacaccagacc

SEQ ID NO: 688721 - RNA, 21 nt, Human
gcacagcauacaccagacccc

SEQ ID NO: 688722 - RNA, 23 nt, Human
gccucagccucccaaggaacugg

SEQ ID NO: 688723 - RNA, 19 nt, Human
gcuaggaaugggacuccca

SEQ ID NO: 688724 - RNA, 23 nt, Human
gcuggucucgaacuccugaccuc

SEQ ID NO: 688725 - RNA, 18 nt, Human
ggaacugggauuacaggc

SEQ ID NO: 688726 - RNA, 23 nt, Human
ggacccuccgggggaacagccgg

SEQ ID NO: 688727 - RNA, 22 nt, Human
ggauuacaggcaugagccaccg

SEQ ID NO: 688728 - RNA, 24 nt, Human
ggcuggucucgaacuccugaccuc

SEQ ID NO: 688729 - RNA, 19 nt, Human
gggguuucgccauguuggc

SEQ ID NO: 688730 - RNA, 22 nt, Human
ggguuucgccauguuggcgagg

SEQ ID NO: 688731 - RNA, 19 nt, Human
ggucucgaacuccugaccu

SEQ ID NO: 688732 - RNA, 23 nt, Human
guagagaugggguuucgccaugu

SEQ ID NO: 688733 - RNA, 24 nt, Human
gugauccacccaccucagccuccc

SEQ ID NO: 688734 - RNA, 18 nt, Human
guggcccaggcuggguac

SEQ ID NO: 688735 - RNA, 22 nt, Human
uaacuugagcaggcuuuggcau

SEQ ID NO: 688736 - RNA, 24 nt, Human
uaacuuuuguauuuuuaguagaga

SEQ ID NO: 688737 - RNA, 18 nt, Human
uaagacauucaagacuaa

SEQ ID NO: 688738 - RNA, 19 nt, Human
uaagagaugucagagccau

SEQ ID NO: 688739 - RNA, 23 nt, Human
uacaggcaugagccaccgcaacc

SEQ ID NO: 688740 - RNA, 24 nt, Human
uacaggccucugccaccacaccca

SEQ ID NO: 688741 - RNA, 22 nt, Human
uagagaugggguuucgccaugu

SEQ ID NO: 688742 - RNA, 18 nt, Human
uaggauuacaggcaugag

SEQ ID NO: 688743 - RNA, 21 nt, Human
uaggauuacaggcaugagcca

SEQ ID NO: 688744 - RNA, 22 nt, Human
uaggauuacaggcaugagccac

SEQ ID NO: 688745 - RNA, 23 nt, Human
uaggauuacaggcaugagccacc

SEQ ID NO: 688746 - RNA, 24 nt, Human
uaggauuacaggcaugagccaccg

SEQ ID NO: 688747 - RNA, 24 nt, Human
uaggauuacaggcaugagccaccg

SEQ ID NO: 688748 - RNA, 24 nt, Human
uaguagagaugggguuucgccaug

SEQ ID NO: 688749 - RNA, 18 nt, Human
uauggccaguauggaagg

SEQ ID NO: 688750 - RNA, 19 nt, Human
ucacugcaaccuccguccc

SEQ ID NO: 688751 - RNA, 22 nt, Human
ucacugcaaccuccguccccgg

SEQ ID NO: 688752 - RNA, 22 nt, Human
ucacugcaaccuccguccccgg

SEQ ID NO: 688753 - RNA, 23 nt, Human
ucacugcaaccuccguccccggg

SEQ ID NO: 688754 - RNA, 26 nt, Human
ucacugcaaccuccguccccggguuc

SEQ ID NO: 688755 - RNA, 18 nt, Human
ucagccucccaaagugcu

SEQ ID NO: 688756 - RNA, 20 nt, Human
ucagccucccaaggaacugg

SEQ ID NO: 688757 - RNA, 20 nt, Human
ucaggugauccacccaccuc

SEQ ID NO: 688758 - RNA, 21 nt, Human
uccacccaccucagccuccca

SEQ ID NO: 688759 - RNA, 24 nt, Human
uccauaacuugagcaggcuuuggc

SEQ ID NO: 688760 - RNA, 24 nt, Human
ucccaaagugcuaggauuacaggc

SEQ ID NO: 688761 - RNA, 19 nt, Human
ucccaacagcugaaguugg

SEQ ID NO: 688762 - RNA, 24 nt, Human
ucccaaggaacugggauuacaggc

SEQ ID NO: 688763 - RNA, 23 nt, Human
ucccaccacccccuucagaccaa

SEQ ID NO: 688764 - RNA, 23 nt, Human
uccccggguucaagcaauucucc

SEQ ID NO: 688765 - RNA, 21 nt, Human
uccuucugaaaggccucugga

SEQ ID NO: 688766 - RNA, 22 nt, Human
ucgccauguuggcgaggcuggu

SEQ ID NO: 688767 - RNA, 24 nt, Human
ucucauagccauaagcaauccacu

SEQ ID NO: 688768 - RNA, 25 nt, Human
ucucccgccucagccucccaaggaa

SEQ ID NO: 688769 - RNA, 23 nt, Human
ucucgaacuccugaccucaggug

SEQ ID NO: 688770 - RNA, 20 nt, Human
ucugaaaggccucuggaccc

SEQ ID NO: 688771 - RNA, 22 nt, Human
ucuugcacuguggcccaggcug

SEQ ID NO: 688772 - RNA, 23 nt, Human
ucuugcacuguggcccaggcugg

SEQ ID NO: 688773 - RNA, 23 nt, Human
ucuugcacuguggcccaggcugg

SEQ ID NO: 688774 - RNA, 24 nt, Human
ucuugcacuguggcccaggcuggg

SEQ ID NO: 688775 - RNA, 25 nt, Human
ucuuuucuuuuuuuuuuugagaugg

SEQ ID NO: 688776 - RNA, 21 nt, Human
ugaaaauaucaccaucuccca

SEQ ID NO: 688777 - RNA, 21 nt, Human
ugaccucaggugauccaccca

SEQ ID NO: 688778 - RNA, 24 nt, Human
ugaccucaggugauccacccaccu

SEQ ID NO: 688779 - RNA, 23 nt, Human
ugagauggagucuugcacugugg

SEQ ID NO: 688780 - RNA, 24 nt, Human
ugauccacccaccucagccuccca

SEQ ID NO: 688781 - RNA, 23 nt, Human
ugcuaggaaugggacucccaucu

SEQ ID NO: 688782 - RNA, 19 nt, Human
uggaggagcucuuguggaa

SEQ ID NO: 688783 - RNA, 18 nt, Human
uggcaucccaccaccccc

SEQ ID NO: 688784 - RNA, 25 nt, Human
uggcaucccaccacccccuucagac

SEQ ID NO: 688785 - RNA, 22 nt, Human
uggcccaggcuggguacagcag

SEQ ID NO: 688786 - RNA, 24 nt, Human
uggcgaggcuggucucgaacuccu

SEQ ID NO: 688787 - RNA, 19 nt, Human
ugggauuacaggccucugc

SEQ ID NO: 688788 - RNA, 21 nt, Human
ugggauuacaggccucugcca

SEQ ID NO: 688789 - RNA, 22 nt, Human
ugggauuacaggccucugccac

SEQ ID NO: 688790 - RNA, 24 nt, Human
ugggauuacaggccucugccacca

SEQ ID NO: 688791 - RNA, 24 nt, Human
ugggguuucgccauguuggcgagg

SEQ ID NO: 688792 - RNA, 19 nt, Human
ugucuaggucaguguucca

SEQ ID NO: 688793 - RNA, 18 nt, Human
uuaguagagaugggguuu

SEQ ID NO: 688794 - RNA, 22 nt, Human
uuaguagagaugggguuucgcc

SEQ ID NO: 688795 - RNA, 24 nt, Human
uuaguagagaugggguuucgccau

SEQ ID NO: 688796 - RNA, 23 nt, Human
uucaagacuaaaggaaccccaga

SEQ ID NO: 688797 - RNA, 24 nt, Human
uucaagcaauucucccgccucagc

SEQ ID NO: 688798 - RNA, 21 nt, Human
uugaaaauaucaccaucuccc

SEQ ID NO: 688799 - RNA, 21 nt, Human
uugcacuguggcccaggcugg

SEQ ID NO: 688800 - RNA, 23 nt, Human
uuguauuuuuaguagagaugggg

SEQ ID NO: 688801 - RNA, 21 nt, Human
uuucgccauguuggcgaggcu

SEQ ID NO: 688802 - RNA, 22 nt, Human
uuuuuaguagagaugggguuuc

SEQ ID NO: 688803 - RNA, 23 nt, Human
uuuuuaguagagaugggguuucg

SEQ ID NO: 688804 - RNA, 20 nt, Human
uuuuuuuuuuuuuuuuuugg

SEQ ID NO: 688805 - RNA, 21 nt, Human
aagagaaaauuauccccaaaa

SEQ ID NO: 688806 - RNA, 18 nt, Human
auacuggaaauugccuaa

SEQ ID NO: 688807 - RNA, 24 nt, Human
cauacacaggcaaaaauaagugug

SEQ ID NO: 688808 - RNA, 19 nt, Human
uaacuuaaucauugccuaa

SEQ ID NO: 688809 - RNA, 22 nt, Human
uccauacacaggcaaaaauaag

SEQ ID NO: 688810 - RNA, 23 nt, Human
ucucuccauacacaggcaaaaau

SEQ ID NO: 688811 - RNA, 21 nt, Human
ugcgguuuuaaaauuauuucu

SEQ ID NO: 688812 - RNA, 24 nt, Human
ugcgguuuuaaaauuauuucuuga

SEQ ID NO: 688813 - RNA, 19 nt, Human
cccugagccgcgggaaccu

SEQ ID NO: 688814 - RNA, 25 nt, Human
cccugagccgcgggaaccucucacc

SEQ ID NO: 688815 - RNA, 22 nt, Human
guccauuuuucccuuuccaucc

SEQ ID NO: 688816 - RNA, 19 nt, Human
uuuuuuuuuuuuuaaggga

SEQ ID NO: 688817 - RNA, 23 nt, Human
uuuuuuuuuuuuuuuuuuaaggg

SEQ ID NO: 688818 - RNA, 22 nt, Human
aaaauauucacauaacuguauc

SEQ ID NO: 688819 - RNA, 26 nt, Human
aaacccaacaaaucuuaaaauugcaa

SEQ ID NO: 688820 - RNA, 25 nt, Human
aaccauugaaacaagucaguaacaa

SEQ ID NO: 688821 - RNA, 19 nt, Human
aacuuaaaaaaauacagag

SEQ ID NO: 688822 - RNA, 21 nt, Human
aauuugucuuaaauaggauuu

SEQ ID NO: 688823 - RNA, 18 nt, Human
acagagcccuuguugauu

SEQ ID NO: 688824 - RNA, 19 nt, Human
acaguaauaaagguuccca

SEQ ID NO: 688825 - RNA, 22 nt, Human
acauaacuguaucacagaucuu

SEQ ID NO: 688826 - RNA, 20 nt, Human
accucgagacgucgccccuc

SEQ ID NO: 688827 - RNA, 22 nt, Human
agacuuaaaagggaccuaaaua

SEQ ID NO: 688828 - RNA, 21 nt, Human
aggaaacagacauucagaaaa

SEQ ID NO: 688829 - RNA, 18 nt, Human
aggcuuuggggagaggga

SEQ ID NO: 688830 - RNA, 18 nt, Human
aguaacaaaauauucaca

SEQ ID NO: 688831 - RNA, 20 nt, Human
agugaaaacuggcaucugaa

SEQ ID NO: 688832 - RNA, 25 nt, Human
auugcaauuagacuuaaaagggacc

SEQ ID NO: 688833 - RNA, 18 nt, Human
cacccgccccucgcggcc

SEQ ID NO: 688834 - RNA, 21 nt, Human
ccacuuuauguuucuuccccc

SEQ ID NO: 688835 - RNA, 20 nt, Human
cccgcaccuccuccguuuua

SEQ ID NO: 688836 - RNA, 20 nt, Human
cccgccccucgcggccuaga

SEQ ID NO: 688837 - RNA, 25 nt, Human
ccucggccucuccagggcuaccggg

SEQ ID NO: 688838 - RNA, 23 nt, Human
cgucccgcaccuccuccguuuua

SEQ ID NO: 688839 - RNA, 19 nt, Human
cuccagggcuaccgggccc

SEQ ID NO: 688840 - RNA, 24 nt, Human
cucuccagggcuaccgggcccgcg

SEQ ID NO: 688841 - RNA, 20 nt, Human
cugacgcugggcggugaucc

SEQ ID NO: 688842 - RNA, 21 nt, Human
gagagggaaggagacgcggug

SEQ ID NO: 688843 - RNA, 22 nt, Human
gccucucauaaaacccaacaaa

SEQ ID NO: 688844 - RNA, 19 nt, Human
ggcggugauccaggcuuug

SEQ ID NO: 688845 - RNA, 20 nt, Human
gucuccgcgucccgcaccuc

SEQ ID NO: 688846 - RNA, 24 nt, Human
uaaaaagaugcaaugcuucaaaaa

SEQ ID NO: 688847 - RNA, 25 nt, Human
uaaaacccaacaaaucuuaaaauug

SEQ ID NO: 688848 - RNA, 24 nt, Human
uaaaagggaccuaaauaccacuuc

SEQ ID NO: 688849 - RNA, 23 nt, Human
uaaaauugcaauuagacuuaaaa

SEQ ID NO: 688850 - RNA, 22 nt, Human
uaacaaaauauucacauaacug

SEQ ID NO: 688851 - RNA, 23 nt, Human
uaacuuaaaaaaauacagagccc

SEQ ID NO: 688852 - RNA, 25 nt, Human
uaaguaacagccucucauaaaaccc

SEQ ID NO: 688853 - RNA, 19 nt, Human
uagacuuaaaagggaccua

SEQ ID NO: 688854 - RNA, 23 nt, Human
uagauuuauuaaaaagaugcaau

SEQ ID NO: 688855 - RNA, 20 nt, Human
uauaaaauccuuauacaagu

SEQ ID NO: 688856 - RNA, 21 nt, Human
uauaacugacuacuuacugag

SEQ ID NO: 688857 - RNA, 23 nt, Human
uaucacagaucuuaggaaacaga

SEQ ID NO: 688858 - RNA, 21 nt, Human
uaucauauauauaaaauccuu

SEQ ID NO: 688859 - RNA, 24 nt, Human
ucacaguaauaaagguucccacaa

SEQ ID NO: 688860 - RNA, 22 nt, Human
ucuccuucacaguaauaaaggu

SEQ ID NO: 688861 - RNA, 23 nt, Human
ugacgcugggcggugauccaggc

SEQ ID NO: 688862 - RNA, 19 nt, Human
ugaggaacuucaaagccgg

SEQ ID NO: 688863 - RNA, 24 nt, Human
uuaacuuaaaaaaauacagagccc

SEQ ID NO: 688864 - RNA, 22 nt, Human
uucaggauagauuuauuaaaaa

SEQ ID NO: 688865 - RNA, 21 nt, Human
uuccauuacagugaauucuga

SEQ ID NO: 688866 - RNA, 18 nt, Human
uuuggggagagggaagga

SEQ ID NO: 688867 - RNA, 18 nt, Human
uuuugcaacauuuucugc

SEQ ID NO: 688868 - RNA, 21 nt, Human
uuuuuuuuuuuuuuuuugcaa

SEQ ID NO: 688869 - RNA, 25 nt, Human
uuuuuuuuuuuuuuuuugcaacauu

SEQ ID NO: 688870 - RNA, 20 nt, Human
uuuuuuuuuuuuuuuuuugg

SEQ ID NO: 688871 - RNA, 23 nt, Human
aaaaaaggcaaauaaaugcagaa

SEQ ID NO: 688872 - RNA, 18 nt, Human
aaaaagaaaaaaggcaaa

SEQ ID NO: 688873 - RNA, 18 nt, Human
aaauaggggaagacaaca

SEQ ID NO: 688874 - RNA, 21 nt, Human
aacagugguggccaccacccc

SEQ ID NO: 688875 - RNA, 19 nt, Human
aagcaagagaaaaagaaaa

SEQ ID NO: 688876 - RNA, 26 nt, Human
aagcaagagaaaaagaaaaaaggcaa

SEQ ID NO: 688877 - RNA, 21 nt, Human
aagcauauuuguucuucagag

SEQ ID NO: 688878 - RNA, 22 nt, Human
aagccggagggagcccugaggc

SEQ ID NO: 688879 - RNA, 20 nt, Human
acagagcaggcuccaacaag

SEQ ID NO: 688880 - RNA, 22 nt, Human
agaaaaagaaaaaaggcaaaua

SEQ ID NO: 688881 - RNA, 19 nt, Human
agacaacaggccaaggcca

SEQ ID NO: 688882 - RNA, 24 nt, Human
agagccucccagaugccccugcuc

SEQ ID NO: 688883 - RNA, 19 nt, Human
agaggggaagggcaagaug

SEQ ID NO: 688884 - RNA, 24 nt, Human
agagugcugaaugucaacucccaa

SEQ ID NO: 688885 - RNA, 25 nt, Human
agcaauaaggaagccaugucugaga

SEQ ID NO: 688886 - RNA, 21 nt, Human
aggaaggaugugugggaauca

SEQ ID NO: 688887 - RNA, 21 nt, Human
aggcagccagagccucccaga

SEQ ID NO: 688888 - RNA, 25 nt, Human
caacucccaggccuccucuuccagc

SEQ ID NO: 688889 - RNA, 27 nt, Human
caagagaaaaagaaaaaaggcaaauaa

SEQ ID NO: 688890 - RNA, 21 nt, Human
cacacuggggccugcaggcau

SEQ ID NO: 688891 - RNA, 19 nt, Human
caccaccccuuagaagcaa

SEQ ID NO: 688892 - RNA, 24 nt, Human
caccaccccuuagaagcaagagaa

SEQ ID NO: 688893 - RNA, 22 nt, Human
caccaggccauugcugcauuug

SEQ ID NO: 688894 - RNA, 18 nt, Human
cagaaaauaggggaagaa

SEQ ID NO: 688895 - RNA, 20 nt, Human
cagaaggcagccagagccuc

SEQ ID NO: 688896 - RNA, 20 nt, Human
cagagccucccagaugcccc

SEQ ID NO: 688897 - RNA, 21 nt, Human
cagggcuuggccacaggcagg

SEQ ID NO: 688898 - RNA, 23 nt, Human
caguugaggcacacacuggggcc

SEQ ID NO: 688899 - RNA, 23 nt, Human
cauagcccaggcagagggacaga

SEQ ID NO: 688900 - RNA, 22 nt, Human
ccaaaagcauauuuguucuuca

SEQ ID NO: 688901 - RNA, 22 nt, Human
ccagagccucccagaugccccu

SEQ ID NO: 688902 - RNA, 22 nt, Human
cccauagcccaggcagagggac

SEQ ID NO: 688903 - RNA, 23 nt, Human
ccccacuucccauagcccaggca

SEQ ID NO: 688904 - RNA, 18 nt, Human
cccgcagucuccgcccuc

SEQ ID NO: 688905 - RNA, 20 nt, Human
cccugcucaggacccuuccc

SEQ ID NO: 688906 - RNA, 26 nt, Human
cccugcugccaaaccaccaugaucca

SEQ ID NO: 688907 - RNA, 20 nt, Human
ccgccccgcagucuccgccc

SEQ ID NO: 688908 - RNA, 18 nt, Human
ccucccagaugccccugc

SEQ ID NO: 688909 - RNA, 24 nt, Human
ccugaagucagaaucaguugaggc

SEQ ID NO: 688910 - RNA, 21 nt, Human
ccugcaggcaucgagugagcc

SEQ ID NO: 688911 - RNA, 19 nt, Human
cuaaaaacaauucucuacg

SEQ ID NO: 688912 - RNA, 18 nt, Human
cuggaagagugcugaaug

SEQ ID NO: 688913 - RNA, 21 nt, Human
cuucccauagcccaggcagag

SEQ ID NO: 688914 - RNA, 20 nt, Human
cuuggccacaggcagggcuu

SEQ ID NO: 688915 - RNA, 19 nt, Human
gaaauggaguggggagcac

SEQ ID NO: 688916 - RNA, 21 nt, Human
gaaggcagccagagccuccca

SEQ ID NO: 688917 - RNA, 18 nt, Human
gccccgcagucuccgccc

SEQ ID NO: 688918 - RNA, 18 nt, Human
gcccugaggccucauccu

SEQ ID NO: 688919 - RNA, 23 nt, Human
gcucaggacccuuccccgcagcu

SEQ ID NO: 688920 - RNA, 20 nt, Human
ggaugcaggaaggaugugug

SEQ ID NO: 688921 - RNA, 18 nt, Human
gggaagacaacaggccaa

SEQ ID NO: 688922 - RNA, 24 nt, Human
gggcaagagccaagcugucuggga

SEQ ID NO: 688923 - RNA, 27 nt, Human
gggcaagagccaagcugucugggaggg

SEQ ID NO: 688924 - RNA, 18 nt, Human
gugguggccaccaccccu

SEQ ID NO: 688925 - RNA, 18 nt, Human
uaaaugcagaaggcagcc

SEQ ID NO: 688926 - RNA, 20 nt, Human
uagcccaggcagagggacag

SEQ ID NO: 688927 - RNA, 21 nt, Human
uauccugucaggggcaagagc

SEQ ID NO: 688928 - RNA, 25 nt, Human
ucccagaugccccugcucaggaccc

SEQ ID NO: 688929 - RNA, 18 nt, Human
uccucacuggggguccua

SEQ ID NO: 688930 - RNA, 19 nt, Human
ucuaaacagugguggccac

SEQ ID NO: 688931 - RNA, 19 nt, Human
ugagaggggaagggcaaga

SEQ ID NO: 688932 - RNA, 20 nt, Human
ugccaagccggagggagccc

SEQ ID NO: 688933 - RNA, 20 nt, Human
uggaagagugcugaauguca

SEQ ID NO: 688934 - RNA, 24 nt, Human
uggaggaacauguugugucugccg

SEQ ID NO: 688935 - RNA, 22 nt, Human
uggaguggggagcacagagcag

SEQ ID NO: 688936 - RNA, 21 nt, Human
ugugggaaucaccaggccauu

SEQ ID NO: 688937 - RNA, 18 nt, Human
uugcugcauuugggguga

SEQ ID NO: 688938 - RNA, 21 nt, Human
uuggcaguggccacucagggc

SEQ ID NO: 688939 - RNA, 22 nt, Human
uuggucacaaacucugcuaaaa

SEQ ID NO: 688940 - RNA, 18 nt, Human
uuuuuuuuuuuuuuuucg

SEQ ID NO: 688941 - RNA, 21 nt, Human
uuuuuuuuuuuuuuuucgugg

SEQ ID NO: 688942 - RNA, 20 nt, Human
uuuuuuuuuuuuuuuuucgu

SEQ ID NO: 688943 - RNA, 21 nt, Human
aaccaauucggcgccggcacc

SEQ ID NO: 688944 - RNA, 21 nt, Human
cacccuuugggugaaaccuaa

SEQ ID NO: 688945 - RNA, 19 nt, Human
cagcuuguguccuugggag

SEQ ID NO: 688946 - RNA, 25 nt, Human
cccgccuuuuuuucuucucggccuc

SEQ ID NO: 688947 - RNA, 21 nt, Human
cccgcgacgcugccuuucuca

SEQ ID NO: 688948 - RNA, 23 nt, Human
ccuuuuguggcuucaagugucua

SEQ ID NO: 688949 - RNA, 19 nt, Human
cuuuuuuucuucucggccu

SEQ ID NO: 688950 - RNA, 19 nt, Human
gaccguuggcccuuggccg

SEQ ID NO: 688951 - RNA, 24 nt, Human
gacgcugccuuucucacuggucac

SEQ ID NO: 688952 - RNA, 22 nt, Human
gacggcucccgccuuuuuuucu

SEQ ID NO: 688953 - RNA, 23 nt, Human
ggcucccgccuuuuuuucuucuc

SEQ ID NO: 688954 - RNA, 21 nt, Human
uaaguacauuagagucaggaa

SEQ ID NO: 688955 - RNA, 18 nt, Human
ucagcccgcgacgcugcc

SEQ ID NO: 688956 - RNA, 21 nt, Human
uccacagacacagggcaaggg

SEQ ID NO: 688957 - RNA, 20 nt, Human
uccucgcgagcagaugagga

SEQ ID NO: 688958 - RNA, 20 nt, Human
ucgcgcacgcgcagugcugc

SEQ ID NO: 688959 - RNA, 24 nt, Human
ugaaaccuaaucagcccgcgacgc

SEQ ID NO: 688960 - RNA, 18 nt, Human
ugcugcggcaacgugggg

SEQ ID NO: 688961 - RNA, 19 nt, Human
uguaugcuuuguacaugua

SEQ ID NO: 688962 - RNA, 18 nt, Human
uguuccacagacacaggg

SEQ ID NO: 688963 - RNA, 19 nt, Human
uuagaaaccaauucggcgc

SEQ ID NO: 688964 - RNA, 19 nt, Human
uucgcaaggcagaagagag

SEQ ID NO: 688965 - RNA, 21 nt, Human
uugggagcugcagucuucucu

SEQ ID NO: 688966 - RNA, 22 nt, Human
uuguacauguaucaaggguccc

SEQ ID NO: 688967 - RNA, 24 nt, Human
acaagucugacuguuaugcccaaa

SEQ ID NO: 688968 - RNA, 18 nt, Human
agcccggcggcaacagcc

SEQ ID NO: 688969 - RNA, 21 nt, Human
caaggcggcgaccgcuccgcu

SEQ ID NO: 688970 - RNA, 20 nt, Human
cacugggugauaaaaggcug

SEQ ID NO: 688971 - RNA, 23 nt, Human
cagcccggcggcaacagccgcag

SEQ ID NO: 688972 - RNA, 18 nt, Human
ccggcggcaacagccgca

SEQ ID NO: 688973 - RNA, 24 nt, Human
ccggcggcaacagccgcagcuccc

SEQ ID NO: 688974 - RNA, 19 nt, Human
cggcgaccgcuccgcuggc

SEQ ID NO: 688975 - RNA, 21 nt, Human
ggcggcaacagccgcagcucc

SEQ ID NO: 688976 - RNA, 26 nt, Human
gguagugggaaaaguggucuuuguac

SEQ ID NO: 688977 - RNA, 21 nt, Human
ucugacuguuaugcccaaaga

SEQ ID NO: 688978 - RNA, 21 nt, Human
ugaugcagaggcuguuucuua

SEQ ID NO: 688979 - RNA, 21 nt, Human
ugcagguagugggaaaagugg

SEQ ID NO: 688980 - RNA, 23 nt, Human
ugcagguagugggaaaagugguc

SEQ ID NO: 688981 - RNA, 26 nt, Human
uggauucuucaacauaugacagaacc

SEQ ID NO: 688982 - RNA, 22 nt, Human
ugggugauaaaaggcugcagga

SEQ ID NO: 688983 - RNA, 22 nt, Human
uuaaucuucaaguuccucagca

SEQ ID NO: 688984 - RNA, 21 nt, Human
uuaaugguguauggauucuuc

SEQ ID NO: 688985 - RNA, 22 nt, Human
uuuuuuuuuucugaagagcaua

SEQ ID NO: 688986 - RNA, 20 nt, Human
uuuuuuuuuuucugaagagc

SEQ ID NO: 688987 - RNA, 18 nt, Human
uuuuuuuuuuuuuuucug

SEQ ID NO: 688988 - RNA, 19 nt, Human
uuuuuuuuuuuuuuuuucu

SEQ ID NO: 688989 - RNA, 19 nt, Human
cccugacaccggagagcuc

SEQ ID NO: 688990 - RNA, 21 nt, Human
ccuuacagaugccaggagcug

SEQ ID NO: 688991 - RNA, 24 nt, Human
ugauuuagucuccucuccuccuug

SEQ ID NO: 688992 - RNA, 22 nt, Human
uuagaauuccaguuuuuccguc

SEQ ID NO: 688993 - RNA, 23 nt, Human
uucucgcccugacaccggagagc

SEQ ID NO: 688994 - RNA, 22 nt, Human
uugaugugauuuagucuccucu

SEQ ID NO: 688995 - RNA, 22 nt, Human
aaaucagucucaguccgugugg

SEQ ID NO: 688996 - RNA, 19 nt, Human
aauacuggggccaaaaaag

SEQ ID NO: 688997 - RNA, 18 nt, Human
aggacagauguugauccc

SEQ ID NO: 688998 - RNA, 23 nt, Human
aggcggagguaaagaagagggac

SEQ ID NO: 688999 - RNA, 21 nt, Human
agggugucucccacaagucau

SEQ ID NO: 689000 - RNA, 24 nt, Human
caaacaccaccaaagcauuuagug

SEQ ID NO: 689001 - RNA, 22 nt, Human
caggggcugucacaaacccaug

SEQ ID NO: 689002 - RNA, 22 nt, Human
ccacucaaagucagcacagcgg

SEQ ID NO: 689003 - RNA, 22 nt, Human
cuaguagguguccaacaaaccc

SEQ ID NO: 689004 - RNA, 26 nt, Human
cuuaaagggcacugagcacgcagggg

SEQ ID NO: 689005 - RNA, 21 nt, Human
gguguccaacaaacccugcca

SEQ ID NO: 689006 - RNA, 21 nt, Human
uaaucaaaucagucucagucc

SEQ ID NO: 689007 - RNA, 21 nt, Human
uaggacagauguugaucccac

SEQ ID NO: 689008 - RNA, 19 nt, Human
ugggaagggaagcuaguag

SEQ ID NO: 689009 - RNA, 25 nt, Human
ugggaagggaagcuaguaggugucc

SEQ ID NO: 689010 - RNA, 18 nt, Human
uggggccaaaaaagaggg

SEQ ID NO: 689011 - RNA, 19 nt, Human
uguguguguguguugaaug

SEQ ID NO: 689012 - RNA, 22 nt, Human
acaagggaggacauuuucugca

SEQ ID NO: 689013 - RNA, 20 nt, Human
agcacaaaaguugaagauga

SEQ ID NO: 689014 - RNA, 23 nt, Human
aggccaagggcaggaacugagga

SEQ ID NO: 689015 - RNA, 23 nt, Human
agggaggacauuuucugcaguug

SEQ ID NO: 689016 - RNA, 21 nt, Human
caacuagguccugagaaagcc

SEQ ID NO: 689017 - RNA, 20 nt, Human
caguagcaacuagguccuga

SEQ ID NO: 689018 - RNA, 23 nt, Human
ccaguagcaacuagguccugaga

SEQ ID NO: 689019 - RNA, 18 nt, Human
ucucucguggaagaauaa

SEQ ID NO: 689020 - RNA, 18 nt, Human
ugagaaagcccucucucc

SEQ ID NO: 689021 - RNA, 24 nt, Human
uggaagaauaacagccaggcggga

SEQ ID NO: 689022 - RNA, 20 nt, Human
uggggcagaagauucuuccu

SEQ ID NO: 689023 - RNA, 21 nt, Human
uugugguacagggugaguaca

SEQ ID NO: 689024 - RNA, 22 nt, Human
uuuaggcaaaggggagcacaaa

SEQ ID NO: 689025 - RNA, 20 nt, Human
aaacaagagaggaauggagg

SEQ ID NO: 689026 - RNA, 20 nt, Human
aaacacaagcgaaggaaccg

SEQ ID NO: 689027 - RNA, 27 nt, Human
aacagcuuucuauccugaagccgacca

SEQ ID NO: 689028 - RNA, 20 nt, Human
aaccaaagcaugugagucuc

SEQ ID NO: 689029 - RNA, 21 nt, Human
aagaaggccaacaagucacaa

SEQ ID NO: 689030 - RNA, 19 nt, Human
aagcaaguuucagaugccu

SEQ ID NO: 689031 - RNA, 20 nt, Human
aaucagauucucugaaucug

SEQ ID NO: 689032 - RNA, 18 nt, Human
aaugaugccugggcuucc

SEQ ID NO: 689033 - RNA, 19 nt, Human
acccgaggagcugagcccc

SEQ ID NO: 689034 - RNA, 22 nt, Human
agaaacacaagcgaaggaacca

SEQ ID NO: 689035 - RNA, 18 nt, Human
agagaggaauggauugca

SEQ ID NO: 689036 - RNA, 23 nt, Human
aguacagaaacacaagcgaagga

SEQ ID NO: 689037 - RNA, 22 nt, Human
caacaagucacaaguagaucuc

SEQ ID NO: 689038 - RNA, 27 nt, Human
caugugagucucuucccugaguccauu

SEQ ID NO: 689039 - RNA, 20 nt, Human
ccaggugaccuacuggcuug

SEQ ID NO: 689040 - RNA, 18 nt, Human
ccccccccagucugaggc

SEQ ID NO: 689041 - RNA, 21 nt, Human
cccgaggagcugagccccccc

SEQ ID NO: 689042 - RNA, 21 nt, Human
cccuauuacacccaccggaaa

SEQ ID NO: 689043 - RNA, 21 nt, Human
ccugcgagcgucagagaugaa

SEQ ID NO: 689044 - RNA, 18 nt, Human
ccugggcuuccuccagga

SEQ ID NO: 689045 - RNA, 25 nt, Human
cuccaggagcaacacaauucccucc

SEQ ID NO: 689046 - RNA, 19 nt, Human
cucccacucaucugccaca

SEQ ID NO: 689047 - RNA, 22 nt, Human
cugagccccccccagucugagg

SEQ ID NO: 689048 - RNA, 19 nt, Human
gaacgugcacccccucuac

SEQ ID NO: 689049 - RNA, 19 nt, Human
gaugaagcaaguuucagau

SEQ ID NO: 689050 - RNA, 24 nt, Human
gccucgccuagugaaugcuccagc

SEQ ID NO: 689051 - RNA, 20 nt, Human
ggaaacacagauacuaacca

SEQ ID NO: 689052 - RNA, 22 nt, Human
ggaacgugcacccccucuaccc

SEQ ID NO: 689053 - RNA, 22 nt, Human
gggcagaggcacguuucccuuu

SEQ ID NO: 689054 - RNA, 22 nt, Human
ggggcuaauccccuauuacacc

SEQ ID NO: 689055 - RNA, 24 nt, Human
ggugaccuacuggcuuguuuaaug

SEQ ID NO: 689056 - RNA, 27 nt, Human
gucacaaguagaucucuggcuccaacu

SEQ ID NO: 689057 - RNA, 21 nt, Human
gucagagaugaagcaaguuuc

SEQ ID NO: 689058 - RNA, 19 nt, Human
gucugaggcagauguggga

SEQ ID NO: 689059 - RNA, 19 nt, Human
uaaaacgaaacagguggga

SEQ ID NO: 689060 - RNA, 21 nt, Human
uaaguacagaaacacaagcga

SEQ ID NO: 689061 - RNA, 18 nt, Human
uagaucucuggcuccaac

SEQ ID NO: 689062 - RNA, 20 nt, Human
ucagcucuccuuaucccugc

SEQ ID NO: 689063 - RNA, 18 nt, Human
ucagucccuucuggggcu

SEQ ID NO: 689064 - RNA, 19 nt, Human
uccaaucucagcucuccuu

SEQ ID NO: 689065 - RNA, 20 nt, Human
ucccuccaaucucagcucuc

SEQ ID NO: 689066 - RNA, 21 nt, Human
ucuaaagcuugucugaaagau

SEQ ID NO: 689067 - RNA, 22 nt, Human
ucuacccguggggcagaggcug

SEQ ID NO: 689068 - RNA, 27 nt, Human
ugaagugguagauuuuugacucuuuga

SEQ ID NO: 689069 - RNA, 19 nt, Human
ugaagugguagauuuuugg

SEQ ID NO: 689070 - RNA, 26 nt, Human
ugaagugguagauuuuugguaaguac

SEQ ID NO: 689071 - RNA, 22 nt, Human
ugaaucuggaaguuccaggaaa

SEQ ID NO: 689072 - RNA, 25 nt, Human
ugaggcagaugugggaagaaggcca

SEQ ID NO: 689073 - RNA, 22 nt, Human
ugaguccauuucucuaaagcuu

SEQ ID NO: 689074 - RNA, 22 nt, Human
ugaugccugggcuuccuccagg

SEQ ID NO: 689075 - RNA, 19 nt, Human
ugcacccccucuacccgug

SEQ ID NO: 689076 - RNA, 18 nt, Human
ugccugggcuuccuccag

SEQ ID NO: 689077 - RNA, 22 nt, Human
ugccugggcuuccuccaggagc

SEQ ID NO: 689078 - RNA, 21 nt, Human
ugggaagaaggccaacaaguc

SEQ ID NO: 689079 - RNA, 21 nt, Human
ugguugaaagcagcaaugcca

SEQ ID NO: 689080 - RNA, 19 nt, Human
ugucuccuaucaaaauuua

SEQ ID NO: 689081 - RNA, 19 nt, Human
ugucuccuaucaaaauuua

SEQ ID NO: 689082 - RNA, 18 nt, Human
uugaaagcagcaaugcca

SEQ ID NO: 689083 - RNA, 23 nt, Human
aaacucccuucuucaaccgacua

SEQ ID NO: 689084 - RNA, 23 nt, Human
aagauacuuuccauaaccaauca

SEQ ID NO: 689085 - RNA, 21 nt, Human
aauuuguuuuccccuccuuaa

SEQ ID NO: 689086 - RNA, 20 nt, Human
agaaaagaggacauaaaaaa

SEQ ID NO: 689087 - RNA, 21 nt, Human
agguuuugauuuuuuucccaa

SEQ ID NO: 689088 - RNA, 21 nt, Human
auaggcuccuuccccaaaaga

SEQ ID NO: 689089 - RNA, 21 nt, Human
aucauuaacaguauuuaacaa

SEQ ID NO: 689090 - RNA, 19 nt, Human
augaaguuuucauuugaug

SEQ ID NO: 689091 - RNA, 19 nt, Human
auguagcagcacacagccu

SEQ ID NO: 689092 - RNA, 19 nt, Human
caaaacuagaagagaaagg

SEQ ID NO: 689093 - RNA, 19 nt, Human
caagaggaagucucucaaa

SEQ ID NO: 689094 - RNA, 22 nt, Human
cagaaagccccuaucaaacccu

SEQ ID NO: 689095 - RNA, 19 nt, Human
cccaaaagacaacaaugaa

SEQ ID NO: 689096 - RNA, 21 nt, Human
ccuccuugugggagccaagag

SEQ ID NO: 689097 - RNA, 18 nt, Human
cucaaaacuagaagagaa

SEQ ID NO: 689098 - RNA, 18 nt, Human
gaaaagaggacauaaaaa

SEQ ID NO: 689099 - RNA, 20 nt, Human
gggcauggugaugauggcag

SEQ ID NO: 689100 - RNA, 19 nt, Human
ggugaugauggcaguggga

SEQ ID NO: 689101 - RNA, 21 nt, Human
gguuucacuggaaaguccaga

SEQ ID NO: 689102 - RNA, 25 nt, Human
guuuagagugaggguugaacaacuu

SEQ ID NO: 689103 - RNA, 21 nt, Human
uaaaguggcuaugugugucaa

SEQ ID NO: 689104 - RNA, 21 nt, Human
uauuucagcaggacaugggca

SEQ ID NO: 689105 - RNA, 19 nt, Human
ucaaccuuucucuugggca

SEQ ID NO: 689106 - RNA, 20 nt, Human
ucauuaacaguauuuaacaa

SEQ ID NO: 689107 - RNA, 22 nt, Human
uccacaacccagaaagagaacc

SEQ ID NO: 689108 - RNA, 25 nt, Human
uccacaacccagaaagagaaccgcu

SEQ ID NO: 689109 - RNA, 18 nt, Human
ucccaagccaaacuauac

SEQ ID NO: 689110 - RNA, 21 nt, Human
ucucaaaacuagaagagaaag

SEQ ID NO: 689111 - RNA, 21 nt, Human
ugaggguugaacaacuuuuca

SEQ ID NO: 689112 - RNA, 21 nt, Human
ugauuuuuuucccaagccaaa

SEQ ID NO: 689113 - RNA, 26 nt, Human
uguccuauucaaccuuucucuugggc

SEQ ID NO: 689114 - RNA, 19 nt, Human
uguucugugugcuaacaau

SEQ ID NO: 689115 - RNA, 23 nt, Human
uuaaaaauaguauuucaaacugu

SEQ ID NO: 689116 - RNA, 18 nt, Human
uugaacaacuuuucauga

SEQ ID NO: 689117 - RNA, 22 nt, Human
uuucaaacucccuucuucaacc

SEQ ID NO: 689118 - RNA, 20 nt, Human
aaaaaucaguucaggacaga

SEQ ID NO: 689119 - RNA, 24 nt, Human
aacaaucuucaaaaaccaggacag

SEQ ID NO: 689120 - RNA, 21 nt, Human
aacuauaaaauuuccacaagg

SEQ ID NO: 689121 - RNA, 23 nt, Human
aaggaaguguccugugugcuaac

SEQ ID NO: 689122 - RNA, 18 nt, Human
aagggaaucaagaacaau

SEQ ID NO: 689123 - RNA, 19 nt, Human
aaguacauauuaaaagcau

SEQ ID NO: 689124 - RNA, 21 nt, Human
aauuuccaaacuccccuccuc

SEQ ID NO: 689125 - RNA, 25 nt, Human
acaaucuucaaaaaccaggacagaa

SEQ ID NO: 689126 - RNA, 24 nt, Human
acacuguaaggcuuccgugccaaa

SEQ ID NO: 689127 - RNA, 24 nt, Human
acugcugugugugugugccaauua

SEQ ID NO: 689128 - RNA, 19 nt, Human
acuugcccuuuccacaaaa

SEQ ID NO: 689129 - RNA, 23 nt, Human
agacaaccacuucgaauaugaaa

SEQ ID NO: 689130 - RNA, 24 nt, Human
agcaauuuuacuucuagguguuua

SEQ ID NO: 689131 - RNA, 22 nt, Human
aggaauaagcaccuaaaaauau

SEQ ID NO: 689132 - RNA, 21 nt, Human
aggccacaucaaaacucucgg

SEQ ID NO: 689133 - RNA, 23 nt, Human
agugcagagacaaccacuucgaa

SEQ ID NO: 689134 - RNA, 19 nt, Human
auagugcagagacaaccac

SEQ ID NO: 689135 - RNA, 22 nt, Human
auaucaaaaaagauagcauaau

SEQ ID NO: 689136 - RNA, 19 nt, Human
augacuuuggguaggaaag

SEQ ID NO: 689137 - RNA, 24 nt, Human
auggcaaaaaauguuaacagguac

SEQ ID NO: 689138 - RNA, 18 nt, Human
augugaaaggcaaaacua

SEQ ID NO: 689139 - RNA, 23 nt, Human
auuuccaaacuccccuccuccaa

SEQ ID NO: 689140 - RNA, 25 nt, Human
caaacaguagagucacuauaaguac

SEQ ID NO: 689141 - RNA, 20 nt, Human
caaacuccccuccuccaaaa

SEQ ID NO: 689142 - RNA, 22 nt, Human
caacauaacuuaaaaaagccaa

SEQ ID NO: 689143 - RNA, 22 nt, Human
caacauaacuuaaaaaagccaa

SEQ ID NO: 689144 - RNA, 25 nt, Human
caaccacuucgaauaugaaaaaugu

SEQ ID NO: 689145 - RNA, 21 nt, Human
caaucuucaaaaaccaggaca

SEQ ID NO: 689146 - RNA, 21 nt, Human
caggaugaauccacaaacuga

SEQ ID NO: 689147 - RNA, 22 nt, Human
cauaaagcauuccuauagaucc

SEQ ID NO: 689148 - RNA, 24 nt, Human
cauaacuuaaaaaagccaaaauuc

SEQ ID NO: 689149 - RNA, 27 nt, Human
ccaggacagaaaauccuauuuucccuu

SEQ ID NO: 689150 - RNA, 19 nt, Human
cccacacuguaaggcuucc

SEQ ID NO: 689151 - RNA, 20 nt, Human
ccccuccuccaaaagucacc

SEQ ID NO: 689152 - RNA, 18 nt, Human
cccuuauguacugcugug

SEQ ID NO: 689153 - RNA, 18 nt, Human
cuuggcaaagauauaugu

SEQ ID NO: 689154 - RNA, 24 nt, Human
cuuuucaguaaauagugcagagac

SEQ ID NO: 689155 - RNA, 18 nt, Human
gaaaggacaaaaugaaaa

SEQ ID NO: 689156 - RNA, 24 nt, Human
gaaauaggcaacaaucuauaacau

SEQ ID NO: 689157 - RNA, 20 nt, Human
gaacaagaaagauuuucaga

SEQ ID NO: 689158 - RNA, 22 nt, Human
gauuuucagagaggguggacac

SEQ ID NO: 689159 - RNA, 21 nt, Human
gcuugagcaguccuguugggu

SEQ ID NO: 689160 - RNA, 21 nt, Human
ggaaaggaucuccccccaaaa

SEQ ID NO: 689161 - RNA, 18 nt, Human
ggacaggagaucuccaca

SEQ ID NO: 689162 - RNA, 18 nt, Human
gggaaagacugaccaaug

SEQ ID NO: 689163 - RNA, 22 nt, Human
guaaaaccagcaggaugaaucc

SEQ ID NO: 689164 - RNA, 24 nt, Human
guaaaccauaaagggaaagacuga

SEQ ID NO: 689165 - RNA, 20 nt, Human
guaaagcacucugcaaacag

SEQ ID NO: 689166 - RNA, 20 nt, Human
guaggaaaggaucucccccc

SEQ ID NO: 689167 - RNA, 19 nt, Human
guccuguugggugcuucug

SEQ ID NO: 689168 - RNA, 21 nt, Human
uaaaaccagcaggaugaaucc

SEQ ID NO: 689169 - RNA, 23 nt, Human
uaaaccauaaagggaaagacuga

SEQ ID NO: 689170 - RNA, 20 nt, Human
uaacaagacacaaaaagcgu

SEQ ID NO: 689171 - RNA, 23 nt, Human
uaacaagacacaaaaagcguaaa

SEQ ID NO: 689172 - RNA, 25 nt, Human
uaacaagacacaaaaagcguaaacc

SEQ ID NO: 689173 - RNA, 28 nt, Human
uaagaaguacauauuaaaaaggguuucc

SEQ ID NO: 689174 - RNA, 23 nt, Human
uaagaaguacauauuaaaagcau

SEQ ID NO: 689175 - RNA, 21 nt, Human
uacaaaucacuggggaaagga

SEQ ID NO: 689176 - RNA, 18 nt, Human
uaccagcuuggcaaagau

SEQ ID NO: 689177 - RNA, 22 nt, Human
uauagauccaugaggaaaggac

SEQ ID NO: 689178 - RNA, 22 nt, Human
uaucaaaaaagauagcauaaua

SEQ ID NO: 689179 - RNA, 19 nt, Human
uaugagcuuuucucaggcc

SEQ ID NO: 689180 - RNA, 20 nt, Human
uauguacugcugugugugug

SEQ ID NO: 689181 - RNA, 19 nt, Human
ucaguaaauagugcagaga

SEQ ID NO: 689182 - RNA, 21 nt, Human
ucaguaaauagugcagagaca

SEQ ID NO: 689183 - RNA, 19 nt, Human
uccaaaagucaccguaaaa

SEQ ID NO: 689184 - RNA, 20 nt, Human
uccaaacuccccuccuccaa

SEQ ID NO: 689185 - RNA, 23 nt, Human
uccaaacuccccuccuccaaaag

SEQ ID NO: 689186 - RNA, 22 nt, Human
uccacaaaagacaacaaggaag

SEQ ID NO: 689187 - RNA, 21 nt, Human
uccacaaacugaaaacaggaa

SEQ ID NO: 689188 - RNA, 22 nt, Human
uccccacacuguaaggcuuccg

SEQ ID NO: 689189 - RNA, 25 nt, Human
ucggggaaagaggagacacgaaguu

SEQ ID NO: 689190 - RNA, 24 nt, Human
ucuauaacauuuuacaauuuccaa

SEQ ID NO: 689191 - RNA, 22 nt, Human
ucuguccuccucacgcuguucc

SEQ ID NO: 689192 - RNA, 24 nt, Human
ugaaaaauguuaaguugaauuucu

SEQ ID NO: 689193 - RNA, 21 nt, Human
ugaaaacaggaaucuuggcuc

SEQ ID NO: 689194 - RNA, 19 nt, Human
ugacuuuggguaggaaagg

SEQ ID NO: 689195 - RNA, 19 nt, Human
ugagugaggaauaagcacc

SEQ ID NO: 689196 - RNA, 19 nt, Human
ugauggcaucggggaaaga

SEQ ID NO: 689197 - RNA, 18 nt, Human
ugccaaaguggcugacac

SEQ ID NO: 689198 - RNA, 19 nt, Human
ugcugugugugugugccaa

SEQ ID NO: 689199 - RNA, 24 nt, Human
ugggaaucaagggaaucaagaaca

SEQ ID NO: 689200 - RNA, 22 nt, Human
ugucagagaaucucuccuggga

SEQ ID NO: 689201 - RNA, 26 nt, Human
uuccaaacuccccuccuccaaaaguc

SEQ ID NO: 689202 - RNA, 25 nt, Human
uuuaacaagacacaaaaagcguaaa

SEQ ID NO: 689203 - RNA, 22 nt, Human
uuucaaacaguagagucacuau

SEQ ID NO: 689204 - RNA, 19 nt, Human
uuucucaggcccacuuuga

SEQ ID NO: 689205 - RNA, 21 nt, Human
aaaaaauaaaagcuuaagaac

SEQ ID NO: 689206 - RNA, 22 nt, Human
acuuucaaaaguuggaaaaaaa

SEQ ID NO: 689207 - RNA, 23 nt, Human
agagcugggguagaggugacugg

SEQ ID NO: 689208 - RNA, 19 nt, Human
agugcuuccaaucucccag

SEQ ID NO: 689209 - RNA, 24 nt, Human
ccucccaccgccauuucuguggcc

SEQ ID NO: 689210 - RNA, 19 nt, Human
ccuccucccaccgccauuu

SEQ ID NO: 689211 - RNA, 23 nt, Human
ccuccucccaccgccauuucugu

SEQ ID NO: 689212 - RNA, 25 nt, Human
cuuccaaucucccagugcuuauuuc

SEQ ID NO: 689213 - RNA, 18 nt, Human
gagaaaaaaauucaaaau

SEQ ID NO: 689214 - RNA, 18 nt, Human
ggaggcagggccggcgcc

SEQ ID NO: 689215 - RNA, 23 nt, Human
gugugauucccacguugguugug

SEQ ID NO: 689216 - RNA, 22 nt, Human
guugugcugcaaggaccagagg

SEQ ID NO: 689217 - RNA, 19 nt, Human
uagcagugcuuccaaucuc

SEQ ID NO: 689218 - RNA, 20 nt, Human
ucucccagugcuuauuucuc

SEQ ID NO: 689219 - RNA, 22 nt, Human
ucucccagugcuuauuucucuc

SEQ ID NO: 689220 - RNA, 26 nt, Human
ucuugcgaggaggucgugagaagagu

SEQ ID NO: 689221 - RNA, 20 nt, Human
ugaaauggaggcagggccgg

SEQ ID NO: 689222 - RNA, 19 nt, Human
ugagaagaguccuccuccc

SEQ ID NO: 689223 - RNA, 21 nt, Human
uggagcugugggaggucugga

SEQ ID NO: 689224 - RNA, 22 nt, Human
uggagcugugggaggucuggag

SEQ ID NO: 689225 - RNA, 18 nt, Human
uggccggguggucccacc

SEQ ID NO: 689226 - RNA, 19 nt, Human
ugggaggucuggagggugu

SEQ ID NO: 689227 - RNA, 18 nt, Human
ugucacagcugaaaugga

SEQ ID NO: 689228 - RNA, 19 nt, Human
ugugcugcaaggaccagag

SEQ ID NO: 689229 - RNA, 21 nt, Human
uguggccggguggucccaccc

SEQ ID NO: 689230 - RNA, 22 nt, Human
uuagcagugcuuccaaucuccc

SEQ ID NO: 689231 - RNA, 22 nt, Human
uugucacagcugaaauggaggc

SEQ ID NO: 689232 - RNA, 21 nt, Human
uugugcugcaaggaccagagg

SEQ ID NO: 689233 - RNA, 19 nt, Human
aaaaaauacuuccgccucu

SEQ ID NO: 689234 - RNA, 21 nt, Human
aaaaugcaccagaggccagca

SEQ ID NO: 689235 - RNA, 26 nt, Human
aaacaaacaaaaacuuaaaagucagg

SEQ ID NO: 689236 - RNA, 19 nt, Human
aaacgauuuggcauugugg

SEQ ID NO: 689237 - RNA, 18 nt, Human
aaacuuaaaagucaggug

SEQ ID NO: 689238 - RNA, 18 nt, Human
aaccuucaggucucuucc

SEQ ID NO: 689239 - RNA, 21 nt, Human
aagcaaaagacaaagaaaauc

SEQ ID NO: 689240 - RNA, 23 nt, Human
aagcaaaagacaaagaaaaucug

SEQ ID NO: 689241 - RNA, 26 nt, Human
aagcaguaccacaucucaaauaacca

SEQ ID NO: 689242 - RNA, 18 nt, Human
aaggaacaaaaagaaaua

SEQ ID NO: 689243 - RNA, 19 nt, Human
acaauaccaaggaacaaaa

SEQ ID NO: 689244 - RNA, 22 nt, Human
accaaggaacaaaaagaaauau

SEQ ID NO: 689245 - RNA, 18 nt, Human
accacaucucaaauaacc

SEQ ID NO: 689246 - RNA, 21 nt, Human
acccugcccugccccgccccc

SEQ ID NO: 689247 - RNA, 23 nt, Human
acccuggagcccccacugaagcu

SEQ ID NO: 689248 - RNA, 25 nt, Human
accuacugacaaaaauacaccacaa

SEQ ID NO: 689249 - RNA, 21 nt, Human
acgccuuucuucccagacugu

SEQ ID NO: 689250 - RNA, 20 nt, Human
acucugcaacccuggagccc

SEQ ID NO: 689251 - RNA, 23 nt, Human
acuggagcuuggcuuagccaaug

SEQ ID NO: 689252 - RNA, 20 nt, Human
agacuugugaggaagcaguc

SEQ ID NO: 689253 - RNA, 19 nt, Human
agaggcaggcgaaugccug

SEQ ID NO: 689254 - RNA, 23 nt, Human
agcaacacagcaagccacaaaaa

SEQ ID NO: 689255 - RNA, 18 nt, Human
agccaguuuaaugcuuuu

SEQ ID NO: 689256 - RNA, 24 nt, Human
agcguuugcugaugcagaacccac

SEQ ID NO: 689257 - RNA, 29 nt, Human
aggccagcacauuucacuaugacaggggu

SEQ ID NO: 689258 - RNA, 19 nt, Human
aggccaugugggucugccc

SEQ ID NO: 689259 - RNA, 23 nt, Human
aggugacucagggugauuggagg

SEQ ID NO: 689260 - RNA, 21 nt, Human
augcuagucuuauuacccagc

SEQ ID NO: 689261 - RNA, 20 nt, Human
augcuuuuuguucauguucu

SEQ ID NO: 689262 - RNA, 24 nt, Human
auuacaccaaaaaauacuuccgcc

SEQ ID NO: 689263 - RNA, 18 nt, Human
caaaaucagcucuucucu

SEQ ID NO: 689264 - RNA, 24 nt, Human
caaaaugcaccagaggccagcaca

SEQ ID NO: 689265 - RNA, 23 nt, Human
caacacgaaacaugccuuuguac

SEQ ID NO: 689266 - RNA, 18 nt, Human
caagcaaaagacaaagaa

SEQ ID NO: 689267 - RNA, 27 nt, Human
caagcaaaagacaaagaaaagggaccc

SEQ ID NO: 689268 - RNA, 23 nt, Human
caauaccaaggaacaaaaagaaa

SEQ ID NO: 689269 - RNA, 20 nt, Human
cacagcaagccacaaaaaaa

SEQ ID NO: 689270 - RNA, 22 nt, Human
cacagcaagccacaaaaaaaua

SEQ ID NO: 689271 - RNA, 18 nt, Human
caccaaaaaauacuuccg

SEQ ID NO: 689272 - RNA, 22 nt, Human
caccagaggccagcacauuuca

SEQ ID NO: 689273 - RNA, 24 nt, Human
caccccgccccccauucuggcugg

SEQ ID NO: 689274 - RNA, 22 nt, Human
cagagcccaggccauguggguc

SEQ ID NO: 689275 - RNA, 23 nt, Human
cagcaacacagcaagccacaaaa

SEQ ID NO: 689276 - RNA, 23 nt, Human
cagcaagccacaaaaaaauaccc

SEQ ID NO: 689277 - RNA, 18 nt, Human
caggaguccucccuccuc

SEQ ID NO: 689278 - RNA, 24 nt, Human
caggcgaaugccugauacgguucc

SEQ ID NO: 689279 - RNA, 21 nt, Human
ccacaaaaaaauacccuuuac

SEQ ID NO: 689280 - RNA, 18 nt, Human
ccagcugguucuggcccu

SEQ ID NO: 689281 - RNA, 24 nt, Human
cccacagagucugugcucuucacu

SEQ ID NO: 689282 - RNA, 18 nt, Human
cccaggccaugugggucu

SEQ ID NO: 689283 - RNA, 19 nt, Human
ccccacccugcccugcccc

SEQ ID NO: 689284 - RNA, 24 nt, Human
ccccacugaagcuacguuuucuua

SEQ ID NO: 689285 - RNA, 19 nt, Human
ccccauaucccaggaguac

SEQ ID NO: 689286 - RNA, 19 nt, Human
cccccacccugcccugccc

SEQ ID NO: 689287 - RNA, 20 nt, Human
cccccugcugcugucucguc

SEQ ID NO: 689288 - RNA, 25 nt, Human
cccgcccccauaucccaggaguaca

SEQ ID NO: 689289 - RNA, 25 nt, Human
cccgccccccauucuggcuggggcc

SEQ ID NO: 689290 - RNA, 21 nt, Human
cccgcccccgcccccauaucc

SEQ ID NO: 689291 - RNA, 27 nt, Human
cccgcccccgcccccauaucccaggag

SEQ ID NO: 689292 - RNA, 21 nt, Human
ccgcccccgcccccauauccc

SEQ ID NO: 689293 - RNA, 26 nt, Human
ccucccucucccccugcugcugucuc

SEQ ID NO: 689294 - RNA, 19 nt, Human
ccucuccaccccgcccccc

SEQ ID NO: 689295 - RNA, 19 nt, Human
ccuucccucccucuccccc

SEQ ID NO: 689296 - RNA, 22 nt, Human
cgaagugggcaaaagacagucc

SEQ ID NO: 689297 - RNA, 23 nt, Human
cgaaugccugauacgguuccagg

SEQ ID NO: 689298 - RNA, 22 nt, Human
cugcccugccccgcccccgccc

SEQ ID NO: 689299 - RNA, 18 nt, Human
cuggagcugacacccugc

SEQ ID NO: 689300 - RNA, 21 nt, Human
cugggcuuaguaaugccaaaa

SEQ ID NO: 689301 - RNA, 22 nt, Human
cugguucuggcccugugggucc

SEQ ID NO: 689302 - RNA, 21 nt, Human
cuuuguacaugagccugacuc

SEQ ID NO: 689303 - RNA, 21 nt, Human
gagcugacacccugcagaacu

SEQ ID NO: 689304 - RNA, 27 nt, Human
gccagcacauuucacuaugacaggggu

SEQ ID NO: 689305 - RNA, 20 nt, Human
gcccugccccgcccccgccc

SEQ ID NO: 689306 - RNA, 18 nt, Human
gcccuucaacgucuucug

SEQ ID NO: 689307 - RNA, 21 nt, Human
gccuuucuucccagacugugc

SEQ ID NO: 689308 - RNA, 23 nt, Human
gcguuugcugaugcagaacccac

SEQ ID NO: 689309 - RNA, 23 nt, Human
ggaaacaacaaacaaacaaaaac

SEQ ID NO: 689310 - RNA, 23 nt, Human
ggagcuuggcuuagccaaugggg

SEQ ID NO: 689311 - RNA, 22 nt, Human
gggaaacaacaaacaaacaaaa

SEQ ID NO: 689312 - RNA, 21 nt, Human
gggugauuggagguuggggga

SEQ ID NO: 689313 - RNA, 21 nt, Human
gguuaugugcguucugggcuu

SEQ ID NO: 689314 - RNA, 23 nt, Human
gucugugcucuucacugcccuuc

SEQ ID NO: 689315 - RNA, 22 nt, Human
gugggucugcccagguccuagg

SEQ ID NO: 689316 - RNA, 23 nt, Human
uaaaaauaucuuacaugggaaca

SEQ ID NO: 689317 - RNA, 22 nt, Human
uaacacaacgaagugggcaaaa

SEQ ID NO: 689318 - RNA, 21 nt, Human
uacaguguugucuuguaacug

SEQ ID NO: 689319 - RNA, 22 nt, Human
uacauuuuccuaacaaagaaua

SEQ ID NO: 689320 - RNA, 24 nt, Human
uacauuuuccuaacaaagaauaag

SEQ ID NO: 689321 - RNA, 19 nt, Human
uaccaaggaacaaaaagaa

SEQ ID NO: 689322 - RNA, 26 nt, Human
uaccacaucucaaauaaccaauucuc

SEQ ID NO: 689323 - RNA, 27 nt, Human
uaggauggaggcccagaaaguuugugc

SEQ ID NO: 689324 - RNA, 25 nt, Human
ucacaugccugucccgugccuuccu

SEQ ID NO: 689325 - RNA, 22 nt, Human
ucacugcccuucaacgucuucu

SEQ ID NO: 689326 - RNA, 23 nt, Human
ucacugcccuucaacgucuucug

SEQ ID NO: 689327 - RNA, 19 nt, Human
uccuggagcugacacccug

SEQ ID NO: 689328 - RNA, 18 nt, Human
uccuuuucugcuguuaca

SEQ ID NO: 689329 - RNA, 18 nt, Human
ucucuccagcucggccau

SEQ ID NO: 689330 - RNA, 23 nt, Human
ucugugucacucauacucugcaa

SEQ ID NO: 689331 - RNA, 25 nt, Human
ugaagaggaggaggacggccaggag

SEQ ID NO: 689332 - RNA, 24 nt, Human
ugacacccugcagaacuggccucc

SEQ ID NO: 689333 - RNA, 22 nt, Human
ugacucggcgacgaaucaacaa

SEQ ID NO: 689334 - RNA, 19 nt, Human
ugcagccgcaccuuccuuc

SEQ ID NO: 689335 - RNA, 22 nt, Human
uggagcugacacccugcagaac

SEQ ID NO: 689336 - RNA, 20 nt, Human
uggaggcccagaaaguuugu

SEQ ID NO: 689337 - RNA, 19 nt, Human
uggcauugugguggcccca

SEQ ID NO: 689338 - RNA, 22 nt, Human
uucaagccaauuugaagaggag

SEQ ID NO: 689339 - RNA, 19 nt, Human
uugcugaugcagaacccac

SEQ ID NO: 689340 - RNA, 23 nt, Human
aacacggcagaaaggggacaccu

SEQ ID NO: 689341 - RNA, 23 nt, Human
aagaacagaagaagagaggaagc

SEQ ID NO: 689342 - RNA, 25 nt, Human
aagaagcugcgggaaggacagcagg

SEQ ID NO: 689343 - RNA, 22 nt, Human
aagcugcgggaaggacagcagg

SEQ ID NO: 689344 - RNA, 22 nt, Human
aauguuaggaacacggcagaaa

SEQ ID NO: 689345 - RNA, 19 nt, Human
acagaagaagagaggaagc

SEQ ID NO: 689346 - RNA, 22 nt, Human
acggcagaaaggggacaccugg

SEQ ID NO: 689347 - RNA, 20 nt, Human
agaacaguaauacgcuagca

SEQ ID NO: 689348 - RNA, 23 nt, Human
agacaggaaucaaaauguuagga

SEQ ID NO: 689349 - RNA, 21 nt, Human
agacuccaagaagaagcugcg

SEQ ID NO: 689350 - RNA, 20 nt, Human
agagaagaaaucaaggccaa

SEQ ID NO: 689351 - RNA, 19 nt, Human
agggaagucacagaacagu

SEQ ID NO: 689352 - RNA, 21 nt, Human
caaacgcaggaugaggaguuc

SEQ ID NO: 689353 - RNA, 25 nt, Human
caaagccaagcccacugcagcugcc

SEQ ID NO: 689354 - RNA, 21 nt, Human
cacugcagcugccacaucccu

SEQ ID NO: 689355 - RNA, 18 nt, Human
cagcugccacaucccugg

SEQ ID NO: 689356 - RNA, 21 nt, Human
cagcugccacaucccugggcu

SEQ ID NO: 689357 - RNA, 24 nt, Human
caggaugaggaguucugcagaggu

SEQ ID NO: 689358 - RNA, 25 nt, Human
cauuucagcuucuggccacugggag

SEQ ID NO: 689359 - RNA, 22 nt, Human
cccacugcagcugccacauccc

SEQ ID NO: 689360 - RNA, 26 nt, Human
cggcagaaaggggacaccuggagacc

SEQ ID NO: 689361 - RNA, 19 nt, Human
cugcagcugccacaucccu

SEQ ID NO: 689362 - RNA, 24 nt, Human
cugcagcugccacaucccugggcu

SEQ ID NO: 689363 - RNA, 24 nt, Human
cugcugucauuucagcuucuggcc

SEQ ID NO: 689364 - RNA, 18 nt, Human
cuggccacugggaggugc

SEQ ID NO: 689365 - RNA, 21 nt, Human
gaaucaaaauguuaggaacac

SEQ ID NO: 689366 - RNA, 22 nt, Human
gaggaguucugcagaggucaca

SEQ ID NO: 689367 - RNA, 20 nt, Human
gcagcaggugcuuuuuucaa

SEQ ID NO: 689368 - RNA, 18 nt, Human
gcuagcaggggcaugggg

SEQ ID NO: 689369 - RNA, 21 nt, Human
gcuuacggugcagcaggugcu

SEQ ID NO: 689370 - RNA, 18 nt, Human
ggacagcagggguccugg

SEQ ID NO: 689371 - RNA, 23 nt, Human
ggcgugaagaacagaagaagaga

SEQ ID NO: 689372 - RNA, 21 nt, Human
gggacaccuggagaccaaacg

SEQ ID NO: 689373 - RNA, 18 nt, Human
ggugcuuuuuucaagaca

SEQ ID NO: 689374 - RNA, 20 nt, Human
gucacagggaagucacagaa

SEQ ID NO: 689375 - RNA, 18 nt, Human
gugaagaacagaagaaga

SEQ ID NO: 689376 - RNA, 26 nt, Human
gugaagaacagaagaagagaggaagc

SEQ ID NO: 689377 - RNA, 24 nt, Human
uaggaacacggcagaaaggggaca

SEQ ID NO: 689378 - RNA, 20 nt, Human
ucccugggcuuacggugcag

SEQ ID NO: 689379 - RNA, 24 nt, Human
uccugggguuuuagccucuggccc

SEQ ID NO: 689380 - RNA, 27 nt, Human
ugccacaucccugggcuuaccggcgcc

SEQ ID NO: 689381 - RNA, 23 nt, Human
uggacacacucaguuccucacaa

SEQ ID NO: 689382 - RNA, 22 nt, Human
ugggguuuuagccucuggccca

SEQ ID NO: 689383 - RNA, 23 nt, Human
agacagaacgacagcguucagga

SEQ ID NO: 689384 - RNA, 20 nt, Human
ccacacccaacagccgacca

SEQ ID NO: 689385 - RNA, 18 nt, Human
cccgaggggcgcugggaa

SEQ ID NO: 689386 - RNA, 22 nt, Human
cuccacacccaacagccgacca

SEQ ID NO: 689387 - RNA, 21 nt, Human
ggaaacagacagaacgacagc

SEQ ID NO: 689388 - RNA, 24 nt, Human
ggaaacuccacacccaacagccga

SEQ ID NO: 689389 - RNA, 23 nt, Human
uccacacccaacagccgaccacc

SEQ ID NO: 689390 - RNA, 19 nt, Human
uggcgccggagcagaacgc

SEQ ID NO: 689391 - RNA, 22 nt, Human
aaaaagcaagaauucacaagca

SEQ ID NO: 689392 - RNA, 21 nt, Human
aaacgcuccuaucaaaaugac

SEQ ID NO: 689393 - RNA, 26 nt, Human
aaagaauccaaaccuaagaacccaag

SEQ ID NO: 689394 - RNA, 21 nt, Human
aaagcaccaccaccuuugcca

SEQ ID NO: 689395 - RNA, 19 nt, Human
aacauggcuacccuaucuc

SEQ ID NO: 689396 - RNA, 21 nt, Human
aacauggcuacccuaucucuu

SEQ ID NO: 689397 - RNA, 19 nt, Human
aagaaagacacaggaagaa

SEQ ID NO: 689398 - RNA, 21 nt, Human
aagaauccaaaccuaagaacc

SEQ ID NO: 689399 - RNA, 18 nt, Human
aagcaagaauucacaagc

SEQ ID NO: 689400 - RNA, 19 nt, Human
aagcuuuguagaggguggc

SEQ ID NO: 689401 - RNA, 18 nt, Human
aaggaccaugcccugccc

SEQ ID NO: 689402 - RNA, 19 nt, Human
aaggcacgggucuccaagc

SEQ ID NO: 689403 - RNA, 24 nt, Human
aaucccaccccacugccucgcaga

SEQ ID NO: 689404 - RNA, 22 nt, Human
acagacauacaggacaccuccc

SEQ ID NO: 689405 - RNA, 23 nt, Human
acagaguguuucuuggcuccaaa

SEQ ID NO: 689406 - RNA, 21 nt, Human
accaccaccuuugccauccca

SEQ ID NO: 689407 - RNA, 21 nt, Human
accagcccugugugaaagaca

SEQ ID NO: 689408 - RNA, 20 nt, Human
accuccccacccucaccccc

SEQ ID NO: 689409 - RNA, 20 nt, Human
acuccuucaucuccuggccu

SEQ ID NO: 689410 - RNA, 23 nt, Human
agacacaggaagaauuuaaacaa

SEQ ID NO: 689411 - RNA, 30 nt, Human
agacaggcagauuccaacaugagaucagag

SEQ ID NO: 689412 - RNA, 25 nt, Human
agaggaaaaaagcaagaauucacaa

SEQ ID NO: 689413 - RNA, 20 nt, Human
agagggugagaacaggaugc

SEQ ID NO: 689414 - RNA, 23 nt, Human
agauccagaaguucuauaaagcu

SEQ ID NO: 689415 - RNA, 22 nt, Human
agcaccaccaccuuugccaucc

SEQ ID NO: 689416 - RNA, 21 nt, Human
aggaagaauuuaaacaagcca

SEQ ID NO: 689417 - RNA, 19 nt, Human
aggaaggggagcuuggcag

SEQ ID NO: 689418 - RNA, 21 nt, Human
aggcaaucaaaagggggaagc

SEQ ID NO: 689419 - RNA, 24 nt, Human
aguggacaggcuguuuugguuucu

SEQ ID NO: 689420 - RNA, 22 nt, Human
aucccaccccacugccucgcag

SEQ ID NO: 689421 - RNA, 22 nt, Human
caacaugagaucagaucaggcc

SEQ ID NO: 689422 - RNA, 24 nt, Human
caacuguuacaccccauucugccu

SEQ ID NO: 689423 - RNA, 19 nt, Human
caagcaaaacuggcaugua

SEQ ID NO: 689424 - RNA, 20 nt, Human
cacccucaccccccuuccag

SEQ ID NO: 689425 - RNA, 20 nt, Human
cagaagucccugccaggggc

SEQ ID NO: 689426 - RNA, 18 nt, Human
cagaaguuauaaauggua

SEQ ID NO: 689427 - RNA, 21 nt, Human
cagaauggaagcgguucugcu

SEQ ID NO: 689428 - RNA, 23 nt, Human
cagaauggaagcgguucugcuaa

SEQ ID NO: 689429 - RNA, 21 nt, Human
cagaguguuucuuggcuccaa

SEQ ID NO: 689430 - RNA, 18 nt, Human
cagcagcaguggacaggc

SEQ ID NO: 689431 - RNA, 18 nt, Human
cagcagggcuugcaugcg

SEQ ID NO: 689432 - RNA, 21 nt, Human
caggacaccucccaaauguaa

SEQ ID NO: 689433 - RNA, 18 nt, Human
caggagacgcugagcagc

SEQ ID NO: 689434 - RNA, 22 nt, Human
caggagacgcugagcagccagg

SEQ ID NO: 689435 - RNA, 18 nt, Human
cauacaggacaccuccca

SEQ ID NO: 689436 - RNA, 26 nt, Human
cauccccacagaggcaucucccagcc

SEQ ID NO: 689437 - RNA, 21 nt, Human
caucuggaaggcacgggucuc

SEQ ID NO: 689438 - RNA, 21 nt, Human
caugcccugccccaccucccc

SEQ ID NO: 689439 - RNA, 22 nt, Human
ccagcccugugugaaagacagg

SEQ ID NO: 689440 - RNA, 23 nt, Human
ccagugugccagguguaggaagg

SEQ ID NO: 689441 - RNA, 21 nt, Human
ccauaacccagaagucccugc

SEQ ID NO: 689442 - RNA, 18 nt, Human
ccaucuggaaggcacggg

SEQ ID NO: 689443 - RNA, 19 nt, Human
cccaaauguaaacgacagc

SEQ ID NO: 689444 - RNA, 22 nt, Human
cccaagcaucucuucuuuccac

SEQ ID NO: 689445 - RNA, 20 nt, Human
cccaccuccccacccucacc

SEQ ID NO: 689446 - RNA, 21 nt, Human
cccagugagcagacuaagcac

SEQ ID NO: 689447 - RNA, 23 nt, Human
cccauaacccagaagucccugcc

SEQ ID NO: 689448 - RNA, 24 nt, Human
ccccacccucaccccccuuccagu

SEQ ID NO: 689449 - RNA, 18 nt, Human
ccccauuucauccccaca

SEQ ID NO: 689450 - RNA, 20 nt, Human
ccgccgccacccucagcucg

SEQ ID NO: 689451 - RNA, 23 nt, Human
ccuaagaacccaagguucccaag

SEQ ID NO: 689452 - RNA, 25 nt, Human
ccuccccacccucaccccccuucca

SEQ ID NO: 689453 - RNA, 20 nt, Human
ccuggccuaaggucucuagu

SEQ ID NO: 689454 - RNA, 18 nt, Human
cgaggaaaagcaaucaag

SEQ ID NO: 689455 - RNA, 20 nt, Human
cgcaggaacucuucuucucc

SEQ ID NO: 689456 - RNA, 25 nt, Human
cucagagcaaagcugcugccgccac

SEQ ID NO: 689457 - RNA, 24 nt, Human
cuccaucacagcugcccaggggcu

SEQ ID NO: 689458 - RNA, 21 nt, Human
cucuguuaacagaugcccacc

SEQ ID NO: 689459 - RNA, 24 nt, Human
cucuucuuccucuuugguguaccu

SEQ ID NO: 689460 - RNA, 21 nt, Human
cugaagaugaaagcaccacca

SEQ ID NO: 689461 - RNA, 18 nt, Human
cuggcuccggguggagca

SEQ ID NO: 689462 - RNA, 23 nt, Human
cuuaauacaaauacagagacgag

SEQ ID NO: 689463 - RNA, 21 nt, Human
cuucuuccucuuugguguacc

SEQ ID NO: 689464 - RNA, 22 nt, Human
gaaagaaggcaggacagaugca

SEQ ID NO: 689465 - RNA, 20 nt, Human
gauaacuauuauuauuuggu

SEQ ID NO: 689466 - RNA, 23 nt, Human
gcagaccccagugugccaggugu

SEQ ID NO: 689467 - RNA, 21 nt, Human
gcagcccuugagggggauggg

SEQ ID NO: 689468 - RNA, 24 nt, Human
gcccaguaccgucacguccuauuu

SEQ ID NO: 689469 - RNA, 18 nt, Human
gccuuguaaaaauaacaa

SEQ ID NO: 689470 - RNA, 18 nt, Human
gcugccgccacccagacg

SEQ ID NO: 689471 - RNA, 18 nt, Human
gcuugcaugcgcaggaac

SEQ ID NO: 689472 - RNA, 27 nt, Human
ggaccaagaccagcccugugugaaaga

SEQ ID NO: 689473 - RNA, 22 nt, Human
ggagacgcugagcagccaggcu

SEQ ID NO: 689474 - RNA, 20 nt, Human
ggcggaaguaaagagcuuuu

SEQ ID NO: 689475 - RNA, 23 nt, Human
gggaugcuggauuuagcagccgu

SEQ ID NO: 689476 - RNA, 23 nt, Human
gggcagaggcuucugccugaaga

SEQ ID NO: 689477 - RNA, 20 nt, Human
gggcagcaugagaacugggc

SEQ ID NO: 689478 - RNA, 23 nt, Human
gggcuucugcuguaguucauauu

SEQ ID NO: 689479 - RNA, 22 nt, Human
ggggagcuuggcaggcggcucc

SEQ ID NO: 689480 - RNA, 24 nt, Human
guacagacauacaggacaccuccc

SEQ ID NO: 689481 - RNA, 25 nt, Human
gugaggcagcaugagccugacugaa

SEQ ID NO: 689482 - RNA, 23 nt, Human
guuucagauggcaggaacugggc

SEQ ID NO: 689483 - RNA, 21 nt, Human
uaaaaauaacaaaacgcuccu

SEQ ID NO: 689484 - RNA, 19 nt, Human
uaaaggaccaagaccagcc

SEQ ID NO: 689485 - RNA, 24 nt, Human
uaagaacccaagguucccaagcau

SEQ ID NO: 689486 - RNA, 20 nt, Human
uacacaugagugauggccag

SEQ ID NO: 689487 - RNA, 18 nt, Human
uacaggacaccucccaaa

SEQ ID NO: 689488 - RNA, 20 nt, Human
uacgccuccuccaucccaca

SEQ ID NO: 689489 - RNA, 24 nt, Human
uauuaaagaauccaaaccuaagaa

SEQ ID NO: 689490 - RNA, 22 nt, Human
uccaaaccuaagaacccaaggu

SEQ ID NO: 689491 - RNA, 23 nt, Human
ucccaagcaucucuucuuuccac

SEQ ID NO: 689492 - RNA, 21 nt, Human
ucccaccccacugccucgcag

SEQ ID NO: 689493 - RNA, 22 nt, Human
ucccaccccacugccucgcaga

SEQ ID NO: 689494 - RNA, 23 nt, Human
ucccaccccgcucauuugggcaa

SEQ ID NO: 689495 - RNA, 19 nt, Human
uccccacccucaccccccu

SEQ ID NO: 689496 - RNA, 21 nt, Human
uccccacccucaccccccuuc

SEQ ID NO: 689497 - RNA, 21 nt, Human
uccucuuugguguaccugaac

SEQ ID NO: 689498 - RNA, 25 nt, Human
ucggaaauaucugaauagauuuuua

SEQ ID NO: 689499 - RNA, 23 nt, Human
ugaaagacaggcagauuccaaca

SEQ ID NO: 689500 - RNA, 24 nt, Human
ugaaagcaccaccaccuuugccau

SEQ ID NO: 689501 - RNA, 26 nt, Human
ugaaagcaccaccaccuuugccaucc

SEQ ID NO: 689502 - RNA, 20 nt, Human
ugaagcacaaaccaccugaa

SEQ ID NO: 689503 - RNA, 20 nt, Human
ugaaucccaccccacugccu

SEQ ID NO: 689504 - RNA, 21 nt, Human
ugaaucccaccccacugccuc

SEQ ID NO: 689505 - RNA, 20 nt, Human
ugacggccaggagacgcuga

SEQ ID NO: 689506 - RNA, 18 nt, Human
ugacuugugaagggaacu

SEQ ID NO: 689507 - RNA, 22 nt, Human
ugacuugugaagggaacugucu

SEQ ID NO: 689508 - RNA, 23 nt, Human
ugacuuugaagcacaaaccaccu

SEQ ID NO: 689509 - RNA, 22 nt, Human
ugacuuugcuacugaacuccuu

SEQ ID NO: 689510 - RNA, 21 nt, Human
ugcaagaagaguaaugucagg

SEQ ID NO: 689511 - RNA, 26 nt, Human
ugcccugccccaccuccccacccuca

SEQ ID NO: 689512 - RNA, 18 nt, Human
uggacaggcuguuuuggu

SEQ ID NO: 689513 - RNA, 21 nt, Human
uggacaggugugacuuugcua

SEQ ID NO: 689514 - RNA, 19 nt, Human
uggcaggaacugggcacuu

SEQ ID NO: 689515 - RNA, 23 nt, Human
uggcaggaacugggcacuucaga

SEQ ID NO: 689516 - RNA, 20 nt, Human
uggcaggcggcuccugcagg

SEQ ID NO: 689517 - RNA, 19 nt, Human
uggccuaaggucucuaguc

SEQ ID NO: 689518 - RNA, 23 nt, Human
uggccuccacagcucuucuuccu

SEQ ID NO: 689519 - RNA, 21 nt, Human
ugggcaaaaggaaaugaaaac

SEQ ID NO: 689520 - RNA, 20 nt, Human
ugggcagaggcuucugccug

SEQ ID NO: 689521 - RNA, 26 nt, Human
uguaaaaauaacaaaacgcuccuauc

SEQ ID NO: 689522 - RNA, 19 nt, Human
uguguguagagucacacag

SEQ ID NO: 689523 - RNA, 22 nt, Human
uguuucaagaaaagacuacaga

SEQ ID NO: 689524 - RNA, 23 nt, Human
uguuuugguuucuuucagucauu

SEQ ID NO: 689525 - RNA, 24 nt, Human
uuagcagccgugaucuccagaaug

SEQ ID NO: 689526 - RNA, 24 nt, Human
uucccaucucugguuucucccaua

SEQ ID NO: 689527 - RNA, 20 nt, Human
uucugcuuacgccuccucca

SEQ ID NO: 689528 - RNA, 26 nt, Human
uuugccaucccauuagcugagugagc

SEQ ID NO: 689529 - RNA, 24 nt, Human
uuuuccucauucccaucucugguu

SEQ ID NO: 689530 - RNA, 19 nt, Human
aaaaagccuccccuccccu

SEQ ID NO: 689531 - RNA, 21 nt, Human
aaccagcgcccccauuccugg

SEQ ID NO: 689532 - RNA, 20 nt, Human
aagcccaaccagcgccccca

SEQ ID NO: 689533 - RNA, 19 nt, Human
accccgggcucggcggcac

SEQ ID NO: 689534 - RNA, 21 nt, Human
agaaagaaugcuuugccucca

SEQ ID NO: 689535 - RNA, 21 nt, Human
agaguccugggugcuguuccu

SEQ ID NO: 689536 - RNA, 19 nt, Human
agcagcccccuugcuucuc

SEQ ID NO: 689537 - RNA, 18 nt, Human
auggcucuggcagugccc

SEQ ID NO: 689538 - RNA, 24 nt, Human
augucuugugcugaaugaaauagg

SEQ ID NO: 689539 - RNA, 18 nt, Human
auucacugacucuuccuu

SEQ ID NO: 689540 - RNA, 23 nt, Human
caagaugaaggccagaggugccg

SEQ ID NO: 689541 - RNA, 25 nt, Human
caagaugaaggccagaggugccguu

SEQ ID NO: 689542 - RNA, 20 nt, Human
caagcccaaccagcgccccc

SEQ ID NO: 689543 - RNA, 21 nt, Human
caagcccaaccagcgccccca

SEQ ID NO: 689544 - RNA, 18 nt, Human
caaucaggaaaccauucu

SEQ ID NO: 689545 - RNA, 19 nt, Human
cacagaaagaaugcuuugc

SEQ ID NO: 689546 - RNA, 20 nt, Human
caccacaccacccucuggcc

SEQ ID NO: 689547 - RNA, 20 nt, Human
caccagugaugggugaagcc

SEQ ID NO: 689548 - RNA, 18 nt, Human
caccaugcaggcucaggc

SEQ ID NO: 689549 - RNA, 24 nt, Human
cacccagguaaggcaagucagaac

SEQ ID NO: 689550 - RNA, 18 nt, Human
caccgcagccauucacug

SEQ ID NO: 689551 - RNA, 19 nt, Human
caccgcagccauucacugg

SEQ ID NO: 689552 - RNA, 18 nt, Human
caccugguuagccccagg

SEQ ID NO: 689553 - RNA, 18 nt, Human
caccugguuagccccagg

SEQ ID NO: 689554 - RNA, 21 nt, Human
caccuucuaaaaucguauguc

SEQ ID NO: 689555 - RNA, 19 nt, Human
cacugcuggaggcuaccug

SEQ ID NO: 689556 - RNA, 22 nt, Human
cagcaccaagaugaaggccaga

SEQ ID NO: 689557 - RNA, 22 nt, Human
cagcccccuugcuucucugucc

SEQ ID NO: 689558 - RNA, 18 nt, Human
cagcgguccuggcugugg

SEQ ID NO: 689559 - RNA, 23 nt, Human
caggaacaaaauagucacagaaa

SEQ ID NO: 689560 - RNA, 19 nt, Human
ccaguucucagcgguccug

SEQ ID NO: 689561 - RNA, 21 nt, Human
ccaugguccuuuuaaggcccu

SEQ ID NO: 689562 - RNA, 19 nt, Human
cccccuugcuucucugucc

SEQ ID NO: 689563 - RNA, 20 nt, Human
ccccuggacaccacaccacc

SEQ ID NO: 689564 - RNA, 21 nt, Human
ccccuggacaccacaccaccc

SEQ ID NO: 689565 - RNA, 25 nt, Human
ccccuggacaccacaccacccucug

SEQ ID NO: 689566 - RNA, 25 nt, Human
cccugcaccagggccuaccuuguug

SEQ ID NO: 689567 - RNA, 21 nt, Human
cccuggacaccacaccacccu

SEQ ID NO: 689568 - RNA, 20 nt, Human
cccugggggcgccgcgcggg

SEQ ID NO: 689569 - RNA, 18 nt, Human
ccuaacgcugugugaugc

SEQ ID NO: 689570 - RNA, 24 nt, Human
ccuccccuccccucaccuucuaaa

SEQ ID NO: 689571 - RNA, 18 nt, Human
ccuccgcgccgcggcccg

SEQ ID NO: 689572 - RNA, 23 nt, Human
ccuuaggcuccuccccuggcccu

SEQ ID NO: 689573 - RNA, 23 nt, Human
ccuugcuucucugucccuccuca

SEQ ID NO: 689574 - RNA, 18 nt, Human
cgaggccuccgcgccgcg

SEQ ID NO: 689575 - RNA, 18 nt, Human
cgccgggauccacagcag

SEQ ID NO: 689576 - RNA, 18 nt, Human
cgcgcgggguccugggag

SEQ ID NO: 689577 - RNA, 22 nt, Human
cggcggcagcggaaguaaggaa

SEQ ID NO: 689578 - RNA, 22 nt, Human
cgucuucagccccaacauggga

SEQ ID NO: 689579 - RNA, 22 nt, Human
cucaaagacacuccccuucucu

SEQ ID NO: 689580 - RNA, 22 nt, Human
cucagaguccugggugcuguuc

SEQ ID NO: 689581 - RNA, 24 nt, Human
cuccgcgccgcggcccgucggguc

SEQ ID NO: 689582 - RNA, 22 nt, Human
cuggaggcuaccugggcgcugg

SEQ ID NO: 689583 - RNA, 19 nt, Human
cuggcucccuccuccaccc

SEQ ID NO: 689584 - RNA, 22 nt, Human
cugggugcuguuccugcaaccc

SEQ ID NO: 689585 - RNA, 18 nt, Human
cugugugaugcuuccucc

SEQ ID NO: 689586 - RNA, 19 nt, Human
gaggcccgccccaccuugc

SEQ ID NO: 689587 - RNA, 22 nt, Human
gcagccugagcuccaagcccaa

SEQ ID NO: 689588 - RNA, 19 nt, Human
gcccgccccaccuugcccc

SEQ ID NO: 689589 - RNA, 22 nt, Human
gccgggccugugggcgaagcgc

SEQ ID NO: 689590 - RNA, 21 nt, Human
gccuggcucccuccuccaccc

SEQ ID NO: 689591 - RNA, 22 nt, Human
gcgcuagaccggcuuugggggc

SEQ ID NO: 689592 - RNA, 19 nt, Human
ggagaagacagguggagau

SEQ ID NO: 689593 - RNA, 22 nt, Human
ggcagcggaaguaaggaagacg

SEQ ID NO: 689594 - RNA, 18 nt, Human
ggcauggauucuggaaag

SEQ ID NO: 689595 - RNA, 18 nt, Human
ggguccugggagcucggg

SEQ ID NO: 689596 - RNA, 24 nt, Human
gguucagaagcauggaccagcauu

SEQ ID NO: 689597 - RNA, 18 nt, Human
guggcggcggcggcagcg

SEQ ID NO: 689598 - RNA, 18 nt, Human
gugguggaggaaggguca

SEQ ID NO: 689599 - RNA, 21 nt, Human
uaaugcacgcagggguguggg

SEQ ID NO: 689600 - RNA, 18 nt, Human
uacacaggcauggauucu

SEQ ID NO: 689601 - RNA, 23 nt, Human
uaccugggcgcuggguuuuauug

SEQ ID NO: 689602 - RNA, 24 nt, Human
uagaaaaagccuccccuccccuca

SEQ ID NO: 689603 - RNA, 21 nt, Human
ucagaguccugggugcuguuc

SEQ ID NO: 689604 - RNA, 22 nt, Human
ucagaguccugggugcuguucc

SEQ ID NO: 689605 - RNA, 19 nt, Human
ucagaucuucaccugguua

SEQ ID NO: 689606 - RNA, 20 nt, Human
ucagcagcccccuugcuucu

SEQ ID NO: 689607 - RNA, 20 nt, Human
ucagccccaacaugggagcu

SEQ ID NO: 689608 - RNA, 22 nt, Human
uccacaauugucgcagcaccaa

SEQ ID NO: 689609 - RNA, 23 nt, Human
uccccucugaggugagcaaaggc

SEQ ID NO: 689610 - RNA, 22 nt, Human
uccccugaacugagguucuugu

SEQ ID NO: 689611 - RNA, 21 nt, Human
uccgcgccgcggcccgucggg

SEQ ID NO: 689612 - RNA, 24 nt, Human
uccucagaucugaugcugcaaaag

SEQ ID NO: 689613 - RNA, 19 nt, Human
uccugggagcucgggaggc

SEQ ID NO: 689614 - RNA, 19 nt, Human
uccugggugcuguuccugc

SEQ ID NO: 689615 - RNA, 20 nt, Human
ucugucccuccucagagucc

SEQ ID NO: 689616 - RNA, 19 nt, Human
ugacucuuccuucugcagc

SEQ ID NO: 689617 - RNA, 27 nt, Human
ugccaggaagccgcacugcuggaggcu

SEQ ID NO: 689618 - RNA, 24 nt, Human
ugccccgaggccuccgcgccgcgg

SEQ ID NO: 689619 - RNA, 19 nt, Human
ugccccugcucgucuucag

SEQ ID NO: 689620 - RNA, 22 nt, Human
ugccccugcucgucuucagccc

SEQ ID NO: 689621 - RNA, 19 nt, Human
ugcuggaggcuaccugggc

SEQ ID NO: 689622 - RNA, 24 nt, Human
ugcuguuccugcaacccaccagug

SEQ ID NO: 689623 - RNA, 19 nt, Human
uggaccccuggacaccaca

SEQ ID NO: 689624 - RNA, 23 nt, Human
uggaccccuggacaccacaccac

SEQ ID NO: 689625 - RNA, 22 nt, Human
uggagcggcgcucguccggguc

SEQ ID NO: 689626 - RNA, 18 nt, Human
uggcggcggcggcagcgg

SEQ ID NO: 689627 - RNA, 18 nt, Human
uggcucccuccuccaccc

SEQ ID NO: 689628 - RNA, 19 nt, Human
uggcucccuccuccacccc

SEQ ID NO: 689629 - RNA, 19 nt, Human
ugggagcucgggaggcccg

SEQ ID NO: 689630 - RNA, 25 nt, Human
ugguuacccaccuuccagucacaug

SEQ ID NO: 689631 - RNA, 22 nt, Human
ugucccaguucucagcgguccu

SEQ ID NO: 689632 - RNA, 22 nt, Human
ugucuugugcugaaugaaauag

SEQ ID NO: 689633 - RNA, 21 nt, Human
ugugggcaggguccucagagc

SEQ ID NO: 689634 - RNA, 20 nt, Human
uguuccugcaacccaccagu

SEQ ID NO: 689635 - RNA, 19 nt, Human
uucucagguagaaaaagcc

SEQ ID NO: 689636 - RNA, 25 nt, Human
uuuaaggcccucaaagacacucccu

SEQ ID NO: 689637 - RNA, 27 nt, Human
aaaaauauagaggauuugagccacaac

SEQ ID NO: 689638 - RNA, 19 nt, Human
aaauauagaggauuugagc

SEQ ID NO: 689639 - RNA, 21 nt, Human
aauguaugggagugagaaaga

SEQ ID NO: 689640 - RNA, 19 nt, Human
acauuugaagaaugaggaa

SEQ ID NO: 689641 - RNA, 19 nt, Human
acucaggaucuggaguucc

SEQ ID NO: 689642 - RNA, 24 nt, Human
agaggauuugagccacaacuggcc

SEQ ID NO: 689643 - RNA, 24 nt, Human
agccugaaauuuguugacaugggg

SEQ ID NO: 689644 - RNA, 20 nt, Human
auguaugggagugagaaaga

SEQ ID NO: 689645 - RNA, 20 nt, Human
caaaaaacaaggcuagcucc

SEQ ID NO: 689646 - RNA, 19 nt, Human
caguggauuuuccuuuuaa

SEQ ID NO: 689647 - RNA, 18 nt, Human
cccugggucuggggcauc

SEQ ID NO: 689648 - RNA, 21 nt, Human
ccuccuauuucucccucccca

SEQ ID NO: 689649 - RNA, 21 nt, Human
cucccugggccugcccgcaua

SEQ ID NO: 689650 - RNA, 20 nt, Human
cugcugccugcucccugggc

SEQ ID NO: 689651 - RNA, 24 nt, Human
gaaauuuguugacauggggcagga

SEQ ID NO: 689652 - RNA, 18 nt, Human
gaggaagagaggacagag

SEQ ID NO: 689653 - RNA, 19 nt, Human
gcccugggucuggggcauc

SEQ ID NO: 689654 - RNA, 19 nt, Human
ggagggaacauugaggguu

SEQ ID NO: 689655 - RNA, 18 nt, Human
ggugccagaguagaagga

SEQ ID NO: 689656 - RNA, 19 nt, Human
uacaagguuagagcccugg

SEQ ID NO: 689657 - RNA, 19 nt, Human
uaugggagugagaaagaug

SEQ ID NO: 689658 - RNA, 19 nt, Human
ucaggacacugaagggagg

SEQ ID NO: 689659 - RNA, 22 nt, Human
ugagccacaacuggcccacauu

SEQ ID NO: 689660 - RNA, 20 nt, Human
uggagaaaguccuguuccuc

SEQ ID NO: 689661 - RNA, 21 nt, Human
uggggcauccuuagccugaaa

SEQ ID NO: 689662 - RNA, 19 nt, Human
uuugaagaaugaggaacaa

SEQ ID NO: 689663 - RNA, 23 nt, Human
uuuuuuuuuuuuuuagcagugga

SEQ ID NO: 689664 - RNA, 22 nt, Human
aaaagguaaaaacaacucuucc

SEQ ID NO: 689665 - RNA, 27 nt, Human
aaacguuaacaauuccaaaacuaaacu

SEQ ID NO: 689666 - RNA, 18 nt, Human
acaacucuuccuuguacu

SEQ ID NO: 689667 - RNA, 22 nt, Human
acuguuugccucauuuaucaag

SEQ ID NO: 689668 - RNA, 26 nt, Human
caacagguucuucuuuuuguuaguuu

SEQ ID NO: 689669 - RNA, 24 nt, Human
ccucauuuaucaagaaaauuuaca

SEQ ID NO: 689670 - RNA, 24 nt, Human
uaaauguaagaagacuaguacuca

SEQ ID NO: 689671 - RNA, 19 nt, Human
uaacaggagcuuguugaaa

SEQ ID NO: 689672 - RNA, 18 nt, Human
uacaagggaagaagccau

SEQ ID NO: 689673 - RNA, 18 nt, Human
ucggucaguuugccgguc

SEQ ID NO: 689674 - RNA, 23 nt, Human
ucucccaaaagcauaaaaaugga

SEQ ID NO: 689675 - RNA, 26 nt, Human
ucucccaaaagcauaaaaauggagac

SEQ ID NO: 689676 - RNA, 22 nt, Human
ugaggcggcgccagucgcagcc

SEQ ID NO: 689677 - RNA, 24 nt, Human
ugggaggcggugaggcggcgccag

SEQ ID NO: 689678 - RNA, 25 nt, Human
ugggaggcggugaggcggcgccagu

SEQ ID NO: 689679 - RNA, 24 nt, Human
uuuuuggucccaagucuguuccug

SEQ ID NO: 689680 - RNA, 18 nt, Human
aaacuaccccccacccca

SEQ ID NO: 689681 - RNA, 19 nt, Human
aaacuaccccccaccccaa

SEQ ID NO: 689682 - RNA, 24 nt, Human
aaacuaccccccaccccaaccccc

SEQ ID NO: 689683 - RNA, 26 nt, Human
aaacuaccccccaccccaacccccac

SEQ ID NO: 689684 - RNA, 19 nt, Human
aaagggaaggggagggaag

SEQ ID NO: 689685 - RNA, 22 nt, Human
aacuaccccccaccccaacccc

SEQ ID NO: 689686 - RNA, 25 nt, Human
aacuaccccccaccccaacccccac

SEQ ID NO: 689687 - RNA, 29 nt, Human
aaggaagagaggaagggggagggaagggg

SEQ ID NO: 689688 - RNA, 22 nt, Human
acaaaaauguguauguggggcc

SEQ ID NO: 689689 - RNA, 24 nt, Human
acaacaaaguaaacuaccccccac

SEQ ID NO: 689690 - RNA, 18 nt, Human
accccaacccccacccag

SEQ ID NO: 689691 - RNA, 22 nt, Human
accccccaccccaacccccacc

SEQ ID NO: 689692 - RNA, 19 nt, Human
acuaccccccaccccaacc

SEQ ID NO: 689693 - RNA, 23 nt, Human
acuaccccccaccccaaccccca

SEQ ID NO: 689694 - RNA, 20 nt, Human
agaaucagcaaguucacucc

SEQ ID NO: 689695 - RNA, 24 nt, Human
agacauuuugcuaguauaaaaacg

SEQ ID NO: 689696 - RNA, 27 nt, Human
agagaggaagggggagggaaggggagc

SEQ ID NO: 689697 - RNA, 21 nt, Human
aggaaggaagagaggaagggg

SEQ ID NO: 689698 - RNA, 21 nt, Human
aggaagggggagggaagggga

SEQ ID NO: 689699 - RNA, 24 nt, Human
aggcaaauagaggaacacccccaa

SEQ ID NO: 689700 - RNA, 20 nt, Human
aggcggugugugugaggggg

SEQ ID NO: 689701 - RNA, 19 nt, Human
agggaaggggagggaagga

SEQ ID NO: 689702 - RNA, 20 nt, Human
agggaaggggagggaaggaa

SEQ ID NO: 689703 - RNA, 21 nt, Human
agggcaaaacagggaaggcgg

SEQ ID NO: 689704 - RNA, 19 nt, Human
aggggagggaaggaaggaa

SEQ ID NO: 689705 - RNA, 20 nt, Human
aggggguggggcuuaggagu

SEQ ID NO: 689706 - RNA, 23 nt, Human
agguggcaggcaaauagaggaac

SEQ ID NO: 689707 - RNA, 21 nt, Human
aguucacucccucccuccccc

SEQ ID NO: 689708 - RNA, 18 nt, Human
auagaaaacgcuguagcc

SEQ ID NO: 689709 - RNA, 25 nt, Human
caacaaaguaaacuaccccccaccc

SEQ ID NO: 689710 - RNA, 19 nt, Human
cacucccucccucccccca

SEQ ID NO: 689711 - RNA, 21 nt, Human
cacucccucccuccccccaaa

SEQ ID NO: 689712 - RNA, 24 nt, Human
cacucccucccuccccccaaaaaa

SEQ ID NO: 689713 - RNA, 30 nt, Human
cagcaaguucacucccucccuccccccaag

SEQ ID NO: 689714 - RNA, 24 nt, Human
ccaacccccacccagguuuugcua

SEQ ID NO: 689715 - RNA, 19 nt, Human
ccaaguaauaauaaaaaaa

SEQ ID NO: 689716 - RNA, 19 nt, Human
ccaccgcuaccgccgccgc

SEQ ID NO: 689717 - RNA, 23 nt, Human
cccaaaaaacacaaauuaaaaca

SEQ ID NO: 689718 - RNA, 18 nt, Human
ccccaacccccacccagg

SEQ ID NO: 689719 - RNA, 18 nt, Human
ccccaaggguaagcagcc

SEQ ID NO: 689720 - RNA, 23 nt, Human
cccccacccagguuuugcuacag

SEQ ID NO: 689721 - RNA, 19 nt, Human
cccccaccccaacccccac

SEQ ID NO: 689722 - RNA, 26 nt, Human
cccccaccccaacccccacccagguu

SEQ ID NO: 689723 - RNA, 20 nt, Human
ccccccaccccaacccccac

SEQ ID NO: 689724 - RNA, 22 nt, Human
ccccccaccccaacccccaccc

SEQ ID NO: 689725 - RNA, 18 nt, Human
cccuccccccaaaaaacc

SEQ ID NO: 689726 - RNA, 23 nt, Human
ccgagguuucgccgucgccgccg

SEQ ID NO: 689727 - RNA, 19 nt, Human
ccuauagccacucccaggc

SEQ ID NO: 689728 - RNA, 23 nt, Human
ccuauagccacucccaggcauuu

SEQ ID NO: 689729 - RNA, 20 nt, Human
ccuccgcuccccccucgucc

SEQ ID NO: 689730 - RNA, 22 nt, Human
cgaggagacuggaagacaacca

SEQ ID NO: 689731 - RNA, 22 nt, Human
cuacacagcuugggcccagccg

SEQ ID NO: 689732 - RNA, 24 nt, Human
cuaccccccaccccaacccccacc

SEQ ID NO: 689733 - RNA, 20 nt, Human
cuaccccuauagccacuccc

SEQ ID NO: 689734 - RNA, 20 nt, Human
cuaccgccgccgccgccacc

SEQ ID NO: 689735 - RNA, 23 nt, Human
cuaccgccgccgccgccaccucc

SEQ ID NO: 689736 - RNA, 25 nt, Human
cuccccccaaaaaacacaaauuaaa

SEQ ID NO: 689737 - RNA, 20 nt, Human
cuggaagacaaccaaggcca

SEQ ID NO: 689738 - RNA, 21 nt, Human
gaagggggagggaaggggagc

SEQ ID NO: 689739 - RNA, 22 nt, Human
gaagggggagggaaggggagcg

SEQ ID NO: 689740 - RNA, 19 nt, Human
gagagacaagagagguggc

SEQ ID NO: 689741 - RNA, 22 nt, Human
gaggaagggggagggaagggga

SEQ ID NO: 689742 - RNA, 22 nt, Human
gauccaaguagauuucauagaa

SEQ ID NO: 689743 - RNA, 21 nt, Human
ggaagagaggaagggggaggg

SEQ ID NO: 689744 - RNA, 20 nt, Human
ggaaggaaggaagagaggaa

SEQ ID NO: 689745 - RNA, 25 nt, Human
ggaaggcggugugugugagggggug

SEQ ID NO: 689746 - RNA, 22 nt, Human
gggaaggaaggaagagaggaag

SEQ ID NO: 689747 - RNA, 21 nt, Human
gggaagggaaaaagggaaggg

SEQ ID NO: 689748 - RNA, 24 nt, Human
gggccgaguccaucuucagaggga

SEQ ID NO: 689749 - RNA, 19 nt, Human
ggggagggaaggggagcgg

SEQ ID NO: 689750 - RNA, 18 nt, Human
ggggguggggcuuaggag

SEQ ID NO: 689751 - RNA, 19 nt, Human
guaaacuaccccccacccc

SEQ ID NO: 689752 - RNA, 23 nt, Human
guccaaguaauaauaaaaaaaua

SEQ ID NO: 689753 - RNA, 18 nt, Human
uaaaaaaauagaguccau

SEQ ID NO: 689754 - RNA, 19 nt, Human
uaaaaaaauagaguccauc

SEQ ID NO: 689755 - RNA, 24 nt, Human
uaaacuaccccccaccccaacccc

SEQ ID NO: 689756 - RNA, 19 nt, Human
uacagaaucagcaaguuca

SEQ ID NO: 689757 - RNA, 19 nt, Human
uaccccccaccccaacccc

SEQ ID NO: 689758 - RNA, 22 nt, Human
uaccccccaccccaacccccac

SEQ ID NO: 689759 - RNA, 20 nt, Human
uaccccuauagccacuccca

SEQ ID NO: 689760 - RNA, 23 nt, Human
uagaaaacgcuguagccagguua

SEQ ID NO: 689761 - RNA, 23 nt, Human
ucacucccucccuccccccaaaa

SEQ ID NO: 689762 - RNA, 20 nt, Human
uccaaguaauaauaaaaaaa

SEQ ID NO: 689763 - RNA, 26 nt, Human
ucccccaagggcaaaacagggaaggc

SEQ ID NO: 689764 - RNA, 23 nt, Human
ucccuccccccaaaaaacacaaa

SEQ ID NO: 689765 - RNA, 23 nt, Human
ugacuguaacacaaaaaugugua

SEQ ID NO: 689766 - RNA, 20 nt, Human
ugcccccgcccugcgagcuc

SEQ ID NO: 689767 - RNA, 19 nt, Human
ugcuacagaaucagcaagu

SEQ ID NO: 689768 - RNA, 22 nt, Human
uggaagacaaccaaggccaccg

SEQ ID NO: 689769 - RNA, 21 nt, Human
uguaacacaaaaauguguaug

SEQ ID NO: 689770 - RNA, 21 nt, Human
ugugaggggguggggcuuagg

SEQ ID NO: 689771 - RNA, 21 nt, Human
uucacucccucccucccccca

SEQ ID NO: 689772 - RNA, 18 nt, Human
uucagagggagagacaga

SEQ ID NO: 689773 - RNA, 21 nt, Human
uuucgccgucgccgccguuau

SEQ ID NO: 689774 - RNA, 22 nt, Human
aaaaagacaaagcuacaacaga

SEQ ID NO: 689775 - RNA, 18 nt, Human
aaaacaguagacaugggu

SEQ ID NO: 689776 - RNA, 23 nt, Human
aaaagaaaaagaaaaagacaaag

SEQ ID NO: 689777 - RNA, 25 nt, Human
aacaccgccaccauauccaccaccu

SEQ ID NO: 689778 - RNA, 22 nt, Human
aacauucuuuacacccaaaacc

SEQ ID NO: 689779 - RNA, 21 nt, Human
aaccaaauagaaauuuugaga

SEQ ID NO: 689780 - RNA, 23 nt, Human
aacuaccaaagaaggaguaacag

SEQ ID NO: 689781 - RNA, 21 nt, Human
aagaguguguucuuugucuuu

SEQ ID NO: 689782 - RNA, 23 nt, Human
aaggaaacaccuucgaaacugca

SEQ ID NO: 689783 - RNA, 24 nt, Human
aauaguaauuaacaaugaucuucu

SEQ ID NO: 689784 - RNA, 20 nt, Human
acaaggaaacaccuucgaaa

SEQ ID NO: 689785 - RNA, 26 nt, Human
acacacauauauauaccuguauauau

SEQ ID NO: 689786 - RNA, 21 nt, Human
acagauaaaagaaccucagga

SEQ ID NO: 689787 - RNA, 18 nt, Human
acaggacucaccucuucc

SEQ ID NO: 689788 - RNA, 24 nt, Human
acaguacaaacaggaaagcaugcc

SEQ ID NO: 689789 - RNA, 19 nt, Human
acccaaaaccuauggcagc

SEQ ID NO: 689790 - RNA, 21 nt, Human
accuugguuuccauauccugg

SEQ ID NO: 689791 - RNA, 18 nt, Human
acuaccacaauuuacagg

SEQ ID NO: 689792 - RNA, 19 nt, Human
acuuccaccaccagaucca

SEQ ID NO: 689793 - RNA, 20 nt, Human
agaaaaagacaaagcuacaa

SEQ ID NO: 689794 - RNA, 22 nt, Human
agacaggacucaccucuuccaa

SEQ ID NO: 689795 - RNA, 23 nt, Human
agcaacaagagagcauauucaaa

SEQ ID NO: 689796 - RNA, 20 nt, Human
aggacucaccucuuccaacu

SEQ ID NO: 689797 - RNA, 18 nt, Human
agggacugcccgagcuuc

SEQ ID NO: 689798 - RNA, 23 nt, Human
auagauuccccuuaaacugcaag

SEQ ID NO: 689799 - RNA, 19 nt, Human
auauaccuguauauauaua

SEQ ID NO: 689800 - RNA, 25 nt, Human
auauauauauauauguauauaugua

SEQ ID NO: 689801 - RNA, 19 nt, Human
auauauccauauauauaua

SEQ ID NO: 689802 - RNA, 19 nt, Human
auauauccauauauauaua

SEQ ID NO: 689803 - RNA, 19 nt, Human
auauaucuauauauauaca

SEQ ID NO: 689804 - RNA, 18 nt, Human
auguauauauguauauac

SEQ ID NO: 689805 - RNA, 21 nt, Human
caaaaaauguaaacuaaugca

SEQ ID NO: 689806 - RNA, 23 nt, Human
caaauugguaacaacaugauuua

SEQ ID NO: 689807 - RNA, 19 nt, Human
caacaccgccaccauaucc

SEQ ID NO: 689808 - RNA, 22 nt, Human
caccaccagauccauaaccacc

SEQ ID NO: 689809 - RNA, 23 nt, Human
caccacuuccaccaccagaucca

SEQ ID NO: 689810 - RNA, 25 nt, Human
caccagauccauaaccaccaccaua

SEQ ID NO: 689811 - RNA, 22 nt, Human
caccauaguuacuaccgucaaa

SEQ ID NO: 689812 - RNA, 22 nt, Human
cacccaaaaccuauggcagcag

SEQ ID NO: 689813 - RNA, 22 nt, Human
cagcagguguuucuuuacaguu

SEQ ID NO: 689814 - RNA, 21 nt, Human
caguacaaacaggaaagcaug

SEQ ID NO: 689815 - RNA, 20 nt, Human
cauacccgccucuacuacua

SEQ ID NO: 689816 - RNA, 20 nt, Human
cauauccuccaacaccgcca

SEQ ID NO: 689817 - RNA, 24 nt, Human
cauauucaaacacuagcaugcgcc

SEQ ID NO: 689818 - RNA, 23 nt, Human
caugaggccaauuuccauguggc

SEQ ID NO: 689819 - RNA, 21 nt, Human
cauguggcauugcaugcaucc

SEQ ID NO: 689820 - RNA, 19 nt, Human
cauugcaaacacacaaauu

SEQ ID NO: 689821 - RNA, 19 nt, Human
ccaaaaccuauggcagcag

SEQ ID NO: 689822 - RNA, 26 nt, Human
ccaccaccuugguuuccauauccugg

SEQ ID NO: 689823 - RNA, 20 nt, Human
ccagggccuucccaacaaau

SEQ ID NO: 689824 - RNA, 18 nt, Human
ccauguggcauugcaugc

SEQ ID NO: 689825 - RNA, 21 nt, Human
ccgucaaaauuuccuccuuca

SEQ ID NO: 689826 - RNA, 24 nt, Human
ccuccaacaccgccaccauaucca

SEQ ID NO: 689827 - RNA, 26 nt, Human
ccugguccaccaccaccauacccgcc

SEQ ID NO: 689828 - RNA, 20 nt, Human
ccuguacuaagcaacugucc

SEQ ID NO: 689829 - RNA, 24 nt, Human
ccuucauuguaaccaucauauccu

SEQ ID NO: 689830 - RNA, 21 nt, Human
ccuucugcuaccauauccacc

SEQ ID NO: 689831 - RNA, 24 nt, Human
cuaaaacacacauugcaaacacac

SEQ ID NO: 689832 - RNA, 24 nt, Human
cuccaacaccgccaccauauccac

SEQ ID NO: 689833 - RNA, 24 nt, Human
cugauguaaugaaaagaaaaagaa

SEQ ID NO: 689834 - RNA, 20 nt, Human
cugcccccuuucaugugucc

SEQ ID NO: 689835 - RNA, 22 nt, Human
cugcuguuuuuagaaccuucug

SEQ ID NO: 689836 - RNA, 22 nt, Human
cuguauauauauauauaaaaua

SEQ ID NO: 689837 - RNA, 25 nt, Human
cuuaaacugcaagucagcagguguu

SEQ ID NO: 689838 - RNA, 19 nt, Human
gaaaagaaaaagaaaaaga

SEQ ID NO: 689839 - RNA, 25 nt, Human
gcaguaaacauucuuuacacccaaa

SEQ ID NO: 689840 - RNA, 19 nt, Human
gccucuacuacuauaaccg

SEQ ID NO: 689841 - RNA, 18 nt, Human
gcuaugacaguccugaac

SEQ ID NO: 689842 - RNA, 26 nt, Human
gcugcaguuagguuauuuuggacaau

SEQ ID NO: 689843 - RNA, 24 nt, Human
ggaaaaaagguuacccacuaauuu

SEQ ID NO: 689844 - RNA, 21 nt, Human
ggagggcaguaaacauucuuu

SEQ ID NO: 689845 - RNA, 18 nt, Human
guauauauauauauaaaa

SEQ ID NO: 689846 - RNA, 20 nt, Human
uaacucacaaggaaacaccu

SEQ ID NO: 689847 - RNA, 19 nt, Human
uaagcacuagcugaagcaa

SEQ ID NO: 689848 - RNA, 22 nt, Human
uaagcugcaguaacuuuucuga

SEQ ID NO: 689849 - RNA, 21 nt, Human
uaaugaaaagaaaaagaaaaa

SEQ ID NO: 689850 - RNA, 23 nt, Human
uacacaagaaauaagaguguguu

SEQ ID NO: 689851 - RNA, 18 nt, Human
uacaguacaaacaggaaa

SEQ ID NO: 689852 - RNA, 18 nt, Human
uaccaaagaaggaguaac

SEQ ID NO: 689853 - RNA, 19 nt, Human
uaccaaagaaggaguaaca

SEQ ID NO: 689854 - RNA, 20 nt, Human
uaccuguauauauauauaua

SEQ ID NO: 689855 - RNA, 19 nt, Human
uacuacuauaaccaggacc

SEQ ID NO: 689856 - RNA, 18 nt, Human
uagcccuuuuccugcugu

SEQ ID NO: 689857 - RNA, 18 nt, Human
uauaaccaggaccacugc

SEQ ID NO: 689858 - RNA, 31 nt, Human
uauacacacacauauauauaccuguauauag

SEQ ID NO: 689859 - RNA, 20 nt, Human
uauaccuguauauauauaua

SEQ ID NO: 689860 - RNA, 19 nt, Human
uauauacacacacauauau

SEQ ID NO: 689861 - RNA, 24 nt, Human
uauauacacacacauauauauacc

SEQ ID NO: 689862 - RNA, 18 nt, Human
uauauacauauauauaua

SEQ ID NO: 689863 - RNA, 18 nt, Human
uauauacauauauauaua

SEQ ID NO: 689864 - RNA, 20 nt, Human
uauauacauauauauauaua

SEQ ID NO: 689865 - RNA, 22 nt, Human
uauauacauauauauauauaca

SEQ ID NO: 689866 - RNA, 24 nt, Human
uauauacauauauauauauacaca

SEQ ID NO: 689867 - RNA, 20 nt, Human
uauauaccuguauauauaua

SEQ ID NO: 689868 - RNA, 19 nt, Human
uauauauacacacacauau

SEQ ID NO: 689869 - RNA, 24 nt, Human
uauauauacacacacauauauaua

SEQ ID NO: 689870 - RNA, 23 nt, Human
uauauauaccuguauauauauau

SEQ ID NO: 689871 - RNA, 22 nt, Human
uauauauauacacacacauagu

SEQ ID NO: 689872 - RNA, 25 nt, Human
uauauauauacacacacauauauag

SEQ ID NO: 689873 - RNA, 18 nt, Human
uauauauauauguauaua

SEQ ID NO: 689874 - RNA, 22 nt, Human
uauauauaucuauauauauaca

SEQ ID NO: 689875 - RNA, 24 nt, Human
uauauauauguauauauguauaua

SEQ ID NO: 689876 - RNA, 20 nt, Human
uauauauccauauauauaua

SEQ ID NO: 689877 - RNA, 20 nt, Human
uauauauccauauauauaua

SEQ ID NO: 689878 - RNA, 18 nt, Human
uauauauguauauacaua

SEQ ID NO: 689879 - RNA, 22 nt, Human
uauauauguauauacauauaua

SEQ ID NO: 689880 - RNA, 20 nt, Human
uauauccauauauauauaua

SEQ ID NO: 689881 - RNA, 20 nt, Human
uauauccauauauauauaua

SEQ ID NO: 689882 - RNA, 21 nt, Human
uauauccauauauauauauau

SEQ ID NO: 689883 - RNA, 22 nt, Human
uauauccauauauauauauaua

SEQ ID NO: 689884 - RNA, 24 nt, Human
uauauccauauauauauauauaug

SEQ ID NO: 689885 - RNA, 20 nt, Human
uauauguauauacauauaua

SEQ ID NO: 689886 - RNA, 22 nt, Human
uauauguauauauccauauaua

SEQ ID NO: 689887 - RNA, 24 nt, Human
uauauguauauauccauauauaua

SEQ ID NO: 689888 - RNA, 24 nt, Human
uauccauauauauauauauaugua

SEQ ID NO: 689889 - RNA, 24 nt, Human
uauccauauauauauauauaugua

SEQ ID NO: 689890 - RNA, 25 nt, Human
uauccauauauauauauauauguaa

SEQ ID NO: 689891 - RNA, 23 nt, Human
uaugacaguccugaacaagaagg

SEQ ID NO: 689892 - RNA, 24 nt, Human
uauguauauacauauauauauaua

SEQ ID NO: 689893 - RNA, 20 nt, Human
uauguauauauccauauaua

SEQ ID NO: 689894 - RNA, 18 nt, Human
uauguauauauguauaua

SEQ ID NO: 689895 - RNA, 21 nt, Human
uauguauauauguauauacau

SEQ ID NO: 689896 - RNA, 24 nt, Human
uauguauauauguauauacauaua

SEQ ID NO: 689897 - RNA, 28 nt, Human
uauguauauauguauauacauauauaua

SEQ ID NO: 689898 - RNA, 21 nt, Human
ucagcagguguuucuuuacag

SEQ ID NO: 689899 - RNA, 20 nt, Human
ucauauccuccaacaccgcc

SEQ ID NO: 689900 - RNA, 18 nt, Human
uccaccaccaccauaccc

SEQ ID NO: 689901 - RNA, 21 nt, Human
uccaccaccagauccauaacc

SEQ ID NO: 689902 - RNA, 24 nt, Human
uccaccaccagauccauaaccacc

SEQ ID NO: 689903 - RNA, 19 nt, Human
uccauauauauauauauau

SEQ ID NO: 689904 - RNA, 19 nt, Human
uccauauauauauauauau

SEQ ID NO: 689905 - RNA, 19 nt, Human
uccauauauauauauauau

SEQ ID NO: 689906 - RNA, 19 nt, Human
uccauauauauauauauau

SEQ ID NO: 689907 - RNA, 28 nt, Human
ucccaacaaauugguaacaacaugauuu

SEQ ID NO: 689908 - RNA, 22 nt, Human
ucuaaaacacacauugcaaaca

SEQ ID NO: 689909 - RNA, 21 nt, Human
ucuaaacacagcuaggacuca

SEQ ID NO: 689910 - RNA, 26 nt, Human
ucuaaacacagcuaggacucagcaag

SEQ ID NO: 689911 - RNA, 20 nt, Human
ucuaacguaggagagggaaa

SEQ ID NO: 689912 - RNA, 24 nt, Human
ugcaagucagcagguguuucuuua

SEQ ID NO: 689913 - RNA, 23 nt, Human
ugcuuuaaaaaaggaaaaaaggu

SEQ ID NO: 689914 - RNA, 21 nt, Human
uggcuaugacaguccugaaca

SEQ ID NO: 689915 - RNA, 21 nt, Human
ugguuuggaaauggggagaau

SEQ ID NO: 689916 - RNA, 19 nt, Human
uguagaaaaacugaacuac

SEQ ID NO: 689917 - RNA, 23 nt, Human
uguauauacauauauauauauac

SEQ ID NO: 689918 - RNA, 21 nt, Human
uguauauauauauauaaaaua

SEQ ID NO: 689919 - RNA, 20 nt, Human
uguauauauccauauauaua

SEQ ID NO: 689920 - RNA, 22 nt, Human
uguauauauccauauauauaua

SEQ ID NO: 689921 - RNA, 20 nt, Human
uguauauauguauauacaua

SEQ ID NO: 689922 - RNA, 21 nt, Human
ugucucaaaguaaccugcagc

SEQ ID NO: 689923 - RNA, 24 nt, Human
uuaaaagaaaaugcacaaaaacca

SEQ ID NO: 689924 - RNA, 19 nt, Human
uuaucuaaaacucuucuca

SEQ ID NO: 689925 - RNA, 21 nt, Human
uuccaccaaaacugcccccuu

SEQ ID NO: 689926 - RNA, 18 nt, Human
uugcaaacuguggcuaug

SEQ ID NO: 689927 - RNA, 20 nt, Human
uuuucagaauuuaaauggaa

SEQ ID NO: 689928 - RNA, 23 nt, Human
aaacaccuagagcucuggaaaua

SEQ ID NO: 689929 - RNA, 19 nt, Human
aacaggagagugauuucca

SEQ ID NO: 689930 - RNA, 21 nt, Human
aacugugucuccuccuccuug

SEQ ID NO: 689931 - RNA, 18 nt, Human
aaggugaaaaaaagguga

SEQ ID NO: 689932 - RNA, 26 nt, Human
accugguaauaaaaaucagcccauga

SEQ ID NO: 689933 - RNA, 21 nt, Human
acuccauauccaaacaaagca

SEQ ID NO: 689934 - RNA, 25 nt, Human
aggccgaggcgcggcggcuccucgc

SEQ ID NO: 689935 - RNA, 29 nt, Human
aggggaaggcgccgcaggcuccccaaggg

SEQ ID NO: 689936 - RNA, 23 nt, Human
caccacacgcugccuaaacaccu

SEQ ID NO: 689937 - RNA, 21 nt, Human
cacuccauauccaaacaaagc

SEQ ID NO: 689938 - RNA, 20 nt, Human
cagacaccacacgcugccua

SEQ ID NO: 689939 - RNA, 23 nt, Human
cagagcggcagcaggaagcagag

SEQ ID NO: 689940 - RNA, 18 nt, Human
caggcugcagagcggcag

SEQ ID NO: 689941 - RNA, 20 nt, Human
ccaacagccaagcuccgucc

SEQ ID NO: 689942 - RNA, 23 nt, Human
ccacggagcugcuccaacugugu

SEQ ID NO: 689943 - RNA, 23 nt, Human
ccccagucagcccacggagcugc

SEQ ID NO: 689944 - RNA, 23 nt, Human
ccgccgccgcacgggaacccacc

SEQ ID NO: 689945 - RNA, 22 nt, Human
gaccugguaauaaaaaucagcc

SEQ ID NO: 689946 - RNA, 18 nt, Human
gacgccgcggggcccgcu

SEQ ID NO: 689947 - RNA, 18 nt, Human
gagcggcagcaggaagca

SEQ ID NO: 689948 - RNA, 19 nt, Human
gagcggcagcaggaagcag

SEQ ID NO: 689949 - RNA, 21 nt, Human
gagcggcagcaggaagcagag

SEQ ID NO: 689950 - RNA, 23 nt, Human
ggaagcagagccucucaccugcu

SEQ ID NO: 689951 - RNA, 21 nt, Human
uaaaauaccuuacaauacauu

SEQ ID NO: 689952 - RNA, 22 nt, Human
uacaaccaggguccacaggucc

SEQ ID NO: 689953 - RNA, 21 nt, Human
ucacccaggcuugggguuuuu

SEQ ID NO: 689954 - RNA, 26 nt, Human
ucagcccaugauggcgcuauggccuc

SEQ ID NO: 689955 - RNA, 24 nt, Human
uccacagguccaggcugcagagcg

SEQ ID NO: 689956 - RNA, 19 nt, Human
ucccacacucacccaggcu

SEQ ID NO: 689957 - RNA, 24 nt, Human
uccuuggccgccgccgcacgggaa

SEQ ID NO: 689958 - RNA, 19 nt, Human
ugcuccaacugugucuccu

SEQ ID NO: 689959 - RNA, 20 nt, Human
uggcaaaaucaggacacgug

SEQ ID NO: 689960 - RNA, 19 nt, Human
uggccgccgccgcacggga

SEQ ID NO: 689961 - RNA, 18 nt, Human
uuacaggaaauguaugac

SEQ ID NO: 689962 - RNA, 23 nt, Human
uuagauucccaaaagggguacca

SEQ ID NO: 689963 - RNA, 19 nt, Human
uucacuccauauccaaaca

SEQ ID NO: 689964 - RNA, 24 nt, Human
uuuuucccacacucacccaggcuu

SEQ ID NO: 689965 - RNA, 23 nt, Human
uuuuuuuuuucccacacucaccc

SEQ ID NO: 689966 - RNA, 21 nt, Human
aacugccccacacagcacacu

SEQ ID NO: 689967 - RNA, 18 nt, Human
aagagauucgauucugag

SEQ ID NO: 689968 - RNA, 23 nt, Human
aagcaaaaauuacaggguaagac

SEQ ID NO: 689969 - RNA, 20 nt, Human
acaugccaacucucauucac

SEQ ID NO: 689970 - RNA, 23 nt, Human
agaggaugcauuugacaugccaa

SEQ ID NO: 689971 - RNA, 21 nt, Human
aguaucaacuuuagaaaacaa

SEQ ID NO: 689972 - RNA, 23 nt, Human
auacuucuaacucaaagcugcuu

SEQ ID NO: 689973 - RNA, 20 nt, Human
augccgacugcugcuggagg

SEQ ID NO: 689974 - RNA, 25 nt, Human
caaaaaaaucucacaagaaggggag

SEQ ID NO: 689975 - RNA, 22 nt, Human
caaaauuaaaagcaaaaauuac

SEQ ID NO: 689976 - RNA, 20 nt, Human
caacgcggccacaaccgcuu

SEQ ID NO: 689977 - RNA, 22 nt, Human
cacaaaaaucccacaguaucaa

SEQ ID NO: 689978 - RNA, 25 nt, Human
ccaaacaucaggcuguucacaaaaa

SEQ ID NO: 689979 - RNA, 18 nt, Human
cccugcauaacaagagau

SEQ ID NO: 689980 - RNA, 21 nt, Human
ccgaaaauguagcugaagauc

SEQ ID NO: 689981 - RNA, 27 nt, Human
cgaaaauguagcugaagaucaaaaaaa

SEQ ID NO: 689982 - RNA, 20 nt, Human
cggcaacgcggccacaaccg

SEQ ID NO: 689983 - RNA, 19 nt, Human
cugaagauacuaggggaga

SEQ ID NO: 689984 - RNA, 23 nt, Human
cugaagaucaaaaaaaucucaca

SEQ ID NO: 689985 - RNA, 18 nt, Human
gagguaucaaaauuaaaa

SEQ ID NO: 689986 - RNA, 21 nt, Human
gauucugagucuccuacuccc

SEQ ID NO: 689987 - RNA, 21 nt, Human
ggaaggacaaggauggggaga

SEQ ID NO: 689988 - RNA, 23 nt, Human
ggacaaggauggggagaacagug

SEQ ID NO: 689989 - RNA, 21 nt, Human
gguaaagaaauaaugggauaa

SEQ ID NO: 689990 - RNA, 22 nt, Human
gguaaagaaauaaugggauaag

SEQ ID NO: 689991 - RNA, 19 nt, Human
uaacaaaacuacuaggagc

SEQ ID NO: 689992 - RNA, 20 nt, Human
uaacucaaagcugcuuucaa

SEQ ID NO: 689993 - RNA, 27 nt, Human
uagcugaagaucaaaaaaaucucacaa

SEQ ID NO: 689994 - RNA, 23 nt, Human
ucacaaaaaucccacaguaucaa

SEQ ID NO: 689995 - RNA, 18 nt, Human
ucuucgucucuucacaaa

SEQ ID NO: 689996 - RNA, 21 nt, Human
ugaaaagaacuguacucccug

SEQ ID NO: 689997 - RNA, 24 nt, Human
ugaaaagaacuguacucccugcau

SEQ ID NO: 689998 - RNA, 18 nt, Human
ugaagaucaaaaaaaucu

SEQ ID NO: 689999 - RNA, 19 nt, Human
ugggaaggacaaggauggg

SEQ ID NO: 690000 - RNA, 23 nt, Human
ugggauaagauuucuaaacccca

SEQ ID NO: 690001 - RNA, 27 nt, Human
aaacaaaaaauggcauaaaggggaccc

SEQ ID NO: 690002 - RNA, 30 nt, Human
accuagcauuuaaaaaaaaaaaaaaaaaaa

SEQ ID NO: 690003 - RNA, 19 nt, Human
agcacaaauguaugaacag

SEQ ID NO: 690004 - RNA, 27 nt, Human
aggaaagagaaaugucuuccugcucag

SEQ ID NO: 690005 - RNA, 19 nt, Human
aggaaagagaaaugucuuu

SEQ ID NO: 690006 - RNA, 22 nt, Human
auaacaguuccccucucccucc

SEQ ID NO: 690007 - RNA, 21 nt, Human
caguuccccucucccuccccc

SEQ ID NO: 690008 - RNA, 22 nt, Human
ccucuacaaaccuagcauuuaa

SEQ ID NO: 690009 - RNA, 25 nt, Human
ccugcagauuuccagcguuuccauu

SEQ ID NO: 690010 - RNA, 23 nt, Human
cuugggagauaacaguuccccuc

SEQ ID NO: 690011 - RNA, 23 nt, Human
gcagcacaaauguaugaacagga

SEQ ID NO: 690012 - RNA, 25 nt, Human
uaacaaaaacaaaaaauggcauaaa

SEQ ID NO: 690013 - RNA, 21 nt, Human
uaacaguuccccucucccucc

SEQ ID NO: 690014 - RNA, 22 nt, Human
uaugaacaggaaaaaaaaaaau

SEQ ID NO: 690015 - RNA, 21 nt, Human
uccccucucccucccccugca

SEQ ID NO: 690016 - RNA, 18 nt, Human
ucuugggagauaacaguu

SEQ ID NO: 690017 - RNA, 19 nt, Human
uggcauaaaggaaagagaa

SEQ ID NO: 690018 - RNA, 24 nt, Human
ugugccaagaguacaugggcagca

SEQ ID NO: 690019 - RNA, 20 nt, Human
uuaaaaaaaaaaaaaaaaaa

SEQ ID NO: 690020 - RNA, 28 nt, Human
uuaaaaaaaaaaaaaaaaaaaaaggaau

SEQ ID NO: 690021 - RNA, 21 nt, Human
aaaaauaaaaagacuugagua

SEQ ID NO: 690022 - RNA, 24 nt, Human
aaaaugcuacuuaaagaugaaaca

SEQ ID NO: 690023 - RNA, 21 nt, Human
aaaucaugauuuaacagugug

SEQ ID NO: 690024 - RNA, 23 nt, Human
aacucugcaagcccaauaauguc

SEQ ID NO: 690025 - RNA, 23 nt, Human
aacucugcaagcccaauaauguc

SEQ ID NO: 690026 - RNA, 18 nt, Human
acuucuaggaaugcaaaa

SEQ ID NO: 690027 - RNA, 20 nt, Human
agacaaagcacuagcuugua

SEQ ID NO: 690028 - RNA, 21 nt, Human
agcuuguuuugaagcuaaaau

SEQ ID NO: 690029 - RNA, 27 nt, Human
aucuaucccaaauccaaaaaaaugaaa

SEQ ID NO: 690030 - RNA, 22 nt, Human
caaaaaaaugaaacuguccaaa

SEQ ID NO: 690031 - RNA, 22 nt, Human
cagcccaauacaaauggcagca

SEQ ID NO: 690032 - RNA, 18 nt, Human
cagggcagagcgggggcc

SEQ ID NO: 690033 - RNA, 25 nt, Human
cagugugcccagcuuguuuugaagc

SEQ ID NO: 690034 - RNA, 23 nt, Human
ccaaaaccaaagguucugcaaaa

SEQ ID NO: 690035 - RNA, 27 nt, Human
cuguccaaaaccaaagguucugcaaaa

SEQ ID NO: 690036 - RNA, 22 nt, Human
gaaauacaaucacaucaaagaa

SEQ ID NO: 690037 - RNA, 20 nt, Human
gaacaagaaauuggaaauac

SEQ ID NO: 690038 - RNA, 26 nt, Human
gggaacucugcaagcccaauaauguc

SEQ ID NO: 690039 - RNA, 19 nt, Human
gggcagagcgggggccggc

SEQ ID NO: 690040 - RNA, 19 nt, Human
gggcagagcgggggccggc

SEQ ID NO: 690041 - RNA, 25 nt, Human
gggccggcagccgggcccgugagaa

SEQ ID NO: 690042 - RNA, 23 nt, Human
uaaaaacacaguuaaccuacuuc

SEQ ID NO: 690043 - RNA, 22 nt, Human
uaaaacuacuaagacaaagcac

SEQ ID NO: 690044 - RNA, 22 nt, Human
uaaaacuacuaagacaaagcac

SEQ ID NO: 690045 - RNA, 20 nt, Human
uaagacaaagcacuagcuug

SEQ ID NO: 690046 - RNA, 18 nt, Human
uacacaauagugauuucu

SEQ ID NO: 690047 - RNA, 24 nt, Human
uccaaaaaaaugaaacuguccaaa

SEQ ID NO: 690048 - RNA, 24 nt, Human
ugaagaauguagaucuagagccaa

SEQ ID NO: 690049 - RNA, 20 nt, Human
uugaagcuaaaaugaagccu

SEQ ID NO: 690050 - RNA, 23 nt, Human
aaaaaaaaucaacccacaaagcu

SEQ ID NO: 690051 - RNA, 22 nt, Human
aacccacaaagcuucuaaaaaa

SEQ ID NO: 690052 - RNA, 23 nt, Human
aaguuuuacauuuuuaacagccc

SEQ ID NO: 690053 - RNA, 23 nt, Human
aaguuuuacauuuuuaacagccc

SEQ ID NO: 690054 - RNA, 22 nt, Human
aaguuuuaguuuucaaucccaa

SEQ ID NO: 690055 - RNA, 22 nt, Human
aaguuuuaguuuucaaucccaa

SEQ ID NO: 690056 - RNA, 20 nt, Human
aauaaaagacaccagguaca

SEQ ID NO: 690057 - RNA, 20 nt, Human
aauaaaagacaccagguaca

SEQ ID NO: 690058 - RNA, 23 nt, Human
aauuaugguauuaaccuucacaa

SEQ ID NO: 690059 - RNA, 23 nt, Human
aauuaugguauuaaccuucacaa

SEQ ID NO: 690060 - RNA, 24 nt, Human
acccacaaagcuucuaaaaaagga

SEQ ID NO: 690061 - RNA, 23 nt, Human
agaaaaaaaaucaacccacaaag

SEQ ID NO: 690062 - RNA, 18 nt, Human
agaaucaaaaugcagaac

SEQ ID NO: 690063 - RNA, 18 nt, Human
agaaucaaaaugcagaac

SEQ ID NO: 690064 - RNA, 18 nt, Human
auaaaaaaaaaaaaaagu

SEQ ID NO: 690065 - RNA, 24 nt, Human
caauuaaaaauguacaaaaaagaa

SEQ ID NO: 690066 - RNA, 23 nt, Human
caccgaguucgcgaggagcucac

SEQ ID NO: 690067 - RNA, 22 nt, Human
caccgaguucgcgaggagcucc

SEQ ID NO: 690068 - RNA, 20 nt, Human
cagaaucaaaaugcagaacc

SEQ ID NO: 690069 - RNA, 19 nt, Human
caggcacuuccucuugugg

SEQ ID NO: 690070 - RNA, 23 nt, Human
cagucgacuucuugugaagguuu

SEQ ID NO: 690071 - RNA, 23 nt, Human
ccacaaagcuucuaaaaaaggaa

SEQ ID NO: 690072 - RNA, 21 nt, Human
cccccuccacuacccagcaaa

SEQ ID NO: 690073 - RNA, 21 nt, Human
cccccuccacuacccagcaaa

SEQ ID NO: 690074 - RNA, 23 nt, Human
cccgcaggcacuuccucuugugg

SEQ ID NO: 690075 - RNA, 24 nt, Human
ccucuuguggaauguuuaaaaagu

SEQ ID NO: 690076 - RNA, 19 nt, Human
cgcaggcacuuccucuugu

SEQ ID NO: 690077 - RNA, 23 nt, Human
cuccacuacccagcaaacuacag

SEQ ID NO: 690078 - RNA, 23 nt, Human
cuccacuacccagcaaacuacag

SEQ ID NO: 690079 - RNA, 20 nt, Human
cuuacccccuccacuaccca

SEQ ID NO: 690080 - RNA, 20 nt, Human
cuuacccccuccacuaccca

SEQ ID NO: 690081 - RNA, 25 nt, Human
gcaauuaaaaauguacaaaaaagaa

SEQ ID NO: 690082 - RNA, 18 nt, Human
gcaggcacuuccucuugu

SEQ ID NO: 690083 - RNA, 20 nt, Human
gcggcggcugcggcugcggc

SEQ ID NO: 690084 - RNA, 18 nt, Human
gcggcugcuccucggccc

SEQ ID NO: 690085 - RNA, 20 nt, Human
gcggcugcugcggcugcucc

SEQ ID NO: 690086 - RNA, 21 nt, Human
gcugcggcugcuccucggccc

SEQ ID NO: 690087 - RNA, 21 nt, Human
ggcggcggcugcggcugcggc

SEQ ID NO: 690088 - RNA, 20 nt, Human
ggcuggagauggguucgugc

SEQ ID NO: 690089 - RNA, 22 nt, Human
gggcggcggcugcggcugcggc

SEQ ID NO: 690090 - RNA, 24 nt, Human
guaaauucuuaauaaaagacacca

SEQ ID NO: 690091 - RNA, 24 nt, Human
guaaauucuuaauaaaagacacca

SEQ ID NO: 690092 - RNA, 25 nt, Human
uaaagaaaacagucgacuucuugug

SEQ ID NO: 690093 - RNA, 22 nt, Human
uaaauucuuaauaaaagacacc

SEQ ID NO: 690094 - RNA, 22 nt, Human
uaaauucuuaauaaaagacacc

SEQ ID NO: 690095 - RNA, 18 nt, Human
uaacagcccuucuacaua

SEQ ID NO: 690096 - RNA, 18 nt, Human
uaacagcccuucuacaua

SEQ ID NO: 690097 - RNA, 18 nt, Human
uacagauaaaauguagaa

SEQ ID NO: 690098 - RNA, 24 nt, Human
uagaacccugaaauacugacacau

SEQ ID NO: 690099 - RNA, 25 nt, Human
uagccuacuaaagaaaacagucgac

SEQ ID NO: 690100 - RNA, 18 nt, Human
ucaaacucggcuccgcuc

SEQ ID NO: 690101 - RNA, 22 nt, Human
ucaccgaguucgcgagggagac

SEQ ID NO: 690102 - RNA, 22 nt, Human
uccacaaauaaugcaaccaagu

SEQ ID NO: 690103 - RNA, 22 nt, Human
uccacaaauaaugcaaccaagu

SEQ ID NO: 690104 - RNA, 22 nt, Human
ucgaacggcgccaauuccuuuc

SEQ ID NO: 690105 - RNA, 26 nt, Human
ucuguugugauaaaaaaaaaaaaaag

SEQ ID NO: 690106 - RNA, 26 nt, Human
ucuguugugauaaaaaaaaaaaaaag

SEQ ID NO: 690107 - RNA, 20 nt, Human
ugaaauacugacacauucuc

SEQ ID NO: 690108 - RNA, 18 nt, Human
ugauaaaaaaaaaaaaaa

SEQ ID NO: 690109 - RNA, 18 nt, Human
ugauaaaaaaaaaaaaaa

SEQ ID NO: 690110 - RNA, 24 nt, Human
uggaauguuuaaaaaguuagccua

SEQ ID NO: 690111 - RNA, 18 nt, Human
ugugagaaauggggggag

SEQ ID NO: 690112 - RNA, 18 nt, Human
ugugagaaauggggggag

SEQ ID NO: 690113 - RNA, 25 nt, Human
uuaacagcccuucuacauacacucc

SEQ ID NO: 690114 - RNA, 25 nt, Human
uuaacagcccuucuacauacacucc

SEQ ID NO: 690115 - RNA, 19 nt, Human
uucagaaucaaaaugcaga

SEQ ID NO: 690116 - RNA, 19 nt, Human
uucagaaucaaaaugcaga

SEQ ID NO: 690117 - RNA, 23 nt, Human
uugugauaaaaaaaaaaaaaagu

SEQ ID NO: 690118 - RNA, 23 nt, Human
uugugauaaaaaaaaaaaaaagu

SEQ ID NO: 690119 - RNA, 19 nt, Human
uuuuuuuuuuacaacaagu

SEQ ID NO: 690120 - RNA, 19 nt, Human
uuuuuuuuuuacaacaagu

SEQ ID NO: 690121 - RNA, 19 nt, Human
aaaacucuuuuccccccaa

SEQ ID NO: 690122 - RNA, 22 nt, Human
aagcgccacgcuugggccggaa

SEQ ID NO: 690123 - RNA, 30 nt, Human
acaacuuccccgaacuccggcagccgcacu

SEQ ID NO: 690124 - RNA, 22 nt, Human
agaauguuccacgugggggcag

SEQ ID NO: 690125 - RNA, 21 nt, Human
agacuccuccgagucuaauau

SEQ ID NO: 690126 - RNA, 18 nt, Human
agcacaggaagugggugg

SEQ ID NO: 690127 - RNA, 19 nt, Human
agccgcacggcacacgccc

SEQ ID NO: 690128 - RNA, 21 nt, Human
agcgccacgcuugggccggaa

SEQ ID NO: 690129 - RNA, 19 nt, Human
caccaaagagguugcacga

SEQ ID NO: 690130 - RNA, 21 nt, Human
caccaaagagguugcacgaug

SEQ ID NO: 690131 - RNA, 23 nt, Human
cacuggcaccaaagagguugcac

SEQ ID NO: 690132 - RNA, 22 nt, Human
cagccucggcuuuugccagccu

SEQ ID NO: 690133 - RNA, 20 nt, Human
caguggguccaagccgggug

SEQ ID NO: 690134 - RNA, 18 nt, Human
cccaaauccagccucggc

SEQ ID NO: 690135 - RNA, 24 nt, Human
cccaaauccagccucggcuuuugc

SEQ ID NO: 690136 - RNA, 28 nt, Human
ccccaaaguauucuuuguuccccuccuu

SEQ ID NO: 690137 - RNA, 23 nt, Human
cccccgggcgagcacaggaagug

SEQ ID NO: 690138 - RNA, 21 nt, Human
ccuugcccacacuggcaccaa

SEQ ID NO: 690139 - RNA, 18 nt, Human
cgaccgggaggcgcgggg

SEQ ID NO: 690140 - RNA, 22 nt, Human
cgagcacaggaagugggugggg

SEQ ID NO: 690141 - RNA, 18 nt, Human
cgcggggacugagcggug

SEQ ID NO: 690142 - RNA, 19 nt, Human
cggaaggucucauucuguu

SEQ ID NO: 690143 - RNA, 18 nt, Human
cggagcgagcgcggggac

SEQ ID NO: 690144 - RNA, 25 nt, Human
cucuauggacugauugaauuuggga

SEQ ID NO: 690145 - RNA, 21 nt, Human
cugagcccuugcccacacugg

SEQ ID NO: 690146 - RNA, 28 nt, Human
cuugcaguggguccaagccgggugugcu

SEQ ID NO: 690147 - RNA, 18 nt, Human
gaaaaccgguuccacgga

SEQ ID NO: 690148 - RNA, 26 nt, Human
gcagagaggcugagcccuugcccaca

SEQ ID NO: 690149 - RNA, 18 nt, Human
gggcucccuccucgcugc

SEQ ID NO: 690150 - RNA, 23 nt, Human
ggugugcuguguucuucccguuu

SEQ ID NO: 690151 - RNA, 21 nt, Human
gucuaauauuccucccccaaa

SEQ ID NO: 690152 - RNA, 19 nt, Human
gugcggagcgagcgcgggg

SEQ ID NO: 690153 - RNA, 24 nt, Human
uauggacugauugaauuugggaug

SEQ ID NO: 690154 - RNA, 26 nt, Human
uccccccaaaguauucuuuguucccc

SEQ ID NO: 690155 - RNA, 23 nt, Human
ucgacagccacaacuuccccgaa

SEQ ID NO: 690156 - RNA, 23 nt, Human
ucuaauauuccucccccaaaucc

SEQ ID NO: 690157 - RNA, 20 nt, Human
ucugucccaugaggcugugu

SEQ ID NO: 690158 - RNA, 19 nt, Human
ugcagcuugcagugggucc

SEQ ID NO: 690159 - RNA, 22 nt, Human
ugcaguggguccaagccgggug

SEQ ID NO: 690160 - RNA, 21 nt, Human
ugcugucgguguugccauugc

SEQ ID NO: 690161 - RNA, 19 nt, Human
ugggcagagaggcugagcc

SEQ ID NO: 690162 - RNA, 18 nt, Human
uggggugcggagcgagcc

SEQ ID NO: 690163 - RNA, 25 nt, Human
uggugguggcggcagccuuucccuu

SEQ ID NO: 690164 - RNA, 18 nt, Human
uggugguggugguggcgg

SEQ ID NO: 690165 - RNA, 20 nt, Human
uggugguggugguggcggca

SEQ ID NO: 690166 - RNA, 20 nt, Human
uggugguggugguggcggcc

SEQ ID NO: 690167 - RNA, 23 nt, Human
ugugggcagagaggcugagcccu

SEQ ID NO: 690168 - RNA, 24 nt, Human
uguuccccucccucaaauuucugu

SEQ ID NO: 690169 - RNA, 23 nt, Human
uugaauuugggauggccagcucc

SEQ ID NO: 690170 - RNA, 21 nt, Human
uugggaaaagaaaacuccauu

SEQ ID NO: 690171 - RNA, 18 nt, Human
uuggugguggugguggcg

SEQ ID NO: 690172 - RNA, 21 nt, Human
uuggugguggugguggcggca

SEQ ID NO: 690173 - RNA, 19 nt, Human
uugguugcugucgguguug

SEQ ID NO: 690174 - RNA, 19 nt, Human
uuuuuuuuuuuuuuuugcu

SEQ ID NO: 690175 - RNA, 24 nt, Human
uuuuuuuuuuuuuuuuugcucuuu

SEQ ID NO: 690176 - RNA, 20 nt, Human
uuuuuuuuuuuuuuuuuugg

SEQ ID NO: 690177 - RNA, 18 nt, Human
aaauguugaagguagacc

SEQ ID NO: 690178 - RNA, 20 nt, Human
aagaaaaggaacacuguugc

SEQ ID NO: 690179 - RNA, 20 nt, Human
acacagaagaacguccuaga

SEQ ID NO: 690180 - RNA, 20 nt, Human
accucacaaggccagagaag

SEQ ID NO: 690181 - RNA, 22 nt, Human
acuuugugccagacauugugcu

SEQ ID NO: 690182 - RNA, 19 nt, Human
agauauaaacaucccugcc

SEQ ID NO: 690183 - RNA, 21 nt, Human
aggcaacuccgggccagaaaa

SEQ ID NO: 690184 - RNA, 22 nt, Human
auguuguucucucugugccccc

SEQ ID NO: 690185 - RNA, 20 nt, Human
cacagcaaaucaucugcuca

SEQ ID NO: 690186 - RNA, 22 nt, Human
cacccaccagaagcuuguuuuc

SEQ ID NO: 690187 - RNA, 22 nt, Human
cagaaaaugcacccaccagaag

SEQ ID NO: 690188 - RNA, 21 nt, Human
cagcaaaucaucugcucagaa

SEQ ID NO: 690189 - RNA, 18 nt, Human
cauaugguugcaacagcc

SEQ ID NO: 690190 - RNA, 22 nt, Human
cauugugcuaggcacccucacu

SEQ ID NO: 690191 - RNA, 21 nt, Human
cucagaaauuaaaaccaagaa

SEQ ID NO: 690192 - RNA, 21 nt, Human
cuuaugaaagauauaaacauc

SEQ ID NO: 690193 - RNA, 19 nt, Human
gggcaguagcguggaugca

SEQ ID NO: 690194 - RNA, 21 nt, Human
gggcggggccugggccucggc

SEQ ID NO: 690195 - RNA, 21 nt, Human
uaaaaccaagaaaaggaacac

SEQ ID NO: 690196 - RNA, 19 nt, Human
uaaaaggagccugauggcu

SEQ ID NO: 690197 - RNA, 24 nt, Human
uaaaaggagccugauggcuuggug

SEQ ID NO: 690198 - RNA, 26 nt, Human
ugaacaaauauuuauuaagcaccuac

SEQ ID NO: 690199 - RNA, 24 nt, Human
ugcacccaccagaagcuuguuuuc

SEQ ID NO: 690200 - RNA, 25 nt, Human
ugugccagacauugugcuaggcacc

SEQ ID NO: 690201 - RNA, 21 nt, Human
uuaaagccucucgauguugac

SEQ ID NO: 690202 - RNA, 20 nt, Human
uuaagcaccuacuuugugcc

SEQ ID NO: 690203 - RNA, 18 nt, Human
aaaacagccccaaagcug

SEQ ID NO: 690204 - RNA, 23 nt, Human
aaacagccccaaagcugccaaca

SEQ ID NO: 690205 - RNA, 22 nt, Human
aaccagagccgacuggggccca

SEQ ID NO: 690206 - RNA, 23 nt, Human
acaaugagaagcucaaaaacagc

SEQ ID NO: 690207 - RNA, 19 nt, Human
accccagcccagcccggcc

SEQ ID NO: 690208 - RNA, 24 nt, Human
caaaaacagccccaaagcugccaa

SEQ ID NO: 690209 - RNA, 22 nt, Human
caaagcugccaacaaccagagc

SEQ ID NO: 690210 - RNA, 21 nt, Human
cacccagggcuaaguugggac

SEQ ID NO: 690211 - RNA, 19 nt, Human
caccccagcccagcccggc

SEQ ID NO: 690212 - RNA, 21 nt, Human
cagccccaaagcugccaacaa

SEQ ID NO: 690213 - RNA, 21 nt, Human
caucccaggccggaaucguuc

SEQ ID NO: 690214 - RNA, 24 nt, Human
ccaacaaccagagccgacuggggc

SEQ ID NO: 690215 - RNA, 20 nt, Human
ccagagagguggcaggagca

SEQ ID NO: 690216 - RNA, 19 nt, Human
ccaggccggaaucguucau

SEQ ID NO: 690217 - RNA, 18 nt, Human
ccccagcccagcccggcc

SEQ ID NO: 690218 - RNA, 20 nt, Human
ccccagcccagcccggcccc

SEQ ID NO: 690219 - RNA, 21 nt, Human
cccccgcggcgcugacuccgc

SEQ ID NO: 690220 - RNA, 21 nt, Human
ccgcgcugccgggcgccccgc

SEQ ID NO: 690221 - RNA, 21 nt, Human
ccgggcccgcgcccuccgcgc

SEQ ID NO: 690222 - RNA, 23 nt, Human
ccuggcccgcaucccaggccgga

SEQ ID NO: 690223 - RNA, 21 nt, Human
cggcgcugacuccgcgcugcc

SEQ ID NO: 690224 - RNA, 22 nt, Human
cuaugccgccugcagccuggcc

SEQ ID NO: 690225 - RNA, 24 nt, Human
cugccgggcgccccgcucgcuccc

SEQ ID NO: 690226 - RNA, 18 nt, Human
cuggcccgcaucccaggc

SEQ ID NO: 690227 - RNA, 21 nt, Human
gagaagcucaaaaacagcccc

SEQ ID NO: 690228 - RNA, 22 nt, Human
gcccgcaucccaggccggaauc

SEQ ID NO: 690229 - RNA, 19 nt, Human
ggagcacugguuuggcccc

SEQ ID NO: 690230 - RNA, 21 nt, Human
ggucaggcugggaugggcagg

SEQ ID NO: 690231 - RNA, 20 nt, Human
ggugcggcccccgcggcgcu

SEQ ID NO: 690232 - RNA, 20 nt, Human
uccgcgcugccgggcgcccc

SEQ ID NO: 690233 - RNA, 22 nt, Human
ugccgggcgccccgcucgcucc

SEQ ID NO: 690234 - RNA, 22 nt, Human
uggcccgcaucccaggccggaa

SEQ ID NO: 690235 - RNA, 21 nt, Human
uggcucccgggcccgcgcccu

SEQ ID NO: 690236 - RNA, 24 nt, Human
ugggaugggcaggcucuagggggc

SEQ ID NO: 690237 - RNA, 21 nt, Human
uggggcccaccccagcccagc

SEQ ID NO: 690238 - RNA, 19 nt, Human
uucauagaaaaccagcccc

SEQ ID NO: 690239 - RNA, 21 nt, Human
uuuuuuuuuuuuucacgcuua

SEQ ID NO: 690240 - RNA, 22 nt, Human
uuuuuuuuuuuuuuucacgcuu

SEQ ID NO: 690241 - RNA, 24 nt, Human
uuuuuuuuuuuuuuuuuuuucacg

SEQ ID NO: 690242 - RNA, 20 nt, Human
aggagccggcguccacgacc

SEQ ID NO: 690243 - RNA, 20 nt, Human
cacccccuccucacccgccc

SEQ ID NO: 690244 - RNA, 25 nt, Human
cacccccuccucacccgcccccgcc

SEQ ID NO: 690245 - RNA, 18 nt, Human
caccugagccccgcccuc

SEQ ID NO: 690246 - RNA, 21 nt, Human
caggcccgacccgcgcagcuc

SEQ ID NO: 690247 - RNA, 18 nt, Human
cccccgccucgcuccagc

SEQ ID NO: 690248 - RNA, 18 nt, Human
cccccuccccuuccuggg

SEQ ID NO: 690249 - RNA, 21 nt, Human
cccgacccgcgcagcucacgc

SEQ ID NO: 690250 - RNA, 18 nt, Human
ccuaccggcucuccucca

SEQ ID NO: 690251 - RNA, 19 nt, Human
ccuccaggagccggcgucc

SEQ ID NO: 690252 - RNA, 21 nt, Human
ccugcuagcccccaggaaagc

SEQ ID NO: 690253 - RNA, 19 nt, Human
cgcccccuccccuuccugg

SEQ ID NO: 690254 - RNA, 21 nt, Human
cgcguccggcgucacccccuc

SEQ ID NO: 690255 - RNA, 21 nt, Human
cgcugccaggcaccugagccc

SEQ ID NO: 690256 - RNA, 23 nt, Human
cgcugccaggcaccugagccccg

SEQ ID NO: 690257 - RNA, 18 nt, Human
cuccaggagccggcgucc

SEQ ID NO: 690258 - RNA, 18 nt, Human
cuccaggagccggcgucc

SEQ ID NO: 690259 - RNA, 20 nt, Human
cucgguaccaggcccgaccc

SEQ ID NO: 690260 - RNA, 18 nt, Human
gcccccgccucgcuccag

SEQ ID NO: 690261 - RNA, 25 nt, Human
gcgcgaacccucgcgcugucgacgc

SEQ ID NO: 690262 - RNA, 21 nt, Human
gcggacaccuucaccucccuc

SEQ ID NO: 690263 - RNA, 23 nt, Human
gcggacaccuucaccucccuccu

SEQ ID NO: 690264 - RNA, 21 nt, Human
gcugccaggcaccugagcccc

SEQ ID NO: 690265 - RNA, 20 nt, Human
ggacaccuucaccucccucc

SEQ ID NO: 690266 - RNA, 18 nt, Human
uccugggccccggccgcg

SEQ ID NO: 690267 - RNA, 19 nt, Human
ugccaggcaccugagcccc

SEQ ID NO: 690268 - RNA, 24 nt, Human
ugccaggcaccugagccccgcccu

SEQ ID NO: 690269 - RNA, 21 nt, Human
ugcuagcccccaggaaagcuc

SEQ ID NO: 690270 - RNA, 22 nt, Human
ugggccccggccgcgcugccag

SEQ ID NO: 690271 - RNA, 19 nt, Human
uuuuuuuuuuuuuuuuugc

SEQ ID NO: 690272 - RNA, 27 nt, Human
uuuuuuuuuuuuuuuuuuuuuuugggg

SEQ ID NO: 690273 - RNA, 18 nt, Human
aaaaagaacaggccuaua

SEQ ID NO: 690274 - RNA, 23 nt, Human
aaaaucagagucuccugaggcag

SEQ ID NO: 690275 - RNA, 19 nt, Human
agagagagaaucaacaaca

SEQ ID NO: 690276 - RNA, 22 nt, Human
agagggaagagcagagaucaug

SEQ ID NO: 690277 - RNA, 18 nt, Human
aggguggguggagcccag

SEQ ID NO: 690278 - RNA, 23 nt, Human
aucacauugcuaaaaagaacagg

SEQ ID NO: 690279 - RNA, 26 nt, Human
aucuaccucccgcccucccuccccac

SEQ ID NO: 690280 - RNA, 20 nt, Human
caaagcucucgagcaccugg

SEQ ID NO: 690281 - RNA, 26 nt, Human
caccuggcugaagcccagugcugggc

SEQ ID NO: 690282 - RNA, 22 nt, Human
cagcacaugaacuccagagaga

SEQ ID NO: 690283 - RNA, 20 nt, Human
cagccuccggguccgccacc

SEQ ID NO: 690284 - RNA, 23 nt, Human
ccaggccacggagccccggcgcc

SEQ ID NO: 690285 - RNA, 20 nt, Human
cccaccaaucugggagaggg

SEQ ID NO: 690286 - RNA, 19 nt, Human
cccgcccucccuccccacc

SEQ ID NO: 690287 - RNA, 21 nt, Human
cccuccccaccaaucugggag

SEQ ID NO: 690288 - RNA, 23 nt, Human
ccuauaucuaccucccgcccucc

SEQ ID NO: 690289 - RNA, 18 nt, Human
ccucccgcccucccuccc

SEQ ID NO: 690290 - RNA, 19 nt, Human
ccucccgcccucccucccc

SEQ ID NO: 690291 - RNA, 24 nt, Human
ccucccgcccucccuccccaccaa

SEQ ID NO: 690292 - RNA, 22 nt, Human
ccucccuccccaccaaucuggg

SEQ ID NO: 690293 - RNA, 21 nt, Human
ccuccggguccgccaccagcg

SEQ ID NO: 690294 - RNA, 21 nt, Human
cgccgcagcagccuccggguc

SEQ ID NO: 690295 - RNA, 19 nt, Human
cggagccccggcgccgcag

SEQ ID NO: 690296 - RNA, 26 nt, Human
cucucgagcaccuggcugaagcccag

SEQ ID NO: 690297 - RNA, 23 nt, Human
gaacaggccuauaucuaccuccc

SEQ ID NO: 690298 - RNA, 24 nt, Human
gagcuggaggaagccagggugggu

SEQ ID NO: 690299 - RNA, 28 nt, Human
gaggaagccaggguggguggagcccagg

SEQ ID NO: 690300 - RNA, 19 nt, Human
ggagcccaggcuggcuuga

SEQ ID NO: 690301 - RNA, 24 nt, Human
ggagccccggcgccgcagcagccu

SEQ ID NO: 690302 - RNA, 21 nt, Human
gggaagagcagagaucauggc

SEQ ID NO: 690303 - RNA, 23 nt, Human
uaaaaagaacaggccuauaucua

SEQ ID NO: 690304 - RNA, 20 nt, Human
ucccgcccucccuccccacc

SEQ ID NO: 690305 - RNA, 19 nt, Human
ucucgagcaccuggcugaa

SEQ ID NO: 690306 - RNA, 23 nt, Human
ucucgagcaccuggcugaagccc

SEQ ID NO: 690307 - RNA, 21 nt, Human
ugaacgccuuuauuuuucuca

SEQ ID NO: 690308 - RNA, 21 nt, Human
ugagcuggaggaagccagggu

SEQ ID NO: 690309 - RNA, 22 nt, Human
ugaggcagcacaugaacuccag

SEQ ID NO: 690310 - RNA, 19 nt, Human
uggagcccaggcuggcuug

SEQ ID NO: 690311 - RNA, 19 nt, Human
uggaggaagccaggguggg

SEQ ID NO: 690312 - RNA, 24 nt, Human
uggaggaagccaggguggguggag

SEQ ID NO: 690313 - RNA, 19 nt, Human
uggguggagcccaggcugg

SEQ ID NO: 690314 - RNA, 25 nt, Human
uuuuuuuuuuugcagauugaacgcc

SEQ ID NO: 690315 - RNA, 23 nt, Human
uuuuuuuuuuuuuuuuugcagau

SEQ ID NO: 690316 - RNA, 26 nt, Human
uuuuuuuuuuuuuuuuugcagauuga

SEQ ID NO: 690317 - RNA, 20 nt, Human
uuuuuuuuuuuuuuuuuugg

SEQ ID NO: 690318 - RNA, 20 nt, Human
aaaaacagccauguggguaa

SEQ ID NO: 690319 - RNA, 18 nt, Human
aaaaauaacugaaaggac

SEQ ID NO: 690320 - RNA, 21 nt, Human
aaaaauaacugaaaggacuac

SEQ ID NO: 690321 - RNA, 24 nt, Human
aaaacaaagauacaggagagagaa

SEQ ID NO: 690322 - RNA, 21 nt, Human
aaacagccauguggguaagac

SEQ ID NO: 690323 - RNA, 19 nt, Human
aacaaagauacaggagaga

SEQ ID NO: 690324 - RNA, 20 nt, Human
aaccaaagaaacuaaaacaa

SEQ ID NO: 690325 - RNA, 30 nt, Human
aagaagaggacauuuucauacaaagaaaaa

SEQ ID NO: 690326 - RNA, 19 nt, Human
aagaggacauuuucauaca

SEQ ID NO: 690327 - RNA, 21 nt, Human
acuaaaacaaagauacaggag

SEQ ID NO: 690328 - RNA, 18 nt, Human
agccugacaccccggcac

SEQ ID NO: 690329 - RNA, 23 nt, Human
auaccugcagccugacaccccgg

SEQ ID NO: 690330 - RNA, 23 nt, Human
caaaauaaaaaccaaagaaacua

SEQ ID NO: 690331 - RNA, 21 nt, Human
caagccuugaacaagcucaca

SEQ ID NO: 690332 - RNA, 22 nt, Human
cacauaccugcagccugacacc

SEQ ID NO: 690333 - RNA, 18 nt, Human
cagccugacaccccggca

SEQ ID NO: 690334 - RNA, 22 nt, Human
ccauguggguaagacaagccuu

SEQ ID NO: 690335 - RNA, 23 nt, Human
ccugcagccugacaccccggcac

SEQ ID NO: 690336 - RNA, 21 nt, Human
cuaaaacaaagauacaggaga

SEQ ID NO: 690337 - RNA, 18 nt, Human
cuaauucauuacaaagcc

SEQ ID NO: 690338 - RNA, 19 nt, Human
cuaauucauuacaaagccu

SEQ ID NO: 690339 - RNA, 20 nt, Human
cucaaaaugagaaacacuaa

SEQ ID NO: 690340 - RNA, 23 nt, Human
ggagcacuggcccgaggccuaga

SEQ ID NO: 690341 - RNA, 26 nt, Human
uacaaaauaaaaaccaaagaaacuaa

SEQ ID NO: 690342 - RNA, 22 nt, Human
ugaaaggacuacaaaauaaaaa

SEQ ID NO: 690343 - RNA, 21 nt, Human
uggcacauuaaaaauaacuga

SEQ ID NO: 690344 - RNA, 27 nt, Human
uggcugaguuuccugaaauguucuugu

SEQ ID NO: 690345 - RNA, 21 nt, Human
ugggugcaggugucugugauu

SEQ ID NO: 690346 - RNA, 23 nt, Human
uguaacagaaguauguugugggu

SEQ ID NO: 690347 - RNA, 21 nt, Human
uuacaaagccuauaccuuuga

SEQ ID NO: 690348 - RNA, 21 nt, Human
uucuuguguguaacagaaguu

SEQ ID NO: 690349 - RNA, 26 nt, Human
aaaagugcuuagaaaauaagauuuug

SEQ ID NO: 690350 - RNA, 18 nt, Human
acacucugaagccucugc

SEQ ID NO: 690351 - RNA, 25 nt, Human
acucugaagccucugcuguuaacca

SEQ ID NO: 690352 - RNA, 22 nt, Human
cccgaguacagguuacacucug

SEQ ID NO: 690353 - RNA, 18 nt, Human
ccucugcuguuaaccaca

SEQ ID NO: 690354 - RNA, 22 nt, Human
uacagguuacacucugaagccu

SEQ ID NO: 690355 - RNA, 24 nt, Human
ucugaagccucugcuguuaaccac

SEQ ID NO: 690356 - RNA, 22 nt, Human
ugaagccucugcuguuaaccac

SEQ ID NO: 690357 - RNA, 22 nt, Human
uugauaucaaaagugcuuagaa

SEQ ID NO: 690358 - RNA, 21 nt, Human
uuuaauaucucaaaaaggaag

SEQ ID NO: 690359 - RNA, 18 nt, Human
acugggucucgcuaguga

SEQ ID NO: 690360 - RNA, 21 nt, Human
agcaggauggggcagcagggg

SEQ ID NO: 690361 - RNA, 21 nt, Human
agucuguguugauuccagcag

SEQ ID NO: 690362 - RNA, 18 nt, Human
auggggcagcaggggcug

SEQ ID NO: 690363 - RNA, 24 nt, Human
caagucuguguugauuccagcagg

SEQ ID NO: 690364 - RNA, 23 nt, Human
caggugaugucuacauuuuccuu

SEQ ID NO: 690365 - RNA, 23 nt, Human
ccucugauuuaaaccucucuucc

SEQ ID NO: 690366 - RNA, 21 nt, Human
gaugucugaaaacagaggaua

SEQ ID NO: 690367 - RNA, 26 nt, Human
uaccuaggcuaagaucacgcuaugac

SEQ ID NO: 690368 - RNA, 22 nt, Human
ucaaucccucugauuuaaaccu

SEQ ID NO: 690369 - RNA, 19 nt, Human
ugaugucuacauuuuccuu

SEQ ID NO: 690370 - RNA, 23 nt, Human
uggaagcagcccagcaggcccac

SEQ ID NO: 690371 - RNA, 27 nt, Human
uguugauuccagcaggauggggcagca

SEQ ID NO: 690372 - RNA, 19 nt, Human
aaacaguggccaggugagc

SEQ ID NO: 690373 - RNA, 19 nt, Human
aacaguggccaggugagcc

SEQ ID NO: 690374 - RNA, 19 nt, Human
aaccagaaccccaggcccc

SEQ ID NO: 690375 - RNA, 21 nt, Human
aaccagugguugcuaucccca

SEQ ID NO: 690376 - RNA, 21 nt, Human
aagacauucuugaccccacag

SEQ ID NO: 690377 - RNA, 22 nt, Human
aagaccacaaucucagaagcuu

SEQ ID NO: 690378 - RNA, 22 nt, Human
aagagacucugaaaagaagaaa

SEQ ID NO: 690379 - RNA, 21 nt, Human
aagaucuugauggaggggagg

SEQ ID NO: 690380 - RNA, 22 nt, Human
aagcagaaccagcacacuugga

SEQ ID NO: 690381 - RNA, 21 nt, Human
aagccaacuccccuaugccca

SEQ ID NO: 690382 - RNA, 20 nt, Human
aagcuuuuuagcaggaagcc

SEQ ID NO: 690383 - RNA, 22 nt, Human
aaucucagcuuccaagucuaga

SEQ ID NO: 690384 - RNA, 21 nt, Human
acaggagaaagaccugaugaa

SEQ ID NO: 690385 - RNA, 26 nt, Human
accacauccuauaaagcauaauccca

SEQ ID NO: 690386 - RNA, 19 nt, Human
acccugggcugacagcacc

SEQ ID NO: 690387 - RNA, 19 nt, Human
accuccuggggcaaaagcc

SEQ ID NO: 690388 - RNA, 20 nt, Human
accuucugcuuagcugagac

SEQ ID NO: 690389 - RNA, 20 nt, Human
agaacacugagugcuugaaa

SEQ ID NO: 690390 - RNA, 19 nt, Human
agacccaauuuggcccugu

SEQ ID NO: 690391 - RNA, 21 nt, Human
agagaaaagaagugaaaaucc

SEQ ID NO: 690392 - RNA, 20 nt, Human
agagcaugccuggcacauuu

SEQ ID NO: 690393 - RNA, 24 nt, Human
agaugugucuuguaaaugaccaua

SEQ ID NO: 690394 - RNA, 23 nt, Human
agccaugaaauucugugugguug

SEQ ID NO: 690395 - RNA, 20 nt, Human
aggaaaggauuuagugccuu

SEQ ID NO: 690396 - RNA, 19 nt, Human
aggaugcuucgaggguucu

SEQ ID NO: 690397 - RNA, 20 nt, Human
aggaugcuucgaggguucug

SEQ ID NO: 690398 - RNA, 20 nt, Human
aggccagccagagaggucau

SEQ ID NO: 690399 - RNA, 20 nt, Human
aggcuggggcuggaagggcc

SEQ ID NO: 690400 - RNA, 19 nt, Human
agggaagagacucugaaaa

SEQ ID NO: 690401 - RNA, 18 nt, Human
agggaugcuuccucucug

SEQ ID NO: 690402 - RNA, 21 nt, Human
agguggggcuagaagacaggg

SEQ ID NO: 690403 - RNA, 23 nt, Human
agucuuagcccugugucaccucc

SEQ ID NO: 690404 - RNA, 19 nt, Human
auaaaaugacuguagcucc

SEQ ID NO: 690405 - RNA, 19 nt, Human
aucuaugugucugugaugc

SEQ ID NO: 690406 - RNA, 23 nt, Human
augaaauucugugugguugcgaa

SEQ ID NO: 690407 - RNA, 22 nt, Human
caacuccuuaaccucaccuccu

SEQ ID NO: 690408 - RNA, 20 nt, Human
caaguacaggagaaagaccu

SEQ ID NO: 690409 - RNA, 28 nt, Human
cacaagacauaccuaauagccggggccc

SEQ ID NO: 690410 - RNA, 22 nt, Human
caccauauggcuggucaugagc

SEQ ID NO: 690411 - RNA, 18 nt, Human
cacccugggcugacagca

SEQ ID NO: 690412 - RNA, 23 nt, Human
caccuguguacuagacuguuuuc

SEQ ID NO: 690413 - RNA, 23 nt, Human
cacugagcuguuagcacagcugc

SEQ ID NO: 690414 - RNA, 19 nt, Human
cagaaccccaggcccccaa

SEQ ID NO: 690415 - RNA, 24 nt, Human
cagagaagcaggacaggugggcac

SEQ ID NO: 690416 - RNA, 22 nt, Human
cagaggacucccaggacagcac

SEQ ID NO: 690417 - RNA, 18 nt, Human
cagaggacugggugggcc

SEQ ID NO: 690418 - RNA, 22 nt, Human
cagaugcaauuccccugccccg

SEQ ID NO: 690419 - RNA, 22 nt, Human
cagcaaggcaaauuucuaccuc

SEQ ID NO: 690420 - RNA, 21 nt, Human
cagcaccuguguacuagacug

SEQ ID NO: 690421 - RNA, 20 nt, Human
cagcuguauagcucauggau

SEQ ID NO: 690422 - RNA, 21 nt, Human
cagcugugcucuccaaggucu

SEQ ID NO: 690423 - RNA, 22 nt, Human
cagcuuagucacagaaauggac

SEQ ID NO: 690424 - RNA, 24 nt, Human
caggagaaagaccugaugaagaag

SEQ ID NO: 690425 - RNA, 23 nt, Human
caguggccuugcuaccuccaagg

SEQ ID NO: 690426 - RNA, 18 nt, Human
cagugguugcaaaccagu

SEQ ID NO: 690427 - RNA, 23 nt, Human
caugcugcaucucuuuccugcag

SEQ ID NO: 690428 - RNA, 22 nt, Human
cauugucaggaaaggauuuagu

SEQ ID NO: 690429 - RNA, 23 nt, Human
ccaaaugcuuuucauuucguccu

SEQ ID NO: 690430 - RNA, 21 nt, Human
ccaauccagaaacgaacuacc

SEQ ID NO: 690431 - RNA, 21 nt, Human
ccagugguugcaaaccagugg

SEQ ID NO: 690432 - RNA, 19 nt, Human
cccacagugaucucuaaag

SEQ ID NO: 690433 - RNA, 21 nt, Human
cccacccugggcugacagcac

SEQ ID NO: 690434 - RNA, 23 nt, Human
cccaguagagcuugggaccaagc

SEQ ID NO: 690435 - RNA, 22 nt, Human
cccaguggccuugcuaccucca

SEQ ID NO: 690436 - RNA, 24 nt, Human
cccauggguauguguguccagaag

SEQ ID NO: 690437 - RNA, 21 nt, Human
ccccagccucaccauauggcu

SEQ ID NO: 690438 - RNA, 23 nt, Human
ccccagcuucuucucuuugggcc

SEQ ID NO: 690439 - RNA, 19 nt, Human
ccccaucccacgccauucc

SEQ ID NO: 690440 - RNA, 25 nt, Human
ccccgggcucagcaaucauuuccug

SEQ ID NO: 690441 - RNA, 22 nt, Human
cccgggcucagcaaucauuucc

SEQ ID NO: 690442 - RNA, 23 nt, Human
cccugggcugacagcaccugugu

SEQ ID NO: 690443 - RNA, 21 nt, Human
ccggcagucaaagcaugcagc

SEQ ID NO: 690444 - RNA, 22 nt, Human
ccucccagacuaaccagccuuc

SEQ ID NO: 690445 - RNA, 22 nt, Human
ccucucaaacagagcaugccug

SEQ ID NO: 690446 - RNA, 19 nt, Human
ccugacuacagcugaaagg

SEQ ID NO: 690447 - RNA, 18 nt, Human
ccuggccuggcauugugu

SEQ ID NO: 690448 - RNA, 18 nt, Human
ccuggccuggcauugugu

SEQ ID NO: 690449 - RNA, 20 nt, Human
ccugucccugaagucagcac

SEQ ID NO: 690450 - RNA, 21 nt, Human
ccugucccugaagucagcacc

SEQ ID NO: 690451 - RNA, 21 nt, Human
ccugugacaggccugugggac

SEQ ID NO: 690452 - RNA, 20 nt, Human
ccuucucucucugcagcaag

SEQ ID NO: 690453 - RNA, 18 nt, Human
cuaaacaguggccaggug

SEQ ID NO: 690454 - RNA, 18 nt, Human
cuaaagucagcucaaagc

SEQ ID NO: 690455 - RNA, 23 nt, Human
cuaaccagaaccccaggccccca

SEQ ID NO: 690456 - RNA, 18 nt, Human
cucaggaauggacagacc

SEQ ID NO: 690457 - RNA, 19 nt, Human
cuccuaaacuuccaaaugc

SEQ ID NO: 690458 - RNA, 19 nt, Human
cuccugaaauaauaaaaug

SEQ ID NO: 690459 - RNA, 21 nt, Human
cuccugacuaugugaucuugc

SEQ ID NO: 690460 - RNA, 18 nt, Human
cuccuuaaccucaccucc

SEQ ID NO: 690461 - RNA, 25 nt, Human
cugaagcagcaaaaacugcugagag

SEQ ID NO: 690462 - RNA, 22 nt, Human
cugaggccggucgccgggucgc

SEQ ID NO: 690463 - RNA, 22 nt, Human
cugcugggcugucugagaauau

SEQ ID NO: 690464 - RNA, 23 nt, Human
cugggugggccagagaggggggc

SEQ ID NO: 690465 - RNA, 22 nt, Human
cuuaaaaaguguuaucugguag

SEQ ID NO: 690466 - RNA, 21 nt, Human
cuuaaccucaccuccuggggc

SEQ ID NO: 690467 - RNA, 20 nt, Human
cuugcccugcugucaaccuc

SEQ ID NO: 690468 - RNA, 24 nt, Human
gaagagacucugaaaagaagaaau

SEQ ID NO: 690469 - RNA, 20 nt, Human
gacaggugggcacucaggag

SEQ ID NO: 690470 - RNA, 23 nt, Human
gacaggugggcacucaggaguga

SEQ ID NO: 690471 - RNA, 18 nt, Human
gacccugccccucaccag

SEQ ID NO: 690472 - RNA, 18 nt, Human
gagaagcaggacaggugg

SEQ ID NO: 690473 - RNA, 24 nt, Human
gaggaagggcuugggcagaggacu

SEQ ID NO: 690474 - RNA, 24 nt, Human
gaggacucccaggacagcacugag

SEQ ID NO: 690475 - RNA, 18 nt, Human
gaggcagaacacugagug

SEQ ID NO: 690476 - RNA, 18 nt, Human
gcuaagccaggcugguga

SEQ ID NO: 690477 - RNA, 18 nt, Human
gcugaagcagcaaaaacu

SEQ ID NO: 690478 - RNA, 20 nt, Human
ggaagagacccccuuuaugg

SEQ ID NO: 690479 - RNA, 18 nt, Human
ggagaccccagcuucuuc

SEQ ID NO: 690480 - RNA, 18 nt, Human
ggaggccagccagagagg

SEQ ID NO: 690481 - RNA, 24 nt, Human
ggcagcugugcucuccaaggucug

SEQ ID NO: 690482 - RNA, 20 nt, Human
ggcuggaaguuugccucaca

SEQ ID NO: 690483 - RNA, 18 nt, Human
gggagguggccaugcccc

SEQ ID NO: 690484 - RNA, 24 nt, Human
gggauggggaagagacccccuuua

SEQ ID NO: 690485 - RNA, 19 nt, Human
gggcacucaggagugagga

SEQ ID NO: 690486 - RNA, 21 nt, Human
gggccagagaggggggcugga

SEQ ID NO: 690487 - RNA, 24 nt, Human
ggguauguguguccagaagccugg

SEQ ID NO: 690488 - RNA, 19 nt, Human
gguggucccaguuccuggc

SEQ ID NO: 690489 - RNA, 20 nt, Human
gguucuggccaagugggagg

SEQ ID NO: 690490 - RNA, 21 nt, Human
gucccuccuccugggaggcca

SEQ ID NO: 690491 - RNA, 24 nt, Human
gugaacuccccagccucaccauau

SEQ ID NO: 690492 - RNA, 27 nt, Human
uaagaugcucaucaauuagcccaaaaa

SEQ ID NO: 690493 - RNA, 23 nt, Human
uaaucccaggaucaagagaauuc

SEQ ID NO: 690494 - RNA, 22 nt, Human
uacccugccuggagaccccagc

SEQ ID NO: 690495 - RNA, 24 nt, Human
uagaguauauuuuaaccuccugaa

SEQ ID NO: 690496 - RNA, 23 nt, Human
uagccagcuccugggagcaaugc

SEQ ID NO: 690497 - RNA, 27 nt, Human
uagcugagacccugacggcuggaaguu

SEQ ID NO: 690498 - RNA, 19 nt, Human
uagucacagaaauggacag

SEQ ID NO: 690499 - RNA, 24 nt, Human
uagugaaaagcuuuucaccagaag

SEQ ID NO: 690500 - RNA, 21 nt, Human
uaugugagaaggcagauucug

SEQ ID NO: 690501 - RNA, 23 nt, Human
ucaaagaucuugauggaggggag

SEQ ID NO: 690502 - RNA, 18 nt, Human
ucaauguuuugauugucu

SEQ ID NO: 690503 - RNA, 22 nt, Human
ucacuuagugaaaagcuuuuca

SEQ ID NO: 690504 - RNA, 27 nt, Human
ucagcacccaaccggaguaaguaugua

SEQ ID NO: 690505 - RNA, 21 nt, Human
ucaggaauggacagacccaau

SEQ ID NO: 690506 - RNA, 19 nt, Human
ucauuucguccuucugcag

SEQ ID NO: 690507 - RNA, 18 nt, Human
ucccagacuaaccagccu

SEQ ID NO: 690508 - RNA, 24 nt, Human
uccccagccucaccauauggcugg

SEQ ID NO: 690509 - RNA, 23 nt, Human
ucccccagaguuuucaccugcag

SEQ ID NO: 690510 - RNA, 19 nt, Human
uccuaaccagaaccccagg

SEQ ID NO: 690511 - RNA, 18 nt, Human
uccugaaauaauaaaaug

SEQ ID NO: 690512 - RNA, 19 nt, Human
ucgcgggccggcagcugug

SEQ ID NO: 690513 - RNA, 18 nt, Human
ucgcuggauggcuccgag

SEQ ID NO: 690514 - RNA, 23 nt, Human
ucgcuggauggcuccgagccucg

SEQ ID NO: 690515 - RNA, 20 nt, Human
ucucuuuugcagggugaggu

SEQ ID NO: 690516 - RNA, 21 nt, Human
ucugaaacuaaacccaaucca

SEQ ID NO: 690517 - RNA, 24 nt, Human
ucugagucagaggacucccaggac

SEQ ID NO: 690518 - RNA, 19 nt, Human
ucuuucuuuucuuuccccc

SEQ ID NO: 690519 - RNA, 18 nt, Human
ugaaaauccucaccucca

SEQ ID NO: 690520 - RNA, 18 nt, Human
ugaaauagcuccucccag

SEQ ID NO: 690521 - RNA, 24 nt, Human
ugaaauagcuccucccagacuaaa

SEQ ID NO: 690522 - RNA, 21 nt, Human
ugaagcagcaaaaacugcuga

SEQ ID NO: 690523 - RNA, 24 nt, Human
ugaagcagcaaaaacugcugagag

SEQ ID NO: 690524 - RNA, 22 nt, Human
ugacagcaccuguguacuagac

SEQ ID NO: 690525 - RNA, 22 nt, Human
ugacagcaccuguguacuagac

SEQ ID NO: 690526 - RNA, 23 nt, Human
ugacauaaauuucauuuuucuua

SEQ ID NO: 690527 - RNA, 20 nt, Human
ugagaaggcagauucuggga

SEQ ID NO: 690528 - RNA, 20 nt, Human
ugagaauauugggccugagg

SEQ ID NO: 690529 - RNA, 19 nt, Human
ugagaguggcagcucagga

SEQ ID NO: 690530 - RNA, 18 nt, Human
ugagcacacagucccugg

SEQ ID NO: 690531 - RNA, 24 nt, Human
ugccauugucaggaaaggauuuag

SEQ ID NO: 690532 - RNA, 19 nt, Human
ugccuaaacaguggccagg

SEQ ID NO: 690533 - RNA, 19 nt, Human
uggaagauguugaacuacc

SEQ ID NO: 690534 - RNA, 21 nt, Human
uggaggggaggaagggcuugg

SEQ ID NO: 690535 - RNA, 20 nt, Human
uggccaagugggaggugggg

SEQ ID NO: 690536 - RNA, 21 nt, Human
uggccaugccccuucuggcca

SEQ ID NO: 690537 - RNA, 23 nt, Human
uggcuccuaaacuuccaaaugcu

SEQ ID NO: 690538 - RNA, 24 nt, Human
ugggacacccaggaguaugcagga

SEQ ID NO: 690539 - RNA, 24 nt, Human
ugggaggccagccagagaggucau

SEQ ID NO: 690540 - RNA, 18 nt, Human
ugggaucuggagccucag

SEQ ID NO: 690541 - RNA, 21 nt, Human
ugggcagaggacugggugggc

SEQ ID NO: 690542 - RNA, 24 nt, Human
uggggcuagaagacaggguacugg

SEQ ID NO: 690543 - RNA, 22 nt, Human
ugggugggccagagaggggggc

SEQ ID NO: 690544 - RNA, 21 nt, Human
uguagcagaaaguugcuuguu

SEQ ID NO: 690545 - RNA, 20 nt, Human
uguccugggccaccuguugu

SEQ ID NO: 690546 - RNA, 18 nt, Human
ugugaguauagaaugaga

SEQ ID NO: 690547 - RNA, 19 nt, Human
ugugaugcugacugaccgc

SEQ ID NO: 690548 - RNA, 23 nt, Human
uguggcaagucucucucagcugg

SEQ ID NO: 690549 - RNA, 18 nt, Human
uguggcagugaaggaaca

SEQ ID NO: 690550 - RNA, 25 nt, Human
uuagucuuaaaaaguguuaucuggu

SEQ ID NO: 690551 - RNA, 23 nt, Human
uucauuuaaucauuuuauaauaa

SEQ ID NO: 690552 - RNA, 18 nt, Human
uuccagagggcacaagau

SEQ ID NO: 690553 - RNA, 18 nt, Human
uuccuggccuggcauugu

SEQ ID NO: 690554 - RNA, 18 nt, Human
uugcagggugaggugguc

SEQ ID NO: 690555 - RNA, 20 nt, Human
uugcuaccuccaagggccca

SEQ ID NO: 690556 - RNA, 22 nt, Human
aaacucaagaccaccaacuggc

SEQ ID NO: 690557 - RNA, 24 nt, Human
aaagagaaaacucaagaccaccaa

SEQ ID NO: 690558 - RNA, 23 nt, Human
aagaaagagaaaacucaagacca

SEQ ID NO: 690559 - RNA, 18 nt, Human
aagagaaaacucaagacc

SEQ ID NO: 690560 - RNA, 20 nt, Human
acaguagaguaauuuugcug

SEQ ID NO: 690561 - RNA, 18 nt, Human
agaaaacucaagaccacc

SEQ ID NO: 690562 - RNA, 19 nt, Human
agaaagagaaaacucaaga

SEQ ID NO: 690563 - RNA, 24 nt, Human
caaacaagcggaaucauccagcaa

SEQ ID NO: 690564 - RNA, 22 nt, Human
ccagcaaggcaaacgcgaaguc

SEQ ID NO: 690565 - RNA, 20 nt, Human
cggaaucauccagcaaggca

SEQ ID NO: 690566 - RNA, 21 nt, Human
gcgaagucggcagcacugcca

SEQ ID NO: 690567 - RNA, 21 nt, Human
ggcagcacugccaccucuggu

SEQ ID NO: 690568 - RNA, 19 nt, Human
ugcaagaaagagaaaacuc

SEQ ID NO: 690569 - RNA, 22 nt, Human
uuaacaguagaguaauuuugcu

SEQ ID NO: 690570 - RNA, 21 nt, Human
aaaacacaagcccacauccca

SEQ ID NO: 690571 - RNA, 23 nt, Human
aaacaagccaggacagaguccac

SEQ ID NO: 690572 - RNA, 21 nt, Human
aaacacaagcccacaucccag

SEQ ID NO: 690573 - RNA, 21 nt, Human
aaacaggcuccucucccaucu

SEQ ID NO: 690574 - RNA, 24 nt, Human
aaacaggcuccucucccaucuccc

SEQ ID NO: 690575 - RNA, 18 nt, Human
aaccagcucuugcuucgg

SEQ ID NO: 690576 - RNA, 21 nt, Human
aaguccucgugcugggccucg

SEQ ID NO: 690577 - RNA, 23 nt, Human
aaucacuuccccagcccuuccau

SEQ ID NO: 690578 - RNA, 18 nt, Human
acagaacaagggggcaag

SEQ ID NO: 690579 - RNA, 23 nt, Human
acagugacaaaacacaagcccac

SEQ ID NO: 690580 - RNA, 18 nt, Human
accccaggguaaguccuc

SEQ ID NO: 690581 - RNA, 19 nt, Human
acuucacccccuagggaca

SEQ ID NO: 690582 - RNA, 21 nt, Human
agaaacccaaaguucccagag

SEQ ID NO: 690583 - RNA, 18 nt, Human
agcucuuuagcuucagau

SEQ ID NO: 690584 - RNA, 22 nt, Human
aggacagaguccacccuccagg

SEQ ID NO: 690585 - RNA, 20 nt, Human
aggcaggggguguggggugg

SEQ ID NO: 690586 - RNA, 22 nt, Human
aggcaggggguguggggugucc

SEQ ID NO: 690587 - RNA, 24 nt, Human
agggaggugaagccgugggagaag

SEQ ID NO: 690588 - RNA, 26 nt, Human
agggggauacagaacaagggggcaag

SEQ ID NO: 690589 - RNA, 22 nt, Human
agucaaaucccaaggcaccggu

SEQ ID NO: 690590 - RNA, 22 nt, Human
aucucccccuucacagugacaa

SEQ ID NO: 690591 - RNA, 21 nt, Human
caagggcaaagggggauacag

SEQ ID NO: 690592 - RNA, 23 nt, Human
caccuagcaucauagcugcaaca

SEQ ID NO: 690593 - RNA, 19 nt, Human
cagaaucagauugccuucc

SEQ ID NO: 690594 - RNA, 21 nt, Human
cagaccccaccccaaaacagg

SEQ ID NO: 690595 - RNA, 24 nt, Human
cagacuccaaaacccacacucaau

SEQ ID NO: 690596 - RNA, 23 nt, Human
cagcaacucuagucaaaucccaa

SEQ ID NO: 690597 - RNA, 24 nt, Human
cagcccuuccaucgccuuuuuuga

SEQ ID NO: 690598 - RNA, 19 nt, Human
caggcuccucucccaucuc

SEQ ID NO: 690599 - RNA, 23 nt, Human
caggcuccucucccaucuccccc

SEQ ID NO: 690600 - RNA, 21 nt, Human
ccaaaacccacacucaauuug

SEQ ID NO: 690601 - RNA, 25 nt, Human
ccaaaacccacacucaauuugcuac

SEQ ID NO: 690602 - RNA, 22 nt, Human
ccaaaccuaacaaaaccccagg

SEQ ID NO: 690603 - RNA, 23 nt, Human
ccaagaucacuuggccuggauuu

SEQ ID NO: 690604 - RNA, 20 nt, Human
cccacacucaauuugcuaca

SEQ ID NO: 690605 - RNA, 21 nt, Human
cccagcccuuccaucgccuuu

SEQ ID NO: 690606 - RNA, 21 nt, Human
ccccaaaacaggcuccucucc

SEQ ID NO: 690607 - RNA, 23 nt, Human
ccccaccccaaaacaggcuccuc

SEQ ID NO: 690608 - RNA, 21 nt, Human
ccccagaccccaccccaaaac

SEQ ID NO: 690609 - RNA, 23 nt, Human
ccccagaccccaccccaaaacag

SEQ ID NO: 690610 - RNA, 22 nt, Human
ccccuagggacagcugcuucca

SEQ ID NO: 690611 - RNA, 24 nt, Human
ccccuucacagugacaaaacacaa

SEQ ID NO: 690612 - RNA, 22 nt, Human
ccucgugcugggccucgagccc

SEQ ID NO: 690613 - RNA, 19 nt, Human
ccuggauuugagccugagg

SEQ ID NO: 690614 - RNA, 22 nt, Human
cuccaaaacccacacucaauuu

SEQ ID NO: 690615 - RNA, 21 nt, Human
cuuccaaaccuaacaaaaccc

SEQ ID NO: 690616 - RNA, 20 nt, Human
cuuccccagcccuuccaucg

SEQ ID NO: 690617 - RNA, 18 nt, Human
gcugcuguggcugccacc

SEQ ID NO: 690618 - RNA, 20 nt, Human
gggcugggccaggccaaggc

SEQ ID NO: 690619 - RNA, 18 nt, Human
gggcuggugauuuugcuc

SEQ ID NO: 690620 - RNA, 21 nt, Human
ggggccaaggcagcugugagc

SEQ ID NO: 690621 - RNA, 23 nt, Human
gggggggacuucacccccuaggg

SEQ ID NO: 690622 - RNA, 21 nt, Human
ggguaaguccucgugcugggc

SEQ ID NO: 690623 - RNA, 24 nt, Human
gguggggccaaggcagcugugagc

SEQ ID NO: 690624 - RNA, 21 nt, Human
gugggagaagcagggguaaaa

SEQ ID NO: 690625 - RNA, 18 nt, Human
uaaaaaaaaaaagggggg

SEQ ID NO: 690626 - RNA, 22 nt, Human
uacagaacaagggggcaaguac

SEQ ID NO: 690627 - RNA, 19 nt, Human
uagcaucauagcugcaaca

SEQ ID NO: 690628 - RNA, 22 nt, Human
uauuuaaucacuuccccagccc

SEQ ID NO: 690629 - RNA, 23 nt, Human
uccaaaacccacacucaauuugc

SEQ ID NO: 690630 - RNA, 25 nt, Human
uccaaaccuaacaaaaccccagggu

SEQ ID NO: 690631 - RNA, 18 nt, Human
ucccagagauuaacuugc

SEQ ID NO: 690632 - RNA, 19 nt, Human
ucccagagauuaacuugcc

SEQ ID NO: 690633 - RNA, 19 nt, Human
uccccagaccccaccccaa

SEQ ID NO: 690634 - RNA, 19 nt, Human
uccccagaccccaccccaa

SEQ ID NO: 690635 - RNA, 19 nt, Human
ucccugaggcugcuguggc

SEQ ID NO: 690636 - RNA, 19 nt, Human
uccucucccaucucccccu

SEQ ID NO: 690637 - RNA, 21 nt, Human
ucucccaucucccccuucaca

SEQ ID NO: 690638 - RNA, 20 nt, Human
ugacaaaacacaagcccaca

SEQ ID NO: 690639 - RNA, 23 nt, Human
ugacaaaacacaagcccacaucc

SEQ ID NO: 690640 - RNA, 19 nt, Human
ugagcaaaaggagaaguau

SEQ ID NO: 690641 - RNA, 25 nt, Human
ugaggacaccaaacaagcuggagac

SEQ ID NO: 690642 - RNA, 22 nt, Human
ugcaugcauuugcauagacggc

SEQ ID NO: 690643 - RNA, 21 nt, Human
uggaagggcaaggcaagggca

SEQ ID NO: 690644 - RNA, 23 nt, Human
uggauuugagccugaggcucaga

SEQ ID NO: 690645 - RNA, 18 nt, Human
ugggauggacccauccau

SEQ ID NO: 690646 - RNA, 19 nt, Human
ugggccucgagccagcaac

SEQ ID NO: 690647 - RNA, 21 nt, Human
uggggacauacacucaagagg

SEQ ID NO: 690648 - RNA, 23 nt, Human
uuaaucacuuccccagcccuucc

SEQ ID NO: 690649 - RNA, 19 nt, Human
uuauuuaaucacuucccca

SEQ ID NO: 690650 - RNA, 24 nt, Human
uuucuugcguugcuuuuauuuaau

SEQ ID NO: 690651 - RNA, 18 nt, Human
uuuuuuuuuuuuuucuug

SEQ ID NO: 690652 - RNA, 22 nt, Human
uuuuuuuuuuuuuucuugcguu

SEQ ID NO: 690653 - RNA, 20 nt, Human
aaacaggacucaauacuaca

SEQ ID NO: 690654 - RNA, 24 nt, Human
aaacaggacucaauacuacaccuc

SEQ ID NO: 690655 - RNA, 18 nt, Human
agagacaaaggcaaggga

SEQ ID NO: 690656 - RNA, 18 nt, Human
aggcaagggaggagaggc

SEQ ID NO: 690657 - RNA, 18 nt, Human
agggaggagaggcaaggg

SEQ ID NO: 690658 - RNA, 27 nt, Human
caggaaaaagagaacaauagcucaaac

SEQ ID NO: 690659 - RNA, 23 nt, Human
cucaauacuacaccucacaaacu

SEQ ID NO: 690660 - RNA, 24 nt, Human
gaaaaagagaacaauagcucaaac

SEQ ID NO: 690661 - RNA, 21 nt, Human
gacucaauacuacaccucaca

SEQ ID NO: 690662 - RNA, 18 nt, Human
gaggcaagggcuugcagu

SEQ ID NO: 690663 - RNA, 21 nt, Human
ggacugaagagacaaaggcaa

SEQ ID NO: 690664 - RNA, 18 nt, Human
ggaggagaggcaagggcu

SEQ ID NO: 690665 - RNA, 18 nt, Human
gggagcaagauauucucc

SEQ ID NO: 690666 - RNA, 22 nt, Human
gggagcaagauauucucccuuu

SEQ ID NO: 690667 - RNA, 18 nt, Human
gggcaacaccaggcugac

SEQ ID NO: 690668 - RNA, 19 nt, Human
ugacucaggaggggagcaa

SEQ ID NO: 690669 - RNA, 21 nt, Human
ugagaucacacaaacaagugg

SEQ ID NO: 690670 - RNA, 23 nt, Human
ugagaucacacaaacaaguggga

SEQ ID NO: 690671 - RNA, 19 nt, Human
ugcacauaaggggaauaaa

SEQ ID NO: 690672 - RNA, 22 nt, Human
aaaaaaaaaucccaaccaacaa

SEQ ID NO: 690673 - RNA, 25 nt, Human
aaaaaaaagacagcaauaaauccaa

SEQ ID NO: 690674 - RNA, 22 nt, Human
aaaaaacagucccugaaaucug

SEQ ID NO: 690675 - RNA, 25 nt, Human
aaaagaaaaaaaaaaacagucccug

SEQ ID NO: 690676 - RNA, 21 nt, Human
aaacaggaaaaaagaaaaaga

SEQ ID NO: 690677 - RNA, 22 nt, Human
aacaaauuugucacauugggcc

SEQ ID NO: 690678 - RNA, 18 nt, Human
aagcggccuuggagucuu

SEQ ID NO: 690679 - RNA, 24 nt, Human
aagcggccuuggagucuuccaguc

SEQ ID NO: 690680 - RNA, 25 nt, Human
aauacagaaagaaaauaucauacaa

SEQ ID NO: 690681 - RNA, 24 nt, Human
aauccacauggcucuuguaaaaag

SEQ ID NO: 690682 - RNA, 24 nt, Human
acaagccaguuacaaaaaaaaaaa

SEQ ID NO: 690683 - RNA, 20 nt, Human
agaaagaaaauaucauacaa

SEQ ID NO: 690684 - RNA, 24 nt, Human
agaaauacagaaagaaaauaucau

SEQ ID NO: 690685 - RNA, 22 nt, Human
agacagcaauaaauccaaucca

SEQ ID NO: 690686 - RNA, 20 nt, Human
agccuggacauccaacauuu

SEQ ID NO: 690687 - RNA, 22 nt, Human
aggugguuuuuagaggccacag

SEQ ID NO: 690688 - RNA, 20 nt, Human
auagagaaauacagaaagaa

SEQ ID NO: 690689 - RNA, 21 nt, Human
caagcggccuuggagucuucc

SEQ ID NO: 690690 - RNA, 20 nt, Human
caccgccuccuguuucuugc

SEQ ID NO: 690691 - RNA, 18 nt, Human
caggaaaaaagaaaaaga

SEQ ID NO: 690692 - RNA, 22 nt, Human
caggaaaaaagaaaaagaaaaa

SEQ ID NO: 690693 - RNA, 22 nt, Human
ccaccgccuccuguuucuugcu

SEQ ID NO: 690694 - RNA, 24 nt, Human
ccaguuacaaaaaaaaaaaaaaaa

SEQ ID NO: 690695 - RNA, 27 nt, Human
ccaguuacaaaaaaaaaaaaaaaaucc

SEQ ID NO: 690696 - RNA, 22 nt, Human
ccucaaaaaaaagacagcaaua

SEQ ID NO: 690697 - RNA, 18 nt, Human
ccuuagucauccugguga

SEQ ID NO: 690698 - RNA, 22 nt, Human
cuagccuggacauccaacauuu

SEQ ID NO: 690699 - RNA, 23 nt, Human
cucaaagacaagcggccuuggag

SEQ ID NO: 690700 - RNA, 24 nt, Human
cugcauuagaaaacaggaaaaaag

SEQ ID NO: 690701 - RNA, 18 nt, Human
ggagucuuccaguccaua

SEQ ID NO: 690702 - RNA, 21 nt, Human
uacaaaaaaaaaaaaaaaauc

SEQ ID NO: 690703 - RNA, 22 nt, Human
uacaaaaaaaaaaaaaaaaucc

SEQ ID NO: 690704 - RNA, 22 nt, Human
uacaaaaugauauagagaaaua

SEQ ID NO: 690705 - RNA, 22 nt, Human
uagaaaacaggaaaaaagaaaa

SEQ ID NO: 690706 - RNA, 18 nt, Human
uagcaaucaagccucaaa

SEQ ID NO: 690707 - RNA, 18 nt, Human
ucccugaaaucuggcagg

SEQ ID NO: 690708 - RNA, 22 nt, Human
ugauuuauagcaaucaagccuc

SEQ ID NO: 690709 - RNA, 22 nt, Human
ugcagucugaggucucaaagac

SEQ ID NO: 690710 - RNA, 22 nt, Human
uggagucuuccaguccauaucu

SEQ ID NO: 690711 - RNA, 23 nt, Human
uuguauucuguggccacaucaug

SEQ ID NO: 690712 - RNA, 22 nt, Human
aaaacaguaaaaucaguaaacc

SEQ ID NO: 690713 - RNA, 24 nt, Human
aaacaguaaaaucaguaaaccaaa

SEQ ID NO: 690714 - RNA, 22 nt, Human
aagaauuggugguuguugggac

SEQ ID NO: 690715 - RNA, 18 nt, Human
agagcccaauugugucuu

SEQ ID NO: 690716 - RNA, 23 nt, Human
aucaguaaaccaaacuccacucc

SEQ ID NO: 690717 - RNA, 21 nt, Human
auucauacuaagcugcauuuc

SEQ ID NO: 690718 - RNA, 23 nt, Human
cacaaaacaguaaaaucaguaaa

SEQ ID NO: 690719 - RNA, 20 nt, Human
caguaaaaucaguaaaccaa

SEQ ID NO: 690720 - RNA, 22 nt, Human
ccaaacuccacuccugcuggcu

SEQ ID NO: 690721 - RNA, 18 nt, Human
guugggacaauuucuugg

SEQ ID NO: 690722 - RNA, 22 nt, Human
uaaaaucaguaaaccaaacucc

SEQ ID NO: 690723 - RNA, 22 nt, Human
uaaaaucaguaaaccaaacucc

SEQ ID NO: 690724 - RNA, 27 nt, Human
uaacuccauuaaaauaaagauucauga

SEQ ID NO: 690725 - RNA, 22 nt, Human
uccaaauacauuuuccugugcu

SEQ ID NO: 690726 - RNA, 18 nt, Human
uguugggacaauuucuug

SEQ ID NO: 690727 - RNA, 21 nt, Human
uugcugacucuguguccagcc

SEQ ID NO: 690728 - RNA, 19 nt, Human
uuggugguuguugggacaa

SEQ ID NO: 690729 - RNA, 19 nt, Human
uuuuuuuuuugcagagccc

SEQ ID NO: 690730 - RNA, 18 nt, Human
uuuuuuuuuuuuuuuuug

SEQ ID NO: 690731 - RNA, 21 nt, Human
uuuuuuuuuuuuuuuuugcag

SEQ ID NO: 690732 - RNA, 23 nt, Human
aaaaaaaaaaagcccucagaaaa

SEQ ID NO: 690733 - RNA, 24 nt, Human
aaagcccucagaaaauuucucaca

SEQ ID NO: 690734 - RNA, 25 nt, Human
aacacucuucuaugaacaaccacca

SEQ ID NO: 690735 - RNA, 20 nt, Human
accaccaccaccaaaaaaaa

SEQ ID NO: 690736 - RNA, 23 nt, Human
accaccaccaccaaaaaaaaaaa

SEQ ID NO: 690737 - RNA, 21 nt, Human
caaaaaaaaaaaaagcccuca

SEQ ID NO: 690738 - RNA, 20 nt, Human
caaaagggauaaaccuaaau

SEQ ID NO: 690739 - RNA, 19 nt, Human
caccaaaaaaaaaaaaagc

SEQ ID NO: 690740 - RNA, 20 nt, Human
caccaaaaaaaaaaaaagcc

SEQ ID NO: 690741 - RNA, 24 nt, Human
ccaccaaaaaaaaaaaaagcccuc

SEQ ID NO: 690742 - RNA, 22 nt, Human
cucaaaauccuuuacaaaagga

SEQ ID NO: 690743 - RNA, 21 nt, Human
cuuguuaucauuagagaggga

SEQ ID NO: 690744 - RNA, 20 nt, Human
gaacaaccaccaccaccaaa

SEQ ID NO: 690745 - RNA, 23 nt, Human
gaacacucuucuaugaacaacca

SEQ ID NO: 690746 - RNA, 23 nt, Human
uccuuuacaaaaggagauaguuc

SEQ ID NO: 690747 - RNA, 25 nt, Human
ucuaugaacaaccaccaccaccaaa

SEQ ID NO: 690748 - RNA, 21 nt, Human
uuuuuuuuuuucaaaagggau

SEQ ID NO: 690749 - RNA, 21 nt, Human
uuuuuuuuuuuuucaaaaggg

SEQ ID NO: 690750 - RNA, 24 nt, Human
uuuuuuuuuuuuuuuucaaaaggg

SEQ ID NO: 690751 - RNA, 23 nt, Human
aaaagacaaaauuuaagccaaaa

SEQ ID NO: 690752 - RNA, 23 nt, Human
aaaagacaggggcaggcaguggg

SEQ ID NO: 690753 - RNA, 23 nt, Human
aaagacaggggcaggcagguccc

SEQ ID NO: 690754 - RNA, 19 nt, Human
aaccaaggggaaaagacag

SEQ ID NO: 690755 - RNA, 18 nt, Human
aaccccagccucuuucca

SEQ ID NO: 690756 - RNA, 25 nt, Human
aacucuuguaacacaaaaccaaggg

SEQ ID NO: 690757 - RNA, 19 nt, Human
aaggggccuggggggaggg

SEQ ID NO: 690758 - RNA, 24 nt, Human
acaaaaccaaggggaaaagacagg

SEQ ID NO: 690759 - RNA, 19 nt, Human
agacaaaauuuaagccaaa

SEQ ID NO: 690760 - RNA, 18 nt, Human
agaggaaaggggccuggg

SEQ ID NO: 690761 - RNA, 21 nt, Human
agaggcuggggcugggcuggg

SEQ ID NO: 690762 - RNA, 21 nt, Human
aggcaggucccagcuccugug

SEQ ID NO: 690763 - RNA, 18 nt, Human
aggcuggggcugggcugg

SEQ ID NO: 690764 - RNA, 22 nt, Human
aggggccuggggggaggggcgg

SEQ ID NO: 690765 - RNA, 19 nt, Human
augggaaccccagccucuu

SEQ ID NO: 690766 - RNA, 22 nt, Human
caaaagacacuaguaaggaagu

SEQ ID NO: 690767 - RNA, 26 nt, Human
caacuucaaaagacaaaauuuaagcc

SEQ ID NO: 690768 - RNA, 22 nt, Human
cacaaaaccaaggggaaaagac

SEQ ID NO: 690769 - RNA, 22 nt, Human
cacacuugggaacgggagcuaa

SEQ ID NO: 690770 - RNA, 20 nt, Human
cacuccuguuccucuuuccc

SEQ ID NO: 690771 - RNA, 23 nt, Human
cagagccuuuucuaaacuggaaa

SEQ ID NO: 690772 - RNA, 22 nt, Human
cagccaccaccacaagaggcuu

SEQ ID NO: 690773 - RNA, 19 nt, Human
cagcuccuguggucccucc

SEQ ID NO: 690774 - RNA, 20 nt, Human
cagcuccuguggucccuccu

SEQ ID NO: 690775 - RNA, 24 nt, Human
caggagcaggcgcacuggcccuug

SEQ ID NO: 690776 - RNA, 20 nt, Human
cagggcugaagaguuggaga

SEQ ID NO: 690777 - RNA, 18 nt, Human
cagggucccucagugcug

SEQ ID NO: 690778 - RNA, 18 nt, Human
caggucccagcuccugug

SEQ ID NO: 690779 - RNA, 18 nt, Human
cagugugacuccgcacau

SEQ ID NO: 690780 - RNA, 24 nt, Human
caucugaaacugucuccaacaacu

SEQ ID NO: 690781 - RNA, 24 nt, Human
ccacagggcauagggggcacagcc

SEQ ID NO: 690782 - RNA, 22 nt, Human
cccgccugcacccccacuccca

SEQ ID NO: 690783 - RNA, 24 nt, Human
cccucagugcugcccgccugcacc

SEQ ID NO: 690784 - RNA, 21 nt, Human
ccuccagccccucuggagucc

SEQ ID NO: 690785 - RNA, 19 nt, Human
ccugcacccccacucccag

SEQ ID NO: 690786 - RNA, 22 nt, Human
ccuggcccggagaccaggaacc

SEQ ID NO: 690787 - RNA, 21 nt, Human
cggcacugcagugugacuccg

SEQ ID NO: 690788 - RNA, 19 nt, Human
cucuuucucagagcugggg

SEQ ID NO: 690789 - RNA, 24 nt, Human
cugaagaguuggagaggaaggcug

SEQ ID NO: 690790 - RNA, 19 nt, Human
cugcacccccacucccagg

SEQ ID NO: 690791 - RNA, 21 nt, Human
gaaaagacaggggcaggcagg

SEQ ID NO: 690792 - RNA, 19 nt, Human
gaaaugccacagggcauag

SEQ ID NO: 690793 - RNA, 20 nt, Human
gaagaguuggagaggaaggc

SEQ ID NO: 690794 - RNA, 19 nt, Human
gagcaggcgcacuggcccu

SEQ ID NO: 690795 - RNA, 19 nt, Human
gagcuaauacuguucggca

SEQ ID NO: 690796 - RNA, 21 nt, Human
gcacagccaccaccacaagag

SEQ ID NO: 690797 - RNA, 21 nt, Human
gccgcgagcccgcucaauccg

SEQ ID NO: 690798 - RNA, 25 nt, Human
gcggcugggcaguggcugcugggug

SEQ ID NO: 690799 - RNA, 19 nt, Human
gcggggcagggucccucag

SEQ ID NO: 690800 - RNA, 20 nt, Human
gcggggcagggucccucagu

SEQ ID NO: 690801 - RNA, 18 nt, Human
gcugcugggugagacagg

SEQ ID NO: 690802 - RNA, 19 nt, Human
ggaaagaccaggagucugg

SEQ ID NO: 690803 - RNA, 21 nt, Human
ggaaagaccaggagucuggca

SEQ ID NO: 690804 - RNA, 19 nt, Human
ggagcaggcgcacuggccc

SEQ ID NO: 690805 - RNA, 21 nt, Human
ggcacagccaccaccacaaga

SEQ ID NO: 690806 - RNA, 18 nt, Human
ggcagccccuucuccugg

SEQ ID NO: 690807 - RNA, 18 nt, Human
ggccuggggggaggggcg

SEQ ID NO: 690808 - RNA, 27 nt, Human
ggcgcugggauugcaguggucgagucc

SEQ ID NO: 690809 - RNA, 21 nt, Human
ggcugcugggugagacagguc

SEQ ID NO: 690810 - RNA, 21 nt, Human
gggaagaagagggcuucucag

SEQ ID NO: 690811 - RNA, 18 nt, Human
gggcaggcaggucccagc

SEQ ID NO: 690812 - RNA, 23 nt, Human
gggggaggggcggggcagggucc

SEQ ID NO: 690813 - RNA, 23 nt, Human
gguugccaguaagacgcagaaau

SEQ ID NO: 690814 - RNA, 21 nt, Human
guaauuccaauucuaaacuuc

SEQ ID NO: 690815 - RNA, 19 nt, Human
guugagaaguggccuuccu

SEQ ID NO: 690816 - RNA, 18 nt, Human
uaaauaaucaucugaaac

SEQ ID NO: 690817 - RNA, 24 nt, Human
ucaauccgcgcgacugcggcugcc

SEQ ID NO: 690818 - RNA, 21 nt, Human
ucagugcugcccgccugcacc

SEQ ID NO: 690819 - RNA, 18 nt, Human
ucccgggauuaagcauuc

SEQ ID NO: 690820 - RNA, 24 nt, Human
ucccucagugcugcccgccugcca

SEQ ID NO: 690821 - RNA, 25 nt, Human
ucccuccuuggcacagagccuuuuc

SEQ ID NO: 690822 - RNA, 20 nt, Human
uccgcacauacaaguagggc

SEQ ID NO: 690823 - RNA, 20 nt, Human
ugacccgagauccccauggc

SEQ ID NO: 690824 - RNA, 21 nt, Human
ugagaaguggccuuccuuggg

SEQ ID NO: 690825 - RNA, 22 nt, Human
ugagacaggucagucucacuug

SEQ ID NO: 690826 - RNA, 19 nt, Human
ugcagaggaaaggggccug

SEQ ID NO: 690827 - RNA, 21 nt, Human
ugcagaggaaaggggccuggg

SEQ ID NO: 690828 - RNA, 18 nt, Human
ugccacagggcauagggg

SEQ ID NO: 690829 - RNA, 24 nt, Human
ugccuccagccccucuggaguccu

SEQ ID NO: 690830 - RNA, 20 nt, Human
ugccuggagugcggcugggc

SEQ ID NO: 690831 - RNA, 22 nt, Human
ugccuggagugcggcugggcag

SEQ ID NO: 690832 - RNA, 20 nt, Human
uggaaagaccaggagucugg

SEQ ID NO: 690833 - RNA, 25 nt, Human
uggagaggaaggcuggaacugaccc

SEQ ID NO: 690834 - RNA, 24 nt, Human
uggaggggcagccccuucuccugg

SEQ ID NO: 690835 - RNA, 21 nt, Human
uggcccggagaccaggaaccc

SEQ ID NO: 690836 - RNA, 20 nt, Human
uggcugccugggacuggagu

SEQ ID NO: 690837 - RNA, 24 nt, Human
ugucuccaacaacucuuguaacac

SEQ ID NO: 690838 - RNA, 19 nt, Human
uguuccagcgagggcugcu

SEQ ID NO: 690839 - RNA, 22 nt, Human
uucaaaagacaaaauuuaagcc

SEQ ID NO: 690840 - RNA, 23 nt, Human
uucaaaagacaaaauuuaagccc

SEQ ID NO: 690841 - RNA, 23 nt, Human
aaaacacccagaauggaaaagca

SEQ ID NO: 690842 - RNA, 27 nt, Human
aaacacccagaauggaaaagcagagaa

SEQ ID NO: 690843 - RNA, 20 nt, Human
aaacaucccacgaacaucaa

SEQ ID NO: 690844 - RNA, 25 nt, Human
aaacaucccacgaacaucaaguuca

SEQ ID NO: 690845 - RNA, 23 nt, Human
aauuuugucucucuugauuaaac

SEQ ID NO: 690846 - RNA, 19 nt, Human
acccaggugcuugcuuugg

SEQ ID NO: 690847 - RNA, 23 nt, Human
agcaggcggugccgagggggccg

SEQ ID NO: 690848 - RNA, 18 nt, Human
aggcagaggagcaugcag

SEQ ID NO: 690849 - RNA, 23 nt, Human
aggccugaggcuuaugcaagaga

SEQ ID NO: 690850 - RNA, 19 nt, Human
aggcggugccgagggggcc

SEQ ID NO: 690851 - RNA, 21 nt, Human
aggcguggcugagggaggcuc

SEQ ID NO: 690852 - RNA, 22 nt, Human
aguaacugcgaagggugggcac

SEQ ID NO: 690853 - RNA, 22 nt, Human
caauccagcccugagcuccuca

SEQ ID NO: 690854 - RNA, 21 nt, Human
cacagcucagccggaagccuu

SEQ ID NO: 690855 - RNA, 24 nt, Human
cacaggcagaggagcaugcagagc

SEQ ID NO: 690856 - RNA, 23 nt, Human
cacccagccuccaguccagccag

SEQ ID NO: 690857 - RNA, 21 nt, Human
cacuuuugggggcagagagag

SEQ ID NO: 690858 - RNA, 18 nt, Human
cagaaggcagcaaaggca

SEQ ID NO: 690859 - RNA, 22 nt, Human
cagcacauggcgaagcggcccc

SEQ ID NO: 690860 - RNA, 19 nt, Human
cagccgggcccccuccucc

SEQ ID NO: 690861 - RNA, 21 nt, Human
cagcgcagcgggcacaggcag

SEQ ID NO: 690862 - RNA, 21 nt, Human
caggaaggcgccuccauggca

SEQ ID NO: 690863 - RNA, 19 nt, Human
cagggccagaugcccagga

SEQ ID NO: 690864 - RNA, 23 nt, Human
cagggccagaugcccaggagacc

SEQ ID NO: 690865 - RNA, 27 nt, Human
ccaauccagcccugagcuccucagcaa

SEQ ID NO: 690866 - RNA, 19 nt, Human
ccacaccugccaauccagc

SEQ ID NO: 690867 - RNA, 23 nt, Human
ccacaccugccaauccagcccug

SEQ ID NO: 690868 - RNA, 19 nt, Human
ccacgaacaucaaguucac

SEQ ID NO: 690869 - RNA, 21 nt, Human
ccagaauggaaaagcagagaa

SEQ ID NO: 690870 - RNA, 18 nt, Human
ccagaauguggggggcag

SEQ ID NO: 690871 - RNA, 18 nt, Human
ccccugggggaacgagcc

SEQ ID NO: 690872 - RNA, 18 nt, Human
cccucgggcccagccggg

SEQ ID NO: 690873 - RNA, 20 nt, Human
cccucgggcccagccgggcc

SEQ ID NO: 690874 - RNA, 20 nt, Human
ccggccgagagcugggcggc

SEQ ID NO: 690875 - RNA, 19 nt, Human
ccgggagccucgucuuugc

SEQ ID NO: 690876 - RNA, 18 nt, Human
ccgggcccccuccuccca

SEQ ID NO: 690877 - RNA, 20 nt, Human
ccggugcgaccgugcagccg

SEQ ID NO: 690878 - RNA, 25 nt, Human
cgagccggguagggggcagcagggc

SEQ ID NO: 690879 - RNA, 25 nt, Human
cgccuugggacccucgggcccagcc

SEQ ID NO: 690880 - RNA, 20 nt, Human
cgggucggguuuccccuggg

SEQ ID NO: 690881 - RNA, 22 nt, Human
cggugcgaccgugcagccggcg

SEQ ID NO: 690882 - RNA, 20 nt, Human
cucacgguuugcagggcagc

SEQ ID NO: 690883 - RNA, 23 nt, Human
cucccaacaacccccagaggccc

SEQ ID NO: 690884 - RNA, 18 nt, Human
cuccucccaacaaccccc

SEQ ID NO: 690885 - RNA, 24 nt, Human
cuggaccgccccugcacgccuugg

SEQ ID NO: 690886 - RNA, 20 nt, Human
cuggccaacccaggaaggcu

SEQ ID NO: 690887 - RNA, 25 nt, Human
cuugggacccucgggcccagccggg

SEQ ID NO: 690888 - RNA, 23 nt, Human
cuuuugggggcagagagaguugg

SEQ ID NO: 690889 - RNA, 20 nt, Human
gaaaagcagagaacagcuuc

SEQ ID NO: 690890 - RNA, 19 nt, Human
gaccugggcugagagaggc

SEQ ID NO: 690891 - RNA, 18 nt, Human
gacggugugcaggugugu

SEQ ID NO: 690892 - RNA, 23 nt, Human
gagagcugggcggccgggagggg

SEQ ID NO: 690893 - RNA, 20 nt, Human
gagcugggcggccgggaggg

SEQ ID NO: 690894 - RNA, 21 nt, Human
gagguccugggugagcaaaca

SEQ ID NO: 690895 - RNA, 25 nt, Human
ggaaaagcagagaacagccgguacc

SEQ ID NO: 690896 - RNA, 22 nt, Human
ggaccuccagacugucccuccc

SEQ ID NO: 690897 - RNA, 22 nt, Human
ggagggaggagggcgugggagc

SEQ ID NO: 690898 - RNA, 22 nt, Human
ggcaggcuuggccaccagggcu

SEQ ID NO: 690899 - RNA, 21 nt, Human
ggccccuugacacuuuugggg

SEQ ID NO: 690900 - RNA, 19 nt, Human
gggcaccagcagggggugg

SEQ ID NO: 690901 - RNA, 22 nt, Human
gggcaccagcagggggugggca

SEQ ID NO: 690902 - RNA, 22 nt, Human
gggcagagagaguuggugggaa

SEQ ID NO: 690903 - RNA, 22 nt, Human
gggccagagcaggcggugccga

SEQ ID NO: 690904 - RNA, 23 nt, Human
gggcccccuccucccaacaaccc

SEQ ID NO: 690905 - RNA, 24 nt, Human
gggcccccuccucccaacaacccc

SEQ ID NO: 690906 - RNA, 23 nt, Human
gggcccuuggccgggucggguuu

SEQ ID NO: 690907 - RNA, 20 nt, Human
gggccggggccggggccaga

SEQ ID NO: 690908 - RNA, 24 nt, Human
gggcggccgggaggggccccggcc

SEQ ID NO: 690909 - RNA, 21 nt, Human
ggugggaagaggggugaaagg

SEQ ID NO: 690910 - RNA, 22 nt, Human
gucugggaccuccagacugucc

SEQ ID NO: 690911 - RNA, 20 nt, Human
gugggaagaggggugaaagg

SEQ ID NO: 690912 - RNA, 24 nt, Human
uaagagagggccacagacacggcg

SEQ ID NO: 690913 - RNA, 23 nt, Human
uagcggagggaggagggcguggg

SEQ ID NO: 690914 - RNA, 21 nt, Human
ucugaaaacacccagaaugga

SEQ ID NO: 690915 - RNA, 21 nt, Human
ugagcaaacagaguggccggg

SEQ ID NO: 690916 - RNA, 23 nt, Human
ugaggggcccucuggccaaccca

SEQ ID NO: 690917 - RNA, 24 nt, Human
ugcagaggcaaacugcuagggcag

SEQ ID NO: 690918 - RNA, 22 nt, Human
ugcagggcagcgcagcgggcac

SEQ ID NO: 690919 - RNA, 18 nt, Human
ugccaauccagcccugag

SEQ ID NO: 690920 - RNA, 22 nt, Human
uggaaaagcagagaacagcuuc

SEQ ID NO: 690921 - RNA, 19 nt, Human
uggcacagcucagccggaa

SEQ ID NO: 690922 - RNA, 19 nt, Human
ugggaagaacaccaaccag

SEQ ID NO: 690923 - RNA, 19 nt, Human
ugggaagaacaccaaccag

SEQ ID NO: 690924 - RNA, 24 nt, Human
ugggaagaacaccaaccaguaacu

SEQ ID NO: 690925 - RNA, 21 nt, Human
ugggaagaggggugaaagggc

SEQ ID NO: 690926 - RNA, 22 nt, Human
ugggacccucgggcccagccgg

SEQ ID NO: 690927 - RNA, 23 nt, Human
ugggggaacgagccggguagggg

SEQ ID NO: 690928 - RNA, 24 nt, Human
ugggggcagagagaguuccccgag

SEQ ID NO: 690929 - RNA, 26 nt, Human
uggugggaagaggggugaaagggcca

SEQ ID NO: 690930 - RNA, 18 nt, Human
uguggggggcagggccgg

SEQ ID NO: 690931 - RNA, 20 nt, Human
uuccuagggccccuugacac

SEQ ID NO: 690932 - RNA, 21 nt, Human
aaaaaauaauuauugacaccc

SEQ ID NO: 690933 - RNA, 26 nt, Human
aaaaauaccaaaauuagccaggcaug

SEQ ID NO: 690934 - RNA, 18 nt, Human
aaaaggacaaaacauaac

SEQ ID NO: 690935 - RNA, 22 nt, Human
aaaaggacaaaacauaaccaaa

SEQ ID NO: 690936 - RNA, 21 nt, Human
aaaagggcaagauaaagggca

SEQ ID NO: 690937 - RNA, 23 nt, Human
aaaauaccaaaauuagccaggca

SEQ ID NO: 690938 - RNA, 19 nt, Human
aaaauggcaaaaccucauc

SEQ ID NO: 690939 - RNA, 24 nt, Human
aaacaaaacuggauuuuuguaauc

SEQ ID NO: 690940 - RNA, 19 nt, Human
aaagugcugggauuucagg

SEQ ID NO: 690941 - RNA, 24 nt, Human
aaagugcugggauuucaggcguga

SEQ ID NO: 690942 - RNA, 19 nt, Human
aacacagugagacuucauc

SEQ ID NO: 690943 - RNA, 20 nt, Human
aacacagugagacuucaucu

SEQ ID NO: 690944 - RNA, 21 nt, Human
aacacagugagacuucaucuc

SEQ ID NO: 690945 - RNA, 20 nt, Human
aacacggcaauacccugucu

SEQ ID NO: 690946 - RNA, 27 nt, Human
aacagaguugggcagucccagccagga

SEQ ID NO: 690947 - RNA, 21 nt, Human
aacccuaccucacccacccac

SEQ ID NO: 690948 - RNA, 24 nt, Human
aagaaacaccaauaaaaucuuacc

SEQ ID NO: 690949 - RNA, 19 nt, Human
aagaaacaugaaaaucacc

SEQ ID NO: 690950 - RNA, 23 nt, Human
aagaaacaugaaaaucaccaaac

SEQ ID NO: 690951 - RNA, 19 nt, Human
aagugcugggauuucaggc

SEQ ID NO: 690952 - RNA, 24 nt, Human
aaucgcuugaacccaggaggcaga

SEQ ID NO: 690953 - RNA, 18 nt, Human
aauuagccaggcauggug

SEQ ID NO: 690954 - RNA, 24 nt, Human
acagagcaagaaucugucucaaaa

SEQ ID NO: 690955 - RNA, 25 nt, Human
acagagcaagacccccaucucaaaa

SEQ ID NO: 690956 - RNA, 23 nt, Human
acagagcaagaugcugucucaaa

SEQ ID NO: 690957 - RNA, 20 nt, Human
accagggccuccaaaauaac

SEQ ID NO: 690958 - RNA, 24 nt, Human
accauguuggccaggauggucucg

SEQ ID NO: 690959 - RNA, 21 nt, Human
acccuaccucacccacccacu

SEQ ID NO: 690960 - RNA, 18 nt, Human
accucaucucuacuaaaa

SEQ ID NO: 690961 - RNA, 24 nt, Human
accucaugauccgcccaccuuggc

SEQ ID NO: 690962 - RNA, 23 nt, Human
accuguagucccacauacuuggg

SEQ ID NO: 690963 - RNA, 24 nt, Human
acgcuccagccugggagacagagc

SEQ ID NO: 690964 - RNA, 18 nt, Human
acuacgcuccagccuggg

SEQ ID NO: 690965 - RNA, 22 nt, Human
acuacgcuccagccugggagac

SEQ ID NO: 690966 - RNA, 24 nt, Human
acuacgcuccagccugggagacag

SEQ ID NO: 690967 - RNA, 18 nt, Human
acugcacuccagccuggg

SEQ ID NO: 690968 - RNA, 18 nt, Human
acugcacuccagccuggg

SEQ ID NO: 690969 - RNA, 18 nt, Human
acugcacuccagccuggg

SEQ ID NO: 690970 - RNA, 19 nt, Human
acugcacuccagccugggu

SEQ ID NO: 690971 - RNA, 21 nt, Human
acugcacuccagccuggguga

SEQ ID NO: 690972 - RNA, 22 nt, Human
acugcacuccagccugggugac

SEQ ID NO: 690973 - RNA, 24 nt, Human
acugcacuccagccugggugacag

SEQ ID NO: 690974 - RNA, 26 nt, Human
acugcacuccagccugggugacagag

SEQ ID NO: 690975 - RNA, 24 nt, Human
acugcacuccugcgugggcaacag

SEQ ID NO: 690976 - RNA, 24 nt, Human
acuuguauuuuaauguuugaaguu

SEQ ID NO: 690977 - RNA, 21 nt, Human
agaaaaagagaacaggaagaa

SEQ ID NO: 690978 - RNA, 24 nt, Human
agacaaggaagaggugaggacuaa

SEQ ID NO: 690979 - RNA, 20 nt, Human
agacaggcagagaacacuuc

SEQ ID NO: 690980 - RNA, 24 nt, Human
agagguugcagugaucccugauca

SEQ ID NO: 690981 - RNA, 25 nt, Human
agccaaggaguuccaggcugcagug

SEQ ID NO: 690982 - RNA, 20 nt, Human
aggaguuugagaccagucug

SEQ ID NO: 690983 - RNA, 24 nt, Human
aggauugcuugagccaaggaguuc

SEQ ID NO: 690984 - RNA, 24 nt, Human
aggauuguuucagcccaggaguuu

SEQ ID NO: 690985 - RNA, 18 nt, Human
aggcagagguugcaguga

SEQ ID NO: 690986 - RNA, 19 nt, Human
aggcagagguugcagugau

SEQ ID NO: 690987 - RNA, 22 nt, Human
aggcagcaggauugcuugagcc

SEQ ID NO: 690988 - RNA, 24 nt, Human
aggcaugcggcgccacaaccagcu

SEQ ID NO: 690989 - RNA, 21 nt, Human
aggccaaggcgggaggauugu

SEQ ID NO: 690990 - RNA, 24 nt, Human
aggcugggcaacacagugagacuu

SEQ ID NO: 690991 - RNA, 22 nt, Human
aguacagaugggguuucaccau

SEQ ID NO: 690992 - RNA, 21 nt, Human
aguagcugggacuacaggcau

SEQ ID NO: 690993 - RNA, 23 nt, Human
agucagggcugcagugagcugag

SEQ ID NO: 690994 - RNA, 21 nt, Human
auaaagggcagaccugauuca

SEQ ID NO: 690995 - RNA, 24 nt, Human
aucaugcuacugcacuccagccug

SEQ ID NO: 690996 - RNA, 22 nt, Human
aucccagcacuuugggaggcca

SEQ ID NO: 690997 - RNA, 22 nt, Human
augcagucucuucaccaucucu

SEQ ID NO: 690998 - RNA, 25 nt, Human
auggaacauagaaagaaaacaaaac

SEQ ID NO: 690999 - RNA, 18 nt, Human
augggguuucaccauguu

SEQ ID NO: 691000 - RNA, 22 nt, Human
augggguuucaccauguuggcc

SEQ ID NO: 691001 - RNA, 24 nt, Human
augggguuucaccauguuggccag

SEQ ID NO: 691002 - RNA, 21 nt, Human
auuccccugccucagccuccc

SEQ ID NO: 691003 - RNA, 24 nt, Human
auugacacccaggcugggcaacac

SEQ ID NO: 691004 - RNA, 24 nt, Human
auugcauuacuacgcuccagccug

SEQ ID NO: 691005 - RNA, 24 nt, Human
auuuuaguacagaugggguuucac

SEQ ID NO: 691006 - RNA, 21 nt, Human
caaaauaacuucacugaggac

SEQ ID NO: 691007 - RNA, 20 nt, Human
caaaguauaaccuaugcuaa

SEQ ID NO: 691008 - RNA, 24 nt, Human
caaagugcugggauuucaggcgug

SEQ ID NO: 691009 - RNA, 22 nt, Human
caacucaaacccuaccucaccc

SEQ ID NO: 691010 - RNA, 20 nt, Human
caagauaaagggcagaccug

SEQ ID NO: 691011 - RNA, 24 nt, Human
cacauaauaaaggaauaccucuga

SEQ ID NO: 691012 - RNA, 18 nt, Human
caccauguuggccaggau

SEQ ID NO: 691013 - RNA, 22 nt, Human
caccauguuggccaggaugguc

SEQ ID NO: 691014 - RNA, 24 nt, Human
caccauguuggccaggauggucuc

SEQ ID NO: 691015 - RNA, 24 nt, Human
caccugcaaucccagcugcucagg

SEQ ID NO: 691016 - RNA, 22 nt, Human
cacuccagccugggugacagag

SEQ ID NO: 691017 - RNA, 18 nt, Human
cacugaucagaacagagu

SEQ ID NO: 691018 - RNA, 23 nt, Human
cacugcacuccugcgugggcaac

SEQ ID NO: 691019 - RNA, 24 nt, Human
cacugcacuccugcgugggcaaca

SEQ ID NO: 691020 - RNA, 26 nt, Human
cacuucaagaaaggcaacaauuuaaa

SEQ ID NO: 691021 - RNA, 22 nt, Human
cagcacuuugggaggccaaggc

SEQ ID NO: 691022 - RNA, 24 nt, Human
cagcacuuugggaggccaaggcgg

SEQ ID NO: 691023 - RNA, 21 nt, Human
caggcgugagccaccaugccc

SEQ ID NO: 691024 - RNA, 19 nt, Human
caucucuacagaaauaauu

SEQ ID NO: 691025 - RNA, 18 nt, Human
ccaaaauaacuucacuga

SEQ ID NO: 691026 - RNA, 22 nt, Human
ccaaaauggcaaaaccucaucu

SEQ ID NO: 691027 - RNA, 22 nt, Human
ccaaagugcugggauuucaggc

SEQ ID NO: 691028 - RNA, 24 nt, Human
ccaaagugcugggauuucaggcgu

SEQ ID NO: 691029 - RNA, 23 nt, Human
ccaccagggccuccaaaauaacu

SEQ ID NO: 691030 - RNA, 20 nt, Human
ccacugcacuccugcguggg

SEQ ID NO: 691031 - RNA, 20 nt, Human
ccacugcacuccugcguggg

SEQ ID NO: 691032 - RNA, 21 nt, Human
ccacugcacuccugcgugggc

SEQ ID NO: 691033 - RNA, 24 nt, Human
ccacugcacuccugcgugggcaac

SEQ ID NO: 691034 - RNA, 21 nt, Human
ccagccugaccaaaauggcaa

SEQ ID NO: 691035 - RNA, 22 nt, Human
ccaggaggcagagguugcagug

SEQ ID NO: 691036 - RNA, 23 nt, Human
cccgaguagcugggacuacaggc

SEQ ID NO: 691037 - RNA, 24 nt, Human
cccgaguagcugggacuacaggca

SEQ ID NO: 691038 - RNA, 20 nt, Human
cccggguucaagcaauuccc

SEQ ID NO: 691039 - RNA, 23 nt, Human
cccggguucaagcaauuccccug

SEQ ID NO: 691040 - RNA, 24 nt, Human
cccugccucagccucccgaguagc

SEQ ID NO: 691041 - RNA, 27 nt, Human
ccgccucccggguucaagcaauucuuu

SEQ ID NO: 691042 - RNA, 22 nt, Human
ccuauaaucccagcacuuuggg

SEQ ID NO: 691043 - RNA, 22 nt, Human
ccucccggguucaagcaauucc

SEQ ID NO: 691044 - RNA, 24 nt, Human
ccugaucaugcuacugcacuccag

SEQ ID NO: 691045 - RNA, 25 nt, Human
ccugcaaucccagcugcucaggugg

SEQ ID NO: 691046 - RNA, 22 nt, Human
ccugcggucccagcuacucugg

SEQ ID NO: 691047 - RNA, 23 nt, Human
ccugcggucccagcuacucugga

SEQ ID NO: 691048 - RNA, 19 nt, Human
ccugcgugggcaacagagc

SEQ ID NO: 691049 - RNA, 19 nt, Human
ccugggugacagagcaaga

SEQ ID NO: 691050 - RNA, 23 nt, Human
ccugugaccaccagggccggggc

SEQ ID NO: 691051 - RNA, 22 nt, Human
cgccucccggguucaagcaauu

SEQ ID NO: 691052 - RNA, 24 nt, Human
cuacugcacuccagccugggugac

SEQ ID NO: 691053 - RNA, 24 nt, Human
cucagccucccgaguagcugggac

SEQ ID NO: 691054 - RNA, 23 nt, Human
cuccaaaauaacuucacugagga

SEQ ID NO: 691055 - RNA, 22 nt, Human
cuccagccugggagacagagca

SEQ ID NO: 691056 - RNA, 20 nt, Human
cuccugaccucaugauccgc

SEQ ID NO: 691057 - RNA, 22 nt, Human
cugaccaaaauggcaaaaccuc

SEQ ID NO: 691058 - RNA, 23 nt, Human
cugaccaaaauggcaaaaccuca

SEQ ID NO: 691059 - RNA, 21 nt, Human
cugcaaucccagcugcucagg

SEQ ID NO: 691060 - RNA, 21 nt, Human
cugcagugagcuaugauugca

SEQ ID NO: 691061 - RNA, 19 nt, Human
cugcagugagcugagagca

SEQ ID NO: 691062 - RNA, 21 nt, Human
cugcagugagcugagagcaug

SEQ ID NO: 691063 - RNA, 23 nt, Human
cugccucagccucccgaguagcu

SEQ ID NO: 691064 - RNA, 21 nt, Human
cuggccaacacggcaauaccc

SEQ ID NO: 691065 - RNA, 20 nt, Human
cuugagccaaggaguuccag

SEQ ID NO: 691066 - RNA, 23 nt, Human
cuugugccuauaaucccagcacu

SEQ ID NO: 691067 - RNA, 23 nt, Human
gaaacaccaauaaaaucuuaccg

SEQ ID NO: 691068 - RNA, 20 nt, Human
gaaauuuugugacaaagaca

SEQ ID NO: 691069 - RNA, 21 nt, Human
gacccccaucucaaaagaaaa

SEQ ID NO: 691070 - RNA, 25 nt, Human
gaccucaugauccgcccaccuuggc

SEQ ID NO: 691071 - RNA, 18 nt, Human
gagaacaggaagaaaugg

SEQ ID NO: 691072 - RNA, 19 nt, Human
gagaugaaauuaacuauga

SEQ ID NO: 691073 - RNA, 18 nt, Human
gagcaagacccccaucuc

SEQ ID NO: 691074 - RNA, 20 nt, Human
gaguagcugggacuacaggc

SEQ ID NO: 691075 - RNA, 24 nt, Human
gaguagcugggacuacaggcaugc

SEQ ID NO: 691076 - RNA, 18 nt, Human
gauuucaggcgugagcca

SEQ ID NO: 691077 - RNA, 21 nt, Human
gauuucaggcgugagccacca

SEQ ID NO: 691078 - RNA, 22 nt, Human
gauuucaggcgugagccaccau

SEQ ID NO: 691079 - RNA, 20 nt, Human
gcaaaacuccgccucccggg

SEQ ID NO: 691080 - RNA, 24 nt, Human
gcacuccagccugggugacagagc

SEQ ID NO: 691081 - RNA, 20 nt, Human
gcagaccugauucauuuagg

SEQ ID NO: 691082 - RNA, 23 nt, Human
gccaacacggcaauacccugucu

SEQ ID NO: 691083 - RNA, 24 nt, Human
gccacugcacuccugcgugggcaa

SEQ ID NO: 691084 - RNA, 23 nt, Human
gccaggagguucuuuuuccuauu

SEQ ID NO: 691085 - RNA, 21 nt, Human
gccaggcuggcaaaacuccgc

SEQ ID NO: 691086 - RNA, 24 nt, Human
gccuaggcagucagggcugcagug

SEQ ID NO: 691087 - RNA, 19 nt, Human
gccuauaaucccagcacuu

SEQ ID NO: 691088 - RNA, 19 nt, Human
gcgugagccaccaugcccg

SEQ ID NO: 691089 - RNA, 19 nt, Human
gcuacugcacuccagccug

SEQ ID NO: 691090 - RNA, 24 nt, Human
gcuacugcacuccagccuggguga

SEQ ID NO: 691091 - RNA, 18 nt, Human
ggacuacaggcaugcggc

SEQ ID NO: 691092 - RNA, 20 nt, Human
ggacuacaggcaugcggcgg

SEQ ID NO: 691093 - RNA, 23 nt, Human
ggauugcuugagccaaggaguuc

SEQ ID NO: 691094 - RNA, 22 nt, Human
ggauuguuucagcccaggaguu

SEQ ID NO: 691095 - RNA, 24 nt, Human
ggauuucaggcgugagccaccaug

SEQ ID NO: 691096 - RNA, 18 nt, Human
ggcaacacagugagacuu

SEQ ID NO: 691097 - RNA, 19 nt, Human
ggcaugcggcgccacaacc

SEQ ID NO: 691098 - RNA, 21 nt, Human
gggcugcagugagcugagagc

SEQ ID NO: 691099 - RNA, 22 nt, Human
gggguuucaccauguuggccag

SEQ ID NO: 691100 - RNA, 18 nt, Human
ggguuucaccauguuggc

SEQ ID NO: 691101 - RNA, 22 nt, Human
ggguuucaccauguuggccagg

SEQ ID NO: 691102 - RNA, 20 nt, Human
ggucucgaucuccugaccuc

SEQ ID NO: 691103 - RNA, 24 nt, Human
ggugucuugugccuauaaucccag

SEQ ID NO: 691104 - RNA, 24 nt, Human
gguuucaccauguuggccaggaug

SEQ ID NO: 691105 - RNA, 24 nt, Human
guaagaagauugcuggagccuagg

SEQ ID NO: 691106 - RNA, 22 nt, Human
guguauauaaacauuauguaca

SEQ ID NO: 691107 - RNA, 21 nt, Human
guucuuuuuccuauugcaugc

SEQ ID NO: 691108 - RNA, 23 nt, Human
uaaaaauaccaaaauuagccagg

SEQ ID NO: 691109 - RNA, 24 nt, Human
uaaaaauaccaaaauuagccaggc

SEQ ID NO: 691110 - RNA, 18 nt, Human
uaaaagacaaggaagagg

SEQ ID NO: 691111 - RNA, 21 nt, Human
uaaaaggacaaaacauaacca

SEQ ID NO: 691112 - RNA, 19 nt, Human
uaaagggcagaccugauuc

SEQ ID NO: 691113 - RNA, 21 nt, Human
uacccugucuuaucaaaauua

SEQ ID NO: 691114 - RNA, 24 nt, Human
uaccuguagucccacauacuuggg

SEQ ID NO: 691115 - RNA, 21 nt, Human
uacugcacuccagccugggug

SEQ ID NO: 691116 - RNA, 23 nt, Human
uacugcacuccagccugggugac

SEQ ID NO: 691117 - RNA, 24 nt, Human
uacugcacuccagccugggugaca

SEQ ID NO: 691118 - RNA, 25 nt, Human
uacugcacuccagccugggugacag

SEQ ID NO: 691119 - RNA, 25 nt, Human
uagaaagaaaacaaaacuggauuuu

SEQ ID NO: 691120 - RNA, 24 nt, Human
uaguacagaugggguuucaccaug

SEQ ID NO: 691121 - RNA, 23 nt, Human
uauaaaaucuggacacacacagg

SEQ ID NO: 691122 - RNA, 22 nt, Human
ucaaaauuaaaaaaaaaaaaaa

SEQ ID NO: 691123 - RNA, 24 nt, Human
ucaaaauuaaaaaaaaaaaaaauu

SEQ ID NO: 691124 - RNA, 22 nt, Human
ucacauaccuaaaauguguagu

SEQ ID NO: 691125 - RNA, 24 nt, Human
ucaccauguuggccaggauggucu

SEQ ID NO: 691126 - RNA, 18 nt, Human
ucaccugggcacaugccc

SEQ ID NO: 691127 - RNA, 21 nt, Human
ucacuggaguaauuuaccauu

SEQ ID NO: 691128 - RNA, 18 nt, Human
ucagcccaggaguuugag

SEQ ID NO: 691129 - RNA, 23 nt, Human
ucagcccaggaguuugagaccag

SEQ ID NO: 691130 - RNA, 23 nt, Human
ucagccucccgaguagcugggac

SEQ ID NO: 691131 - RNA, 23 nt, Human
ucaugcuacugcacuccagccug

SEQ ID NO: 691132 - RNA, 24 nt, Human
uccagccugggugacagagcaaga

SEQ ID NO: 691133 - RNA, 24 nt, Human
ucccaaagugcugggauuucaggc

SEQ ID NO: 691134 - RNA, 20 nt, Human
ucccacacuacgcuuucuuc

SEQ ID NO: 691135 - RNA, 24 nt, Human
uccccugccucagccucccgagua

SEQ ID NO: 691136 - RNA, 24 nt, Human
ucccgaguagcugggacuacaggc

SEQ ID NO: 691137 - RNA, 19 nt, Human
ucccggguucaagcaauuc

SEQ ID NO: 691138 - RNA, 24 nt, Human
ucccggguucaagcaauuccccug

SEQ ID NO: 691139 - RNA, 22 nt, Human
ucuaagaaacaugaaaaucacc

SEQ ID NO: 691140 - RNA, 21 nt, Human
ucucuacuaaaaauaccaaaa

SEQ ID NO: 691141 - RNA, 24 nt, Human
ucugucucaaaaaaccuuuuuaaa

SEQ ID NO: 691142 - RNA, 22 nt, Human
ucuugccaacucaaacccuacc

SEQ ID NO: 691143 - RNA, 24 nt, Human
ucuugccaacucaaacccuaccuc

SEQ ID NO: 691144 - RNA, 18 nt, Human
ucuugcucuguugccagg

SEQ ID NO: 691145 - RNA, 21 nt, Human
ucuugcucuguugccaggcug

SEQ ID NO: 691146 - RNA, 22 nt, Human
ucuugcucuguugccaggcugg

SEQ ID NO: 691147 - RNA, 20 nt, Human
ugacaaagacaggcagagaa

SEQ ID NO: 691148 - RNA, 24 nt, Human
ugacacccaggcugggcaacacaa

SEQ ID NO: 691149 - RNA, 22 nt, Human
ugacuucaaagugcagaucuga

SEQ ID NO: 691150 - RNA, 23 nt, Human
ugagaaaaaugaaauuuugugac

SEQ ID NO: 691151 - RNA, 19 nt, Human
ugagaccagucuggccaac

SEQ ID NO: 691152 - RNA, 23 nt, Human
ugagaccagucuggccaacacgg

SEQ ID NO: 691153 - RNA, 22 nt, Human
ugaucagaacagaguugggcag

SEQ ID NO: 691154 - RNA, 24 nt, Human
ugauccgcccaccuuggccuccca

SEQ ID NO: 691155 - RNA, 20 nt, Human
ugauguggaagcuagaaaaa

SEQ ID NO: 691156 - RNA, 20 nt, Human
ugcaccugcaaucccagcug

SEQ ID NO: 691157 - RNA, 21 nt, Human
ugcauuacuacgcuccagccu

SEQ ID NO: 691158 - RNA, 24 nt, Human
ugccucagccucccgaguagcugg

SEQ ID NO: 691159 - RNA, 19 nt, Human
ugccugcggucccagcuac

SEQ ID NO: 691160 - RNA, 24 nt, Human
ugccugcggucccagcuacucugg

SEQ ID NO: 691161 - RNA, 22 nt, Human
uggcaaaacuccgccucccggg

SEQ ID NO: 691162 - RNA, 18 nt, Human
uggcaagugccugcgguc

SEQ ID NO: 691163 - RNA, 22 nt, Human
uggcaugcaccugcaaucccag

SEQ ID NO: 691164 - RNA, 24 nt, Human
uggccaggauggucucgaucuccu

SEQ ID NO: 691165 - RNA, 23 nt, Human
ugggacaagccauacuuucaacc

SEQ ID NO: 691166 - RNA, 24 nt, Human
ugggacuacaggcaugcggcgcca

SEQ ID NO: 691167 - RNA, 21 nt, Human
ugggagacagagcaagaugcu

SEQ ID NO: 691168 - RNA, 19 nt, Human
ugggaggccaaggcagcag

SEQ ID NO: 691169 - RNA, 19 nt, Human
ugggaggccaaggcagcag

SEQ ID NO: 691170 - RNA, 21 nt, Human
ugggaggccaaggcagcagga

SEQ ID NO: 691171 - RNA, 24 nt, Human
ugggaggccaaggcagcaggauug

SEQ ID NO: 691172 - RNA, 22 nt, Human
ugggaggccaaggcgggaggau

SEQ ID NO: 691173 - RNA, 18 nt, Human
ugggauuucaggcgugag

SEQ ID NO: 691174 - RNA, 24 nt, Human
ugggauuucaggcgugagccacca

SEQ ID NO: 691175 - RNA, 25 nt, Human
ugggauuucaggcgugagccaccau

SEQ ID NO: 691176 - RNA, 24 nt, Human
ugggguuucaccauguuggccagg

SEQ ID NO: 691177 - RNA, 24 nt, Human
ugggugacagagcaagaaucuguc

SEQ ID NO: 691178 - RNA, 24 nt, Human
ugguggcgaguaccuguaguccca

SEQ ID NO: 691179 - RNA, 24 nt, Human
uggugucuugugccuauaauccca

SEQ ID NO: 691180 - RNA, 22 nt, Human
ugucuugugccuauaaucccag

SEQ ID NO: 691181 - RNA, 24 nt, Human
ugucuugugccuauaaucccagca

SEQ ID NO: 691182 - RNA, 21 nt, Human
ugucuugugccuccggugucc

SEQ ID NO: 691183 - RNA, 20 nt, Human
ugugccuauaaucccagcac

SEQ ID NO: 691184 - RNA, 24 nt, Human
ugugccuauaaucccagcacuuug

SEQ ID NO: 691185 - RNA, 25 nt, Human
uuaaaaaauaauuauugacacccag

SEQ ID NO: 691186 - RNA, 19 nt, Human
uuacuacgcuccagccugg

SEQ ID NO: 691187 - RNA, 24 nt, Human
uuacuacgcuccagccugggagac

SEQ ID NO: 691188 - RNA, 18 nt, Human
uuaguacagaugggguuu

SEQ ID NO: 691189 - RNA, 22 nt, Human
uuaguacagaugggguuucacc

SEQ ID NO: 691190 - RNA, 24 nt, Human
uuaguacagaugggguuucaccau

SEQ ID NO: 691191 - RNA, 24 nt, Human
uuaguggggcgugguggcaagugc

SEQ ID NO: 691192 - RNA, 25 nt, Human
uuaguggggcgugguggcaagugcc

SEQ ID NO: 691193 - RNA, 19 nt, Human
uuauugacacccaggcugg

SEQ ID NO: 691194 - RNA, 23 nt, Human
uucaaccauuggugaccacugcc

SEQ ID NO: 691195 - RNA, 21 nt, Human
uucaagcaauuccccugccuc

SEQ ID NO: 691196 - RNA, 24 nt, Human
uucaagcaauuccccugccucagc

SEQ ID NO: 691197 - RNA, 23 nt, Human
uucagcccaggaguuugagacca

SEQ ID NO: 691198 - RNA, 19 nt, Human
uucaggcgugagccaccau

SEQ ID NO: 691199 - RNA, 19 nt, Human
uuccccugccucagccucc

SEQ ID NO: 691200 - RNA, 18 nt, Human
uugcuggagccuaggcag

SEQ ID NO: 691201 - RNA, 24 nt, Human
uugcuugagccaaggaguuccagg

SEQ ID NO: 691202 - RNA, 18 nt, Human
uuggccucccaaagugcu

SEQ ID NO: 691203 - RNA, 19 nt, Human
uugggcagucccagccagg

SEQ ID NO: 691204 - RNA, 21 nt, Human
uuguuucagcccaggaguuug

SEQ ID NO: 691205 - RNA, 20 nt, Human
uuuaaaaaauuuuuaguggg

SEQ ID NO: 691206 - RNA, 25 nt, Human
uuuaaaaggacaaaacauaaccaaa

SEQ ID NO: 691207 - RNA, 23 nt, Human
uuucaaccauuggugaccacugc

SEQ ID NO: 691208 - RNA, 19 nt, Human
uuucaccauguuggccagg

SEQ ID NO: 691209 - RNA, 20 nt, Human
uuucaccauguuggccagga

SEQ ID NO: 691210 - RNA, 23 nt, Human
uuucagcccaggaguuugagacc

SEQ ID NO: 691211 - RNA, 20 nt, Human
uuuguauuuuaguacagaug

SEQ ID NO: 691212 - RNA, 18 nt, Human
uuuuuuuuuuuuuuuuug

SEQ ID NO: 691213 - RNA, 26 nt, Human
aaacugaagguggagagaagggaccc

SEQ ID NO: 691214 - RNA, 19 nt, Human
aaacuggaacaguccagug

SEQ ID NO: 691215 - RNA, 21 nt, Human
aaagguuggaaguugcacacu

SEQ ID NO: 691216 - RNA, 25 nt, Human
aagcuuugcaagggugugguuuugg

SEQ ID NO: 691217 - RNA, 18 nt, Human
aaggagcuuguggggcag

SEQ ID NO: 691218 - RNA, 19 nt, Human
aaggagcuuguggggcagg

SEQ ID NO: 691219 - RNA, 20 nt, Human
aaggagcuuguggggcaggg

SEQ ID NO: 691220 - RNA, 21 nt, Human
aauaaagauuaaaaauuuacu

SEQ ID NO: 691221 - RNA, 20 nt, Human
acaauaaaggaggaaguacc

SEQ ID NO: 691222 - RNA, 22 nt, Human
agaggcagcagaagguuuggag

SEQ ID NO: 691223 - RNA, 20 nt, Human
agcccagcacugccacacuc

SEQ ID NO: 691224 - RNA, 20 nt, Human
agcugccuggagaucaucug

SEQ ID NO: 691225 - RNA, 18 nt, Human
aggcagcagaagguuugg

SEQ ID NO: 691226 - RNA, 25 nt, Human
aggcaggaaagagaucugagcugcc

SEQ ID NO: 691227 - RNA, 23 nt, Human
agguaggaaauucaggaaaagga

SEQ ID NO: 691228 - RNA, 24 nt, Human
cagcaaaaucauacgccaucuacc

SEQ ID NO: 691229 - RNA, 22 nt, Human
cagcccagcacugccacacucc

SEQ ID NO: 691230 - RNA, 22 nt, Human
cagguaaugaacuucagcugca

SEQ ID NO: 691231 - RNA, 21 nt, Human
ccggccagcccagcacugcca

SEQ ID NO: 691232 - RNA, 21 nt, Human
ccggccgcgcgcgggccgcag

SEQ ID NO: 691233 - RNA, 21 nt, Human
cgcuaaacugaagguggagag

SEQ ID NO: 691234 - RNA, 18 nt, Human
cgggccgcagcccagccc

SEQ ID NO: 691235 - RNA, 18 nt, Human
gaaaaggagcuugugggg

SEQ ID NO: 691236 - RNA, 19 nt, Human
gagaucaucuggggugcgg

SEQ ID NO: 691237 - RNA, 18 nt, Human
gaggaugagguccaaguu

SEQ ID NO: 691238 - RNA, 18 nt, Human
gaguacaaagcuuugcaa

SEQ ID NO: 691239 - RNA, 20 nt, Human
gaguaugugcaggcccgggc

SEQ ID NO: 691240 - RNA, 19 nt, Human
gcagcccagcccgccggcc

SEQ ID NO: 691241 - RNA, 18 nt, Human
gcaggaagggaaggaacg

SEQ ID NO: 691242 - RNA, 19 nt, Human
gcaggcccgggcuugggca

SEQ ID NO: 691243 - RNA, 20 nt, Human
gcaggcccgggcuugggcag

SEQ ID NO: 691244 - RNA, 22 nt, Human
gggaacagugcagggcaaaggc

SEQ ID NO: 691245 - RNA, 20 nt, Human
gggcacucugacaucuuuaa

SEQ ID NO: 691246 - RNA, 21 nt, Human
gggcaggaagggaaggaacgg

SEQ ID NO: 691247 - RNA, 24 nt, Human
ggucaacagaguugaaaggagaaa

SEQ ID NO: 691248 - RNA, 18 nt, Human
guaggaaauucaggaaaa

SEQ ID NO: 691249 - RNA, 21 nt, Human
uaacaagucuuguaaaggcuu

SEQ ID NO: 691250 - RNA, 21 nt, Human
uacaaagcuuugcaagggugu

SEQ ID NO: 691251 - RNA, 18 nt, Human
uacagauuggcuggggag

SEQ ID NO: 691252 - RNA, 19 nt, Human
uaccggggaacagugcagg

SEQ ID NO: 691253 - RNA, 21 nt, Human
uaccgugaugacugccaacuc

SEQ ID NO: 691254 - RNA, 21 nt, Human
uaccuuaaaaguuaaguccac

SEQ ID NO: 691255 - RNA, 27 nt, Human
ucaaaaaccaauucaucagaucgcugc

SEQ ID NO: 691256 - RNA, 24 nt, Human
ucuagaggaagaccagacagaggg

SEQ ID NO: 691257 - RNA, 22 nt, Human
ugaaaggagaaaauaauugagg

SEQ ID NO: 691258 - RNA, 23 nt, Human
ugaaaggggcaggaagacuggca

SEQ ID NO: 691259 - RNA, 21 nt, Human
ugcaagggugugguuuuggaa

SEQ ID NO: 691260 - RNA, 21 nt, Human
ugcaggcccgggcuugggcag

SEQ ID NO: 691261 - RNA, 20 nt, Human
ugccuggagaucaucugggg

SEQ ID NO: 691262 - RNA, 22 nt, Human
uggcagacccuuucugggauuc

SEQ ID NO: 691263 - RNA, 20 nt, Human
uguaccaacuauacccuaau

SEQ ID NO: 691264 - RNA, 22 nt, Human
ugugaaaggggcaggaagacug

SEQ ID NO: 691265 - RNA, 23 nt, Human
ugugcaggcccgggcuugggcag

SEQ ID NO: 691266 - RNA, 22 nt, Human
uuacauuccaguuaacuaccuu

SEQ ID NO: 691267 - RNA, 23 nt, Human
uuuagguaggaaauucaggaaaa

SEQ ID NO: 691268 - RNA, 24 nt, Human
aaauggaaucuagaagcuaaauuu

SEQ ID NO: 691269 - RNA, 18 nt, Human
accaaacucuuuguaacu

SEQ ID NO: 691270 - RNA, 21 nt, Human
accaaauggaaucuagaagcu

SEQ ID NO: 691271 - RNA, 23 nt, Human
acccugaugcagacgaagagaaa

SEQ ID NO: 691272 - RNA, 24 nt, Human
acuaaaacucuucaaacccaguag

SEQ ID NO: 691273 - RNA, 20 nt, Human
acuacuguuuaccgaguacu

SEQ ID NO: 691274 - RNA, 23 nt, Human
acuauucuaauacuaauacacca

SEQ ID NO: 691275 - RNA, 18 nt, Human
agaccaaacucuuuguaa

SEQ ID NO: 691276 - RNA, 23 nt, Human
agauguagccaucguuccuauca

SEQ ID NO: 691277 - RNA, 22 nt, Human
aggcacaagaugguggacaggg

SEQ ID NO: 691278 - RNA, 24 nt, Human
auaaaagacagugcuaaaccuaca

SEQ ID NO: 691279 - RNA, 20 nt, Human
caaaagaucuacucugugcc

SEQ ID NO: 691280 - RNA, 20 nt, Human
caacucuuacaccaauacau

SEQ ID NO: 691281 - RNA, 20 nt, Human
cacaaaugacaagcccuagc

SEQ ID NO: 691282 - RNA, 24 nt, Human
cauaagauuauuccaugauuaaaa

SEQ ID NO: 691283 - RNA, 25 nt, Human
cauacacaugaccagaaauuauaua

SEQ ID NO: 691284 - RNA, 24 nt, Human
cauccagauguggcuaacauaagg

SEQ ID NO: 691285 - RNA, 25 nt, Human
ccuaucauaggcaagagcaucuccg

SEQ ID NO: 691286 - RNA, 18 nt, Human
cggaagggaaauaggaag

SEQ ID NO: 691287 - RNA, 22 nt, Human
cuaaauacacaaaugacaagcc

SEQ ID NO: 691288 - RNA, 24 nt, Human
cuccguagugaugaaaagcucuau

SEQ ID NO: 691289 - RNA, 23 nt, Human
cugugccagagaaaacacaaauc

SEQ ID NO: 691290 - RNA, 19 nt, Human
gaugcaaaauguuugcagu

SEQ ID NO: 691291 - RNA, 24 nt, Human
gaugcaaaauguuugcaguuugac

SEQ ID NO: 691292 - RNA, 22 nt, Human
gcaaaaagaaguuuuuaacaac

SEQ ID NO: 691293 - RNA, 23 nt, Human
gcccaaaucuaauaaccuuaagc

SEQ ID NO: 691294 - RNA, 19 nt, Human
ggaaauaggaaggaagagg

SEQ ID NO: 691295 - RNA, 18 nt, Human
guuuaccgaguacuuuuc

SEQ ID NO: 691296 - RNA, 25 nt, Human
uaaaagacagugcuaaaccuacaaa

SEQ ID NO: 691297 - RNA, 25 nt, Human
uaaguuucauaaauauaugcaauuc

SEQ ID NO: 691298 - RNA, 21 nt, Human
uaccgaguacuuuuccacccu

SEQ ID NO: 691299 - RNA, 20 nt, Human
uacucugugccagagaaaac

SEQ ID NO: 691300 - RNA, 24 nt, Human
uauaagauuuuagcaauacuucca

SEQ ID NO: 691301 - RNA, 22 nt, Human
uauaugcaauucuaaucauaaa

SEQ ID NO: 691302 - RNA, 23 nt, Human
uaucuuaacacuaaauacacaaa

SEQ ID NO: 691303 - RNA, 23 nt, Human
uaucuuauuuugguuaaguuuca

SEQ ID NO: 691304 - RNA, 25 nt, Human
ucaaagaaaaaccuucauuuuuagc

SEQ ID NO: 691305 - RNA, 23 nt, Human
uccacuuucauauauauuuccca

SEQ ID NO: 691306 - RNA, 23 nt, Human
ucccaaaagaucuacucugugcc

SEQ ID NO: 691307 - RNA, 20 nt, Human
uccguagugaugaaaagcuc

SEQ ID NO: 691308 - RNA, 22 nt, Human
ugacaagcccuagcugagacag

SEQ ID NO: 691309 - RNA, 23 nt, Human
ugacaccaauuuuuuuccuuagc

SEQ ID NO: 691310 - RNA, 23 nt, Human
ugagcaagauaauaaguauacau

SEQ ID NO: 691311 - RNA, 23 nt, Human
ugcuaaaccuacaaauucaauaa

SEQ ID NO: 691312 - RNA, 27 nt, Human
ugcuaaaccuacaaauucaauaaaaca

SEQ ID NO: 691313 - RNA, 19 nt, Human
uggacaggguacauaaagc

SEQ ID NO: 691314 - RNA, 23 nt, Human
ugguggacaggguacauaaagcu

SEQ ID NO: 691315 - RNA, 20 nt, Human
ugguuacuacuguuuaccga

SEQ ID NO: 691316 - RNA, 28 nt, Human
uuagcaauacuuccaauauugauuuccu

SEQ ID NO: 691317 - RNA, 21 nt, Human
uuccuaucauaggcaagagcu

SEQ ID NO: 691318 - RNA, 22 nt, Human
uugcagaaguugacccacuggg

SEQ ID NO: 691319 - RNA, 22 nt, Human
uuuacagaaaauucuagaacaa

SEQ ID NO: 691320 - RNA, 19 nt, Human
uuuaccgaguacuuuucca

SEQ ID NO: 691321 - RNA, 22 nt, Human
uuugcucagcuucagauguagc

SEQ ID NO: 691322 - RNA, 24 nt, Human
uuuuaacauacacaugaccagaaa

SEQ ID NO: 691323 - RNA, 22 nt, Human
aaaguauaaaguguuuuggaaa

SEQ ID NO: 691324 - RNA, 21 nt, Human
acucacacacaggcucugcag

SEQ ID NO: 691325 - RNA, 25 nt, Human
agagggggaccaggguuggaggcac

SEQ ID NO: 691326 - RNA, 21 nt, Human
agcaggaggcaggaacgugga

SEQ ID NO: 691327 - RNA, 21 nt, Human
agccucgaaggaggcuguggg

SEQ ID NO: 691328 - RNA, 22 nt, Human
agccuggagggucugcagcugg

SEQ ID NO: 691329 - RNA, 22 nt, Human
aggaaaaaaaucuauauaaaaa

SEQ ID NO: 691330 - RNA, 26 nt, Human
aggaauugcuuuuuuuuuuuuuuuuu

SEQ ID NO: 691331 - RNA, 19 nt, Human
aggcaggaacguggacgcg

SEQ ID NO: 691332 - RNA, 22 nt, Human
agggaaggagggcggcuggucc

SEQ ID NO: 691333 - RNA, 19 nt, Human
agggggacaaaauggaccc

SEQ ID NO: 691334 - RNA, 21 nt, Human
agggggaccaggguuggaggc

SEQ ID NO: 691335 - RNA, 18 nt, Human
agguagggcaggaagagg

SEQ ID NO: 691336 - RNA, 20 nt, Human
aguuaagagguucagggagg

SEQ ID NO: 691337 - RNA, 19 nt, Human
auaugcagugugugugugu

SEQ ID NO: 691338 - RNA, 26 nt, Human
auaugcagugugugugugugugugug

SEQ ID NO: 691339 - RNA, 21 nt, Human
auggaccccguugagaaccgc

SEQ ID NO: 691340 - RNA, 18 nt, Human
caaccagaaguauuccca

SEQ ID NO: 691341 - RNA, 20 nt, Human
cacacaggcucugcagucag

SEQ ID NO: 691342 - RNA, 18 nt, Human
cacagccaaaugucccca

SEQ ID NO: 691343 - RNA, 20 nt, Human
cacguguggcccacagaggg

SEQ ID NO: 691344 - RNA, 21 nt, Human
cagacacagccaaaugucccc

SEQ ID NO: 691345 - RNA, 20 nt, Human
cagaccucugggccagggcc

SEQ ID NO: 691346 - RNA, 20 nt, Human
cagcucagaagcccaagcag

SEQ ID NO: 691347 - RNA, 23 nt, Human
ccaagggggacaaaauggacccc

SEQ ID NO: 691348 - RNA, 20 nt, Human
ccagggcggcgggagcagga

SEQ ID NO: 691349 - RNA, 21 nt, Human
cccacagaggguggggagaaa

SEQ ID NO: 691350 - RNA, 25 nt, Human
ccccccacuuccccggggcaagggu

SEQ ID NO: 691351 - RNA, 19 nt, Human
ccccgccgccgccgccgcc

SEQ ID NO: 691352 - RNA, 21 nt, Human
ccccgccgccgccgccgccgc

SEQ ID NO: 691353 - RNA, 25 nt, Human
cccgccgccgccgccgccgccgccc

SEQ ID NO: 691354 - RNA, 18 nt, Human
cccucucggccgcccgcc

SEQ ID NO: 691355 - RNA, 25 nt, Human
ccgccgccgccccucucggccgccc

SEQ ID NO: 691356 - RNA, 19 nt, Human
ccgccgccgccgccgcccc

SEQ ID NO: 691357 - RNA, 24 nt, Human
ccgccgccgccgccgccccucucg

SEQ ID NO: 691358 - RNA, 18 nt, Human
ccgccgccgccgccgccg

SEQ ID NO: 691359 - RNA, 18 nt, Human
ccgccgccgccgccgccg

SEQ ID NO: 691360 - RNA, 24 nt, Human
ccgccgccgccgccgccgccgccc

SEQ ID NO: 691361 - RNA, 22 nt, Human
ccgccgccgccgccgccgccgg

SEQ ID NO: 691362 - RNA, 19 nt, Human
ccuccagccuggagggucu

SEQ ID NO: 691363 - RNA, 25 nt, Human
ccucugggccagggccaccagcucu

SEQ ID NO: 691364 - RNA, 18 nt, Human
ccuggagggucugcagcu

SEQ ID NO: 691365 - RNA, 20 nt, Human
cgccccagggcggcgggagc

SEQ ID NO: 691366 - RNA, 18 nt, Human
cggccgcccgccgccgcg

SEQ ID NO: 691367 - RNA, 25 nt, Human
cggcgccccagggcggcgggagcag

SEQ ID NO: 691368 - RNA, 28 nt, Human
cggggcaaggguccaaguggcgaacacg

SEQ ID NO: 691369 - RNA, 21 nt, Human
cucucgggccgggcuccgcgg

SEQ ID NO: 691370 - RNA, 25 nt, Human
cugcagaccuccuuguguggggccu

SEQ ID NO: 691371 - RNA, 26 nt, Human
cuggagacagagggggaccaggguug

SEQ ID NO: 691372 - RNA, 23 nt, Human
cuggaggcuccccuguccugcag

SEQ ID NO: 691373 - RNA, 23 nt, Human
cugggccuccgccagaccucugg

SEQ ID NO: 691374 - RNA, 30 nt, Human
cugugugucugugugugugugugugugugg

SEQ ID NO: 691375 - RNA, 19 nt, Human
cuucacauauaaaauccug

SEQ ID NO: 691376 - RNA, 21 nt, Human
cuuggcccagugggccucggc

SEQ ID NO: 691377 - RNA, 22 nt, Human
cuuuuuuuuuuuuuuuuuaaag

SEQ ID NO: 691378 - RNA, 19 nt, Human
gacacagccaaaugucccc

SEQ ID NO: 691379 - RNA, 19 nt, Human
gaggcuccccuguccugca

SEQ ID NO: 691380 - RNA, 18 nt, Human
gcacagccucgaaggagg

SEQ ID NO: 691381 - RNA, 25 nt, Human
gcacagccucgaaggaggcuguggg

SEQ ID NO: 691382 - RNA, 23 nt, Human
gccagaccucugggccagggcca

SEQ ID NO: 691383 - RNA, 20 nt, Human
gccccccacuuccccggggc

SEQ ID NO: 691384 - RNA, 18 nt, Human
gccgccgccgccccucuc

SEQ ID NO: 691385 - RNA, 20 nt, Human
gccuggagggucugcagcug

SEQ ID NO: 691386 - RNA, 23 nt, Human
gcgccccagggcggcgggagcag

SEQ ID NO: 691387 - RNA, 18 nt, Human
gcuggagacagaggggga

SEQ ID NO: 691388 - RNA, 24 nt, Human
ggaauugcuuuuuuuuuuuuuuuu

SEQ ID NO: 691389 - RNA, 21 nt, Human
ggagacagagggggaccaggg

SEQ ID NO: 691390 - RNA, 21 nt, Human
ggagggaaggagggcggcugg

SEQ ID NO: 691391 - RNA, 22 nt, Human
ggccacuagccccccacuuccc

SEQ ID NO: 691392 - RNA, 23 nt, Human
ggcuguggggccauggaggccag

SEQ ID NO: 691393 - RNA, 21 nt, Human
gggcaggaaguguuaguagga

SEQ ID NO: 691394 - RNA, 18 nt, Human
ggggccauggaggccagc

SEQ ID NO: 691395 - RNA, 18 nt, Human
guccaagugcagaguguc

SEQ ID NO: 691396 - RNA, 22 nt, Human
guccugcagaccuccuugugug

SEQ ID NO: 691397 - RNA, 18 nt, Human
gucugugugugugugugu

SEQ ID NO: 691398 - RNA, 26 nt, Human
guguguguauccguguggcgucagcg

SEQ ID NO: 691399 - RNA, 21 nt, Human
guguguguguguguauccgug

SEQ ID NO: 691400 - RNA, 22 nt, Human
guguguguguguguguguguaa

SEQ ID NO: 691401 - RNA, 21 nt, Human
gugugugugugugugugugug

SEQ ID NO: 691402 - RNA, 21 nt, Human
gugugugugugugugugugug

SEQ ID NO: 691403 - RNA, 20 nt, Human
uacaugugugcacgugugug

SEQ ID NO: 691404 - RNA, 23 nt, Human
uagcucccucuguccugagcccc

SEQ ID NO: 691405 - RNA, 21 nt, Human
uauauauguguacacacacac

SEQ ID NO: 691406 - RNA, 23 nt, Human
uaugugucugugugucugugugu

SEQ ID NO: 691407 - RNA, 20 nt, Human
uccccgacgcugccccggcc

SEQ ID NO: 691408 - RNA, 21 nt, Human
uccccgacgcugccccggccc

SEQ ID NO: 691409 - RNA, 21 nt, Human
ucccuguguucagggagugac

SEQ ID NO: 691410 - RNA, 20 nt, Human
uccgccagaccucugggcca

SEQ ID NO: 691411 - RNA, 22 nt, Human
uccuccagccuggagggucugc

SEQ ID NO: 691412 - RNA, 24 nt, Human
ucgggccgggcuccgcggcgcggg

SEQ ID NO: 691413 - RNA, 26 nt, Human
ucugcacccagcacagccucgaagga

SEQ ID NO: 691414 - RNA, 21 nt, Human
ucuggcgguucugcacccagc

SEQ ID NO: 691415 - RNA, 18 nt, Human
ucugugugucugugugug

SEQ ID NO: 691416 - RNA, 24 nt, Human
ucugugugugugugugugugugug

SEQ ID NO: 691417 - RNA, 23 nt, Human
ugcacguguggcccacagagggu

SEQ ID NO: 691418 - RNA, 22 nt, Human
ugccccggccccuuccauccgc

SEQ ID NO: 691419 - RNA, 18 nt, Human
ugccugggccuccgccag

SEQ ID NO: 691420 - RNA, 25 nt, Human
ugccugggccuccgccagaccucug

SEQ ID NO: 691421 - RNA, 21 nt, Human
uggaggcuccccuguccugca

SEQ ID NO: 691422 - RNA, 21 nt, Human
uggcccagugggccucggcag

SEQ ID NO: 691423 - RNA, 24 nt, Human
ugguacggguccaaauggggcagg

SEQ ID NO: 691424 - RNA, 18 nt, Human
uguacuaagcauuguuuu

SEQ ID NO: 691425 - RNA, 24 nt, Human
uguacuaagcauuguuuuuauugg

SEQ ID NO: 691426 - RNA, 18 nt, Human
uguccugcagaccuccuu

SEQ ID NO: 691427 - RNA, 28 nt, Human
ugugacaaccagaaguauucccagacac

SEQ ID NO: 691428 - RNA, 19 nt, Human
ugugcacgugugugcguau

SEQ ID NO: 691429 - RNA, 19 nt, Human
ugugcacgugugugcguau

SEQ ID NO: 691430 - RNA, 24 nt, Human
uguguacaugugugcacgugugug

SEQ ID NO: 691431 - RNA, 26 nt, Human
uguguauccguguguacaugugugca

SEQ ID NO: 691432 - RNA, 20 nt, Human
ugugugcacgugugugcgua

SEQ ID NO: 691433 - RNA, 18 nt, Human
uguguguauccgugugua

SEQ ID NO: 691434 - RNA, 20 nt, Human
ugugugucugugugugugug

SEQ ID NO: 691435 - RNA, 21 nt, Human
ugugugucugugugugugugu

SEQ ID NO: 691436 - RNA, 21 nt, Human
ugugugucugugugugugugu

SEQ ID NO: 691437 - RNA, 21 nt, Human
ugugugucugugugugugugu

SEQ ID NO: 691438 - RNA, 23 nt, Human
ugugugucugugugugugugugu

SEQ ID NO: 691439 - RNA, 20 nt, Human
uguguguguauccgugugua

SEQ ID NO: 691440 - RNA, 21 nt, Human
uguguguguguauccgugugu

SEQ ID NO: 691441 - RNA, 23 nt, Human
uguguguguguguauccgugugu

SEQ ID NO: 691442 - RNA, 20 nt, Human
uguguguguguguggugggu

SEQ ID NO: 691443 - RNA, 22 nt, Human
uguguguguguguguauccgug

SEQ ID NO: 691444 - RNA, 26 nt, Human
uguguguguguguguauccgugugua

SEQ ID NO: 691445 - RNA, 18 nt, Human
ugugugugugugugugug

SEQ ID NO: 691446 - RNA, 18 nt, Human
ugugugugugugugugug

SEQ ID NO: 691447 - RNA, 18 nt, Human
ugugugugugugugugug

SEQ ID NO: 691448 - RNA, 18 nt, Human
ugugugugugugugugug

SEQ ID NO: 691449 - RNA, 18 nt, Human
ugugugugugugugugug

SEQ ID NO: 691450 - RNA, 18 nt, Human
ugugugugugugugugug

SEQ ID NO: 691451 - RNA, 18 nt, Human
ugugugugugugugugug

SEQ ID NO: 691452 - RNA, 18 nt, Human
ugugugugugugugugug

SEQ ID NO: 691453 - RNA, 18 nt, Human
ugugugugugugugugug

SEQ ID NO: 691454 - RNA, 19 nt, Human
ugugugugugugugugugu

SEQ ID NO: 691455 - RNA, 19 nt, Human
ugugugugugugugugugu

SEQ ID NO: 691456 - RNA, 20 nt, Human
ugugugugugugugugugug

SEQ ID NO: 691457 - RNA, 21 nt, Human
ugugugugugugugugugugu

SEQ ID NO: 691458 - RNA, 21 nt, Human
ugugugugugugugugugugu

SEQ ID NO: 691459 - RNA, 21 nt, Human
ugugugugugugugugugugu

SEQ ID NO: 691460 - RNA, 21 nt, Human
ugugugugugugugugugugu

SEQ ID NO: 691461 - RNA, 21 nt, Human
ugugugugugugugugugugu

SEQ ID NO: 691462 - RNA, 21 nt, Human
ugugugugugugugugugugu

SEQ ID NO: 691463 - RNA, 21 nt, Human
ugugugugugugugugugugu

SEQ ID NO: 691464 - RNA, 21 nt, Human
ugugugugugugugugugugu

SEQ ID NO: 691465 - RNA, 21 nt, Human
ugugugugugugugugugugu

SEQ ID NO: 691466 - RNA, 21 nt, Human
ugugugugugugugugugugu

SEQ ID NO: 691467 - RNA, 21 nt, Human
ugugugugugugugugugugu

SEQ ID NO: 691468 - RNA, 21 nt, Human
ugugugugugugugugugugu

SEQ ID NO: 691469 - RNA, 21 nt, Human
ugugugugugugugugugugu

SEQ ID NO: 691470 - RNA, 21 nt, Human
ugugugugugugugugugugu

SEQ ID NO: 691471 - RNA, 22 nt, Human
ugugugugugugugugugugug

SEQ ID NO: 691472 - RNA, 22 nt, Human
ugugugugugugugugugugug

SEQ ID NO: 691473 - RNA, 22 nt, Human
ugugugugugugugugugugug

SEQ ID NO: 691474 - RNA, 22 nt, Human
ugugugugugugugugugugug

SEQ ID NO: 691475 - RNA, 24 nt, Human
uuaaaguauaaaguguuuuggaaa

SEQ ID NO: 691476 - RNA, 28 nt, Human
uuauauauguguacacacacacggugug

SEQ ID NO: 691477 - RNA, 25 nt, Human
uuauauauguguacacacacacguu

SEQ ID NO: 691478 - RNA, 19 nt, Human
uucagggagcagaagagaa

SEQ ID NO: 691479 - RNA, 18 nt, Human
uuccccgacgcugccccg

SEQ ID NO: 691480 - RNA, 26 nt, Human
uuuuuuuuuuuuucacaauaaaauua

SEQ ID NO: 691481 - RNA, 23 nt, Human
uuuuuuuuuuuuuuuuucacaau

SEQ ID NO: 691482 - RNA, 26 nt, Human
aaaaaaauuaacaaaauacauuuuua

SEQ ID NO: 691483 - RNA, 22 nt, Human
aaaauacaaucaaagcacacua

SEQ ID NO: 691484 - RNA, 21 nt, Human
aaagagucagaacacagacca

SEQ ID NO: 691485 - RNA, 24 nt, Human
aaauauacaaccccaaacaucgua

SEQ ID NO: 691486 - RNA, 20 nt, Human
aacaaaauacauuuuuacag

SEQ ID NO: 691487 - RNA, 22 nt, Human
aacaauucuuccaaguuuucca

SEQ ID NO: 691488 - RNA, 20 nt, Human
aaccaugaauaagccuuacc

SEQ ID NO: 691489 - RNA, 18 nt, Human
aagaaaggcaacagagua

SEQ ID NO: 691490 - RNA, 21 nt, Human
aagcacacuauguggugagcc

SEQ ID NO: 691491 - RNA, 22 nt, Human
aagccaaaauacaaucaaagca

SEQ ID NO: 691492 - RNA, 18 nt, Human
aagccaaugauucacuca

SEQ ID NO: 691493 - RNA, 23 nt, Human
aagcuuucugguguuuuucccag

SEQ ID NO: 691494 - RNA, 24 nt, Human
aaggggaaagggaaaaggaaagga

SEQ ID NO: 691495 - RNA, 18 nt, Human
aauacaaaguguuauugg

SEQ ID NO: 691496 - RNA, 18 nt, Human
aauacaaugaacaaaggc

SEQ ID NO: 691497 - RNA, 21 nt, Human
acaaaauauacaaccccaaac

SEQ ID NO: 691498 - RNA, 20 nt, Human
acaacacagcaacuggagag

SEQ ID NO: 691499 - RNA, 23 nt, Human
acacagaccaggagagcgucucc

SEQ ID NO: 691500 - RNA, 20 nt, Human
accccaaacaucguacuaug

SEQ ID NO: 691501 - RNA, 18 nt, Human
agagcgucuccggcugcc

SEQ ID NO: 691502 - RNA, 19 nt, Human
auauauauauauauauaua

SEQ ID NO: 691503 - RNA, 19 nt, Human
auauauauauauauauaua

SEQ ID NO: 691504 - RNA, 19 nt, Human
auauauauauauauauaua

SEQ ID NO: 691505 - RNA, 25 nt, Human
caaagccaaaauacaaucaaagcac

SEQ ID NO: 691506 - RNA, 25 nt, Human
cacaacacaaauggcugcuaaacaa

SEQ ID NO: 691507 - RNA, 23 nt, Human
cacagcaacuggagaggucagcu

SEQ ID NO: 691508 - RNA, 21 nt, Human
cagaacacagaccaggagagc

SEQ ID NO: 691509 - RNA, 21 nt, Human
cagagcugcggccgcugcgcg

SEQ ID NO: 691510 - RNA, 19 nt, Human
cagcaagcuuucugguguu

SEQ ID NO: 691511 - RNA, 18 nt, Human
cagcugccuccauccucc

SEQ ID NO: 691512 - RNA, 28 nt, Human
cauuuuuacagauauauauauauauauu

SEQ ID NO: 691513 - RNA, 21 nt, Human
ccaaaaaaauuaacaaaauac

SEQ ID NO: 691514 - RNA, 21 nt, Human
ccacggcgacagcucugaccc

SEQ ID NO: 691515 - RNA, 18 nt, Human
ccacuggugaccccagcc

SEQ ID NO: 691516 - RNA, 18 nt, Human
ccagagcugcggccgcug

SEQ ID NO: 691517 - RNA, 18 nt, Human
ccagaugagauaacaaac

SEQ ID NO: 691518 - RNA, 22 nt, Human
cccguggcggggacggcgaggc

SEQ ID NO: 691519 - RNA, 19 nt, Human
ccgucgucuuuaggccggu

SEQ ID NO: 691520 - RNA, 18 nt, Human
ccucccccacauuucaga

SEQ ID NO: 691521 - RNA, 22 nt, Human
cgacgggcccgaggcggggacg

SEQ ID NO: 691522 - RNA, 21 nt, Human
cgcgggccgcccccgccgucg

SEQ ID NO: 691523 - RNA, 21 nt, Human
cggcgcgggacuccccucggc

SEQ ID NO: 691524 - RNA, 21 nt, Human
cggcgggaagagucgucggcc

SEQ ID NO: 691525 - RNA, 18 nt, Human
cgggccugaagaggagcc

SEQ ID NO: 691526 - RNA, 21 nt, Human
cggugccuugagggcgagcgg

SEQ ID NO: 691527 - RNA, 18 nt, Human
cuccauccucccccacau

SEQ ID NO: 691528 - RNA, 20 nt, Human
cugcggccgcugcgcgggcc

SEQ ID NO: 691529 - RNA, 20 nt, Human
cugcggccgcugcgcgggcc

SEQ ID NO: 691530 - RNA, 19 nt, Human
cugggcaucugauuucuag

SEQ ID NO: 691531 - RNA, 21 nt, Human
cugguguuuuaaggggaaagg

SEQ ID NO: 691532 - RNA, 20 nt, Human
cuucacaacacaaauggcug

SEQ ID NO: 691533 - RNA, 23 nt, Human
gaaaggaggagguugaggaaagg

SEQ ID NO: 691534 - RNA, 23 nt, Human
gaaauggcagagucaaagccaaa

SEQ ID NO: 691535 - RNA, 18 nt, Human
gacggggagccgcgacgg

SEQ ID NO: 691536 - RNA, 20 nt, Human
gaggagcgagcgcugcuugc

SEQ ID NO: 691537 - RNA, 21 nt, Human
gcaaugaaccaugaauaagcc

SEQ ID NO: 691538 - RNA, 23 nt, Human
gcgggccgcccccgccgucgucu

SEQ ID NO: 691539 - RNA, 21 nt, Human
gcuccuggcaaugaaccauga

SEQ ID NO: 691540 - RNA, 21 nt, Human
gcugcgcgggccgcccccgcc

SEQ ID NO: 691541 - RNA, 18 nt, Human
ggaaagggaaaaggaaag

SEQ ID NO: 691542 - RNA, 20 nt, Human
ggaaagggaaaaggaaagga

SEQ ID NO: 691543 - RNA, 18 nt, Human
ggcucggagcgcgccgcc

SEQ ID NO: 691544 - RNA, 19 nt, Human
gggcccgaggcggggacgg

SEQ ID NO: 691545 - RNA, 22 nt, Human
uaaauuuuuuagcuuccaugaa

SEQ ID NO: 691546 - RNA, 23 nt, Human
uaacaaaauauacaaccccaaac

SEQ ID NO: 691547 - RNA, 20 nt, Human
uacaacacagcaacuggaga

SEQ ID NO: 691548 - RNA, 18 nt, Human
uacagauauauauauaua

SEQ ID NO: 691549 - RNA, 30 nt, Human
uacauuuuuacagauauauauauauauauu

SEQ ID NO: 691550 - RNA, 25 nt, Human
uagcaggacaaugcaucucaagaaa

SEQ ID NO: 691551 - RNA, 22 nt, Human
uaggaauacaacacagcaacug

SEQ ID NO: 691552 - RNA, 19 nt, Human
uagucuuggaucaucuggg

SEQ ID NO: 691553 - RNA, 22 nt, Human
uauacaaccccaaacaucguac

SEQ ID NO: 691554 - RNA, 19 nt, Human
uauauauauauauauauau

SEQ ID NO: 691555 - RNA, 23 nt, Human
ucagaaauggcagagucaaagcc

SEQ ID NO: 691556 - RNA, 21 nt, Human
uccaaguuuuccauuucagca

SEQ ID NO: 691557 - RNA, 23 nt, Human
uccgcgacgaggagccggagggc

SEQ ID NO: 691558 - RNA, 18 nt, Human
uccuuaagcucuuuucca

SEQ ID NO: 691559 - RNA, 18 nt, Human
ucuaccccuucacaacac

SEQ ID NO: 691560 - RNA, 26 nt, Human
ucuccggcugccgcugucgccuggau

SEQ ID NO: 691561 - RNA, 21 nt, Human
ucucuugguguagguuccaga

SEQ ID NO: 691562 - RNA, 24 nt, Human
ucuucuaccccuucacaacacaaa

SEQ ID NO: 691563 - RNA, 20 nt, Human
ugaagccggccgggcccggc

SEQ ID NO: 691564 - RNA, 23 nt, Human
ugauucacucacaaguagcucua

SEQ ID NO: 691565 - RNA, 22 nt, Human
uggguaggaauacaacacagca

SEQ ID NO: 691566 - RNA, 23 nt, Human
uguaaacaguaaacaaaagagcu

SEQ ID NO: 691567 - RNA, 24 nt, Human
uuacagauauauauauauauauau

SEQ ID NO: 691568 - RNA, 19 nt, Human
uucagagaucuucuacccc

SEQ ID NO: 691569 - RNA, 18 nt, Human
uuggaucaucugggcauc

SEQ ID NO: 691570 - RNA, 19 nt, Human
uuuacagauauauauauau

SEQ ID NO: 691571 - RNA, 21 nt, Human
uuuacagauauauauauauau

SEQ ID NO: 691572 - RNA, 22 nt, Human
uuuuacagauauauauauauau

SEQ ID NO: 691573 - RNA, 18 nt, Human
uuuuuuuuuuuuuuucug

SEQ ID NO: 691574 - RNA, 19 nt, Human
caggguuuucaccaaccug

SEQ ID NO: 691575 - RNA, 22 nt, Human
cauucuguguuucuacgaucgc

SEQ ID NO: 691576 - RNA, 20 nt, Human
cccccucuggaaaacgggac

SEQ ID NO: 691577 - RNA, 22 nt, Human
ccccgcgcucgggccgccccuc

SEQ ID NO: 691578 - RNA, 19 nt, Human
ccccucgccuccucucccu

SEQ ID NO: 691579 - RNA, 21 nt, Human
ccccucgccuccucucccucc

SEQ ID NO: 691580 - RNA, 19 nt, Human
ccgccgcgcuccagccgcc

SEQ ID NO: 691581 - RNA, 19 nt, Human
ccgccgcgcuccagccgcc

SEQ ID NO: 691582 - RNA, 22 nt, Human
ccgccgcgcuccagccgccggg

SEQ ID NO: 691583 - RNA, 25 nt, Human
ccgccgcgcuccagccgccgggggc

SEQ ID NO: 691584 - RNA, 19 nt, Human
ccgcgcuccagccgccggg

SEQ ID NO: 691585 - RNA, 19 nt, Human
ccgcgcuccagccgccggg

SEQ ID NO: 691586 - RNA, 19 nt, Human
ccgcggccuuucaagcucu

SEQ ID NO: 691587 - RNA, 18 nt, Human
ccucgccuccucucccuc

SEQ ID NO: 691588 - RNA, 25 nt, Human
ccucuggaaaacgggaaccagcuuu

SEQ ID NO: 691589 - RNA, 19 nt, Human
cgccgcgcuccagccgccg

SEQ ID NO: 691590 - RNA, 19 nt, Human
cgggccgccccucgccucc

SEQ ID NO: 691591 - RNA, 25 nt, Human
cucggcuccggccccaccaagaagc

SEQ ID NO: 691592 - RNA, 21 nt, Human
cuguuucugcagcuggauuuc

SEQ ID NO: 691593 - RNA, 22 nt, Human
gcuggccucgcucccgccccgc

SEQ ID NO: 691594 - RNA, 21 nt, Human
gcuuccccagucccauucugu

SEQ ID NO: 691595 - RNA, 22 nt, Human
uauauauauagagcuguaugua

SEQ ID NO: 691596 - RNA, 23 nt, Human
uccaaggacacaggguuuucacc

SEQ ID NO: 691597 - RNA, 23 nt, Human
uccccagucccauucuguguuuc

SEQ ID NO: 691598 - RNA, 19 nt, Human
ucccuccggccucugcgcc

SEQ ID NO: 691599 - RNA, 19 nt, Human
ucccuccggccucugcgcc

SEQ ID NO: 691600 - RNA, 25 nt, Human
ucgcuccggcugggucucggcuccc

SEQ ID NO: 691601 - RNA, 19 nt, Human
ucucggcuccggccccacc

SEQ ID NO: 691602 - RNA, 21 nt, Human
ucugggcucccccucuggaaa

SEQ ID NO: 691603 - RNA, 20 nt, Human
ugcagcuggauuuccaaagg

SEQ ID NO: 691604 - RNA, 18 nt, Human
ugucuguuucugcagcug

SEQ ID NO: 691605 - RNA, 22 nt, Human
uuccccagucccauucuguguu

SEQ ID NO: 691606 - RNA, 22 nt, Human
uucuacgaucgcuccaggcgcu

SEQ ID NO: 691607 - RNA, 21 nt, Human
aggaaccgcggaggggaaagc

SEQ ID NO: 691608 - RNA, 27 nt, Human
caguaacucuuccucuagcuggaguuu

SEQ ID NO: 691609 - RNA, 21 nt, Human
cggcucggggaggaaccgcgg

SEQ ID NO: 691610 - RNA, 24 nt, Human
cucgccggcccccaggccuugcag

SEQ ID NO: 691611 - RNA, 26 nt, Human
gggcggcucggggaggaaccgcggag

SEQ ID NO: 691612 - RNA, 22 nt, Human
guagauucuuccagaaguucac

SEQ ID NO: 691613 - RNA, 22 nt, Human
uacgccccuggcgaguucccag

SEQ ID NO: 691614 - RNA, 22 nt, Human
uauauuggauguauuucuggaa

SEQ ID NO: 691615 - RNA, 22 nt, Human
ugagagaaggcaagggaaggaa

SEQ ID NO: 691616 - RNA, 20 nt, Human
ugucaguaacucuuccucua

SEQ ID NO: 691617 - RNA, 24 nt, Human
uugcuugugucaguaacucuuccu

SEQ ID NO: 691618 - RNA, 22 nt, Human
uuguagauucuuccagaaguuc

SEQ ID NO: 691619 - RNA, 22 nt, Human
uuuuucguauauauuggaugua

SEQ ID NO: 691620 - RNA, 18 nt, Human
uuuuuuuuuuuuuuuucg

SEQ ID NO: 691621 - RNA, 20 nt, Human
uuuuuuuuuuuuuuuuucgu

SEQ ID NO: 691622 - RNA, 29 nt, Human
acacaugcacgcacacgcacaccaccgca

SEQ ID NO: 691623 - RNA, 22 nt, Human
acacaugcacgcacacgcacag

SEQ ID NO: 691624 - RNA, 21 nt, Human
accgcacacacagauaaucug

SEQ ID NO: 691625 - RNA, 21 nt, Human
accuaggucuacccacuuggu

SEQ ID NO: 691626 - RNA, 27 nt, Human
acgcacacgcacaccaccgcacacaca

SEQ ID NO: 691627 - RNA, 26 nt, Human
agaacaccuaggucuacccacuuggu

SEQ ID NO: 691628 - RNA, 22 nt, Human
agaccagaacuaguacagagaa

SEQ ID NO: 691629 - RNA, 21 nt, Human
agguucuaguggaagcaaucu

SEQ ID NO: 691630 - RNA, 23 nt, Human
agucaaaaggagaccagaacuag

SEQ ID NO: 691631 - RNA, 28 nt, Human
auauauauucuaggcacacgcgcacgca

SEQ ID NO: 691632 - RNA, 22 nt, Human
caaaaggagaccagaacuagua

SEQ ID NO: 691633 - RNA, 19 nt, Human
caacagaaucuccucugag

SEQ ID NO: 691634 - RNA, 24 nt, Human
caaucuucaaggcagaguugaaaa

SEQ ID NO: 691635 - RNA, 23 nt, Human
cacacaccccucugagagaacac

SEQ ID NO: 691636 - RNA, 22 nt, Human
cacgcacacgcacaccaccgca

SEQ ID NO: 691637 - RNA, 22 nt, Human
cagcuggguugaguggacacau

SEQ ID NO: 691638 - RNA, 25 nt, Human
caugcacgcacacgcacaccaccgc

SEQ ID NO: 691639 - RNA, 20 nt, Human
cccagccacagcacgccagg

SEQ ID NO: 691640 - RNA, 19 nt, Human
cccgcagcaugcaaaacuc

SEQ ID NO: 691641 - RNA, 18 nt, Human
cccggagagucacaguua

SEQ ID NO: 691642 - RNA, 19 nt, Human
ccgcguucuccgccauuuu

SEQ ID NO: 691643 - RNA, 25 nt, Human
ccucggggcccagccacagcacgcc

SEQ ID NO: 691644 - RNA, 26 nt, Human
ccugcaaggguuuggugauaccgaga

SEQ ID NO: 691645 - RNA, 18 nt, Human
ccugggcagcuggguuga

SEQ ID NO: 691646 - RNA, 27 nt, Human
cgcacacacacacacaccccucugaga

SEQ ID NO: 691647 - RNA, 22 nt, Human
cgcacacgcacaccaccgcaca

SEQ ID NO: 691648 - RNA, 25 nt, Human
cgcgcacgcacacacacacacaccc

SEQ ID NO: 691649 - RNA, 26 nt, Human
cgggcugggggggcugggaggggggg

SEQ ID NO: 691650 - RNA, 23 nt, Human
cguccugggcagcuggguugagu

SEQ ID NO: 691651 - RNA, 18 nt, Human
cuaugucuccagguucua

SEQ ID NO: 691652 - RNA, 19 nt, Human
cuccgccauuuuccuccuc

SEQ ID NO: 691653 - RNA, 22 nt, Human
cuggaggccuucuguccagugg

SEQ ID NO: 691654 - RNA, 18 nt, Human
gaacuaguacagagaaug

SEQ ID NO: 691655 - RNA, 21 nt, Human
gagcaggcagcgggaggagug

SEQ ID NO: 691656 - RNA, 23 nt, Human
gcacacgcacaccaccgcacaca

SEQ ID NO: 691657 - RNA, 22 nt, Human
gcacgcacacacacacacaccc

SEQ ID NO: 691658 - RNA, 21 nt, Human
gcccacuggagcccuggggag

SEQ ID NO: 691659 - RNA, 22 nt, Human
gcggaggagcuggaggccuucu

SEQ ID NO: 691660 - RNA, 23 nt, Human
gcugggggggcugggaggggggg

SEQ ID NO: 691661 - RNA, 21 nt, Human
ggcagagcccacuggagcccu

SEQ ID NO: 691662 - RNA, 23 nt, Human
gggcagagcggaggagcuggagg

SEQ ID NO: 691663 - RNA, 21 nt, Human
gggcugggggggcugggaggg

SEQ ID NO: 691664 - RNA, 22 nt, Human
uaaucacaaaacaaauuccuau

SEQ ID NO: 691665 - RNA, 23 nt, Human
uagcagggacgacgggcuggggg

SEQ ID NO: 691666 - RNA, 31 nt, Human
uaggcacacgcgcacgcacacacacacacag

SEQ ID NO: 691667 - RNA, 28 nt, Human
uauaugcacgcauauacagguguuugug

SEQ ID NO: 691668 - RNA, 26 nt, Human
uauauucuaggcacacgcgcacgcac

SEQ ID NO: 691669 - RNA, 24 nt, Human
ucaaggcagaguugaaaacucugg

SEQ ID NO: 691670 - RNA, 19 nt, Human
ucagagccacaguccaguc

SEQ ID NO: 691671 - RNA, 23 nt, Human
ugaguggacacaugauggacgca

SEQ ID NO: 691672 - RNA, 23 nt, Human
ugcacgcacacgcacaccaccgc

SEQ ID NO: 691673 - RNA, 18 nt, Human
ugccccguccugggcagc

SEQ ID NO: 691674 - RNA, 23 nt, Human
uggcaacacaaagccuucgugaa

SEQ ID NO: 691675 - RNA, 22 nt, Human
ugguuguauaugcacgcauaua

SEQ ID NO: 691676 - RNA, 25 nt, Human
uuguauaugcacgcauauacaggug

SEQ ID NO: 691677 - RNA, 19 nt, Human
uuucaugcccauaagagcc

SEQ ID NO: 691678 - RNA, 20 nt, Human
uuuuuguucucauguguguu

SEQ ID NO: 691679 - RNA, 19 nt, Human
uuuuuuuuuuuuuuguucu

SEQ ID NO: 691680 - RNA, 19 nt, Human
uuuuuuuuuuuuuuuuguu

SEQ ID NO: 691681 - RNA, 20 nt, Human
agaaaauacuccucaaagag

SEQ ID NO: 691682 - RNA, 21 nt, Human
agaaaauacuccucaaagagc

SEQ ID NO: 691683 - RNA, 20 nt, Human
auacgccacucagcuagcuu

SEQ ID NO: 691684 - RNA, 23 nt, Human
aucaugggccucccuaaagaggg

SEQ ID NO: 691685 - RNA, 22 nt, Human
cagcuccaccugcauacgccac

SEQ ID NO: 691686 - RNA, 18 nt, Human
caucuccaccacggccac

SEQ ID NO: 691687 - RNA, 24 nt, Human
cgaucaugggccucccuaaagagg

SEQ ID NO: 691688 - RNA, 18 nt, Human
cgccuagggucaccugcu

SEQ ID NO: 691689 - RNA, 21 nt, Human
cuccuugaccauugaauccaa

SEQ ID NO: 691690 - RNA, 18 nt, Human
gagccaauauucagcucc

SEQ ID NO: 691691 - RNA, 19 nt, Human
gccaauauucagcuccacc

SEQ ID NO: 691692 - RNA, 18 nt, Human
ggacaggcugcgccuagg

SEQ ID NO: 691693 - RNA, 23 nt, Human
ucagcaacucagaaauauucucc

SEQ ID NO: 691694 - RNA, 19 nt, Human
ucagcuccaccugcauacg

SEQ ID NO: 691695 - RNA, 21 nt, Human
uccaauguugaaaagucccag

SEQ ID NO: 691696 - RNA, 26 nt, Human
ugaggaagacauuauaguuggcugcc

SEQ ID NO: 691697 - RNA, 18 nt, Human
ugcagaaaauacuccuca

SEQ ID NO: 691698 - RNA, 21 nt, Human
ugcaucaucuccaccacggcc

SEQ ID NO: 691699 - RNA, 22 nt, Human
ugcaucaucuccaccacggcca

SEQ ID NO: 691700 - RNA, 22 nt, Human
ugcuaagccagccaggcccugc

SEQ ID NO: 691701 - RNA, 28 nt, Human
uguuuuuuuguuuuuuuguuuuuuuuuu

SEQ ID NO: 691702 - RNA, 23 nt, Human
uuagucgaucaugggccucccua

SEQ ID NO: 691703 - RNA, 25 nt, Human
uucaccucuuccacugcaugcucca

SEQ ID NO: 691704 - RNA, 24 nt, Human
uuguuuuuuuguuuuuuuguuuuu

SEQ ID NO: 691705 - RNA, 20 nt, Human
uuguuuuuuuguuuuuuuuu

SEQ ID NO: 691706 - RNA, 19 nt, Human
aaaaugcccuccauuuaac

SEQ ID NO: 691707 - RNA, 23 nt, Human
aaacaauacaaaaugcccuccau

SEQ ID NO: 691708 - RNA, 20 nt, Human
acacaauguuaacaaccaug

SEQ ID NO: 691709 - RNA, 22 nt, Human
acacaauguuaacaaccaugaa

SEQ ID NO: 691710 - RNA, 21 nt, Human
aggaaaguuucugagcuuagc

SEQ ID NO: 691711 - RNA, 20 nt, Human
aguggcacaugggcguuuca

SEQ ID NO: 691712 - RNA, 24 nt, Human
aguuccuucauauagagacauauu

SEQ ID NO: 691713 - RNA, 20 nt, Human
uaacaaguagaaaaauauaa

SEQ ID NO: 691714 - RNA, 19 nt, Human
uaguauauauggcaauugu

SEQ ID NO: 691715 - RNA, 23 nt, Human
ucagugaaauaguuuaguuccuu

SEQ ID NO: 691716 - RNA, 24 nt, Human
ucagugaaauaguuuaguuccuuc

SEQ ID NO: 691717 - RNA, 24 nt, Human
ugaaaaacaauacaaaaugcccuc

SEQ ID NO: 691718 - RNA, 20 nt, Human
aaaggaacuguugacccaaa

SEQ ID NO: 691719 - RNA, 21 nt, Human
aaaggaacuguugacccaaag

SEQ ID NO: 691720 - RNA, 18 nt, Human
aagaaccacaccacuaaa

SEQ ID NO: 691721 - RNA, 19 nt, Human
aagaaccacaccacuaaau

SEQ ID NO: 691722 - RNA, 20 nt, Human
aagaagaagcuauaaauaaa

SEQ ID NO: 691723 - RNA, 20 nt, Human
aagcccccaucccugcccag

SEQ ID NO: 691724 - RNA, 24 nt, Human
aagccugaugaacuuaauccguac

SEQ ID NO: 691725 - RNA, 19 nt, Human
aagcuggggcaggagagag

SEQ ID NO: 691726 - RNA, 21 nt, Human
acaccacuaaauccccuuggc

SEQ ID NO: 691727 - RNA, 21 nt, Human
accauccuguccuuggacccc

SEQ ID NO: 691728 - RNA, 23 nt, Human
acccaaagcaugaagcaggaccc

SEQ ID NO: 691729 - RNA, 18 nt, Human
accuagacaaaaacaauu

SEQ ID NO: 691730 - RNA, 19 nt, Human
acugccagcugccgccgcc

SEQ ID NO: 691731 - RNA, 23 nt, Human
acugugguggcugaguggaagcu

SEQ ID NO: 691732 - RNA, 26 nt, Human
agaaaggagaacagaggcaggggagc

SEQ ID NO: 691733 - RNA, 24 nt, Human
agaaucugaaagcucgagucccag

SEQ ID NO: 691734 - RNA, 21 nt, Human
agagacaccagcuuggccucc

SEQ ID NO: 691735 - RNA, 23 nt, Human
agcacgcuuuccucugacccacu

SEQ ID NO: 691736 - RNA, 20 nt, Human
agcuccacucccugccuguu

SEQ ID NO: 691737 - RNA, 22 nt, Human
aggacccccaccaaccccagcc

SEQ ID NO: 691738 - RNA, 24 nt, Human
aggagacugcuuuccaaaugcagc

SEQ ID NO: 691739 - RNA, 25 nt, Human
aggccaggagagcagcuccaggcac

SEQ ID NO: 691740 - RNA, 26 nt, Human
aggccucuggcuggguguccaccucc

SEQ ID NO: 691741 - RNA, 18 nt, Human
agggaguggguggggccu

SEQ ID NO: 691742 - RNA, 19 nt, Human
agggaguggguggggccug

SEQ ID NO: 691743 - RNA, 24 nt, Human
agggcauaaggaauggggacaggg

SEQ ID NO: 691744 - RNA, 22 nt, Human
aggggcuaugggauggccugga

SEQ ID NO: 691745 - RNA, 18 nt, Human
aggguggggagggcugag

SEQ ID NO: 691746 - RNA, 18 nt, Human
aggucuggggguccuggu

SEQ ID NO: 691747 - RNA, 21 nt, Human
aggugaggucaccuugagcca

SEQ ID NO: 691748 - RNA, 23 nt, Human
aggugaggucaccuugagccagg

SEQ ID NO: 691749 - RNA, 20 nt, Human
agugcugugugcauaguugg

SEQ ID NO: 691750 - RNA, 23 nt, Human
aucagcuuuggccuccugaccca

SEQ ID NO: 691751 - RNA, 19 nt, Human
aucccuggccaaagccucc

SEQ ID NO: 691752 - RNA, 23 nt, Human
augaauaaccaaaaaauuucuuc

SEQ ID NO: 691753 - RNA, 23 nt, Human
auugggggcagccagaagaggag

SEQ ID NO: 691754 - RNA, 21 nt, Human
caaaacaaccugcgcucaggc

SEQ ID NO: 691755 - RNA, 23 nt, Human
caaaggaacuguugacccaaagc

SEQ ID NO: 691756 - RNA, 21 nt, Human
caaaucccagugggucagaaa

SEQ ID NO: 691757 - RNA, 23 nt, Human
caagaggccuccccguggccacc

SEQ ID NO: 691758 - RNA, 23 nt, Human
cacaaguggcagcaucccuggcc

SEQ ID NO: 691759 - RNA, 22 nt, Human
cacaccccccaagaggccuccc

SEQ ID NO: 691760 - RNA, 24 nt, Human
cacaccccccaagaggccuccccg

SEQ ID NO: 691761 - RNA, 26 nt, Human
caccaaccccagccagguggccugca

SEQ ID NO: 691762 - RNA, 21 nt, Human
caccacuaaauccccuuggca

SEQ ID NO: 691763 - RNA, 23 nt, Human
cacccugcccuguugaccauccu

SEQ ID NO: 691764 - RNA, 23 nt, Human
cacgugcuuacaacggauaugca

SEQ ID NO: 691765 - RNA, 21 nt, Human
cagaaaggagaacagaggcag

SEQ ID NO: 691766 - RNA, 21 nt, Human
cagaggcaggggagcccucgg

SEQ ID NO: 691767 - RNA, 22 nt, Human
cagcaucccuggccaaagccuc

SEQ ID NO: 691768 - RNA, 19 nt, Human
cagcugccgccgccucugg

SEQ ID NO: 691769 - RNA, 20 nt, Human
cagcugccgccgccucugga

SEQ ID NO: 691770 - RNA, 18 nt, Human
caggaagcccauggugaa

SEQ ID NO: 691771 - RNA, 18 nt, Human
cauggcuuuugguagggc

SEQ ID NO: 691772 - RNA, 18 nt, Human
ccaaagccuccccacucc

SEQ ID NO: 691773 - RNA, 19 nt, Human
ccaaucuacucucuggggg

SEQ ID NO: 691774 - RNA, 23 nt, Human
ccaccaaccccagccagguggcc

SEQ ID NO: 691775 - RNA, 24 nt, Human
ccaccuacagcuguuuugccaagg

SEQ ID NO: 691776 - RNA, 19 nt, Human
ccacucccugccuguuucc

SEQ ID NO: 691777 - RNA, 18 nt, Human
ccagggagguggcccugc

SEQ ID NO: 691778 - RNA, 18 nt, Human
ccauccuguccuuggacc

SEQ ID NO: 691779 - RNA, 23 nt, Human
cccagggagguggcccugcgcgg

SEQ ID NO: 691780 - RNA, 19 nt, Human
ccccaaaguaaaauggggc

SEQ ID NO: 691781 - RNA, 19 nt, Human
cccccaagaggccuccccg

SEQ ID NO: 691782 - RNA, 19 nt, Human
ccccccaagaggccucccc

SEQ ID NO: 691783 - RNA, 21 nt, Human
cccgcgcacccaggaagccca

SEQ ID NO: 691784 - RNA, 20 nt, Human
cccggacagaggagcuaaga

SEQ ID NO: 691785 - RNA, 22 nt, Human
ccuacagcuguuuugccaaggc

SEQ ID NO: 691786 - RNA, 22 nt, Human
ccuaguagcccggacagaggag

SEQ ID NO: 691787 - RNA, 20 nt, Human
ccucccuuugaaagaaccac

SEQ ID NO: 691788 - RNA, 23 nt, Human
ccugaacaucagcuuuggccucc

SEQ ID NO: 691789 - RNA, 18 nt, Human
ccugaccccagcuucggc

SEQ ID NO: 691790 - RNA, 22 nt, Human
ccugaccccagcuucggcuucc

SEQ ID NO: 691791 - RNA, 28 nt, Human
ccugcgcucaggcccgcgcacccaggaa

SEQ ID NO: 691792 - RNA, 19 nt, Human
ccugcggccugagcacaca

SEQ ID NO: 691793 - RNA, 27 nt, Human
ccuggagcuggggcaguugccagaagc

SEQ ID NO: 691794 - RNA, 20 nt, Human
ccuggguucaaguuaaacag

SEQ ID NO: 691795 - RNA, 26 nt, Human
ccuuccagucugagccaggccugccu

SEQ ID NO: 691796 - RNA, 23 nt, Human
cgauaaauccaaggaggccagga

SEQ ID NO: 691797 - RNA, 18 nt, Human
cggcgcuggcacgcuguc

SEQ ID NO: 691798 - RNA, 22 nt, Human
cucacaauccccugaacguguu

SEQ ID NO: 691799 - RNA, 24 nt, Human
cucaggcccgcgcacccaggaagc

SEQ ID NO: 691800 - RNA, 18 nt, Human
cuccaagggccagccgcg

SEQ ID NO: 691801 - RNA, 18 nt, Human
cucccggccuggcagguc

SEQ ID NO: 691802 - RNA, 23 nt, Human
cucccugccuguuuccguccuca

SEQ ID NO: 691803 - RNA, 19 nt, Human
cucuugcgcaaaccuucag

SEQ ID NO: 691804 - RNA, 24 nt, Human
cugcagagcccacugcccuaccuc

SEQ ID NO: 691805 - RNA, 22 nt, Human
cuucgagcacgcuuuccucuga

SEQ ID NO: 691806 - RNA, 24 nt, Human
cuugcgcaaaccuucaguuuuugc

SEQ ID NO: 691807 - RNA, 20 nt, Human
gacagggcacagggcacgug

SEQ ID NO: 691808 - RNA, 21 nt, Human
gaccugucgucuguccuguuu

SEQ ID NO: 691809 - RNA, 22 nt, Human
gagaggacccccaccaacccca

SEQ ID NO: 691810 - RNA, 19 nt, Human
gagaggggagcaggcuucc

SEQ ID NO: 691811 - RNA, 22 nt, Human
gagcagauucccauugacccug

SEQ ID NO: 691812 - RNA, 18 nt, Human
gagcaggcuuccuggggg

SEQ ID NO: 691813 - RNA, 22 nt, Human
gagcccacugcccuaccucuga

SEQ ID NO: 691814 - RNA, 18 nt, Human
gcacgcuguccacccugc

SEQ ID NO: 691815 - RNA, 21 nt, Human
gcacgcuuuccucugacccac

SEQ ID NO: 691816 - RNA, 19 nt, Human
gcagaaggcgcuugcuccc

SEQ ID NO: 691817 - RNA, 21 nt, Human
gcauccacccagggagguggc

SEQ ID NO: 691818 - RNA, 23 nt, Human
gccaaggugccccacguggcuug

SEQ ID NO: 691819 - RNA, 19 nt, Human
gccagagaggggagcaggc

SEQ ID NO: 691820 - RNA, 18 nt, Human
gcccucgguccccagccc

SEQ ID NO: 691821 - RNA, 18 nt, Human
gccugagcacaccaaucu

SEQ ID NO: 691822 - RNA, 23 nt, Human
gcuuuugguagggccauugcagc

SEQ ID NO: 691823 - RNA, 24 nt, Human
ggacacuugggggcugagggcacu

SEQ ID NO: 691824 - RNA, 20 nt, Human
ggagagcagcuccaggcaca

SEQ ID NO: 691825 - RNA, 21 nt, Human
ggagagccaggguggggaggg

SEQ ID NO: 691826 - RNA, 24 nt, Human
ggaggggacguuugcaggucuggg

SEQ ID NO: 691827 - RNA, 18 nt, Human
ggauggccuggagcuggg

SEQ ID NO: 691828 - RNA, 22 nt, Human
ggcaggggcuauggucccaugc

SEQ ID NO: 691829 - RNA, 18 nt, Human
ggccuggagcuggggcag

SEQ ID NO: 691830 - RNA, 20 nt, Human
ggccuggagcuggggcaguu

SEQ ID NO: 691831 - RNA, 23 nt, Human
ggcuaguugagaaucugaaagcu

SEQ ID NO: 691832 - RNA, 18 nt, Human
gggacguuugcaggucug

SEQ ID NO: 691833 - RNA, 19 nt, Human
gggacguuugcaggucugg

SEQ ID NO: 691834 - RNA, 19 nt, Human
gggcagccagaagaggagg

SEQ ID NO: 691835 - RNA, 19 nt, Human
ggggacguuugcaggucug

SEQ ID NO: 691836 - RNA, 20 nt, Human
ggggagggcugagugucugg

SEQ ID NO: 691837 - RNA, 20 nt, Human
ggggcagccagaagaggagg

SEQ ID NO: 691838 - RNA, 22 nt, Human
gggggcagccagaagaggaggg

SEQ ID NO: 691839 - RNA, 20 nt, Human
gguguggcaacugugguggc

SEQ ID NO: 691840 - RNA, 19 nt, Human
gugcuuccgugugaguugg

SEQ ID NO: 691841 - RNA, 25 nt, Human
uaaagcuuuaaacaauccuggguuc

SEQ ID NO: 691842 - RNA, 18 nt, Human
uaagagcgagugcugugu

SEQ ID NO: 691843 - RNA, 21 nt, Human
uaagcuguuagcuccacuccc

SEQ ID NO: 691844 - RNA, 21 nt, Human
uacaacggauaugcaacaugg

SEQ ID NO: 691845 - RNA, 20 nt, Human
uauguacaaaacaaccugcg

SEQ ID NO: 691846 - RNA, 23 nt, Human
ucacgcacaaguggcagcauccc

SEQ ID NO: 691847 - RNA, 21 nt, Human
ucagaaaggagaacagaggca

SEQ ID NO: 691848 - RNA, 21 nt, Human
uccacccugcccuguugacca

SEQ ID NO: 691849 - RNA, 22 nt, Human
uccaccuccugccgggaagcca

SEQ ID NO: 691850 - RNA, 22 nt, Human
uccagucugagccaggccugcc

SEQ ID NO: 691851 - RNA, 20 nt, Human
ucccaagcccguggugaccc

SEQ ID NO: 691852 - RNA, 20 nt, Human
uccccguggccaccaccgcc

SEQ ID NO: 691853 - RNA, 18 nt, Human
ucccuggccaaagccucc

SEQ ID NO: 691854 - RNA, 21 nt, Human
uccgaggguacggcuccuggg

SEQ ID NO: 691855 - RNA, 18 nt, Human
uccguacgcuggugggag

SEQ ID NO: 691856 - RNA, 21 nt, Human
uccguccucacagcccuggga

SEQ ID NO: 691857 - RNA, 18 nt, Human
uccucgucucuugcgcaa

SEQ ID NO: 691858 - RNA, 18 nt, Human
ucucugggggauccaggg

SEQ ID NO: 691859 - RNA, 21 nt, Human
ugaaagaaccacaccacuaaa

SEQ ID NO: 691860 - RNA, 20 nt, Human
ugaaggugaggucaccuuga

SEQ ID NO: 691861 - RNA, 22 nt, Human
ugaccauggcauccuucgagca

SEQ ID NO: 691862 - RNA, 20 nt, Human
ugacccaaagcaugaagcag

SEQ ID NO: 691863 - RNA, 21 nt, Human
ugaccccagcuucggcuuccu

SEQ ID NO: 691864 - RNA, 25 nt, Human
ugacuugcuuuuccaucaucaacuc

SEQ ID NO: 691865 - RNA, 19 nt, Human
ugagaaucugaaagcucga

SEQ ID NO: 691866 - RNA, 19 nt, Human
ugagggagcuacagauggg

SEQ ID NO: 691867 - RNA, 20 nt, Human
ugauggggcuggggcagccu

SEQ ID NO: 691868 - RNA, 22 nt, Human
ugcagaaggcgcuugcucccaa

SEQ ID NO: 691869 - RNA, 23 nt, Human
ugcagcgaagagacugagacaag

SEQ ID NO: 691870 - RNA, 24 nt, Human
ugcagcucgggccuacuacccaaa

SEQ ID NO: 691871 - RNA, 22 nt, Human
ugccaaggcuaguugagaaucu

SEQ ID NO: 691872 - RNA, 23 nt, Human
ugccaggcuggacacuugggggc

SEQ ID NO: 691873 - RNA, 25 nt, Human
ugccaguuggcccgaggaaggccgg

SEQ ID NO: 691874 - RNA, 23 nt, Human
ugcccuguugaccauccuguccu

SEQ ID NO: 691875 - RNA, 21 nt, Human
ugcgauaaauccaaggaggcc

SEQ ID NO: 691876 - RNA, 23 nt, Human
ugcgcaaaccuucaguuuuugcc

SEQ ID NO: 691877 - RNA, 18 nt, Human
uggagcagguuugggaug

SEQ ID NO: 691878 - RNA, 21 nt, Human
uggcccgaggaaggccggcaa

SEQ ID NO: 691879 - RNA, 21 nt, Human
uggcuggguguccaccuccug

SEQ ID NO: 691880 - RNA, 24 nt, Human
ugggaugcucaucccuugacaguc

SEQ ID NO: 691881 - RNA, 28 nt, Human
ugggauggccuggagcuggggcaguugc

SEQ ID NO: 691882 - RNA, 20 nt, Human
uggggcaguugccagaagcu

SEQ ID NO: 691883 - RNA, 19 nt, Human
ugggggcagccagaagagg

SEQ ID NO: 691884 - RNA, 24 nt, Human
ugggggcuggacucgagucuucuu

SEQ ID NO: 691885 - RNA, 18 nt, Human
ugggucagaaaggagaac

SEQ ID NO: 691886 - RNA, 18 nt, Human
ugguauuugagcucuuga

SEQ ID NO: 691887 - RNA, 21 nt, Human
ugguggcugaguggaagcugg

SEQ ID NO: 691888 - RNA, 23 nt, Human
ugguguggcaacugugguggcug

SEQ ID NO: 691889 - RNA, 20 nt, Human
uguacaaaacaaccugcgcu

SEQ ID NO: 691890 - RNA, 28 nt, Human
uguccuguuuuaucccccacacccccca

SEQ ID NO: 691891 - RNA, 19 nt, Human
ugugaugcauccacccagg

SEQ ID NO: 691892 - RNA, 24 nt, Human
ugugcaagaccucaccgguucccc

SEQ ID NO: 691893 - RNA, 18 nt, Human
uguggcaacugugguggc

SEQ ID NO: 691894 - RNA, 21 nt, Human
uguuccuggcuuccccuucca

SEQ ID NO: 691895 - RNA, 21 nt, Human
uguugaccauccuguccuugg

SEQ ID NO: 691896 - RNA, 19 nt, Human
uguuggccagguuguacgg

SEQ ID NO: 691897 - RNA, 20 nt, Human
uucaaguuaaacaguuccag

SEQ ID NO: 691898 - RNA, 24 nt, Human
uuccgcuguccucgucucuugcgc

SEQ ID NO: 691899 - RNA, 19 nt, Human
uuggcccgaggaaggccgg

SEQ ID NO: 691900 - RNA, 20 nt, Human
aagcccccaucccugcccag

SEQ ID NO: 691901 - RNA, 23 nt, Human
acccaaagcaugaagcaggaccc

SEQ ID NO: 691902 - RNA, 19 nt, Human
acuuugagggagcuacaga

SEQ ID NO: 691903 - RNA, 23 nt, Human
agcacgcuuuccucugacccacu

SEQ ID NO: 691904 - RNA, 25 nt, Human
aggccaggagagcagcuccaggcac

SEQ ID NO: 691905 - RNA, 18 nt, Human
agggaguggguggggccu

SEQ ID NO: 691906 - RNA, 19 nt, Human
agggaguggguggggccug

SEQ ID NO: 691907 - RNA, 22 nt, Human
aggggcuaugggauggccugga

SEQ ID NO: 691908 - RNA, 23 nt, Human
aucagcuuuggccuccugaccca

SEQ ID NO: 691909 - RNA, 23 nt, Human
auugggggcagccagaagaggag

SEQ ID NO: 691910 - RNA, 23 nt, Human
caagaggccuccccguggccacc

SEQ ID NO: 691911 - RNA, 22 nt, Human
cacaccccccaagaggccuccc

SEQ ID NO: 691912 - RNA, 24 nt, Human
cacaccccccaagaggccuccccg

SEQ ID NO: 691913 - RNA, 22 nt, Human
ccccaggccucggggcauuggg

SEQ ID NO: 691914 - RNA, 19 nt, Human
cccccaagaggccuccccg

SEQ ID NO: 691915 - RNA, 19 nt, Human
ccccccaagaggccucccc

SEQ ID NO: 691916 - RNA, 19 nt, Human
cccggacagaggaguuaag

SEQ ID NO: 691917 - RNA, 19 nt, Human
cccggcccggcuacucggc

SEQ ID NO: 691918 - RNA, 18 nt, Human
ccgccgcgcccgcgcucc

SEQ ID NO: 691919 - RNA, 20 nt, Human
ccgcgcccgcgcuccggccc

SEQ ID NO: 691920 - RNA, 21 nt, Human
ccgcgcccgcgcuccggcccu

SEQ ID NO: 691921 - RNA, 20 nt, Human
ccgcgcuccggcccggcccg

SEQ ID NO: 691922 - RNA, 22 nt, Human
ccuaguagcccggacagaggag

SEQ ID NO: 691923 - RNA, 23 nt, Human
ccugaacaucagcuuuggccucc

SEQ ID NO: 691924 - RNA, 27 nt, Human
ccuggagcuggggcaguugccagaagc

SEQ ID NO: 691925 - RNA, 23 nt, Human
cgauaaauccaaggaggccagga

SEQ ID NO: 691926 - RNA, 25 nt, Human
cgccgcgcccgcgcuccggcccggc

SEQ ID NO: 691927 - RNA, 21 nt, Human
cggcccggcccggcuacucgg

SEQ ID NO: 691928 - RNA, 18 nt, Human
cucccggccuggcagguc

SEQ ID NO: 691929 - RNA, 19 nt, Human
cucuugcgcaaaccuucag

SEQ ID NO: 691930 - RNA, 20 nt, Human
cuguagggagugggugggag

SEQ ID NO: 691931 - RNA, 22 nt, Human
cuucgagcacgcuuuccucuga

SEQ ID NO: 691932 - RNA, 24 nt, Human
cuugcgcaaaccuucaguuuuugc

SEQ ID NO: 691933 - RNA, 26 nt, Human
cuuuccgcuguccucgucucuugcgc

SEQ ID NO: 691934 - RNA, 19 nt, Human
gagaggggagcaggcuucc

SEQ ID NO: 691935 - RNA, 19 nt, Human
gaggaggggcuaugggaug

SEQ ID NO: 691936 - RNA, 21 nt, Human
gagugcugugugcauaguugg

SEQ ID NO: 691937 - RNA, 21 nt, Human
gcacgcuuuccucugacccac

SEQ ID NO: 691938 - RNA, 19 nt, Human
gccagagaggggagcaggc

SEQ ID NO: 691939 - RNA, 18 nt, Human
gccgcgcggccgccgccg

SEQ ID NO: 691940 - RNA, 18 nt, Human
gccuggagcuggggcagu

SEQ ID NO: 691941 - RNA, 20 nt, Human
ggagagcagcuccaggcaca

SEQ ID NO: 691942 - RNA, 27 nt, Human
ggaggggaggagccgggcgcagcugcc

SEQ ID NO: 691943 - RNA, 18 nt, Human
ggauggccuggagcuggg

SEQ ID NO: 691944 - RNA, 25 nt, Human
ggcauugggggcagccagaagagga

SEQ ID NO: 691945 - RNA, 18 nt, Human
ggccuggagcuggggcag

SEQ ID NO: 691946 - RNA, 21 nt, Human
ggccugggaggggaggagccg

SEQ ID NO: 691947 - RNA, 22 nt, Human
gggaggagccgggcgcagcugc

SEQ ID NO: 691948 - RNA, 19 nt, Human
gggcagccagaagaggagg

SEQ ID NO: 691949 - RNA, 20 nt, Human
ggggcagccagaagaggagg

SEQ ID NO: 691950 - RNA, 18 nt, Human
ggggcccgggcggggggc

SEQ ID NO: 691951 - RNA, 22 nt, Human
gggggcagccagaagaggaggg

SEQ ID NO: 691952 - RNA, 18 nt, Human
uaagagcgagugcugugu

SEQ ID NO: 691953 - RNA, 20 nt, Human
uccccguggccaccaccgcc

SEQ ID NO: 691954 - RNA, 18 nt, Human
uccucgucucuugcgcaa

SEQ ID NO: 691955 - RNA, 18 nt, Human
ucgccggggcccgggcgg

SEQ ID NO: 691956 - RNA, 22 nt, Human
ugaccauggcauccuucgagca

SEQ ID NO: 691957 - RNA, 20 nt, Human
ugacccaaagcaugaagcag

SEQ ID NO: 691958 - RNA, 19 nt, Human
ugagggagcuacagauggg

SEQ ID NO: 691959 - RNA, 21 nt, Human
ugcgauaaauccaaggaggcc

SEQ ID NO: 691960 - RNA, 23 nt, Human
ugcgcaaaccuucaguuuuugcc

SEQ ID NO: 691961 - RNA, 18 nt, Human
uggagcagguuugggaug

SEQ ID NO: 691962 - RNA, 19 nt, Human
ugggaggggaggagccggg

SEQ ID NO: 691963 - RNA, 24 nt, Human
ugggaugcucaucccuugacaguc

SEQ ID NO: 691964 - RNA, 28 nt, Human
ugggauggccuggagcuggggcaguugc

SEQ ID NO: 691965 - RNA, 20 nt, Human
uggggcaguugccagaagcu

SEQ ID NO: 691966 - RNA, 24 nt, Human
ugggggcuggacucgagucuucuu

SEQ ID NO: 691967 - RNA, 28 nt, Human
uguccuguuuuaucccccacacccccca

SEQ ID NO: 691968 - RNA, 24 nt, Human
uuccgcuguccucgucucuugcgc

SEQ ID NO: 691969 - RNA, 23 nt, Human
uuccucugacccacugggcugca

SEQ ID NO: 691970 - RNA, 19 nt, Human
agaaauauguauuuucucu

SEQ ID NO: 691971 - RNA, 19 nt, Human
aucccaugaguucuuguuc

SEQ ID NO: 691972 - RNA, 21 nt, Human
cagagaauacucuaaucccau

SEQ ID NO: 691973 - RNA, 26 nt, Human
cuuuccuuuuucucucucucucuuuu

SEQ ID NO: 691974 - RNA, 24 nt, Human
uauuuucucuuuccuuuuucucuc

SEQ ID NO: 691975 - RNA, 18 nt, Human
ucucuuuccuuuuucucu

SEQ ID NO: 691976 - RNA, 18 nt, Human
ucucuuuuuuuuuguuuu

SEQ ID NO: 691977 - RNA, 23 nt, Human
uuuucucuuuccuuuuucucucu

SEQ ID NO: 691978 - RNA, 25 nt, Human
uuuuucagaucucuagcagagaaua

SEQ ID NO: 691979 - RNA, 21 nt, Human
aaaggaaaaaagacacaaagc

SEQ ID NO: 691980 - RNA, 23 nt, Human
aaaucaaaucacaacaaagcuga

SEQ ID NO: 691981 - RNA, 22 nt, Human
aaaucacaacaaagcugacuug

SEQ ID NO: 691982 - RNA, 21 nt, Human
aagagagaaaaggaaaaaaga

SEQ ID NO: 691983 - RNA, 21 nt, Human
aaucacaacaaagcugacuug

SEQ ID NO: 691984 - RNA, 22 nt, Human
agagggagaguaaaggggggac

SEQ ID NO: 691985 - RNA, 20 nt, Human
agaggggugggaggggcaga

SEQ ID NO: 691986 - RNA, 25 nt, Human
agaguaaaggggggacaaauuuagg

SEQ ID NO: 691987 - RNA, 23 nt, Human
agggcagagaggggugggagggg

SEQ ID NO: 691988 - RNA, 20 nt, Human
augaccccggcaccgccggc

SEQ ID NO: 691989 - RNA, 20 nt, Human
augaccccggcaccgccggc

SEQ ID NO: 691990 - RNA, 19 nt, Human
caaaucacaacaaagcuga

SEQ ID NO: 691991 - RNA, 23 nt, Human
cacagcccagcccuuggagcagg

SEQ ID NO: 691992 - RNA, 25 nt, Human
cagagccccuggcccauguguccaa

SEQ ID NO: 691993 - RNA, 18 nt, Human
ccaccccaacucaggugg

SEQ ID NO: 691994 - RNA, 21 nt, Human
ccagggcagagagggguggga

SEQ ID NO: 691995 - RNA, 23 nt, Human
cccaaaaucccaguaucccaccc

SEQ ID NO: 691996 - RNA, 23 nt, Human
cccaaaaucccaguaucccaccc

SEQ ID NO: 691997 - RNA, 22 nt, Human
cccacagcccagcccuuggagc

SEQ ID NO: 691998 - RNA, 18 nt, Human
cccucccuuuccccccca

SEQ ID NO: 691999 - RNA, 19 nt, Human
cccuuggagcaggagugaa

SEQ ID NO: 692000 - RNA, 18 nt, Human
ccuuggagcaggagugaa

SEQ ID NO: 692001 - RNA, 22 nt, Human
cgcccucccuuucccccccacc

SEQ ID NO: 692002 - RNA, 19 nt, Human
cucuuugagccuccuggau

SEQ ID NO: 692003 - RNA, 18 nt, Human
gagagaaaaauagaggga

SEQ ID NO: 692004 - RNA, 21 nt, Human
gagccuccuggaucaccguau

SEQ ID NO: 692005 - RNA, 20 nt, Human
gaggggcagacccugcccag

SEQ ID NO: 692006 - RNA, 19 nt, Human
gauucggcucuccuaggcu

SEQ ID NO: 692007 - RNA, 24 nt, Human
gcccaaaaucccaguaucccaccc

SEQ ID NO: 692008 - RNA, 21 nt, Human
gcccucccuuucccccccacc

SEQ ID NO: 692009 - RNA, 19 nt, Human
gcucccagggcagagaggg

SEQ ID NO: 692010 - RNA, 18 nt, Human
gcugcuucagagccccug

SEQ ID NO: 692011 - RNA, 18 nt, Human
ggaaaauccaguggccca

SEQ ID NO: 692012 - RNA, 19 nt, Human
ggaaaauccaguggcccaa

SEQ ID NO: 692013 - RNA, 21 nt, Human
ggcagagaggggugggagggg

SEQ ID NO: 692014 - RNA, 23 nt, Human
gggcagagaggggugggaggggc

SEQ ID NO: 692015 - RNA, 20 nt, Human
uaagagugaggcugcuucag

SEQ ID NO: 692016 - RNA, 20 nt, Human
uagagggagaguaaaggggg

SEQ ID NO: 692017 - RNA, 21 nt, Human
uagagggagaguaaagggggg

SEQ ID NO: 692018 - RNA, 24 nt, Human
uagaucaguuuuguacaagaguuu

SEQ ID NO: 692019 - RNA, 21 nt, Human
ucacaacaaagcugacuuggc

SEQ ID NO: 692020 - RNA, 19 nt, Human
uccagacuccaaguggagu

SEQ ID NO: 692021 - RNA, 20 nt, Human
ucccaguaucccacccacag

SEQ ID NO: 692022 - RNA, 23 nt, Human
ucccaguaucccacccacagccc

SEQ ID NO: 692023 - RNA, 20 nt, Human
ucccccccaccccaacucag

SEQ ID NO: 692024 - RNA, 18 nt, Human
ucccuuucccccccaccc

SEQ ID NO: 692025 - RNA, 24 nt, Human
ucccuuucccccccaccccaacuc

SEQ ID NO: 692026 - RNA, 21 nt, Human
ucgcccucccuuuccccccca

SEQ ID NO: 692027 - RNA, 21 nt, Human
ucuucacaaacacugauucgg

SEQ ID NO: 692028 - RNA, 19 nt, Human
ugacuuggcuucucuuuga

SEQ ID NO: 692029 - RNA, 22 nt, Human
ugagccuccuggaucaccguau

SEQ ID NO: 692030 - RNA, 19 nt, Human
ugguuacaggucugaggga

SEQ ID NO: 692031 - RNA, 22 nt, Human
ugguuuaaaagagagaaaagga

SEQ ID NO: 692032 - RNA, 23 nt, Human
uguguccauccagacuccaagug

SEQ ID NO: 692033 - RNA, 23 nt, Human
uuccauggagugugaacacgaag

SEQ ID NO: 692034 - RNA, 19 nt, Human
uuucccccccaccccaacu

SEQ ID NO: 692035 - RNA, 21 nt, Human
aacaauggaugcaugaaggga

SEQ ID NO: 692036 - RNA, 22 nt, Human
aaggaagggccgagcaccggug

SEQ ID NO: 692037 - RNA, 19 nt, Human
accccacuggaccucccca

SEQ ID NO: 692038 - RNA, 22 nt, Human
accccggaacuccagcuuccac

SEQ ID NO: 692039 - RNA, 20 nt, Human
acggacagucgccuccccgc

SEQ ID NO: 692040 - RNA, 22 nt, Human
caccacggacagucgccucccc

SEQ ID NO: 692041 - RNA, 19 nt, Human
caugucacacugcuccugu

SEQ ID NO: 692042 - RNA, 25 nt, Human
ccccgcccaccccggaacuccagcc

SEQ ID NO: 692043 - RNA, 28 nt, Human
ccccgcccaccccggaacuccagcuucc

SEQ ID NO: 692044 - RNA, 20 nt, Human
ccccggaacuccagcuucca

SEQ ID NO: 692045 - RNA, 24 nt, Human
cccuaagcgaccccacuggaccuc

SEQ ID NO: 692046 - RNA, 18 nt, Human
ccuuugggacgaacugcc

SEQ ID NO: 692047 - RNA, 22 nt, Human
cucaugucacacugcuccuguu

SEQ ID NO: 692048 - RNA, 20 nt, Human
cuccagcuuccacucgcgcc

SEQ ID NO: 692049 - RNA, 20 nt, Human
cucgcgccccugccucgcuc

SEQ ID NO: 692050 - RNA, 21 nt, Human
gaaugaacagaacaauggaug

SEQ ID NO: 692051 - RNA, 22 nt, Human
gcuccgcgcccgcucucgccgg

SEQ ID NO: 692052 - RNA, 25 nt, Human
gggagcuuuuggagccggguggggg

SEQ ID NO: 692053 - RNA, 21 nt, Human
gggccgagcaccggugccugg

SEQ ID NO: 692054 - RNA, 24 nt, Human
gggccgagcaccggugccugggga

SEQ ID NO: 692055 - RNA, 24 nt, Human
ucagaggcagguggauguauggau

SEQ ID NO: 692056 - RNA, 22 nt, Human
uccccgcccaccccggaacucc

SEQ ID NO: 692057 - RNA, 23 nt, Human
ugaagggaagcgauggggcccuu

SEQ ID NO: 692058 - RNA, 23 nt, Human
ugcaugaagggaagcgauggggc

SEQ ID NO: 692059 - RNA, 21 nt, Human
ugccucgcucguuugcgccca

SEQ ID NO: 692060 - RNA, 20 nt, Human
uggauguauggaugaaugaa

SEQ ID NO: 692061 - RNA, 23 nt, Human
ugggagcuuuuggagccgggugg

SEQ ID NO: 692062 - RNA, 23 nt, Human
ugggagcuuuuggagccgggugg

SEQ ID NO: 692063 - RNA, 18 nt, Human
ugggcccuaagcgacccc

SEQ ID NO: 692064 - RNA, 24 nt, Human
uucucaguucuggcagagucuuau

SEQ ID NO: 692065 - RNA, 20 nt, Human
uuggggcgcccuccugaugc

SEQ ID NO: 692066 - RNA, 27 nt, Human
uuucugaccgaaggaagggccgagcac

SEQ ID NO: 692067 - RNA, 21 nt, Human
aaaauugcugugucucaaagc

SEQ ID NO: 692068 - RNA, 21 nt, Human
aaccacagaggcagcgugaga

SEQ ID NO: 692069 - RNA, 19 nt, Human
aagcaacaguggacucgua

SEQ ID NO: 692070 - RNA, 22 nt, Human
aagcaagagagagggaggugag

SEQ ID NO: 692071 - RNA, 25 nt, Human
aagcaagagagagggaggugaggag

SEQ ID NO: 692072 - RNA, 23 nt, Human
aagccaaacaaauucagagcuag

SEQ ID NO: 692073 - RNA, 19 nt, Human
aagccaaaugaagcaagag

SEQ ID NO: 692074 - RNA, 24 nt, Human
aagcuuaccaaugaucaccaucca

SEQ ID NO: 692075 - RNA, 26 nt, Human
aagggguaggggaggggaaagaaugg

SEQ ID NO: 692076 - RNA, 22 nt, Human
aauccauaauuucccaagccaa

SEQ ID NO: 692077 - RNA, 21 nt, Human
acaaaauacauuauacagaag

SEQ ID NO: 692078 - RNA, 23 nt, Human
acaaucuacauuccagccagggc

SEQ ID NO: 692079 - RNA, 21 nt, Human
acacuguaaccaaaaaaagca

SEQ ID NO: 692080 - RNA, 22 nt, Human
acagaagacagcucacaguaca

SEQ ID NO: 692081 - RNA, 23 nt, Human
acaguacacauuacuaaaaacac

SEQ ID NO: 692082 - RNA, 23 nt, Human
acauuacuaaaaacacaaucuac

SEQ ID NO: 692083 - RNA, 24 nt, Human
acauuacuaaaaacacaaucuaca

SEQ ID NO: 692084 - RNA, 23 nt, Human
accucaucuucccucccuggcag

SEQ ID NO: 692085 - RNA, 23 nt, Human
agaacaaccccccuuaaaaugcu

SEQ ID NO: 692086 - RNA, 23 nt, Human
agaagccacuuuccaggagagga

SEQ ID NO: 692087 - RNA, 22 nt, Human
agcagcaaacauuaaaaguccc

SEQ ID NO: 692088 - RNA, 21 nt, Human
aggacacagguguauagaaca

SEQ ID NO: 692089 - RNA, 23 nt, Human
aggacccaccuugugggaguggc

SEQ ID NO: 692090 - RNA, 20 nt, Human
aggcaguugucccaagucug

SEQ ID NO: 692091 - RNA, 19 nt, Human
agggagggaaccacagagg

SEQ ID NO: 692092 - RNA, 23 nt, Human
aggggauggggugggaugugcga

SEQ ID NO: 692093 - RNA, 20 nt, Human
agguggguguggguagaguu

SEQ ID NO: 692094 - RNA, 26 nt, Human
aguacagacuccccaccucaucuucc

SEQ ID NO: 692095 - RNA, 21 nt, Human
auuguaguuuggcaggccagg

SEQ ID NO: 692096 - RNA, 24 nt, Human
caagccaaacaaauucagagcuag

SEQ ID NO: 692097 - RNA, 25 nt, Human
caagucuggguuuucugagacuugg

SEQ ID NO: 692098 - RNA, 21 nt, Human
caccucaucuucccucccugg

SEQ ID NO: 692099 - RNA, 23 nt, Human
cagacuccccaccucaucuuccc

SEQ ID NO: 692100 - RNA, 25 nt, Human
cagcaaguacauacaacacagcacu

SEQ ID NO: 692101 - RNA, 20 nt, Human
cagcauugagugggacuggu

SEQ ID NO: 692102 - RNA, 24 nt, Human
cagcgugagauccaaauacagcau

SEQ ID NO: 692103 - RNA, 26 nt, Human
caggaaaaaugagggagggaaccaca

SEQ ID NO: 692104 - RNA, 19 nt, Human
caggcucugcauuccaagg

SEQ ID NO: 692105 - RNA, 20 nt, Human
caguacagacuccccaccuc

SEQ ID NO: 692106 - RNA, 23 nt, Human
caucucaguacagacuccccacc

SEQ ID NO: 692107 - RNA, 18 nt, Human
caucucuaccaaagcaac

SEQ ID NO: 692108 - RNA, 18 nt, Human
ccaccucccaaguaguuc

SEQ ID NO: 692109 - RNA, 25 nt, Human
cccagagcaagcuuacagacaaaga

SEQ ID NO: 692110 - RNA, 27 nt, Human
cccauccccacucaauucauucaaaag

SEQ ID NO: 692111 - RNA, 23 nt, Human
ccccaccucaucuucccucccug

SEQ ID NO: 692112 - RNA, 25 nt, Human
ccccaccucaucuucccucccuggc

SEQ ID NO: 692113 - RNA, 18 nt, Human
ccccuccccaccucccaa

SEQ ID NO: 692114 - RNA, 18 nt, Human
cccucaaaagaaaagggg

SEQ ID NO: 692115 - RNA, 21 nt, Human
ccgcuagaugcaaagucaugc

SEQ ID NO: 692116 - RNA, 21 nt, Human
ccugagccugggguaaggaca

SEQ ID NO: 692117 - RNA, 19 nt, Human
ccugggguaaggacacagg

SEQ ID NO: 692118 - RNA, 22 nt, Human
cguaccccuccccaccucccaa

SEQ ID NO: 692119 - RNA, 21 nt, Human
cguuuagaauagccaucauug

SEQ ID NO: 692120 - RNA, 20 nt, Human
cuagucuggagcacagcuga

SEQ ID NO: 692121 - RNA, 25 nt, Human
cucaaccucagcauguuuuauuagc

SEQ ID NO: 692122 - RNA, 18 nt, Human
cucccuggcaguuccuga

SEQ ID NO: 692123 - RNA, 27 nt, Human
cucuagcauccuaguucccaggcaguu

SEQ ID NO: 692124 - RNA, 19 nt, Human
cugagacuugggucuucac

SEQ ID NO: 692125 - RNA, 24 nt, Human
cuugagccucauuuucuuuuucuu

SEQ ID NO: 692126 - RNA, 22 nt, Human
gacucguaccccuccccaccuc

SEQ ID NO: 692127 - RNA, 18 nt, Human
gaggagaaaucuaggggc

SEQ ID NO: 692128 - RNA, 21 nt, Human
gaggagaaaucuaggggcaga

SEQ ID NO: 692129 - RNA, 20 nt, Human
gccacagaggccuugaaaac

SEQ ID NO: 692130 - RNA, 18 nt, Human
ggacucguaccccucccc

SEQ ID NO: 692131 - RNA, 20 nt, Human
ggccaucuuuggccucuguc

SEQ ID NO: 692132 - RNA, 26 nt, Human
gggcaggugcugguugcuccagaggc

SEQ ID NO: 692133 - RNA, 22 nt, Human
gguaggggaggggaaagaaugg

SEQ ID NO: 692134 - RNA, 18 nt, Human
ggugagcaaagcuuacca

SEQ ID NO: 692135 - RNA, 20 nt, Human
ggugguaaguucagaagaaa

SEQ ID NO: 692136 - RNA, 22 nt, Human
guaccccuccccaccucccaag

SEQ ID NO: 692137 - RNA, 19 nt, Human
guaguucaggggauggggu

SEQ ID NO: 692138 - RNA, 21 nt, Human
guccuaagaauuaacaccauc

SEQ ID NO: 692139 - RNA, 25 nt, Human
uaaaaacacaaucuacauuccagcc

SEQ ID NO: 692140 - RNA, 24 nt, Human
uaaaaauaaagaugagucaagacc

SEQ ID NO: 692141 - RNA, 21 nt, Human
uaagaggcugagucccagagc

SEQ ID NO: 692142 - RNA, 20 nt, Human
uacagacuccccaccucauc

SEQ ID NO: 692143 - RNA, 21 nt, Human
uaccccuccccaccucccaag

SEQ ID NO: 692144 - RNA, 25 nt, Human
uagaacaaccccccuuaaaaugcua

SEQ ID NO: 692145 - RNA, 19 nt, Human
uagcaaggguuccagcaag

SEQ ID NO: 692146 - RNA, 20 nt, Human
uagcaaggguuccagcaagg

SEQ ID NO: 692147 - RNA, 20 nt, Human
uagcguuuagaauagccauc

SEQ ID NO: 692148 - RNA, 21 nt, Human
uagguggguguggguagaguu

SEQ ID NO: 692149 - RNA, 22 nt, Human
uaguucaggggaugggguggga

SEQ ID NO: 692150 - RNA, 27 nt, Human
ucacaguacacauuacuaaaaacacaa

SEQ ID NO: 692151 - RNA, 22 nt, Human
ucaguacagacuccccaccuca

SEQ ID NO: 692152 - RNA, 19 nt, Human
ucaugcccaaacuuuuaca

SEQ ID NO: 692153 - RNA, 23 nt, Human
uccaaguuucucuugcuuuagca

SEQ ID NO: 692154 - RNA, 19 nt, Human
uccagcaauauaaggaggc

SEQ ID NO: 692155 - RNA, 21 nt, Human
uccauaauuucccaagccaaa

SEQ ID NO: 692156 - RNA, 22 nt, Human
uccauaauuucccaagccaaac

SEQ ID NO: 692157 - RNA, 26 nt, Human
uccauaauuucccaagccaaacaaau

SEQ ID NO: 692158 - RNA, 21 nt, Human
ucccaaagauacauuuuuuuc

SEQ ID NO: 692159 - RNA, 24 nt, Human
ucccuggcaguuccugagccuggg

SEQ ID NO: 692160 - RNA, 23 nt, Human
ucguaccccuccccaccucccaa

SEQ ID NO: 692161 - RNA, 19 nt, Human
ucucuugcuuuagcagcaa

SEQ ID NO: 692162 - RNA, 22 nt, Human
ucuggguuuucugagacuuggg

SEQ ID NO: 692163 - RNA, 23 nt, Human
ucuuuggccucugucauuucacu

SEQ ID NO: 692164 - RNA, 24 nt, Human
ugaaaacaucugugacuagaaaag

SEQ ID NO: 692165 - RNA, 19 nt, Human
ugagaucagaaaagaccac

SEQ ID NO: 692166 - RNA, 20 nt, Human
ugagccugggguaaggacac

SEQ ID NO: 692167 - RNA, 21 nt, Human
ugagggagggaaccacagagg

SEQ ID NO: 692168 - RNA, 18 nt, Human
ugccuggggagggaggaa

SEQ ID NO: 692169 - RNA, 28 nt, Human
ugggguaaggacacagguggcgaacacg

SEQ ID NO: 692170 - RNA, 18 nt, Human
ugguuggucuguaaguca

SEQ ID NO: 692171 - RNA, 18 nt, Human
ugucucaaagcauuacag

SEQ ID NO: 692172 - RNA, 21 nt, Human
ugugcgaauaaaaauaaagau

SEQ ID NO: 692173 - RNA, 27 nt, Human
uugcagccacacagcugagaucagaaa

SEQ ID NO: 692174 - RNA, 19 nt, Human
uugguuggucuguaaguca

SEQ ID NO: 692175 - RNA, 22 nt, Human
uuguaguuuggcaggccaggcu

SEQ ID NO: 692176 - RNA, 19 nt, Human
uuugauaaagccaaaugaa

SEQ ID NO: 692177 - RNA, 18 nt, Human
aaaauaccauaaagguag

SEQ ID NO: 692178 - RNA, 22 nt, Human
aacaaucagcugguccuaaagc

SEQ ID NO: 692179 - RNA, 20 nt, Human
aagaagaugcagguuuuuaa

SEQ ID NO: 692180 - RNA, 21 nt, Human
aagcagccauugagggauuac

SEQ ID NO: 692181 - RNA, 23 nt, Human
aagcagccauugagggauuaccu

SEQ ID NO: 692182 - RNA, 19 nt, Human
aauaucaaguccuggauaa

SEQ ID NO: 692183 - RNA, 18 nt, Human
acgcggccaaggccucgg

SEQ ID NO: 692184 - RNA, 21 nt, Human
acgcggccaaggccucggggc

SEQ ID NO: 692185 - RNA, 20 nt, Human
acucgggagcacaaagcuug

SEQ ID NO: 692186 - RNA, 24 nt, Human
aggaaaagggauuucccccagugc

SEQ ID NO: 692187 - RNA, 21 nt, Human
aggaagaaggguucuggucgg

SEQ ID NO: 692188 - RNA, 19 nt, Human
aggcacuagaagucuaggc

SEQ ID NO: 692189 - RNA, 19 nt, Human
aggcagacaggcaggcagg

SEQ ID NO: 692190 - RNA, 25 nt, Human
aggcaggaaaagggauuucccccag

SEQ ID NO: 692191 - RNA, 19 nt, Human
agugaacaccaaaauacca

SEQ ID NO: 692192 - RNA, 23 nt, Human
agugaacaccaaaauaccauaaa

SEQ ID NO: 692193 - RNA, 22 nt, Human
auggcaccacaauuuucacaaa

SEQ ID NO: 692194 - RNA, 22 nt, Human
auucagaaauacugauuucaac

SEQ ID NO: 692195 - RNA, 21 nt, Human
caaagacccuuuccgccggcu

SEQ ID NO: 692196 - RNA, 22 nt, Human
caaagacccuuuccgccggcuc

SEQ ID NO: 692197 - RNA, 18 nt, Human
cacagcauucacaggacu

SEQ ID NO: 692198 - RNA, 22 nt, Human
cacagcauucacaggacugaag

SEQ ID NO: 692199 - RNA, 22 nt, Human
caccucaaacuccccucagccc

SEQ ID NO: 692200 - RNA, 19 nt, Human
cagccccaauauccuggca

SEQ ID NO: 692201 - RNA, 25 nt, Human
caggaaaagggauuucccccagugc

SEQ ID NO: 692202 - RNA, 21 nt, Human
cauaaaaccugcagaauucac

SEQ ID NO: 692203 - RNA, 22 nt, Human
cauaaaaccugcagaauucacc

SEQ ID NO: 692204 - RNA, 23 nt, Human
cauaacaaucagcugguccuaaa

SEQ ID NO: 692205 - RNA, 19 nt, Human
caucccugcuuacucggga

SEQ ID NO: 692206 - RNA, 22 nt, Human
ccagcccuucacguugugacaa

SEQ ID NO: 692207 - RNA, 22 nt, Human
cccauaaaaccugcagaauuca

SEQ ID NO: 692208 - RNA, 24 nt, Human
ccccauacugcguuuaagccaaau

SEQ ID NO: 692209 - RNA, 22 nt, Human
ccccggggcucgccgccuuccu

SEQ ID NO: 692210 - RNA, 22 nt, Human
ccccucagccccaauauccugg

SEQ ID NO: 692211 - RNA, 18 nt, Human
cccugcuuacucgggagc

SEQ ID NO: 692212 - RNA, 21 nt, Human
ccucaaacuccccucagcccc

SEQ ID NO: 692213 - RNA, 18 nt, Human
ccucacuuccuccucccg

SEQ ID NO: 692214 - RNA, 18 nt, Human
ccucaggagugucucugu

SEQ ID NO: 692215 - RNA, 24 nt, Human
ccucaucuuuaacucuuucuccaa

SEQ ID NO: 692216 - RNA, 21 nt, Human
ccuugcaagauuccuauuuuu

SEQ ID NO: 692217 - RNA, 23 nt, Human
cguaagugaacaccaaaauacca

SEQ ID NO: 692218 - RNA, 25 nt, Human
cguuacauacacgcugucacauaca

SEQ ID NO: 692219 - RNA, 23 nt, Human
cuagcaaaaaccuacaauggaaa

SEQ ID NO: 692220 - RNA, 22 nt, Human
cucagccccaauauccuggcau

SEQ ID NO: 692221 - RNA, 20 nt, Human
cucgaagcgggaccuggggc

SEQ ID NO: 692222 - RNA, 18 nt, Human
cucucauuuauuucaugc

SEQ ID NO: 692223 - RNA, 19 nt, Human
cucucauuuauuucaugcu

SEQ ID NO: 692224 - RNA, 18 nt, Human
cuucaagaagaugcaggu

SEQ ID NO: 692225 - RNA, 23 nt, Human
gaauuaccuugcaagauuccuau

SEQ ID NO: 692226 - RNA, 22 nt, Human
gagaaaagcaaggaaguccaac

SEQ ID NO: 692227 - RNA, 19 nt, Human
gauaugugccugcugugga

SEQ ID NO: 692228 - RNA, 25 nt, Human
gcccauaaaaccugcagaauucacc

SEQ ID NO: 692229 - RNA, 24 nt, Human
gccccgggucccuuccuagggagu

SEQ ID NO: 692230 - RNA, 20 nt, Human
gcccuggguuaacagcaacc

SEQ ID NO: 692231 - RNA, 20 nt, Human
gcggccaaggccucggggcc

SEQ ID NO: 692232 - RNA, 19 nt, Human
ggaaaagggauuuccccca

SEQ ID NO: 692233 - RNA, 21 nt, Human
ggagagugagauccaggcugu

SEQ ID NO: 692234 - RNA, 21 nt, Human
ggaggggaugauuuuccacug

SEQ ID NO: 692235 - RNA, 19 nt, Human
ggcagggagaaaacucuga

SEQ ID NO: 692236 - RNA, 18 nt, Human
ggccaaggccucggggcc

SEQ ID NO: 692237 - RNA, 20 nt, Human
ggcccuggguuaacagcaac

SEQ ID NO: 692238 - RNA, 22 nt, Human
ggggaggggaugauuuuccacu

SEQ ID NO: 692239 - RNA, 20 nt, Human
ggggaugagaagcacacagu

SEQ ID NO: 692240 - RNA, 19 nt, Human
gggucccuuccuagggagu

SEQ ID NO: 692241 - RNA, 22 nt, Human
gguaauauacauuccagcccuu

SEQ ID NO: 692242 - RNA, 18 nt, Human
ggucacaggcagacaggc

SEQ ID NO: 692243 - RNA, 19 nt, Human
gguccuuuuuuuuuccccc

SEQ ID NO: 692244 - RNA, 21 nt, Human
gguggaaguacguuuguugcu

SEQ ID NO: 692245 - RNA, 18 nt, Human
guccuggauaacuucaua

SEQ ID NO: 692246 - RNA, 19 nt, Human
guccuuuuuuuuucccccu

SEQ ID NO: 692247 - RNA, 21 nt, Human
guccuuuuuuuuucccccuaa

SEQ ID NO: 692248 - RNA, 23 nt, Human
guggaucuggggacacaucuggu

SEQ ID NO: 692249 - RNA, 24 nt, Human
uaaaacugaugcuucaagaagaug

SEQ ID NO: 692250 - RNA, 20 nt, Human
uaacucuuucuccaacaccu

SEQ ID NO: 692251 - RNA, 24 nt, Human
uaagcauaaaacuggucaucccuu

SEQ ID NO: 692252 - RNA, 18 nt, Human
uaagccaaauuaggcuaa

SEQ ID NO: 692253 - RNA, 24 nt, Human
uaagccaaauuaggcuaaaauggg

SEQ ID NO: 692254 - RNA, 21 nt, Human
uaagugaacaccaaaauacca

SEQ ID NO: 692255 - RNA, 21 nt, Human
uaagugaacaccaaaauaccu

SEQ ID NO: 692256 - RNA, 20 nt, Human
uaauacguacacaggucaca

SEQ ID NO: 692257 - RNA, 22 nt, Human
uaauauaaauaggauuccuaca

SEQ ID NO: 692258 - RNA, 25 nt, Human
uaccacaaccaggggaugagaagca

SEQ ID NO: 692259 - RNA, 21 nt, Human
ucacaggcagacaggcaggca

SEQ ID NO: 692260 - RNA, 19 nt, Human
ucacguugugacaagccca

SEQ ID NO: 692261 - RNA, 18 nt, Human
uccaacaccuuuuuccag

SEQ ID NO: 692262 - RNA, 19 nt, Human
ucccccagugcaggcuccu

SEQ ID NO: 692263 - RNA, 18 nt, Human
ucccugcuuacucgggag

SEQ ID NO: 692264 - RNA, 20 nt, Human
uccuugaccuaccacaacca

SEQ ID NO: 692265 - RNA, 24 nt, Human
uccuuugguucugccucagaggca

SEQ ID NO: 692266 - RNA, 26 nt, Human
ucuauggguggggagugccacaggaa

SEQ ID NO: 692267 - RNA, 20 nt, Human
ucugccucagaggcacuaga

SEQ ID NO: 692268 - RNA, 26 nt, Human
ugaacacauaacccacuugcaaauaa

SEQ ID NO: 692269 - RNA, 19 nt, Human
ugaacaccaaaauaccaua

SEQ ID NO: 692270 - RNA, 23 nt, Human
ugcccgggcgcagcagcaaagac

SEQ ID NO: 692271 - RNA, 19 nt, Human
ugccugggagcuuccuggc

SEQ ID NO: 692272 - RNA, 21 nt, Human
uguuacuaagaggagagugag

SEQ ID NO: 692273 - RNA, 20 nt, Human
uuaacaccucaaacuccccu

SEQ ID NO: 692274 - RNA, 26 nt, Human
uuaccugaaggaccuuucuuaauugc

SEQ ID NO: 692275 - RNA, 21 nt, Human
uucaaagcagccauugaggga

SEQ ID NO: 692276 - RNA, 18 nt, Human
uucuccaacaccuuuuuc

SEQ ID NO: 692277 - RNA, 21 nt, Human
uucugccucagaggcacuaga

SEQ ID NO: 692278 - RNA, 18 nt, Human
uuuaacaccucaaacucc

SEQ ID NO: 692279 - RNA, 20 nt, Human
uuuggcccuaccuugcucuu

SEQ ID NO: 692280 - RNA, 20 nt, Human
uuuuuccagucauccaucuu

SEQ ID NO: 692281 - RNA, 23 nt, Human
aaaaaguacagaagcauauccuc

SEQ ID NO: 692282 - RNA, 18 nt, Human
aaaauuuauacaaauuug

SEQ ID NO: 692283 - RNA, 19 nt, Human
aaagugcuggaauuacagg

SEQ ID NO: 692284 - RNA, 24 nt, Human
aaagugcuggaauuacaggcguga

SEQ ID NO: 692285 - RNA, 25 nt, Human
aagcgauccuccugccucagccucc

SEQ ID NO: 692286 - RNA, 24 nt, Human
aaguaccugggacuacaggugugu

SEQ ID NO: 692287 - RNA, 26 nt, Human
aagugcuggaauuacaggcgugagcc

SEQ ID NO: 692288 - RNA, 18 nt, Human
aauuacaggcgugagcca

SEQ ID NO: 692289 - RNA, 22 nt, Human
aauuacaggcgugagccacugc

SEQ ID NO: 692290 - RNA, 22 nt, Human
aauuacaggcgugagccacugc

SEQ ID NO: 692291 - RNA, 22 nt, Human
aauucucauuuuaauaaucuua

SEQ ID NO: 692292 - RNA, 18 nt, Human
acaggguuuuaccauguu

SEQ ID NO: 692293 - RNA, 21 nt, Human
acaggguuuuaccauguuggc

SEQ ID NO: 692294 - RNA, 24 nt, Human
acaggguuuuaccauguuggccag

SEQ ID NO: 692295 - RNA, 22 nt, Human
accauguuggccagccuggucu

SEQ ID NO: 692296 - RNA, 22 nt, Human
accauguuggccagccuggucu

SEQ ID NO: 692297 - RNA, 23 nt, Human
accucggccucccaaagugcugg

SEQ ID NO: 692298 - RNA, 19 nt, Human
acuacaggugugugccacc

SEQ ID NO: 692299 - RNA, 23 nt, Human
acucuguagcccaggcuggacug

SEQ ID NO: 692300 - RNA, 25 nt, Human
acucuguagcccaggcuggacugca

SEQ ID NO: 692301 - RNA, 24 nt, Human
acugcaguagcacgaucucagcuc

SEQ ID NO: 692302 - RNA, 22 nt, Human
acuucauaaacaaaaaaaacua

SEQ ID NO: 692303 - RNA, 26 nt, Human
agccuggucuugaacuccugaccucc

SEQ ID NO: 692304 - RNA, 18 nt, Human
aggcacugggggauggag

SEQ ID NO: 692305 - RNA, 21 nt, Human
auaaacaaaaaaaacuauaca

SEQ ID NO: 692306 - RNA, 24 nt, Human
auaauaaaaucuucugggaguuca

SEQ ID NO: 692307 - RNA, 24 nt, Human
caaagugcuggaauuacaggcgug

SEQ ID NO: 692308 - RNA, 22 nt, Human
caagcgauccuccugccucagc

SEQ ID NO: 692309 - RNA, 27 nt, Human
caagcgauccuccugccucagccuccc

SEQ ID NO: 692310 - RNA, 25 nt, Human
cacaauuuagauuuauuuucuaccu

SEQ ID NO: 692311 - RNA, 18 nt, Human
cacucuguagcccaggcu

SEQ ID NO: 692312 - RNA, 23 nt, Human
cacugcaaccucugcuuccuggg

SEQ ID NO: 692313 - RNA, 23 nt, Human
caggguuuuaccauguuggccag

SEQ ID NO: 692314 - RNA, 24 nt, Human
caguagagacaggguuuuaccaug

SEQ ID NO: 692315 - RNA, 22 nt, Human
ccaaagugcuggaauuacaggc

SEQ ID NO: 692316 - RNA, 24 nt, Human
ccaaagugcuggaauuacaggcgu

SEQ ID NO: 692317 - RNA, 20 nt, Human
ccaccacacccgacuaauuu

SEQ ID NO: 692318 - RNA, 22 nt, Human
cccaaguaccugggacuacagg

SEQ ID NO: 692319 - RNA, 21 nt, Human
ccugcagcggggugccagagc

SEQ ID NO: 692320 - RNA, 20 nt, Human
ccuggguucaagcgauccuc

SEQ ID NO: 692321 - RNA, 23 nt, Human
ccuggguucaagcgauccuccug

SEQ ID NO: 692322 - RNA, 24 nt, Human
cucacugcaaccucugcuuccugg

SEQ ID NO: 692323 - RNA, 23 nt, Human
cugcaaccucugcuuccuggguu

SEQ ID NO: 692324 - RNA, 24 nt, Human
cugcaaccucugcuuccuggguuc

SEQ ID NO: 692325 - RNA, 24 nt, Human
cuuccuggguucaagcgauccucc

SEQ ID NO: 692326 - RNA, 21 nt, Human
cuugaacuccugaccucaacc

SEQ ID NO: 692327 - RNA, 24 nt, Human
gaccucaacugacccgcccaccuc

SEQ ID NO: 692328 - RNA, 20 nt, Human
gagcagcugagcgcaggccc

SEQ ID NO: 692329 - RNA, 24 nt, Human
gccuggucuugaacuccugaccuc

SEQ ID NO: 692330 - RNA, 24 nt, Human
gcgauccuccugccucagccuccc

SEQ ID NO: 692331 - RNA, 19 nt, Human
ggucuugaacuccugaccu

SEQ ID NO: 692332 - RNA, 18 nt, Human
guacagaagcauauccuc

SEQ ID NO: 692333 - RNA, 18 nt, Human
guuuuuguuguuuuucag

SEQ ID NO: 692334 - RNA, 21 nt, Human
uaaaaucuucugggaguucau

SEQ ID NO: 692335 - RNA, 23 nt, Human
uacaggcgugagccacugcgucc

SEQ ID NO: 692336 - RNA, 23 nt, Human
uacaggcgugagccacugcgucc

SEQ ID NO: 692337 - RNA, 23 nt, Human
uacaggugugugccaccacaccc

SEQ ID NO: 692338 - RNA, 21 nt, Human
uaccauguuggccagccuggu

SEQ ID NO: 692339 - RNA, 24 nt, Human
uaccauguuggccagccuggucuu

SEQ ID NO: 692340 - RNA, 21 nt, Human
uagagacaggguuuuaccaug

SEQ ID NO: 692341 - RNA, 22 nt, Human
uagagacaggguuuuaccaugu

SEQ ID NO: 692342 - RNA, 20 nt, Human
uagauauaauuaauaacacu

SEQ ID NO: 692343 - RNA, 24 nt, Human
uagcacgaucucagcucacugcaa

SEQ ID NO: 692344 - RNA, 18 nt, Human
uauccucaagaugugaag

SEQ ID NO: 692345 - RNA, 19 nt, Human
ucaagcgauccuccugccu

SEQ ID NO: 692346 - RNA, 24 nt, Human
ucacugcaaccucugcuuccuggg

SEQ ID NO: 692347 - RNA, 24 nt, Human
ucaguagagacaggguuuuaccau

SEQ ID NO: 692348 - RNA, 24 nt, Human
ucccaaagugcuggaauuacaggc

SEQ ID NO: 692349 - RNA, 24 nt, Human
ucccaaguaccugggacuacaggu

SEQ ID NO: 692350 - RNA, 26 nt, Human
uccuccugccucagccucccaaguac

SEQ ID NO: 692351 - RNA, 21 nt, Human
uccuggguucaagcgauccuc

SEQ ID NO: 692352 - RNA, 24 nt, Human
uccuggguucaagcgauccuccug

SEQ ID NO: 692353 - RNA, 23 nt, Human
ucucacucuguagcccaggcugg

SEQ ID NO: 692354 - RNA, 24 nt, Human
ucucacucuguagcccaggcugga

SEQ ID NO: 692355 - RNA, 18 nt, Human
ucugauugggacauaaga

SEQ ID NO: 692356 - RNA, 18 nt, Human
ucuguagcccaggcugga

SEQ ID NO: 692357 - RNA, 24 nt, Human
ucuguagcccaggcuggacugcag

SEQ ID NO: 692358 - RNA, 19 nt, Human
ucuugaacuccugaccuca

SEQ ID NO: 692359 - RNA, 24 nt, Human
ugacccgcccaccucggccuccca

SEQ ID NO: 692360 - RNA, 22 nt, Human
ugaccucaacugacccgcccac

SEQ ID NO: 692361 - RNA, 18 nt, Human
ugagcgcaggcccuucug

SEQ ID NO: 692362 - RNA, 18 nt, Human
ugagcgcaggcccuucug

SEQ ID NO: 692363 - RNA, 19 nt, Human
ugcaaccucugcuuccugg

SEQ ID NO: 692364 - RNA, 24 nt, Human
ugccucagccucccaaguaccugg

SEQ ID NO: 692365 - RNA, 24 nt, Human
ugcuggaauuacaggcgugagcca

SEQ ID NO: 692366 - RNA, 19 nt, Human
uggaauuacaggcgugagc

SEQ ID NO: 692367 - RNA, 21 nt, Human
uggaauuacaggcgugagcca

SEQ ID NO: 692368 - RNA, 22 nt, Human
uggaauuacaggcgugagccac

SEQ ID NO: 692369 - RNA, 22 nt, Human
uggaauuacaggcgugagccac

SEQ ID NO: 692370 - RNA, 24 nt, Human
uggaauuacaggcgugagccacug

SEQ ID NO: 692371 - RNA, 24 nt, Human
uggaauuacaggcgugagccacug

SEQ ID NO: 692372 - RNA, 26 nt, Human
uggaauuacaggcgugagccacugcg

SEQ ID NO: 692373 - RNA, 22 nt, Human
uggaggacaccuuguuuccuca

SEQ ID NO: 692374 - RNA, 21 nt, Human
ugggacuacaggugugugcca

SEQ ID NO: 692375 - RNA, 22 nt, Human
ugggacuacaggugugugccac

SEQ ID NO: 692376 - RNA, 24 nt, Human
ugggacuacaggugugugccacca

SEQ ID NO: 692377 - RNA, 18 nt, Human
ugggaguucaugaucccu

SEQ ID NO: 692378 - RNA, 23 nt, Human
uggguucaagcgauccuccugcc

SEQ ID NO: 692379 - RNA, 24 nt, Human
uggguucaagcgauccuccugccu

SEQ ID NO: 692380 - RNA, 21 nt, Human
uguagcccaggcuggacugca

SEQ ID NO: 692381 - RNA, 23 nt, Human
ugugaaggcacugggggauggag

SEQ ID NO: 692382 - RNA, 27 nt, Human
uguuggccagccuggucuugaacuccu

SEQ ID NO: 692383 - RNA, 25 nt, Human
uuaccauguuggccagccuggucuu

SEQ ID NO: 692384 - RNA, 21 nt, Human
uucaagcgauccuccugccuc

SEQ ID NO: 692385 - RNA, 24 nt, Human
uucaagcgauccuccugccucagc

SEQ ID NO: 692386 - RNA, 22 nt, Human
uuguuguuuguuuuuguuuuuu

SEQ ID NO: 692387 - RNA, 22 nt, Human
uuuaccauguuggccagccugg

SEQ ID NO: 692388 - RNA, 24 nt, Human
uuuucaguagagacaggguuuuac

SEQ ID NO: 692389 - RNA, 23 nt, Human
aaaaaaaccaucaucaucuuaag

SEQ ID NO: 692390 - RNA, 20 nt, Human
aaacugccauucagagcgag

SEQ ID NO: 692391 - RNA, 18 nt, Human
aaagaggggcucugggug

SEQ ID NO: 692392 - RNA, 18 nt, Human
aaaggccauucuaugagu

SEQ ID NO: 692393 - RNA, 24 nt, Human
aacauuuggaagaauccuaaacag

SEQ ID NO: 692394 - RNA, 26 nt, Human
aaccaaugcucagcgacccaacucuc

SEQ ID NO: 692395 - RNA, 21 nt, Human
aacccaggcuucccagcucca

SEQ ID NO: 692396 - RNA, 28 nt, Human
aacccauuuuccuccugaaauaaacuuu

SEQ ID NO: 692397 - RNA, 18 nt, Human
aacucagcccaauaaaaa

SEQ ID NO: 692398 - RNA, 23 nt, Human
aagaaaugccaacuugaacagaa

SEQ ID NO: 692399 - RNA, 18 nt, Human
aagaagaaucugacaagc

SEQ ID NO: 692400 - RNA, 23 nt, Human
aauaaaaaaaaccaucaucaucu

SEQ ID NO: 692401 - RNA, 23 nt, Human
aauaucaaagaccccaggaagaa

SEQ ID NO: 692402 - RNA, 21 nt, Human
acaaacaaauaucaaagaccc

SEQ ID NO: 692403 - RNA, 22 nt, Human
acaaacaaauaucaaagacccc

SEQ ID NO: 692404 - RNA, 18 nt, Human
acaaagaggggcucuggg

SEQ ID NO: 692405 - RNA, 22 nt, Human
acaagaaaugccaacuugaaca

SEQ ID NO: 692406 - RNA, 24 nt, Human
acaggaucuuauuuaacccuguaa

SEQ ID NO: 692407 - RNA, 22 nt, Human
accaauaccgauuggauacucu

SEQ ID NO: 692408 - RNA, 23 nt, Human
accuaauuggguucuccccauaa

SEQ ID NO: 692409 - RNA, 22 nt, Human
agaccuuggggacaagucuggu

SEQ ID NO: 692410 - RNA, 22 nt, Human
agcccaauaaaaaaaaccauca

SEQ ID NO: 692411 - RNA, 19 nt, Human
agccuccagggucacagua

SEQ ID NO: 692412 - RNA, 21 nt, Human
agcgcugagaccuuggggaca

SEQ ID NO: 692413 - RNA, 23 nt, Human
aggaggaaaacacugacuauuuc

SEQ ID NO: 692414 - RNA, 23 nt, Human
aggcacagagagggcgugacuug

SEQ ID NO: 692415 - RNA, 24 nt, Human
aggcacagagagggcgugacuugu

SEQ ID NO: 692416 - RNA, 23 nt, Human
agugaaggaagaaaguaucuaaa

SEQ ID NO: 692417 - RNA, 23 nt, Human
augcagaaaacggaggcacagag

SEQ ID NO: 692418 - RNA, 22 nt, Human
caaacaaauaucaaagacccca

SEQ ID NO: 692419 - RNA, 20 nt, Human
caaagaccccaggaagaaca

SEQ ID NO: 692420 - RNA, 23 nt, Human
caacucucaucugaauggacacc

SEQ ID NO: 692421 - RNA, 20 nt, Human
caagaaaugccaacuugaac

SEQ ID NO: 692422 - RNA, 22 nt, Human
cacaauccagaaauagucucgg

SEQ ID NO: 692423 - RNA, 19 nt, Human
cacccaugcuuccuauugu

SEQ ID NO: 692424 - RNA, 19 nt, Human
cagaaaacggaggcacaga

SEQ ID NO: 692425 - RNA, 23 nt, Human
cagaauguaguuugcuuuuugug

SEQ ID NO: 692426 - RNA, 21 nt, Human
caggccccuuauuuccugggg

SEQ ID NO: 692427 - RNA, 20 nt, Human
caucagggcacaaagagggg

SEQ ID NO: 692428 - RNA, 26 nt, Human
caucaucaucuuaagagccuccaggg

SEQ ID NO: 692429 - RNA, 23 nt, Human
cauuuggaagaauccuaaacagg

SEQ ID NO: 692430 - RNA, 23 nt, Human
ccaggaaaucugguguuccuagg

SEQ ID NO: 692431 - RNA, 19 nt, Human
ccaucaucaucuuaagagc

SEQ ID NO: 692432 - RNA, 19 nt, Human
cccaauaaaaaaaaccauc

SEQ ID NO: 692433 - RNA, 23 nt, Human
ccccuaauucgugaacucagccc

SEQ ID NO: 692434 - RNA, 24 nt, Human
cccugcucaucccaacaucuucca

SEQ ID NO: 692435 - RNA, 22 nt, Human
ccugcucaucccaacaucuucc

SEQ ID NO: 692436 - RNA, 21 nt, Human
cgacuuccagcuccugccccu

SEQ ID NO: 692437 - RNA, 18 nt, Human
cgaggagcacacaaucca

SEQ ID NO: 692438 - RNA, 20 nt, Human
cgagugcaguccuguugagc

SEQ ID NO: 692439 - RNA, 23 nt, Human
cgcagcgcugagaccuuggggac

SEQ ID NO: 692440 - RNA, 18 nt, Human
cuccaggauuuggcagcg

SEQ ID NO: 692441 - RNA, 23 nt, Human
cuccccugcaauauuaguuuuau

SEQ ID NO: 692442 - RNA, 24 nt, Human
cugugugccaucccagcacugggg

SEQ ID NO: 692443 - RNA, 21 nt, Human
cuucccaggagagaaaacccu

SEQ ID NO: 692444 - RNA, 21 nt, Human
cuugggguuacacacaggauu

SEQ ID NO: 692445 - RNA, 19 nt, Human
gaaaacggaggcacagaga

SEQ ID NO: 692446 - RNA, 24 nt, Human
gaaauaaacuuucuaagcacccau

SEQ ID NO: 692447 - RNA, 18 nt, Human
gaaccaggaaaucuggug

SEQ ID NO: 692448 - RNA, 19 nt, Human
gaccagaacccaggcuucc

SEQ ID NO: 692449 - RNA, 22 nt, Human
gacccaacucucaucugaaugg

SEQ ID NO: 692450 - RNA, 24 nt, Human
gacccaacucucaucugaauggac

SEQ ID NO: 692451 - RNA, 24 nt, Human
gaccgcagcgcugagaccuugggg

SEQ ID NO: 692452 - RNA, 21 nt, Human
gaccuuggggacaagucuggu

SEQ ID NO: 692453 - RNA, 19 nt, Human
gagcacacaauccagaaau

SEQ ID NO: 692454 - RNA, 21 nt, Human
gaguucugcugcaggucuggg

SEQ ID NO: 692455 - RNA, 23 nt, Human
gaugacauggacagccccaagga

SEQ ID NO: 692456 - RNA, 20 nt, Human
ggcaagcuucucccugagca

SEQ ID NO: 692457 - RNA, 21 nt, Human
ggcagaaguguuuaaccccuu

SEQ ID NO: 692458 - RNA, 23 nt, Human
gggacaagucuggucugcaugcu

SEQ ID NO: 692459 - RNA, 18 nt, Human
gggcagggcagagacgag

SEQ ID NO: 692460 - RNA, 21 nt, Human
guuuucaggggugagacaggg

SEQ ID NO: 692461 - RNA, 28 nt, Human
uaacaaacaaauaucaaagaccccagga

SEQ ID NO: 692462 - RNA, 18 nt, Human
uaacccuguaacuccccu

SEQ ID NO: 692463 - RNA, 19 nt, Human
uaauucgugaacucagccc

SEQ ID NO: 692464 - RNA, 20 nt, Human
uagaaggggccaacauauca

SEQ ID NO: 692465 - RNA, 20 nt, Human
uaguuugcuuuuugugugaa

SEQ ID NO: 692466 - RNA, 20 nt, Human
ucagcccaauaaaaaaaacc

SEQ ID NO: 692467 - RNA, 18 nt, Human
uccagcuccugccccuaa

SEQ ID NO: 692468 - RNA, 23 nt, Human
ucccagcacuggggauauggugg

SEQ ID NO: 692469 - RNA, 18 nt, Human
uccugggggaggugggga

SEQ ID NO: 692470 - RNA, 23 nt, Human
ugaaaaaauaaaaacacagucga

SEQ ID NO: 692471 - RNA, 20 nt, Human
ugaaacuaaaagguaaggau

SEQ ID NO: 692472 - RNA, 21 nt, Human
ugaggaaacugccauucagag

SEQ ID NO: 692473 - RNA, 24 nt, Human
ugauggggacaugaaguaaagaaa

SEQ ID NO: 692474 - RNA, 21 nt, Human
ugccagagaaugcacaugaag

SEQ ID NO: 692475 - RNA, 25 nt, Human
ugccccuaauucgugaacucagccc

SEQ ID NO: 692476 - RNA, 20 nt, Human
ugcuuugccuaaggucuccc

SEQ ID NO: 692477 - RNA, 20 nt, Human
uggacagccccaaggauuga

SEQ ID NO: 692478 - RNA, 22 nt, Human
uggggaaugggggucacuucaa

SEQ ID NO: 692479 - RNA, 23 nt, Human
ugggggagguggggagcaggacg

SEQ ID NO: 692480 - RNA, 19 nt, Human
uggugaggacugcugaaac

SEQ ID NO: 692481 - RNA, 22 nt, Human
uuccaguucaaaggcaagcuuc

SEQ ID NO: 692482 - RNA, 26 nt, Human
uucccaggagagaaaacccugaaagc

SEQ ID NO: 692483 - RNA, 22 nt, Human
uuccgccguugcugccgcugcu

SEQ ID NO: 692484 - RNA, 21 nt, Human
uuuuaagaaaucuaagagaug

SEQ ID NO: 692485 - RNA, 20 nt, Human
aaagugccaucgaggcaaaa

SEQ ID NO: 692486 - RNA, 25 nt, Human
aaaugagucucuuucucauaggcuc

SEQ ID NO: 692487 - RNA, 20 nt, Human
aggaaagugccaucgaggca

SEQ ID NO: 692488 - RNA, 22 nt, Human
aggcaaaauucccccaucugcg

SEQ ID NO: 692489 - RNA, 23 nt, Human
caaaacaaggaucugcuggugau

SEQ ID NO: 692490 - RNA, 19 nt, Human
cucuggugggggcggaguc

SEQ ID NO: 692491 - RNA, 23 nt, Human
cugaggcuggggcucuggguacc

SEQ ID NO: 692492 - RNA, 21 nt, Human
gagccuagccccucugguggg

SEQ ID NO: 692493 - RNA, 24 nt, Human
gaugcuucacagugaaaccuccau

SEQ ID NO: 692494 - RNA, 18 nt, Human
ucccagagccuagccccu

SEQ ID NO: 692495 - RNA, 24 nt, Human
ucccagagccuagccccucuggug

SEQ ID NO: 692496 - RNA, 22 nt, Human
ugccuuuagacuuauucugcuc

SEQ ID NO: 692497 - RNA, 19 nt, Human
ugcuggugaugcuucacag

SEQ ID NO: 692498 - RNA, 19 nt, Human
uuuuuuuuuuuuuuuuugu

SEQ ID NO: 692499 - RNA, 27 nt, Human
uuuuuuuuuuuuuuuuuuuuuuugggg

SEQ ID NO: 692500 - RNA, 18 nt, Human
aaaaaacaagcugaacuc

SEQ ID NO: 692501 - RNA, 25 nt, Human
aaacaaaaaucagacaggaagacga

SEQ ID NO: 692502 - RNA, 23 nt, Human
aaagaucgacaggauccaggcug

SEQ ID NO: 692503 - RNA, 26 nt, Human
aaaucaaccccaaauccagacgucac

SEQ ID NO: 692504 - RNA, 19 nt, Human
aacaacaggaccccaucuc

SEQ ID NO: 692505 - RNA, 19 nt, Human
aacguggggacagaaagaa

SEQ ID NO: 692506 - RNA, 22 nt, Human
aacguggggacagaaagaauaa

SEQ ID NO: 692507 - RNA, 21 nt, Human
aaggaaucgagggcccagaac

SEQ ID NO: 692508 - RNA, 25 nt, Human
aauaagacuccucucucugccuucu

SEQ ID NO: 692509 - RNA, 21 nt, Human
aaucccaccccagcacaaaaa

SEQ ID NO: 692510 - RNA, 27 nt, Human
acaaaaaucagacaggaagacgaaaca

SEQ ID NO: 692511 - RNA, 19 nt, Human
acaacaggaccccaucuca

SEQ ID NO: 692512 - RNA, 21 nt, Human
acuacaaaacaaaaaucagac

SEQ ID NO: 692513 - RNA, 18 nt, Human
agcaaaccgaagaaaaac

SEQ ID NO: 692514 - RNA, 18 nt, Human
agcacagucaaugcugca

SEQ ID NO: 692515 - RNA, 20 nt, Human
aggaccacgguuuauuacca

SEQ ID NO: 692516 - RNA, 22 nt, Human
aucaaugugaccauuagcuccg

SEQ ID NO: 692517 - RNA, 18 nt, Human
aucgcaaaaaggaccacg

SEQ ID NO: 692518 - RNA, 24 nt, Human
auucuucaacauugacccauaauc

SEQ ID NO: 692519 - RNA, 21 nt, Human
caacaggaccccaucucagau

SEQ ID NO: 692520 - RNA, 18 nt, Human
cacaaaaaucaaccccaa

SEQ ID NO: 692521 - RNA, 19 nt, Human
cacaaaaaucaaccccaaa

SEQ ID NO: 692522 - RNA, 22 nt, Human
cacaaaaaucaaccccaaaucc

SEQ ID NO: 692523 - RNA, 24 nt, Human
cagcacaaaaaucaaccccaaauc

SEQ ID NO: 692524 - RNA, 23 nt, Human
cagcgaaagauagagaugcccuu

SEQ ID NO: 692525 - RNA, 20 nt, Human
caggauccaggcugcacugu

SEQ ID NO: 692526 - RNA, 20 nt, Human
cagggccaaggcaauaguga

SEQ ID NO: 692527 - RNA, 21 nt, Human
cagggccaaggcaauagugag

SEQ ID NO: 692528 - RNA, 23 nt, Human
ccaaagaauagaauauauauuua

SEQ ID NO: 692529 - RNA, 21 nt, Human
ccacgguuuauuaccaucucu

SEQ ID NO: 692530 - RNA, 19 nt, Human
ccagcaaaccgaagaaaaa

SEQ ID NO: 692531 - RNA, 18 nt, Human
cccaccccagcacaaaaa

SEQ ID NO: 692532 - RNA, 18 nt, Human
ccuaaaaaucccacagca

SEQ ID NO: 692533 - RNA, 21 nt, Human
cgaaggauguccaauaagcac

SEQ ID NO: 692534 - RNA, 19 nt, Human
cgacaggauccaggcugca

SEQ ID NO: 692535 - RNA, 21 nt, Human
cucucaaaucuugcagcccuu

SEQ ID NO: 692536 - RNA, 22 nt, Human
cuggcugcuccaaguuccuuuu

SEQ ID NO: 692537 - RNA, 24 nt, Human
cugggcggcacuggugcaccucug

SEQ ID NO: 692538 - RNA, 21 nt, Human
cuuuucuugggaaaagggugc

SEQ ID NO: 692539 - RNA, 18 nt, Human
gacccauaaucccacccc

SEQ ID NO: 692540 - RNA, 18 nt, Human
gacuucuucuggcugcuc

SEQ ID NO: 692541 - RNA, 18 nt, Human
gacuuuucuugggaaaag

SEQ ID NO: 692542 - RNA, 22 nt, Human
gacuuuucuugggaaaagggug

SEQ ID NO: 692543 - RNA, 18 nt, Human
gcacugugugcacaacag

SEQ ID NO: 692544 - RNA, 18 nt, Human
gggaaaggaaucgagggc

SEQ ID NO: 692545 - RNA, 21 nt, Human
gggccaaggcaauagugagaa

SEQ ID NO: 692546 - RNA, 24 nt, Human
ggugggaaaggaaucgagggccca

SEQ ID NO: 692547 - RNA, 22 nt, Human
gguggugggaaaggaaucgagg

SEQ ID NO: 692548 - RNA, 20 nt, Human
guccaauaagcaccugggaa

SEQ ID NO: 692549 - RNA, 24 nt, Human
uaaaaauaauaagacuccucucuc

SEQ ID NO: 692550 - RNA, 18 nt, Human
uaacaaagaccccgcgug

SEQ ID NO: 692551 - RNA, 21 nt, Human
uacaaaacaaaaaucagacag

SEQ ID NO: 692552 - RNA, 19 nt, Human
uacaacagacagacuauac

SEQ ID NO: 692553 - RNA, 23 nt, Human
uacagacuuaaaaauucuucaac

SEQ ID NO: 692554 - RNA, 19 nt, Human
uaccaucucuaacgcccau

SEQ ID NO: 692555 - RNA, 22 nt, Human
uacuggagccaaaaaacaagcu

SEQ ID NO: 692556 - RNA, 24 nt, Human
uagagaugcccuugaaaauguguc

SEQ ID NO: 692557 - RNA, 23 nt, Human
ucaguccuggauggauccuagac

SEQ ID NO: 692558 - RNA, 20 nt, Human
uccagcaaaccgaagaaaaa

SEQ ID NO: 692559 - RNA, 20 nt, Human
uccaggcugcacugugugcc

SEQ ID NO: 692560 - RNA, 24 nt, Human
ucccaccccagcacaaaaaucaac

SEQ ID NO: 692561 - RNA, 22 nt, Human
uccccgagggaagaacggaagc

SEQ ID NO: 692562 - RNA, 21 nt, Human
ucuuaucuaccugggcggcac

SEQ ID NO: 692563 - RNA, 26 nt, Human
ucuugcagcccuuuacuuccuuuauu

SEQ ID NO: 692564 - RNA, 19 nt, Human
ugacaucgcaaaaaggacc

SEQ ID NO: 692565 - RNA, 24 nt, Human
ugacccauaaucccaccccagcac

SEQ ID NO: 692566 - RNA, 22 nt, Human
ugagcaggagcgagagggcgcc

SEQ ID NO: 692567 - RNA, 20 nt, Human
ugauaauaaacaacaggacc

SEQ ID NO: 692568 - RNA, 18 nt, Human
ugcaccucugaggucagg

SEQ ID NO: 692569 - RNA, 25 nt, Human
ugcgcgccccacccugugcaagaau

SEQ ID NO: 692570 - RNA, 21 nt, Human
uggauccuagaccuggggcuu

SEQ ID NO: 692571 - RNA, 20 nt, Human
uggauggauccuagaccugg

SEQ ID NO: 692572 - RNA, 18 nt, Human
ugucuucaggugccacaa

SEQ ID NO: 692573 - RNA, 21 nt, Human
ugugaccauuagcuccgccac

SEQ ID NO: 692574 - RNA, 20 nt, Human
uuaaaacugcagaggaauac

SEQ ID NO: 692575 - RNA, 24 nt, Human
uuaaaagacacaauguuaaaaaua

SEQ ID NO: 692576 - RNA, 22 nt, Human
uuaacagcacaaaagacgacac

SEQ ID NO: 692577 - RNA, 21 nt, Human
uucaggugccacaacgugggg

SEQ ID NO: 692578 - RNA, 21 nt, Human
uucgugccacaguguaaucaa

SEQ ID NO: 692579 - RNA, 18 nt, Human
uugcagcccuuuacuucc

SEQ ID NO: 692580 - RNA, 25 nt, Human
uuuaaaaauaauaagacuccucucu

SEQ ID NO: 692581 - RNA, 20 nt, Human
aagaccccagccccugcugc

SEQ ID NO: 692582 - RNA, 22 nt, Human
aggagggacgguggugcugggg

SEQ ID NO: 692583 - RNA, 18 nt, Human
aggcagccugagugagcc

SEQ ID NO: 692584 - RNA, 21 nt, Human
caccaggaugcgccggguuuc

SEQ ID NO: 692585 - RNA, 21 nt, Human
cagccgggaccagaaccagga

SEQ ID NO: 692586 - RNA, 23 nt, Human
caggagccgcccaguggaagggu

SEQ ID NO: 692587 - RNA, 22 nt, Human
caguggaaggguaggugcugga

SEQ ID NO: 692588 - RNA, 22 nt, Human
caugcacgcaaguguccagaaa

SEQ ID NO: 692589 - RNA, 19 nt, Human
ccagaaccaggagccgccc

SEQ ID NO: 692590 - RNA, 20 nt, Human
ccaggagccgcccaguggaa

SEQ ID NO: 692591 - RNA, 23 nt, Human
ccaggccggcuggguguggcuuc

SEQ ID NO: 692592 - RNA, 20 nt, Human
cccauggagucaggcuucag

SEQ ID NO: 692593 - RNA, 20 nt, Human
ccccagccucccgucacacc

SEQ ID NO: 692594 - RNA, 20 nt, Human
cccggggccugggaccaggc

SEQ ID NO: 692595 - RNA, 21 nt, Human
cccugccgacucagccccggc

SEQ ID NO: 692596 - RNA, 19 nt, Human
ccgacgcuacaaacagcag

SEQ ID NO: 692597 - RNA, 21 nt, Human
ccgggaccagaaccaggagcc

SEQ ID NO: 692598 - RNA, 21 nt, Human
ccgugcccggggccugggacc

SEQ ID NO: 692599 - RNA, 22 nt, Human
ccucccgucacaccucugcugg

SEQ ID NO: 692600 - RNA, 21 nt, Human
cggggcgagucccaaacugug

SEQ ID NO: 692601 - RNA, 21 nt, Human
cgguggugcuggggccuuggc

SEQ ID NO: 692602 - RNA, 23 nt, Human
cucacuugagggguuuucuuuuu

SEQ ID NO: 692603 - RNA, 22 nt, Human
cuccccaacacagcgauuuucc

SEQ ID NO: 692604 - RNA, 19 nt, Human
cuccuggcuccugugugcu

SEQ ID NO: 692605 - RNA, 20 nt, Human
cugcugcuccccaacacagc

SEQ ID NO: 692606 - RNA, 19 nt, Human
gaagcagaugggaguggag

SEQ ID NO: 692607 - RNA, 19 nt, Human
gaagcagaugggaguggag

SEQ ID NO: 692608 - RNA, 21 nt, Human
gacgcuacaaacagcagcaac

SEQ ID NO: 692609 - RNA, 23 nt, Human
gagccagccgggaccagaaccag

SEQ ID NO: 692610 - RNA, 23 nt, Human
gcccggggccugggaccaggccg

SEQ ID NO: 692611 - RNA, 21 nt, Human
gcccuggggucggggggcaga

SEQ ID NO: 692612 - RNA, 22 nt, Human
gccugagugagccagccgggac

SEQ ID NO: 692613 - RNA, 19 nt, Human
gcucugaaagggaagcaga

SEQ ID NO: 692614 - RNA, 23 nt, Human
ggaccagaaccaggagccgccca

SEQ ID NO: 692615 - RNA, 19 nt, Human
ggcucugaaagggaagcag

SEQ ID NO: 692616 - RNA, 22 nt, Human
gggucggggggcagaggugggu

SEQ ID NO: 692617 - RNA, 20 nt, Human
ggucggggggcagagguggg

SEQ ID NO: 692618 - RNA, 23 nt, Human
gucucuccccagccucccgucac

SEQ ID NO: 692619 - RNA, 18 nt, Human
gugcugggcaugcacgca

SEQ ID NO: 692620 - RNA, 23 nt, Human
gugcugggcuucgguuuaucaca

SEQ ID NO: 692621 - RNA, 25 nt, Human
guggaaggguaggugcuggaugccc

SEQ ID NO: 692622 - RNA, 27 nt, Human
guggaaggguaggugcuggaugcccug

SEQ ID NO: 692623 - RNA, 18 nt, Human
guggcucacuugaggggu

SEQ ID NO: 692624 - RNA, 20 nt, Human
guggugcuggggccuuggcc

SEQ ID NO: 692625 - RNA, 25 nt, Human
uacagcccuggggucggggggcaga

SEQ ID NO: 692626 - RNA, 21 nt, Human
ucaacucggggcgagucccaa

SEQ ID NO: 692627 - RNA, 22 nt, Human
ucaaggugcuggggucucuccc

SEQ ID NO: 692628 - RNA, 21 nt, Human
uccaggauccgacgcuacaaa

SEQ ID NO: 692629 - RNA, 26 nt, Human
uccgacgcuacaaacagcagcaacau

SEQ ID NO: 692630 - RNA, 20 nt, Human
ucggggggcagagguggguu

SEQ ID NO: 692631 - RNA, 24 nt, Human
ucuccccagccucccgucacaccu

SEQ ID NO: 692632 - RNA, 23 nt, Human
ugcacgcaaguguccagaaagcg

SEQ ID NO: 692633 - RNA, 18 nt, Human
ugcuggggccuuggccac

SEQ ID NO: 692634 - RNA, 19 nt, Human
ugcuuucuuuccaguggcu

SEQ ID NO: 692635 - RNA, 21 nt, Human
ugcuuucuuuccaguggcuca

SEQ ID NO: 692636 - RNA, 21 nt, Human
uggagcgccgacuccagaggg

SEQ ID NO: 692637 - RNA, 24 nt, Human
uggaggggaccccgugcccggggc

SEQ ID NO: 692638 - RNA, 18 nt, Human
uggccaccggccgggcag

SEQ ID NO: 692639 - RNA, 19 nt, Human
uggcucacuugagggguuu

SEQ ID NO: 692640 - RNA, 18 nt, Human
ugggaccaggccggcugg

SEQ ID NO: 692641 - RNA, 20 nt, Human
uggggucggggggcagaggu

SEQ ID NO: 692642 - RNA, 21 nt, Human
uggggucucuccccagccucc

SEQ ID NO: 692643 - RNA, 18 nt, Human
ugugugcucaaggugcug

SEQ ID NO: 692644 - RNA, 23 nt, Human
uguuuugcuuucuuuccaguggc

SEQ ID NO: 692645 - RNA, 20 nt, Human
uuacagcccuggggucgggg

SEQ ID NO: 692646 - RNA, 23 nt, Human
uucaggagaagaccccagccccu

SEQ ID NO: 692647 - RNA, 22 nt, Human
uucucagaagggcgagcuggug

SEQ ID NO: 692648 - RNA, 20 nt, Human
uucuuuggggucccauggag

SEQ ID NO: 692649 - RNA, 23 nt, Human
uuucucagaagggcgagcuggug

SEQ ID NO: 692650 - RNA, 22 nt, Human
uuuucccaggcccugggggagc

SEQ ID NO: 692651 - RNA, 22 nt, Human
aaaaauggcuaacuagucaccu

SEQ ID NO: 692652 - RNA, 18 nt, Human
aacauacuuaucaugaca

SEQ ID NO: 692653 - RNA, 21 nt, Human
aaggaaaaauacaguaauuca

SEQ ID NO: 692654 - RNA, 20 nt, Human
aagguacuuuugaacaacca

SEQ ID NO: 692655 - RNA, 18 nt, Human
acaaaaucagcccaauga

SEQ ID NO: 692656 - RNA, 20 nt, Human
acucacuccugcuccucuca

SEQ ID NO: 692657 - RNA, 21 nt, Human
acugaaaucaguaacaaucca

SEQ ID NO: 692658 - RNA, 18 nt, Human
acuucaauugcuucgauc

SEQ ID NO: 692659 - RNA, 20 nt, Human
acuuuacugaaaucaguaac

SEQ ID NO: 692660 - RNA, 19 nt, Human
cacacacggccaccagagc

SEQ ID NO: 692661 - RNA, 22 nt, Human
cacacacggccaccagagcagc

SEQ ID NO: 692662 - RNA, 22 nt, Human
cacacggccaccagagcagcuc

SEQ ID NO: 692663 - RNA, 23 nt, Human
cacccgcgacagcaguaaaucca

SEQ ID NO: 692664 - RNA, 19 nt, Human
caguaaauccaacucgugg

SEQ ID NO: 692665 - RNA, 19 nt, Human
caucaagcacacacacuca

SEQ ID NO: 692666 - RNA, 21 nt, Human
cgagggacagggaauggcgug

SEQ ID NO: 692667 - RNA, 19 nt, Human
cucacuuucgccgggagac

SEQ ID NO: 692668 - RNA, 21 nt, Human
cucgcucacuuucgccgggag

SEQ ID NO: 692669 - RNA, 20 nt, Human
cugaaaucaguaacaaucca

SEQ ID NO: 692670 - RNA, 21 nt, Human
cuuuugaacaaccacacacaa

SEQ ID NO: 692671 - RNA, 22 nt, Human
gaaauaauagauuuauucaaag

SEQ ID NO: 692672 - RNA, 22 nt, Human
gggccgagggacagggaauggc

SEQ ID NO: 692673 - RNA, 18 nt, Human
ggggccgagggacaggga

SEQ ID NO: 692674 - RNA, 20 nt, Human
gguacuaacagccagggagg

SEQ ID NO: 692675 - RNA, 23 nt, Human
uaaaacauacuuaucaugacaac

SEQ ID NO: 692676 - RNA, 23 nt, Human
uaaaauguccuggguaaagcuuc

SEQ ID NO: 692677 - RNA, 25 nt, Human
uaagucaaauacuaaaacauacuua

SEQ ID NO: 692678 - RNA, 25 nt, Human
uaaguguaacuagucuucugcacaa

SEQ ID NO: 692679 - RNA, 24 nt, Human
uaauaauacuauuucugauacugu

SEQ ID NO: 692680 - RNA, 23 nt, Human
ucacuccugcuccucucacacac

SEQ ID NO: 692681 - RNA, 25 nt, Human
uccugcuccucucacacacggccac

SEQ ID NO: 692682 - RNA, 22 nt, Human
ucgcucacuuucgccgggagac

SEQ ID NO: 692683 - RNA, 20 nt, Human
ucuauaaaaacgcuacaccc

SEQ ID NO: 692684 - RNA, 24 nt, Human
ucucugaaaaauggcuaacuaguc

SEQ ID NO: 692685 - RNA, 24 nt, Human
ugaaaaauggcuaacuagucaccu

SEQ ID NO: 692686 - RNA, 25 nt, Human
ugaaauaauagauuuauucaaagag

SEQ ID NO: 692687 - RNA, 18 nt, Human
ugacaacucaaggugaca

SEQ ID NO: 692688 - RNA, 21 nt, Human
uggcaaaacauacuuuacuga

SEQ ID NO: 692689 - RNA, 21 nt, Human
uguaucucugaaaaauggcua

SEQ ID NO: 692690 - RNA, 21 nt, Human
aacagagcuaaaggccuaaag

SEQ ID NO: 692691 - RNA, 19 nt, Human
acagagcuaaaggccuaaa

SEQ ID NO: 692692 - RNA, 22 nt, Human
acgucaaggaggaccaaagagg

SEQ ID NO: 692693 - RNA, 18 nt, Human
aggaggaccaaagagggc

SEQ ID NO: 692694 - RNA, 24 nt, Human
caaaaauagucaaguaaauaaugu

SEQ ID NO: 692695 - RNA, 22 nt, Human
caacaguaguaguauugaacca

SEQ ID NO: 692696 - RNA, 22 nt, Human
cagaaagcgggcccacaggccc

SEQ ID NO: 692697 - RNA, 19 nt, Human
cagagcuaaaggccuaaag

SEQ ID NO: 692698 - RNA, 24 nt, Human
cuugaaaauuucuguuuuccaaau

SEQ ID NO: 692699 - RNA, 20 nt, Human
gaagcauauuuuaacuuuuu

SEQ ID NO: 692700 - RNA, 22 nt, Human
guaaagcaaaagcauuaucuuc

SEQ ID NO: 692701 - RNA, 23 nt, Human
uacaguauauaacaguaaauaga

SEQ ID NO: 692702 - RNA, 18 nt, Human
uacuggaggaacagagcu

SEQ ID NO: 692703 - RNA, 24 nt, Human
uacuuagaacuuuccaacuuuaaa

SEQ ID NO: 692704 - RNA, 21 nt, Human
uccaacuuuaaaauucagaau

SEQ ID NO: 692705 - RNA, 19 nt, Human
ugaauagauuggaccagca

SEQ ID NO: 692706 - RNA, 25 nt, Human
uuauauauuaaaaacuuugauacuu

SEQ ID NO: 692707 - RNA, 24 nt, Human
uucagaaucauaaauggugacaac

SEQ ID NO: 692708 - RNA, 20 nt, Human
aagguaggggacaguaguca

SEQ ID NO: 692709 - RNA, 19 nt, Human
agcacugaggggagcuggg

SEQ ID NO: 692710 - RNA, 21 nt, Human
cagcacugaggggagcugggg

SEQ ID NO: 692711 - RNA, 19 nt, Human
cagcagcacugaggggagc

SEQ ID NO: 692712 - RNA, 24 nt, Human
ccucgcgcucaucgccggccccgg

SEQ ID NO: 692713 - RNA, 23 nt, Human
cuggagagggguccaguuggugg

SEQ ID NO: 692714 - RNA, 21 nt, Human
gacaguagucaacgcuucccc

SEQ ID NO: 692715 - RNA, 20 nt, Human
gaggggagcugggggcugcc

SEQ ID NO: 692716 - RNA, 22 nt, Human
gagggguccaguugguggcuca

SEQ ID NO: 692717 - RNA, 21 nt, Human
gaguguagacagucgccaacc

SEQ ID NO: 692718 - RNA, 23 nt, Human
ggacaguagucaacgcuucccca

SEQ ID NO: 692719 - RNA, 18 nt, Human
gggaggugguggcggugg

SEQ ID NO: 692720 - RNA, 27 nt, Human
ggguggggguggucucgggggaggagu

SEQ ID NO: 692721 - RNA, 19 nt, Human
ggguggucucgggggagga

SEQ ID NO: 692722 - RNA, 26 nt, Human
ucucgggggaggaguguaacguaaac

SEQ ID NO: 692723 - RNA, 18 nt, Human
ugacagcagcacugaggg

SEQ ID NO: 692724 - RNA, 19 nt, Human
uggagagggguccaguugg

SEQ ID NO: 692725 - RNA, 20 nt, Human
uggggguggucucgggggag

SEQ ID NO: 692726 - RNA, 20 nt, Human
uugcuggagagggguccagu

SEQ ID NO: 692727 - RNA, 19 nt, Human
aaaaacucaaagcaaauga

SEQ ID NO: 692728 - RNA, 22 nt, Human
aaaacaccacuauuaauguaaa

SEQ ID NO: 692729 - RNA, 19 nt, Human
aaaauacacauuggggaga

SEQ ID NO: 692730 - RNA, 25 nt, Human
aaacauaaaguucuauaacuuuagc

SEQ ID NO: 692731 - RNA, 20 nt, Human
aaggaauauaaaaacucaaa

SEQ ID NO: 692732 - RNA, 25 nt, Human
ccaugugguaucucucuguuauccu

SEQ ID NO: 692733 - RNA, 20 nt, Human
gcaugagacugccauccaaa

SEQ ID NO: 692734 - RNA, 19 nt, Human
guauuuucuuuuugugucg

SEQ ID NO: 692735 - RNA, 19 nt, Human
uaaaaaaucugcaugagac

SEQ ID NO: 692736 - RNA, 21 nt, Human
uaaagcaugcauauuuuuccu

SEQ ID NO: 692737 - RNA, 24 nt, Human
uaaagcaugcauauuuuuccuaaa

SEQ ID NO: 692738 - RNA, 20 nt, Human
uagaaauguagaauuuauug

SEQ ID NO: 692739 - RNA, 21 nt, Human
uccaaauuaaaauacacauug

SEQ ID NO: 692740 - RNA, 19 nt, Human
uccuaaauccuuaagaccc

SEQ ID NO: 692741 - RNA, 24 nt, Human
uggaaaugcagcccugcucugcca

SEQ ID NO: 692742 - RNA, 19 nt, Human
uggagcugcugcacgcgcc

SEQ ID NO: 692743 - RNA, 18 nt, Human
uuuuccuaaauccuuaag

SEQ ID NO: 692744 - RNA, 22 nt, Human
aaaaaugccagauuccaguaua

SEQ ID NO: 692745 - RNA, 22 nt, Human
aaaugccagauuccaguauaaa

SEQ ID NO: 692746 - RNA, 20 nt, Human
auaaaaccugucuacacaua

SEQ ID NO: 692747 - RNA, 21 nt, Human
caagaaacuggggggaaauca

SEQ ID NO: 692748 - RNA, 18 nt, Human
caagaaccgccaaaguuu

SEQ ID NO: 692749 - RNA, 23 nt, Human
cacauaguaguuagcugcaaaaa

SEQ ID NO: 692750 - RNA, 20 nt, Human
ccccgaugcccagcuuggcg

SEQ ID NO: 692751 - RNA, 22 nt, Human
guccaagaugugaagauaccau

SEQ ID NO: 692752 - RNA, 18 nt, Human
uaugcaagaaccgccaaa

SEQ ID NO: 692753 - RNA, 18 nt, Human
uccccgaugcccagcuug

SEQ ID NO: 692754 - RNA, 25 nt, Human
ugaagauaccauguucaagaaacug

SEQ ID NO: 692755 - RNA, 21 nt, Human
uguuuaauaaugaauagcaca

SEQ ID NO: 692756 - RNA, 25 nt, Human
aaaaaacuacuaaccaaauguccac

SEQ ID NO: 692757 - RNA, 23 nt, Human
aaaacucauugcaguuuuccaaa

SEQ ID NO: 692758 - RNA, 27 nt, Human
aaacaaaaauagaaaauuuccugucug

SEQ ID NO: 692759 - RNA, 22 nt, Human
aacucuaaacaaaaauagaaaa

SEQ ID NO: 692760 - RNA, 24 nt, Human
aagaugcuaggauuacagguguga

SEQ ID NO: 692761 - RNA, 25 nt, Human
aagcaauccucccaccucagccucc

SEQ ID NO: 692762 - RNA, 22 nt, Human
aagcucuugacuauagcugucu

SEQ ID NO: 692763 - RNA, 25 nt, Human
acaauccugcuaaaaguguugaaaa

SEQ ID NO: 692764 - RNA, 19 nt, Human
acagauaguuggaaguggg

SEQ ID NO: 692765 - RNA, 20 nt, Human
accaacugucaccacaaacu

SEQ ID NO: 692766 - RNA, 24 nt, Human
acccaagcuggagugcaguggcgu

SEQ ID NO: 692767 - RNA, 18 nt, Human
accuuuccuucucccauc

SEQ ID NO: 692768 - RNA, 18 nt, Human
acuauacugcccaggcaa

SEQ ID NO: 692769 - RNA, 18 nt, Human
acuuugucacccaagcug

SEQ ID NO: 692770 - RNA, 25 nt, Human
acuuugucacccaagcuggagugca

SEQ ID NO: 692771 - RNA, 25 nt, Human
agaaaaaagaaaaauaggcuauaaa

SEQ ID NO: 692772 - RNA, 26 nt, Human
agaugcuaggauuacaggugugagcc

SEQ ID NO: 692773 - RNA, 20 nt, Human
aggcacguaccaccacaccc

SEQ ID NO: 692774 - RNA, 18 nt, Human
aguagcugggacuacagg

SEQ ID NO: 692775 - RNA, 23 nt, Human
agugcaauggcaagaucauagcu

SEQ ID NO: 692776 - RNA, 19 nt, Human
agugcaguggcgugauccc

SEQ ID NO: 692777 - RNA, 20 nt, Human
agugcaguggcgugauccca

SEQ ID NO: 692778 - RNA, 22 nt, Human
agugcaguggcgugaucccauu

SEQ ID NO: 692779 - RNA, 21 nt, Human
auaaaauuuaccauguuaccc

SEQ ID NO: 692780 - RNA, 23 nt, Human
aucauagcucccuacaaccucaa

SEQ ID NO: 692781 - RNA, 21 nt, Human
augcuaggauuacagguguga

SEQ ID NO: 692782 - RNA, 19 nt, Human
caaaacacaagcucuugac

SEQ ID NO: 692783 - RNA, 25 nt, Human
caaacuccugggcucaagcaauccu

SEQ ID NO: 692784 - RNA, 22 nt, Human
caacccuccugccugggccucc

SEQ ID NO: 692785 - RNA, 24 nt, Human
caaccucaaacuccugggcucaag

SEQ ID NO: 692786 - RNA, 24 nt, Human
caagaugcuaggauuacaggugug

SEQ ID NO: 692787 - RNA, 27 nt, Human
caagcaauccucccaccucagccuccu

SEQ ID NO: 692788 - RNA, 23 nt, Human
caagcagucuuucuaccagcuuc

SEQ ID NO: 692789 - RNA, 25 nt, Human
caagcagucuuucuaccagcuuccc

SEQ ID NO: 692790 - RNA, 19 nt, Human
caagcucuugacuauagcu

SEQ ID NO: 692791 - RNA, 19 nt, Human
cacaccaccacacuuggcu

SEQ ID NO: 692792 - RNA, 24 nt, Human
cacccaagcuggagugcaguggcg

SEQ ID NO: 692793 - RNA, 24 nt, Human
caccucagccuccuaaguagcuag

SEQ ID NO: 692794 - RNA, 18 nt, Human
cacguaccaccacaccca

SEQ ID NO: 692795 - RNA, 23 nt, Human
cacugcaaccuaugucuuccagg

SEQ ID NO: 692796 - RNA, 18 nt, Human
cagcucaggcucugcugg

SEQ ID NO: 692797 - RNA, 21 nt, Human
caggugcacaccaccacacuu

SEQ ID NO: 692798 - RNA, 24 nt, Human
cauucaaaaaaacuacuaaccaaa

SEQ ID NO: 692799 - RNA, 24 nt, Human
ccaaaacacacacaauuguguuca

SEQ ID NO: 692800 - RNA, 24 nt, Human
ccaagaugcuaggauuacaggugu

SEQ ID NO: 692801 - RNA, 18 nt, Human
ccacugcacccagcuaag

SEQ ID NO: 692802 - RNA, 19 nt, Human
ccacugcacccagcuaagu

SEQ ID NO: 692803 - RNA, 23 nt, Human
cccaccucagccuccuaaguagc

SEQ ID NO: 692804 - RNA, 18 nt, Human
cccaggcaaauucuuauu

SEQ ID NO: 692805 - RNA, 18 nt, Human
cccaucuauuuuucuccc

SEQ ID NO: 692806 - RNA, 23 nt, Human
cccgaguagcugggacuacaggu

SEQ ID NO: 692807 - RNA, 24 nt, Human
cccgaguagcugggacuacaggug

SEQ ID NO: 692808 - RNA, 24 nt, Human
ccucccaccucagccuccuaagua

SEQ ID NO: 692809 - RNA, 20 nt, Human
ccugggcucaagcaauccuc

SEQ ID NO: 692810 - RNA, 23 nt, Human
cuacaaccucaaacuccugggcu

SEQ ID NO: 692811 - RNA, 21 nt, Human
cuaccagcuucccgaguagcu

SEQ ID NO: 692812 - RNA, 24 nt, Human
cucaagcaauccucccaccucagc

SEQ ID NO: 692813 - RNA, 19 nt, Human
cucaagcagucuuucuacc

SEQ ID NO: 692814 - RNA, 20 nt, Human
cugaggaauucaggauaaga

SEQ ID NO: 692815 - RNA, 24 nt, Human
cugcaaccuaugucuuccaggcuc

SEQ ID NO: 692816 - RNA, 23 nt, Human
cugcuagauguaacucaaaccau

SEQ ID NO: 692817 - RNA, 24 nt, Human
cuuacuuugucacccaagcuggag

SEQ ID NO: 692818 - RNA, 25 nt, Human
cuuccaggcucaagcagucuuucua

SEQ ID NO: 692819 - RNA, 21 nt, Human
cuuuccuucucccaucugccc

SEQ ID NO: 692820 - RNA, 24 nt, Human
cuuuuuuuuuuuuuuaagacaggg

SEQ ID NO: 692821 - RNA, 22 nt, Human
gaauaaguuuuagugcugcuag

SEQ ID NO: 692822 - RNA, 26 nt, Human
gaguagcugggacuacaggugcacac

SEQ ID NO: 692823 - RNA, 18 nt, Human
gauuacaggugugagcca

SEQ ID NO: 692824 - RNA, 22 nt, Human
gauuacaggugugagccacugc

SEQ ID NO: 692825 - RNA, 23 nt, Human
gauuacaggugugagccacugca

SEQ ID NO: 692826 - RNA, 19 nt, Human
gccuacaggcacguaccac

SEQ ID NO: 692827 - RNA, 23 nt, Human
gcuggagugcaauggcaagauca

SEQ ID NO: 692828 - RNA, 25 nt, Human
gcuggagugcaguggcgugauccca

SEQ ID NO: 692829 - RNA, 22 nt, Human
ggauuacaggugugagccacug

SEQ ID NO: 692830 - RNA, 22 nt, Human
gguagugacugcaaauagguac

SEQ ID NO: 692831 - RNA, 21 nt, Human
guggugauagagguagugacu

SEQ ID NO: 692832 - RNA, 22 nt, Human
uaaaaguguugaaaagcucuua

SEQ ID NO: 692833 - RNA, 21 nt, Human
uaaacucuacuaaagaaaaau

SEQ ID NO: 692834 - RNA, 19 nt, Human
uaaccaaaacacacacaau

SEQ ID NO: 692835 - RNA, 25 nt, Human
uaacccaucuauuuuucucccaaca

SEQ ID NO: 692836 - RNA, 21 nt, Human
uaagacagggucuuacuuugu

SEQ ID NO: 692837 - RNA, 23 nt, Human
uaaguguuaucuacaaaauuugu

SEQ ID NO: 692838 - RNA, 20 nt, Human
uaauguauuuguagauuuug

SEQ ID NO: 692839 - RNA, 21 nt, Human
uacaggugcacaccaccacac

SEQ ID NO: 692840 - RNA, 19 nt, Human
uacaggugugagccacugc

SEQ ID NO: 692841 - RNA, 24 nt, Human
uacaggugugagccacugcaccca

SEQ ID NO: 692842 - RNA, 23 nt, Human
uaccaccacacccagcuaaauuu

SEQ ID NO: 692843 - RNA, 24 nt, Human
uacuuugucacccaagcuggagug

SEQ ID NO: 692844 - RNA, 20 nt, Human
uagaaaaaagaaaaauaggc

SEQ ID NO: 692845 - RNA, 26 nt, Human
uagaauaaauaaccuuuccuucuccc

SEQ ID NO: 692846 - RNA, 19 nt, Human
uaggauuacaggugugagc

SEQ ID NO: 692847 - RNA, 21 nt, Human
uaggauuacaggugugagcca

SEQ ID NO: 692848 - RNA, 22 nt, Human
uaggauuacaggugugagccac

SEQ ID NO: 692849 - RNA, 22 nt, Human
uaggauuacaggugugagccac

SEQ ID NO: 692850 - RNA, 24 nt, Human
uaggauuacaggugugagccacug

SEQ ID NO: 692851 - RNA, 24 nt, Human
uaggccuacaggcacguaccacca

SEQ ID NO: 692852 - RNA, 23 nt, Human
uauacugcccaggcaaauucuua

SEQ ID NO: 692853 - RNA, 19 nt, Human
uauguuacccggacugucg

SEQ ID NO: 692854 - RNA, 23 nt, Human
uauguuacccggacugucgugaa

SEQ ID NO: 692855 - RNA, 23 nt, Human
ucaggcucugcugguggugguga

SEQ ID NO: 692856 - RNA, 20 nt, Human
uccaaauuccuuuuuuuuuu

SEQ ID NO: 692857 - RNA, 23 nt, Human
ucccaagaugcuaggauuacagg

SEQ ID NO: 692858 - RNA, 23 nt, Human
ucccgaguagcugggacuacagg

SEQ ID NO: 692859 - RNA, 22 nt, Human
ucccuacaaccucaaacuccug

SEQ ID NO: 692860 - RNA, 19 nt, Human
uccuaaguagcuaggccua

SEQ ID NO: 692861 - RNA, 24 nt, Human
uccuaaguagcuaggccuacaggc

SEQ ID NO: 692862 - RNA, 18 nt, Human
uccugggcucaagcaauc

SEQ ID NO: 692863 - RNA, 22 nt, Human
uccugggcucaagcaauccucc

SEQ ID NO: 692864 - RNA, 24 nt, Human
uccugggcucaagcaauccuccca

SEQ ID NO: 692865 - RNA, 23 nt, Human
ucgauaucugauguauuuguaac

SEQ ID NO: 692866 - RNA, 23 nt, Human
ucucacuauacugcccaggcaaa

SEQ ID NO: 692867 - RNA, 22 nt, Human
ucucagcuggagugcaauggca

SEQ ID NO: 692868 - RNA, 24 nt, Human
ucuuacuuugucacccaagcugga

SEQ ID NO: 692869 - RNA, 21 nt, Human
ugacauacccauucaaaaaaa

SEQ ID NO: 692870 - RNA, 20 nt, Human
ugacuucaacccuccugccu

SEQ ID NO: 692871 - RNA, 24 nt, Human
ugcuaggauuacaggugugagcca

SEQ ID NO: 692872 - RNA, 19 nt, Human
uggaaaacagccauuucau

SEQ ID NO: 692873 - RNA, 21 nt, Human
uggagugcaauggcaagauca

SEQ ID NO: 692874 - RNA, 19 nt, Human
uggagugcaguggcgugau

SEQ ID NO: 692875 - RNA, 19 nt, Human
uggagugcaguggcgugau

SEQ ID NO: 692876 - RNA, 23 nt, Human
uggagugcaguggcgugauccca

SEQ ID NO: 692877 - RNA, 28 nt, Human
uggagugcaguggcgugauggcucuagc

SEQ ID NO: 692878 - RNA, 23 nt, Human
uggcuauaggugcuauuuuagag

SEQ ID NO: 692879 - RNA, 24 nt, Human
ugggacuacaggugcacaccacca

SEQ ID NO: 692880 - RNA, 27 nt, Human
uguauuuguagauuuugucacccaagg

SEQ ID NO: 692881 - RNA, 26 nt, Human
uguauuuguagauuuugucacccagg

SEQ ID NO: 692882 - RNA, 21 nt, Human
uguguagucugaaccugugug

SEQ ID NO: 692883 - RNA, 18 nt, Human
uguuaucuacaaaauuug

SEQ ID NO: 692884 - RNA, 20 nt, Human
uuuaacagauaguuggaagu

SEQ ID NO: 692885 - RNA, 24 nt, Human
uuugucacccaagcuggagugcag

SEQ ID NO: 692886 - RNA, 23 nt, Human
uuuuuuuuuuaagacagggucuu

SEQ ID NO: 692887 - RNA, 23 nt, Human
uuuuuuuuuuuuaagacaggguc

SEQ ID NO: 692888 - RNA, 24 nt, Human
uuuuuuuuuuuuaagacagggucu

SEQ ID NO: 692889 - RNA, 18 nt, Human
acacggugaagaaugggg

SEQ ID NO: 692890 - RNA, 21 nt, Human
aguauuggagaagacauaggu

SEQ ID NO: 692891 - RNA, 19 nt, Human
caguauuggagaagacaua

SEQ ID NO: 692892 - RNA, 26 nt, Human
cucugcgaugagcccgggaaccccuc

SEQ ID NO: 692893 - RNA, 19 nt, Human
gaccuaagccagucuggua

SEQ ID NO: 692894 - RNA, 20 nt, Human
gaccuaagccagucugguau

SEQ ID NO: 692895 - RNA, 25 nt, Human
gcccgggaaccccuccucgauucuc

SEQ ID NO: 692896 - RNA, 25 nt, Human
ggaaccccuccucgauucuccgccu

SEQ ID NO: 692897 - RNA, 26 nt, Human
ucagaaaucuucaaucucaaauauuc

SEQ ID NO: 692898 - RNA, 23 nt, Human
ucagaggggcugcccauucggcg

SEQ ID NO: 692899 - RNA, 23 nt, Human
uccgccuagcugggccggcaccc

SEQ ID NO: 692900 - RNA, 21 nt, Human
ucucucccugaagagugagga

SEQ ID NO: 692901 - RNA, 20 nt, Human
ugggagguagagggggucuc

SEQ ID NO: 692902 - RNA, 18 nt, Human
agaggagccgacgggggc

SEQ ID NO: 692903 - RNA, 23 nt, Human
aguggaggacuggaaaagaggag

SEQ ID NO: 692904 - RNA, 23 nt, Human
ccgcggccgggcccagccccggc

SEQ ID NO: 692905 - RNA, 24 nt, Human
ccuucgguccuucccgcggccggg

SEQ ID NO: 692906 - RNA, 21 nt, Human
cgccaggccguugcuaagggc

SEQ ID NO: 692907 - RNA, 22 nt, Human
cucuugcagccgccgcagggac

SEQ ID NO: 692908 - RNA, 20 nt, Human
gcugcagcagcagggaaacc

SEQ ID NO: 692909 - RNA, 18 nt, Human
ggacuggaaaagaggagc

SEQ ID NO: 692910 - RNA, 22 nt, Human
ggcaguggaggacuggaaaaga

SEQ ID NO: 692911 - RNA, 18 nt, Human
gggcugcagcagcaggga

SEQ ID NO: 692912 - RNA, 23 nt, Human
guggaggacuggaaaagaggagc

SEQ ID NO: 692913 - RNA, 19 nt, Human
uggaggacuggaaaagagg

SEQ ID NO: 692914 - RNA, 21 nt, Human
uggaggacuggaaaagaggag

SEQ ID NO: 692915 - RNA, 23 nt, Human
uugcagccgccgcagggacacgc

SEQ ID NO: 692916 - RNA, 24 nt, Human
uuuuuuuuuuuuuuuuguuacugg

SEQ ID NO: 692917 - RNA, 24 nt, Human
uuuuuuuuuuuuuuuuuuguuacu

SEQ ID NO: 692918 - RNA, 23 nt, Human
uuuuuuuuuuuuuuuuuuuuggg

SEQ ID NO: 692919 - RNA, 23 nt, Human
aaacaaaucaaaucgaucuccau

SEQ ID NO: 692920 - RNA, 19 nt, Human
aagcagauaaaacugccaa

SEQ ID NO: 692921 - RNA, 21 nt, Human
aagcagauaaaacugccaagu

SEQ ID NO: 692922 - RNA, 18 nt, Human
aagcauaguuuagugggc

SEQ ID NO: 692923 - RNA, 18 nt, Human
aagucagucuuauauuaa

SEQ ID NO: 692924 - RNA, 19 nt, Human
acacagccuagguaaagac

SEQ ID NO: 692925 - RNA, 24 nt, Human
agagaaaauacaggaauaaugauc

SEQ ID NO: 692926 - RNA, 21 nt, Human
aggcagcuggguguccaagca

SEQ ID NO: 692927 - RNA, 19 nt, Human
agucuuauauuaagucauu

SEQ ID NO: 692928 - RNA, 20 nt, Human
auaaaaccguaaagagaucu

SEQ ID NO: 692929 - RNA, 24 nt, Human
auaaagaacaauuccauauaaaug

SEQ ID NO: 692930 - RNA, 27 nt, Human
aucaaaucgaucuccauuucuucaagu

SEQ ID NO: 692931 - RNA, 23 nt, Human
auuucaaucaccaaagaaaugua

SEQ ID NO: 692932 - RNA, 20 nt, Human
caaaauuaaaagccagaagc

SEQ ID NO: 692933 - RNA, 18 nt, Human
caguuucagagaaaauac

SEQ ID NO: 692934 - RNA, 20 nt, Human
caguuucagagaaaauacag

SEQ ID NO: 692935 - RNA, 20 nt, Human
cuuuccacuaggccucacua

SEQ ID NO: 692936 - RNA, 25 nt, Human
cuuuccacuaggccucacuaccuuc

SEQ ID NO: 692937 - RNA, 21 nt, Human
gggcuucaugugucagaaaua

SEQ ID NO: 692938 - RNA, 20 nt, Human
ggugcugaaaacucagagcu

SEQ ID NO: 692939 - RNA, 18 nt, Human
guagaguaucaacuuaaa

SEQ ID NO: 692940 - RNA, 21 nt, Human
uaaacugagaagaaauaugca

SEQ ID NO: 692941 - RNA, 23 nt, Human
uaaaugacaaccuuuauucugag

SEQ ID NO: 692942 - RNA, 20 nt, Human
uaaauugcagugugucugcu

SEQ ID NO: 692943 - RNA, 23 nt, Human
uaaggccccauuuuuuuuucuuu

SEQ ID NO: 692944 - RNA, 22 nt, Human
uacccuugauaaagaacaauuc

SEQ ID NO: 692945 - RNA, 22 nt, Human
uagugggcuucaugugucagaa

SEQ ID NO: 692946 - RNA, 23 nt, Human
uauccagaauauaugucagaaac

SEQ ID NO: 692947 - RNA, 23 nt, Human
uaugucagaaaccccuaaaagca

SEQ ID NO: 692948 - RNA, 23 nt, Human
ucagaaaccccuaaaagcaacuu

SEQ ID NO: 692949 - RNA, 21 nt, Human
ucagucuuauauuaagucauu

SEQ ID NO: 692950 - RNA, 22 nt, Human
ucaguuucagagaaaauacagg

SEQ ID NO: 692951 - RNA, 20 nt, Human
uccaggaggaggcgccggcc

SEQ ID NO: 692952 - RNA, 23 nt, Human
ugacaaggucagauuuucaaaac

SEQ ID NO: 692953 - RNA, 22 nt, Human
ugagaagaaauaugcauuauag

SEQ ID NO: 692954 - RNA, 21 nt, Human
ugcugaaaacucagagcuuag

SEQ ID NO: 692955 - RNA, 21 nt, Human
uggcaaaauuaaaagccagaa

SEQ ID NO: 692956 - RNA, 21 nt, Human
ugguaccauagauggcugcca

SEQ ID NO: 692957 - RNA, 21 nt, Human
uguaaauugcagugugucugc

SEQ ID NO: 692958 - RNA, 21 nt, Human
ugucauaugugugaucaauau

SEQ ID NO: 692959 - RNA, 21 nt, Human
uuucacaauuauuuucauguc

SEQ ID NO: 692960 - RNA, 20 nt, Human
uuucugggucaggguuucag

SEQ ID NO: 692961 - RNA, 20 nt, Human
uuugaagcagauaaaacugc

SEQ ID NO: 692962 - RNA, 20 nt, Human
uuuuuguuuguuuauuuuuu

SEQ ID NO: 692963 - RNA, 20 nt, Human
aaccucugccucccagccuc

SEQ ID NO: 692964 - RNA, 24 nt, Human
aagugauccuucugccuuggccuc

SEQ ID NO: 692965 - RNA, 25 nt, Human
aagugauccuucugccuuggccucc

SEQ ID NO: 692966 - RNA, 26 nt, Human
accucauccuucugaguagcugggac

SEQ ID NO: 692967 - RNA, 24 nt, Human
acuauguuucucaggcuggucuug

SEQ ID NO: 692968 - RNA, 21 nt, Human
agaagguaugcaauguuccag

SEQ ID NO: 692969 - RNA, 18 nt, Human
agagauccucccaccuca

SEQ ID NO: 692970 - RNA, 25 nt, Human
aggcuggagugcaguggcacaaucu

SEQ ID NO: 692971 - RNA, 21 nt, Human
aggcuggucuugaacuccugg

SEQ ID NO: 692972 - RNA, 21 nt, Human
agugcaguggcacaaucucag

SEQ ID NO: 692973 - RNA, 22 nt, Human
caagugauccuucugccuuggc

SEQ ID NO: 692974 - RNA, 27 nt, Human
caagugauccuucugccuuggccuccc

SEQ ID NO: 692975 - RNA, 21 nt, Human
caccucauccuucugaguagc

SEQ ID NO: 692976 - RNA, 24 nt, Human
cacuauguuucucaggcuggucuu

SEQ ID NO: 692977 - RNA, 18 nt, Human
cacugcaaccucugccuc

SEQ ID NO: 692978 - RNA, 21 nt, Human
cacugcaaccucugccuccca

SEQ ID NO: 692979 - RNA, 20 nt, Human
cagaagguaugcaauguucc

SEQ ID NO: 692980 - RNA, 20 nt, Human
cagccucaagagauccuccc

SEQ ID NO: 692981 - RNA, 22 nt, Human
cagggucucgcugucacccagg

SEQ ID NO: 692982 - RNA, 22 nt, Human
caugccaccacacccagcuauu

SEQ ID NO: 692983 - RNA, 24 nt, Human
ccucccaccucauccuucugagua

SEQ ID NO: 692984 - RNA, 24 nt, Human
ccucccagccucaagagauccucc

SEQ ID NO: 692985 - RNA, 18 nt, Human
ccuggucucaagugaucc

SEQ ID NO: 692986 - RNA, 18 nt, Human
ccuggucucaagugaucc

SEQ ID NO: 692987 - RNA, 20 nt, Human
ccuggucucaagugauccuu

SEQ ID NO: 692988 - RNA, 20 nt, Human
cgcaugccaccacacccagc

SEQ ID NO: 692989 - RNA, 19 nt, Human
cucaagagauccucccacc

SEQ ID NO: 692990 - RNA, 24 nt, Human
cucaagagauccucccaccucauc

SEQ ID NO: 692991 - RNA, 20 nt, Human
cucaagugauccuucugccu

SEQ ID NO: 692992 - RNA, 24 nt, Human
cucaagugauccuucugccuuggc

SEQ ID NO: 692993 - RNA, 24 nt, Human
cucacugcaaccucugccucccag

SEQ ID NO: 692994 - RNA, 24 nt, Human
cugcaaccucugccucccagccuc

SEQ ID NO: 692995 - RNA, 23 nt, Human
cugccuuggccucccaaagugcu

SEQ ID NO: 692996 - RNA, 20 nt, Human
gacagggucucgcugucacc

SEQ ID NO: 692997 - RNA, 26 nt, Human
gaguagcugggacuacaugcgcaugc

SEQ ID NO: 692998 - RNA, 19 nt, Human
gcaugccaccacacccagc

SEQ ID NO: 692999 - RNA, 22 nt, Human
gccuuggccucccaaagugcug

SEQ ID NO: 693000 - RNA, 19 nt, Human
gcuggagugcaguggcaca

SEQ ID NO: 693001 - RNA, 24 nt, Human
gcugucacccaggcuggagugcag

SEQ ID NO: 693002 - RNA, 24 nt, Human
ggcuggucuugaacuccuggucuc

SEQ ID NO: 693003 - RNA, 24 nt, Human
ggucucaagugauccuucugccuu

SEQ ID NO: 693004 - RNA, 23 nt, Human
gucucgcugucacccaggcugga

SEQ ID NO: 693005 - RNA, 24 nt, Human
uacaugcgcaugccaccacaccca

SEQ ID NO: 693006 - RNA, 22 nt, Human
uagagacaagggcucacuaugu

SEQ ID NO: 693007 - RNA, 19 nt, Human
uauguuucucaggcugguc

SEQ ID NO: 693008 - RNA, 24 nt, Human
uauguuucucaggcuggucuugaa

SEQ ID NO: 693009 - RNA, 22 nt, Human
ucacccaggcuggagugcagug

SEQ ID NO: 693010 - RNA, 19 nt, Human
ucacugcaaccucugccuc

SEQ ID NO: 693011 - RNA, 23 nt, Human
ucacugcaaccucugccucccag

SEQ ID NO: 693012 - RNA, 24 nt, Human
ucacugcaaccucugccucccagc

SEQ ID NO: 693013 - RNA, 26 nt, Human
ucacugcaaccucugccucccagccu

SEQ ID NO: 693014 - RNA, 27 nt, Human
ucagcucacugcaaccucugccuccca

SEQ ID NO: 693015 - RNA, 23 nt, Human
ucauccuucugaguagcugggac

SEQ ID NO: 693016 - RNA, 23 nt, Human
ucgcugucacccaggcuggagug

SEQ ID NO: 693017 - RNA, 21 nt, Human
ucucgcugucacccaggcugg

SEQ ID NO: 693018 - RNA, 21 nt, Human
ucucgcugucacccaggcugg

SEQ ID NO: 693019 - RNA, 22 nt, Human
ucucgcugucacccaggcugga

SEQ ID NO: 693020 - RNA, 24 nt, Human
ucucgcugucacccaggcuggagu

SEQ ID NO: 693021 - RNA, 18 nt, Human
ucugaguagcugggacua

SEQ ID NO: 693022 - RNA, 21 nt, Human
ucugaguagcugggacuacau

SEQ ID NO: 693023 - RNA, 21 nt, Human
ucuugaacuccuggucucaag

SEQ ID NO: 693024 - RNA, 22 nt, Human
ugcaguggcacaaucucagcuc

SEQ ID NO: 693025 - RNA, 19 nt, Human
ugccaccacacccagcuau

SEQ ID NO: 693026 - RNA, 18 nt, Human
uggagugcaguggcacaa

SEQ ID NO: 693027 - RNA, 23 nt, Human
uggagugcaguggcacaaucuca

SEQ ID NO: 693028 - RNA, 24 nt, Human
uggagugcaguggcacaaucucag

SEQ ID NO: 693029 - RNA, 24 nt, Human
uggcacaaucucagcucacugcaa

SEQ ID NO: 693030 - RNA, 24 nt, Human
ugggacuacaugcgcaugccacca

SEQ ID NO: 693031 - RNA, 20 nt, Human
uggucucaagugauccuucu

SEQ ID NO: 693032 - RNA, 23 nt, Human
uggucucaagugauccuucugcc

SEQ ID NO: 693033 - RNA, 24 nt, Human
uuccagagugucauugucagcucu

SEQ ID NO: 693034 - RNA, 24 nt, Human
uucucaggcuggucuugaacuccu

SEQ ID NO: 693035 - RNA, 20 nt, Human
uugagacagggucucgcugu

SEQ ID NO: 693036 - RNA, 18 nt, Human
uuggccucccaaagugcu

SEQ ID NO: 693037 - RNA, 18 nt, Human
acacagccccggggccca

SEQ ID NO: 693038 - RNA, 23 nt, Human
agcccugcacugggggugggggu

SEQ ID NO: 693039 - RNA, 20 nt, Human
auccaaaauacaauucugac

SEQ ID NO: 693040 - RNA, 25 nt, Human
caaaauacaauucugacuaugaaca

SEQ ID NO: 693041 - RNA, 18 nt, Human
caagaccagcccugcacu

SEQ ID NO: 693042 - RNA, 19 nt, Human
cccaagaccagcccugcac

SEQ ID NO: 693043 - RNA, 22 nt, Human
ccccaaccaaaccacaggacac

SEQ ID NO: 693044 - RNA, 20 nt, Human
ccccaagaccagcccugcac

SEQ ID NO: 693045 - RNA, 20 nt, Human
ccccggggcccagcauggcc

SEQ ID NO: 693046 - RNA, 19 nt, Human
ccgcgccagccuuccgggc

SEQ ID NO: 693047 - RNA, 22 nt, Human
ccgcgccagccuuccgggccgc

SEQ ID NO: 693048 - RNA, 19 nt, Human
ccgcgccgccgcccgcugc

SEQ ID NO: 693049 - RNA, 19 nt, Human
ccgcgccgccgcccgcugc

SEQ ID NO: 693050 - RNA, 23 nt, Human
ccgcugcgcacacacagccccgg

SEQ ID NO: 693051 - RNA, 22 nt, Human
cgccgcccgcugcgcacacaca

SEQ ID NO: 693052 - RNA, 22 nt, Human
cugaccagaggugcugcccaga

SEQ ID NO: 693053 - RNA, 24 nt, Human
cuguguguauauaucuguguaucu

SEQ ID NO: 693054 - RNA, 21 nt, Human
gagcggccgcaaagaggggcc

SEQ ID NO: 693055 - RNA, 23 nt, Human
gagcggccgcaaagaggggccga

SEQ ID NO: 693056 - RNA, 25 nt, Human
gagggagcggccgcaaagaggggcc

SEQ ID NO: 693057 - RNA, 18 nt, Human
gcagggucaguccaggug

SEQ ID NO: 693058 - RNA, 20 nt, Human
gccagccuuccgggccgcgc

SEQ ID NO: 693059 - RNA, 19 nt, Human
gcccugcacuggggguggg

SEQ ID NO: 693060 - RNA, 20 nt, Human
gccgcgccgccgcccgcugc

SEQ ID NO: 693061 - RNA, 19 nt, Human
gcggccgacccaccagugc

SEQ ID NO: 693062 - RNA, 18 nt, Human
ggacacgggguuggggga

SEQ ID NO: 693063 - RNA, 19 nt, Human
ggccgcaaagaggggccga

SEQ ID NO: 693064 - RNA, 22 nt, Human
gggaauaggcggagggagcggc

SEQ ID NO: 693065 - RNA, 21 nt, Human
gucuguuuauagaucucugcc

SEQ ID NO: 693066 - RNA, 24 nt, Human
uauggcggccgacccaccagugcc

SEQ ID NO: 693067 - RNA, 18 nt, Human
ucaguccagguguggcug

SEQ ID NO: 693068 - RNA, 22 nt, Human
uccccaagaccagcccugcacu

SEQ ID NO: 693069 - RNA, 19 nt, Human
ugaccagaggugcugccca

SEQ ID NO: 693070 - RNA, 20 nt, Human
ugcccugccuccccaagaca

SEQ ID NO: 693071 - RNA, 23 nt, Human
ugcccugccuccccaagaccagc

SEQ ID NO: 693072 - RNA, 24 nt, Human
uggcaggccagggugacccuccuc

SEQ ID NO: 693073 - RNA, 18 nt, Human
uggcccagcuccuccggg

SEQ ID NO: 693074 - RNA, 19 nt, Human
ugggcggcuggcccagcuc

SEQ ID NO: 693075 - RNA, 19 nt, Human
ugggggugggggugggcgg

SEQ ID NO: 693076 - RNA, 22 nt, Human
ugggggugggggugggcggcug

SEQ ID NO: 693077 - RNA, 18 nt, Human
ugucuuguccguccaucc

SEQ ID NO: 693078 - RNA, 18 nt, Human
uguguaaaaauccaaaag

SEQ ID NO: 693079 - RNA, 19 nt, Human
uguguguauauaucugugu

SEQ ID NO: 693080 - RNA, 20 nt, Human
uguguguauauaucugugua

SEQ ID NO: 693081 - RNA, 19 nt, Human
uuuuuuuuuuuuagagccu

SEQ ID NO: 693082 - RNA, 23 nt, Human
aaaaauaacuggagcagagaagc

SEQ ID NO: 693083 - RNA, 24 nt, Human
aaacaaaacaaagcaauuuacaaa

SEQ ID NO: 693084 - RNA, 23 nt, Human
aaacaaagcaauuuacaaaaaaa

SEQ ID NO: 693085 - RNA, 23 nt, Human
aaacaaaugaaguuuuacaagau

SEQ ID NO: 693086 - RNA, 24 nt, Human
aaagaaacaaaugaaguuuuacaa

SEQ ID NO: 693087 - RNA, 22 nt, Human
aaagauauccaauuuaccaaaa

SEQ ID NO: 693088 - RNA, 18 nt, Human
aacaaaacaaagcaauuu

SEQ ID NO: 693089 - RNA, 21 nt, Human
acaaaacaaagcaauuuacaa

SEQ ID NO: 693090 - RNA, 27 nt, Human
acaaagcaauuuacaaaaaaaguacca

SEQ ID NO: 693091 - RNA, 24 nt, Human
acauguaaaguccacuuccugggg

SEQ ID NO: 693092 - RNA, 22 nt, Human
accggaaaaccuuuauuuaaaa

SEQ ID NO: 693093 - RNA, 20 nt, Human
acuggagcagagaagcuuua

SEQ ID NO: 693094 - RNA, 19 nt, Human
aggugcuuuuauuccacag

SEQ ID NO: 693095 - RNA, 21 nt, Human
augcaaauagacagcaucaaa

SEQ ID NO: 693096 - RNA, 25 nt, Human
caaaaaaacacaaaccggaaaaccu

SEQ ID NO: 693097 - RNA, 21 nt, Human
caaacaggaaaacaaacaaaa

SEQ ID NO: 693098 - RNA, 24 nt, Human
caaaugacuuacacucaaugcaaa

SEQ ID NO: 693099 - RNA, 25 nt, Human
caagauacaggcacuuuauguuccc

SEQ ID NO: 693100 - RNA, 23 nt, Human
cacaguaucugauuaaacaaaac

SEQ ID NO: 693101 - RNA, 21 nt, Human
cacuccaucccaucccacccc

SEQ ID NO: 693102 - RNA, 23 nt, Human
cagcgagcauucacguacacuuu

SEQ ID NO: 693103 - RNA, 19 nt, Human
caucaaacaggaaaacaaa

SEQ ID NO: 693104 - RNA, 26 nt, Human
cgcggugguagcggcggcggcagcuu

SEQ ID NO: 693105 - RNA, 19 nt, Human
cucacuccaucccauccca

SEQ ID NO: 693106 - RNA, 19 nt, Human
cucacuccaucccauccca

SEQ ID NO: 693107 - RNA, 20 nt, Human
cuccaucccaucccaccccc

SEQ ID NO: 693108 - RNA, 18 nt, Human
gaaagcucugcaagagug

SEQ ID NO: 693109 - RNA, 21 nt, Human
gaaccaaaagaaacaaaugaa

SEQ ID NO: 693110 - RNA, 20 nt, Human
gcagcugaguaacaccugaa

SEQ ID NO: 693111 - RNA, 24 nt, Human
gcagcugaguaacaccugaaagcu

SEQ ID NO: 693112 - RNA, 21 nt, Human
gcggugguagcggcggcggca

SEQ ID NO: 693113 - RNA, 25 nt, Human
ggaaaaccuuuauuuaaaacuaguc

SEQ ID NO: 693114 - RNA, 24 nt, Human
guaaaaaaaagauauccaauuuac

SEQ ID NO: 693115 - RNA, 27 nt, Human
guagcggcggcggcagcuacggcagca

SEQ ID NO: 693116 - RNA, 28 nt, Human
uaaaaaaaagauauccaauuuaccaaaa

SEQ ID NO: 693117 - RNA, 23 nt, Human
uaaaaauaacuggagcagagaag

SEQ ID NO: 693118 - RNA, 21 nt, Human
uacaaaaaaaguaccaaauga

SEQ ID NO: 693119 - RNA, 23 nt, Human
uacauguaaaguccacuuccugg

SEQ ID NO: 693120 - RNA, 22 nt, Human
uacucaacauucauuguauuua

SEQ ID NO: 693121 - RNA, 22 nt, Human
ucaaaaaaacacaaaccggaaa

SEQ ID NO: 693122 - RNA, 19 nt, Human
ucagacagcgagcauucac

SEQ ID NO: 693123 - RNA, 21 nt, Human
ucuauauauauggagcuggaa

SEQ ID NO: 693124 - RNA, 20 nt, Human
ucugaaccaaaagaaacaaa

SEQ ID NO: 693125 - RNA, 19 nt, Human
ugaaagcucugcaagagug

SEQ ID NO: 693126 - RNA, 18 nt, Human
ugagaaaagcaaaaggug

SEQ ID NO: 693127 - RNA, 22 nt, Human
uuaaacaaaacaaagcaauuua

SEQ ID NO: 693128 - RNA, 22 nt, Human
uuagugagaaaagcaaaaggug

SEQ ID NO: 693129 - RNA, 22 nt, Human
uucucugaaccaaaagaaacaa

SEQ ID NO: 693130 - RNA, 19 nt, Human
auaauugcagaaauuuuua

SEQ ID NO: 693131 - RNA, 20 nt, Human
cugcaugguuuucaggacug

SEQ ID NO: 693132 - RNA, 18 nt, Human
uacucuuccggccugcau

SEQ ID NO: 693133 - RNA, 22 nt, Human
uuugucaauguaaauguuaguc

SEQ ID NO: 693134 - RNA, 22 nt, Human
aaaccuacauuuauugaaaaug

SEQ ID NO: 693135 - RNA, 20 nt, Human
aaacggcccagaggccagag

SEQ ID NO: 693136 - RNA, 24 nt, Human
aagcugcugccuucagcuugugcc

SEQ ID NO: 693137 - RNA, 18 nt, Human
aagucaguuccaggaggu

SEQ ID NO: 693138 - RNA, 18 nt, Human
agaagucaguuccaggag

SEQ ID NO: 693139 - RNA, 21 nt, Human
agaauggacaaccaugugaag

SEQ ID NO: 693140 - RNA, 21 nt, Human
aggggcuuuaccagcccuugg

SEQ ID NO: 693141 - RNA, 23 nt, Human
caacagcagccucacaucccuga

SEQ ID NO: 693142 - RNA, 24 nt, Human
caacagcagccucacaucccugau

SEQ ID NO: 693143 - RNA, 23 nt, Human
caaccaugugaagcagcucaggu

SEQ ID NO: 693144 - RNA, 21 nt, Human
caaccugcucaaaacccuaag

SEQ ID NO: 693145 - RNA, 24 nt, Human
cacacugcaaaccccuccacccac

SEQ ID NO: 693146 - RNA, 21 nt, Human
caccauaccccaaccugcuca

SEQ ID NO: 693147 - RNA, 27 nt, Human
caccccaaccagcaccaaggccucuac

SEQ ID NO: 693148 - RNA, 21 nt, Human
cacccccaacagcagccucac

SEQ ID NO: 693149 - RNA, 20 nt, Human
cacgcccagcuccacagcca

SEQ ID NO: 693150 - RNA, 27 nt, Human
cacugcaaaccccuccacccacccuca

SEQ ID NO: 693151 - RNA, 20 nt, Human
cagaagaagucaguuccagg

SEQ ID NO: 693152 - RNA, 21 nt, Human
cagaauggacaaccaugugaa

SEQ ID NO: 693153 - RNA, 19 nt, Human
cagcagccucacaucccug

SEQ ID NO: 693154 - RNA, 25 nt, Human
caggagguccuuucucccccagccu

SEQ ID NO: 693155 - RNA, 23 nt, Human
caggcaccauaccccaaccugcu

SEQ ID NO: 693156 - RNA, 19 nt, Human
ccaaccugcucaaaacccu

SEQ ID NO: 693157 - RNA, 26 nt, Human
cccaacagcagccucacaucccugau

SEQ ID NO: 693158 - RNA, 25 nt, Human
ccccaacagcagccucacaucccug

SEQ ID NO: 693159 - RNA, 26 nt, Human
ccccaaccugcucaaaacccuaaguu

SEQ ID NO: 693160 - RNA, 25 nt, Human
ccccccacccccaacagcagccuca

SEQ ID NO: 693161 - RNA, 19 nt, Human
cccgguuccgggccggggc

SEQ ID NO: 693162 - RNA, 18 nt, Human
cccuccacccacccucaa

SEQ ID NO: 693163 - RNA, 23 nt, Human
cccuccacccacccucaacucac

SEQ ID NO: 693164 - RNA, 22 nt, Human
ccgggccggggccggacgagca

SEQ ID NO: 693165 - RNA, 20 nt, Human
ccuccacccacccucaacuc

SEQ ID NO: 693166 - RNA, 22 nt, Human
ccugcccauuccccucccccca

SEQ ID NO: 693167 - RNA, 24 nt, Human
cggacgagcagcacgcccagcucc

SEQ ID NO: 693168 - RNA, 18 nt, Human
cgggccggggccggacga

SEQ ID NO: 693169 - RNA, 20 nt, Human
cugcaaaccccuccacccac

SEQ ID NO: 693170 - RNA, 22 nt, Human
cugcaggccccaccccaaccag

SEQ ID NO: 693171 - RNA, 18 nt, Human
cuuuaagccccagaaugg

SEQ ID NO: 693172 - RNA, 20 nt, Human
gaacagguauggcuggaaac

SEQ ID NO: 693173 - RNA, 24 nt, Human
gccacauucccacacugcaaaccc

SEQ ID NO: 693174 - RNA, 19 nt, Human
gcccauuccccucccccca

SEQ ID NO: 693175 - RNA, 26 nt, Human
gccugcccauuccccuccccccaccc

SEQ ID NO: 693176 - RNA, 22 nt, Human
gcucaggucaacugcagggcca

SEQ ID NO: 693177 - RNA, 22 nt, Human
ggacgagcagcacgcccagcuc

SEQ ID NO: 693178 - RNA, 20 nt, Human
gggccggggccggacgagca

SEQ ID NO: 693179 - RNA, 23 nt, Human
gggccggggccggacgagcagca

SEQ ID NO: 693180 - RNA, 19 nt, Human
guccuuucucccccagccu

SEQ ID NO: 693181 - RNA, 24 nt, Human
uaacaaaccuacauuuauugaaaa

SEQ ID NO: 693182 - RNA, 22 nt, Human
uaaguuagcaaaggaagacaac

SEQ ID NO: 693183 - RNA, 18 nt, Human
uaccaaacggcccagagg

SEQ ID NO: 693184 - RNA, 18 nt, Human
uaccccaaccugcucaaa

SEQ ID NO: 693185 - RNA, 20 nt, Human
uacuuggucuggucccaguu

SEQ ID NO: 693186 - RNA, 23 nt, Human
ucagcuugugccugugggugccu

SEQ ID NO: 693187 - RNA, 23 nt, Human
ucaguaacuaagacucugcaggc

SEQ ID NO: 693188 - RNA, 23 nt, Human
uccacagccaucuugcuccaccu

SEQ ID NO: 693189 - RNA, 25 nt, Human
uccacccacccucaacucacacaca

SEQ ID NO: 693190 - RNA, 20 nt, Human
uccagccccucucccuucca

SEQ ID NO: 693191 - RNA, 20 nt, Human
ucccacacugcaaaccccuc

SEQ ID NO: 693192 - RNA, 23 nt, Human
ucccacacugcaaaccccuccac

SEQ ID NO: 693193 - RNA, 21 nt, Human
uccuuucucccccagccuggg

SEQ ID NO: 693194 - RNA, 26 nt, Human
uccuuucucccccagccugggaggau

SEQ ID NO: 693195 - RNA, 19 nt, Human
ucuaggcugaaagagagaa

SEQ ID NO: 693196 - RNA, 19 nt, Human
ucugcaggccccaccccaa

SEQ ID NO: 693197 - RNA, 18 nt, Human
ugaagcagcucaggucaa

SEQ ID NO: 693198 - RNA, 18 nt, Human
ugacaggcaccauacccc

SEQ ID NO: 693199 - RNA, 22 nt, Human
ugaggugccaagaggaggggcu

SEQ ID NO: 693200 - RNA, 22 nt, Human
ugauucugaggugccaagagga

SEQ ID NO: 693201 - RNA, 24 nt, Human
ugccuccagccccucucccuucca

SEQ ID NO: 693202 - RNA, 22 nt, Human
ugccugugggugccuccagccc

SEQ ID NO: 693203 - RNA, 21 nt, Human
uggaaaccaguccuccugaca

SEQ ID NO: 693204 - RNA, 22 nt, Human
ugggugccuccagccccucucc

SEQ ID NO: 693205 - RNA, 23 nt, Human
uuuuuuuuuuauugggaaacuca

SEQ ID NO: 693206 - RNA, 22 nt, Human
aaaaagaaaaaagagaagcuaa

SEQ ID NO: 693207 - RNA, 21 nt, Human
aaagguucuagggccucuccu

SEQ ID NO: 693208 - RNA, 23 nt, Human
aagaaaaaagagaagcuaaaugu

SEQ ID NO: 693209 - RNA, 20 nt, Human
aagagaagcuaaaugugcug

SEQ ID NO: 693210 - RNA, 22 nt, Human
aucaggcucugucccgacgccu

SEQ ID NO: 693211 - RNA, 18 nt, Human
ccucuccgacugcgagag

SEQ ID NO: 693212 - RNA, 22 nt, Human
ccugagagaaagucugaaaccc

SEQ ID NO: 693213 - RNA, 22 nt, Human
ccuggaucaggcucugucccga

SEQ ID NO: 693214 - RNA, 22 nt, Human
cgagagcugccaccggccgccg

SEQ ID NO: 693215 - RNA, 24 nt, Human
cuagggccucuccuucgcgucucu

SEQ ID NO: 693216 - RNA, 21 nt, Human
cucuccuucgcgucucugcug

SEQ ID NO: 693217 - RNA, 21 nt, Human
cugaaacccacucaguccccg

SEQ ID NO: 693218 - RNA, 19 nt, Human
cugaagccagcggaaaucc

SEQ ID NO: 693219 - RNA, 23 nt, Human
cugagagaaagucugaaacccac

SEQ ID NO: 693220 - RNA, 20 nt, Human
gaaccugaagccagcggaaa

SEQ ID NO: 693221 - RNA, 24 nt, Human
gccgaagccuggaucaggcucugu

SEQ ID NO: 693222 - RNA, 22 nt, Human
ucuccuucgcgucucugcugug

SEQ ID NO: 693223 - RNA, 24 nt, Human
ucugaaacccacucaguccccgaa

SEQ ID NO: 693224 - RNA, 22 nt, Human
ugaaacccacucaguccccgaa

SEQ ID NO: 693225 - RNA, 23 nt, Human
ugagagaaagucugaaacccacu

SEQ ID NO: 693226 - RNA, 22 nt, Human
ugccaccggccgccgaagccug

SEQ ID NO: 693227 - RNA, 25 nt, Human
aacagaacaaacagaugauauggga

SEQ ID NO: 693228 - RNA, 21 nt, Human
aacaucuuuauuccauuuccc

SEQ ID NO: 693229 - RNA, 22 nt, Human
aaguagcugggauuacaggcau

SEQ ID NO: 693230 - RNA, 24 nt, Human
aaguagcugggauuacaggcaugc

SEQ ID NO: 693231 - RNA, 20 nt, Human
aauaaccagcucaccccaug

SEQ ID NO: 693232 - RNA, 24 nt, Human
acagagugcugggacuacaggcau

SEQ ID NO: 693233 - RNA, 18 nt, Human
accauguuggccaggcug

SEQ ID NO: 693234 - RNA, 18 nt, Human
acccauagcucuguggcc

SEQ ID NO: 693235 - RNA, 18 nt, Human
acgggguuucaccauguu

SEQ ID NO: 693236 - RNA, 23 nt, Human
acgggguuucaccauguuggcca

SEQ ID NO: 693237 - RNA, 24 nt, Human
acgggguuucaccauguuggccag

SEQ ID NO: 693238 - RNA, 23 nt, Human
acucugucauccaggcuggacug

SEQ ID NO: 693239 - RNA, 25 nt, Human
acucugucauccaggcuggacugca

SEQ ID NO: 693240 - RNA, 24 nt, Human
acugcagugaugcgaucucggcuc

SEQ ID NO: 693241 - RNA, 18 nt, Human
agacaacagaacaaacag

SEQ ID NO: 693242 - RNA, 24 nt, Human
agagugcugggacuacaggcauga

SEQ ID NO: 693243 - RNA, 18 nt, Human
agccccuggcagcgaguc

SEQ ID NO: 693244 - RNA, 19 nt, Human
aggaacagaccccaaaaac

SEQ ID NO: 693245 - RNA, 20 nt, Human
aggaacagaccccaaaaaca

SEQ ID NO: 693246 - RNA, 18 nt, Human
aggcaugagccacugagc

SEQ ID NO: 693247 - RNA, 21 nt, Human
aggcaugagccacugagcccg

SEQ ID NO: 693248 - RNA, 22 nt, Human
agugcaggaacagaccccaaaa

SEQ ID NO: 693249 - RNA, 23 nt, Human
agugcaggaacagaccccaaaaa

SEQ ID NO: 693250 - RNA, 18 nt, Human
agugcugggacuacaggc

SEQ ID NO: 693251 - RNA, 22 nt, Human
agugcugggacuacaggcauga

SEQ ID NO: 693252 - RNA, 19 nt, Human
auagacgggguuucaccau

SEQ ID NO: 693253 - RNA, 19 nt, Human
augagccacugagcccggc

SEQ ID NO: 693254 - RNA, 28 nt, Human
caagcaauucucccgccucaggcuccca

SEQ ID NO: 693255 - RNA, 24 nt, Human
caagcgaucugccugccucggccc

SEQ ID NO: 693256 - RNA, 21 nt, Human
caccauguuggccaggcuggu

SEQ ID NO: 693257 - RNA, 24 nt, Human
caccauguuggccaggcuggucuc

SEQ ID NO: 693258 - RNA, 27 nt, Human
caccauguuggccaggcuggucucaaa

SEQ ID NO: 693259 - RNA, 23 nt, Human
cacucugucauccaggcuggacu

SEQ ID NO: 693260 - RNA, 24 nt, Human
cacucugucauccaggcuggacug

SEQ ID NO: 693261 - RNA, 21 nt, Human
cacugcaaccucugccucccg

SEQ ID NO: 693262 - RNA, 23 nt, Human
cacugcaaccucugccucccggg

SEQ ID NO: 693263 - RNA, 21 nt, Human
cacuggggcugauguauagcu

SEQ ID NO: 693264 - RNA, 23 nt, Human
cagagugcugggacuacaggcau

SEQ ID NO: 693265 - RNA, 24 nt, Human
cagagugcugggacuacaggcaug

SEQ ID NO: 693266 - RNA, 24 nt, Human
caggagccuggguuucgauucaag

SEQ ID NO: 693267 - RNA, 20 nt, Human
cauccaggcuggacugcagu

SEQ ID NO: 693268 - RNA, 24 nt, Human
cauguuggccaggcuggucucaaa

SEQ ID NO: 693269 - RNA, 23 nt, Human
ccaaguagcugggauuacaggca

SEQ ID NO: 693270 - RNA, 24 nt, Human
ccaaguagcugggauuacaggcau

SEQ ID NO: 693271 - RNA, 19 nt, Human
ccacugagcccggcuugca

SEQ ID NO: 693272 - RNA, 24 nt, Human
cccaaaaacaucuuuauuccauuu

SEQ ID NO: 693273 - RNA, 23 nt, Human
cccaaguagcugggauuacaggc

SEQ ID NO: 693274 - RNA, 24 nt, Human
cccaaguagcugggauuacaggca

SEQ ID NO: 693275 - RNA, 26 nt, Human
cccacagagugcugggacuacaggca

SEQ ID NO: 693276 - RNA, 20 nt, Human
cccuuggauggccgaggccc

SEQ ID NO: 693277 - RNA, 22 nt, Human
ccucagucucuucuucaaaaca

SEQ ID NO: 693278 - RNA, 24 nt, Human
ccucccggguucaagcaauucucc

SEQ ID NO: 693279 - RNA, 21 nt, Human
ccugaccucaagcgaucugcc

SEQ ID NO: 693280 - RNA, 21 nt, Human
cgccucaggcucccaaguagc

SEQ ID NO: 693281 - RNA, 24 nt, Human
cucacugcaaccucugccucccgg

SEQ ID NO: 693282 - RNA, 26 nt, Human
cuccugaccucaagcgaucugccugc

SEQ ID NO: 693283 - RNA, 23 nt, Human
cugcaaccucugccucccggguu

SEQ ID NO: 693284 - RNA, 24 nt, Human
cugcaaccucugccucccggguuc

SEQ ID NO: 693285 - RNA, 24 nt, Human
gaccucaagcgaucugccugccuc

SEQ ID NO: 693286 - RNA, 21 nt, Human
gacuacaggcaugagccacug

SEQ ID NO: 693287 - RNA, 18 nt, Human
gauuacaggcaugcgcca

SEQ ID NO: 693288 - RNA, 22 nt, Human
gccagugccugcaggagccugg

SEQ ID NO: 693289 - RNA, 21 nt, Human
gccccuggcagcgagucccag

SEQ ID NO: 693290 - RNA, 23 nt, Human
gccucaggcucccaaguagcugg

SEQ ID NO: 693291 - RNA, 23 nt, Human
gcuggucucaaacuccugaccuc

SEQ ID NO: 693292 - RNA, 25 nt, Human
ggaaaagggcucggauucaccuggc

SEQ ID NO: 693293 - RNA, 20 nt, Human
ggacuacaggcaugagccac

SEQ ID NO: 693294 - RNA, 22 nt, Human
ggacuacaggcaugagccacug

SEQ ID NO: 693295 - RNA, 19 nt, Human
ggauuacaggcaugcgcca

SEQ ID NO: 693296 - RNA, 24 nt, Human
ggcuggucucaaacuccugaccuc

SEQ ID NO: 693297 - RNA, 23 nt, Human
gggguuucaccauguuggccagg

SEQ ID NO: 693298 - RNA, 22 nt, Human
ggguuucaccauguuggccagg

SEQ ID NO: 693299 - RNA, 18 nt, Human
ggucuggcacuggggcug

SEQ ID NO: 693300 - RNA, 21 nt, Human
gguguggggccauggaagaaa

SEQ ID NO: 693301 - RNA, 19 nt, Human
gucccagagccagggugga

SEQ ID NO: 693302 - RNA, 25 nt, Human
uaauuuuugaauuuuuuaguauaga

SEQ ID NO: 693303 - RNA, 23 nt, Human
uacaggcaugagccacugagccc

SEQ ID NO: 693304 - RNA, 23 nt, Human
uacaggcaugcgccaccacgucc

SEQ ID NO: 693305 - RNA, 26 nt, Human
uagacaacagaacaaacagaugauau

SEQ ID NO: 693306 - RNA, 24 nt, Human
uaguauagacgggguuucaccaug

SEQ ID NO: 693307 - RNA, 18 nt, Human
ucaaauccuggugcugac

SEQ ID NO: 693308 - RNA, 21 nt, Human
ucaccuggcuucaaauccugg

SEQ ID NO: 693309 - RNA, 24 nt, Human
ucacugcaaccucugccucccggg

SEQ ID NO: 693310 - RNA, 25 nt, Human
ucacugcaaccucugccucccgggu

SEQ ID NO: 693311 - RNA, 24 nt, Human
ucccaaguagcugggauuacaggc

SEQ ID NO: 693312 - RNA, 21 nt, Human
ucccggguucaagcaauucuc

SEQ ID NO: 693313 - RNA, 24 nt, Human
ucccggguucaagcaauucucccg

SEQ ID NO: 693314 - RNA, 21 nt, Human
ucccugagggccuugcucuga

SEQ ID NO: 693315 - RNA, 24 nt, Human
uccugggguggagggaaggucacc

SEQ ID NO: 693316 - RNA, 23 nt, Human
ucucacucugucauccaggcugg

SEQ ID NO: 693317 - RNA, 24 nt, Human
ucucacucugucauccaggcugga

SEQ ID NO: 693318 - RNA, 24 nt, Human
ucugccucccggguucaagcaauu

SEQ ID NO: 693319 - RNA, 24 nt, Human
ucugucauccaggcuggacugcag

SEQ ID NO: 693320 - RNA, 18 nt, Human
ugaccucaagcgaucugc

SEQ ID NO: 693321 - RNA, 22 nt, Human
ugagauggagucucacucuguc

SEQ ID NO: 693322 - RNA, 22 nt, Human
ugcagugaugcgaucucggcuc

SEQ ID NO: 693323 - RNA, 18 nt, Human
ugccagugccugcaggag

SEQ ID NO: 693324 - RNA, 23 nt, Human
ugccaugguguggggccauggaa

SEQ ID NO: 693325 - RNA, 25 nt, Human
ugccccaaaccaucagcgucacucu

SEQ ID NO: 693326 - RNA, 24 nt, Human
uggacugcagugaugcgaucucgg

SEQ ID NO: 693327 - RNA, 24 nt, Human
uggccaggcuggucucaaacuccu

SEQ ID NO: 693328 - RNA, 21 nt, Human
ugggacuacaggcaugagcca

SEQ ID NO: 693329 - RNA, 22 nt, Human
ugggacuacaggcaugagccac

SEQ ID NO: 693330 - RNA, 22 nt, Human
ugggacuacaggcaugagccac

SEQ ID NO: 693331 - RNA, 24 nt, Human
ugggacuacaggcaugagccacug

SEQ ID NO: 693332 - RNA, 24 nt, Human
ugggacuacaggcaugagccacug

SEQ ID NO: 693333 - RNA, 26 nt, Human
ugggacuacaggcaugagccacugag

SEQ ID NO: 693334 - RNA, 18 nt, Human
ugggauuacaggcaugcg

SEQ ID NO: 693335 - RNA, 21 nt, Human
ugggauuacaggcaugcgcca

SEQ ID NO: 693336 - RNA, 22 nt, Human
ugggauuacaggcaugcgccac

SEQ ID NO: 693337 - RNA, 24 nt, Human
ugggauuacaggcaugcgccacca

SEQ ID NO: 693338 - RNA, 23 nt, Human
ugggguggagggaaggucaccug

SEQ ID NO: 693339 - RNA, 25 nt, Human
ugguguggggccauggaagaaaugu

SEQ ID NO: 693340 - RNA, 20 nt, Human
ugugccagugccugcaggag

SEQ ID NO: 693341 - RNA, 24 nt, Human
uuaguauagacgggguuucaccau

SEQ ID NO: 693342 - RNA, 22 nt, Human
uucaaaacauggaggaugaccc

SEQ ID NO: 693343 - RNA, 25 nt, Human
uucaagcaauucucccgccucaggc

SEQ ID NO: 693344 - RNA, 22 nt, Human
uucccgaagacccccggaugcc

SEQ ID NO: 693345 - RNA, 18 nt, Human
uucccggguucccgaaga

SEQ ID NO: 693346 - RNA, 21 nt, Human
uucccggguucccgaagaccc

SEQ ID NO: 693347 - RNA, 21 nt, Human
uuguugcuaaaauaaccagcu

SEQ ID NO: 693348 - RNA, 24 nt, Human
uuucaccauguuggccaggcuggu

SEQ ID NO: 693349 - RNA, 24 nt, Human
uuuuuaguauagacgggguuucac

SEQ ID NO: 693350 - RNA, 21 nt, Human
aaaacaccaacuuucaaagca

SEQ ID NO: 693351 - RNA, 20 nt, Human
aaaauuagugacagggauaa

SEQ ID NO: 693352 - RNA, 18 nt, Human
aaacaccaacuuucaaag

SEQ ID NO: 693353 - RNA, 18 nt, Human
acaauacacacacauaua

SEQ ID NO: 693354 - RNA, 18 nt, Human
acaauacacacacauaua

SEQ ID NO: 693355 - RNA, 21 nt, Human
acugaaauguaaagacauuua

SEQ ID NO: 693356 - RNA, 20 nt, Human
aguuuuuuuuuuuuuuuuuu

SEQ ID NO: 693357 - RNA, 25 nt, Human
auuucauuacuggguaugugaacaa

SEQ ID NO: 693358 - RNA, 21 nt, Human
caaccaaaaacaccaacuuuc

SEQ ID NO: 693359 - RNA, 24 nt, Human
caggugacagagacaguuuuuuuu

SEQ ID NO: 693360 - RNA, 22 nt, Human
ccaaaaacaccaacuuucaaag

SEQ ID NO: 693361 - RNA, 23 nt, Human
ccaaaaacaccaacuuucaaagc

SEQ ID NO: 693362 - RNA, 24 nt, Human
ccaaaaacaccaacuuucaaagca

SEQ ID NO: 693363 - RNA, 27 nt, Human
ccaacuuucaaagcaaacagucccaua

SEQ ID NO: 693364 - RNA, 30 nt, Human
gacagagacaguuuuuuuuuuuuuuuuuuu

SEQ ID NO: 693365 - RNA, 20 nt, Human
gagacaguuuuuuuuuuuuu

SEQ ID NO: 693366 - RNA, 20 nt, Human
ggaccaaauuuauucuacaa

SEQ ID NO: 693367 - RNA, 25 nt, Human
uaaauucucaucaaccaaaaacacc

SEQ ID NO: 693368 - RNA, 19 nt, Human
uacaauacacacacauaua

SEQ ID NO: 693369 - RNA, 25 nt, Human
uacaauacacacacauauagguagg

SEQ ID NO: 693370 - RNA, 27 nt, Human
uaccauuaauaccucaauauauguuau

SEQ ID NO: 693371 - RNA, 22 nt, Human
uacuggguaugugaacaauuga

SEQ ID NO: 693372 - RNA, 23 nt, Human
uagauugcagacguaaauucuca

SEQ ID NO: 693373 - RNA, 19 nt, Human
uauggcacuaagaaaggua

SEQ ID NO: 693374 - RNA, 22 nt, Human
ucucaucaaccaaaaacaccaa

SEQ ID NO: 693375 - RNA, 23 nt, Human
ugaaggaaauccaaacggccauu

SEQ ID NO: 693376 - RNA, 21 nt, Human
uuuuuuuuuuuuuuuugaagg

SEQ ID NO: 693377 - RNA, 18 nt, Human
uuuuuuuuuuuuuuuuug

SEQ ID NO: 693378 - RNA, 23 nt, Human
aacagaaaacaaguuuaaugcaa

SEQ ID NO: 693379 - RNA, 22 nt, Human
aaccaagagguaaucaacagaa

SEQ ID NO: 693380 - RNA, 24 nt, Human
aagcagccauccacagcgccuccc

SEQ ID NO: 693381 - RNA, 21 nt, Human
aaggaaaagaguggccaucag

SEQ ID NO: 693382 - RNA, 21 nt, Human
acccugggaagucaaaccaag

SEQ ID NO: 693383 - RNA, 24 nt, Human
accugauccccacucucccauccc

SEQ ID NO: 693384 - RNA, 22 nt, Human
acgcagccccugagcccaaggg

SEQ ID NO: 693385 - RNA, 19 nt, Human
agauguugaacacacacgu

SEQ ID NO: 693386 - RNA, 20 nt, Human
agccccugagcccaagggcc

SEQ ID NO: 693387 - RNA, 22 nt, Human
aggaccccacggcccacagaaa

SEQ ID NO: 693388 - RNA, 25 nt, Human
aggaguccuucacuccagggauguc

SEQ ID NO: 693389 - RNA, 20 nt, Human
auacugaagcccucagaggc

SEQ ID NO: 693390 - RNA, 20 nt, Human
auguugaacacacacgugug

SEQ ID NO: 693391 - RNA, 22 nt, Human
cacucucccaucccaagacccu

SEQ ID NO: 693392 - RNA, 23 nt, Human
cagaggcagaggggagucaagga

SEQ ID NO: 693393 - RNA, 21 nt, Human
cagccuccgcgcgccucuccc

SEQ ID NO: 693394 - RNA, 22 nt, Human
cauucagacucccccaguguuc

SEQ ID NO: 693395 - RNA, 20 nt, Human
ccaagacccugggaagucaa

SEQ ID NO: 693396 - RNA, 18 nt, Human
ccccacucucccauccca

SEQ ID NO: 693397 - RNA, 20 nt, Human
ccccacugccccccaugcug

SEQ ID NO: 693398 - RNA, 22 nt, Human
ccccaucaauacugaagcccuc

SEQ ID NO: 693399 - RNA, 21 nt, Human
ccccaugcugaggaguccuuc

SEQ ID NO: 693400 - RNA, 18 nt, Human
ccccugagcccaagggcc

SEQ ID NO: 693401 - RNA, 22 nt, Human
ccccugagcccaagggccgucu

SEQ ID NO: 693402 - RNA, 23 nt, Human
cccuccccgcccuucuggaaccu

SEQ ID NO: 693403 - RNA, 19 nt, Human
cccugagcccaagggccgu

SEQ ID NO: 693404 - RNA, 21 nt, Human
ccucaucucagggccucgcgg

SEQ ID NO: 693405 - RNA, 22 nt, Human
ccuccaccacuggaaugggggc

SEQ ID NO: 693406 - RNA, 18 nt, Human
ccucccacccgccggggc

SEQ ID NO: 693407 - RNA, 19 nt, Human
cgcagccuccgcgcgccuc

SEQ ID NO: 693408 - RNA, 25 nt, Human
cgcgccucccacccgccggggccug

SEQ ID NO: 693409 - RNA, 23 nt, Human
cggccaggcaggaacgggcgcgg

SEQ ID NO: 693410 - RNA, 18 nt, Human
cgguucugagucccgccu

SEQ ID NO: 693411 - RNA, 20 nt, Human
cuaacgugugccccacugcc

SEQ ID NO: 693412 - RNA, 22 nt, Human
cucccaucccaagacccuggga

SEQ ID NO: 693413 - RNA, 23 nt, Human
cugaggaguccuucacuccaggg

SEQ ID NO: 693414 - RNA, 21 nt, Human
cuggaaugggggcagcccuaa

SEQ ID NO: 693415 - RNA, 20 nt, Human
gauccccacucucccauccc

SEQ ID NO: 693416 - RNA, 18 nt, Human
gcaggaacgggcgcggga

SEQ ID NO: 693417 - RNA, 23 nt, Human
gccauccacagcgccuccaccac

SEQ ID NO: 693418 - RNA, 19 nt, Human
gcgccucccacccgccggg

SEQ ID NO: 693419 - RNA, 18 nt, Human
gcggccaggcaggaacgg

SEQ ID NO: 693420 - RNA, 25 nt, Human
gcggcccugaacgccgguucugagu

SEQ ID NO: 693421 - RNA, 19 nt, Human
ggaaugggggcagcccuaa

SEQ ID NO: 693422 - RNA, 19 nt, Human
ggcgcccccuccccgcccu

SEQ ID NO: 693423 - RNA, 18 nt, Human
ggugacaacggucuggag

SEQ ID NO: 693424 - RNA, 23 nt, Human
gugcugcuguuggagcggccggc

SEQ ID NO: 693425 - RNA, 23 nt, Human
guucugagucccgccuugugcug

SEQ ID NO: 693426 - RNA, 23 nt, Human
uaacgugugccccacugcccccc

SEQ ID NO: 693427 - RNA, 21 nt, Human
uaaugcaacaggugacaacgg

SEQ ID NO: 693428 - RNA, 22 nt, Human
uacccugaugcucucuacuugg

SEQ ID NO: 693429 - RNA, 18 nt, Human
uacugaagcccucagagg

SEQ ID NO: 693430 - RNA, 20 nt, Human
uaguuaucuucugccuccug

SEQ ID NO: 693431 - RNA, 18 nt, Human
ucaauacugaagcccuca

SEQ ID NO: 693432 - RNA, 21 nt, Human
ucagcgcgcggcgcccccucc

SEQ ID NO: 693433 - RNA, 22 nt, Human
uccacagcgccuccaccacugg

SEQ ID NO: 693434 - RNA, 27 nt, Human
ucccaagacccugggaagucaaaccaa

SEQ ID NO: 693435 - RNA, 21 nt, Human
uccccaucaauacugaagccc

SEQ ID NO: 693436 - RNA, 18 nt, Human
ucccgccuugugcugcug

SEQ ID NO: 693437 - RNA, 21 nt, Human
ucccuccccaucaauacugaa

SEQ ID NO: 693438 - RNA, 18 nt, Human
ucgcggccgcuggcggcc

SEQ ID NO: 693439 - RNA, 19 nt, Human
ucgcggccgcuggcggccc

SEQ ID NO: 693440 - RNA, 21 nt, Human
ugauccccacucucccauccc

SEQ ID NO: 693441 - RNA, 28 nt, Human
uggcggcccugaacgccgguucugaguc

SEQ ID NO: 693442 - RNA, 22 nt, Human
ugucuucaccccaaucauucag

SEQ ID NO: 693443 - RNA, 22 nt, Human
uugaggaaaagcagccauccac

SEQ ID NO: 693444 - RNA, 23 nt, Human
uuuggagccucaucucagggccu

SEQ ID NO: 693445 - RNA, 19 nt, Human
aaaagcccagcccaaacca

SEQ ID NO: 693446 - RNA, 19 nt, Human
aaaaucuccccaucucaca

SEQ ID NO: 693447 - RNA, 18 nt, Human
aaccauacaccaccuccc

SEQ ID NO: 693448 - RNA, 20 nt, Human
aaccauacaccaccuccccc

SEQ ID NO: 693449 - RNA, 21 nt, Human
aaccauacaccaccuccccca

SEQ ID NO: 693450 - RNA, 25 nt, Human
aacccggcauccagcucagaacaca

SEQ ID NO: 693451 - RNA, 24 nt, Human
aaccuggcuccucgggccccucca

SEQ ID NO: 693452 - RNA, 20 nt, Human
aagaugcacagcuccguaac

SEQ ID NO: 693453 - RNA, 21 nt, Human
aagcagcggcaugccuggagc

SEQ ID NO: 693454 - RNA, 18 nt, Human
aagccauacaagcagcgg

SEQ ID NO: 693455 - RNA, 21 nt, Human
acaaaagcccagcccaaacca

SEQ ID NO: 693456 - RNA, 19 nt, Human
acacacgcccccgcgggug

SEQ ID NO: 693457 - RNA, 24 nt, Human
acagggauaaaucaaaagacaaaa

SEQ ID NO: 693458 - RNA, 24 nt, Human
accagggcacaaaagcccagccca

SEQ ID NO: 693459 - RNA, 20 nt, Human
acccgccacccaggccccgg

SEQ ID NO: 693460 - RNA, 19 nt, Human
acccggcauccagcucaga

SEQ ID NO: 693461 - RNA, 22 nt, Human
accugggcugccgcauggccuc

SEQ ID NO: 693462 - RNA, 26 nt, Human
acggcagugaaagcaagcgaugcgcc

SEQ ID NO: 693463 - RNA, 19 nt, Human
agaaauggaggguccccuc

SEQ ID NO: 693464 - RNA, 21 nt, Human
agcaggaggcuccacucugcc

SEQ ID NO: 693465 - RNA, 20 nt, Human
agcugguuuugguucgucuc

SEQ ID NO: 693466 - RNA, 22 nt, Human
aggcagggaggaggagaggcag

SEQ ID NO: 693467 - RNA, 19 nt, Human
agggaggaggagaggcagu

SEQ ID NO: 693468 - RNA, 20 nt, Human
agggggagaaauggaggguc

SEQ ID NO: 693469 - RNA, 23 nt, Human
agggucagaggccaaagaaagcc

SEQ ID NO: 693470 - RNA, 20 nt, Human
aguccccaggagccagcacc

SEQ ID NO: 693471 - RNA, 23 nt, Human
auaaaucaaaagacaaaaucucc

SEQ ID NO: 693472 - RNA, 20 nt, Human
auacaccaccucccccaagc

SEQ ID NO: 693473 - RNA, 19 nt, Human
aucaaaagacaaaaucucc

SEQ ID NO: 693474 - RNA, 24 nt, Human
aucauucccccuucaucuacaacc

SEQ ID NO: 693475 - RNA, 20 nt, Human
caaaagacaaaaucucccca

SEQ ID NO: 693476 - RNA, 21 nt, Human
caaaaucuccccaucucacag

SEQ ID NO: 693477 - RNA, 20 nt, Human
caacaccagaagagaagcaa

SEQ ID NO: 693478 - RNA, 22 nt, Human
caacccuaggccaaguccuccu

SEQ ID NO: 693479 - RNA, 22 nt, Human
caagccccaccacacacacgcc

SEQ ID NO: 693480 - RNA, 22 nt, Human
caauaaaugcaaccuggcuccu

SEQ ID NO: 693481 - RNA, 18 nt, Human
cacagcccuaccggcccc

SEQ ID NO: 693482 - RNA, 21 nt, Human
cacagcccuaccggccccagc

SEQ ID NO: 693483 - RNA, 20 nt, Human
caccacacacacgcccccgc

SEQ ID NO: 693484 - RNA, 21 nt, Human
caccaccucccccaagcggga

SEQ ID NO: 693485 - RNA, 20 nt, Human
caccacucccucccuggcca

SEQ ID NO: 693486 - RNA, 19 nt, Human
caccagaagagaagcaacg

SEQ ID NO: 693487 - RNA, 19 nt, Human
caccccccacccugggcuu

SEQ ID NO: 693488 - RNA, 19 nt, Human
cacccgccacccaggcccc

SEQ ID NO: 693489 - RNA, 24 nt, Human
cacccgccacccaggccccggcuc

SEQ ID NO: 693490 - RNA, 25 nt, Human
cacccggcuagccuccccagaagau

SEQ ID NO: 693491 - RNA, 22 nt, Human
cacccugggcuucaccagggac

SEQ ID NO: 693492 - RNA, 18 nt, Human
cacucccucccuggccac

SEQ ID NO: 693493 - RNA, 18 nt, Human
cacugggcuccccaggca

SEQ ID NO: 693494 - RNA, 20 nt, Human
cagaaaugaggccgggcaca

SEQ ID NO: 693495 - RNA, 22 nt, Human
cagagagaaugggagggaggaa

SEQ ID NO: 693496 - RNA, 23 nt, Human
cagaggccaaagaaagccauaca

SEQ ID NO: 693497 - RNA, 19 nt, Human
cagcaaaucccaaguccac

SEQ ID NO: 693498 - RNA, 19 nt, Human
cagcaacacagguggcaga

SEQ ID NO: 693499 - RNA, 24 nt, Human
cagcagggucagaggccaaagaaa

SEQ ID NO: 693500 - RNA, 19 nt, Human
cagcaugcagaccugggcu

SEQ ID NO: 693501 - RNA, 21 nt, Human
cagcccaaaccacuaaugccc

SEQ ID NO: 693502 - RNA, 24 nt, Human
cagcggcaugccuggagcuggagc

SEQ ID NO: 693503 - RNA, 18 nt, Human
caggaggcuccacucugc

SEQ ID NO: 693504 - RNA, 23 nt, Human
cagggcacaaaagcccagcccaa

SEQ ID NO: 693505 - RNA, 22 nt, Human
cauacaccaccucccccaagcu

SEQ ID NO: 693506 - RNA, 20 nt, Human
caucagcaacacagguggca

SEQ ID NO: 693507 - RNA, 24 nt, Human
caugccaagccccaccacacacac

SEQ ID NO: 693508 - RNA, 24 nt, Human
caugccuggagcuggagcugccau

SEQ ID NO: 693509 - RNA, 21 nt, Human
cauggccucucccugagcccu

SEQ ID NO: 693510 - RNA, 23 nt, Human
ccaaacacccaaggaagagggag

SEQ ID NO: 693511 - RNA, 18 nt, Human
ccaagccccaccacacac

SEQ ID NO: 693512 - RNA, 24 nt, Human
ccacccggcccccacccgccaccc

SEQ ID NO: 693513 - RNA, 20 nt, Human
ccaccucccacccggccccc

SEQ ID NO: 693514 - RNA, 24 nt, Human
ccacugcccugacaccccccaccc

SEQ ID NO: 693515 - RNA, 19 nt, Human
ccacugggcuccccaggca

SEQ ID NO: 693516 - RNA, 23 nt, Human
ccagcccaaaccacuaaugcccc

SEQ ID NO: 693517 - RNA, 19 nt, Human
cccacacuccucagcuuuc

SEQ ID NO: 693518 - RNA, 22 nt, Human
cccacccgccacccaggccccg

SEQ ID NO: 693519 - RNA, 21 nt, Human
cccacccggcccccacccgcc

SEQ ID NO: 693520 - RNA, 18 nt, Human
cccacccggcuagccucc

SEQ ID NO: 693521 - RNA, 22 nt, Human
ccccaccacacacacgcccccg

SEQ ID NO: 693522 - RNA, 20 nt, Human
ccccacccgccacccaggcc

SEQ ID NO: 693523 - RNA, 21 nt, Human
ccccacccgccacccaggccc

SEQ ID NO: 693524 - RNA, 25 nt, Human
ccccagaagaucucacagcccuacc

SEQ ID NO: 693525 - RNA, 19 nt, Human
ccccagcaucuuccucgcc

SEQ ID NO: 693526 - RNA, 22 nt, Human
ccccaggagccagcaccaaaca

SEQ ID NO: 693527 - RNA, 21 nt, Human
cccccacccgccacccaggcc

SEQ ID NO: 693528 - RNA, 28 nt, Human
cccccacccgccacccaggccccggcuc

SEQ ID NO: 693529 - RNA, 22 nt, Human
ccccuccacugcccugacaccc

SEQ ID NO: 693530 - RNA, 22 nt, Human
ccccuggaucugagcucagccc

SEQ ID NO: 693531 - RNA, 22 nt, Human
cccggcauccagcucagaacac

SEQ ID NO: 693532 - RNA, 19 nt, Human
cccuccuaucccaccucuu

SEQ ID NO: 693533 - RNA, 27 nt, Human
cccugacaccccccacccugggcuuca

SEQ ID NO: 693534 - RNA, 22 nt, Human
cccuggcuuguuccugggaccc

SEQ ID NO: 693535 - RNA, 21 nt, Human
ccuaucagcccugggcugagc

SEQ ID NO: 693536 - RNA, 23 nt, Human
ccucccacccggcccccacccgc

SEQ ID NO: 693537 - RNA, 24 nt, Human
ccuccccagaagaucucacagccc

SEQ ID NO: 693538 - RNA, 19 nt, Human
ccuccuaucccaccucuuc

SEQ ID NO: 693539 - RNA, 20 nt, Human
ccucgggccccuccacugcc

SEQ ID NO: 693540 - RNA, 26 nt, Human
ccugccagcccuacagggauaaauca

SEQ ID NO: 693541 - RNA, 22 nt, Human
ccugggaccccaggcugcccaa

SEQ ID NO: 693542 - RNA, 23 nt, Human
ccugggaccccaggcugcccaag

SEQ ID NO: 693543 - RNA, 19 nt, Human
cgagagggaggaggagugg

SEQ ID NO: 693544 - RNA, 19 nt, Human
cgagagggaggaggagugg

SEQ ID NO: 693545 - RNA, 20 nt, Human
cgccacauugaggccuucuc

SEQ ID NO: 693546 - RNA, 19 nt, Human
cggcccccacccgccaccc

SEQ ID NO: 693547 - RNA, 22 nt, Human
cguaaccauacaccaccucccc

SEQ ID NO: 693548 - RNA, 22 nt, Human
cuaaugccccuuggagcucccc

SEQ ID NO: 693549 - RNA, 21 nt, Human
cuaccggccccagcaucuucc

SEQ ID NO: 693550 - RNA, 24 nt, Human
cuagccuccccagaagaucucaca

SEQ ID NO: 693551 - RNA, 19 nt, Human
cucacagcccuaccggccu

SEQ ID NO: 693552 - RNA, 21 nt, Human
cuccaguggagcugccggcuc

SEQ ID NO: 693553 - RNA, 25 nt, Human
cuccccauccaauaaaugcaaccug

SEQ ID NO: 693554 - RNA, 23 nt, Human
cuccccaucucacagcgagugac

SEQ ID NO: 693555 - RNA, 20 nt, Human
cucccuggccacugggcucc

SEQ ID NO: 693556 - RNA, 21 nt, Human
cuccguaaccauacaccaccu

SEQ ID NO: 693557 - RNA, 21 nt, Human
cuccucgggccccuccacugc

SEQ ID NO: 693558 - RNA, 20 nt, Human
cucugccugcacugcucucc

SEQ ID NO: 693559 - RNA, 24 nt, Human
cugacaccccccacccugggcuuc

SEQ ID NO: 693560 - RNA, 23 nt, Human
cugaggcaacgagagggaggagg

SEQ ID NO: 693561 - RNA, 21 nt, Human
cuggcuccucgggccccucca

SEQ ID NO: 693562 - RNA, 24 nt, Human
cuuccagcauuucuucccccugga

SEQ ID NO: 693563 - RNA, 18 nt, Human
cuuccucgccacauugag

SEQ ID NO: 693564 - RNA, 18 nt, Human
gaagagagugcacaggcu

SEQ ID NO: 693565 - RNA, 22 nt, Human
gaaggaagaagggaguccuagc

SEQ ID NO: 693566 - RNA, 19 nt, Human
gaaggaaggaagaagggag

SEQ ID NO: 693567 - RNA, 18 nt, Human
gagccagcaccaaacacc

SEQ ID NO: 693568 - RNA, 25 nt, Human
gagccagcaccaaacacccaaggaa

SEQ ID NO: 693569 - RNA, 19 nt, Human
gcaagcuguggaggauggg

SEQ ID NO: 693570 - RNA, 22 nt, Human
gcaguccccuccuaucccaccu

SEQ ID NO: 693571 - RNA, 23 nt, Human
gccaccucccacccggcccccac

SEQ ID NO: 693572 - RNA, 22 nt, Human
gccccagcaucuuccucgccac

SEQ ID NO: 693573 - RNA, 22 nt, Human
gccugcacugcucuccagugga

SEQ ID NO: 693574 - RNA, 27 nt, Human
gccuugcccucgaagcucucugccagc

SEQ ID NO: 693575 - RNA, 19 nt, Human
gcuccguaaccauacacca

SEQ ID NO: 693576 - RNA, 23 nt, Human
ggagagcaggaggcuccacucug

SEQ ID NO: 693577 - RNA, 21 nt, Human
ggagcugccaucacaugccaa

SEQ ID NO: 693578 - RNA, 21 nt, Human
ggaguugcagagagaauggga

SEQ ID NO: 693579 - RNA, 19 nt, Human
ggaguuggaaagcaguucc

SEQ ID NO: 693580 - RNA, 21 nt, Human
ggcagugaaagcaagcgaugc

SEQ ID NO: 693581 - RNA, 20 nt, Human
ggcccccacccgccacccag

SEQ ID NO: 693582 - RNA, 18 nt, Human
ggccuggggagggaaacu

SEQ ID NO: 693583 - RNA, 28 nt, Human
ggccuugcccucgaagcucucugccagc

SEQ ID NO: 693584 - RNA, 21 nt, Human
ggcggggugacaggagagagc

SEQ ID NO: 693585 - RNA, 18 nt, Human
ggcuccccaggcagggag

SEQ ID NO: 693586 - RNA, 20 nt, Human
gggaaggaaggaagaaggga

SEQ ID NO: 693587 - RNA, 18 nt, Human
gggccccuccacugcccu

SEQ ID NO: 693588 - RNA, 18 nt, Human
ggggcggggugacaggag

SEQ ID NO: 693589 - RNA, 21 nt, Human
gggggucugcagcugguccag

SEQ ID NO: 693590 - RNA, 24 nt, Human
ggguguggggggccuggggaggga

SEQ ID NO: 693591 - RNA, 20 nt, Human
ggguugggggucugcagcug

SEQ ID NO: 693592 - RNA, 22 nt, Human
ggugagggggagaaauggaggg

SEQ ID NO: 693593 - RNA, 23 nt, Human
gguguggggggccuggggaggga

SEQ ID NO: 693594 - RNA, 19 nt, Human
gguugggggucugcagcug

SEQ ID NO: 693595 - RNA, 18 nt, Human
gugagggggagaaaugga

SEQ ID NO: 693596 - RNA, 21 nt, Human
guuacagcgacuggcuccacc

SEQ ID NO: 693597 - RNA, 18 nt, Human
uaaccauacaccaccucc

SEQ ID NO: 693598 - RNA, 23 nt, Human
uaaccauacaccaccucccccaa

SEQ ID NO: 693599 - RNA, 22 nt, Human
uaagacuacugccaccucccac

SEQ ID NO: 693600 - RNA, 18 nt, Human
uacaacccugccagcccu

SEQ ID NO: 693601 - RNA, 24 nt, Human
uacaagcagcggcaugccuggagc

SEQ ID NO: 693602 - RNA, 18 nt, Human
uacaccaccucccccaag

SEQ ID NO: 693603 - RNA, 22 nt, Human
uaccagggcacaaaagcccagc

SEQ ID NO: 693604 - RNA, 19 nt, Human
uagcaagacgugucagggg

SEQ ID NO: 693605 - RNA, 19 nt, Human
uagucugagggugagggca

SEQ ID NO: 693606 - RNA, 18 nt, Human
ucaaaagacaaaaucucc

SEQ ID NO: 693607 - RNA, 21 nt, Human
ucaaaagacaaaaucucccca

SEQ ID NO: 693608 - RNA, 22 nt, Human
ucaccucugccuagucugaggg

SEQ ID NO: 693609 - RNA, 21 nt, Human
ucaguguuacagcgacuggcu

SEQ ID NO: 693610 - RNA, 24 nt, Human
ucaguuuuauugacuuccagcauu

SEQ ID NO: 693611 - RNA, 19 nt, Human
uccccaggagccagcacca

SEQ ID NO: 693612 - RNA, 20 nt, Human
ucccccuucaucuacaaccc

SEQ ID NO: 693613 - RNA, 24 nt, Human
ucuacacucagcaugggugagggg

SEQ ID NO: 693614 - RNA, 19 nt, Human
ugaaucuggacagcugaga

SEQ ID NO: 693615 - RNA, 20 nt, Human
ugacaccccccacccugggg

SEQ ID NO: 693616 - RNA, 20 nt, Human
ugacuuccagcauuucuucc

SEQ ID NO: 693617 - RNA, 23 nt, Human
ugacuuccagcauuucuuccccc

SEQ ID NO: 693618 - RNA, 18 nt, Human
ugagaggcucccgcccca

SEQ ID NO: 693619 - RNA, 20 nt, Human
ugagggggagaaauggaggg

SEQ ID NO: 693620 - RNA, 19 nt, Human
ugcagagagaaugggaggg

SEQ ID NO: 693621 - RNA, 18 nt, Human
ugcccugacaccccccac

SEQ ID NO: 693622 - RNA, 24 nt, Human
ugcccugcccacucuaacccuggg

SEQ ID NO: 693623 - RNA, 26 nt, Human
ugccgcauggccucucccugagcccu

SEQ ID NO: 693624 - RNA, 18 nt, Human
uggaaagcaguuccuaca

SEQ ID NO: 693625 - RNA, 19 nt, Human
uggaggauggggcucagca

SEQ ID NO: 693626 - RNA, 20 nt, Human
uggagggagcuuggaguugg

SEQ ID NO: 693627 - RNA, 22 nt, Human
uggcacagaaaccaggguuggg

SEQ ID NO: 693628 - RNA, 24 nt, Human
uggcacagaaaccaggguuggggg

SEQ ID NO: 693629 - RNA, 19 nt, Human
uggcuccucgggccccucc

SEQ ID NO: 693630 - RNA, 20 nt, Human
ugggaccccaggcugcccaa

SEQ ID NO: 693631 - RNA, 23 nt, Human
ugggaccccaggcugcccaaggg

SEQ ID NO: 693632 - RNA, 23 nt, Human
uggggagggaaacuuguggaggg

SEQ ID NO: 693633 - RNA, 18 nt, Human
uggggggccuggggaggg

SEQ ID NO: 693634 - RNA, 20 nt, Human
ugggggucugcagcuggucc

SEQ ID NO: 693635 - RNA, 23 nt, Human
ugggguguggggggccuggggag

SEQ ID NO: 693636 - RNA, 22 nt, Human
uguuggaaagaaugggcagcag

SEQ ID NO: 693637 - RNA, 20 nt, Human
uucccccuucaucuacaacc

SEQ ID NO: 693638 - RNA, 19 nt, Human
uuccucgccacauugaggc

SEQ ID NO: 693639 - RNA, 23 nt, Human
uuccugggaccccaggcugccca

SEQ ID NO: 693640 - RNA, 18 nt, Human
uuggagcuccccauccaa

SEQ ID NO: 693641 - RNA, 21 nt, Human
uuuuuuuucucaaacucaguu

SEQ ID NO: 693642 - RNA, 21 nt, Human
aucucuuaggaaacaaaagcu

SEQ ID NO: 693643 - RNA, 21 nt, Human
cuaaccucaaaguacggcaug

SEQ ID NO: 693644 - RNA, 25 nt, Human
uaagugcaagaaguauuuucauucc

SEQ ID NO: 693645 - RNA, 23 nt, Human
ucagaacauuacaagaggcauga

SEQ ID NO: 693646 - RNA, 22 nt, Human
ucagacuaaccucaaaguacgg

SEQ ID NO: 693647 - RNA, 21 nt, Human
ugaaagaaaaaauaauuccau

SEQ ID NO: 693648 - RNA, 19 nt, Human
uuaauacuuucaucauuca

SEQ ID NO: 693649 - RNA, 23 nt, Human
uuuuuuuuuuuuuuuuuuacuga

SEQ ID NO: 693650 - RNA, 24 nt, Human
aaaaaaaacaaaaaaaaaccguau

SEQ ID NO: 693651 - RNA, 23 nt, Human
aaaaagaaagugaagucuuuaau

SEQ ID NO: 693652 - RNA, 20 nt, Human
aaacaccccagcagccccuc

SEQ ID NO: 693653 - RNA, 22 nt, Human
aaacuaaugaggaacaaaacaa

SEQ ID NO: 693654 - RNA, 19 nt, Human
aaagcgcugggauuauagg

SEQ ID NO: 693655 - RNA, 24 nt, Human
aaagcgcugggauuauagguguga

SEQ ID NO: 693656 - RNA, 19 nt, Human
aacauggauaaaccccauc

SEQ ID NO: 693657 - RNA, 20 nt, Human
aacauggauaaaccccaucu

SEQ ID NO: 693658 - RNA, 21 nt, Human
aacauggauaaaccccaucuc

SEQ ID NO: 693659 - RNA, 20 nt, Human
aacuuuuuuuuuuuuuugaa

SEQ ID NO: 693660 - RNA, 21 nt, Human
aagcaaauguuuuagagcuga

SEQ ID NO: 693661 - RNA, 25 nt, Human
aagcaauccuuucaccucagccucc

SEQ ID NO: 693662 - RNA, 22 nt, Human
aagcacuuugggaggccgaggc

SEQ ID NO: 693663 - RNA, 24 nt, Human
aagcacuuugggaggccgaggcgg

SEQ ID NO: 693664 - RNA, 26 nt, Human
aagcgcugggauuauaggugugagcc

SEQ ID NO: 693665 - RNA, 24 nt, Human
aaucacuugaacccaggaggcaga

SEQ ID NO: 693666 - RNA, 19 nt, Human
acaaaaaaaaaccguauag

SEQ ID NO: 693667 - RNA, 20 nt, Human
acaagagcgaaacuccgucu

SEQ ID NO: 693668 - RNA, 21 nt, Human
acaagagcgaaacuccgucuc

SEQ ID NO: 693669 - RNA, 22 nt, Human
accauugcacuccagccugggc

SEQ ID NO: 693670 - RNA, 24 nt, Human
accccaucucuacuaaaaauacaa

SEQ ID NO: 693671 - RNA, 23 nt, Human
accucagccuccugaguaucugg

SEQ ID NO: 693672 - RNA, 24 nt, Human
accugaggucaggaguucaagacc

SEQ ID NO: 693673 - RNA, 19 nt, Human
acugcacugagauuccggc

SEQ ID NO: 693674 - RNA, 25 nt, Human
acugcagccuugaccucccuggcuc

SEQ ID NO: 693675 - RNA, 20 nt, Human
agacaacaggcuuaacugca

SEQ ID NO: 693676 - RNA, 24 nt, Human
agagcuugcagugagccgagaucg

SEQ ID NO: 693677 - RNA, 21 nt, Human
agcaauccuccaaccucagcc

SEQ ID NO: 693678 - RNA, 23 nt, Human
agcacuuugggaggccgaggcgg

SEQ ID NO: 693679 - RNA, 24 nt, Human
agcacuuugggaggccgaggcggg

SEQ ID NO: 693680 - RNA, 18 nt, Human
agcgcugggauuauaggu

SEQ ID NO: 693681 - RNA, 24 nt, Human
aggaaaaggcaguuuuaggaugua

SEQ ID NO: 693682 - RNA, 23 nt, Human
aggaggcugaggcaggagaauca

SEQ ID NO: 693683 - RNA, 21 nt, Human
aggcagagcuugcagugagcc

SEQ ID NO: 693684 - RNA, 24 nt, Human
aggcagagcuugcagugagccgag

SEQ ID NO: 693685 - RNA, 18 nt, Human
aggcaggagaaucacuug

SEQ ID NO: 693686 - RNA, 23 nt, Human
aggcaggagaaucacuugaaccc

SEQ ID NO: 693687 - RNA, 24 nt, Human
aggcaggagaaucacuugaaccca

SEQ ID NO: 693688 - RNA, 21 nt, Human
aggccgaggcgggcggaucac

SEQ ID NO: 693689 - RNA, 22 nt, Human
aggcgggcggaucaccugaggu

SEQ ID NO: 693690 - RNA, 26 nt, Human
aggcgggcggaucaccugaggucagg

SEQ ID NO: 693691 - RNA, 24 nt, Human
aggcugaggcaggagaaucacuug

SEQ ID NO: 693692 - RNA, 18 nt, Human
aggcuggagugcaguggc

SEQ ID NO: 693693 - RNA, 22 nt, Human
agugcaguggccuuucacggcu

SEQ ID NO: 693694 - RNA, 23 nt, Human
agugcaguggccuuucacggcuc

SEQ ID NO: 693695 - RNA, 24 nt, Human
aucaccugaggucaggaguucaag

SEQ ID NO: 693696 - RNA, 24 nt, Human
aucgcaccauugcacuccagccug

SEQ ID NO: 693697 - RNA, 28 nt, Human
aucgcaccauugcacuccagccugggca

SEQ ID NO: 693698 - RNA, 23 nt, Human
auggcgggugucuguaaucccag

SEQ ID NO: 693699 - RNA, 23 nt, Human
augugcuagaagaauuccaaacu

SEQ ID NO: 693700 - RNA, 24 nt, Human
auugcacuccagccugggcaacaa

SEQ ID NO: 693701 - RNA, 31 nt, Human
caaaaaaaaaaaacaaaaaaaaaccguauag

SEQ ID NO: 693702 - RNA, 20 nt, Human
caaaaaaaaaccguauaggu

SEQ ID NO: 693703 - RNA, 19 nt, Human
caaaacuuuacauagaugu

SEQ ID NO: 693704 - RNA, 24 nt, Human
caaagcgcugggauuauaggugug

SEQ ID NO: 693705 - RNA, 18 nt, Human
caacauggauaaacccca

SEQ ID NO: 693706 - RNA, 22 nt, Human
caacauggauaaaccccaucuc

SEQ ID NO: 693707 - RNA, 27 nt, Human
caagcaauccuuucaccucagccuccu

SEQ ID NO: 693708 - RNA, 23 nt, Human
caccugaggucaggaguucaaga

SEQ ID NO: 693709 - RNA, 24 nt, Human
cacuccagccugggcaacaagagc

SEQ ID NO: 693710 - RNA, 25 nt, Human
cacuccagccugggcaacaagagcg

SEQ ID NO: 693711 - RNA, 20 nt, Human
cagaagcaggaacucuuccc

SEQ ID NO: 693712 - RNA, 20 nt, Human
cagccuccugaguaucuggg

SEQ ID NO: 693713 - RNA, 21 nt, Human
cagccuugaccucccuggcuc

SEQ ID NO: 693714 - RNA, 24 nt, Human
cagcuacucaggaggcugaggcag

SEQ ID NO: 693715 - RNA, 19 nt, Human
cagcuccgcaaaccgccga

SEQ ID NO: 693716 - RNA, 24 nt, Human
cagucgguguucaaaacaagggca

SEQ ID NO: 693717 - RNA, 22 nt, Human
cauacuggcacagacacagcua

SEQ ID NO: 693718 - RNA, 25 nt, Human
caucuccaccuuuugugcuugggga

SEQ ID NO: 693719 - RNA, 24 nt, Human
caugccuguaauccaagcacuuug

SEQ ID NO: 693720 - RNA, 18 nt, Human
cauggauaaaccccaucu

SEQ ID NO: 693721 - RNA, 24 nt, Human
cauguuacccaggcuggucuugaa

SEQ ID NO: 693722 - RNA, 24 nt, Human
cauucugucacucaggcuggagug

SEQ ID NO: 693723 - RNA, 19 nt, Human
cauugcacuccagccuggg

SEQ ID NO: 693724 - RNA, 21 nt, Human
cauugcacuccagccugggca

SEQ ID NO: 693725 - RNA, 23 nt, Human
cauugcacuccagccugggcaac

SEQ ID NO: 693726 - RNA, 20 nt, Human
cauuguggaaaaacugaaau

SEQ ID NO: 693727 - RNA, 21 nt, Human
ccaaagcgcugggauuauagg

SEQ ID NO: 693728 - RNA, 21 nt, Human
ccaaagcgcugggauuauagg

SEQ ID NO: 693729 - RNA, 24 nt, Human
ccaaagcgcugggauuauaggugu

SEQ ID NO: 693730 - RNA, 22 nt, Human
ccaaccucagccuccaaagcgc

SEQ ID NO: 693731 - RNA, 22 nt, Human
ccaagaaacuuuuuuuuuuuuu

SEQ ID NO: 693732 - RNA, 19 nt, Human
ccagcagccccucgcguuc

SEQ ID NO: 693733 - RNA, 20 nt, Human
ccauugcacuccagccuggg

SEQ ID NO: 693734 - RNA, 21 nt, Human
ccauugcacuccagccugggc

SEQ ID NO: 693735 - RNA, 23 nt, Human
ccauugcacuccagccugggcaa

SEQ ID NO: 693736 - RNA, 24 nt, Human
ccauugcacuccagccugggcaac

SEQ ID NO: 693737 - RNA, 25 nt, Human
ccauugcacuccagccugggcaaca

SEQ ID NO: 693738 - RNA, 23 nt, Human
cccaacccuuucaagggcagcaa

SEQ ID NO: 693739 - RNA, 19 nt, Human
cccacacagcugacagcca

SEQ ID NO: 693740 - RNA, 24 nt, Human
cccauguuacccaggcuggucuug

SEQ ID NO: 693741 - RNA, 24 nt, Human
ccccauguuacccaggcuggucuu

SEQ ID NO: 693742 - RNA, 27 nt, Human
ccccauguuacccaggcuggucuugaa

SEQ ID NO: 693743 - RNA, 19 nt, Human
cccuggcucaagcaauccu

SEQ ID NO: 693744 - RNA, 20 nt, Human
cccuggcucaagcaauccuu

SEQ ID NO: 693745 - RNA, 23 nt, Human
ccuccaaccucagccuccaaagc

SEQ ID NO: 693746 - RNA, 23 nt, Human
ccucgcguuccgcgcucggcccu

SEQ ID NO: 693747 - RNA, 24 nt, Human
ccugaccaacauggauaaacccca

SEQ ID NO: 693748 - RNA, 24 nt, Human
ccugaguaucugggacuacaggcu

SEQ ID NO: 693749 - RNA, 22 nt, Human
ccuguaauccaagcacuuuggg

SEQ ID NO: 693750 - RNA, 24 nt, Human
ccuguaauccaagcacuuugggag

SEQ ID NO: 693751 - RNA, 23 nt, Human
ccuuuuuuuuuuuuuuuuuuuaa

SEQ ID NO: 693752 - RNA, 24 nt, Human
cgaaacuccgucuccagaaaaaag

SEQ ID NO: 693753 - RNA, 20 nt, Human
cgaggcgggcggaucaccug

SEQ ID NO: 693754 - RNA, 24 nt, Human
cgaggcgggcggaucaccugaggu

SEQ ID NO: 693755 - RNA, 21 nt, Human
cgcaccauugcacuccagccu

SEQ ID NO: 693756 - RNA, 24 nt, Human
cggaucaccugaggucaggaguuc

SEQ ID NO: 693757 - RNA, 27 nt, Human
cggaucaccugaggucaggaguucaag

SEQ ID NO: 693758 - RNA, 24 nt, Human
cggcucacugcagccuugaccucc

SEQ ID NO: 693759 - RNA, 18 nt, Human
cgggcggaucaccugagg

SEQ ID NO: 693760 - RNA, 24 nt, Human
cgggcggaucaccugaggucagga

SEQ ID NO: 693761 - RNA, 24 nt, Human
cucaagcaauccuuucaccucagc

SEQ ID NO: 693762 - RNA, 23 nt, Human
cucauaguguacugguuuacauu

SEQ ID NO: 693763 - RNA, 24 nt, Human
cucaugccuguaauccaagcacuu

SEQ ID NO: 693764 - RNA, 24 nt, Human
cucauucugucacucaggcuggag

SEQ ID NO: 693765 - RNA, 24 nt, Human
cuccaaccucagccuccaaagcgc

SEQ ID NO: 693766 - RNA, 19 nt, Human
cucccacacagcugacagc

SEQ ID NO: 693767 - RNA, 20 nt, Human
cucccuggcucaagcaaucc

SEQ ID NO: 693768 - RNA, 21 nt, Human
cugaagagaacuccgcccagu

SEQ ID NO: 693769 - RNA, 19 nt, Human
cugaauuuuuccuuuuuuu

SEQ ID NO: 693770 - RNA, 21 nt, Human
cugggauuauaggugugagcc

SEQ ID NO: 693771 - RNA, 18 nt, Human
cuguaaucccagcuacuc

SEQ ID NO: 693772 - RNA, 21 nt, Human
cuguaaucccagcuacucagg

SEQ ID NO: 693773 - RNA, 19 nt, Human
cuugcagugagccgagauc

SEQ ID NO: 693774 - RNA, 21 nt, Human
cuugcagugagccgagaucgc

SEQ ID NO: 693775 - RNA, 24 nt, Human
cuuuuuuuuuuuuuuuuuuuaagg

SEQ ID NO: 693776 - RNA, 18 nt, Human
gaaauaucuacacaaacg

SEQ ID NO: 693777 - RNA, 18 nt, Human
gaagagaacuccgcccag

SEQ ID NO: 693778 - RNA, 24 nt, Human
gacaaacaccccagcagccccucg

SEQ ID NO: 693779 - RNA, 23 nt, Human
gagaaucacuugaacccaggagg

SEQ ID NO: 693780 - RNA, 23 nt, Human
gagaucgcaccauugcacuccag

SEQ ID NO: 693781 - RNA, 25 nt, Human
gaggcgggcggaucaccugagguca

SEQ ID NO: 693782 - RNA, 18 nt, Human
gagggugguggcucccac

SEQ ID NO: 693783 - RNA, 21 nt, Human
gaucaccugaggucaggaguu

SEQ ID NO: 693784 - RNA, 23 nt, Human
gaucaccugaggucaggaguuca

SEQ ID NO: 693785 - RNA, 24 nt, Human
gaucaccugaggucaggaguucaa

SEQ ID NO: 693786 - RNA, 18 nt, Human
gauuauaggugugagcca

SEQ ID NO: 693787 - RNA, 21 nt, Human
gauuauaggugugagccacca

SEQ ID NO: 693788 - RNA, 22 nt, Human
gauuauaggugugagccaccac

SEQ ID NO: 693789 - RNA, 20 nt, Human
gcaccauugcacuccagccu

SEQ ID NO: 693790 - RNA, 22 nt, Human
gcaggagaaucacuugaaccca

SEQ ID NO: 693791 - RNA, 20 nt, Human
gcgggugucuguaaucccag

SEQ ID NO: 693792 - RNA, 18 nt, Human
gcugggugcgguggcuca

SEQ ID NO: 693793 - RNA, 22 nt, Human
gcugggugcgguggcucaugcc

SEQ ID NO: 693794 - RNA, 23 nt, Human
ggaucaccugaggucaggaguuc

SEQ ID NO: 693795 - RNA, 21 nt, Human
ggcggaucaccugaggucagg

SEQ ID NO: 693796 - RNA, 18 nt, Human
ggcuggucuugaacuccu

SEQ ID NO: 693797 - RNA, 20 nt, Human
ggcuuuucaaaaaaaaaaaa

SEQ ID NO: 693798 - RNA, 19 nt, Human
gggcuaguagaaaauuuca

SEQ ID NO: 693799 - RNA, 24 nt, Human
gggugcgguggcucaugccuguaa

SEQ ID NO: 693800 - RNA, 21 nt, Human
gguggcucaugccuguaaucc

SEQ ID NO: 693801 - RNA, 24 nt, Human
gguggcucaugccuguaauccaag

SEQ ID NO: 693802 - RNA, 20 nt, Human
gucuggacacugcacugaga

SEQ ID NO: 693803 - RNA, 26 nt, Human
uaaaaauacaaaauuagcugggugcc

SEQ ID NO: 693804 - RNA, 20 nt, Human
uaaauaauccucauauguac

SEQ ID NO: 693805 - RNA, 23 nt, Human
uaacugcaagagguuuacagaca

SEQ ID NO: 693806 - RNA, 24 nt, Human
uacccaggcuggucuugaacuccu

SEQ ID NO: 693807 - RNA, 20 nt, Human
uacuacaucuuagauucucu

SEQ ID NO: 693808 - RNA, 19 nt, Human
uacuagaaaaagaucaggc

SEQ ID NO: 693809 - RNA, 22 nt, Human
uacuagaaaaagaucaggccuc

SEQ ID NO: 693810 - RNA, 24 nt, Human
uauaggugugagccaccacgcucu

SEQ ID NO: 693811 - RNA, 24 nt, Human
ucacucaggcuggagugcaguggc

SEQ ID NO: 693812 - RNA, 19 nt, Human
ucacugcagccuugaccuc

SEQ ID NO: 693813 - RNA, 24 nt, Human
ucacugcagccuugaccucccugg

SEQ ID NO: 693814 - RNA, 25 nt, Human
ucacugcagccuugaccucccuggc

SEQ ID NO: 693815 - RNA, 22 nt, Human
ucauucugucacucaggcugga

SEQ ID NO: 693816 - RNA, 24 nt, Human
ucauucugucacucaggcuggagu

SEQ ID NO: 693817 - RNA, 23 nt, Human
uccaaagcgcugggauuauaggu

SEQ ID NO: 693818 - RNA, 19 nt, Human
uccauaacccagacugagc

SEQ ID NO: 693819 - RNA, 20 nt, Human
ucccagagagggugguggcu

SEQ ID NO: 693820 - RNA, 24 nt, Human
ucccuggcucaagcaauccuuuca

SEQ ID NO: 693821 - RNA, 24 nt, Human
uccgcaaaccgccgaggaaaaccc

SEQ ID NO: 693822 - RNA, 19 nt, Human
uccuccaaccucagccucc

SEQ ID NO: 693823 - RNA, 24 nt, Human
uccugaguaucugggacuacaggc

SEQ ID NO: 693824 - RNA, 18 nt, Human
uccuuuuuuuuuuuuuuu

SEQ ID NO: 693825 - RNA, 18 nt, Human
uccuuuuuuuuuuuuuuu

SEQ ID NO: 693826 - RNA, 23 nt, Human
ucgcaccauugcacuccagccug

SEQ ID NO: 693827 - RNA, 31 nt, Human; identical to SEQ ID NO: 515949

SEQ ID NO: 693828 - RNA, 23 nt, Human
ucucauucugucacucaggcugg

SEQ ID NO: 693829 - RNA, 24 nt, Human
ucucauucugucacucaggcugga

SEQ ID NO: 693830 - RNA, 20 nt, Human
ucucuacuaaaaauacaaaa

SEQ ID NO: 693831 - RNA, 24 nt, Human
ucugaaauaucuacacaaacguga

SEQ ID NO: 693832 - RNA, 21 nt, Human
ucuguaaucccagcuacucag

SEQ ID NO: 693833 - RNA, 24 nt, Human
ucugucacucaggcuggagugcag

SEQ ID NO: 693834 - RNA, 28 nt, Human
ucuuacagacuacaacagacaacaggcu

SEQ ID NO: 693835 - RNA, 23 nt, Human
ucuugaacuccuggacuuaagca

SEQ ID NO: 693836 - RNA, 24 nt, Human
ucuugcugggugcgguggcucaug

SEQ ID NO: 693837 - RNA, 24 nt, Human
ugaacuccuggacuuaagcaaucc

SEQ ID NO: 693838 - RNA, 22 nt, Human
ugagacaaggucucauucuguc

SEQ ID NO: 693839 - RNA, 22 nt, Human
ugagccgagaucgcaccauugc

SEQ ID NO: 693840 - RNA, 20 nt, Human
ugaggcaggagaaucacuug

SEQ ID NO: 693841 - RNA, 24 nt, Human
ugaggcaggagaaucacuugaacc

SEQ ID NO: 693842 - RNA, 25 nt, Human
ugaggcaggagaaucacuugaaccc

SEQ ID NO: 693843 - RNA, 19 nt, Human
ugcacuccagccugggcaa

SEQ ID NO: 693844 - RNA, 22 nt, Human
ugcacuccagccugggcaacaa

SEQ ID NO: 693845 - RNA, 22 nt, Human
ugcaguggccuuucacggcuca

SEQ ID NO: 693846 - RNA, 23 nt, Human
ugccuguaauccaagcacuuugg

SEQ ID NO: 693847 - RNA, 22 nt, Human
ugcgacaaacaccccagcagcc

SEQ ID NO: 693848 - RNA, 20 nt, Human
uggacuuaagcaauccucca

SEQ ID NO: 693849 - RNA, 18 nt, Human
uggagugcaguggccuuu

SEQ ID NO: 693850 - RNA, 23 nt, Human
uggagugcaguggccuuucacgg

SEQ ID NO: 693851 - RNA, 21 nt, Human
uggcgggugucuguaauccca

SEQ ID NO: 693852 - RNA, 24 nt, Human
uggcgggugucuguaaucccagcu

SEQ ID NO: 693853 - RNA, 24 nt, Human
uggcucaugccuguaauccaagca

SEQ ID NO: 693854 - RNA, 21 nt, Human
ugggacuacaggcuuguucca

SEQ ID NO: 693855 - RNA, 19 nt, Human
ugggaggccgaggcgggcg

SEQ ID NO: 693856 - RNA, 24 nt, Human
ugggaggccgaggcgggcggauca

SEQ ID NO: 693857 - RNA, 18 nt, Human
ugggauuauaggugugag

SEQ ID NO: 693858 - RNA, 19 nt, Human
ugggauuauaggugugagc

SEQ ID NO: 693859 - RNA, 22 nt, Human
ugggauuauaggugugagccac

SEQ ID NO: 693860 - RNA, 23 nt, Human
ugggauuauaggugugagccacc

SEQ ID NO: 693861 - RNA, 24 nt, Human
ugggauuauaggugugagccacca

SEQ ID NO: 693862 - RNA, 22 nt, Human
ugggugcgguggcucaugccug

SEQ ID NO: 693863 - RNA, 21 nt, Human
ugguggcucccacacagcuga

SEQ ID NO: 693864 - RNA, 21 nt, Human
uguaagcaaauguuuuagagc

SEQ ID NO: 693865 - RNA, 19 nt, Human
ugucaaagagaguauagga

SEQ ID NO: 693866 - RNA, 24 nt, Human
ugucuguaaucccagcuacucagg

SEQ ID NO: 693867 - RNA, 24 nt, Human
uuagagcugaauuuuuccuuuuuu

SEQ ID NO: 693868 - RNA, 23 nt, Human
uuccaccccauguuacccaggcu

SEQ ID NO: 693869 - RNA, 18 nt, Human
uugcagugagccgagauc

SEQ ID NO: 693870 - RNA, 19 nt, Human
uugcagugagccgagaucg

SEQ ID NO: 693871 - RNA, 22 nt, Human
uugcagugagccgagaucgcac

SEQ ID NO: 693872 - RNA, 25 nt, Human
uugggaggccgaggcgggcggauca

SEQ ID NO: 693873 - RNA, 19 nt, Human
uugugcuuggggaaugugu

SEQ ID NO: 693874 - RNA, 24 nt, Human
uuucaaaaaaaaaaaacaaaaaaa

SEQ ID NO: 693875 - RNA, 25 nt, Human
uuucaaaaaaaaaaaacaaaaaaaa

SEQ ID NO: 693876 - RNA, 26 nt, Human
uuucaaaaaaaaaaaacaaaaaaaaa

SEQ ID NO: 693877 - RNA, 23 nt, Human
uuuuagagcugaauuuuuccuuu

SEQ ID NO: 693878 - RNA, 21 nt, Human
uuuucaacuucuccauaaccc

SEQ ID NO: 693879 - RNA, 20 nt, Human
uuuuuuuuuuugagacaagg

SEQ ID NO: 693880 - RNA, 23 nt, Human
uuuuuuuuuuuugagacaagguc

SEQ ID NO: 693881 - RNA, 26 nt, Human
uuuuuuuuuuuugagacaaggucuca

SEQ ID NO: 693882 - RNA, 23 nt, Human
aaagcaucauucccauuucacag

SEQ ID NO: 693883 - RNA, 21 nt, Human
aacagggcagcuccuggcccc

SEQ ID NO: 693884 - RNA, 19 nt, Human
acggggccgcuuggugagg

SEQ ID NO: 693885 - RNA, 21 nt, Human
agcccuuucccuucugugccc

SEQ ID NO: 693886 - RNA, 24 nt, Human
agucacacagcugugcagggggca

SEQ ID NO: 693887 - RNA, 22 nt, Human
auggaauguacccaggagcccc

SEQ ID NO: 693888 - RNA, 25 nt, Human
cagcugguuuucucugccacgaccu

SEQ ID NO: 693889 - RNA, 21 nt, Human
caggagccccuaaucccccau

SEQ ID NO: 693890 - RNA, 23 nt, Human
cauucccauuucacagauaaggg

SEQ ID NO: 693891 - RNA, 23 nt, Human
ccauggagacucugcacggcccc

SEQ ID NO: 693892 - RNA, 22 nt, Human
ccuccucacaaccccauggaga

SEQ ID NO: 693893 - RNA, 24 nt, Human
cuggaguggaguccagguugggcu

SEQ ID NO: 693894 - RNA, 21 nt, Human
cugugcagggggcaaaccugg

SEQ ID NO: 693895 - RNA, 21 nt, Human
cuuucugaguuaagccaggga

SEQ ID NO: 693896 - RNA, 21 nt, Human
gcagggggcaaaccuggagug

SEQ ID NO: 693897 - RNA, 19 nt, Human
gccccggcucuuucugagu

SEQ ID NO: 693898 - RNA, 21 nt, Human
uaagccagggacugaaauggg

SEQ ID NO: 693899 - RNA, 25 nt, Human
uaagggggacugaggcucagcagug

SEQ ID NO: 693900 - RNA, 23 nt, Human
uacaaggaaagcaucauucccau

SEQ ID NO: 693901 - RNA, 19 nt, Human
uauuaacagggcagcuccu

SEQ ID NO: 693902 - RNA, 19 nt, Human
ucaauggaauguacccagg

SEQ ID NO: 693903 - RNA, 22 nt, Human
ucagcagucuucuugucccacu

SEQ ID NO: 693904 - RNA, 23 nt, Human
uccucacaaccccauggagacuc

SEQ ID NO: 693905 - RNA, 23 nt, Human
ucucaauggaauguacccaggag

SEQ ID NO: 693906 - RNA, 19 nt, Human
ucugccacgaccugaaguc

SEQ ID NO: 693907 - RNA, 22 nt, Human
ucugguuccaucuucccacgcc

SEQ ID NO: 693908 - RNA, 18 nt, Human
ucuucggcaucacucguu

SEQ ID NO: 693909 - RNA, 20 nt, Human
ugcucucccgcugucucaau

SEQ ID NO: 693910 - RNA, 23 nt, Human
ugcucugcucucccgcugucuca

SEQ ID NO: 693911 - RNA, 20 nt, Human
uggugagggcugcggaugcc

SEQ ID NO: 693912 - RNA, 24 nt, Human
ugugcagccccggcucuuucugag

SEQ ID NO: 693913 - RNA, 23 nt, Human
uucccuucugugcccuccucaca

SEQ ID NO: 693914 - RNA, 18 nt, Human
uuuauaaagcccuuuccc

SEQ ID NO: 693915 - RNA, 24 nt, Human
uuuugcucugcucguucgaauugu

SEQ ID NO: 693916 - RNA, 21 nt, Human
aaaaaaccuugaagcaucuga

SEQ ID NO: 693917 - RNA, 22 nt, Human
aaaaacaaacaaaacaggccug

SEQ ID NO: 693918 - RNA, 19 nt, Human
aaacaaacaaacaaacagg

SEQ ID NO: 693919 - RNA, 21 nt, Human
aaacaaacaaacaaacaggcc

SEQ ID NO: 693920 - RNA, 21 nt, Human
aaacaaacaaacaggccaggc

SEQ ID NO: 693921 - RNA, 25 nt, Human
aaacaggccaggcacagugguucac

SEQ ID NO: 693922 - RNA, 24 nt, Human
aaacuguuggagaguaugaccugg

SEQ ID NO: 693923 - RNA, 23 nt, Human
aaaguggcauuuuguugguuguu

SEQ ID NO: 693924 - RNA, 23 nt, Human
aacacuugaauccaggaggcaga

SEQ ID NO: 693925 - RNA, 19 nt, Human
aacauggcgaaaccccauc

SEQ ID NO: 693926 - RNA, 20 nt, Human
aacauggcgaaaccccaucu

SEQ ID NO: 693927 - RNA, 21 nt, Human
aacauggcgaaaccccaucuc

SEQ ID NO: 693928 - RNA, 21 nt, Human
aacauggcgaaaccccaucuc

SEQ ID NO: 693929 - RNA, 20 nt, Human
aacauggugaaaccccaugu

SEQ ID NO: 693930 - RNA, 20 nt, Human
aacauggugaaaccccaugu

SEQ ID NO: 693931 - RNA, 21 nt, Human
aacauggugaaaccccauguc

SEQ ID NO: 693932 - RNA, 22 nt, Human
aacauggugaaaccccaugucu

SEQ ID NO: 693933 - RNA, 21 nt, Human
aagcaucugacagaggaaacg

SEQ ID NO: 693934 - RNA, 19 nt, Human
acaaaaacaaacaaaacag

SEQ ID NO: 693935 - RNA, 21 nt, Human
acaaaaacaaacaaaacaggc

SEQ ID NO: 693936 - RNA, 21 nt, Human
acaaacaaaaaaacaauugug

SEQ ID NO: 693937 - RNA, 23 nt, Human
acagaggaaacguacuccagagc

SEQ ID NO: 693938 - RNA, 23 nt, Human
acauacaguuuucugaaaguggc

SEQ ID NO: 693939 - RNA, 19 nt, Human
acaucuguaauccuagcac

SEQ ID NO: 693940 - RNA, 19 nt, Human
acucugcaucucaaacaaa

SEQ ID NO: 693941 - RNA, 23 nt, Human
acuuuguucaguguuccuuucua

SEQ ID NO: 693942 - RNA, 24 nt, Human
agagaguuugcucugggaccugga

SEQ ID NO: 693943 - RNA, 19 nt, Human
agcaaaaaaaaaaaaaaaa

SEQ ID NO: 693944 - RNA, 24 nt, Human
agcacuuucggaggccgagguggg

SEQ ID NO: 693945 - RNA, 19 nt, Human
agcacuuugggaggucggg

SEQ ID NO: 693946 - RNA, 22 nt, Human
agccugggcaacauggcgaaac

SEQ ID NO: 693947 - RNA, 24 nt, Human
agccugggcaacauggcgaaaccc

SEQ ID NO: 693948 - RNA, 19 nt, Human
agccugggcaacaugguga

SEQ ID NO: 693949 - RNA, 22 nt, Human
agccugggcaacauggugaaac

SEQ ID NO: 693950 - RNA, 24 nt, Human
agccugggcaacauggugaaaccc

SEQ ID NO: 693951 - RNA, 23 nt, Human
agccuguaaucccagcacuuugg

SEQ ID NO: 693952 - RNA, 24 nt, Human
agccuguaaucccagcacuuuggg

SEQ ID NO: 693953 - RNA, 21 nt, Human
aggaauuugagauuagccugg

SEQ ID NO: 693954 - RNA, 24 nt, Human
aggcacagugguucacaucuguaa

SEQ ID NO: 693955 - RNA, 20 nt, Human
aggcagagguuacaguaagc

SEQ ID NO: 693956 - RNA, 21 nt, Human
aggccgaggugggcagaucgc

SEQ ID NO: 693957 - RNA, 19 nt, Human
aggccucaucuguacccaa

SEQ ID NO: 693958 - RNA, 18 nt, Human
aggcucugcuuuauccug

SEQ ID NO: 693959 - RNA, 26 nt, Human
aggcucugcuuuauccuggugggggg

SEQ ID NO: 693960 - RNA, 26 nt, Human
aggugggcagaucgcuuuagcucagg

SEQ ID NO: 693961 - RNA, 24 nt, Human
agugguucacaucuguaauccuag

SEQ ID NO: 693962 - RNA, 21 nt, Human
aguguccccucagcaggcagc

SEQ ID NO: 693963 - RNA, 24 nt, Human
caaaacaggccuggcacgguggcu

SEQ ID NO: 693964 - RNA, 23 nt, Human
caaacaaacaaaaaaacaauugu

SEQ ID NO: 693965 - RNA, 23 nt, Human
caaaggccuguggacaauaacug

SEQ ID NO: 693966 - RNA, 25 nt, Human
caacacgaacagauauugguccuca

SEQ ID NO: 693967 - RNA, 24 nt, Human
caacauggcgaaaccccaucucuc

SEQ ID NO: 693968 - RNA, 24 nt, Human
caacauggugaaaccccaugucua

SEQ ID NO: 693969 - RNA, 24 nt, Human
caagccuguaaucccagcacuuug

SEQ ID NO: 693970 - RNA, 28 nt, Human
caauaacugccucagcaaaaaaaaaaaa

SEQ ID NO: 693971 - RNA, 20 nt, Human
cacaucuguaauccuagcac

SEQ ID NO: 693972 - RNA, 23 nt, Human
cacaucuguaauccuagcacuuu

SEQ ID NO: 693973 - RNA, 20 nt, Human
caccgugagcugccccuguu

SEQ ID NO: 693974 - RNA, 20 nt, Human
cacugcacucuagacucugc

SEQ ID NO: 693975 - RNA, 27 nt, Human
cacuuauaucucaagacuuuucaaggg

SEQ ID NO: 693976 - RNA, 25 nt, Human
cagagccaccgugagcugccccugu

SEQ ID NO: 693977 - RNA, 24 nt, Human
cagaucacuugaggucgggagguc

SEQ ID NO: 693978 - RNA, 24 nt, Human
cagaucgcuuuagcucaggaauuu

SEQ ID NO: 693979 - RNA, 24 nt, Human
cagcacuuugggaggucggggcag

SEQ ID NO: 693980 - RNA, 25 nt, Human
cagcacuuugggaggucggggcagg

SEQ ID NO: 693981 - RNA, 22 nt, Human
cagccccgaggccucaucugua

SEQ ID NO: 693982 - RNA, 21 nt, Human
cagcuggaggcucccaggcau

SEQ ID NO: 693983 - RNA, 23 nt, Human
caggccaggcacagugguucaca

SEQ ID NO: 693984 - RNA, 20 nt, Human
caucucaaacaaacaaaaaa

SEQ ID NO: 693985 - RNA, 24 nt, Human
caucuguaauccuagcacuuucgg

SEQ ID NO: 693986 - RNA, 21 nt, Human
ccaacccaggguuguagagug

SEQ ID NO: 693987 - RNA, 21 nt, Human
ccaccaagcccagccuggaca

SEQ ID NO: 693988 - RNA, 20 nt, Human
ccacugcacucuagacucug

SEQ ID NO: 693989 - RNA, 20 nt, Human
ccacugcacucuagacucug

SEQ ID NO: 693990 - RNA, 21 nt, Human
ccacugcacucuagacucugc

SEQ ID NO: 693991 - RNA, 21 nt, Human
ccacugcacucuagacucugg

SEQ ID NO: 693992 - RNA, 24 nt, Human
ccacuggauccaacccaggguugu

SEQ ID NO: 693993 - RNA, 19 nt, Human
ccaguuauaaaaacaaagc

SEQ ID NO: 693994 - RNA, 18 nt, Human
ccccaguccugcuuuccc

SEQ ID NO: 693995 - RNA, 22 nt, Human
cccgcccuggccugaggcuggc

SEQ ID NO: 693996 - RNA, 21 nt, Human
ccgaggccucaucuguaccca

SEQ ID NO: 693997 - RNA, 22 nt, Human
ccucagcaaaaaaaaaaaaaaa

SEQ ID NO: 693998 - RNA, 20 nt, Human
ccugcuuucccgcccuggcc

SEQ ID NO: 693999 - RNA, 22 nt, Human
ccugggacugaaacuguggagc

SEQ ID NO: 694000 - RNA, 24 nt, Human
ccugggcaacauggcgaaacccca

SEQ ID NO: 694001 - RNA, 24 nt, Human
ccugggcaacauggugaaacccca

SEQ ID NO: 694002 - RNA, 18 nt, Human
cgaggugggcagaucgcu

SEQ ID NO: 694003 - RNA, 26 nt, Human
cgaggugggcagaucgcuuuagcuca

SEQ ID NO: 694004 - RNA, 28 nt, Human
cucaagacuuuucaagggcugacccuuu

SEQ ID NO: 694005 - RNA, 24 nt, Human
cucaagccuguaaucccagcacuu

SEQ ID NO: 694006 - RNA, 24 nt, Human
cucagcaaaaaaaaaaaaaaaaaa

SEQ ID NO: 694007 - RNA, 22 nt, Human
cucucuacaaaaacaaacaaaa

SEQ ID NO: 694008 - RNA, 24 nt, Human
cucucuacaaaaacaaacaaaaca

SEQ ID NO: 694009 - RNA, 19 nt, Human
cugcaccucaucuccucaa

SEQ ID NO: 694010 - RNA, 24 nt, Human
gaaaguggcauuuuguugguuguu

SEQ ID NO: 694011 - RNA, 23 nt, Human
gacaauaacugccucagcaaaaa

SEQ ID NO: 694012 - RNA, 25 nt, Human
gaccuggaaugagugauggagaaau

SEQ ID NO: 694013 - RNA, 23 nt, Human
gagcuugcaccacugcacucuag

SEQ ID NO: 694014 - RNA, 24 nt, Human
gaucacuugaggucgggaggucaa

SEQ ID NO: 694015 - RNA, 25 nt, Human
gaucgcuuuagcucaggaauuugag

SEQ ID NO: 694016 - RNA, 18 nt, Human
gaugugaacacuuacucc

SEQ ID NO: 694017 - RNA, 23 nt, Human
gcaaaaaaaaaaaaaaaaaaaaa

SEQ ID NO: 694018 - RNA, 18 nt, Human
gcacagugguucacaucu

SEQ ID NO: 694019 - RNA, 19 nt, Human
gccucaucuguacccaaag

SEQ ID NO: 694020 - RNA, 19 nt, Human
ggaccuggaaugagugaug

SEQ ID NO: 694021 - RNA, 18 nt, Human
ggaggccgaggugggcag

SEQ ID NO: 694022 - RNA, 23 nt, Human
ggcacgguggcucaagccuguaa

SEQ ID NO: 694023 - RNA, 21 nt, Human
ggcagaucgcuuuagcucagg

SEQ ID NO: 694024 - RNA, 20 nt, Human
ggcaggcagaucacuugagg

SEQ ID NO: 694025 - RNA, 21 nt, Human
ggcaggcagaucacuugaggu

SEQ ID NO: 694026 - RNA, 25 nt, Human
ggcaggcagaucacuugaggucggg

SEQ ID NO: 694027 - RNA, 20 nt, Human
gggaggucggggcaggcaga

SEQ ID NO: 694028 - RNA, 21 nt, Human
gggcauuacagauuuuugaua

SEQ ID NO: 694029 - RNA, 22 nt, Human
ggucgggaggucaagaccagcc

SEQ ID NO: 694030 - RNA, 23 nt, Human
gguggcucaagccuguaauccca

SEQ ID NO: 694031 - RNA, 24 nt, Human
gguggcucaagccuguaaucccag

SEQ ID NO: 694032 - RNA, 23 nt, Human
guccuggaucucuccccaguccu

SEQ ID NO: 694033 - RNA, 22 nt, Human
gugggaagguuccuagguuuac

SEQ ID NO: 694034 - RNA, 21 nt, Human
uaaaaauacaaaacuuagcug

SEQ ID NO: 694035 - RNA, 24 nt, Human
uaaaaugagaucaauaggaauauu

SEQ ID NO: 694036 - RNA, 25 nt, Human
uaaacaaacaaacaaacaggccagg

SEQ ID NO: 694037 - RNA, 26 nt, Human
uaacagcuggaggcucccaggcauac

SEQ ID NO: 694038 - RNA, 19 nt, Human
uaaccacuggauccaaccc

SEQ ID NO: 694039 - RNA, 21 nt, Human
uaacugccucagcaaaaaaaa

SEQ ID NO: 694040 - RNA, 23 nt, Human
uacuccagagccaccgugagcug

SEQ ID NO: 694041 - RNA, 26 nt, Human
uacugcacuccaguuuaaaacagugg

SEQ ID NO: 694042 - RNA, 24 nt, Human
uagcacuuucggaggccgaggugg

SEQ ID NO: 694043 - RNA, 19 nt, Human
uauccuggugggggauggg

SEQ ID NO: 694044 - RNA, 23 nt, Human
uauuuugguauuucuacuuuuga

SEQ ID NO: 694045 - RNA, 18 nt, Human
ucaaacaaacaaaaaaac

SEQ ID NO: 694046 - RNA, 23 nt, Human
ucacaucuguaauccuagcacuu

SEQ ID NO: 694047 - RNA, 23 nt, Human
ucagcaaaaaaaaaaaaaaaaaa

SEQ ID NO: 694048 - RNA, 19 nt, Human
ucagccccgaggccucauc

SEQ ID NO: 694049 - RNA, 23 nt, Human
ucagccccgaggccucaucugua

SEQ ID NO: 694050 - RNA, 21 nt, Human
uccccaaguguccccucagca

SEQ ID NO: 694051 - RNA, 26 nt, Human
ucuacaaaaacaaacaaaacaggccu

SEQ ID NO: 694052 - RNA, 18 nt, Human
ucuacuaaaaauacaaaa

SEQ ID NO: 694053 - RNA, 19 nt, Human
ugaccaccaagcccagccu

SEQ ID NO: 694054 - RNA, 24 nt, Human
ugagaaguuuuuagaaaggauggc

SEQ ID NO: 694055 - RNA, 24 nt, Human
ugagaucaauaggaauauuccagg

SEQ ID NO: 694056 - RNA, 23 nt, Human
ugagauuagccugggcaacaugg

SEQ ID NO: 694057 - RNA, 18 nt, Human
ugcuuucccaccggugcc

SEQ ID NO: 694058 - RNA, 18 nt, Human
uggcaucuacauauauau

SEQ ID NO: 694059 - RNA, 23 nt, Human
uggccugaggcuggcucaguccu

SEQ ID NO: 694060 - RNA, 24 nt, Human
uggcucaagccuguaaucccagca

SEQ ID NO: 694061 - RNA, 21 nt, Human
ugggaggucggggcaggcaga

SEQ ID NO: 694062 - RNA, 24 nt, Human
ugggaggucggggcaggcagauca

SEQ ID NO: 694063 - RNA, 22 nt, Human
ugggcaacauggcgaaacccca

SEQ ID NO: 694064 - RNA, 22 nt, Human
ugggcaacauggugaaacccca

SEQ ID NO: 694065 - RNA, 21 nt, Human
ugguucacaucuguaauccua

SEQ ID NO: 694066 - RNA, 24 nt, Human
ugguucacaucuguaauccuagca

SEQ ID NO: 694067 - RNA, 24 nt, Human
ugguuguuauuauacugaugacac

SEQ ID NO: 694068 - RNA, 18 nt, Human
uguggagucugcaccuca

SEQ ID NO: 694069 - RNA, 23 nt, Human
uuaaacaaacaaacaaacaggcc

SEQ ID NO: 694070 - RNA, 21 nt, Human
uuagcugggcguggggccaca

SEQ ID NO: 694071 - RNA, 21 nt, Human
uuagcugggcguggggccaca

SEQ ID NO: 694072 - RNA, 18 nt, Human
uucaagggcugacccacc

SEQ ID NO: 694073 - RNA, 24 nt, Human
uucuaaaaccuaaccacuggaucc

SEQ ID NO: 694074 - RNA, 21 nt, Human
uugaacuuuguucaguguucc

SEQ ID NO: 694075 - RNA, 24 nt, Human
uuguagaguguccauucugagucu

SEQ ID NO: 694076 - RNA, 19 nt, Human
uuucaagggcugacccacc

SEQ ID NO: 694077 - RNA, 20 nt, Human
uuuuuagaaaggauggcauc

SEQ ID NO: 694078 - RNA, 19 nt, Human
aacacaaagagggauccac

SEQ ID NO: 694079 - RNA, 20 nt, Human
aacagccaaacaaguaacau

SEQ ID NO: 694080 - RNA, 22 nt, Human
acaaagagggauccaccccggc

SEQ ID NO: 694081 - RNA, 18 nt, Human
agccacuggaaagauaag

SEQ ID NO: 694082 - RNA, 18 nt, Human
aggaaguugggugugaug

SEQ ID NO: 694083 - RNA, 18 nt, Human
caacacaaagagggaucc

SEQ ID NO: 694084 - RNA, 21 nt, Human
caagcaaaagguuucgaugca

SEQ ID NO: 694085 - RNA, 19 nt, Human
cacacuuuuaauagcaugg

SEQ ID NO: 694086 - RNA, 23 nt, Human
cacauccccaagcaaaagguuuc

SEQ ID NO: 694087 - RNA, 23 nt, Human
caccgugacuacaugaacagcca

SEQ ID NO: 694088 - RNA, 18 nt, Human
ccaaacaaguaacauaau

SEQ ID NO: 694089 - RNA, 24 nt, Human
cccgggcagccugcccaagccaga

SEQ ID NO: 694090 - RNA, 26 nt, Human
gagcaccgugacuacaugaacagcca

SEQ ID NO: 694091 - RNA, 19 nt, Human
gaggcucuuggucuguggg

SEQ ID NO: 694092 - RNA, 21 nt, Human
gccacuggaaagauaaggaag

SEQ ID NO: 694093 - RNA, 25 nt, Human
gcccgggcagccugcccaagccaga

SEQ ID NO: 694094 - RNA, 18 nt, Human
gcguuaucugccucucca

SEQ ID NO: 694095 - RNA, 19 nt, Human
ggaaauguugaggcucuug

SEQ ID NO: 694096 - RNA, 18 nt, Human
ggccgcggcugcuuccgg

SEQ ID NO: 694097 - RNA, 21 nt, Human
ggccgcggcugcuuccggcuu

SEQ ID NO: 694098 - RNA, 19 nt, Human
gggccgcggcugcuuccgg

SEQ ID NO: 694099 - RNA, 20 nt, Human
uaaaaaacccagcauauuaa

SEQ ID NO: 694100 - RNA, 22 nt, Human
uaauagcauggacuacaacaca

SEQ ID NO: 694101 - RNA, 22 nt, Human
uaguaaaaugccgcaugugcac

SEQ ID NO: 694102 - RNA, 19 nt, Human
uauuaaaaaacccagcaua

SEQ ID NO: 694103 - RNA, 22 nt, Human
uccaagcacauccccaagcaaa

SEQ ID NO: 694104 - RNA, 21 nt, Human
uccuggguccagaguggggcu

SEQ ID NO: 694105 - RNA, 22 nt, Human
ugaacagccaaacaaguaacau

SEQ ID NO: 694106 - RNA, 19 nt, Human
ugagaauaaaacucaucuc

SEQ ID NO: 694107 - RNA, 19 nt, Human
ugagagcaccgugacuaca

SEQ ID NO: 694108 - RNA, 20 nt, Human
ugcauaagguggcagcugcc

SEQ ID NO: 694109 - RNA, 21 nt, Human
ugccgcaugugcacauguaua

SEQ ID NO: 694110 - RNA, 25 nt, Human
ugcuuccggcuuccugccacggccc

SEQ ID NO: 694111 - RNA, 25 nt, Human
ugugcacauguauacagauaguaug

SEQ ID NO: 694112 - RNA, 19 nt, Human
uuccugccacggcccgggc

SEQ ID NO: 694113 - RNA, 24 nt, Human
uuggucugugggccacacuuuuaa

SEQ ID NO: 694114 - RNA, 21 nt, Human
aaaugcaagaaaacuaccuug

SEQ ID NO: 694115 - RNA, 22 nt, Human
aacaggaucgacauuucuucca

SEQ ID NO: 694116 - RNA, 21 nt, Human
aacccugggagaaagcggggc

SEQ ID NO: 694117 - RNA, 22 nt, Human
aacccugggagaaagcggggcu

SEQ ID NO: 694118 - RNA, 24 nt, Human
acagccgcggccugucaggagccu

SEQ ID NO: 694119 - RNA, 20 nt, Human
acauugacaauauacuguau

SEQ ID NO: 694120 - RNA, 21 nt, Human
agaaagcggggcucagccucc

SEQ ID NO: 694121 - RNA, 18 nt, Human
agaaaugguuuuagaaag

SEQ ID NO: 694122 - RNA, 26 nt, Human
agacaaaagucaguuucauccucagu

SEQ ID NO: 694123 - RNA, 18 nt, Human
agagagaaaguuuaaagu

SEQ ID NO: 694124 - RNA, 21 nt, Human
agcaaaaugcaagaaaacuag

SEQ ID NO: 694125 - RNA, 23 nt, Human
aggaaucugaaaguuaccaaggc

SEQ ID NO: 694126 - RNA, 22 nt, Human
aucacagcccucuugaacaaca

SEQ ID NO: 694127 - RNA, 25 nt, Human
caaaagacaaaagucaguuucaucc

SEQ ID NO: 694128 - RNA, 20 nt, Human
caauuccacaggaaucugaa

SEQ ID NO: 694129 - RNA, 23 nt, Human
cacauuugacuagcuuuuguuuu

SEQ ID NO: 694130 - RNA, 21 nt, Human
cacccacacacaugcugaaug

SEQ ID NO: 694131 - RNA, 18 nt, Human
caguacaguuuuuuuucu

SEQ ID NO: 694132 - RNA, 20 nt, Human
caguacaguuuuuuuucucc

SEQ ID NO: 694133 - RNA, 20 nt, Human
cauccacacccacacacaug

SEQ ID NO: 694134 - RNA, 25 nt, Human
cauccacacccacacacaugcugaa

SEQ ID NO: 694135 - RNA, 24 nt, Human
cauuugacuagcuuuuguuuuacu

SEQ ID NO: 694136 - RNA, 18 nt, Human
cccugggagaaagcgggg

SEQ ID NO: 694137 - RNA, 24 nt, Human
ccgccucgggucucggucugcguc

SEQ ID NO: 694138 - RNA, 21 nt, Human
ccucgggucucggucugcguc

SEQ ID NO: 694139 - RNA, 24 nt, Human
cgccuccgccucgggucucggucu

SEQ ID NO: 694140 - RNA, 21 nt, Human
cgcggcucgcacaccggcgcc

SEQ ID NO: 694141 - RNA, 21 nt, Human
cgcgguccgccuccgccucgg

SEQ ID NO: 694142 - RNA, 18 nt, Human
cuccaaaagacaaaaguc

SEQ ID NO: 694143 - RNA, 19 nt, Human
cuccgcaccucggguugcc

SEQ ID NO: 694144 - RNA, 23 nt, Human
cuucuccugccgccgcuuucugc

SEQ ID NO: 694145 - RNA, 18 nt, Human
cuugaacaacaguacagu

SEQ ID NO: 694146 - RNA, 21 nt, Human
cuuucugcccuggccgcguuc

SEQ ID NO: 694147 - RNA, 22 nt, Human
gccgccgcuuucugcccuggcc

SEQ ID NO: 694148 - RNA, 20 nt, Human
gccucgggucucggucugcg

SEQ ID NO: 694149 - RNA, 24 nt, Human
gcugauaagaaacccugggagaaa

SEQ ID NO: 694150 - RNA, 20 nt, Human
gcuuucugcccuggccgcgu

SEQ ID NO: 694151 - RNA, 20 nt, Human
ggagccuccuacucccccgg

SEQ ID NO: 694152 - RNA, 22 nt, Human
ggcccccugccugcuucuccug

SEQ ID NO: 694153 - RNA, 20 nt, Human
uaaacauccacacccacaca

SEQ ID NO: 694154 - RNA, 22 nt, Human
uacuauggcaaaaauauuuuau

SEQ ID NO: 694155 - RNA, 18 nt, Human
uauaaacauccacaccca

SEQ ID NO: 694156 - RNA, 18 nt, Human
uauagugagagagaaagu

SEQ ID NO: 694157 - RNA, 20 nt, Human
uccaaaagacaaaagucagu

SEQ ID NO: 694158 - RNA, 21 nt, Human
uccaaaagacaaaagucaguu

SEQ ID NO: 694159 - RNA, 20 nt, Human
uccacacccacacacaugcu

SEQ ID NO: 694160 - RNA, 24 nt, Human
ucuaaauauccuuaaaaaagaaaa

SEQ ID NO: 694161 - RNA, 18 nt, Human
ucuccaaaagacaaaagu

SEQ ID NO: 694162 - RNA, 22 nt, Human
ucuccaaaagacaaaagucaga

SEQ ID NO: 694163 - RNA, 22 nt, Human
ugacaccauaagaugaacuuua

SEQ ID NO: 694164 - RNA, 19 nt, Human
ugauaagaaacccugggag

SEQ ID NO: 694165 - RNA, 20 nt, Human
ugcaagaaaacuaccuuggc

SEQ ID NO: 694166 - RNA, 23 nt, Human
ugcguccuccggcccccugccug

SEQ ID NO: 694167 - RNA, 22 nt, Human
ugcuccggcccgcggggucugg

SEQ ID NO: 694168 - RNA, 23 nt, Human
uggcaaaaauauuuuauuaauug

SEQ ID NO: 694169 - RNA, 19 nt, Human
uggcaggaacaaaugcuua

SEQ ID NO: 694170 - RNA, 23 nt, Human
ugucaggagccuccuacuccccc

SEQ ID NO: 694171 - RNA, 23 nt, Human
uuccacaggaaucugaaaguuac

SEQ ID NO: 694172 - RNA, 18 nt, Human
aaagagggggauggaugg

SEQ ID NO: 694173 - RNA, 24 nt, Human
aaagccccauccaugcccuggcuu

SEQ ID NO: 694174 - RNA, 18 nt, Human
aagaacacaggccugugg

SEQ ID NO: 694175 - RNA, 18 nt, Human
aaggaccagccccacccc

SEQ ID NO: 694176 - RNA, 24 nt, Human
aaggaccagccccacccccaaccc

SEQ ID NO: 694177 - RNA, 18 nt, Human
acaaagcacagcacucag

SEQ ID NO: 694178 - RNA, 18 nt, Human
acagcagccccaggggcc

SEQ ID NO: 694179 - RNA, 22 nt, Human
acagcagccccaggggccuccu

SEQ ID NO: 694180 - RNA, 21 nt, Human
accagccccacccccaacccc

SEQ ID NO: 694181 - RNA, 21 nt, Human
acccaaagccccauccaugcc

SEQ ID NO: 694182 - RNA, 21 nt, Human
acccacccuuccccuccaccc

SEQ ID NO: 694183 - RNA, 26 nt, Human
accggcccugcugacagcccgacacg

SEQ ID NO: 694184 - RNA, 23 nt, Human
acuccucagugcccagagguggg

SEQ ID NO: 694185 - RNA, 21 nt, Human
agaaccugggcugagaugucc

SEQ ID NO: 694186 - RNA, 19 nt, Human
agcagccccaggggccucc

SEQ ID NO: 694187 - RNA, 22 nt, Human
agcagccccaggggccuccuca

SEQ ID NO: 694188 - RNA, 24 nt, Human
agcagcuguugacacccuggguuc

SEQ ID NO: 694189 - RNA, 18 nt, Human
agccccacccccaacccc

SEQ ID NO: 694190 - RNA, 21 nt, Human
agcccgacacgcaggccgaga

SEQ ID NO: 694191 - RNA, 18 nt, Human
aggccgaucacagcagcc

SEQ ID NO: 694192 - RNA, 19 nt, Human
agggcccuaguuugggagg

SEQ ID NO: 694193 - RNA, 21 nt, Human
aggggcccagaguggugggag

SEQ ID NO: 694194 - RNA, 18 nt, Human
agguuccagcgucagggc

SEQ ID NO: 694195 - RNA, 19 nt, Human
agguuccagcgucagggcu

SEQ ID NO: 694196 - RNA, 20 nt, Human
aguggagggcccuaguuugg

SEQ ID NO: 694197 - RNA, 22 nt, Human
aguggagggcccuaguuuggga

SEQ ID NO: 694198 - RNA, 20 nt, Human
aguggugggagugagaggga

SEQ ID NO: 694199 - RNA, 21 nt, Human
auacagauguggcauggcucu

SEQ ID NO: 694200 - RNA, 21 nt, Human
auauguccugcuggucccauu

SEQ ID NO: 694201 - RNA, 21 nt, Human
augacuccccccaucccccag

SEQ ID NO: 694202 - RNA, 21 nt, Human
augggagcagccccaagaaca

SEQ ID NO: 694203 - RNA, 23 nt, Human
caaagcacagcacucaguggcuc

SEQ ID NO: 694204 - RNA, 21 nt, Human
cacccccaaccccacguggcc

SEQ ID NO: 694205 - RNA, 19 nt, Human
cacccuuccccuccacccu

SEQ ID NO: 694206 - RNA, 19 nt, Human
cacccuuccccuccaccuc

SEQ ID NO: 694207 - RNA, 18 nt, Human
cacccuugccugugaccu

SEQ ID NO: 694208 - RNA, 22 nt, Human
cacguggccuugccuggaggcc

SEQ ID NO: 694209 - RNA, 18 nt, Human
cacugcacagggcuggau

SEQ ID NO: 694210 - RNA, 22 nt, Human
cagccugggggcuccugaggac

SEQ ID NO: 694211 - RNA, 18 nt, Human
caggagagggugugggcg

SEQ ID NO: 694212 - RNA, 21 nt, Human
cagugcccagagguggggagu

SEQ ID NO: 694213 - RNA, 23 nt, Human
ccaaagccccauccaugcccugg

SEQ ID NO: 694214 - RNA, 23 nt, Human
ccacccccaaccccacguggccu

SEQ ID NO: 694215 - RNA, 25 nt, Human
ccaccuggggucuggggugcguggg

SEQ ID NO: 694216 - RNA, 23 nt, Human
ccagagguggggaguugagagca

SEQ ID NO: 694217 - RNA, 23 nt, Human
ccaggccgaucacagcagcccca

SEQ ID NO: 694218 - RNA, 23 nt, Human
ccaguccucccccaaggggccca

SEQ ID NO: 694219 - RNA, 21 nt, Human
cccaaagccccauccaugccc

SEQ ID NO: 694220 - RNA, 22 nt, Human
cccaaagccccauccaugcccu

SEQ ID NO: 694221 - RNA, 24 nt, Human
cccacccccaaccccacguggccg

SEQ ID NO: 694222 - RNA, 23 nt, Human
cccacccuuccccuccacccugc

SEQ ID NO: 694223 - RNA, 25 nt, Human
cccacggcccccuccccaguccucc

SEQ ID NO: 694224 - RNA, 18 nt, Human
cccaucccccagcuggaa

SEQ ID NO: 694225 - RNA, 24 nt, Human
ccccacccccaaccccacguggcc

SEQ ID NO: 694226 - RNA, 22 nt, Human
ccccagaaccuugcaaguuugg

SEQ ID NO: 694227 - RNA, 18 nt, Human
ccccagccccuguacucu

SEQ ID NO: 694228 - RNA, 23 nt, Human
ccccagccccuguacucuggauu

SEQ ID NO: 694229 - RNA, 18 nt, Human
ccccaggggccuccucac

SEQ ID NO: 694230 - RNA, 18 nt, Human
cccccaaccccacguggc

SEQ ID NO: 694231 - RNA, 22 nt, Human
ccccccaucccccagcuggaag

SEQ ID NO: 694232 - RNA, 18 nt, Human
cccggaggggaagguggc

SEQ ID NO: 694233 - RNA, 21 nt, Human
cccguuaaugaaaauggagau

SEQ ID NO: 694234 - RNA, 21 nt, Human
cccuccagacucugguucucc

SEQ ID NO: 694235 - RNA, 21 nt, Human
cccugcuaacugagacccacc

SEQ ID NO: 694236 - RNA, 23 nt, Human
cccugcuaacugagacccacccu

SEQ ID NO: 694237 - RNA, 18 nt, Human
cccugcugacagcccgac

SEQ ID NO: 694238 - RNA, 22 nt, Human
cccuggauagaguggagggccc

SEQ ID NO: 694239 - RNA, 23 nt, Human
cccugggcuuggggccaggguac

SEQ ID NO: 694240 - RNA, 22 nt, Human
ccgacacgcaggccgagagggc

SEQ ID NO: 694241 - RNA, 18 nt, Human
ccggaggggaagguggca

SEQ ID NO: 694242 - RNA, 18 nt, Human
ccgggcccugcccaggcg

SEQ ID NO: 694243 - RNA, 23 nt, Human
ccucgaggacccaaagccccauc

SEQ ID NO: 694244 - RNA, 20 nt, Human
ccucgggcaauuaguuccac

SEQ ID NO: 694245 - RNA, 27 nt, Human
ccugaccccagccccuguaccgguucc

SEQ ID NO: 694246 - RNA, 20 nt, Human
ccugcucgcuggcguggggc

SEQ ID NO: 694247 - RNA, 19 nt, Human
ccugcuggucccauucccc

SEQ ID NO: 694248 - RNA, 23 nt, Human
ccugggcugagauguccuggagc

SEQ ID NO: 694249 - RNA, 21 nt, Human
cggcccccuccccaguccucc

SEQ ID NO: 694250 - RNA, 25 nt, Human
cguggccuugccuggaggccccagc

SEQ ID NO: 694251 - RNA, 22 nt, Human
cuaaccuucagugacaaagcac

SEQ ID NO: 694252 - RNA, 28 nt, Human
cuaacugagacccacccuuccccuccaa

SEQ ID NO: 694253 - RNA, 22 nt, Human
cucaccacugcacagggcugga

SEQ ID NO: 694254 - RNA, 22 nt, Human
cucucccacggcccccucccca

SEQ ID NO: 694255 - RNA, 20 nt, Human
cucugucguucccacucccc

SEQ ID NO: 694256 - RNA, 25 nt, Human
cuggaaaucuucucccgugcaccgg

SEQ ID NO: 694257 - RNA, 20 nt, Human
cuggauuaagugacggaggc

SEQ ID NO: 694258 - RNA, 24 nt, Human
cugggcuuggggccagccccuugu

SEQ ID NO: 694259 - RNA, 21 nt, Human
cugggggcuccugaggacugu

SEQ ID NO: 694260 - RNA, 24 nt, Human
cuggguucagaucuaaccuucagu

SEQ ID NO: 694261 - RNA, 18 nt, Human
cuguccuuuauuguguau

SEQ ID NO: 694262 - RNA, 18 nt, Human
cugucguucccacucccc

SEQ ID NO: 694263 - RNA, 20 nt, Human
gaaccuugcaaguuuggggu

SEQ ID NO: 694264 - RNA, 23 nt, Human
gacccacccuuccccuccacccu

SEQ ID NO: 694265 - RNA, 19 nt, Human
gagcagccccaagaacaca

SEQ ID NO: 694266 - RNA, 23 nt, Human
gagcucacagccugacauuccag

SEQ ID NO: 694267 - RNA, 22 nt, Human
gaggaugguccaccuggggucu

SEQ ID NO: 694268 - RNA, 22 nt, Human
gagggugugggcgcaggccucu

SEQ ID NO: 694269 - RNA, 19 nt, Human
gauccugucuccuugccac

SEQ ID NO: 694270 - RNA, 24 nt, Human
gauccugucuccuugccacucgga

SEQ ID NO: 694271 - RNA, 20 nt, Human
gcaccggcccugcugacagc

SEQ ID NO: 694272 - RNA, 18 nt, Human
gcacggggugggcaggca

SEQ ID NO: 694273 - RNA, 19 nt, Human
gcacggggugggcaggcag

SEQ ID NO: 694274 - RNA, 18 nt, Human
gcccuggggaccccugcu

SEQ ID NO: 694275 - RNA, 21 nt, Human
gccuguccauggcccagaggg

SEQ ID NO: 694276 - RNA, 21 nt, Human
gccuugccuggaggccccagc

SEQ ID NO: 694277 - RNA, 20 nt, Human
gcgcaggccucugggcgagc

SEQ ID NO: 694278 - RNA, 21 nt, Human
gcguggggcuuggaggcuggu

SEQ ID NO: 694279 - RNA, 19 nt, Human
gcugggggcacgggguggg

SEQ ID NO: 694280 - RNA, 20 nt, Human
ggacaggagagggugugggc

SEQ ID NO: 694281 - RNA, 20 nt, Human
ggaccucggugccugcccca

SEQ ID NO: 694282 - RNA, 23 nt, Human
ggcacagccagcuggcugggggc

SEQ ID NO: 694283 - RNA, 19 nt, Human
ggcgccgggcccugcccag

SEQ ID NO: 694284 - RNA, 21 nt, Human
gggacagggaaagggaaggga

SEQ ID NO: 694285 - RNA, 21 nt, Human
gggcgaaggcuggacaggaga

SEQ ID NO: 694286 - RNA, 18 nt, Human
ggggcggggggacaggga

SEQ ID NO: 694287 - RNA, 21 nt, Human
guccauggcccagagggggcu

SEQ ID NO: 694288 - RNA, 23 nt, Human
guggccuugccuggaggccccag

SEQ ID NO: 694289 - RNA, 21 nt, Human
guguuuuguuuccccugucag

SEQ ID NO: 694290 - RNA, 19 nt, Human
uacagguuccagcgucagg

SEQ ID NO: 694291 - RNA, 23 nt, Human
uagaaccugggcugagauguccu

SEQ ID NO: 694292 - RNA, 23 nt, Human
uaugugggagacgaaaccaagag

SEQ ID NO: 694293 - RNA, 23 nt, Human
ucagaggguuugucugccugucu

SEQ ID NO: 694294 - RNA, 20 nt, Human
ucaggccagggagucccugg

SEQ ID NO: 694295 - RNA, 23 nt, Human
ucaguggcucggggauguuuccc

SEQ ID NO: 694296 - RNA, 22 nt, Human
uccaugcccuggcuuccaucuc

SEQ ID NO: 694297 - RNA, 18 nt, Human
uccauggcccagaggggg

SEQ ID NO: 694298 - RNA, 20 nt, Human
ucccacggcccccuccccag

SEQ ID NO: 694299 - RNA, 24 nt, Human
ucccacggcccccuccccaguccu

SEQ ID NO: 694300 - RNA, 18 nt, Human
ucccaggguuaaggcuga

SEQ ID NO: 694301 - RNA, 19 nt, Human
uccccugucagccuggggg

SEQ ID NO: 694302 - RNA, 21 nt, Human
uccccugucagccugggggcu

SEQ ID NO: 694303 - RNA, 21 nt, Human
ucccucugucguucccacucc

SEQ ID NO: 694304 - RNA, 22 nt, Human
ucccucugucguucccacuccc

SEQ ID NO: 694305 - RNA, 21 nt, Human
ucccugggcuuggggccagcc

SEQ ID NO: 694306 - RNA, 22 nt, Human
ucccugggcuuggggccagccc

SEQ ID NO: 694307 - RNA, 19 nt, Human
uccucagugcccagaggug

SEQ ID NO: 694308 - RNA, 22 nt, Human
uccugcuggucccauuccccug

SEQ ID NO: 694309 - RNA, 19 nt, Human
uccuggagcuguuguaaug

SEQ ID NO: 694310 - RNA, 22 nt, Human
ucuccuugccacucggaccucg

SEQ ID NO: 694311 - RNA, 19 nt, Human
ugaaggacaacgauagggg

SEQ ID NO: 694312 - RNA, 19 nt, Human
ugaccagagaggcauggag

SEQ ID NO: 694313 - RNA, 19 nt, Human
ugacuccccccauccccca

SEQ ID NO: 694314 - RNA, 26 nt, Human
ugagacccacccuuccccuccacccu

SEQ ID NO: 694315 - RNA, 18 nt, Human
ugagaggccacccuaagg

SEQ ID NO: 694316 - RNA, 19 nt, Human
ugcagagacuucauagauc

SEQ ID NO: 694317 - RNA, 23 nt, Human
ugcaugggagcagccccaagaac

SEQ ID NO: 694318 - RNA, 23 nt, Human
ugcccggaggggaagguggcaag

SEQ ID NO: 694319 - RNA, 19 nt, Human
ugcccuggauagaguggag

SEQ ID NO: 694320 - RNA, 21 nt, Human
ugcccuggcuuccaucucugu

SEQ ID NO: 694321 - RNA, 22 nt, Human
ugcccuggggaccccugcuaac

SEQ ID NO: 694322 - RNA, 22 nt, Human
ugccugccccagaaccuugcaa

SEQ ID NO: 694323 - RNA, 18 nt, Human
uggaggccccagcaggcg

SEQ ID NO: 694324 - RNA, 26 nt, Human
uggcaagaagcugggguccaaccucg

SEQ ID NO: 694325 - RNA, 26 nt, Human
uggcaagaagcuggggucccggaagc

SEQ ID NO: 694326 - RNA, 21 nt, Human
uggcugggggcacgggguggg

SEQ ID NO: 694327 - RNA, 19 nt, Human
ugggagcagccccaagaac

SEQ ID NO: 694328 - RNA, 20 nt, Human
ugggcaggcagccugcucgc

SEQ ID NO: 694329 - RNA, 20 nt, Human
ugggcgagcgugccaggcuc

SEQ ID NO: 694330 - RNA, 19 nt, Human
ugggggcacggggugggca

SEQ ID NO: 694331 - RNA, 24 nt, Human
ugggggcagcaggcauuucccagg

SEQ ID NO: 694332 - RNA, 21 nt, Human
ugucagccugggggcuccuga

SEQ ID NO: 694333 - RNA, 22 nt, Human
uguccugcagagcuucucgucg

SEQ ID NO: 694334 - RNA, 19 nt, Human
uguccugcuggucccauuc

SEQ ID NO: 694335 - RNA, 21 nt, Human
uguccuggagcuguuguaaug

SEQ ID NO: 694336 - RNA, 20 nt, Human
uguguguuuuguuuccccug

SEQ ID NO: 694337 - RNA, 21 nt, Human
uguuaggugauccugucugca

SEQ ID NO: 694338 - RNA, 22 nt, Human
uguuaggugauccugucugcau

SEQ ID NO: 694339 - RNA, 18 nt, Human
uguuuuguuuccccuguc

SEQ ID NO: 694340 - RNA, 20 nt, Human
uguuuuguuuccccugucaa

SEQ ID NO: 694341 - RNA, 20 nt, Human
uuagcgaggcuuugcuggca

SEQ ID NO: 694342 - RNA, 23 nt, Human
uugccuggaggccccagcaggcg

SEQ ID NO: 694343 - RNA, 20 nt, Human
uuggccucaaccaaugguaa

SEQ ID NO: 694344 - RNA, 21 nt, Human
uugggguuuauuguguguuuu

SEQ ID NO: 694345 - RNA, 18 nt, Human
uuguguguuuuguuuccc

SEQ ID NO: 694346 - RNA, 20 nt, Human
uuuccccugucagccugggg

SEQ ID NO: 694347 - RNA, 19 nt, Human
uuuccuaugacucccccca

SEQ ID NO: 694348 - RNA, 18 nt, Human
uuuuuuuuuuuuuuucug

SEQ ID NO: 694349 - RNA, 19 nt, Human
uuuuuuuuuuuuuuucugu

SEQ ID NO: 694350 - RNA, 23 nt, Human
aaaaguaagcagccgguuggucc

SEQ ID NO: 694351 - RNA, 20 nt, Human
aaagagcagccaguuuggcc

SEQ ID NO: 694352 - RNA, 24 nt, Human
aagaagccccggcgacucccgccc

SEQ ID NO: 694353 - RNA, 19 nt, Human
aagcuuacaaacaaagagc

SEQ ID NO: 694354 - RNA, 19 nt, Human
aaguaugggaugagagagg

SEQ ID NO: 694355 - RNA, 24 nt, Human
agacauuacuuccugcuggaaaua

SEQ ID NO: 694356 - RNA, 21 nt, Human
agacccgaagcugcaccacag

SEQ ID NO: 694357 - RNA, 24 nt, Human
aggcggagcggagcuggggugggg

SEQ ID NO: 694358 - RNA, 19 nt, Human
aguaugggaugagagagga

SEQ ID NO: 694359 - RNA, 23 nt, Human
cagaguaggggccaaacuccgag

SEQ ID NO: 694360 - RNA, 18 nt, Human
caggcuaaaaguauggga

SEQ ID NO: 694361 - RNA, 20 nt, Human
caugaaagaagguggcaaca

SEQ ID NO: 694362 - RNA, 21 nt, Human
ccccggcgacucccgccccuc

SEQ ID NO: 694363 - RNA, 21 nt, Human
cggagcggagcuggggugggg

SEQ ID NO: 694364 - RNA, 24 nt, Human
cugggguggggucagaguaggggc

SEQ ID NO: 694365 - RNA, 18 nt, Human
gaacccaaggcggagcgg

SEQ ID NO: 694366 - RNA, 21 nt, Human
gaacccaaggcggagcggagc

SEQ ID NO: 694367 - RNA, 25 nt, Human
gagcugggguggggucagaguaggg

SEQ ID NO: 694368 - RNA, 23 nt, Human
gaggaaugugcaugaaagaaggu

SEQ ID NO: 694369 - RNA, 23 nt, Human
gcaccacaggaagaagccccggc

SEQ ID NO: 694370 - RNA, 21 nt, Human
ggcggagcggagcuggggugg

SEQ ID NO: 694371 - RNA, 22 nt, Human
gggguggggucagaguaggggc

SEQ ID NO: 694372 - RNA, 24 nt, Human
uaaauacauuuacaaaugugcaaa

SEQ ID NO: 694373 - RNA, 20 nt, Human
uaggggccaaacuccgagac

SEQ ID NO: 694374 - RNA, 22 nt, Human
uaggggccaaacuccgagaccc

SEQ ID NO: 694375 - RNA, 26 nt, Human
ucaucuuuauuuuagucauacuacuu

SEQ ID NO: 694376 - RNA, 20 nt, Human
ucccugguugaggcugagga

SEQ ID NO: 694377 - RNA, 19 nt, Human
uuuuaaaagucaucuucca

SEQ ID NO: 694378 - RNA, 20 nt, Human
uuuuuuuuuuuuuuguucgu

SEQ ID NO: 694379 - RNA, 18 nt, Human
uuuuuuuuuuuuuuuuug

SEQ ID NO: 694380 - RNA, 24 nt, Human
uuuuuuuuuuuuuuuuuuguucgu

SEQ ID NO: 694381 - RNA, 26 nt, Human
aacccgugccccuccucccguccccc

SEQ ID NO: 694382 - RNA, 20 nt, Human
acugcacagagacgggcugg

SEQ ID NO: 694383 - RNA, 18 nt, Human
agacgggcuggcacaccc

SEQ ID NO: 694384 - RNA, 22 nt, Human
agacgggcuggcacacccuggg

SEQ ID NO: 694385 - RNA, 23 nt, Human
agacgggcuggcacacccugggu

SEQ ID NO: 694386 - RNA, 19 nt, Human
agcucuggcguccugaugg

SEQ ID NO: 694387 - RNA, 23 nt, Human
aggcaagaggccugggguuccca

SEQ ID NO: 694388 - RNA, 18 nt, Human
agguggucaccgcugaag

SEQ ID NO: 694389 - RNA, 19 nt, Human
agugaaggaggagaaggag

SEQ ID NO: 694390 - RNA, 19 nt, Human
caagucccuuaaacccgug

SEQ ID NO: 694391 - RNA, 21 nt, Human
caagucccuuaaacccgugcc

SEQ ID NO: 694392 - RNA, 19 nt, Human
cacccuccaaaggagauga

SEQ ID NO: 694393 - RNA, 19 nt, Human
ccacggagaagggggcaag

SEQ ID NO: 694394 - RNA, 21 nt, Human
ccaggcaccuaggcccugcga

SEQ ID NO: 694395 - RNA, 21 nt, Human
ccaguggcuccccaagucccu

SEQ ID NO: 694396 - RNA, 18 nt, Human
cccaugcacccuccaaag

SEQ ID NO: 694397 - RNA, 22 nt, Human
cccaugcacccuccaaaggaga

SEQ ID NO: 694398 - RNA, 19 nt, Human
ccccaagucccuuaaaccc

SEQ ID NO: 694399 - RNA, 19 nt, Human
ccccucccauccgggcccc

SEQ ID NO: 694400 - RNA, 19 nt, Human
ccccuccucccguccccca

SEQ ID NO: 694401 - RNA, 24 nt, Human
cccuggguccaggcaccuaggccc

SEQ ID NO: 694402 - RNA, 25 nt, Human
cccuugggagagggccuuguaggug

SEQ ID NO: 694403 - RNA, 27 nt, Human
cccuugggagagggccuuguagguggg

SEQ ID NO: 694404 - RNA, 21 nt, Human
ccuacagacaaagucguccgc

SEQ ID NO: 694405 - RNA, 20 nt, Human
ccuucgugcgggcgccgccc

SEQ ID NO: 694406 - RNA, 19 nt, Human
cgccgcugcuccuacagac

SEQ ID NO: 694407 - RNA, 22 nt, Human
cgucccccaugcacccuccaaa

SEQ ID NO: 694408 - RNA, 21 nt, Human
cucaaguagcuggucaaagcc

SEQ ID NO: 694409 - RNA, 19 nt, Human
cuccaagcugggacgcccc

SEQ ID NO: 694410 - RNA, 18 nt, Human
cuccuacagacaaagucg

SEQ ID NO: 694411 - RNA, 20 nt, Human
cugaagcagcucuggcgucc

SEQ ID NO: 694412 - RNA, 22 nt, Human
cuucgugcgggcgccgccccuu

SEQ ID NO: 694413 - RNA, 24 nt, Human
gaugacaaaggcggcagugaagga

SEQ ID NO: 694414 - RNA, 19 nt, Human
gauucuugagggucucccc

SEQ ID NO: 694415 - RNA, 19 nt, Human
gccccuccucccguccccc

SEQ ID NO: 694416 - RNA, 19 nt, Human
ggagaagguggucaccgcu

SEQ ID NO: 694417 - RNA, 21 nt, Human
ggaggugggguccaaggagcu

SEQ ID NO: 694418 - RNA, 21 nt, Human
uacagacaaagucguccgcac

SEQ ID NO: 694419 - RNA, 22 nt, Human
uccccaagucccuuaaacccgu

SEQ ID NO: 694420 - RNA, 20 nt, Human
ugagagcaugggaggugggg

SEQ ID NO: 694421 - RNA, 19 nt, Human
ugagagugagagcauggga

SEQ ID NO: 694422 - RNA, 24 nt, Human
uggcuccccaagucccuuaaaccc

SEQ ID NO: 694423 - RNA, 21 nt, Human
ugggagagggccuuguaggug

SEQ ID NO: 694424 - RNA, 21 nt, Human
ugggaggugggguccaaggag

SEQ ID NO: 694425 - RNA, 21 nt, Human
uggggagggaggcaagaggcc

SEQ ID NO: 694426 - RNA, 27 nt, Human
uggugccuuucucagcgccccuuccag

SEQ ID NO: 694427 - RNA, 21 nt, Human
uguguuagagggagaaggugg

SEQ ID NO: 694428 - RNA, 19 nt, Human
uuggaagagcuguguggac

SEQ ID NO: 694429 - RNA, 20 nt, Human
uuuuuuuuuuaaagagcaac

SEQ ID NO: 694430 - RNA, 19 nt, Human
uuuuuuuuuuuuaaagagc

SEQ ID NO: 694431 - RNA, 21 nt, Human
uuuuuuuuuuuuuaaagagca

SEQ ID NO: 694432 - RNA, 22 nt, Human
uuuuuuuuuuuuuuuuuuaaag

SEQ ID NO: 694433 - RNA, 19 nt, Human
aacucgcguccggucccuc

SEQ ID NO: 694434 - RNA, 18 nt, Human
ugacuggagaacccagau

SEQ ID NO: 694435 - RNA, 19 nt, Human
uuuuuuuuuuuuaaagucu

SEQ ID NO: 694436 - RNA, 19 nt, Human
uuuuuuuuuuuuuuuuuaa

SEQ ID NO: 694437 - RNA, 26 nt, Human
aaaaaacaaagucccauccucccccc

SEQ ID NO: 694438 - RNA, 23 nt, Human
aaaacaaagucccauccuccccc

SEQ ID NO: 694439 - RNA, 20 nt, Human
agaucuccgaggugccuccc

SEQ ID NO: 694440 - RNA, 18 nt, Human
cacccagaucuccgaggu

SEQ ID NO: 694441 - RNA, 22 nt, Human
cccauccuccccccauugucua

SEQ ID NO: 694442 - RNA, 26 nt, Human
cccauccuccccccauugucuaagaa

SEQ ID NO: 694443 - RNA, 21 nt, Human
cuuggaaaaaacaaaguccca

SEQ ID NO: 694444 - RNA, 23 nt, Human
ggccccgccccuccaaaugguca

SEQ ID NO: 694445 - RNA, 21 nt, Human
uaacccugggcuuuugcaccc

SEQ ID NO: 694446 - RNA, 25 nt, Human
ucccgcgggccgcugcccgcugcuu

SEQ ID NO: 694447 - RNA, 20 nt, Human
uggaaaaaacaaagucccau

SEQ ID NO: 694448 - RNA, 20 nt, Human
aaacaaggaaacaaacuaca

SEQ ID NO: 694449 - RNA, 22 nt, Human
aacaaggaaacaaacuacaaga

SEQ ID NO: 694450 - RNA, 21 nt, Human
aaggaaacaaacuacaagaag

SEQ ID NO: 694451 - RNA, 24 nt, Human
aaggggguaaaccacaaagucaga

SEQ ID NO: 694452 - RNA, 25 nt, Human
aguucuguucuuuugacauuggcca

SEQ ID NO: 694453 - RNA, 19 nt, Human
augcacaccucucaaacaa

SEQ ID NO: 694454 - RNA, 22 nt, Human
caagguuaguaagaaggccaac

SEQ ID NO: 694455 - RNA, 19 nt, Human
cacagcaagugugcagugg

SEQ ID NO: 694456 - RNA, 24 nt, Human
ccucguaacaacugcgucccugga

SEQ ID NO: 694457 - RNA, 22 nt, Human
cuccagcagguuggacaugauc

SEQ ID NO: 694458 - RNA, 21 nt, Human
gagcugccacgucuaaccucg

SEQ ID NO: 694459 - RNA, 19 nt, Human
guucuuuugacauuggcca

SEQ ID NO: 694460 - RNA, 22 nt, Human
uaaaccacaaagucagaaacuu

SEQ ID NO: 694461 - RNA, 19 nt, Human
uacacagcaagugugcagu

SEQ ID NO: 694462 - RNA, 23 nt, Human
ucauuguacacagcaagugugca

SEQ ID NO: 694463 - RNA, 21 nt, Human
ucuugggcucaaucacggucc

SEQ ID NO: 694464 - RNA, 18 nt, Human
ugaaggggcuccagcagg

SEQ ID NO: 694465 - RNA, 19 nt, Human
ugaaggggcuccagcaggu

SEQ ID NO: 694466 - RNA, 25 nt, Human
ugaaggggguaaaccacaaagucaa

SEQ ID NO: 694467 - RNA, 23 nt, Human
ugacauuggccaaaugcguaagu

SEQ ID NO: 694468 - RNA, 22 nt, Human
ugagcaggauucaauuucuaca

SEQ ID NO: 694469 - RNA, 23 nt, Human
uggggcaucauccaccaugugaa

SEQ ID NO: 694470 - RNA, 19 nt, Human
uguacacagcaagugugca

SEQ ID NO: 694471 - RNA, 18 nt, Human
ugugcagugggcaaaguu

SEQ ID NO: 694472 - RNA, 19 nt, Human
ugugcagugggcaaaguuc

SEQ ID NO: 694473 - RNA, 25 nt, Human
uucucaauuugacccuauguauccc

SEQ ID NO: 694474 - RNA, 21 nt, Human
uuuuuuuuuuuuuuuuuccag

SEQ ID NO: 694475 - RNA, 23 nt, Human
uuuuuuuuuuuuuuuuuuccagg

SEQ ID NO: 694476 - RNA, 19 nt, Human
aaacagguugaauugaaac

SEQ ID NO: 694477 - RNA, 18 nt, Human
aagaugacuauaaacaag

SEQ ID NO: 694478 - RNA, 21 nt, Human
aagaugacuauaaacaagaug

SEQ ID NO: 694479 - RNA, 22 nt, Human
acuuuuuuaaagacaaaggcua

SEQ ID NO: 694480 - RNA, 18 nt, Human
agaacaagaaaaaaugag

SEQ ID NO: 694481 - RNA, 19 nt, Human
agaccagaccaaaaucaaa

SEQ ID NO: 694482 - RNA, 20 nt, Human
agaccagaccaaaaucaaaa

SEQ ID NO: 694483 - RNA, 23 nt, Human
caaaauauacuuuuaauuguaaa

SEQ ID NO: 694484 - RNA, 21 nt, Human
cgaccccgccgcucacuuccg

SEQ ID NO: 694485 - RNA, 27 nt, Human
cucucugccccguuaccgucagucgac

SEQ ID NO: 694486 - RNA, 24 nt, Human
cuguaaaccaaagaccccuccaaa

SEQ ID NO: 694487 - RNA, 23 nt, Human
gcaacaacuuuuuuaaagacaaa

SEQ ID NO: 694488 - RNA, 21 nt, Human
gcuacuauaaaguuuauagac

SEQ ID NO: 694489 - RNA, 23 nt, Human
uaaagaccagaccaaaaucaaaa

SEQ ID NO: 694490 - RNA, 21 nt, Human
uacaaaaaaaccuagaaacag

SEQ ID NO: 694491 - RNA, 22 nt, Human
uacaaagaugacuauaaacaag

SEQ ID NO: 694492 - RNA, 19 nt, Human
uacaguacaaagaugacua

SEQ ID NO: 694493 - RNA, 23 nt, Human
ucaaaacuaaauuuacaaaaaaa

SEQ ID NO: 694494 - RNA, 26 nt, Human
ucaaacaauaacuauaauccuaaaau

SEQ ID NO: 694495 - RNA, 22 nt, Human
ucugaaagaugcuacuauaaag

SEQ ID NO: 694496 - RNA, 23 nt, Human
ucugcgaacagccucucugcccc

SEQ ID NO: 694497 - RNA, 25 nt, Human
ugaaaucaauuaaaaauguuuauuc

SEQ ID NO: 694498 - RNA, 19 nt, Human
ugacuauaaacaagaugca

SEQ ID NO: 694499 - RNA, 20 nt, Human
uuaaagacaaaggcuacugu

SEQ ID NO: 694500 - RNA, 27 nt, Human
uuauucugaaagaugcuacuauaaagu

SEQ ID NO: 694501 - RNA, 18 nt, Human
uugcuuuaauuuuucacu

SEQ ID NO: 694502 - RNA, 20 nt, Human
uuuuuuuuuuuuuuuuugcu

SEQ ID NO: 694503 - RNA, 23 nt, Human
uuuuuuuuuuuuuuuuuugcuaa

SEQ ID NO: 694504 - RNA, 27 nt, Human
uuuuuuuuuuuuuuuuuuuuuuugggg

SEQ ID NO: 694505 - RNA, 22 nt, Human
caacagcuccaagacaacacuu

SEQ ID NO: 694506 - RNA, 28 nt, Human
cagaugaaauaaagggucaccaucuccu

SEQ ID NO: 694507 - RNA, 21 nt, Human
ccugccgccgcuuccccagac

SEQ ID NO: 694508 - RNA, 21 nt, Human
cuccaagacaacacuuaauuc

SEQ ID NO: 694509 - RNA, 18 nt, Human
gcaaaagauguuauggca

SEQ ID NO: 694510 - RNA, 18 nt, Human
uauggcagggaauagaga

SEQ ID NO: 694511 - RNA, 20 nt, Human
uggcaaaagauguuauggca

SEQ ID NO: 694512 - RNA, 22 nt, Human
aaagaaaaaagaaacacuuugu

SEQ ID NO: 694513 - RNA, 21 nt, Human
aaaugccuauaaaauaaaaua

SEQ ID NO: 694514 - RNA, 21 nt, Human
aacucuaaaaaccuaagaaau

SEQ ID NO: 694515 - RNA, 25 nt, Human
aagaagaaaauauuccuuuaaaaaa

SEQ ID NO: 694516 - RNA, 22 nt, Human
aagaagaaauuaauaaaugaaa

SEQ ID NO: 694517 - RNA, 22 nt, Human
aagauaccagaagucuagaaua

SEQ ID NO: 694518 - RNA, 20 nt, Human
aagcaagaagaaauuaauaa

SEQ ID NO: 694519 - RNA, 22 nt, Human
aaucacaguuuaucuucuuucu

SEQ ID NO: 694520 - RNA, 21 nt, Human
aaucauaugcuucaaaucaag

SEQ ID NO: 694521 - RNA, 19 nt, Human
acaugucauuuucuaacuc

SEQ ID NO: 694522 - RNA, 23 nt, Human
acauuaaaauagauaacauugcu

SEQ ID NO: 694523 - RNA, 22 nt, Human
accauaaaucuuuuuacaaaga

SEQ ID NO: 694524 - RNA, 23 nt, Human
accccuccugucucucuucucca

SEQ ID NO: 694525 - RNA, 20 nt, Human
acuguaacugauuaauuuuu

SEQ ID NO: 694526 - RNA, 19 nt, Human
agaaacaauaaggaugauc

SEQ ID NO: 694527 - RNA, 18 nt, Human
agaaagaaguggaaaagg

SEQ ID NO: 694528 - RNA, 23 nt, Human
agcaaugacucaaccagaaaaaa

SEQ ID NO: 694529 - RNA, 25 nt, Human
agcagcauaaacagugacagcagaa

SEQ ID NO: 694530 - RNA, 19 nt, Human
aggaaagaaaaaucgaaaa

SEQ ID NO: 694531 - RNA, 18 nt, Human
augaaauaaaggcaaaaa

SEQ ID NO: 694532 - RNA, 19 nt, Human
auggaucugaaguccuugu

SEQ ID NO: 694533 - RNA, 19 nt, Human
auucuuguaaauacauaua

SEQ ID NO: 694534 - RNA, 23 nt, Human
caaauucucuuuuuaacaaaauu

SEQ ID NO: 694535 - RNA, 24 nt, Human
caacaaagccuauuuccaccaaaa

SEQ ID NO: 694536 - RNA, 24 nt, Human
caacauucaguacuaugcaaauca

SEQ ID NO: 694537 - RNA, 22 nt, Human
cagcagaacaaaccccagcaca

SEQ ID NO: 694538 - RNA, 21 nt, Human
cagcauaaacagugacagcag

SEQ ID NO: 694539 - RNA, 25 nt, Human
cagugcuaaguuccagcagcauaaa

SEQ ID NO: 694540 - RNA, 18 nt, Human
caucugauugaaauaauu

SEQ ID NO: 694541 - RNA, 25 nt, Human
ccaaaaaagcaagaagaaauuaaua

SEQ ID NO: 694542 - RNA, 23 nt, Human
ccaaaauagaauuucugagcacg

SEQ ID NO: 694543 - RNA, 21 nt, Human
ccaacagucuuacagugagca

SEQ ID NO: 694544 - RNA, 24 nt, Human
ccacuuacagaauugaacauguca

SEQ ID NO: 694545 - RNA, 19 nt, Human
cccuccugucucucuucuc

SEQ ID NO: 694546 - RNA, 22 nt, Human
ccuccugucucucuucuccaaa

SEQ ID NO: 694547 - RNA, 21 nt, Human
ccugaacucuaaaaaccuaag

SEQ ID NO: 694548 - RNA, 22 nt, Human
ccuuaagcugguuuuaccccuc

SEQ ID NO: 694549 - RNA, 25 nt, Human
ccuuuauuuuaaugugucaaaaaaa

SEQ ID NO: 694550 - RNA, 19 nt, Human
cuaaagagcaaugacucaa

SEQ ID NO: 694551 - RNA, 23 nt, Human
cuaaagagcaaugacucaaccag

SEQ ID NO: 694552 - RNA, 23 nt, Human
cucaaaaagucaccacuuacaga

SEQ ID NO: 694553 - RNA, 24 nt, Human
cucaaccagaaaaaauaguaaagg

SEQ ID NO: 694554 - RNA, 22 nt, Human
cucaauacacaccacuguccaa

SEQ ID NO: 694555 - RNA, 25 nt, Human
cugccuuuuccuuuuuaaagugcuu

SEQ ID NO: 694556 - RNA, 22 nt, Human
cuggaaauuaaaaauauccaaa

SEQ ID NO: 694557 - RNA, 26 nt, Human
cuuaaagauauucuuguaaauacaua

SEQ ID NO: 694558 - RNA, 23 nt, Human
cuuuuaaaaauugucagggaggu

SEQ ID NO: 694559 - RNA, 24 nt, Human
gaaaauucuuauuuaaaaauggau

SEQ ID NO: 694560 - RNA, 24 nt, Human
gagacugaauuauauauuauugug

SEQ ID NO: 694561 - RNA, 21 nt, Human
gauuaaauagauuaaggaaau

SEQ ID NO: 694562 - RNA, 21 nt, Human
guggaaaaggaaagaaaaauc

SEQ ID NO: 694563 - RNA, 29 nt, Human
guuagaaagaaguggaaaaggaaagaaaa

SEQ ID NO: 694564 - RNA, 24 nt, Human
uaagaagaaaauauuccuuuaaaa

SEQ ID NO: 694565 - RNA, 21 nt, Human
uaauacugaaaggugcucaaa

SEQ ID NO: 694566 - RNA, 22 nt, Human
uacaaauacauaauacugaaag

SEQ ID NO: 694567 - RNA, 20 nt, Human
uacaacaaagccuauuucca

SEQ ID NO: 694568 - RNA, 21 nt, Human
uacacaccacuguccaacagu

SEQ ID NO: 694569 - RNA, 20 nt, Human
uagaauuucugagcacgaac

SEQ ID NO: 694570 - RNA, 20 nt, Human
uagagcauuuuauaguauag

SEQ ID NO: 694571 - RNA, 24 nt, Human
uagagcauuuuauaguauaggaag

SEQ ID NO: 694572 - RNA, 18 nt, Human
uauaucuuaagaagaaaa

SEQ ID NO: 694573 - RNA, 20 nt, Human
uauuucacuccacauaaaca

SEQ ID NO: 694574 - RNA, 21 nt, Human
ucaaaucaagacagugcuaag

SEQ ID NO: 694575 - RNA, 20 nt, Human
ucaauacacaccacugucca

SEQ ID NO: 694576 - RNA, 22 nt, Human
ucaauacacaccacuguccaac

SEQ ID NO: 694577 - RNA, 18 nt, Human
ucaguggaucacagcaga

SEQ ID NO: 694578 - RNA, 20 nt, Human
uccacauaaacaguaaacau

SEQ ID NO: 694579 - RNA, 22 nt, Human
uccaccaaaaaagcaagaagaa

SEQ ID NO: 694580 - RNA, 21 nt, Human
ucugcauuaaugaagauugcu

SEQ ID NO: 694581 - RNA, 21 nt, Human
ugaaauccugaacucuaaaaa

SEQ ID NO: 694582 - RNA, 23 nt, Human
ugaaauccugaacucuaaaaacc

SEQ ID NO: 694583 - RNA, 21 nt, Human
ugaaaucuauugcugaugcua

SEQ ID NO: 694584 - RNA, 21 nt, Human
ugaauauaauaaagcaaucca

SEQ ID NO: 694585 - RNA, 28 nt, Human
ugacaaauacacauuaaaaaggguuucc

SEQ ID NO: 694586 - RNA, 21 nt, Human
ugacagcagaacaaaccccag

SEQ ID NO: 694587 - RNA, 22 nt, Human
ugacagcagaacaaaccccagc

SEQ ID NO: 694588 - RNA, 19 nt, Human
ugggggguaauuaagcuac

SEQ ID NO: 694589 - RNA, 23 nt, Human
uguaaauacauauaagcugugug

SEQ ID NO: 694590 - RNA, 26 nt, Human
uguacaacauauuaacuauauauaua

SEQ ID NO: 694591 - RNA, 21 nt, Human
uguauuucuuaagagcuugac

SEQ ID NO: 694592 - RNA, 23 nt, Human
ugucaaaaaaacacuuaaagaua

SEQ ID NO: 694593 - RNA, 22 nt, Human
ugucagggagguuugcaaucag

SEQ ID NO: 694594 - RNA, 20 nt, Human
uguuauugugacaaauacac

SEQ ID NO: 694595 - RNA, 25 nt, Human
uuaaaaauauccaaaucuguuagaa

SEQ ID NO: 694596 - RNA, 22 nt, Human
uuacaaauacauaauacugaaa

SEQ ID NO: 694597 - RNA, 20 nt, Human
uugcuucaaauggcucucaa

SEQ ID NO: 694598 - RNA, 22 nt, Human
uuuaaaaauugucagggagguu

SEQ ID NO: 694599 - RNA, 19 nt, Human
uuuaaagugcuuauuagcu

SEQ ID NO: 694600 - RNA, 21 nt, Human
uuuacaaauacauaauacuga

SEQ ID NO: 694601 - RNA, 20 nt, Human
uuuucugcaugagacuaucg

SEQ ID NO: 694602 - RNA, 19 nt, Human
agcccagugcugggggaca

SEQ ID NO: 694603 - RNA, 29 nt, Human
agguagggggugggauguugggggacccc

SEQ ID NO: 694604 - RNA, 22 nt, Human
cacccuuggcccccacugaagu

SEQ ID NO: 694605 - RNA, 24 nt, Human
cacccuuggcccccacugaaguuc

SEQ ID NO: 694606 - RNA, 20 nt, Human
caggaccugggaaggggcac

SEQ ID NO: 694607 - RNA, 18 nt, Human
caggguccucuuccugac

SEQ ID NO: 694608 - RNA, 22 nt, Human
ccuguggaggcaggaccuggga

SEQ ID NO: 694609 - RNA, 22 nt, Human
cugggggacaggguccucuucc

SEQ ID NO: 694610 - RNA, 20 nt, Human
gcagccugugggaugacuug

SEQ ID NO: 694611 - RNA, 21 nt, Human
ggagguagggggugggauguu

SEQ ID NO: 694612 - RNA, 20 nt, Human
ucagcacccuuggcccccac

SEQ ID NO: 694613 - RNA, 20 nt, Human
ucauugcuggguucucagca

SEQ ID NO: 694614 - RNA, 19 nt, Human
ucuaggugaagcccagugc

SEQ ID NO: 694615 - RNA, 22 nt, Human
ugcaaggucccauauggaggua

SEQ ID NO: 694616 - RNA, 21 nt, Human
uuuuuuuuuuuuacugacaaa

SEQ ID NO: 694617 - RNA, 23 nt, Human
uuuuuuuuuuuuuuuuuuacuga

SEQ ID NO: 694618 - RNA, 19 nt, Human
aaagugcugggauuacagg

SEQ ID NO: 694619 - RNA, 24 nt, Human
aaagugcugggauuacaggcgcga

SEQ ID NO: 694620 - RNA, 23 nt, Human
aaccucaagugauccguccgccu

SEQ ID NO: 694621 - RNA, 24 nt, Human
aagugauccguccgccuuggccuc

SEQ ID NO: 694622 - RNA, 18 nt, Human
aagugcugggauuacagg

SEQ ID NO: 694623 - RNA, 19 nt, Human
aagugcugggauuacaggc

SEQ ID NO: 694624 - RNA, 18 nt, Human
aaucaugauuucuaauuc

SEQ ID NO: 694625 - RNA, 23 nt, Human
acacaaacacaggaaacaaagcu

SEQ ID NO: 694626 - RNA, 23 nt, Human
acaccaauuacuguauagaaaaa

SEQ ID NO: 694627 - RNA, 22 nt, Human
acagaagaaaaugaaccuuauu

SEQ ID NO: 694628 - RNA, 23 nt, Human
acaguaaauaagaagucccugaa

SEQ ID NO: 694629 - RNA, 18 nt, Human
accauguuggccaggcug

SEQ ID NO: 694630 - RNA, 20 nt, Human
acccguuuuucuucuauacc

SEQ ID NO: 694631 - RNA, 18 nt, Human
agcugguagguggcagaa

SEQ ID NO: 694632 - RNA, 20 nt, Human
agguagauggccaaagcuga

SEQ ID NO: 694633 - RNA, 18 nt, Human
augggguuucaccauguu

SEQ ID NO: 694634 - RNA, 22 nt, Human
augggguuucaccauguuggcc

SEQ ID NO: 694635 - RNA, 24 nt, Human
augggguuucaccauguuggccag

SEQ ID NO: 694636 - RNA, 18 nt, Human
caaagaucugaaacccca

SEQ ID NO: 694637 - RNA, 24 nt, Human
caaagugcugggauuacaggcgcg

SEQ ID NO: 694638 - RNA, 19 nt, Human
cacacaaacacaggaaaca

SEQ ID NO: 694639 - RNA, 21 nt, Human
caccauguuggccaggcuggu

SEQ ID NO: 694640 - RNA, 24 nt, Human
caccauguuggccaggcuggucuc

SEQ ID NO: 694641 - RNA, 27 nt, Human
caccauguuggccaggcuggucucaaa

SEQ ID NO: 694642 - RNA, 21 nt, Human
cagguagauggccaaagcuga

SEQ ID NO: 694643 - RNA, 24 nt, Human
cauguuggccaggcuggucucaaa

SEQ ID NO: 694644 - RNA, 21 nt, Human
ccaaaaaucagacuuucuaau

SEQ ID NO: 694645 - RNA, 19 nt, Human
ccaaagugcugggauuaca

SEQ ID NO: 694646 - RNA, 20 nt, Human
ccaaagugcugggauuacag

SEQ ID NO: 694647 - RNA, 22 nt, Human
ccaaagugcugggauuacaggc

SEQ ID NO: 694648 - RNA, 23 nt, Human
ccaaagugcugggauuacaggcg

SEQ ID NO: 694649 - RNA, 22 nt, Human
ccacacaaacacaggaaacaaa

SEQ ID NO: 694650 - RNA, 21 nt, Human
ccgccuuggccucccaaagug

SEQ ID NO: 694651 - RNA, 18 nt, Human
ccuaaccucaagugaucc

SEQ ID NO: 694652 - RNA, 26 nt, Human
cuccuaaccucaagugauccguccgc

SEQ ID NO: 694653 - RNA, 20 nt, Human
cuucuauaccacacaccaau

SEQ ID NO: 694654 - RNA, 24 nt, Human
gaacccguuuuucuucuauaccac

SEQ ID NO: 694655 - RNA, 23 nt, Human
gaaccuuauuaaagcugaaugac

SEQ ID NO: 694656 - RNA, 21 nt, Human
gaagugggguuugaacccguu

SEQ ID NO: 694657 - RNA, 18 nt, Human
gagaugggguuucaccau

SEQ ID NO: 694658 - RNA, 24 nt, Human
gagaugggguuucaccauguuggc

SEQ ID NO: 694659 - RNA, 19 nt, Human
gauuacaggcgcgacacug

SEQ ID NO: 694660 - RNA, 22 nt, Human
gccuuggccucccaaagugcug

SEQ ID NO: 694661 - RNA, 23 nt, Human
gcuggucucaaacuccuaaccuc

SEQ ID NO: 694662 - RNA, 23 nt, Human
ggcagaagugggguuugaacccg

SEQ ID NO: 694663 - RNA, 22 nt, Human
gggguuucaccauguuggccag

SEQ ID NO: 694664 - RNA, 18 nt, Human
ggguuucaccauguuggc

SEQ ID NO: 694665 - RNA, 22 nt, Human
ggguuucaccauguuggccagg

SEQ ID NO: 694666 - RNA, 23 nt, Human
guagagaugggguuucaccaugu

SEQ ID NO: 694667 - RNA, 18 nt, Human
guccacacaaacacagga

SEQ ID NO: 694668 - RNA, 19 nt, Human
uaaccucaagugauccguc

SEQ ID NO: 694669 - RNA, 20 nt, Human
uaauaaaaaagaaaauccuu

SEQ ID NO: 694670 - RNA, 18 nt, Human
uaauaagaauccagccug

SEQ ID NO: 694671 - RNA, 24 nt, Human
uagaaaaauagcugaauugcuccu

SEQ ID NO: 694672 - RNA, 22 nt, Human
uagagaugggguuucaccaugu

SEQ ID NO: 694673 - RNA, 24 nt, Human
uaguagagaugggguuucaccaug

SEQ ID NO: 694674 - RNA, 26 nt, Human
uaguagagaugggguuucaccauguu

SEQ ID NO: 694675 - RNA, 22 nt, Human
uauuaauaaaaaagaaaauccu

SEQ ID NO: 694676 - RNA, 18 nt, Human
ucacagauaacaauaagc

SEQ ID NO: 694677 - RNA, 23 nt, Human
ucagguagauggccaaagcugau

SEQ ID NO: 694678 - RNA, 26 nt, Human
uccacacaaacacaggaaacaaagcu

SEQ ID NO: 694679 - RNA, 24 nt, Human
ucccaaagugcugggauuacaggc

SEQ ID NO: 694680 - RNA, 20 nt, Human
ugacaaaauucaacaugaug

SEQ ID NO: 694681 - RNA, 19 nt, Human
ugaugguggaguccacaca

SEQ ID NO: 694682 - RNA, 24 nt, Human
ugcauauuaauaaaaaagaaaauc

SEQ ID NO: 694683 - RNA, 22 nt, Human
ugcugggauuacaggcgcgaca

SEQ ID NO: 694684 - RNA, 24 nt, Human
uggccaggcuggucucaaacuccu

SEQ ID NO: 694685 - RNA, 18 nt, Human
ugggauuacaggcgcgac

SEQ ID NO: 694686 - RNA, 19 nt, Human
ugggauuacaggcgcgaca

SEQ ID NO: 694687 - RNA, 20 nt, Human
ugggauuacaggcgcgacac

SEQ ID NO: 694688 - RNA, 20 nt, Human
ugggauuacaggcgcgacac

SEQ ID NO: 694689 - RNA, 22 nt, Human
ugggauuacaggcgcgacacug

SEQ ID NO: 694690 - RNA, 23 nt, Human
ugggauuacaggcgcgacacugu

SEQ ID NO: 694691 - RNA, 24 nt, Human
ugggguuucaccauguuggccagg

SEQ ID NO: 694692 - RNA, 20 nt, Human
ugucagugauagagaguacc

SEQ ID NO: 694693 - RNA, 21 nt, Human
uuaaacagaagaaaaugaacc

SEQ ID NO: 694694 - RNA, 22 nt, Human
uuaaagcugaaugacucauuca

SEQ ID NO: 694695 - RNA, 18 nt, Human
uuaguagagaugggguuu

SEQ ID NO: 694696 - RNA, 22 nt, Human
uuaguagagaugggguuucacc

SEQ ID NO: 694697 - RNA, 24 nt, Human
uuaguagagaugggguuucaccau

SEQ ID NO: 694698 - RNA, 19 nt, Human
uuaucacagauaacaauaa

SEQ ID NO: 694699 - RNA, 22 nt, Human
uucuaauuccaaaaaucagacu

SEQ ID NO: 694700 - RNA, 21 nt, Human
uucuucuauaccacacaccaa

SEQ ID NO: 694701 - RNA, 18 nt, Human
uugagccaucucuguaua

SEQ ID NO: 694702 - RNA, 24 nt, Human
uuuaaacagaagaaaaugaaccuu

SEQ ID NO: 694703 - RNA, 19 nt, Human
uuucaaguuuugugucuuu

SEQ ID NO: 694704 - RNA, 24 nt, Human
uuucaccauguuggccaggcuggu

SEQ ID NO: 694705 - RNA, 24 nt, Human
uuuuuaguagagaugggguuucac

SEQ ID NO: 694706 - RNA, 23 nt, Human
uuuuuuaguagagaugggguuuc

SEQ ID NO: 694707 - RNA, 21 nt, Human
aaaacagauaaauagaaaccc

SEQ ID NO: 694708 - RNA, 20 nt, Human
aaaagacaaccuauccagca

SEQ ID NO: 694709 - RNA, 23 nt, Human
aaacagauaaauagaaacccugg

SEQ ID NO: 694710 - RNA, 20 nt, Human
aaacauaaucaucaugugac

SEQ ID NO: 694711 - RNA, 24 nt, Human
aacauaaucaucaugugacugaca

SEQ ID NO: 694712 - RNA, 21 nt, Human
aauaaacagucuucuugggua

SEQ ID NO: 694713 - RNA, 22 nt, Human
aauaacaagugcauggaaagaa

SEQ ID NO: 694714 - RNA, 23 nt, Human
aauuacuuuuuaaaaauccuuuu

SEQ ID NO: 694715 - RNA, 21 nt, Human
acaaaagacaaccuauccagc

SEQ ID NO: 694716 - RNA, 21 nt, Human
acaaucucaccacagcaugaa

SEQ ID NO: 694717 - RNA, 20 nt, Human
acacuggucuggucucauca

SEQ ID NO: 694718 - RNA, 22 nt, Human
acagaauucucccugaaaucag

SEQ ID NO: 694719 - RNA, 18 nt, Human
aucauuguaaaaagggca

SEQ ID NO: 694720 - RNA, 20 nt, Human
auuucaucccugagaaguga

SEQ ID NO: 694721 - RNA, 23 nt, Human
caaaaacauaaucaucaugugac

SEQ ID NO: 694722 - RNA, 19 nt, Human
caaaagacaaccuauccag

SEQ ID NO: 694723 - RNA, 21 nt, Human
caaaauaauuaaccaaggagc

SEQ ID NO: 694724 - RNA, 25 nt, Human
caaggaacuucaaaacuuugaaaaa

SEQ ID NO: 694725 - RNA, 18 nt, Human
cacacuccacaaugugcu

SEQ ID NO: 694726 - RNA, 23 nt, Human
caccaagaaauagaaauguaaug

SEQ ID NO: 694727 - RNA, 20 nt, Human
caucaugugacugacagaau

SEQ ID NO: 694728 - RNA, 23 nt, Human
ccgaaguccaagcgauuucucuc

SEQ ID NO: 694729 - RNA, 20 nt, Human
ccuauugacaaacucaauga

SEQ ID NO: 694730 - RNA, 23 nt, Human
cguccgaggccgccccgaagucc

SEQ ID NO: 694731 - RNA, 21 nt, Human
cguggcgccuccacggccucg

SEQ ID NO: 694732 - RNA, 21 nt, Human
cuacaagugcaacauuaaaaa

SEQ ID NO: 694733 - RNA, 24 nt, Human
cuccaccaagaaauagaaauguaa

SEQ ID NO: 694734 - RNA, 20 nt, Human
gaaagaauuguuaaacaaaa

SEQ ID NO: 694735 - RNA, 24 nt, Human
gccaagcuaagauauaaauauucc

SEQ ID NO: 694736 - RNA, 22 nt, Human
uaaaaaaaaaaacagauaaaua

SEQ ID NO: 694737 - RNA, 21 nt, Human
uaaaaaaagagaagcaacagu

SEQ ID NO: 694738 - RNA, 24 nt, Human
uaaaacuguauuaugagauaggca

SEQ ID NO: 694739 - RNA, 24 nt, Human
uaaaugcuucacaauaaacagucu

SEQ ID NO: 694740 - RNA, 18 nt, Human
uacuauuaacacugagca

SEQ ID NO: 694741 - RNA, 19 nt, Human
uagaaaaauaucuaaaaaa

SEQ ID NO: 694742 - RNA, 23 nt, Human
uaucuaaaaaaagagaagcaaca

SEQ ID NO: 694743 - RNA, 19 nt, Human
ucacacuccacaaugugcu

SEQ ID NO: 694744 - RNA, 24 nt, Human
uccaagcgauuucucucccgccgc

SEQ ID NO: 694745 - RNA, 22 nt, Human
ucccugagaagugagagauaga

SEQ ID NO: 694746 - RNA, 19 nt, Human
uccucuucugagucuccau

SEQ ID NO: 694747 - RNA, 19 nt, Human
uccuggagaguuacugccc

SEQ ID NO: 694748 - RNA, 18 nt, Human
ucugacaaugaaaaucug

SEQ ID NO: 694749 - RNA, 24 nt, Human
ucuugcacccuuuuaacaaucuca

SEQ ID NO: 694750 - RNA, 24 nt, Human
ugaaaaagaauuucaucccugaga

SEQ ID NO: 694751 - RNA, 20 nt, Human
ugacugacagaauucucccu

SEQ ID NO: 694752 - RNA, 25 nt, Human
ugacugacagaauucucccugaaau

SEQ ID NO: 694753 - RNA, 23 nt, Human
ugagacauaaaaacaaaagacaa

SEQ ID NO: 694754 - RNA, 21 nt, Human
ugagauaggcaaacaaucuca

SEQ ID NO: 694755 - RNA, 23 nt, Human
ugcaaggaacuucaaaacuuuga

SEQ ID NO: 694756 - RNA, 21 nt, Human
ugccauucuacaccuuuaaaa

SEQ ID NO: 694757 - RNA, 24 nt, Human
uuaaaaauccuuuuaauuuuaucu

SEQ ID NO: 694758 - RNA, 25 nt, Human
uuccaguccuggagaguuacugccu

SEQ ID NO: 694759 - RNA, 24 nt, Human
uucuccuauaaacaaagaugccau

SEQ ID NO: 694760 - RNA, 27 nt, Human
uucuccuauaaacaaagaugccauucu

SEQ ID NO: 694761 - RNA, 24 nt, Human
uucucucccgccgccgcaagggac

SEQ ID NO: 694762 - RNA, 19 nt, Human
uugugggcuaauauuuacg

SEQ ID NO: 694763 - RNA, 22 nt, Human
uuuaaaucaucauuguaaaaag

SEQ ID NO: 694764 - RNA, 21 nt, Human
uuuuaugcagaaagguugaaa

SEQ ID NO: 694765 - RNA, 24 nt, Human
uuuucugacaaugaaaaucuguag

SEQ ID NO: 694766 - RNA, 24 nt, Human
aaagugcugggauuacaggcauga

SEQ ID NO: 694767 - RNA, 28 nt, Human
aacaaaaauggaaaacagaaccacacaa

SEQ ID NO: 694768 - RNA, 21 nt, Human
aacucgcggcacuacaaccuu

SEQ ID NO: 694769 - RNA, 22 nt, Human
aagaggagcucaacucgcggca

SEQ ID NO: 694770 - RNA, 24 nt, Human
aagugaucugcccgccuuggccuc

SEQ ID NO: 694771 - RNA, 19 nt, Human
aagugcugggauuacaggc

SEQ ID NO: 694772 - RNA, 21 nt, Human
aagugcugggauuacaggcau

SEQ ID NO: 694773 - RNA, 18 nt, Human
acaggguuucaccauguu

SEQ ID NO: 694774 - RNA, 21 nt, Human
acaggguuucaccauguuggc

SEQ ID NO: 694775 - RNA, 24 nt, Human
acaggguuucaccauguuggccag

SEQ ID NO: 694776 - RNA, 18 nt, Human
accauguuggccaggcug

SEQ ID NO: 694777 - RNA, 19 nt, Human
acccaggcuggagugcagu

SEQ ID NO: 694778 - RNA, 18 nt, Human
accuucccgcccccgcug

SEQ ID NO: 694779 - RNA, 22 nt, Human
acucacugucacccaggcugga

SEQ ID NO: 694780 - RNA, 24 nt, Human
acucacugucacccaggcuggagu

SEQ ID NO: 694781 - RNA, 25 nt, Human
aggcuggagugcagugacaccgucu

SEQ ID NO: 694782 - RNA, 23 nt, Human
aguagcugggauuacaggcgugu

SEQ ID NO: 694783 - RNA, 24 nt, Human
agugcagugacaccgucucagcuc

SEQ ID NO: 694784 - RNA, 18 nt, Human
agugcugggauuacaggc

SEQ ID NO: 694785 - RNA, 22 nt, Human
aguggcaauuggucagcacuuc

SEQ ID NO: 694786 - RNA, 19 nt, Human
aguuauaaguccagaaaga

SEQ ID NO: 694787 - RNA, 19 nt, Human
auuacaggcgugugccacc

SEQ ID NO: 694788 - RNA, 21 nt, Human
caaaaaauaucaaaguucacc

SEQ ID NO: 694789 - RNA, 24 nt, Human
caaagugcugggauuacaggcaug

SEQ ID NO: 694790 - RNA, 22 nt, Human
caagcgauucuccugccucagc

SEQ ID NO: 694791 - RNA, 24 nt, Human
caaucaccugggacccgaggacac

SEQ ID NO: 694792 - RNA, 23 nt, Human
cacacaaacucaucauuuaugug

SEQ ID NO: 694793 - RNA, 25 nt, Human
cacacaaacucaucauuuauguggu

SEQ ID NO: 694794 - RNA, 21 nt, Human
caccauguuggccaggcuggu

SEQ ID NO: 694795 - RNA, 24 nt, Human
caccauguuggccaggcuggucuc

SEQ ID NO: 694796 - RNA, 27 nt, Human
caccauguuggccaggcuggucucaaa

SEQ ID NO: 694797 - RNA, 20 nt, Human
caccugggacccgaggacac

SEQ ID NO: 694798 - RNA, 19 nt, Human
cacuacaaccuucccgccc

SEQ ID NO: 694799 - RNA, 21 nt, Human
cacugcaaccccugccuccca

SEQ ID NO: 694800 - RNA, 19 nt, Human
cagcacuucacaaucaccu

SEQ ID NO: 694801 - RNA, 20 nt, Human
cagccuccugaguagcuggg

SEQ ID NO: 694802 - RNA, 25 nt, Human
cagcuuccacagcucucaucauccu

SEQ ID NO: 694803 - RNA, 24 nt, Human
caggguuucaccauguuggccagg

SEQ ID NO: 694804 - RNA, 24 nt, Human
cauguuggccaggcuggucucaaa

SEQ ID NO: 694805 - RNA, 23 nt, Human
ccaaagugcugggauuacaggca

SEQ ID NO: 694806 - RNA, 24 nt, Human
ccaaagugcugggauuacaggcau

SEQ ID NO: 694807 - RNA, 24 nt, Human
cccaaagugcugggauuacaggca

SEQ ID NO: 694808 - RNA, 20 nt, Human
cccagguucaagcgauucuc

SEQ ID NO: 694809 - RNA, 23 nt, Human
cccagguucaagcgauucuccug

SEQ ID NO: 694810 - RNA, 22 nt, Human
cccgccuuggccucccaaagug

SEQ ID NO: 694811 - RNA, 20 nt, Human
ccgcccccgcugcgcuuccc

SEQ ID NO: 694812 - RNA, 24 nt, Human
ccucccagguucaagcgauucucc

SEQ ID NO: 694813 - RNA, 23 nt, Human
ccugaguagcugggauuacaggc

SEQ ID NO: 694814 - RNA, 23 nt, Human
ccugaguagcugggauuacaggc

SEQ ID NO: 694815 - RNA, 22 nt, Human
ccugaucucaagugaucugccc

SEQ ID NO: 694816 - RNA, 22 nt, Human
ccugggacccgaggacaccggg

SEQ ID NO: 694817 - RNA, 18 nt, Human
cgaggacaccgggaccgc

SEQ ID NO: 694818 - RNA, 24 nt, Human
cggcacuacaaccuucccgccccc

SEQ ID NO: 694819 - RNA, 24 nt, Human
cgugugccaccacacauggcuaau

SEQ ID NO: 694820 - RNA, 20 nt, Human
cucaagugaucugcccgccu

SEQ ID NO: 694821 - RNA, 24 nt, Human
cucacugcaaccccugccucccag

SEQ ID NO: 694822 - RNA, 21 nt, Human
cucacugucacccaggcugga

SEQ ID NO: 694823 - RNA, 23 nt, Human
cucagccuccugaguagcuggga

SEQ ID NO: 694824 - RNA, 22 nt, Human
cuccugccucagccuccugagu

SEQ ID NO: 694825 - RNA, 24 nt, Human
cuccuuacaaucgcugcucuuaaa

SEQ ID NO: 694826 - RNA, 22 nt, Human
cugaguagcugggauuacaggc

SEQ ID NO: 694827 - RNA, 24 nt, Human
cugaguagcugggauuacaggcgu

SEQ ID NO: 694828 - RNA, 21 nt, Human
cugcaaccccugccucccagg

SEQ ID NO: 694829 - RNA, 23 nt, Human
cugcaaccccugccucccagguu

SEQ ID NO: 694830 - RNA, 24 nt, Human
cugcaaccccugccucccagguuc

SEQ ID NO: 694831 - RNA, 23 nt, Human
cugccucagccuccugaguagcu

SEQ ID NO: 694832 - RNA, 19 nt, Human
cugcucuuaaagggggcgc

SEQ ID NO: 694833 - RNA, 19 nt, Human
cuucccgcccccgcugcgc

SEQ ID NO: 694834 - RNA, 20 nt, Human
cuugaaaaucuacuguggac

SEQ ID NO: 694835 - RNA, 25 nt, Human
cuuucagcuuucacuuacacauucc

SEQ ID NO: 694836 - RNA, 24 nt, Human
cuuuuaguagagacaggguuucac

SEQ ID NO: 694837 - RNA, 26 nt, Human
gaacaaaaauggaaaacagaaccaca

SEQ ID NO: 694838 - RNA, 20 nt, Human
gaguagcugggauuacaggc

SEQ ID NO: 694839 - RNA, 25 nt, Human
gaguagcugggauuacaggcgugug

SEQ ID NO: 694840 - RNA, 18 nt, Human
gauuacaggcaugaggca

SEQ ID NO: 694841 - RNA, 20 nt, Human
gauuacaggcaugaggcacc

SEQ ID NO: 694842 - RNA, 18 nt, Human
gauuacaggcgugugcca

SEQ ID NO: 694843 - RNA, 21 nt, Human
gauucuccugccucagccucc

SEQ ID NO: 694844 - RNA, 20 nt, Human
gccucagccuccugaguagc

SEQ ID NO: 694845 - RNA, 22 nt, Human
gccuuggccucccaaagugcug

SEQ ID NO: 694846 - RNA, 24 nt, Human
gcgauucuccugccucagccuccu

SEQ ID NO: 694847 - RNA, 20 nt, Human
gcuggagugcagugacaccg

SEQ ID NO: 694848 - RNA, 24 nt, Human
ggauuacaggcaugaggcaccgug

SEQ ID NO: 694849 - RNA, 24 nt, Human
ggcuggucucaaacuccugaucuc

SEQ ID NO: 694850 - RNA, 22 nt, Human
ggguuucaccauguuggccagg

SEQ ID NO: 694851 - RNA, 18 nt, Human
guagcugggauuacaggc

SEQ ID NO: 694852 - RNA, 23 nt, Human
gugugccaccacacauggcuaau

SEQ ID NO: 694853 - RNA, 22 nt, Human
uaaaagcagccuuguuucuuua

SEQ ID NO: 694854 - RNA, 22 nt, Human
uaaacagcaaauauggaugcaa

SEQ ID NO: 694855 - RNA, 18 nt, Human
uaaacgcaaaagguauac

SEQ ID NO: 694856 - RNA, 24 nt, Human
uaauuuuuuauacuuuuaguagag

SEQ ID NO: 694857 - RNA, 24 nt, Human
uacaggcaugaggcaccgugccca

SEQ ID NO: 694858 - RNA, 22 nt, Human
uagagacaggguuucaccaugu

SEQ ID NO: 694859 - RNA, 24 nt, Human
uaguagagacaggguuucaccaug

SEQ ID NO: 694860 - RNA, 26 nt, Human
uaguagagacaggguuucaccauguu

SEQ ID NO: 694861 - RNA, 21 nt, Human
uauaaaagaugguuaagacug

SEQ ID NO: 694862 - RNA, 20 nt, Human
uauuacaaagucacuuuucc

SEQ ID NO: 694863 - RNA, 24 nt, Human
ucacccaggcuggagugcagugac

SEQ ID NO: 694864 - RNA, 18 nt, Human
ucacugcaaccccugccu

SEQ ID NO: 694865 - RNA, 19 nt, Human
ucacugcaaccccugccuc

SEQ ID NO: 694866 - RNA, 24 nt, Human
ucacugcaaccccugccucccagg

SEQ ID NO: 694867 - RNA, 23 nt, Human
ucacugucacccaggcuggagug

SEQ ID NO: 694868 - RNA, 20 nt, Human
ucagccuccugaguagcugg

SEQ ID NO: 694869 - RNA, 26 nt, Human
ucagcucacugcaaccccugccuccc

SEQ ID NO: 694870 - RNA, 24 nt, Human
ucccaaagugcugggauuacaggc

SEQ ID NO: 694871 - RNA, 21 nt, Human
ucccagguucaagcgauucuc

SEQ ID NO: 694872 - RNA, 24 nt, Human
ucccagguucaagcgauucuccug

SEQ ID NO: 694873 - RNA, 24 nt, Human
uccugaguagcugggauuacaggc

SEQ ID NO: 694874 - RNA, 22 nt, Human
uccuuggacgauacagcuucca

SEQ ID NO: 694875 - RNA, 24 nt, Human
uccuuggacgauacagcuuccaca

SEQ ID NO: 694876 - RNA, 24 nt, Human
ugacaccgucucagcucacugcaa

SEQ ID NO: 694877 - RNA, 20 nt, Human
ugacuauaaacgcaaaaggu

SEQ ID NO: 694878 - RNA, 20 nt, Human
ugauaguagcuuuggcauuu

SEQ ID NO: 694879 - RNA, 18 nt, Human
ugaucucaagugaucugc

SEQ ID NO: 694880 - RNA, 24 nt, Human
ugaucucaagugaucugcccgccu

SEQ ID NO: 694881 - RNA, 24 nt, Human
ugccucagccuccugaguagcugg

SEQ ID NO: 694882 - RNA, 24 nt, Human
ugcugggauuacaggcaugaggca

SEQ ID NO: 694883 - RNA, 20 nt, Human
uggaaaacagaaccacacaa

SEQ ID NO: 694884 - RNA, 23 nt, Human
uggagugcagugacaccgucuca

SEQ ID NO: 694885 - RNA, 24 nt, Human
uggccaggcuggucucaaacuccu

SEQ ID NO: 694886 - RNA, 18 nt, Human
ugggauuacaggcaugag

SEQ ID NO: 694887 - RNA, 18 nt, Human
ugggauuacaggcaugag

SEQ ID NO: 694888 - RNA, 19 nt, Human
ugggauuacaggcaugagg

SEQ ID NO: 694889 - RNA, 21 nt, Human
ugggauuacaggcaugaggca

SEQ ID NO: 694890 - RNA, 22 nt, Human
ugggauuacaggcaugaggcac

SEQ ID NO: 694891 - RNA, 23 nt, Human
ugggauuacaggcaugaggcacc

SEQ ID NO: 694892 - RNA, 23 nt, Human
ugggauuacaggcaugaggcacc

SEQ ID NO: 694893 - RNA, 24 nt, Human
ugggauuacaggcaugaggcaccg

SEQ ID NO: 694894 - RNA, 18 nt, Human
ugggauuacaggcgugug

SEQ ID NO: 694895 - RNA, 19 nt, Human
ugggauuacaggcgugugc

SEQ ID NO: 694896 - RNA, 21 nt, Human
ugggauuacaggcgugugcca

SEQ ID NO: 694897 - RNA, 22 nt, Human
ugggauuacaggcgugugccac

SEQ ID NO: 694898 - RNA, 24 nt, Human
ugggauuacaggcgugugccacca

SEQ ID NO: 694899 - RNA, 21 nt, Human
ugucacccaggcuggagugca

SEQ ID NO: 694900 - RNA, 24 nt, Human
uuaaagugaaaaagggggaaguag

SEQ ID NO: 694901 - RNA, 20 nt, Human
uuacaggcaugaggcaccgu

SEQ ID NO: 694902 - RNA, 24 nt, Human
uuaguagagacaggguuucaccau

SEQ ID NO: 694903 - RNA, 25 nt, Human
uuaguucauuuuuuaaaagcagccu

SEQ ID NO: 694904 - RNA, 21 nt, Human
uucaagcgauucuccugccuc

SEQ ID NO: 694905 - RNA, 23 nt, Human
uucaagcgauucuccugccucag

SEQ ID NO: 694906 - RNA, 24 nt, Human
uucaagcgauucuccugccucagc

SEQ ID NO: 694907 - RNA, 22 nt, Human
uucacuuacacauuccuuucuu

SEQ ID NO: 694908 - RNA, 23 nt, Human
uucuugagguuuguuuuaaagug

SEQ ID NO: 694909 - RNA, 24 nt, Human
uuucaccauguuggccaggcuggu

SEQ ID NO: 694910 - RNA, 21 nt, Human
uuuuuauacuuuuaguagaga

SEQ ID NO: 694911 - RNA, 24 nt, Human
uuuuuuauacuuuuaguagagaca

SEQ ID NO: 694912 - RNA, 19 nt, Human
agauaggaggcugaagggg

SEQ ID NO: 694913 - RNA, 26 nt, Human
cagcaguccuccagccucagccuccc

SEQ ID NO: 694914 - RNA, 23 nt, Human
caggugccgaggcaagagaccga

SEQ ID NO: 694915 - RNA, 26 nt, Human
caggugccgaggcaagagaccgaggg

SEQ ID NO: 694916 - RNA, 22 nt, Human
ccaccguggucuagcuguagcg

SEQ ID NO: 694917 - RNA, 18 nt, Human
ccagaagacaagagugcg

SEQ ID NO: 694918 - RNA, 26 nt, Human
ccuccagccucagccucccaaagugc

SEQ ID NO: 694919 - RNA, 31 nt, Human
ccuggccuccagcaguccuccagccucagcc

SEQ ID NO: 694920 - RNA, 22 nt, Human
cgaggcaagagaccgagggcac

SEQ ID NO: 694921 - RNA, 22 nt, Human
cgcucuacaaucauaaccuagg

SEQ ID NO: 694922 - RNA, 19 nt, Human
cuccagcaguccuccagcc

SEQ ID NO: 694923 - RNA, 25 nt, Human
cuccagccucagccucccaaagugc

SEQ ID NO: 694924 - RNA, 21 nt, Human
cugguauugaacuccuggccu

SEQ ID NO: 694925 - RNA, 21 nt, Human
gaggcaagagaccgagggcac

SEQ ID NO: 694926 - RNA, 23 nt, Human
gccuccagcaguccuccagccuc

SEQ ID NO: 694927 - RNA, 22 nt, Human
gcugguauugaacuccuggccu

SEQ ID NO: 694928 - RNA, 23 nt, Human
gcugguauugaacuccuggccuc

SEQ ID NO: 694929 - RNA, 24 nt, Human
ggcugguauugaacuccuggccuc

SEQ ID NO: 694930 - RNA, 24 nt, Human
gggggucucccuauguugcccagg

SEQ ID NO: 694931 - RNA, 22 nt, Human
gggucucccuauguugcccagg

SEQ ID NO: 694932 - RNA, 19 nt, Human
gguauugaacuccuggccu

SEQ ID NO: 694933 - RNA, 18 nt, Human
uaaccuaggaaacaccag

SEQ ID NO: 694934 - RNA, 23 nt, Human
uauguugcccaggcugguauuga

SEQ ID NO: 694935 - RNA, 24 nt, Human
uauguugcccaggcugguauugaa

SEQ ID NO: 694936 - RNA, 21 nt, Human
ucagccucccaaagugcacuu

SEQ ID NO: 694937 - RNA, 24 nt, Human
ucagccucccaaagugcacuuggg

SEQ ID NO: 694938 - RNA, 19 nt, Human
ucccaaagugcacuuggug

SEQ ID NO: 694939 - RNA, 19 nt, Human
uccuccagccucagccucc

SEQ ID NO: 694940 - RNA, 21 nt, Human
ucuacaaucauaaccuaggaa

SEQ ID NO: 694941 - RNA, 23 nt, Human
ucucccuauguugcccaggcugg

SEQ ID NO: 694942 - RNA, 24 nt, Human
ucucccuauguugcccaggcuggu

SEQ ID NO: 694943 - RNA, 24 nt, Human
ugaacuccuggccuccagcagucc

SEQ ID NO: 694944 - RNA, 19 nt, Human
ugcacuugguggauguggg

SEQ ID NO: 694945 - RNA, 24 nt, Human
ugcccaggcugguauugaacuccu

SEQ ID NO: 694946 - RNA, 19 nt, Human
ugggaagacaccuguugcc

SEQ ID NO: 694947 - RNA, 23 nt, Human
ugugggcagcaagccacccaggu

SEQ ID NO: 694948 - RNA, 18 nt, Human
aaagcgccuccaccucuc

SEQ ID NO: 694949 - RNA, 24 nt, Human
aagccuauuucccccacuuagaau

SEQ ID NO: 694950 - RNA, 24 nt, Human
aauuucgcaaaguggauccugcca

SEQ ID NO: 694951 - RNA, 18 nt, Human
acacccggaagggugaac

SEQ ID NO: 694952 - RNA, 23 nt, Human
acagccccgcaccgcccucgcgc

SEQ ID NO: 694953 - RNA, 24 nt, Human
acaguccacaauuucgcaaagugg

SEQ ID NO: 694954 - RNA, 22 nt, Human
auuauucauuaaaauccguuaa

SEQ ID NO: 694955 - RNA, 22 nt, Human
caaaguggauccugccagcaug

SEQ ID NO: 694956 - RNA, 20 nt, Human
caccgcccucgcgcucucac

SEQ ID NO: 694957 - RNA, 18 nt, Human
ccaggagggaggggcaca

SEQ ID NO: 694958 - RNA, 21 nt, Human
ccccacuuagaaucacagucc

SEQ ID NO: 694959 - RNA, 22 nt, Human
cccccacuuagaaucacagucc

SEQ ID NO: 694960 - RNA, 22 nt, Human
cccgcaccgcccucgcgcucuc

SEQ ID NO: 694961 - RNA, 24 nt, Human
cucaccuuucaaagcgccuccacc

SEQ ID NO: 694962 - RNA, 19 nt, Human
guggauccugccagcaugg

SEQ ID NO: 694963 - RNA, 20 nt, Human
guggauccugccagcauggu

SEQ ID NO: 694964 - RNA, 24 nt, Human
uagaaucacaguccaacaguccac

SEQ ID NO: 694965 - RNA, 20 nt, Human
uucaaagcgccuccaccucc

SEQ ID NO: 694966 - RNA, 22 nt, Human
aaaaaagaaaaagauaaauggg

SEQ ID NO: 694967 - RNA, 23 nt, Human
aaaaaagaaaaagauaaaugggc

SEQ ID NO: 694968 - RNA, 24 nt, Human
aaaagauaaaugggcacauauaua

SEQ ID NO: 694969 - RNA, 20 nt, Human
aaaauacugucaauuucuac

SEQ ID NO: 694970 - RNA, 20 nt, Human
aagaaaaagauaaaugggca

SEQ ID NO: 694971 - RNA, 19 nt, Human
aauuucuacugggccaaca

SEQ ID NO: 694972 - RNA, 22 nt, Human
cacauguacuccuggcacagcc

SEQ ID NO: 694973 - RNA, 18 nt, Human
caccgcagauaauacugc

SEQ ID NO: 694974 - RNA, 19 nt, Human
cagucuuucccugcagagu

SEQ ID NO: 694975 - RNA, 21 nt, Human
cauguacuccuggcacagcca

SEQ ID NO: 694976 - RNA, 24 nt, Human
cccccaccgcagauaauacugcuu

SEQ ID NO: 694977 - RNA, 24 nt, Human
cuacugggccaacacaguagccac

SEQ ID NO: 694978 - RNA, 23 nt, Human
cuauaucuccuccccccaccgca

SEQ ID NO: 694979 - RNA, 19 nt, Human
gcaccugagccuccuugcc

SEQ ID NO: 694980 - RNA, 21 nt, Human
gccacaauaccagucucuggg

SEQ ID NO: 694981 - RNA, 21 nt, Human
gcuuccucggguggcccuugg

SEQ ID NO: 694982 - RNA, 24 nt, Human
uagccacugcaauguuucuccuuu

SEQ ID NO: 694983 - RNA, 20 nt, Human
uaugucaccuacuccacgug

SEQ ID NO: 694984 - RNA, 22 nt, Human
uccuugccagucuuucccugca

SEQ ID NO: 694985 - RNA, 23 nt, Human
uggcacagccacaauaccagucu

SEQ ID NO: 694986 - RNA, 18 nt, Human
uggcagggagcuggagug

SEQ ID NO: 694987 - RNA, 21 nt, Human
ugggccaacacaguagccacu

SEQ ID NO: 694988 - RNA, 21 nt, Human
augauggugagggcgaaggug

SEQ ID NO: 694989 - RNA, 19 nt, Human
cgaugauggugagggcgaa

SEQ ID NO: 694990 - RNA, 18 nt, Human
uuuuuuuuuuucaagggc

SEQ ID NO: 694991 - RNA, 20 nt, Human
uuuuuuuuuuucaagggcaa

SEQ ID NO: 694992 - RNA, 24 nt, Human
uuuuuuuuuuuuuuuuuuucaagg

SEQ ID NO: 694993 - RNA, 19 nt, Human
acagcucgaucagcaacag

SEQ ID NO: 694994 - RNA, 22 nt, Human
acucucugaauccgagggcaga

SEQ ID NO: 694995 - RNA, 25 nt, Human
agcaacagauacugggcauuugucu

SEQ ID NO: 694996 - RNA, 19 nt, Human
aucaauauccaauaaaagg

SEQ ID NO: 694997 - RNA, 21 nt, Human
cacccugcgcugcccucugcc

SEQ ID NO: 694998 - RNA, 23 nt, Human
cagauacugggcauuugucucuu

SEQ ID NO: 694999 - RNA, 19 nt, Human
cagcaacagauacugggca

SEQ ID NO: 695000 - RNA, 21 nt, Human
ccuccacggcuucaaacccau

SEQ ID NO: 695001 - RNA, 23 nt, Human
cugaugcugcaacuuugaucagc

SEQ ID NO: 695002 - RNA, 22 nt, Human
cugcgcugcccucugccuccac

SEQ ID NO: 695003 - RNA, 18 nt, Human
cuuccauauaaaaacugu

SEQ ID NO: 695004 - RNA, 24 nt, Human
ggcacccugcgcugcccucugccu

SEQ ID NO: 695005 - RNA, 21 nt, Human
uaaacauauuauaauggcaaa

SEQ ID NO: 695006 - RNA, 21 nt, Human
ucaauauccaauaaaaggcuu

SEQ ID NO: 695007 - RNA, 26 nt, Human
ucucugaauccgagggcagaaguugg

SEQ ID NO: 695008 - RNA, 25 nt, Human
ugaauaccgaaaaucaauauccaau

SEQ ID NO: 695009 - RNA, 23 nt, Human
ugaucagcucaugcaaccuuggu

SEQ ID NO: 695010 - RNA, 22 nt, Human
uuccccggcacccugcgcugcc

SEQ ID NO: 695011 - RNA, 18 nt, Human
uugaauguaauagccaga

SEQ ID NO: 695012 - RNA, 19 nt, Human
cacagcuggaggcaguggc

SEQ ID NO: 695013 - RNA, 20 nt, Human
cacagcuggaggcaguggcc

SEQ ID NO: 695014 - RNA, 22 nt, Human
aaaaauagcaugaagcuguggc

SEQ ID NO: 695015 - RNA, 20 nt, Human
aaaauagcaugaagcugugg

SEQ ID NO: 695016 - RNA, 24 nt, Human
aaagccccuuccuuuuagcacccu

SEQ ID NO: 695017 - RNA, 23 nt, Human
aagucaguucuggcacuuacugg

SEQ ID NO: 695018 - RNA, 21 nt, Human
acagcuguaaaacagggauac

SEQ ID NO: 695019 - RNA, 22 nt, Human
agccaaguggaauuuacuggga

SEQ ID NO: 695020 - RNA, 21 nt, Human
aucaagacagagagcuagguu

SEQ ID NO: 695021 - RNA, 26 nt, Human
augaaacaucuagcaaaaaguaagca

SEQ ID NO: 695022 - RNA, 21 nt, Human
caccaauggaaagagcaguag

SEQ ID NO: 695023 - RNA, 18 nt, Human
cagaaagguuccuaaaaa

SEQ ID NO: 695024 - RNA, 20 nt, Human
ccaccugcuacuucccuuuu

SEQ ID NO: 695025 - RNA, 21 nt, Human
cccuuuuuuuuuuuuuuuccc

SEQ ID NO: 695026 - RNA, 24 nt, Human
ccucugaaaccccagccaagugga

SEQ ID NO: 695027 - RNA, 20 nt, Human
ccugaaucaagacagagagc

SEQ ID NO: 695028 - RNA, 23 nt, Human
ccuuuuuuuuuuuuuuucccauu

SEQ ID NO: 695029 - RNA, 19 nt, Human
cuacuucccuuuuuuuuuu

SEQ ID NO: 695030 - RNA, 25 nt, Human
cucaaagccccuuccuuuuagcacc

SEQ ID NO: 695031 - RNA, 19 nt, Human
cugaaaccccagccaagug

SEQ ID NO: 695032 - RNA, 20 nt, Human
cugaaaccccagccaagugg

SEQ ID NO: 695033 - RNA, 18 nt, Human
cugggaacugggucacac

SEQ ID NO: 695034 - RNA, 19 nt, Human
gcugcauaggaccuuuaac

SEQ ID NO: 695035 - RNA, 27 nt, Human
uaaaaggaacaaaaaaauuuaugauag

SEQ ID NO: 695036 - RNA, 19 nt, Human
uaagcaggggucccugugc

SEQ ID NO: 695037 - RNA, 19 nt, Human
uacuucccuuuuuuuuuuu

SEQ ID NO: 695038 - RNA, 23 nt, Human
uaucccaucaucuuugccucuca

SEQ ID NO: 695039 - RNA, 18 nt, Human
ucccuuuuuuuuuuuuuu

SEQ ID NO: 695040 - RNA, 22 nt, Human
ucccuuuuuuuuuuuuuuuccc

SEQ ID NO: 695041 - RNA, 24 nt, Human
uccuucacuucacuuuccacagcu

SEQ ID NO: 695042 - RNA, 20 nt, Human
ugaguaaaaagccugcuugc

SEQ ID NO: 695043 - RNA, 24 nt, Human
ugcuugcucaccucugaaacccca

SEQ ID NO: 695044 - RNA, 26 nt, Human
ugcuugcucaccucugaaaccccagc

SEQ ID NO: 695045 - RNA, 20 nt, Human
uggcaacuguagaugugcag

SEQ ID NO: 695046 - RNA, 23 nt, Human
ugggcugccacugguuucagaaa

SEQ ID NO: 695047 - RNA, 23 nt, Human
uguaaaacagggauacgggauaa

SEQ ID NO: 695048 - RNA, 21 nt, Human
uuacaugugacugaugcugga

SEQ ID NO: 695049 - RNA, 21 nt, Human
uuaucuccaccugcuacuucc

SEQ ID NO: 695050 - RNA, 18 nt, Human
uuuccuaucaaucccuaa

SEQ ID NO: 695051 - RNA, 22 nt, Human
uuuuuuuuuuuuuuucccauuu

SEQ ID NO: 695052 - RNA, 24 nt, Human
aaaagcagguaaaggagaaggcca

SEQ ID NO: 695053 - RNA, 21 nt, Human
aacacacuucauccaaaaguc

SEQ ID NO: 695054 - RNA, 22 nt, Human
aacacacuucauccaaaagucu

SEQ ID NO: 695055 - RNA, 21 nt, Human
aacauauugacauuuuuuccc

SEQ ID NO: 695056 - RNA, 23 nt, Human
aaccaguacuggaaacuaaccuc

SEQ ID NO: 695057 - RNA, 21 nt, Human
aacuugacuggggcccuucug

SEQ ID NO: 695058 - RNA, 23 nt, Human
aagcagguaaaggagaaggccag

SEQ ID NO: 695059 - RNA, 24 nt, Human
aagcagguaaaggagaaggccagg

SEQ ID NO: 695060 - RNA, 22 nt, Human
aagugaucgugaucagcagaac

SEQ ID NO: 695061 - RNA, 23 nt, Human
aaucuuucaaaaucaucauuuaa

SEQ ID NO: 695062 - RNA, 22 nt, Human
aaugauaaggagcaggaagaaa

SEQ ID NO: 695063 - RNA, 18 nt, Human
acaagcaggaaaucugca

SEQ ID NO: 695064 - RNA, 24 nt, Human
acacagcuuucaaauaauaccucu

SEQ ID NO: 695065 - RNA, 23 nt, Human
acagcaaaagaccaagaaauaaa

SEQ ID NO: 695066 - RNA, 24 nt, Human
acagcaaaagaccaagaaauaaaa

SEQ ID NO: 695067 - RNA, 19 nt, Human
acauacacacauacaguau

SEQ ID NO: 695068 - RNA, 21 nt, Human
accaagaaaaccuccaucacg

SEQ ID NO: 695069 - RNA, 19 nt, Human
accaaugucagugacccca

SEQ ID NO: 695070 - RNA, 21 nt, Human
accacacucucuacacacaua

SEQ ID NO: 695071 - RNA, 18 nt, Human
accuuauccucuucccca

SEQ ID NO: 695072 - RNA, 18 nt, Human
acuaaugauuccuccaca

SEQ ID NO: 695073 - RNA, 24 nt, Human
acuagccauaccauggaguuacac

SEQ ID NO: 695074 - RNA, 21 nt, Human
agaaaagcagguaaaggagaa

SEQ ID NO: 695075 - RNA, 21 nt, Human
agaagacaauuaucacacuag

SEQ ID NO: 695076 - RNA, 20 nt, Human
agaaggccaggcacugugcc

SEQ ID NO: 695077 - RNA, 19 nt, Human
agacacugcaagcuacucc

SEQ ID NO: 695078 - RNA, 21 nt, Human
aggaaaucugcagcuccucug

SEQ ID NO: 695079 - RNA, 20 nt, Human
aggaagaaaagcagguaaag

SEQ ID NO: 695080 - RNA, 20 nt, Human
aggaagaaaagcagguaaag

SEQ ID NO: 695081 - RNA, 22 nt, Human
aggaagaaaagcagguaaagga

SEQ ID NO: 695082 - RNA, 22 nt, Human
aguuuccaacauauugacauuu

SEQ ID NO: 695083 - RNA, 22 nt, Human
auacacuaacacaauaccaaca

SEQ ID NO: 695084 - RNA, 23 nt, Human
auaugauuaagacaaaguacacc

SEQ ID NO: 695085 - RNA, 23 nt, Human
aucacacauaauuauucccaauu

SEQ ID NO: 695086 - RNA, 24 nt, Human
caaagcucaaugauaaggagcagg

SEQ ID NO: 695087 - RNA, 27 nt, Human
caagaaaaccuccaucacggagaaugc

SEQ ID NO: 695088 - RNA, 22 nt, Human
caagaaaaugucuacaaacuca

SEQ ID NO: 695089 - RNA, 23 nt, Human
caaugaacaucccuggcccucuc

SEQ ID NO: 695090 - RNA, 22 nt, Human
cacauacacacauacaguauaa

SEQ ID NO: 695091 - RNA, 24 nt, Human
caccacacucucuacacacauaca

SEQ ID NO: 695092 - RNA, 22 nt, Human
cacccuuaaaaucuucugcaua

SEQ ID NO: 695093 - RNA, 21 nt, Human
caggaaccaagaaaaccucca

SEQ ID NO: 695094 - RNA, 18 nt, Human
caggcacugugccaggug

SEQ ID NO: 695095 - RNA, 19 nt, Human
cauaacaccaucacacaua

SEQ ID NO: 695096 - RNA, 24 nt, Human
caucacggagaaugcauucugaua

SEQ ID NO: 695097 - RNA, 18 nt, Human
ccaaaacauuucagaaau

SEQ ID NO: 695098 - RNA, 19 nt, Human
cccaacacacuucauccaa

SEQ ID NO: 695099 - RNA, 19 nt, Human
ccuacuguggguugcugcu

SEQ ID NO: 695100 - RNA, 20 nt, Human
ccuggcccucucagucugac

SEQ ID NO: 695101 - RNA, 23 nt, Human
cucaaugauaaggagcaggaaga

SEQ ID NO: 695102 - RNA, 19 nt, Human
cuguggguugcugcucagg

SEQ ID NO: 695103 - RNA, 18 nt, Human
cuuuaagaaaaaaggucc

SEQ ID NO: 695104 - RNA, 22 nt, Human
cuuuaagccucaccacacucuc

SEQ ID NO: 695105 - RNA, 20 nt, Human
gagccaggaaccaagaaaaa

SEQ ID NO: 695106 - RNA, 22 nt, Human
guacuggauaaaauagucauau

SEQ ID NO: 695107 - RNA, 20 nt, Human
guaggacaauaaagugaucg

SEQ ID NO: 695108 - RNA, 21 nt, Human
gugaaacauacaaauacagaa

SEQ ID NO: 695109 - RNA, 22 nt, Human
guugcacagcuguauaaaaaaa

SEQ ID NO: 695110 - RNA, 18 nt, Human
guuuacauaacaccauca

SEQ ID NO: 695111 - RNA, 24 nt, Human
uaaaaaaauaggaauaugauuaag

SEQ ID NO: 695112 - RNA, 23 nt, Human
uaaaacucgcucagcccccuuaa

SEQ ID NO: 695113 - RNA, 19 nt, Human
uaaagacacugcaagcuac

SEQ ID NO: 695114 - RNA, 26 nt, Human
uaaagacacugcaagcuacuccaguc

SEQ ID NO: 695115 - RNA, 22 nt, Human
uaaucuccacaaugaacauccc

SEQ ID NO: 695116 - RNA, 23 nt, Human
uaaucuccacaaugaacaucccu

SEQ ID NO: 695117 - RNA, 21 nt, Human
uacaagcaggaaaucugcagc

SEQ ID NO: 695118 - RNA, 25 nt, Human
uacacacauacacacauacaguaua

SEQ ID NO: 695119 - RNA, 18 nt, Human
uacuagggaaacauuuac

SEQ ID NO: 695120 - RNA, 21 nt, Human
uagucauauuacuagggaaac

SEQ ID NO: 695121 - RNA, 24 nt, Human
uauuauagugaaacauacaaauac

SEQ ID NO: 695122 - RNA, 21 nt, Human
ucacuuacucagaacauuuaa

SEQ ID NO: 695123 - RNA, 22 nt, Human
ucagaacauuuaaucuccacaa

SEQ ID NO: 695124 - RNA, 23 nt, Human
ucagaagacaauuaucacacuag

SEQ ID NO: 695125 - RNA, 27 nt, Human
ucagugaccccacccuuaaaaucuucu

SEQ ID NO: 695126 - RNA, 24 nt, Human
ucauccaucauguauucugauccc

SEQ ID NO: 695127 - RNA, 24 nt, Human
uccaaacuucucuuuccucaggac

SEQ ID NO: 695128 - RNA, 23 nt, Human
uccacaaugaacaucccuggccc

SEQ ID NO: 695129 - RNA, 24 nt, Human
uccacaaugaacaucccuggcccu

SEQ ID NO: 695130 - RNA, 22 nt, Human
ucccagaagcaauaugguugca

SEQ ID NO: 695131 - RNA, 30 nt, Human
uccccaacacacuucauccaaaagucuguu

SEQ ID NO: 695132 - RNA, 22 nt, Human
ucccccgucaaaccccaguaag

SEQ ID NO: 695133 - RNA, 18 nt, Human
uccgugagagcguggcca

SEQ ID NO: 695134 - RNA, 22 nt, Human
ucuacacacauacacacauaca

SEQ ID NO: 695135 - RNA, 19 nt, Human
ucucaaugcacauuauccu

SEQ ID NO: 695136 - RNA, 18 nt, Human
ucuccacaaugaacaucc

SEQ ID NO: 695137 - RNA, 18 nt, Human
ugaaacagcccauuuucc

SEQ ID NO: 695138 - RNA, 23 nt, Human
ugacauuuuuucccagaagcaau

SEQ ID NO: 695139 - RNA, 25 nt, Human
ugcauucugauacaucaacuacugu

SEQ ID NO: 695140 - RNA, 21 nt, Human
ugcccaaaacauuucagaaau

SEQ ID NO: 695141 - RNA, 24 nt, Human
ugugccagguguuuacauaacacc

SEQ ID NO: 695142 - RNA, 23 nt, Human
uguuuacauaacaccaucacaca

SEQ ID NO: 695143 - RNA, 31 nt, Human
uuacauaacaccaucacacauaauuauuccc

SEQ ID NO: 695144 - RNA, 22 nt, Human
uuagguaucauacauaaaagcc

SEQ ID NO: 695145 - RNA, 25 nt, Human
uugacucuacucaaauuaacuauau

SEQ ID NO: 695146 - RNA, 20 nt, Human
uugcugcucaggaggaacga

SEQ ID NO: 695147 - RNA, 19 nt, Human
uuggcuuaaaaucugaguu

SEQ ID NO: 695148 - RNA, 18 nt, Human
uugguccauacacuaaca

SEQ ID NO: 695149 - RNA, 20 nt, Human
uugugcuucaacggcagcug

SEQ ID NO: 695150 - RNA, 20 nt, Human
uuuucuggucaaugcucuga

SEQ ID NO: 695151 - RNA, 24 nt, Human
uuuuucagaguuuuggcuaaaacu

SEQ ID NO: 695152 - RNA, 22 nt, Human
aagaacacacaagaaauauaua

SEQ ID NO: 695153 - RNA, 26 nt, Human
acacaagaaauauauaggauuucagu

SEQ ID NO: 695154 - RNA, 20 nt, Human
agagaagccagugcuggccg

SEQ ID NO: 695155 - RNA, 27 nt, Human
agagaagccagugcuggccggcgcaga

SEQ ID NO: 695156 - RNA, 21 nt, Human
caaauagaaaagaacacacaa

SEQ ID NO: 695157 - RNA, 21 nt, Human
gaaaagaacacacaagaaaua

SEQ ID NO: 695158 - RNA, 23 nt, Human
gauauggugaaauggagaugaug

SEQ ID NO: 695159 - RNA, 22 nt, Human
uaauaaaggauauaauucagca

SEQ ID NO: 695160 - RNA, 18 nt, Human
ucuggguucuucuccugg

SEQ ID NO: 695161 - RNA, 28 nt, Human
ugagcagaagcaagauguucuacauuca

SEQ ID NO: 695162 - RNA, 21 nt, Human
uuacaaauagaaaagaacaca

SEQ ID NO: 695163 - RNA, 22 nt, Human
uuuacaaauagaaaagaacaca

SEQ ID NO: 695164 - RNA, 21 nt, Human
uuuuuuuuuuuuuuuuuccgg

SEQ ID NO: 695165 - RNA, 28 nt, Human
uuuuuuuuuuuuuuuuuccggggaauua

SEQ ID NO: 695166 - RNA, 24 nt, Human
uuuuuuuuuuuuuuuuuuuccggg

SEQ ID NO: 695167 - RNA, 19 nt, Human
aaaacagugacauaaucug

SEQ ID NO: 695168 - RNA, 20 nt, Human
aacacuugguacagauacga

SEQ ID NO: 695169 - RNA, 20 nt, Human
aagaacaauccucagagauu

SEQ ID NO: 695170 - RNA, 19 nt, Human
aagaaucuauagcuuaaaa

SEQ ID NO: 695171 - RNA, 19 nt, Human
aagcaggagggaguuaugg

SEQ ID NO: 695172 - RNA, 25 nt, Human
aagccagucaugguaacaugauggc

SEQ ID NO: 695173 - RNA, 21 nt, Human
aagcugccuaguaaccacuua

SEQ ID NO: 695174 - RNA, 22 nt, Human
aaugggagaaaggcuggagaag

SEQ ID NO: 695175 - RNA, 18 nt, Human
aauguccaucauuucgcg

SEQ ID NO: 695176 - RNA, 21 nt, Human
acucugccauccacaaacaag

SEQ ID NO: 695177 - RNA, 24 nt, Human
acuuccucauggaccuccucauca

SEQ ID NO: 695178 - RNA, 22 nt, Human
agacaaggaguuagaaaucaag

SEQ ID NO: 695179 - RNA, 19 nt, Human
agaggcuacuuugaagguu

SEQ ID NO: 695180 - RNA, 18 nt, Human
agaucagacuuuggcaga

SEQ ID NO: 695181 - RNA, 20 nt, Human
agcaaaugagccugguugug

SEQ ID NO: 695182 - RNA, 18 nt, Human
aggagggaguuaugggua

SEQ ID NO: 695183 - RNA, 22 nt, Human
aggaguuagaaaucaagaguuc

SEQ ID NO: 695184 - RNA, 23 nt, Human
aggaguuagaaaucaagaguucu

SEQ ID NO: 695185 - RNA, 23 nt, Human
agggauauauuuuauaggcagag

SEQ ID NO: 695186 - RNA, 22 nt, Human
agguaguuuuggaaaugcuggg

SEQ ID NO: 695187 - RNA, 19 nt, Human
aguacugaccgaucaucau

SEQ ID NO: 695188 - RNA, 19 nt, Human
agugaggugguaauaaacu

SEQ ID NO: 695189 - RNA, 23 nt, Human
augggacuagguaguuuuggaaa

SEQ ID NO: 695190 - RNA, 18 nt, Human
cagugacauaaucugacu

SEQ ID NO: 695191 - RNA, 23 nt, Human
ccucauggaccuccucaucacuu

SEQ ID NO: 695192 - RNA, 18 nt, Human
cgggcggcggcgccgggc

SEQ ID NO: 695193 - RNA, 25 nt, Human
cucaacucugccauccacaaacaau

SEQ ID NO: 695194 - RNA, 24 nt, Human
cuggggaaaaaaaaaaagccuugu

SEQ ID NO: 695195 - RNA, 24 nt, Human
gacacgaauagugauaucacaaaa

SEQ ID NO: 695196 - RNA, 21 nt, Human
gaccgaucaucaucauccgga

SEQ ID NO: 695197 - RNA, 20 nt, Human
gagaagcaggauucagacaa

SEQ ID NO: 695198 - RNA, 22 nt, Human
gaugaagagugguaaggaaaaa

SEQ ID NO: 695199 - RNA, 21 nt, Human
gcagaguugacaggacuuaag

SEQ ID NO: 695200 - RNA, 20 nt, Human
gcuggggaaaaaaaaaaagc

SEQ ID NO: 695201 - RNA, 18 nt, Human
ggagaagcaggauucaga

SEQ ID NO: 695202 - RNA, 19 nt, Human
ggagcuaugaguaaauguu

SEQ ID NO: 695203 - RNA, 20 nt, Human
gggaagaaugcaaucagagg

SEQ ID NO: 695204 - RNA, 21 nt, Human
gggcggcggcgccgggcccgg

SEQ ID NO: 695205 - RNA, 22 nt, Human
uaauuaaaaaagaaaagaugau

SEQ ID NO: 695206 - RNA, 20 nt, Human
uacagauuagaaaaguagac

SEQ ID NO: 695207 - RNA, 24 nt, Human
uacuuugaagguuauugcaguagu

SEQ ID NO: 695208 - RNA, 22 nt, Human
ucacagcaguccguacagcaca

SEQ ID NO: 695209 - RNA, 19 nt, Human
ucacucagcgaacucugag

SEQ ID NO: 695210 - RNA, 21 nt, Human
ucauccggagagcauuagugc

SEQ ID NO: 695211 - RNA, 20 nt, Human
ucguguagggcuuuagaagg

SEQ ID NO: 695212 - RNA, 23 nt, Human
ucugacuuaauuaaaaaagaaaa

SEQ ID NO: 695213 - RNA, 21 nt, Human
ugaaaugcccuuuauacauuu

SEQ ID NO: 695214 - RNA, 21 nt, Human
ugacaggcugggacacuuccu

SEQ ID NO: 695215 - RNA, 20 nt, Human
ugagaugaaaugcuugaauu

SEQ ID NO: 695216 - RNA, 18 nt, Human
ugcgaaagaaaucacugc

SEQ ID NO: 695217 - RNA, 19 nt, Human
uggaacugucugcugauca

SEQ ID NO: 695218 - RNA, 24 nt, Human
uggagaagcaggauucagacaagg

SEQ ID NO: 695219 - RNA, 20 nt, Human
uggaguuguaaacucaaccc

SEQ ID NO: 695220 - RNA, 22 nt, Human
uggggaaaaaaaaaaagccuug

SEQ ID NO: 695221 - RNA, 22 nt, Human
ugguacagauacgauuuaaagc

SEQ ID NO: 695222 - RNA, 23 nt, Human
uguaaacucaacccuuaagaggu

SEQ ID NO: 695223 - RNA, 22 nt, Human
uguccuggacacgaauagugau

SEQ ID NO: 695224 - RNA, 22 nt, Human
uguuucaaccacucaacucugc

SEQ ID NO: 695225 - RNA, 24 nt, Human
uuacuuugaaaaguauacugaagu

SEQ ID NO: 695226 - RNA, 21 nt, Human
uugaaaaguauacugaaguga

SEQ ID NO: 695227 - RNA, 20 nt, Human
uuggacuuguucacuuccug

SEQ ID NO: 695228 - RNA, 19 nt, Human
uuucucauccucggcuugg

SEQ ID NO: 695229 - RNA, 23 nt, Human
uuugccaacacuugguacagaua

SEQ ID NO: 695230 - RNA, 22 nt, Human
uuuggcagauguuuuucacagc

SEQ ID NO: 695231 - RNA, 21 nt, Human
aaaaaaaaaaaaaauuagcug

SEQ ID NO: 695232 - RNA, 19 nt, Human
aaacaaacaccaacauuuc

SEQ ID NO: 695233 - RNA, 20 nt, Human
aaacaaacaccaacauuuca

SEQ ID NO: 695234 - RNA, 21 nt, Human
aaacagaaacaaacaccaaca

SEQ ID NO: 695235 - RNA, 22 nt, Human
aaacaugaaggacugccucuca

SEQ ID NO: 695236 - RNA, 19 nt, Human
aaagaaagagagaaagaga

SEQ ID NO: 695237 - RNA, 20 nt, Human
aaagcacccccuuccaucca

SEQ ID NO: 695238 - RNA, 19 nt, Human
aacaaguaucauacuuccu

SEQ ID NO: 695239 - RNA, 19 nt, Human
aacaucgugaaaccccauc

SEQ ID NO: 695240 - RNA, 20 nt, Human
aacaucgugaaaccccaucu

SEQ ID NO: 695241 - RNA, 21 nt, Human
aacaucgugaaaccccaucuc

SEQ ID NO: 695242 - RNA, 20 nt, Human
aacaugaaggacugccucuc

SEQ ID NO: 695243 - RNA, 19 nt, Human
aacauggugaaaccccauc

SEQ ID NO: 695244 - RNA, 20 nt, Human
aacauggugaaaccccaucu

SEQ ID NO: 695245 - RNA, 21 nt, Human
aacauggugaaaccccaucuc

SEQ ID NO: 695246 - RNA, 21 nt, Human
aacauggugaaaccccaucuc

SEQ ID NO: 695247 - RNA, 22 nt, Human
aacugugacacaccucuaaaca

SEQ ID NO: 695248 - RNA, 20 nt, Human
aagagaaaaagcguauaugc

SEQ ID NO: 695249 - RNA, 21 nt, Human
aagcacccccuuccauccaag

SEQ ID NO: 695250 - RNA, 18 nt, Human
aagccguggccugccucu

SEQ ID NO: 695251 - RNA, 23 nt, Human
aaucgcuugaacccaggaggagg

SEQ ID NO: 695252 - RNA, 19 nt, Human
aaugaaguccucaaggccu

SEQ ID NO: 695253 - RNA, 21 nt, Human
aaugaaguccucaaggccuuc

SEQ ID NO: 695254 - RNA, 21 nt, Human
aauucccaagucccagaggac

SEQ ID NO: 695255 - RNA, 24 nt, Human
aauugcuugaaucccagaggugga

SEQ ID NO: 695256 - RNA, 18 nt, Human
acacaccucuaaacaugc

SEQ ID NO: 695257 - RNA, 24 nt, Human
acagagcaagacuccaucucaaaa

SEQ ID NO: 695258 - RNA, 18 nt, Human
accccaucucuacuaaaa

SEQ ID NO: 695259 - RNA, 23 nt, Human
accccaucucuacuaaaaauaca

SEQ ID NO: 695260 - RNA, 23 nt, Human
acggcagcuuugcagcauggccu

SEQ ID NO: 695261 - RNA, 20 nt, Human
acucagccuggguggggggu

SEQ ID NO: 695262 - RNA, 24 nt, Human
acuccagcaugggggacagagcaa

SEQ ID NO: 695263 - RNA, 19 nt, Human
acucugcacucacccaucc

SEQ ID NO: 695264 - RNA, 18 nt, Human
acugcacuccagcauggg

SEQ ID NO: 695265 - RNA, 19 nt, Human
acugcacuccagccuuggg

SEQ ID NO: 695266 - RNA, 19 nt, Human
acugcacuccagccuuggg

SEQ ID NO: 695267 - RNA, 18 nt, Human
agaaauauguuugcccuu

SEQ ID NO: 695268 - RNA, 21 nt, Human
agacagggaacagugagagga

SEQ ID NO: 695269 - RNA, 21 nt, Human
agacgugcccuggccuguuuc

SEQ ID NO: 695270 - RNA, 28 nt, Human
agagagaaagagagacagagagagugac

SEQ ID NO: 695271 - RNA, 24 nt, Human
agagagugaccaagacagaccaca

SEQ ID NO: 695272 - RNA, 21 nt, Human
agagcacggccagccaggcug

SEQ ID NO: 695273 - RNA, 19 nt, Human
agaucacaaaaugaaagac

SEQ ID NO: 695274 - RNA, 21 nt, Human
agcaaauggaucacauccaag

SEQ ID NO: 695275 - RNA, 23 nt, Human
agccaggugugguggugggcgcc

SEQ ID NO: 695276 - RNA, 24 nt, Human
agccuggccaacaucgugaaaccc

SEQ ID NO: 695277 - RNA, 22 nt, Human
agccuggccaacauggugaaac

SEQ ID NO: 695278 - RNA, 24 nt, Human
agccuggccaacauggugaaaccc

SEQ ID NO: 695279 - RNA, 18 nt, Human
agcggccccugccaaugc

SEQ ID NO: 695280 - RNA, 24 nt, Human
agcuacucgagaggcugagguggg

SEQ ID NO: 695281 - RNA, 24 nt, Human
agcugggcaugguggcgcauagcu

SEQ ID NO: 695282 - RNA, 19 nt, Human
agcuguucgccucugccuc

SEQ ID NO: 695283 - RNA, 18 nt, Human
aggaaucaggcaggucuc

SEQ ID NO: 695284 - RNA, 19 nt, Human
aggaggaggagguugcagc

SEQ ID NO: 695285 - RNA, 22 nt, Human
aggaggaggagguugcagcgag

SEQ ID NO: 695286 - RNA, 24 nt, Human
aggaggagguugcagcgagccgag

SEQ ID NO: 695287 - RNA, 21 nt, Human
aggcaggccacacaggucaga

SEQ ID NO: 695288 - RNA, 20 nt, Human
aggccgaggcggguggauca

SEQ ID NO: 695289 - RNA, 22 nt, Human
aggcgggcagaucacuugaagg

SEQ ID NO: 695290 - RNA, 24 nt, Human
aggcggguggaucaugaggucagg

SEQ ID NO: 695291 - RNA, 24 nt, Human
aggcugagguaggagaaucgcuug

SEQ ID NO: 695292 - RNA, 24 nt, Human
aggcugaggugggagaauugcuug

SEQ ID NO: 695293 - RNA, 23 nt, Human
agguaggagaaucgcuugaaccc

SEQ ID NO: 695294 - RNA, 24 nt, Human
agguggagguugcagugagccaag

SEQ ID NO: 695295 - RNA, 24 nt, Human
aggugugggaaggucacuuucacu

SEQ ID NO: 695296 - RNA, 24 nt, Human
aggugugguggugggcgccuguaa

SEQ ID NO: 695297 - RNA, 23 nt, Human
aguggcucacgccuguaauccca

SEQ ID NO: 695298 - RNA, 24 nt, Human
aucaugccacugcacuccagcaug

SEQ ID NO: 695299 - RNA, 25 nt, Human
auugcaccacugcacuccagccuug

SEQ ID NO: 695300 - RNA, 20 nt, Human
auuguuuccuguuguuaauu

SEQ ID NO: 695301 - RNA, 22 nt, Human
caaaacagaaacaaacaccaac

SEQ ID NO: 695302 - RNA, 25 nt, Human
caaaacagaaacaaacaccaacauu

SEQ ID NO: 695303 - RNA, 20 nt, Human
caaacaaguaucauacuucc

SEQ ID NO: 695304 - RNA, 24 nt, Human
caacacuuggggaggccgaggcgg

SEQ ID NO: 695305 - RNA, 24 nt, Human
caacauggugaaaccccaucucua

SEQ ID NO: 695306 - RNA, 19 nt, Human
caaccauuccgucaaacaa

SEQ ID NO: 695307 - RNA, 21 nt, Human
caagacuccaucucaaaaaaa

SEQ ID NO: 695308 - RNA, 23 nt, Human
cacagggggacccaggaagccca

SEQ ID NO: 695309 - RNA, 20 nt, Human
caccaaacugaagaguaaac

SEQ ID NO: 695310 - RNA, 27 nt, Human
caccacugcacuccagccuuggggaca

SEQ ID NO: 695311 - RNA, 24 nt, Human
caccaggcagacagggaacaguga

SEQ ID NO: 695312 - RNA, 23 nt, Human
cacgccuguaaucccaacacuug

SEQ ID NO: 695313 - RNA, 23 nt, Human
cacuccagcaugggggacagagc

SEQ ID NO: 695314 - RNA, 18 nt, Human
cacugcacuccagcaugg

SEQ ID NO: 695315 - RNA, 19 nt, Human
cacugcacuccagcauggg

SEQ ID NO: 695316 - RNA, 19 nt, Human
cacugcacuccagcauggg

SEQ ID NO: 695317 - RNA, 24 nt, Human
cacugcacuccagcaugggggaca

SEQ ID NO: 695318 - RNA, 20 nt, Human
cacugcacuccagccuugga

SEQ ID NO: 695319 - RNA, 20 nt, Human
cacugcacuccagccuuggg

SEQ ID NO: 695320 - RNA, 20 nt, Human
cacugcacuccagccuuggg

SEQ ID NO: 695321 - RNA, 24 nt, Human
cacugcacuccagccuuggggaca

SEQ ID NO: 695322 - RNA, 24 nt, Human
cacuggucuucaucucuguucugg

SEQ ID NO: 695323 - RNA, 18 nt, Human
cacugugcugugcucagc

SEQ ID NO: 695324 - RNA, 21 nt, Human
cagaucacuugaaguuagauu

SEQ ID NO: 695325 - RNA, 24 nt, Human
cagcacuuugagagggcgaggcgg

SEQ ID NO: 695326 - RNA, 24 nt, Human
cagcuacucgagaggcugaggugg

SEQ ID NO: 695327 - RNA, 22 nt, Human
cagugagaaccagcguaaaaca

SEQ ID NO: 695328 - RNA, 20 nt, Human
caucuuguuggaauuugugg

SEQ ID NO: 695329 - RNA, 22 nt, Human
caugccuaaucccagcacuuug

SEQ ID NO: 695330 - RNA, 23 nt, Human
ccacacaggucagaaguggcugg

SEQ ID NO: 695331 - RNA, 21 nt, Human
ccacccccuucucggaccaag

SEQ ID NO: 695332 - RNA, 20 nt, Human
ccacugcacuccagcauggg

SEQ ID NO: 695333 - RNA, 22 nt, Human
ccacugcacuccagcauggggg

SEQ ID NO: 695334 - RNA, 24 nt, Human
ccacugcacuccagcaugggggac

SEQ ID NO: 695335 - RNA, 18 nt, Human
ccacugcacuccagccuu

SEQ ID NO: 695336 - RNA, 21 nt, Human
ccacugcacuccagccuuggg

SEQ ID NO: 695337 - RNA, 22 nt, Human
ccacugcacuccagccuugggg

SEQ ID NO: 695338 - RNA, 24 nt, Human
ccacugcacuccagccuuggggac

SEQ ID NO: 695339 - RNA, 24 nt, Human
ccagagguggagguugcagugagc

SEQ ID NO: 695340 - RNA, 21 nt, Human
ccagccuggccaacaucguga

SEQ ID NO: 695341 - RNA, 19 nt, Human
ccaggcacugugcugugcu

SEQ ID NO: 695342 - RNA, 20 nt, Human
cccagagguggagguugcag

SEQ ID NO: 695343 - RNA, 21 nt, Human
cccaugggcagauguggccca

SEQ ID NO: 695344 - RNA, 23 nt, Human
cccauguuuucccacuggucuuc

SEQ ID NO: 695345 - RNA, 18 nt, Human
ccccaugaccuaggcaga

SEQ ID NO: 695346 - RNA, 23 nt, Human
ccccugccaaugccgugugccca

SEQ ID NO: 695347 - RNA, 20 nt, Human
cccugugguucuuucagugg

SEQ ID NO: 695348 - RNA, 19 nt, Human
ccucugucuuggaaauaug

SEQ ID NO: 695349 - RNA, 18 nt, Human
ccugaaacccaacaaaag

SEQ ID NO: 695350 - RNA, 23 nt, Human
ccuggccaacaucgugaaacccc

SEQ ID NO: 695351 - RNA, 24 nt, Human
ccuggccaacaucgugaaacccca

SEQ ID NO: 695352 - RNA, 23 nt, Human
ccuggccaacauggugaaacccc

SEQ ID NO: 695353 - RNA, 24 nt, Human
ccuggccaacauggugaaacccca

SEQ ID NO: 695354 - RNA, 18 nt, Human
ccuguaaucccagcuacu

SEQ ID NO: 695355 - RNA, 21 nt, Human
ccuguaaucccagcuacuggg

SEQ ID NO: 695356 - RNA, 22 nt, Human
ccuguaaucccagcuacugggg

SEQ ID NO: 695357 - RNA, 21 nt, Human
ccuuggccugcugagagauca

SEQ ID NO: 695358 - RNA, 24 nt, Human
cgacuaggaaacagcucuagagau

SEQ ID NO: 695359 - RNA, 24 nt, Human
cgagaccagccuggccaacauggu

SEQ ID NO: 695360 - RNA, 23 nt, Human
cgagccgagaucaugccacugca

SEQ ID NO: 695361 - RNA, 22 nt, Human
cgaggcggguggaucaugaggu

SEQ ID NO: 695362 - RNA, 24 nt, Human
cgaggcggguggaucaugagguca

SEQ ID NO: 695363 - RNA, 22 nt, Human
cgccuguaaucccaacacuugg

SEQ ID NO: 695364 - RNA, 23 nt, Human
cgccuguaaucccaacacuuggg

SEQ ID NO: 695365 - RNA, 20 nt, Human
cuaauuucaaagauguugau

SEQ ID NO: 695366 - RNA, 18 nt, Human
cuacaguuaagacaaacu

SEQ ID NO: 695367 - RNA, 18 nt, Human
cuacuaaaaauacagaaa

SEQ ID NO: 695368 - RNA, 20 nt, Human
cuagaaaggagcugauuacu

SEQ ID NO: 695369 - RNA, 18 nt, Human
cuaggcagacauagugag

SEQ ID NO: 695370 - RNA, 22 nt, Human
cucacgccuguaaucccaacac

SEQ ID NO: 695371 - RNA, 24 nt, Human
cucacgccuguaaucccaacacuu

SEQ ID NO: 695372 - RNA, 19 nt, Human
cuccaucucaaaaaaaaaa

SEQ ID NO: 695373 - RNA, 24 nt, Human
cucucccuccucuaucccucuccc

SEQ ID NO: 695374 - RNA, 24 nt, Human
cugcucgugguucagucuguucag

SEQ ID NO: 695375 - RNA, 19 nt, Human
cugcugagagaucaccagg

SEQ ID NO: 695376 - RNA, 21 nt, Human
cuggagcuguucgccucugcc

SEQ ID NO: 695377 - RNA, 23 nt, Human
cuggccaacaucgugaaacccca

SEQ ID NO: 695378 - RNA, 23 nt, Human
cuggccaacauggugaaacccca

SEQ ID NO: 695379 - RNA, 24 nt, Human
cuguggccgcucccuugggagaug

SEQ ID NO: 695380 - RNA, 19 nt, Human
cuguucagauuguuuccug

SEQ ID NO: 695381 - RNA, 20 nt, Human
cuucagaagucgcagccccu

SEQ ID NO: 695382 - RNA, 24 nt, Human
cuuuucccauuuuccccaacuuuu

SEQ ID NO: 695383 - RNA, 20 nt, Human
gaaacaaacaccaacauuuc

SEQ ID NO: 695384 - RNA, 22 nt, Human
gaacaaacaguauauugcacaa

SEQ ID NO: 695385 - RNA, 24 nt, Human
gaagacccagagcacggccagcca

SEQ ID NO: 695386 - RNA, 20 nt, Human
gacaaaacagaaacaaacac

SEQ ID NO: 695387 - RNA, 20 nt, Human
gacacaccucuaaacaugcc

SEQ ID NO: 695388 - RNA, 19 nt, Human
gacuagaaaggagcugauu

SEQ ID NO: 695389 - RNA, 23 nt, Human
gagaaucgcuugaacccaggagg

SEQ ID NO: 695390 - RNA, 20 nt, Human
gagaggagaccuaggggugu

SEQ ID NO: 695391 - RNA, 23 nt, Human
gagaucaugccacugcacuccag

SEQ ID NO: 695392 - RNA, 23 nt, Human
gaggcggguggaucaugagguca

SEQ ID NO: 695393 - RNA, 24 nt, Human
gaggugggagaauugcuugaaucc

SEQ ID NO: 695394 - RNA, 18 nt, Human
gagguugcagugagccaa

SEQ ID NO: 695395 - RNA, 23 nt, Human
gagguugcagugagccaagauug

SEQ ID NO: 695396 - RNA, 22 nt, Human
gaucaugaggucaggaguucga

SEQ ID NO: 695397 - RNA, 24 nt, Human
gaucaugaggucaggaguucgaga

SEQ ID NO: 695398 - RNA, 19 nt, Human
gcacccccuuccauccaag

SEQ ID NO: 695399 - RNA, 24 nt, Human
gccaacaucgugaaaccccaucuc

SEQ ID NO: 695400 - RNA, 24 nt, Human
gccaacauggugaaaccccaucuc

SEQ ID NO: 695401 - RNA, 23 nt, Human
gccaugggaggggcaggaauucc

SEQ ID NO: 695402 - RNA, 21 nt, Human
ggaaaagaucacaaaaugaaa

SEQ ID NO: 695403 - RNA, 23 nt, Human
ggaagguuuggccaaaggacugg

SEQ ID NO: 695404 - RNA, 23 nt, Human
ggagguugcagcgagccgagauc

SEQ ID NO: 695405 - RNA, 24 nt, Human
ggagguugcagcgagccgagauca

SEQ ID NO: 695406 - RNA, 22 nt, Human
ggagguugcagugagccaagau

SEQ ID NO: 695407 - RNA, 24 nt, Human
ggagguugcagugagccaagauug

SEQ ID NO: 695408 - RNA, 20 nt, Human
ggaguagggaagacccagag

SEQ ID NO: 695409 - RNA, 23 nt, Human
ggauuauggggaagagaaaaagc

SEQ ID NO: 695410 - RNA, 23 nt, Human
ggccaaaggacuggaaaggggca

SEQ ID NO: 695411 - RNA, 23 nt, Human
ggcgccuguaaucccagcuacug

SEQ ID NO: 695412 - RNA, 23 nt, Human
ggcggguggaucaugaggucagg

SEQ ID NO: 695413 - RNA, 21 nt, Human
gggaagguuuggccaaaggac

SEQ ID NO: 695414 - RNA, 22 nt, Human
gggaagguuuggccaaaggacu

SEQ ID NO: 695415 - RNA, 23 nt, Human
gggaggccgaggcggguggauca

SEQ ID NO: 695416 - RNA, 22 nt, Human
gggaggcugagguaggagaauc

SEQ ID NO: 695417 - RNA, 26 nt, Human
gggcaugguggcgcauagcuguagcc

SEQ ID NO: 695418 - RNA, 19 nt, Human
gggccaugggaggggcagg

SEQ ID NO: 695419 - RNA, 20 nt, Human
ggggacccaggaagcccaau

SEQ ID NO: 695420 - RNA, 21 nt, Human
gggggguugggaacaccaggc

SEQ ID NO: 695421 - RNA, 22 nt, Human
gguaguucaugccuaaucccag

SEQ ID NO: 695422 - RNA, 23 nt, Human
ggugcaguggcucacgccuguaa

SEQ ID NO: 695423 - RNA, 23 nt, Human
gguggaucaugaggucaggaguu

SEQ ID NO: 695424 - RNA, 19 nt, Human
ggugggggguugggaacac

SEQ ID NO: 695425 - RNA, 24 nt, Human
gguggugggcgccuguaaucccag

SEQ ID NO: 695426 - RNA, 22 nt, Human
guacuggguccucugccagguc

SEQ ID NO: 695427 - RNA, 21 nt, Human
guagcuccagaggggcaccug

SEQ ID NO: 695428 - RNA, 23 nt, Human
guggaucaugaggucaggaguuc

SEQ ID NO: 695429 - RNA, 21 nt, Human
guggugagacgugcccuggcc

SEQ ID NO: 695430 - RNA, 22 nt, Human
uaaaaauacagaaauuaggccg

SEQ ID NO: 695431 - RNA, 26 nt, Human
uaaaaauuagccaggugugguggugg

SEQ ID NO: 695432 - RNA, 23 nt, Human
uaacugcaaaguucagguugguu

SEQ ID NO: 695433 - RNA, 18 nt, Human
uaacuguaucuuagacuc

SEQ ID NO: 695434 - RNA, 24 nt, Human
uaacugugacacaccucuaaacau

SEQ ID NO: 695435 - RNA, 23 nt, Human
uaccccaccaaacugaagaguaa

SEQ ID NO: 695436 - RNA, 24 nt, Human
uaccccaccaaacugaagaguaaa

SEQ ID NO: 695437 - RNA, 19 nt, Human
uacucagccuggguggggg

SEQ ID NO: 695438 - RNA, 25 nt, Human
uacuggguccucugccagguggggg

SEQ ID NO: 695439 - RNA, 18 nt, Human
uagaaaggagcugauuac

SEQ ID NO: 695440 - RNA, 24 nt, Human
uagccccagcuacucgagaggcug

SEQ ID NO: 695441 - RNA, 23 nt, Human
uagccuggggaugaccacccccu

SEQ ID NO: 695442 - RNA, 20 nt, Human
uaguucaugccuaaucccag

SEQ ID NO: 695443 - RNA, 22 nt, Human
uaguucaugccuaaucccagca

SEQ ID NO: 695444 - RNA, 18 nt, Human
ucaaagccacaauuccca

SEQ ID NO: 695445 - RNA, 20 nt, Human
ucacaaaaugaaagacccca

SEQ ID NO: 695446 - RNA, 22 nt, Human
ucaggaaugagaagccagaaga

SEQ ID NO: 695447 - RNA, 21 nt, Human
ucaggagugccacacuaaagc

SEQ ID NO: 695448 - RNA, 18 nt, Human
ucaucuugguuuccuucg

SEQ ID NO: 695449 - RNA, 24 nt, Human
ucaugaggucaggaguucgagacc

SEQ ID NO: 695450 - RNA, 21 nt, Human
ucaugccuaaucccagcacuu

SEQ ID NO: 695451 - RNA, 21 nt, Human
ucauguaguggucuguaagcc

SEQ ID NO: 695452 - RNA, 20 nt, Human
uccaaacugcgagagcaaca

SEQ ID NO: 695453 - RNA, 21 nt, Human
uccaggggccaggcugugaaa

SEQ ID NO: 695454 - RNA, 23 nt, Human
uccaucucaaaaaaaaaaaaaaa

SEQ ID NO: 695455 - RNA, 20 nt, Human
ucgcuugaacccaggaggag

SEQ ID NO: 695456 - RNA, 20 nt, Human
ucggacugaugaaaggggga

SEQ ID NO: 695457 - RNA, 18 nt, Human
ucuaccaaucacucaucc

SEQ ID NO: 695458 - RNA, 21 nt, Human
ucucuacuaaaaauaaaaauu

SEQ ID NO: 695459 - RNA, 24 nt, Human
ucugcugcucgugguucagucugu

SEQ ID NO: 695460 - RNA, 19 nt, Human
ucuguaagccguggccugc

SEQ ID NO: 695461 - RNA, 19 nt, Human
ucuguggguucugagagga

SEQ ID NO: 695462 - RNA, 19 nt, Human
ucuugguuuccuucgugcu

SEQ ID NO: 695463 - RNA, 19 nt, Human
ugaaaccccaucucuacua

SEQ ID NO: 695464 - RNA, 19 nt, Human
ugaaaccccaucucuacua

SEQ ID NO: 695465 - RNA, 19 nt, Human
ugaaagaccccacucuggg

SEQ ID NO: 695466 - RNA, 21 nt, Human
ugaccaagacagaccacacac

SEQ ID NO: 695467 - RNA, 24 nt, Human
ugagagggcgaggcgggcagauca

SEQ ID NO: 695468 - RNA, 24 nt, Human
ugagguaggagaaucgcuugaacc

SEQ ID NO: 695469 - RNA, 23 nt, Human
ugaggugggagaauugcuugaau

SEQ ID NO: 695470 - RNA, 21 nt, Human
ugcaccacugcacuccagccu

SEQ ID NO: 695471 - RNA, 21 nt, Human
ugcaccacugcacuccagccu

SEQ ID NO: 695472 - RNA, 23 nt, Human
ugcagggacaaagaaggaccauc

SEQ ID NO: 695473 - RNA, 18 nt, Human
ugcccagguggguggaac

SEQ ID NO: 695474 - RNA, 21 nt, Human
ugccccauuuccagugagaac

SEQ ID NO: 695475 - RNA, 23 nt, Human
ugcugugugccaggcacugugcu

SEQ ID NO: 695476 - RNA, 20 nt, Human
uggaacagugaccugcaaaa

SEQ ID NO: 695477 - RNA, 24 nt, Human
uggaagacuacagcaaauggauca

SEQ ID NO: 695478 - RNA, 22 nt, Human
uggaucaugaggucaggaguuc

SEQ ID NO: 695479 - RNA, 24 nt, Human
uggaucaugaggucaggaguucga

SEQ ID NO: 695480 - RNA, 24 nt, Human
uggccaacauggugaaaccccauc

SEQ ID NO: 695481 - RNA, 21 nt, Human
uggccagggagcccccaugac

SEQ ID NO: 695482 - RNA, 24 nt, Human
uggcucacgccuguaaucccaaca

SEQ ID NO: 695483 - RNA, 25 nt, Human
ugggaacaccaggcagacagggaac

SEQ ID NO: 695484 - RNA, 20 nt, Human
ugggaaggucacuuucacua

SEQ ID NO: 695485 - RNA, 23 nt, Human
ugggaggggcaggaauuccuuug

SEQ ID NO: 695486 - RNA, 21 nt, Human
uggguccucugccaggugggg

SEQ ID NO: 695487 - RNA, 21 nt, Human
ugguaacaguuccaggggcca

SEQ ID NO: 695488 - RNA, 20 nt, Human
ugguaagcaguugccaggug

SEQ ID NO: 695489 - RNA, 24 nt, Human
ugguggugggcgccuguaauccca

SEQ ID NO: 695490 - RNA, 24 nt, Human
uguaguggucuguaagccguggcc

SEQ ID NO: 695491 - RNA, 19 nt, Human
uguggugguggcugccuag

SEQ ID NO: 695492 - RNA, 23 nt, Human
uuaaaagacacacccuaauuuca

SEQ ID NO: 695493 - RNA, 24 nt, Human
uuaaaagacacacccuaauuucaa

SEQ ID NO: 695494 - RNA, 18 nt, Human
uuagcugggcaugguggc

SEQ ID NO: 695495 - RNA, 20 nt, Human
uuagcugggcaugguggcgc

SEQ ID NO: 695496 - RNA, 24 nt, Human
uuaggccgggugcaguggcucacg

SEQ ID NO: 695497 - RNA, 18 nt, Human
uuccaaaguugguguaac

SEQ ID NO: 695498 - RNA, 23 nt, Human
uucccaagucccagaggacugcu

SEQ ID NO: 695499 - RNA, 19 nt, Human
uugaaagagaauaccccac

SEQ ID NO: 695500 - RNA, 24 nt, Human
uugaaucccagagguggagguugc

SEQ ID NO: 695501 - RNA, 23 nt, Human
uugcaccacugcacuccagccuu

SEQ ID NO: 695502 - RNA, 20 nt, Human
uugcagcgagccgagaucau

SEQ ID NO: 695503 - RNA, 22 nt, Human
uugcagugagccaagauugcac

SEQ ID NO: 695504 - RNA, 22 nt, Human
uugccagggucccauaucuagc

SEQ ID NO: 695505 - RNA, 24 nt, Human
uugcuugaaucccagagguggagg

SEQ ID NO: 695506 - RNA, 20 nt, Human
uuguggugguggcugccuag

SEQ ID NO: 695507 - RNA, 18 nt, Human
uuucccugaaacccaaca

SEQ ID NO: 695508 - RNA, 19 nt, Human
uuugcugugugccaggcac

SEQ ID NO: 695509 - RNA, 20 nt, Human
uuuuuuguaaucccaagaaa

SEQ ID NO: 695510 - RNA, 21 nt, Human
uuuuuuguaaucccaagaaag

SEQ ID NO: 695511 - RNA, 26 nt, Human
aaaaagaaacauacagcuguauugga

SEQ ID NO: 695512 - RNA, 20 nt, Human
aaaagaaaaagaaacauaca

SEQ ID NO: 695513 - RNA, 21 nt, Human
aaacuggaacuuugcaacaac

SEQ ID NO: 695514 - RNA, 23 nt, Human
aaagaaacauacagcuguauugg

SEQ ID NO: 695515 - RNA, 19 nt, Human
aaaguucccaagcuugaaa

SEQ ID NO: 695516 - RNA, 22 nt, Human
acagaaaauggcuuccaagcau

SEQ ID NO: 695517 - RNA, 22 nt, Human
agaaaaagaaacauacagcugu

SEQ ID NO: 695518 - RNA, 23 nt, Human
agaaaagaaaaagaaacauacag

SEQ ID NO: 695519 - RNA, 20 nt, Human
agaacggcuuggggacagga

SEQ ID NO: 695520 - RNA, 21 nt, Human
caaaaggcucucaaaaucuuu

SEQ ID NO: 695521 - RNA, 23 nt, Human
caccaaauuagaaaagaaaaaga

SEQ ID NO: 695522 - RNA, 22 nt, Human
ccaauccuaauguguccuuagc

SEQ ID NO: 695523 - RNA, 26 nt, Human
ccaccaaauuagaaaagaaaaagaaa

SEQ ID NO: 695524 - RNA, 19 nt, Human
cccaagcuugaaaucaagu

SEQ ID NO: 695525 - RNA, 21 nt, Human
cgcagccgcgcacggguuucc

SEQ ID NO: 695526 - RNA, 22 nt, Human
cuuuaauguuuuuuuuaaaagu

SEQ ID NO: 695527 - RNA, 21 nt, Human
gaacuuugcaacaacuccucu

SEQ ID NO: 695528 - RNA, 18 nt, Human
gucuagaacggcuugggg

SEQ ID NO: 695529 - RNA, 20 nt, Human
uaaagaaaaaaaccacccuc

SEQ ID NO: 695530 - RNA, 24 nt, Human
uagaaaagaaaaagaaacauacag

SEQ ID NO: 695531 - RNA, 22 nt, Human
ucccaagcuugaaaucaaguua

SEQ ID NO: 695532 - RNA, 25 nt, Human
ucccaagcuugaaaucaaguuaguu

SEQ ID NO: 695533 - RNA, 25 nt, Human
ugacaacacacguccuauacaaaga

SEQ ID NO: 695534 - RNA, 26 nt, Human
ugccaccaaauuagaaaagaaaaaga

SEQ ID NO: 695535 - RNA, 23 nt, Human
uggaacuuugcaacaacuccucu

SEQ ID NO: 695536 - RNA, 21 nt, Human
uggcuuccaagcaucacaccu

SEQ ID NO: 695537 - RNA, 22 nt, Human
uggcuuccaagcaucacaccuu

SEQ ID NO: 695538 - RNA, 23 nt, Human
uuaaagaaaaaaaccacccucau

SEQ ID NO: 695539 - RNA, 21 nt, Human
uucauccgcgucuagaacggc

SEQ ID NO: 695540 - RNA, 23 nt, Human
uuuuuuuuaaaaguucccaagcu

SEQ ID NO: 695541 - RNA, 20 nt, Human
agaaagcagcuugggguaca

SEQ ID NO: 695542 - RNA, 18 nt, Human
agacagggcuccugcuuc

SEQ ID NO: 695543 - RNA, 20 nt, Human
agcaggcuagaccaggcuuc

SEQ ID NO: 695544 - RNA, 21 nt, Human
agcauugguccagagaaagca

SEQ ID NO: 695545 - RNA, 21 nt, Human
cagagcagguccacuggcacc

SEQ ID NO: 695546 - RNA, 19 nt, Human
cagccagacagggcuccug

SEQ ID NO: 695547 - RNA, 21 nt, Human
cagguccacuggcacccacaa

SEQ ID NO: 695548 - RNA, 21 nt, Human
ccucacaauaguguguccaca

SEQ ID NO: 695549 - RNA, 19 nt, Human
ccuccagcaggcuagacca

SEQ ID NO: 695550 - RNA, 19 nt, Human
cgggaugccauggucuugg

SEQ ID NO: 695551 - RNA, 19 nt, Human
cguggauccccucuaacuu

SEQ ID NO: 695552 - RNA, 21 nt, Human
cucucaggacuccacuuucag

SEQ ID NO: 695553 - RNA, 23 nt, Human
cuggggcuuuggcuggaacgauu

SEQ ID NO: 695554 - RNA, 19 nt, Human
gacagggcuccugcuucuu

SEQ ID NO: 695555 - RNA, 19 nt, Human
gagcucagccuacaugggc

SEQ ID NO: 695556 - RNA, 23 nt, Human
gcccgcgggccugcggcagauuc

SEQ ID NO: 695557 - RNA, 21 nt, Human
gcuccaugggagaggagccug

SEQ ID NO: 695558 - RNA, 20 nt, Human
gggaugccauggucuuggau

SEQ ID NO: 695559 - RNA, 21 nt, Human
gggaugccauggucuuggaug

SEQ ID NO: 695560 - RNA, 18 nt, Human
gguggcccuucucaucug

SEQ ID NO: 695561 - RNA, 19 nt, Human
guucagguggcccuucuca

SEQ ID NO: 695562 - RNA, 22 nt, Human
uacauccuuaguaggccucaca

SEQ ID NO: 695563 - RNA, 19 nt, Human
uacuggggcuuuggcugga

SEQ ID NO: 695564 - RNA, 21 nt, Human
ucaguuucuuccacuucuggg

SEQ ID NO: 695565 - RNA, 21 nt, Human
uccacaauacggguuaguggg

SEQ ID NO: 695566 - RNA, 21 nt, Human
uccacuuucaguuucuuccac

SEQ ID NO: 695567 - RNA, 21 nt, Human
ucccgggcggcccgcgggccu

SEQ ID NO: 695568 - RNA, 26 nt, Human
ucuauuacuggggcuuuggcuggaac

SEQ ID NO: 695569 - RNA, 22 nt, Human
ucucauccuccagcaggcuaga

SEQ ID NO: 695570 - RNA, 22 nt, Human
ugaugguggaaggguucccucu

SEQ ID NO: 695571 - RNA, 20 nt, Human
uggagaguuguccuucuggg

SEQ ID NO: 695572 - RNA, 23 nt, Human
uggagaguuguccuucuggguuu

SEQ ID NO: 695573 - RNA, 24 nt, Human
ugggaugcuccaugggagaggagc

SEQ ID NO: 695574 - RNA, 18 nt, Human
aagaugcacacuggaagg

SEQ ID NO: 695575 - RNA, 22 nt, Human
agaauuuacagggcugggagga

SEQ ID NO: 695576 - RNA, 23 nt, Human
caguggcugacucguccagcuuc

SEQ ID NO: 695577 - RNA, 23 nt, Human
cuagaguagaagcaacucucuuc

SEQ ID NO: 695578 - RNA, 18 nt, Human
cuggaaggcugaggcuga

SEQ ID NO: 695579 - RNA, 18 nt, Human
gauagaauuuacagggcu

SEQ ID NO: 695580 - RNA, 22 nt, Human
guagaagcaacucucuucccuu

SEQ ID NO: 695581 - RNA, 24 nt, Human
uaagauaaguaucaaagauagaau

SEQ ID NO: 695582 - RNA, 20 nt, Human
uaucaaagauagaauuuaca

SEQ ID NO: 695583 - RNA, 20 nt, Human
ucaaagauagaauuuacagg

SEQ ID NO: 695584 - RNA, 21 nt, Human
ucaaagauagaauuuacaggg

SEQ ID NO: 695585 - RNA, 19 nt, Human
ucguccagcuucaggcaau

SEQ ID NO: 695586 - RNA, 20 nt, Human
ugagccugggcuagagacca

SEQ ID NO: 695587 - RNA, 19 nt, Human
uggaaggcugaggcugagc

SEQ ID NO: 695588 - RNA, 18 nt, Human
uuggaaauguucuagucc

SEQ ID NO: 695589 - RNA, 21 nt, Human
uuuuuuuuugcuagaguagaa

SEQ ID NO: 695590 - RNA, 22 nt, Human
ugcaggaacaagggcgcggcag

SEQ ID NO: 695591 - RNA, 22 nt, Human
uguggcagucaaaagauaacug

SEQ ID NO: 695592 - RNA, 21 nt, Human
cccaagugaccugcagagccc

SEQ ID NO: 695593 - RNA, 24 nt, Human
uuuuuuuuuuguagacaagucugg

SEQ ID NO: 695594 - RNA, 18 nt, Human
uuuuuuuuuuuuuuuuug

SEQ ID NO: 695595 - RNA, 19 nt, Human
uuuuuuuuuuuuuuuuugu

SEQ ID NO: 695596 - RNA, 20 nt, Human
aacacgcugccucugucucu

SEQ ID NO: 695597 - RNA, 23 nt, Human
aacagcagguucuggcuuuuccg

SEQ ID NO: 695598 - RNA, 22 nt, Human
acacagcaccuccuugccuuac

SEQ ID NO: 695599 - RNA, 20 nt, Human
accaccgcaccagcagcuca

SEQ ID NO: 695600 - RNA, 20 nt, Human
accagcagcucaaacacgcu

SEQ ID NO: 695601 - RNA, 22 nt, Human
acucccggcccugugauuccgg

SEQ ID NO: 695602 - RNA, 22 nt, Human
agcaccuccuugccuuacaccc

SEQ ID NO: 695603 - RNA, 24 nt, Human
agccacacagcaccuccuugccuu

SEQ ID NO: 695604 - RNA, 26 nt, Human
cacccuggcuccagcuucacuggucc

SEQ ID NO: 695605 - RNA, 21 nt, Human
caccgcaccagcagcucaaac

SEQ ID NO: 695606 - RNA, 18 nt, Human
ccacccugaaaacagcag

SEQ ID NO: 695607 - RNA, 24 nt, Human
ccggaaggcgugcacaaggcuuug

SEQ ID NO: 695608 - RNA, 19 nt, Human
ccucagccuggggcagcug

SEQ ID NO: 695609 - RNA, 18 nt, Human
ccuugccuuacacccugg

SEQ ID NO: 695610 - RNA, 18 nt, Human
cugccucugucucucaga

SEQ ID NO: 695611 - RNA, 18 nt, Human
cuucaccgggaggcugag

SEQ ID NO: 695612 - RNA, 19 nt, Human
gcuccagcuucacuggucc

SEQ ID NO: 695613 - RNA, 18 nt, Human
ggcauuuggggaaaugua

SEQ ID NO: 695614 - RNA, 18 nt, Human
gggaccuggccagccccu

SEQ ID NO: 695615 - RNA, 23 nt, Human
ggggcagcugugauguaaacccc

SEQ ID NO: 695616 - RNA, 22 nt, Human
uauuauguacacacuauauuua

SEQ ID NO: 695617 - RNA, 19 nt, Human
ucacccacccugaaaacag

SEQ ID NO: 695618 - RNA, 19 nt, Human
uccccagagcggggagugu

SEQ ID NO: 695619 - RNA, 23 nt, Human
ucuccugcugcuguggcccggac

SEQ ID NO: 695620 - RNA, 18 nt, Human
ugaaccaucgaagccucc

SEQ ID NO: 695621 - RNA, 20 nt, Human
ugccucugucucucagaccu

SEQ ID NO: 695622 - RNA, 22 nt, Human
ugccuuacacccuggcuccagc

SEQ ID NO: 695623 - RNA, 26 nt, Human
ugccuuacacccuggcuccagcuuca

SEQ ID NO: 695624 - RNA, 21 nt, Human
uggagccucugagaacaguuc

SEQ ID NO: 695625 - RNA, 26 nt, Human
uggcuccagcuucacugguccggggg

SEQ ID NO: 695626 - RNA, 19 nt, Human
ugguacccauagguugccu

SEQ ID NO: 695627 - RNA, 18 nt, Human
ugugcacgugugugugua

SEQ ID NO: 695628 - RNA, 23 nt, Human
uuccgugaacccccagaugaaua

SEQ ID NO: 695629 - RNA, 18 nt, Human
uucugauuccaugggacc

SEQ ID NO: 695630 - RNA, 23 nt, Human
uuuuccgugaacccccagaugaa

SEQ ID NO: 695631 - RNA, 20 nt, Human
uuuucuccugcugcuguggc

SEQ ID NO: 695632 - RNA, 24 nt, Human
aaaggugggcaaugugccucuucc

SEQ ID NO: 695633 - RNA, 20 nt, Human
acagaacuuucuucaugaca

SEQ ID NO: 695634 - RNA, 18 nt, Human
acaucuacccaucccuaa

SEQ ID NO: 695635 - RNA, 18 nt, Human
acuucagagaggguuggu

SEQ ID NO: 695636 - RNA, 19 nt, Human
agccgcugccgcguagucc

SEQ ID NO: 695637 - RNA, 24 nt, Human
aggcauauuccucccuuuccaaag

SEQ ID NO: 695638 - RNA, 18 nt, Human
cacuuccacuucagagag

SEQ ID NO: 695639 - RNA, 18 nt, Human
cagaacuuucuucaugac

SEQ ID NO: 695640 - RNA, 23 nt, Human
cccugaaagcagcagccucccca

SEQ ID NO: 695641 - RNA, 20 nt, Human
ccucccuuuccaaagguggg

SEQ ID NO: 695642 - RNA, 20 nt, Human
cggaauguaaacagagcuug

SEQ ID NO: 695643 - RNA, 20 nt, Human
cgggccccugaaagcagcag

SEQ ID NO: 695644 - RNA, 20 nt, Human
cuaaagaucaguaugacugg

SEQ ID NO: 695645 - RNA, 21 nt, Human
cugaaagcagcagccucccca

SEQ ID NO: 695646 - RNA, 22 nt, Human
gaacuuucuucaugacaccucu

SEQ ID NO: 695647 - RNA, 20 nt, Human
gcguaaggcaguuugacauc

SEQ ID NO: 695648 - RNA, 22 nt, Human
gggccccugaaagcagcagccu

SEQ ID NO: 695649 - RNA, 18 nt, Human
ggugucaggcagcccugc

SEQ ID NO: 695650 - RNA, 24 nt, Human
uaaagaucaguaugacugcguaag

SEQ ID NO: 695651 - RNA, 19 nt, Human
uccacuuccacuucagaga

SEQ ID NO: 695652 - RNA, 25 nt, Human
ugaacagaacuuucuucaugacacc

SEQ ID NO: 695653 - RNA, 19 nt, Human
uggaacaaccaaggagaag

SEQ ID NO: 695654 - RNA, 19 nt, Human
uggaacaaccaaggagaag

SEQ ID NO: 695655 - RNA, 20 nt, Human
uggcuaaagaucaguaugac

SEQ ID NO: 695656 - RNA, 23 nt, Human
uguaaacagagcuuggugugaag

SEQ ID NO: 695657 - RNA, 24 nt, Human
ugucaggcagcccugcuguccaag

SEQ ID NO: 695658 - RNA, 22 nt, Human
uuacaagcacgggccccugaaa

SEQ ID NO: 695659 - RNA, 19 nt, Human
uugaagagccgcugccgcg

SEQ ID NO: 695660 - RNA, 22 nt, Human
uuuacaagcacgggccccugaa

SEQ ID NO: 695661 - RNA, 21 nt, Human
aaagcaggccucaaacccuag

SEQ ID NO: 695662 - RNA, 24 nt, Human
aacaugagauaggguugggguggg

SEQ ID NO: 695663 - RNA, 18 nt, Human
aagaaugaaccucucauc

SEQ ID NO: 695664 - RNA, 19 nt, Human
agaaagcaggccucaaacc

SEQ ID NO: 695665 - RNA, 20 nt, Human
agcagaaagcaggccucaaa

SEQ ID NO: 695666 - RNA, 21 nt, Human
aggcuaggcucgcugcgccuc

SEQ ID NO: 695667 - RNA, 20 nt, Human
aggcucgcugcgccucgcug

SEQ ID NO: 695668 - RNA, 20 nt, Human
caagaaugaaccucucaucc

SEQ ID NO: 695669 - RNA, 25 nt, Human
cacaagaaugaaccucucaucagau

SEQ ID NO: 695670 - RNA, 22 nt, Human
cagaaagcaggccucaaacccu

SEQ ID NO: 695671 - RNA, 23 nt, Human
cagaaagcaggccucaaacccua

SEQ ID NO: 695672 - RNA, 20 nt, Human
cgagcagaaagcaggccuca

SEQ ID NO: 695673 - RNA, 24 nt, Human
cgagcagaaagcaggccucaaacc

SEQ ID NO: 695674 - RNA, 20 nt, Human
cgccucgcugccucagguaa

SEQ ID NO: 695675 - RNA, 21 nt, Human
cgcgagcagaaagcaggccuc

SEQ ID NO: 695676 - RNA, 19 nt, Human
gcaagaagccaucuaaauc

SEQ ID NO: 695677 - RNA, 23 nt, Human
gcgccugcaacccggcaccucga

SEQ ID NO: 695678 - RNA, 20 nt, Human
uaacagccuucuauagagug

SEQ ID NO: 695679 - RNA, 21 nt, Human
uagccucacugagaauuuaau

SEQ ID NO: 695680 - RNA, 23 nt, Human
uagcugaaaagaacaaaucucaa

SEQ ID NO: 695681 - RNA, 21 nt, Human
ucagauaucaggaauccaugu

SEQ ID NO: 695682 - RNA, 21 nt, Human
ucaugcaaguacuacaauaag

SEQ ID NO: 695683 - RNA, 21 nt, Human
ucuggcauguauuagacagac

SEQ ID NO: 695684 - RNA, 22 nt, Human
ugaaccucucaucagauaucag

SEQ ID NO: 695685 - RNA, 18 nt, Human
ugagauaggguuggggug

SEQ ID NO: 695686 - RNA, 21 nt, Human
ugagauaggguuggggugggc

SEQ ID NO: 695687 - RNA, 18 nt, Human
ugagccuuuuggugucau

SEQ ID NO: 695688 - RNA, 18 nt, Human
ugagcgccugcaacccgc

SEQ ID NO: 695689 - RNA, 19 nt, Human
ugagcgccugcaacccggc

SEQ ID NO: 695690 - RNA, 18 nt, Human
ugagucacuuuaacagcc

SEQ ID NO: 695691 - RNA, 24 nt, Human
ugcaacccggcaccucgagauacc

SEQ ID NO: 695692 - RNA, 20 nt, Human
ugccucagguagugcucugc

SEQ ID NO: 695693 - RNA, 22 nt, Human
uggggugggcugagccuuuugg

SEQ ID NO: 695694 - RNA, 23 nt, Human
uuaacauuaaaaaaacuuuuaca

SEQ ID NO: 695695 - RNA, 25 nt, Human
uugguucaagaagguaaaacugucg

SEQ ID NO: 695696 - RNA, 19 nt, Human
augcgcucagguucaggcc

SEQ ID NO: 695697 - RNA, 23 nt, Human
gcaaaaaaugagaaaauauacag

SEQ ID NO: 695698 - RNA, 19 nt, Human
ggcgcaggacaacucucgg

SEQ ID NO: 695699 - RNA, 24 nt, Human
uacagcaggagggaugaggaguac

SEQ ID NO: 695700 - RNA, 20 nt, Human
ucaggccgcacgugggaaca

SEQ ID NO: 695701 - RNA, 24 nt, Human
ucaggccgcacgugggaacaccgg

SEQ ID NO: 695702 - RNA, 21 nt, Human
ugggaacaccggcgcaggaca

SEQ ID NO: 695703 - RNA, 18 nt, Human
uuuuuuuuuuuuuuuuug

SEQ ID NO: 695704 - RNA, 20 nt, Human
uuuuuuuuuuuuuuuuuggu

SEQ ID NO: 695705 - RNA, 18 nt, Human
agcaauccaguuuauguc

SEQ ID NO: 695706 - RNA, 22 nt, Human
cacagaagaaccuaauaggcag

SEQ ID NO: 695707 - RNA, 20 nt, Human
cagaagaaccuaauaggcag

SEQ ID NO: 695708 - RNA, 23 nt, Human
cauaauaaaaauaugugaacauc

SEQ ID NO: 695709 - RNA, 21 nt, Human
gaggcacaugucacagaagaa

SEQ ID NO: 695710 - RNA, 19 nt, Human
uacaaaaguauuacaugcu

SEQ ID NO: 695711 - RNA, 19 nt, Human
ucacugcugggaggcacau

SEQ ID NO: 695712 - RNA, 19 nt, Human
ucagaggcaaauaaauaag

SEQ ID NO: 695713 - RNA, 20 nt, Human
ucucauaugguacaaaaguu

SEQ ID NO: 695714 - RNA, 20 nt, Human
ucuugcaaaauaagagguuc

SEQ ID NO: 695715 - RNA, 23 nt, Human
uuacaugcuugggccugucuugc

SEQ ID NO: 695716 - RNA, 21 nt, Human
uucacugcugggaggcacaug

SEQ ID NO: 695717 - RNA, 26 nt, Human
aaacagaauucuuuauaaacugcaga

SEQ ID NO: 695718 - RNA, 21 nt, Human
aaaugaaacuuacauagacua

SEQ ID NO: 695719 - RNA, 23 nt, Human
aacugcauugguggcuugggagu

SEQ ID NO: 695720 - RNA, 26 nt, Human
aagaaaaagcaagacgggguacaaaa

SEQ ID NO: 695721 - RNA, 21 nt, Human
aagugccguucuuugacaucc

SEQ ID NO: 695722 - RNA, 19 nt, Human
aauaaugggcaccaaaaga

SEQ ID NO: 695723 - RNA, 20 nt, Human
acaaaaacagucugagccug

SEQ ID NO: 695724 - RNA, 28 nt, Human
acaaacccacuuagagcaccaaacagag

SEQ ID NO: 695725 - RNA, 18 nt, Human
acaaagcaggaaaacggc

SEQ ID NO: 695726 - RNA, 25 nt, Human
accccgcagcagcaacagaaccagc

SEQ ID NO: 695727 - RNA, 23 nt, Human
acuucauuccuggagaaaaccaa

SEQ ID NO: 695728 - RNA, 22 nt, Human
agaaaaaccacuaugagagcau

SEQ ID NO: 695729 - RNA, 20 nt, Human
agauauacgccaucacaaug

SEQ ID NO: 695730 - RNA, 21 nt, Human
agcaccaaacagagagaaaau

SEQ ID NO: 695731 - RNA, 18 nt, Human
agcugcauuagagaacca

SEQ ID NO: 695732 - RNA, 22 nt, Human
aggcagcaguaacuaaaucaag

SEQ ID NO: 695733 - RNA, 23 nt, Human
aggcuccggcgauggucccgacu

SEQ ID NO: 695734 - RNA, 19 nt, Human
auguauucgaucugagaua

SEQ ID NO: 695735 - RNA, 24 nt, Human
caaaaugcaaauuucaccaguaug

SEQ ID NO: 695736 - RNA, 24 nt, Human
caaauucuaccuuccauaaaaagc

SEQ ID NO: 695737 - RNA, 22 nt, Human
caacagaaccagcuccuucagc

SEQ ID NO: 695738 - RNA, 22 nt, Human
caagacgggguacaaaaugcaa

SEQ ID NO: 695739 - RNA, 18 nt, Human
caagccaaacaggugacc

SEQ ID NO: 695740 - RNA, 25 nt, Human
cagauguccugucauaaaaaauuuc

SEQ ID NO: 695741 - RNA, 19 nt, Human
cagcagcaacagaaccagc

SEQ ID NO: 695742 - RNA, 21 nt, Human
caguaacuaaaucaagccaaa

SEQ ID NO: 695743 - RNA, 20 nt, Human
caucacaaugguuuaaaucu

SEQ ID NO: 695744 - RNA, 18 nt, Human
ccaaacagagagaaaaua

SEQ ID NO: 695745 - RNA, 19 nt, Human
ccacaggauuaugcauagc

SEQ ID NO: 695746 - RNA, 31 nt, Human
cccgcagcagcaacagaaccagcuccuucuu

SEQ ID NO: 695747 - RNA, 23 nt, Human
cccgcuuaccccgcagcagcaac

SEQ ID NO: 695748 - RNA, 22 nt, Human
ccggcgauggucccgacugcgc

SEQ ID NO: 695749 - RNA, 22 nt, Human
cuacaggucaaacugcuggugg

SEQ ID NO: 695750 - RNA, 22 nt, Human
cuugauuuuugaaaagauuuca

SEQ ID NO: 695751 - RNA, 18 nt, Human
cuuucuccucaaagauug

SEQ ID NO: 695752 - RNA, 19 nt, Human
gauuuuugaaaagauuuca

SEQ ID NO: 695753 - RNA, 21 nt, Human
gcauagaaaaaccacuaugag

SEQ ID NO: 695754 - RNA, 18 nt, Human
gggaguguacugcgccac

SEQ ID NO: 695755 - RNA, 24 nt, Human
uaaaaagccucccgaaaaggagau

SEQ ID NO: 695756 - RNA, 25 nt, Human
uaaacaaauauacaaugugcaggca

SEQ ID NO: 695757 - RNA, 25 nt, Human
uaacaagcauacaaaauaucaaacu

SEQ ID NO: 695758 - RNA, 24 nt, Human
uaacugagagcauaacagagguac

SEQ ID NO: 695759 - RNA, 25 nt, Human
uaagaaaaagcaagacgggguacaa

SEQ ID NO: 695760 - RNA, 23 nt, Human
uaauaaaaaacuaaaaauugacu

SEQ ID NO: 695761 - RNA, 26 nt, Human
uacaguagaauauuacagaaacaaaa

SEQ ID NO: 695762 - RNA, 20 nt, Human
uaccaagacuguuauacagu

SEQ ID NO: 695763 - RNA, 24 nt, Human
uaccaagacuguuauacaguuuua

SEQ ID NO: 695764 - RNA, 22 nt, Human
uaccccgcagcagcaacagaac

SEQ ID NO: 695765 - RNA, 19 nt, Human
uagaaaaaccacuaugaga

SEQ ID NO: 695766 - RNA, 22 nt, Human
uagaaaaaccacuaugagagca

SEQ ID NO: 695767 - RNA, 18 nt, Human
uagaaaauacugagucac

SEQ ID NO: 695768 - RNA, 18 nt, Human
uagagcaccaaacagaga

SEQ ID NO: 695769 - RNA, 26 nt, Human
uagcauagaaaaaccacuaugagagc

SEQ ID NO: 695770 - RNA, 18 nt, Human
uauggcaauguuuugucu

SEQ ID NO: 695771 - RNA, 19 nt, Human
ucaagccaaacaggugacc

SEQ ID NO: 695772 - RNA, 19 nt, Human
ucacuggaguugccuaguu

SEQ ID NO: 695773 - RNA, 21 nt, Human
ucagccagucgccauuucccg

SEQ ID NO: 695774 - RNA, 18 nt, Human
ucauucauauauucuuau

SEQ ID NO: 695775 - RNA, 19 nt, Human
uccauaaaaagccucccga

SEQ ID NO: 695776 - RNA, 19 nt, Human
ugaaaagauuucaccuaca

SEQ ID NO: 695777 - RNA, 19 nt, Human
ugaagcgccucaacuaaaa

SEQ ID NO: 695778 - RNA, 18 nt, Human
ugagagcauauuaacugc

SEQ ID NO: 695779 - RNA, 23 nt, Human
ugagauagauaaagucuccuuuc

SEQ ID NO: 695780 - RNA, 23 nt, Human
ugcaguugagaggcaaagcauac

SEQ ID NO: 695781 - RNA, 18 nt, Human
ugcauugguggcuuggga

SEQ ID NO: 695782 - RNA, 21 nt, Human
ugcgccacaggauuaugcaua

SEQ ID NO: 695783 - RNA, 21 nt, Human
uguauucgaucugagauagau

SEQ ID NO: 695784 - RNA, 26 nt, Human
uuaauaaugggcaccaaaagauaaga

SEQ ID NO: 695785 - RNA, 19 nt, Human
uucauauagcauagaaaaa

SEQ ID NO: 695786 - RNA, 21 nt, Human
uuccuggagaaaaccaaaggc

SEQ ID NO: 695787 - RNA, 22 nt, Human
uuuuuuuuuuuuuuuuuaucag

SEQ ID NO: 695788 - RNA, 23 nt, Human
uuuuuuuuuuuuuuuuuaucagu

SEQ ID NO: 695789 - RNA, 21 nt, Human
accucggccggugccggaagc

SEQ ID NO: 695790 - RNA, 22 nt, Human
agaugaucagacugauuucuuu

SEQ ID NO: 695791 - RNA, 20 nt, Human
agcauuuugguuucuagucu

SEQ ID NO: 695792 - RNA, 19 nt, Human
cugcagcuuucuuugaaca

SEQ ID NO: 695793 - RNA, 21 nt, Human
gaaggcacaggaucucuggag

SEQ ID NO: 695794 - RNA, 19 nt, Human
gcugaaauuuucgggugau

SEQ ID NO: 695795 - RNA, 18 nt, Human
uaagaaacuuuuugauca

SEQ ID NO: 695796 - RNA, 19 nt, Human
uaucuugauuuuccauucu

SEQ ID NO: 695797 - RNA, 18 nt, Human
uauuuuuugagauggagu

SEQ ID NO: 695798 - RNA, 19 nt, Human
ugaaggcacaggaucucug

SEQ ID NO: 695799 - RNA, 22 nt, Human
ugaaggcacaggaucucuggag

SEQ ID NO: 695800 - RNA, 18 nt, Human
uguguaaggaauauacug

SEQ ID NO: 695801 - RNA, 27 nt, Human
uuuauuauuauuauuauuuuuugagau

SEQ ID NO: 695802 - RNA, 20 nt, Human
uuuccauucugcagcuuucu

SEQ ID NO: 695803 - RNA, 29 nt, Human
uuuuuuuuuuuuuuuuuuuucuaugaaaa

SEQ ID NO: 695804 - RNA, 24 nt, Human
acacuaccacccucagccgggugc

SEQ ID NO: 695805 - RNA, 21 nt, Human
agcucgccucucccgccuccg

SEQ ID NO: 695806 - RNA, 20 nt, Human
aggaagaaaggaccaacaaa

SEQ ID NO: 695807 - RNA, 22 nt, Human
caagggcuccuucuguagcaag

SEQ ID NO: 695808 - RNA, 18 nt, Human
cacccucagcaugacuuc

SEQ ID NO: 695809 - RNA, 21 nt, Human
ccccaaaaaguuauccuccuu

SEQ ID NO: 695810 - RNA, 25 nt, Human
ccccaaaaaguuauccuccuuuagc

SEQ ID NO: 695811 - RNA, 18 nt, Human
cugcccaguuuuauuggg

SEQ ID NO: 695812 - RNA, 19 nt, Human
gaagaaaggaccaacaaag

SEQ ID NO: 695813 - RNA, 22 nt, Human
gagaagggagcccaagggcucc

SEQ ID NO: 695814 - RNA, 20 nt, Human
gagcucgccucucccgccuc

SEQ ID NO: 695815 - RNA, 24 nt, Human
gccucucccgccuccgcccucagc

SEQ ID NO: 695816 - RNA, 21 nt, Human
gggcugggaggguaagagacc

SEQ ID NO: 695817 - RNA, 26 nt, Human
uaacugcuaucaaagagaagggagcu

SEQ ID NO: 695818 - RNA, 20 nt, Human
ucacacuaccacccucagca

SEQ ID NO: 695819 - RNA, 19 nt, Human
ucgccucucccgccuccgc

SEQ ID NO: 695820 - RNA, 25 nt, Human
uggcacuuaaggaagaaaggaccaa

SEQ ID NO: 695821 - RNA, 20 nt, Human
uuuuuuuuuuccaucugccc

SEQ ID NO: 695822 - RNA, 20 nt, Human
uuuuuuuuuuuuuuuuccau

SEQ ID NO: 695823 - RNA, 21 nt, Human
uuuuuuuuuuuuuuuuuucca

SEQ ID NO: 695824 - RNA, 18 nt, Human
uuuuuuuuuuuuuuuuug

SEQ ID NO: 695825 - RNA, 22 nt, Human
aaaaaaaugaaucauagccaaa

SEQ ID NO: 695826 - RNA, 20 nt, Human
aaaacaaaaugucuugccuu

SEQ ID NO: 695827 - RNA, 21 nt, Human
aaacaaaaugucuugccuuug

SEQ ID NO: 695828 - RNA, 20 nt, Human
aagaaccuuccagaauuugc

SEQ ID NO: 695829 - RNA, 19 nt, Human
aaucauagccaaaacaaaa

SEQ ID NO: 695830 - RNA, 20 nt, Human
agaaugccucugcccccgcg

SEQ ID NO: 695831 - RNA, 18 nt, Human
agcuucagucucuaagca

SEQ ID NO: 695832 - RNA, 19 nt, Human
caagaaugccucugccccc

SEQ ID NO: 695833 - RNA, 19 nt, Human
cagcggcaagaaugccucu

SEQ ID NO: 695834 - RNA, 19 nt, Human
cccccgcgaacucugaccu

SEQ ID NO: 695835 - RNA, 19 nt, Human
cccuagucgagacuaagaa

SEQ ID NO: 695836 - RNA, 23 nt, Human
ccggcgacuaggaguccuggggc

SEQ ID NO: 695837 - RNA, 22 nt, Human
cucugcccccgcgaacucugac

SEQ ID NO: 695838 - RNA, 25 nt, Human
cugaagccggcgacuaggaguccug

SEQ ID NO: 695839 - RNA, 25 nt, Human
gaccuucucuuccuaagcagcccac

SEQ ID NO: 695840 - RNA, 23 nt, Human
ggaaaaaagucuuuaaugaugaa

SEQ ID NO: 695841 - RNA, 20 nt, Human
ggaguccuggggcuacugcc

SEQ ID NO: 695842 - RNA, 22 nt, Human
uaaaaaaaaugaaucauagcca

SEQ ID NO: 695843 - RNA, 19 nt, Human
uaagcuucagucucuaagc

SEQ ID NO: 695844 - RNA, 22 nt, Human
uacuuggcacacuacuguuugg

SEQ ID NO: 695845 - RNA, 20 nt, Human
uagccaaaacaaaaugucuu

SEQ ID NO: 695846 - RNA, 23 nt, Human
ucagucucuaagcaguuuuuaaa

SEQ ID NO: 695847 - RNA, 21 nt, Human
ugccucugcccccgcgaacuc

SEQ ID NO: 695848 - RNA, 21 nt, Human
uggcacacuacuguuugguau

SEQ ID NO: 695849 - RNA, 23 nt, Human
uuuuuuuuuuuuuuuuuacuugg

SEQ ID NO: 695850 - RNA, 25 nt, Human
uuuuuuuuuuuuuuuuuuuacuugg

SEQ ID NO: 695851 - RNA, 19 nt, Human
acaaacuaggaguggaaau

SEQ ID NO: 695852 - RNA, 21 nt, Human
agacacagaaaaugggugccc

SEQ ID NO: 695853 - RNA, 22 nt, Human
agggaagaacaaaaauuaucca

SEQ ID NO: 695854 - RNA, 18 nt, Human
aucacacagggaagaaca

SEQ ID NO: 695855 - RNA, 21 nt, Human
ccugaaccuccuucuaaauca

SEQ ID NO: 695856 - RNA, 23 nt, Human
cguagccugaaccuccuucuaaa

SEQ ID NO: 695857 - RNA, 28 nt, Human
cucaccguagccugaaccuccuucuaaa

SEQ ID NO: 695858 - RNA, 18 nt, Human
gaauccuggguuucccuc

SEQ ID NO: 695859 - RNA, 22 nt, Human
ggagacacagaaaaugggugcc

SEQ ID NO: 695860 - RNA, 25 nt, Human
gggaagaacaaaaauuauccaugac

SEQ ID NO: 695861 - RNA, 24 nt, Human
uacagccggaaguuguacggcgcc

SEQ ID NO: 695862 - RNA, 19 nt, Human
ucccuccuaggacccugca

SEQ ID NO: 695863 - RNA, 23 nt, Human
uuuuuuuuuuuuaacgagucuca

SEQ ID NO: 695864 - RNA, 24 nt, Human
uuuuuuuuuuuuaacgagucucaa

SEQ ID NO: 695865 - RNA, 20 nt, Human
uuuuuuuuuuuuuuuuuaac

SEQ ID NO: 695866 - RNA, 23 nt, Human
aaaaaguacacaaaaaccacuga

SEQ ID NO: 695867 - RNA, 23 nt, Human
aaucaacggagauacaagaaaga

SEQ ID NO: 695868 - RNA, 22 nt, Human
acaagcccagguaagcauacca

SEQ ID NO: 695869 - RNA, 27 nt, Human
agcauaccaagcaagcccccucacacc

SEQ ID NO: 695870 - RNA, 24 nt, Human
aggcaacgagaggcagccuagaac

SEQ ID NO: 695871 - RNA, 20 nt, Human
auggaggcaacgagaggcag

SEQ ID NO: 695872 - RNA, 18 nt, Human
caagcccccucacaccuu

SEQ ID NO: 695873 - RNA, 18 nt, Human
ccagcagcaguaucucag

SEQ ID NO: 695874 - RNA, 21 nt, Human
ccuccaaaacccgcgcagagc

SEQ ID NO: 695875 - RNA, 23 nt, Human
cucaaauccuucccuccguuauc

SEQ ID NO: 695876 - RNA, 19 nt, Human
cugaauggauaaucuagau

SEQ ID NO: 695877 - RNA, 26 nt, Human
gcuacagacccaacacucugcagacu

SEQ ID NO: 695878 - RNA, 22 nt, Human
ggcaacgagaggcagccuagaa

SEQ ID NO: 695879 - RNA, 22 nt, Human
guaagcauaccaagcaagcccc

SEQ ID NO: 695880 - RNA, 23 nt, Human
gucuccaacuuuugcgaaacaca

SEQ ID NO: 695881 - RNA, 20 nt, Human
uaccaagcaagcccccucac

SEQ ID NO: 695882 - RNA, 24 nt, Human
uaccaagcaagcccccucacaccu

SEQ ID NO: 695883 - RNA, 21 nt, Human
ucacugggaaguggcuccaca

SEQ ID NO: 695884 - RNA, 23 nt, Human
ucacugggaaguggcuccacaga

SEQ ID NO: 695885 - RNA, 18 nt, Human
uccagcagcaguaucuca

SEQ ID NO: 695886 - RNA, 25 nt, Human
uccuccaaaacccgcgcagagcgag

SEQ ID NO: 695887 - RNA, 22 nt, Human
ucuuugcagcaaugucucgccc

SEQ ID NO: 695888 - RNA, 18 nt, Human
ucuuuuuuuuuuuuuuuu

SEQ ID NO: 695889 - RNA, 28 nt, Human
ugaaaaaagcuugacuucuuugcagcag

SEQ ID NO: 695890 - RNA, 22 nt, Human
ugaauggauaaucuagaugaug

SEQ ID NO: 695891 - RNA, 20 nt, Human
ugagguacacaagcccaggu

SEQ ID NO: 695892 - RNA, 23 nt, Human
ugccccuaaacucuucucgguuc

SEQ ID NO: 695893 - RNA, 23 nt, Human
ugcuaauguccuccaaaacccgc

SEQ ID NO: 695894 - RNA, 18 nt, Human
uggcuccacagagacacu

SEQ ID NO: 695895 - RNA, 20 nt, Human
ugggaaguggcuccacagag

SEQ ID NO: 695896 - RNA, 27 nt, Human
ugucucgcccauuccagcagcaguauc

SEQ ID NO: 695897 - RNA, 22 nt, Human
ugucugaaaaaagcuugacuuc

SEQ ID NO: 695898 - RNA, 24 nt, Human
uucucgguucuguccuugguccuu

SEQ ID NO: 695899 - RNA, 22 nt, Human
uugaaaaaaguacacaaaaacc

SEQ ID NO: 695900 - RNA, 23 nt, Human
uugaaaaaaguacacaaaaacca

SEQ ID NO: 695901 - RNA, 23 nt, Human
uuuuuuuuuuuuuuuuucuuuuu

SEQ ID NO: 695902 - RNA, 23 nt, Human
aaaagaaaaaaaaacucauaaaa

SEQ ID NO: 695903 - RNA, 20 nt, Human
cacacacaauuuagacaggg

SEQ ID NO: 695904 - RNA, 22 nt, Human
caggaaaacauaucacuggaaa

SEQ ID NO: 695905 - RNA, 21 nt, Human
cgaagaucauacagacgccau

SEQ ID NO: 695906 - RNA, 20 nt, Human
gaaaagaaaaaaaaacucau

SEQ ID NO: 695907 - RNA, 23 nt, Human
ggaaaagaaaaaaaaacucauaa

SEQ ID NO: 695908 - RNA, 19 nt, Human
uaagguaucacuaaagaaa

SEQ ID NO: 695909 - RNA, 22 nt, Human
uagacaggggaaaagaaaaaaa

SEQ ID NO: 695910 - RNA, 23 nt, Human
uaucacuggaaacauuuggagaa

SEQ ID NO: 695911 - RNA, 21 nt, Human
ucacuaaagaaaaagauagga

SEQ ID NO: 695912 - RNA, 18 nt, Human
uuggagaaugcaaacugg

SEQ ID NO: 695913 - RNA, 21 nt, Human
uuuuuuuuuuuuuuuuuauuu

SEQ ID NO: 695914 - RNA, 19 nt, Human
aagguaggcaacuuagauc

SEQ ID NO: 695915 - RNA, 21 nt, Human
agcugacaccccucacaacgc

SEQ ID NO: 695916 - RNA, 22 nt, Human
agcugccugggaugcacugagc

SEQ ID NO: 695917 - RNA, 24 nt, Human
aucaccuuggcaaagaacacauua

SEQ ID NO: 695918 - RNA, 21 nt, Human
caaaauacauauguacaagau

SEQ ID NO: 695919 - RNA, 21 nt, Human
caacgcagcaacgcgcggacc

SEQ ID NO: 695920 - RNA, 21 nt, Human
caagauaaauaaacuacacaa

SEQ ID NO: 695921 - RNA, 21 nt, Human
caagguaggcaacuuagauca

SEQ ID NO: 695922 - RNA, 25 nt, Human
caccccucacaacgcagcaacgcgc

SEQ ID NO: 695923 - RNA, 22 nt, Human
caccuuggcaaagaacacauua

SEQ ID NO: 695924 - RNA, 22 nt, Human
gggaugcacugagcugacaccc

SEQ ID NO: 695925 - RNA, 22 nt, Human
uaagaugaaccaggacaagucc

SEQ ID NO: 695926 - RNA, 22 nt, Human
uagaaggaaccacacacaguuc

SEQ ID NO: 695927 - RNA, 18 nt, Human
ugcacugagcugacaccc

SEQ ID NO: 695928 - RNA, 18 nt, Human
ugccugggaugcacugag

SEQ ID NO: 695929 - RNA, 18 nt, Human
ugggaugcacugagcuga

SEQ ID NO: 695930 - RNA, 24 nt, Human
agaucaacaaaaauacacagucau

SEQ ID NO: 695931 - RNA, 23 nt, Human
auacacacggcagaauucggaaa

SEQ ID NO: 695932 - RNA, 18 nt, Human
caagaaaaacuggcgccu

SEQ ID NO: 695933 - RNA, 22 nt, Human
caagaaaaacuggcgccuggca

SEQ ID NO: 695934 - RNA, 25 nt, Human
gauacacacggcagaauucggaaac

SEQ ID NO: 695935 - RNA, 23 nt, Human
uacacagucauaacaagaaaaac

SEQ ID NO: 695936 - RNA, 19 nt, Human
ucgccaggccggaaccgga

SEQ ID NO: 695937 - RNA, 18 nt, Human
ugagaaaaaaauauauaa

SEQ ID NO: 695938 - RNA, 21 nt, Human
ugagaaaaaaauauauaauac

SEQ ID NO: 695939 - RNA, 24 nt, Human
ugagaaaaaaauauauaauaccga

SEQ ID NO: 695940 - RNA, 18 nt, Human
uuuuugguuuuaaaccuu

SEQ ID NO: 695941 - RNA, 22 nt, Human
uuuuuuuuuuuuuugguuuuaa

SEQ ID NO: 695942 - RNA, 18 nt, Human
uuuuuuuuuuuuuuuuug

SEQ ID NO: 695943 - RNA, 24 nt, Human
uuuuuuuuuuuuuuuuuugguuuu

SEQ ID NO: 695944 - RNA, 21 nt, Human
aaaugaauacaauacuaaaau

SEQ ID NO: 695945 - RNA, 20 nt, Human
caacaaauacuguauuagau

SEQ ID NO: 695946 - RNA, 22 nt, Human
caacauccaucagaaaccugcu

SEQ ID NO: 695947 - RNA, 19 nt, Human
cacuuuauaagccauacac

SEQ ID NO: 695948 - RNA, 21 nt, Human
ccaauaacaaacauuucuaau

SEQ ID NO: 695949 - RNA, 18 nt, Human
cggccggacacguacuca

SEQ ID NO: 695950 - RNA, 21 nt, Human
cuccagggagaaccugauguc

SEQ ID NO: 695951 - RNA, 22 nt, Human
ggaaagcuuuaggguucacuac

SEQ ID NO: 695952 - RNA, 19 nt, Human
uaaaaugaauacaauacua

SEQ ID NO: 695953 - RNA, 19 nt, Human
uaugcuguauuucauaauu

SEQ ID NO: 695954 - RNA, 19 nt, Human
ucuccagggagaaccugau

SEQ ID NO: 695955 - RNA, 23 nt, Human
ucuuucuuuugaacacauucugg

SEQ ID NO: 695956 - RNA, 24 nt, Human
ugcggccggacacguacucaagcc

SEQ ID NO: 695957 - RNA, 20 nt, Human
ugucaugauugagucaaugg

SEQ ID NO: 695958 - RNA, 21 nt, Human
uguuaggcaaaaacgucaguu

SEQ ID NO: 695959 - RNA, 19 nt, Human
uuaaagcagaaauauuguc

SEQ ID NO: 695960 - RNA, 22 nt, Human
aaggucccucugcccugccuca

SEQ ID NO: 695961 - RNA, 22 nt, Human
agaagaacagaauguaaacaga

SEQ ID NO: 695962 - RNA, 19 nt, Human
aggaagcagcuuuuauuga

SEQ ID NO: 695963 - RNA, 19 nt, Human
ccaaagcccagucuuuccc

SEQ ID NO: 695964 - RNA, 19 nt, Human
cccccgugccuccagaauc

SEQ ID NO: 695965 - RNA, 20 nt, Human
ccgcuugugagugcaucgag

SEQ ID NO: 695966 - RNA, 22 nt, Human
ccuccagaaucgcauguugcuc

SEQ ID NO: 695967 - RNA, 24 nt, Human
ccucugcccugccucaguggcuug

SEQ ID NO: 695968 - RNA, 19 nt, Human
ccugugcagccuuagaaac

SEQ ID NO: 695969 - RNA, 20 nt, Human
ccuucccugugcagccuuag

SEQ ID NO: 695970 - RNA, 22 nt, Human
cgagaagaacagaauguaaaca

SEQ ID NO: 695971 - RNA, 25 nt, Human
cgagaagaacagaauguaaacagau

SEQ ID NO: 695972 - RNA, 19 nt, Human
cuccaccugggggcggaua

SEQ ID NO: 695973 - RNA, 22 nt, Human
cucuagauuguccaaagcccag

SEQ ID NO: 695974 - RNA, 23 nt, Human
gcaagagaaacgcggaaguggug

SEQ ID NO: 695975 - RNA, 18 nt, Human
gccuccagaaucgcaugu

SEQ ID NO: 695976 - RNA, 19 nt, Human
gcgcaagagaaacgcggaa

SEQ ID NO: 695977 - RNA, 19 nt, Human
ggauauaaauuaccucuag

SEQ ID NO: 695978 - RNA, 25 nt, Human
gggaagaugagacguuggguugcug

SEQ ID NO: 695979 - RNA, 24 nt, Human
ggggcggauauaaauuaccucuag

SEQ ID NO: 695980 - RNA, 18 nt, Human
uagagguggagggugucc

SEQ ID NO: 695981 - RNA, 22 nt, Human
uagaugaguuaagugugaugca

SEQ ID NO: 695982 - RNA, 28 nt, Human
ucaaaggucccucugcccugccucaggg

SEQ ID NO: 695983 - RNA, 21 nt, Human
uccccagcaaugccuacugca

SEQ ID NO: 695984 - RNA, 23 nt, Human
uguuuguuucuuccccagcaaug

SEQ ID NO: 695985 - RNA, 23 nt, Human
uuaguaacaacuagagguggagg

SEQ ID NO: 695986 - RNA, 19 nt, Human
uucccuucccugugcagcc

SEQ ID NO: 695987 - RNA, 22 nt, Human
uugguguguguuuguuucuucc

SEQ ID NO: 695988 - RNA, 19 nt, Human
uuucuugucaccuaguuac

SEQ ID NO: 695989 - RNA, 22 nt, Human
uuuuuuuuuuuuuuuuaccaga

SEQ ID NO: 695990 - RNA, 25 nt, Human
uuuuuuuuuuuuuuuuuuuuaccag

SEQ ID NO: 695991 - RNA, 23 nt, Human
aaaaacccaaaaugaagcugaug

SEQ ID NO: 695992 - RNA, 26 nt, Human
aaaaacccaaaaugaagcugaugcua

SEQ ID NO: 695993 - RNA, 25 nt, Human
aaaacccaaaaugaagcugaugcua

SEQ ID NO: 695994 - RNA, 28 nt, Human
aacauacauauacacacauacacacagu

SEQ ID NO: 695995 - RNA, 27 nt, Human
aacauauucaaaacauacauauacaca

SEQ ID NO: 695996 - RNA, 20 nt, Human
aacccaaaaugaagcugaug

SEQ ID NO: 695997 - RNA, 21 nt, Human
aagaaaaaacaaaaaccacuc

SEQ ID NO: 695998 - RNA, 22 nt, Human
aaggagcagaacuuucuaaaca

SEQ ID NO: 695999 - RNA, 24 nt, Human
acaucugaaaagaaaaaacaaaaa

SEQ ID NO: 696000 - RNA, 30 nt, Human
acucuaaguguccaaauauuggaaaaaaag

SEQ ID NO: 696001 - RNA, 19 nt, Human
agccggcccgggugcuggc

SEQ ID NO: 696002 - RNA, 22 nt, Human
agccgugccagugcgcggcacg

SEQ ID NO: 696003 - RNA, 18 nt, Human
agggaaauguaaaaaugc

SEQ ID NO: 696004 - RNA, 22 nt, Human
auauacacacauacacacagug

SEQ ID NO: 696005 - RNA, 21 nt, Human
augguucaugcaaaagauuac

SEQ ID NO: 696006 - RNA, 18 nt, Human
caaaaucuaagacugcug

SEQ ID NO: 696007 - RNA, 26 nt, Human
caaacucuucaguuucucuuaagaag

SEQ ID NO: 696008 - RNA, 25 nt, Human
cacauuaacaucugaaaagaaaaaa

SEQ ID NO: 696009 - RNA, 21 nt, Human
cagagcacgaggcuccucccc

SEQ ID NO: 696010 - RNA, 20 nt, Human
cagccgugccagugcgcggc

SEQ ID NO: 696011 - RNA, 21 nt, Human
ccaaaaugaagcugaugcuau

SEQ ID NO: 696012 - RNA, 19 nt, Human
ccgcgccggcuccugcugc

SEQ ID NO: 696013 - RNA, 22 nt, Human
ccugcuuaauaucagagaaaaa

SEQ ID NO: 696014 - RNA, 18 nt, Human
ccuggcucgcgccccagc

SEQ ID NO: 696015 - RNA, 19 nt, Human
cgcggggcuccgggcuccg

SEQ ID NO: 696016 - RNA, 20 nt, Human
cggcucccgcgccggcuccu

SEQ ID NO: 696017 - RNA, 18 nt, Human
cuccacacacaaagcacc

SEQ ID NO: 696018 - RNA, 19 nt, Human
cucccgcgccggcuccugc

SEQ ID NO: 696019 - RNA, 23 nt, Human
cuccggacaaggcuuagccggcc

SEQ ID NO: 696020 - RNA, 18 nt, Human
cuccgggcuccgggcucc

SEQ ID NO: 696021 - RNA, 22 nt, Human
gaaaaaaaagaagcaagcggag

SEQ ID NO: 696022 - RNA, 20 nt, Human
gcgcggggcuccgggcuccg

SEQ ID NO: 696023 - RNA, 24 nt, Human
gcuccuccccggggggcugccccg

SEQ ID NO: 696024 - RNA, 22 nt, Human
ggaaaacuccacacacaaagca

SEQ ID NO: 696025 - RNA, 18 nt, Human
ggaaacgugcagccuggc

SEQ ID NO: 696026 - RNA, 23 nt, Human
ggaaauguaaaaaugcaacaccc

SEQ ID NO: 696027 - RNA, 21 nt, Human
ggaggaggcaaaaacccaaaa

SEQ ID NO: 696028 - RNA, 21 nt, Human
gugcagccuggcucgcgcccc

SEQ ID NO: 696029 - RNA, 20 nt, Human
uacacacauacacacagugg

SEQ ID NO: 696030 - RNA, 25 nt, Human
uacauauacacacauacacacagug

SEQ ID NO: 696031 - RNA, 22 nt, Human
uacauguugccaguuuagacuc

SEQ ID NO: 696032 - RNA, 21 nt, Human
uagcaagaucauuagggaaau

SEQ ID NO: 696033 - RNA, 23 nt, Human
ucauuagggaaauguaaaaaugc

SEQ ID NO: 696034 - RNA, 24 nt, Human
uccccggggggcugccccgcgcgg

SEQ ID NO: 696035 - RNA, 22 nt, Human
ucgcggcucccgcgccggcucc

SEQ ID NO: 696036 - RNA, 22 nt, Human
ucuaggaaaaauaacaucugau

SEQ ID NO: 696037 - RNA, 21 nt, Human
ugcgcggcacgcgucccagag

SEQ ID NO: 696038 - RNA, 23 nt, Human
uggaaaacuccacacacaaagca

SEQ ID NO: 696039 - RNA, 20 nt, Human
uuagggaaauguaaaaaugc

SEQ ID NO: 696040 - RNA, 18 nt, Human
uuuaauaaagaaaacaua

SEQ ID NO: 696041 - RNA, 21 nt, Human
uuuuauuuucaucuaggaaaa

SEQ ID NO: 696042 - RNA, 18 nt, Human
uuuuuuuuuuuuuuuuug

SEQ ID NO: 696043 - RNA, 20 nt, Human
aagggcaccccaaaugaguu

SEQ ID NO: 696044 - RNA, 19 nt, Human
acucccacaaaugacucca

SEQ ID NO: 696045 - RNA, 18 nt, Human
aggacgggggagcggggg

SEQ ID NO: 696046 - RNA, 20 nt, Human
aggacgggggagcgggggac

SEQ ID NO: 696047 - RNA, 18 nt, Human
cagcugccaccucggagg

SEQ ID NO: 696048 - RNA, 21 nt, Human
cauagcagaacuuccugaacc

SEQ ID NO: 696049 - RNA, 28 nt, Human
ccuaacucccacaaaugaccgggugucc

SEQ ID NO: 696050 - RNA, 22 nt, Human
ccucggaggacgggggagcggg

SEQ ID NO: 696051 - RNA, 23 nt, Human
ccucggaggacgggggagcgggg

SEQ ID NO: 696052 - RNA, 22 nt, Human
ccugaaccucugccgggaggcu

SEQ ID NO: 696053 - RNA, 21 nt, Human
cucauagcagaacuuccugaa

SEQ ID NO: 696054 - RNA, 22 nt, Human
cugagggucucuggugggagcc

SEQ ID NO: 696055 - RNA, 24 nt, Human
cuuaaagucuucaacagagucuuc

SEQ ID NO: 696056 - RNA, 22 nt, Human
gcgggggacgaggaaagaucag

SEQ ID NO: 696057 - RNA, 19 nt, Human
ggaccuggaaagcagguag

SEQ ID NO: 696058 - RNA, 26 nt, Human
uaagacccuaacucccacaaaugacu

SEQ ID NO: 696059 - RNA, 21 nt, Human
uauuucaagggcaccccaaau

SEQ ID NO: 696060 - RNA, 23 nt, Human
ucacugagggucucuggugggag

SEQ ID NO: 696061 - RNA, 18 nt, Human
ucccuggggccagcugca

SEQ ID NO: 696062 - RNA, 21 nt, Human
ucccuggggccagcugcaucc

SEQ ID NO: 696063 - RNA, 21 nt, Human
uccucggccuaucauuucauu

SEQ ID NO: 696064 - RNA, 22 nt, Human
ucuaagaaaaaacguuccagac

SEQ ID NO: 696065 - RNA, 22 nt, Human
ucucuggguacacuucagucac

SEQ ID NO: 696066 - RNA, 21 nt, Human
ucucuggugggagcccagaag

SEQ ID NO: 696067 - RNA, 24 nt, Human
ugacuccaggaaagggagacaacc

SEQ ID NO: 696068 - RNA, 20 nt, Human
uggaaagcagguaguaggac

SEQ ID NO: 696069 - RNA, 20 nt, Human
uggaaagcagguaguaggac

SEQ ID NO: 696070 - RNA, 24 nt, Human
uggaaagcagguaguaggacaauu

SEQ ID NO: 696071 - RNA, 19 nt, Human
uggggccagcugcauccuc

SEQ ID NO: 696072 - RNA, 23 nt, Human
uuuuuuuuuuuuuugauugagga

SEQ ID NO: 696073 - RNA, 18 nt, Human
uuuuuuuuuuuuuuuuug

SEQ ID NO: 696074 - RNA, 19 nt, Human
ccagaccaacagucagaua

SEQ ID NO: 696075 - RNA, 21 nt, Human
cuugcuaggacacuucuucca

SEQ ID NO: 696076 - RNA, 23 nt, Human
cuuuuuaagucuccagaucuugc

SEQ ID NO: 696077 - RNA, 20 nt, Human
gguauaauggcucggugucu

SEQ ID NO: 696078 - RNA, 22 nt, Human
ggugucuuugucccaacagcuu

SEQ ID NO: 696079 - RNA, 24 nt, Human
ugaaacuugccauuuguuuuuguu

SEQ ID NO: 696080 - RNA, 25 nt, Human
uggguauaauggcucggugucuuug

SEQ ID NO: 696081 - RNA, 20 nt, Human
cgccgccgcuccuuccgucc

SEQ ID NO: 696082 - RNA, 19 nt, Human
cuccucaacugugcacugu

SEQ ID NO: 696083 - RNA, 23 nt, Human
cuccuccgucgccgccgcuccuu

SEQ ID NO: 696084 - RNA, 22 nt, Human
gaaaauauauacugcuaugguc

SEQ ID NO: 696085 - RNA, 18 nt, Human
ggcuccucaacugugcac

SEQ ID NO: 696086 - RNA, 20 nt, Human
guaguguaggcugacuucaa

SEQ ID NO: 696087 - RNA, 23 nt, Human
uccuccgucgccgccgcuccuuc

SEQ ID NO: 696088 - RNA, 21 nt, Human
ucgccgccgcuccuuccgucc

SEQ ID NO: 696089 - RNA, 24 nt, Human
ugacuucaaccacggcuucuccag

SEQ ID NO: 696090 - RNA, 18 nt, Human
uuuuuuuuuuuuuuccug

SEQ ID NO: 696091 - RNA, 26 nt, Human
uuuuuuuuuuuuuuuuuccuguuuuu

SEQ ID NO: 696092 - RNA, 18 nt, Human
aagggcagccugcauaug

SEQ ID NO: 696093 - RNA, 21 nt, Human
acuuccuacacugaagagggg

SEQ ID NO: 696094 - RNA, 24 nt, Human
acuuccuacacugaagagggguuc

SEQ ID NO: 696095 - RNA, 20 nt, Human
aggaacugcuggcaucaccu

SEQ ID NO: 696096 - RNA, 19 nt, Human
cagcugggucauggcagug

SEQ ID NO: 696097 - RNA, 21 nt, Human
caguggcccuggcaagcuggc

SEQ ID NO: 696098 - RNA, 23 nt, Human
caguggcccuggcaagcuggcug

SEQ ID NO: 696099 - RNA, 20 nt, Human
ccaacuguaacuucuggaug

SEQ ID NO: 696100 - RNA, 26 nt, Human
cccugcuguccccaccauccugccug

SEQ ID NO: 696101 - RNA, 22 nt, Human
ccugccuguugucagcugcagc

SEQ ID NO: 696102 - RNA, 21 nt, Human
gaagagggguuccaguauggu

SEQ ID NO: 696103 - RNA, 21 nt, Human
gagaacagcgggggaucuggc

SEQ ID NO: 696104 - RNA, 22 nt, Human
gcaguagcccccugcugucccc

SEQ ID NO: 696105 - RNA, 21 nt, Human
ucaaacagcuaugcagaggca

SEQ ID NO: 696106 - RNA, 20 nt, Human
ucacucaugagcagcugggu

SEQ ID NO: 696107 - RNA, 18 nt, Human
ucccuccauguguucugg

SEQ ID NO: 696108 - RNA, 22 nt, Human
ucccugacagaggagcaggaac

SEQ ID NO: 696109 - RNA, 21 nt, Human
ucugugggcucugccuggcuu

SEQ ID NO: 696110 - RNA, 23 nt, Human
uggauaggcugcaugauuugggc

SEQ ID NO: 696111 - RNA, 18 nt, Human
uggugguaauuaaguugc

SEQ ID NO: 696112 - RNA, 19 nt, Human
uguccccaccauccugccu

SEQ ID NO: 696113 - RNA, 21 nt, Human
uguccccaccauccugccugu

SEQ ID NO: 696114 - RNA, 20 nt, Human
uguccgauucccuccaugug

SEQ ID NO: 696115 - RNA, 18 nt, Human
uguugucagcugcagcug

SEQ ID NO: 696116 - RNA, 19 nt, Human
uguugucagcugcagcugc

SEQ ID NO: 696117 - RNA, 27 nt, Human
uucagaaagagaaagaagaugagugag

SEQ ID NO: 696118 - RNA, 18 nt, Human
uuuuuuuuuuuuuuuuug

SEQ ID NO: 696119 - RNA, 22 nt, Human
aaaccgcaaucacuaagcacca

SEQ ID NO: 696120 - RNA, 20 nt, Human
acagagccacccagggccag

SEQ ID NO: 696121 - RNA, 24 nt, Human
accgcaaucacuaagcaccacauc

SEQ ID NO: 696122 - RNA, 19 nt, Human
aguggccuguggccacaau

SEQ ID NO: 696123 - RNA, 21 nt, Human
auaaguauacccaauaccuca

SEQ ID NO: 696124 - RNA, 22 nt, Human
caccacaucggcagcucaugca

SEQ ID NO: 696125 - RNA, 21 nt, Human
cacuaagcaccacaucggcag

SEQ ID NO: 696126 - RNA, 22 nt, Human
cacuaagcaccacaucggcagc

SEQ ID NO: 696127 - RNA, 23 nt, Human
cacugucugcagugaaccagggg

SEQ ID NO: 696128 - RNA, 26 nt, Human
cccuggacuagacccucauugcuccc

SEQ ID NO: 696129 - RNA, 18 nt, Human
ccucagacugcuuuuggc

SEQ ID NO: 696130 - RNA, 21 nt, Human
ccucagacugcuuuuggcccc

SEQ ID NO: 696131 - RNA, 25 nt, Human
cgaggcaaauacccagcccgggaaa

SEQ ID NO: 696132 - RNA, 19 nt, Human
cucauugugcucuggugcu

SEQ ID NO: 696133 - RNA, 18 nt, Human
cuuccggcgcagaccgaa

SEQ ID NO: 696134 - RNA, 21 nt, Human
gagccacccagggccaguggc

SEQ ID NO: 696135 - RNA, 19 nt, Human
ggaaacacgggagagcgac

SEQ ID NO: 696136 - RNA, 25 nt, Human
ggccacaaugucaauggcuauaacc

SEQ ID NO: 696137 - RNA, 21 nt, Human
ggcugugcacccugacagagc

SEQ ID NO: 696138 - RNA, 24 nt, Human
ucuaagccauuuauucaacgaccc

SEQ ID NO: 696139 - RNA, 19 nt, Human
ugacagagccacccagggc

SEQ ID NO: 696140 - RNA, 19 nt, Human
ugaggggcugugcacccug

SEQ ID NO: 696141 - RNA, 20 nt, Human
uggccccuggacuagacccu

SEQ ID NO: 696142 - RNA, 24 nt, Human
uggggugccacugucugcagugaa

SEQ ID NO: 696143 - RNA, 23 nt, Human
uuuuuuuuuuuuuuuuucacauu

SEQ ID NO: 696144 - RNA, 21 nt, Human
aaaccagaaacggaagcagag

SEQ ID NO: 696145 - RNA, 24 nt, Human
aacacuagagcaaaaccagaaacg

SEQ ID NO: 696146 - RNA, 21 nt, Human
acaaaacccaucaaaaaggcc

SEQ ID NO: 696147 - RNA, 27 nt, Human
acaaaacccaucaaaaaggccaucacu

SEQ ID NO: 696148 - RNA, 21 nt, Human
acaauagaaaaugauucugaa

SEQ ID NO: 696149 - RNA, 18 nt, Human
accauagaaucaaaauac

SEQ ID NO: 696150 - RNA, 18 nt, Human
agaaaaugauucugaauc

SEQ ID NO: 696151 - RNA, 19 nt, Human
agacuguagaguuacacug

SEQ ID NO: 696152 - RNA, 19 nt, Human
aggaaagaaaccuaaaucu

SEQ ID NO: 696153 - RNA, 20 nt, Human
auuaaacuuuccuucaaagg

SEQ ID NO: 696154 - RNA, 19 nt, Human
caaaaccagaaacggaagc

SEQ ID NO: 696155 - RNA, 20 nt, Human
caaaacccaucaaaaaggcc

SEQ ID NO: 696156 - RNA, 24 nt, Human
caacaaaacccaucaaaaaggcca

SEQ ID NO: 696157 - RNA, 23 nt, Human
caaccuauaauaccacaauagaa

SEQ ID NO: 696158 - RNA, 18 nt, Human
caagacacaacaaaaccc

SEQ ID NO: 696159 - RNA, 25 nt, Human
caagacacaacaaaacccaucaaaa

SEQ ID NO: 696160 - RNA, 22 nt, Human
cacaacaaaacccaucaaaaag

SEQ ID NO: 696161 - RNA, 23 nt, Human
cagccgcgaagaaacccaaacac

SEQ ID NO: 696162 - RNA, 19 nt, Human
cuucaaagaaaggaaagaa

SEQ ID NO: 696163 - RNA, 25 nt, Human
cuuguucacaagacacaacaaaacc

SEQ ID NO: 696164 - RNA, 18 nt, Human
gagcagccgcgaagaaac

SEQ ID NO: 696165 - RNA, 23 nt, Human
gauuuuuuuuuuuuuccuuuuga

SEQ ID NO: 696166 - RNA, 25 nt, Human
gccgcgaagaaacccaaacacuaga

SEQ ID NO: 696167 - RNA, 25 nt, Human
uaaacuuuccuucaaagaaaggaaa

SEQ ID NO: 696168 - RNA, 21 nt, Human
uaaauaaauguccuauacauu

SEQ ID NO: 696169 - RNA, 21 nt, Human
uaaauauuuccuagucccaua

SEQ ID NO: 696170 - RNA, 21 nt, Human
uaagauuccauuuccuuaguu

SEQ ID NO: 696171 - RNA, 23 nt, Human
uagagcaaaaccagaaacggaag

SEQ ID NO: 696172 - RNA, 18 nt, Human
uauggcaaauuuggaaag

SEQ ID NO: 696173 - RNA, 24 nt, Human
ucaaaauacccacucaugauacag

SEQ ID NO: 696174 - RNA, 18 nt, Human
ucaaagaaaggaaagaaa

SEQ ID NO: 696175 - RNA, 21 nt, Human
ucccaagcaaugagucucuua

SEQ ID NO: 696176 - RNA, 22 nt, Human
ugagggaaccauagaaucaaaa

SEQ ID NO: 696177 - RNA, 20 nt, Human
uggaaaaaauaaaagagcaa

SEQ ID NO: 696178 - RNA, 21 nt, Human
uucaaagaaaggaaagaaacc

SEQ ID NO: 696179 - RNA, 24 nt, Human
uucacaagacacaacaaaacccau

SEQ ID NO: 696180 - RNA, 25 nt, Human
uuccaauaauggacacaggguaccc

SEQ ID NO: 696181 - RNA, 19 nt, Human
uuccuagucccauaauaug

SEQ ID NO: 696182 - RNA, 22 nt, Human
uugauuuuuuuuuuuuuccuuu

SEQ ID NO: 696183 - RNA, 24 nt, Human
uuuugauuuuuuuuuuuuuccuuu

SEQ ID NO: 696184 - RNA, 22 nt, Human
uuuuuuugauuuuuuuuuuuuu

SEQ ID NO: 696185 - RNA, 25 nt, Human
uuuuuuuuuuuuuuuuuugauuuuu

SEQ ID NO: 696186 - RNA, 27 nt, Human
uuuuuuuuuuuuuuuuuuuuuuugggg

SEQ ID NO: 696187 - RNA, 21 nt, Human
aacuuuguaaucaauaucccg

SEQ ID NO: 696188 - RNA, 22 nt, Human
agaacaccuguaaguaaaaaca

SEQ ID NO: 696189 - RNA, 18 nt, Human
agggagggaaggcaggca

SEQ ID NO: 696190 - RNA, 18 nt, Human
aguaaaaguggaaaagaa

SEQ ID NO: 696191 - RNA, 23 nt, Human
augaacaacaggaagcuccagag

SEQ ID NO: 696192 - RNA, 20 nt, Human
caauuccaggucauuccuaa

SEQ ID NO: 696193 - RNA, 18 nt, Human
cagcagggcucuguacag

SEQ ID NO: 696194 - RNA, 21 nt, Human
ccuaccgcggcuuccgcgcga

SEQ ID NO: 696195 - RNA, 21 nt, Human
cgcaaaucccgcggcucuccc

SEQ ID NO: 696196 - RNA, 18 nt, Human
cgggaagugcacacaaac

SEQ ID NO: 696197 - RNA, 21 nt, Human
cuuuuugguuaaagaagaaaa

SEQ ID NO: 696198 - RNA, 26 nt, Human
ggaaggcaggcacacgaagacacagg

SEQ ID NO: 696199 - RNA, 19 nt, Human
gggaggagggagggaaggc

SEQ ID NO: 696200 - RNA, 21 nt, Human
guaaguaaaaacaaaugucag

SEQ ID NO: 696201 - RNA, 21 nt, Human
guuuuggcaucuccucuccca

SEQ ID NO: 696202 - RNA, 21 nt, Human
uaaagaagaaaaacuuuguaa

SEQ ID NO: 696203 - RNA, 22 nt, Human
uaacacgccgcagcagggcucu

SEQ ID NO: 696204 - RNA, 22 nt, Human
uaaguaaaaguggaaaagaaga

SEQ ID NO: 696205 - RNA, 22 nt, Human
uaucccgcucauaaguaaaagu

SEQ ID NO: 696206 - RNA, 23 nt, Human
uaugaacaacaggaagcuccaga

SEQ ID NO: 696207 - RNA, 20 nt, Human
ucccgcuuggguucccaccc

SEQ ID NO: 696208 - RNA, 19 nt, Human
uggggaggagggagggaag

SEQ ID NO: 696209 - RNA, 20 nt, Human
ugguuaaagaagaaaaacuu

SEQ ID NO: 696210 - RNA, 21 nt, Human
uugguuaaagaagaaaaacuu

SEQ ID NO: 696211 - RNA, 26 nt, Human
uuuuugguuaaagaagaaaaacuuug

SEQ ID NO: 696212 - RNA, 22 nt, Human
uuuuuuuuuuuuuuuuugacag

SEQ ID NO: 696213 - RNA, 19 nt, Human
aacagcugauaucuuuagg

SEQ ID NO: 696214 - RNA, 19 nt, Human
acaccacacuccccaccuc

SEQ ID NO: 696215 - RNA, 18 nt, Human
acucacggauuccuccuu

SEQ ID NO: 696216 - RNA, 23 nt, Human
agcgcagaagccccaggaagaug

SEQ ID NO: 696217 - RNA, 19 nt, Human
aggcagggcucugccuuug

SEQ ID NO: 696218 - RNA, 19 nt, Human
aggcccagugcagcagccu

SEQ ID NO: 696219 - RNA, 20 nt, Human
aggcggcggcgagaagggga

SEQ ID NO: 696220 - RNA, 22 nt, Human
agggaaggaagguuggggcggg

SEQ ID NO: 696221 - RNA, 22 nt, Human
caacaacagcgcagaagcccca

SEQ ID NO: 696222 - RNA, 23 nt, Human
caccacacuccccaccuccaucc

SEQ ID NO: 696223 - RNA, 18 nt, Human
cagccucaggcucucacc

SEQ ID NO: 696224 - RNA, 22 nt, Human
cauucccaucucagcuccagaa

SEQ ID NO: 696225 - RNA, 22 nt, Human
ccaggaagauggcgcagauucc

SEQ ID NO: 696226 - RNA, 21 nt, Human
ccagggcccugaacaccagcc

SEQ ID NO: 696227 - RNA, 18 nt, Human
ccccaacaacagcgcaga

SEQ ID NO: 696228 - RNA, 23 nt, Human
ccccaacaacagcgcagaagccc

SEQ ID NO: 696229 - RNA, 23 nt, Human
cccugaacaccagccucaggcuc

SEQ ID NO: 696230 - RNA, 22 nt, Human
ccuccuucaggcagggcucugc

SEQ ID NO: 696231 - RNA, 20 nt, Human
ccucucagguccgggcgacc

SEQ ID NO: 696232 - RNA, 18 nt, Human
cgggcgacuccaagcggc

SEQ ID NO: 696233 - RNA, 19 nt, Human
cugggugugccccaggaac

SEQ ID NO: 696234 - RNA, 20 nt, Human
cuuuacacaccacacucccc

SEQ ID NO: 696235 - RNA, 18 nt, Human
gaagccccaggaagaugg

SEQ ID NO: 696236 - RNA, 21 nt, Human
gaaggaagguuggggcggggc

SEQ ID NO: 696237 - RNA, 18 nt, Human
gacuccaagcggccccgg

SEQ ID NO: 696238 - RNA, 19 nt, Human
gccgaaagagagaagccga

SEQ ID NO: 696239 - RNA, 18 nt, Human
gcggcggcgagaagggga

SEQ ID NO: 696240 - RNA, 20 nt, Human
gcggcugcucugugucugug

SEQ ID NO: 696241 - RNA, 19 nt, Human
ggaccucugggugugcccc

SEQ ID NO: 696242 - RNA, 20 nt, Human
ggaccucugggugugcccca

SEQ ID NO: 696243 - RNA, 19 nt, Human
ggacuggggucccuucccc

SEQ ID NO: 696244 - RNA, 20 nt, Human
ggccugguugggggguggaa

SEQ ID NO: 696245 - RNA, 21 nt, Human
ggcgacuccaagcggccccgg

SEQ ID NO: 696246 - RNA, 21 nt, Human
ggcggcgccggccgaaagaga

SEQ ID NO: 696247 - RNA, 22 nt, Human
gggcgacuccaagcggccccgg

SEQ ID NO: 696248 - RNA, 20 nt, Human
gguggaaggcaggacugggg

SEQ ID NO: 696249 - RNA, 21 nt, Human
uacacaccacacuccccaccu

SEQ ID NO: 696250 - RNA, 18 nt, Human
uagaggacuccauucugu

SEQ ID NO: 696251 - RNA, 24 nt, Human
ucauucccaucucagcuccagaac

SEQ ID NO: 696252 - RNA, 24 nt, Human
uccagaacacggaggaccugaaga

SEQ ID NO: 696253 - RNA, 21 nt, Human
uccagggcccugaacaccagc

SEQ ID NO: 696254 - RNA, 19 nt, Human
uccccaacaacagcgcaga

SEQ ID NO: 696255 - RNA, 21 nt, Human
uccccaacaacagcgcagaag

SEQ ID NO: 696256 - RNA, 19 nt, Human
uccccaccuccauccaguc

SEQ ID NO: 696257 - RNA, 19 nt, Human
ucucagguccgggcgacuc

SEQ ID NO: 696258 - RNA, 18 nt, Human
ucuggacaggaguccagg

SEQ ID NO: 696259 - RNA, 20 nt, Human
ucugggugugccccaggaac

SEQ ID NO: 696260 - RNA, 20 nt, Human
ucuguguccagggcccugaa

SEQ ID NO: 696261 - RNA, 18 nt, Human
ugccuuugagaugcggcu

SEQ ID NO: 696262 - RNA, 22 nt, Human
aaaaaacaacaaaaagcaacua

SEQ ID NO: 696263 - RNA, 27 nt, Human
aaaaaacaacaaaaagcaacuaaucac

SEQ ID NO: 696264 - RNA, 30 nt, Human
aaaaaacaacaaaaagcaacuaaucacccu

SEQ ID NO: 696265 - RNA, 19 nt, Human
aaaagcaacuaaucacccc

SEQ ID NO: 696266 - RNA, 22 nt, Human
aaacagccugguuuccuaaaac

SEQ ID NO: 696267 - RNA, 18 nt, Human
aaacaggaaugaaaucug

SEQ ID NO: 696268 - RNA, 18 nt, Human
aaacaggaaugaaaucug

SEQ ID NO: 696269 - RNA, 18 nt, Human
aaacaggaaugaaaucug

SEQ ID NO: 696270 - RNA, 24 nt, Human
aaacaggaaugaaaucugugagag

SEQ ID NO: 696271 - RNA, 19 nt, Human
aaagcaacuaaucaccccc

SEQ ID NO: 696272 - RNA, 21 nt, Human
aaauuaaaaaacaacaaaaag

SEQ ID NO: 696273 - RNA, 24 nt, Human
aacauucucuuuaugaacgugagu

SEQ ID NO: 696274 - RNA, 19 nt, Human
acaaaacagccugguuucc

SEQ ID NO: 696275 - RNA, 27 nt, Human
acaaaacagccugguuuccuaaaacaa

SEQ ID NO: 696276 - RNA, 23 nt, Human
acugugggugcagcucagcuggc

SEQ ID NO: 696277 - RNA, 26 nt, Human
agagggagccugccaacugccgaggg

SEQ ID NO: 696278 - RNA, 21 nt, Human
agcagugcccggguccggagc

SEQ ID NO: 696279 - RNA, 21 nt, Human
agcaguuuaaauuuuuuucuu

SEQ ID NO: 696280 - RNA, 23 nt, Human
aggaagcuggccgugggcagggg

SEQ ID NO: 696281 - RNA, 20 nt, Human
aggaaugaaaucugugagag

SEQ ID NO: 696282 - RNA, 20 nt, Human
aggcggggaggggggggagc

SEQ ID NO: 696283 - RNA, 21 nt, Human
cacaaaaacugcaucuccugc

SEQ ID NO: 696284 - RNA, 22 nt, Human
cagaccaggaccuggcccugcu

SEQ ID NO: 696285 - RNA, 24 nt, Human
cagcagugcccggguccggagccc

SEQ ID NO: 696286 - RNA, 18 nt, Human
caggcacauggucaggug

SEQ ID NO: 696287 - RNA, 19 nt, Human
caggggggcccaggccgca

SEQ ID NO: 696288 - RNA, 25 nt, Human
cauccccgcucaggcucagccgccu

SEQ ID NO: 696289 - RNA, 19 nt, Human
ccaccgccgccgucgccgc

SEQ ID NO: 696290 - RNA, 22 nt, Human
ccaccgccgcggugcgcuccgc

SEQ ID NO: 696291 - RNA, 24 nt, Human
ccagugccgccucugcugccgccg

SEQ ID NO: 696292 - RNA, 21 nt, Human
cccacccccaccagcagggga

SEQ ID NO: 696293 - RNA, 23 nt, Human
cccacccccaccagcaggggacc

SEQ ID NO: 696294 - RNA, 24 nt, Human
cccacccccaccagcaggggacca

SEQ ID NO: 696295 - RNA, 19 nt, Human
cccagaccccacugcagag

SEQ ID NO: 696296 - RNA, 20 nt, Human
cccaggccgcagggggcccc

SEQ ID NO: 696297 - RNA, 18 nt, Human
ccccuccucccccucccc

SEQ ID NO: 696298 - RNA, 20 nt, Human
ccccuccucccccuccccgc

SEQ ID NO: 696299 - RNA, 20 nt, Human
ccccuggggacccaccccca

SEQ ID NO: 696300 - RNA, 22 nt, Human
ccccuggggacccacccccacc

SEQ ID NO: 696301 - RNA, 18 nt, Human
cccuuucuucuguugcca

SEQ ID NO: 696302 - RNA, 23 nt, Human
ccgccgccgucgccgcgaggccg

SEQ ID NO: 696303 - RNA, 20 nt, Human
ccgccucugcugccgccgcc

SEQ ID NO: 696304 - RNA, 18 nt, Human
ccgcgcgcccgcccgggc

SEQ ID NO: 696305 - RNA, 18 nt, Human
ccgcuccagccgccagca

SEQ ID NO: 696306 - RNA, 18 nt, Human
ccuggcccugcugcccac

SEQ ID NO: 696307 - RNA, 24 nt, Human
ccuggcccugcugcccacaacaga

SEQ ID NO: 696308 - RNA, 28 nt, Human
ccuucugugagcucccugcuggcagcuc

SEQ ID NO: 696309 - RNA, 21 nt, Human
cgagcagugacauugcacgga

SEQ ID NO: 696310 - RNA, 23 nt, Human
cgcccgaaucccuugcuggagac

SEQ ID NO: 696311 - RNA, 21 nt, Human
cgccucugccgccgccgccgc

SEQ ID NO: 696312 - RNA, 26 nt, Human
cgccucugcugccgccgccucuacau

SEQ ID NO: 696313 - RNA, 23 nt, Human
cggcccaaauuaaaaaacaacaa

SEQ ID NO: 696314 - RNA, 20 nt, Human
cggugcgcuccgcuccagcc

SEQ ID NO: 696315 - RNA, 21 nt, Human
cgugggcaggggggcccaggc

SEQ ID NO: 696316 - RNA, 26 nt, Human
cuccagccgccagcagugcccggguc

SEQ ID NO: 696317 - RNA, 27 nt, Human
cuccccagaucgcaauggauaaacgaa

SEQ ID NO: 696318 - RNA, 23 nt, Human
cucuacacaaaaacugcaucucc

SEQ ID NO: 696319 - RNA, 20 nt, Human
cucugccgccgccgccgcgc

SEQ ID NO: 696320 - RNA, 23 nt, Human
cugcacagacaacaucgacaucg

SEQ ID NO: 696321 - RNA, 22 nt, Human
cugcagcaccugccccuccucc

SEQ ID NO: 696322 - RNA, 21 nt, Human
cugcccgggggcugccggcaa

SEQ ID NO: 696323 - RNA, 25 nt, Human
gacccacccccaccagcaggggacc

SEQ ID NO: 696324 - RNA, 22 nt, Human
gaccuggcccugcugcccacaa

SEQ ID NO: 696325 - RNA, 20 nt, Human
gaggguggaguuaaacugug

SEQ ID NO: 696326 - RNA, 19 nt, Human
gcccaggccgcagggggcc

SEQ ID NO: 696327 - RNA, 20 nt, Human
gcccggguccggagcccgag

SEQ ID NO: 696328 - RNA, 20 nt, Human
gcccugcugcccacaacagg

SEQ ID NO: 696329 - RNA, 24 nt, Human
gccgccaccgccgccgucgccggc

SEQ ID NO: 696330 - RNA, 19 nt, Human
gccgccgccgccgcgcgcc

SEQ ID NO: 696331 - RNA, 23 nt, Human
gccgccgccgccgcgcgcccgcc

SEQ ID NO: 696332 - RNA, 22 nt, Human
gccgccucugccgccgccgccg

SEQ ID NO: 696333 - RNA, 19 nt, Human
gccgccucugcugccgccg

SEQ ID NO: 696334 - RNA, 21 nt, Human
gccugcagcaccugccccucc

SEQ ID NO: 696335 - RNA, 19 nt, Human
gcgcggcucgcgggcggag

SEQ ID NO: 696336 - RNA, 22 nt, Human
gcuccgcuccagccgccagcag

SEQ ID NO: 696337 - RNA, 21 nt, Human
gcugggacgcggggcccggcu

SEQ ID NO: 696338 - RNA, 26 nt, Human
ggagcuaugaacgcugcccgggggcu

SEQ ID NO: 696339 - RNA, 21 nt, Human
ggcccaggccgcagggggccc

SEQ ID NO: 696340 - RNA, 21 nt, Human
ggccgugggcaggggggccca

SEQ ID NO: 696341 - RNA, 20 nt, Human
ggcugggcagggcugggacg

SEQ ID NO: 696342 - RNA, 21 nt, Human
gggcagggcugggacgcgggg

SEQ ID NO: 696343 - RNA, 18 nt, Human
gggcggggcagggagcug

SEQ ID NO: 696344 - RNA, 23 nt, Human
ggggcccaggccgcagggggccc

SEQ ID NO: 696345 - RNA, 18 nt, Human
ggggggcccaggccgcag

SEQ ID NO: 696346 - RNA, 22 nt, Human
gucgcgccgccgcggcuggccc

SEQ ID NO: 696347 - RNA, 19 nt, Human
gugcagcucagcuggccug

SEQ ID NO: 696348 - RNA, 20 nt, Human
gugcagcucagcuggccugg

SEQ ID NO: 696349 - RNA, 21 nt, Human
guugccauuagcaaggccaga

SEQ ID NO: 696350 - RNA, 21 nt, Human
uacacggcgccaucaacauuc

SEQ ID NO: 696351 - RNA, 22 nt, Human
uagcaaggccagaaaaaaagga

SEQ ID NO: 696352 - RNA, 19 nt, Human
uauagauucgucuuuaccu

SEQ ID NO: 696353 - RNA, 23 nt, Human
uauauaaaaacaggaaugaaauc

SEQ ID NO: 696354 - RNA, 23 nt, Human
uaugaacgcugcccgggggcugc

SEQ ID NO: 696355 - RNA, 20 nt, Human
uaugcuagggacguggagau

SEQ ID NO: 696356 - RNA, 23 nt, Human
uauuaguaacuagauuucaaaag

SEQ ID NO: 696357 - RNA, 19 nt, Human
ucacuguugggguggggga

SEQ ID NO: 696358 - RNA, 20 nt, Human
ucagcaggaagcuggccgug

SEQ ID NO: 696359 - RNA, 21 nt, Human
ucagcuggccuggugcucccu

SEQ ID NO: 696360 - RNA, 21 nt, Human
uccacagaccaggaccuggcc

SEQ ID NO: 696361 - RNA, 22 nt, Human
uccacagaccaggaccuggccc

SEQ ID NO: 696362 - RNA, 23 nt, Human
uccacagaccaggaccuggcccu

SEQ ID NO: 696363 - RNA, 19 nt, Human
uccauucuuugcccaggaa

SEQ ID NO: 696364 - RNA, 23 nt, Human
ucccagucucgggacugugggug

SEQ ID NO: 696365 - RNA, 21 nt, Human
ucgacacaggaaggaaacuga

SEQ ID NO: 696366 - RNA, 20 nt, Human
ucgcgggcggagggcucagc

SEQ ID NO: 696367 - RNA, 21 nt, Human
ugaaaucugugagagaauauu

SEQ ID NO: 696368 - RNA, 21 nt, Human
ugagcucccugcuggcagcuc

SEQ ID NO: 696369 - RNA, 19 nt, Human
ugcacagacaacaucgaca

SEQ ID NO: 696370 - RNA, 20 nt, Human
ugccccuccucccccucccc

SEQ ID NO: 696371 - RNA, 24 nt, Human
ugcucagggcaggcacauggucag

SEQ ID NO: 696372 - RNA, 21 nt, Human
ugcuuauuaguaacuagauuu

SEQ ID NO: 696373 - RNA, 24 nt, Human
uggcccugcugcccacaacagaga

SEQ ID NO: 696374 - RNA, 26 nt, Human
uggccuggugcucccuccccuucugu

SEQ ID NO: 696375 - RNA, 20 nt, Human
uggcugggcgcgggcugggc

SEQ ID NO: 696376 - RNA, 24 nt, Human
uggggccgaggcccagaccccacu

SEQ ID NO: 696377 - RNA, 22 nt, Human
ugggugcagcucagcuggccug

SEQ ID NO: 696378 - RNA, 18 nt, Human
uucaaaagguuacagaaa

SEQ ID NO: 696379 - RNA, 23 nt, Human
uucuuccgaaaaagcaguuuaaa

SEQ ID NO: 696380 - RNA, 19 nt, Human
uucuuuuuaugcuagggac

SEQ ID NO: 696381 - RNA, 23 nt, Human
uuuuucuuuuuaugcuagggacg

SEQ ID NO: 696382 - RNA, 20 nt, Human
uuuuuuguuguuguucuucc

SEQ ID NO: 696383 - RNA, 25 nt, Human
uuuuuuguuguuguucuuccgaaaa

SEQ ID NO: 696384 - RNA, 21 nt, Human
aaacaaaacaaagacaaaccc

SEQ ID NO: 696385 - RNA, 22 nt, Human
aaacaaaacaaagacaaaccca

SEQ ID NO: 696386 - RNA, 23 nt, Human
aaacaaaacaaagacaaacccaa

SEQ ID NO: 696387 - RNA, 24 nt, Human
aaacaaaacaaagacaaacccaaa

SEQ ID NO: 696388 - RNA, 19 nt, Human
aaacaaacugaaacacaac

SEQ ID NO: 696389 - RNA, 23 nt, Human
aaccauaaacaaaacaaagacaa

SEQ ID NO: 696390 - RNA, 24 nt, Human
acaaaacaaagacaaacccaaaca

SEQ ID NO: 696391 - RNA, 27 nt, Human
acaaguauguuuguuuuucuucugagg

SEQ ID NO: 696392 - RNA, 19 nt, Human
acaggaacaauaauccaaa

SEQ ID NO: 696393 - RNA, 22 nt, Human
acaggaacaauaauccaaacaa

SEQ ID NO: 696394 - RNA, 18 nt, Human
agaaaaccuguuauauaa

SEQ ID NO: 696395 - RNA, 20 nt, Human
agagaagcgagggcuuccua

SEQ ID NO: 696396 - RNA, 24 nt, Human
agguuuuuggcauuucacaugucu

SEQ ID NO: 696397 - RNA, 18 nt, Human
caaaacaaagacaaaccc

SEQ ID NO: 696398 - RNA, 21 nt, Human
caaaacaaagacaaacccaaa

SEQ ID NO: 696399 - RNA, 18 nt, Human
caaucuauaaacagaaaa

SEQ ID NO: 696400 - RNA, 20 nt, Human
cauccgggccacagcgagcu

SEQ ID NO: 696401 - RNA, 23 nt, Human
ccaaacauuaagauauacugaca

SEQ ID NO: 696402 - RNA, 18 nt, Human
ccuaaagaacagcugaac

SEQ ID NO: 696403 - RNA, 22 nt, Human
cugaaacacaacagguacguac

SEQ ID NO: 696404 - RNA, 18 nt, Human
cuucucagguuuuuggca

SEQ ID NO: 696405 - RNA, 27 nt, Human
cuuuuuauuauuguuuucuuuacagga

SEQ ID NO: 696406 - RNA, 25 nt, Human
gaguuuugcauuuuccaagucugua

SEQ ID NO: 696407 - RNA, 22 nt, Human
gcacuagaucagcggaucuggc

SEQ ID NO: 696408 - RNA, 25 nt, Human
uaaacaaaacaaagacaaacccaaa

SEQ ID NO: 696409 - RNA, 20 nt, Human
uaaauagauaacaaaaaaca

SEQ ID NO: 696410 - RNA, 24 nt, Human
uaaauagauaacaaaaaacaauau

SEQ ID NO: 696411 - RNA, 24 nt, Human
uaauccaaacaaaucuugaaccaa

SEQ ID NO: 696412 - RNA, 19 nt, Human
uacccuguguaacagagua

SEQ ID NO: 696413 - RNA, 23 nt, Human
uauuacagaguuuugcauuuucc

SEQ ID NO: 696414 - RNA, 19 nt, Human
ugaaaaacaaacugaaaca

SEQ ID NO: 696415 - RNA, 26 nt, Human
ugaaaauaaauagauaacaaaaaaca

SEQ ID NO: 696416 - RNA, 20 nt, Human
ugcccuaaagaacagcugaa

SEQ ID NO: 696417 - RNA, 20 nt, Human
uuucgagaagcacuagauca

SEQ ID NO: 696418 - RNA, 18 nt, Human
uuuuuuuuuuuuuuuuug

SEQ ID NO: 696419 - RNA, 25 nt, Human
uuuuuuuuuuuuuuuuuuguaauuu

SEQ ID NO: 696420 - RNA, 23 nt, Human
aaaaagucacucucauuccagcu

SEQ ID NO: 696421 - RNA, 25 nt, Human
aaccccacacuccuuuaacagaacu

SEQ ID NO: 696422 - RNA, 24 nt, Human
agaacaggaaaaacuuaggggagc

SEQ ID NO: 696423 - RNA, 20 nt, Human
agcugaccgaaaggaacuca

SEQ ID NO: 696424 - RNA, 23 nt, Human
aucccugaaaggaaacgggucuc

SEQ ID NO: 696425 - RNA, 22 nt, Human
cacuccuuuaacagaaccaugc

SEQ ID NO: 696426 - RNA, 21 nt, Human
cagaacacugcuccacauuga

SEQ ID NO: 696427 - RNA, 24 nt, Human
ccccuacggcaaacgcuugucccu

SEQ ID NO: 696428 - RNA, 18 nt, Human
gcugaaauggguggucag

SEQ ID NO: 696429 - RNA, 23 nt, Human
ucacucucauuccagcuaucucc

SEQ ID NO: 696430 - RNA, 18 nt, Human
ucucucagccagaugcag

SEQ ID NO: 696431 - RNA, 20 nt, Human
uugcugcccuuacccugucc

SEQ ID NO: 696432 - RNA, 18 nt, Human
aaacauuuugaacagccc

SEQ ID NO: 696433 - RNA, 18 nt, Human
aaagacaugagggaggcu

SEQ ID NO: 696434 - RNA, 20 nt, Human
aauccaaaagccacauccaa

SEQ ID NO: 696435 - RNA, 18 nt, Human
accuuaaagacaugaggg

SEQ ID NO: 696436 - RNA, 27 nt, Human
agaaaauccaaaagccacauccaaaga

SEQ ID NO: 696437 - RNA, 20 nt, Human
agaucaaaaagcauuuggug

SEQ ID NO: 696438 - RNA, 19 nt, Human
ccuuccgcuuccgcucucc

SEQ ID NO: 696439 - RNA, 21 nt, Human
cugcuaaguuuauuaauguau

SEQ ID NO: 696440 - RNA, 21 nt, Human
uccaaaagccacauccaaaga

SEQ ID NO: 696441 - RNA, 20 nt, Human
uguucagaaaauccaaaagc

SEQ ID NO: 696442 - RNA, 26 nt, Human
uuucaaauaaacauuuugaacagccc

SEQ ID NO: 696443 - RNA, 24 nt, Human
uuuuuuuuuuuuuuucaccuuuug

SEQ ID NO: 696444 - RNA, 25 nt, Human
uuuuuuuuuuuuuuuuucaccuuuu

SEQ ID NO: 696445 - RNA, 28 nt, Human
uuuuuuuuuuuuuuuuuucaccuuuuga

SEQ ID NO: 696446 - RNA, 21 nt, Human
aaaacaaaaaacaaaaaaccu

SEQ ID NO: 696447 - RNA, 21 nt, Human
aaacaaaaaacaaaaaaccug

SEQ ID NO: 696448 - RNA, 25 nt, Human
aaauguucauaccucuuguaaaaga

SEQ ID NO: 696449 - RNA, 22 nt, Human
aaccacagacaaaacauaaaug

SEQ ID NO: 696450 - RNA, 28 nt, Human
aacccuacaaauguucauaccucuugua

SEQ ID NO: 696451 - RNA, 18 nt, Human
aacugccuaugaagcaaa

SEQ ID NO: 696452 - RNA, 20 nt, Human
aagaaggcguuuuuaagcac

SEQ ID NO: 696453 - RNA, 24 nt, Human
aauggacaaugaaaacugguugag

SEQ ID NO: 696454 - RNA, 21 nt, Human
aaugucuuuucagauucaucc

SEQ ID NO: 696455 - RNA, 19 nt, Human
acacaguaaguucauaauu

SEQ ID NO: 696456 - RNA, 19 nt, Human
acagacaaaacauaaauga

SEQ ID NO: 696457 - RNA, 24 nt, Human
acaguaaguucauaauuccccaca

SEQ ID NO: 696458 - RNA, 20 nt, Human
acauuacagauuuuaaaaaa

SEQ ID NO: 696459 - RNA, 19 nt, Human
accaaacccuguacaauag

SEQ ID NO: 696460 - RNA, 19 nt, Human
accaagucuuccuuaaaac

SEQ ID NO: 696461 - RNA, 20 nt, Human
agagguguguuuucauuuuu

SEQ ID NO: 696462 - RNA, 24 nt, Human
agugauuuguuuuuucccaaaagg

SEQ ID NO: 696463 - RNA, 26 nt, Human
auaaaaaucugauacacacagauuuc

SEQ ID NO: 696464 - RNA, 20 nt, Human
aucuauuuccucccuuuuag

SEQ ID NO: 696465 - RNA, 23 nt, Human
caccaugcagcccacuaccagcg

SEQ ID NO: 696466 - RNA, 21 nt, Human
caggcaaauaaaaacagacau

SEQ ID NO: 696467 - RNA, 23 nt, Human
cauuuuacagagaagggcucugu

SEQ ID NO: 696468 - RNA, 24 nt, Human
cauuuuacagagaagggcucuguc

SEQ ID NO: 696469 - RNA, 21 nt, Human
ccaaacccuguacaauagcau

SEQ ID NO: 696470 - RNA, 22 nt, Human
ccuauagaaacacccauauucc

SEQ ID NO: 696471 - RNA, 31 nt, Human
cuaauccuacuguuacaucagaacacauugu

SEQ ID NO: 696472 - RNA, 18 nt, Human
cuuuucagauucauccag

SEQ ID NO: 696473 - RNA, 19 nt, Human
gaagauagaguaauggacu

SEQ ID NO: 696474 - RNA, 22 nt, Human
gaagcaaauaccaauucaucuu

SEQ ID NO: 696475 - RNA, 23 nt, Human
gaagguaggguauaaaauaggag

SEQ ID NO: 696476 - RNA, 19 nt, Human
gagcauuggauuucuagau

SEQ ID NO: 696477 - RNA, 23 nt, Human
gcagucaaacugccuaugaagca

SEQ ID NO: 696478 - RNA, 20 nt, Human
gcgcuaagcacuucagguac

SEQ ID NO: 696479 - RNA, 19 nt, Human
gcuaacaucagcccuauau

SEQ ID NO: 696480 - RNA, 22 nt, Human
ggugucauuuccauuuuacaga

SEQ ID NO: 696481 - RNA, 19 nt, Human
gugauucuaccucuuuacc

SEQ ID NO: 696482 - RNA, 21 nt, Human
uaaaaaucugauacacacaga

SEQ ID NO: 696483 - RNA, 23 nt, Human
uaaaauggaccagauaaauuuca

SEQ ID NO: 696484 - RNA, 22 nt, Human
uaaacgaauccuuguauuuauu

SEQ ID NO: 696485 - RNA, 23 nt, Human
uacaauagcauuacauuuaugca

SEQ ID NO: 696486 - RNA, 20 nt, Human
uacagcagcagaggaguacc

SEQ ID NO: 696487 - RNA, 18 nt, Human
uagaugcaaauguggaac

SEQ ID NO: 696488 - RNA, 22 nt, Human
uagaugcaaauguggaacccua

SEQ ID NO: 696489 - RNA, 20 nt, Human
uagcaugaauaaaauggacc

SEQ ID NO: 696490 - RNA, 23 nt, Human
uagcaugaauaaaauggaccaga

SEQ ID NO: 696491 - RNA, 19 nt, Human
uaggaaaauguuuuuuagg

SEQ ID NO: 696492 - RNA, 18 nt, Human
uaguauugacacuaaaca

SEQ ID NO: 696493 - RNA, 19 nt, Human
uauaggaaaaaauacaaau

SEQ ID NO: 696494 - RNA, 21 nt, Human
uaucaagguuugaauuaaaau

SEQ ID NO: 696495 - RNA, 27 nt, Human
uaucuuaaaaaacaaaaaacaaaaaac

SEQ ID NO: 696496 - RNA, 23 nt, Human
uauuagggaaauaaauuauuaac

SEQ ID NO: 696497 - RNA, 22 nt, Human
ucauguaacacuaaaggucauc

SEQ ID NO: 696498 - RNA, 25 nt, Human
uccaggcauuacuacaaauaucuuc

SEQ ID NO: 696499 - RNA, 21 nt, Human
uccauucuacagcagcagagg

SEQ ID NO: 696500 - RNA, 19 nt, Human
ucuagaugcaaauguggaa

SEQ ID NO: 696501 - RNA, 18 nt, Human
ucuaugagggagggacuu

SEQ ID NO: 696502 - RNA, 24 nt, Human
ucugaaucacccauagcuauccac

SEQ ID NO: 696503 - RNA, 19 nt, Human
ugaaaugcuaccaugcgcu

SEQ ID NO: 696504 - RNA, 23 nt, Human
ugaaugcuucaauaaaaaucuga

SEQ ID NO: 696505 - RNA, 22 nt, Human
ugacuuuuaaaaaagacaaucc

SEQ ID NO: 696506 - RNA, 18 nt, Human
ugagggagggacuuuuuu

SEQ ID NO: 696507 - RNA, 22 nt, Human
ugaguuagugauuuguuuuuuc

SEQ ID NO: 696508 - RNA, 22 nt, Human
ugcuucaauaaaaaucugauac

SEQ ID NO: 696509 - RNA, 21 nt, Human
uggcuaguggugucauuucca

SEQ ID NO: 696510 - RNA, 19 nt, Human
ugggauuuccugauauuag

SEQ ID NO: 696511 - RNA, 26 nt, Human
uguuaguuccucaugccaaaaauaca

SEQ ID NO: 696512 - RNA, 18 nt, Human
uuagugauuuguuuuuuc

SEQ ID NO: 696513 - RNA, 19 nt, Human
uuucacacagcacaaaugc

SEQ ID NO: 696514 - RNA, 19 nt, Human
uuuucagauucauccagca

SEQ ID NO: 696515 - RNA, 23 nt, Human
uuuuuuuuuuuuuuuuuuaaaug

SEQ ID NO: 696516 - RNA, 18 nt, Human
aaacauuuuaaacagacc

SEQ ID NO: 696517 - RNA, 22 nt, Human
aaauacaaaaauuugaaucaaa

SEQ ID NO: 696518 - RNA, 18 nt, Human
aacacuuugagaggcuga

SEQ ID NO: 696519 - RNA, 19 nt, Human
aacauggugaaccccaucu

SEQ ID NO: 696520 - RNA, 20 nt, Human
aacauggugaaccccaucuc

SEQ ID NO: 696521 - RNA, 20 nt, Human
aagaaaaagcaagcaacaaa

SEQ ID NO: 696522 - RNA, 23 nt, Human
aagccacgacucuggcccuccgg

SEQ ID NO: 696523 - RNA, 23 nt, Human
accccguaaaugcagccguccgc

SEQ ID NO: 696524 - RNA, 21 nt, Human
acugaaauguugucaacuauc

SEQ ID NO: 696525 - RNA, 24 nt, Human
agagacuagccuggccaacauggu

SEQ ID NO: 696526 - RNA, 23 nt, Human
agccuggccaacauggugaaccc

SEQ ID NO: 696527 - RNA, 21 nt, Human
agcgguggcucacgccuguaa

SEQ ID NO: 696528 - RNA, 22 nt, Human
aggaaaaaaaauuuuuagaaac

SEQ ID NO: 696529 - RNA, 21 nt, Human
aggcaggcagaucacuugagg

SEQ ID NO: 696530 - RNA, 26 nt, Human
aggcaggcagaucacuugaggccagg

SEQ ID NO: 696531 - RNA, 24 nt, Human
aggcugaggcaggcagaucacuug

SEQ ID NO: 696532 - RNA, 20 nt, Human
aucacuugaggccaggaguu

SEQ ID NO: 696533 - RNA, 22 nt, Human
auuacaaguuacaaagccuaag

SEQ ID NO: 696534 - RNA, 24 nt, Human
caacacuuugagaggcugaggcag

SEQ ID NO: 696535 - RNA, 19 nt, Human
caacauggugaaccccauc

SEQ ID NO: 696536 - RNA, 24 nt, Human
cacgccuguaaucucaacacuuug

SEQ ID NO: 696537 - RNA, 27 nt, Human
cagaucacuugaggccaggaguuagag

SEQ ID NO: 696538 - RNA, 24 nt, Human
caggcagaucacuugaggccagga

SEQ ID NO: 696539 - RNA, 18 nt, Human
ccuggccaacauggugaa

SEQ ID NO: 696540 - RNA, 23 nt, Human
ccuggccaacauggugaacccca

SEQ ID NO: 696541 - RNA, 23 nt, Human
cgccuguaaucucaacacuuuga

SEQ ID NO: 696542 - RNA, 19 nt, Human
cgggagaccccguaaaugc

SEQ ID NO: 696543 - RNA, 22 nt, Human
cucacgccuguaaucucaacac

SEQ ID NO: 696544 - RNA, 24 nt, Human
cucacgccuguaaucucaacacuu

SEQ ID NO: 696545 - RNA, 18 nt, Human
gaucacuugaggccagga

SEQ ID NO: 696546 - RNA, 24 nt, Human
gaucacuugaggccaggaguuaga

SEQ ID NO: 696547 - RNA, 19 nt, Human
gcagggagcgguggcucac

SEQ ID NO: 696548 - RNA, 23 nt, Human
gccaacauggugaaccccaucuc

SEQ ID NO: 696549 - RNA, 18 nt, Human
ggcagggagcgguggcuc

SEQ ID NO: 696550 - RNA, 18 nt, Human
gggagaccccguaaaugc

SEQ ID NO: 696551 - RNA, 23 nt, Human
gguggcucacgccuguaaucuca

SEQ ID NO: 696552 - RNA, 23 nt, Human
uagccuggccaacauggugaacc

SEQ ID NO: 696553 - RNA, 21 nt, Human
uaggauaguacacuuuaacau

SEQ ID NO: 696554 - RNA, 24 nt, Human
uccaggaaaaaaaauuuuuagaaa

SEQ ID NO: 696555 - RNA, 25 nt, Human
uccgcucgccgccguuaucccaggu

SEQ ID NO: 696556 - RNA, 18 nt, Human
ugagaggcugaggcaggc

SEQ ID NO: 696557 - RNA, 20 nt, Human
ugagaggcugaggcaggcag

SEQ ID NO: 696558 - RNA, 24 nt, Human
ugagaggcugaggcaggcagauca

SEQ ID NO: 696559 - RNA, 20 nt, Human
ugaggcaggcagaucacuug

SEQ ID NO: 696560 - RNA, 26 nt, Human
ugaggcaggcagaucacuugaggcca

SEQ ID NO: 696561 - RNA, 24 nt, Human
uggcucacgccuguaaucucaaca

SEQ ID NO: 696562 - RNA, 19 nt, Human
ugggcagggagcgguggcu

SEQ ID NO: 696563 - RNA, 18 nt, Human
ugguauauguguugggca

SEQ ID NO: 696564 - RNA, 18 nt, Human
uguguugggcagggagcg

SEQ ID NO: 696565 - RNA, 24 nt, Human
uucucugcaucacaaaaauuccau

SEQ ID NO: 696566 - RNA, 25 nt, Human
uugagaggcugaggcaggcagauca

SEQ ID NO: 696567 - RNA, 21 nt, Human
uugaggccaggaguuagagac

SEQ ID NO: 696568 - RNA, 18 nt, Human
uuucucugcaucacaaaa

SEQ ID NO: 696569 - RNA, 24 nt, Human
aacucaccuccacaacagucucug

SEQ ID NO: 696570 - RNA, 18 nt, Human
acagaccaauaggaaggg

SEQ ID NO: 696571 - RNA, 23 nt, Human
accacccccuacacucuuuauac

SEQ ID NO: 696572 - RNA, 22 nt, Human
agagaucacccaccaguuggcc

SEQ ID NO: 696573 - RNA, 23 nt, Human
aggagucucaaggcacaaggcuc

SEQ ID NO: 696574 - RNA, 18 nt, Human
auggcuccuccauuucuc

SEQ ID NO: 696575 - RNA, 20 nt, Human
caaagggaccaggagugaua

SEQ ID NO: 696576 - RNA, 19 nt, Human
cacaaggcuccugguuucu

SEQ ID NO: 696577 - RNA, 18 nt, Human
caccuccacaacagucuc

SEQ ID NO: 696578 - RNA, 20 nt, Human
caccuccacaacagucucug

SEQ ID NO: 696579 - RNA, 18 nt, Human
cagccgaacucaccucca

SEQ ID NO: 696580 - RNA, 24 nt, Human
caggagucucaaggcacaaggcuc

SEQ ID NO: 696581 - RNA, 20 nt, Human
caguggcagcuggagagggu

SEQ ID NO: 696582 - RNA, 18 nt, Human
ccagucucugcucccaug

SEQ ID NO: 696583 - RNA, 24 nt, Human
ccuccacaacagucucuguggcuc

SEQ ID NO: 696584 - RNA, 23 nt, Human
ccuccugcugccagucucugcuc

SEQ ID NO: 696585 - RNA, 25 nt, Human
ccugcugaaugaaggaaguugggug

SEQ ID NO: 696586 - RNA, 19 nt, Human
cuccagguccccgagucgc

SEQ ID NO: 696587 - RNA, 21 nt, Human
cucccaaaccugccuguugca

SEQ ID NO: 696588 - RNA, 25 nt, Human
cucucaaccacccccuacacucuuu

SEQ ID NO: 696589 - RNA, 24 nt, Human
cugaaguagaaucaacugauucac

SEQ ID NO: 696590 - RNA, 19 nt, Human
cuguggccgcuggaugccc

SEQ ID NO: 696591 - RNA, 22 nt, Human
gcugaacuaaacgccgacccca

SEQ ID NO: 696592 - RNA, 23 nt, Human
ggaggaaugggaaaagugagcac

SEQ ID NO: 696593 - RNA, 21 nt, Human
guggcucuagccuggacuccc

SEQ ID NO: 696594 - RNA, 20 nt, Human
uacaagugucuaggcgucag

SEQ ID NO: 696595 - RNA, 21 nt, Human
uacucucaaccacccccuaca

SEQ ID NO: 696596 - RNA, 20 nt, Human
uaggaggaaugggaaaagug

SEQ ID NO: 696597 - RNA, 23 nt, Human
ucauucaggcagcugcuuuugac

SEQ ID NO: 696598 - RNA, 19 nt, Human
uccacaacagucucugugg

SEQ ID NO: 696599 - RNA, 23 nt, Human
uccacaacagucucuguggcucu

SEQ ID NO: 696600 - RNA, 21 nt, Human
uccccccuccugcugccaguc

SEQ ID NO: 696601 - RNA, 18 nt, Human
ucucccaugggagcgaag

SEQ ID NO: 696602 - RNA, 19 nt, Human
ucuuggcuucgcugucugg

SEQ ID NO: 696603 - RNA, 20 nt, Human
ucuuuccaggagucucaagg

SEQ ID NO: 696604 - RNA, 22 nt, Human
ugaaugaaugggugagcugcag

SEQ ID NO: 696605 - RNA, 21 nt, Human
ugaccucuaacucccaaaccu

SEQ ID NO: 696606 - RNA, 21 nt, Human
uggaugccacuucuagcauag

SEQ ID NO: 696607 - RNA, 18 nt, Human
uguuaggaggaaugggaa

SEQ ID NO: 696608 - RNA, 20 nt, Human
uuaggaggaaugggaaaagu

SEQ ID NO: 696609 - RNA, 21 nt, Human
uugcaugaggggaagccaucu

SEQ ID NO: 696610 - RNA, 26 nt, Human
cagccacaccgggacgcugaagcaac

SEQ ID NO: 696611 - RNA, 22 nt, Human
ccacaccgggacgcugaagcaa

SEQ ID NO: 696612 - RNA, 20 nt, Human
ccgcacaggaccaacggcac

SEQ ID NO: 696613 - RNA, 23 nt, Human
cggcacagccacaccgggacgcu

SEQ ID NO: 696614 - RNA, 24 nt, Human
gcacaggaccaacggcacagccac

SEQ ID NO: 696615 - RNA, 22 nt, Human
gccacaccgggacgcugaagca

SEQ ID NO: 696616 - RNA, 20 nt, Human
aaaaaguagauccuacaaga

SEQ ID NO: 696617 - RNA, 19 nt, Human
aaagaaaaacauccuugaa

SEQ ID NO: 696618 - RNA, 22 nt, Human
aacuuugcuccuccaaacaaua

SEQ ID NO: 696619 - RNA, 21 nt, Human
acaaauacuuuucuaaacauc

SEQ ID NO: 696620 - RNA, 24 nt, Human
acaagcccuguggagagauccuuc

SEQ ID NO: 696621 - RNA, 25 nt, Human
acacaguacucaucaaugggcucaa

SEQ ID NO: 696622 - RNA, 24 nt, Human
acagcaacaccaggaugcugaagc

SEQ ID NO: 696623 - RNA, 23 nt, Human
acaggagugcaguuucguaaagc

SEQ ID NO: 696624 - RNA, 19 nt, Human
accaggaugcugaagcaac

SEQ ID NO: 696625 - RNA, 19 nt, Human
acccacggcacagcaacac

SEQ ID NO: 696626 - RNA, 23 nt, Human
agagaaaccaucucaucaccaga

SEQ ID NO: 696627 - RNA, 18 nt, Human
agagauccuuccaucaag

SEQ ID NO: 696628 - RNA, 20 nt, Human
agauguaacaaauacuuuuc

SEQ ID NO: 696629 - RNA, 19 nt, Human
agcaagaugagcagauccu

SEQ ID NO: 696630 - RNA, 21 nt, Human
aggcugaguuagcuaccuggu

SEQ ID NO: 696631 - RNA, 21 nt, Human
aucaaguugcuucaguuuaac

SEQ ID NO: 696632 - RNA, 28 nt, Human
auguuacauacaucuuacaacgcacggu

SEQ ID NO: 696633 - RNA, 22 nt, Human
auuugauguuguucuuuuucuu

SEQ ID NO: 696634 - RNA, 24 nt, Human
auuuugagagucuucuuguauucc

SEQ ID NO: 696635 - RNA, 22 nt, Human
caaucgguuugacacaaccacc

SEQ ID NO: 696636 - RNA, 23 nt, Human
caaugggcucaaucauauagauc

SEQ ID NO: 696637 - RNA, 24 nt, Human
cacagcaacaccaggaugcugaag

SEQ ID NO: 696638 - RNA, 22 nt, Human
caccaaucgguuugacacaacc

SEQ ID NO: 696639 - RNA, 22 nt, Human
cacggcacagcaacaccaggau

SEQ ID NO: 696640 - RNA, 21 nt, Human
cacuaaagucuuccccucaaa

SEQ ID NO: 696641 - RNA, 20 nt, Human
cacuuuagaccacaaaguua

SEQ ID NO: 696642 - RNA, 19 nt, Human
caucaagguauagcucagg

SEQ ID NO: 696643 - RNA, 20 nt, Human
caucaaguugcuucaguuua

SEQ ID NO: 696644 - RNA, 22 nt, Human
cauuuccauccacaagaccggg

SEQ ID NO: 696645 - RNA, 18 nt, Human
ccagaagacaggagugca

SEQ ID NO: 696646 - RNA, 19 nt, Human
ccucacaguuauccaugau

SEQ ID NO: 696647 - RNA, 21 nt, Human
ccuccaaacaauacuuuucuu

SEQ ID NO: 696648 - RNA, 18 nt, Human
ccuccgagucuaccaccc

SEQ ID NO: 696649 - RNA, 19 nt, Human
ccuccgagucuaccacccc

SEQ ID NO: 696650 - RNA, 21 nt, Human
ccuccgagucuaccaccccuc

SEQ ID NO: 696651 - RNA, 21 nt, Human
ccuugagagaaaccaucucau

SEQ ID NO: 696652 - RNA, 20 nt, Human
cggcuugacagcuaaacacu

SEQ ID NO: 696653 - RNA, 20 nt, Human
cuccgagucuaccaccccuc

SEQ ID NO: 696654 - RNA, 18 nt, Human
cucuuuaucuuccgccag

SEQ ID NO: 696655 - RNA, 19 nt, Human
cuggggaucuuccagacug

SEQ ID NO: 696656 - RNA, 22 nt, Human
cuggggaucuuccagacugaag

SEQ ID NO: 696657 - RNA, 22 nt, Human
cuuaucagccucugccuuuugc

SEQ ID NO: 696658 - RNA, 18 nt, Human
gaagccagaagacaggag

SEQ ID NO: 696659 - RNA, 23 nt, Human
gacuugucauucuuaucagccuc

SEQ ID NO: 696660 - RNA, 19 nt, Human
gagaaaccaucucaucacc

SEQ ID NO: 696661 - RNA, 23 nt, Human
gagauccuuccaucaaguugcuu

SEQ ID NO: 696662 - RNA, 20 nt, Human
gauauaauagauauguuucu

SEQ ID NO: 696663 - RNA, 21 nt, Human
gcaagaugagcagauccuuca

SEQ ID NO: 696664 - RNA, 22 nt, Human
ggaucuuccagacugaagccag

SEQ ID NO: 696665 - RNA, 19 nt, Human
guaaagcaagaugagcaga

SEQ ID NO: 696666 - RNA, 26 nt, Human
uaaaccgacgugaaacucaaaaagca

SEQ ID NO: 696667 - RNA, 21 nt, Human
uaaagcaagaugagcagaucc

SEQ ID NO: 696668 - RNA, 23 nt, Human
uaagaagaaugugacucgagcac

SEQ ID NO: 696669 - RNA, 18 nt, Human
uaccugguccuuggucuc

SEQ ID NO: 696670 - RNA, 19 nt, Human
uagcucaggaacacuucga

SEQ ID NO: 696671 - RNA, 24 nt, Human
ucacagcaucacuuaguagacaga

SEQ ID NO: 696672 - RNA, 22 nt, Human
ucacuucuaagccauguuuccc

SEQ ID NO: 696673 - RNA, 19 nt, Human
uccagacugaagccagaag

SEQ ID NO: 696674 - RNA, 21 nt, Human
uccagacugaagccagaagac

SEQ ID NO: 696675 - RNA, 18 nt, Human
uccagguguuucuuggcu

SEQ ID NO: 696676 - RNA, 19 nt, Human
uccaugaugaaaucucugc

SEQ ID NO: 696677 - RNA, 22 nt, Human
uccuuccaucaaguugcuucag

SEQ ID NO: 696678 - RNA, 24 nt, Human
ucuaagcauuuuuugaccaaauuu

SEQ ID NO: 696679 - RNA, 22 nt, Human
ucuccagguguuucuuggcugc

SEQ ID NO: 696680 - RNA, 19 nt, Human
ucugcuuuagugccuaagg

SEQ ID NO: 696681 - RNA, 21 nt, Human
ucuuccgauuuugagagucuu

SEQ ID NO: 696682 - RNA, 22 nt, Human
ucuuucaugguuuugcagaggu

SEQ ID NO: 696683 - RNA, 18 nt, Human
ucuuuggaaaacaagccc

SEQ ID NO: 696684 - RNA, 21 nt, Human
ucuuuggugacuggcacuaaa

SEQ ID NO: 696685 - RNA, 23 nt, Human
ucuuuuucuuuucuucauccucu

SEQ ID NO: 696686 - RNA, 18 nt, Human
ugguuuugcagagguucu

SEQ ID NO: 696687 - RNA, 21 nt, Human
ugugaaaauaaaccgacguga

SEQ ID NO: 696688 - RNA, 18 nt, Human
uucaugguuuugcagagg

SEQ ID NO: 696689 - RNA, 20 nt, Human
uucaugguuuugcagagguu

SEQ ID NO: 696690 - RNA, 27 nt, Human
uuccccuuaaaguaguuguugucaugc

SEQ ID NO: 696691 - RNA, 20 nt, Human
uuggucucaccugugauaua

SEQ ID NO: 696692 - RNA, 18 nt, Human
uuugcagagguucucaaa

SEQ ID NO: 696693 - RNA, 19 nt, Human
aaaaaacugauuccuggac

SEQ ID NO: 696694 - RNA, 23 nt, Human
aaaaaacugauuccuggacaggc

SEQ ID NO: 696695 - RNA, 19 nt, Human
aagcacacccccacuggcu

SEQ ID NO: 696696 - RNA, 21 nt, Human
aagcaguuuuagcuugagaga

SEQ ID NO: 696697 - RNA, 25 nt, Human
aagcccagcccaucagacaggaccc

SEQ ID NO: 696698 - RNA, 19 nt, Human
aagcccuccccaccugcca

SEQ ID NO: 696699 - RNA, 19 nt, Human
aagcuagcuuugcccugcc

SEQ ID NO: 696700 - RNA, 20 nt, Human
aagcuagcuuugcccugccu

SEQ ID NO: 696701 - RNA, 18 nt, Human
aaguggaguccaaaaacu

SEQ ID NO: 696702 - RNA, 20 nt, Human
aaguggaguccaaaaacuug

SEQ ID NO: 696703 - RNA, 19 nt, Human
accucuuuggacuuggaga

SEQ ID NO: 696704 - RNA, 18 nt, Human
agaaaaccaagcccagcc

SEQ ID NO: 696705 - RNA, 19 nt, Human
agacaggaccccuggcucc

SEQ ID NO: 696706 - RNA, 25 nt, Human
aggcaggcaggucaagaaaaccaag

SEQ ID NO: 696707 - RNA, 26 nt, Human
aggcaggucaagaaaaccaagcccag

SEQ ID NO: 696708 - RNA, 19 nt, Human
aggcgcgguggcucacgcc

SEQ ID NO: 696709 - RNA, 21 nt, Human
aggucaagaaaaccaagccca

SEQ ID NO: 696710 - RNA, 24 nt, Human
auccacccaccagggcuccaguca

SEQ ID NO: 696711 - RNA, 18 nt, Human
augcuggucuacuccugg

SEQ ID NO: 696712 - RNA, 18 nt, Human
caaaccuugcaggggcug

SEQ ID NO: 696713 - RNA, 24 nt, Human
caaaguggaguccaaaaacuuguu

SEQ ID NO: 696714 - RNA, 22 nt, Human
caagaaaaccaagcccagccca

SEQ ID NO: 696715 - RNA, 19 nt, Human
cacacccuucaacucagcc

SEQ ID NO: 696716 - RNA, 19 nt, Human
caccaggagcugacagggc

SEQ ID NO: 696717 - RNA, 19 nt, Human
cacccccacuggcucaaag

SEQ ID NO: 696718 - RNA, 21 nt, Human
cagaggcccugccuggucagu

SEQ ID NO: 696719 - RNA, 22 nt, Human
caggcgcgguggcucacgccuc

SEQ ID NO: 696720 - RNA, 22 nt, Human
caggucaggauuucucaaagug

SEQ ID NO: 696721 - RNA, 18 nt, Human
caggucccaggacagauc

SEQ ID NO: 696722 - RNA, 20 nt, Human
ccagaucagcacccccuuug

SEQ ID NO: 696723 - RNA, 20 nt, Human
ccagcccaucagacaggacc

SEQ ID NO: 696724 - RNA, 25 nt, Human
ccagcccccugcauucaccauaugc

SEQ ID NO: 696725 - RNA, 18 nt, Human
cccagaagcuagcuuugc

SEQ ID NO: 696726 - RNA, 26 nt, Human
ccccuaccauugagcaccugccacuc

SEQ ID NO: 696727 - RNA, 22 nt, Human
cccucacucaggccugcccacu

SEQ ID NO: 696728 - RNA, 18 nt, Human
cccuuugcccaucacccc

SEQ ID NO: 696729 - RNA, 24 nt, Human
ccucacucaggccugcccacuccu

SEQ ID NO: 696730 - RNA, 24 nt, Human
ccuccugcccuuugcccaucaccc

SEQ ID NO: 696731 - RNA, 21 nt, Human
ccugcauucaccauaugcccu

SEQ ID NO: 696732 - RNA, 23 nt, Human
ccugccagcccccugcauucacc

SEQ ID NO: 696733 - RNA, 18 nt, Human
ccugcccacagccuuucc

SEQ ID NO: 696734 - RNA, 24 nt, Human
ccuggacaggcgcgguggcucacg

SEQ ID NO: 696735 - RNA, 18 nt, Human
cucaaaguggaguccaaa

SEQ ID NO: 696736 - RNA, 23 nt, Human
cucaggccugcccacuccucaga

SEQ ID NO: 696737 - RNA, 19 nt, Human
cucccccuccccaccucag

SEQ ID NO: 696738 - RNA, 19 nt, Human
cugccagcccccugcauuc

SEQ ID NO: 696739 - RNA, 23 nt, Human
cugcucccccuccccaccucagg

SEQ ID NO: 696740 - RNA, 24 nt, Human
cugucuccagaucagcacccccuu

SEQ ID NO: 696741 - RNA, 21 nt, Human
gaauucacccacccuccugcc

SEQ ID NO: 696742 - RNA, 25 nt, Human
gaccccuggcuccugcccacagccu

SEQ ID NO: 696743 - RNA, 19 nt, Human
gaccuguggacagaguccc

SEQ ID NO: 696744 - RNA, 21 nt, Human
gcccuccccaccugccagccc

SEQ ID NO: 696745 - RNA, 24 nt, Human
gccugcccacuccucagaaggcca

SEQ ID NO: 696746 - RNA, 22 nt, Human
gcgcugccuuuaauaaguaagg

SEQ ID NO: 696747 - RNA, 23 nt, Human
ggaauucacccacccuccugccc

SEQ ID NO: 696748 - RNA, 19 nt, Human
gggcuccagucauacccag

SEQ ID NO: 696749 - RNA, 22 nt, Human
gggcugaaggaacccagaagcu

SEQ ID NO: 696750 - RNA, 23 nt, Human
ggucaggauuucucaaaguggag

SEQ ID NO: 696751 - RNA, 24 nt, Human
gucccaggacagaucugucuccag

SEQ ID NO: 696752 - RNA, 19 nt, Human
guguucaagcccuccccac

SEQ ID NO: 696753 - RNA, 21 nt, Human
guuccugcucccccuccccac

SEQ ID NO: 696754 - RNA, 20 nt, Human
uaaggagagguccagagacc

SEQ ID NO: 696755 - RNA, 21 nt, Human
uacggguaccucuuuggacuu

SEQ ID NO: 696756 - RNA, 24 nt, Human
uaugagggcugaaaaaauguggca

SEQ ID NO: 696757 - RNA, 22 nt, Human
ucccaggacagaucugucucca

SEQ ID NO: 696758 - RNA, 22 nt, Human
ucccccuccccaccucaggggu

SEQ ID NO: 696759 - RNA, 23 nt, Human
ucuccagaucagcacccccuuug

SEQ ID NO: 696760 - RNA, 27 nt, Human
ugaaacaggucccaggacagaucuguc

SEQ ID NO: 696761 - RNA, 21 nt, Human
ugaagcacacccccacuggcu

SEQ ID NO: 696762 - RNA, 23 nt, Human
ugaagcacacccccacuggcuca

SEQ ID NO: 696763 - RNA, 22 nt, Human
ugacagggcugaaacagguccc

SEQ ID NO: 696764 - RNA, 19 nt, Human
ugcccugccuuuugggcca

SEQ ID NO: 696765 - RNA, 23 nt, Human
uggaaaaaacugauuccuggaca

SEQ ID NO: 696766 - RNA, 23 nt, Human
uguggacagagucccaaaccuug

SEQ ID NO: 696767 - RNA, 21 nt, Human
uuccccuaccauugagcaccu

SEQ ID NO: 696768 - RNA, 23 nt, Human
uuccugcucccccuccccaccuc

SEQ ID NO: 696769 - RNA, 24 nt, Human
uugcccugccuuuugggccacacu

SEQ ID NO: 696770 - RNA, 21 nt, Human
uuuagcuugagagacacaaga

SEQ ID NO: 696771 - RNA, 23 nt, Human
uuuuuuuuuuuuggugcagcgcu

SEQ ID NO: 696772 - RNA, 23 nt, Human
aaagcgcugccgccucggccccc

SEQ ID NO: 696773 - RNA, 18 nt, Human
aaggaggagaagacggcg

SEQ ID NO: 696774 - RNA, 18 nt, Human
accccgcccccgccccuc

SEQ ID NO: 696775 - RNA, 24 nt, Human
accccgcccccgccccucuuaucg

SEQ ID NO: 696776 - RNA, 19 nt, Human
agaaaaaaggugaaagagg

SEQ ID NO: 696777 - RNA, 21 nt, Human
agaagaaaaaaggugaaagag

SEQ ID NO: 696778 - RNA, 18 nt, Human
agagcccuucuuccaguc

SEQ ID NO: 696779 - RNA, 25 nt, Human
agcaaaagugggaaaagauuuggca

SEQ ID NO: 696780 - RNA, 24 nt, Human
agccaagcgcacccggcagccccc

SEQ ID NO: 696781 - RNA, 20 nt, Human
agcgcacccggcagcccccc

SEQ ID NO: 696782 - RNA, 21 nt, Human
aggaccccgcccccgccccuc

SEQ ID NO: 696783 - RNA, 23 nt, Human
aggagaagacggcgccggguccg

SEQ ID NO: 696784 - RNA, 18 nt, Human
aggagccaggcggaaaug

SEQ ID NO: 696785 - RNA, 18 nt, Human
aggcgugcgggcgaggcc

SEQ ID NO: 696786 - RNA, 21 nt, Human
agugguggggagacaagagag

SEQ ID NO: 696787 - RNA, 25 nt, Human
aucgcaauaaagucuccaacgcgcc

SEQ ID NO: 696788 - RNA, 21 nt, Human
caagcgcacccggcagccccc

SEQ ID NO: 696789 - RNA, 24 nt, Human
cacagccaagcgcacccggcagcc

SEQ ID NO: 696790 - RNA, 23 nt, Human
caccaaaccugcucaggucccag

SEQ ID NO: 696791 - RNA, 23 nt, Human
cacccggcagccccccgcgcccc

SEQ ID NO: 696792 - RNA, 27 nt, Human
caccucggaccccagcagccacagccc

SEQ ID NO: 696793 - RNA, 19 nt, Human
cagccaagcgcacccggca

SEQ ID NO: 696794 - RNA, 22 nt, Human
caggaccccgcccccgccccuc

SEQ ID NO: 696795 - RNA, 22 nt, Human
ccaaaccugcucaggucccagg

SEQ ID NO: 696796 - RNA, 24 nt, Human
ccaacgcgccgcgccacagccaag

SEQ ID NO: 696797 - RNA, 20 nt, Human
ccaccucggaccccagcagc

SEQ ID NO: 696798 - RNA, 20 nt, Human
ccccaggaccccgcccccgc

SEQ ID NO: 696799 - RNA, 22 nt, Human
cccccaggaccccgcccccgcc

SEQ ID NO: 696800 - RNA, 21 nt, Human
ccccccgcgccccgcagccgg

SEQ ID NO: 696801 - RNA, 19 nt, Human
cccccgcgccccgcagccg

SEQ ID NO: 696802 - RNA, 22 nt, Human
cccccgcgcggcccggggccgc

SEQ ID NO: 696803 - RNA, 24 nt, Human
cccccgcgcggcccggggccgcaa

SEQ ID NO: 696804 - RNA, 20 nt, Human
ccccgcccccgccccucuua

SEQ ID NO: 696805 - RNA, 19 nt, Human
cccgcgcggcccggggccg

SEQ ID NO: 696806 - RNA, 21 nt, Human
cccgcgcggcccggggccgca

SEQ ID NO: 696807 - RNA, 24 nt, Human
cccggccccaccucggaccccagc

SEQ ID NO: 696808 - RNA, 22 nt, Human
cccuccggcccccgcgcggccc

SEQ ID NO: 696809 - RNA, 19 nt, Human
ccgcccgaagcgaccgcgg

SEQ ID NO: 696810 - RNA, 21 nt, Human
ccgccggggacugggcggugg

SEQ ID NO: 696811 - RNA, 20 nt, Human
ccggcagccccccgcgcccc

SEQ ID NO: 696812 - RNA, 21 nt, Human
ccuagaagaaaaaaggugaaa

SEQ ID NO: 696813 - RNA, 23 nt, Human
ccuccacgugcugaggugggagc

SEQ ID NO: 696814 - RNA, 21 nt, Human
ccucccuagagcccuucuucc

SEQ ID NO: 696815 - RNA, 22 nt, Human
ccuccgggaccuggagaccuag

SEQ ID NO: 696816 - RNA, 25 nt, Human
cgcccccgccccucuuaucguccca

SEQ ID NO: 696817 - RNA, 19 nt, Human
cgccggggacugggcggug

SEQ ID NO: 696818 - RNA, 22 nt, Human
cggcccccaggaccccgccccc

SEQ ID NO: 696819 - RNA, 20 nt, Human
cggcccccgcgcggcccggg

SEQ ID NO: 696820 - RNA, 21 nt, Human
cggcccggggccgcaauuucc

SEQ ID NO: 696821 - RNA, 18 nt, Human
cgggagggggcagcccgg

SEQ ID NO: 696822 - RNA, 20 nt, Human
cgggagggggcagcccgggc

SEQ ID NO: 696823 - RNA, 21 nt, Human
cgggagggggcagcccgggcg

SEQ ID NO: 696824 - RNA, 20 nt, Human
cgguggcaccgauccccgcc

SEQ ID NO: 696825 - RNA, 23 nt, Human
cucccgggcccuccccgggaugc

SEQ ID NO: 696826 - RNA, 22 nt, Human
cuuucaccaaaccugcucaggu

SEQ ID NO: 696827 - RNA, 22 nt, Human
gaaagggucagaaacacaccgg

SEQ ID NO: 696828 - RNA, 18 nt, Human
gaccccagcagccacagc

SEQ ID NO: 696829 - RNA, 19 nt, Human
gaccccgcccccgccccuc

SEQ ID NO: 696830 - RNA, 19 nt, Human
gaccuagaagaaaaaaggu

SEQ ID NO: 696831 - RNA, 20 nt, Human
gacugcggggugggacagga

SEQ ID NO: 696832 - RNA, 23 nt, Human
gagcuuuaauggggcugaaaggg

SEQ ID NO: 696833 - RNA, 23 nt, Human
gaguguggggacaggaggaaggg

SEQ ID NO: 696834 - RNA, 21 nt, Human
gccaagcgcacccggcagccc

SEQ ID NO: 696835 - RNA, 20 nt, Human
gccccaccucggaccccagc

SEQ ID NO: 696836 - RNA, 20 nt, Human
gccuggcgggagggggcagc

SEQ ID NO: 696837 - RNA, 19 nt, Human
gcgggagggggcagcccgg

SEQ ID NO: 696838 - RNA, 25 nt, Human
gcguggcggggguugcggggggguc

SEQ ID NO: 696839 - RNA, 20 nt, Human
ggacaggaggaagggggccg

SEQ ID NO: 696840 - RNA, 21 nt, Human
ggaccccagcagccacagccc

SEQ ID NO: 696841 - RNA, 23 nt, Human
ggaguguggggacaggaggaagg

SEQ ID NO: 696842 - RNA, 18 nt, Human
ggaguuucuccugggagu

SEQ ID NO: 696843 - RNA, 20 nt, Human
ggaucgggcgagacucuagg

SEQ ID NO: 696844 - RNA, 18 nt, Human
ggccaugugcccugaugg

SEQ ID NO: 696845 - RNA, 18 nt, Human
gggacaggaggaaggggg

SEQ ID NO: 696846 - RNA, 19 nt, Human
gggagggggcagcccgggc

SEQ ID NO: 696847 - RNA, 23 nt, Human
gggccuggcgggagggggcagcc

SEQ ID NO: 696848 - RNA, 20 nt, Human
ggggacugggcggugggaga

SEQ ID NO: 696849 - RNA, 21 nt, Human
ggggcagcccgggcguggcgg

SEQ ID NO: 696850 - RNA, 18 nt, Human
ggucccgucccccugcua

SEQ ID NO: 696851 - RNA, 22 nt, Human
guggcggggguugcgggggggu

SEQ ID NO: 696852 - RNA, 24 nt, Human
ucacggaggacgguggcuuucacc

SEQ ID NO: 696853 - RNA, 19 nt, Human
uccaacgcgccgcgccaca

SEQ ID NO: 696854 - RNA, 23 nt, Human
uccaacgcgccgcgccacagcca

SEQ ID NO: 696855 - RNA, 19 nt, Human
ucccaggaaggaggaccgu

SEQ ID NO: 696856 - RNA, 18 nt, Human
ucccuagagcccuucuuc

SEQ ID NO: 696857 - RNA, 19 nt, Human
ucccuagagcccuucuucc

SEQ ID NO: 696858 - RNA, 21 nt, Human
ucgcccuccucaggggacugc

SEQ ID NO: 696859 - RNA, 20 nt, Human
ucggcccccaggaccccgcc

SEQ ID NO: 696860 - RNA, 19 nt, Human
ucggcucccgcuccacucg

SEQ ID NO: 696861 - RNA, 18 nt, Human
ucgguggcaccgaucccc

SEQ ID NO: 696862 - RNA, 25 nt, Human
ucgguggcaccgauccccgcccgaa

SEQ ID NO: 696863 - RNA, 18 nt, Human
ucuccugggagugugggg

SEQ ID NO: 696864 - RNA, 22 nt, Human
ucucugcaaacagugauggggc

SEQ ID NO: 696865 - RNA, 19 nt, Human
ugacaaggaggagaagacg

SEQ ID NO: 696866 - RNA, 22 nt, Human
ugacggaggcucccgggcccuc

SEQ ID NO: 696867 - RNA, 18 nt, Human
ugcggggggguccuggag

SEQ ID NO: 696868 - RNA, 23 nt, Human
uggcaccgauccccgcccgaagc

SEQ ID NO: 696869 - RNA, 25 nt, Human
uggcaccgauccccgcccgaagcga

SEQ ID NO: 696870 - RNA, 21 nt, Human
uggcgggagggggcagcccgg

SEQ ID NO: 696871 - RNA, 18 nt, Human
ugggagaugggggggacg

SEQ ID NO: 696872 - RNA, 22 nt, Human
ugggcggugggagauggggggg

SEQ ID NO: 696873 - RNA, 22 nt, Human
uggggacaggaggaagggggcc

SEQ ID NO: 696874 - RNA, 22 nt, Human
uuccuuggggaagagcaaaagu

SEQ ID NO: 696875 - RNA, 22 nt, Human
uuuuuuuuuuuuugagagcuca

SEQ ID NO: 696876 - RNA, 18 nt, Human
uuuuuuuuuuuuuuuuug

SEQ ID NO: 696877 - RNA, 24 nt, Human
acuucuagcugaacucaucuugau

SEQ ID NO: 696878 - RNA, 27 nt, Human
cacuucagaaagaaaaaaguuguuggg

SEQ ID NO: 696879 - RNA, 18 nt, Human
gguaugacuucuagcuga

SEQ ID NO: 696880 - RNA, 23 nt, Human
uaacgugcauugauuugcuaaaa

SEQ ID NO: 696881 - RNA, 24 nt, Human
uaagaacauccuccuggacuuugg

SEQ ID NO: 696882 - RNA, 19 nt, Human
uguaaaacuauuuccaaga

SEQ ID NO: 696883 - RNA, 21 nt, Human
uuuuguaagaacauccuccug

SEQ ID NO: 696884 - RNA, 24 nt, Human
uuuuuaaauccauuuuuguaaaac

SEQ ID NO: 696885 - RNA, 24 nt, Human
uuuuuuuuuuuuuuuuuuuauuuu

SEQ ID NO: 696886 - RNA, 22 nt, Human
accgcggccccgcucgcacguc

SEQ ID NO: 696887 - RNA, 23 nt, Human
caccccucccccugcagggccca

SEQ ID NO: 696888 - RNA, 18 nt, Human
cagcccggggacccaggc

SEQ ID NO: 696889 - RNA, 19 nt, Human
caggccugucccuccgcug

SEQ ID NO: 696890 - RNA, 24 nt, Human
cccacgcgcgcagccgccgccgca

SEQ ID NO: 696891 - RNA, 24 nt, Human
cccacgcgcgcagccgccgccgca

SEQ ID NO: 696892 - RNA, 18 nt, Human
cccacggccucgccccgc

SEQ ID NO: 696893 - RNA, 21 nt, Human
cccacggccucgccccgcgcc

SEQ ID NO: 696894 - RNA, 24 nt, Human
cccaggcuugagccagccacuccc

SEQ ID NO: 696895 - RNA, 21 nt, Human
ccccacgauacccaauccagg

SEQ ID NO: 696896 - RNA, 18 nt, Human
ccccacggccucgccccg

SEQ ID NO: 696897 - RNA, 20 nt, Human
cccccgagccccaccgcggc

SEQ ID NO: 696898 - RNA, 26 nt, Human
cccccgagccccaccgcggccccgcu

SEQ ID NO: 696899 - RNA, 21 nt, Human
ccccgagccccaccgcggccc

SEQ ID NO: 696900 - RNA, 22 nt, Human
ccccgagccccaccgcggcccc

SEQ ID NO: 696901 - RNA, 18 nt, Human
ccccucccccugcagggc

SEQ ID NO: 696902 - RNA, 24 nt, Human
ccccuccucaccgauuccaccacc

SEQ ID NO: 696903 - RNA, 21 nt, Human
cccggggacccaggcuugagc

SEQ ID NO: 696904 - RNA, 22 nt, Human
ccgcgccuggggacaggccugu

SEQ ID NO: 696905 - RNA, 20 nt, Human
ccgcggccccgcucgcacgu

SEQ ID NO: 696906 - RNA, 24 nt, Human
ccgcuggcuccggguggccgcccu

SEQ ID NO: 696907 - RNA, 24 nt, Human
cgcccccgagccccaccgcggccc

SEQ ID NO: 696908 - RNA, 25 nt, Human
cgcccccgagccccaccgcggcccc

SEQ ID NO: 696909 - RNA, 22 nt, Human
cgccccgcgccccgggccccac

SEQ ID NO: 696910 - RNA, 24 nt, Human
cgccccgggccccacgcgcgcagc

SEQ ID NO: 696911 - RNA, 22 nt, Human
cgccgcagccaccacacacuuu

SEQ ID NO: 696912 - RNA, 21 nt, Human
cgccuggggacaggccugucc

SEQ ID NO: 696913 - RNA, 24 nt, Human
cgccuggggacaggccugucccuc

SEQ ID NO: 696914 - RNA, 22 nt, Human
cgcucgcacguccccacggccu

SEQ ID NO: 696915 - RNA, 20 nt, Human
cuccggguggccgcccucug

SEQ ID NO: 696916 - RNA, 22 nt, Human
cucgcccugucaccccuccccc

SEQ ID NO: 696917 - RNA, 23 nt, Human
cucgcccugucaccccucccccu

SEQ ID NO: 696918 - RNA, 21 nt, Human
cugagaagcccccuccucacc

SEQ ID NO: 696919 - RNA, 21 nt, Human
gagaagcccccuccucaccga

SEQ ID NO: 696920 - RNA, 23 nt, Human
gcccugucaccccucccccugca

SEQ ID NO: 696921 - RNA, 22 nt, Human
ggacugagaagcccccuccuca

SEQ ID NO: 696922 - RNA, 21 nt, Human
guggacgcgcccccgagcccc

SEQ ID NO: 696923 - RNA, 21 nt, Human
ucaccccucccccugcagggc

SEQ ID NO: 696924 - RNA, 19 nt, Human
ugagaagcccccuccucac

SEQ ID NO: 696925 - RNA, 24 nt, Human
uggacgcgcccccgagccccaccg

SEQ ID NO: 696926 - RNA, 20 nt, Human
uggaugggaggacggcacag

SEQ ID NO: 696927 - RNA, 24 nt, Human
uggccagggugaccugccccacgg

SEQ ID NO: 696928 - RNA, 18 nt, Human
uggcuccggguggccgcc

SEQ ID NO: 696929 - RNA, 20 nt, Human
uggcuccggguggccgcccu

SEQ ID NO: 696930 - RNA, 22 nt, Human
uggcuccggguggccgcccucu

SEQ ID NO: 696931 - RNA, 18 nt, Human
uggggugggggcucgccc

SEQ ID NO: 696932 - RNA, 22 nt, Human
uggggugggggcucgcccuguc

SEQ ID NO: 696933 - RNA, 19 nt, Human
ugucaccccucccccugca

SEQ ID NO: 696934 - RNA, 27 nt, Human
ugucaccccucccccugcagggcccaa

SEQ ID NO: 696935 - RNA, 18 nt, Human
aaguaaauaaaggagcaa

SEQ ID NO: 696936 - RNA, 19 nt, Human
aauaaguaaauaaaggagc

SEQ ID NO: 696937 - RNA, 18 nt, Human
aauguaaaauguugcagu

SEQ ID NO: 696938 - RNA, 23 nt, Human
auaaguaaauaaaggagcaaugu

SEQ ID NO: 696939 - RNA, 18 nt, Human
uccugcugcauuugcugc

SEQ ID NO: 696940 - RNA, 18 nt, Human
uccugcugcauuugcugc

SEQ ID NO: 696941 - RNA, 22 nt, Human
uguaaaauguugcaguuugcuu

SEQ ID NO: 696942 - RNA, 23 nt, Human
uuucuucuucuuucggaacuuuu

SEQ ID NO: 696943 - RNA, 20 nt, Human
aagaagccuuucccaacauc

SEQ ID NO: 696944 - RNA, 20 nt, Human
aagaagcuccaacacaauua

SEQ ID NO: 696945 - RNA, 21 nt, Human
aagcuccaacacaauuaaaua

SEQ ID NO: 696946 - RNA, 22 nt, Human
agccagucagggucggccaccu

SEQ ID NO: 696947 - RNA, 18 nt, Human
ccagccagucagggucgg

SEQ ID NO: 696948 - RNA, 20 nt, Human
cgaguugacaaagaaugcca

SEQ ID NO: 696949 - RNA, 22 nt, Human
cgucuggggcuccacggacggc

SEQ ID NO: 696950 - RNA, 21 nt, Human
cgugacaagcgucacgcuacc

SEQ ID NO: 696951 - RNA, 22 nt, Human
cuaaaaagucaacaggucaaaa

SEQ ID NO: 696952 - RNA, 19 nt, Human
cuguaguuuuucuuccccg

SEQ ID NO: 696953 - RNA, 24 nt, Human
cuuugaguucuccacagaaggcuu

SEQ ID NO: 696954 - RNA, 22 nt, Human
gaaaaguucaaagcaguuagaa

SEQ ID NO: 696955 - RNA, 23 nt, Human
gaagccuuucccaacaucucuau

SEQ ID NO: 696956 - RNA, 26 nt, Human
gaaggugggcuuuggcucgucugggg

SEQ ID NO: 696957 - RNA, 20 nt, Human
gagaaggugggcuuuggcuc

SEQ ID NO: 696958 - RNA, 18 nt, Human
gcucgucuggggcuccac

SEQ ID NO: 696959 - RNA, 23 nt, Human
guaauuucaagaagccuuuccca

SEQ ID NO: 696960 - RNA, 26 nt, Human
uagaaaagcagcgaguugacaaagaa

SEQ ID NO: 696961 - RNA, 23 nt, Human
ucaauuuauccaucaccgucucu

SEQ ID NO: 696962 - RNA, 19 nt, Human
uccacagaaggcuucgagc

SEQ ID NO: 696963 - RNA, 21 nt, Human
uccccgaaaaucauguuucca

SEQ ID NO: 696964 - RNA, 22 nt, Human
ucgcauaauccuucccugcgug

SEQ ID NO: 696965 - RNA, 18 nt, Human
ucgcuggcucccugacug

SEQ ID NO: 696966 - RNA, 20 nt, Human
ucgcuggcucccugacugcc

SEQ ID NO: 696967 - RNA, 20 nt, Human
ugcuaguaaauccuacagag

SEQ ID NO: 696968 - RNA, 19 nt, Human
ugggaggcugaggacguga

SEQ ID NO: 696969 - RNA, 23 nt, Human
uucaaauacagaaaauccgaaaa

SEQ ID NO: 696970 - RNA, 19 nt, Human
uuccagccagucagggucg

SEQ ID NO: 696971 - RNA, 20 nt, Human
uucuccacagaaggcuucga

SEQ ID NO: 696972 - RNA, 19 nt, Human
uuucaagaagccuuuccca

SEQ ID NO: 696973 - RNA, 20 nt, Human
uuuuuuuuuuuuuuuuuugg

SEQ ID NO: 696974 - RNA, 25 nt, Human
uuuuuuuuuuuuuuuuuugucuuuu

SEQ ID NO: 696975 - RNA, 19 nt, Human
aaggagcuggcucagccac

SEQ ID NO: 696976 - RNA, 21 nt, Human
caagauggccuuccacaaguc

SEQ ID NO: 696977 - RNA, 18 nt, Human
cagcggggccccguccca

SEQ ID NO: 696978 - RNA, 25 nt, Human
cagcugccagauccagcuucuucaa

SEQ ID NO: 696979 - RNA, 19 nt, Human
cccaaccccaccauccucu

SEQ ID NO: 696980 - RNA, 19 nt, Human
cccagcuccccaggccugg

SEQ ID NO: 696981 - RNA, 21 nt, Human
ccuccccugccauuucuguuc

SEQ ID NO: 696982 - RNA, 22 nt, Human
cuccccaggccuggugagcucc

SEQ ID NO: 696983 - RNA, 21 nt, Human
cuggcaucaagauggccuucc

SEQ ID NO: 696984 - RNA, 21 nt, Human
cuguucugcuccugaugucac

SEQ ID NO: 696985 - RNA, 24 nt, Human
cuguucugcuccugaugucacacu

SEQ ID NO: 696986 - RNA, 21 nt, Human
gagcuccaggcuagccugugc

SEQ ID NO: 696987 - RNA, 20 nt, Human
gcacagacugggagagagga

SEQ ID NO: 696988 - RNA, 21 nt, Human
gcuacaaagaaggugugugcu

SEQ ID NO: 696989 - RNA, 21 nt, Human
ggacagagagcuugcuguucu

SEQ ID NO: 696990 - RNA, 22 nt, Human
uagguccccaagaugguggggg

SEQ ID NO: 696991 - RNA, 21 nt, Human
ucaacugaggaggcgaaggga

SEQ ID NO: 696992 - RNA, 21 nt, Human
uccaggcuagccugugcacug

SEQ ID NO: 696993 - RNA, 20 nt, Human
ucccaaccccaccauccucu

SEQ ID NO: 696994 - RNA, 21 nt, Human
ucccaaccccaccauccucuu

SEQ ID NO: 696995 - RNA, 23 nt, Human
ucccaaccccaccauccucuuca

SEQ ID NO: 696996 - RNA, 19 nt, Human
uccccugccauuucuguuc

SEQ ID NO: 696997 - RNA, 18 nt, Human
uggcaucaagauggccuu

SEQ ID NO: 696998 - RNA, 24 nt, Human
ugucacacaggggcuuccugugug

SEQ ID NO: 696999 - RNA, 20 nt, Human
uguccucugaguccaggccc

SEQ ID NO: 697000 - RNA, 18 nt, Human
uguccuggcaucaagaug

SEQ ID NO: 697001 - RNA, 19 nt, Human
uucuguucagggaggcaca

SEQ ID NO: 697002 - RNA, 26 nt, Human
aacccagccuccagaaccagaaccaa

SEQ ID NO: 697003 - RNA, 18 nt, Human
agaaccagaaccaagagc
